United States Patent 11,332,783 (SAMPLE ANALYSIS, PRESENCE DETERMINATION OF A TARGET SEQUENCE) - sequence listing, part 14

SEQ ID NO: 275832 - DNA, 75 bp, Artificial Sequence
  Synthetic
acttcctgggaggacaagcggctcccctgcagccgagccgcaactccccaggagaggacacccccgacgcctccg

SEQ ID NO: 275833 - DNA, 75 bp, Artificial Sequence
  Synthetic
catcacccacgatatacgtctaactggggagattttttcattctttcggaggttcgtacacccccgtctagaagc

SEQ ID NO: 275834 - DNA, 75 bp, Artificial Sequence
  Synthetic
cctgcagccgagccgcaactccccaggagaggacacccccgacgcctccgaacaccctcccgcccccggccatcg

SEQ ID NO: 275835 - DNA, 75 bp, Artificial Sequence
  Synthetic
cagagcccctgagagccaaccagaggcccccctagtctcgcctggaacccccccgaagaagccccggcagggtcc

SEQ ID NO: 275836 - DNA, 75 bp, Artificial Sequence
  Synthetic
cgcagccgagccgcagctccccagaataggacacccccgcacactccgaacacccccccgccccccgccaccggg

SEQ ID NO: 275837 - DNA, 75 bp, Artificial Sequence
  Synthetic
gcccccctagtctcgcctggaacccccccgaagaagccccggcagggtcccctggctcgacgacccctgcacgcg

SEQ ID NO: 275838 - DNA, 75 bp, Artificial Sequence
  Synthetic
gatcgcccaatccatttaaaccatcatgacaacgatcccaaccttgaaatttttgtttttttccccgattactat

SEQ ID NO: 275839 - DNA, 75 bp, Artificial Sequence
  Synthetic
accaaacaaagttgggtaaggatagatcttacaatgactatagactagcaaacttaggagtaaagatcctactgt

SEQ ID NO: 275840 - DNA, 75 bp, Artificial Sequence
  Synthetic
ctatccaagatagggattgttggaacagggagtgccagttacagggtgatgactaggcaagcccaccaaaccctg

SEQ ID NO: 275841 - DNA, 75 bp, Artificial Sequence
  Synthetic
agaaatttcagaatacaaaagattgctgatcacagtgttaaagcctgtagaggatgctctgtcagtgataaccaa

SEQ ID NO: 275842 - DNA, 75 bp, Artificial Sequence
  Synthetic
tgagtcatcactcaacagatcaagaaggttgcgattgttgacccttgggcctggaacaagctgtctcggtagggc

SEQ ID NO: 275843 - DNA, 75 bp, Artificial Sequence
  Synthetic
ttcaggaggggccatccgggggattaagaatgttatcatagtccctatccccggggactcatccatcattacccg

SEQ ID NO: 275844 - DNA, 75 bp, Artificial Sequence
  Synthetic
acgcctgggcgcaggacccgccgttttgccggggctgttctggccggagtggcacttggagtcgcgacggctgct

SEQ ID NO: 275845 - DNA, 75 bp, Artificial Sequence
  Synthetic
gataaaggagacagggcggttgtttgccaaaatgacctataagatgcgggcctgtcaggtaatcgctgaaaatct

SEQ ID NO: 275846 - DNA, 75 bp, Artificial Sequence
  Synthetic
ctcagtgttcaccgtagttgaagagggattattcggaagaacgtacactgtctggagatctgatgccgggaatcc

SEQ ID NO: 275847 - DNA, 75 bp, Artificial Sequence
  Synthetic
atcaatccttgatgaactcccaagcgattgagagtttaaagaccagtctcgagaagtcgaatcaggcaattgaag

SEQ ID NO: 275848 - DNA, 75 bp, Artificial Sequence
  Synthetic
ttccgagacaatgggatggcaaaggacgagcatgacctaacaaaagcccttcacactctggcagtctcaggtgtt

SEQ ID NO: 275849 - DNA, 75 bp, Artificial Sequence
  Synthetic
catccgtcttgttgaggtagttcaaagtaccaggtcccagtccggattgacctttgcatcacgtggtgctgattt

SEQ ID NO: 275850 - DNA, 75 bp, Artificial Sequence
  Synthetic
cgtactggcagtgcagggtgtccaagactatatcaacagtgaacttgtcccttctgtccataaaatgtcatgtga

SEQ ID NO: 275851 - DNA, 75 bp, Artificial Sequence
  Synthetic
gcttgtaggtcacaaactcagtctcaagctccttaggtattacaccgagatcttgtctatattcgggcctagcct

SEQ ID NO: 275852 - DNA, 75 bp, Artificial Sequence
  Synthetic
aagctccttaggtattacaccgagatcttgtctatattcgggcctagcctccgagacccgatagctgctgaaata

SEQ ID NO: 275853 - DNA, 75 bp, Artificial Sequence
  Synthetic
gtgcaagatgcagaagagttcaatatgttgttagcctccatcttagcacaagtttggatcctcctggccaaggcg

SEQ ID NO: 275854 - DNA, 75 bp, Artificial Sequence
  Synthetic
taggtggagatattaataaaatcctggataagcttgggtatagcggcgaggatttccttgctatcctagaaagca

SEQ ID NO: 275855 - DNA, 75 bp, Artificial Sequence
  Synthetic
ggataagcttgggtatagcggcgaggatttccttgctatcctagaaagcaaggggataaaggctcgagttacata

SEQ ID NO: 275856 - DNA, 75 bp, Artificial Sequence
  Synthetic
attctaagtatagcctacccaactttatctgaaatcaagggggtgatagttcataaaatagaagccatatcatac

SEQ ID NO: 275857 - DNA, 75 bp, Artificial Sequence
  Synthetic
tctacgtcagtgacccacattgccctcgcgacctagataatcatatccctctggacagtgtccctaatgcccaaa

SEQ ID NO: 275858 - DNA, 75 bp, Artificial Sequence
  Synthetic
tatctgaaatcaagggggtgatagttcataaaatagaagccatatcatacaacattggggcacaggaatggtaca

SEQ ID NO: 275859 - DNA, 75 bp, Artificial Sequence
  Synthetic
aaggattgcagaaatgatctgcgacattgacaactatattgtcgaggccggactcgcaagtttcattcttactat

SEQ ID NO: 275860 - DNA, 75 bp, Artificial Sequence
  Synthetic
tcaggggtatttgatatcgaattttgatgagacgtcgtgcgtattcactccagaggggacagtctgcagtcagaa

SEQ ID NO: 275861 - DNA, 75 bp, Artificial Sequence
  Synthetic
cctgcactaggccttcacgagttcgctggggaattgtccactattgaatccttgatgaacttgtatcaacagcta

SEQ ID NO: 275862 - DNA, 75 bp, Artificial Sequence
  Synthetic
ggtgacaatcagacaatcgcagtgacaaaaagagttccaagttcttggccttattcactaaaaaagagggaggca

SEQ ID NO: 275863 - DNA, 75 bp, Artificial Sequence
  Synthetic
tgctttgtacccaatgagcccattgcttcaggagtgtttcagggggtcgacaaagtcgtgcgccagaactctagt

SEQ ID NO: 275864 - DNA, 75 bp, Artificial Sequence
  Synthetic
caaattgtgcatcagttttgtgcaagtgttacacaacggagacagttatcagccaagatcctgataaattactaa

SEQ ID NO: 275865 - DNA, 75 bp, Artificial Sequence
  Synthetic
gccgacgaaggatctgaggtacataacagccacttatgatgtttccaggagcgagcatgcaatcgtgtactatat

SEQ ID NO: 275866 - DNA, 75 bp, Artificial Sequence
  Synthetic
tgtagttgaggtggatggggtgacaatacaggtcggcagtcgtgagtacccagactccgtgtacctacacaaaat

SEQ ID NO: 275867 - DNA, 75 bp, Artificial Sequence
  Synthetic
atacaggtcggcagtcgtgagtacccagactccgtgtacctacacaaaatagacctaggcccagccatctctctg

SEQ ID NO: 275868 - DNA, 75 bp, Artificial Sequence
  Synthetic
taggtaatgcagttacaagactggagaatgcaaaggagctcttagatgcatcagaccagatattgaagactgtta

SEQ ID NO: 275869 - DNA, 75 bp, Artificial Sequence
  Synthetic
ggcatagaggtaacatgtaatccagcctgagcggagctgcgaccatcactcaagcaggcctccgagctaatccca

SEQ ID NO: 275870 - DNA, 75 bp, Artificial Sequence
  Synthetic
gttagagggactgggcctcgacaggcgcaggtttccttcctccagcacaaaataggtgagggagagtcgcctaca

SEQ ID NO: 275871 - DNA, 75 bp, Artificial Sequence
  Synthetic
gaatgcaaaggagctcttagatgcatcagaccagatattgaagactgttaaaggagtacccttaggtggcaatct

SEQ ID NO: 275872 - DNA, 75 bp, Artificial Sequence
  Synthetic
ctgcgatcccaaacggatctgaaggaagggacataaagcgaacacgcccagggaagcccagaggagaaactcccg

SEQ ID NO: 275873 - DNA, 75 bp, Artificial Sequence
  Synthetic
ggagtatccctagggcttgtcacattaatatgctgctgtaaggggagatgtaggaacaaagagattcctacgtcc

SEQ ID NO: 275874 - DNA, 75 bp, Artificial Sequence
  Synthetic
accagacaaagctgggtaaggatagttcttataatgactatagactggcaaacttaggagtaaagatcctactgt

SEQ ID NO: 275875 - DNA, 75 bp, Artificial Sequence
  Synthetic
aagggacataaagcgaacacgcccagggaagcccagaggagaaactcccgggcaactgcttctggagatcatgcc

SEQ ID NO: 275876 - DNA, 75 bp, Artificial Sequence
  Synthetic
aaaatcaacccagggctcaaacctgatctgaccgggacctcaaagtcatacgtgagatcactgtagtcagaataa

SEQ ID NO: 275877 - DNA, 75 bp, Artificial Sequence
  Synthetic
acccggtcacctcctctatagccgacctgaagaggatgatagatgctgggctaatgccagaagaaacattgcatc

SEQ ID NO: 275878 - DNA, 75 bp, Artificial Sequence
  Synthetic
atattctttgaatatcctcaagattttccaacagatccttatatcccttaacttcactattaacacaacaatgac

SEQ ID NO: 275879 - DNA, 75 bp, Artificial Sequence
  Synthetic
tgtccttgaagaccagacccttatcaagaatattagatatagactagggtgcggtttctcaaatcaaatgatcat

SEQ ID NO: 275880 - DNA, 75 bp, Artificial Sequence
  Synthetic
cacatgtgcaacacaagcggtcagaggatgcagaagattcaacttccgatcaccaacctggccccgctctatgct

SEQ ID NO: 275881 - DNA, 75 bp, Artificial Sequence
  Synthetic
ctgccagtattataaaaaacttaggacccaggtccaaccaaccgcacatcgacaccccagtcaatcgagcggaga

SEQ ID NO: 275882 - DNA, 75 bp, Artificial Sequence
  Synthetic
gtaagaaaaggatcaactggtttgagaacagagaaataatagacatagaggtgcaagatgcagaagagttcaata

SEQ ID NO: 275883 - DNA, 75 bp, Artificial Sequence
  Synthetic
tagagatgaagacgaggagcttgcaagtttcttaatggatcggcatataattgttccaagagctgcacatgaaat

SEQ ID NO: 275884 - DNA, 75 bp, Artificial Sequence
  Synthetic
taacaagaatcatagggtaatcctggatagagaacgcttgactattgaaagaccctacatcttactaggggtcct

SEQ ID NO: 275885 - DNA, 75 bp, Artificial Sequence
  Synthetic
tatcaagtccctcaaagcctctcccccggatctatccaccatccaagatgcccttgagagctggagagaggggtt

SEQ ID NO: 275886 - DNA, 75 bp, Artificial Sequence
  Synthetic
ggactgctggccattgcagggatcagacttcaccgagccaccgttggaactgcagagatccagagtcggcttaat

SEQ ID NO: 275887 - DNA, 75 bp, Artificial Sequence
  Synthetic
aaccatgatacgtccaagggggaccatcagaatatcaaccaatcatgctcatcagcaatcggatcagacaaagtc

SEQ ID NO: 275888 - DNA, 75 bp, Artificial Sequence
  Synthetic
gacatgtctcctgaaggtaatctcggatttagagagatcacttgtgatgacaatgaggctgggctcggaggagtt

SEQ ID NO: 275889 - DNA, 75 bp, Artificial Sequence
  Synthetic
ttgatcaccaaaccaagaatgtcctaactccgctgtttaaagtcattggtgatgaagtcggcataagaatcccgc

SEQ ID NO: 275890 - DNA, 75 bp, Artificial Sequence
  Synthetic
aaccctgacagagaatatgattttagggatctccggtggtgtatgaatccccccgagagagtcaaaattaatttt

SEQ ID NO: 275891 - DNA, 75 bp, Artificial Sequence
  Synthetic
ataggttggaggtgcccgatatagtggaatcgatgaacggctaccttaccaaacgccacgagtcttgtgctatct

SEQ ID NO: 275892 - DNA, 75 bp, Artificial Sequence
  Synthetic
cagataagtcaattgaacatatatttgagtcatcactcaacaggtcaagaaggttgcaattgttgacccttgggc

SEQ ID NO: 275893 - DNA, 75 bp, Artificial Sequence
  Synthetic
cagatgatcccgacagagatcctctatatgaccggggacctgctgccggcaatgatgtctctaggtcaacagatg

SEQ ID NO: 275894 - DNA, 75 bp, Artificial Sequence
  Synthetic
tgagtcatcactcaacaggtcaagaaggttgcaattgttgacccttgggcctggaacgagctgtctcggtagggc

SEQ ID NO: 275895 - DNA, 75 bp, Artificial Sequence
  Synthetic
ctgactctgaccctgttggatctggatctcgagatgaaaaacaacgtgtcctcagtgttcaccgtagttgaagag

SEQ ID NO: 275896 - DNA, 75 bp, Artificial Sequence
  Synthetic
gttagagggactgggcctcgacaggcgcaggtctccttcctccagcataaaacagatgagggagagtcgcctaca

SEQ ID NO: 275897 - DNA, 75 bp, Artificial Sequence
  Synthetic
tcaagaagttcttaactcccagaagagtaaaggaggaagattccagggcgggaaaatcttgcgagtcccggaaat

SEQ ID NO: 275898 - DNA, 75 bp, Artificial Sequence
  Synthetic
ctcagtgttcaccgtagttgaagagggattattcggaagaacatacattgtctggagacctgatgtcgggaatcc

SEQ ID NO: 275899 - DNA, 75 bp, Artificial Sequence
  Synthetic
tcggcccaatcaattaaaaagggcacagacgggagctcagtcttatctggaatggtgacagagtgttcatcgata

SEQ ID NO: 275900 - DNA, 75 bp, Artificial Sequence
  Synthetic
ctgcgatcccaaatgggtccgaaggaagggacacaaagcgaacacgctcaggaaagcccagaggagaaactcccg

SEQ ID NO: 275901 - DNA, 75 bp, Artificial Sequence
  Synthetic
tttttaagagtcttcgagatcgggctggtaagagatctcgggctgggtgctcctgttctccatatgaccaatcat

SEQ ID NO: 275902 - DNA, 75 bp, Artificial Sequence
  Synthetic
atcggagctgtcttttagcagtaggggagctgaagctggcagccctatgcaccccatccgagactgtgacactga

SEQ ID NO: 275903 - DNA, 75 bp, Artificial Sequence
  Synthetic
ggagctgaagctggcagccctatgcaccccatccgagactgtgacactgagtgagagaggagttccaaagagaga

SEQ ID NO: 275904 - DNA, 75 bp, Artificial Sequence
  Synthetic
gtccaaatcagtgacaagacatcgcccgccagtattataaaaaacttaggacccaggtccaagcaaccacacatc

SEQ ID NO: 275905 - DNA, 75 bp, Artificial Sequence
  Synthetic
gtgagagaggagttccaaagagagagcctcttgtggttgtgatactcaacctagccgggcctactctaggtggcg

SEQ ID NO: 275906 - DNA, 75 bp, Artificial Sequence
  Synthetic
gcaggacattcgtgcaagcattgctaagatccatgatgacaacaaaactatcctctcaaaacttgattctctact

SEQ ID NO: 275907 - DNA, 75 bp, Artificial Sequence
  Synthetic
gaggtggccctcctagaaggaccacaagccgagagatgagatcaaaccaagacatcaacagacaaactagagaca

SEQ ID NO: 275908 - DNA, 75 bp, Artificial Sequence
  Synthetic
tgacctcacggtggagaaacttcatctatcctcacacagagggattatcaaagataacgaggccaattgggtagt

SEQ ID NO: 275909 - DNA, 75 bp, Artificial Sequence
  Synthetic
ctatcctcacacagagggattatcaaagataacgaggccaattgggtagtaccgtccaccgatgttcgtgatctt

SEQ ID NO: 275910 - DNA, 75 bp, Artificial Sequence
  Synthetic
tacggatgagctatgcacaaaccctttgatctacgacaggtctcccatcatagagcacgatgcaacccgactata

SEQ ID NO: 275911 - DNA, 75 bp, Artificial Sequence
  Synthetic
aagcatgtaagactcgacctccttcattttgcaatggcacgggagtgggcccatggtcagaggggagaatccctg

SEQ ID NO: 275912 - DNA, 75 bp, Artificial Sequence
  Synthetic
tagagcacgatgcaacccgactatattcacagagccacaggagacatctggtggagtttgttacctggtcaccaa

SEQ ID NO: 275913 - DNA, 75 bp, Artificial Sequence
  Synthetic
ccatggtcagaggggagaatccctgcctacggggtgatcagggtcagtcttgacttagccagtgaccctgacata

SEQ ID NO: 275914 - DNA, 75 bp, Artificial Sequence
  Synthetic
tgataggtctcagaagagcggaatcaaagtcaactccggttcaaagggtcagctcctcaaggatctccagctaaa

SEQ ID NO: 275915 - DNA, 75 bp, Artificial Sequence
  Synthetic
tgtatctggcagcctatgagagcggagtaagaattgcctcactagtgcaaggtgataatcagacaattgcagtga

SEQ ID NO: 275916 - DNA, 75 bp, Artificial Sequence
  Synthetic
tgatacctcacctgtctggcatggatctttacaacaacccgttctcaagcgctgtgtggttggcggtaccacctt

SEQ ID NO: 275917 - DNA, 75 bp, Artificial Sequence
  Synthetic
aaatactattggcctcccaaatagagcagaggttatgccacacattttgaccacagagatcaaggggcctcgggg

SEQ ID NO: 275918 - DNA, 75 bp, Artificial Sequence
  Synthetic
gcagaggttatgccacacattttgaccacagagatcaaggggcctcggggtcgttgtcatgttcccatagaattg

SEQ ID NO: 275919 - DNA, 75 bp, Artificial Sequence
  Synthetic
tcgaaaaattagaaggtgatgacattcaagaagttcttaactcccagaagagtaaaggaggaagattccaaggcg

SEQ ID NO: 275920 - DNA, 75 bp, Artificial Sequence
  Synthetic
cctctactctctgctctctcggatgagcaaaggagtatataagatcgtcaccaacgccgtgagccaccccaaagt

SEQ ID NO: 275921 - DNA, 75 bp, Artificial Sequence
  Synthetic
tagatttactgaatgatgtgaaaggctctaaggatctcaaggaattccacaagatgctaacagccattcttgcca

SEQ ID NO: 275922 - DNA, 75 bp, Artificial Sequence
  Synthetic
ccacagagatcaaggggcctcggggtcgttgtcatgttcccatagaattgtcccgcaggattgatgatgacatca

SEQ ID NO: 275923 - DNA, 75 bp, Artificial Sequence
  Synthetic
gtcattgagccgattcatggcccatccctggatacacagaatttacatgtcactgtctgtgacatgatatatggg

SEQ ID NO: 275924 - DNA, 75 bp, Artificial Sequence
  Synthetic
agtggtgcaacccaagctgtgccagagtccagatgggagtcatcagagcgaaatgcgtctgtggggagtgtcccc

SEQ ID NO: 275925 - DNA, 75 bp, Artificial Sequence
  Synthetic
tcctctcaatcaggctattacaaaaaacttaggagcaagggcaactgagcttcacagacaggatgaccgagattt

SEQ ID NO: 275926 - DNA, 75 bp, Artificial Sequence
  Synthetic
tacttctacccggctcgattgaatttcaaaggcaatcctctctctctgaggatagagtgtttcccctggcatcat

SEQ ID NO: 275927 - DNA, 75 bp, Artificial Sequence
  Synthetic
gatagagtgtttcccctggcatcataaggtatggtgctaccatgattgtcttatatacaacaccataacaaacga

SEQ ID NO: 275928 - DNA, 75 bp, Artificial Sequence
  Synthetic
gaggtcgtagtcacagagaggttcgtcaacattcaagccaaacatctctgtgtattggccgatgtatattgcagc

SEQ ID NO: 275929 - DNA, 75 bp, Artificial Sequence
  Synthetic
ttatatacaacaccataacaaacgaagaagtccataagagaggattgatcggcatagaggtaacatgtaattcag

SEQ ID NO: 275930 - DNA, 75 bp, Artificial Sequence
  Synthetic
ggcatagaggtaacatgtaattcagcctgagcggagctgcggccgccactcaagcaggcctccgagctaatccca

SEQ ID NO: 275931 - DNA, 75 bp, Artificial Sequence
  Synthetic
ctcgacaacacaacccagtcaacaatgttataaaaaacttaggggccaaggctataggagccatggactccctgt

SEQ ID NO: 275932 - DNA, 75 bp, Artificial Sequence
  Synthetic
tgttataaaaaacttaggggccaaggctataggagccatggactccctgtcagtcaatcaggtcttgtaccctga

SEQ ID NO: 275933 - DNA, 75 bp, Artificial Sequence
  Synthetic
ctagatatagtggtgaggcgcacggcaggactaaatgagaaactggtattttacaacaacactccgctatctttg

SEQ ID NO: 275934 - DNA, 75 bp, Artificial Sequence
  Synthetic
acaaacaagctggttgccatcctcgagtactcaggcattgaccacaactatgtccttgaagaccagaccctcatc

SEQ ID NO: 275935 - DNA, 75 bp, Artificial Sequence
  Synthetic
gacgtcgactttaaacagcctcgcaaggctaagttagatatatacgttgttgggttgactgatttctctccccct

SEQ ID NO: 275936 - DNA, 75 bp, Artificial Sequence
  Synthetic
agtactcaggcattgaccacaactatgtccttgaagaccagaccctcatcaagaatattagatatagactggggt

SEQ ID NO: 275937 - DNA, 75 bp, Artificial Sequence
  Synthetic
aacatctcatactcggttgaaaacatcctctcaatcaggctattacaaaaaacttaggagcaagggcaactgagc

SEQ ID NO: 275938 - DNA, 75 bp, Artificial Sequence
  Synthetic
tgtccttgaagaccagaccctcatcaagaatattagatatagactggggtgtggtttctcaaatcaaatgatcat

SEQ ID NO: 275939 - DNA, 75 bp, Artificial Sequence
  Synthetic
gtcaactctaaacttaaaagttacccccgtaattgtcatatcatatacccagattgcaataaggatctgttttgt

SEQ ID NO: 275940 - DNA, 75 bp, Artificial Sequence
  Synthetic
cccgtaattgtcatatcatatacccagattgcaataaggatctgttttgtatcaaagacagctgcatatctagga

SEQ ID NO: 275941 - DNA, 75 bp, Artificial Sequence
  Synthetic
acgttaatcaggccatccttagaagtcggagagcatggattgttcttaggagaaggttccggttcaatgctggct

SEQ ID NO: 275942 - DNA, 75 bp, Artificial Sequence
  Synthetic
agaggtcacatttatggtacacgtgggcaactttagaagaaagaagaacgaagtatactctgctgattattgcaa

SEQ ID NO: 275943 - DNA, 75 bp, Artificial Sequence
  Synthetic
taattccctatactcgaaggtaagtcaccaggtactggattgtcttacaagagtcaacggtaaattaggcttggg

SEQ ID NO: 275944 - DNA, 75 bp, Artificial Sequence
  Synthetic
caaattgttattacaacagcggggtaacagcggagggcagagccggacagagggaaatatctccctatccttcag

SEQ ID NO: 275945 - DNA, 75 bp, Artificial Sequence
  Synthetic
gtttttgccttgggaggaataggtggaacaagtctccatattcgaagcacagggaaaatgagcaagaccctccat

SEQ ID NO: 275946 - DNA, 75 bp, Artificial Sequence
  Synthetic
gagggtatccttgacttggggttacacatgcacagctctcaatggttcgagactttcctgttctggttcactatc

SEQ ID NO: 275947 - DNA, 75 bp, Artificial Sequence
  Synthetic
gaacaagtctccatattcgaagcacagggaaaatgagcaagaccctccatgcacagctggggttcaagaaaattc

SEQ ID NO: 275948 - DNA, 75 bp, Artificial Sequence
  Synthetic
caagtacataatcagtaacatccaaacctctagtctgggtttcatacattcagatattgagacactcccaaccaa

SEQ ID NO: 275949 - DNA, 75 bp, Artificial Sequence
  Synthetic
tcgggggacgcattcgaggtgctcgtatcacgagacctcgttgcgataattggcaagaatacccagtatgtctac

SEQ ID NO: 275950 - DNA, 75 bp, Artificial Sequence
  Synthetic
tagattgtcagataatggttattatagtgtccccagaagaatgttggagttccgctcagccaatgcagtcgcctt

SEQ ID NO: 275951 - DNA, 75 bp, Artificial Sequence
  Synthetic
gttgcctctatcctatccttatccttgattttgggaaaaatcggctctattacagttgtcaaagttatgcccatt

SEQ ID NO: 275952 - DNA, 75 bp, Artificial Sequence
  Synthetic
ggaagaggccctcccacctcccgcccaaaacacacaccccaagactccccgaaacagcgccggcaaaaccactct

SEQ ID NO: 275953 - DNA, 75 bp, Artificial Sequence
  Synthetic
caaaacacacaccccaagactccccgaaacagcgccggcaaaaccactctcccggcgggacgagaccgacccccc

SEQ ID NO: 275954 - DNA, 75 bp, Artificial Sequence
  Synthetic
agcggggattttacccaaggtttcatagcctatgctatccaatattttagggagagcctgcttgcctatgctaga

SEQ ID NO: 275955 - DNA, 75 bp, Artificial Sequence
  Synthetic
cccccccgcgacccgccgggcgccgaccgcgcgagccggcgagacacccccaagaggcttcgacgaagaccgggg

SEQ ID NO: 275956 - DNA, 75 bp, Artificial Sequence
  Synthetic
ttgctctgcttgaaccgctgtcgttggcttatctccaacttcaggatgtcaccctggagttaagaggtgcttttt

SEQ ID NO: 275957 - DNA, 75 bp, Artificial Sequence
  Synthetic
aaacacacccaagaccatgcgcctagcacccccagccccccaaccggcgggacagggggccaggaaggggtcccc

SEQ ID NO: 275958 - DNA, 75 bp, Artificial Sequence
  Synthetic
tgagatactagagcattgcggcattgacacggaaggcacctacaattccatcactgaaggattggactacgtatt

SEQ ID NO: 275959 - DNA, 75 bp, Artificial Sequence
  Synthetic
cgggggtcaggactgcaccaggacttgtgagccatatattatcagggaaacagataggttgtattcaatctttct

SEQ ID NO: 275960 - DNA, 75 bp, Artificial Sequence
  Synthetic
gggagaggccttcctccctcccgtccaaaacacacaccccaaggttccccgaaacagcgccgacacagccacccc

SEQ ID NO: 275961 - DNA, 75 bp, Artificial Sequence
  Synthetic
gcccaaacaaagcagacccccaagacgaaatctcccagagcaccccattcatcatcaaacaaaacttaggggcca

SEQ ID NO: 275962 - DNA, 75 bp, Artificial Sequence
  Synthetic
tatcacccacgatatacatttaactggggagatattttcatttttccggagtttcggacacccccgcctcgaagc

SEQ ID NO: 275963 - DNA, 75 bp, Artificial Sequence
  Synthetic
atcatcaaacaaaacttaggggccaagtccagacgacagaccctggcccgccaggcagcaagccacagaaaagaa

SEQ ID NO: 275964 - DNA, 75 bp, Artificial Sequence
  Synthetic
caacaaactcgctccgggggggggccccccccacgacccgccgggcgccgaccgcgcgagccggcgagacacccc

SEQ ID NO: 275965 - DNA, 75 bp, Artificial Sequence
  Synthetic
tcagttatgagactatgatgaaagggcatgcagtgttttgcgggataatcataaatgggtttagagaccggcatg

SEQ ID NO: 275966 - DNA, 75 bp, Artificial Sequence
  Synthetic
ggagacaagatctgcccgggaagaggacacccaaccacagaaacccccagctccaggggaagagccccccctcca

SEQ ID NO: 275967 - DNA, 75 bp, Artificial Sequence
  Synthetic
gctccgccgacccagcacagacccggcccaaacaaagcagacccccaagacgaaatctcccagagcaccccattc

SEQ ID NO: 275968 - DNA, 75 bp, Artificial Sequence
  Synthetic
ctccaggggaagagccccccctccacacgacggaggaacgggcgagagacaccgaggagaacacgatcgggagcc

SEQ ID NO: 275969 - DNA, 75 bp, Artificial Sequence
  Synthetic
tgttccacccctacccagtactggccaacagcaggcagcgtgaattaattcttcgaatagccaagaaattctggg

SEQ ID NO: 275970 - DNA, 75 bp, Artificial Sequence
  Synthetic
cacgacggaggaacgggcgagagacaccgaggagaacacgatcgggagccgagagccggagacgccggcggcaaa

SEQ ID NO: 275971 - DNA, 75 bp, Artificial Sequence
  Synthetic
aacacacccgaggccaggcgccgggcacccccagccccgccaccggcgggacaggaggacaagacggggtccccc

SEQ ID NO: 275972 - DNA, 75 bp, Artificial Sequence
  Synthetic
gcatgcagtgttttgcgggataatcataaatgggtttagagaccggcatggcggcagctggccccccgttgcatt

SEQ ID NO: 275973 - DNA, 75 bp, Artificial Sequence
  Synthetic
ccggaggacccgaggagagcccgactccgcgcagactcgacggcagaggacccagtcccgccacaaagagaggtg

SEQ ID NO: 275974 - DNA, 75 bp, Artificial Sequence
  Synthetic
cccaaacaaagcagacccccaagacgaaatcgcccagcacaccccattcatcatcaaacaaaacttaggggtcaa

SEQ ID NO: 275975 - DNA, 75 bp, Artificial Sequence
  Synthetic
ccttaaagacaaagcactggctgcactgaagaatgagtgggattcagtttacccgaaagaatacctccgctataa

SEQ ID NO: 275976 - DNA, 75 bp, Artificial Sequence
  Synthetic
ggcaaacagaccgcgggaggaccacctcccagcaagacagacgtctcccccgcagccgagccgcagctcctcaga

SEQ ID NO: 275977 - DNA, 75 bp, Artificial Sequence
  Synthetic
caggcagcaagccgcagaaaggaaggagacaagaccggcccggaaggaggacacccaaccacagaaacccccaac

SEQ ID NO: 275978 - DNA, 75 bp, Artificial Sequence
  Synthetic
taagaagggaatggttgttcaccctcgatacgaaagaagtgaaagagtcgttcgaattggtaggttacagtgcac

SEQ ID NO: 275979 - DNA, 75 bp, Artificial Sequence
  Synthetic
cgcagccgagccgcagctcctcagaagagggcacccccgaagccccccagaacccctccgctcacggccgccggg

SEQ ID NO: 275980 - DNA, 75 bp, Artificial Sequence
  Synthetic
tctgcccccttttcctccgccataagaccccactgatgatccaaaagattatagaaaactacatattggataagt

SEQ ID NO: 275981 - DNA, 75 bp, Artificial Sequence
  Synthetic
tctgcccgtcaccggaaccggggtcttgaactatgaagtccatgcttatcgtagaattggcctgaattcatcagc

SEQ ID NO: 275982 - DNA, 75 bp, Artificial Sequence
  Synthetic
accgaggagaacccgatcgggagccaggagccggagacgccagcggtaaacaggccgggcacacatccgacacca

SEQ ID NO: 275983 - DNA, 75 bp, Artificial Sequence
  Synthetic
atcttataataactatgaattgccacgcttaggattaaagatcctactgccggggggaggagtaggagcaagatc

SEQ ID NO: 275984 - DNA, 75 bp, Artificial Sequence
  Synthetic
cccccccagtccctcccggcgatcccccacagaggccccagcaaggtcccccggcccgacgacccctgcatgcgc

SEQ ID NO: 275985 - DNA, 75 bp, Artificial Sequence
  Synthetic
gcaaaaatgacttacaagatgcgggcctgtcaggtaattgcggagaatctgatatcaaatggagtcgggaagtat

SEQ ID NO: 275986 - DNA, 75 bp, Artificial Sequence
  Synthetic
cccgcgtggacccgacggcaggggatctaaccccgccacaaagagaggcgagaaccctcccccccgcacacaacc

SEQ ID NO: 275987 - DNA, 75 bp, Artificial Sequence
  Synthetic
cgaaagggaaacccaccagaggacgtccagcacatccgtgcataaacatcatgacacgggtcgcaaccttggtat

SEQ ID NO: 275988 - DNA, 75 bp, Artificial Sequence
  Synthetic
cctgactatggcgactctcctcaagagcttggcattgttcaagaagaacagggacaaagcgccgacggcatcagg

SEQ ID NO: 275989 - DNA, 75 bp, Artificial Sequence
  Synthetic
ccacactctggcagtctcaggtgttcccaagaacaataaagatagccaccgaggtggccctcctcgaaggaccac

SEQ ID NO: 275990 - DNA, 75 bp, Artificial Sequence
  Synthetic
aagaatgttatcatagtcccgattcccggagactcatccatcattacccgttcaagattgctcgacaggcttgtc

SEQ ID NO: 275991 - DNA, 75 bp, Artificial Sequence
  Synthetic
cgcgtgccagattcactggggcaatctatccaagatagggattgtcggaacagggagtgccagttacaaggtgat

SEQ ID NO: 275992 - DNA, 75 bp, Artificial Sequence
  Synthetic
gaggtggccctcctcgaaggaccacaagccgagagatgagatcaaaccaggacatcaacagacaaaatagagaca

SEQ ID NO: 275993 - DNA, 75 bp, Artificial Sequence
  Synthetic
gaccaggccaagccaccaaactctggttataaagttgatgccaaatataacagccatcgacaattgtacgaaatc

SEQ ID NO: 275994 - DNA, 75 bp, Artificial Sequence
  Synthetic
acgggtcaaagctgaccggcgtgatgatcagcatgctgtctttgttcgtagagtcacccgggcaactgatccagc

SEQ ID NO: 275995 - DNA, 75 bp, Artificial Sequence
  Synthetic
ctatttgcggtgccaaccaatcagccctgaccagagtgagtcatacgagactgttagtgcattcatcaccgctga

SEQ ID NO: 275996 - DNA, 75 bp, Artificial Sequence
  Synthetic
cccccccaatccctcccggcgccctcccacagaggctccagcaaagtccctcggcccgacgacccatgcatgcgc

SEQ ID NO: 275997 - DNA, 75 bp, Artificial Sequence
  Synthetic
gatcagcatgctgtctttgttcgtagagtcacccgggcaactgatccagcggatcacagatgatccagatgtcag

SEQ ID NO: 275998 - DNA, 75 bp, Artificial Sequence
  Synthetic
ccttaagaagtattgcctgaattggagatacgagacaatcagcatatttgcacagagacttaatgaaatttacgg

SEQ ID NO: 275999 - DNA, 75 bp, Artificial Sequence
  Synthetic
tttgcctctatcctatccttatccctaattttaggaaaaatcggctctattacggttatcaaaattatgcccatt

SEQ ID NO: 276000 - DNA, 75 bp, Artificial Sequence
  Synthetic
cctttgcatcacgtggtgctgatttggacaatgaggcagacatgtattttgcaactgaagggccctcgagtggga

SEQ ID NO: 276001 - DNA, 75 bp, Artificial Sequence
  Synthetic
cacagggtattggaaaaatctgtgctctacgtcagtgacccacattgcccccccgacttggatgatcacgtcccc

SEQ ID NO: 276002 - DNA, 75 bp, Artificial Sequence
  Synthetic
agcacttggagtcgcgacggctgctcaaataactgccggagtcgcactccatcagtcattgatgaattcccaagc

SEQ ID NO: 276003 - DNA, 75 bp, Artificial Sequence
  Synthetic
gttaccttattatgataggattgaaagccaatcggttgataaacccggaggccattaagcaaagcatagtcagag

SEQ ID NO: 276004 - DNA, 75 bp, Artificial Sequence
  Synthetic
gaacagggaaataatagatatagaagtacaggatgcagaagagttcaatatgttattagcctccatactggcaca

SEQ ID NO: 276005 - DNA, 75 bp, Artificial Sequence
  Synthetic
gttacagcaccagacactgcagctgactcagaattgagaaggtgggttaagtacacacaacaaagaagggtgatt

SEQ ID NO: 276006 - DNA, 75 bp, Artificial Sequence
  Synthetic
aaaaatctgtagggatctaatccaccatgatatcgcctccggtccagacggtctgatgagctccacaatcatttt

SEQ ID NO: 276007 - DNA, 75 bp, Artificial Sequence
  Synthetic
catactggcggtacagggcgtccaagattatatcaacaacgagcttgtcccctctgttcatagaatgtcatgtga

SEQ ID NO: 276008 - DNA, 75 bp, Artificial Sequence
  Synthetic
actcagaattgagaaggtgggttaagtacacacaacaaagaagggtgattggggaattccgctttgacaaagggt

SEQ ID NO: 276009 - DNA, 75 bp, Artificial Sequence
  Synthetic
aaactccttaggtattataccgagatcctgtctatattcgggcctagccttcgagacccgatagctgctgaaata

SEQ ID NO: 276010 - DNA, 75 bp, Artificial Sequence
  Synthetic
tgcagaagatctatcactccggcggttcatggtatctcttatacttgacatcaaaaggacccctgggaacaagcc

SEQ ID NO: 276011 - DNA, 75 bp, Artificial Sequence
  Synthetic
ttactcactaaaaaagagggaggcatccaaagcagctcagaattacttcgtggttttaaggcagaggttgcacga

SEQ ID NO: 276012 - DNA, 75 bp, Artificial Sequence
  Synthetic
ttcatggtatctcttatacttgacatcaaaaggacccctgggaacaagccaaggattgcagaaatgatctgtgac

SEQ ID NO: 276013 - DNA, 75 bp, Artificial Sequence
  Synthetic
taggcggagacatcaataaaattctggacaagcttgggtatagcggcggggatttccttgctattctagaaagca

SEQ ID NO: 276014 - DNA, 75 bp, Artificial Sequence
  Synthetic
gaaaccatagtatcctctcacttttttgtatactcgaaagggatttattatgatggcttattagtctcacaatca

SEQ ID NO: 276015 - DNA, 75 bp, Artificial Sequence
  Synthetic
ggctcgccagtttcatccttactatcaagtttggtattgaaaccatgtatcctgcgctaggtcttcacgagtttg

SEQ ID NO: 276016 - DNA, 75 bp, Artificial Sequence
  Synthetic
ctaaagagcattgccaggtgtgtcttctggtccgagactattgtggacgaaaccagagcggcctgtagcaatatt

SEQ ID NO: 276017 - DNA, 75 bp, Artificial Sequence
  Synthetic
tgtggacacaagagattactttataattcttagcatagcctacccaaccttatctgagatcaaaggggtgatagt

SEQ ID NO: 276018 - DNA, 75 bp, Artificial Sequence
  Synthetic
ccggagagttgtccactatagaatccttgatgaatctatatcaacagctaggcgaagttgcaccctacatggtga

SEQ ID NO: 276019 - DNA, 75 bp, Artificial Sequence
  Synthetic
aagaacttaaagaggaaccacctaacctttgacttacacagtaatccgtttattaagggcctatccaaagctgag

SEQ ID NO: 276020 - DNA, 75 bp, Artificial Sequence
  Synthetic
atactctttgaatatcctcaagattttccaacagatccttatatccctcaacttcaccattaacacgacgatgac

SEQ ID NO: 276021 - DNA, 75 bp, Artificial Sequence
  Synthetic
gtgactctactggcaatctaaaagattaaagaaaactacatattggataagtatctattcccagctttgtctggt

SEQ ID NO: 276022 - DNA, 75 bp, Artificial Sequence
  Synthetic
gagaatggcgatctactaataaggatggcacttttgccagcacccattgggggtctcaactatcttaacatgagc

SEQ ID NO: 276023 - DNA, 75 bp, Artificial Sequence
  Synthetic
tgcgctgtatccaatgagcccattgcttcaggaatgtttcagggggtcgacaaaatcgtgtgccagaaccctagt

SEQ ID NO: 276024 - DNA, 75 bp, Artificial Sequence
  Synthetic
acccggtcacttcctctatagccgacctgaagaggatgatagacgctgggctaatgccagaggaaacattgcatc

SEQ ID NO: 276025 - DNA, 75 bp, Artificial Sequence
  Synthetic
aagctaaactagtctcggaaattgcctctcagactggggacgaaaggaccgctagagggaccgggcccagacagg

SEQ ID NO: 276026 - DNA, 75 bp, Artificial Sequence
  Synthetic
ctaatgccagaggaaacattgcatcaagtgatgacccagacccctggagaatcgtcttaccttgattgggcaagt

SEQ ID NO: 276027 - DNA, 75 bp, Artificial Sequence
  Synthetic
atcctatcaaaagggaacttgattgcaaattgtgcgtcagttttgtgcaagtgttacacaacggagacagttatc

SEQ ID NO: 276028 - DNA, 75 bp, Artificial Sequence
  Synthetic
gctagagggaccgggcccagacaggcgcaggtttccttcctccagcataaaataggagagggagagtcacatgca

SEQ ID NO: 276029 - DNA, 75 bp, Artificial Sequence
  Synthetic
aataggagagggagagtcacatgcatcggcgaccggggaagaagtcaaagctgcgaccccaaatgggcccgacga

SEQ ID NO: 276030 - DNA, 75 bp, Artificial Sequence
  Synthetic
gcgtacagagtataactcgccttctcaaaaacatcactgctcggtatattttaatcagcagccctaatccgatgc

SEQ ID NO: 276031 - DNA, 75 bp, Artificial Sequence
  Synthetic
ttaatcagcagccctaatccgatgctaaaaggattgttccatgaggggagcagagatgaagacgaagagcttgcg

SEQ ID NO: 276032 - DNA, 75 bp, Artificial Sequence
  Synthetic
agacttaggcccagccatctctctggaaaaactggatgtaggcaccaatttaggcaatgcagtcacaagactgga

SEQ ID NO: 276033 - DNA, 75 bp, Artificial Sequence
  Synthetic
accaactgctcctggaaatcatgcctgaagacgaggtcccgcgagggtctggacaaaaccctcgtgaggctcaaa

SEQ ID NO: 276034 - DNA, 75 bp, Artificial Sequence
  Synthetic
gcaggccatggccaagatcctagagggccaagaggagggggaagacaacagccagacatacaacgacaaggacct

SEQ ID NO: 276035 - DNA, 75 bp, Artificial Sequence
  Synthetic
aagtatgaaacgaggtggcctcacccctcgagtcctagctcgcctttccaattatgattatgaacaattcagatc

SEQ ID NO: 276036 - DNA, 75 bp, Artificial Sequence
  Synthetic
cctcgagtcctagctcgcctttccaattatgattatgaacaattcagatccggaataacattactgacccaaaaa

SEQ ID NO: 276037 - DNA, 75 bp, Artificial Sequence
  Synthetic
taggaacaaggagattcctgcctccaaaatcaacccagggctcaaacccgacctgaccgggacttcaaagtctta

SEQ ID NO: 276038 - DNA, 75 bp, Artificial Sequence
  Synthetic
atcaaaaccagcaacaagacaccgcccttcagtattataaaaaacttaggacccaggtccaagcagtcacactcc

SEQ ID NO: 276039 - DNA, 75 bp, Artificial Sequence
  Synthetic
aaaatcaacccagggctcaaacccgacctgaccgggacttcaaagtcttacgtgagatcactgtagtcagaataa

SEQ ID NO: 276040 - DNA, 75 bp, Artificial Sequence
  Synthetic
actcgtgctcggtgcagctcgctatagctctgaggggccatatgtgggctaggttagctcgtgggagacctatct

SEQ ID NO: 276041 - DNA, 75 bp, Artificial Sequence
  Synthetic
ccaccgatggcagaggaacaagcataccatgtcaacaagggactggaatgtatcaagtccctcaaagcctctccc

SEQ ID NO: 276042 - DNA, 75 bp, Artificial Sequence
  Synthetic
accatgtcaacaagggactggaatgtatcaagtccctcaaagcctctcccccggatctctccaccatcagagata

SEQ ID NO: 276043 - DNA, 75 bp, Artificial Sequence
  Synthetic
aaaatcaacccagggctcaaacccgacctaaccgggacttcaaagtcgtacgtgagatcactgtagttagaataa

SEQ ID NO: 276044 - DNA, 75 bp, Artificial Sequence
  Synthetic
agaatcgatgaacggctaccttatcaaacgccacgagtcttgtgccatttgcgaaacgggctcaaatcactacgg

SEQ ID NO: 276045 - DNA, 75 bp, Artificial Sequence
  Synthetic
tgacacatcggaccgtgcagcaccgaaccctgatatatccaagggggaccatcagaatatcaaccaatcatgccc

SEQ ID NO: 276046 - DNA, 75 bp, Artificial Sequence
  Synthetic
cagcttgacgatgtctctagagagacttctgccctccgtgtaccttatgtcggatcgacaactgaggaaaggaca

SEQ ID NO: 276047 - DNA, 75 bp, Artificial Sequence
  Synthetic
gacgtgtctactgaaagtaatctcggatatagagagatcaatcacgatgacagtgaggctggactcagaggagtt

SEQ ID NO: 276048 - DNA, 75 bp, Artificial Sequence
  Synthetic
ggcttcaccgggccaccgttggaactgcggagatccagagtcggctgaataccaacattgagttgaccgaatcca

SEQ ID NO: 276049 - DNA, 75 bp, Artificial Sequence
  Synthetic
catctccgataagattaagttcctcaaccctgacagagaatatgattttagggatctccggtggtgtatgaaccc

SEQ ID NO: 276050 - DNA, 75 bp, Artificial Sequence
  Synthetic
accaacattgagttgaccgaatccattgatcatcaaactaaggatgtcttaacacccctgttcaaaatcattggt

SEQ ID NO: 276051 - DNA, 75 bp, Artificial Sequence
  Synthetic
caggcagagagctgatatcaccttagatgaattgagaatgatcactccagtctctacatccaccaacctagccca

SEQ ID NO: 276052 - DNA, 75 bp, Artificial Sequence
  Synthetic
gatgaattgagaatgatcactccagtctctacatccaccaacctagcccatcggctgagggacaggagtacccag

SEQ ID NO: 276053 - DNA, 75 bp, Artificial Sequence
  Synthetic
gaccagttttgtgaatacaaagccgcagtcaagtcagttgaacatatatttgagtcatcactcaacaggtcagaa

SEQ ID NO: 276054 - DNA, 75 bp, Artificial Sequence
  Synthetic
cagatgatcccgacagagatcctctatatgaccggggatctgttgccgacaatgatgtcgttaagtccacagatg

SEQ ID NO: 276055 - DNA, 75 bp, Artificial Sequence
  Synthetic
gacgacagcgatgtggactctggcccagatgatcccgacagagatcctctatatgaccggggatctgttgccgac

SEQ ID NO: 276056 - DNA, 75 bp, Artificial Sequence
  Synthetic
ttccaatgataatttgtcatttgtaatatctgagaagaaagtagatactaacttcatttaccagcaagggatgtt

SEQ ID NO: 276057 - DNA, 75 bp, Artificial Sequence
  Synthetic
ccggaacaggctgtctcggcaggacagtaacaagagctcagttctcagagcttacgctgaccctgatggacctgg

SEQ ID NO: 276058 - DNA, 75 bp, Artificial Sequence
  Synthetic
tcaagaagttcttaactctcagaagagcaagaggggaaaattccaaggcgggaaaaccttgcgagtccctgaaac

SEQ ID NO: 276059 - DNA, 75 bp, Artificial Sequence
  Synthetic
gatcaattctgtgaatacaaagccacggtcaagtcagttgaacatatatttgagtcatcattcaacaggtcagaa

SEQ ID NO: 276060 - DNA, 75 bp, Artificial Sequence
  Synthetic
gctcggtcttgggatccttgaaaatcttttcagattggaggccaccacaggggtatccaacacagtgttacattt

SEQ ID NO: 276061 - DNA, 75 bp, Artificial Sequence
  Synthetic
tctctacatccaccaacctagcccatcggctgagggacaggagtacccaggtgaaatattcagggacatccctcg

SEQ ID NO: 276062 - DNA, 75 bp, Artificial Sequence
  Synthetic
tcagcccaatcaattaaaaagggcacagacgggaactcagtcttatctggaacggtgacagagtgttcatcgata

SEQ ID NO: 276063 - DNA, 75 bp, Artificial Sequence
  Synthetic
gtacctatggttgatcacccaaggataccgagtctccgtgacattaaagttacgagtgagctatgcacaaacccc

SEQ ID NO: 276064 - DNA, 75 bp, Artificial Sequence
  Synthetic
taccgagtctccgtgacattaaagttacgagtgagctatgcacaaaccccttgatctacgacaagtctcccatca

SEQ ID NO: 276065 - DNA, 75 bp, Artificial Sequence
  Synthetic
agtaacaagagctcagttctcagaacttacgctgaccctgatggacctggatctcgagatgaagcacaacgtgtc

SEQ ID NO: 276066 - DNA, 75 bp, Artificial Sequence
  Synthetic
gagcaccagtctagatattggccagtttttaagagttttcgagatcgggttggtgagggatctcgagctgggtgc

SEQ ID NO: 276067 - DNA, 75 bp, Artificial Sequence
  Synthetic
aactatacagtgtattgcctaccactgaccccacggtggagaaactctatttatcctcacatagggggattatca

SEQ ID NO: 276068 - DNA, 75 bp, Artificial Sequence
  Synthetic
gcaggacattcgtgcaagcattgccaagatccatgatgacaacaaaaccatcctctcaaagcttgactctatact

SEQ ID NO: 276069 - DNA, 75 bp, Artificial Sequence
  Synthetic
tggagatgacgacatcaatagtttcatcacagaatttttgctagtagagcccagactgtttatagtctacctcgg

SEQ ID NO: 276070 - DNA, 75 bp, Artificial Sequence
  Synthetic
tttgacatacattatcatcggccctcgggcaagtaccagatgggggagctcctctactctttactctctaggatg

SEQ ID NO: 276071 - DNA, 75 bp, Artificial Sequence
  Synthetic
atcaagaaacaaatcagcaaacagaatataagtatatctaccattgagggccatctttccagtataatgatagcc

SEQ ID NO: 276072 - DNA, 75 bp, Artificial Sequence
  Synthetic
accccatctgagactgtgactctgagtgagagaggagttccaaagagagagcctcttgtggttgtgatactcaac

SEQ ID NO: 276073 - DNA, 75 bp, Artificial Sequence
  Synthetic
attttgcaatggcacaggaataggcccatggtcagaggggagaatccctgcctacggggtgatcagggtcagtct

SEQ ID NO: 276074 - DNA, 75 bp, Artificial Sequence
  Synthetic
ccatctttccagtataatgatagccatcccgggtttcgggaaggaggtcaaggacccaacatccgaggttgagtt

SEQ ID NO: 276075 - DNA, 75 bp, Artificial Sequence
  Synthetic
cctctactctttactctctaggatgagcaaaggggtatataagatcttcaccaatgctttgagccaccccaaagt

SEQ ID NO: 276076 - DNA, 75 bp, Artificial Sequence
  Synthetic
tgacctcatggtggagaaactccatctatcctcacatagagggatcatcaaagacaacgaggccaattgggtagt

SEQ ID NO: 276077 - DNA, 75 bp, Artificial Sequence
  Synthetic
atcattgagccgactcatggcccgtccctagatacacagaacttacatgtcactgtctgtgacatgatatatgga

SEQ ID NO: 276078 - DNA, 75 bp, Artificial Sequence
  Synthetic
aagacaacgaggccaattgggtagtaccgtctaccgatgttcgtgatctccaaaacaagggagaatgtctggtgg

SEQ ID NO: 276079 - DNA, 75 bp, Artificial Sequence
  Synthetic
gcctcttgtggttgtgatactcaacctagttgggcctactctagggggcgaactatacagtgtcttgcctacctc

SEQ ID NO: 276080 - DNA, 75 bp, Artificial Sequence
  Synthetic
ccctagatacacagaacttacatgtcactgtctgtgacatgatatatggatcctacgtcacttacctggatcttt

SEQ ID NO: 276081 - DNA, 75 bp, Artificial Sequence
  Synthetic
cacgtatttgctctgtgaaagtgatgaggacgtggtcacagacaggttcgataacattcaagccaagcatctctg

SEQ ID NO: 276082 - DNA, 75 bp, Artificial Sequence
  Synthetic
acccgttgacaaacaggcaagttctgccatagggtttgtcccgtctgaccatgaatcatccagaagtgtcatccg

SEQ ID NO: 276083 - DNA, 75 bp, Artificial Sequence
  Synthetic
gaggacgtggtcacagacaggttcgataacattcaagccaagcatctctgtgtattggccgatttatattgcacc

SEQ ID NO: 276084 - DNA, 75 bp, Artificial Sequence
  Synthetic
ctctataatcaagtcaagcaagctcaacattgatcacaaagactatcttttagatttactgaatgatgtgaaagg

SEQ ID NO: 276085 - DNA, 75 bp, Artificial Sequence
  Synthetic
ggatgtcccctatagaaaaatgtactgtcctcacacattacatcaagggagaatcaatccaatccccgtctggga

SEQ ID NO: 276086 - DNA, 75 bp, Artificial Sequence
  Synthetic
gttatcacttcagtgtttggcccactgatacctcacctatctggcatggatctttacaacaatccgttttcaaga

SEQ ID NO: 276087 - DNA, 75 bp, Artificial Sequence
  Synthetic
tagatttactgaatgatgtgaaaggctccaaggatctcaaagaattccacaagatgctaacagctattcttgcta

SEQ ID NO: 276088 - DNA, 75 bp, Artificial Sequence
  Synthetic
tgtcctcacacattacatcaagggagaatcaatccaatccccgtctgggacctcatggaacactggtcccctcgt

SEQ ID NO: 276089 - DNA, 75 bp, Artificial Sequence
  Synthetic
acgagcagtcatttctaggaatgataaatacaattggcttcccggacagagcagaggtcatgccgcacattttga

SEQ ID NO: 276090 - DNA, 75 bp, Artificial Sequence
  Synthetic
aatttctcatgctcagctgaaaacagccccacaaccaggctattacaaaaaacttaggagcaagggcaaccgagc

SEQ ID NO: 276091 - DNA, 75 bp, Artificial Sequence
  Synthetic
acctaccttcgccgaggttccattaaacaaatcaggttgagagtggatcccgggtttgtattcgaggcgttgaca

SEQ ID NO: 276092 - DNA, 75 bp, Artificial Sequence
  Synthetic
ccacagagatcaaagggcctcgaggtcgttgtcatgttcctatagagttgtcccgcaggattgatgatgatatca

SEQ ID NO: 276093 - DNA, 75 bp, Artificial Sequence
  Synthetic
gacatcgacatcaaacagccttgcaaggctaaactggatgtatctgttgtggggttgactgacttctctccccct

SEQ ID NO: 276094 - DNA, 75 bp, Artificial Sequence
  Synthetic
gccccacaaccaggctattacaaaaaacttaggagcaagggcaaccgagcttcgcagacaagatgaccgagatct

SEQ ID NO: 276095 - DNA, 75 bp, Artificial Sequence
  Synthetic
cgtcaaaggatcaatagctcccatagagcccaccacttatcacgatggtcgactgataccccaggtgagagtcat

SEQ ID NO: 276096 - DNA, 75 bp, Artificial Sequence
  Synthetic
ggggttgactgacttctctcccccttgggacaacgtcggtgactttctagggactatcaacacattgagacacaa

SEQ ID NO: 276097 - DNA, 75 bp, Artificial Sequence
  Synthetic
gactgataccccaggtgagagtcatcgatcctgggctaggagacaggaaagatgaatgcttcatgtacttgtttc

SEQ ID NO: 276098 - DNA, 75 bp, Artificial Sequence
  Synthetic
cgatcctgggctaggagacaggaaagatgaatgcttcatgtacttgtttctcctaggggtgattgaggataatga

SEQ ID NO: 276099 - DNA, 75 bp, Artificial Sequence
  Synthetic
ctatgacacgggtcgatcatcatcttacttctacccagttcgattgaatttcaagggcaatcctctctctctgag

SEQ ID NO: 276100 - DNA, 75 bp, Artificial Sequence
  Synthetic
tctgcccgtcaccggaaccggggtctcgaactatgaagtccatgcttatcgtaggattggcctgaattcatcagc

SEQ ID NO: 276101 - DNA, 75 bp, Artificial Sequence
  Synthetic
acgttaatcaagtcatcattagaagtcggagagcatggattgtttttaggggaaggttccggttctatgctggct

SEQ ID NO: 276102 - DNA, 75 bp, Artificial Sequence
  Synthetic
gggaggcccagaggagagacccccggccaactgctcctggaattcatgccagatgatgaggtctcgcgagaatct

SEQ ID NO: 276103 - DNA, 75 bp, Artificial Sequence
  Synthetic
aagaacagtcccatatatgccacaagaggaggtataacccaatttttgtgtcgggggatgcattcgaggtgctcg

SEQ ID NO: 276104 - DNA, 75 bp, Artificial Sequence
  Synthetic
tcggtaggtcaactgctaagccagaagaactattaagggaggccactgaacttgacatagtggtgagacgcacag

SEQ ID NO: 276105 - DNA, 75 bp, Artificial Sequence
  Synthetic
ggtatagaggtaacatgcaatccagtctgagtcgagctgaaaccatcgctcaagcaggcttccgagccatcccct

SEQ ID NO: 276106 - DNA, 75 bp, Artificial Sequence
  Synthetic
gacagcggaggacagagctggacagagggaaatatccccctatccttcagagatgagcctagtagagaaccagat

SEQ ID NO: 276107 - DNA, 75 bp, Artificial Sequence
  Synthetic
ggaaggttccggttctatgctggctgcatacaaggaagttctcaaattagcaaactgttattacaacagcggggt

SEQ ID NO: 276108 - DNA, 75 bp, Artificial Sequence
  Synthetic
agggaaatatccccctatccttcagagatgagcctagtagagaaccagatggggatagagaggagtgttaaggtg

SEQ ID NO: 276109 - DNA, 75 bp, Artificial Sequence
  Synthetic
cgcagcagcacaacccagccaacaatgttataaaaaacttaggagccaaggttgtaggagccatggactcactat

SEQ ID NO: 276110 - DNA, 75 bp, Artificial Sequence
  Synthetic
atcccactcgatactccccagagattcagggttgtgtacatgaccatcactagattgtctgacaatggttattat

SEQ ID NO: 276111 - DNA, 75 bp, Artificial Sequence
  Synthetic
cttgggtggggaccaccgattgctataagtatataatcagtaacattcaaacctctagtttaggtctcatacact

SEQ ID NO: 276112 - DNA, 75 bp, Artificial Sequence
  Synthetic
agtgtccccaagagaatgttagagttccgctcagccaatgccgtcgccttcaatatcctggtgacactgagaatt

SEQ ID NO: 276113 - DNA, 75 bp, Artificial Sequence
  Synthetic
acaaacaaactagttgctatccttgaatactcggggatcaaccacaactatgttcttgaagaccagactcttatc

SEQ ID NO: 276114 - DNA, 75 bp, Artificial Sequence
  Synthetic
agatgctgttgaaaaattagaagaatttgcctctattctatccttatccctaattttagggaaaatcggctctat

SEQ ID NO: 276115 - DNA, 75 bp, Artificial Sequence
  Synthetic
tgttcttgaagaccagactcttatcaaaaatattagatatagactggggtgtggtttctcaaatcaaatgatcat

SEQ ID NO: 276116 - DNA, 75 bp, Artificial Sequence
  Synthetic
tccgctcagccaatgccgtcgccttcaatatcctggtgacactgagaattgagaatgggacaaaccctagacgat

SEQ ID NO: 276117 - DNA, 75 bp, Artificial Sequence
  Synthetic
tttgcctctattctatccttatccctaattttagggaaaatcggctctattacagttatcaaaattatgcccatt

SEQ ID NO: 276118 - DNA, 75 bp, Artificial Sequence
  Synthetic
ggcaactttagaagaaagaagaatgacgtatattccgctgattactgcaaaatgaagattgagaagatgggtctg

SEQ ID NO: 276119 - DNA, 75 bp, Artificial Sequence
  Synthetic
agatttggctgcttcatgccgctcagcctagatagtgatttgaccatgtacctcaaagacaaagcactggctgca

SEQ ID NO: 276120 - DNA, 75 bp, Artificial Sequence
  Synthetic
taggatatgccattcaatattttagagagagcctgcttgcctatccgagatatagcaacttcatctccactgagt

SEQ ID NO: 276121 - DNA, 75 bp, Artificial Sequence
  Synthetic
tatagcaacttcatctccactgagtgttaccttattatgataggattgaaagccaatcggttgataaacccggag

SEQ ID NO: 276122 - DNA, 75 bp, Artificial Sequence
  Synthetic
gaacaagtcttcacattagaagtaccgggaaaatgagcaagaccctccatgcacagctggggttcaagaaaatct

SEQ ID NO: 276123 - DNA, 75 bp, Artificial Sequence
  Synthetic
agccaatcggttgataaacccggaggcaattaagcaaagcataattagagtggggactaggactgcaccaggact

SEQ ID NO: 276124 - DNA, 75 bp, Artificial Sequence
  Synthetic
tatgctaccccttaatggatattaatgaggatctcaatcgatatctttggcgggcagagtgccgaatagtcaaaa

SEQ ID NO: 276125 - DNA, 75 bp, Artificial Sequence
  Synthetic
cctgtcaggtaattgctgaaaatctgatatcaaatggtgttgggaagtatttccgagacaatgggatggcaaaag

SEQ ID NO: 276126 - DNA, 75 bp, Artificial Sequence
  Synthetic
cttcaataaacaccttaaagctctaacacctattgagagaatcctagtaaattgtggtctctcgatcaatggtac

SEQ ID NO: 276127 - DNA, 75 bp, Artificial Sequence
  Synthetic
acgagcatgacctaacaaaagcccttcacactctagcagtctcaggtgttcctaagaataacaaagataaccacc

SEQ ID NO: 276128 - DNA, 75 bp, Artificial Sequence
  Synthetic
gatgtcatcattaatgatgaccaaggcttgttcaagatcctgtaactcactcacagaacaatggacccgcctcca

SEQ ID NO: 276129 - DNA, 75 bp, Artificial Sequence
  Synthetic
cagaaaacacaccccgagccccccccaaaaaacgccgacatggtcatcctcccggtaggacaaggatgaccccct

SEQ ID NO: 276130 - DNA, 75 bp, Artificial Sequence
  Synthetic
aagccgagagatgagatcaagccaagacatcaacacacaaaatagagacaagatccaagggggccctatgtacaa

SEQ ID NO: 276131 - DNA, 75 bp, Artificial Sequence
  Synthetic
tatcacgagacctcgtagtgataattgataagaacacccagtatgtcttctacctgacgtttgagctggtcctta

SEQ ID NO: 276132 - DNA, 75 bp, Artificial Sequence
  Synthetic
gtctgatgagctccacaatcattttatatagggagttggctcatttcaaagacaatataagaagtcagcacggga

SEQ ID NO: 276133 - DNA, 75 bp, Artificial Sequence
  Synthetic
cagtagcaggcaacgtgaattaatcctccgaatagccaagaaattctgggggtatgtcttgctgtactctgatga

SEQ ID NO: 276134 - DNA, 75 bp, Artificial Sequence
  Synthetic
gaccgcgcagggcaccgaggccctactgggaggccccacggcagaccaggcaccctccttcctccgcgtcgcgcc

SEQ ID NO: 276135 - DNA, 75 bp, Artificial Sequence
  Synthetic
acttatgacggagacagccatggctatagaccagagatattcagagcttctaaaccgagtcagatacttgtggga

SEQ ID NO: 276136 - DNA, 75 bp, Artificial Sequence
  Synthetic
caaaaaacgccgacatggtcatcctcccggtaggacaaggatgaccccctcatcggacccgagtctgcggggggg

SEQ ID NO: 276137 - DNA, 75 bp, Artificial Sequence
  Synthetic
ctgggtaacaccacataccaagttgttgctctgcttgaaccactgtcgttggcttatcttcaacttcaggatgtc

SEQ ID NO: 276138 - DNA, 75 bp, Artificial Sequence
  Synthetic
gagcacccccagccaagccaacgacaggacagacacccaagtaggggtcctcgaccgaagagaataccagggtgg

SEQ ID NO: 276139 - DNA, 75 bp, Artificial Sequence
  Synthetic
aagaacttaaagaggaaccatctgacttttgacttacacagtaacccgtttattaagggcctatccaaagctgag

SEQ ID NO: 276140 - DNA, 75 bp, Artificial Sequence
  Synthetic
tggaccactgcttcaaagaactttatgagatactggagcattgtggcattgacacggaaggtacctacaattcta

SEQ ID NO: 276141 - DNA, 75 bp, Artificial Sequence
  Synthetic
tcaggagagaatggttgttcactatcgagacgaaagaagtgaaagagtggttcaaattggtgggttacagtgcac

SEQ ID NO: 276142 - DNA, 75 bp, Artificial Sequence
  Synthetic
aacttaggagcaagggcaactgagcttcgcagacaagatgaccgagatctacgacttcgacaaatcagcatggga

SEQ ID NO: 276143 - DNA, 75 bp, Artificial Sequence
  Synthetic
tgagatactggagcattgtggcattgacacggaaggtacctacaattctatcactgagggattggattacgtatt

SEQ ID NO: 276144 - DNA, 75 bp, Artificial Sequence
  Synthetic
cggaatctcccagtgcactccactcatcatcaaacaaaacttaggggccaaggtccgacgactgaccccactccg

SEQ ID NO: 276145 - DNA, 75 bp, Artificial Sequence
  Synthetic
ggggagattttttcatttttccggagtttcggacacccccgcctcgaagcggtcaccgctgcagagaatgtcaga

SEQ ID NO: 276146 - DNA, 75 bp, Artificial Sequence
  Synthetic
gcagacaagacaggcccggaaggcagacacccgaccacagagacatccaggcctcggggaggaggcctcccccct

SEQ ID NO: 276147 - DNA, 75 bp, Artificial Sequence
  Synthetic
gacacccgaccacagagacatccaggcctcggggaggaggcctcccccctcaaggcggaggagcgggagggaaac

SEQ ID NO: 276148 - DNA, 75 bp, Artificial Sequence
  Synthetic
cgagacgaaagaagtgaaagagtggttcaaattggtgggttacagtgcactcgtcagaggttgattagcgagcgc

SEQ ID NO: 276149 - DNA, 75 bp, Artificial Sequence
  Synthetic
aagacaaagcgccgacagcatcaggttcaggaggggccatccgggggattaagaatgttatcatagtcccgattc

SEQ ID NO: 276150 - DNA, 75 bp, Artificial Sequence
  Synthetic
gcaacaactatcgccaagagtatagagaggggttatgataggtacctcgcatactctttgaatatcctcaaaatt

SEQ ID NO: 276151 - DNA, 75 bp, Artificial Sequence
  Synthetic
gggacccggaggctccaacgacaaccgggcccggcacacacccggcacccccggcgagacagaggagagcccgag

SEQ ID NO: 276152 - DNA, 75 bp, Artificial Sequence
  Synthetic
gccagaacatgcttctgctgcgatccggaatgcgcaggcatccggcgaaggactgacccacgacctgtgtataga

SEQ ID NO: 276153 - DNA, 75 bp, Artificial Sequence
  Synthetic
tccaggccgtcttacagccatcagtaccccaagaattccgtgtctacgatgatgtcatcatcaacgatgatcaag

SEQ ID NO: 276154 - DNA, 75 bp, Artificial Sequence
  Synthetic
cgggcccggcacacacccggcacccccggcgagacagaggagagcccgagcccgcttggacccgacggcagaggg

SEQ ID NO: 276155 - DNA, 75 bp, Artificial Sequence
  Synthetic
gatgtcatcatcaacgatgatcaaggcttgttcaagatcttgtagttcatttgcaaaggaatgaacccaccccca

SEQ ID NO: 276156 - DNA, 75 bp, Artificial Sequence
  Synthetic
aggagatctcccgccgcacacagtcggccgacaacccacagggggaccacctcccgggaggataagcggccgtcc

SEQ ID NO: 276157 - DNA, 75 bp, Artificial Sequence
  Synthetic
ggccgacaacccacagggggaccacctcccgggaggataagcggccgtcccacaactgagccgccaccccccaga

SEQ ID NO: 276158 - DNA, 75 bp, Artificial Sequence
  Synthetic
aaaaaacacaccccaaggctccccgacacagcgccaacacagccactctcccgatgggacgaggttggcccccca

SEQ ID NO: 276159 - DNA, 75 bp, Artificial Sequence
  Synthetic
tatccccccgtcctcgaccaccgggggaggggccacaccgacaaagcccagagccaccgggagccgaccaaaggt

SEQ ID NO: 276160 - DNA, 75 bp, Artificial Sequence
  Synthetic
ggaggggccacaccgacaaagcccagagccaccgggagccgaccaaaggtcccccccggccccgcccggcacccc

SEQ ID NO: 276161 - DNA, 75 bp, Artificial Sequence
  Synthetic
ccccccctgacccgccgggcgccgaccgagcaggccggcgagaagcccccaagaggccccgacgaagaccgagca

SEQ ID NO: 276162 - DNA, 75 bp, Artificial Sequence
  Synthetic
tcgacccaacaacccccacacgcgccaagacagaaacctgccagtggacatccggcacattcatgcacaaacatc

SEQ ID NO: 276163 - DNA, 75 bp, Artificial Sequence
  Synthetic
cccctcccccccaaaccgttcccccaacacgcccgaggccaggcgccgggcacccccagacccgccaccggcggg

SEQ ID NO: 276164 - DNA, 75 bp, Artificial Sequence
  Synthetic
ttgttccgagagctgcacatgaaatcttagaccatagcataaccggagcaagagaagctatagccgggatgttgg

SEQ ID NO: 276165 - DNA, 75 bp, Artificial Sequence
  Synthetic
ccctgtttctcctcaccagcactgtcgtatcccagattcactggggcaacctatccaagatcgggattgtgggga

SEQ ID NO: 276166 - DNA, 75 bp, Artificial Sequence
  Synthetic
ctatccaagatcgggattgtggggacaggaagtgccagttataaggtgatgactaggccgagccaacagaccctg

SEQ ID NO: 276167 - DNA, 75 bp, Artificial Sequence
  Synthetic
acacccaaccaccgaaacacccagccccagggaaggagcccccccccacatggcgaaagaacgggcaagataccc

SEQ ID NO: 276168 - DNA, 75 bp, Artificial Sequence
  Synthetic
aggatgctctgtcagtgataaccaagaatgtaagaccaattcaagctctaacacccggtcgcaggactcgccgtt

SEQ ID NO: 276169 - DNA, 75 bp, Artificial Sequence
  Synthetic
cctgatcagggtgagtcatacgagactgttagtgcattcatcaccgctgaccttaagaagtattgcctaaattgg

SEQ ID NO: 276170 - DNA, 75 bp, Artificial Sequence
  Synthetic
ggcacttggggtcgcaacggctgctcagataactgccggagtcgcactccatcaatctttgatgaactcccaagc

SEQ ID NO: 276171 - DNA, 75 bp, Artificial Sequence
  Synthetic
gtgaaacgggctcaagtcactacgggtggtttttcgtccctgcagggtgccagcttgacgatgtctcaagagaga

SEQ ID NO: 276172 - DNA, 75 bp, Artificial Sequence
  Synthetic
agtcagaattgccacagtttactcatgggcctacggggatgatgagaaatcatggagtgaagcttggatgctagc

SEQ ID NO: 276173 - DNA, 75 bp, Artificial Sequence
  Synthetic
tcccgacttagatgatcatatccctctggacagtgtccctaatgcccaaatattcatcaagtacccaatgggcgg

SEQ ID NO: 276174 - DNA, 75 bp, Artificial Sequence
  Synthetic
tattcatcaagtacccaatgggcggaatagaaggttattgtcaaaaactatggacaatcagtactataccatact

SEQ ID NO: 276175 - DNA, 75 bp, Artificial Sequence
  Synthetic
gattacatcaacaacgagctaatcccttctgttcataagatgtcatgtgagttggtaggtcacaaactcagcctc

SEQ ID NO: 276176 - DNA, 75 bp, Artificial Sequence
  Synthetic
acaggacacccccgtacactcaaaacacccccccgccccccgccaccgggacaggggctccgccaccacagacca

SEQ ID NO: 276177 - DNA, 75 bp, Artificial Sequence
  Synthetic
aagggacagaaagcaaacacgcccaggaaggcccagaggagagacctccggccaactgctcctggacatcatgcc

SEQ ID NO: 276178 - DNA, 75 bp, Artificial Sequence
  Synthetic
tcttgtctgtattcgggcccagccttcgagacccgatagctgctgaaatatcaatccaggcactcagttatgcac

SEQ ID NO: 276179 - DNA, 75 bp, Artificial Sequence
  Synthetic
aggggataaaggcccgagtcacctatgtggatacaagagattactttataattcttagcatagcctacccgacct

SEQ ID NO: 276180 - DNA, 75 bp, Artificial Sequence
  Synthetic
tgtggatacaagagattactttataattcttagcatagcctacccgaccttatctgagatcaaaggggtgatagt

SEQ ID NO: 276181 - DNA, 75 bp, Artificial Sequence
  Synthetic
ttgtgtactctaaagggatctattatgacggcctgttagtttcacaatcactaaagagcatcgccagatgtgtct

SEQ ID NO: 276182 - DNA, 75 bp, Artificial Sequence
  Synthetic
tcataaaatggaagctgtgtcatacaacatcggggcacaagaatggtacactactatccctaaatatgtagccac

SEQ ID NO: 276183 - DNA, 75 bp, Artificial Sequence
  Synthetic
ctactatccctaaatatgtagccactcagggatacttgatatcaaattttgacgagacgtcatgcgtgttcactc

SEQ ID NO: 276184 - DNA, 75 bp, Artificial Sequence
  Synthetic
tcagggatacttgatatcaaattttgacgagacgtcatgcgtgttcactccaggagggacagtctgcagtcagaa

SEQ ID NO: 276185 - DNA, 75 bp, Artificial Sequence
  Synthetic
agaggggttatgataggtacctcgcatactctttgaatatcctcaaaattttccaacagatccttgtatcccttg

SEQ ID NO: 276186 - DNA, 75 bp, Artificial Sequence
  Synthetic
atactctttgaatatcctcaaaattttccaacagatccttgtatcccttgacttcacgattaatacaacaatgac

SEQ ID NO: 276187 - DNA, 75 bp, Artificial Sequence
  Synthetic
tcaagatgtcgtggcaccgatcatcgagaacggtgatttactgataaggatggcactcttgccagcacccattgg

SEQ ID NO: 276188 - DNA, 75 bp, Artificial Sequence
  Synthetic
aatggtatcgctgggtccacagatgtcgaaaaactagaaggtgctgatattcaagaagttcttaactcccagaaa

SEQ ID NO: 276189 - DNA, 75 bp, Artificial Sequence
  Synthetic
gagaacggtgatttactgataaggatggcactcttgccagcacccattgggggtctcaattatctcaacatgagc

SEQ ID NO: 276190 - DNA, 75 bp, Artificial Sequence
  Synthetic
ctgttatagcctctgataaatgtcctgtagttgaagtggatggagtgacgatacaggtcggcagtagggagtacc

SEQ ID NO: 276191 - DNA, 75 bp, Artificial Sequence
  Synthetic
cagattctgtgtacctacataaaatagacttgggcccagccatctctctagaaaaactggatgtaggcaccaatt

SEQ ID NO: 276192 - DNA, 75 bp, Artificial Sequence
  Synthetic
gcgtacagagtataactcgccttctcaagaacatcactgcacggtatattttaatcagcagcccaaatccgatgc

SEQ ID NO: 276193 - DNA, 75 bp, Artificial Sequence
  Synthetic
gcaaaatgcgtctgtggggagtgtcctcaagtctgcgaggagtgcaaagacgatccaggggtcgacacaagaatc

SEQ ID NO: 276194 - DNA, 75 bp, Artificial Sequence
  Synthetic
agacttgggcccagccatctctctagaaaaactggatgtaggcaccaatttaggcaatgcagttactaggctgga

SEQ ID NO: 276195 - DNA, 75 bp, Artificial Sequence
  Synthetic
cgatccaggggtcgacacaagaatctggtaccatagcatcactgactcagcctaaagagaatgactccgagtatg

SEQ ID NO: 276196 - DNA, 75 bp, Artificial Sequence
  Synthetic
agggggtacccttcagcggcaatttgtacataggactggcagcttgcatcggggtatctctagggcttgtcacat

SEQ ID NO: 276197 - DNA, 75 bp, Artificial Sequence
  Synthetic
aagatcaacccagggcttaaaccagacctgaccgggacctcaaagtcgtacgtaagatcactgtaatcagaatag

SEQ ID NO: 276198 - DNA, 75 bp, Artificial Sequence
  Synthetic
attatgattatgaacaattcagatccgggataacactattgacaaagaaagggcagtgttatctcattgacaagg

SEQ ID NO: 276199 - DNA, 75 bp, Artificial Sequence
  Synthetic
gacatgtgcaacacaagcagtcaggggactcagagggttcaacttccgatcctcaacctgatcccattccaagcc

SEQ ID NO: 276200 - DNA, 75 bp, Artificial Sequence
  Synthetic
ggactcagagggttcaacttccgatcctcaacctgatcccattccaagccccattgcacatcggttattaaataa

SEQ ID NO: 276201 - DNA, 75 bp, Artificial Sequence
  Synthetic
gttgaacccagatctaagacctataataagccgtgactctggcagagctctcgcggaggtcctcaagaaacccgc

SEQ ID NO: 276202 - DNA, 75 bp, Artificial Sequence
  Synthetic
atgtccgcacaaagagagaggatcaatgccttctacaaagacactcctcacaacaagaaccatagggtgaccctg

SEQ ID NO: 276203 - DNA, 75 bp, Artificial Sequence
  Synthetic
cagcttgacgatgtctcaagagagacttcagctcttcgtgtgccttatgtcggatcaaccactgaggaaaggaca

SEQ ID NO: 276204 - DNA, 75 bp, Artificial Sequence
  Synthetic
cttcagctcttcgtgtgccttatgtcggatcaaccactgaggaaaggacagatatgaaacttgctttcgttagat

SEQ ID NO: 276205 - DNA, 75 bp, Artificial Sequence
  Synthetic
gggttgctggccattgcagggattagacttcaccgagccaccgtcggaactgcagagatccagggccggcttaat

SEQ ID NO: 276206 - DNA, 75 bp, Artificial Sequence
  Synthetic
ggagacaagaccggcccggaaagaggacacccagccacagaaacccccaactccaggggaggagccccccctcca

SEQ ID NO: 276207 - DNA, 75 bp, Artificial Sequence
  Synthetic
tgggcctacggggatgatgagaaatcatggagtgaagcttggatgctagctaggcagagagccgatgtcacctta

SEQ ID NO: 276208 - DNA, 75 bp, Artificial Sequence
  Synthetic
ttgatcatcaaactaaggatgtcctaactcccctatttaaaatcatcggtgatgaagtcggcataaggattccac

SEQ ID NO: 276209 - DNA, 75 bp, Artificial Sequence
  Synthetic
tctctacatccaccaacctagctcatcggttaagggatcggagcactcaggttaaatattcggggacatcccttg

SEQ ID NO: 276210 - DNA, 75 bp, Artificial Sequence
  Synthetic
catctccgataagattaaattcttcaaccctgacagagaatatgatttcagggacctccggtggtgtatgaatcc

SEQ ID NO: 276211 - DNA, 75 bp, Artificial Sequence
  Synthetic
tcggttaagggatcggagcactcaggttaaatattcggggacatcccttgtgagggttgcaaggtacacaaccat

SEQ ID NO: 276212 - DNA, 75 bp, Artificial Sequence
  Synthetic
cggataagtcgattgaacatatatttgagttaccactcaacaggtcaaaagagttgcgatcgttgactcttgggc

SEQ ID NO: 276213 - DNA, 75 bp, Artificial Sequence
  Synthetic
ctcttcaggttagaggccaccacaggggtatccaacacagtgctacacctgcacgtggaaacagaatgttgtgtt

SEQ ID NO: 276214 - DNA, 75 bp, Artificial Sequence
  Synthetic
gagcaccgatctaggtatcggccattttttaagagtcttcgagattggactggtaagagatctcgggctgggtcc

SEQ ID NO: 276215 - DNA, 75 bp, Artificial Sequence
  Synthetic
cgaccccctgtctccccccgtcggaagaacctttggctctctacctctaggggttggtaggtcaactgccaagcc

SEQ ID NO: 276216 - DNA, 75 bp, Artificial Sequence
  Synthetic
gcacgtggaaacagaatgttgtgttgtacctatggttgaccacccaaggataccgagtctccgcaatatcaaagt

SEQ ID NO: 276217 - DNA, 75 bp, Artificial Sequence
  Synthetic
cttatctacgacaagtcccccatcatagaacacgatgcaactcgattatactcacaaagccacaggagacatttg

SEQ ID NO: 276218 - DNA, 75 bp, Artificial Sequence
  Synthetic
ggattattcggaagaacatataccgtctggagatcatatgccggaaatctgagtaccgcctcaggtctcggccat

SEQ ID NO: 276219 - DNA, 75 bp, Artificial Sequence
  Synthetic
tggtaagagattttgggctaagtgcccctgttttccatatgactaactatctcacagtgaacatgagtgatgact

SEQ ID NO: 276220 - DNA, 75 bp, Artificial Sequence
  Synthetic
gccagctctatcatatactggccaaatctacagcaatgtccatgattgagctgatcacaagatttgagaaagatc

SEQ ID NO: 276221 - DNA, 75 bp, Artificial Sequence
  Synthetic
ctgatcacaagatttgagaaagatcacatgaatgaaatagccgctctgattggcgatgacgacatcaacagtttc

SEQ ID NO: 276222 - DNA, 75 bp, Artificial Sequence
  Synthetic
ccctgttttccatatgactaactatctcacagtgaacatgagtgatgactaccggagctgtctattagcagtggg

SEQ ID NO: 276223 - DNA, 75 bp, Artificial Sequence
  Synthetic
acccattctgagactgtgactctgagtgagagaggagttcctaagagagagcctcttgcggttgtaatacttaat

SEQ ID NO: 276224 - DNA, 75 bp, Artificial Sequence
  Synthetic
gtgagagaggagttcctaagagagagcctcttgcggttgtaatacttaatctagccgggcctactctagggggcg

SEQ ID NO: 276225 - DNA, 75 bp, Artificial Sequence
  Synthetic
tgacctcatggtagaaaaactctatttctcatcaaatagggggattatcaaagacaacgaggccaattgggtagt

SEQ ID NO: 276226 - DNA, 75 bp, Artificial Sequence
  Synthetic
ttctcatcaaatagggggattatcaaagacaacgaggccaattgggtagtaccatctaccgatgtacgtgatctt

SEQ ID NO: 276227 - DNA, 75 bp, Artificial Sequence
  Synthetic
aggcatgcaaaactcgacctccttcattttgcaatggtacagggttaggcccatggtcagaggggagaatccctg

SEQ ID NO: 276228 - DNA, 75 bp, Artificial Sequence
  Synthetic
ccatggtcagaggggagaatccctgcctacggggtgatcagagtcagtcttgacgtagctagtgatccagatgtg

SEQ ID NO: 276229 - DNA, 75 bp, Artificial Sequence
  Synthetic
tgatacctcatctatctggcatggatctttacaacaacccattctccagagctgtgtggttggctgtaccacctt

SEQ ID NO: 276230 - DNA, 75 bp, Artificial Sequence
  Synthetic
ggatgtcccctatagaaaaatgtaccatcctcacacattacatcaagggagaatcggtacaatccccgtccggga

SEQ ID NO: 276231 - DNA, 75 bp, Artificial Sequence
  Synthetic
aaatacaattgccttcccaagtagagcagaggttatgccgcatattttgaccacagagatcagagggcttcgggg

SEQ ID NO: 276232 - DNA, 75 bp, Artificial Sequence
  Synthetic
gaatcggtacaatccccgtccgggatctcatggaacaccgatccccttgtagtagatcattactcatgctctctg

SEQ ID NO: 276233 - DNA, 75 bp, Artificial Sequence
  Synthetic
agctctcggagctattcaagaagggtaattccttgtactctaagataagtcaccaggtactggactgtcttaaga

SEQ ID NO: 276234 - DNA, 75 bp, Artificial Sequence
  Synthetic
gcagaggttatgccgcatattttgaccacagagatcagagggcttcggggtcgttgtcatgttcccatagaattg

SEQ ID NO: 276235 - DNA, 75 bp, Artificial Sequence
  Synthetic
ccggcacagcgccaacacagctactcccgcgatggaacgaggtcggcccccgaacaaatccggtccagggggggg

SEQ ID NO: 276236 - DNA, 75 bp, Artificial Sequence
  Synthetic
agattggctccaacatggttgtattaccgacgaaggacctgaggtacattacagccacttacgatgtttccagga

SEQ ID NO: 276237 - DNA, 75 bp, Artificial Sequence
  Synthetic
accgacgaaggacctgaggtacattacagccacttacgatgtttccaggagcgatcatgcaatcgtgtattatat

SEQ ID NO: 276238 - DNA, 75 bp, Artificial Sequence
  Synthetic
ccgaccgagcaggccggcgagaagcccccaagaggccccgacgaagaccgagcaccccatccccccaaaaacgtc

SEQ ID NO: 276239 - DNA, 75 bp, Artificial Sequence
  Synthetic
gggattgactgatttttctcccccttgggataacgtcggtgattttctagggactatcaacacattgaggcacaa

SEQ ID NO: 276240 - DNA, 75 bp, Artificial Sequence
  Synthetic
tacttcttccccgctcgattaaagctcaaaggtaaccctctctctatgaggatagagtgtttcccctggcatcat

SEQ ID NO: 276241 - DNA, 75 bp, Artificial Sequence
  Synthetic
tcgaactatgaagtccacgcttatcgtagaattggtctgaattcatcagcatgttataaagctgtagagatctcc

SEQ ID NO: 276242 - DNA, 75 bp, Artificial Sequence
  Synthetic
tggttacacaggatattggaaaaatccgtactctacgtcagtgacccacattgccctcccgacctagataataag

SEQ ID NO: 276243 - DNA, 75 bp, Artificial Sequence
  Synthetic
taggctccgccgaaccagcacagacccgacccaagcaaggcggacccccaacacgaaactgcccagcacacccta

SEQ ID NO: 276244 - DNA, 75 bp, Artificial Sequence
  Synthetic
acgttaataaagtcatccttagaagctggggagaatggattgttcttaggagaaggctccggctcgatgctggct

SEQ ID NO: 276245 - DNA, 75 bp, Artificial Sequence
  Synthetic
ggcatagaggtaacatgtaatccagtctgagcagagctgcgaccatcaatcaagcaagcttccgagccattccca

SEQ ID NO: 276246 - DNA, 75 bp, Artificial Sequence
  Synthetic
ccaagtccatacgagaggccctagtccgtcaggcggagggacgcagaaaggaaggagacacgaccgtcccagaag

SEQ ID NO: 276247 - DNA, 75 bp, Artificial Sequence
  Synthetic
ccgtcaggcggagggacgcagaaaggaaggagacacgaccgtcccagaaggaggacacccaaccaccgaaacgcc

SEQ ID NO: 276248 - DNA, 75 bp, Artificial Sequence
  Synthetic
ctcaacagcacaactcagccgacagtgttataaaaaacttaggagccagggctattggagccatggactccctgt

SEQ ID NO: 276249 - DNA, 75 bp, Artificial Sequence
  Synthetic
acgcagcgaaggagcgggtgggagacctcggggagggcccgaccgggacccgggggccggcggcgccggcggtga

SEQ ID NO: 276250 - DNA, 75 bp, Artificial Sequence
  Synthetic
ggggatagagagaagtgttaaagtcctgttcaatggcaaacctgaagtaacctgggtagggaccaccgattgcta

SEQ ID NO: 276251 - DNA, 75 bp, Artificial Sequence
  Synthetic
ggtccatttagacagccccattgtcacaaacaagctagttgccatccttgaatactcgggcatcgaccacaacta

SEQ ID NO: 276252 - DNA, 75 bp, Artificial Sequence
  Synthetic
caagtatataatcagtaacattcagacctctagtctgggtttcatacactcagatatcgagacactcccaaccaa

SEQ ID NO: 276253 - DNA, 75 bp, Artificial Sequence
  Synthetic
cgggggccggcggcgccggcggtgagcaggccgggcgcatacctgaccccaccggaggatccgaggagggcccga

SEQ ID NO: 276254 - DNA, 75 bp, Artificial Sequence
  Synthetic
acaaacaagctagttgccatccttgaatactcgggcatcgaccacaactatgttcttgaggaccagactcttatc

SEQ ID NO: 276255 - DNA, 75 bp, Artificial Sequence
  Synthetic
gcccaaccccaccaaaaagagaggcgaggccccccctccctccccccccgcacacaacccgcagacagaccgagg

SEQ ID NO: 276256 - DNA, 75 bp, Artificial Sequence
  Synthetic
tttgcctctattctatctctatccctaattttgggaaaaatcggctctattacagttgtcaaaattatgcccatt

SEQ ID NO: 276257 - DNA, 75 bp, Artificial Sequence
  Synthetic
caataacaggggggtaggtgaaacagtcaattccaaacttaaaagttacccccgtaattgtcatgtcatatatcc

SEQ ID NO: 276258 - DNA, 75 bp, Artificial Sequence
  Synthetic
aacccgagaggtgagatcaagccgggacaccagaacacaaaatagagacaaggtccaagggggacctatgtacaa

SEQ ID NO: 276259 - DNA, 75 bp, Artificial Sequence
  Synthetic
caccaggtactagattgtctcagaagagtcaacggcaaaatgggcctgggcacagatcttagccatggcctgaag

SEQ ID NO: 276260 - DNA, 75 bp, Artificial Sequence
  Synthetic
gacaccagaacacaaaatagagacaaggtccaagggggacctatgtacaactatttgcaatgccaaccaatcagc

SEQ ID NO: 276261 - DNA, 75 bp, Artificial Sequence
  Synthetic
caaggccccccagcccgacgtcccccgcacgcaccgaaagaaggacccgcccgagaacgtgcggcacatccatgc

SEQ ID NO: 276262 - DNA, 75 bp, Artificial Sequence
  Synthetic
gagggtatcctcgatttagggttgcacatgcatagctctcagtggtttgagaccttcctgttctggttcactatc

SEQ ID NO: 276263 - DNA, 75 bp, Artificial Sequence
  Synthetic
aagaacaatcccatatatgccacaagaggaggtataacccaacctttgtctcaggagatgcactcgaggtgcttg

SEQ ID NO: 276264 - DNA, 75 bp, Artificial Sequence
  Synthetic
tggggcaatctatccaagatcgggattgtaggaacagggagtgccagctacaaggtgatgactaggccaagccac

SEQ ID NO: 276265 - DNA, 75 bp, Artificial Sequence
  Synthetic
aaaaatctgtagggatctaatccaccatgatattgcctccggtccagacggtctgatgagctccacaattatttt

SEQ ID NO: 276266 - DNA, 75 bp, Artificial Sequence
  Synthetic
tgataaaaccactcagtgtgtctattacctgacattcgagctggtccttatgtattgcgatgtcatagagggcag

SEQ ID NO: 276267 - DNA, 75 bp, Artificial Sequence
  Synthetic
atagaccagaggtattcagaactgctaagccgggtcaaatacttatgggatcttattgatgggttcttcccaaca

SEQ ID NO: 276268 - DNA, 75 bp, Artificial Sequence
  Synthetic
ctaggtaacgccacataccaagttgttgctctgcttgaaccgttatcgttggcttaccttcaacttcaggatgtc

SEQ ID NO: 276269 - DNA, 75 bp, Artificial Sequence
  Synthetic
gtttagtgcaggagcctatcctcttctctggagctatgcgatgggtgttggagtcgagctggagaactcaatggg

SEQ ID NO: 276270 - DNA, 75 bp, Artificial Sequence
  Synthetic
cctttgacttacacagtaatccgtttattaagggcttatccaaagctgagaaactgctagtgcggacaagttcac

SEQ ID NO: 276271 - DNA, 75 bp, Artificial Sequence
  Synthetic
tggatcactgcttcaaagaactctacgagatactggaacattgtggcgttgacacggaaagcacctacgattcca

SEQ ID NO: 276272 - DNA, 75 bp, Artificial Sequence
  Synthetic
cgagatactggaacattgtggcgttgacacggaaagcacctacgattccatcatcgaaggattggattacgtatt

SEQ ID NO: 276273 - DNA, 75 bp, Artificial Sequence
  Synthetic
tttgacccggcttattttcgtctcggacaggagatggtcagaagatccgcaggaaaggtcagctctgtaatcgca

SEQ ID NO: 276274 - DNA, 75 bp, Artificial Sequence
  Synthetic
tatcacccacgatatacacttaactggggagattttctcctttttccggagtttcggacatccccgccttgaggc

SEQ ID NO: 276275 - DNA, 75 bp, Artificial Sequence
  Synthetic
ggggagattttctcctttttccggagtttcggacatccccgccttgaggcggtcactgccgcagagaatgtcagg

SEQ ID NO: 276276 - DNA, 75 bp, Artificial Sequence
  Synthetic
tcagttatgagactatgatgaaagggcacgcagtgttttgcgggatcatcataaatgggtttagggaccgccatg

SEQ ID NO: 276277 - DNA, 75 bp, Artificial Sequence
  Synthetic
ggaaaaccttgcgagtcccggaaatacccgatgtcaagcactccagaccatcagcccaatcaattaaaaagggca

SEQ ID NO: 276278 - DNA, 75 bp, Artificial Sequence
  Synthetic
gttatgcattaggcggagacattaataaaatcctggacaagcttgggtatagcggtggggatttccttgccatcc

SEQ ID NO: 276279 - DNA, 75 bp, Artificial Sequence
  Synthetic
ggaaggccaagaggaggaacccccgaccaactgctcctggaaatcatgcctgaagacgaggtcccgcgagggtct

SEQ ID NO: 276280 - DNA, 75 bp, Artificial Sequence
  Synthetic
ggttgacccatgacctgtgtatagacaactggaagtccttcgttggattcaggtttggctgttttatgccgctca

SEQ ID NO: 276281 - DNA, 75 bp, Artificial Sequence
  Synthetic
taggcagagagccaatatcaccttagatgaattgagaatgatcactccagtctctacatccaccaacctagccca

SEQ ID NO: 276282 - DNA, 75 bp, Artificial Sequence
  Synthetic
gatgaattgagaatgatcactccagtctctacatccaccaacctagcccaccggttgagggatcggagcacccag

SEQ ID NO: 276283 - DNA, 75 bp, Artificial Sequence
  Synthetic
ctgaaaaatgagtgggattcagtttatccgaaagaatacctccgctataacccacccagagggacggagtcaagg

SEQ ID NO: 276284 - DNA, 75 bp, Artificial Sequence
  Synthetic
actccagctttgatccttataacttgataatgtacgttgtgaatggctcctaccttgaagaccatgagtttaatc

SEQ ID NO: 276285 - DNA, 75 bp, Artificial Sequence
  Synthetic
accatgtcgtggagggactggcatgtctcaagtccctctttgcctctcccccggatctttcccccatccgagata

SEQ ID NO: 276286 - DNA, 75 bp, Artificial Sequence
  Synthetic
taccttgaagaccatgagtttaatctctcatacagcttgaaagagaaagagataaaagagacagggcgactgttt

SEQ ID NO: 276287 - DNA, 75 bp, Artificial Sequence
  Synthetic
gataaaagagacagggcgactgtttgcaaaaatgacttacaaaatgcgggcctgccaggtcattgcggagaatct

SEQ ID NO: 276288 - DNA, 75 bp, Artificial Sequence
  Synthetic
tgacccatcccaccgtggaaccccgaaccctgatatgtccgaggggaaccatcagaatatcaaccaatcatgccc

SEQ ID NO: 276289 - DNA, 75 bp, Artificial Sequence
  Synthetic
gatatagagagatcaattacgatgacagtgaggctggactcagaggagttcaggtctacggatcccaccctcaaa

SEQ ID NO: 276290 - DNA, 75 bp, Artificial Sequence
  Synthetic
gagagtatccggattctgtatacttacacaaaatagacttaggtccagccatctccctagaaaaactggatgtag

SEQ ID NO: 276291 - DNA, 75 bp, Artificial Sequence
  Synthetic
ggggtgggcctcctagaaggaccacaagccaaaagatgaggtcagatcggggcatcaccagtcaagatagggaca

SEQ ID NO: 276292 - DNA, 75 bp, Artificial Sequence
  Synthetic
cgggcgtgaagagattgaaggactccaggatgctgactctctcatgggtcaagcagatccaccacttgctaacac

SEQ ID NO: 276293 - DNA, 75 bp, Artificial Sequence
  Synthetic
ctatctgcgatgccaaccagtcagccctgatcagggtgagtcatacgagactgttagtgcattcatcaccgctga

SEQ ID NO: 276294 - DNA, 75 bp, Artificial Sequence
  Synthetic
ctgttagtgcattcatcaccgctgacctgaagaaatattgcctgaactggagatacgagacaatcagcatatttg

SEQ ID NO: 276295 - DNA, 75 bp, Artificial Sequence
  Synthetic
cctatctccaaaatcaacccagggctcaaacccgacctgaccgggacctcaaagtcgtacgtaagatcactgtag

SEQ ID NO: 276296 - DNA, 75 bp, Artificial Sequence
  Synthetic
ctggacagtgtccccaatgcccaaatattcatcaagtacccgatgggcgggatagaaggttattgtcaaaaatta

SEQ ID NO: 276297 - DNA, 75 bp, Artificial Sequence
  Synthetic
tcacacacatacatgcacgacacaggcagtccgaggacgcaagaaacccagcctccggtcacccacccgacccca

SEQ ID NO: 276298 - DNA, 75 bp, Artificial Sequence
  Synthetic
gatagaaggttattgtcaaaaattatggacaatcagtactataccatacttgtatctagcagcccatgagagcgg

SEQ ID NO: 276299 - DNA, 75 bp, Artificial Sequence
  Synthetic
tgtatctagcagcccatgagagcggagtaagaatcgcctctctagtgcaaggtgataatcaaacaattgcagtga

SEQ ID NO: 276300 - DNA, 75 bp, Artificial Sequence
  Synthetic
gacgtcgactttaaacaacctcgcaaagctaagttagatatatcggtcgttgggttgactgatttctctccccct

SEQ ID NO: 276301 - DNA, 75 bp, Artificial Sequence
  Synthetic
aaatgcatttgtggagagtgtccccaaatctgcgaggagtgcaaagacgatccaggagttgacacaagaatctgg

SEQ ID NO: 276302 - DNA, 75 bp, Artificial Sequence
  Synthetic
ctccacgctccaccacacattagtcatcaaacaaaacttaggacgaaaggtcaatcaccatgtccgcacaaaggg

SEQ ID NO: 276303 - DNA, 75 bp, Artificial Sequence
  Synthetic
agtaagaatcgcctctctagtgcaaggtgataatcaaacaattgcagtgacaaagagagtcccgagttcctggcc

SEQ ID NO: 276304 - DNA, 75 bp, Artificial Sequence
  Synthetic
tctagagcagctcagaattacttcgtggttttaagacagaggttgcatgatgtaggtcatcacttaaaggccaat

SEQ ID NO: 276305 - DNA, 75 bp, Artificial Sequence
  Synthetic
aaagaaaatgactccgagtatgagtatgaggatgacctatttacagaaatgcaggacattcgtgcaagcattgcc

SEQ ID NO: 276306 - DNA, 75 bp, Artificial Sequence
  Synthetic
atccctctggacagtgtccctaatgcccaaatattcatcaagtacccaatgggcggaatagaaggttattgccaa

SEQ ID NO: 276307 - DNA, 75 bp, Artificial Sequence
  Synthetic
ttgtatactcaaaagggatttattatgatggcctgttagtatcacaatcactaaagagcattgccagatgtgtct

SEQ ID NO: 276308 - DNA, 75 bp, Artificial Sequence
  Synthetic
tgatggcctgttagtatcacaatcactaaagagcattgccagatgtgtcttctggtccgagactattgtggatga

SEQ ID NO: 276309 - DNA, 75 bp, Artificial Sequence
  Synthetic
ggggagatattttcatttttccggagtttcggacacccccgcctcgaagcggtcaccgccgcagagaatgtcaga

SEQ ID NO: 276310 - DNA, 75 bp, Artificial Sequence
  Synthetic
tctggtccgagactattgtggatgaaaccagagccgcctgcagcaatattgcaacaactgtcgccaagagtatag

SEQ ID NO: 276311 - DNA, 75 bp, Artificial Sequence
  Synthetic
aaccagagccgcctgcagcaatattgcaacaactgtcgccaagagtatagagaggggttatgacaggtaccttgc

SEQ ID NO: 276312 - DNA, 75 bp, Artificial Sequence
  Synthetic
atcattggcgatgaagtcggcatcagaattccacagaaattcagtgatcttgtcaagttcatctccgataagatt

SEQ ID NO: 276313 - DNA, 75 bp, Artificial Sequence
  Synthetic
ttttagggagagcctgcttgcctatccgagatatagtaacttcatctcgactgagtgttaccttattatgatagg

SEQ ID NO: 276314 - DNA, 75 bp, Artificial Sequence
  Synthetic
ctccaacagatccttatatcccttgacttcactatcaacacaacaatgactcaagatgtcgtggcaccgatcatc

SEQ ID NO: 276315 - DNA, 75 bp, Artificial Sequence
  Synthetic
agccgtgattctggcagggctctcgcggaggtcctcaagaaacctgctgttgataggtctcccaaaaccggattc

SEQ ID NO: 276316 - DNA, 75 bp, Artificial Sequence
  Synthetic
tcaagatgtcgtggcaccgatcatcgagaacggtgacctgctaacaaggatggcacttttgccagcacccatcgg

SEQ ID NO: 276317 - DNA, 75 bp, Artificial Sequence
  Synthetic
cggaggtcctcaagaaacctgctgttgataggtctcccaaaaccggattcaaagtcaactctggttcaaagggtc

SEQ ID NO: 276318 - DNA, 75 bp, Artificial Sequence
  Synthetic
ttcaagactgctcgacaggcttgtcagactggccggagatcctgacatcaacgggtcaaagctgaccggcgtgat

SEQ ID NO: 276319 - DNA, 75 bp, Artificial Sequence
  Synthetic
ctaatgccagaggaaacattgcaccaggtgatgacccagaccccgggagaatcatcttaccttgattgggcaagt

SEQ ID NO: 276320 - DNA, 75 bp, Artificial Sequence
  Synthetic
tggacctggatctagagatgaagcacaacgtgtcctcagtgtttaccgtagttgaagagggattattcggaagaa

SEQ ID NO: 276321 - DNA, 75 bp, Artificial Sequence
  Synthetic
aacattgaacacaaagactatcttttagatttggtgaatgatgtgaaaggctccaaggatcgtaaagaattccac

SEQ ID NO: 276322 - DNA, 75 bp, Artificial Sequence
  Synthetic
tagatttggtgaatgatgtgaaaggctccaaggatcgtaaagaattccacaagatgctaacagctattcttgcca

SEQ ID NO: 276323 - DNA, 75 bp, Artificial Sequence
  Synthetic
cagagatgaggatgaagagcttgcgagtttcctgatggatcggcatataattgttcccagagctgcacatgaaat

SEQ ID NO: 276324 - DNA, 75 bp, Artificial Sequence
  Synthetic
agcggtaggggagttgaagttgacagccctatgcacctcatctgagactgtgacactgagtgagagaggagttcc

SEQ ID NO: 276325 - DNA, 75 bp, Artificial Sequence
  Synthetic
agagaagctattgccggtatgttagataccaccaagggtctgattagaacaagtatgaaacgaggtggccttacg

SEQ ID NO: 276326 - DNA, 75 bp, Artificial Sequence
  Synthetic
tcaagaggacccccggcaacaagccaaggattgcagaaatgatctgcgacattgacaactatattgtcgaagccg

SEQ ID NO: 276327 - DNA, 75 bp, Artificial Sequence
  Synthetic
acctttggttctttacctctaggggtcggtaggtcaactgctaagccagaagaactattaagggaggccactgaa

SEQ ID NO: 276328 - DNA, 75 bp, Artificial Sequence
  Synthetic
attatgattatgaacaatttagatccggtataacattgctgacaaagaagggacagtgttatctcattgacaaag

SEQ ID NO: 276329 - DNA, 75 bp, Artificial Sequence
  Synthetic
gcctacctctgatctcatggtggagaaactctatttgtcttcacatagagggatcatcaaagatgatgaggccaa

SEQ ID NO: 276330 - DNA, 75 bp, Artificial Sequence
  Synthetic
caagtttggtattgaaaccatgtatcctgcattaggccttcacgagttcgccggggaattgtccactattgaatc

SEQ ID NO: 276331 - DNA, 75 bp, Artificial Sequence
  Synthetic
ttacaacaacactccgctgtctttgttaacaccttggaggagagtcctgacaaccggaagtgtgtttagcgctaa

SEQ ID NO: 276332 - DNA, 75 bp, Artificial Sequence
  Synthetic
agccctgaggagtcatatgtgggctaggttggcccgcgggagacctatctatgggttggaagtgcctgatgtact

SEQ ID NO: 276333 - DNA, 75 bp, Artificial Sequence
  Synthetic
aggttggcccgcgggagacctatctatgggttggaagtgcctgatgtactggaatcgatgaatggctatcttatc

SEQ ID NO: 276334 - DNA, 75 bp, Artificial Sequence
  Synthetic
ccaggtttgtaacgcagtcaatctagtcccactcgatactccccagagattcagggttgtgtacatgaccatcac

SEQ ID NO: 276335 - DNA, 75 bp, Artificial Sequence
  Synthetic
aagaccccactgatgatccaaaagattatagaaaactacatattggataagtatctattcccagctttgtctggt

SEQ ID NO: 276336 - DNA, 75 bp, Artificial Sequence
  Synthetic
tttgacccggcctattttcgtctcggacaggagatggtcagaagatctgcaggaaaggtcagctctgtaattgcg

SEQ ID NO: 276337 - DNA, 75 bp, Artificial Sequence
  Synthetic
gtggttcttcgtccctgcagggtgccagcttgacgatgtctcgaaagagacttcagctcttcgtgtgccttatgt

SEQ ID NO: 276338 - DNA, 75 bp, Artificial Sequence
  Synthetic
cagcttgacgatgtctcgaaagagacttcagctcttcgtgtgccttatgttggatcaaccacagaggaaaggaca

SEQ ID NO: 276339 - DNA, 75 bp, Artificial Sequence
  Synthetic
aggaaaggtcagctctgtaattgcggctgagcttggcatcacagcagaggaagccaaactagtctcggaaatcgc

SEQ ID NO: 276340 - DNA, 75 bp, Artificial Sequence
  Synthetic
agaggtcacattcatgatacatgtgggcaactttagaagaaagaagaacgacgtatattctgctgattactgcaa

SEQ ID NO: 276341 - DNA, 75 bp, Artificial Sequence
  Synthetic
ctccgagtcgatccctcaaatcagcagtcagaattgctaccgtttattcatgggcctatggggatgatgaaaaat

SEQ ID NO: 276342 - DNA, 75 bp, Artificial Sequence
  Synthetic
ctcgcagactggggaagaacgaaccgttagagggactgggcctcgacaggcgcaggtttccttcctccagcacaa

SEQ ID NO: 276343 - DNA, 75 bp, Artificial Sequence
  Synthetic
accaaacaaagttgggtaaggatagatcttataataactatgaattgccacgcttaggattaaagatcctactgc

SEQ ID NO: 276344 - DNA, 75 bp, Artificial Sequence
  Synthetic
accccaagaattccgtgtctacgatgatgtcatcattaacgatgaccaaggcttgttcaagatcctgtaattcac

SEQ ID NO: 276345 - DNA, 75 bp, Artificial Sequence
  Synthetic
tgggcctatggggatgatgaaaaatcatggagtgaagcctggacgttggcaaggcagagagccgacatcacccta

SEQ ID NO: 276346 - DNA, 75 bp, Artificial Sequence
  Synthetic
gatgtcatcattaacgatgaccaaggcttgttcaagatcctgtaattcacttacagaacaatggacccgcctcca

SEQ ID NO: 276347 - DNA, 75 bp, Artificial Sequence
  Synthetic
tctctacgtcgaccaacctagcccatcggttgagggatcggagcacccaggtgaaatactcggggacatcccttg

SEQ ID NO: 276348 - DNA, 75 bp, Artificial Sequence
  Synthetic
cgcttaggattaaagatcctactgccggggggaggagtaggagcaagatccctgactatggcgactctcctcaag

SEQ ID NO: 276349 - DNA, 75 bp, Artificial Sequence
  Synthetic
cagaaaacacaccccgagcccccccaaaaaaacgccgacatggtcatccccccggtaggacgaggacgacccccc

SEQ ID NO: 276350 - DNA, 75 bp, Artificial Sequence
  Synthetic
aaaaaaacgccgacatggtcatccccccggtaggacgaggacgacccccccagcggacccgatctgtgggggggc

SEQ ID NO: 276351 - DNA, 75 bp, Artificial Sequence
  Synthetic
atatctgagaagaaagtagataccaacttcatttaccagcaagggatgctcctcggtcttgggatccttgagaat

SEQ ID NO: 276352 - DNA, 75 bp, Artificial Sequence
  Synthetic
accgcgcggggcaacaagaccctcctgggaggccccaaggtagaccgggcacccccccccccgcgtcggcccaca

SEQ ID NO: 276353 - DNA, 75 bp, Artificial Sequence
  Synthetic
ctctttgaggatagagtgtttcccctggcgtcgtaaggtgtggtgctaccatgattgtcttatatacaacaccat

SEQ ID NO: 276354 - DNA, 75 bp, Artificial Sequence
  Synthetic
gggtatccaacacagtgctacatctgcacgtggagacagaatgttgtgttgtacctatgattgatcacccaagaa

SEQ ID NO: 276355 - DNA, 75 bp, Artificial Sequence
  Synthetic
cacccccagccctaccaccgacaggacagacacccaagccagggtccctcgaaccaaagagaccaccagggtggg

SEQ ID NO: 276356 - DNA, 75 bp, Artificial Sequence
  Synthetic
tacgaatgagctatgtacaaaccccttgatctacgacaagtctcctatcatagaacacgatgcaactcgattata

SEQ ID NO: 276357 - DNA, 75 bp, Artificial Sequence
  Synthetic
ttgatctacgacaagtctcctatcatagaacacgatgcaactcgattatactcacaaagccacagaagacatctg

SEQ ID NO: 276358 - DNA, 75 bp, Artificial Sequence
  Synthetic
agccaacaatgttataaaaaacttaggagccagggttgtaggggccatggactctctatcagtcaatcaggtctt

SEQ ID NO: 276359 - DNA, 75 bp, Artificial Sequence
  Synthetic
gtcagctttaccatatactagctaagtctacagcaatgtccatgattgagttgattacaagattcgagaaggatc

SEQ ID NO: 276360 - DNA, 75 bp, Artificial Sequence
  Synthetic
ttgattacaagattcgagaaggatcacatgaatgaaataaccgccttgattggcgatgacgacatcaacagtttt

SEQ ID NO: 276361 - DNA, 75 bp, Artificial Sequence
  Synthetic
cagacaagacaggctcggaaggcagacaccccaccacagaaacacccaggcctcggggaggaggcccctcctcca

SEQ ID NO: 276362 - DNA, 75 bp, Artificial Sequence
  Synthetic
cctcggggaggaggcccctcctccacaaggcggaggagcgggagggaaacaccagggacaacccgaccgggagcc

SEQ ID NO: 276363 - DNA, 75 bp, Artificial Sequence
  Synthetic
ctagactgtttatagtctaccttggccagtgtgctgccatcaattgggcttttgatatacattatcatcgcccat

SEQ ID NO: 276364 - DNA, 75 bp, Artificial Sequence
  Synthetic
ccaggcagcaagccacagaaaagaaggagacaagatctgcccgggaagaggacacccaaccacagaaacccccag

SEQ ID NO: 276365 - DNA, 75 bp, Artificial Sequence
  Synthetic
gtcatcgagccgattcatggcccgtccttagacacacagaatctacatgtcactgtctgtgatatgatatatgga

SEQ ID NO: 276366 - DNA, 75 bp, Artificial Sequence
  Synthetic
catccccccgccctcgaccaccgggggagggggtacaccgataaagactagagccaccgggagccaactaagggt

SEQ ID NO: 276367 - DNA, 75 bp, Artificial Sequence
  Synthetic
ggagggggtacaccgataaagactagagccaccgggagccaactaagggtcccccccggccccgcccggcgcccc

SEQ ID NO: 276368 - DNA, 75 bp, Artificial Sequence
  Synthetic
tacgtatctgctctgcgaaagtgatgaggacgtggtcacagacaggtttgataacatccaagccaaacatctctg

SEQ ID NO: 276369 - DNA, 75 bp, Artificial Sequence
  Synthetic
cggggagaggaggaggagcaagatctttgaccatggcgactctccttaaaagcttagcattgttcaagaggaaca

SEQ ID NO: 276370 - DNA, 75 bp, Artificial Sequence
  Synthetic
ccggcccaacaacccccgcacgcgccaagacagaaagagagcagaggttatccagcacattcatgcacaaacatc

SEQ ID NO: 276371 - DNA, 75 bp, Artificial Sequence
  Synthetic
tccaaaaggtgtccctcaataatcgggatgtctcctatagaaaaatgtaccatcctcacacattacataaaaggg

SEQ ID NO: 276372 - DNA, 75 bp, Artificial Sequence
  Synthetic
caagacagaaagagagcagaggttatccagcacattcatgcacaaacatcatgacaaaggtcgcaatcttgacat

SEQ ID NO: 276373 - DNA, 75 bp, Artificial Sequence
  Synthetic
aagatgctaacagccattcttgccaagcagccgtaacacatcccataatctacatctcatactcggttgaaagca

SEQ ID NO: 276374 - DNA, 75 bp, Artificial Sequence
  Synthetic
gaatcaatacagtctccgtctggggcctcatggaacactgatcctcttgtagtagatcattactcatgctctctg

SEQ ID NO: 276375 - DNA, 75 bp, Artificial Sequence
  Synthetic
tggtccttatgtattgtgatgtcatagagggtagacttatgacggagacagccatggccatagaccagagatatt

SEQ ID NO: 276376 - DNA, 75 bp, Artificial Sequence
  Synthetic
agtagatcattactcatgctctctgacataccttcgtcgcggttccatcaaacaaatcaggttgagagtagatcc

SEQ ID NO: 276377 - DNA, 75 bp, Artificial Sequence
  Synthetic
gatcagcatgttatctttgttcgtggagtcacccgggcaattgatacagcggatcacagatgatccagatgtcag

SEQ ID NO: 276378 - DNA, 75 bp, Artificial Sequence
  Synthetic
aacaaatcaggttgagagtagatcctgggtttgtatttgaggcattgacagacatcgacgtcaaacagcctcgca

SEQ ID NO: 276379 - DNA, 75 bp, Artificial Sequence
  Synthetic
gataatgtacgtggtgaatggctcttaccttaaagaccctgagtttaatctctcatatagcttaaaggagaagga

SEQ ID NO: 276380 - DNA, 75 bp, Artificial Sequence
  Synthetic
ttaaactatgaggtccacgcttatcgtagaattggtttgaattcatcagcatgttataaagctgtagagatctcc

SEQ ID NO: 276381 - DNA, 75 bp, Artificial Sequence
  Synthetic
atacacacaacaaaggagagtgattggggaatttcgccttgacaaagggtggctggacgcagtccgcaacaggat

SEQ ID NO: 276382 - DNA, 75 bp, Artificial Sequence
  Synthetic
atgttataaagctgtagagatctccacgttaatcaagccatccttagaagtcggagagcatgggttgttcttagg

SEQ ID NO: 276383 - DNA, 75 bp, Artificial Sequence
  Synthetic
gattatatcaacaatgagcttatcccttctgttcataagatgtcatgtgagcttgtaggtcacacactcagtctc

SEQ ID NO: 276384 - DNA, 75 bp, Artificial Sequence
  Synthetic
ggaaggttccggttctatgctggctgcgtacaaggaaattcttaaattagccaactgttattacaacagcggagt

SEQ ID NO: 276385 - DNA, 75 bp, Artificial Sequence
  Synthetic
gcgtacaaggaaattcttaaattagccaactgttattacaacagcggagtaatagctgagggcagagccggacaa

SEQ ID NO: 276386 - DNA, 75 bp, Artificial Sequence
  Synthetic
tcaatccaggcactcagttatgcactaggtggagatatcaataagatcctggataagcttgggtatagcggcgag

SEQ ID NO: 276387 - DNA, 75 bp, Artificial Sequence
  Synthetic
agatgagcctagtagagaatcaaatggggttagaaaagagtgttaaagtgctgttcaacggcaaacctgaagtaa

SEQ ID NO: 276388 - DNA, 75 bp, Artificial Sequence
  Synthetic
gggataatcataaatggttttcgggaccgacatggcggcagctggccccctgttgcactgccagaacatgcctct

SEQ ID NO: 276389 - DNA, 75 bp, Artificial Sequence
  Synthetic
ggggttagaaaagagtgttaaagtgctgttcaacggcaaacctgaagtaacctgggtagggactaccgattgtta

SEQ ID NO: 276390 - DNA, 75 bp, Artificial Sequence
  Synthetic
tgaggatcttaaccgatatctctggcgggcagagtgccgaatagtcaaaatccaggccgtcttacagccatcagt

SEQ ID NO: 276391 - DNA, 75 bp, Artificial Sequence
  Synthetic
caggtgagggactgacccatgacctgtgtatagacaactggaaatcctttgttggattcaaatttggctgcttta

SEQ ID NO: 276392 - DNA, 75 bp, Artificial Sequence
  Synthetic
acctctagtctgggtttcatacactcggatattgagactctcccaaccaaagatgctgttgagaaattagaagaa

SEQ ID NO: 276393 - DNA, 75 bp, Artificial Sequence
  Synthetic
accccaagaattccgtgtctatgatgatgtcatcatcaacgatgaccaaggcctgttcaagatcctgtaagtcac

SEQ ID NO: 276394 - DNA, 75 bp, Artificial Sequence
  Synthetic
gacaggagatggtcagaagatctgcaggaaaggtcagctccgtaatcgcggctgagcttggcatcacagcagagg

SEQ ID NO: 276395 - DNA, 75 bp, Artificial Sequence
  Synthetic
cggatattgagactctcccaaccaaagatgctgttgagaaattagaagaatttgcctctatcctttccttatccc

SEQ ID NO: 276396 - DNA, 75 bp, Artificial Sequence
  Synthetic
cctgtcaggtaattgcggagaatctgatatcaaatggagtcgggaagtatttccgagacaatggaatggcgaaag

SEQ ID NO: 276397 - DNA, 75 bp, Artificial Sequence
  Synthetic
tacagttatcaaagttatgcctattagcggagattttactcagggcttcataagctatgccatccagtattttag

SEQ ID NO: 276398 - DNA, 75 bp, Artificial Sequence
  Synthetic
cttcaggaatgtttcagggggtctacaaaatcgtgcgctagaaccctagtttcagggaccataagtaatcgattt

SEQ ID NO: 276399 - DNA, 75 bp, Artificial Sequence
  Synthetic
taagctatgccatccagtattttagggagagcctgcttgtctatccgagatatagtaatttcatttcaactgagt

SEQ ID NO: 276400 - DNA, 75 bp, Artificial Sequence
  Synthetic
caacaaacccgctccggaggggggccccccccgcgacccgccgggcgccaaccgcgcgagccggcgagacacccc

SEQ ID NO: 276401 - DNA, 75 bp, Artificial Sequence
  Synthetic
cccccccgcgacccgccgggcgccaaccgcgcgagccggcgagacacccccaagaggcctcgacggagaccgggc

SEQ ID NO: 276402 - DNA, 75 bp, Artificial Sequence
  Synthetic
ctgcgattccaaatgggtctgaaggaagggacataaagcgaacacgctcagggaagcccagaggagaaactcccg

SEQ ID NO: 276403 - DNA, 75 bp, Artificial Sequence
  Synthetic
caacacacccaaggccatgcgctgagcacccccagccctccaatcggcaggacaagaggccaggacggggtcccc

SEQ ID NO: 276404 - DNA, 75 bp, Artificial Sequence
  Synthetic
gttagagggactgggcctcgtcaggcgcaggtttccttcctccagcataaaatggatgagggagagtcgcctaca

SEQ ID NO: 276405 - DNA, 75 bp, Artificial Sequence
  Synthetic
agtgagccatatattatcagagaaacaaaaagggtgtatccaatcttatctgggtgatccttacatccaaggaga

SEQ ID NO: 276406 - DNA, 75 bp, Artificial Sequence
  Synthetic
tcagatcagatattgaagactgttaagggggtacccttcagcggcaatttgtacataggactggcagcttgcatt

SEQ ID NO: 276407 - DNA, 75 bp, Artificial Sequence
  Synthetic
caaaaagggtgtatccaatcttatctgggtgatccttacatccaaggagacttcaataaacaccttaaatctcta

SEQ ID NO: 276408 - DNA, 75 bp, Artificial Sequence
  Synthetic
gaccaggaggagggagaagacaacagtcagatccacaacgacaaggatctcctcagttgagcagatgcaccctcc

SEQ ID NO: 276409 - DNA, 75 bp, Artificial Sequence
  Synthetic
agaggatgaagtctcgcgagagtccagtcaaaaccctcgtgaggctcaaagatcggctgaggcactcttcaggct

SEQ ID NO: 276410 - DNA, 75 bp, Artificial Sequence
  Synthetic
attgtggtctctcggtcaatggcacaaaaatctgtagggatctaatccaccatgatatcgcctctggtccggacg

SEQ ID NO: 276411 - DNA, 75 bp, Artificial Sequence
  Synthetic
taggaacaaggagattcctacccctaaaatcaacccagggctcaaaccagacctgaccgggacctcaaagtcgta

SEQ ID NO: 276412 - DNA, 75 bp, Artificial Sequence
  Synthetic
ataaccaccgaggtgggcctcccagaaggacaacaaaccgaggggtgagatcaagccaaggcaccaaaacacaag

SEQ ID NO: 276413 - DNA, 75 bp, Artificial Sequence
  Synthetic
atacagggagctggctcatttcaaagacaacgtaagaagtcagcacgggatgttccacccctacccagtactggc

SEQ ID NO: 276414 - DNA, 75 bp, Artificial Sequence
  Synthetic
accatgtcaacaagggactggaatgtatcaagtctctcaaagcctctcccccggatctatccaccatcaaagatg

SEQ ID NO: 276415 - DNA, 75 bp, Artificial Sequence
  Synthetic
cttcgaatcgccaagaaattctggggttatgtcttgctatattctgatgatccggcactgatcaggcaaacaatc

SEQ ID NO: 276416 - DNA, 75 bp, Artificial Sequence
  Synthetic
tagccccccaggccgtgcaacaccgaaccctgatacgcccgagggagaccatcagaatatcaaccaatcatgctc

SEQ ID NO: 276417 - DNA, 75 bp, Artificial Sequence
  Synthetic
aagaatttgaaaaggaaccacttaacctttgacctacacaataacccgtttattaagggcctgtccagagctgag

SEQ ID NO: 276418 - DNA, 75 bp, Artificial Sequence
  Synthetic
actggtaatgtttctgagtctaattgggttgctggccattgcagggattagacttcaccgagccaccgtcggaac

SEQ ID NO: 276419 - DNA, 75 bp, Artificial Sequence
  Synthetic
cctttgacctacacaataacccgtttattaagggcctgtccagagctgagaaactgctagtgcgtacgagttcac

SEQ ID NO: 276420 - DNA, 75 bp, Artificial Sequence
  Synthetic
gacatgtctcctgaagataatctcggatttagagagatcacttgtactgacagtgaggccgggctcggaggagtt

SEQ ID NO: 276421 - DNA, 75 bp, Artificial Sequence
  Synthetic
cgcaactgagccgcagctcctcagaagagggcacccccgaaacctcccagaacccctccgctcacggccgcaggg

SEQ ID NO: 276422 - DNA, 75 bp, Artificial Sequence
  Synthetic
cgaaacgaaggaagtgaaagaatggtttaaactggtgggctacagtgcactcgtcagaggttaattagctataca

SEQ ID NO: 276423 - DNA, 75 bp, Artificial Sequence
  Synthetic
gatcagttttgtgaatacaaagccgcggataagtcgattgaacatatatttgagtcaccactcaacaggtcaaaa

SEQ ID NO: 276424 - DNA, 75 bp, Artificial Sequence
  Synthetic
gaaattccactggcaatctaatagattaaagaaaactacagatcagataagtatctattcccagctttgtctggt

SEQ ID NO: 276425 - DNA, 75 bp, Artificial Sequence
  Synthetic
agagtatagagaggggttatgataggtaccttgcatattctttgaatatcctcaagattttccaacagatcctta

SEQ ID NO: 276426 - DNA, 75 bp, Artificial Sequence
  Synthetic
tatccgccttgttgaggtagttcaaagtactaggtcccagtccgggttgacctttgcatcacgtggtgctgattt

SEQ ID NO: 276427 - DNA, 75 bp, Artificial Sequence
  Synthetic
tcaactgaggggccctcgagtggaagtaagaaaaggatcaactggtttgagaacagagaaataatagacatagag

SEQ ID NO: 276428 - DNA, 75 bp, Artificial Sequence
  Synthetic
aacatgagcaggttatttgtgagaaatatcggtgacccggtcacctcctctatagccgacctgaagaggatgata

SEQ ID NO: 276429 - DNA, 75 bp, Artificial Sequence
  Synthetic
gttacggcaccggatacggcagctgactcagaactgagaaggtgggttaaatacacacaacagaggagagtgatt

SEQ ID NO: 276430 - DNA, 75 bp, Artificial Sequence
  Synthetic
cagaggggacagtctgcagccagaatgcgttgtatccaatgagcccattgcttcaggaatgtttcagggggtcga

SEQ ID NO: 276431 - DNA, 75 bp, Artificial Sequence
  Synthetic
aggacccaacatctgaggttgagttgaacccagatttgagacctataatcagccgtgattctggcagggctcttg

SEQ ID NO: 276432 - DNA, 75 bp, Artificial Sequence
  Synthetic
gccgtgtggttggctgtaccaccttatgagcagtcatttctgggaatgataaatacaattgcattcccaaataga

SEQ ID NO: 276433 - DNA, 75 bp, Artificial Sequence
  Synthetic
gcaatcgggtttgttccatccgaccatgaatcatccaggagtgtcatccgctccataatcaagtcgagcaagctt

SEQ ID NO: 276434 - DNA, 75 bp, Artificial Sequence
  Synthetic
ctccataatcaagtcgagcaagcttaacattgatcacaaggactatcttctagatttactgaatgatgtgaaagg

SEQ ID NO: 276435 - DNA, 75 bp, Artificial Sequence
  Synthetic
ggggtatccctagggcttgtcacattaatatgctgctgtaaggggagatgtaggaacaaggagattcctgcctcc

SEQ ID NO: 276436 - DNA, 75 bp, Artificial Sequence
  Synthetic
ttctagagaactcaattcagaacaagtttagtgcaggagcttatcccctcctctggagctatgcgatgggtgtcg

SEQ ID NO: 276437 - DNA, 75 bp, Artificial Sequence
  Synthetic
tcatatacaacaccaccacaaacgaagaagtccatacgagagggctaaccggcatagaggtaacatgtaatccag

SEQ ID NO: 276438 - DNA, 75 bp, Artificial Sequence
  Synthetic
aacttaggagcaagggcaactgagcttcacagacaagatgaccgagatctacgatttcgataaatcagcatggga

SEQ ID NO: 276439 - DNA, 75 bp, Artificial Sequence
  Synthetic
gacaggagatggtcagaagatctgcaggaaaggtcagctctgtgattgcggctgagctcggcatcacagcagagg

SEQ ID NO: 276440 - DNA, 75 bp, Artificial Sequence
  Synthetic
tgtcaaagggtcaattgctcgcatagaacccaccacctatcacgacggccgactgataccccaggtgagggtcat

SEQ ID NO: 276441 - DNA, 75 bp, Artificial Sequence
  Synthetic
gatagggaacgcttaactattgaaagaccctacatcttacttggagtcctgctggtaatgttcctgagtctaatc

SEQ ID NO: 276442 - DNA, 75 bp, Artificial Sequence
  Synthetic
ttgacaaggactcgtgctcggtgcagctcgctatagctctgaggggccacatgtgggctaagttggctcgcggga

SEQ ID NO: 276443 - DNA, 75 bp, Artificial Sequence
  Synthetic
gccagagggactgggcctcgacaggcgcaggtctccttcctccagcacaaaacaggagagggagattcgcccaca

SEQ ID NO: 276444 - DNA, 75 bp, Artificial Sequence
  Synthetic
ttctaggagtgattgaggataacgaccccctgtctcccccagtcgggagaaccttcgggtctttacctctagggg

SEQ ID NO: 276445 - DNA, 75 bp, Artificial Sequence
  Synthetic
gatgagtgcttcatgtacctgtttcttctaggagtgattgaggataacgaccccctgtctcccccagtcgggaga

SEQ ID NO: 276446 - DNA, 75 bp, Artificial Sequence
  Synthetic
cgcaggtctccttcctccagcacaaaacaggagagggagattcgcccacaccagcgaccagagaaggggtcaaag

SEQ ID NO: 276447 - DNA, 75 bp, Artificial Sequence
  Synthetic
accttatgtcggatcaacaactgaggaaaggacagacatgaaacttgcatttgttaggtctccaagtagatccct

SEQ ID NO: 276448 - DNA, 75 bp, Artificial Sequence
  Synthetic
ggaactactaagggaggccacagaactagatatagtggtgaggcgcacggcaggactaaatgagaaactggtatt

SEQ ID NO: 276449 - DNA, 75 bp, Artificial Sequence
  Synthetic
atcagggacggctgcatatctaggaagctctctgagctattcaagaagggtaattccctgtactctaagataagt

SEQ ID NO: 276450 - DNA, 75 bp, Artificial Sequence
  Synthetic
ccggatctatccaccatcagagataccatcgagagctggagagaggggcttagcccctcgggccgtgcaacaccg

SEQ ID NO: 276451 - DNA, 75 bp, Artificial Sequence
  Synthetic
cagggaaaaggatccaactctcaagtacagcgttactatgtttatagccacgggggtgaagagattgaaggactc

SEQ ID NO: 276452 - DNA, 75 bp, Artificial Sequence
  Synthetic
tacagcgttactatgtttatagccacgggggtgaagagattgaaggactcgaggatgctgactctctcgtggttc

SEQ ID NO: 276453 - DNA, 75 bp, Artificial Sequence
  Synthetic
actggctaagtctacagcaatgtccatgattgaattgatcacgagattcgagaaagatcacatgaatgaaatagc

SEQ ID NO: 276454 - DNA, 75 bp, Artificial Sequence
  Synthetic
ggaagaggccctctcctctcccgtccaaaacacacaccccaaggctccccgaaacagcgccgacacagccactct

SEQ ID NO: 276455 - DNA, 75 bp, Artificial Sequence
  Synthetic
agaaagatcacatgaatgaaatagccgccctgattggcgatgacgacatcaacagcttcatcacagaatttttgc

SEQ ID NO: 276456 - DNA, 75 bp, Artificial Sequence
  Synthetic
gcgagcatgcaatcgtgtactatatctatgacacgggtcgctcatcatcttacttctacccagttcgattgaatt

SEQ ID NO: 276457 - DNA, 75 bp, Artificial Sequence
  Synthetic
gacgacagcgatgtggactctggcccagatgatcccggcagagatactctatatgaccggggatctgttgccggc

SEQ ID NO: 276458 - DNA, 75 bp, Artificial Sequence
  Synthetic
cctcaaagacaaagcactagctgcactgaaaaatgagtgggattcagtttatccgaaagaatacctccgctataa

SEQ ID NO: 276459 - DNA, 75 bp, Artificial Sequence
  Synthetic
cccccccacgacccgccgggcgttgaccgcgcgagccggcgagacacccccaagaggccccgacgaagaccgggc

SEQ ID NO: 276460 - DNA, 75 bp, Artificial Sequence
  Synthetic
aaggtgtggtgctaccatgattgtcttatatacaacaccatgacaaacgaagaagtccatacgagagggctgacc

SEQ ID NO: 276461 - DNA, 75 bp, Artificial Sequence
  Synthetic
cttcaatggaggagaggatggatctgacgacagcgatgtggactctggcccagatgatcccggcagagatactct

SEQ ID NO: 276462 - DNA, 75 bp, Artificial Sequence
  Synthetic
gcacccccagccccgccatcggcgggacaggaggccaagacggggtccccccaaccaaagggaccaccagggaag

SEQ ID NO: 276463 - DNA, 75 bp, Artificial Sequence
  Synthetic
tctcggatgagcaaaggagtatataagatctttactaatgctttgagccaccccaaagtttacaagaaattttgg

SEQ ID NO: 276464 - DNA, 75 bp, Artificial Sequence
  Synthetic
accgcgcgagccggcgagacacccccaagaggccccgacgaagaccgggcaaccctccccccaaaaaaagccccc

SEQ ID NO: 276465 - DNA, 75 bp, Artificial Sequence
  Synthetic
ccaaccaaagggaccaccagggaaggctctgccgacccagcacagacccggcccaaacaaggcagacccccaaga

SEQ ID NO: 276466 - DNA, 75 bp, Artificial Sequence
  Synthetic
aacggtgacagagtgtttatcgataagtggtgcaacccaagctgtgccagagtcaagatgggagtcatcagagca

SEQ ID NO: 276467 - DNA, 75 bp, Artificial Sequence
  Synthetic
gcggtttttcaaatcaaatgatcatcaataataggggggtaggtgaaacagtcaattccaaacttaaaagttacc

SEQ ID NO: 276468 - DNA, 75 bp, Artificial Sequence
  Synthetic
ttccgagacaatggaatggcgaaagatgagcatgacctaacaaaggcccttcataccttggcagtctcaggcgtt

SEQ ID NO: 276469 - DNA, 75 bp, Artificial Sequence
  Synthetic
gtcaattccaaacttaaaagttacccccgtaactgtcatatcatatacccagactgcaataaggagttgttttgt

SEQ ID NO: 276470 - DNA, 75 bp, Artificial Sequence
  Synthetic
gagagtgatgaggacgtggtcacagacaggttcgacaacattcaagccaaacatctctgtgtattggccgatgta

SEQ ID NO: 276471 - DNA, 75 bp, Artificial Sequence
  Synthetic
ggggtgggcctcctagaaggaccacaagccaaaagatgaggtcagatcgaggcatcaccagacaagatagggaca

SEQ ID NO: 276472 - DNA, 75 bp, Artificial Sequence
  Synthetic
tggatcttttgctgaatgatgagctagatgattacccgtatttgctctgcgagagtgatgaggacgtggtcacag

SEQ ID NO: 276473 - DNA, 75 bp, Artificial Sequence
  Synthetic
accggggagaacccgatcgggagccaggagccggagacgccagcggcaaacaggccgggcacacaaccgacacca

SEQ ID NO: 276474 - DNA, 75 bp, Artificial Sequence
  Synthetic
gatggtatcctcgacttggggttgcacatgcatagctctcaatggttcgagacctttctgttctggttcactatc

SEQ ID NO: 276475 - DNA, 75 bp, Artificial Sequence
  Synthetic
cctgatcagggtgagtcatacgagactgttagtgcattcatcaccgctgaccttaagaaatattgcctgaactgg

SEQ ID NO: 276476 - DNA, 75 bp, Artificial Sequence
  Synthetic
agtggtgcaacccaagctgtgccagagtcaagatgggagtcatcagagcaaaatgcgtctgtggggagtgtcctc

SEQ ID NO: 276477 - DNA, 75 bp, Artificial Sequence
  Synthetic
cccgcgtagacccgacggcagaggacccaaccccgccactaagaggggcgagaaccctcccccccgcacacaacc

SEQ ID NO: 276478 - DNA, 75 bp, Artificial Sequence
  Synthetic
tccccttgtagtagatcattactcatgctctctgatctaccttcgccgcggttccatcaaacaaatcaggttgag

SEQ ID NO: 276479 - DNA, 75 bp, Artificial Sequence
  Synthetic
atcaagaaacaaatcagcaagcagaatataagtatatccaccattgagggccatctctccagtataatgatagcc

SEQ ID NO: 276480 - DNA, 75 bp, Artificial Sequence
  Synthetic
actaccatctttctttcagtggttacacagggtattagaaaaatctgtgctgtacgtcagtgacccacattgccc

SEQ ID NO: 276481 - DNA, 75 bp, Artificial Sequence
  Synthetic
aggacccaacatccgaggttgagttgaacccagatttaagacctataataagccgtgactctggcagagctctcg

SEQ ID NO: 276482 - DNA, 75 bp, Artificial Sequence
  Synthetic
cgcagccgagccgcagctccccagaagaggacacccccgaaacctcccagaacccctccgctcccggccgccggg

SEQ ID NO: 276483 - DNA, 75 bp, Artificial Sequence
  Synthetic
atataagtatatccaccattgagggccatctctccagtataatgatagccatcccgggctttgggaaggatatca

SEQ ID NO: 276484 - DNA, 75 bp, Artificial Sequence
  Synthetic
agaggacacccccgaaacctcccagaacccctccgctcccggccgccgggacaggagctccgccgccaaagacta

SEQ ID NO: 276485 - DNA, 75 bp, Artificial Sequence
  Synthetic
cccaaccccgccactaagaggggcgagaaccctcccccccgcacacaaccggcaagcagaccgagggaggaccac

SEQ ID NO: 276486 - DNA, 75 bp, Artificial Sequence
  Synthetic
aaagccaactccagctcaaagggtcagcttcttaaggatctccagctaaaacctgtcgacaagcaagcaagctct

SEQ ID NO: 276487 - DNA, 75 bp, Artificial Sequence
  Synthetic
cccccccagtccctcccggcgttctcccgcagaggccccagcaaggtcccccggcccgacgacccctgcatgcgc

SEQ ID NO: 276488 - DNA, 75 bp, Artificial Sequence
  Synthetic
cgaaagagaaacccaccaaaggacgtccagcacatccatgtataaacatcatgacacgggtcgcaaccttggtat

SEQ ID NO: 276489 - DNA, 75 bp, Artificial Sequence
  Synthetic
atgacacgggtcgcaaccttggtatttctgtttcttttcccaaacactgtcgcgtgccagattcactggggcaat

SEQ ID NO: 276490 - DNA, 75 bp, Artificial Sequence
  Synthetic
gaatgtaagaccaattcaaactctaacacctgggcgcaggacccgccgttttgccggagctgttctggccggagt

SEQ ID NO: 276491 - DNA, 75 bp, Artificial Sequence
  Synthetic
aacatccaaacctctagtctgggtttcatacattcagatattgagacgctcccaaccaaagatgctgttgagaaa

SEQ ID NO: 276492 - DNA, 75 bp, Artificial Sequence
  Synthetic
gaggtgggccccccagaaggaacgcaagccgagagatgagatcaagccaagccgtcaacacacaaaatagagaca

SEQ ID NO: 276493 - DNA, 75 bp, Artificial Sequence
  Synthetic
cacggcggaggaacgggcgagggacaccgaggagaacccgatcgggagccaggagccggagacgccagcggtaaa

SEQ ID NO: 276494 - DNA, 75 bp, Artificial Sequence
  Synthetic
gtgtacagagtataactcgccttctcaagaacatcactgcaaggtacattttaaccagcagcccaaatccgatgc

SEQ ID NO: 276495 - DNA, 75 bp, Artificial Sequence
  Synthetic
aaatcagacttgcaaataaggagaccatactggcagtacagggcgtccaagattatatcaacaatgagcttgtcc

SEQ ID NO: 276496 - DNA, 75 bp, Artificial Sequence
  Synthetic
aagtatgaaacgaggtggccttaccccacgggtcttagctcgcctttccaattatgattatgaacaattcagatc

SEQ ID NO: 276497 - DNA, 75 bp, Artificial Sequence
  Synthetic
tcagagaaacaaaaaggttgtattcaatctttcttgggtgatccttatatccaaggagacttcaataagcacctt

SEQ ID NO: 276498 - DNA, 75 bp, Artificial Sequence
  Synthetic
ccaaggagacttcaataagcaccttaaatctctaacctctattgagaaaatcctggtaaattgtggtctctcgat

SEQ ID NO: 276499 - DNA, 75 bp, Artificial Sequence
  Synthetic
acatagtcggctcatgggagaatccagaggtcacatttatggtacacgtgggcaactttagaagaaagaagaacg

SEQ ID NO: 276500 - DNA, 75 bp, Artificial Sequence
  Synthetic
agaggtcacatttatggtacacgtgggcaactttagaagaaagaagaacgaagtatactctgctgattactgcaa

SEQ ID NO: 276501 - DNA, 75 bp, Artificial Sequence
  Synthetic
gcgagacgggctcaagtcattacgggtggttcttcgtccctgcagggtgccagcttgacgatgtctcgaaagaga

SEQ ID NO: 276502 - DNA, 75 bp, Artificial Sequence
  Synthetic
aacattggggcacaggaatggtatactactatccctaaatatgtagccactcagggatatctgatatcgaatttc

SEQ ID NO: 276503 - DNA, 75 bp, Artificial Sequence
  Synthetic
gtttttgccctgggaggaataggtggaacaagtctccatattagaagcaccgggaaaatgagcaaaaccctccat

SEQ ID NO: 276504 - DNA, 75 bp, Artificial Sequence
  Synthetic
aattattttatatagggaattggctcatttcaaagataatataaggagtcagcacggaatgttccacccctaccc

SEQ ID NO: 276505 - DNA, 75 bp, Artificial Sequence
  Synthetic
agtcagaattgctaccgtttattcatgggcctatggggatgatgaaaaatcatggagtgaagcctggatgctggc

SEQ ID NO: 276506 - DNA, 75 bp, Artificial Sequence
  Synthetic
ttctgatgacccggcactaatcagacaaacaatcaagaacttgaaacggaatcatctaacctttgacttacatag

SEQ ID NO: 276507 - DNA, 75 bp, Artificial Sequence
  Synthetic
tgagggttgcaagatacacaaccatttccaatgataatttgtcatttgtgatatctgagaagaaagtagatacca

SEQ ID NO: 276508 - DNA, 75 bp, Artificial Sequence
  Synthetic
ctgttatagcctccgataagtgtcccgtagttgaggtggatggagtgacaatacaggtcggcagtcgagagtacc

SEQ ID NO: 276509 - DNA, 75 bp, Artificial Sequence
  Synthetic
cctcggtcttgggatccttgagaatcttttcaggttggaggccaccacaggggtatccaacacagtgctacatct

SEQ ID NO: 276510 - DNA, 75 bp, Artificial Sequence
  Synthetic
tctaaccccgccacaaagagaggcgagaaccctcccccccgcacacaaccggcagacagaccgagggaggaccac

SEQ ID NO: 276511 - DNA, 75 bp, Artificial Sequence
  Synthetic
ttgcaaaggaatgaacccacccccaggaaggggccctaccctcctccgccaaaaaacacactccaaggctccccg

SEQ ID NO: 276512 - DNA, 75 bp, Artificial Sequence
  Synthetic
cgagttcactaagaagagaatggttgttcactctcgaaacgaaagaagtaaaagagtggttcaaattggtaggtt

SEQ ID NO: 276513 - DNA, 75 bp, Artificial Sequence
  Synthetic
ggaaggggccctaccctcctccgccaaaaaacacactccaaggctccccgacatagcgccaacacagccactctc

SEQ ID NO: 276514 - DNA, 75 bp, Artificial Sequence
  Synthetic
tagagatgaagacgaggagcttgcgagtttcttaatggatcggcatataattgttccgagagctgcacatgaaat

SEQ ID NO: 276515 - DNA, 75 bp, Artificial Sequence
  Synthetic
aaaaaacacactccaaggctccccgacatagcgccaacacagccactctcccgatgggacgaggctgggccccag

SEQ ID NO: 276516 - DNA, 75 bp, Artificial Sequence
  Synthetic
ccccccccgacccgctgggcgccgaccgagcaggtcggcgagaagcccacaacaggccccgacgaagaccgagca

SEQ ID NO: 276517 - DNA, 75 bp, Artificial Sequence
  Synthetic
acctgaccgggacttcaaagtcgtacgtgagatcactgtagtcagagtaacccgaatcatccagcatcacacgta

SEQ ID NO: 276518 - DNA, 75 bp, Artificial Sequence
  Synthetic
tacatgtgcgacacaagcagtcagaggacacagaagacccaacttccgatcaccgatcagacccttctctacgcc

SEQ ID NO: 276519 - DNA, 75 bp, Artificial Sequence
  Synthetic
cgggcaaataccagatgggagagcttctctactctttactctctaggatgagcaaaggagtatataagatcttta

SEQ ID NO: 276520 - DNA, 75 bp, Artificial Sequence
  Synthetic
aaaccaaaggggccaccggggaaggctccgccgaaccagcacggacccgacccaagcaagtcggacctccaacac

SEQ ID NO: 276521 - DNA, 75 bp, Artificial Sequence
  Synthetic
gaccctacatcttacttggagtcctgctggtaatgttcctgagtctaatcgggctgctggccattgcagggatca

SEQ ID NO: 276522 - DNA, 75 bp, Artificial Sequence
  Synthetic
gctggtaatgttcctgagtctaatcgggctgctggccattgcagggatcaggcttcaccgggccaccgttggaac

SEQ ID NO: 276523 - DNA, 75 bp, Artificial Sequence
  Synthetic
tgctgaatgatgagctagatgattatacgtatctgctctgcgagagtgatgaggacgtggtcacagacaggttcg

SEQ ID NO: 276524 - DNA, 75 bp, Artificial Sequence
  Synthetic
tccaaaaggtgtccctcgataatcgggatgtctcctatagaaaaatgtaccatcctcacacattacatcaaggga

SEQ ID NO: 276525 - DNA, 75 bp, Artificial Sequence
  Synthetic
caaccccgccacaaaaagaagtgaggctctcctcccccccgcacacaacccgcagacagaccaagggaggaccac

SEQ ID NO: 276526 - DNA, 75 bp, Artificial Sequence
  Synthetic
ataattgagccggttcatggcccatccctagatacacagaatttacatgtcactgtctgtgacatgatatacgga

SEQ ID NO: 276527 - DNA, 75 bp, Artificial Sequence
  Synthetic
gatcagttttgtgaatacaaagccgcggtcaaatcagttgaacatatatttgagtcatcactcaacaggtcagaa

SEQ ID NO: 276528 - DNA, 75 bp, Artificial Sequence
  Synthetic
ggggttgactgatttctctcctccttgggataacattggtgattttctaaggactatcaacaccttgagacacaa

SEQ ID NO: 276529 - DNA, 75 bp, Artificial Sequence
  Synthetic
ttacaagaaattttggcgaagtggtataattgagccggttcatggcccatccctagatacacagaatttacatgt

SEQ ID NO: 276530 - DNA, 75 bp, Artificial Sequence
  Synthetic
aagggacagaaagcaaacacgcccaggaaggcccagaggagagacccccggccaactgctcctggaaatcatgcc

SEQ ID NO: 276531 - DNA, 75 bp, Artificial Sequence
  Synthetic
gagccaccgagagccagccaggggtcccctccagtcccgctcagcacccccccgaggaggccccggcgaggcccc

SEQ ID NO: 276532 - DNA, 75 bp, Artificial Sequence
  Synthetic
ggattattcggaagaacatatactgtctggagatccgacaccgggaaaccgagcaccagtccaggtattggccat

SEQ ID NO: 276533 - DNA, 75 bp, Artificial Sequence
  Synthetic
tggtgagagatctcgagctgggtgcccctattttccatatgaccaactacctcacagtgaacatgagtgatgact

SEQ ID NO: 276534 - DNA, 75 bp, Artificial Sequence
  Synthetic
tgcgtgccagattcactggggcaatctatccaagatcgggattgtaggaacagggagtgccagctacaaggtgat

SEQ ID NO: 276535 - DNA, 75 bp, Artificial Sequence
  Synthetic
ccaccgatggcagaagaacaagcataccatgtcaacaaggggctggaatgtatcaagtccctcaaagcctctccc

SEQ ID NO: 276536 - DNA, 75 bp, Artificial Sequence
  Synthetic
aattgagagtttaaaaaccagtcttgagaagtcgaatcaggcaatagaagaaatcagacttgcaaataaggagac

SEQ ID NO: 276537 - DNA, 75 bp, Artificial Sequence
  Synthetic
gttaccttattatgataggattgaaagccaatcggttgataaacccagaagccattaagcaaagcataatcagag

SEQ ID NO: 276538 - DNA, 75 bp, Artificial Sequence
  Synthetic
ttatcctcacatagagggattatcaaagataacgaggccaattgggtagtaccgtctaccgatgttcgtgatctt

SEQ ID NO: 276539 - DNA, 75 bp, Artificial Sequence
  Synthetic
gacaacataagaagtcagcacgggatgttccacccctacccagtactggccagtagcaggcaacgtgaattaatt

SEQ ID NO: 276540 - DNA, 75 bp, Artificial Sequence
  Synthetic
gctgcatggttagctgtaccaccttatgagcagtcatttctaggaatgataaatacaattggcttcccggacaga

SEQ ID NO: 276541 - DNA, 75 bp, Artificial Sequence
  Synthetic
tgtggacacaagagattactttataattcttagcatcgcctacccaaccttatctgagatcaagggagtgatagt

SEQ ID NO: 276542 - DNA, 75 bp, Artificial Sequence
  Synthetic
tcgaaaaactagaaggtgctgatattcaagaagttctcaactcccagaaaggcagaggaggaagattccaaggcg

SEQ ID NO: 276543 - DNA, 75 bp, Artificial Sequence
  Synthetic
gaaattctactggcaatctaatagattaaagaaaactacagatcggataagtatctattccgagttttttctggt

SEQ ID NO: 276544 - DNA, 75 bp, Artificial Sequence
  Synthetic
cttcaggaatgtttcagggggtcaacaaaatcgtgcgccagaaccctagtttcagggaccataagtaatagattt

SEQ ID NO: 276545 - DNA, 75 bp, Artificial Sequence
  Synthetic
gacaggagatggtcagaagatccgcaggaaaggtcagctctgcaatcgcagctgagctcggcatcacagcagagg

SEQ ID NO: 276546 - DNA, 75 bp, Artificial Sequence
  Synthetic
gatagagtgttttccctggtatcataaggtgtggtgctaccatgattgccttatatacaacaccataacaaacga

SEQ ID NO: 276547 - DNA, 75 bp, Artificial Sequence
  Synthetic
ggtatagaggtaacatgtaatccagtctgagtagagctacaaccatcgctcaagcaggcctccgagccatcccct

SEQ ID NO: 276548 - DNA, 75 bp, Artificial Sequence
  Synthetic
ctccaaggatcttaaggaattccacaagatgctaacagcaattctcgccaagcacccgtaacacatcctccagtc

SEQ ID NO: 276549 - DNA, 75 bp, Artificial Sequence
  Synthetic
cagtcaatcaggtcttgtaccctgaggtccatctagatagccctattgtcacaaacaaactagttgccatccttg

SEQ ID NO: 276550 - DNA, 75 bp, Artificial Sequence
  Synthetic
gaaaaactggatgtaggcaccaatttaggcaatgcagtcacaagactggagaatgcaaaggagctcctagatgca

SEQ ID NO: 276551 - DNA, 75 bp, Artificial Sequence
  Synthetic
taggcaatgcagtcacaagactggagaatgcaaaggagctcctagatgcatcagaccaaatactgaagactgtta

SEQ ID NO: 276552 - DNA, 75 bp, Artificial Sequence
  Synthetic
gtacatagcactggcagcttgcattggggtatccctagggcttgtcacattaatatgctgctgtaaggggaggtg

SEQ ID NO: 276553 - DNA, 75 bp, Artificial Sequence
  Synthetic
aaaaaacacactccaaggctccccgacatagcgccaacacagccactctcccgatgggacgaggctggcgcccca

SEQ ID NO: 276554 - DNA, 75 bp, Artificial Sequence
  Synthetic
taatatgctgctgtaaggggaggtgtaagaacaaggaaatccctatctccaaaatcaacccagggctcaaacccg

SEQ ID NO: 276555 - DNA, 75 bp, Artificial Sequence
  Synthetic
taattccttgtactctaagataagtcaccaggtactggattgtcttaagagagtcaacgggaaattaggcctggg

SEQ ID NO: 276556 - DNA, 75 bp, Artificial Sequence
  Synthetic
cgaaagagggacccgcccgagaacgtcctgcacatccatgcgtaaacatcatgacacgggtcgcaatcttgacat

SEQ ID NO: 276557 - DNA, 75 bp, Artificial Sequence
  Synthetic
cgtgagatcactgtagtcagaatcacccgaatcatccggcatcacacacacacatgcacgacacaagcagtcaga

SEQ ID NO: 276558 - DNA, 75 bp, Artificial Sequence
  Synthetic
aaaatcaacccagggctcaaacccgacctgaccgggacctcaaagtcgtacgtgagatcactgtagtcagaatca

SEQ ID NO: 276559 - DNA, 75 bp, Artificial Sequence
  Synthetic
cccgaatcatccggcatcacacacacacatgcacgacacaagcagtcagaggaggcaggagacccagcctccgat

SEQ ID NO: 276560 - DNA, 75 bp, Artificial Sequence
  Synthetic
gactaggccgagccaacaaaccctggttataaagctaatgccaaatataacagccatcgacaattgtacgaaatc

SEQ ID NO: 276561 - DNA, 75 bp, Artificial Sequence
  Synthetic
aacttaggacgaaaggtcaatcaccatgtccgcacaaagggaaagaatcaatgccttctacaaagacaatcctca

SEQ ID NO: 276562 - DNA, 75 bp, Artificial Sequence
  Synthetic
ctgatcacagtgttaaaacctgtcgaggatgctctgtcagtgataaccaagaatgtaagaccaattcaagctcta

SEQ ID NO: 276563 - DNA, 75 bp, Artificial Sequence
  Synthetic
ggactgctggccattgcagggatcaggcttcaccgggccaccgttggaacttcagagatccagagtcggctgaat

SEQ ID NO: 276564 - DNA, 75 bp, Artificial Sequence
  Synthetic
aatgatgtcgctaggtccacagatgtcgaaaaactagaaggtgctgatattcaagaggttcttaactcccagaaa

SEQ ID NO: 276565 - DNA, 75 bp, Artificial Sequence
  Synthetic
acaaaacacactccaaggctccccgacacagcgccaacacagccacccccccgactggacgaggccggcccccca

SEQ ID NO: 276566 - DNA, 75 bp, Artificial Sequence
  Synthetic
ccccatccccccaaaacgtctctccaacacgctcgaggccaggcgccgggcacccccagatccgccaccggcgag

SEQ ID NO: 276567 - DNA, 75 bp, Artificial Sequence
  Synthetic
tcatcaaacaaaacttaggggccaagcccatacgacaggccccagtccgccaggcggagggacgcagaaaggaag

SEQ ID NO: 276568 - DNA, 75 bp, Artificial Sequence
  Synthetic
ctcagtgtttaccgtagttgaagagggattattcggaagaacatatacagtctggagattcgatgccagggatcc

SEQ ID NO: 276569 - DNA, 75 bp, Artificial Sequence
  Synthetic
ctgaagaatgagtgggattcagtttacccgaaagaatacctccgttataatccacctagagggacagagtcaagg

SEQ ID NO: 276570 - DNA, 75 bp, Artificial Sequence
  Synthetic
atgctttctacaaagacactcctcacaacaagaaccatagggtgaccctggataaggagcgtctgactattgaaa

SEQ ID NO: 276571 - DNA, 75 bp, Artificial Sequence
  Synthetic
gagccggcggcgccggcagcaaacaagccgggcaaacacccgaccccaccagaggagccgaggagagcccgaccc

SEQ ID NO: 276572 - DNA, 75 bp, Artificial Sequence
  Synthetic
agccgggcaaacacccgaccccaccagaggagccgaggagagcccgaccccgcacgaaccaaacggcagggagcc

SEQ ID NO: 276573 - DNA, 75 bp, Artificial Sequence
  Synthetic
agaggagccgaggagagcccgaccccgcacgaaccaaacggcagggagcccaaccccaccacaaaaagaggcgag

SEQ ID NO: 276574 - DNA, 75 bp, Artificial Sequence
  Synthetic
gataaaagagacagggcggttgtttgccaaaatgacctacaagatgcgggcctgtcaggtaattgctgaaaatct

SEQ ID NO: 276575 - DNA, 75 bp, Artificial Sequence
  Synthetic
atcggagatgtcttttagcggtaggggagttgaagttgacagccttatgcacctcatctgagactgtgacactga

SEQ ID NO: 276576 - DNA, 75 bp, Artificial Sequence
  Synthetic
ctagctgggcccactctagggggagaactatacagtgtcttgcctacctctgatctcatggtggagaaactctat

SEQ ID NO: 276577 - DNA, 75 bp, Artificial Sequence
  Synthetic
cgcagacagaccgagggaggaccaccccccaaccagacaggcggcccccccgcagccaagccgcagctcctcgga

SEQ ID NO: 276578 - DNA, 75 bp, Artificial Sequence
  Synthetic
aagatgacgaggccaattgggtagtgccgtcaaccgatgttcgtgatcttcagaacaaaggagaatgtctagtgg

SEQ ID NO: 276579 - DNA, 75 bp, Artificial Sequence
  Synthetic
caacccccctccccccgccaccgggacaggggctccgccaccacagaccaaagccacagagagccagccagaggt

SEQ ID NO: 276580 - DNA, 75 bp, Artificial Sequence
  Synthetic
aagccgagagatgagatcaagccaagccatcaacacacaaaatagagacaggatccaagggggccctatgtacaa

SEQ ID NO: 276581 - DNA, 75 bp, Artificial Sequence
  Synthetic
cccccccagtctcgcccggtgcccccccgaaaaggccccggcaaggccccccaacccgacgtcccccgcacgcac

SEQ ID NO: 276582 - DNA, 75 bp, Artificial Sequence
  Synthetic
cccgaaaaggccccggcaaggccccccaacccgacgtcccccgcacgcaccgaaagaagggcccgcccgagaacg

SEQ ID NO: 276583 - DNA, 75 bp, Artificial Sequence
  Synthetic
tctttacaataacccgttttcaagagatgtatggttggctgtaccaccttatgagcagtcatttctaggaatgat

SEQ ID NO: 276584 - DNA, 75 bp, Artificial Sequence
  Synthetic
atgacacgggtcgcaatcttgacatttctgtttcttctcccaaatgttgttgcgtgccagattcactggggcaat

SEQ ID NO: 276585 - DNA, 75 bp, Artificial Sequence
  Synthetic
ctatccaagatcgggattgtaggaacagggagtgccagctacaaggtgatgactaggccaagccaccaaactctg

SEQ ID NO: 276586 - DNA, 75 bp, Artificial Sequence
  Synthetic
tcatcaaacaaaacttaggggccaagtccatacgacaggccccagcccgccagacggagggccgcagaaaggaag

SEQ ID NO: 276587 - DNA, 75 bp, Artificial Sequence
  Synthetic
tcgttgccatgttcccatagaattgtcccgcagggttgatgacgatatcaagatcgggtccaacatggtcatatt

SEQ ID NO: 276588 - DNA, 75 bp, Artificial Sequence
  Synthetic
agaggagccgaggagagcctgaccccgcgtggaccaaacggcagggaatccaaccccgccaaaaaaagaggtgag

SEQ ID NO: 276589 - DNA, 75 bp, Artificial Sequence
  Synthetic
gccgacgatggacctgaggtatattacagccacttatgatgtttccaggagcgagcatgcaatcgtgtattatat

SEQ ID NO: 276590 - DNA, 75 bp, Artificial Sequence
  Synthetic
tacttctacccagttcgactgaatttcaaaggcaatcctctctctctgaggatagagtgtttcccttggcgtcat

SEQ ID NO: 276591 - DNA, 75 bp, Artificial Sequence
  Synthetic
ttgctggagctgttctggccggagtagcacttggagttgcgacagccgctcagataactgcaggagtcgctcttc

SEQ ID NO: 276592 - DNA, 75 bp, Artificial Sequence
  Synthetic
tggtcttaaggcaaaggttgcacgatgtaggtcatcacttaaaggctaatgagaccatagtatcttctcactttt

SEQ ID NO: 276593 - DNA, 75 bp, Artificial Sequence
  Synthetic
tattaagggcctgtccagagctgagaaattgctagtgcggacaagttcactcagaagagagtggttgttcactct

SEQ ID NO: 276594 - DNA, 75 bp, Artificial Sequence
  Synthetic
tgttcttgaagaccagacccttgtcaagaatattaggtatagactggggtgcggtttttcaaatcaaatgatcat

SEQ ID NO: 276595 - DNA, 75 bp, Artificial Sequence
  Synthetic
aagaatattaggtatagactggggtgcggtttttcaaatcaaatgatcatcaataacaggggggtgggtgaaaca

SEQ ID NO: 276596 - DNA, 75 bp, Artificial Sequence
  Synthetic
gtcaattctaaacttaaaagttacccccataatcgtcatatcatatacccggattgcaataaggagttgttttgt

SEQ ID NO: 276597 - DNA, 75 bp, Artificial Sequence
  Synthetic
cccataatcgtcatatcatatacccggattgcaataaggagttgttttgtatcaaagatagctgcatatctaaga

SEQ ID NO: 276598 - DNA, 75 bp, Artificial Sequence
  Synthetic
agtactagatctcagtccgggttgacctttgcatcacgtggtgctgatttggataatgaggcagacatgtatttt

SEQ ID NO: 276599 - DNA, 75 bp, Artificial Sequence
  Synthetic
tgtattgtgatgtcatagagggcagacttatgacggagacagccatggccatagaccagagatattcagaacttc

SEQ ID NO: 276600 - DNA, 75 bp, Artificial Sequence
  Synthetic
aacttaggacgaaaggtcaatcaccatgtccgcacaaagggaaaggatcaatgccttctacaaagacaatcctca

SEQ ID NO: 276601 - DNA, 75 bp, Artificial Sequence
  Synthetic
atagaccagagatattcagaacttctaagccgggtcagatacttgtgggatcttattgatgggttcttcccaaca

SEQ ID NO: 276602 - DNA, 75 bp, Artificial Sequence
  Synthetic
aggttagctcgcgggagacctatctatgggttggaggtgcctgatgtactggaatcgatgaacggctaccttatc

SEQ ID NO: 276603 - DNA, 75 bp, Artificial Sequence
  Synthetic
gcaaaaaaaggatcaactggtttgagaacagggaaataatagacatagaagtgcaggatgcagaagagttcaata

SEQ ID NO: 276604 - DNA, 75 bp, Artificial Sequence
  Synthetic
gtgcaggatgcagaagagttcaatatgttattagcctccatactggcacaagtttggattctcctggccaaagcg

SEQ ID NO: 276605 - DNA, 75 bp, Artificial Sequence
  Synthetic
catcacccacgatatacatctaactggggagattttttcattttttcggagtttcggacacccccgtctagaagc

SEQ ID NO: 276606 - DNA, 75 bp, Artificial Sequence
  Synthetic
attgataactatattgtcgaagccgggctcgcaagtttcatccttaccatcaagtttggtattgaaaccatgtat

SEQ ID NO: 276607 - DNA, 75 bp, Artificial Sequence
  Synthetic
aaacatatgaaccaaccgaaggtaatcagttatgagactatgatgaaagggcatgcagtattttgcgggataatc

SEQ ID NO: 276608 - DNA, 75 bp, Artificial Sequence
  Synthetic
caagtttggtattgaaaccatgtatcctgcactaggtcttcacgagtttgccggggagttgtccactatagaatc

SEQ ID NO: 276609 - DNA, 75 bp, Artificial Sequence
  Synthetic
ccggggagttgtccactatagaatccttgatgaatctgtatcaacagctaggcgaagttgcaccctacatggtta

SEQ ID NO: 276610 - DNA, 75 bp, Artificial Sequence
  Synthetic
gcacgtggaaacagaatgttgtgttgtacctatggttgatcacccaaggataccgagtctccgtaatattaaagt

SEQ ID NO: 276611 - DNA, 75 bp, Artificial Sequence
  Synthetic
tcgttgccatgttcccatagaattgtctcgcagggttgatgacgacatcaagattgggtccaacatggtcatatt

SEQ ID NO: 276612 - DNA, 75 bp, Artificial Sequence
  Synthetic
aggaaaggtcagctctgtaatcgcagctgagctcggcatcacagcagaggaggccaaactagtctcggaaatcgc

SEQ ID NO: 276613 - DNA, 75 bp, Artificial Sequence
  Synthetic
cgactggtggaggtgttcctgaatgactccagctttgatccttataacatgataatgtacgtggtgaatggctcc

SEQ ID NO: 276614 - DNA, 75 bp, Artificial Sequence
  Synthetic
actccagctttgatccttataacatgataatgtacgtggtgaatggctcctaccttaaagaccctgagtttaatc

SEQ ID NO: 276615 - DNA, 75 bp, Artificial Sequence
  Synthetic
actagagggactgggcccagacaggcgcaggtttccttcctccagcataaaacaggagagggagagtcacatgca

SEQ ID NO: 276616 - DNA, 75 bp, Artificial Sequence
  Synthetic
aacaggagagggagagtcacatgcatcggtgaccagggaagaagtcacagctgagaccccaaatgggcccgacga

SEQ ID NO: 276617 - DNA, 75 bp, Artificial Sequence
  Synthetic
tcgggggatgcattcgaggtgcttgtatcacgagacctcgttgtgataattgataagaatacccagtatgtcttc

SEQ ID NO: 276618 - DNA, 75 bp, Artificial Sequence
  Synthetic
cgggcaagtaccagatgggggaactcctctactctttactctctcggatgagcaaaggagtatataagatcttca

SEQ ID NO: 276619 - DNA, 75 bp, Artificial Sequence
  Synthetic
accaactgctcctggagatcatgcctgaagacgaggtcccgcgagggcctggacaaacccctcgtgaggctcaac

SEQ ID NO: 276620 - DNA, 75 bp, Artificial Sequence
  Synthetic
tcacaccctggcagtctcaggtgttcccaagaacaacaaagataaccaccgaggtgggcctcccagaaggaaaac

SEQ ID NO: 276621 - DNA, 75 bp, Artificial Sequence
  Synthetic
acaggccatggccaagattctagagggccaggaggagggagaagacaacagtcagatatacaacgacaaggatct

SEQ ID NO: 276622 - DNA, 75 bp, Artificial Sequence
  Synthetic
aggtccaaggggggcctatgtacaactatttgcgatgccgaccaatcagccctgatcagggtgagtcatacgaga

SEQ ID NO: 276623 - DNA, 75 bp, Artificial Sequence
  Synthetic
ggtatagaggtaacatgcaatccagtttgagcaaagctacgaccgtcactcaagcagtcccttgagtcgccaccg

SEQ ID NO: 276624 - DNA, 75 bp, Artificial Sequence
  Synthetic
atcgaaaccagtgacaagacaccgcccatcagtattataaaaaacttaggacccaggtccaagcggtcacacccc

SEQ ID NO: 276625 - DNA, 75 bp, Artificial Sequence
  Synthetic
ctgttagtgcattcatcaccgctgaccttaagaagtattgcctgaattggagatacgagacaatcagcatatttg

SEQ ID NO: 276626 - DNA, 75 bp, Artificial Sequence
  Synthetic
ccatcagtattataaaaaacttaggacccaggtccaagcggtcacaccccggcaccccagccgaccgagcggaga

SEQ ID NO: 276627 - DNA, 75 bp, Artificial Sequence
  Synthetic
actaccatccttctttcaatggttacacaggatattggaaaaatccgtactctacgtcagtgacccacattgccc

SEQ ID NO: 276628 - DNA, 75 bp, Artificial Sequence
  Synthetic
aacaaatcaggttgagagtggatcctgggtttgtattcgaggcgttgacagacatcgacttcaaacagcctcgca

SEQ ID NO: 276629 - DNA, 75 bp, Artificial Sequence
  Synthetic
cccttgaaaactggagagaggggcttgacccatcggaccgtgcaacaccgaaccctaatatgtccgaggggaacc

SEQ ID NO: 276630 - DNA, 75 bp, Artificial Sequence
  Synthetic
tgacccatcggaccgtgcaacaccgaaccctaatatgtccgaggggaaccatcagaatatcaaccaatcatgctc

SEQ ID NO: 276631 - DNA, 75 bp, Artificial Sequence
  Synthetic
ctcaacagcacagcccagccaacaatgttataaaaaacttaggagccagggttgtaagggccatggactccctat

SEQ ID NO: 276632 - DNA, 75 bp, Artificial Sequence
  Synthetic
tgggataacgtcggtgattttctagggactatcaacacattgaggcacaatctgcccgtcaccggaaccggggtc

SEQ ID NO: 276633 - DNA, 75 bp, Artificial Sequence
  Synthetic
ggactatcaacacattgaggcacaatctgcccgtcaccggaaccggggtctcgaactatgaagtccacgcttatc

SEQ ID NO: 276634 - DNA, 75 bp, Artificial Sequence
  Synthetic
gacgtgtctactgaaggtaatctcagatatagagagatcaattacgatgacagtgaggctggactcagaggagtt

SEQ ID NO: 276635 - DNA, 75 bp, Artificial Sequence
  Synthetic
agtaagaatcgcctcactagtgcagggtgacaatcagacaatcgcagtgacaaaaagagttccaagttcttggcc

SEQ ID NO: 276636 - DNA, 75 bp, Artificial Sequence
  Synthetic
tcggagaggatggattgttcttaggagaaggttccggttctatgctggctgcgtacaaggaagttcttaaattgg

SEQ ID NO: 276637 - DNA, 75 bp, Artificial Sequence
  Synthetic
tagtcttaaggcaaagattgcacgatgtaggtcatcacttaaaggctaatgaaaccatagtatcttctcactttt

SEQ ID NO: 276638 - DNA, 75 bp, Artificial Sequence
  Synthetic
gcgtacaaggaagttcttaaattggcaaactgttattacaacagcggggtaacagcggagggtagagccggacag

SEQ ID NO: 276639 - DNA, 75 bp, Artificial Sequence
  Synthetic
caaactgttattacaacagcggggtaacagcggagggtagagccggacagagggaaatctctccctatccctcag

SEQ ID NO: 276640 - DNA, 75 bp, Artificial Sequence
  Synthetic
ctaaagagcatcgccagatgtgtcttctggtccgagactatagtggatgaaaccagagcggcttgcagcaatatt

SEQ ID NO: 276641 - DNA, 75 bp, Artificial Sequence
  Synthetic
tcaagaagttcttaactctcagaagagtaaaagaggaagattccaaggcgggaaaactttgcgagtccctgaaac

SEQ ID NO: 276642 - DNA, 75 bp, Artificial Sequence
  Synthetic
agtcaagatgggagtcatcagagcgaaatgcatttgtggagagtgtccccaaatctgcgaggagtgcaaagacga

SEQ ID NO: 276643 - DNA, 75 bp, Artificial Sequence
  Synthetic
gttaccttattatgataggattaaaggccaatcggttgataaacccagaagccattaagcaaagcataatcagag

SEQ ID NO: 276644 - DNA, 75 bp, Artificial Sequence
  Synthetic
tgctgaatgatgagctagatgattacccgtatttactctgcgagagtgatgaggacgtagtcacagacaggttcg

SEQ ID NO: 276645 - DNA, 75 bp, Artificial Sequence
  Synthetic
tgtgagccacatattatcagagaaacagaaaggttgtattcaatcttttctgggtgatccttatatccaaggaga

SEQ ID NO: 276646 - DNA, 75 bp, Artificial Sequence
  Synthetic
ataaatggttttagggaccgacatggcggcagctggccccctgttgcattgccagaacatgcttctgctgcgatc

SEQ ID NO: 276647 - DNA, 75 bp, Artificial Sequence
  Synthetic
cagaaaggttgtattcaatcttttctgggtgatccttatatccaaggagacttcaataagcaccttaaagctcta

SEQ ID NO: 276648 - DNA, 75 bp, Artificial Sequence
  Synthetic
gccagaacatgcttctgctgcgatccggaatgcgcaggcatcaggtgagggactgacccatgacctgtgtataga

SEQ ID NO: 276649 - DNA, 75 bp, Artificial Sequence
  Synthetic
gcgtacagagtataactcgccttctcaaaaacatcactgcacgatatattttaatcagcagcccaaacccgatgc

SEQ ID NO: 276650 - DNA, 75 bp, Artificial Sequence
  Synthetic
attgtggtctctcgatcaatggcacaaaaatctgtagggatctaatccaccatgatatcgcctccggtccagacg

SEQ ID NO: 276651 - DNA, 75 bp, Artificial Sequence
  Synthetic
ttgatcatcaaactaaggatgtcttaacacccctgttcaaaatcattggtgatgaagtcggtatcagaattccac

SEQ ID NO: 276652 - DNA, 75 bp, Artificial Sequence
  Synthetic
gacaatataagaagtcagcacggtatgttccacccctacccagtattggccagtagcaggcaacgtgaattaatc

SEQ ID NO: 276653 - DNA, 75 bp, Artificial Sequence
  Synthetic
cttcgaatagccaagaaattctgggggtatgtcttgctatattctgatgacccggcactaatcaaacaaacgatc

SEQ ID NO: 276654 - DNA, 75 bp, Artificial Sequence
  Synthetic
tctgcccccttctcctccaccatgagactctactggcaatctaaaagattaaagaaaactacatattggataagt

SEQ ID NO: 276655 - DNA, 75 bp, Artificial Sequence
  Synthetic
cccaagaacaacaaagataaccaccgaggtgggcctcccagaaggacaacaagccgagaggtgagatcaagccaa

SEQ ID NO: 276656 - DNA, 75 bp, Artificial Sequence
  Synthetic
agaatcgatgaacggctaccttatcaaacgccacgagtcttgtgctatctgtgaaacgggctcaagtcactacgg

SEQ ID NO: 276657 - DNA, 75 bp, Artificial Sequence
  Synthetic
aagatgctaacagctattcttgccaagcaaccgtaatgcaccgcccaatcaacttcccatgctcggctgaaaaca

SEQ ID NO: 276658 - DNA, 75 bp, Artificial Sequence
  Synthetic
atggtttttcgtccctgcagggtgccagcttgacgatgtatctagagagacttcggctcttcgtgtaccttatgt

SEQ ID NO: 276659 - DNA, 75 bp, Artificial Sequence
  Synthetic
cagcttgacgatgtatctagagagacttcggctcttcgtgtaccttatgtcggatcaacaactgaggaaaggaca

SEQ ID NO: 276660 - DNA, 75 bp, Artificial Sequence
  Synthetic
cgatcccgggctaggagataggaaagatgagtgcttcatgtacctgttcctcctaggggtgattgaggataatga

SEQ ID NO: 276661 - DNA, 75 bp, Artificial Sequence
  Synthetic
tgggcctacggggatgatgagaaatcatggagtgaagcctggatgctagctaggcagagagccaatatcacctta

SEQ ID NO: 276662 - DNA, 75 bp, Artificial Sequence
  Synthetic
ccggttgagggatcggagcacccaggtgaaatactcggggacatcccttgtgagggttgcaagatacacaaccat

SEQ ID NO: 276663 - DNA, 75 bp, Artificial Sequence
  Synthetic
atatctgagaaaaaagtggataccaacttcatttatcagcaagggatgctgctcggtcttgggatccttgagaac

SEQ ID NO: 276664 - DNA, 75 bp, Artificial Sequence
  Synthetic
gctcggtcttgggatccttgagaacctctttaggctagaggccaccaccggagtatccaacacagtgctacacct

SEQ ID NO: 276665 - DNA, 75 bp, Artificial Sequence
  Synthetic
gtcccactcgatactccccagagatttagggttgtgtacatgaccatcactagattgtcggacaacggttattat

SEQ ID NO: 276666 - DNA, 75 bp, Artificial Sequence
  Synthetic
ttcgctcagccaatgccgtcgccttcaatatcttggttacactgagaattgagaatgggacaaaccctagaaggt

SEQ ID NO: 276667 - DNA, 75 bp, Artificial Sequence
  Synthetic
gtacctatggtggatcacccaaggataccgagtctccgtaatataaaagttacggatgagctatgcacaaaccct

SEQ ID NO: 276668 - DNA, 75 bp, Artificial Sequence
  Synthetic
ctcacagagccacaggagacatttggtggagtttgttacctggtcaacaagccagctttaccatatactggctaa

SEQ ID NO: 276669 - DNA, 75 bp, Artificial Sequence
  Synthetic
ccctaacaaggcagatccccaaaacgaaatcgcccagtgcactccactcatcatcaaacaaaacttaggggccaa

SEQ ID NO: 276670 - DNA, 75 bp, Artificial Sequence
  Synthetic
cgggccaggcacacacccgacacccccggcggagcagaggagagcccgaccccgcgtggccccgacggcagaaga

SEQ ID NO: 276671 - DNA, 75 bp, Artificial Sequence
  Synthetic
gatgtcatcattaacgatgaccaaggcttgtttaagatcctgtaattcactcacagagcaatggacccgcctccg

SEQ ID NO: 276672 - DNA, 75 bp, Artificial Sequence
  Synthetic
caaaaaacatactccgagcccccccaaaaaaacgccgacatggtcatccccccggtcggacgaggacgacccccc

SEQ ID NO: 276673 - DNA, 75 bp, Artificial Sequence
  Synthetic
agcaaaggagtatataagatcttcaccaatgctctgagccaccccaaagtttacaagaaattttggcgaagtggt

SEQ ID NO: 276674 - DNA, 75 bp, Artificial Sequence
  Synthetic
aaaaaaacgccgacatggtcatccccccggtcggacgaggacgacccccccagcggacccgagtctgcggggggg

SEQ ID NO: 276675 - DNA, 75 bp, Artificial Sequence
  Synthetic
cgaccgcgcggggcagcaggactcccctgggaggccccaaggtagaccgggcaccccctcccccccccgtcgccc

SEQ ID NO: 276676 - DNA, 75 bp, Artificial Sequence
  Synthetic
gagcacccccagccctgccaccgacaggacaacaaccatgccagggcccccgaccaaagagaccaccagggaggg

SEQ ID NO: 276677 - DNA, 75 bp, Artificial Sequence
  Synthetic
atctcaatatgaagcacaacgtgtcctcagtgtttaccatagttgaagagggattattcggaagaacatacaccg

SEQ ID NO: 276678 - DNA, 75 bp, Artificial Sequence
  Synthetic
gaaatcgcccagtgcactccactcatcatcaaacaaaacttaggggccaagctcagacgacagaccccaccccgc

SEQ ID NO: 276679 - DNA, 75 bp, Artificial Sequence
  Synthetic
agtagatcattactcatgctctctgacctaccttcgccgcggttccatcaaacaaatcaggttgagagtggatcc

SEQ ID NO: 276680 - DNA, 75 bp, Artificial Sequence
  Synthetic
cacacaagaccggctcggaaggcagacacccgaccacagaaacactcaagccccggggagggggcccccccccca

SEQ ID NO: 276681 - DNA, 75 bp, Artificial Sequence
  Synthetic
ccccggggagggggccccccccccaaaaagcggaggggcgggagagaaacaccgaggacaacccgaccgggagcc

SEQ ID NO: 276682 - DNA, 75 bp, Artificial Sequence
  Synthetic
tcagtgtgctgccatcaattgggcctttgatatacattatcatcggccctcgggcaagtaccagatgggggaact

SEQ ID NO: 276683 - DNA, 75 bp, Artificial Sequence
  Synthetic
aggagatcctccaccgcacacagccggcagacaaaccatagggggaccacctcccgggaggacaagcggccctcc

SEQ ID NO: 276684 - DNA, 75 bp, Artificial Sequence
  Synthetic
ggcagacaaaccatagggggaccacctcccgggaggacaagcggccctcccacaactgagccgccatcccccaga

SEQ ID NO: 276685 - DNA, 75 bp, Artificial Sequence
  Synthetic
cccgtagttgtcatgtcatatatccggattgcaataaggatctgttttgtatcagggacggctgcatatctagaa

SEQ ID NO: 276686 - DNA, 75 bp, Artificial Sequence
  Synthetic
cccgtatttgctctgcgagagtgatgaggacgtggtcacagacaggttcgacaacattcaagccaaacatctctg

SEQ ID NO: 276687 - DNA, 75 bp, Artificial Sequence
  Synthetic
ggggatagagcggagtgttaaagtgctgttcaacggtaaacctgaagtaacttgggtggggaccaccgattgcta

SEQ ID NO: 276688 - DNA, 75 bp, Artificial Sequence
  Synthetic
cacctccctgccctcgaccaccgggagagggaccacaccgacaaagactagagccaccgggagccaaccaagggt

SEQ ID NO: 276689 - DNA, 75 bp, Artificial Sequence
  Synthetic
agagggaccacaccgacaaagactagagccaccgggagccaaccaagggtccctctcggactcgcccggcgcccc

SEQ ID NO: 276690 - DNA, 75 bp, Artificial Sequence
  Synthetic
tcggcccaacaacccccgcacgcgccaaaataaaaacccaccagaggatatccagcacattcatacacaaacatc

SEQ ID NO: 276691 - DNA, 75 bp, Artificial Sequence
  Synthetic
tgattttgggaaaaatcggctctattacagttgtcaaaattatgcccattagcggggattttacccaaggcttca

SEQ ID NO: 276692 - DNA, 75 bp, Artificial Sequence
  Synthetic
tccagcacattcatacacaaacatcatgacaagagtcgcaatcttgacatctctgtttctcctcaccaacactgt

SEQ ID NO: 276693 - DNA, 75 bp, Artificial Sequence
  Synthetic
cgcatcccagattcactggggcaacctatccaagatcgggattgtgggaacaggaagtgccagttataaggtgat

SEQ ID NO: 276694 - DNA, 75 bp, Artificial Sequence
  Synthetic
attgtggtctctcgatcaatggcacaaaaatctgtagagatctaatccaccatgatatcgcctccggtccagacg

SEQ ID NO: 276695 - DNA, 75 bp, Artificial Sequence
  Synthetic
ggcacttggagtcgcaactgctgctcagataactgccggagtcgcacttcatcaatctttgatgaactcccaagc

SEQ ID NO: 276696 - DNA, 75 bp, Artificial Sequence
  Synthetic
ggtcaaaaccctcgtgaggctcaaagatcggctgaggcactcttcaggctgcaggccatggccaaaattctggag

SEQ ID NO: 276697 - DNA, 75 bp, Artificial Sequence
  Synthetic
gagaagtcaaatcaggcaatagaagaaatcagacttgcaaataaggaaaccatactggcagtacagggtgtccaa

SEQ ID NO: 276698 - DNA, 75 bp, Artificial Sequence
  Synthetic
gaccaggaggagggagaagacaacagtcagatctacaacgacaaggatctcctcagctgagcagacacaccctcc

SEQ ID NO: 276699 - DNA, 75 bp, Artificial Sequence
  Synthetic
gattatatcaacaatgagctagtcccttctgttcataaaatgtcatgtgagttggtaggtcacaaactcagcctc

SEQ ID NO: 276700 - DNA, 75 bp, Artificial Sequence
  Synthetic
ggagttgaagctgacagccctatgcaccccatctgagactgtgactctgagtgagagaggagttccaaagagaga

SEQ ID NO: 276701 - DNA, 75 bp, Artificial Sequence
  Synthetic
tattaaagggctatccaaagctgagaaactgctggtgcggacgagttcactaagaagggaatggttgttcactct

SEQ ID NO: 276702 - DNA, 75 bp, Artificial Sequence
  Synthetic
taagaagggaatggttgttcactctcgatacgaaagaagtgaaagagtggttcaaattggtgggttacagtgcac

SEQ ID NO: 276703 - DNA, 75 bp, Artificial Sequence
  Synthetic
tctgcccccttctcctccgccatgagaccccactgacgatccaaaagattaaagaaaactacatattggataagt

SEQ ID NO: 276704 - DNA, 75 bp, Artificial Sequence
  Synthetic
gagaccccactgacgatccaaaagattaaagaaaactacatattggataagtatctattcccagctttgtctggt

SEQ ID NO: 276705 - DNA, 75 bp, Artificial Sequence
  Synthetic
accaaacaaagttgggtaaggatagatcttataataactatggactggcaaacttaggagtaaagatcctactgt

SEQ ID NO: 276706 - DNA, 75 bp, Artificial Sequence
  Synthetic
cttcgatggaggagaggatggatctgacaacagcgatgtggactctggcccagatgatcccggcagagatcctct

SEQ ID NO: 276707 - DNA, 75 bp, Artificial Sequence
  Synthetic
agcttagcattgttcaaaaggaacaaagacaaagcgccgacggcatcaggttcaggaggggccatccgggggatt

SEQ ID NO: 276708 - DNA, 75 bp, Artificial Sequence
  Synthetic
actcagaactgagaaggtgggttaaatacacacaacaaaggagagtgattggggaatttcgccttgacaaagggt

SEQ ID NO: 276709 - DNA, 75 bp, Artificial Sequence
  Synthetic
ttcatggtatctctcatacttgacatcaagaggacccccggcaacaagccaaggattgcagaaatgatctgcgac

SEQ ID NO: 276710 - DNA, 75 bp, Artificial Sequence
  Synthetic
ccaattgtgcatcagtcctgtgcaaatgttacacaacggagacaattatcagccaagatcctgataaactactaa

SEQ ID NO: 276711 - DNA, 75 bp, Artificial Sequence
  Synthetic
aagctaaactagtctcggaaatcgcctcgcaggctggggacgaaagaaccgctagagggactgggcctcgacagg

SEQ ID NO: 276712 - DNA, 75 bp, Artificial Sequence
  Synthetic
cgaccggaagtgtgttcagcgccaaccaggtttgcaatgcggtcaacctagtcccacttgatactccccagagat

SEQ ID NO: 276713 - DNA, 75 bp, Artificial Sequence
  Synthetic
agaggatgaggtcacgcgagagtctggccaaaaccctcgtgaggcccagagatcggccgaggcactcttcaggct

SEQ ID NO: 276714 - DNA, 75 bp, Artificial Sequence
  Synthetic
agaggatgaggtctcgcgagagtctggccaaaaccctcgtgaggcccagagatcggccgaggcactcttcaggct

SEQ ID NO: 276715 - DNA, 75 bp, Artificial Sequence
  Synthetic
agaggatgaggtcccgcgagagtctggccaaaaccctcgtgaggcccagagatcggccgaggcactcttcaggct

SEQ ID NO: 276716 - DNA, 75 bp, Artificial Sequence
  Synthetic
agaggatgaggtcgcgcgagagtctggccaaaaccctcgtgaggcccagagatcggccgaggcactcttcaggct

SEQ ID NO: 276717 - DNA, 75 bp, Artificial Sequence
  Synthetic
ctaccagtattataaaaaacttaggacccaggtccaagcaagcacacatcgacactccaaccagtcgagcggaga

SEQ ID NO: 276718 - DNA, 75 bp, Artificial Sequence
  Synthetic
acctgacagggacctcaaagtcgtacgtgagatcactgtagtcagaataacccgaatcatccatcgtcacacaca

SEQ ID NO: 276719 - DNA, 75 bp, Artificial Sequence
  Synthetic
ggtcgtagaagattcaacttccgatcatcaacctggccttactctacgccccattgcacattggttatcaaacaa

SEQ ID NO: 276720 - DNA, 75 bp, Artificial Sequence
  Synthetic
ccatcgagagctggagagaggggcttagcccctcgggccgtgcaacaccgaaccctgatacgtccgagggagatc

SEQ ID NO: 276721 - DNA, 75 bp, Artificial Sequence
  Synthetic
cccccccgcgacccgccgggcgccgaccgcgcgagctggcgagacacccccaagaggcctcgacgaagatcgggg

SEQ ID NO: 276722 - DNA, 75 bp, Artificial Sequence
  Synthetic
aaccctgatacgtccgagggagatcatcagaatatcaaccaatcatgctcaccagcaatcggaccaaacaaagtc

SEQ ID NO: 276723 - DNA, 75 bp, Artificial Sequence
  Synthetic
caacacacccaaggccatgcgctgagcacccccagccccccaaccggcgggacaggaggccaggacggggctccc

SEQ ID NO: 276724 - DNA, 75 bp, Artificial Sequence
  Synthetic
tcaagaagttcttaactcccagaaaggcaaaggaggaagattccaaggcgggaaaaccttacgagtcccggaaat

SEQ ID NO: 276725 - DNA, 75 bp, Artificial Sequence
  Synthetic
cacaacgggggaacgggcgagagacaccgaggagagcacgatcgggagccgggagccggagacgccggcggcaag

SEQ ID NO: 276726 - DNA, 75 bp, Artificial Sequence
  Synthetic
tcaggacatccgtgcaagcattgccaagatccatgatgacaacaaaactatcctctcaaagcttgattctatact

SEQ ID NO: 276727 - DNA, 75 bp, Artificial Sequence
  Synthetic
cgggtaagtcgattgaacatatatttgagtcaccactcaacaggtcaaaaaggttgcgatcgttaactctagggc

SEQ ID NO: 276728 - DNA, 75 bp, Artificial Sequence
  Synthetic
agtaacaagggcccagttctcagagcttactctgaccctgttggatctggatctcaatatgaagcacaacgtgtc

SEQ ID NO: 276729 - DNA, 75 bp, Artificial Sequence
  Synthetic
ctcagtgtttaccataattgaagagggattattcggaagaacatacaccgtctggagatcagatgccggaaatct

SEQ ID NO: 276730 - DNA, 75 bp, Artificial Sequence
  Synthetic
cgcagccgagccgcagctcctcagaagagggcacccccgaaatctcccagaacccctccgctcacggccgccggg

SEQ ID NO: 276731 - DNA, 75 bp, Artificial Sequence
  Synthetic
aacattgatcacaaggactatcttctagatttactaaatgatgtgaaaggctccaaggatcttaaggaattccac

SEQ ID NO: 276732 - DNA, 75 bp, Artificial Sequence
  Synthetic
gagccaccgagagtcaaccaggggtcccccccagtccctcccggcgatcccccacagaggccccagcaaggtccc

SEQ ID NO: 276733 - DNA, 75 bp, Artificial Sequence
  Synthetic
tttctgagagtcttcgagatcggactggtaagagatttcgggctaagtgcccctgttttccatatgactaactat

SEQ ID NO: 276734 - DNA, 75 bp, Artificial Sequence
  Synthetic
actcgttctgagactgtgactctgagtgatagaggagttcctaagagagagcctcttgtggttgtaatacttaat

SEQ ID NO: 276735 - DNA, 75 bp, Artificial Sequence
  Synthetic
gtgatagaggagttcctaagagagagcctcttgtggttgtaatacttaatctggccgggcctactctagggggcg

SEQ ID NO: 276736 - DNA, 75 bp, Artificial Sequence
  Synthetic
tgacctcatggtagagaaactctatttgtcatcacatagagggattatcaaagacaacgaggccaattgggtagt

SEQ ID NO: 276737 - DNA, 75 bp, Artificial Sequence
  Synthetic
ccccctgtctccccccgtcggaagaacctttggctctttacctctaggggtcggtaggtcaactgctaagccaga

SEQ ID NO: 276738 - DNA, 75 bp, Artificial Sequence
  Synthetic
ttgtcatcacatagagggattatcaaagacaacgaggccaattgggtagtaccgtctaccgatgttcgtgatctt

SEQ ID NO: 276739 - DNA, 75 bp, Artificial Sequence
  Synthetic
ctagatatagtggtgaggcgcactgcaggagtaaatgagaaactggtattttacaacaacactccgctgtccttg

SEQ ID NO: 276740 - DNA, 75 bp, Artificial Sequence
  Synthetic
caaccggaagtgtgtttagcgctaaccaggtttgcaatgcagtcaacctagtcccgcttgatactccccagagat

SEQ ID NO: 276741 - DNA, 75 bp, Artificial Sequence
  Synthetic
taggcaatgcagtcacaagactggagaatgcaaaggagctcctagacgcatcagaccagatactgaagactgtca

SEQ ID NO: 276742 - DNA, 75 bp, Artificial Sequence
  Synthetic
agtgtgcccagaagaatgctggagttccgctcagccaatgcagtagccttcaacatcttggttacactaagaatt

SEQ ID NO: 276743 - DNA, 75 bp, Artificial Sequence
  Synthetic
tctttacaacaacccattctcaagggctgtgtggttggctgtaccaccttatgagcagtcatttctgggaatgat

SEQ ID NO: 276744 - DNA, 75 bp, Artificial Sequence
  Synthetic
tacatgtgcgacacaagcagtcagaggacgcagaagactcaacctccgatcaccgaccagaccccactctacgcc

SEQ ID NO: 276745 - DNA, 75 bp, Artificial Sequence
  Synthetic
gaaaatggcacaaaccctagaagatacatagtcggctcatgggagaatccagaggtcacatttatggtacacgtg

SEQ ID NO: 276746 - DNA, 75 bp, Artificial Sequence
  Synthetic
caaaaacacactccaaggctccccggcacagcgccaacacagccactcccgcgatggaacgaggtcggcccccga

SEQ ID NO: 276747 - DNA, 75 bp, Artificial Sequence
  Synthetic
gctgtgtggttggctgtaccaccttatgagcagtcatttctgggaatgataaatacaattgccttcccagataga

SEQ ID NO: 276748 - DNA, 75 bp, Artificial Sequence
  Synthetic
ccacagagatcagagggcttcggggtcgttgtcatgttcctatagaattgtcccgcaggattgatgatgatatta

SEQ ID NO: 276749 - DNA, 75 bp, Artificial Sequence
  Synthetic
accccatcccctcaaaaacgtcccccaacacgcccgaggccagccaccggacacccccagacccgccaccggcga

SEQ ID NO: 276750 - DNA, 75 bp, Artificial Sequence
  Synthetic
acagccacttatgatgtttccaggagcgatcacgccattgtgtactatatctatgacacaggtcgctcatcatct

SEQ ID NO: 276751 - DNA, 75 bp, Artificial Sequence
  Synthetic
aagagcccccgacgaagaccgagcaccccatccccccaaaacgtctccccaacacgcccgaggccaggcgccggg

SEQ ID NO: 276752 - DNA, 75 bp, Artificial Sequence
  Synthetic
tcaaaggcaaccctctctccctgagaatagagtgtttcccctggtatcataaggtgtggtgctaccatgactgcc

SEQ ID NO: 276753 - DNA, 75 bp, Artificial Sequence
  Synthetic
acagaacctcaaggggggaccccccaaaccaaagggaccaacgggggaggctccgccgaaccagcacagacccga

SEQ ID NO: 276754 - DNA, 75 bp, Artificial Sequence
  Synthetic
ccccattttccatatgaccaactacctcacagtgaacatgagtgatgactatcggaattgccttttagcggtagg

SEQ ID NO: 276755 - DNA, 75 bp, Artificial Sequence
  Synthetic
aaaccaaagggaccaacgggggaggctccgccgaaccagcacagacccgacccaagcaaggcggacccccaacac

SEQ ID NO: 276756 - DNA, 75 bp, Artificial Sequence
  Synthetic
tgttataaaaaacttaggagccagggctataggagccatggactccctgtcagtcaatcaggtcctataccctga

SEQ ID NO: 276757 - DNA, 75 bp, Artificial Sequence
  Synthetic
cggcgaaggaacgggtgagagaccccgaggagaacccgaccgggagccaggagccggcgacgccggtggcaaaca

SEQ ID NO: 276758 - DNA, 75 bp, Artificial Sequence
  Synthetic
tgcagacagaccgagggaggaccacctcccaacaagacaggcggctccctcgcagccgagccgcagctccccaga

SEQ ID NO: 276759 - DNA, 75 bp, Artificial Sequence
  Synthetic
ggattgcaataaggatctgttttgtatcaaggacggctgcatatctagaaagctctctgagctattcaagaaggg

SEQ ID NO: 276760 - DNA, 75 bp, Artificial Sequence
  Synthetic
caccccctcgccccccgccaccgggacaggggctccgccaccacagaccagagccaccgagagccagccagaggt

SEQ ID NO: 276761 - DNA, 75 bp, Artificial Sequence
  Synthetic
gagccaccgagagccagccagaggtcccctccagtcccgcccggtgcccccccgaagaggccccggcaaggcccc

SEQ ID NO: 276762 - DNA, 75 bp, Artificial Sequence
  Synthetic
ttctgtttcttttcccaaatgctgttgcgtgccagattcactggggcaatctatccaagatcgggattgtaggaa

SEQ ID NO: 276763 - DNA, 75 bp, Artificial Sequence
  Synthetic
tgacaagaatactcagtgtgtctattacctgacattcgagctggtccttatgtattgtgatgtcatagagggcag

SEQ ID NO: 276764 - DNA, 75 bp, Artificial Sequence
  Synthetic
agattgctgatcacagtgttaaagcctgtagaggatgctctgtcggtgataaccaagaatgtaagaccaattcaa

SEQ ID NO: 276765 - DNA, 75 bp, Artificial Sequence
  Synthetic
aagctccttaggtactacaccgagatcctgtccatattcgggcccagccttcgagacccgatagctgccgaaata

SEQ ID NO: 276766 - DNA, 75 bp, Artificial Sequence
  Synthetic
cacagagactgaatgaaatatatgggttgccatccttctttcaatggttacataaggtattggaaaaatccgtgc

SEQ ID NO: 276767 - DNA, 75 bp, Artificial Sequence
  Synthetic
ctactatccctaaatatgtagccactcaggggtatctgatatcgaactttgatgagacgtcatgcgtattcactc

SEQ ID NO: 276768 - DNA, 75 bp, Artificial Sequence
  Synthetic
tgacggcctgttagtttcacaatcactaaagagcatcgccagatgtgtcttctggtccgagactatcgtggatga

SEQ ID NO: 276769 - DNA, 75 bp, Artificial Sequence
  Synthetic
ttcagggaccataagtaatagatttatcctatcaaaagggaacctgattgcaaattgtgcgtcagttttgtgcaa

SEQ ID NO: 276770 - DNA, 75 bp, Artificial Sequence
  Synthetic
caaattgtgcgtcagttttgtgcaaatgttacacaacggagacagttatcagccaagatcctgacaaactactaa

SEQ ID NO: 276771 - DNA, 75 bp, Artificial Sequence
  Synthetic
gccagaacatgcctctgctgcaattcggaatgcgcaggcatccggtgaggggctgacccatgacctgtgtataga

SEQ ID NO: 276772 - DNA, 75 bp, Artificial Sequence
  Synthetic
ctgttgtagcatccgacaagtgtcctgtagttgaggtggatggagtgacaatacaggtcggcagtcgagagtatc

SEQ ID NO: 276773 - DNA, 75 bp, Artificial Sequence
  Synthetic
cggaatgcgcaggcatccggtgaggggctgacccatgacctgtgtatagacaactggaagtccttcgttggattc

SEQ ID NO: 276774 - DNA, 75 bp, Artificial Sequence
  Synthetic
tcagaccaaatactgaagactgttaaaggggtacctttcggtgggaatatgtacatagcactggcagcttgcatt

SEQ ID NO: 276775 - DNA, 75 bp, Artificial Sequence
  Synthetic
tcactccagaggggacagtttgcagccagaatgcgttgtacccaatgagcccattgcttcaggaatgtttcaggg

SEQ ID NO: 276776 - DNA, 75 bp, Artificial Sequence
  Synthetic
tacatgtacgacacaagcagtctgaggacgcaggaaacccagcctccgatcacccacctgaccctactccacact

SEQ ID NO: 276777 - DNA, 75 bp, Artificial Sequence
  Synthetic
ccagactgtttatagtttacctcggccagtgtgctgccatcaattgggcttttgatatacattatcatcggccct

SEQ ID NO: 276778 - DNA, 75 bp, Artificial Sequence
  Synthetic
atgccttctacaaagacaatcctcacaataagaaccatagggtgatcctggatagagaacgcttggtcattgaaa

SEQ ID NO: 276779 - DNA, 75 bp, Artificial Sequence
  Synthetic
gggatctccggtggtgtatgaatccccccgagagagtcaaaattaattttgatcagttttgtgagtacaaagctg

SEQ ID NO: 276780 - DNA, 75 bp, Artificial Sequence
  Synthetic
tgacactgatcatgagttgcaaatatcccctggaggcccgggctccctcggcaagaacagctgccgggaaacaga

SEQ ID NO: 276781 - DNA, 75 bp, Artificial Sequence
  Synthetic
aaccagctcaggacttgtagaacgctctaatggcattcttaaaactttattatataagtactttactgatagacc

SEQ ID NO: 276782 - DNA, 75 bp, Artificial Sequence
  Synthetic
gccctccccccgggccatgccccctctgtcaagacccaactcactggaagcgggactgtccccgcctaaagcccg

SEQ ID NO: 276783 - DNA, 75 bp, Artificial Sequence
  Synthetic
agtctaaaaggtcagagggcccagactgggtgctgacgtatccccccagagggacgactcagccccagtgaaaat

SEQ ID NO: 276784 - DNA, 75 bp, Artificial Sequence
  Synthetic
tgggctctgacgtgtccccctcagaaggaccaaatatgaacccggtctccgggaagccgccgggagccacccact

SEQ ID NO: 276785 - DNA, 75 bp, Artificial Sequence
  Synthetic
actgacaacccgcacccaaaaaactccatagggggggaggtttaacctccccccccacggtgcgacaggtccatc

SEQ ID NO: 276786 - DNA, 75 bp, Artificial Sequence
  Synthetic
atcgcctccagcctcccctgccaataattaacctctcccatcaaatcctccttctcctgcagcaacttcctccgt

SEQ ID NO: 276787 - DNA, 75 bp, Artificial Sequence
  Synthetic
tcctccccatgtttgtccgtcgcctctgggcgctgacgacaacccctagccccaaaaattttaacatggcacgca

SEQ ID NO: 276788 - DNA, 75 bp, Artificial Sequence
  Synthetic
cttctcctgcagcaacttcctccgttcagcctccaaggactccacctcgccttccaactgtctagtatagccatc

SEQ ID NO: 276789 - DNA, 75 bp, Artificial Sequence
  Synthetic
tatggcttaataaaacaccaggagtctataaaagcgtggagacagttcaggagggggctcgcaacttcacccgcg

SEQ ID NO: 276790 - DNA, 75 bp, Artificial Sequence
  Synthetic
ttgacacccagaccggtcacccaaggaccattgaagctttactagatacaggagcggacatgacagtccttccaa

SEQ ID NO: 276791 - DNA, 75 bp, Artificial Sequence
  Synthetic
aatccccaactcctgcattttttctttcctagcactatgctgtttcgccttctcagccccttgtctccacttgcg

SEQ ID NO: 276792 - DNA, 75 bp, Artificial Sequence
  Synthetic
cctcaaagacacatccgtgttaggggcaggaggccaaacccaagaccactttaagctcacctcccttcctgtgct

SEQ ID NO: 276793 - DNA, 75 bp, Artificial Sequence
  Synthetic
cccgccgccctacctgaggccgccatccgtgctggttgagtcgaggtctatcgtctcccgctctcggtgcctcct

SEQ ID NO: 276794 - DNA, 75 bp, Artificial Sequence
  Synthetic
gaccattgaagctttactagatacaggagcggacatgacagtccttccaatagccttgttctcaaatgacactcc

SEQ ID NO: 276795 - DNA, 75 bp, Artificial Sequence
  Synthetic
gaactgcgcccgtcgtctaggtaagctcggagctcaggttgagaccggtctgctggcccggcgctcccttgaagc

SEQ ID NO: 276796 - DNA, 75 bp, Artificial Sequence
  Synthetic
aggcagaaaggccgcctgtaatcctgccaatacaggcgccagccatccttgggctagaacacctcccaaggcccc

SEQ ID NO: 276797 - DNA, 75 bp, Artificial Sequence
  Synthetic
ccccctaggctcgatcggctctccacgcttttgccaggccctgcttgctcgcctcacttccttgtttcgtttctg

SEQ ID NO: 276798 - DNA, 75 bp, Artificial Sequence
  Synthetic
ttacgcgccgccgcaaaccggaggttcctcccctttccccctcgctagcgcccgattgacggcttggcccacggc

SEQ ID NO: 276799 - DNA, 75 bp, Artificial Sequence
  Synthetic
gaggtggcgctttctcccctggagggccccgtcgcagccggccgcggctttcctcttctaaggatagcaaaccgt

SEQ ID NO: 276800 - DNA, 75 bp, Artificial Sequence
  Synthetic
ccaacgccggcaggctaactggctcggagccagtcggtgcccacctaactcggtcccgcgcgtctctccgggaga

SEQ ID NO: 276801 - DNA, 75 bp, Artificial Sequence
  Synthetic
acggcccaggcactagatacgcctggagagtactaccccaagggtttaaaaatagtcccaccctgttcgagatgc

SEQ ID NO: 276802 - DNA, 75 bp, Artificial Sequence
  Synthetic
gaagcgccaaacacagttgggggctcgtccgggatctgaaccccccgccccctcctctcgcctccctaggacaat

SEQ ID NO: 276803 - DNA, 75 bp, Artificial Sequence
  Synthetic
tcttagcaagcccctcccatgaagacctacagcagctctcagaggccacaatggcttccctaatctcccacggat

SEQ ID NO: 276804 - DNA, 75 bp, Artificial Sequence
  Synthetic
tgcctgtatcccaagacaaaacccaacaaacccctgggacaattaagttcctagggcaaataatttcaccaaacc

SEQ ID NO: 276805 - DNA, 75 bp, Artificial Sequence
  Synthetic
gggccaaatcattccccgcgtcaccagccctattccccggcccccccgggggctagctacacaccactggctcaa

SEQ ID NO: 276806 - DNA, 75 bp, Artificial Sequence
  Synthetic
ttttctccaggcggcctatcgcttagaacctggtccctccagctacgactttcaccagctcagacaattccttaa

SEQ ID NO: 276807 - DNA, 75 bp, Artificial Sequence
  Synthetic
actagctttagaaacccctgtctggatgagccctattaattattccctcctggcgaatctcctccccaagggata

SEQ ID NO: 276808 - DNA, 75 bp, Artificial Sequence
  Synthetic
agcccaaaccctgcccctcctgggggccattatgctaaccctcactggcaccactactgtagtgttccagtccaa

SEQ ID NO: 276809 - DNA, 75 bp, Artificial Sequence
  Synthetic
tcccggccgagtcaatgaaatactaaatatactcatccaagcccaggtccaaacccctccccatcccccctcccc

SEQ ID NO: 276810 - DNA, 75 bp, Artificial Sequence
  Synthetic
gttatcagcctctcccaacactgcccccagctcccagtttcccgctgaaactagtctaactgcctctgacctcca

SEQ ID NO: 276811 - DNA, 75 bp, Artificial Sequence
  Synthetic
catcccacccccctatgcggagccctctgctccccaagtcctcccagttgtacacccccacggggccccgcccaa

SEQ ID NO: 276812 - DNA, 75 bp, Artificial Sequence
  Synthetic
actggagaactttggaacacttttcttaaaacggccgccccattggcccctgtaagggccctcacgccagtgttt

SEQ ID NO: 276813 - DNA, 75 bp, Artificial Sequence
  Synthetic
ccaccgcccttggcagatgaaagacctccaagccataaagcaggaggtatcccaagccgctccgggaagccccca

SEQ ID NO: 276814 - DNA, 75 bp, Artificial Sequence
  Synthetic
gttcatgcaaaccgttaggctagcggtacaacaattcgatcccactgccaaggatctgcaggatctcctgcagta

SEQ ID NO: 276815 - DNA, 75 bp, Artificial Sequence
  Synthetic
tctatgttcctccctaatagcctccctccaccatcaacagctagatagcctcatctcagaggcagaaacccgagg

SEQ ID NO: 276816 - DNA, 75 bp, Artificial Sequence
  Synthetic
aattaccggatacaaccccctggcgggacccctacgtgtccaagctaacaacccacaacagcaaggactccggcg

SEQ ID NO: 276817 - DNA, 75 bp, Artificial Sequence
  Synthetic
tcgccttcatgtatgggtagatactttttcaggggccatctcagctacccaaaaaagaaaagaaacaagctcaga

SEQ ID NO: 276818 - DNA, 75 bp, Artificial Sequence
  Synthetic
tccttccgttccactcaaccctcaccactccaggccttatttggacatttaccgatggcacgcctatgatttccg

SEQ ID NO: 276819 - DNA, 75 bp, Artificial Sequence
  Synthetic
agaataccagcaactctggctcgccgctttctctgccttgccagggagtgccaaagacccctcatgggcctccat

SEQ ID NO: 276820 - DNA, 75 bp, Artificial Sequence
  Synthetic
ccttcagggtctagaagaaccctatcactcttttgtggagcgcctcaatgtagcattagataatgggctaccaga

SEQ ID NO: 276821 - DNA, 75 bp, Artificial Sequence
  Synthetic
accaacaccatgggtaagtttctcaccactttaattttattcctccagttctgccccccaattctctgttattac

SEQ ID NO: 276822 - DNA, 75 bp, Artificial Sequence
  Synthetic
aggcactcctaaagaccctatccttcgctccctggcctactctaacgccaacaaggaatgccaaaagctactaca

SEQ ID NO: 276823 - DNA, 75 bp, Artificial Sequence
  Synthetic
ggccagggggcatactaacagccccctgggagacatgttgcgagcctgccaggcctgggcccctaaggacaaagc

SEQ ID NO: 276824 - DNA, 75 bp, Artificial Sequence
  Synthetic
aaatatcccccgggggcttagagcctcccagtgaaaaacatttccgagaaacagaagtctgaaaaggtcagggcc

SEQ ID NO: 276825 - DNA, 75 bp, Artificial Sequence
  Synthetic
caaggtactagtagtccagccaaaaaagcctcccccaaatcaaccttgcttccgatgcgggaaagctggccattg

SEQ ID NO: 276826 - DNA, 75 bp, Artificial Sequence
  Synthetic
ccctatacaggggccgtctccagcccctactggaagtttcagcaagatgtcaattttactcaagaagtctcacgc

SEQ ID NO: 276827 - DNA, 75 bp, Artificial Sequence
  Synthetic
gagccgagactgcacccagcctcgcccacctcccggcccatgccccctttgtcaagacccaacccactggaaaag

SEQ ID NO: 276828 - DNA, 75 bp, Artificial Sequence
  Synthetic
atctggctccttaataccgaacccagccaactgccccccactgcccctcctctacttccccactccaacttagac

SEQ ID NO: 276829 - DNA, 75 bp, Artificial Sequence
  Synthetic
tgaagacaaatcataagctcagacctccgggaagccaccgggaaccacccatttcctccccatgtttgtcaagcc

SEQ ID NO: 276830 - DNA, 75 bp, Artificial Sequence
  Synthetic
ggactgccctcgcctaaaacccgccaccgcagagccagaggaggaagcccttctactagacctccctgcggatgt

SEQ ID NO: 276831 - DNA, 75 bp, Artificial Sequence
  Synthetic
gtcctaccaaaaaaacttgatagggggggaggcttaatctccccccaaccagaatcggccgtgcccgtctccgga

SEQ ID NO: 276832 - DNA, 75 bp, Artificial Sequence
  Synthetic
cccgccaccattttgccagttataccattggaccctaaacagcggcctttaattaaggccgaaattgaagtccca

SEQ ID NO: 276833 - DNA, 75 bp, Artificial Sequence
  Synthetic
acaaattcccgaaaacctgttcaagccctgttagacactggggcggacatgaccgtcctcccccttgccctgttt

SEQ ID NO: 276834 - DNA, 75 bp, Artificial Sequence
  Synthetic
tctctttttcgctttctcttctcctcggcccgtcgctgccgatcacgatgcgtttccccgcgaggtggcgcttcc

SEQ ID NO: 276835 - DNA, 75 bp, Artificial Sequence
  Synthetic
cggcccgtcgctgccgatcacgatgcgtttccccgcgaggtggcgcttcctctcctggagggccccatcgcagcc

SEQ ID NO: 276836 - DNA, 75 bp, Artificial Sequence
  Synthetic
accgggcctttgtccggcgctcccttggagcctacctagactcagccggctctccacgctttgcctgaccctgct

SEQ ID NO: 276837 - DNA, 75 bp, Artificial Sequence
  Synthetic
ccggaaaataccccccttgaaaacaccgcagttgtaggagcaggaggccaaactcaagatcagtttaaaatcgcc

SEQ ID NO: 276838 - DNA, 75 bp, Artificial Sequence
  Synthetic
tcccttccggtgttaattcacctccctttccggacgacacccattgtgttaacctcatgccttatagataccgaa

SEQ ID NO: 276839 - DNA, 75 bp, Artificial Sequence
  Synthetic
aacaactgggtcataattggccgcgacgccctacagcaatgccaaggggccctatacctccctgaggcaggtcgc

SEQ ID NO: 276840 - DNA, 75 bp, Artificial Sequence
  Synthetic
gctctccaactgtctagcataaccgtcaacccccaactccgtcattctttcttttctagcactacgctgtcttgc

SEQ ID NO: 276841 - DNA, 75 bp, Artificial Sequence
  Synthetic
ccaccactaatactgccagttcaggcgccggccatgctaggcctcgagcatttcccaaaaccccccgaaatcagc

SEQ ID NO: 276842 - DNA, 75 bp, Artificial Sequence
  Synthetic
cttttctagcactacgctgtcttgccttcccagctccttgttctgcctgtctccacttgcgctcgcggcgctcct

SEQ ID NO: 276843 - DNA, 75 bp, Artificial Sequence
  Synthetic
cagtttcctttaaacctgaacgcctccaggccctgcagcacttggtccacagagctctggaggcaaatcacattg

SEQ ID NO: 276844 - DNA, 75 bp, Artificial Sequence
  Synthetic
aaccatactttggacccggaaataacccagtgttcccagttaaaaagtccagcggggcctggagattcatccatg

SEQ ID NO: 276845 - DNA, 75 bp, Artificial Sequence
  Synthetic
actccgttggctcggagccagcgacagcccattctatagcactctcaggagagaaacgtagtacacagttggggg

SEQ ID NO: 276846 - DNA, 75 bp, Artificial Sequence
  Synthetic
acctaagagccaccaactccctgactactgacctagcatcttcctcccccggccctccagatctctccagcctcc

SEQ ID NO: 276847 - DNA, 75 bp, Artificial Sequence
  Synthetic
cggtcacgctaccgcacctacaaaccatagaccttaaagatgccttttttcagatcccactgcccaagaagttcc

SEQ ID NO: 276848 - DNA, 75 bp, Artificial Sequence
  Synthetic
tcatcactggcttaacttcctccaggcggcatatcgcctagaacccggtccctccagttacgatttccaccagtt

SEQ ID NO: 276849 - DNA, 75 bp, Artificial Sequence
  Synthetic
agccttatttcgcctttacagttccacaacaatgtaattatggccctggaaataggtatgcctggaaggttcttc

SEQ ID NO: 276850 - DNA, 75 bp, Artificial Sequence
  Synthetic
cacaggggtttaaaaatagcccaaccatattcgaaatgcagctagctagtattctgcagccaatccggcatacct

SEQ ID NO: 276851 - DNA, 75 bp, Artificial Sequence
  Synthetic
tccctcattcggccatcatccagtacatggatgacatacttttagcaagccccactccggaagacctacagcggc

SEQ ID NO: 276852 - DNA, 75 bp, Artificial Sequence
  Synthetic
cctcttcctttatatttcataaatttcaaaccaaggcctatcacccctcagtcctactctcacatggcttcatac

SEQ ID NO: 276853 - DNA, 75 bp, Artificial Sequence
  Synthetic
tctctaaagctgtaatagtagccctagccactcatgggctccctgtgtcccatgaaaaaacacaacaaactccag

SEQ ID NO: 276854 - DNA, 75 bp, Artificial Sequence
  Synthetic
gggcaattaaattcctaggacaattaatttcaccagaccatgtcacctacaccgctgtgcccactgtgcctgtcc

SEQ ID NO: 276855 - DNA, 75 bp, Artificial Sequence
  Synthetic
ggtcccagtggaccctcccagaacttcaaaccctcctaggcgaggtccaatgggtttccaagggaacccccattc

SEQ ID NO: 276856 - DNA, 75 bp, Artificial Sequence
  Synthetic
gacaacccctcacctcaaaaaacttttcatggcacgcatacggctcaataaaacagcaggagtctataaaagcgt

SEQ ID NO: 276857 - DNA, 75 bp, Artificial Sequence
  Synthetic
tgcgtcagcccctccaatgtctatactccaccctacaaggtcattctgaccccagggaccttatacatcttggcc

SEQ ID NO: 276858 - DNA, 75 bp, Artificial Sequence
  Synthetic
ccgcccaagtacaggctctaagggagctacaacaggcattatctcacaattgccgcagcaggctggttacgacgt

SEQ ID NO: 276859 - DNA, 75 bp, Artificial Sequence
  Synthetic
tgaccatgaccatgagccccaaatatcccccgagggcttagagccttccagtgaaaaacatttccgcgaaacaga

SEQ ID NO: 276860 - DNA, 75 bp, Artificial Sequence
  Synthetic
tgcccctccttggggctataatgctaactcccaccggtaccaccacggtggtgtttcagtaccggcagcgatggc

SEQ ID NO: 276861 - DNA, 75 bp, Artificial Sequence
  Synthetic
ctggctcgccgccttcgccgccctgccagggagtgccaaagacccttcctgggcctctatcctccaaggcctgga

SEQ ID NO: 276862 - DNA, 75 bp, Artificial Sequence
  Synthetic
agtctaaaaaggtcagggcccagactgaggctctgacgtctccccccggagggacagctcagcaccggctcagac

SEQ ID NO: 276863 - DNA, 75 bp, Artificial Sequence
  Synthetic
cccttgcctggctgcacgcccccttgcctcacaccagtcagtgcccctggggacagttactagcctcggcggtcc

SEQ ID NO: 276864 - DNA, 75 bp, Artificial Sequence
  Synthetic
tgaggctctgacgtctccccccggagggacagctcagcaccggctcagactgggccctgacgtgtccccctgaaa

SEQ ID NO: 276865 - DNA, 75 bp, Artificial Sequence
  Synthetic
tactactagacaaatacaccctacagtcatatggactcctttgtcaaacgattcatcacaatgtgtccacacaga

SEQ ID NO: 276866 - DNA, 75 bp, Artificial Sequence
  Synthetic
caggcgttgacgacaacccctcacctcaaaaattttttcatggcacgcatacggcttaataaaataacaggagtc

SEQ ID NO: 276867 - DNA, 75 bp, Artificial Sequence
  Synthetic
ccttcaaccatttcatccacacctctgaccaccccagcgtccccattctactccatcacttccaccggtttaaaa

SEQ ID NO: 276868 - DNA, 75 bp, Artificial Sequence
  Synthetic
acctgggtgcccagactggagaattatggactacctttttaaagacagccgcccctctagcccccgtaacggctc

SEQ ID NO: 276869 - DNA, 75 bp, Artificial Sequence
  Synthetic
catccacgccggtcgagtcgcgttctgcctcccgcctgtggtgcctcctgaactgcgttcgccgtctaggtaagt

SEQ ID NO: 276870 - DNA, 75 bp, Artificial Sequence
  Synthetic
ttatgcctgtcttcaccgtttccccggtagtcctggacactgccccctgcctgttttctgatggctctgcctccc

SEQ ID NO: 276871 - DNA, 75 bp, Artificial Sequence
  Synthetic
ggagacagttcaggagggggctcgcttctttccctcacgcgcccgccgccctacctgaggccgccatccacgccg

SEQ ID NO: 276872 - DNA, 75 bp, Artificial Sequence
  Synthetic
ttagagctcaggtcgagaccgggtctttgtccggtgctcccttagagccttcctagactcagccggctctccacg

SEQ ID NO: 276873 - DNA, 75 bp, Artificial Sequence
  Synthetic
aggcagcatatgtactttggaacaaaaaaataatctcacaggaaacgtttaccctaccaacatcacatacgtcag

SEQ ID NO: 276874 - DNA, 75 bp, Artificial Sequence
  Synthetic
actggaagcgagactgcccccgcctaaagcccactatcccagaaccagagccagaggaagatgccctcctattag

SEQ ID NO: 276875 - DNA, 75 bp, Artificial Sequence
  Synthetic
cccagcaggccgagctatttggccttttacatggcctcgccaaggctcgcccctggccctgtctcaacatctttc

SEQ ID NO: 276876 - DNA, 75 bp, Artificial Sequence
  Synthetic
ttgattccaaatatctatatcattacctacggaccctatctttaggaacctttcagggaaaatcctcccaagctc

SEQ ID NO: 276877 - DNA, 75 bp, Artificial Sequence
  Synthetic
aagtaccggcgactttactggctcggagccagcgacagcctattccataacactctccaggagagaaatttagta

SEQ ID NO: 276878 - DNA, 75 bp, Artificial Sequence
  Synthetic
cccttcaggccttactaccgcatttactacaacacaaaatcatttacctccaccacgtccgtagtcacactaatc

SEQ ID NO: 276879 - DNA, 75 bp, Artificial Sequence
  Synthetic
cacaggtgggggctcgtccgggatctgagcgcccctttattccctaggcaatgggccagatcttttcccgtagcg

SEQ ID NO: 276880 - DNA, 75 bp, Artificial Sequence
  Synthetic
tagatacaggagcagacatgacagtccttccgatagccttgttctcaagtaatactcccctcaaaaatacatccg

SEQ ID NO: 276881 - DNA, 75 bp, Artificial Sequence
  Synthetic
tgcctgatcctatctccaaacttaatgcctttaccgattccctgttggttacccctgtcctccaactttctcctg

SEQ ID NO: 276882 - DNA, 75 bp, Artificial Sequence
  Synthetic
atgggccagatcttttcccgtagcgctaaccctattccgcggccgccccgggggctggctgctcatcactggctt

SEQ ID NO: 276883 - DNA, 75 bp, Artificial Sequence
  Synthetic
gaagccaccggaaccacccatttcctccccatgtttgtcaagccgtcctcaggcgttgacgacaacccctcacct

SEQ ID NO: 276884 - DNA, 75 bp, Artificial Sequence
  Synthetic
ccaaactacatagttttactcattgcggacaagcagcccttacacttcatggggccaccacaacagaggccctca

SEQ ID NO: 276885 - DNA, 75 bp, Artificial Sequence
  Synthetic
acatcctgcactcatgtcacgcctgccgcaaaaataacccacaacaccaaatgccccggggacacatccggcgcg

SEQ ID NO: 276886 - DNA, 75 bp, Artificial Sequence
  Synthetic
aaaatggctctagaaacaccggtctggatctgtcccattaactactccgtcctagccagcctgctcccaaaagga

SEQ ID NO: 276887 - DNA, 75 bp, Artificial Sequence
  Synthetic
gcttactccccaaccacatttggcaaggcgatattactcatttcaaatacaaaaacaccctttaccgccttcatg

SEQ ID NO: 276888 - DNA, 75 bp, Artificial Sequence
  Synthetic
taccccggccgggtaaatgaaattttacatatactcatccaaacccaagcccacgtcccgccccagatcccgtcc

SEQ ID NO: 276889 - DNA, 75 bp, Artificial Sequence
  Synthetic
gaataccagcaactctggctcgccgccttcgccgccctgccggggagtgccaaagacccttcctgggcctctatc

SEQ ID NO: 276890 - DNA, 75 bp, Artificial Sequence
  Synthetic
tatgggtagacacattctctggatctgtgtccgccactcacaaaaaaagggaaacaagttcagaagccatctctt

SEQ ID NO: 276891 - DNA, 75 bp, Artificial Sequence
  Synthetic
caccctgcgccaccgccgccgcagtcccccagccacgaccccccggattcagatccgcagatcccccctccctat

SEQ ID NO: 276892 - DNA, 75 bp, Artificial Sequence
  Synthetic
ccctactccacgccattgcccatttaggaagacctagccacatcaataccgacaacggccctgcctatgcctccc

SEQ ID NO: 276893 - DNA, 75 bp, Artificial Sequence
  Synthetic
aagagttccaacacgcctgtacctccctagccatccgccacaccacccacatcccatataaccccaccagctccg

SEQ ID NO: 276894 - DNA, 75 bp, Artificial Sequence
  Synthetic
cgtggaccctcgacctgctggccctttcagcagatcaggccctacagcccccctgccctaatctagtaagttact

SEQ ID NO: 276895 - DNA, 75 bp, Artificial Sequence
  Synthetic
gggccactaactctctaaccatagatctctcatcatcttcccccgggccccctgacttgtccagcctgccaacta

SEQ ID NO: 276896 - DNA, 75 bp, Artificial Sequence
  Synthetic
gacttgtagaacgcactaatggcatcctcaaaactctcctttacaagtacttctcagataaccccaatttgccaa

SEQ ID NO: 276897 - DNA, 75 bp, Artificial Sequence
  Synthetic
gagcccccagttcatgcagaccatccggctcgcggtgcagcagttcgaccctactgccaaagacctccaagacct

SEQ ID NO: 276898 - DNA, 75 bp, Artificial Sequence
  Synthetic
tggacaatgccctatccgttgctctttggacaattaaccaccttaatgtattaacccactgccagaaaacccggt

SEQ ID NO: 276899 - DNA, 75 bp, Artificial Sequence
  Synthetic
gtggcttccctccatcaccagcagctagatagccttatatcagaggccgaaactcgaggtattacaggctataac

SEQ ID NO: 276900 - DNA, 75 bp, Artificial Sequence
  Synthetic
ggcaattacaccactccccccggttaccacccatcccggaagccaagccagttaccacctcaaaaacccactggt

SEQ ID NO: 276901 - DNA, 75 bp, Artificial Sequence
  Synthetic
cccttagctggtcccctccgtgtccaagccaacaatccacaacagcaaggattaaggcgagaatatcaacaactt

SEQ ID NO: 276902 - DNA, 75 bp, Artificial Sequence
  Synthetic
attatttcaaaatccctggtcttaatagccgacagtggaaaggaccccagagagccctccaggaggctgcaggcg

SEQ ID NO: 276903 - DNA, 75 bp, Artificial Sequence
  Synthetic
cagcccattcggcaagctttcccccaatgcactattcttcagtacatggatgacattctcctggcaagcccctcc

SEQ ID NO: 276904 - DNA, 75 bp, Artificial Sequence
  Synthetic
cagccctcatccccgtcagcgacactgcagcccagtggatcccgtggaaacttcttaaacgggctgtatgcccaa

SEQ ID NO: 276905 - DNA, 75 bp, Artificial Sequence
  Synthetic
gagccctaccacaccttcgtagaacgtctcaacgtagcccttgacaatggactgccagaaggcacgcccaaagac

SEQ ID NO: 276906 - DNA, 75 bp, Artificial Sequence
  Synthetic
cctagcactatgctgtttcgccttctcagccccttgtctccacttgggctcacggcgctcctgctcttcctgctt

SEQ ID NO: 276907 - DNA, 75 bp, Artificial Sequence
  Synthetic
gactcgccggggacaccgccgatcccaaagaaagagaccaccaacaccatgggtaagtctttatttttcttctgc

SEQ ID NO: 276908 - DNA, 75 bp, Artificial Sequence
  Synthetic
gtctcaacgtagcccttgacaatggactgccagaaggcacgcccaaagaccccattttgcgttccttagcctact

SEQ ID NO: 276909 - DNA, 75 bp, Artificial Sequence
  Synthetic
ataatagtccaagcctgcctccccaccctttgcgaccgaggccccagctgctgtaccctcacagtcggggtctcc

SEQ ID NO: 276910 - DNA, 75 bp, Artificial Sequence
  Synthetic
tcctaccactcaaagccctgtaatcctacccagcccatttgctcctggaccttagacctacttacacttactacc

SEQ ID NO: 276911 - DNA, 75 bp, Artificial Sequence
  Synthetic
gatcaggccctacaacccccttgtcctaacctgataggctactcaaactaccatgccacttaccccctctaccta

SEQ ID NO: 276912 - DNA, 75 bp, Artificial Sequence
  Synthetic
cagcctcgtccccctcctgggccatgccccctatgtcaagacccaactcactggaagcgagattgcccccgcctg

SEQ ID NO: 276913 - DNA, 75 bp, Artificial Sequence
  Synthetic
ctggaagcgagattgcccccgcctgaagcccactatcccagaaccagaaccagaggaagatgccctcctattaga

SEQ ID NO: 276914 - DNA, 75 bp, Artificial Sequence
  Synthetic
tttccccattgggtaaaaaaacccaacaggggtggaggagggtactattccgcttcctattctgacccctgctcc

SEQ ID NO: 276915 - DNA, 75 bp, Artificial Sequence
  Synthetic
ctgaagtgcccttaccttggttgccagtcctggacatgcccctacacaggggccgtttccggaccttattggaaa

SEQ ID NO: 276916 - DNA, 75 bp, Artificial Sequence
  Synthetic
gtccttcctaaccaagacccagcatctattctgccagttataccgttagatcccgcccgtcggcccataattaaa

SEQ ID NO: 276917 - DNA, 75 bp, Artificial Sequence
  Synthetic
taccaaactgatgtaaattttacccaggacgtctcacggctcactgtccacctacatttctctaaatgtgggttt

SEQ ID NO: 276918 - DNA, 75 bp, Artificial Sequence
  Synthetic
ccacgttttgcctgaccctgcttgctcaactctgcgtctctgtttcgttttctgttctgcgccgctacagattga

SEQ ID NO: 276919 - DNA, 75 bp, Artificial Sequence
  Synthetic
gtccaggttgacacccagaccagccacctaaagtctattgaagctttactagacacaggagcagacatgacagtc

SEQ ID NO: 276920 - DNA, 75 bp, Artificial Sequence
  Synthetic
cccttctcccttctaatcgatgcacccgggtatgaccctatttggctcatcaactcggagcccagccagctgcca

SEQ ID NO: 276921 - DNA, 75 bp, Artificial Sequence
  Synthetic
agacacaggagcagacatgacagtccttccaatagccttgttctcaagtgatactcccctcaaagacacatccgt

SEQ ID NO: 276922 - DNA, 75 bp, Artificial Sequence
  Synthetic
accatgagccccaaatatcccccgggggcttagagcctcccagtgaaaaacatttccgcgaaacagaagtctgaa

SEQ ID NO: 276923 - DNA, 75 bp, Artificial Sequence
  Synthetic
cctaccgccccccccttactccctcattccaacctggaccatatcctcgagccctccataccatggaagtcaaaa

SEQ ID NO: 276924 - DNA, 75 bp, Artificial Sequence
  Synthetic
cttctaacccttgtccaactaaccctacaaagcaccaactacacttgtattgtctgcctggaccgcgccagtctg

SEQ ID NO: 276925 - DNA, 75 bp, Artificial Sequence
  Synthetic
cggaaccacccatttcctccccatgtttgtcaagccgccctcaggcgttgacgacaacccctcacctcaaaaaac

SEQ ID NO: 276926 - DNA, 75 bp, Artificial Sequence
  Synthetic
tccacctggcatgtcctctactccccaaacatgtccgtgccctcctctccttcggtgcccctcatctacccctcc

SEQ ID NO: 276927 - DNA, 75 bp, Artificial Sequence
  Synthetic
ctccccgaggcgaaaaggccgcctgtaatcctgccaatacaggcgccagccgtcattggactagaacacctccca

SEQ ID NO: 276928 - DNA, 75 bp, Artificial Sequence
  Synthetic
ttagctctgcccgctcctcacctagcgttacccttcaattggacccactgttttgaccccaaactgcaagctatc

SEQ ID NO: 276929 - DNA, 75 bp, Artificial Sequence
  Synthetic
cctatattctctgggacaagcatatattgtcacaaagatcattcccccttccgccaccgcacaagtcggcccaac

SEQ ID NO: 276930 - DNA, 75 bp, Artificial Sequence
  Synthetic
aggccccccgaaatcagccagttccctttaaaccggaacgcctccaggccttacaacacttggtccggaaggccc

SEQ ID NO: 276931 - DNA, 75 bp, Artificial Sequence
  Synthetic
acctctgcccattgctacaacgctctcattctacctcccttctccctgtcgcccgtccccgccctgagccaccgc

SEQ ID NO: 276932 - DNA, 75 bp, Artificial Sequence
  Synthetic
actcggcgggccgtgccagtggcagtctggctcgtgtctgccctagctatggggacaggcatagctgggggtatc

SEQ ID NO: 276933 - DNA, 75 bp, Artificial Sequence
  Synthetic
actcagccggctctccacgctttgcctgaccctgcttgttcaaccctgcgtctttgtttcgttttctgttctgcg

SEQ ID NO: 276934 - DNA, 75 bp, Artificial Sequence
  Synthetic
acaggatctatgtccctcgcttcaggacgaagcctattacatgaggtagacaaagatatctcccaacttacccaa

SEQ ID NO: 276935 - DNA, 75 bp, Artificial Sequence
  Synthetic
gctatagttaaaaaccataaaaacctcctcaaaattgcccagtatgctgcccaaaacaggagaggcttagatctt

SEQ ID NO: 276936 - DNA, 75 bp, Artificial Sequence
  Synthetic
gccggcttggcccacggccaagtaccggcgactccgttggctcggagccagcgacagcccattctatagcactct

SEQ ID NO: 276937 - DNA, 75 bp, Artificial Sequence
  Synthetic
ctgttttgggaacaaggaggcctatgcaaggccttacaagaacaatgctgcttcctcaacatcaccaattcccat

SEQ ID NO: 276938 - DNA, 75 bp, Artificial Sequence
  Synthetic
tgtaactacggccccggcactagatacgcctggaaagtactaccccaagggtttaaaaatagccccaccctgttt

SEQ ID NO: 276939 - DNA, 75 bp, Artificial Sequence
  Synthetic
gtctcaattctacaagaaaggcccccccttgaaaatcgggtcctcacaggctggggccttaattgggaccttgga

SEQ ID NO: 276940 - DNA, 75 bp, Artificial Sequence
  Synthetic
gagatgcagctggcccacatcctgcagcccattcggcaagccttcccccaatgcgttattcttcagtacatggat

SEQ ID NO: 276941 - DNA, 75 bp, Artificial Sequence
  Synthetic
ctgtctcaatgggcgcgtgaggccctacaaactggaattaccctcattgccctaattctcctaatagtctttata

SEQ ID NO: 276942 - DNA, 75 bp, Artificial Sequence
  Synthetic
gatattctcctggcaagcccttcccataaggacctacaattactctcggaggtcacactggcttccctaatttcc

SEQ ID NO: 276943 - DNA, 75 bp, Artificial Sequence
  Synthetic
gggccatgtattcttcgccaactacaacggctccctacacgcattcaacacccccattactcacttatcaatcct

SEQ ID NO: 276944 - DNA, 75 bp, Artificial Sequence
  Synthetic
catgggttgcctgtgtccgaaaacaaaacccaacaaacccctgggacaattaagttcctaggacaaataatctca

SEQ ID NO: 276945 - DNA, 75 bp, Artificial Sequence
  Synthetic
gaacccttataaatgccctgtagcctgctctagttctcccttaaggaggtcgttccacctcccccgccaataatt

SEQ ID NO: 276946 - DNA, 75 bp, Artificial Sequence
  Synthetic
cccaatcacctcacttatgatgcaatccccacggtacctatacggtcccgctgggcactatctgaacttcaagcc

SEQ ID NO: 276947 - DNA, 75 bp, Artificial Sequence
  Synthetic
caattcgcccgttaacctctcccgctcctggatccaccccctccgctgggcttctagagagtcaacctcctcctc

SEQ ID NO: 276948 - DNA, 75 bp, Artificial Sequence
  Synthetic
ctacttggggagattcagtgggtttccaaaggaactcctaccttacgccagccccttcacaatctctactgtgcc

SEQ ID NO: 276949 - DNA, 75 bp, Artificial Sequence
  Synthetic
tagttgcctggtatacccctccactccaaactctttaattttctcccttcggtcgctacgctgcctctctttctc

SEQ ID NO: 276950 - DNA, 75 bp, Artificial Sequence
  Synthetic
ctacagaggcataccgatccccgtgaccaaatatgtttaaatccttctcaagttcaatcattagtgcagctgcga

SEQ ID NO: 276951 - DNA, 75 bp, Artificial Sequence
  Synthetic
tgccccttctatcaatgcctttagtttccgttctcgacgttctttctcctcctctctccgccgagcagcacgggc

SEQ ID NO: 276952 - DNA, 75 bp, Artificial Sequence
  Synthetic
cccctgggagcccccagtttatgcagaccatccggcttgcggtgcagcagtttgaccccactgccaaagacctcc

SEQ ID NO: 276953 - DNA, 75 bp, Artificial Sequence
  Synthetic
cgcttcttcctctaaccgccgcctgcggcaagctgctttctccgcttgcctcttcaggtgctcagttatcagcct

SEQ ID NO: 276954 - DNA, 75 bp, Artificial Sequence
  Synthetic
ctccctcgtggcttccctccatcaccagcagctagatagccttatatcagaggccgaaacccgaggtattacagg

SEQ ID NO: 276955 - DNA, 75 bp, Artificial Sequence
  Synthetic
gtcctcctcctcctcacgctccctcttacgcctcctcttttcctccgcccggcgatgccggtctcgctgcgtctc

SEQ ID NO: 276956 - DNA, 75 bp, Artificial Sequence
  Synthetic
ctggctacatgcccccctaccccacactagccagtgcccctgggggcagctacttgcctcagctgtgttactgct

SEQ ID NO: 276957 - DNA, 75 bp, Artificial Sequence
  Synthetic
tcccttaggccaagactccagccctttatccaatgtctctctccgactctcatattcctcctccagagacaaaat

SEQ ID NO: 276958 - DNA, 75 bp, Artificial Sequence
  Synthetic
cgacaaatacaccctacaatcctatggactactctgccaaaccatacatcataacatctccacccaaaccttcaa

SEQ ID NO: 276959 - DNA, 75 bp, Artificial Sequence
  Synthetic
atcgtccaacacggactcctcctgcttcttttgtccggtcaattcttcctccagggacaacagcccgtccaccac

SEQ ID NO: 276960 - DNA, 75 bp, Artificial Sequence
  Synthetic
ccacttcattcacacatctgaccaccccagtgttcctatcttgctccaccacagtcatcgattcaaaaatttagg

SEQ ID NO: 276961 - DNA, 75 bp, Artificial Sequence
  Synthetic
ctcttccattaacaggtcttccggggaaggaactggcagacatcggaaaggtcctaaaaacaaaaacaatattaa

SEQ ID NO: 276962 - DNA, 75 bp, Artificial Sequence
  Synthetic
tgcccagactggagaactttggaacacttttcttaaaacagccgccccattggctcctgtgaaaaccctcatgcc

SEQ ID NO: 276963 - DNA, 75 bp, Artificial Sequence
  Synthetic
ccttgcctattatcagcccatttcccagggtttggacaaagcctcctctatggatacccagtctacgtgtttgga

SEQ ID NO: 276964 - DNA, 75 bp, Artificial Sequence
  Synthetic
actgtttactctttccccggtgatcataaacgccgccccctgcctgttctcggacggatctaccacccaggcggc

SEQ ID NO: 276965 - DNA, 75 bp, Artificial Sequence
  Synthetic
gactgtgtgcagggcgactggtgccccatctctgggggactatgctcagcccgccttcatcgtcatgcccttttg

SEQ ID NO: 276966 - DNA, 75 bp, Artificial Sequence
  Synthetic
gccacttgcccggaacaccaggtcacctgggaccccatcgatggacgcgttatcggatcaactctacaattcctt

SEQ ID NO: 276967 - DNA, 75 bp, Artificial Sequence
  Synthetic
tgcccatacctggggtgccaatcatggacctgcccctatacaggagccgtctccagcccctactggaagtttcag

SEQ ID NO: 276968 - DNA, 75 bp, Artificial Sequence
  Synthetic
atccctcgactcccctctttccccacccagcgaacctccaagacccttaaagtcctcacccctccaaccactcat

SEQ ID NO: 276969 - DNA, 75 bp, Artificial Sequence
  Synthetic
acgacccccaacattccgccctccttcctccaagccatgcgcaagcactccccgtttcgaaacggatatatggag

SEQ ID NO: 276970 - DNA, 75 bp, Artificial Sequence
  Synthetic
cgtaaggtcgtctacttgcaccacgttcgcagccataccaatctgcctgatcccatttccaggctcaacgctctc

SEQ ID NO: 276971 - DNA, 75 bp, Artificial Sequence
  Synthetic
cccacccttggagagcaactcccgtccctgtctttccccgaccccggcttacgtccccaaaacctctataccctc

SEQ ID NO: 276972 - DNA, 75 bp, Artificial Sequence
  Synthetic
tcctgcagctctctcctgcagagctacacagtttcacccattgcggacaggcagccctcacactgcaaggggcaa

SEQ ID NO: 276973 - DNA, 75 bp, Artificial Sequence
  Synthetic
tggggaaattcagtcgtctgcctctacctctaccaactatcccccccaatcacctggcccctcttgcctcatgta

SEQ ID NO: 276974 - DNA, 75 bp, Artificial Sequence
  Synthetic
gtcttttgccatcccgcccaattaggggccttcctcactcatgttccttacaagcgaatggaagaactcctttat

SEQ ID NO: 276975 - DNA, 75 bp, Artificial Sequence
  Synthetic
tcctaaccacatctggcaaggcgacattacccatttcaaatataaaaatacactgtatcgccttcatgtatgggt

SEQ ID NO: 276976 - DNA, 75 bp, Artificial Sequence
  Synthetic
catccgtattaggggcagggggccaaacccaagatcactttaagctcacctcccttcctgtgctaatacgcctcc

SEQ ID NO: 276977 - DNA, 75 bp, Artificial Sequence
  Synthetic
aaaattttcctcaacacaggggccctcatcgtactgccagaagacgctctgcccactaccctctttcagcccgcc

SEQ ID NO: 276978 - DNA, 75 bp, Artificial Sequence
  Synthetic
agggcgcctgccactctaacggcttggcaaaatggcctcctcccgttccagacaagcctcaccacccccggcctt

SEQ ID NO: 276979 - DNA, 75 bp, Artificial Sequence
  Synthetic
gctcagaagctatttcctctttgctccaggccattgcctatctaggcaagcccaattacataaacacagacaatg

SEQ ID NO: 276980 - DNA, 75 bp, Artificial Sequence
  Synthetic
atttggactttcactgatggctcccccatgatttccggcccatgccctaaagaagggcaaccttccctagtacta

SEQ ID NO: 276981 - DNA, 75 bp, Artificial Sequence
  Synthetic
caatcctcctcctttatattccaaaaattccagactaaggcctaccacccttcatttctactttcgcacgggctc

SEQ ID NO: 276982 - DNA, 75 bp, Artificial Sequence
  Synthetic
atacaatactcttctttccacactctccaccttctcttcactgaatatacaaacatccccatttctctacttttt

SEQ ID NO: 276983 - DNA, 75 bp, Artificial Sequence
  Synthetic
tccaccttctcttcactgaatatacaaacatccccatttctctactttttaatgaaaaagaggcagatgacactg

SEQ ID NO: 276984 - DNA, 75 bp, Artificial Sequence
  Synthetic
aaccctacaccgggccaggaaataacccagtattcccagttaaaaaggccaatggaacctggcgattcatccacg

SEQ ID NO: 276985 - DNA, 75 bp, Artificial Sequence
  Synthetic
atcaaccacctgaatgtgctaacccactgccacaaaacccgatggcagcttcaccactccccccgactccagccg

SEQ ID NO: 276986 - DNA, 75 bp, Artificial Sequence
  Synthetic
actgccacaaaacccgatggcagcttcaccactccccccgactccagccggtcccagagacgcattccctcagca

SEQ ID NO: 276987 - DNA, 75 bp, Artificial Sequence
  Synthetic
ataaacaaacccattggtattatttcaagcttcctggtcttaatagccgccagtggaaaagaccacaggaagctc

SEQ ID NO: 276988 - DNA, 75 bp, Artificial Sequence
  Synthetic
tatagaccttaaagacgcctttttccaaatccccttacctaaacagttccagccctactttgctttcactgtccc

SEQ ID NO: 276989 - DNA, 75 bp, Artificial Sequence
  Synthetic
tccaagaagccgccggtgctgctctcatcccagtaagcgctggttctgcccagtggatcccgtggaggctcctca

SEQ ID NO: 276990 - DNA, 75 bp, Artificial Sequence
  Synthetic
tccctgtaaaccaagcacacaattattgcaaccacatcgcctccagcctcccctgccaaataattaacctctccc

SEQ ID NO: 276991 - DNA, 75 bp, Artificial Sequence
  Synthetic
tccagttctgccccctcattctcggtgattacagccccagctgctgtattctcacaattggggtctcctcatacc

SEQ ID NO: 276992 - DNA, 75 bp, Artificial Sequence
  Synthetic
ctactggccctttcagcagatcaagccctacagcccccctgccctaatctagtaagttactccagctaccacgcc

SEQ ID NO: 276993 - DNA, 75 bp, Artificial Sequence
  Synthetic
ccctacagcccccctgccctaatctagtaagttactccagctaccacgccacttattccctatatctattccctc

SEQ ID NO: 276994 - DNA, 75 bp, Artificial Sequence
  Synthetic
attggattaaaaagccaaaccgaaatggcggaggctattattcggcctcttattcagacccatgttccttaaagt

SEQ ID NO: 276995 - DNA, 75 bp, Artificial Sequence
  Synthetic
gcccatacctagggtgccaatcatggacctgcccctatacaggagccgtctccagcccctattggaaatttcagc

SEQ ID NO: 276996 - DNA, 75 bp, Artificial Sequence
  Synthetic
taactggctcggagccagtcggtgcccacctaactcggtcccgcgcgtctctccgggagagaagcgccaaacaca

SEQ ID NO: 276997 - DNA, 75 bp, Artificial Sequence
  Synthetic
tgacaatgaccatgagccccaaatatcccccgggggcttagagcctcccagtgaaaaacatttccgcgaaacaga

SEQ ID NO: 276998 - DNA, 75 bp, Artificial Sequence
  Synthetic
cccctcctctactcccccactctaacctggaccacatcctcgagccctctataccatggaaatcaaaacttctga

SEQ ID NO: 276999 - DNA, 75 bp, Artificial Sequence
  Synthetic
tccccatgtttgtcaagccgccctcaggcgttgacgacaacccctcacctcaaaaaacttttcatggcacgcata

SEQ ID NO: 277000 - DNA, 75 bp, Artificial Sequence
  Synthetic
ctcttgtccagctaaccctacaaagcactaattacacttgcatcgtctgtatagaccgtgccagcctctctactt

SEQ ID NO: 277001 - DNA, 75 bp, Artificial Sequence
  Synthetic
ggcatgtcctgtactctcccaacgtctctgttccgtcctcttcttctacccccctcctttacccgtcgttagcgc

SEQ ID NO: 277002 - DNA, 75 bp, Artificial Sequence
  Synthetic
ctctgttccgtcctcttcttctacccccctcctttacccgtcgttagcgcttccagctccccacctgacgctacc

SEQ ID NO: 277003 - DNA, 75 bp, Artificial Sequence
  Synthetic
gcccgccgccctacctgaggccgccatccacgccggttgagtcgcgttctgccgcctcccgcctgtggtgcctcc

SEQ ID NO: 277004 - DNA, 75 bp, Artificial Sequence
  Synthetic
atccacgccggttgagtcgcgttctgccgcctcccgcctgtggtgcctcctgaactgcgtccgccgtctaggtaa

SEQ ID NO: 277005 - DNA, 75 bp, Artificial Sequence
  Synthetic
cctttggccggcgctcccttggagcctacctagactcagccggctctccacgctttgcctgaccctgcttgctca

SEQ ID NO: 277006 - DNA, 75 bp, Artificial Sequence
  Synthetic
gttctgcgccgctacagatcgaaagttccacccctttccctttcattcacgactgactgccggcttggcccacgg

SEQ ID NO: 277007 - DNA, 75 bp, Artificial Sequence
  Synthetic
cggagccagcgacagcccattctatagcactctccaggagagaaacttagtacacagttgggggctcgtccggga

SEQ ID NO: 277008 - DNA, 75 bp, Artificial Sequence
  Synthetic
acctggcccctcctgccccacgtgattttttgccaccccggccagctcggggccttcctcaccaatgttccctac

SEQ ID NO: 277009 - DNA, 75 bp, Artificial Sequence
  Synthetic
tacgagcgcccctttattccctaggcaatgggccaaatcttttcccgtagcgctagccctattccgcggccgccc

SEQ ID NO: 277010 - DNA, 75 bp, Artificial Sequence
  Synthetic
aatattaccaattcccatgtctcaataatacaagaaagacccccccttgagaatcgagtcctcactggctggggc

SEQ ID NO: 277011 - DNA, 75 bp, Artificial Sequence
  Synthetic
cgggggctggccgctcatcactggcttaacttcctccaagcggcatatcgcctagaacccggtccctccagttac

SEQ ID NO: 277012 - DNA, 75 bp, Artificial Sequence
  Synthetic
cttaactgggaccttggcctttcacagtgggctcgagaggccttacaaactgggatcacccttgttgcactactc

SEQ ID NO: 277013 - DNA, 75 bp, Artificial Sequence
  Synthetic
gcatcctccgtcagctacgacacctcccctcgcgcgtcagatacccccattattctcttataaaccctgagtcgt

SEQ ID NO: 277014 - DNA, 75 bp, Artificial Sequence
  Synthetic
ctcctagccagcctactcccaaaaggataccccggccgggtgaatgaaattttacacatactcatccaaacccaa

SEQ ID NO: 277015 - DNA, 75 bp, Artificial Sequence
  Synthetic
ccctgtaaaccacgcacatagttattgcaaccacatcgcctccagcctcccctgccaataattaacctctcccac

SEQ ID NO: 277016 - DNA, 75 bp, Artificial Sequence
  Synthetic
gcccagatcccgtcccgtcccgcgccaccgccgccgtcatcccccacccacgaccccccggattctgatccacaa

SEQ ID NO: 277017 - DNA, 75 bp, Artificial Sequence
  Synthetic
caccgccgccgtcatcccccacccacgaccccccggattctgatccacaaatcccccctccctatgttgagccta

SEQ ID NO: 277018 - DNA, 75 bp, Artificial Sequence
  Synthetic
caaatcctccttctcctgcagcagcctcctccgctcggcctccaaggactccacctcgtcttccaactgtctagt

SEQ ID NO: 277019 - DNA, 75 bp, Artificial Sequence
  Synthetic
atcccccctccctatgttgagcctacggccccccaagtccttccagtcatgcacccacatggtgcccctcccaac

SEQ ID NO: 277020 - DNA, 75 bp, Artificial Sequence
  Synthetic
aacatccccatttctctactttttaacgaaaaagaggcagatgacaatgaccacgagccccaaatatcccccggg

SEQ ID NO: 277021 - DNA, 75 bp, Artificial Sequence
  Synthetic
catcgcccatggcaaatgaaagacctacaggccattaagcaagaagtctcccaagcagcccctgggagcccccag

SEQ ID NO: 277022 - DNA, 75 bp, Artificial Sequence
  Synthetic
atagccgtcaacccccaactcccgcattttttctctcctagcactatttcgttccgccttctcagcctcttgtct

SEQ ID NO: 277023 - DNA, 75 bp, Artificial Sequence
  Synthetic
ccttgctattcgccatactacccatgtcccctacaatccaaccagctcaggacttgtagaacgctctaatggcat

SEQ ID NO: 277024 - DNA, 75 bp, Artificial Sequence
  Synthetic
ccacttgcgctcacggcgctcctgctcttcccgctttctccgggcgaagtccgcggccttcttctccgcccgctc

SEQ ID NO: 277025 - DNA, 75 bp, Artificial Sequence
  Synthetic
gcctcccagtgaaaaacatttccgcgaaacagaagtctgaaaaggtcagggcccagactaaggctctgacgtcta

SEQ ID NO: 277026 - DNA, 75 bp, Artificial Sequence
  Synthetic
agacctccaagacctcctgcagtacctttgctcctccctcgtggcttccctccatcaccagcagctagatagcct

SEQ ID NO: 277027 - DNA, 75 bp, Artificial Sequence
  Synthetic
cttgcgccgagccctctcccctgccttccttctcaaatactcagcaatctgcttttcctcctctttctcccgctc

SEQ ID NO: 277028 - DNA, 75 bp, Artificial Sequence
  Synthetic
tctttttcgctttctcttctcttcagcctgtcgctgccgatcgcgatgcgtctcccctcgaggtggcgtttcctc

SEQ ID NO: 277029 - DNA, 75 bp, Artificial Sequence
  Synthetic
attacaggttataaccccttagccggtcccctccgtgtccaagccaacaatccacaacaacaaggattaaggcga

SEQ ID NO: 277030 - DNA, 75 bp, Artificial Sequence
  Synthetic
ccctagaagaccccgtcgcagccgaccacggctttcctcttctagagatagcagaccgtcaagcacagcttcctc

SEQ ID NO: 277031 - DNA, 75 bp, Artificial Sequence
  Synthetic
ccttcgccgccctgccagggagtgccaaagacccttcctgggcctctatcctccaaggcctggaggagccttacc

SEQ ID NO: 277032 - DNA, 75 bp, Artificial Sequence
  Synthetic
caaagacccttcctgggcctctatcctccaaggcctggaggagccttaccacgccttcgtagaacgcctcaacat

SEQ ID NO: 277033 - DNA, 75 bp, Artificial Sequence
  Synthetic
ctcctccctgttccttatctcttcctccaaggataatagcccgtccaccaagtcctccaccagcagatcctccgg

SEQ ID NO: 277034 - DNA, 75 bp, Artificial Sequence
  Synthetic
agtcctccaccagcagatcctccgggcaaggagcatgcaaacatcgaaatagccctgcaaatacaaagttaatca

SEQ ID NO: 277035 - DNA, 75 bp, Artificial Sequence
  Synthetic
caaagaatgccaaaaattactacaggcccgaggacacactaatagccctctaggagatatgttgcgggcttgtca

SEQ ID NO: 277036 - DNA, 75 bp, Artificial Sequence
  Synthetic
atacccagtctacgtgtttggagactgtgtacaaggcgactggtgccccatctctgggggacttcgttcggcccg

SEQ ID NO: 277037 - DNA, 75 bp, Artificial Sequence
  Synthetic
taggagatatgttgcgggcttgtcagacctggacccccaaagacaaaaccaaagtgttagttgtccagcctaaaa

SEQ ID NO: 277038 - DNA, 75 bp, Artificial Sequence
  Synthetic
aaagtgttagttgtccagcctaaaaaaccccccccaaatcagccgtgcttccggtgcgggaaagcaggccactgg

SEQ ID NO: 277039 - DNA, 75 bp, Artificial Sequence
  Synthetic
cctacatcgtcacgccctactggccacctgtccagagcatcagatcacctgggaccccgtcgacggacgcgttat

SEQ ID NO: 277040 - DNA, 75 bp, Artificial Sequence
  Synthetic
tagggggggaggtttaacctccccccccacattacagcaagtccttcttaaccaagacccagcatctattctgcc

SEQ ID NO: 277041 - DNA, 75 bp, Artificial Sequence
  Synthetic
gatcaggccctacagcccccctgccctaatctagtaagttactccagctaccatgccacctattccctatatcta

SEQ ID NO: 277042 - DNA, 75 bp, Artificial Sequence
  Synthetic
agagaacctctaagaccctcaaggtccttaccccgccgaccactcatacaacccccaacattccaccctccttcc

SEQ ID NO: 277043 - DNA, 75 bp, Artificial Sequence
  Synthetic
tgccctcctattagacctccccgctgacatcccacacccaaaaaactccatagggggggaggtttaacctccccc

SEQ ID NO: 277044 - DNA, 75 bp, Artificial Sequence
  Synthetic
acccttgggcgacacctcccaaccctgtcttttccagaccccggcctcctgccccaaaacctgcacaccctctgg

SEQ ID NO: 277045 - DNA, 75 bp, Artificial Sequence
  Synthetic
agttataccgttagatcccgcccgtcggcccgtaattaaagcccaggttgacacccagaccagccacccaaagac

SEQ ID NO: 277046 - DNA, 75 bp, Artificial Sequence
  Synthetic
tttcagcaagatgtcaattttactcaagaagtttcacgcctcaatattaatctccatttttcgaaatgcggtttt

SEQ ID NO: 277047 - DNA, 75 bp, Artificial Sequence
  Synthetic
tatcgaagctttactagatacaggagcagacatgacagtccttccgatagccttgttctcaagtaatactcccct

SEQ ID NO: 277048 - DNA, 75 bp, Artificial Sequence
  Synthetic
gcgaatggaagaactcctctataaaatttcccttaccacaggggccctaataattttacccgaagactgtttgcc

SEQ ID NO: 277049 - DNA, 75 bp, Artificial Sequence
  Synthetic
atttcccttaccacaggggccctaataattttacccgaagactgtttgcctaccacccttttccagcctgctagg

SEQ ID NO: 277050 - DNA, 75 bp, Artificial Sequence
  Synthetic
attgttttaacatcttgcctagttgataccaaaaacaactgggccatcataggtcgcgatgccttacaacaatgc

SEQ ID NO: 277051 - DNA, 75 bp, Artificial Sequence
  Synthetic
aaccctcaccactcaaggccttatttggacatttaccgatggcacgcctatgatttccggaccctgccccaaaga

SEQ ID NO: 277052 - DNA, 75 bp, Artificial Sequence
  Synthetic
tcaaatataaaaatacactgtatcgccttcatgtatgggtagacaccttttcaggagccatctcagctacccaaa

SEQ ID NO: 277053 - DNA, 75 bp, Artificial Sequence
  Synthetic
tggccagccatctttagtactgcagtcctcctcctttatatttcacaagtttcaaaccaaggcctaccacccttc

SEQ ID NO: 277054 - DNA, 75 bp, Artificial Sequence
  Synthetic
atttctactctcacacggcctcatacagtactcttcctttcacaatttacatctcctttttgaagaatacaccaa

SEQ ID NO: 277055 - DNA, 75 bp, Artificial Sequence
  Synthetic
atctcctttttgaagaatacaccaacatccccatttctctactttttaacgaaaaagaggcaaatgaccatgacc

SEQ ID NO: 277056 - DNA, 75 bp, Artificial Sequence
  Synthetic
ggaaataacccagtattcccagttaaaaaggccaatggaacctggcgattcatccacgacctgcgggccactaac

SEQ ID NO: 277057 - DNA, 75 bp, Artificial Sequence
  Synthetic
cagcctgccaactacactagcccacttgcaaactatagaccttaaagacgcctttttccaaatccccttacctaa

SEQ ID NO: 277058 - DNA, 75 bp, Artificial Sequence
  Synthetic
cctttttccaaatccccttacctaaacagttccagccctactttgctttcactgtcccacagcagtgtaactacg

SEQ ID NO: 277059 - DNA, 75 bp, Artificial Sequence
  Synthetic
gccccggcactagatacgcctggaaggtactaccccaagggtttaaaaatagtcccaccctgttcgaaatgcagc

SEQ ID NO: 277060 - DNA, 75 bp, Artificial Sequence
  Synthetic
gcaaagcattacaagaacagtgctgttttctaaatattactaattcccatgtctcaatactacaagaaagacccc

SEQ ID NO: 277061 - DNA, 75 bp, Artificial Sequence
  Synthetic
cttcagtacatggatgacattctcctggcaagcccctcccatgaggacctactactactctcagaggccacaatg

SEQ ID NO: 277062 - DNA, 75 bp, Artificial Sequence
  Synthetic
ctgtgtccgaaaacaaaacccagcaaacccctggaacaattaagttcctagggcaaataatttcacccaaccacc

SEQ ID NO: 277063 - DNA, 75 bp, Artificial Sequence
  Synthetic
cttgttccttaaagtgcccatacctggggtgccaatcatggacctgtccctataaatgcggttttcccttctccc

SEQ ID NO: 277064 - DNA, 75 bp, Artificial Sequence
  Synthetic
cctgaacttcaagccctacttggcgagattcagtgggtctccaagggaactcctaccttacgccagccccttcac

SEQ ID NO: 277065 - DNA, 75 bp, Artificial Sequence
  Synthetic
agtctctactgtgccttacaaaggcatactgatccccgagaccaaatatatttaaatccttctcaagttcaatca

SEQ ID NO: 277066 - DNA, 75 bp, Artificial Sequence
  Synthetic
accggcgactttactggctcggagccagcgacagcctattccataacactctccaggagagaaatttagtacaca

SEQ ID NO: 277067 - DNA, 75 bp, Artificial Sequence
  Synthetic
ttagtgcagctgcggcaggccctgtcacagaactgccgcagtagactagtccaaaccctgcccctcctaggggct

SEQ ID NO: 277068 - DNA, 75 bp, Artificial Sequence
  Synthetic
cacagaactgccgcagtagactagtccaaaccctgcccctcctaggggctattatgctgaccctcactggcacca

SEQ ID NO: 277069 - DNA, 75 bp, Artificial Sequence
  Synthetic
ccaaaccctgcccctcctaggggctattatgctgaccctcactggcaccactactgtagtgttccagtccaagca

SEQ ID NO: 277070 - DNA, 75 bp, Artificial Sequence
  Synthetic
cccgcctcctgcgccgtgccttctcctcttccttccttttcaaatactcagcaatctgcttttcctcctctttct

SEQ ID NO: 277071 - DNA, 75 bp, Artificial Sequence
  Synthetic
gcaacgtcagcggccttcttctccgcccgcctcctgcgccgtgccttctcctcttccttccttttcaaatactca

SEQ ID NO: 277072 - DNA, 75 bp, Artificial Sequence
  Synthetic
gcagtggccacttgtctggctacatgcccccctaccccacactagccagtgcccctgggggcagctacttgcctc

SEQ ID NO: 277073 - DNA, 75 bp, Artificial Sequence
  Synthetic
agctgtgttattactcgacaaatacaccttgcaatcctatgggctactctgccaaaccatacatcataacatctc

SEQ ID NO: 277074 - DNA, 75 bp, Artificial Sequence
  Synthetic
accttgcaatcctatgggctactctgccaaaccatacatcataacatctccacccaaaccttcaaccaattcatt

SEQ ID NO: 277075 - DNA, 75 bp, Artificial Sequence
  Synthetic
ctttttcccctggagggccccgtcgcagccggccgcggcgttcctcttctaaggacagcaaaccgtcaagcacag

SEQ ID NO: 277076 - DNA, 75 bp, Artificial Sequence
  Synthetic
cctgtcataactccctcatcctgccccccttttccttgtcacctgttcccaccctaggatcccgctcccgccgag

SEQ ID NO: 277077 - DNA, 75 bp, Artificial Sequence
  Synthetic
gaaagccctcatgccagtgtttactctttccccggtgatcataaacaccgccccctgcctgttttcagacggatc

SEQ ID NO: 277078 - DNA, 75 bp, Artificial Sequence
  Synthetic
tgggacaagcatatattgtcacaaagatcattcccccttccgccaccgcacaagtcggcccaacgggccgaactt

SEQ ID NO: 277079 - DNA, 75 bp, Artificial Sequence
  Synthetic
ctcggacttttgcatggcctctccagcgcccgttcgtggcgctgtctcaacatatttctagactccaagtatctt

SEQ ID NO: 277080 - DNA, 75 bp, Artificial Sequence
  Synthetic
catatttctagactccaagtatctttatcattaccttcggacccttgccctaggcaccttccaaggcaggtcctc

SEQ ID NO: 277081 - DNA, 75 bp, Artificial Sequence
  Synthetic
tatcattaccttcggacccttgccctaggcaccttccaaggcaggtcctctcaggccccctttcaggccctcctg

SEQ ID NO: 277082 - DNA, 75 bp, Artificial Sequence
  Synthetic
tcaggccccctttcaggccctcctgccccgcttactatcgcgtaaggtcgtctatttgcaccacgttcgcagcca

SEQ ID NO: 277083 - DNA, 75 bp, Artificial Sequence
  Synthetic
taccaatctacctgatcccatctccaggctcaacgctctcacagatgccctactaatcacccctgtcctgcagct

SEQ ID NO: 277084 - DNA, 75 bp, Artificial Sequence
  Synthetic
cattgcaaggggcaaccacaactgaggcttccaatatcctgcgctcttgccacgcctgccgcaaaaataacccac

SEQ ID NO: 277085 - DNA, 75 bp, Artificial Sequence
  Synthetic
tcaggagccatctcagctacccaaaagagaaaagaaacaagctcagaagctatttcctctttgcttcaggccatt

SEQ ID NO: 277086 - DNA, 75 bp, Artificial Sequence
  Synthetic
gcctatctaggcaagcctagctacataaacacagacaacggccctgcctatatttcccaagacttcctcaatatg

SEQ ID NO: 277087 - DNA, 75 bp, Artificial Sequence
  Synthetic
cgtcgctgccgatcacgatgcgtttccccgcgaggtggcgctttctcccctggagggccccgtcgcagccggccg

SEQ ID NO: 277088 - DNA, 75 bp, Artificial Sequence
  Synthetic
ctacccatgtcccctacaatccaaccagctcaggacttgtagaacgctctaatggcattcttaaaccctattata

SEQ ID NO: 277089 - DNA, 75 bp, Artificial Sequence
  Synthetic
ctacccatggataatgctctatccatagccctatggacaatcaaccacctgaatgtgttaaccaactgccacaaa

SEQ ID NO: 277090 - DNA, 75 bp, Artificial Sequence
  Synthetic
acccgatggcagcttcaccactccccccgactccagccgatcccagagacacattccctcagcaataaacaaacc

SEQ ID NO: 277091 - DNA, 75 bp, Artificial Sequence
  Synthetic
gctctgacgtctccccccggagggacagctcagcaccggctcaggctaggccctgacgtgtccccctgaagacaa

SEQ ID NO: 277092 - DNA, 75 bp, Artificial Sequence
  Synthetic
gtcttaatagccgccagtggaaaggaccacaggaggctctccaagaagctgccggcgctgctctcatcccggtaa

SEQ ID NO: 277093 - DNA, 75 bp, Artificial Sequence
  Synthetic
gtacaaggcgactggtgccccatctctgggggactatgttcggcccgcctacatcgtcacgccctactggccacc

SEQ ID NO: 277094 - DNA, 75 bp, Artificial Sequence
  Synthetic
gccggcgctgctctcatcccggtaagcgctagttctgcccagtggatcccgtggagactcctcaagcgagctgca

SEQ ID NO: 277095 - DNA, 75 bp, Artificial Sequence
  Synthetic
gcgctagttctgcccagtggatcccgtggagactcctcaagcgagctgcatgcccaagacccgtcggaggccccg

SEQ ID NO: 277096 - DNA, 75 bp, Artificial Sequence
  Synthetic
aaacttttcatggcacgcatatggctgaataaactaacaggagtctataaaagcgtggagacagttcaggagggg

SEQ ID NO: 277097 - DNA, 75 bp, Artificial Sequence
  Synthetic
ccgatcccaaagaaaaagaccaccaacaccatgggtaagtttctcgccactttgattttattcttccagttctgc

SEQ ID NO: 277098 - DNA, 75 bp, Artificial Sequence
  Synthetic
cccctcatcctcggtgattacagccccagctgctgtactctcacaattggagtctcctcataccactctaaaccc

SEQ ID NO: 277099 - DNA, 75 bp, Artificial Sequence
  Synthetic
atatctattccctcattggactaaaaagccaaaccgaaatggcggaggctattattcagcctcttattcagaccc

SEQ ID NO: 277100 - DNA, 75 bp, Artificial Sequence
  Synthetic
aagccaaaccgaaatggcggaggctattattcagcctcttattcagacccttgttccttaaagtgcccataccta

SEQ ID NO: 277101 - DNA, 75 bp, Artificial Sequence
  Synthetic
gttggctcggagccagcgacagcccattctatagcactctccaggagagaaacttagtacacagttgggggctcg

SEQ ID NO: 277102 - DNA, 75 bp, Artificial Sequence
  Synthetic
ttctacccgaagactgtttgcccaccacccttttccagcctgttagggcacccgtcacgctaacagcctggcaaa

SEQ ID NO: 277103 - DNA, 75 bp, Artificial Sequence
  Synthetic
cggttttcccttctcccttctagtcgacgctccaggatatgaccccatctggttccttaataccgaacccagcca

SEQ ID NO: 277104 - DNA, 75 bp, Artificial Sequence
  Synthetic
gacgctccaggatatgaccccatctggttccttaataccgaacccagccaactgcctcccaccgcccctcctcta

SEQ ID NO: 277105 - DNA, 75 bp, Artificial Sequence
  Synthetic
tcctcgagccctctataccatggaaatcaaaactcctgacccttgtccagttaaccctacaaagcactaattata

SEQ ID NO: 277106 - DNA, 75 bp, Artificial Sequence
  Synthetic
aaaccaaggcctaccacccctcatttctactctcacacggcctcatacagtactcttcctttcataatttacatc

SEQ ID NO: 277107 - DNA, 75 bp, Artificial Sequence
  Synthetic
ttaaccctacaaagcactaattatacttgcattgtctgtatcgatcgtgccagcctatccacttggcacgtccta

SEQ ID NO: 277108 - DNA, 75 bp, Artificial Sequence
  Synthetic
tcctgtttgaagaatacaccaacatccccatttctctactttttaacgaaaaagaggcagatgacaatgaccatg

SEQ ID NO: 277109 - DNA, 75 bp, Artificial Sequence
  Synthetic
tactctcccaacgtctctgttccatcctcttcttctacccccctcctttacccatcgttagcgcttccagccccc

SEQ ID NO: 277110 - DNA, 75 bp, Artificial Sequence
  Synthetic
aaaaaccccccccaaatcagccgtgcttccggtgcgggaaagcaggccactggagccgagactgcactcagcctc

SEQ ID NO: 277111 - DNA, 75 bp, Artificial Sequence
  Synthetic
atcccgctcccgccgagcggtaccggtggcagtctggcttgtctccgccctggccatgggagccggggtggctgg

SEQ ID NO: 277112 - DNA, 75 bp, Artificial Sequence
  Synthetic
cggggttaccggccccatgtccctcgcctcaggaaagagcctcttacatgaggtagacaaagatatttcccaatt

SEQ ID NO: 277113 - DNA, 75 bp, Artificial Sequence
  Synthetic
aagccgccctcaggcgttgacgacaacccctcacctcaaaaaacttttcatggcacgcatatggctgaataaact

SEQ ID NO: 277114 - DNA, 75 bp, Artificial Sequence
  Synthetic
atgctgcccagaacagacgaggccttgatctcctgttctgggagcaaggaggattatgcaaagcattacaagaac

SEQ ID NO: 277115 - DNA, 75 bp, Artificial Sequence
  Synthetic
tgatctcctgttctgggagcaaggaggattatgcaaagcattacaagaacagtgctgttttctaaatattactaa

SEQ ID NO: 277116 - DNA, 75 bp, Artificial Sequence
  Synthetic
tgactggctggggccttaactgggaccttggcctctcacagtgggctcgagaggccttacaaactggaatcaccc

SEQ ID NO: 277117 - DNA, 75 bp, Artificial Sequence
  Synthetic
ccttggcctctcacagtgggctcgagaggccttacaaactggaatcacccttgtcgcgctactccttcttgttat

SEQ ID NO: 277118 - DNA, 75 bp, Artificial Sequence
  Synthetic
ccttgcaggaccatgcatcctccgtcagctacgacacctcccctcgcgcgtcagatacccccattactctcttat

SEQ ID NO: 277119 - DNA, 75 bp, Artificial Sequence
  Synthetic
taccggcgactccgttggctcggagccagcgacagcccattctatagcactctccaggagagaaacttagtacac

SEQ ID NO: 277120 - DNA, 75 bp, Artificial Sequence
  Synthetic
cacggcgctcctgctcttcctgttttctccgggcgacgtcagcggcctttttctccggccgcctcctgcgccgtg

SEQ ID NO: 277121 - DNA, 75 bp, Artificial Sequence
  Synthetic
tctttctcccgctctttttttcgcttcctcttctcctcagcccgtcgctgccgatcacgatgcgtttccccgcga

SEQ ID NO: 277122 - DNA, 75 bp, Artificial Sequence
  Synthetic
atcgaaagttccacccctttccctttcattcacgactgactgccggcttggcccacggccaagtaccggcgactc

SEQ ID NO: 277123 - DNA, 75 bp, Artificial Sequence
  Synthetic
agcacagcttcctcctcctccttgtcctttaactcttcctccaaggataatagcccgtccaccaattcctccacc

SEQ ID NO: 277124 - DNA, 75 bp, Artificial Sequence
  Synthetic
tacaaagttaaccatgcttattatcagcccacttcccagggtttggacagagtcttcttttcggatacccagtct

SEQ ID NO: 277125 - DNA, 75 bp, Artificial Sequence
  Synthetic
tgatactgaccatgaacccgaaatgtttcccgagggcctggagcctcccggtaaaaaacatttccgcgaaacaga

SEQ ID NO: 277126 - DNA, 75 bp, Artificial Sequence
  Synthetic
tacagttccttatccctcgactcccctccttccccacccagagaacctctaagaccctcaaggtccttaccccgc

SEQ ID NO: 277127 - DNA, 75 bp, Artificial Sequence
  Synthetic
ctccttccccacccagagaacctctaagaccctcaaggtccttaccccgccaatcactcatacaacccccaacat

SEQ ID NO: 277128 - DNA, 75 bp, Artificial Sequence
  Synthetic
agtctgaaaaggtcagggcccagactagggctctgacgtctgcccccggagagacagctcagccctgggtcagac

SEQ ID NO: 277129 - DNA, 75 bp, Artificial Sequence
  Synthetic
gatggacgcgttatcggctcagctctacagttccttatccctcgactcccctccttccccacccagagaacctct

SEQ ID NO: 277130 - DNA, 75 bp, Artificial Sequence
  Synthetic
tgggccctgacgtatccccctaaagacaagtcacaagcccaaaagccgccgggaaccacccatttcctccccatg

SEQ ID NO: 277131 - DNA, 75 bp, Artificial Sequence
  Synthetic
tttgtcaagacgtccccgggcgttgacgacaacccctcacctcaaaaaacttttcatggcacgcatactgcttaa

SEQ ID NO: 277132 - DNA, 75 bp, Artificial Sequence
  Synthetic
tgtctgcatgtacctctaccagctttccccccccatcacctggcccctcctgccccacgtgattttttgccaccc

SEQ ID NO: 277133 - DNA, 75 bp, Artificial Sequence
  Synthetic
taaaacagcaggagtctataaaagcgtggagacagttcaggagggggctcgcctttttccctcacgcgcctgccg

SEQ ID NO: 277134 - DNA, 75 bp, Artificial Sequence
  Synthetic
tgccccacgtgattttttgccaccccggccagctcggggccttcctcaccaatgttccctacaagcgaatagaag

SEQ ID NO: 277135 - DNA, 75 bp, Artificial Sequence
  Synthetic
ccctacctgaggccgccatccacgccggtcgagtcgcgcttggtcgcctcccgcctgtggtgcctcctgaactgc

SEQ ID NO: 277136 - DNA, 75 bp, Artificial Sequence
  Synthetic
gtccgccgtctaggtaagtctggagctcaggtcgagaccgggcctttgtccggcgctcccttggagcccacctag

SEQ ID NO: 277137 - DNA, 75 bp, Artificial Sequence
  Synthetic
caacgcctattattttaacatcgtgcctagttgataccaaaaacaactgggccatcataggtcgtgatgccttac

SEQ ID NO: 277138 - DNA, 75 bp, Artificial Sequence
  Synthetic
gctcggccggctctccacgctttgcccgaccctgcttgctcaaatccacgtctttgtttcgttttctgttccgcg

SEQ ID NO: 277139 - DNA, 75 bp, Artificial Sequence
  Synthetic
cttccgttccactcaaccctcaccactccaggccttatttggacatttaccgatggcacgcctatgatttccggg

SEQ ID NO: 277140 - DNA, 75 bp, Artificial Sequence
  Synthetic
ccctgccctaaagatggccagccatctttagtactacagtcctcctcctttatatttcacaaatttcaaaccaag

SEQ ID NO: 277141 - DNA, 75 bp, Artificial Sequence
  Synthetic
ccgccgctaatcgaaagttccacccctttccctttcactcacgtccgactacccggttggcccacggccaagccc

SEQ ID NO: 277142 - DNA, 75 bp, Artificial Sequence
  Synthetic
cggcaccttcactggctcggagccagtaatagtctattctataactctctccaggagagaaatttagtacacagt

SEQ ID NO: 277143 - DNA, 75 bp, Artificial Sequence
  Synthetic
ctcatcatcttcccccgggccccctgacttgtccagcctgccaactacactagcccacttgcaaactatagacct

SEQ ID NO: 277144 - DNA, 75 bp, Artificial Sequence
  Synthetic
tgggggctcgtccgggatttgagcgcccctctattctctaggcaatgggccaaatattcccccgtatcactagcc

SEQ ID NO: 277145 - DNA, 75 bp, Artificial Sequence
  Synthetic
ccattccgcggccgccccgggggctggccgctcaccactggcttaattttcttcaggcagcatatcgcttagagc

SEQ ID NO: 277146 - DNA, 75 bp, Artificial Sequence
  Synthetic
ccggtccttccagttacgatttccatcagttaaagcagtttcttaaaatggccttagagacgccagtctggatgt

SEQ ID NO: 277147 - DNA, 75 bp, Artificial Sequence
  Synthetic
gtcccatcgactactccctcctagctagtctactcccgaaaggtaccccggccgggtaaatgaaattttacacat

SEQ ID NO: 277148 - DNA, 75 bp, Artificial Sequence
  Synthetic
acttattcaaacccaggcccagagcccgtcccgccccgcgccgccgccgccgtcacctcccacccacagcccccc

SEQ ID NO: 277149 - DNA, 75 bp, Artificial Sequence
  Synthetic
agattccgatccgcaaatcccccctccctacattgagcctacggccccccaggtccttccagtcatgcacccgca

SEQ ID NO: 277150 - DNA, 75 bp, Artificial Sequence
  Synthetic
tggtgcccctcctagccaccgtccatggcaaatgaaagacctacaggccattaaacaggaggtctcccaggcagc

SEQ ID NO: 277151 - DNA, 75 bp, Artificial Sequence
  Synthetic
ccctgggagcccccagtttatgcaaactgtcaggcttgcggtacagcagtttgaccccactgccaaggacctcca

SEQ ID NO: 277152 - DNA, 75 bp, Artificial Sequence
  Synthetic
ggacctcctgcaatacctttgctcctccctggtggcttccctccatcaccaacagctagatagccttatgtcaga

SEQ ID NO: 277153 - DNA, 75 bp, Artificial Sequence
  Synthetic
agccgagactcgaggtattacaggctataaccccttggctggccccctccgtgtccaggcaaataacccacaaca

SEQ ID NO: 277154 - DNA, 75 bp, Artificial Sequence
  Synthetic
acaaggattaaggcgagaataccagcaactctggctcgctgccttttccgccctgccagggagcgctaaagaccc

SEQ ID NO: 277155 - DNA, 75 bp, Artificial Sequence
  Synthetic
cccccggagggacagctcagcaccggctcaggctaggccctgacgtgtccccctgaagacaaatcataagctcag

SEQ ID NO: 277156 - DNA, 75 bp, Artificial Sequence
  Synthetic
ccctgaagacaaatcataagctcagacctccgggaagccaccggaaccacccatttcctccccatgtttgtcaag

SEQ ID NO: 277157 - DNA, 75 bp, Artificial Sequence
  Synthetic
ttcctgggcctctatcctccaaggcctggaagagccttaccacgcctttgtagaacgcctcaatgtagcccttga

SEQ ID NO: 277158 - DNA, 75 bp, Artificial Sequence
  Synthetic
taacggactgccagaaggcacgcccaaagaccctattttacgctccttagcctactccaatgcaaataaggagtg

SEQ ID NO: 277159 - DNA, 75 bp, Artificial Sequence
  Synthetic
aggagtctataaaagcgtggagacagttcaggagggggctcgcatctctccttcacgcgcccgccgccctacctg

SEQ ID NO: 277160 - DNA, 75 bp, Artificial Sequence
  Synthetic
ccaaaaattactacaggctcgaggacacaccaatagtcctctaggagatatgctgcgggcttgtcaggcctggac

SEQ ID NO: 277161 - DNA, 75 bp, Artificial Sequence
  Synthetic
ccccaaagacaaaaccaaagtgctagttatccagcccaaaaaaccccccccaaatcagccatgtttccggtgcgg

SEQ ID NO: 277162 - DNA, 75 bp, Artificial Sequence
  Synthetic
gtgcctcctgaactgcgtccgccgtctaggtaagttcagagctcaggtcgagaccgggcctttgtccggcgctcc

SEQ ID NO: 277163 - DNA, 75 bp, Artificial Sequence
  Synthetic
aaaagcaggccactggagccgggactgcactcaacctcgtcctccccccgggccatgccccctctgtcaggaccc

SEQ ID NO: 277164 - DNA, 75 bp, Artificial Sequence
  Synthetic
aactcactggaagcgggactgtcctcgcctaaagcccaccaccccagaaccagagccagaagaagacgccctcct

SEQ ID NO: 277165 - DNA, 75 bp, Artificial Sequence
  Synthetic
attagacctccccactgacatcccacacccaaaaaactccatagggggggaggtctaacctcccccctcacgtca

SEQ ID NO: 277166 - DNA, 75 bp, Artificial Sequence
  Synthetic
cggcaggaccattccaacggagacccagcacatattctgccagtaataccgttagatcccgcccggcgcccctaa

SEQ ID NO: 277167 - DNA, 75 bp, Artificial Sequence
  Synthetic
ttaaggcccaagtggacacccagaccaatggcccaaaaaccatcgaagcgttactagatacgggggcggacatga

SEQ ID NO: 277168 - DNA, 75 bp, Artificial Sequence
  Synthetic
cggtccttccaatagccctattctcaaataacaccccccttaaaaacacatctgtactaggggcaggaggccaaa

SEQ ID NO: 277169 - DNA, 75 bp, Artificial Sequence
  Synthetic
aaataacaccccccttaaaaacacatctgtactaggggcaggaggccaaactcaagatcactttaagctcacctc

SEQ ID NO: 277170 - DNA, 75 bp, Artificial Sequence
  Synthetic
ccttccggtgctaatacgcctccctttccggacaacgcctattgttttaacatcttgcctagtcgatactaaaaa

SEQ ID NO: 277171 - DNA, 75 bp, Artificial Sequence
  Synthetic
caactgggccatcataggtcgtgacgccttacaacaatgccaaggcgtcctatatcttcccgaggcaaaggggcc

SEQ ID NO: 277172 - DNA, 75 bp, Artificial Sequence
  Synthetic
gtctgtcatcttaccaatacagacgccagccgtccttgggctagagcacctcccgaagccccccgaaattggcca

SEQ ID NO: 277173 - DNA, 75 bp, Artificial Sequence
  Synthetic
gttccctttaaaccggaacgcctccaggccttgcaacatctggtccggaaggccctggaggcaggccatatcgaa

SEQ ID NO: 277174 - DNA, 75 bp, Artificial Sequence
  Synthetic
aggccttgcaacatctggtccggaaggccctggaggcaggccatatcgaaccctatgccgggccaggaaataacc

SEQ ID NO: 277175 - DNA, 75 bp, Artificial Sequence
  Synthetic
cagtattcccagttaaaaaggccaatggaacctggcgattcatccacgacctgcgggccaccaactctctgacca

SEQ ID NO: 277176 - DNA, 75 bp, Artificial Sequence
  Synthetic
tagacctctcatcatcttcccccgggccccctgatttgtctagcctaccaactacactagcttacttacaaacta

SEQ ID NO: 277177 - DNA, 75 bp, Artificial Sequence
  Synthetic
tagcccttaaggacgcctttttccaaatccccttgcctaaacaatttcagccctactttgcctttactgtcccac

SEQ ID NO: 277178 - DNA, 75 bp, Artificial Sequence
  Synthetic
aacaatgtaactacggcccaggcaccaggtacccctggagagtactaccccaagggtttaaaaatagtcctaccc

SEQ ID NO: 277179 - DNA, 75 bp, Artificial Sequence
  Synthetic
tgtttgaaatgcagttggctcatatcctgcagcccatccggcaagccttcccccaatgtattattcttcagtaca

SEQ ID NO: 277180 - DNA, 75 bp, Artificial Sequence
  Synthetic
tggatgatatccttttggcaagcccctcccgtgaagatctacaacaactctcggagaccacaatggcttccctaa

SEQ ID NO: 277181 - DNA, 75 bp, Artificial Sequence
  Synthetic
aatctcataagttacccgtgtcccaagacaaaacccaacaaccccccgggacaattaagtttttagggcaaataa

SEQ ID NO: 277182 - DNA, 75 bp, Artificial Sequence
  Synthetic
tttcacccaatcacatcacttacgacgcagtccccacggtacctatacggtcccgctgggcgctatcggaacatc

SEQ ID NO: 277183 - DNA, 75 bp, Artificial Sequence
  Synthetic
ccgtgcttccggtgcgggaaagcaggccactggagtcgggactgcactcagcctcgtcccccccccgggccatgc

SEQ ID NO: 277184 - DNA, 75 bp, Artificial Sequence
  Synthetic
aagccctactcggcgaaattcagtgggtctccaaaggaactcctaccttacgccagccccttcatagtctttact

SEQ ID NO: 277185 - DNA, 75 bp, Artificial Sequence
  Synthetic
cccctatgtcaagacccaactcactggaagcgagactgcccccgcctaaagcccactatcccagaaccagagcca

SEQ ID NO: 277186 - DNA, 75 bp, Artificial Sequence
  Synthetic
gtgccttacagggacatactgatccccgagaccaaatatatttaaatccttcccaggttcaatcattggtgcaat

SEQ ID NO: 277187 - DNA, 75 bp, Artificial Sequence
  Synthetic
gaggaagatgccctcctattagacctccccgctgacatcccacacccaaaaaactccatagggggggaggtttaa

SEQ ID NO: 277188 - DNA, 75 bp, Artificial Sequence
  Synthetic
tccccgctgacatcccacacccaaaaaactccatagggggggaggtttaacctccccccccacattacagcaagt

SEQ ID NO: 277189 - DNA, 75 bp, Artificial Sequence
  Synthetic
tacaacgggccctgtcacgaaactgccgcagtagattagtccaaactctgcctcctcctggggccatcatgctaa

SEQ ID NO: 277190 - DNA, 75 bp, Artificial Sequence
  Synthetic
ctctcactggcaccactactgtagtgttccagttcaagcagcaatggccgcttgtttggctacatgcccccctac

SEQ ID NO: 277191 - DNA, 75 bp, Artificial Sequence
  Synthetic
cccacactagccagtgcccctgggggcaactacttgcctcggccgtgttactactggacaaatacaccttacaat

SEQ ID NO: 277192 - DNA, 75 bp, Artificial Sequence
  Synthetic
cttatggactactctgccaaaccatacatcataacatctccatccaaaccttcaaccaatttatccaaacatctg

SEQ ID NO: 277193 - DNA, 75 bp, Artificial Sequence
  Synthetic
accacccaagcgttcctatcctgctgcaccacagccaccggtttaaaaacttgggtgcccaaacaggcgagcttt

SEQ ID NO: 277194 - DNA, 75 bp, Artificial Sequence
  Synthetic
ccctttccctttcattcacgactgactgccggcttggcccacggccaagtaccggcgactccgttggctcggagc

SEQ ID NO: 277195 - DNA, 75 bp, Artificial Sequence
  Synthetic
ggctcgcatctctccttcacgcgcccgccgccttacctgaggccgccatccacgccggttgagtcgcgttctgcc

SEQ ID NO: 277196 - DNA, 75 bp, Artificial Sequence
  Synthetic
ggaacacttttcctaaaacggctgcccccttggcccccgtaaaggccctcacgccagtgtttacccttcccccgt

SEQ ID NO: 277197 - DNA, 75 bp, Artificial Sequence
  Synthetic
cctagttgataccaaaaacaactgggccatcataggtcgtgatgccttacaacaatgccaaggcgtcctgtacct

SEQ ID NO: 277198 - DNA, 75 bp, Artificial Sequence
  Synthetic
aattataaataccgccccctgcctgttctcagacggatccacctcccgggcagcctatatcttttgggacaaaca

SEQ ID NO: 277199 - DNA, 75 bp, Artificial Sequence
  Synthetic
atcttgccaatacaggcgccagccgtccttgggctagaacacctcccaaggccccccgaaatcagccagttccct

SEQ ID NO: 277200 - DNA, 75 bp, Artificial Sequence
  Synthetic
tatattgtcacaaggatcattcccccttcagcctcctcacaagtcagcccaacaggctgagcttcttggacttat

SEQ ID NO: 277201 - DNA, 75 bp, Artificial Sequence
  Synthetic
cacccctttccctttcattcacgactgactgccggcttggcccacggccaagtaccggcaactctgctggctcgg

SEQ ID NO: 277202 - DNA, 75 bp, Artificial Sequence
  Synthetic
ttaaaccagaacgcctccaggccttgcaacacttggtccggaaggccctggaggcaggccatatcgaaccctaca

SEQ ID NO: 277203 - DNA, 75 bp, Artificial Sequence
  Synthetic
acatggcctctccagcgcccgtacgtggcattgtcttaacatattcttagactccaaatatctttatcattacct

SEQ ID NO: 277204 - DNA, 75 bp, Artificial Sequence
  Synthetic
tcggactctcgctttgggcaccttccaaggcaagtcttctcaggcccctttgcaagctctcctaccccgcctatt

SEQ ID NO: 277205 - DNA, 75 bp, Artificial Sequence
  Synthetic
atcacataaggtcatctatttgcaccacgttcgcagccataccgacctacctgatcccatttccaggctcaacgc

SEQ ID NO: 277206 - DNA, 75 bp, Artificial Sequence
  Synthetic
ccttacagacgccctattgatcacccctgtcctacaactctctcccgcccaactacacagtttcacccattgcgg

SEQ ID NO: 277207 - DNA, 75 bp, Artificial Sequence
  Synthetic
cctgtcctacaactctctcccgcccaactacacagtttcacccattgcggacaggcggctcttacattgcaaggg

SEQ ID NO: 277208 - DNA, 75 bp, Artificial Sequence
  Synthetic
gcctggaaggtgctaccccaagggtttaaaaatagtcccaccctgttcgaaatgcagctagcccatatcctgcag

SEQ ID NO: 277209 - DNA, 75 bp, Artificial Sequence
  Synthetic
gcaaccacaactgaggcctccaatatcctgcgctcttgccatgcctgccgcaaaaataacccacaacatcaaatg

SEQ ID NO: 277210 - DNA, 75 bp, Artificial Sequence
  Synthetic
ccccggggacacatccgccgcggcctacttcctaaccacatttggcaaggcgacgttacccatttcaagtacaaa

SEQ ID NO: 277211 - DNA, 75 bp, Artificial Sequence
  Synthetic
aatacactttatcgccttcatgtataggtagatactttttcaggggccatctcggctacccaaaaaaggagagaa

SEQ ID NO: 277212 - DNA, 75 bp, Artificial Sequence
  Synthetic
ccacaatggcttccctaatctcccatgggttgcctgtgtccgaaaacaaaacccagcaaacccctggaacaatta

SEQ ID NO: 277213 - DNA, 75 bp, Artificial Sequence
  Synthetic
cccacatggtgcccctcccaaccaccgcccatggcaaatgaaagacctacaggccattaagcaagaagtctccca

SEQ ID NO: 277214 - DNA, 75 bp, Artificial Sequence
  Synthetic
acaagctcagaggctatttcctccttactccaggctattgcccatctaggcaagcccagcaacataaataccgac

SEQ ID NO: 277215 - DNA, 75 bp, Artificial Sequence
  Synthetic
cgcccatggcaaatgaaagacctacaggccattaagcaagaagtctcccaagcggcccctggaagcccccagttt

SEQ ID NO: 277216 - DNA, 75 bp, Artificial Sequence
  Synthetic
aatggccctgcctacatttctcaagactttctcaatatgtgcacctcccttgccattcgccatactactcacgtc

SEQ ID NO: 277217 - DNA, 75 bp, Artificial Sequence
  Synthetic
ccttacaatccaaccagctcaggacttgtagagcgctctaatggcatccttaaaactctactatataagtacttt

SEQ ID NO: 277218 - DNA, 75 bp, Artificial Sequence
  Synthetic
gccgacagacccgacctacctatggataatgccttatccatagccctatggacaattaaccacctaaatgtacta

SEQ ID NO: 277219 - DNA, 75 bp, Artificial Sequence
  Synthetic
acccattgccacaaaacccgatggcaacttcaccactccccccggctgcagcccatcccggaggcacgctccccc

SEQ ID NO: 277220 - DNA, 75 bp, Artificial Sequence
  Synthetic
accagtaaacaaacccattggtattattttaaacttcctggtattaatagccgccagtggaaaggaccacaggag

SEQ ID NO: 277221 - DNA, 75 bp, Artificial Sequence
  Synthetic
tcttgacaatgggctgccagaaggcacgcccaaagaccccattttacgttccttagcctactctaatgcaaacaa

SEQ ID NO: 277222 - DNA, 75 bp, Artificial Sequence
  Synthetic
gcgctccaagaggccgccggcgcagctctcattccggtaagcgccaattccgcccagtggatcccgtggaggctc

SEQ ID NO: 277223 - DNA, 75 bp, Artificial Sequence
  Synthetic
cttaagcgagctgcatgcccaagacccgtcgaggaccccgccgatcccaaagaaagagaccatcaacaccatggg

SEQ ID NO: 277224 - DNA, 75 bp, Artificial Sequence
  Synthetic
cagtgttcctatcttactccaccacagtcaccgattcaaaaatttaggtgcccaaactggagaactttggaacac

SEQ ID NO: 277225 - DNA, 75 bp, Artificial Sequence
  Synthetic
taagtttcttgccactctgagtttattcctctggttctttccccccattctctgtgactatagccccagctgctg

SEQ ID NO: 277226 - DNA, 75 bp, Artificial Sequence
  Synthetic
gtgcgggaaagcaggccactggagtcgggactgcactcagcctcgtcctccccctgggccatgccccctatgtca

SEQ ID NO: 277227 - DNA, 75 bp, Artificial Sequence
  Synthetic
tactctcacaataggagtctcctcataccactctaaaccctgcaatcctgcccagccggtttgttcatggactct

SEQ ID NO: 277228 - DNA, 75 bp, Artificial Sequence
  Synthetic
tgcccccgcctaaagcccactatcccagaaccagagccagaggaggatgccctcctattagatctccccgccgac

SEQ ID NO: 277229 - DNA, 75 bp, Artificial Sequence
  Synthetic
cgacctgctggccctctcagcagatcaggccctacagcctccctgccctaatctggtaggttactccagctacca

SEQ ID NO: 277230 - DNA, 75 bp, Artificial Sequence
  Synthetic
tgccacctattccctatatttattccctcattggatcaaaaagccaaaccgaaatggcggaggttattattcggc

SEQ ID NO: 277231 - DNA, 75 bp, Artificial Sequence
  Synthetic
ctcttactcagatccttgctccctaaaatgcccatacctagggtgccaatcatggacctgcccctacacaggggc

SEQ ID NO: 277232 - DNA, 75 bp, Artificial Sequence
  Synthetic
cgtttccagcccctactggagattcaaacaagatgtcaattttactcaggaggtttcactctttaatatttatct

SEQ ID NO: 277233 - DNA, 75 bp, Artificial Sequence
  Synthetic
tcatttttcaaaatgcggtttctccttctcccttctggtggatgcaccaggatatgaccccatctggttccttaa

SEQ ID NO: 277234 - DNA, 75 bp, Artificial Sequence
  Synthetic
tactgaacccagccaattaccccccactgcccctcctctgctcccccactccaacttagaccatatcctcgagcc

SEQ ID NO: 277235 - DNA, 75 bp, Artificial Sequence
  Synthetic
ttccataccatggaaatcaaaactcctaactcttgtccaactaaccctacaaagcactaattacacttgcattgt

SEQ ID NO: 277236 - DNA, 75 bp, Artificial Sequence
  Synthetic
ctgtatagatcgtgctagcttatccacctggcacgtcctatactctcccaatatctctgttccatcctcttccac

SEQ ID NO: 277237 - DNA, 75 bp, Artificial Sequence
  Synthetic
ctaaccacatctggcaaggcgacattacccatttcaaatataaaaatacgctgtatcgccttcatgtatgggtag

SEQ ID NO: 277238 - DNA, 75 bp, Artificial Sequence
  Synthetic
tcccctcctttacccatcactagcacttccagccccccacctgatgctaccatttaactggacccattgctttga

SEQ ID NO: 277239 - DNA, 75 bp, Artificial Sequence
  Synthetic
acaccttttcaggagccatctcagctacccaaaagagaaaagaaacaagctcagaagctatttcctctttgcttc

SEQ ID NO: 277240 - DNA, 75 bp, Artificial Sequence
  Synthetic
tccggaaggccctggaggcaggccatatcgaaccctacaccgggccaggaaataacccagtattcccagttaaaa

SEQ ID NO: 277241 - DNA, 75 bp, Artificial Sequence
  Synthetic
cccccaaattcaagctatagtctcctccccctgctataactccattatcttgccccccttctctttgtcgcctgt

SEQ ID NO: 277242 - DNA, 75 bp, Artificial Sequence
  Synthetic
ccccgccctaggatcccgctcccgccgagcggtaccggtggcagtctggcttgtctctgccctggccatgggaac

SEQ ID NO: 277243 - DNA, 75 bp, Artificial Sequence
  Synthetic
aatccaaccagctcaggacttgtagaacgctctaatggcattcttaaaaccctattatataagtactttactgac

SEQ ID NO: 277244 - DNA, 75 bp, Artificial Sequence
  Synthetic
cggaattgcaggcggaattactggctccatgtccctcgcttcaggaaaaagccttctacatgaagtagacaaaga

SEQ ID NO: 277245 - DNA, 75 bp, Artificial Sequence
  Synthetic
tatttcccaattaacccaggcagtagttaaaaatcacaaaaatctacttaaaattgcacagtatgctgcccaaaa

SEQ ID NO: 277246 - DNA, 75 bp, Artificial Sequence
  Synthetic
tagacgaggccttgatctcctattttgggagcagggaggattatgcaaggcactacaggaacagtgctgttttct

SEQ ID NO: 277247 - DNA, 75 bp, Artificial Sequence
  Synthetic
cccagagacacattccctcagcaataaacaaacccattggtattatttcaagcttcctggtcttaatagccgcca

SEQ ID NO: 277248 - DNA, 75 bp, Artificial Sequence
  Synthetic
aaacattactaattcccatgtctcaatattacaagaaggacccccccttgaaaatcgagtcctgactggctgggg

SEQ ID NO: 277249 - DNA, 75 bp, Artificial Sequence
  Synthetic
cagtacatggatgacattctcctggcaagcccctcccatgcggacctgcaactactctcagaggccacaatggct

SEQ ID NO: 277250 - DNA, 75 bp, Artificial Sequence
  Synthetic
ccttaactgggaccttggcctttctcaatgggcccgagaggccttacaaactggaatcacccttgttgccttatt

SEQ ID NO: 277251 - DNA, 75 bp, Artificial Sequence
  Synthetic
cctccttgtcatccttgcagggccgtgcatcctccgtcagctacagcaactcccctcgcgtattagataccccca

SEQ ID NO: 277252 - DNA, 75 bp, Artificial Sequence
  Synthetic
ttactctcttataaaccccgagtcatccctatgaaccaagcataccactattgcgaccactcctctcccagtctc

SEQ ID NO: 277253 - DNA, 75 bp, Artificial Sequence
  Synthetic
ttctgccaataattaacttctcccggtagatcctccacctcctgcagcaatctcctgcgttcggcctccaaagaa

SEQ ID NO: 277254 - DNA, 75 bp, Artificial Sequence
  Synthetic
tctaaaccctgcaatcctgcccagccagtttgttcgtggaccctcgacctgctggccctttcagcagatcaggcc

SEQ ID NO: 277255 - DNA, 75 bp, Artificial Sequence
  Synthetic
tccacctcgctctccatcagtctagtgtaaccttcaacccccaactcccctatttttcctctcctagcaccacgc

SEQ ID NO: 277256 - DNA, 75 bp, Artificial Sequence
  Synthetic
ctacagcccccctgccctaatctagtaggttactctagctaccatgccacctattccctatatctattccctcat

SEQ ID NO: 277257 - DNA, 75 bp, Artificial Sequence
  Synthetic
atgctgaccctcactggcaccaccactgtggtgttccagtccaagcagcagtggccacttgtctggctacatgcc

SEQ ID NO: 277258 - DNA, 75 bp, Artificial Sequence
  Synthetic
ggctttgccttctgagccctttgttctgcctctctccgtttgcgctcacggagctcctcctcctcctgctttctc

SEQ ID NO: 277259 - DNA, 75 bp, Artificial Sequence
  Synthetic
gcggaggctattattcagcctcttattcagacccttgttccttaaaggtcccatacctggggtgccaatcatgga

SEQ ID NO: 277260 - DNA, 75 bp, Artificial Sequence
  Synthetic
cgggcggcataggcggctttttccgcagcctgcctcctacgccgagcctccttctcttccttccttcttaaaaac

SEQ ID NO: 277261 - DNA, 75 bp, Artificial Sequence
  Synthetic
tcagcaatctgtttctcctcctctttctccagctccctctttcgcttctccttctcctccgcccgcctgtgccgc

SEQ ID NO: 277262 - DNA, 75 bp, Artificial Sequence
  Synthetic
gatgtcaattttactcaagaagtttcacgcctcaatattaatctccatttttcgaaatgcggttttcccttctcc

SEQ ID NO: 277263 - DNA, 75 bp, Artificial Sequence
  Synthetic
ccaaaccttcaaccaattcattcaaacatctgaccaccccagtgttcctatcttactccaccacagtcaccgatt

SEQ ID NO: 277264 - DNA, 75 bp, Artificial Sequence
  Synthetic
tcacgatgcgtctccccgcgagggggggcttcctcccctcgaggaccacattgcagcctgctggcgcgttcctct

SEQ ID NO: 277265 - DNA, 75 bp, Artificial Sequence
  Synthetic
tctagagataacaggccatcaagcacagactcctcctccttcctctggtcctttaactcctcctccagagataat

SEQ ID NO: 277266 - DNA, 75 bp, Artificial Sequence
  Synthetic
caactgccccattggctcctgtgaaagcccttatgccagtgtttactctttcccctgtgatcataaacaccgccc

SEQ ID NO: 277267 - DNA, 75 bp, Artificial Sequence
  Synthetic
cctcctctactcccccactctaacctagaccacatcctcgagccctctataccatggaaatcaaaactcctgacc

SEQ ID NO: 277268 - DNA, 75 bp, Artificial Sequence
  Synthetic
agcccgtccaccaggtcgtccaccagcaggtcctccgggcaaggaacaggtaaacatcggaatagccctacaaat

SEQ ID NO: 277269 - DNA, 75 bp, Artificial Sequence
  Synthetic
agcccttatgccagtgtttactctttcccctgtgatcataaacaccgccccttgcctgttttcagacggatccac

SEQ ID NO: 277270 - DNA, 75 bp, Artificial Sequence
  Synthetic
gcaggtcctccgggcaaggaacaggtaaacatcggaatagccctacaaatacaaattcacttatacttattatca

SEQ ID NO: 277271 - DNA, 75 bp, Artificial Sequence
  Synthetic
cgtgtttggagactgtgtacaaggtgactggtgccccatctccgggggactatgttcagcccgcctacatcgtca

SEQ ID NO: 277272 - DNA, 75 bp, Artificial Sequence
  Synthetic
cgccctactggccacctgcccagagcatcagatcacctgggaccccatcgatggacgcgttatcggctcaacttt

SEQ ID NO: 277273 - DNA, 75 bp, Artificial Sequence
  Synthetic
acagttccttatccctcgactcccctccttccccacccagagaacctctaagaccctcaaagtccttaccccgcc

SEQ ID NO: 277274 - DNA, 75 bp, Artificial Sequence
  Synthetic
gaccactcatacagcccccaacattccgccctccttcttccaggccatacgcaagtattcccccttccggaatgg

SEQ ID NO: 277275 - DNA, 75 bp, Artificial Sequence
  Synthetic
atgtccctcgcctcaggaaagagcctcctacatgaggtggacaaagatatttcccaattaactcaagcaatagtc

SEQ ID NO: 277276 - DNA, 75 bp, Artificial Sequence
  Synthetic
taatcacccctgtcctgcagctctctcctgcagacctacacagtttcacccattgcggacagacggccctcacac

SEQ ID NO: 277277 - DNA, 75 bp, Artificial Sequence
  Synthetic
atacatggagcccaccctgcggcagcaactcccaaccctgtcctttcccgaccccggcctccggccccaaaacct

SEQ ID NO: 277278 - DNA, 75 bp, Artificial Sequence
  Synthetic
tgcaaggggcaaccacaactgaggcctccaatatcctgcgctcttgccacgcctgccgcaaaaataacccacaac

SEQ ID NO: 277279 - DNA, 75 bp, Artificial Sequence
  Synthetic
gtacaccctctgggaaggctctgtcgtctgcatgtacctctatcaactttccccccccatcacctggcccctcct

SEQ ID NO: 277280 - DNA, 75 bp, Artificial Sequence
  Synthetic
gcctgccgcaaaaataacccacaacatcagatgcctcaaggacacatccgccgtggcctactccctaaccacatc

SEQ ID NO: 277281 - DNA, 75 bp, Artificial Sequence
  Synthetic
gccccacgtaatcttttgccaccccggccagctcggggccttcctcaccaatgtcccctataagcgaatggaaga

SEQ ID NO: 277282 - DNA, 75 bp, Artificial Sequence
  Synthetic
ggagccatctcagctacccaaaagagaaaagaaacaagctcagaagctatttcctctttgctccaggccattgcc

SEQ ID NO: 277283 - DNA, 75 bp, Artificial Sequence
  Synthetic
acttctctataagattttcctcaacacaggggccctaatagtcttgcccgaggactgtttgcccaccaccctttt

SEQ ID NO: 277284 - DNA, 75 bp, Artificial Sequence
  Synthetic
ccaacctactagggcacccgccacaatgactgcctggcaaaatggcctccttccgtttcaatcaaccctcaccac

SEQ ID NO: 277285 - DNA, 75 bp, Artificial Sequence
  Synthetic
ctctcttataaaccctgagtcatccctgtaaaccaagcacacaattattgcaaccacatcgcctccagcctcccc

SEQ ID NO: 277286 - DNA, 75 bp, Artificial Sequence
  Synthetic
tccaggccttatttgggcattcaccgatggcacgcccatgatttccgggccctgccccaaggatggccagccgtc

SEQ ID NO: 277287 - DNA, 75 bp, Artificial Sequence
  Synthetic
tttagtactgcagtcctcctcctttatattcaacaaatttcaaaccaaggcctaccacccctcattcctactctc

SEQ ID NO: 277288 - DNA, 75 bp, Artificial Sequence
  Synthetic
agtactttactgacaaacccgacctacctatggataatgctctatccatagccctatggacaatcaaccacctaa

SEQ ID NO: 277289 - DNA, 75 bp, Artificial Sequence
  Synthetic
acacggcctcatacagtactcttccttccacaatttacatctcctctttgaagagtacaccaatatccctgtctc

SEQ ID NO: 277290 - DNA, 75 bp, Artificial Sequence
  Synthetic
atgtattaaccaactgccacaaaacccgatggcagcttcaccactccccccgactccagccgatcccagagacac

SEQ ID NO: 277291 - DNA, 75 bp, Artificial Sequence
  Synthetic
aagagtacaccaatatccctgtctctctactttttaatgaaaaggaggcaaatgatactgaccatgaacccgaaa

SEQ ID NO: 277292 - DNA, 75 bp, Artificial Sequence
  Synthetic
tctcctcataccactctaaaccctgcaatcctgcccagccagtttgttcatggaccctcgacctgctggcccttt

SEQ ID NO: 277293 - DNA, 75 bp, Artificial Sequence
  Synthetic
tcctccaccagcaggtcctccgggcatggcacaggcaggcatcgaaacagccctacagatacaaagttaaccatg

SEQ ID NO: 277294 - DNA, 75 bp, Artificial Sequence
  Synthetic
tacatcgtcacgccctactggccacctgtccagagcatcagatcacctgggaccccatcgatggacgcgttatcg

SEQ ID NO: 277295 - DNA, 75 bp, Artificial Sequence
  Synthetic
gaccccatcgatggacgcgttatcggctcagctctacagttccttatccctcgactcccctccttccccacccag

SEQ ID NO: 277296 - DNA, 75 bp, Artificial Sequence
  Synthetic
ggaaatttcagcaagatgtcaattttactcaagaagtttcacacctcaatattaatctccatttttcaaaatgcg

SEQ ID NO: 277297 - DNA, 75 bp, Artificial Sequence
  Synthetic
cccggcaccttcactggctcggagccagtaatagtctattctataactctctccaggagagaaatttagtacaca

SEQ ID NO: 277298 - DNA, 75 bp, Artificial Sequence
  Synthetic
ccccaacattccaccctccttcctccaggccatgcgcaaatactcccccttccgaaatggatacatggaacccac

SEQ ID NO: 277299 - DNA, 75 bp, Artificial Sequence
  Synthetic
ttccttaataccgaacccagccaactgcctcccaccgcccctcctctactctcccactctaacctagaccatatc

SEQ ID NO: 277300 - DNA, 75 bp, Artificial Sequence
  Synthetic
ccttgggcagcacctcccaaccctgtcttttccagaccccggactccggccccaaaacctgtacaccctctgggg

SEQ ID NO: 277301 - DNA, 75 bp, Artificial Sequence
  Synthetic
ggcccctcctgccccacgtgattttttgccaccccggccagctcggggccttcctcaccaatgttccctacaagc

SEQ ID NO: 277302 - DNA, 75 bp, Artificial Sequence
  Synthetic
cactgctttgacccccagattcaagctatagtctcctccccctgtcataactccctcatcctgccccccttttcc

SEQ ID NO: 277303 - DNA, 75 bp, Artificial Sequence
  Synthetic
cctcccgcctgtggtgcctcctgaactgcgtccgccgtctaggtaagtttagagctcaggtcgagaccgggcctt

SEQ ID NO: 277304 - DNA, 75 bp, Artificial Sequence
  Synthetic
tgacaatgaccatgagccccaaatatcccccgggggcttagagcctctcagtgaaaaacatttccgtgaaacaga

SEQ ID NO: 277305 - DNA, 75 bp, Artificial Sequence
  Synthetic
gtggacaaagatatttcccaattaactcaagcaatagtcaaaaaccacaaaaatctgctcaaaattgcacagtat

SEQ ID NO: 277306 - DNA, 75 bp, Artificial Sequence
  Synthetic
gagctccaaatatcccccgggggcttagagcctcccagtgaaaaacatttccgcgaaacagaagtctgaaaaggt

SEQ ID NO: 277307 - DNA, 75 bp, Artificial Sequence
  Synthetic
tagagcctcccagtgaaaaacatttccgcgaaacagaagtctgaaaaggtcagggcccagactaaggctctgacg

SEQ ID NO: 277308 - DNA, 75 bp, Artificial Sequence
  Synthetic
cagggcccagactaaggctctgacgtctccccccggagggacagctcagcaccggctcaggctaggccctgacgt

SEQ ID NO: 277309 - DNA, 75 bp, Artificial Sequence
  Synthetic
accctgagtcatccctgtaaaccaagcacacaattattgcaaccacatcgcctccagcctcccctgccaataatt

SEQ ID NO: 277310 - DNA, 75 bp, Artificial Sequence
  Synthetic
cggcgctcctgctcttcctgctttctccgggcgaagtcagcggccttctcctccgcccgcttcctgcgccgtgcc

SEQ ID NO: 277311 - DNA, 75 bp, Artificial Sequence
  Synthetic
gcccagatcccgtcccgccccgcgccgccgccgccgtcatcctccacccacgaccccccggattctgacccacaa

SEQ ID NO: 277312 - DNA, 75 bp, Artificial Sequence
  Synthetic
tcacgactaactgccggcttggcccacggccaagtgccggcgactccgttggctcggagccagcgacagccattt

SEQ ID NO: 277313 - DNA, 75 bp, Artificial Sequence
  Synthetic
ggaaaaacttggagtgtagttctgacaatgaccatgagccccaaatatcccccgggggcttagagcctcccagtg

SEQ ID NO: 277314 - DNA, 75 bp, Artificial Sequence
  Synthetic
tggcgctttcccccctggagggccccgtcgcagccggccgcggctttcctcttctagagatagcaaaccgtcaag

SEQ ID NO: 277315 - DNA, 75 bp, Artificial Sequence
  Synthetic
cagctcagcaccggctcgggctaggccctgacgtgtccccctgaagacaaatcataagctcagacctccgggaag

SEQ ID NO: 277316 - DNA, 75 bp, Artificial Sequence
  Synthetic
gcccgtccaccaattcctccaccagcaggtcctccgggcatggaacaggcaaacatcgaaacagccctacggata

SEQ ID NO: 277317 - DNA, 75 bp, Artificial Sequence
  Synthetic
ccctgacgtgtccccctgaagacaaatcataagctcagacctccgggaagccaccaagaaccacccatttcctcc

SEQ ID NO: 277318 - DNA, 75 bp, Artificial Sequence
  Synthetic
agtaccggcgactccgttggctcggagccagcgacagcccatcctatagcactctcaggagagaaatttagtaca

SEQ ID NO: 277319 - DNA, 75 bp, Artificial Sequence
  Synthetic
ccccatgtgattttttgccaccccggccagctcggggccttcctcaccaatgttccctacaaacgaatagaaaaa

SEQ ID NO: 277320 - DNA, 75 bp, Artificial Sequence
  Synthetic
cttcctccaggcggcatatcgcctagaacccggtccctccagttacgatttccaccagttaaaaaaatttcttaa

SEQ ID NO: 277321 - DNA, 75 bp, Artificial Sequence
  Synthetic
tccaccagttaaaaaaatttcttaaaatagctttagaaacaccggctcggatctgtcccattaactactccctcc

SEQ ID NO: 277322 - DNA, 75 bp, Artificial Sequence
  Synthetic
cccctccctatgttgagcctacggccccccaagtccttccagtcatgcatccacatggtgctcctcctaaccatc

SEQ ID NO: 277323 - DNA, 75 bp, Artificial Sequence
  Synthetic
ataaggctctgacgtctccccccggaggacagctcagcaccagctcaggctaggccctgacgtgtccccctaaag

SEQ ID NO: 277324 - DNA, 75 bp, Artificial Sequence
  Synthetic
acggctcaataaaataacaggagtctataaaagcgtggggacagttcaggagggggctcgcatctctccttcacg

SEQ ID NO: 277325 - DNA, 75 bp, Artificial Sequence
  Synthetic
cttcgtagaacgcctcaacatagctcttgacaatgggctgccagaaggcacgcccaaagaccccatcttacgttc

SEQ ID NO: 277326 - DNA, 75 bp, Artificial Sequence
  Synthetic
tccggcgctcccttggagcctacctagactcagccggctctccacgctttgcctgaccctgcttgctcaactcta

SEQ ID NO: 277327 - DNA, 75 bp, Artificial Sequence
  Synthetic
cctgtgtccgaaaacaaaacccagcaaacccctggaacaattaagttcctagggcaaataatttcacccaatcac

SEQ ID NO: 277328 - DNA, 75 bp, Artificial Sequence
  Synthetic
agggcaaataatttcacccaatcacctcacttatgatgcagtccccacggtacctatacggtcccgctgggcgct

SEQ ID NO: 277329 - DNA, 75 bp, Artificial Sequence
  Synthetic
caggctcaacgctctcacagatgccctattaatcacccctgtcctgcagctctctcctgcagaactacacagttt

SEQ ID NO: 277330 - DNA, 75 bp, Artificial Sequence
  Synthetic
ataagtactttactgacaaacccgacctacctatggataatgctctatccatagccctatggacaatcaaccacc

SEQ ID NO: 277331 - DNA, 75 bp, Artificial Sequence
  Synthetic
tcccacagcagtgtaactacggccccggcactagatacgcctggaaagtactaccccaagggtttaaaaatagtc

SEQ ID NO: 277332 - DNA, 75 bp, Artificial Sequence
  Synthetic
acagaagtctgaaaaggtcagggcccagactaaggctctgacgtctccccccggaggacagctcagcaccggctc

SEQ ID NO: 277333 - DNA, 75 bp, Artificial Sequence
  Synthetic
gcaaggggcaaccacaactgaggcttccaatatcctgcgctcttgccacgcctgccgcggaggcaacccacaaca

SEQ ID NO: 277334 - DNA, 75 bp, Artificial Sequence
  Synthetic
atttccaccagttaaaaaaatttcttaaaatagctttagaaacaccggtctggatctgtcccattaactactccc

SEQ ID NO: 277335 - DNA, 75 bp, Artificial Sequence
  Synthetic
ttccctcagcaataaacaaacccattggtattatttcaagcttcctggtcttaatagccgccagtggaaaggacc

SEQ ID NO: 277336 - DNA, 75 bp, Artificial Sequence
  Synthetic
tgccaatcatggacctgcccctatacaggagccgtctccagcccctactggaagtttcaacacgatgtcaatttt

SEQ ID NO: 277337 - DNA, 75 bp, Artificial Sequence
  Synthetic
gccctcctattagacctccccactgacatcccacacccaaaaaactccatagggggggaggtttaacctcccccc

SEQ ID NO: 277338 - DNA, 75 bp, Artificial Sequence
  Synthetic
ttccagcctgctagggcacccgtcacgctgacagcctggcaaaacggcctccttccgttccactcaaccctcacc

SEQ ID NO: 277339 - DNA, 75 bp, Artificial Sequence
  Synthetic
ttgttttaacatcttgcctagttgataccaaaaacaactgggccatcataggtcgtgatgccttacaacaatgcc

SEQ ID NO: 277340 - DNA, 75 bp, Artificial Sequence
  Synthetic
ctcagtgaaaaacatttccgtgaaacagaagtctgagaaggtcagggcccagaataaggctctgacgtctccccc

SEQ ID NO: 277341 - DNA, 75 bp, Artificial Sequence
  Synthetic
ccgctcccgccgagcggtaccggtggcggtctggcttgtctccgccctggccatgggagccggagtggctggcgg

SEQ ID NO: 277342 - DNA, 75 bp, Artificial Sequence
  Synthetic
gcggtctggcttgtctccgccctggccatgggagccggagtggctggcgggattaccggctccatgtccctcgcc

SEQ ID NO: 277343 - DNA, 75 bp, Artificial Sequence
  Synthetic
ttatgcaaagcattacaagaacagtgccgttttccgaatattaccaattcccatgtcccaatactacaagaaaga

SEQ ID NO: 277344 - DNA, 75 bp, Artificial Sequence
  Synthetic
caagtaccggcgactccgttggctcggagccagcgacagcccatcctatagcactctccaggagagaaacttagt

SEQ ID NO: 277345 - DNA, 75 bp, Artificial Sequence
  Synthetic
gatacccccattactctcttataaaacctgagtcatccctgtaaaccaagcacgcaattattgcaaccacatcgc

SEQ ID NO: 277346 - DNA, 75 bp, Artificial Sequence
  Synthetic
gccccttgtctccacttgcgctcacggcgctcctgctcttcctgcttcctcctagcgacgtcagcggccttcttc

SEQ ID NO: 277347 - DNA, 75 bp, Artificial Sequence
  Synthetic
tccgcccgcctcctgcgccgtgccttctcctcttccttccttttcaaatactcagcggtctgcttttcctcctct

SEQ ID NO: 277348 - DNA, 75 bp, Artificial Sequence
  Synthetic
cccgtccaccaattcctccaccagcaggtcctccgggcatgacacaggcaagcatcgaaacagccctgcagatac

SEQ ID NO: 277349 - DNA, 75 bp, Artificial Sequence
  Synthetic
cttcttttcggatacccagtctacgtgtttggagactgtgtacaaggcgactggtgccccatctctgggggacta

SEQ ID NO: 277350 - DNA, 75 bp, Artificial Sequence
  Synthetic
ggacgcgttatcggctcagctctacagttccttatccctcgactcccctccttccccacccagagaacctctaag

SEQ ID NO: 277351 - DNA, 75 bp, Artificial Sequence
  Synthetic
acctcccgggcagcctatattctctgggacaagcatatattgtcacaaagatcattcccccttccgccaccgcac

SEQ ID NO: 277352 - DNA, 75 bp, Artificial Sequence
  Synthetic
acaccctctggggaggctccgttgtctgcatgtacctctaccagctttccccccccatcacctggcccctcctgc

SEQ ID NO: 277353 - DNA, 75 bp, Artificial Sequence
  Synthetic
gtactaccccaagggtttaaaaatagtcccaccctgttcgaaatgcagctggcccatatcctgcagcccattcgg

SEQ ID NO: 277354 - DNA, 75 bp, Artificial Sequence
  Synthetic
actaatcacccctgtcctgcagctctctcctgcagaactacacagtttcacccattgcggacagacggccctcac

SEQ ID NO: 277355 - DNA, 75 bp, Artificial Sequence
  Synthetic
agcctgctagggcacccgtcacgctaacagcctggcaaaacggcctccttccgttccactcaaccctcaccactc

SEQ ID NO: 277356 - DNA, 75 bp, Artificial Sequence
  Synthetic
ttcaaaaatttaggtgcccaaactggagaactttggaacacttttcttaaaacagctgccccattggctcctgtg

SEQ ID NO: 277357 - DNA, 75 bp, Artificial Sequence
  Synthetic
atatctattccctcattggattaaaaagccaaaccgaaatggcggaggctattattcagcctcttattcagaccc

SEQ ID NO: 277358 - DNA, 75 bp, Artificial Sequence
  Synthetic
gggtgccaatcatggacctgcccctatacaggagccgtctccagcccctactggaagtttcagcaagatgtcaat

SEQ ID NO: 277359 - DNA, 75 bp, Artificial Sequence
  Synthetic
gttggctcggagccagcgacagcccatcctatagcactctcaggagagaaatttagtacacatagttggaggtag

SEQ ID NO: 277360 - DNA, 75 bp, Artificial Sequence
  Synthetic
tgatactgaccatgggccccaaataccttccgagggcctagagcctcccagtgaaaaacatttccacgaaacaga

SEQ ID NO: 277361 - DNA, 75 bp, Artificial Sequence
  Synthetic
taaggctctgacgtctccccccggagggacagctcagcactagttcagactaggccctgacgtatccccctggag

SEQ ID NO: 277362 - DNA, 75 bp, Artificial Sequence
  Synthetic
ataagtcataggcccagacctccgggaagccaccgagaaccacccatttcctccccatgtttgtcaggccgtccc

SEQ ID NO: 277363 - DNA, 75 bp, Artificial Sequence
  Synthetic
gaagccaccgagaaccacccatttcctccccatgtttgtcaggccgtcccccgggcgctgacgacaacccctcac

SEQ ID NO: 277364 - DNA, 75 bp, Artificial Sequence
  Synthetic
ccgggcgctgacgacaacccctcacctcaaaaaaacttttcatggcacgcatatggctcaataaaacagcaggag

SEQ ID NO: 277365 - DNA, 75 bp, Artificial Sequence
  Synthetic
ctcaaaaaaacttttcatggcacgcatatggctcaataaaacagcaggagtctataaaagcgtggagacagttca

SEQ ID NO: 277366 - DNA, 75 bp, Artificial Sequence
  Synthetic
agacccccccttgagaatcgagtcctgactggctggggccttaactgggaccttggcctctcacagtgggctcga

SEQ ID NO: 277367 - DNA, 75 bp, Artificial Sequence
  Synthetic
taagttcggagctcaggtcgagaccgggcctttgtccggcgctcccttagagcccacttagattcggtcggctct

SEQ ID NO: 277368 - DNA, 75 bp, Artificial Sequence
  Synthetic
ccacgctttgcctgaccctgcttgctcaactccacgtctttgtttcgttttctgttctgcgccgctaccgatcga

SEQ ID NO: 277369 - DNA, 75 bp, Artificial Sequence
  Synthetic
aactcctctataaaatttcccttaccacaggggccctaataattctacccgaagactgtttgcccaccacccttt

SEQ ID NO: 277370 - DNA, 75 bp, Artificial Sequence
  Synthetic
aagttccgcccctttccctttcattcacgtctgactgccggcttggcccacggccaagcaccggcacccttactg

SEQ ID NO: 277371 - DNA, 75 bp, Artificial Sequence
  Synthetic
ttaacctctcccattaaatcctccttctcctgcagcaacttcctccgttcagcctccaaggactccacctcgcct

SEQ ID NO: 277372 - DNA, 75 bp, Artificial Sequence
  Synthetic
gctcggagccagcgacagcccattctatacctctctccaggagagagacatagaacacagttgggggctcgtccg

SEQ ID NO: 277373 - DNA, 75 bp, Artificial Sequence
  Synthetic
tcagccccttgtctccacttgcgctcacggcgctcctgctcttcctgctttctccgggcgacgtcagcggccttc

SEQ ID NO: 277374 - DNA, 75 bp, Artificial Sequence
  Synthetic
ggattttaagcgtccctttattccctaggcaatgggccaaatcttccctcgtagcgctaaccctattccgcggcc

SEQ ID NO: 277375 - DNA, 75 bp, Artificial Sequence
  Synthetic
gccccgggggctggccgctcatcactggctcaatttcctccaggcggcataccgcctggagcccggtccttccag

SEQ ID NO: 277376 - DNA, 75 bp, Artificial Sequence
  Synthetic
accgcctggagcccggtccttccagttacgattttcatcagttaaaacagtttcttaaaatggccctagaaacgc

SEQ ID NO: 277377 - DNA, 75 bp, Artificial Sequence
  Synthetic
aaaggataccctggccgagtaaatgaaatcttacacatactcatccaaacccaaactcagatcccgtctcacccc

SEQ ID NO: 277378 - DNA, 75 bp, Artificial Sequence
  Synthetic
gcgccgccgccgccgtcatcccccacccacgaccccccagattctaatccacagatcccccctccctatgttgag

SEQ ID NO: 277379 - DNA, 75 bp, Artificial Sequence
  Synthetic
cccacgaccccccagattctaatccacagatcccccctccctatgttgagcctacagccccccaagtccttccag

SEQ ID NO: 277380 - DNA, 75 bp, Artificial Sequence
  Synthetic
accggcgactccgttggctcggagccagcgacagcccatcctatagcactctccaggagagaaacttagtacaca

SEQ ID NO: 277381 - DNA, 75 bp, Artificial Sequence
  Synthetic
cctacagccccccaagtccttccagtcatgcacccacacggtgtccctcccagccaccgcccgtggcaaatgaag

SEQ ID NO: 277382 - DNA, 75 bp, Artificial Sequence
  Synthetic
cagccaccgcccgtggcaaatgaaggacctacaggccatcaagcaggaggtctcccaagcagcccctgggagccc

SEQ ID NO: 277383 - DNA, 75 bp, Artificial Sequence
  Synthetic
ccagtttatgcagaccatccggcttgcagtacagcagtttgaccccactgccaaggacctccaggacctcctgca

SEQ ID NO: 277384 - DNA, 75 bp, Artificial Sequence
  Synthetic
ccaaggacctccaggacctcctgcagtacctttgctcctccctagtagcctccctccatcaccagcagctagata

SEQ ID NO: 277385 - DNA, 75 bp, Artificial Sequence
  Synthetic
gccggtcccctccgtgtccaagccaacaatccacagcaacaaggattgaggcgagaataccagcaactttggctc

SEQ ID NO: 277386 - DNA, 75 bp, Artificial Sequence
  Synthetic
accgcatttgccgccctgcctgggagtgccaaagacccttcctgggcctccatcctccaaggcctagaggagcct

SEQ ID NO: 277387 - DNA, 75 bp, Artificial Sequence
  Synthetic
taccacaccttcgtagaacgcctcaacgtagcccttgataatggactgccagaaggcacgcctaaagaccccatt

SEQ ID NO: 277388 - DNA, 75 bp, Artificial Sequence
  Synthetic
ttacgctccttagcctactccaatgcaaacaaagagtgccaaaaattactacaggcccgaggacacaccaatagc

SEQ ID NO: 277389 - DNA, 75 bp, Artificial Sequence
  Synthetic
aatcccgctcccccctccctatgttgagcctacggccccccaagttcttccagtcatgcacccacatggtgcccc

SEQ ID NO: 277390 - DNA, 75 bp, Artificial Sequence
  Synthetic
aactaaagtgttagtcgtccagcctaaaaaaccccccccaaatcagccgtgcttccggtgcgggaaagcaggcca

SEQ ID NO: 277391 - DNA, 75 bp, Artificial Sequence
  Synthetic
ttgatactgactatgggccccgaatacctcccgggggcctagagcctcccagtgaaaaacatttccacgaaacag

SEQ ID NO: 277392 - DNA, 75 bp, Artificial Sequence
  Synthetic
cggcgactccgttggctcggagccagcgacagcccattctatagcactctccaggagagaaacttagtacacagt

SEQ ID NO: 277393 - DNA, 75 bp, Artificial Sequence
  Synthetic
ctagggctctgacgtctccccccggaggacaactcagcactagttcagactgggccctgacgtatccccctgggg

SEQ ID NO: 277394 - DNA, 75 bp, Artificial Sequence
  Synthetic
aggatgccctcctactagacctccccactgacaacccgcacccaaaaaactccatagggggggaggtttaacctc

SEQ ID NO: 277395 - DNA, 75 bp, Artificial Sequence
  Synthetic
cactgacaacccgcacccaaaaaactccatagggggggaggtttaacctccccccccacggtgcgacacgtccag

SEQ ID NO: 277396 - DNA, 75 bp, Artificial Sequence
  Synthetic
gaagccaccgagaaccacccatttcctccccatgtttgtcaggccgtccccgggcgttgacgacaacccctcacc

SEQ ID NO: 277397 - DNA, 75 bp, Artificial Sequence
  Synthetic
ccaaacaaagacccagcatccattctaccagttataccgttagatcctgcccggcggcccctaattaaagcccaa

SEQ ID NO: 277398 - DNA, 75 bp, Artificial Sequence
  Synthetic
taccagttataccgttagatcctgcccggcggcccctaattaaagcccaagttgacacccagaccagtcacccaa

SEQ ID NO: 277399 - DNA, 75 bp, Artificial Sequence
  Synthetic
cgcccgccgccctacctgaggccgccatccacgccggttgagtcgctctgccgcctcccgcctgtggtgcctcct

SEQ ID NO: 277400 - DNA, 75 bp, Artificial Sequence
  Synthetic
gttgacacccagaccagtcacccaaggaccattgaagctttactagatacaggagcagacatgacagtccttcca

SEQ ID NO: 277401 - DNA, 75 bp, Artificial Sequence
  Synthetic
aggagcagacatgacagtccttccaatagctttgttctcaaatgatactcccctcaaagacacatccgtattagg

SEQ ID NO: 277402 - DNA, 75 bp, Artificial Sequence
  Synthetic
tttaagctcacctcccttcctgtgctaatacgcctccctttccggactacgcctattgttttaacatcttgctta

SEQ ID NO: 277403 - DNA, 75 bp, Artificial Sequence
  Synthetic
gtcgataccaaaaacaactgggccatcataggtcgcgatgccttacagcaatgccaaggcgtcctgtatcttcct

SEQ ID NO: 277404 - DNA, 75 bp, Artificial Sequence
  Synthetic
tccgcccccttccctttcattcacgtctgattgccggcttggcccacggccaagcaccggcacctctactggccc

SEQ ID NO: 277405 - DNA, 75 bp, Artificial Sequence
  Synthetic
tcataggtcgcgatgccttacagcaatgccaaggcgtcctgtatcttcctgaggcagaaaggccgcctgtaatct

SEQ ID NO: 277406 - DNA, 75 bp, Artificial Sequence
  Synthetic
gaggcagaaaggccgcctgtaatcttgccaatacaggcgccagccatccttgggctagaacacctcccaaagccc

SEQ ID NO: 277407 - DNA, 75 bp, Artificial Sequence
  Synthetic
ggagccagtgacagcccattctatacctctctccaggagagaaacatagaacacagttgggggctcgtccgggat

SEQ ID NO: 277408 - DNA, 75 bp, Artificial Sequence
  Synthetic
ccagaaattagccagttccctttaaaccagaacgcctccaggccctgcaacacctggtccggaaggccctggagg

SEQ ID NO: 277409 - DNA, 75 bp, Artificial Sequence
  Synthetic
tctaacgagcgcccctttattccctaggcaatgggccaaatcttccctcgtagcgctaaccctatcccgcggccg

SEQ ID NO: 277410 - DNA, 75 bp, Artificial Sequence
  Synthetic
caggccatattgaaccgtacaccgggccaggaaataacccagtattcccagttaaaaaggccaatggaacctggc

SEQ ID NO: 277411 - DNA, 75 bp, Artificial Sequence
  Synthetic
ccccgggggctggccactcatcactggcttaatttcctccaggcggcataccgcctggagcccggtccttccagt

SEQ ID NO: 277412 - DNA, 75 bp, Artificial Sequence
  Synthetic
gttaaaaaggccaatggaacctggcgattcatccacgacctgcgggccactaattctctaaccgtagacctctca

SEQ ID NO: 277413 - DNA, 75 bp, Artificial Sequence
  Synthetic
ggcttaatttcctccaggcggcataccgcctggagcccggtccttccagttacgattttcatcagttaaaaacag

SEQ ID NO: 277414 - DNA, 75 bp, Artificial Sequence
  Synthetic
tcgtcttcccccgggcccccagacttatccagcctgccaactacactagctcacttacaaactatagaccttaaa

SEQ ID NO: 277415 - DNA, 75 bp, Artificial Sequence
  Synthetic
gacgcttttttccaaatccccttacctaaacaattccagccctactttgcttttaccgttccacaacagtgtaac

SEQ ID NO: 277416 - DNA, 75 bp, Artificial Sequence
  Synthetic
aaggataccctggccaggtaaatgaaattttacaggtactcatccaaacccaaacccagatcccgtcccaccccg

SEQ ID NO: 277417 - DNA, 75 bp, Artificial Sequence
  Synthetic
cactttaagctcacctcccttcctgtgctaatacgcctccctttccggacaacgcctattgttttaacatcttgc

SEQ ID NO: 277418 - DNA, 75 bp, Artificial Sequence
  Synthetic
cagctagcccatatcctgcagcccatccggcaagctttcccccaatgtattattcttcaatacatggatgacatt

SEQ ID NO: 277419 - DNA, 75 bp, Artificial Sequence
  Synthetic
ctacagccccccaagtccttccagtcatgcacccacacggtgtccctcccacgcaccgcccgtggcaaatgaaag

SEQ ID NO: 277420 - DNA, 75 bp, Artificial Sequence
  Synthetic
ctcttagcaagcccctcccatgaagacctacagcagctctcaagggccacaatggcttccctaatctcccacgga

SEQ ID NO: 277421 - DNA, 75 bp, Artificial Sequence
  Synthetic
acgcaccgcccgtggcaaatgaaagacctacaggcctattaagcaggaagtctcccaagcagcccccgggagccc

SEQ ID NO: 277422 - DNA, 75 bp, Artificial Sequence
  Synthetic
tccggcaagctttcccccaatgtattattcttcaatacatggatgacattctcttagcaagcccctcccatgaag

SEQ ID NO: 277423 - DNA, 75 bp, Artificial Sequence
  Synthetic
acctacagcagctctcaagggccacaatggcttccctaatctcccacggattgcctgtatcccaagacaaaaccc

SEQ ID NO: 277424 - DNA, 75 bp, Artificial Sequence
  Synthetic
gctacctgaacttcaagccctacttggcgagattcagtgggtctccaaaggaactcctaccttacgtcagcccct

SEQ ID NO: 277425 - DNA, 75 bp, Artificial Sequence
  Synthetic
gccggtcccctccgtgtccaagccaacaatccacagcaacaaggattaaggcgagaataccaacaactttggctc

SEQ ID NO: 277426 - DNA, 75 bp, Artificial Sequence
  Synthetic
gggcatactgatccccgagaccaaatatatttaaatccttctcaagttcaatcattaatgcagctgcaacaggcc

SEQ ID NO: 277427 - DNA, 75 bp, Artificial Sequence
  Synthetic
tagcccaaaccctgcccctcctgggggccattatgctaaccctcactggcaccactaccgtagtgttccagtcga

SEQ ID NO: 277428 - DNA, 75 bp, Artificial Sequence
  Synthetic
agcagcagtggccacttgtttggctacatgcccccctaccgcacactagccagtgcccctgggggcaactacttg

SEQ ID NO: 277429 - DNA, 75 bp, Artificial Sequence
  Synthetic
ctctgccaaaccatacatcataacatctccatccaaaccttcaaccaatttattcaaacatctgaccaccccagt

SEQ ID NO: 277430 - DNA, 75 bp, Artificial Sequence
  Synthetic
tctgtcaagacccaactcactggaagcgggactgtccccgcctaaagcccgccatcccagaaccagagccagagg

SEQ ID NO: 277431 - DNA, 75 bp, Artificial Sequence
  Synthetic
gggttgcctgtgtccgaaaacaaaacccagcaaacccctggaacaattaagttcctagggcaaataatttcaccc

SEQ ID NO: 277432 - DNA, 75 bp, Artificial Sequence
  Synthetic
aagatgccctcctactagacctccccgctgacatcccgcatccaaaaaactccatagggggggaggtttaacctc

SEQ ID NO: 277433 - DNA, 75 bp, Artificial Sequence
  Synthetic
tactctgtcccctgtgatcataaataccgccccctgcctgttttcagacggatctacctcccaggcggcctatat

SEQ ID NO: 277434 - DNA, 75 bp, Artificial Sequence
  Synthetic
cccccccacgttgcgacaagtccatccgaataaagacccggcatccattctaccagttataccattagatcctgc

SEQ ID NO: 277435 - DNA, 75 bp, Artificial Sequence
  Synthetic
accgccccctgcctgttttcagacggatctacctcccaggcggcctatatcctctgggacaaacacatactatcg

SEQ ID NO: 277436 - DNA, 75 bp, Artificial Sequence
  Synthetic
caaagatcattcccccttccgccacctcacaagtcggcccagcaagccgaacttcttggacttttgcatggcctc

SEQ ID NO: 277437 - DNA, 75 bp, Artificial Sequence
  Synthetic
ccggcggcccctaattaaggcccaagttgacacccagaccagtcacccgaggaccatcgaagccttattagatac

SEQ ID NO: 277438 - DNA, 75 bp, Artificial Sequence
  Synthetic
tccagcgcccgttcgtggcactgtctcaacatatttttagactccaaatatctttatcattaccttcggaccctt

SEQ ID NO: 277439 - DNA, 75 bp, Artificial Sequence
  Synthetic
aggagcagacatgacagtccttccaatagccttattctcaagtgacactccccttaaagacacatccgtgttagg

SEQ ID NO: 277440 - DNA, 75 bp, Artificial Sequence
  Synthetic
gccctaggtaccttccaaggcaagtcctctcaggccccctttcaagctctcctgccccgcctactgtcgcataaa

SEQ ID NO: 277441 - DNA, 75 bp, Artificial Sequence
  Synthetic
cctctcaggccccctttcaagctctcctgccccgcctactgtcgcataaagtcatctatttgcaccacgttcgca

SEQ ID NO: 277442 - DNA, 75 bp, Artificial Sequence
  Synthetic
gtcgataccaaaaacaactgggccatcataggtcgtgatgccttacagcaatgccaaggcgttctgtatcttcct

SEQ ID NO: 277443 - DNA, 75 bp, Artificial Sequence
  Synthetic
gccctattaatcacccctatcctgcagctctctcccgcagaactgcacagtttcacccactgcggacaaacagcc

SEQ ID NO: 277444 - DNA, 75 bp, Artificial Sequence
  Synthetic
gaggcaaaaaggccgcctgtaattcttgccaatacaggcgccagccgtccttggactagaacacctcccaaggcc

SEQ ID NO: 277445 - DNA, 75 bp, Artificial Sequence
  Synthetic
ttgccaatacaggcgccagccgtccttggactagaacacctcccaaggcccccagaaattagccagttcccttta

SEQ ID NO: 277446 - DNA, 75 bp, Artificial Sequence
  Synthetic
atcgccttcatgtatgggtagatactttttcaggagccatctcagctacccaaaaaagaaaggaaacaagcgcag

SEQ ID NO: 277447 - DNA, 75 bp, Artificial Sequence
  Synthetic
aggctatttcctccttactccaggctattgcccacctaggcaagcccagctacataaacacagacaatggccccg

SEQ ID NO: 277448 - DNA, 75 bp, Artificial Sequence
  Synthetic
agacgcctttttccaaatccccttacctaaacaattccagccatactttgcctttaccgttccacaacagtgtaa

SEQ ID NO: 277449 - DNA, 75 bp, Artificial Sequence
  Synthetic
tggaaagtactaccccaagggtttaaaaatagtcccaccctgttcgagatgcagctagccagtatcctgcagccc

SEQ ID NO: 277450 - DNA, 75 bp, Artificial Sequence
  Synthetic
ttatataagtactttactgatagacccgacctacctatggagaatgctctatccatagccctatggacaattaac

SEQ ID NO: 277451 - DNA, 75 bp, Artificial Sequence
  Synthetic
ccgacctacctatggagaatgctctatccatagccctatggacaattaaccacctgaatgtgttaacccattgcc

SEQ ID NO: 277452 - DNA, 75 bp, Artificial Sequence
  Synthetic
atccggcaagctttccctcaatgtgttattcttcaatacatggatgacattctcttggcaagcccctcccccgaa

SEQ ID NO: 277453 - DNA, 75 bp, Artificial Sequence
  Synthetic
acaaaacccggtggcagcttcaccactccccccgactgcaacccatcccagagacacactccctcatcagtaaac

SEQ ID NO: 277454 - DNA, 75 bp, Artificial Sequence
  Synthetic
gacctacagcagctctcggaggccacaatggcttccctaatctcccatggattgcctgtatcccaagacaaaacc

SEQ ID NO: 277455 - DNA, 75 bp, Artificial Sequence
  Synthetic
aaacccactggtattatttcaagcttcccggtcttaatagccgccagtggaaaggaccacaggaggctctccaag

SEQ ID NO: 277456 - DNA, 75 bp, Artificial Sequence
  Synthetic
aagccgccggcgctgctctcatcccagtaagcgccaattctgcccagtggatcccgtggaggctcctcaagcgag

SEQ ID NO: 277457 - DNA, 75 bp, Artificial Sequence
  Synthetic
aacccacaacatcagatgcctcggggacacatccgccgtggcctacttcctaaccacatctggcaaggcgacatt

SEQ ID NO: 277458 - DNA, 75 bp, Artificial Sequence
  Synthetic
cgctacctgaacttcaagccctacttggcgaaattcagtaggtctccaaaggaactcctaccctacgccagcccc

SEQ ID NO: 277459 - DNA, 75 bp, Artificial Sequence
  Synthetic
ctgcatgcccaagacccgtcgagggccccgccgatcccaaagaaaaagaccaccaacaccatgggtaagtttctc

SEQ ID NO: 277460 - DNA, 75 bp, Artificial Sequence
  Synthetic
ttcatagtctctactgtgccttacaagggcatactgatccccgagaccaaatatacttaaatccttctcaagttc

SEQ ID NO: 277461 - DNA, 75 bp, Artificial Sequence
  Synthetic
caccaacaccatgggtaagtttctcaccactttgattttattcctccagttctgcccccctattctctgttatta

SEQ ID NO: 277462 - DNA, 75 bp, Artificial Sequence
  Synthetic
atcccgtggaggctcctcaagcgagctgcatgcccaagacccgtcgagggccccgccgatcccaaagaaaaagac

SEQ ID NO: 277463 - DNA, 75 bp, Artificial Sequence
  Synthetic
cagccccagctgctgtactctcactatcggagtctcctcataccactctaaaccctgcaatcctgcccagccagt

SEQ ID NO: 277464 - DNA, 75 bp, Artificial Sequence
  Synthetic
gggctattatgctaaccctcactggcaccactaccgtagtgttccagtccaagcagcagtggccacttgtttggc

SEQ ID NO: 277465 - DNA, 75 bp, Artificial Sequence
  Synthetic
ttgctcatggaccctcgacttgttggccctttcagcagatcaggccctacagcctccctgccctaatctagtaag

SEQ ID NO: 277466 - DNA, 75 bp, Artificial Sequence
  Synthetic
ctactccaactaccatgccacctattccctatatctattccctcactggattaaaaagccaaaccgaaatggcgg

SEQ ID NO: 277467 - DNA, 75 bp, Artificial Sequence
  Synthetic
gcctcagccgtgttattactcgacaaatacaccttgcaatcttacgggctactctgccaaaccatacatcataac

SEQ ID NO: 277468 - DNA, 75 bp, Artificial Sequence
  Synthetic
aggctactattcagcctcttattcagacccttgttccctgaaatgcccatacctcgggtgccaatcatggacctg

SEQ ID NO: 277469 - DNA, 75 bp, Artificial Sequence
  Synthetic
acctcgggtgccaatcatggacctgcccctatacaggggccgtctccagcccctactggaagtttcagcaagatg

SEQ ID NO: 277470 - DNA, 75 bp, Artificial Sequence
  Synthetic
tgttcctatcttactccaccacagtcaccgatttcaaaaatttaggtgcccaaactggagaactttggaacactt

SEQ ID NO: 277471 - DNA, 75 bp, Artificial Sequence
  Synthetic
cctgaatattaatctccatttttcaaaatgcggtttccccttctcccttctagtcgatgcacccggatatgaccc

SEQ ID NO: 277472 - DNA, 75 bp, Artificial Sequence
  Synthetic
ttcttaaaacggccgccccattggctcctgtgaaggccctcacgccagtgtttactctgtcccctataatcataa

SEQ ID NO: 277473 - DNA, 75 bp, Artificial Sequence
  Synthetic
aaatgcggtttccccttctcccttctagtcgatgcacccggatatgaccccatctggctccttaataccgaaccc

SEQ ID NO: 277474 - DNA, 75 bp, Artificial Sequence
  Synthetic
ataccgccccctgcctgttttcagacggatctacctcccaggcggcctatatcctctgggacaaacatatactat

SEQ ID NO: 277475 - DNA, 75 bp, Artificial Sequence
  Synthetic
cggatctacctcccaggcggcctatatcctctgggacaaacatatactatcacaaagatcattcccccttccgcc

SEQ ID NO: 277476 - DNA, 75 bp, Artificial Sequence
  Synthetic
ctctacttccccactccaacttagaccacatccttgagccctctataccatggaaatcaaaactcctgactctag

SEQ ID NO: 277477 - DNA, 75 bp, Artificial Sequence
  Synthetic
tccagctaaccctacaaagcactaattatacttgtattgtctgtatagatcgtgctagcctgtccacctggcacg

SEQ ID NO: 277478 - DNA, 75 bp, Artificial Sequence
  Synthetic
ttatacttgtattgtctgtatagatcgtgctagcctgtccacctggcacgtcctatactctcctaacatctctat

SEQ ID NO: 277479 - DNA, 75 bp, Artificial Sequence
  Synthetic
tccatcctcttcttctactcccctcctttacccatcgttagcgcttccagctccccacctgacgttaccgtttaa

SEQ ID NO: 277480 - DNA, 75 bp, Artificial Sequence
  Synthetic
gtcctctcaggccccctttcaggccctcctgccccgcctactggcgcataaggtcatctatttgcaccacgttcg

SEQ ID NO: 277481 - DNA, 75 bp, Artificial Sequence
  Synthetic
ctccccacctgacgttaccgtttaactggactcactgctttgacccccagattcaagctatagtctcctccccct

SEQ ID NO: 277482 - DNA, 75 bp, Artificial Sequence
  Synthetic
cagccataccaatctacctgatcctatttccaagctcaacgctctcactgatgccctattaatcacccctatcct

SEQ ID NO: 277483 - DNA, 75 bp, Artificial Sequence
  Synthetic
atttccaagctcaacgctctcactgatgccctattaatcacccctatcctgcagctgtctcccgcagaactacac

SEQ ID NO: 277484 - DNA, 75 bp, Artificial Sequence
  Synthetic
attcaagctatagtctcctccccctgtcataactccctcatcctgccccccttttccctgtcacctgttccgacc

SEQ ID NO: 277485 - DNA, 75 bp, Artificial Sequence
  Synthetic
ctacgatcccgttcccgccgagcggtaccggtggcagtctggctagtctccgccctggccatgggaaccggaatt

SEQ ID NO: 277486 - DNA, 75 bp, Artificial Sequence
  Synthetic
agtttcacccactgcggacaaacagcccttacattgcaaggggcaaccacaactgaggcctccaatatcctgcgc

SEQ ID NO: 277487 - DNA, 75 bp, Artificial Sequence
  Synthetic
cgccctggccatgggaaccggaattgctggcgggattaccggctccatgtccctcgcctcaggaaagaatcttct

SEQ ID NO: 277488 - DNA, 75 bp, Artificial Sequence
  Synthetic
acatgaggtagacaaagatatttcccaattaacccaagcaatagtcaaaaatcacaaaaatctactcaaaattgc

SEQ ID NO: 277489 - DNA, 75 bp, Artificial Sequence
  Synthetic
acaatatgctgcccaaaacagacgaggccttgatctcctgttctgggaacaaggaggattatgcaaggcactaca

SEQ ID NO: 277490 - DNA, 75 bp, Artificial Sequence
  Synthetic
gtatcgccttcatgtataggtagatactttttcaggagccatctcagctacccaaaaaagaaaagaaacaagctc

SEQ ID NO: 277491 - DNA, 75 bp, Artificial Sequence
  Synthetic
agaacagtgctgttttctaaacattactaattcccacgtttcaatactacaagaaagaccaccccttgagaatcg

SEQ ID NO: 277492 - DNA, 75 bp, Artificial Sequence
  Synthetic
gtggctggcgggattaccggctccatgtccctcgcctcaggaaagagcctcttacatgaggtggacaaagatatt

SEQ ID NO: 277493 - DNA, 75 bp, Artificial Sequence
  Synthetic
agaggctatctcctccttactccaggctattgcccaactaggcaagcccagctacataaacactgataatggccc

SEQ ID NO: 277494 - DNA, 75 bp, Artificial Sequence
  Synthetic
agtcctaactggctggggtcttaactgggaccttggcctctcacaatgggcccgagaggccctacaaactggcat

SEQ ID NO: 277495 - DNA, 75 bp, Artificial Sequence
  Synthetic
cgcctatatttctcaagactttctcagtatgtgcacctcccttgctattcgccatactactcatgtcccctacaa

SEQ ID NO: 277496 - DNA, 75 bp, Artificial Sequence
  Synthetic
cacccttgttgcgctactccttcttgttatccttgcaggaccatgcatcctccgtcagctacgacaactcccctc

SEQ ID NO: 277497 - DNA, 75 bp, Artificial Sequence
  Synthetic
gttatccttgcaggaccatgcatcctccgtcagctacgacaactcccctcgcgcaccagatacccccattactct

SEQ ID NO: 277498 - DNA, 75 bp, Artificial Sequence
  Synthetic
gcgcaccagatacccccattactctcttataaaccctgagtcatccctataagccaagcatgcagttattgcgac

SEQ ID NO: 277499 - DNA, 75 bp, Artificial Sequence
  Synthetic
cttataaaccctgagtcatccctataagccaagcatgcagttattgcgaccacatcgcttccagcctcttctgcc

SEQ ID NO: 277500 - DNA, 75 bp, Artificial Sequence
  Synthetic
acccgacctacctatggacaatgctctatccatagccttatggacaattaaccacctgaatgtattaacccattg

SEQ ID NO: 277501 - DNA, 75 bp, Artificial Sequence
  Synthetic
ctatccatagccttatggacaattaaccacctgaatgtattaacccattgccacaaaacccggtggcagcttcac

SEQ ID NO: 277502 - DNA, 75 bp, Artificial Sequence
  Synthetic
aataattgacctctcccatcaaatcctcattctcctgcagcaacctcctccgttcagcctccaaggactctgcct

SEQ ID NO: 277503 - DNA, 75 bp, Artificial Sequence
  Synthetic
ctcattctcctgcagcaacctcctccgttcagcctccaaggactctgcctcgctctccaactgtctagcataacc

SEQ ID NO: 277504 - DNA, 75 bp, Artificial Sequence
  Synthetic
cgctctccaactgtctagcataaccatcaacccccaactccgtcattctttctcttctagcactacgctgccttg

SEQ ID NO: 277505 - DNA, 75 bp, Artificial Sequence
  Synthetic
acaaacccactggtattatttcaagcttcctggtcttaatagccgccagtggaaaggaccacaggaggcttctcc

SEQ ID NO: 277506 - DNA, 75 bp, Artificial Sequence
  Synthetic
tctcttctagcactacgctgccttgccttcccagctccttgttctgtctgtctccacttgcgctcgcggcgcttc

SEQ ID NO: 277507 - DNA, 75 bp, Artificial Sequence
  Synthetic
cttcctggtcttaatagccgccagtggaaaggaccacaggaggcttctccaagaagccgccggcgctgctctcat

SEQ ID NO: 277508 - DNA, 75 bp, Artificial Sequence
  Synthetic
tcttcctccagttttctccgggcgcggtcggcggccttctcctccgcccgcctcctgcgccaagcctccttctct

SEQ ID NO: 277509 - DNA, 75 bp, Artificial Sequence
  Synthetic
ctcttccttttcaaaaactcagcaatctgtttctcctcctctttttcccgctctctttttcgctttctcttctcc

SEQ ID NO: 277510 - DNA, 75 bp, Artificial Sequence
  Synthetic
ttacagccccagctgctgtactctcactattggagtctcctcataccactctaaaccctgcaatcctgcccagcc

SEQ ID NO: 277511 - DNA, 75 bp, Artificial Sequence
  Synthetic
tcggcccgtcgccgccgatcacgatgcgtttccccgcgaggtggcgcttcctcttccggagggccccatcgcagc

SEQ ID NO: 277512 - DNA, 75 bp, Artificial Sequence
  Synthetic
cggctttcttcttctagagatagcacaccgtcaagcacagattcctcctcctccctctggtcctttaaatcgtcc

SEQ ID NO: 277513 - DNA, 75 bp, Artificial Sequence
  Synthetic
ggtttgctcatggaccctcgacctgttagccctttcagcagatcaagccctacagcctccctgccctatcctagt

SEQ ID NO: 277514 - DNA, 75 bp, Artificial Sequence
  Synthetic
tctaaggataacagcccgtccaccaagtcctccaccagcaggtcctccggacgaggaacaggtaaacaccgaaat

SEQ ID NO: 277515 - DNA, 75 bp, Artificial Sequence
  Synthetic
aagttactccagctaccatgccacctattccctatatgtatttcctcattggattaaaaagccaaaccgaaatgg

SEQ ID NO: 277516 - DNA, 75 bp, Artificial Sequence
  Synthetic
cggaggctactattcagcctcttattcagacccttgttccctaaagtgcccatacctcggatgccaatcatggac

SEQ ID NO: 277517 - DNA, 75 bp, Artificial Sequence
  Synthetic
gaggcggccgcgcggcccgtagttctgacaatgaccatgagccccaaatatcccccgggggcttagagcctccca

SEQ ID NO: 277518 - DNA, 75 bp, Artificial Sequence
  Synthetic
cctacatcgtcacgccctactggccacctgcccagaacatcagatcacctgggaccccatcgatggacgcgttat

SEQ ID NO: 277519 - DNA, 75 bp, Artificial Sequence
  Synthetic
cggctcagctctacaattccttatccctcgactcccctccttccccacccagagaacccctaagaccctcaaggt

SEQ ID NO: 277520 - DNA, 75 bp, Artificial Sequence
  Synthetic
ccttaccccaccgaccactcatacaacccccaacattccaccctccttcttccaggccatacgcaaacactcccc

SEQ ID NO: 277521 - DNA, 75 bp, Artificial Sequence
  Synthetic
agaccacatccttgagccctctataccgtggaaatcaaaactcctgaccctggtccagctaaccctacaaagcac

SEQ ID NO: 277522 - DNA, 75 bp, Artificial Sequence
  Synthetic
cttccgaaatgggtacatggagcccacccttgggcagcagctcccaagcctgtcctttcccgaccccggcctccg

SEQ ID NO: 277523 - DNA, 75 bp, Artificial Sequence
  Synthetic
gatcgtgctagcctgtccacctggcacgtcctgtactctcccaacatctctattccatcctcttcttctactccc

SEQ ID NO: 277524 - DNA, 75 bp, Artificial Sequence
  Synthetic
gccccaaaacctatacaccctctggggaagctccgtcgtctgcatgtacctctatcagctttccccccccatcac

SEQ ID NO: 277525 - DNA, 75 bp, Artificial Sequence
  Synthetic
tgccctcctattagacctccccactgacatcccacacccaaaaaactccatagggggggcccccccacattacag

SEQ ID NO: 277526 - DNA, 75 bp, Artificial Sequence
  Synthetic
tctatcagctttccccccccatcacctggcccctcctgccccaggtgatattttgccaccccggccagctcgggg

SEQ ID NO: 277527 - DNA, 75 bp, Artificial Sequence
  Synthetic
cagattcaagctatagtctcctccccctgtcataactccctcatcctgccccccttttccctgtcacccgttccg

SEQ ID NO: 277528 - DNA, 75 bp, Artificial Sequence
  Synthetic
ccttcctcaccaatgttccctacaaacgaatggaagaactcctctataaaattttccttaacacaggggccctga

SEQ ID NO: 277529 - DNA, 75 bp, Artificial Sequence
  Synthetic
acgaatggaagaactcctctataaaattttccttaacacaggggccctgataattctacccgaaggctgtttacc

SEQ ID NO: 277530 - DNA, 75 bp, Artificial Sequence
  Synthetic
gccccacgatcccgttcccgccgagcggtgccggtggcggtctggctagtctccgccctggccatgggaaccggg

SEQ ID NO: 277531 - DNA, 75 bp, Artificial Sequence
  Synthetic
taattctacccgaaggctgtttacccaccacccttttccaacctatcagggcgccggccacgctgacagcctggc

SEQ ID NO: 277532 - DNA, 75 bp, Artificial Sequence
  Synthetic
gcgccggccacgctgacagcctggcaaaatggcctccttccgttccaatcaaccctcaccactccaggccttatt

SEQ ID NO: 277533 - DNA, 75 bp, Artificial Sequence
  Synthetic
attgctggcaggattaccggctccatgtccctcgcctcaggaaagagtctcctacatgaggtagacaaagatatt

SEQ ID NO: 277534 - DNA, 75 bp, Artificial Sequence
  Synthetic
caagatcactttaagctcacctcccttcctgtgctaatacgcctccctttccggacaacgcctattgttttaaca

SEQ ID NO: 277535 - DNA, 75 bp, Artificial Sequence
  Synthetic
tggacattttccgatggcacgcccatgatttccgggccttgcccaaaagacggtcagccatctttagtactacag

SEQ ID NO: 277536 - DNA, 75 bp, Artificial Sequence
  Synthetic
tgatttccgggccttgcccaaaagacggtcagccatctttagtactacagtcctcttcctttatatttcataaat

SEQ ID NO: 277537 - DNA, 75 bp, Artificial Sequence
  Synthetic
tgcactaatatgctgcccagaacagacgacgccttgatctcctgttctgggaacaaggaggattatgcaaggcgc

SEQ ID NO: 277538 - DNA, 75 bp, Artificial Sequence
  Synthetic
tcctcttcctttatatttcataaatttcaaaccaaggcctatcacccctcagtcctactctcacacggcctcata

SEQ ID NO: 277539 - DNA, 75 bp, Artificial Sequence
  Synthetic
cttacaacaatgccaaggcgtcctgtacctccctgaggcaaaagggccgcctgtaatcttgccaatacaggcgcc

SEQ ID NO: 277540 - DNA, 75 bp, Artificial Sequence
  Synthetic
ttcaaaccaaggcctatcacccctcagtcctactctcacacggcctcatacagtactcttccttccacagtttgc

SEQ ID NO: 277541 - DNA, 75 bp, Artificial Sequence
  Synthetic
cagtactcttccttccacagtttgcatctcctcttcgaagaatacaccaacatccccatttctttactttttaac

SEQ ID NO: 277542 - DNA, 75 bp, Artificial Sequence
  Synthetic
atctcctcttcgaagaatacaccaacatccccatttctttactttttaacgaaaaagaggcagatgatactgacc

SEQ ID NO: 277543 - DNA, 75 bp, Artificial Sequence
  Synthetic
acgacgccttgatctcctgttctgggaacaaggaggattatgcaaggcgctacaagaacagtgctgttttctaaa

SEQ ID NO: 277544 - DNA, 75 bp, Artificial Sequence
  Synthetic
ctctcttataaaccctgagtcgtccttatagaccaagcatacagttattgcgaccacatcgcttccagcctcctc

SEQ ID NO: 277545 - DNA, 75 bp, Artificial Sequence
  Synthetic
tgccaataattgacctctcccatcaaatcatcattctcctgcagcaacctccctcgttcagcctccaaggactct

SEQ ID NO: 277546 - DNA, 75 bp, Artificial Sequence
  Synthetic
gcctcgctctccaactgcctagcataaccatcaacccccaactccgtcattttttcctttctagcacttcgctgt

SEQ ID NO: 277547 - DNA, 75 bp, Artificial Sequence
  Synthetic
tttttcctttctagcacttcgctgttttgctccttgttctgtctgtctccacttgcgctcgcggcgctcctcctc

SEQ ID NO: 277548 - DNA, 75 bp, Artificial Sequence
  Synthetic
tgcgccaagcctccttctctctcttccttttcaaaaactcagcaatctgtttttcctcctctttctctcgctccc

SEQ ID NO: 277549 - DNA, 75 bp, Artificial Sequence
  Synthetic
tttttcgctttctcttctcctcggcccgtcgctgccggtcacgatgcgtttccccgcgaggtggcgcttcctctc

SEQ ID NO: 277550 - DNA, 75 bp, Artificial Sequence
  Synthetic
ctgaccctgcttgctcaactccacgtctttgtttcgttttctgttctgcgccgctaccgatcgaaagttccgccc

SEQ ID NO: 277551 - DNA, 75 bp, Artificial Sequence
  Synthetic
ctacagggccccatcgcaaccggctttcttcttctagagacagcacaccgtcaagcacagattcctcctcctccc

SEQ ID NO: 277552 - DNA, 75 bp, Artificial Sequence
  Synthetic
ccgctgggcgctacctgaacttcaagccctacttggcgagattcagtgggtctccaagggaactcctaccttacg

SEQ ID NO: 277553 - DNA, 75 bp, Artificial Sequence
  Synthetic
accggcacccttactggctcggagccagcgacagcccattctatacctctctccaggagagagacatagaacaca

SEQ ID NO: 277554 - DNA, 75 bp, Artificial Sequence
  Synthetic
tctggtcctttagctcgtcctccaaggatagtagcccgtccaccaagtcctccaccagcaggtcctccggacaag

SEQ ID NO: 277555 - DNA, 75 bp, Artificial Sequence
  Synthetic
gaacaggtaaacaccgaaatggccctacgaatacaaagttaatcatgcttattatcagcccacttcccagggttt

SEQ ID NO: 277556 - DNA, 75 bp, Artificial Sequence
  Synthetic
attatcagcccacttcccagggtttggacaaagtcttctttacggatatccagtctacgtgtttggagactgtgt

SEQ ID NO: 277557 - DNA, 75 bp, Artificial Sequence
  Synthetic
acaaatcataagctcagacctccgggaagccaccgggaaccacccatttcctccccatgtttgtcaagccgtcct

SEQ ID NO: 277558 - DNA, 75 bp, Artificial Sequence
  Synthetic
caggcgttgacgacaacccctcacctcaaaaaacttttcatggcacgcatatggctcaataaactaacaggagtc

SEQ ID NO: 277559 - DNA, 75 bp, Artificial Sequence
  Synthetic
acctctaaaaccctcaaggtccttaccccaccgaccactcatacaacccccaacattccaccctccttcttccag

SEQ ID NO: 277560 - DNA, 75 bp, Artificial Sequence
  Synthetic
gccgtacgccaacactcccccttccgaaatgggtgcatggagcccacccttgggcagcagctcccaagcctgtcc

SEQ ID NO: 277561 - DNA, 75 bp, Artificial Sequence
  Synthetic
gaaatgggtgcatggagcccacccttgggcagcagctcccaagcctgtccttccccgaccccggcctccggcccc

SEQ ID NO: 277562 - DNA, 75 bp, Artificial Sequence
  Synthetic
cagctttccccccccatcacctggcccctcctgccccaggtaatattttgccaccccggtcagctcggggccttc

SEQ ID NO: 277563 - DNA, 75 bp, Artificial Sequence
  Synthetic
gtacacagttgggggctcgtccgggatacgagcgcccctttattccctaggcaatgggccaaatcttttcccgta

SEQ ID NO: 277564 - DNA, 75 bp, Artificial Sequence
  Synthetic
ctacccgaaggctgtttacccaccacccttttccaacctattagggcaccagccacgctgacagcctggcaaaat

SEQ ID NO: 277565 - DNA, 75 bp, Artificial Sequence
  Synthetic
agccacgctgacagcctggcaaaatggcctccttccgtttcaatcaaccctcaccaccccaggccttatttggac

SEQ ID NO: 277566 - DNA, 75 bp, Artificial Sequence
  Synthetic
ctcttccttccacagtttgcatctccccttcgaagaatacaccaacatccctatttctttactttttaacaaaag

SEQ ID NO: 277567 - DNA, 75 bp, Artificial Sequence
  Synthetic
cagacggccctcacattgcaaggggcaaccacaactgaggcttccaatatcctgcgctcttgccacgcctgccgc

SEQ ID NO: 277568 - DNA, 75 bp, Artificial Sequence
  Synthetic
cccttcgaagaatacaccaacatccctatttctttactttttaacaaaagagaggcagatgatactgactatggg

SEQ ID NO: 277569 - DNA, 75 bp, Artificial Sequence
  Synthetic
aaaaataacccacaacatcagatgcctcggggacacatccgccggggcctacttcctaaccacatctggcaaggc

SEQ ID NO: 277570 - DNA, 75 bp, Artificial Sequence
  Synthetic
tcagctacccaaaagagaaaagaaacaagctcagaagctatttcctctttgcttcaggcattgcctatctaggca

SEQ ID NO: 277571 - DNA, 75 bp, Artificial Sequence
  Synthetic
gaccgggcctttgtccggcgctcccttagagcccacttagattcggtcggcttctccacgctttgcctgaccctg

SEQ ID NO: 277572 - DNA, 75 bp, Artificial Sequence
  Synthetic
cgttccttagcctactccaatgcaaacaaagaatgccaaaaattactacaggcccgaggacacactaatagccct

SEQ ID NO: 277573 - DNA, 75 bp, Artificial Sequence
  Synthetic
accggcacctctactggcccggagccagtgacagcccattctatacctctctccaggagagaaacatagaacaca

SEQ ID NO: 277574 - DNA, 75 bp, Artificial Sequence
  Synthetic
ctataaaagcgtggagacagttcaggagggggctcgcttctttccctcacgcgcccgccgccctacctgaggccg

SEQ ID NO: 277575 - DNA, 75 bp, Artificial Sequence
  Synthetic
ccccacattacagcaagtccttcctaaccaagacccagcatctattctgccagttataccgttagatcccgcccg

SEQ ID NO: 277576 - DNA, 75 bp, Artificial Sequence
  Synthetic
ttcttaaaatggccctagaaacgccggtctggatgtgtcccattaactactccctcctagctagtctactcccaa

SEQ ID NO: 277577 - DNA, 75 bp, Artificial Sequence
  Synthetic
aaggataccctggccgggtaaatgaaatcttacacatactcatccaaacccaaacccagatcccgtctcaccccg

SEQ ID NO: 277578 - DNA, 75 bp, Artificial Sequence
  Synthetic
gatatttcccaattaactcaagcaatagtcaaaaaccacaaaaatctactcaaaattgcgcagtatgctgcccag

SEQ ID NO: 277579 - DNA, 75 bp, Artificial Sequence
  Synthetic
ccctccatcaccagcagctagatagccttatatctgaggctgagactcgaggtattacaggatataaccccttgg

SEQ ID NO: 277580 - DNA, 75 bp, Artificial Sequence
  Synthetic
ctcacttatgatgcagtccccacggtacctatacggtcccgctgggcgctacctgaacttcaagccctacttggc

SEQ ID NO: 277581 - DNA, 75 bp, Artificial Sequence
  Synthetic
acctgaacttcaagccctacttggcgagattcagtgggtctccaaaggaactcctaccttacgccagccccttca

SEQ ID NO: 277582 - DNA, 75 bp, Artificial Sequence
  Synthetic
ctccttcttgttatccttgcaggaccatgcatcctccgtcagctacgacacctcccctcgcgcgtcagatacccc

SEQ ID NO: 277583 - DNA, 75 bp, Artificial Sequence
  Synthetic
caggcccgaggacacaccaatagccctctaggagatatgctacgggcttgtcaggcctggacccccaaagacaaa

SEQ ID NO: 277584 - DNA, 75 bp, Artificial Sequence
  Synthetic
gattcaaaaatttaggtgcccagactggagaactttggaacacttttcttaaaacagctgccccattggctcctg

SEQ ID NO: 277585 - DNA, 75 bp, Artificial Sequence
  Synthetic
tctttccccggtgatcataaacaccgccccctgcctgttttcagacggatctacctcccgggcagcctatattct

SEQ ID NO: 277586 - DNA, 75 bp, Artificial Sequence
  Synthetic
atagcaaaccgtcaagcacagcttcctcctcctccttgtcctttaactcttcctccaaggataatagcccgtcca

SEQ ID NO: 277587 - DNA, 75 bp, Artificial Sequence
  Synthetic
tttaccgttccacaacagtgtaactacggcccaggcactagatacgcctggagagtactaccccaagggtttaaa

SEQ ID NO: 277588 - DNA, 75 bp, Artificial Sequence
  Synthetic
ataaacacagacaacggccctgcctatatttcccaagacttcctcaatatgtgtacctcccttgctattcgccat

SEQ ID NO: 277589 - DNA, 75 bp, Artificial Sequence
  Synthetic
gcccaccacccttttccagcctgttaaggcacccgtcacgctaacagcctggcaaaacgcctccttccgttccac

SEQ ID NO: 277590 - DNA, 75 bp, Artificial Sequence
  Synthetic
tcttagcaagcccctcccatgaagacctacagcaactctcaggggccacaatggcttccctaatctcccacggat

SEQ ID NO: 277591 - DNA, 75 bp, Artificial Sequence
  Synthetic
acatcacttatgacgcagtccccacggtacctatacgatcccgctgggcgctacctgaacttcaagccctacttg

SEQ ID NO: 277592 - DNA, 75 bp, Artificial Sequence
  Synthetic
tcattaatgcagctgcaacaggccctgtcacagaactgccgcagtagactagcccaaaccctgcccctcctgggg

SEQ ID NO: 277593 - DNA, 75 bp, Artificial Sequence
  Synthetic
ctcagccggctctccacgctttgcctgaccctgcttgctcaactctgcgtctttgtttcgttttctgttctgcgc

SEQ ID NO: 277594 - DNA, 75 bp, Artificial Sequence
  Synthetic
aaaagccaaaccgaaatggcggaggctattattcagcctcttattcagacccttgttccttaaagtgcccatacc

SEQ ID NO: 277595 - DNA, 75 bp, Artificial Sequence
  Synthetic
tggcccacggccaagtaccggcgactccgttggctcggagccagcgacagcccatcctatagaattcgattcctc

SEQ ID NO: 277596 - DNA, 75 bp, Artificial Sequence
  Synthetic
tgatactgaccatgggccccgaataccttctgagggcctagagcctcccagtgaaaaacatttccacgaaacaga

SEQ ID NO: 277597 - DNA, 75 bp, Artificial Sequence
  Synthetic
actggagaactttggaacacttttcttaaaacagccgccccattggctcctgtgaaggccctcacgccagtgttt

SEQ ID NO: 277598 - DNA, 75 bp, Artificial Sequence
  Synthetic
gtgaaaaacatttccacgaaacagaagtctgaaaaggtcagggcccagactaaggctctgacgtctccccccgga

SEQ ID NO: 277599 - DNA, 75 bp, Artificial Sequence
  Synthetic
ctggttccttaataccgaacccagccaactgcctcccaccgcccctcctctactcccccactctaacctagacca

SEQ ID NO: 277600 - DNA, 75 bp, Artificial Sequence
  Synthetic
tcatctatttgcaccacgttcgcagccataccaatctacctgatcctatttccaagctcaacgcccttactgatg

SEQ ID NO: 277601 - DNA, 75 bp, Artificial Sequence
  Synthetic
cccacctgacgttaccatttaactggacccactgctttgacccccagattcaagctatagtctcctccccctgtc

SEQ ID NO: 277602 - DNA, 75 bp, Artificial Sequence
  Synthetic
ggatcccgctcccgccgagcggtaccggtggcggtctggcttgtctccgccctggccatgggagccggagtggct

SEQ ID NO: 277603 - DNA, 75 bp, Artificial Sequence
  Synthetic
cacaacatcagatgccccggggacacatccgccgcggcctacttcctaaccacatctggcaaggcgacattaccc

SEQ ID NO: 277604 - DNA, 75 bp, Artificial Sequence
  Synthetic
atttcaaatacaaaaatacactgtatcgccttcatgtatgggtagatactttttcaggagccatctcagctaccc

SEQ ID NO: 277605 - DNA, 75 bp, Artificial Sequence
  Synthetic
aaaaaccccccccaaatcagccgtgcttccggtgcgggaaagcaggccactggagccgggactgcactcagcctc

SEQ ID NO: 277606 - DNA, 75 bp, Artificial Sequence
  Synthetic
tgacaatggcgaccagcctcctgagccagccgcccagggcgagtcatcgacccaaaaggtcagaccgtctcacac

SEQ ID NO: 277607 - DNA, 75 bp, Artificial Sequence
  Synthetic
cgtctccccctttataggaactgaaaccaaggccctgacgtcccccccaggaaccaggaaaaagctctccagaaa

SEQ ID NO: 277608 - DNA, 75 bp, Artificial Sequence
  Synthetic
aataaacctcgcccttacccacttcccctagcactgaaaaacaaggctctgacgattacccccctgcccataaaa

SEQ ID NO: 277609 - DNA, 75 bp, Artificial Sequence
  Synthetic
ccctagcactgaaaaacaaggctctgacgattacccccctgcccataaaatttgcctagccaaaaataaaggatg

SEQ ID NO: 277610 - DNA, 75 bp, Artificial Sequence
  Synthetic
tttgcctagccaaaaataaaggatgccgagtctataaaagcgcaaggacagttcaggaggtctctcgctccatca

SEQ ID NO: 277611 - DNA, 75 bp, Artificial Sequence
  Synthetic
ccgaccctccggtcacggagactcaccttggggatccatcctctccaagcggcctcggtcgagacgccttccgtg

SEQ ID NO: 277612 - DNA, 75 bp, Artificial Sequence
  Synthetic
agccatacaggagcaatgttgcttcctcaatatcagtaacactcatgtatccgtcctccaagaacggccccctct

SEQ ID NO: 277613 - DNA, 75 bp, Artificial Sequence
  Synthetic
ggactgtctcccggcctcagcacctcctgaactgctccttccagggtaagtctcctctcaggtcgagctcggctg

SEQ ID NO: 277614 - DNA, 75 bp, Artificial Sequence
  Synthetic
cctgcgctcggctagactctggcttgaaacctcacttccgcgttcttggtctcgttctttcctcttcgtcgtcac

SEQ ID NO: 277615 - DNA, 75 bp, Artificial Sequence
  Synthetic
tgaaaacgaaacttcaacgccgcccttctggcaggcttggcccggggccaacatactgccgcggaggcgcagtaa

SEQ ID NO: 277616 - DNA, 75 bp, Artificial Sequence
  Synthetic
ttctggcaggcttggcccggggccaacatactgccgcggaggcgcagtaagggctagggcttcctgaacctctcc

SEQ ID NO: 277617 - DNA, 75 bp, Artificial Sequence
  Synthetic
gggctagggcttcctgaacctctccgggagaggtccatcgctataggcaggcccgccccaggagcatctgtcttc

SEQ ID NO: 277618 - DNA, 75 bp, Artificial Sequence
  Synthetic
atgcctctcttccctctcccggcgcttttgatccttttccgcaggcgctccttcctgcgccgctcccgctcctca

SEQ ID NO: 277619 - DNA, 75 bp, Artificial Sequence
  Synthetic
ccggggaagacaaacaagtgggggctcgtccgggatctgaattcctccattctcacattatggggcaaatccacg

SEQ ID NO: 277620 - DNA, 75 bp, Artificial Sequence
  Synthetic
tcgtccgggatctgaattcctccattctcacattatggggcaaatccacgggctttccccaactccaatacccaa

SEQ ID NO: 277621 - DNA, 75 bp, Artificial Sequence
  Synthetic
ggcccccagggggctatcgatccaccactggcttaattttctccaggctgcttaccgcctgcagcctgggccctc

SEQ ID NO: 277622 - DNA, 75 bp, Artificial Sequence
  Synthetic
cttaccgcctgcagcctgggccctccgatttcgacttccaacagctacgacgctttcttaaactagcccttaaaa

SEQ ID NO: 277623 - DNA, 75 bp, Artificial Sequence
  Synthetic
ctctccagggggaggcacatcagatgtcagactctcctccccctggtctcctaacggcaatctcctaaaatagtc

SEQ ID NO: 277624 - DNA, 75 bp, Artificial Sequence
  Synthetic
cgcccatttggctaaatcctatcgactactcgcttttagctagccttatccccaaaggatatccgggaagggtgg

SEQ ID NO: 277625 - DNA, 75 bp, Artificial Sequence
  Synthetic
gtcccccccccttacgtagaacccactaccacacaatgctttcctatcttacatccccctggagccccctcagct

SEQ ID NO: 277626 - DNA, 75 bp, Artificial Sequence
  Synthetic
ctcctctgcccctggcagcccccagttcatgcagaccctccggctggcggtacaacagtttgaccccaccgccaa

SEQ ID NO: 277627 - DNA, 75 bp, Artificial Sequence
  Synthetic
ctcccccaaggttccacccgccttcttccaatcaatgcgaaagcacaccccctatcgcaatggatgcctggaacc

SEQ ID NO: 277628 - DNA, 75 bp, Artificial Sequence
  Synthetic
ttcatgcagaccctccggctggcggtacaacagtttgaccccaccgccaaggatttacaagatctcctccagtac

SEQ ID NO: 277629 - DNA, 75 bp, Artificial Sequence
  Synthetic
tacaccatcagcagctcaacacactaatcaccgaggctgagactcgcggggtgacaggctacaaccccatggcag

SEQ ID NO: 277630 - DNA, 75 bp, Artificial Sequence
  Synthetic
ccgtgacccctcttgggcggctatcctacaggggctggaagaaccctattgcgcgttcgtagagcgccttaatgt

SEQ ID NO: 277631 - DNA, 75 bp, Artificial Sequence
  Synthetic
ggcacccccaaagagcccatcttacgctccctagcgtactcaaatgccaacaaagaatgccaaaaaatcttacaa

SEQ ID NO: 277632 - DNA, 75 bp, Artificial Sequence
  Synthetic
ggactgcccacagcttaaaccccctcaggaggaaggggaacccctcctgttggatctctcctccacctcaggtac

SEQ ID NO: 277633 - DNA, 75 bp, Artificial Sequence
  Synthetic
ggcgtggacacccaaggacaaaaccaaggtccttgtggtccaaccacggaggcccccccccacacagccctgctt

SEQ ID NO: 277634 - DNA, 75 bp, Artificial Sequence
  Synthetic
aaggtccttgtggtccaaccacggaggcccccccccacacagccctgctttcgttgtggcaaggtaggacactgg

SEQ ID NO: 277635 - DNA, 75 bp, Artificial Sequence
  Synthetic
cagggcagccatctttagtagttcaatcctctctattaatcttcaaaaaattccaaaccaaagcctcccatccct

SEQ ID NO: 277636 - DNA, 75 bp, Artificial Sequence
  Synthetic
agtcgggactgcacccagccacgcccccctcctggcccctgccccctatgccaagatccttctcactggaaaagg

SEQ ID NO: 277637 - DNA, 75 bp, Artificial Sequence
  Synthetic
actgaggaaaaaaactccttagggggggagatctaatctccccccatcccgatcaagacatctcaatactcccac

SEQ ID NO: 277638 - DNA, 75 bp, Artificial Sequence
  Synthetic
cccctgcccataaaatttgcctagccaaaaataaaggatgccgagtctataaaagcgcaaggacagttcaggagg

SEQ ID NO: 277639 - DNA, 75 bp, Artificial Sequence
  Synthetic
acgacaccctggtcctaggcgccagtgggcaaactaatacccagttcaaactcctccaaacccccctacacatat

SEQ ID NO: 277640 - DNA, 75 bp, Artificial Sequence
  Synthetic
ctcctccaaacccccctacacatattcttacccttccgaaagtcccccgttattcttccctcctgtctcttagac

SEQ ID NO: 277641 - DNA, 75 bp, Artificial Sequence
  Synthetic
tcttacccttccgaaagtcccccgttattcttccctcctgtctcttagacacccacaacaaatggaccatcattg

SEQ ID NO: 277642 - DNA, 75 bp, Artificial Sequence
  Synthetic
cccagcccccaccaattgctgccaatagccactccacacaccataggcctcgaacaccttcccccaccgccccag

SEQ ID NO: 277643 - DNA, 75 bp, Artificial Sequence
  Synthetic
gcgcctccaggccctaaatgacctggtctccaaggccctggaggctggccacattgaaccgtactcaggaccagg

SEQ ID NO: 277644 - DNA, 75 bp, Artificial Sequence
  Synthetic
caataaccccgtcttccccgttaaaaaaccaaatggcaaatggaggttcattcatgacctaagagctaccaacgc

SEQ ID NO: 277645 - DNA, 75 bp, Artificial Sequence
  Synthetic
acaaatcatagaccttactgacgcctttttccaaatccccctccctaagcagttccagccatacttcgccttcac

SEQ ID NO: 277646 - DNA, 75 bp, Artificial Sequence
  Synthetic
tttttccaaatccccctccctaagcagttccagccatacttcgccttcaccatcccccagtcatgtaattgtggc

SEQ ID NO: 277647 - DNA, 75 bp, Artificial Sequence
  Synthetic
cccgggaccagatatgcatggactgtccttccacaggggtttaaaaacagccccaccctcttcgagcaacaatta

SEQ ID NO: 277648 - DNA, 75 bp, Artificial Sequence
  Synthetic
aaatgtttcccacgtcgaccattgtccaatacatggatgacatacttttggccagccccaccaataaggaattac

SEQ ID NO: 277649 - DNA, 75 bp, Artificial Sequence
  Synthetic
ccatccttcgcaaacacctgcagtccctatattctgcccttcgcgggtaccgggacccaagagcctgtatcaccc

SEQ ID NO: 277650 - DNA, 75 bp, Artificial Sequence
  Synthetic
ttacaccacaacaactccatgcgctacatgccatccaacaagctctacaacataactgccgtggccgcctcaacc

SEQ ID NO: 277651 - DNA, 75 bp, Artificial Sequence
  Synthetic
ccctacaacattatggccagctctgccaatctttccaccacaacatgtcaaaacaggccctttgcgacttcctaa

SEQ ID NO: 277652 - DNA, 75 bp, Artificial Sequence
  Synthetic
acatgccatccaacaagctctacaacataactgccgtggccgcctcaaccctgccctacctctcctcggccttat

SEQ ID NO: 277653 - DNA, 75 bp, Artificial Sequence
  Synthetic
tctgtcatctttcaacccaagcaaaattggcccctggcttggctccataccccccaccctccgaccagtttatgt

SEQ ID NO: 277654 - DNA, 75 bp, Artificial Sequence
  Synthetic
attggcccctggcttggctccataccccccaccctccgaccagtttatgtccttggggtcacctactggcctgta

SEQ ID NO: 277655 - DNA, 75 bp, Artificial Sequence
  Synthetic
cccccaccctccgaccagtttatgtccttggggtcacctactggcctgtaccattctaactctagacaaatacac

SEQ ID NO: 277656 - DNA, 75 bp, Artificial Sequence
  Synthetic
caatctttccaccacaacatgtcaaaacaggccctttgcgacttcctaaggaattcccctcatccaagtgtcggc

SEQ ID NO: 277657 - DNA, 75 bp, Artificial Sequence
  Synthetic
tccttgcacttatctgtggactacgtgctgccaagccatggccctcccttaatatcttcttagactctaaatact

SEQ ID NO: 277658 - DNA, 75 bp, Artificial Sequence
  Synthetic
cttccaacccttctccaggaaccacgactcctcagaccaattttcaccctctcccccatcgtgcttgacacggcc

SEQ ID NO: 277659 - DNA, 75 bp, Artificial Sequence
  Synthetic
cattggggccttcctcggaacttccgcccatcaaaccctccaggcggccttaccacccctactgcaaggcaagac

SEQ ID NO: 277660 - DNA, 75 bp, Artificial Sequence
  Synthetic
gctgccaagccatggccctcccttaatatcttcttagactctaaatacttaatcaaatacctacactccctcgcc

SEQ ID NO: 277661 - DNA, 75 bp, Artificial Sequence
  Synthetic
cccatcaaaccctccaggcggccttaccacccctactacagggcaagaccatctacctccatcatgttcgtagcc

SEQ ID NO: 277662 - DNA, 75 bp, Artificial Sequence
  Synthetic
ccatacctgccagatcatcaactcacaacatcatatgcctcaagggcacattcgccggggcctcctacccaacca

SEQ ID NO: 277663 - DNA, 75 bp, Artificial Sequence
  Synthetic
catatggcaaggtgatgtaacccattataagtacaaaaaatacaaatactgcctccacgtctgggtagacacctt

SEQ ID NO: 277664 - DNA, 75 bp, Artificial Sequence
  Synthetic
aagaagaaagaaaccagctgtgagactatcagcgccttccttcaggccatttccctcctgggaaaaccactccac

SEQ ID NO: 277665 - DNA, 75 bp, Artificial Sequence
  Synthetic
attaatacagataatgggccagccttcttgtcacaagaattccaggagttttgtacctcctatcacatcaaacat

SEQ ID NO: 277666 - DNA, 75 bp, Artificial Sequence
  Synthetic
tctacccatataccatacaaccccaccagctcaggcctggtcgaaaggaccaatggtatagtcaaaaacttacta

SEQ ID NO: 277667 - DNA, 75 bp, Artificial Sequence
  Synthetic
caaagccctttggaccctcaatcagctaaatgtcatgaaccccagtggtaaaacccgatggcaaatccatcacag

SEQ ID NO: 277668 - DNA, 75 bp, Artificial Sequence
  Synthetic
tcctccattgccacccattcctgaaacctctaaccctcccaaaccaccatctaaatggttttattataaactccc

SEQ ID NO: 277669 - DNA, 75 bp, Artificial Sequence
  Synthetic
ttcccactagcccagcagagccgatgcacactcacggttggtatttcctcctaccactccagcccctgtagccca

SEQ ID NO: 277670 - DNA, 75 bp, Artificial Sequence
  Synthetic
ctaaatggttttattataaactccccggccttaccaatcagcggtggaaaggtccattacaatccctccaggaag

SEQ ID NO: 277671 - DNA, 75 bp, Artificial Sequence
  Synthetic
cggccttaccaatcagcggtggaaaggtccattacaatccctccaggaagctgctggggcagccttgctctccat

SEQ ID NO: 277672 - DNA, 75 bp, Artificial Sequence
  Synthetic
ctacttttattcagtctcacacacttcacaccagtccagcagagccgatgcacactcacggttggtatttcctcc

SEQ ID NO: 277673 - DNA, 75 bp, Artificial Sequence
  Synthetic
tcacaccagtccagcagagccgatgcacactcacggttggtatttcctcctaccattccaacccctgtagcccaa

SEQ ID NO: 277674 - DNA, 75 bp, Artificial Sequence
  Synthetic
ccacattggataaagaagccaaacagacagggcctaggatactactcgccctcctataatgacccttgctcactg

SEQ ID NO: 277675 - DNA, 75 bp, Artificial Sequence
  Synthetic
caatgcccctacttaggctgccaatcatggacatgcccatacacgggccccgtctccagtccatcctggaagttt

SEQ ID NO: 277676 - DNA, 75 bp, Artificial Sequence
  Synthetic
catggacatgcccatacacgggccccgtctccagtccatcctggaagtttcattcagatgtaaatttcacccaag

SEQ ID NO: 277677 - DNA, 75 bp, Artificial Sequence
  Synthetic
aagtcagccaagtgtcccttcgactacacttctctaagtgcggctcctccatgacccttctagtagatgcccctg

SEQ ID NO: 277678 - DNA, 75 bp, Artificial Sequence
  Synthetic
acacttctctaagtgcggctcctccatgacccttctagtagatgcccctggatatgatcctttatggttcatcac

SEQ ID NO: 277679 - DNA, 75 bp, Artificial Sequence
  Synthetic
gatatgatcctttatggttcatcacctcagaacccactcagcctcccccaactcctcccccattggtccatgact

SEQ ID NO: 277680 - DNA, 75 bp, Artificial Sequence
  Synthetic
ccgaccttgaacacgtcctaaccccctccacgtcttggacaaccaaaatgctcaagtttatccagctgaccttgc

SEQ ID NO: 277681 - DNA, 75 bp, Artificial Sequence
  Synthetic
agagcaccaattactcctgcatggtttgcgtggatagatccagcctctcatcctggcatgtgctctacaccccca

SEQ ID NO: 277682 - DNA, 75 bp, Artificial Sequence
  Synthetic
tggcttgtctccgctctagcggccgggacaggtatcgctggcggagtaacaggctccctatctctagcttccagt

SEQ ID NO: 277683 - DNA, 75 bp, Artificial Sequence
  Synthetic
acagataactgcaacaactccattatcctcccccctttttccctcgcccccgtacctcctccggcgacaagacgc

SEQ ID NO: 277684 - DNA, 75 bp, Artificial Sequence
  Synthetic
atagtcaaaaatcatcaaaacatcctccgggttgcacaatatgcagcccagaatagacgaggattagacctccta

SEQ ID NO: 277685 - DNA, 75 bp, Artificial Sequence
  Synthetic
cccagagaccatgctataatagacccgctagcttctgcagcaaatccccatggttcatccccctaccattgaccc

SEQ ID NO: 277686 - DNA, 75 bp, Artificial Sequence
  Synthetic
tggttcatccccctaccattgacccatccacagtcctctataccagatgagtcacccccgatgtccagccccgac

SEQ ID NO: 277687 - DNA, 75 bp, Artificial Sequence
  Synthetic
gggactaaactgggatcttggtctgtcccagtgggcacgagaagccctccagacaggcataaccattctcgccct

SEQ ID NO: 277688 - DNA, 75 bp, Artificial Sequence
  Synthetic
ccctgtatcctccgccaaattcaaacccttccgcagcggttacaaaaccgacacaaccagtatgcccttattaac

SEQ ID NO: 277689 - DNA, 75 bp, Artificial Sequence
  Synthetic
tcacgctcctgcagaagctttaagatctcccgctgctcctccgccaacagcttccgacgagagtctcgcacctgc

SEQ ID NO: 277690 - DNA, 75 bp, Artificial Sequence
  Synthetic
ctcctccaacccccgctcacattcctcccatagggcctttttttcctcttccaaaaaatccacataaccctgaag

SEQ ID NO: 277691 - DNA, 75 bp, Artificial Sequence
  Synthetic
tcccatagggcctttttttcctcttccaaaaaatccacataaccctgaagcagatcacaaaacccatcaaaaccc

SEQ ID NO: 277692 - DNA, 75 bp, Artificial Sequence
  Synthetic
ctcctaacggcaatctcctaaaatagtctaaaaaattacacataattacaaccctgtctcctctcagcccatttc

SEQ ID NO: 277693 - DNA, 75 bp, Artificial Sequence
  Synthetic
ccaggattcggacagagcctcctatatggataccccgtctacgtgtttggcgattgtgtacaggccgattggtgt

SEQ ID NO: 277694 - DNA, 75 bp, Artificial Sequence
  Synthetic
tcctttctgcgccgctcccgctcctcacgctcctgcagaagcttcaagatctcccgctgctcctccgccaatagc

SEQ ID NO: 277695 - DNA, 75 bp, Artificial Sequence
  Synthetic
cacgctcctgcagaagcttcaagatctcccgctgctcctccgccaatagcttccgacgagagtctcgcacctgct

SEQ ID NO: 277696 - DNA, 75 bp, Artificial Sequence
  Synthetic
cgctgaccgatcccgaccccagagggcggccttttgctgtccttcttggttcctctccagggggaggcacaccag

SEQ ID NO: 277697 - DNA, 75 bp, Artificial Sequence
  Synthetic
atgtcagactctcctccccctggtctcctaacggcaatctcctaaaatagtctaaaaagattacacataattaca

SEQ ID NO: 277698 - DNA, 75 bp, Artificial Sequence
  Synthetic
accctgtctcctctcagcccatttcccaggatttggacagagcctcctatatagataccccgtctacgtgtctgg

SEQ ID NO: 277699 - DNA, 75 bp, Artificial Sequence
  Synthetic
cgattgtgtacaggccgattggtgtcccgtctcaggtggtctatgttccacccgcctacatcgacatgccctcct

SEQ ID NO: 277700 - DNA, 75 bp, Artificial Sequence
  Synthetic
cccgtctcaggtggtctatgttccacccgcctacatcgacatgccctcctggccacctgtccagagcaccagctc

SEQ ID NO: 277701 - DNA, 75 bp, Artificial Sequence
  Synthetic
acctgggaccccatcgatggacgcgttgtcagctctcctctccaataccttatccctcgcctcccctccttcccc

SEQ ID NO: 277702 - DNA, 75 bp, Artificial Sequence
  Synthetic
cctcttatctactctctcatcaacttatacaatactcctccttccataaccttcacctcctattcgacgaataca

SEQ ID NO: 277703 - DNA, 75 bp, Artificial Sequence
  Synthetic
acccagagaacctccaagaccctcaaggtccttacccctcccaccactcctgtctcccccaaggttccacccgcc

SEQ ID NO: 277704 - DNA, 75 bp, Artificial Sequence
  Synthetic
ccccctatcgcaatggatgcctggaaccaaccctcggggatcagctcccctccctcgccttccctgaacctggcc

SEQ ID NO: 277705 - DNA, 75 bp, Artificial Sequence
  Synthetic
ctggggaaaaaccgtagtgtgcctatacctattccagctttccccacccatgacctggccacttataccccatgt

SEQ ID NO: 277706 - DNA, 75 bp, Artificial Sequence
  Synthetic
caaaatgttcctacacacaggggcagtcatagtcctcccggaggacgacctacccaccacaatgttccagcccgt

SEQ ID NO: 277707 - DNA, 75 bp, Artificial Sequence
  Synthetic
ctcaggtcgagctcggctgcctcttaggtagtcgctccccgagggtctttagagacacccgggttcccgcctgcg

SEQ ID NO: 277708 - DNA, 75 bp, Artificial Sequence
  Synthetic
aagggctccctgtatccagactgcctggtgtacaggacttctcccctatcactccatcctaacaaccccaggcct

SEQ ID NO: 277709 - DNA, 75 bp, Artificial Sequence
  Synthetic
tggtgtacaggacttctcccctatcactccatcctaacaaccccaggcctaatatggaccttcaacgatggctca

SEQ ID NO: 277710 - DNA, 75 bp, Artificial Sequence
  Synthetic
ccaatgatttccggcccttgccctaaggcagggcagccatctttagtagttcaatcctctctattaatcttcgaa

SEQ ID NO: 277711 - DNA, 75 bp, Artificial Sequence
  Synthetic
aggcagggcagccatctttagtagttcaatcctctctattaatcttcgaaaaattccaaaccaaagccttccatc

SEQ ID NO: 277712 - DNA, 75 bp, Artificial Sequence
  Synthetic
ccaacatccctgtctctattttatttaataaagaagaggcggatgacaatggcgaccagcctcctgagccagccg

SEQ ID NO: 277713 - DNA, 75 bp, Artificial Sequence
  Synthetic
accacggccctgacgtccctcccccccaggaaccaggaacagctctccagaaaaaaatagacctcacccttaccc

SEQ ID NO: 277714 - DNA, 75 bp, Artificial Sequence
  Synthetic
cccagggcgagtcatcgacccaaaaggtcagaccgtctcacacaaacaatcccaagtaaaggctctgacgtctcc

SEQ ID NO: 277715 - DNA, 75 bp, Artificial Sequence
  Synthetic
atgccgagtctataaaagcgcaaggacagttcaggaggtgtctcgctccctcaccgaccctctggtcacggagac

SEQ ID NO: 277716 - DNA, 75 bp, Artificial Sequence
  Synthetic
gaaaaagctctccagaaaaataaacctcgcccttacccacttcccctagcactgaaaaacaaggctctgacgatt

SEQ ID NO: 277717 - DNA, 75 bp, Artificial Sequence
  Synthetic
tctcgttctttcctcttcgccgtcactgaaaacgaaacctcaacgccgccctcttggcaggcgtggcccggggcc

SEQ ID NO: 277718 - DNA, 75 bp, Artificial Sequence
  Synthetic
gtcgagacgccttccgtgggactgtctcccggcctcagcacctcctgaactgctccttccagggtaagtctcctc

SEQ ID NO: 277719 - DNA, 75 bp, Artificial Sequence
  Synthetic
aacatactgccgtggaggcgcagcaagggctagggcttcctgaacctctccgggagaggtccattgctataggca

SEQ ID NO: 277720 - DNA, 75 bp, Artificial Sequence
  Synthetic
agggctagggcttcctgaacctctccgggagaggtccattgctataggcaggcccgccctaggagcatctgtctt

SEQ ID NO: 277721 - DNA, 75 bp, Artificial Sequence
  Synthetic
tttcctcttcgtcgtcactgaaaacgaaacttcaacgccgcccttctggcaggcttggcccggggccaacatact

SEQ ID NO: 277722 - DNA, 75 bp, Artificial Sequence
  Synthetic
ggcttcctgaacctctccgggagaggtccatcgctataggcaggcccgccctaggagcattgtcttcaagccgaa

SEQ ID NO: 277723 - DNA, 75 bp, Artificial Sequence
  Synthetic
tgccctactactactcctccgccacctccccccccttccccggaggcccatgttccccctccttacgcggaaccc

SEQ ID NO: 277724 - DNA, 75 bp, Artificial Sequence
  Synthetic
ttcctgaacctctccgggagaggtccatcgctataggcaggcccgccctaggagcattgtcttcaagccgaattc

SEQ ID NO: 277725 - DNA, 75 bp, Artificial Sequence
  Synthetic
ttacaggccatcaagcaggaggtcagctcctctgctcctggcagcccccagttcatgcagaccctccggctggcg

SEQ ID NO: 277726 - DNA, 75 bp, Artificial Sequence
  Synthetic
ccgagtctataaaagcgcaaggacagttcaggaggtctctcgctccttcaccgaccctccggtcgcgaagactca

SEQ ID NO: 277727 - DNA, 75 bp, Artificial Sequence
  Synthetic
cctatgctcctccctcgtagtttccttacaccatcagcagctcaacacactaattaccgaggctgagacccgcgg

SEQ ID NO: 277728 - DNA, 75 bp, Artificial Sequence
  Synthetic
tgcgcgttcgtagagcgccttaacgtggcccttgacaacggcctccccgaaggtacccccaaagagcccatctta

SEQ ID NO: 277729 - DNA, 75 bp, Artificial Sequence
  Synthetic
tccccccccttccccggaggcccatgttccccccccttacgtggaacccactaccacacaatgctttcctatctt

SEQ ID NO: 277730 - DNA, 75 bp, Artificial Sequence
  Synthetic
cacccacaacaaatggaccatcattggaagggacgccctacaacaatgccaggggcttctataccttccagacga

SEQ ID NO: 277731 - DNA, 75 bp, Artificial Sequence
  Synthetic
ttcatgcagaccctccggctggcggtacaacagtttgaccccaccgccaaggacttacaagatctcctccagtac

SEQ ID NO: 277732 - DNA, 75 bp, Artificial Sequence
  Synthetic
cacaggccctggcagatgaaagacttacaggccatcaagcaggaggtcagctcctctgcccctggcagcccccag

SEQ ID NO: 277733 - DNA, 75 bp, Artificial Sequence
  Synthetic
ctacaggggctggaagaaccctactgcgcgttcgtagagcgccttaatgtggcccttgacaacggcctccccgag

SEQ ID NO: 277734 - DNA, 75 bp, Artificial Sequence
  Synthetic
ccctatattctgcccttcacgggtaccgggacccaagagcttgtatcaccctcacaccacaacaacttcatgcgt

SEQ ID NO: 277735 - DNA, 75 bp, Artificial Sequence
  Synthetic
tcgttgtggcaagataggacactggagtcgggactgcacccagccacgcccccctcctggcccctgccccctatg

SEQ ID NO: 277736 - DNA, 75 bp, Artificial Sequence
  Synthetic
gttatgggacaaacacctcagcctacccaagcgctacttgacacaggagccgaccgtacggttataccccagaca

SEQ ID NO: 277737 - DNA, 75 bp, Artificial Sequence
  Synthetic
cccaagcgctacttgacacaggagccgaccgtacggttataccccagacactcgtgcctgggccggtaaagctcc

SEQ ID NO: 277738 - DNA, 75 bp, Artificial Sequence
  Synthetic
acaacatcatatgcctcgagggtacattcgccggggcctcttgcccaaccacatatggcaaggtgatgtaaccca

SEQ ID NO: 277739 - DNA, 75 bp, Artificial Sequence
  Synthetic
gtggaccaatttcctttaaacctgagcgcctccaggccttaaatgacctggtctccaaggccctggaggctggcc

SEQ ID NO: 277740 - DNA, 75 bp, Artificial Sequence
  Synthetic
catcgctaccaccctcacctctccttccccagggccccccgacctcactagcctaccaacagccttaccccacct

SEQ ID NO: 277741 - DNA, 75 bp, Artificial Sequence
  Synthetic
tccccagggccccccgacctcactagcctaccaacagccttaccccacctacagaccatagaccttactgacgcc

SEQ ID NO: 277742 - DNA, 75 bp, Artificial Sequence
  Synthetic
ccaacaccatgggtaatgttttcttcctacttttattcagtctcacacattttccaccagcccagcagagccgat

SEQ ID NO: 277743 - DNA, 75 bp, Artificial Sequence
  Synthetic
aacttctcccccattggtccatgactccgaccttgaacatgtcctaaccccctccacgtcctggacgaccaagat

SEQ ID NO: 277744 - DNA, 75 bp, Artificial Sequence
  Synthetic
tccttccacaggggtttaaaaacagccccaccctcttcgagcaacaattagcggctgtcctcaaccccatgagga

SEQ ID NO: 277745 - DNA, 75 bp, Artificial Sequence
  Synthetic
aacaactctcccagttaaccctccaggcactgaccacacatggccttccaatctcccaggaaaaaacgcaacgta

SEQ ID NO: 277746 - DNA, 75 bp, Artificial Sequence
  Synthetic
ggcactgaccacacatggccttccaatctcccaggaaaaaacgcaacgtaccccaggccagatacgcttcttagg

SEQ ID NO: 277747 - DNA, 75 bp, Artificial Sequence
  Synthetic
ccccaggccagatacgcttcttaggacaagtcatctcccctaatcacattacatatgaaagtacccctgctattc

SEQ ID NO: 277748 - DNA, 75 bp, Artificial Sequence
  Synthetic
ccatccttcgcaaacacctacaatccctatattctgcccttcacgggtaccgggacccaagagcctgtatcaccc

SEQ ID NO: 277749 - DNA, 75 bp, Artificial Sequence
  Synthetic
cataactgccgtggccgcctcgaccctaccctacctctcctcggccttatctcgttgagtacatctggcacaaca

SEQ ID NO: 277750 - DNA, 75 bp, Artificial Sequence
  Synthetic
aaaagccttctcctcgaggttgacaaagatatctcccaccttacccaggccatagtcaaaaatcatcaaaacatc

SEQ ID NO: 277751 - DNA, 75 bp, Artificial Sequence
  Synthetic
aaggccatacaggagcaatgttgcttcctcaatatcagtaacactcatgtatccgtcctccaggaacggccccct

SEQ ID NO: 277752 - DNA, 75 bp, Artificial Sequence
  Synthetic
cccctgtatcctccgccaaatccaggcccttccgcagcggttacaaaaccgacataaccagtattcccttatcaa

SEQ ID NO: 277753 - DNA, 75 bp, Artificial Sequence
  Synthetic
atcctcattcaccacatgggtcgcttccataaccttggcagtcaaccgtctggcccgtggaagactctcttacac

SEQ ID NO: 277754 - DNA, 75 bp, Artificial Sequence
  Synthetic
gacataaccagtattcccttatcaacccagaaaccatgctataatagacctgctagcttctgcagcaaatcccca

SEQ ID NO: 277755 - DNA, 75 bp, Artificial Sequence
  Synthetic
tggttcatccccctaccattaacccatccacagtcttctataccagatgagtcgcccccgatgtccagccccgac

SEQ ID NO: 277756 - DNA, 75 bp, Artificial Sequence
  Synthetic
atccacagtcttctataccagatgagtcgcccccgatgtccagccccgactcgaactgaataattgcctcaaata

SEQ ID NO: 277757 - DNA, 75 bp, Artificial Sequence
  Synthetic
ccctgccttttttccgatggctcccctcaaaaggcagcatacgtcctctgggaccagactatccttcaacaagac

SEQ ID NO: 277758 - DNA, 75 bp, Artificial Sequence
  Synthetic
ctcccccgtcgtgcttgacacggccccctgccttttttccgatggctcccctcaaaaggcagcatacgtcctctg

SEQ ID NO: 277759 - DNA, 75 bp, Artificial Sequence
  Synthetic
ggaccagactatccttcaacaagacattactcccctgccccctcacgaaacaaattccgcacaaaagggagaact

SEQ ID NO: 277760 - DNA, 75 bp, Artificial Sequence
  Synthetic
tccaggaaatccacataaccctgaagcaagtcacaaaacccatcaaaacccaggagtcctatacactccaactgc

SEQ ID NO: 277761 - DNA, 75 bp, Artificial Sequence
  Synthetic
caccttcaatgaatacacagactcccttattgtagctccccttgtccccctgacgccccagggcctccacggcct

SEQ ID NO: 277762 - DNA, 75 bp, Artificial Sequence
  Synthetic
cacccattgcaaccaaagggctctagtctcctttggcgccacaccaaaggaagccaagtcccttgtacagacttg

SEQ ID NO: 277763 - DNA, 75 bp, Artificial Sequence
  Synthetic
tctccgacgagaatctcgcacctgctcgctgaccgatcccgaccccagagggcgaccttttgctgtccttcgtgg

SEQ ID NO: 277764 - DNA, 75 bp, Artificial Sequence
  Synthetic
gtctcctttggcgccacaccaaaggaagccaagtcccttgtacagacttgccatacctgtcagatcatcaactca

SEQ ID NO: 277765 - DNA, 75 bp, Artificial Sequence
  Synthetic
tctacccacataccatacaaccccaccagctcaggcctggtcgaaaggaccaatggtataatcaaaaatttacta

SEQ ID NO: 277766 - DNA, 75 bp, Artificial Sequence
  Synthetic
accttcccctagacaatgccattaacaaagccctctggaccctcaatcagctaaatgtcatgaaccccagtggta

SEQ ID NO: 277767 - DNA, 75 bp, Artificial Sequence
  Synthetic
aaacccgatggcaaatccatcacagccctccattgccacccattcctgaagcctctacccctcccaaaccaccat

SEQ ID NO: 277768 - DNA, 75 bp, Artificial Sequence
  Synthetic
cggccttaccaatcagcggtggaaaggtccattacaatccctccaggaagcggctggggcagccctgctctccat

SEQ ID NO: 277769 - DNA, 75 bp, Artificial Sequence
  Synthetic
taaaacgattagaagaacttctatacaaaatgttcctacacacaggggcagtcatagtcctcccggaggacgacc

SEQ ID NO: 277770 - DNA, 75 bp, Artificial Sequence
  Synthetic
taccactccagcccctgtagcccaacccaacccgtctgcacgtggaacctcgaccttaattccctaacgacggac

SEQ ID NO: 277771 - DNA, 75 bp, Artificial Sequence
  Synthetic
tacccaccacaatgttccaacccgtgagggctccctgtatccagactgcctggtgtacaggacttctcccctatc

SEQ ID NO: 277772 - DNA, 75 bp, Artificial Sequence
  Synthetic
cccaacccgtctgcacgtggaacctcgaccttaattccctaacgacggaccagcgactacatcccccctgcccta

SEQ ID NO: 277773 - DNA, 75 bp, Artificial Sequence
  Synthetic
actccatcttaacaaccccaggtctaatatggaccttcaatgacggctcaccaatgatttccggcccttgcccca

SEQ ID NO: 277774 - DNA, 75 bp, Artificial Sequence
  Synthetic
aatatggaccttcaatgacggctcaccaatgatttccggcccttgccccaaggcagggcagccatctttagtagt

SEQ ID NO: 277775 - DNA, 75 bp, Artificial Sequence
  Synthetic
cccaagtaaaggctctgacgtctcccccttttttaggaactgaaaccacggccctgacgtccctcccccccagga

SEQ ID NO: 277776 - DNA, 75 bp, Artificial Sequence
  Synthetic
cttgccctgcccgctcctccattccaacccttcccttggacccattgctaccaacctcgcctacaggcaataacg

SEQ ID NO: 277777 - DNA, 75 bp, Artificial Sequence
  Synthetic
tcctcccccctttttccctcgcccccgtacctcctccggcgacaagacgccgccgtgccgttccaatagcagtgt

SEQ ID NO: 277778 - DNA, 75 bp, Artificial Sequence
  Synthetic
cgtacctcctccggcgacaagacgccgccgtgccgttccaatagcagtgtggcttgtctccgctctagcggccgg

SEQ ID NO: 277779 - DNA, 75 bp, Artificial Sequence
  Synthetic
ttgaaaagcgtgtcatcaccggttggggactaaactgggatcttggtctgtcccagtgggcacgagaagccctcc

SEQ ID NO: 277780 - DNA, 75 bp, Artificial Sequence
  Synthetic
ccctgcatcctccgccaaatccaagcccttccgcagcggttacaaaaccgacatagccagtatgcccttatcaac

SEQ ID NO: 277781 - DNA, 75 bp, Artificial Sequence
  Synthetic
tttcctcttcgccgtcactgaaaacgaaacctcaacgccgccctcttggcaggcgtcccggggccaacatactgc

SEQ ID NO: 277782 - DNA, 75 bp, Artificial Sequence
  Synthetic
cgtggagcgcagcaagggctagggcttcctgaacctctccgggagaggtctattgctataggcaggcccgcccta

SEQ ID NO: 277783 - DNA, 75 bp, Artificial Sequence
  Synthetic
ggttcatccccctaccattgacccatccacagtcttctatgccagatgagtcacccccgatgtccagccccgact

SEQ ID NO: 277784 - DNA, 75 bp, Artificial Sequence
  Synthetic
gaacctctccgggagaggtctattgctataggcaggcccgccctaggagcattgtcttcccggggaagacaaaca

SEQ ID NO: 277785 - DNA, 75 bp, Artificial Sequence
  Synthetic
tgacaatggcgaccggcctcctgagccagcgcccagggcgagtcatcgacccaaaaggtcagaccgtctcacaca

SEQ ID NO: 277786 - DNA, 75 bp, Artificial Sequence
  Synthetic
aggagtcctatacactccaactgctgatgcctctcttccctctcccggcgcttttgatccttttcccgcaggcgc

SEQ ID NO: 277787 - DNA, 75 bp, Artificial Sequence
  Synthetic
gtctccccctttataggaactgaaaccaaggccctgacgtcccccccccaggaaccaggaaaagctctccagaaa

SEQ ID NO: 277788 - DNA, 75 bp, Artificial Sequence
  Synthetic
tttgcctagccaaaaataaaggatgccgagtctataaaagcgtaaggacagttcaggaggtggctcgctccttca

SEQ ID NO: 277789 - DNA, 75 bp, Artificial Sequence
  Synthetic
tcctaacggcaatctcctaaaatagtctaaaaattacacataattacaaccctgtctcctctcagcccatttccc

SEQ ID NO: 277790 - DNA, 75 bp, Artificial Sequence
  Synthetic
cctgtctcctctcagcccatttcccaggattcggacagagcctcctatatggataccccgtctacgtgtttggcg

SEQ ID NO: 277791 - DNA, 75 bp, Artificial Sequence
  Synthetic
cggggaagacaaacaagtgggggctcgtccgggatttgaacccgggacctctcgcattatggggcaaatccacgg

SEQ ID NO: 277792 - DNA, 75 bp, Artificial Sequence
  Synthetic
ccaaaggatatccgggaagggtggtagagattataaacatccttgtcaaaaaccaagtctcccctagcgcccccg

SEQ ID NO: 277793 - DNA, 75 bp, Artificial Sequence
  Synthetic
cctattccagctttccccacccatgacctggccacttataccccatgtcatattctgccacccaagacaattggg

SEQ ID NO: 277794 - DNA, 75 bp, Artificial Sequence
  Synthetic
ccgccccagttccgacacctatctgccctaccactacccctccgccacctccccccccttccccggaggcccatg

SEQ ID NO: 277795 - DNA, 75 bp, Artificial Sequence
  Synthetic
aaatgttcctacacacaggagcggtcatagtcctcccggaggacgacctacccaccacaatgttccagcccgtaa

SEQ ID NO: 277796 - DNA, 75 bp, Artificial Sequence
  Synthetic
tgacaggctacaaccccatggcagggcccctaagaatgcaggctaataaccccgcccaacaaggtcttagacggg

SEQ ID NO: 277797 - DNA, 75 bp, Artificial Sequence
  Synthetic
aataccagaacctttggctggctgctttctccacccttccaggcaatacccgtgacccctcttgggcggctatcc

SEQ ID NO: 277798 - DNA, 75 bp, Artificial Sequence
  Synthetic
ctttataggaactgaaaccaaggccctgacgtccccccccaggaaccaggaaaagctctccagaaaaataaacct

SEQ ID NO: 277799 - DNA, 75 bp, Artificial Sequence
  Synthetic
gtcgggactgcacccagccacgcccccctcctggcccctgccccctatgccaggatccttctcactggaaaaggg

SEQ ID NO: 277800 - DNA, 75 bp, Artificial Sequence
  Synthetic
atcaagacatctcaatactcccactcattcccctgcggcaacaacaacaaccaattctaggagtccggatttccg

SEQ ID NO: 277801 - DNA, 75 bp, Artificial Sequence
  Synthetic
tcctcttcgtcgtcactgaaaacgaaacttcaacgccgcccttctggcaggcttggcccggggccagcatactgc

SEQ ID NO: 277802 - DNA, 75 bp, Artificial Sequence
  Synthetic
aacctctccgggagaggtccatcgctataggcaggcccgccccaggagcatctgtcttcccggggaagacaaaca

SEQ ID NO: 277803 - DNA, 75 bp, Artificial Sequence
  Synthetic
tgacagtgactctgaccctgggccttctagcctcggggcccccagggcgagtcatcagcttaaaggtcacgctgt

SEQ ID NO: 277804 - DNA, 75 bp, Artificial Sequence
  Synthetic
ctcacacaaacaatcccgggaacaggctctgacgtttccccctgcagaccatttgaggaaccaggaaccagtctc

SEQ ID NO: 277805 - DNA, 75 bp, Artificial Sequence
  Synthetic
cagaaaaataacctcacccttacccacttccccttgccttgaaaaacaaaggctctgacgactaccccccccacc

SEQ ID NO: 277806 - DNA, 75 bp, Artificial Sequence
  Synthetic
acttccccttgccttgaaaaacaaaggctctgacgactaccccccccacccataaaatttgcctactcaataaag

SEQ ID NO: 277807 - DNA, 75 bp, Artificial Sequence
  Synthetic
cccaggcctataaaagcgcaaggacggttcaggagggggtcaccttctttccacctgcccgctgtgcctaccttg

SEQ ID NO: 277808 - DNA, 75 bp, Artificial Sequence
  Synthetic
gagatccattccgcccggggcctcggtcgagacgtctcgagaaaagctccgtctcccgttccagacactctgaac

SEQ ID NO: 277809 - DNA, 75 bp, Artificial Sequence
  Synthetic
cgcgcctttcagggtaagtctccccccggttgagctgggctacgactcccgtagtcgctcccgcagtcggttgag

SEQ ID NO: 277810 - DNA, 75 bp, Artificial Sequence
  Synthetic
gctccctgaccctccggccgcgcacgttaggctctggtttgtaaccctacttccgcgttcttgtcttattctgcg

SEQ ID NO: 277811 - DNA, 75 bp, Artificial Sequence
  Synthetic
ccgaaaccgaaagcacagcgcctctgggtgccacgctggcccggggccagcatcctgtccagggacgcgcgccta

SEQ ID NO: 277812 - DNA, 75 bp, Artificial Sequence
  Synthetic
ctgaacccgaaggcgcctcaggcctctccgggaggggcactcggctcgggcccttgttctctccgggagagacaa

SEQ ID NO: 277813 - DNA, 75 bp, Artificial Sequence
  Synthetic
acaagtgggggctcgtccggggatacctacccctgccctgtcgcattatgggacaaacctacggcctctcgccta

SEQ ID NO: 277814 - DNA, 75 bp, Artificial Sequence
  Synthetic
gcccaatccccaaggcccccagaggtttatcaacccaccactggttaaatttcctccaagcctcctaccggctac

SEQ ID NO: 277815 - DNA, 75 bp, Artificial Sequence
  Synthetic
gcactgaccacacatggccttccaatttcccaggaaaaaacgcaacgtaccccaggccagatacgcttcttagga

SEQ ID NO: 277816 - DNA, 75 bp, Artificial Sequence
  Synthetic
aacctgggccctccgactttgattttcagcaactacgtcgtttcctgaaactagctcttaaaacacctatttggt

SEQ ID NO: 277817 - DNA, 75 bp, Artificial Sequence
  Synthetic
caagtcatctcccctaatcacattacatatgaaagtacccctgctattcccataaaatcccaatggacactcact

SEQ ID NO: 277818 - DNA, 75 bp, Artificial Sequence
  Synthetic
taaatccaatcgattactccctcctggccagcctcatccccaagggttaccccgggcggacaagcgagattatta

SEQ ID NO: 277819 - DNA, 75 bp, Artificial Sequence
  Synthetic
cataaaatcccaatggacactcactgagctacaggttatcctaggagaaatccagtgggtctctaaaggtacccc

SEQ ID NO: 277820 - DNA, 75 bp, Artificial Sequence
  Synthetic
atgtgttaattagaaatcaagcgtcccccaccccgcctcctgccccgtctctacccgaaccggctaacccaccgc

SEQ ID NO: 277821 - DNA, 75 bp, Artificial Sequence
  Synthetic
ccctccagcagccctcggctcctccggaaccccatacgccccccccctatatagagcctcccgctacccattgcc

SEQ ID NO: 277822 - DNA, 75 bp, Artificial Sequence
  Synthetic
catgccatccaacaagctctacaacataactgccgtggccgcctcgaccccaccctacctctcctcggccttatc

SEQ ID NO: 277823 - DNA, 75 bp, Artificial Sequence
  Synthetic
ttcccatactacatccacatggggctccctcggctcacaggccatggcaaatgaaagacctgcaggccatcaaac

SEQ ID NO: 277824 - DNA, 75 bp, Artificial Sequence
  Synthetic
aggaggtcaatacctcggcccctgggagtccccagttcatgcaaacagtccggctcgcaattcagcaattcgacc

SEQ ID NO: 277825 - DNA, 75 bp, Artificial Sequence
  Synthetic
ccacggccaaagacttacaagatctcttgcagtacctctgctcctccctagtcgtctcccttcaccatcaacaac

SEQ ID NO: 277826 - DNA, 75 bp, Artificial Sequence
  Synthetic
tccataccctaattaccgaggctgaaaccaggggaatgacaggttataatcccatggccggacccctaaggatgc

SEQ ID NO: 277827 - DNA, 75 bp, Artificial Sequence
  Synthetic
aggccaacaaccccgcccaggaaggactccggagggaataccaaaacctctggctggcagccttttcggctctgc

SEQ ID NO: 277828 - DNA, 75 bp, Artificial Sequence
  Synthetic
cagggaacacccgcgacccatcttgggcggcaatcttgcaagggctagaagaaccctattgcgccttgctagagc

SEQ ID NO: 277829 - DNA, 75 bp, Artificial Sequence
  Synthetic
gccttaatgttgctcttgacaacggtctccccgagggaaccccaaaggagcccatcttgcgctccctggcttact

SEQ ID NO: 277830 - DNA, 75 bp, Artificial Sequence
  Synthetic
ccaacgccaacaaagactgccaaaaacttgcaggctcggggccatactaatagccccttgggagacatgctccga

SEQ ID NO: 277831 - DNA, 75 bp, Artificial Sequence
  Synthetic
gcctgtcaagcatggacacccaaggacaaagcccgggtcctcgtcgtccaatcacgaaagcccccgcccacgcag

SEQ ID NO: 277832 - DNA, 75 bp, Artificial Sequence
  Synthetic
cccctgttccgctgtggaaaggcagggcattggagccgagactgcaccctcccacgccccccccctggtccatgc

SEQ ID NO: 277833 - DNA, 75 bp, Artificial Sequence
  Synthetic
cccttgtgcaaagacccttcccattggaaacgagattgtccacagctcaaaccccccccgacggaggaggaaccc

SEQ ID NO: 277834 - DNA, 75 bp, Artificial Sequence
  Synthetic
ctcctgctggacctgccctcagatgccgttgccaccgaggaaaaaaactccctagggggggagatctaatctccc

SEQ ID NO: 277835 - DNA, 75 bp, Artificial Sequence
  Synthetic
cccaacaaatctcactgctccctctcattcctttagagcaacagcagcagccccttctagacgttcaggtctcca

SEQ ID NO: 277836 - DNA, 75 bp, Artificial Sequence
  Synthetic
ttgcaggcgccccccctcgacctacccaggcactcttagacacaggggctgatctcaccgtcctgccccaggccc

SEQ ID NO: 277837 - DNA, 75 bp, Artificial Sequence
  Synthetic
ttgcccccgagtcagaaggtctctgacacaacggttctaggcgctggcggtcagaccagctcccagttcaaactc

SEQ ID NO: 277838 - DNA, 75 bp, Artificial Sequence
  Synthetic
cctccacgtctgggtagacaccttctccggtgcggtttccgtctcctgtaagaagaaagaaaccagctgtgagac

SEQ ID NO: 277839 - DNA, 75 bp, Artificial Sequence
  Synthetic
ctccgatcccccctgtgtgtctacctgcccttccggaaggcccccgttactctcccgtcatgccttctagacacc

SEQ ID NO: 277840 - DNA, 75 bp, Artificial Sequence
  Synthetic
gataataaatgggccattattggccgtgatatcctccagcaatgccagagtgtcctgtacctcccggaggacaat

SEQ ID NO: 277841 - DNA, 75 bp, Artificial Sequence
  Synthetic
ctctgcgaaggtaccccccggccctccggcagaatgaattccccccgactattacccgtggccacccccagtgtc

SEQ ID NO: 277842 - DNA, 75 bp, Artificial Sequence
  Synthetic
atcggccttgagcacttcccaccacccccacagatagatcagttcccctttaaacctgagcgcctccaggccttg

SEQ ID NO: 277843 - DNA, 75 bp, Artificial Sequence
  Synthetic
actgacctggtctccaaggccctggaggctagctacattgaaccttactctggaccaggcaacaaccctgtcttt

SEQ ID NO: 277844 - DNA, 75 bp, Artificial Sequence
  Synthetic
ccggtcaaaaaaccaaacggcaagtggagatttattcatgacctgagggccaccaatgccatcacgaccaccttg

SEQ ID NO: 277845 - DNA, 75 bp, Artificial Sequence
  Synthetic
gcctccccgtcccccggacctcccgatctcaccagcttatcaacagccctcccatatgtgcaaactatagacctt

SEQ ID NO: 277846 - DNA, 75 bp, Artificial Sequence
  Synthetic
gctgacgccttcttccaaattccccttccaaaacagttccagccatacttcgccttcactatcccccagccatgc

SEQ ID NO: 277847 - DNA, 75 bp, Artificial Sequence
  Synthetic
gccgagcacgccgcaacagaccaccaacaccatgggtaacgttttcttcctacttttattcagtctcacacactt

SEQ ID NO: 277848 - DNA, 75 bp, Artificial Sequence
  Synthetic
aattatggccccggggctcggtatgcctggactgtccttccacaaggattcaaaaatagtcccaccctgtttgag

SEQ ID NO: 277849 - DNA, 75 bp, Artificial Sequence
  Synthetic
caacagctggctgccatcctttcccctatcaggaaagccttccctacgtccactatcatccaatacatggatgat

SEQ ID NO: 277850 - DNA, 75 bp, Artificial Sequence
  Synthetic
atactcttggccagtcctgcgcagggggaactgcaacaactctccaagatgaccctccaagcgctagtcacccac

SEQ ID NO: 277851 - DNA, 75 bp, Artificial Sequence
  Synthetic
ggccttccagtctcccaggccccccgggaacaaacccctgggcaaatacgtttcttaggtcaagttatatctcct

SEQ ID NO: 277852 - DNA, 75 bp, Artificial Sequence
  Synthetic
cacattggataaagaagccaaacagacagggcctaggatactactcgccctcctataatgacccttgctcgctac

SEQ ID NO: 277853 - DNA, 75 bp, Artificial Sequence
  Synthetic
gaccatattacctatgaaaccacccccaccattcctatgaaatcccagtggactctcgctgaactacagactgtg

SEQ ID NO: 277854 - DNA, 75 bp, Artificial Sequence
  Synthetic
ctaggagagatccaatgggtctcaaaaggaacccccatcctccgcaaacacctgcagtgtttatactccgccctt

SEQ ID NO: 277855 - DNA, 75 bp, Artificial Sequence
  Synthetic
cgcggatatcaggaccccagggcacacctcctcctccagaaacaacagctccatgccctccatgccatccaaccc

SEQ ID NO: 277856 - DNA, 75 bp, Artificial Sequence
  Synthetic
ttacagcacaattgccgcagccgtctcaatcctgccttgcccatcctgggacttatctccttgagctcgtctggt

SEQ ID NO: 277857 - DNA, 75 bp, Artificial Sequence
  Synthetic
acaacctccgtcctcttccaagcccggcagcgatggcccctggtttggttgcacaccccccatccaccaaccagc

SEQ ID NO: 277858 - DNA, 75 bp, Artificial Sequence
  Synthetic
cttggcccctggggtcacttactggcctgcactatcctgaccttagacaaatactcccttcagcactatggccgg

SEQ ID NO: 277859 - DNA, 75 bp, Artificial Sequence
  Synthetic
ctgtgccagtccttggaggacaacatgtccaacacagccctccacgattttgtgaaaaactccccccacccgagg

SEQ ID NO: 277860 - DNA, 75 bp, Artificial Sequence
  Synthetic
gtaggcatccttatccatcacatgagccgctttcataacctcggtagtcagccatctggcccttggaaggctctc

SEQ ID NO: 277861 - DNA, 75 bp, Artificial Sequence
  Synthetic
ttacaccttcccgctctcctccaagcggcacggctcctccgacctctcttcacgctatctcccgtggtcttaaca

SEQ ID NO: 277862 - DNA, 75 bp, Artificial Sequence
  Synthetic
acgcaccctgtctcttctccgacgggtcttcccaaaaaggcggcatacgtactctgggaccagaccatcctccgc

SEQ ID NO: 277863 - DNA, 75 bp, Artificial Sequence
  Synthetic
catgactctatcacattgcccccccatggcagcaactcagctcaaagaggagagctcctcgccctcctttcagga

SEQ ID NO: 277864 - DNA, 75 bp, Artificial Sequence
  Synthetic
aatagacgaggattagacctcctattctgggaacaagggggtttgtgcaaagccatacaggagcaatgttgcttc

SEQ ID NO: 277865 - DNA, 75 bp, Artificial Sequence
  Synthetic
ctccgggcggccaagtcatggccatccctaaatatttttcttgactccaagtacttaattaaatatctccattcc

SEQ ID NO: 277866 - DNA, 75 bp, Artificial Sequence
  Synthetic
cttgccactggagcctttcttgggacttcgactcaccagtccctctatgcccatttgcctgccctattgcataac

SEQ ID NO: 277867 - DNA, 75 bp, Artificial Sequence
  Synthetic
aaagttatctacctccaccacattcgtagccacaccaatctccccgaccccatctccactctcaacgaatacaca

SEQ ID NO: 277868 - DNA, 75 bp, Artificial Sequence
  Synthetic
cccagtgggcacgagaagccctccagacaggcataaccattctcgccctactcctccttgtcatattgtttggcc

SEQ ID NO: 277869 - DNA, 75 bp, Artificial Sequence
  Synthetic
gactcgcttattattatagcccccctcattcccctaacgcctcaggatctgcacagacttacccattgcaactcc

SEQ ID NO: 277870 - DNA, 75 bp, Artificial Sequence
  Synthetic
aggggcccttgtttcttccgggccaccccacagcagagccaagtcgctcttgaaagccgtgttacacctgcaaca

SEQ ID NO: 277871 - DNA, 75 bp, Artificial Sequence
  Synthetic
tcactaaactcacaacatcacatgcctcaagggcacatccgtcgggggttgctgcccaaccacatatggcaagga

SEQ ID NO: 277872 - DNA, 75 bp, Artificial Sequence
  Synthetic
cacccccgatgtccagccccgactcaaactccataattgcctcaaatagctcctccaacccccgctcacattcct

SEQ ID NO: 277873 - DNA, 75 bp, Artificial Sequence
  Synthetic
gatgtaacccactacaaatacaagcggcaccgatactgcctgcacgtctgggttgataccttctccaacgcagtc

SEQ ID NO: 277874 - DNA, 75 bp, Artificial Sequence
  Synthetic
tcctccaacccccgctcacattcctcccatagggcctttttttcctcttccaagaaatccacataaccctgaagc

SEQ ID NO: 277875 - DNA, 75 bp, Artificial Sequence
  Synthetic
tccattacctgcaaaacaaaagagactagctctgagactgtcagcgccctcttgcacgctatcactatcttaggc

SEQ ID NO: 277876 - DNA, 75 bp, Artificial Sequence
  Synthetic
aagcccctttctataaacactgacaatggttctgccttcctatctcaagaattccaggccttttgtacctcatgg

SEQ ID NO: 277877 - DNA, 75 bp, Artificial Sequence
  Synthetic
cacatcagacattccacccatgtgccctacaaccctaccagctccgggctggtagagagaaccaatggcattgtc

SEQ ID NO: 277878 - DNA, 75 bp, Artificial Sequence
  Synthetic
tccgacgagagtctcgcacctgctcgctgaccgatcccgaccccagagggcggccttttgctgtccttctcggtt

SEQ ID NO: 277879 - DNA, 75 bp, Artificial Sequence
  Synthetic
aaggccctcctcaacaaatatctcctagacagcccgaacctccccctggacaatgccatcagtaaatccctatgg

SEQ ID NO: 277880 - DNA, 75 bp, Artificial Sequence
  Synthetic
accctaaaccaactcaatgtcatgtcccccagtggaaaaacccgctggcaactccatcatggcccccggttgccc

SEQ ID NO: 277881 - DNA, 75 bp, Artificial Sequence
  Synthetic
ccatccctgcaaatacctcagccctctaaggcacccgcgaactggtactatgtactaactcctggtcttaccaat

SEQ ID NO: 277882 - DNA, 75 bp, Artificial Sequence
  Synthetic
cagcggtggaaaggacctttacatctctccaggaagctgcaggagcgcttactttcgatagacggctcccctcag

SEQ ID NO: 277883 - DNA, 75 bp, Artificial Sequence
  Synthetic
tggatcccgtggcggctcctgaaaaagactgtatgcccaaggccagacggcagcgaactcgccgcgcacgcagca

SEQ ID NO: 277884 - DNA, 75 bp, Artificial Sequence
  Synthetic
acagaccaccaacaccatgggtaatataattgctttccttttatttcatcttacatgcatcacaatcactaaaca

SEQ ID NO: 277885 - DNA, 75 bp, Artificial Sequence
  Synthetic
aagccggtgcacacttacggtaggtgtttcctcgtatcactctagtccctgcagtcttgcccaacctgtctgtgc

SEQ ID NO: 277886 - DNA, 75 bp, Artificial Sequence
  Synthetic
ctgggaccttgaccttcattccttaactgcagaccaacgcctacaccctccctgccccaatctagtttcttactc

SEQ ID NO: 277887 - DNA, 75 bp, Artificial Sequence
  Synthetic
taacttccacaaatcttactccttatatctattcccgcattgggtaaaaaaaccaaacaggcaaggcctaggata

SEQ ID NO: 277888 - DNA, 75 bp, Artificial Sequence
  Synthetic
cattttgccatcctacagcgatccctgctcgctccaatgtccttatttaggaagccagtcttggacatgccctta

SEQ ID NO: 277889 - DNA, 75 bp, Artificial Sequence
  Synthetic
caccggccccatctccagcccttcctggaggttccattgggatgttaacttcactcaggaggtcaaccatgtaac

SEQ ID NO: 277890 - DNA, 75 bp, Artificial Sequence
  Synthetic
cctccggctacccttctcccgatgtggctcttccatgaccctcctcatagacgccccaggctacgatcccctgtg

SEQ ID NO: 277891 - DNA, 75 bp, Artificial Sequence
  Synthetic
ttcctcttcgtcgtcactgaaaacgaaacttcaacgccgcccttctggcaggcttggcccggggccaacatacgc

SEQ ID NO: 277892 - DNA, 75 bp, Artificial Sequence
  Synthetic
gttcatttcttctgaacccactcagcccccccctacttccccgccattagtccgcgactccgaccttgagcatat

SEQ ID NO: 277893 - DNA, 75 bp, Artificial Sequence
  Synthetic
cgcggagcgcagtaagggctagggcttcctgaacctctccgggagaggtccatcgctataggcaggcccgcccca

SEQ ID NO: 277894 - DNA, 75 bp, Artificial Sequence
  Synthetic
cttaaccccctcctcctcctgggccgctaggatgctgaccctcatccaactaactctacaaagtaccaattactc

SEQ ID NO: 277895 - DNA, 75 bp, Artificial Sequence
  Synthetic
ctgcatggtttgtatagacaggactagcttgtcgtcttggcatgtactctatacccccaatatctctgcctcacc

SEQ ID NO: 277896 - DNA, 75 bp, Artificial Sequence
  Synthetic
tgggggcgactccttgcctatactttatccttccttggccctaccggccccccgaccccaaccgttttcctggac

SEQ ID NO: 277897 - DNA, 75 bp, Artificial Sequence
  Synthetic
tcactgctaccagccccacttacaggcagtcactacagccaattgcaacaattccattatcttgcccccattctc

SEQ ID NO: 277898 - DNA, 75 bp, Artificial Sequence
  Synthetic
tctcactccggtgccttcccctgggacaagaagccgccgggccattccagtggccgtatggctcgtttcagccct

SEQ ID NO: 277899 - DNA, 75 bp, Artificial Sequence
  Synthetic
agcggccgggactggtattgcagggggaataaccggatccctgtccctagcatcaagccgcagcctgcttttcga

SEQ ID NO: 277900 - DNA, 75 bp, Artificial Sequence
  Synthetic
agttgacaaagatatttcccacctcacacaagccatcgttaaaaaccatcagaacatcctccgcgtagcgcaata

SEQ ID NO: 277901 - DNA, 75 bp, Artificial Sequence
  Synthetic
tgcagcccaaaatagaagaggactagacctcctgttttgggaacaaggaggcctctgcaaagccatacaagagca

SEQ ID NO: 277902 - DNA, 75 bp, Artificial Sequence
  Synthetic
atgttgcttccttaacattagcaacacccatgtgtccgtccttcaggagcgcccccccttagaaaagagagtcat

SEQ ID NO: 277903 - DNA, 75 bp, Artificial Sequence
  Synthetic
ttcccggggaagacaaacaattgggggctcgtccgggatctgaattcctccattctcacattatgggacaaatcc

SEQ ID NO: 277904 - DNA, 75 bp, Artificial Sequence
  Synthetic
ggctcgtccgggatctgaattcctccattctcacattatgggacaaatccacgggctttccccaactccaatacc

SEQ ID NO: 277905 - DNA, 75 bp, Artificial Sequence
  Synthetic
cacaggatggggtctcaattgggacctggggctatcccaatgggcacgggaagcactccaaactggtataaccat

SEQ ID NO: 277906 - DNA, 75 bp, Artificial Sequence
  Synthetic
cctagccttactcctccttgtcatactgttcggcccctgtatccttcgccaactccaatcacttccccaccggct

SEQ ID NO: 277907 - DNA, 75 bp, Artificial Sequence
  Synthetic
ctccgatttcgacttccagcagctacgacgctttctgaaattagcccttaaaacgcccatttggctaaatcctat

SEQ ID NO: 277908 - DNA, 75 bp, Artificial Sequence
  Synthetic
acagaacaggcacaaccaatactctcttattaaccaggagaccacactatagcaacccagctaattgctgtatgg

SEQ ID NO: 277909 - DNA, 75 bp, Artificial Sequence
  Synthetic
agatctccatggcacttccccctaccgtttatccacccacactccccaatcccagaggaatctccccctatgtcc

SEQ ID NO: 277910 - DNA, 75 bp, Artificial Sequence
  Synthetic
aggcccgattcaaactgatttagtaactcaaaaagctcctctaactcccgttcgcattccccccacaaacacgtc

SEQ ID NO: 277911 - DNA, 75 bp, Artificial Sequence
  Synthetic
tctgccctactactactcctccgccacctgccccgccgccccagtatgcacatgcttccccgccctacggcgaac

SEQ ID NO: 277912 - DNA, 75 bp, Artificial Sequence
  Synthetic
cgctccccttccaagacaccgatataaccctctaacatctcacaatatccctcaaaccctagcaaccctatacac

SEQ ID NO: 277913 - DNA, 75 bp, Artificial Sequence
  Synthetic
ccaccaccacgcaatgcttccctatcttacatcccccaggagccccctcagctcacaggccctggcagatgaaag

SEQ ID NO: 277914 - DNA, 75 bp, Artificial Sequence
  Synthetic
cttacatcccccaggagccccctcagctcacaggccctggcagatgaaagacttacaggccatcaagcaggaggt

SEQ ID NO: 277915 - DNA, 75 bp, Artificial Sequence
  Synthetic
tctaactgttgatgtctcttctcgcgctctcgacgtttctcttccttctcccgcaaccgctcccttctgcgctgc

SEQ ID NO: 277916 - DNA, 75 bp, Artificial Sequence
  Synthetic
tccttctcctcgcgctgtttcaagatttccatgatttccttctgctcttccgccagcctccggcgaccatcccgt

SEQ ID NO: 277917 - DNA, 75 bp, Artificial Sequence
  Synthetic
acgtcctctccgaccgaccctgatcccaagggtcgcccccgcgctgtcttcctcaggcctcctccagaacacgat

SEQ ID NO: 277918 - DNA, 75 bp, Artificial Sequence
  Synthetic
acaccagtcaccaccacctcaggatcccccaatggcagccttctgaaatactctaaacaaaatacatgcttttct

SEQ ID NO: 277919 - DNA, 75 bp, Artificial Sequence
  Synthetic
taaccccgcccagcaaggtcttagacgggagtaccagaacctttggctggctgctttctccaccctgccaggcaa

SEQ ID NO: 277920 - DNA, 75 bp, Artificial Sequence
  Synthetic
tcagcccactttccaggttttggacagagcctcctctatggatacccagtctacgtgtttggcgattgtgttcaa

SEQ ID NO: 277921 - DNA, 75 bp, Artificial Sequence
  Synthetic
gccgattggtgtcccgtttcaggtgggctttgttccacccgcctgcaccggaacgcccttctcgccacctgccca

SEQ ID NO: 277922 - DNA, 75 bp, Artificial Sequence
  Synthetic
gagcaccagctcacctgggaccccatcgatggacgggttgtcggctctcgtctccaataccttatccctcgactc

SEQ ID NO: 277923 - DNA, 75 bp, Artificial Sequence
  Synthetic
ccctccttccccacccagagaacctccaagacccttaaggtcctcactccccctaccactcctgtctcccccaag

SEQ ID NO: 277924 - DNA, 75 bp, Artificial Sequence
  Synthetic
attccaccgccttcttcccaatcaatgcggaggctctccccttaccggaacggttgcctgcatccaactctcgga

SEQ ID NO: 277925 - DNA, 75 bp, Artificial Sequence
  Synthetic
gatcagctcccctccctttccttccccgaccccggtgtccgaccccaaaacatctacaccacctggggaagaact

SEQ ID NO: 277926 - DNA, 75 bp, Artificial Sequence
  Synthetic
gtagtttgcttgtacctctaccaactatcccccccgatgacctggcccctaatacctcatgtcatattctgccat

SEQ ID NO: 277927 - DNA, 75 bp, Artificial Sequence
  Synthetic
agggactgcccacaactcaaaccccctcaggaggaaggggaacccctcctgttggatctctcttccacctcaggc

SEQ ID NO: 277928 - DNA, 75 bp, Artificial Sequence
  Synthetic
cccaagcagttaggaaccttcctgaccaacgtacctctaaaacgcctggaagaattactatacaaaatattccta

SEQ ID NO: 277929 - DNA, 75 bp, Artificial Sequence
  Synthetic
actactgaggaaaaaaactccttagggggggagatctaatctccccccatcccgatcaagacatctcgatactcc

SEQ ID NO: 277930 - DNA, 75 bp, Artificial Sequence
  Synthetic
cacaccggggccatcatagttctccccgaagacagggtgggtactacattgttccaacctgttagagccccctgc

SEQ ID NO: 277931 - DNA, 75 bp, Artificial Sequence
  Synthetic
gtccagaccgcctgggatacagggcttctaccctaccactctctcataactactccgggcctaatatggacattt

SEQ ID NO: 277932 - DNA, 75 bp, Artificial Sequence
  Synthetic
aatgacggttcacccatgatttccggcccctgccccaaaacagggcagccatctttcctagtacagtcctccctg

SEQ ID NO: 277933 - DNA, 75 bp, Artificial Sequence
  Synthetic
ttaatctttgaaaaattccagaccaaggcctttcatccttccttcctactgtcccatcaactcatccagtactct

SEQ ID NO: 277934 - DNA, 75 bp, Artificial Sequence
  Synthetic
tcattccagtactcttcattccataacctccacccttccttcgaggaatacactaacatcccagtttcctatttc

SEQ ID NO: 277935 - DNA, 75 bp, Artificial Sequence
  Synthetic
acctccacccttccttcgaggaatacactaacatcccagtttcctatttctttaacgaaaaacaggcagatgaca

SEQ ID NO: 277936 - DNA, 75 bp, Artificial Sequence
  Synthetic
cctcgaacaccttcccccacctccccaagtggaccaatttcctttaaacctgagcgcctccaggccttaaatgac

SEQ ID NO: 277937 - DNA, 75 bp, Artificial Sequence
  Synthetic
aggcaataaccccgtcttccccgttaaaaaaccaaatggtaaatggaggttcattcatgacctaagagccaccaa

SEQ ID NO: 277938 - DNA, 75 bp, Artificial Sequence
  Synthetic
cccgaaggcgcctcaggcctctccgggaggggcactcggctcgggcccttgttctctccgggagagacaaacacc

SEQ ID NO: 277939 - DNA, 75 bp, Artificial Sequence
  Synthetic
accccgccctacctctccttggcctcatctcgttaagtacatctggtacaacatctgtcatctttcaacccaagc

SEQ ID NO: 277940 - DNA, 75 bp, Artificial Sequence
  Synthetic
tccggccgcgcacgttaggctctggtttgtaaccctacttccgcgttcttgtcttattctgcgccgaaaccgaaa

SEQ ID NO: 277941 - DNA, 75 bp, Artificial Sequence
  Synthetic
ccgagtctataaaagcgcaaggacagttcaggaggggggtcgctccttcaccaaccctctggtcacggagactca

SEQ ID NO: 277942 - DNA, 75 bp, Artificial Sequence
  Synthetic
ggcctcggtggagacgccttccgtgggaccgtctcccggcctcagcacctcctgaactgctccttccggggtaag

SEQ ID NO: 277943 - DNA, 75 bp, Artificial Sequence
  Synthetic
tctcctctcaggtcgagctcggctgcctcttaggtagtcgctccccgagggtctttagagacacccgggtttccg

SEQ ID NO: 277944 - DNA, 75 bp, Artificial Sequence
  Synthetic
cttaccgcctgcagcctgggccctccggtttcgacttccaacagctacgacgctttcttaaactatctcttaaaa

SEQ ID NO: 277945 - DNA, 75 bp, Artificial Sequence
  Synthetic
tagagattatatacatccttgtcaaaaaccaagtctcccctagcgcctcacccgccccagttccgactcctatct

SEQ ID NO: 277946 - DNA, 75 bp, Artificial Sequence
  Synthetic
gccctaccaggtaccacgcaatgctttcctatcttacatccccctggagccccctcagatcacaggccttggcag

SEQ ID NO: 277947 - DNA, 75 bp, Artificial Sequence
  Synthetic
aatcttacaagcccgtggacacactaacagccccctcggggagatgcttcgggcatgccaggcgtggacacccaa

SEQ ID NO: 277948 - DNA, 75 bp, Artificial Sequence
  Synthetic
cagtcctccactaccacccatttctgaagcctctacccctcccaaaccacctcccaaatggttctattataaact

SEQ ID NO: 277949 - DNA, 75 bp, Artificial Sequence
  Synthetic
ccccggccttaccaatcagcggtggaaaggtccattacaatccctccaggaagcggctggggcagccttgctctc

SEQ ID NO: 277950 - DNA, 75 bp, Artificial Sequence
  Synthetic
aaaccccctcaggaggaaggggaacccctcctgttggatctctcctccacctcaggtactactgaggaaaaaaac

SEQ ID NO: 277951 - DNA, 75 bp, Artificial Sequence
  Synthetic
acacaggagccgaccgtacggttataccccatacactcgtgcctgggccggtaaaactccacgacaccctggtcc

SEQ ID NO: 277952 - DNA, 75 bp, Artificial Sequence
  Synthetic
accatcattggaagagacgccctacaacaatgccaggggcttctataccttccagacgatcccagcccccaccaa

SEQ ID NO: 277953 - DNA, 75 bp, Artificial Sequence
  Synthetic
ttgctgccaatatccactccacaccccataggcttcgaacaccttcccccaccgccgcaggtggaccaatttcct

SEQ ID NO: 277954 - DNA, 75 bp, Artificial Sequence
  Synthetic
ttaaacgtgagcgcctccaggccttaaatgacttggtctccaaggccctggaggctggccacattgaaccgtatt

SEQ ID NO: 277955 - DNA, 75 bp, Artificial Sequence
  Synthetic
caggaccaggcaataaccccgtcttccccgttaaaaaaccaaatggcaaatggaggttcattcatgacctaagag

SEQ ID NO: 277956 - DNA, 75 bp, Artificial Sequence
  Synthetic
tactgacgcctttttccaaatccccctccccaagcagttccagccatacttcgccttcaccattccccagccatg

SEQ ID NO: 277957 - DNA, 75 bp, Artificial Sequence
  Synthetic
tcgccttcaccattccccagccatgtaattatggccccgggaccagatatgcatggactgtccttccacaggggt

SEQ ID NO: 277958 - DNA, 75 bp, Artificial Sequence
  Synthetic
ttatcctcccccctttttccctcgctcccgtacctcctccggcgacaagacgccgccgtgccgttccaatagcag

SEQ ID NO: 277959 - DNA, 75 bp, Artificial Sequence
  Synthetic
ggacactcactgagctacaggttatcctaagaaaaatccaatgggtctctaaaggtacccccatccttcgcagac

SEQ ID NO: 277960 - DNA, 75 bp, Artificial Sequence
  Synthetic
ctggggactaaactgggatcttggactgtcccaatgggcacgagaagccctccagacaggcataaccattctcgc

SEQ ID NO: 277961 - DNA, 75 bp, Artificial Sequence
  Synthetic
tcggccttatctcgttaagtacatctggcacaacatctgtcatctttcaacccaagcaaaactggcccctggctt

SEQ ID NO: 277962 - DNA, 75 bp, Artificial Sequence
  Synthetic
aacccagaaaccatgctataatagacctgctagcttctgcagcaaatccccataggttcatccccctaccattga

SEQ ID NO: 277963 - DNA, 75 bp, Artificial Sequence
  Synthetic
cagtttatgtccttggggtcacctactggcctgtaccattccaactctagacaaattcaccctacaacattatgg

SEQ ID NO: 277964 - DNA, 75 bp, Artificial Sequence
  Synthetic
cccatccacagtcctctataccagatgagtcgcccccgatgtccagccccaactcgaatctgaataattgcctca

SEQ ID NO: 277965 - DNA, 75 bp, Artificial Sequence
  Synthetic
acttcctaaggaactcccctcatccaagtgtcggcatcctcattcaccacatgggtcgcttccataaccttggca

SEQ ID NO: 277966 - DNA, 75 bp, Artificial Sequence
  Synthetic
aatagctcctccaacccccgctcacattcctcccataggaccttcttttccccttccaggaaatccacataaccc

SEQ ID NO: 277967 - DNA, 75 bp, Artificial Sequence
  Synthetic
acagtctccgacgagaatctcgcacctgctcgctgaccgatcccgaccccagagggcgaccttttgctgtccttc

SEQ ID NO: 277968 - DNA, 75 bp, Artificial Sequence
  Synthetic
gggcaagaccatctacctccatcatgttcgtagccacaccaatctccccgacccaatttccaccttcaatgaata

SEQ ID NO: 277969 - DNA, 75 bp, Artificial Sequence
  Synthetic
tgccttctttcaatcaatgcgaaagcacaccccctaccgaaatggatgcctggaaccaaccctcggggatcagct

SEQ ID NO: 277970 - DNA, 75 bp, Artificial Sequence
  Synthetic
aaatttactaaacaaatatctactagattgtcctaaccttcccctagacaatgccattaacaaagccctttggac

SEQ ID NO: 277971 - DNA, 75 bp, Artificial Sequence
  Synthetic
atgccattaacaaagccctttggaccctcaatcagctaaatgtcatgaaccccagtggtaaaacccgatggcaaa

SEQ ID NO: 277972 - DNA, 75 bp, Artificial Sequence
  Synthetic
tgctctccatagacggcttcccccggtggatcccgtggcgattcctgaaaaaagctgcatgcccaagaccagacg

SEQ ID NO: 277973 - DNA, 75 bp, Artificial Sequence
  Synthetic
tacaccaacatccctgtctctattttatttaataaagaagaggcggatgacaatggcgaccagcctcccgagcca

SEQ ID NO: 277974 - DNA, 75 bp, Artificial Sequence
  Synthetic
aaagctgcatgcccaagaccagacgccagcgaacccgccgagcacgccgcaacagaccaccaacaccatgggtaa

SEQ ID NO: 277975 - DNA, 75 bp, Artificial Sequence
  Synthetic
caatcccaagtaaaggctctgacgtctccccctttttaggaactgaaaccacggccctgacgtccctccccccca

SEQ ID NO: 277976 - DNA, 75 bp, Artificial Sequence
  Synthetic
ccctgccctaacctaattacttactctggcttccacaaaacttattccttatacttattcccacattggataaag

SEQ ID NO: 277977 - DNA, 75 bp, Artificial Sequence
  Synthetic
acacgggccccgtctccagtccatcctggaagtttcattcagatgtaaatttcacccaagaagtcagccaagtgt

SEQ ID NO: 277978 - DNA, 75 bp, Artificial Sequence
  Synthetic
cccttggactacatttctctaagggcggctcttccatgacccttctagtagatgcccctggatatgatcctttat

SEQ ID NO: 277979 - DNA, 75 bp, Artificial Sequence
  Synthetic
ggttcatcacttcagaacccattcagcttcccccaactccccccccattggtccatgactccgaccttgaacacg

SEQ ID NO: 277980 - DNA, 75 bp, Artificial Sequence
  Synthetic
ggcaggcttggcccggggccaacatactgccgtggaggcgcagcaagggctagggctttcctgaacctctccggg

SEQ ID NO: 277981 - DNA, 75 bp, Artificial Sequence
  Synthetic
acctctccgggagaaggtccattgatataggcaggcccgccccaggagcttttgtcttcccggggaagacaaaca

SEQ ID NO: 277982 - DNA, 75 bp, Artificial Sequence
  Synthetic
tacacccccaacatctccattccccaacaaacctcctcccgaaccatcctctttccttctcttgccctgcccgct

SEQ ID NO: 277983 - DNA, 75 bp, Artificial Sequence
  Synthetic
cactcatgtatccgtcctccaggaacggccccctcttgaaaaacgtgtcatcaccggttggggactaaactggga

SEQ ID NO: 277984 - DNA, 75 bp, Artificial Sequence
  Synthetic
aaccctgaagcaaatcacaaaacccatcaaaacccaggagtcctatacactccaactgctgatgcctttcttccc

SEQ ID NO: 277985 - DNA, 75 bp, Artificial Sequence
  Synthetic
tctcccggcgcttttgatctttttcccgcaagcgctcctttctgcgccgctcccgatcctcacgctcctgcagaa

SEQ ID NO: 277986 - DNA, 75 bp, Artificial Sequence
  Synthetic
cagctcccctccctcgccttccctgaacctggcctccgtccccaaaacatctacaccacctggggaaaaaccgta

SEQ ID NO: 277987 - DNA, 75 bp, Artificial Sequence
  Synthetic
agacaattgggagccttcctcaccaaggtgcctctaaaacgactagaagaacttctatacaaaatgttcctacac

SEQ ID NO: 277988 - DNA, 75 bp, Artificial Sequence
  Synthetic
acaaacaatcccaagtaaaggctctgacgtctccccctttataggaactgaaaccaaggccctgacgtccccccc

SEQ ID NO: 277989 - DNA, 75 bp, Artificial Sequence
  Synthetic
tgccgagtctttaaaagcgcaaggacagttcaggagggggttggttctttcaccaaccttcgggtcagggagact

SEQ ID NO: 277990 - DNA, 75 bp, Artificial Sequence
  Synthetic
cacatgggggatccatcttctccaagcggcctcggtcgagacgccttcagtgggaccgtttcccggcttcagcac

SEQ ID NO: 277991 - DNA, 75 bp, Artificial Sequence
  Synthetic
ctcgtgaactgctcattcgggggtaagtgtcctctcaggtcgagctcggctgcctctcaggtagtcgctcccgga

SEQ ID NO: 277992 - DNA, 75 bp, Artificial Sequence
  Synthetic
gggtctgtagagacacccgggttcccgcctgcgctcgggtagactctggcttgaaacatcacttccgcgttcttg

SEQ ID NO: 277993 - DNA, 75 bp, Artificial Sequence
  Synthetic
ttgaaacatcacttccgcgttcttggtctcgttctttcctctttgtcgtcactgaaaacgaaacttcaacgccgc

SEQ ID NO: 277994 - DNA, 75 bp, Artificial Sequence
  Synthetic
tgacaatggcgaccagcctcctgggccagccgcccaggacgagtcatcggcctaaaaggtcagaccgtctcacac

SEQ ID NO: 277995 - DNA, 75 bp, Artificial Sequence
  Synthetic
cctaaaaggtcagaccgtctcacacaaacaatcccgagtaaaggctctgacgtctccccctttttaagaactgaa

SEQ ID NO: 277996 - DNA, 75 bp, Artificial Sequence
  Synthetic
accaaggccctgacgtcccccccctggaaccaggaacagctctccagaaaaataaacctcgcccttacccacttc

SEQ ID NO: 277997 - DNA, 75 bp, Artificial Sequence
  Synthetic
ccccaagcactgaaaaacaaggctctgacgattacccccctgcccataaaatttgcttaaccaaataaagacgcc

SEQ ID NO: 277998 - DNA, 75 bp, Artificial Sequence
  Synthetic
tcacaccacaacaacttcatgcgttacatgccattcaacaagctctacaacataactgtcgtagccgcctcaacc

SEQ ID NO: 277999 - DNA, 75 bp, Artificial Sequence
  Synthetic
gagtctataaaagcgcaaggacagttcaggaggggggctctctctccttctcaccgaccccccggtcgcggagac

SEQ ID NO: 278000 - DNA, 75 bp, Artificial Sequence
  Synthetic
ccttggggtcacctactggcctgcaccatcttaactctagacaaatataccctacaacattatggccagctctgc

SEQ ID NO: 278001 - DNA, 75 bp, Artificial Sequence
  Synthetic
ctgcctcttgggcagtcgctccccgagggtctttagaggcacccgggtccccgcctgcgctcggttagactccgg

SEQ ID NO: 278002 - DNA, 75 bp, Artificial Sequence
  Synthetic
caatctttccaccacaacatgtcaaagcaagccctttgcgacttcctaaggaactcccctcatccaagtgtcggc

SEQ ID NO: 278003 - DNA, 75 bp, Artificial Sequence
  Synthetic
cttaaaacctcacttccgcgttctcggtctcgttctttccttttcgccgtcactgaaagcgaaacctcaacgccg

SEQ ID NO: 278004 - DNA, 75 bp, Artificial Sequence
  Synthetic
ccctcctgacaggcctggcccggggccaacatactgtcgtggaggcgcagttaagggctggggcttcctgaacct

SEQ ID NO: 278005 - DNA, 75 bp, Artificial Sequence
  Synthetic
ttcccagggaagacaaacaagtgggggctcgtccgggatctgaatccctccattcccacattatgggacaaatcc

SEQ ID NO: 278006 - DNA, 75 bp, Artificial Sequence
  Synthetic
acgggctttccccaactccaatacccaaggcccccagggggctatcgacccaccactggcttaactttctccagg

SEQ ID NO: 278007 - DNA, 75 bp, Artificial Sequence
  Synthetic
ctgcttaccgcttgcagcctgggccctccgacttcgacttccagcaactacgacgctttctaaaactagcactta

SEQ ID NO: 278008 - DNA, 75 bp, Artificial Sequence
  Synthetic
aaacgcctatttggctaaaccctattgattactcactcctggctagccttatccccaagggatatccaggaaggg

SEQ ID NO: 278009 - DNA, 75 bp, Artificial Sequence
  Synthetic
tggtagaaattataaacatccttgtcaaaaatcatgtctcccctagcgcccccgccgccccagttccgacaccta

SEQ ID NO: 278010 - DNA, 75 bp, Artificial Sequence
  Synthetic
tctgcccgacgactgctcctccgccaccgccccccccttccccggagggccatgtcccccccccttatgcagagc

SEQ ID NO: 278011 - DNA, 75 bp, Artificial Sequence
  Synthetic
ccactaccacacaatgctttcccatattacatccccctggggccccctcagctcacaggccctggcaaatgaaag

SEQ ID NO: 278012 - DNA, 75 bp, Artificial Sequence
  Synthetic
gctcacaggccctggcaaatgaaagacttacaagccatcaaacaggaggtcagctcctctgcccctggcagcccc

SEQ ID NO: 278013 - DNA, 75 bp, Artificial Sequence
  Synthetic
tacctatgctcctctctcgtggtctccctacaccatcagcagctcaacacactaatcaccgaggctgagacccgc

SEQ ID NO: 278014 - DNA, 75 bp, Artificial Sequence
  Synthetic
actaatcaccgaggctgagacccgcgggatggcaggctataaccccatggcagggcccctaagaatgcaggccaa

SEQ ID NO: 278015 - DNA, 75 bp, Artificial Sequence
  Synthetic
cacccgtgatccctcttgggcggctatcctacaggggctggaggaaccctattgcgcgttcgtagaacgccttaa

SEQ ID NO: 278016 - DNA, 75 bp, Artificial Sequence
  Synthetic
tgtggccctcgataacggcctccccgaaggtacccccaaggagcccatcttacgctccctagcgtactcaaacgc

SEQ ID NO: 278017 - DNA, 75 bp, Artificial Sequence
  Synthetic
caacaaagagtgccagaaaatcttacaggcccgcggacatactaacagcccccttggggagatgctccgggcatg

SEQ ID NO: 278018 - DNA, 75 bp, Artificial Sequence
  Synthetic
cccttggggagatgctccgggcatgtcagacatggacacccaaagacaaaaccaaggtccttgtggtccaaccac

SEQ ID NO: 278019 - DNA, 75 bp, Artificial Sequence
  Synthetic
ggaggcccccccccacacagccctgctttcgttttggcaaggtaggacactggggtcgggactgcacccagccac

SEQ ID NO: 278020 - DNA, 75 bp, Artificial Sequence
  Synthetic
gcccccctcctggcccctgccccctatgccaagatccctctcactggaaaagagactgcccacagcttaaacccc

SEQ ID NO: 278021 - DNA, 75 bp, Artificial Sequence
  Synthetic
ctcaggaggaaggggaacccctcctgttagatctctcctccacctcaaatactactgaggaaaaaaactccttgg

SEQ ID NO: 278022 - DNA, 75 bp, Artificial Sequence
  Synthetic
ggggggagatctaatctccccccatcccgataaaaacttctcaatactcccactcatccccctgcagcagcaaca

SEQ ID NO: 278023 - DNA, 75 bp, Artificial Sequence
  Synthetic
acaaccgattctaggggtccggatttccgttatgggacaaacacctcagcctacccaagcgctactggacacagg

SEQ ID NO: 278024 - DNA, 75 bp, Artificial Sequence
  Synthetic
agccgaccttacggtcataccccagacactcgtgcctgggccggtaaagctccacgacacccaagtcctgggcgc

SEQ ID NO: 278025 - DNA, 75 bp, Artificial Sequence
  Synthetic
tccacgacacccaagtcctgggcgccagtgggcaaactaacacccagttcaaactcctccaaacccccctacaca

SEQ ID NO: 278026 - DNA, 75 bp, Artificial Sequence
  Synthetic
ttgggagggatgccctgcaacaatgccagggacttctatacctcccagacgatcccagcccccggtgctcccacc

SEQ ID NO: 278027 - DNA, 75 bp, Artificial Sequence
  Synthetic
gatcccagcccccggtgctcccaccaattgctgccaatagccactccaaacaccataggcctcgaacaccttccc

SEQ ID NO: 278028 - DNA, 75 bp, Artificial Sequence
  Synthetic
ttaaatgacctggtctccaaggccctggaggctggccacattgaaccatactcaggaccaggcaataaccccgtc

SEQ ID NO: 278029 - DNA, 75 bp, Artificial Sequence
  Synthetic
ttccccgttaagaaaccaaatgggaaatggaggttcattcatgacctaagagccaccaacgccattaccaccacc

SEQ ID NO: 278030 - DNA, 75 bp, Artificial Sequence
  Synthetic
ctcacctccccttccccaggcccccccgatctcactagcctaccaacagccttgccccacctacagaccatagac

SEQ ID NO: 278031 - DNA, 75 bp, Artificial Sequence
  Synthetic
cttactgacgccttcttccaaatccccctccccaaacagttccaaccatacttcgccttcaccatcccccagcca

SEQ ID NO: 278032 - DNA, 75 bp, Artificial Sequence
  Synthetic
tgtaattatggccctgggaccagatatgcgtggactgtccttccacaggggtttaaaaacagccccaccctcttc

SEQ ID NO: 278033 - DNA, 75 bp, Artificial Sequence
  Synthetic
agatatctcccaccttacccaggccatagtcaaaaatcatcaaaacatcctccgggttgcacagtatgcagccca

SEQ ID NO: 278034 - DNA, 75 bp, Artificial Sequence
  Synthetic
gagcaacaattggcggccgtcctcaaccccataaggaagacgttccccgcgtcaaccattgtccaatacatggat

SEQ ID NO: 278035 - DNA, 75 bp, Artificial Sequence
  Synthetic
gacatacttttggccagccccaccaatgaggagttacaacaactctcccagctaaccctccaggcactgaccaca

SEQ ID NO: 278036 - DNA, 75 bp, Artificial Sequence
  Synthetic
catggcctcccaatttcccaggaaaaaacgcaacgaactccaggccaaatacgcttcttaggacaggtcatctcc

SEQ ID NO: 278037 - DNA, 75 bp, Artificial Sequence
  Synthetic
cctaatcacattacctatgaaagtacccccactattcctataaaatctcaatggacactcactgaactacaaatt

SEQ ID NO: 278038 - DNA, 75 bp, Artificial Sequence
  Synthetic
atcctaggagagatccagtgggtctccaaaggcacccccatccttcgtagacacctacagtccctatactctgcc

SEQ ID NO: 278039 - DNA, 75 bp, Artificial Sequence
  Synthetic
ctccatgggtatcgggacccaagagcccgaatcgctcttacatcacaacaactccatgcactgcattccatccaa

SEQ ID NO: 278040 - DNA, 75 bp, Artificial Sequence
  Synthetic
caagctctacaacacaactgtcgtggccgcctcaaccccaccctacctctcctcggcctcatctcgttaagtgca

SEQ ID NO: 278041 - DNA, 75 bp, Artificial Sequence
  Synthetic
cctcggcctcatctcgttaagtgcatctggcacaacatctgtcattttccaacccaagcaaaattggcccctggc

SEQ ID NO: 278042 - DNA, 75 bp, Artificial Sequence
  Synthetic
ttggctccataccccccaccctccaaccagtttatgtccttggggtcacctactggcctgtaccattctaaccct

SEQ ID NO: 278043 - DNA, 75 bp, Artificial Sequence
  Synthetic
agataaatataccctacaacattatggccagctctgccaatccttccaccacaacatgtcaaaacaagccctttg

SEQ ID NO: 278044 - DNA, 75 bp, Artificial Sequence
  Synthetic
cgacttcctgaggaactcccctcatccaagtgtcggcatcctcattcaccacatgggtcgcttccacaaccttgg

SEQ ID NO: 278045 - DNA, 75 bp, Artificial Sequence
  Synthetic
cagtcaaccgtctgggccgtggaagaccctcttgcatctcccaaccctcctccaggaaccacgactcctcaggcc

SEQ ID NO: 278046 - DNA, 75 bp, Artificial Sequence
  Synthetic
agttttcaccctctcccccgttgtgcttgacacggccccctgcctcttttccgatggctcccctcaaaaggcagc

SEQ ID NO: 278047 - DNA, 75 bp, Artificial Sequence
  Synthetic
gtacgttctctgggatcagaccatccttcaccaggacattacccccctaccctctcacgaaacaaactccgcaca

SEQ ID NO: 278048 - DNA, 75 bp, Artificial Sequence
  Synthetic
aaaaggagaactccttgcacttatctgtggactacgtgctgccaagccatggccctcccttaacatttttctaga

SEQ ID NO: 278049 - DNA, 75 bp, Artificial Sequence
  Synthetic
ctctaaatacttaatcaaatacctacattccctcgccattggagccttcctcggcacttccgcccatcaaaccct

SEQ ID NO: 278050 - DNA, 75 bp, Artificial Sequence
  Synthetic
tcaggcggccttaccacccctattacagggcaagaccatttacctccatcatgttcgtagccacaccaacctccc

SEQ ID NO: 278051 - DNA, 75 bp, Artificial Sequence
  Synthetic
cagggcaagaccatttacctccatcatgttcgtagccacaccaacctccccgaccccatttccaccttcaatgaa

SEQ ID NO: 278052 - DNA, 75 bp, Artificial Sequence
  Synthetic
tacacagactcccttattgtggctccccttgtccccctgacgccccagggcctccacggcctcacccattgcaat

SEQ ID NO: 278053 - DNA, 75 bp, Artificial Sequence
  Synthetic
caaagggctctggtctcttttggcgccacgccaagagaggccaagtcccttgtacagacttgccatacctgtcag

SEQ ID NO: 278054 - DNA, 75 bp, Artificial Sequence
  Synthetic
accatcaactcacaacatcatatgcctcaagggcacatccgccgaggcctcctgcccaaccacatatggcagggt

SEQ ID NO: 278055 - DNA, 75 bp, Artificial Sequence
  Synthetic
gatgtaacccattacaaatacaaaaaatataaatactgcctccacgtttgggtagacaccttctccggtgcggtt

SEQ ID NO: 278056 - DNA, 75 bp, Artificial Sequence
  Synthetic
tccgtctcctgcaaaaggaaagagaccagctgtgagactatcagcgccttcctccaggccatctccctcctaggg

SEQ ID NO: 278057 - DNA, 75 bp, Artificial Sequence
  Synthetic
aagccactccacattaatacagacaatgggccagccttcttatcacaagaattccaggaattttgcgcctcctat

SEQ ID NO: 278058 - DNA, 75 bp, Artificial Sequence
  Synthetic
cacatcaagcactctacccatataccatacaaccccaccagctcaggcctggtcgagaggaccaatggtataatc

SEQ ID NO: 278059 - DNA, 75 bp, Artificial Sequence
  Synthetic
aaaaatttactaaacaaatatctactggactgtcctaaccttcccctagataatgccattaacaaagccctttgg

SEQ ID NO: 278060 - DNA, 75 bp, Artificial Sequence
  Synthetic
accctcaatcagctaaatatcatgaaccccagtggtaaaacccgatggcaaatccaccacagtcctccgctacca

SEQ ID NO: 278061 - DNA, 75 bp, Artificial Sequence
  Synthetic
cccatccctgaatcctctacccctcccaaaccatcacccacatggttctattacaaactccccggccttaccaat

SEQ ID NO: 278062 - DNA, 75 bp, Artificial Sequence
  Synthetic
cagcggtggaaaggtccgttacaatccctccaggaagcggctggggcggccttgctctccatagacgactccccc

SEQ ID NO: 278063 - DNA, 75 bp, Artificial Sequence
  Synthetic
cggtggatcccgtggcgattcctgaaaaaagctgcatgcccaagaccagacgccagcgaactcgccgagcacgcc

SEQ ID NO: 278064 - DNA, 75 bp, Artificial Sequence
  Synthetic
acaacagaccaccaacgccatgggtaatgttttcttcctccttttattcagtctcacacacttccctccagtcca

SEQ ID NO: 278065 - DNA, 75 bp, Artificial Sequence
  Synthetic
gcagagccgatgcacactcacggttggtatctcctcctaccactccagcccctgtaaccccacccaacccgtctg

SEQ ID NO: 278066 - DNA, 75 bp, Artificial Sequence
  Synthetic
cacttgggacctcgaccttgattccctaacaacagaccaacgactacatcccccctgccctaacctaatcactta

SEQ ID NO: 278067 - DNA, 75 bp, Artificial Sequence
  Synthetic
ctaacaacagaccaacgactacatcccccctgccctaacctaatcacttactctggcttccacaagacttattca

SEQ ID NO: 278068 - DNA, 75 bp, Artificial Sequence
  Synthetic
ttatacttattcccacattggataaaaaagccaaacagacagggcctaggatactactcgccctcctataatgac

SEQ ID NO: 278069 - DNA, 75 bp, Artificial Sequence
  Synthetic
aaaagccaaacagacagggcctaggatactactcgccctcctataatgacccttgctcgttacaatgcccctact

SEQ ID NO: 278070 - DNA, 75 bp, Artificial Sequence
  Synthetic
aaacctcaacgccgccctcctggcaggcttggcccggggccaacatactgccgtggaggcgcagcaagggctagg

SEQ ID NO: 278071 - DNA, 75 bp, Artificial Sequence
  Synthetic
atttcacccaagaagtcagccaggtgtcccttcgactacacttctctaagtgcggttcctccatgaccctcctag

SEQ ID NO: 278072 - DNA, 75 bp, Artificial Sequence
  Synthetic
aacctctccgggagaggtccattgatataggcaggcccgccccaggagcttctgtcttcccggggaagacaaaca

SEQ ID NO: 278073 - DNA, 75 bp, Artificial Sequence
  Synthetic
tagacgcccctggatatgaccccttatggttcatcacctcggaacccactcaacctcccccaactccccccccat

SEQ ID NO: 278074 - DNA, 75 bp, Artificial Sequence
  Synthetic
taattcatgactccgaccttgaacacgtcttaaccccctccacgtcttggacgaccaaaatgctcaaattcatcc

SEQ ID NO: 278075 - DNA, 75 bp, Artificial Sequence
  Synthetic
agctgaccctgcaaagcaccaactactcctgcatggtctgcgtggacagatccagcctctcatcctggcacgtgc

SEQ ID NO: 278076 - DNA, 75 bp, Artificial Sequence
  Synthetic
tctacacccccaacatctccattcctcaacaaacctcctcccgaaccatcctttttccctctcttgctctacccg

SEQ ID NO: 278077 - DNA, 75 bp, Artificial Sequence
  Synthetic
ctcctccattccaacccttcccctggacccattgctaccaacctcgcctacaggccataacaacagatgattgca

SEQ ID NO: 278078 - DNA, 75 bp, Artificial Sequence
  Synthetic
acaactccattatccttccccccttttccatcgctcccgtaccccctccggcgacaagacgccgccgcgctgttc

SEQ ID NO: 278079 - DNA, 75 bp, Artificial Sequence
  Synthetic
caatagcagtatggcttgtctccgccctagcggccggtacaggcattgccggtggggtaacaggctccctatccc

SEQ ID NO: 278080 - DNA, 75 bp, Artificial Sequence
  Synthetic
gtctcgttctttcctcttcgccgtcactgaaaacgaaacctcaacgccgccctcttggcaggcgtcccggggcca

SEQ ID NO: 278081 - DNA, 75 bp, Artificial Sequence
  Synthetic
tagcctccagtaaaagccttctccttgaggttgacaaagacatctcccaccttacccaggccatagtcaaaaacc

SEQ ID NO: 278082 - DNA, 75 bp, Artificial Sequence
  Synthetic
actgaaaacgaaacctcaacgccgccctcttggcaggcgtcccggggccaacatacgccgtggagcgcagcaagg

SEQ ID NO: 278083 - DNA, 75 bp, Artificial Sequence
  Synthetic
atcaaaacatcctccgggttgcgcagtatgctgcccaaaatagacgaggactagacctcctgttctgggaacaag

SEQ ID NO: 278084 - DNA, 75 bp, Artificial Sequence
  Synthetic
gtatgctgcccaaaatagacgaggactagacctcctgttctgggaacaagggggtttatgcaaggccatacagga

SEQ ID NO: 278085 - DNA, 75 bp, Artificial Sequence
  Synthetic
aacactcatgtgtccgtcctccaggaacggccccctcttgagaaacgtgtcattaccggctggggactaaactgg

SEQ ID NO: 278086 - DNA, 75 bp, Artificial Sequence
  Synthetic
tttccccaactccaatacccaaagcccccagggggctatcaacccaccactggcttaactttctccaggctgctt

SEQ ID NO: 278087 - DNA, 75 bp, Artificial Sequence
  Synthetic
tggcttaactttctccaggctgcttaccgcttgcagcctaggccctccgatttcgacttccagcagctacgacgc

SEQ ID NO: 278088 - DNA, 75 bp, Artificial Sequence
  Synthetic
gagaagccctccagacaggcataaccattctcgccctactcctcctcgtcatattgtttggcccctgtatcctcc

SEQ ID NO: 278089 - DNA, 75 bp, Artificial Sequence
  Synthetic
gccaaatccaagcccttccacatcggttacaaaaccgacataaccaatattccctcatcaacccagaaaccatgc

SEQ ID NO: 278090 - DNA, 75 bp, Artificial Sequence
  Synthetic
tataacaaacccgctaactgctgcagcaaatccccatggttcatccccctaccattgacccacccacagtcctct

SEQ ID NO: 278091 - DNA, 75 bp, Artificial Sequence
  Synthetic
ctactactactcctccgccacctccccccccttccccggaggcccatgttccccccccttacgtggaacccacca

SEQ ID NO: 278092 - DNA, 75 bp, Artificial Sequence
  Synthetic
atgccagatgagtcgcccccgatgtccagccccgactcaaacccaataattgcctcaaataggtcctccaacccc

SEQ ID NO: 278093 - DNA, 75 bp, Artificial Sequence
  Synthetic
tgctcacattcctcccataggaccttcttttcctcctccaggacatcaatgtaaccctggagtaaatcacagaac

SEQ ID NO: 278094 - DNA, 75 bp, Artificial Sequence
  Synthetic
ccatcaaagcccaggattcctatacactccaactgctgatgcctctcttccctctcccggcgcttctggtccttt

SEQ ID NO: 278095 - DNA, 75 bp, Artificial Sequence
  Synthetic
tcccgcaaacgctcctttctgcgccgctcccgctcttcacgctcctgtaaaagttttaaaatctcccgctgttcc

SEQ ID NO: 278096 - DNA, 75 bp, Artificial Sequence
  Synthetic
tccgccagcatcctccgacgagagtctcgcacctgctcgctgaccgatcccgaccccaaagggcggcctttcgct

SEQ ID NO: 278097 - DNA, 75 bp, Artificial Sequence
  Synthetic
gtcctccttggttcctctccggggggaggcacaatcggcgtcagactcgcctccccctgtatcctaacggcaatc

SEQ ID NO: 278098 - DNA, 75 bp, Artificial Sequence
  Synthetic
acccccaaagagcccatcttacgttccctagcgtactcaaacgccaacaaagaatgccaaaaaatcttacaagcc

SEQ ID NO: 278099 - DNA, 75 bp, Artificial Sequence
  Synthetic
tccttccccacccagagaacctccaggaccctcaaggtccttacccctcccaccactcctgtctcccccaaggtt

SEQ ID NO: 278100 - DNA, 75 bp, Artificial Sequence
  Synthetic
ggaccctcaaggtccttacccctcccaccactcctgtctcccccaaggttccacctgccttcttccaatcaatgc

SEQ ID NO: 278101 - DNA, 75 bp, Artificial Sequence
  Synthetic
ccacctgccttcttccaatcaatgcgaaaacacaccccctatcgcaacggatgcttggaaccaacccttggggac

SEQ ID NO: 278102 - DNA, 75 bp, Artificial Sequence
  Synthetic
gtatgcctgtatctattccagctctccccacccatgacctggccacttatacctcatgtcatattctgccaccca

SEQ ID NO: 278103 - DNA, 75 bp, Artificial Sequence
  Synthetic
aaacaattaggagccttcctcaccaaggtgcctctaaagcgattagaggaacttctgtacaaaatgttcctacac

SEQ ID NO: 278104 - DNA, 75 bp, Artificial Sequence
  Synthetic
caagacatctcgatactcccactcatccccctgcggcagcaacagcaaccaattctaggggtccggatctccgtt

SEQ ID NO: 278105 - DNA, 75 bp, Artificial Sequence
  Synthetic
accggggcagtcatagtccttccggaggacgacctacccaccacaatgttccaacccgttagggctccctgtatc

SEQ ID NO: 278106 - DNA, 75 bp, Artificial Sequence
  Synthetic
cagaccgcctggtgtacaggacttcttccttatcactccatcttgacaaccccaggcctaatatggaccttcaat

SEQ ID NO: 278107 - DNA, 75 bp, Artificial Sequence
  Synthetic
gatggctcaccaatgatttccggcccttgccccaaagcggggcagccatctttggtagttcagtcctccctatta

SEQ ID NO: 278108 - DNA, 75 bp, Artificial Sequence
  Synthetic
atctttgaaaaattccaaaccaaagccttccatccctcttatctactgtcccatcaacttatacaatactcctcc

SEQ ID NO: 278109 - DNA, 75 bp, Artificial Sequence
  Synthetic
ccatcaacttatacaatactcctcctttcataaccttcacctcctattcgatgaatacaccaacatccctgtctc

SEQ ID NO: 278110 - DNA, 75 bp, Artificial Sequence
  Synthetic
actcaccttggggatccatcctctccaagcggcctcggtcgagacgccttccgtgggactgtctcccggcctcgg

SEQ ID NO: 278111 - DNA, 75 bp, Artificial Sequence
  Synthetic
gaacctctccgggagaggtctctcgccacaggcaggccgccccaggagtacctgtcttcccagggaagacaaaca

SEQ ID NO: 278112 - DNA, 75 bp, Artificial Sequence
  Synthetic
tgacaatggcgactagcctcccaagccagccacccagggcgagtcatcgacccaaaaggtcagaccgtctcacac

SEQ ID NO: 278113 - DNA, 75 bp, Artificial Sequence
  Synthetic
cagtgggtctctaaaggaacacccatccttcgcaaacacctacaatccctatattctgcccttcacgggtaccgg

SEQ ID NO: 278114 - DNA, 75 bp, Artificial Sequence
  Synthetic
ccccaggaaccaggaacagctctccagaaaaatagacctcacccttacccacttcccctagcgctgaaaaacaag

SEQ ID NO: 278115 - DNA, 75 bp, Artificial Sequence
  Synthetic
gctctgacgattaccccctgcccataaaatttgcctagtcaaaataaaagatgccgagtctataaaagcgcaagg

SEQ ID NO: 278116 - DNA, 75 bp, Artificial Sequence
  Synthetic
gtgggaccgtctcccggcctcggcacctcctgaactgctcctcccagggtaagtctcctctcaggtcgagctcgg

SEQ ID NO: 278117 - DNA, 75 bp, Artificial Sequence
  Synthetic
ctgccccttaggtagtcgctccccgagggtctttagagacacccgggtttccgcctgcgctcggctagactctgc

SEQ ID NO: 278118 - DNA, 75 bp, Artificial Sequence
  Synthetic
cttaaacttcacttccgcgttcttgtctcgttctttcctcttcgccgtcactgaaaacgaaacctcaacgccgcc

SEQ ID NO: 278119 - DNA, 75 bp, Artificial Sequence
  Synthetic
tctcgttctttcctcttcgccgtcactgaaaacgaaacctcaacgccgccctcctgacaggctggtcccggggcc

SEQ ID NO: 278120 - DNA, 75 bp, Artificial Sequence
  Synthetic
tgcacttatctgtggactacgtgctgccaagccatggccttcccttaacatctttttagactctaaatatttaat

SEQ ID NO: 278121 - DNA, 75 bp, Artificial Sequence
  Synthetic
gccaagccatggccttcccttaacatctttttagactctaaatatttaatcaaatacctacattccctcgccatt

SEQ ID NO: 278122 - DNA, 75 bp, Artificial Sequence
  Synthetic
aagcccccagggggctatcgacccaccactggcttaactttctccaggctgcttaccgcttgcagcctgggccct

SEQ ID NO: 278123 - DNA, 75 bp, Artificial Sequence
  Synthetic
gcttaccgcttgcagcctgggccctccgatttcgacttccagcagctacgacgctttctaaaactagcccttaaa

SEQ ID NO: 278124 - DNA, 75 bp, Artificial Sequence
  Synthetic
acgcccatttggctaaatcctattggctactcgcttttagctagccttatccccaagggatatccaggaagggtg

SEQ ID NO: 278125 - DNA, 75 bp, Artificial Sequence
  Synthetic
gctactcgcttttagctagccttatccccaagggatatccaggaagggtggtagagattataaatatccttgtca

SEQ ID NO: 278126 - DNA, 75 bp, Artificial Sequence
  Synthetic
aaaatcaagtctcccctagcgcccccgccgccccagttccgacacctatctgccctactactactcctccgccac

SEQ ID NO: 278127 - DNA, 75 bp, Artificial Sequence
  Synthetic
taattaccgaggctgagacccgcgggatgacaggctacaaccccatggcagggcccctaagaatgcaggctaata

SEQ ID NO: 278128 - DNA, 75 bp, Artificial Sequence
  Synthetic
gctttctccaccctgccaggcaatacccgtgacccctcttgggcagctatcctacaggggctggaggaaccctat

SEQ ID NO: 278129 - DNA, 75 bp, Artificial Sequence
  Synthetic
aatggttctattataaactccccggccttaccaatcagcggtggaaaggtccattgcaatccctccaggaagcgg

SEQ ID NO: 278130 - DNA, 75 bp, Artificial Sequence
  Synthetic
agcccgcggacacactaacagcccccttggggagatgctccggacatgtcaggcgtggacacccaaggacaaaac

SEQ ID NO: 278131 - DNA, 75 bp, Artificial Sequence
  Synthetic
gagtcgggactgtacccagccacgcccccctcctggcccctgccccctatgccaagatccttctcactggaaaag

SEQ ID NO: 278132 - DNA, 75 bp, Artificial Sequence
  Synthetic
ccgaccttacggttataccccagacactcgtgcccgggccggtaaagctccacgacaccctgatcctaggcgcca

SEQ ID NO: 278133 - DNA, 75 bp, Artificial Sequence
  Synthetic
actcgtgcccgggccggtaaagctccacgacaccctgatcctaggcgccagtgggcaaaccaacacccagttcaa

SEQ ID NO: 278134 - DNA, 75 bp, Artificial Sequence
  Synthetic
ctacaatgacccttgctcgctacaatgcccctacttgggctgccaagcatggacatccgcatacacgggccccgt

SEQ ID NO: 278135 - DNA, 75 bp, Artificial Sequence
  Synthetic
actcctccaaacccccctacacatattcttgcccttccgaaagtcccccgttatcctttcctcctgcctcttaga

SEQ ID NO: 278136 - DNA, 75 bp, Artificial Sequence
  Synthetic
tcagatgtaaatttcacccaggaagtcagccaagtgtcccttcgactacacttctctaagtgcggctcctccatg

SEQ ID NO: 278137 - DNA, 75 bp, Artificial Sequence
  Synthetic
ccccagcccccaccaattgctgccaatagccactccaaacaccataggcctcgaacaccttcccccacctcccca

SEQ ID NO: 278138 - DNA, 75 bp, Artificial Sequence
  Synthetic
gcaataaccccgtcttccccgttaaaaaaccaaatggtaaatggaggttcattcatgacctaagagccaccaatg

SEQ ID NO: 278139 - DNA, 75 bp, Artificial Sequence
  Synthetic
ccattactaccaccctcacctctccttccccagggccccccgatctcactagcctaccgacagccttaccccacc

SEQ ID NO: 278140 - DNA, 75 bp, Artificial Sequence
  Synthetic
tacagaccatagatcttactgacgcctttttccaaatccccctccccaagcagtaccagccatacttcgccttca

SEQ ID NO: 278141 - DNA, 75 bp, Artificial Sequence
  Synthetic
gtccttccacaggggtttaaaaacagccccaccctcttcgaacaacaattagcagccgtcctcaaccccatgagg

SEQ ID NO: 278142 - DNA, 75 bp, Artificial Sequence
  Synthetic
aaaatgtttcccacatcgaccattgtccaatacatggatgacatactttcagccagccccaccaatgaggaatta

SEQ ID NO: 278143 - DNA, 75 bp, Artificial Sequence
  Synthetic
caacaactctcccagctaaccctccaggcactgaccacgcatggccttccaatttcccaggaaaaaacacaacaa

SEQ ID NO: 278144 - DNA, 75 bp, Artificial Sequence
  Synthetic
accccaggccaaatacgcttcttaggacaggtcatctcccctaatcacattacatatgagagtacccctactatt

SEQ ID NO: 278145 - DNA, 75 bp, Artificial Sequence
  Synthetic
cccataaaatcccaatggacactcactgaattacaagttatcctaggagagatccagtgggtctctaaaggaaca

SEQ ID NO: 278146 - DNA, 75 bp, Artificial Sequence
  Synthetic
ccctatattctgcccttcacgggtaccgggacccaagagcttgtatcaccctcaccccacaacaactccatgcgt

SEQ ID NO: 278147 - DNA, 75 bp, Artificial Sequence
  Synthetic
tacatgccattcaacaagctctacaacataactgccgcggccgcctcaaccccgccctacctctccttggcctca

SEQ ID NO: 278148 - DNA, 75 bp, Artificial Sequence
  Synthetic
catcctcattcaccacatgggtcgattccataaccttggcagccaaccgtctggtccgtggaagactctcttaca

SEQ ID NO: 278149 - DNA, 75 bp, Artificial Sequence
  Synthetic
cctcccaacccttctccaggaaccacgactcctcaggccaattttcaccctctcccccgtcgtgcttgacacggc

SEQ ID NO: 278150 - DNA, 75 bp, Artificial Sequence
  Synthetic
cccctgccttttttccgatggctcccctcaaaaggcagcgtacgttctctgggaccagactatccttcaacagga

SEQ ID NO: 278151 - DNA, 75 bp, Artificial Sequence
  Synthetic
catcactcccctgccctctcacgaaacaaattccgcacaaaagggggagctccttgcacttatctgtggactacg

SEQ ID NO: 278152 - DNA, 75 bp, Artificial Sequence
  Synthetic
cattggggccttcctcggcacttccgcccatcaaaccctccaggcggccttaccacccctactgcagggcaagac

SEQ ID NO: 278153 - DNA, 75 bp, Artificial Sequence
  Synthetic
catctacctccaccatgtccgcagccacaccaacctccccgacccaatttccaccttcaatgaatacacagactc

SEQ ID NO: 278154 - DNA, 75 bp, Artificial Sequence
  Synthetic
ccttatcttagctccccttgttcccctgacgccccaaggcctccacggcctcacccattgcaatcaaagggctct

SEQ ID NO: 278155 - DNA, 75 bp, Artificial Sequence
  Synthetic
agtctcttttggcgccacaccaagggaagccaagtcccttgtacagacttgccatacctgtcaaaccatcaactc

SEQ ID NO: 278156 - DNA, 75 bp, Artificial Sequence
  Synthetic
tctccggtgcggtttccgtctcctgtaaaaagaaagaaaccagctgtgagactatcagcgccgttcttcaggcca

SEQ ID NO: 278157 - DNA, 75 bp, Artificial Sequence
  Synthetic
tttccctcctagggaaaccactccacattaacacagataatgggccagccttcctatcacaagaattccaggagt

SEQ ID NO: 278158 - DNA, 75 bp, Artificial Sequence
  Synthetic
tttgtacctcctatcgcatcaagcattctacccatataccatacaaccccaccagctcaggcctggtcgagagaa

SEQ ID NO: 278159 - DNA, 75 bp, Artificial Sequence
  Synthetic
ccaatggtgtaatcaaaaacttactaaataaatatctactagactgtcctaaccttcccctagacaatgccattc

SEQ ID NO: 278160 - DNA, 75 bp, Artificial Sequence
  Synthetic
acaaagccctttggactctcaatcagctaaatgtcatgaaccccagtggtaaaacccgatggcaaatccaccaca

SEQ ID NO: 278161 - DNA, 75 bp, Artificial Sequence
  Synthetic
agcctctacccctcccaaaccacctcccaaatggttctattataaactccccggccttaccaatcagcggtggaa

SEQ ID NO: 278162 - DNA, 75 bp, Artificial Sequence
  Synthetic
ccggccttaccaatcagcggtggaaaggtccattgcaatccctccaggaagcggctggggcagccttgctctcca

SEQ ID NO: 278163 - DNA, 75 bp, Artificial Sequence
  Synthetic
tagacggctccccccggtggatcccgtggcgattcctgaaaaaagctgcatgcccaagaccagacgccagcgaac

SEQ ID NO: 278164 - DNA, 75 bp, Artificial Sequence
  Synthetic
ggaacagctctccagaaaaaaatagacctcacccttacccacttcccctagcgctgaaaaacaaggctctgacga

SEQ ID NO: 278165 - DNA, 75 bp, Artificial Sequence
  Synthetic
tgcccaagaccagacgccagcgaactcgccgagcacgccgcaacagaccaccaacaccatgggtaatgttttttt

SEQ ID NO: 278166 - DNA, 75 bp, Artificial Sequence
  Synthetic
cctacttttattcagtctcacacattttccactagcccagcagagccgatgcacactcacggttggtatctcctc

SEQ ID NO: 278167 - DNA, 75 bp, Artificial Sequence
  Synthetic
gcacactcacggttggtatctcctcctaccactccagcccctgtagcccaacccaacccgtctgcacgtggaacc

SEQ ID NO: 278168 - DNA, 75 bp, Artificial Sequence
  Synthetic
tctggtcacggagactcaccttggggatccatcctctccaagcggcctcggttgagacgccttccgtgggaccgt

SEQ ID NO: 278169 - DNA, 75 bp, Artificial Sequence
  Synthetic
acccaacccgtctgcacgtggaacctcgaccttaattccctaacaacggaccaacgactacaccccccctgccct

SEQ ID NO: 278170 - DNA, 75 bp, Artificial Sequence
  Synthetic
aacctaattacttactctggcttccataagacttattccttatacttattcccacattggataaaaaagccaaac

SEQ ID NO: 278171 - DNA, 75 bp, Artificial Sequence
  Synthetic
agacagggcctagggtactactcgccttcctacaatgacccttgctcgctacaatgcccctacttgggctgccaa

SEQ ID NO: 278172 - DNA, 75 bp, Artificial Sequence
  Synthetic
catgaccctcctagtagatgcccctggatatgatcctttatggttcatcacctcagaacccactcagcctccacc

SEQ ID NO: 278173 - DNA, 75 bp, Artificial Sequence
  Synthetic
ccgagtctataaaagcgcaaggacagttcaggaggtggcgggctccttcaaccgacctccggtcccggagactca

SEQ ID NO: 278174 - DNA, 75 bp, Artificial Sequence
  Synthetic
actcaaatttatccagctgaccttacagagcaccaattactcctgcatggtttgcgtggatagatccagcctctc

SEQ ID NO: 278175 - DNA, 75 bp, Artificial Sequence
  Synthetic
atcctggcatgtactctacacccccaacatctccattccccaacaaacctcctcccgaaccatcctctttccttc

SEQ ID NO: 278176 - DNA, 75 bp, Artificial Sequence
  Synthetic
ccttgccctgcccgctcctccatcccaaccctccccttggacccattgctaccaacctcgcctacaggcgataac

SEQ ID NO: 278177 - DNA, 75 bp, Artificial Sequence
  Synthetic
accaacctcgcctacaggcgataacgacagataactgcaacaactccattatcctcccccctttttccctcgctc

SEQ ID NO: 278178 - DNA, 75 bp, Artificial Sequence
  Synthetic
atcctcccccctttttccctcgctcccgtacctcctccggcgacaagacgccgccgtgccgttccaatagcagtg

SEQ ID NO: 278179 - DNA, 75 bp, Artificial Sequence
  Synthetic
tggcttgtctccgccctagcggccggaacaggtatcgctggtggagtaacaggctccctatctctggcttccagt

SEQ ID NO: 278180 - DNA, 75 bp, Artificial Sequence
  Synthetic
agagattataaacatccttgtcaaaaatcaagtctcccctagcgcccccgccgccccagttccgacacctatctg

SEQ ID NO: 278181 - DNA, 75 bp, Artificial Sequence
  Synthetic
ccccactaccactcctccgccacccccccccccttccccggaggcccatgttccccccccttacgtggaacccac

SEQ ID NO: 278182 - DNA, 75 bp, Artificial Sequence
  Synthetic
catagtcaaaaatcatcaaaacatcctccgggttgcacagtatgcagcccaaaatagacgaggattagacctcct

SEQ ID NO: 278183 - DNA, 75 bp, Artificial Sequence
  Synthetic
ttccccccccttacgtggaacccacctccacgaaatgctttcctatcttacatccccctggagccccctcagctc

SEQ ID NO: 278184 - DNA, 75 bp, Artificial Sequence
  Synthetic
gacttacaagatctcctccagtacctatgctcctccctcgtggtttccttacaccatcagcagctcaacacacta

SEQ ID NO: 278185 - DNA, 75 bp, Artificial Sequence
  Synthetic
gtcccaatgggcacgagaagccctccagacaggcataaccattctcgctctactcctcctcgtcatattgtttgg

SEQ ID NO: 278186 - DNA, 75 bp, Artificial Sequence
  Synthetic
cgcgttcgtagagcgccttaatgtggcccttgacaacggcctccccgagggtacccccaaagagcccatcttacg

SEQ ID NO: 278187 - DNA, 75 bp, Artificial Sequence
  Synthetic
gtacccccaaagagcccatcttacgctccctagcgtactcaaatgccaacaaagaatgccagaaaatcttacaag

SEQ ID NO: 278188 - DNA, 75 bp, Artificial Sequence
  Synthetic
aggttcgtccccctaccattgacccatccacagtcctctataccagatgagtcgcccccgatgtccagccctaac

SEQ ID NO: 278189 - DNA, 75 bp, Artificial Sequence
  Synthetic
tcgattctgaataattgcctcaaatagttcctctaacccccgctcacattcctcccataggaccttcttttcccc

SEQ ID NO: 278190 - DNA, 75 bp, Artificial Sequence
  Synthetic
agttcctctaacccccgctcacattcctcccataggaccttcttttccccttccaggaaatccacataaccctaa

SEQ ID NO: 278191 - DNA, 75 bp, Artificial Sequence
  Synthetic
ccctcctggcccctgccccctatgccaggatccttctcactggaaaagggactgcccacaacccaaaccccctca

SEQ ID NO: 278192 - DNA, 75 bp, Artificial Sequence
  Synthetic
ctgatgcctttcttccctctcccggcgcttttgatccttttcccgcaggcgctcctttctgcgccgctcccgctc

SEQ ID NO: 278193 - DNA, 75 bp, Artificial Sequence
  Synthetic
gctcctttctgcgccgctcccgctcctcacgctcctgcagaagttttaagatctcccgctgctcctccgccaaca

SEQ ID NO: 278194 - DNA, 75 bp, Artificial Sequence
  Synthetic
ttatggggcaaacacctcagcctacccaagcgctacttgacacaggagccgaccgtacggttataccccagacac

SEQ ID NO: 278195 - DNA, 75 bp, Artificial Sequence
  Synthetic
gttcctctccagggggaggcacaccagatgtcagactcgcctctccctggtctcctaacggcaatctcctaaaat

SEQ ID NO: 278196 - DNA, 75 bp, Artificial Sequence
  Synthetic
agatgtcagactcgcctctccctggtctcctaacggcaatctcctaaaatagtctaaaaaatcacacataattac

SEQ ID NO: 278197 - DNA, 75 bp, Artificial Sequence
  Synthetic
tctcctaacggcaatctcctaaaatagtctaaaaaatcacacataattacaatcctgtctcctctcagcccattt

SEQ ID NO: 278198 - DNA, 75 bp, Artificial Sequence
  Synthetic
cataaaatcccaatggacactcactgaattacaggttatcctaggagaaatccagtgggtctctaaaggaacccc

SEQ ID NO: 278199 - DNA, 75 bp, Artificial Sequence
  Synthetic
ctccctcgccttccccgaacctggcctccgtccccaaaacatctacaccacctggggaaaaaccgtagtatgcct

SEQ ID NO: 278200 - DNA, 75 bp, Artificial Sequence
  Synthetic
atacctataccagctttccccacccatgacatggccacttataccccatgtcatattctgccaccccagacaatt

SEQ ID NO: 278201 - DNA, 75 bp, Artificial Sequence
  Synthetic
tcatattctgccaccccagacaattaggagcctttctcaccaaggtgcctctaaaacgattagaagaacttctat

SEQ ID NO: 278202 - DNA, 75 bp, Artificial Sequence
  Synthetic
acaaaatgttcctacacacagggacagtcatagtcctcccggaggacgacctacccaccacaatgttccaacccg

SEQ ID NO: 278203 - DNA, 75 bp, Artificial Sequence
  Synthetic
cctgccttttttccgatggctcccctcaaaaggcagcatacatcctctgggaccagactatccttcaacaggaca

SEQ ID NO: 278204 - DNA, 75 bp, Artificial Sequence
  Synthetic
aaagcagggcagccatctttagtagttcagtcctccctattaatcttcgaaaaattccaaaccaaagccttccat

SEQ ID NO: 278205 - DNA, 75 bp, Artificial Sequence
  Synthetic
gaccagactatccttcaacaggacattactcccctgccccctcacgaaaaacattcccgacaaaagggggaactc

SEQ ID NO: 278206 - DNA, 75 bp, Artificial Sequence
  Synthetic
ccctcctatctactctctcatcagcttatacaatactcctccttccataaccttcaccttctattcgatgaatac

SEQ ID NO: 278207 - DNA, 75 bp, Artificial Sequence
  Synthetic
atcaaatacctacactccctcgccattggggccttcctcggcacttccgcccatcaaaccctccaggcggcctta

SEQ ID NO: 278208 - DNA, 75 bp, Artificial Sequence
  Synthetic
ccacccctactacagggcaagaccatctacctccaccatatccgcacccacaccaacctccccgacccaatttcc

SEQ ID NO: 278209 - DNA, 75 bp, Artificial Sequence
  Synthetic
tcccaagtaaaggctctgacgtctccccctttttttaggaactgaaaccacggccctgacgtccctcccccccag

SEQ ID NO: 278210 - DNA, 75 bp, Artificial Sequence
  Synthetic
cccctttttttaggaactgaaaccacggccctgacgtccctcccccccaggaacaggaacagctctccagaaaaa

SEQ ID NO: 278211 - DNA, 75 bp, Artificial Sequence
  Synthetic
aatagacctcacccttacccacttcccctagcgctgaaaaacaaggctctgacgattaccccctgcccataaaat

SEQ ID NO: 278212 - DNA, 75 bp, Artificial Sequence
  Synthetic
catacctgtcagatcatcaactcacagcatcatatgcctcaagggtacattcgccggggcctcctacccaaccac

SEQ ID NO: 278213 - DNA, 75 bp, Artificial Sequence
  Synthetic
agaagaaagaaaccagctgtgagactatcagcgcccttcttcaggccatctccctcctagggaaaccactccaca

SEQ ID NO: 278214 - DNA, 75 bp, Artificial Sequence
  Synthetic
ccttcccctagacaatgccattaacaaagccctctggactctcaatcagctaaatgtcatgaaccccagtggtaa

SEQ ID NO: 278215 - DNA, 75 bp, Artificial Sequence
  Synthetic
aacccgatggcaaatccactacagccctccattgccacccattcctgaagcctctacccctcccaaaccacctct

SEQ ID NO: 278216 - DNA, 75 bp, Artificial Sequence
  Synthetic
aacctctccgggagaggtctattgctataggcaggcccgccccaggagcatttgtcttcccggggaagacaaaca

SEQ ID NO: 278217 - DNA, 75 bp, Artificial Sequence
  Synthetic
tgacaatggcgaccagcctcctgagccagccacccagggcgagtcatcgacccaaaaggtcagaccgtctcacac

SEQ ID NO: 278218 - DNA, 75 bp, Artificial Sequence
  Synthetic
cccaaaaggtcagaccgtctcacacaaacaatcccaagtaaaggctctgacgtctcccccttttataggaactga

SEQ ID NO: 278219 - DNA, 75 bp, Artificial Sequence
  Synthetic
gtctccagtccatcctggaagtttcactcagatgtaaatttcacccaagaagtcagccaagtgtccttccgacta

SEQ ID NO: 278220 - DNA, 75 bp, Artificial Sequence
  Synthetic
acacaaagacggcacgatgatttttacaattttgaacgttttaacaagagccatgctcgtgatgagcatgtattc

SEQ ID NO: 278221 - DNA, 75 bp, Artificial Sequence
  Synthetic
catatcatgaatgaaaataaatgctttgaacaatgtggcgcaattggttgtggttgttttaacattaatccttcc

SEQ ID NO: 278222 - DNA, 75 bp, Artificial Sequence
  Synthetic
agccaaagatgaacccacaataatgaggtgtaagatggcagcagctatctgcttccgtatgaagaagaatttagg

SEQ ID NO: 278223 - DNA, 75 bp, Artificial Sequence
  Synthetic
actcacctctagaaggcctagtttactactgggagacacactcaaaaaaacatgactataagaagcaagagtctc

SEQ ID NO: 278224 - DNA, 75 bp, Artificial Sequence
  Synthetic
catgactataagaagcaagagtctcagaaatgcagagttggagactcagataaaaaaatgatatctaatgtcaca

SEQ ID NO: 278225 - DNA, 75 bp, Artificial Sequence
  Synthetic
ggtctatctagctatatatccctcagagaagtccacatcaaacactgattttgtcatggaatacaattctgaatt

SEQ ID NO: 278226 - DNA, 75 bp, Artificial Sequence
  Synthetic
agaaatgcagagttggagactcagataaaaaaatgatatctaatgtcacaataatctctctgatttctgaaatac

SEQ ID NO: 278227 - DNA, 75 bp, Artificial Sequence
  Synthetic
tttctttcattcacagcatgtcaggccaaccataagatggatagcagctagttgcagtctgccagaagttgagac

SEQ ID NO: 278228 - DNA, 75 bp, Artificial Sequence
  Synthetic
atcatgtggtaatgatgacaattctactgggcaagtcttaacattcaatggattagaagatacaatacgaggcga

SEQ ID NO: 278229 - DNA, 75 bp, Artificial Sequence
  Synthetic
gttgcagtctgccagaagttgagacattagtggcaagacaagaagaggcgtctaacctaatgaccgcagtcacgg

SEQ ID NO: 278230 - DNA, 75 bp, Artificial Sequence
  Synthetic
attagtggcaagacaagaagaggcgtctaacctaatgaccgcagtcacggaggggggtggatccttttctctggc

SEQ ID NO: 278231 - DNA, 75 bp, Artificial Sequence
  Synthetic
ttacattgtagactgtgtgactggcttgtatcagtcagatattggagtcggtgtggggctggggaggactcacca

SEQ ID NO: 278232 - DNA, 75 bp, Artificial Sequence
  Synthetic
ttgtatcagtcagatattggagtcggtgtggggctggggaggactcaccatgatcatcatcaagtgaaaaacaag

SEQ ID NO: 278233 - DNA, 75 bp, Artificial Sequence
  Synthetic
tgatcatcatcaagtgaaaaacaaggcagtcgtgatagatgagaaagaaagaatgatatcactcctagagactca

SEQ ID NO: 278234 - DNA, 75 bp, Artificial Sequence
  Synthetic
acaaagtgagaatgatataaagatgcaagtactaatgtctgaaattgaacaactgaagaatcaactgtcaaggaa

SEQ ID NO: 278235 - DNA, 75 bp, Artificial Sequence
  Synthetic
tacttgataatccatattgtgctggcttaggaggtttcaggttcaacctttacaaagcaataacaagaacatcat

SEQ ID NO: 278236 - DNA, 75 bp, Artificial Sequence
  Synthetic
aactgaagaatcaactgtcaaggaagcgaaatgagagaggacaggagaaaagagatgctgaaaaggtgatgtcag

SEQ ID NO: 278237 - DNA, 75 bp, Artificial Sequence
  Synthetic
gaagaaagtgaggtctgtgagtgaagatgagcagttggaggcttgtagcgttagcccaggcggtgcaataatatt

SEQ ID NO: 278238 - DNA, 75 bp, Artificial Sequence
  Synthetic
gatgagcagttggaggcttgtagcgttagcccaggcggtgcaataatattgagttcctcacttaaatggggatcc

SEQ ID NO: 278239 - DNA, 75 bp, Artificial Sequence
  Synthetic
acttgatggccaggaattctgatttacggaagcataatgatattctcactgctgagatatctcagatggaaaata

SEQ ID NO: 278240 - DNA, 75 bp, Artificial Sequence
  Synthetic
gagttcctcacttaaatggggatccagacaaaagtatctaaaactgaggtcaagactaaacatccctgacaactg

SEQ ID NO: 278241 - DNA, 75 bp, Artificial Sequence
  Synthetic
agacaaaagtatctaaaactgaggtcaagactaaacatccctgacaactggattgacttaataaacgagaaccct

SEQ ID NO: 278242 - DNA, 75 bp, Artificial Sequence
  Synthetic
gattgacttaataaacgagaacccttcagtattatatcgagcaccccggacatctgaagaaataatgctaaggat

SEQ ID NO: 278243 - DNA, 75 bp, Artificial Sequence
  Synthetic
tgcatctccagattcaccgatgattaatccatggcctcatgcaaaaaacagggttggcacaggaatgtacaaata

SEQ ID NO: 278244 - DNA, 75 bp, Artificial Sequence
  Synthetic
tactgtcaggttttacattttcaaaaaccattagtagatgaaagactttcatattcttgtggatctgagcctaag

SEQ ID NO: 278245 - DNA, 75 bp, Artificial Sequence
  Synthetic
tgatgaaaatgatgactcaggctgcagaccaatcagatatggggtttcatgcataggatttgactttatgcttaa

SEQ ID NO: 278246 - DNA, 75 bp, Artificial Sequence
  Synthetic
ttcagtttacttcttgtcagcatctatatttcaggattcaaataagcaagaattcagtatcatggagtccagcaa

SEQ ID NO: 278247 - DNA, 75 bp, Artificial Sequence
  Synthetic
cttatagtgattaagggaacattagtttacatgggtgtatatgatttcagaaacaaaacaggtggttcttcaaca

SEQ ID NO: 278248 - DNA, 75 bp, Artificial Sequence
  Synthetic
aatggacaaatatcctttctttaatgcatttataggccataaaactcccttagaatcctttgctgataaaataat

SEQ ID NO: 278249 - DNA, 75 bp, Artificial Sequence
  Synthetic
ttgaattaacaatggaagatattcttttcttgttcccaaacattgatgatttgcagcagttagactgtatagtgt

SEQ ID NO: 278250 - DNA, 75 bp, Artificial Sequence
  Synthetic
tgagaaagaggaagaaacatgtgagataggaacaaacaaagagtttaaatgtttcgaagagagagcttacataaa

SEQ ID NO: 278251 - DNA, 75 bp, Artificial Sequence
  Synthetic
ggggacatgcccaactaacatcaatgcagttcactacattgacaataaaggtaaattgcgatatgtaaaatgcaa

SEQ ID NO: 278252 - DNA, 75 bp, Artificial Sequence
  Synthetic
acacagaccaaaattacagtatttgaaggacatcaaaatctaaaaacaccagcagaatatatggtttcagataag

SEQ ID NO: 278253 - DNA, 75 bp, Artificial Sequence
  Synthetic
tggtttggcacaatgaaaagtaagattggctcatcaggatttgaaaatgaatggtcaaagttgaaaaccataatc

SEQ ID NO: 278254 - DNA, 75 bp, Artificial Sequence
  Synthetic
agaaagctggtcagtctattcaggtgcagaaaacttcagtcccacttcaagatgcaatttgtcaagaaaattctg

SEQ ID NO: 278255 - DNA, 75 bp, Artificial Sequence
  Synthetic
acatggttgacagatacacctgcagcaacacttgagaagtcaccactgtcaaatcatgttcaaattaggaatttc

SEQ ID NO: 278256 - DNA, 75 bp, Artificial Sequence
  Synthetic
ctagagaccactcctcaaccaggaataaacctcaaaatacaatgagtgactaatcttcacgcatgcatcatctct

SEQ ID NO: 278257 - DNA, 75 bp, Artificial Sequence
  Synthetic
ttctctagaatggaaagcaaacctagaactgtacgtgtcactggagcacctgttaagaaaagatcaggctcaagt

SEQ ID NO: 278258 - DNA, 75 bp, Artificial Sequence
  Synthetic
ctcattcatcacactcaaagagaaggggaaaatttacattgagcacctgatgttgaaaaatatagaggtggttac

SEQ ID NO: 278259 - DNA, 75 bp, Artificial Sequence
  Synthetic
tgttaagaaaagatcaggctcaagtaagatctccttggttatcagagataatttcactaagattggttttctccg

SEQ ID NO: 278260 - DNA, 75 bp, Artificial Sequence
  Synthetic
aaatgtctcttttgtttgctacgaacatgcaggtcaggatgagcaagaggtagaacacagggctctgaagagagt

SEQ ID NO: 278261 - DNA, 75 bp, Artificial Sequence
  Synthetic
tagaacacagggctctgaagagagtatcagttaatgattgtaagattgtggacaactctaaacagaaaatttgca

SEQ ID NO: 278262 - DNA, 75 bp, Artificial Sequence
  Synthetic
cacgatgatttttacaattttaaatattttaacaagagccatgctcgtaatgagcatgtattctttaacaacatg

SEQ ID NO: 278263 - DNA, 75 bp, Artificial Sequence
  Synthetic
gacaactctaaacagaaaatttgcacaggagatcacattttctgtgaaaagtatgattgttctacatcttatcca

SEQ ID NO: 278264 - DNA, 75 bp, Artificial Sequence
  Synthetic
gatgttacttgtatccatgcgccaggatcaggaccattgtacataaatctcatgggctcatggataaaaccccaa

SEQ ID NO: 278265 - DNA, 75 bp, Artificial Sequence
  Synthetic
aagagaatcagatgggaaaaccaggacaaaccagttggcagtatttcaaaactttgtgaatagtgaccctgacat

SEQ ID NO: 278266 - DNA, 75 bp, Artificial Sequence
  Synthetic
tgcttctctaatgactcacctctagaaggcttagtttactactgggagacacactcaaaaagacatgattataag

SEQ ID NO: 278267 - DNA, 75 bp, Artificial Sequence
  Synthetic
tgtgtgggctacgagagagtcttagtagatagagaagtcaagcagccattgctggcaccagaacagaactgtgac

SEQ ID NO: 278268 - DNA, 75 bp, Artificial Sequence
  Synthetic
ggagtctggcgaggggtcatggatggatcccaaatacagatagagatagataacaagcagggtctcccacctcag

SEQ ID NO: 278269 - DNA, 75 bp, Artificial Sequence
  Synthetic
atttctgaaatacaaaaaagcatctctgaattgtcactatcatgtggcaatgatgacaattctaccgggcaagtc

SEQ ID NO: 278270 - DNA, 75 bp, Artificial Sequence
  Synthetic
agggggtccatataaagtccaccggttttgagataacatcagcagtagcctgctctcatggatcttgcatctcag

SEQ ID NO: 278271 - DNA, 75 bp, Artificial Sequence
  Synthetic
tgatgacaattctaccgggcaagtcttaacattcaatggactagaagataccatacgaggcgattacattgtaga

SEQ ID NO: 278272 - DNA, 75 bp, Artificial Sequence
  Synthetic
gttggtgtaaagaatgatgtggatatgtcaaaacggagtagaagtggtgctagattttggctttatgactttaaa

SEQ ID NO: 278273 - DNA, 75 bp, Artificial Sequence
  Synthetic
tgtcaaaacggagtagaagtggtgctagattttggctttatgactttaaagcattcacgcaagacaaaccatttg

SEQ ID NO: 278274 - DNA, 75 bp, Artificial Sequence
  Synthetic
gccagtgtgggcggaagaattgggattcacctctcgcacacctctgactctgctagtgtgcacatggtggtggtt

SEQ ID NO: 278275 - DNA, 75 bp, Artificial Sequence
  Synthetic
ccagtctttgccattcgcctttgtgcataaggtcttagagttatgcagtggagtgctagtgagggatcacattga

SEQ ID NO: 278276 - DNA, 75 bp, Artificial Sequence
  Synthetic
agtgaaaaacaaggcagttgtgatagatgagaaggaaagaatgatatcactcctggagactcaacaaagtgagaa

SEQ ID NO: 278277 - DNA, 75 bp, Artificial Sequence
  Synthetic
tgccctcccagagacagctgtgcagctcataattgcctgctatgctatcatggtatcctgaattatcagtgccat

SEQ ID NO: 278278 - DNA, 75 bp, Artificial Sequence
  Synthetic
taacgagaggctttccaagatagtacagttgtgcactgagaactctttgaggacgaaggtgggtactatttattc

SEQ ID NO: 278279 - DNA, 75 bp, Artificial Sequence
  Synthetic
tggtatcctgaattatcagtgccattcaacattaagtgctatcctgacttcctttctattaattctcttcatata

SEQ ID NO: 278280 - DNA, 75 bp, Artificial Sequence
  Synthetic
tcaacattaagtgctatcctgacttcctttctattaattctcttcatatacactgttttttctgtcacgacaaat

SEQ ID NO: 278281 - DNA, 75 bp, Artificial Sequence
  Synthetic
agctctaccaaatttctctgaaggaagatcaataatagatgttgattccattgttgatttaatgatagaggacat

SEQ ID NO: 278282 - DNA, 75 bp, Artificial Sequence
  Synthetic
atgttatatgtgctcagactaatacctaaacagctaaagagtccagttggatggctcagactcttcattaactgg

SEQ ID NO: 278283 - DNA, 75 bp, Artificial Sequence
  Synthetic
ggctaaggaagacttcaatgatgctgttaaaatgatggaaacagaagaaccagcatcatatgagaatgaatcatt

SEQ ID NO: 278284 - DNA, 75 bp, Artificial Sequence
  Synthetic
gttaaaatgatggaaacagaagaaccagcatcatatgagaatgaatcatttgatataagtgatattgatttattt

SEQ ID NO: 278285 - DNA, 75 bp, Artificial Sequence
  Synthetic
ctattaactgctttaagaatcaaaactaggaatgttatggggaggataaaccagaggataggatgggttgaccat

SEQ ID NO: 278286 - DNA, 75 bp, Artificial Sequence
  Synthetic
cagatgaaatatgataacacaatccaaagaaataaaaatgtcatgagtactactgtagtcccagcaatactttca

SEQ ID NO: 278287 - DNA, 75 bp, Artificial Sequence
  Synthetic
gtggccttactgtcatcatcagttgctcccattatagctgcgcctccagattcaccgatgattaatccatggcct

SEQ ID NO: 278288 - DNA, 75 bp, Artificial Sequence
  Synthetic
tctgatggatgactttgttaatgtactgatcctaaaatgtggcagaaaggacattagaagatgccttgagacagg

SEQ ID NO: 278289 - DNA, 75 bp, Artificial Sequence
  Synthetic
catgatgtagagaggccaaggcacagagaacctatgaggagattcaaaacaactctattgttgactctgataatg

SEQ ID NO: 278290 - DNA, 75 bp, Artificial Sequence
  Synthetic
atgactggaggaaatgcttgctccaatacagtagtagccaattcaaagcaaaccagatgtgtgcaggaaggatca

SEQ ID NO: 278291 - DNA, 75 bp, Artificial Sequence
  Synthetic
gagatgcatgacaagaaataaaatatacatgagagatctattctcaagcataggtagaaatcctgacgatgtaca

SEQ ID NO: 278292 - DNA, 75 bp, Artificial Sequence
  Synthetic
tacatgagagatctattctcaagcataggtagaaatcctgacgatgtacatgctgatgactacaatgaaagcgag

SEQ ID NO: 278293 - DNA, 75 bp, Artificial Sequence
  Synthetic
agcacaaagtgttcaatcactgcaacgataactttaagggcaggtgtgattggtgcagagtcatgttttatcata

SEQ ID NO: 278294 - DNA, 75 bp, Artificial Sequence
  Synthetic
cgataactttaagggcaggtgtgattggtgcagagtcatgttttatcataaaaggccctatggaaaatcagcaga

SEQ ID NO: 278295 - DNA, 75 bp, Artificial Sequence
  Synthetic
tcagatccggatgatgatttgatcggttagagctactaatcacaaaaaagtgaataaccaaagataataaaaaaa

SEQ ID NO: 278296 - DNA, 75 bp, Artificial Sequence
  Synthetic
aaacaatatcaatcaaaaccatctctagtgaaacagtatgcagggagggatcaagcttctggactagtttatata

SEQ ID NO: 278297 - DNA, 75 bp, Artificial Sequence
  Synthetic
tcaaaaatagtactttgagcattgtaaaagatagtttgatttcataattaacaatttaaaaaaaatgggacggtc

SEQ ID NO: 278298 - DNA, 75 bp, Artificial Sequence
  Synthetic
tagtgaaacagtatgcagggagggatcaagcttctggactagtttatatatcccatcctgtcttagttctaggag

SEQ ID NO: 278299 - DNA, 75 bp, Artificial Sequence
  Synthetic
tcccatcctgtcttagttctaggaggtgtcatcttgttggtgattgtgtgggcaataaatgccagtcgtggagag

SEQ ID NO: 278300 - DNA, 75 bp, Artificial Sequence
  Synthetic
ttgccgttcagtttgcctctgagtctatagatgagcaagctgttgccggttgggtgactgattttgcttatcaag

SEQ ID NO: 278301 - DNA, 75 bp, Artificial Sequence
  Synthetic
ggcaataaatgccagtcgtggagagatgatcagctatctagggaattctcaggagtaaaggataatcatatcatg

SEQ ID NO: 278302 - DNA, 75 bp, Artificial Sequence
  Synthetic
tagtactttgagcattgtaaaagatagtttgatttcataattaacaatttaaaaaaaatgggacggtctttgtgt

SEQ ID NO: 278303 - DNA, 75 bp, Artificial Sequence
  Synthetic
aggaaaatcaagaagaaagctggtcagtctgttcaggtgcagaaaacttcagtcccacttcaagatgcaatttgt

SEQ ID NO: 278304 - DNA, 75 bp, Artificial Sequence
  Synthetic
tcttgtgaaagatcgtggaggtgaggactggaagcaggatgtcaagaagatgattgttctctctcttaccagagg

SEQ ID NO: 278305 - DNA, 75 bp, Artificial Sequence
  Synthetic
taacattaatccttcctgcttgtacgttcatgcttacctcaagagtgctagaaatgaagcagttagggttttctc

SEQ ID NO: 278306 - DNA, 75 bp, Artificial Sequence
  Synthetic
tgattgttctctctcttaccagaggcaacaagccaaacaagatggttcttaagatgtcagacaagggcaaggcaa

SEQ ID NO: 278307 - DNA, 75 bp, Artificial Sequence
  Synthetic
aagatgtcagacaagggcaaggcaatggtgaatgagctcgtgttgaaatacaagctcaagtctggaaacccttct

SEQ ID NO: 278308 - DNA, 75 bp, Artificial Sequence
  Synthetic
agtcccacttcaagatgcaatttgtcaagaaaattcagacacttattctggaccaaagataccctttaaaggggt

SEQ ID NO: 278309 - DNA, 75 bp, Artificial Sequence
  Synthetic
gtggcgcaattggttgtggttgttttaacattaatccttcctgcttgtacgttcatgcttacctcaagagtgcta

SEQ ID NO: 278310 - DNA, 75 bp, Artificial Sequence
  Synthetic
gtgagacagagctggtcgcattgggaagcctaggcaccaagtttttaaactggggcaccctgtctttatccttgg

SEQ ID NO: 278311 - DNA, 75 bp, Artificial Sequence
  Synthetic
tggggcaccctgtctttatccttggatgcagaaggcatcagcggaaccaacagcatcagttttctggaaagtagt

SEQ ID NO: 278312 - DNA, 75 bp, Artificial Sequence
  Synthetic
aacccaagctcactgcttgttcatgatccaattctcaaagaccatcaacccctcactgagaggcttaagtaagga

SEQ ID NO: 278313 - DNA, 75 bp, Artificial Sequence
  Synthetic
cagcatcagttttctggaaagtagtaaaggaggatttgccttatacgatgaaggctatagtgagataccaagaga

SEQ ID NO: 278314 - DNA, 75 bp, Artificial Sequence
  Synthetic
aaaggaggatttgccttatacgatgaaggctatagtgagataccaagagagggatttcttggcgagataaggtgt

SEQ ID NO: 278315 - DNA, 75 bp, Artificial Sequence
  Synthetic
tgaaattgtctccagctttgagcggccaatgcaagctgcaatcagtagcacatttttaacatctgccaatagaag

SEQ ID NO: 278316 - DNA, 75 bp, Artificial Sequence
  Synthetic
ttgtaagattgtggacaactccaagcagaaaatttgcacaggagatcacgttttctgtgaaaagtatgattgttc

SEQ ID NO: 278317 - DNA, 75 bp, Artificial Sequence
  Synthetic
cttcagatccctttgaaacaccagaggccttgattaaacttagacaacatgtgcattccaaattggacattccaa

SEQ ID NO: 278318 - DNA, 75 bp, Artificial Sequence
  Synthetic
ggccttgattaaacttagacaacatgtgcattccaaattggacattccaaaacacactgtgagtcaaacttcaaa

SEQ ID NO: 278319 - DNA, 75 bp, Artificial Sequence
  Synthetic
tgtacataaatcttatgggctcatggattaaaccccaatgtgtgggctacgagagagtcttggtagacagggaag

SEQ ID NO: 278320 - DNA, 75 bp, Artificial Sequence
  Synthetic
caaaagacaagaagacagtacaggctttcactaatggagcgataaaagcgctattgtctattaatttagatgatc

SEQ ID NO: 278321 - DNA, 75 bp, Artificial Sequence
  Synthetic
aaaacaaagaaaaaaacaataaaatataaaacaaaacaacaaaaaaatgtaaaaaacataaaaacaaaagaaaaa

SEQ ID NO: 278322 - DNA, 75 bp, Artificial Sequence
  Synthetic
aaaaaacataaaaacaaaagaaaaaacaaaaaaacaaaaaaacaaaaaacgaacaaaaatcaaaaaacattgact

SEQ ID NO: 278323 - DNA, 75 bp, Artificial Sequence
  Synthetic
aatgttagtggttgctactcctgtgattatggagcacatgtctgtgtgaaagtcaaatcctcagaatcagctgat

SEQ ID NO: 278324 - DNA, 75 bp, Artificial Sequence
  Synthetic
tgcctaggtgtgtgtgagagtgtgtttgtggttttctttgagagtgtttttgaggagttttttggtttttcttgt

SEQ ID NO: 278325 - DNA, 75 bp, Artificial Sequence
  Synthetic
ttctttgcagaatcagaagacaagacaacagttttatctttcccaatacagtctggcacccatgattactgtcag

SEQ ID NO: 278326 - DNA, 75 bp, Artificial Sequence
  Synthetic
tttttattttgagagtcagattggggtctcatctctttgtggtttatatgtcctgatttagcattgttagaggaa

SEQ ID NO: 278327 - DNA, 75 bp, Artificial Sequence
  Synthetic
gtctcatctctttgtggtttatatgtcctgatttagcattgttagaggaaaccagattctgtttcccagtagttc

SEQ ID NO: 278328 - DNA, 75 bp, Artificial Sequence
  Synthetic
tagatgaaagactttcatattcttgtggatctgagcctaagcttatagtgattaagggaacattagtttacatgg

SEQ ID NO: 278329 - DNA, 75 bp, Artificial Sequence
  Synthetic
ttatcagtgccattcaacattaagtgccatcctgacttcctttctattaattctcttcatatacactgttttttc

SEQ ID NO: 278330 - DNA, 75 bp, Artificial Sequence
  Synthetic
attaagggaacattagtttacatgggtgtatatgatttcagaaacaaaacaggtggttcttcaacagtggtaaat

SEQ ID NO: 278331 - DNA, 75 bp, Artificial Sequence
  Synthetic
tgtgacgacaaatatgttatatgtgctcagactaataccaaaacagctaaagagtccagtgggatggctcaaact

SEQ ID NO: 278332 - DNA, 75 bp, Artificial Sequence
  Synthetic
ccttcagaaggcgcctggagcatctcaaattggttttcaggccttctagactggttaggcgggcctatgaaggct

SEQ ID NO: 278333 - DNA, 75 bp, Artificial Sequence
  Synthetic
ctctaatgctgtcatgagtctgatcagttgtatgtaggcaatctctttctctatggcttgacctgtgaatacttc

SEQ ID NO: 278334 - DNA, 75 bp, Artificial Sequence
  Synthetic
atactgaagattctgggcttcattgctattgggattgtttgctttattttattcatgattatgatcagaattgca

SEQ ID NO: 278335 - DNA, 75 bp, Artificial Sequence
  Synthetic
atgggttgaccattttgatgtagagagaccaaggcacagagagcctatgagaagattcaaaacaactctattgtt

SEQ ID NO: 278336 - DNA, 75 bp, Artificial Sequence
  Synthetic
gtcaactcaataaatatcaagaagaaaaactagtaacaatgcaagcgcatttgaaaaccatccaatcccacaaga

SEQ ID NO: 278337 - DNA, 75 bp, Artificial Sequence
  Synthetic
gttgcaaagtcacattttttctcccagtttaactggtaaccatccagtgttgagaattcaaagaatttcaaagtt

SEQ ID NO: 278338 - DNA, 75 bp, Artificial Sequence
  Synthetic
acaaaaaaatgaacaaaacccacaccaacgagcacaagaaacaatagaaacaccaagcacaacaaaacaattgga

SEQ ID NO: 278339 - DNA, 75 bp, Artificial Sequence
  Synthetic
ggataagtaagaggccaggacagagccctcttaatgtttggttcacaccactttagtgcgtctttaatgtctaac

SEQ ID NO: 278340 - DNA, 75 bp, Artificial Sequence
  Synthetic
caacgagcacaagaaacaatagaaacaccaagcacaacaaaacaattggaaagccaaatcacaaaaaacacaaaa

SEQ ID NO: 278341 - DNA, 75 bp, Artificial Sequence
  Synthetic
tcaatcactgcaacgataactttaagggcaggtgtgattggtgcagaatcatgttttatcataaaagggcctatg

SEQ ID NO: 278342 - DNA, 75 bp, Artificial Sequence
  Synthetic
attgagatacgggctattgtaacatcaaaaaatgatggagaggcctttatcacaagaccttgcccatatccccac

SEQ ID NO: 278343 - DNA, 75 bp, Artificial Sequence
  Synthetic
gggcaggtgtgattggtgcagaatcatgttttatcataaaagggcctatggaaaatcagcagaaaacaatatcaa

SEQ ID NO: 278344 - DNA, 75 bp, Artificial Sequence
  Synthetic
aatgcttgctccaatacagtagtagccaattcaaagcaaaccagatgtgtgcaggaaggatcaaacacaaaatgt

SEQ ID NO: 278345 - DNA, 75 bp, Artificial Sequence
  Synthetic
aaatacaatgagtgactaatcttcacgcatgcatcatctctgcagtccagctattacataactagtcatcttcat

SEQ ID NO: 278346 - DNA, 75 bp, Artificial Sequence
  Synthetic
gtctcttgcaaggtgagagtatagaaaacacagatattggtttactgttcattttataaatttagtgagatgtgc

SEQ ID NO: 278347 - DNA, 75 bp, Artificial Sequence
  Synthetic
gtgagagtatagaaaacacagatattggtttactgttcattttataaatttagtgagatgtgccggtctttgtgt

SEQ ID NO: 278348 - DNA, 75 bp, Artificial Sequence
  Synthetic
acacaaagaagtcccaattacaatggaatctttgctacgaaaacaaaccatcaacaatgaagggttttttaagcc

SEQ ID NO: 278349 - DNA, 75 bp, Artificial Sequence
  Synthetic
actcttttcaactggtctggagaagtgctcattacgggcaactcgcgagcataatagtttatgttggacatgacg

SEQ ID NO: 278350 - DNA, 75 bp, Artificial Sequence
  Synthetic
tcaacaatgaagggttttttaagcctgaattacgtcatagtgaccatgacttgttaaacgcagatttgcccacat

SEQ ID NO: 278351 - DNA, 75 bp, Artificial Sequence
  Synthetic
gggacaccaaagaccccctgaattttttcgtcatgtccaacataaactattatgctcgcgagttgcccataatga

SEQ ID NO: 278352 - DNA, 75 bp, Artificial Sequence
  Synthetic
agtgggatctccatacctttgtaaaggctgactggggcattgtgacgcttaccgaatgggacaaaatccacagtc

SEQ ID NO: 278353 - DNA, 75 bp, Artificial Sequence
  Synthetic
tcctagtggagagagcatctagtaagattgttattgatttgaacctcgactcattgaaccccaattcaactgtgg

SEQ ID NO: 278354 - DNA, 75 bp, Artificial Sequence
  Synthetic
gcacttctccgaaccagttgaaaagagtgaccgtggattttgtcccattcggtaagcgtcataatgccccagtca

SEQ ID NO: 278355 - DNA, 75 bp, Artificial Sequence
  Synthetic
ttagggttttctcatgttctgattgggttcacagagtttcttttgaggtgaagggccctgatggtgagacagagc

SEQ ID NO: 278356 - DNA, 75 bp, Artificial Sequence
  Synthetic
gcctttacaaaggtatggagatcccactgcacaatctcagacaatctgttatagccaaaaatagactaattacct

SEQ ID NO: 278357 - DNA, 75 bp, Artificial Sequence
  Synthetic
tagtcacattgggaagcttaggcaccaagtttttaaactggggcaccctgtctttatccttggatgcagaaggca

SEQ ID NO: 278358 - DNA, 75 bp, Artificial Sequence
  Synthetic
atattgctgattctactgatgttaagctgtcatctaagtttggcatagttggtgatggctatgatcatctgagcc

SEQ ID NO: 278359 - DNA, 75 bp, Artificial Sequence
  Synthetic
tcttaaataattatgatttacctaaggagtggggatatgaacaaggtcttgtaataaaggcctctccatcatttt

SEQ ID NO: 278360 - DNA, 75 bp, Artificial Sequence
  Synthetic
ggtgatggctatgatcatctgagcccagacatgattgtcgaaacaacatcaggttcatatattgttgttgagttt

SEQ ID NO: 278361 - DNA, 75 bp, Artificial Sequence
  Synthetic
ttgatgtcacaatagcccgtatttcaatgttggacgttaaagatgcactaaagtggtgtgaaccaaacattaaga

SEQ ID NO: 278362 - DNA, 75 bp, Artificial Sequence
  Synthetic
tctggaaagtagtaaaggaggatttgccttatacgatgaaggctatagtgagataccaagagaagggtttcttgg

SEQ ID NO: 278363 - DNA, 75 bp, Artificial Sequence
  Synthetic
accactttcagagggagtgagagaggctgccttaatgccgcaaaagataagtttgcaaagtaccagatagcatgt

SEQ ID NO: 278364 - DNA, 75 bp, Artificial Sequence
  Synthetic
gggctctgtcctggcctcttacttatccaacttttaaattttttgaattctcaacactggatggttaccagttaa

SEQ ID NO: 278365 - DNA, 75 bp, Artificial Sequence
  Synthetic
cgagataaggtgtagctctgaatccgcagctatatcagctcataagtcctgcattagggctcctggtttaatcaa

SEQ ID NO: 278366 - DNA, 75 bp, Artificial Sequence
  Synthetic
gagaacagatcaagaacagtaccggtttcattgtatgtcatctctgttcatagagatggattatggaccaacatg

SEQ ID NO: 278367 - DNA, 75 bp, Artificial Sequence
  Synthetic
actgggagaaaaaatgtgactttgcaactcaaatctgcagagttgggaagggtcttggtctggatgattcattaa

SEQ ID NO: 278368 - DNA, 75 bp, Artificial Sequence
  Synthetic
tgttcacttacaagaccatgatgagagagctatctgttaggaacatacctgcagaagtatttacaggtcaagcca

SEQ ID NO: 278369 - DNA, 75 bp, Artificial Sequence
  Synthetic
aagatctgcccagaactgacagatgatgattcagatctgtccaaggcagagagagaactgctgggaacactatct

SEQ ID NO: 278370 - DNA, 75 bp, Artificial Sequence
  Synthetic
tagagaaagagattgcctacatacaactgatcagactcatgacagcattagagcatgataaaagagatgattgct

SEQ ID NO: 278371 - DNA, 75 bp, Artificial Sequence
  Synthetic
ttcatagatctcgactggaataaaacagagaaaatatttccaatgttcaaaaaagcagtgtttgacaattttcac

SEQ ID NO: 278372 - DNA, 75 bp, Artificial Sequence
  Synthetic
gtcagtcagaattgtttaagttagtggagttacagtatgaagttacatccaaagaactactgggaaacagactct

SEQ ID NO: 278373 - DNA, 75 bp, Artificial Sequence
  Synthetic
acatctccacctgatgagaactatatgagtcacataatatcaaaagaactcgagagatctcaatctgatctgctg

SEQ ID NO: 278374 - DNA, 75 bp, Artificial Sequence
  Synthetic
ggcttcctctaacaatgctaaatcaagacatatagaccacaaagagatggaaccccaatccgactttcaaaataa

SEQ ID NO: 278375 - DNA, 75 bp, Artificial Sequence
  Synthetic
aagtcatctttttttcaagaaggtctcactgcggaagataggagattcttaaataggtccgagtgtgacatcaaa

SEQ ID NO: 278376 - DNA, 75 bp, Artificial Sequence
  Synthetic
ataaaaaacacaagaaaaccaaaaaactccccaagaaacactctcaaagaaaactacaaacacactcttacacac

SEQ ID NO: 278377 - DNA, 75 bp, Artificial Sequence
  Synthetic
acagagaagaagagttgagagacccatttgactctaagtcaacaattcagattcctccttgggtattcactgatg

SEQ ID NO: 278378 - DNA, 75 bp, Artificial Sequence
  Synthetic
acctaggcagataagctgcccaggtgggactgtgggtcaatgtttctaattttgttcgtttttttgtttttgttt

SEQ ID NO: 278379 - DNA, 75 bp, Artificial Sequence
  Synthetic
attcctccttgggtattcactgatgctgaggaggggaaaagtttaaccatcttaaaaattttaaaggtggaaggt

SEQ ID NO: 278380 - DNA, 75 bp, Artificial Sequence
  Synthetic
ctgaggaggggaaaagtttaaccatcttaaaaattttaaaggtggaaggtgagcatccaatggcaagattctgga

SEQ ID NO: 278381 - DNA, 75 bp, Artificial Sequence
  Synthetic
ttttgtttgtttttttgttttgttttttatgtttttttatttttttgttgttttattttatattttattgttttt

SEQ ID NO: 278382 - DNA, 75 bp, Artificial Sequence
  Synthetic
gcctggagcatctcaaattggttctctggccttctagactggttaggtgggcctatgaaggccatactgaagatt

SEQ ID NO: 278383 - DNA, 75 bp, Artificial Sequence
  Synthetic
ctttgtttttttgttttgacccacagtgtgttttggaatgtccaatttagtatgcacatattgtctaggtttcat

SEQ ID NO: 278384 - DNA, 75 bp, Artificial Sequence
  Synthetic
ctgggcttcattgctattgggattgtttgctttattttatttatgattctgatcagaattgcagtcaactcaata

SEQ ID NO: 278385 - DNA, 75 bp, Artificial Sequence
  Synthetic
ggcatgttgtaagctctgcacaactagaggagattgatagaatgtatgacgatccagaagctgagttgcagtatg

SEQ ID NO: 278386 - DNA, 75 bp, Artificial Sequence
  Synthetic
caaggcctctggtgtttcaaagggatctgaagacttttgcagcactcacagttgaagatgagggctttaggttat

SEQ ID NO: 278387 - DNA, 75 bp, Artificial Sequence
  Synthetic
tgagcagaagaacaagtaccacagagtgaaacttaatttatcttctgaggaggatgagtacctggcaactctggg

SEQ ID NO: 278388 - DNA, 75 bp, Artificial Sequence
  Synthetic
aatatcaagaagaaaaactaataacaatgcaagcgcattcgaagaccatccaatcctacaagaacaaaaaataaa

SEQ ID NO: 278389 - DNA, 75 bp, Artificial Sequence
  Synthetic
aggatgagtacctggcaactctgggcataagtgggaagaaaatgaaggatctagcgtcagtcaaagagtccagag

SEQ ID NO: 278390 - DNA, 75 bp, Artificial Sequence
  Synthetic
catttatgatcccaagagtcttcaacattgctcttctattggcagaagttaaaaatgtactgctgattgcagctt

SEQ ID NO: 278391 - DNA, 75 bp, Artificial Sequence
  Synthetic
caaaacccacaccaacgagcacaagaaacaatagaaacaccaagcataataaaacaattggatagccgaattaca

SEQ ID NO: 278392 - DNA, 75 bp, Artificial Sequence
  Synthetic
ccaggagtaagaaggccttttctattcaacatgatatctcaagattagaaaacttcttatacggagacagtagta

SEQ ID NO: 278393 - DNA, 75 bp, Artificial Sequence
  Synthetic
aaaacacaaaacaacaacaaacacaggcaagacaaagcctggcagcatgtatctagagaccactcctcaaccagg

SEQ ID NO: 278394 - DNA, 75 bp, Artificial Sequence
  Synthetic
gcattggtcgctcaaagctggagacaatttcatccttactcaaacctctcagtgaggggttgatagtctttgaga

SEQ ID NO: 278395 - DNA, 75 bp, Artificial Sequence
  Synthetic
aaatatttgaggcaaatgatgacttgttctgcccgcttgctgaggactttgagctaaggatgatggcacaagcga

SEQ ID NO: 278396 - DNA, 75 bp, Artificial Sequence
  Synthetic
attggatcatgaacaagcagtgagcttgagttatctcagagaacacatctgctggaagctcttggtcaatcagtc

SEQ ID NO: 278397 - DNA, 75 bp, Artificial Sequence
  Synthetic
actaatcttcacgcatgcatcatctctgcagtctagccattacataactagtcaccttcaggtctcttgcaaggt

SEQ ID NO: 278398 - DNA, 75 bp, Artificial Sequence
  Synthetic
ttcatcaaccaacgatgacgaaagatcagggcccaaatgaagtattgaagaatcatctaagattgttacacaccc

SEQ ID NO: 278399 - DNA, 75 bp, Artificial Sequence
  Synthetic
cagcaaagctgggatgcatcatcgccctaggataactgctggatatggcatccatggctctgccagtcactggca

SEQ ID NO: 278400 - DNA, 75 bp, Artificial Sequence
  Synthetic
cttttggatcatggtgtcaaatggtgagcctaataggagcagaattgtctgcatccgtgaagcagcatgtgaagc

SEQ ID NO: 278401 - DNA, 75 bp, Artificial Sequence
  Synthetic
gagcctaataggagcagaattgtctgcatccgtgaagcagcatgtgaagccaggacaatttataataaagagact

SEQ ID NO: 278402 - DNA, 75 bp, Artificial Sequence
  Synthetic
agtactcctggacataatcagcagcctgacatgtccaaccagcaaaagcagcagtgattctggaaagagtcaagt

SEQ ID NO: 278403 - DNA, 75 bp, Artificial Sequence
  Synthetic
catctcgagaagggtttccagatttgagcttgtattttaacacgagctcattcaccattgccttgcccttgtctg

SEQ ID NO: 278404 - DNA, 75 bp, Artificial Sequence
  Synthetic
acttaattcaccattgataatggcagttaggcctacttcctctaaaagtcacatttttgtctcttttggattaat

SEQ ID NO: 278405 - DNA, 75 bp, Artificial Sequence
  Synthetic
acattttaagaatcattttgtttggcttgttgcctctagtaagagagagaacaatcatcttcttgacatcctgct

SEQ ID NO: 278406 - DNA, 75 bp, Artificial Sequence
  Synthetic
taaggcataccacgccatggacattgagaccggaaatgttttcaagtcttatattgatgcaggtgatctgttcat

SEQ ID NO: 278407 - DNA, 75 bp, Artificial Sequence
  Synthetic
gatcttctctaacctctgtaatagagataccagaaaagaatcttatgaacatggttcatgatataacttttggcc

SEQ ID NO: 278408 - DNA, 75 bp, Artificial Sequence
  Synthetic
tccagtcctcacctccacgatctttcacaagagctatcaccctcttcgcatcaaatccttgataagcaaaatcag

SEQ ID NO: 278409 - DNA, 75 bp, Artificial Sequence
  Synthetic
tacagattttgtttcctataagctaagcaaactgaccaatctctgcaagtgcagctcattaatggagtgttcatc

SEQ ID NO: 278410 - DNA, 75 bp, Artificial Sequence
  Synthetic
atattgccgattccactgatgttaagctgtcatccaagtttggcatagttggtgacggctatgatcatctaagtc

SEQ ID NO: 278411 - DNA, 75 bp, Artificial Sequence
  Synthetic
ggtgacggctatgatcatctaagtccagacatgattgttgaaacaacatctggatcatatattgttgttgagttc

SEQ ID NO: 278412 - DNA, 75 bp, Artificial Sequence
  Synthetic
aaatttttggattgaagcatttaattatgcaatttgggattcagcaaaattacttgcagccgacaggagtccagg

SEQ ID NO: 278413 - DNA, 75 bp, Artificial Sequence
  Synthetic
atctatagactcagaggcaaactgaacggcaatctcttcgtatgacattttgtattaaataaattttcagggagc

SEQ ID NO: 278414 - DNA, 75 bp, Artificial Sequence
  Synthetic
cgatgatttttacaattttaaatattttaacaagagccatgctcgtaatgagcatgtattctttaactacgtggg

SEQ ID NO: 278415 - DNA, 75 bp, Artificial Sequence
  Synthetic
tgtgaaggaagcatcttttatgataaagctctcactactgacattattggaagataaagctgtgactgaagaact

SEQ ID NO: 278416 - DNA, 75 bp, Artificial Sequence
  Synthetic
gagaacagatcaagaacagcaccggtttcattgtatgtcattgctgtccatagagatggattatggaccaatatg

SEQ ID NO: 278417 - DNA, 75 bp, Artificial Sequence
  Synthetic
cacaagagctatcaccctcttcgcatcaaatccttgataagcaaaatcagtcacccaaccggcaacagtttgctc

SEQ ID NO: 278418 - DNA, 75 bp, Artificial Sequence
  Synthetic
gcagacaatacagagatacataatgatggaaggatttgtctcacagccagagttgcctaagccacataaaatgct

SEQ ID NO: 278419 - DNA, 75 bp, Artificial Sequence
  Synthetic
gactcagaggcaaactgaacggcaatctcttcgtatgacattttgtattaaataaattttcagggagctatgtgt

SEQ ID NO: 278420 - DNA, 75 bp, Artificial Sequence
  Synthetic
caacaaagtccccggggtgctgaggtcagagctacaggtttttttattttggagagtgataaaatcaatgaagag

SEQ ID NO: 278421 - DNA, 75 bp, Artificial Sequence
  Synthetic
atgattcagatctgtccaaggcagagagagaactgctgggaacactgtcttttatagacctagattggaataaga

SEQ ID NO: 278422 - DNA, 75 bp, Artificial Sequence
  Synthetic
aatatctgagtctcctttcttactctcaaagagaaatggccagataagctggagtggtttgttcaatcccctgtc

SEQ ID NO: 278423 - DNA, 75 bp, Artificial Sequence
  Synthetic
tcaaagagaaatggccagataagctggagtggtttgttcaatcccctgtctggtaatgatgtgagatctttgcag

SEQ ID NO: 278424 - DNA, 75 bp, Artificial Sequence
  Synthetic
cagaaaaaatattcccaatgttcaaaaaagcggtgtttgacaattttcatgcatctccacctgatgagaactaca

SEQ ID NO: 278425 - DNA, 75 bp, Artificial Sequence
  Synthetic
aactgagccatcatcgttatcaaagatgtacaagaagattattgagctagaacatctttgcccagaagatgacaa

SEQ ID NO: 278426 - DNA, 75 bp, Artificial Sequence
  Synthetic
ttactgcggaggataggagatttctaaataggtcagagtgtgacattaaaatcaacgaatttcttaaagtatttg

SEQ ID NO: 278427 - DNA, 75 bp, Artificial Sequence
  Synthetic
tgaaaaacaaagcagttgtgatagatgaaaaagaaagaatgatatcactcctagagactcaacaaagtgagaatg

SEQ ID NO: 278428 - DNA, 75 bp, Artificial Sequence
  Synthetic
ctagagactcaacaaagtgagaatgatataaagatgcaagtactaatgtctgaaattgaacaactgaagaatcaa

SEQ ID NO: 278429 - DNA, 75 bp, Artificial Sequence
  Synthetic
gaagctacttaaagcagagtgtcctacatggaaaagacttgctcaaacgaatgtatggacagaacttcatggaac

SEQ ID NO: 278430 - DNA, 75 bp, Artificial Sequence
  Synthetic
ctgaagaagggaagagtctgaccattttaaaagttttaaaggtggaaggtgagcatccaatggcaagattctgga

SEQ ID NO: 278431 - DNA, 75 bp, Artificial Sequence
  Synthetic
agattgacagacaaataactcgagaagttgcttctctaagcttagaaaggctggcaactctaaaggctactagca

SEQ ID NO: 278432 - DNA, 75 bp, Artificial Sequence
  Synthetic
ggtgatgtcagacttgatggccaggaattctgacttacggaagcataatgatattctcactgctgaaatatctca

SEQ ID NO: 278433 - DNA, 75 bp, Artificial Sequence
  Synthetic
cactgtctggagacataccaagggctgagcagaagaataagtaccacagagtgaaactcaatttatcttctgagg

SEQ ID NO: 278434 - DNA, 75 bp, Artificial Sequence
  Synthetic
tgtcagagattgccaaagatggcaagactctagcaatacatgcatttaatgattgcatgaatgctgtagagtcca

SEQ ID NO: 278435 - DNA, 75 bp, Artificial Sequence
  Synthetic
aagatgagtacttagcaactctgggtataagtgggaaaaagatgaaggatttagcatcagtcagagagtccagag

SEQ ID NO: 278436 - DNA, 75 bp, Artificial Sequence
  Synthetic
gagggtgcatgcacatttgccttttcaagaagcagcagcatggtggattgcgtgaaatttatgttttgggggctg

SEQ ID NO: 278437 - DNA, 75 bp, Artificial Sequence
  Synthetic
tcaggagcaagaaggccttttctattcaacatgacatctcaagattagaaaacttcttatacggagatagtagca

SEQ ID NO: 278438 - DNA, 75 bp, Artificial Sequence
  Synthetic
aagaaaggattgttcaaagcttaatagaaaccattgctaggagtataggtaggttctttccttctgatacactgt

SEQ ID NO: 278439 - DNA, 75 bp, Artificial Sequence
  Synthetic
agaaaccattgctaggagtataggtaggttctttccttctgatacactgtgtaatcccaacaacaaaatgaagat

SEQ ID NO: 278440 - DNA, 75 bp, Artificial Sequence
  Synthetic
agatgtttgaggcaaatgatgacttgttctgcccacttgctgaggactttgaactaagaatgatggcacaggcaa

SEQ ID NO: 278441 - DNA, 75 bp, Artificial Sequence
  Synthetic
tcctgaaagtcatggactaagagctaggaaacactgcaagggtccagtctggacctgtgcaacatctgatgatgc

SEQ ID NO: 278442 - DNA, 75 bp, Artificial Sequence
  Synthetic
gataaaataattgagaaagaggaagaaacatgtgagataggaacaaacaaagagtttaaatgtttcgaggagaga

SEQ ID NO: 278443 - DNA, 75 bp, Artificial Sequence
  Synthetic
ttcatcaaccaacattgacaaaagatcagggtccaaatgaagtgttgaagaatcatctgagattgttacacaccc

SEQ ID NO: 278444 - DNA, 75 bp, Artificial Sequence
  Synthetic
gagaaaatggaaccaaggccactttgtaacaaaatttgcattaatgctgtgtgagttcacacatccaaaatggtg

SEQ ID NO: 278445 - DNA, 75 bp, Artificial Sequence
  Synthetic
gagcctcataggagcagaattgtctgcatctgtgaagcagcatgtgaagcctggacaatttataataaaaagact

SEQ ID NO: 278446 - DNA, 75 bp, Artificial Sequence
  Synthetic
tgacagccatatggaattgaaggtagaagatcagtttgttcaagatttatttaaggcgtatcatggagaggttcc

SEQ ID NO: 278447 - DNA, 75 bp, Artificial Sequence
  Synthetic
taaagcataccacactatggacattgagactggcaatgtattcaagtcctatattgatgcgggtgatcttttcat

SEQ ID NO: 278448 - DNA, 75 bp, Artificial Sequence
  Synthetic
acagacttggatggacccaggaaagactttcattaagacaaagacaggaatgatgcagggaatactgcacttcac

SEQ ID NO: 278449 - DNA, 75 bp, Artificial Sequence
  Synthetic
aacagattttgtttcctataaactaagcaaactgaccaatctctgtaaatgcagctcattaatggaatgttcatc

SEQ ID NO: 278450 - DNA, 75 bp, Artificial Sequence
  Synthetic
tgatgcagggaatactgcacttcacttcatcattactgcacaccttacatcaggaatttgtgagatcgctaacat

SEQ ID NO: 278451 - DNA, 75 bp, Artificial Sequence
  Synthetic
aaacttctggatagaagcatttaattatccaatttgggactcaacaaaattacttgcaactgacaggagcccagg

SEQ ID NO: 278452 - DNA, 75 bp, Artificial Sequence
  Synthetic
tcctgaaatgtcatactcaatggtgtgtgatatgatgcagggctctgatgatagcagtatgcttttaagttttcc

SEQ ID NO: 278453 - DNA, 75 bp, Artificial Sequence
  Synthetic
tgtgaaggaagcttctttcatgataaagctttcactactaacactattggaagacaaagctgtgactgaagaact

SEQ ID NO: 278454 - DNA, 75 bp, Artificial Sequence
  Synthetic
gcagacgatacagaggtatatagtgatggaaggatttgtctcacagccagaattgcctaagccacacaaaatgct

SEQ ID NO: 278455 - DNA, 75 bp, Artificial Sequence
  Synthetic
gaaaatttgcacaggagatcatgttttttgtgaaaagtatgattgttctacatcttatccagatgttacttgtat

SEQ ID NO: 278456 - DNA, 75 bp, Artificial Sequence
  Synthetic
caacaaagttcccggagtgctgagatcagaactacaggtttttttattctggagagtgataaaatcaatgaagag

SEQ ID NO: 278457 - DNA, 75 bp, Artificial Sequence
  Synthetic
cttctttcattcacagcatgttaggccaaccataagatggatagcagccagttgcagtctgccagaagttgagac

SEQ ID NO: 278458 - DNA, 75 bp, Artificial Sequence
  Synthetic
ccatgcaccaggatcaggaccattgtatataaatctcatgggctcatggataaaaccccaatgtgtgggctacga

SEQ ID NO: 278459 - DNA, 75 bp, Artificial Sequence
  Synthetic
gatttctgagtcccccttcttactctcaaagagaaatggccagataagttggagtggcttattcaatcctctatc

SEQ ID NO: 278460 - DNA, 75 bp, Artificial Sequence
  Synthetic
tctggtggcaagacaagaagaggcgtctaacctaatgaccgcagtcacggaagggggtggatccttctctctggc

SEQ ID NO: 278461 - DNA, 75 bp, Artificial Sequence
  Synthetic
tggaaatgatgtgagatctttgcaagcagtcataagctcttgctacaatggttatttcaagaataaagaggagga

SEQ ID NO: 278462 - DNA, 75 bp, Artificial Sequence
  Synthetic
gaaagtcttagtagatagagaagtcaagcagccgttgcttgcaccagaacagaattgtgacacctgtgtttcaga

SEQ ID NO: 278463 - DNA, 75 bp, Artificial Sequence
  Synthetic
atatagcatacaacaggctcagtgcactctgcactacatgctaatgggcatgggtgtcagttctctgttttcaga

SEQ ID NO: 278464 - DNA, 75 bp, Artificial Sequence
  Synthetic
aaccgagccatcatcattatcaaagatgtataagaagattattgagctagaacacctttgcccagaagatgacaa

SEQ ID NO: 278465 - DNA, 75 bp, Artificial Sequence
  Synthetic
ttgcatctcagctcatcaagaagcgtctacatcagtaattgtcccatatccaggattgttggccagtgtgggcgg

SEQ ID NO: 278466 - DNA, 75 bp, Artificial Sequence
  Synthetic
atttaagaaagctatagcaaaatggaaggaccctgggttaggtttcttcctacttgacaatccatactgtgctgg

SEQ ID NO: 278467 - DNA, 75 bp, Artificial Sequence
  Synthetic
atacttgggaatgagtgatccagaagaccctaaaatgcatgagtttagtagaagctacctaaagcagagtgtcct

SEQ ID NO: 278468 - DNA, 75 bp, Artificial Sequence
  Synthetic
cttaggaggtttcaggttcaacctttacaaagcaataacaagaacatcattaaaacgcctttatgcttacttcat

SEQ ID NO: 278469 - DNA, 75 bp, Artificial Sequence
  Synthetic
tacaaagcaataacaagaacatcattaaaacgcctttatgcttacttcatgaagaaagtgagatctgtgagtgaa

SEQ ID NO: 278470 - DNA, 75 bp, Artificial Sequence
  Synthetic
acatggcaaagacttgcttaaacgaatgtatgggcagaactttatggaacagattgatagacagataactcgaga

SEQ ID NO: 278471 - DNA, 75 bp, Artificial Sequence
  Synthetic
gaagaaagtgagatctgtgagtgaagatgagcagttagaggcttgtagcgttagcccaggaggtgcgataatatt

SEQ ID NO: 278472 - DNA, 75 bp, Artificial Sequence
  Synthetic
tggtagtggtttgccctcccagagacagttgtgcagctcataattgtctgctgtgctatcatggtatcctgaatt

SEQ ID NO: 278473 - DNA, 75 bp, Artificial Sequence
  Synthetic
atgtatgggcagaactttatggaacagattgatagacagataactcgagaggttgcttctctaagcttggagaga

SEQ ID NO: 278474 - DNA, 75 bp, Artificial Sequence
  Synthetic
tctacatcagtaattgtcccatatccaggattgttggccagtgtgggcgggaaaattgggattcacctctcgcac

SEQ ID NO: 278475 - DNA, 75 bp, Artificial Sequence
  Synthetic
actagggaaaaagtgctagtccgaatgtcagagattgctaaagatggtaagactctagcaattcatgcatttaat

SEQ ID NO: 278476 - DNA, 75 bp, Artificial Sequence
  Synthetic
gattgacttgataaacgagaacccttcagtgttataccgagcacccaggacatctgaagaaataatgctgagaat

SEQ ID NO: 278477 - DNA, 75 bp, Artificial Sequence
  Synthetic
gattgtatgaatgctgtagaggctagaggatgtatgcacatttgccttttcaagaagcagcagcacggtggattg

SEQ ID NO: 278478 - DNA, 75 bp, Artificial Sequence
  Synthetic
gggttgaccatcatgatgtagagagaccaaggcacagagaacctatgaggagattcaaaacaactctattgttga

SEQ ID NO: 278479 - DNA, 75 bp, Artificial Sequence
  Synthetic
ttcagtttacttcttatcagcatctatatttcaggattcaaacaagcaagaattcagcatcatggagtccagcaa

SEQ ID NO: 278480 - DNA, 75 bp, Artificial Sequence
  Synthetic
agaaaccattgctaggagtataggcaggttcttcccttctgacacactgtgtaatcccaataacaaaatgaagat

SEQ ID NO: 278481 - DNA, 75 bp, Artificial Sequence
  Synthetic
gtacagtttattgcagaagatgatggcttatgatggctttgagaataatcttgaattaacaatggaagatattct

SEQ ID NO: 278482 - DNA, 75 bp, Artificial Sequence
  Synthetic
gcttatgatggctttgagaataatcttgaattaacaatggaagatattcttttcttgtttcccaacattgatgat

SEQ ID NO: 278483 - DNA, 75 bp, Artificial Sequence
  Synthetic
aagaaaatggaaccaaggtcactttgtaacaaaatttgcattaatgctatgtgagtttacacatccaaagtggtg

SEQ ID NO: 278484 - DNA, 75 bp, Artificial Sequence
  Synthetic
gccgattatcatcaggggctgctcaatgttcacaaacaaatacatgatgatgaaccttcagtatttgaggatcct

SEQ ID NO: 278485 - DNA, 75 bp, Artificial Sequence
  Synthetic
acacagaccaagattacggtatttgaaggacatcaaaatctaaaaacaccagcagaatatatggtttcagataag

SEQ ID NO: 278486 - DNA, 75 bp, Artificial Sequence
  Synthetic
aaaaccatctccagtgagacagtatgcagggagggatcaagcttttggactagtttatatattccatcatgtctt

SEQ ID NO: 278487 - DNA, 75 bp, Artificial Sequence
  Synthetic
tgatagccatatggaactaaaggtagaagatcagtttgttcaagatttatttaaggcatatcatggagaagttcc

SEQ ID NO: 278488 - DNA, 75 bp, Artificial Sequence
  Synthetic
gtgattgtgtaggcaataaatgccagtcgtggagagatgatcaactatctagggaattttcaggagtaaaggata

SEQ ID NO: 278489 - DNA, 75 bp, Artificial Sequence
  Synthetic
acagacttggatggacccagggaaaactttcattaagacaaagacaggaatgatgcagggaatattgcacttcac

SEQ ID NO: 278490 - DNA, 75 bp, Artificial Sequence
  Synthetic
acatggttaacagatacacctgcagcaacacttgagaagtcaccactgtcaaatcatgttcaaatcaggaatttc

SEQ ID NO: 278491 - DNA, 75 bp, Artificial Sequence
  Synthetic
actttcattaagacaaagacaggaatgatgcagggaatattgcacttcacttcatcactgctgcatactttacat

SEQ ID NO: 278492 - DNA, 75 bp, Artificial Sequence
  Synthetic
ttctctagaatggaaagcaaacccaggactgtacgtgtcactggagcacctgttaagaaaagatcaggctcaagc

SEQ ID NO: 278493 - DNA, 75 bp, Artificial Sequence
  Synthetic
ggactgtacgtgtcactggagcacctgttaagaaaagatcaggctcaagcaagatctctttagtcatcagagata

SEQ ID NO: 278494 - DNA, 75 bp, Artificial Sequence
  Synthetic
aagatctctttagtcatcagagataatttcacaaagattggttttctccgtgattttgaagatatcagctcagcc

SEQ ID NO: 278495 - DNA, 75 bp, Artificial Sequence
  Synthetic
atagtagtatgcttttgagtttcccagccaaagatgaacccacaataatgaggtgtaagatggcagcagccatct

SEQ ID NO: 278496 - DNA, 75 bp, Artificial Sequence
  Synthetic
acaagagctttctcagtggaagtcttaaaacattttttattttgcacactacaaggcccgtactctgtgcagacg

SEQ ID NO: 278497 - DNA, 75 bp, Artificial Sequence
  Synthetic
agtttttaaactggggcaccctgtctttatccctggatgcagaaggcatcagcggaaccaacagcatcagctttc

SEQ ID NO: 278498 - DNA, 75 bp, Artificial Sequence
  Synthetic
gctttcgtatgaagaagaatttagggatctatcttgccatatatccctcagagaagtccacatcaaacactgatt

SEQ ID NO: 278499 - DNA, 75 bp, Artificial Sequence
  Synthetic
aagtttgatttgtgctataaaattttaagtgagtctgaagtcataggcataagggaatcagatggaaaaaccagg

SEQ ID NO: 278500 - DNA, 75 bp, Artificial Sequence
  Synthetic
ttgttatggagtacaattctgaattcttctttcactcacagcatgtcaggccaactataagatggatagcagcta

SEQ ID NO: 278501 - DNA, 75 bp, Artificial Sequence
  Synthetic
aagggaatcagatggaaaaaccaggacaaaccaattggcagtgtttcagaactttgtaaacagtgaccctgatat

SEQ ID NO: 278502 - DNA, 75 bp, Artificial Sequence
  Synthetic
gttgcagtctgccagaagttgagacactagtggcaagacaagaagaggcgtctaacctaatgactgcagtcacgg

SEQ ID NO: 278503 - DNA, 75 bp, Artificial Sequence
  Synthetic
agataaggtgtagttctgaatccgcagctatatcagctcataagtcttgtattagagctcctggtttaatcaagt

SEQ ID NO: 278504 - DNA, 75 bp, Artificial Sequence
  Synthetic
gcaggaaccataggtggtttcattataccacaaaagagcaaggaagtgtctgggaaggttgtttattatggacga

SEQ ID NO: 278505 - DNA, 75 bp, Artificial Sequence
  Synthetic
agggaggtggatccttctctttggcatacagcatacaacaggctcagtgcactctgcactacatgctaatgggca

SEQ ID NO: 278506 - DNA, 75 bp, Artificial Sequence
  Synthetic
tgggtgtcagttccctattttcagaattcaagaaagctattgcaaaatggaaggatcctggtttaggtttcttcc

SEQ ID NO: 278507 - DNA, 75 bp, Artificial Sequence
  Synthetic
ttcgcaattttccttaaaggatctcttcctcaaactagaaatgggcaaacattcaccagcacaaaagacaagaag

SEQ ID NO: 278508 - DNA, 75 bp, Artificial Sequence
  Synthetic
acagttcaggctttcactaatggggcgataaaagcactattgtctattaacttagatgatcatgaaattgtcttt

SEQ ID NO: 278509 - DNA, 75 bp, Artificial Sequence
  Synthetic
cttagatgatcatgaaattgtctttattaacaaagtgagaagctgtgatgcaacatttctaaatgttagtggctg

SEQ ID NO: 278510 - DNA, 75 bp, Artificial Sequence
  Synthetic
gtcggtgtaaagaatgatgtggatatgtcaaaacggagtcgacgtggtgctagattctggctctatgactttaaa

SEQ ID NO: 278511 - DNA, 75 bp, Artificial Sequence
  Synthetic
gaaaaaagtgagatctgtaagtgaagatgaacagttggaggcttgtagtgtaagcccaggaggtgcaataatatt

SEQ ID NO: 278512 - DNA, 75 bp, Artificial Sequence
  Synthetic
ctcatcaagaagcgtccacatcagtaattgtcccatatccaggattgttggccagtgtgggcggaagaattggga

SEQ ID NO: 278513 - DNA, 75 bp, Artificial Sequence
  Synthetic
gagttcttcacttaaatggggatcaagacagaagtatttaaaactgaggtcaagactgaacattcctgacaattg

SEQ ID NO: 278514 - DNA, 75 bp, Artificial Sequence
  Synthetic
tagaatgacagatttcagatctgtaagcaatgaagatgtaaaattcaaaataaggaaatgtactatgaatctatt

SEQ ID NO: 278515 - DNA, 75 bp, Artificial Sequence
  Synthetic
gattgacctgataaacgagaacccttcagtattataccgagcacccaggacatctgaagaaataatgctgaggat

SEQ ID NO: 278516 - DNA, 75 bp, Artificial Sequence
  Synthetic
agctgatagtgatcaagggaacattggtttacatgggtgtctatgatttcagaaacaaaacaggtggttcttcaa

SEQ ID NO: 278517 - DNA, 75 bp, Artificial Sequence
  Synthetic
atggagatctaagttctagcattttcagaagcccagatgactcagtctgtagattgaagaaacacttttcaaaag

SEQ ID NO: 278518 - DNA, 75 bp, Artificial Sequence
  Synthetic
gtatagtttattgcagaagatgatggcttatgatggctttgaaaataatcttgaattgacaatggaagacattct

SEQ ID NO: 278519 - DNA, 75 bp, Artificial Sequence
  Synthetic
gggtgctagtgagggatcatattgataatgagaggctttctaagattgtacaattatgcactgagaactctttaa

SEQ ID NO: 278520 - DNA, 75 bp, Artificial Sequence
  Synthetic
ttgaattgacaatggaagacattcttttcttgttcccaaacattgatgatttgcagcaattagactgtatagtat

SEQ ID NO: 278521 - DNA, 75 bp, Artificial Sequence
  Synthetic
gaacaaaggtgggtactatctattcagctctaccaaatttctctgaaggaagatcaataatagatgttgattcta

SEQ ID NO: 278522 - DNA, 75 bp, Artificial Sequence
  Synthetic
tcagaattgcagtcaactcaataaacatcaagaagaaaaactagcaacaatgtaagtgcatatgaggaccatcca

SEQ ID NO: 278523 - DNA, 75 bp, Artificial Sequence
  Synthetic
ttgtcgatttaatgatagaggacatggctaaagaagacttcaatgatgctgttaaaatgatggaaacagaagaac

SEQ ID NO: 278524 - DNA, 75 bp, Artificial Sequence
  Synthetic
atcccataagaacaaacacaaacaacccatatcaacaagcataagaaataattgaaatacaaaatacaacaaaac

SEQ ID NO: 278525 - DNA, 75 bp, Artificial Sequence
  Synthetic
acacagaccaaaattacagtatttgaaggacatcaaaatctgaagacaccagcagaatacatggtttcggataag

SEQ ID NO: 278526 - DNA, 75 bp, Artificial Sequence
  Synthetic
cagcatcatatgagagtgaatcatttgacataagtgatattgacttattcggacctgcgcactataaagaagtat

SEQ ID NO: 278527 - DNA, 75 bp, Artificial Sequence
  Synthetic
aatcggtgagacaaattaaaaaataaaaaatacaaaacaacaacaaaacaatcggtgagacaaaccaaaaaacaa

SEQ ID NO: 278528 - DNA, 75 bp, Artificial Sequence
  Synthetic
ctgagctaactaccatttcacaccctctgatggatgactttgttaatgtgttgatcctaaaatgtggaagaaagg

SEQ ID NO: 278529 - DNA, 75 bp, Artificial Sequence
  Synthetic
aaaaataaaaataaaaataaaaaacacaaaacaacaacaaaacacaggcgagacaaagcctggcagcatatacac

SEQ ID NO: 278530 - DNA, 75 bp, Artificial Sequence
  Synthetic
acatggttaacagatacgcctgcagcaacacttgagaagtcaccgctgtcaaatcatgttcagatcaggaacttc

SEQ ID NO: 278531 - DNA, 75 bp, Artificial Sequence
  Synthetic
acattagaagatgccttgagacagggagatgcatgacaagaaataaggtatacatgagggatctattctcaagca

SEQ ID NO: 278532 - DNA, 75 bp, Artificial Sequence
  Synthetic
aaaaaaccactcctcaaccaggaaacaatcctcaaagcataaaaaaatgattagtcctcacgcacacttcaccca

SEQ ID NO: 278533 - DNA, 75 bp, Artificial Sequence
  Synthetic
tgcagtccagccatcatacatctaatcatcttcaggtctcttgcaaggtgagagtgtagaaaacacagatgttgg

SEQ ID NO: 278534 - DNA, 75 bp, Artificial Sequence
  Synthetic
taggtagaaatcctaacgatgtgcaggctgatgactataatgagagtgagtcagatccggatgatgatttaatcg

SEQ ID NO: 278535 - DNA, 75 bp, Artificial Sequence
  Synthetic
tcagatccggatgatgatttaatcggttaggactaataatcacaaaaaagtgaataatcaaatttaataaaaatt

SEQ ID NO: 278536 - DNA, 75 bp, Artificial Sequence
  Synthetic
gagtgttagtgagggatcacattgataatgagaggctttctaagatagtacagttatgtactgagaactccttaa

SEQ ID NO: 278537 - DNA, 75 bp, Artificial Sequence
  Synthetic
gtgagagtgtagaaaacacagatgttggtttactattcgttttataaacttagtgagatgtgccggtctttgtgt

SEQ ID NO: 278538 - DNA, 75 bp, Artificial Sequence
  Synthetic
gttaggactaataatcacaaaaaagtgaataatcaaatttaataaaaattcaaaaaattagtattttaagcattg

SEQ ID NO: 278539 - DNA, 75 bp, Artificial Sequence
  Synthetic
tagtattttaagcattgtggaatatagtttgatttcatgattaacaatttagaaaaaatgggacggtctttgtgt

SEQ ID NO: 278540 - DNA, 75 bp, Artificial Sequence
  Synthetic
ttgctgttcagtttgcctctgagtctatagatgagcaagcggttgccggttgggtgactgattttgcttatcaag

SEQ ID NO: 278541 - DNA, 75 bp, Artificial Sequence
  Synthetic
tgacataagtgatattgacttattcggacctgcgcactacaaagaagtgtctgagctaaccacaatttcacaccc

SEQ ID NO: 278542 - DNA, 75 bp, Artificial Sequence
  Synthetic
tcattgaaccccaattcaactgtaggatcttctctaacttctgtgatagagataccagaaaagaaccttatgaac

SEQ ID NO: 278543 - DNA, 75 bp, Artificial Sequence
  Synthetic
gatttgatgcaaagagagtgatagctcttgtaaaggatcgtggaggtgatgactggaagcaagatgtcaagaaga

SEQ ID NO: 278544 - DNA, 75 bp, Artificial Sequence
  Synthetic
atggttcatgatataacttttggccatattgccgactctactgatgttaagctgtcatccaagtttggtatagtt

SEQ ID NO: 278545 - DNA, 75 bp, Artificial Sequence
  Synthetic
tctaatggatgattttgttaatgtgttaatcctaaaatgtggtaggaaggacattagaagatgtctcgagacagg

SEQ ID NO: 278546 - DNA, 75 bp, Artificial Sequence
  Synthetic
tgattgttctctctcttaccagaggcaacaagccaaacaagatggttctcaagatgtcagacaagggcaaggcaa

SEQ ID NO: 278547 - DNA, 75 bp, Artificial Sequence
  Synthetic
caacaagccaaacaagatggttctcaagatgtcagacaagggcaaggcaatggtgaatgagctcgtattgaaata

SEQ ID NO: 278548 - DNA, 75 bp, Artificial Sequence
  Synthetic
accactttcagagggagtgagagaggctgccttaatgccgcgaaagataagtttgcaaagtaccagatagcatgt

SEQ ID NO: 278549 - DNA, 75 bp, Artificial Sequence
  Synthetic
ggctgatgactataatgagagtgagtcagatccggatgatgatttgataggttagagttactaatcacagaaaag

SEQ ID NO: 278550 - DNA, 75 bp, Artificial Sequence
  Synthetic
caagctcaaatctggaaacccttctcgagatgacttgactctttccaggatcactgctgcttttgctggttggac

SEQ ID NO: 278551 - DNA, 75 bp, Artificial Sequence
  Synthetic
tcactgctgcttttgctggttggacatgtcaggctgctgattatgtccaggagtacttgccagtgactggcagag

SEQ ID NO: 278552 - DNA, 75 bp, Artificial Sequence
  Synthetic
ttaaaaaccaaaaataataaaaattcagtaaaaatagtatcaaagcattgtggagtatagtttgatttcatgatt

SEQ ID NO: 278553 - DNA, 75 bp, Artificial Sequence
  Synthetic
cgagatgacttgactctttccaggatcactgctgcttttgctggttggacatgtcaggctgctgattatgtccag

SEQ ID NO: 278554 - DNA, 75 bp, Artificial Sequence
  Synthetic
ccatggatgccatatccagcagttatcccagggcgatgatgcaccccagctttgctggtttgattgatcaagagc

SEQ ID NO: 278555 - DNA, 75 bp, Artificial Sequence
  Synthetic
tcccagggcgatgatgcaccccagctttgctggtttgattgatcaagagcttccagcagatgtattgtctgagat

SEQ ID NO: 278556 - DNA, 75 bp, Artificial Sequence
  Synthetic
aaaaataataaaaattcagtaaaaatagtatcaaagcattgtggagtatagtttgatttcatgattaacaattta

SEQ ID NO: 278557 - DNA, 75 bp, Artificial Sequence
  Synthetic
aacccaagctcactgcttgttcatgatccaattctcaaagaccatcaacccctctctgagaggcttaagtaagga

SEQ ID NO: 278558 - DNA, 75 bp, Artificial Sequence
  Synthetic
tttatagacctagattggaataaaacagaaaaaatatttccaatgttcaaaaaagcggtttttgacaattttcat

SEQ ID NO: 278559 - DNA, 75 bp, Artificial Sequence
  Synthetic
tgaaattgtctccagctttgagcgaccaatgcaggctgcaattagcagcacattcttgacatctgcaaacaggag

SEQ ID NO: 278560 - DNA, 75 bp, Artificial Sequence
  Synthetic
cttcaactgcgagtgctgcaaaagtcttcagatccctttaaaacaccagaggccttgatgaaacctagacaacat

SEQ ID NO: 278561 - DNA, 75 bp, Artificial Sequence
  Synthetic
atagagaagaagagttgagagacccatttgactctaagtcaacaattcagattcctccttgggtgtttactgatg

SEQ ID NO: 278562 - DNA, 75 bp, Artificial Sequence
  Synthetic
tgaaattgtctccagctttgagcgaccaatgcaggctgcaatcagcagcacattcttaacatctgcaaacagaag

SEQ ID NO: 278563 - DNA, 75 bp, Artificial Sequence
  Synthetic
atgcattccaaaccgaacattccaaacagactgtgagtcaaacctaaaataaaaaacaaataaaaacaataaaaa

SEQ ID NO: 278564 - DNA, 75 bp, Artificial Sequence
  Synthetic
aaaaaacaaataaaaacaataaaaaaacaaaaaacaaaacaaaaaaacaaaaaaacaaaaaaaacaaaaacaaaa

SEQ ID NO: 278565 - DNA, 75 bp, Artificial Sequence
  Synthetic
ggcatgttgtaagctctgcacaactagaggagattgatagaatgtatgatgatccagaagctgagttgcagtatg

SEQ ID NO: 278566 - DNA, 75 bp, Artificial Sequence
  Synthetic
agaggagattgatagaatgtatgatgatccagaagctgagttgcagtatgcattgtctggagacataccaagagc

SEQ ID NO: 278567 - DNA, 75 bp, Artificial Sequence
  Synthetic
agacattgactcacagtcccacccaggcagcttatctgcctgggtgtgtgtgagagtgtgtttttgtagtttttt

SEQ ID NO: 278568 - DNA, 75 bp, Artificial Sequence
  Synthetic
tgagagtgtgtttttgtagttttttacgagagtgtttttgactttttcttttagttttggtgttagatgtagtcg

SEQ ID NO: 278569 - DNA, 75 bp, Artificial Sequence
  Synthetic
cttcagatccctttaaaacaccagaggccctgatgaaacccagacaacatatgcattccaaattgaacattccta

SEQ ID NO: 278570 - DNA, 75 bp, Artificial Sequence
  Synthetic
acagactgtgagttaaacttagaataaaaaataaagaaaacaacaaaaaaacaaaaaaaacaaaaaacaaaagta

SEQ ID NO: 278571 - DNA, 75 bp, Artificial Sequence
  Synthetic
tttttctttgtggcttatatgtcttgatttagcattgttagaggaagccagagcctattccccagtaattctttg

SEQ ID NO: 278572 - DNA, 75 bp, Artificial Sequence
  Synthetic
aaaaaacaaaaaacaaaaaacaaatcaaaaaaacaacaaaaaaacaaaacaaaaaaacaaaaataaagaaagaca

SEQ ID NO: 278573 - DNA, 75 bp, Artificial Sequence
  Synthetic
cattgtctggagacataccaagagctgagcagaagaataaataccacagagtaaaactcaatttatcttctgagg

SEQ ID NO: 278574 - DNA, 75 bp, Artificial Sequence
  Synthetic
gacgtaacttcatattgcaactctaccagcttaaacaattctgactggcagcaatcatctcttttatcatgctct

SEQ ID NO: 278575 - DNA, 75 bp, Artificial Sequence
  Synthetic
ttgactcacagtctcacccaggcagcttatctgcctgggtgtgtgtgagagtgtgtttttgtggttttttgtgag

SEQ ID NO: 278576 - DNA, 75 bp, Artificial Sequence
  Synthetic
aacgctgtcattagtctgataagctgtatgtaagcaatttctttctctatggcttggcctgtgaatacttctgca

SEQ ID NO: 278577 - DNA, 75 bp, Artificial Sequence
  Synthetic
gtatgtaagcaatttctttctctatggcttggcctgtgaatacttctgcaggtatattcctaacagacagctctc

SEQ ID NO: 278578 - DNA, 75 bp, Artificial Sequence
  Synthetic
ttcatcaaccaacaatgacgaaagatcaaggcccaaatgaagtattgaaaaatcatctaaaattgttacacactc

SEQ ID NO: 278579 - DNA, 75 bp, Artificial Sequence
  Synthetic
cctttggatcatggtgtcaaatggtgagcctcataggggcagaattgtctgcatctgtgaagcagcatgtgaagc

SEQ ID NO: 278580 - DNA, 75 bp, Artificial Sequence
  Synthetic
tcatcatggtcttgtaggtgaacattagtgagtcatccaaaccaagaccctttccaattctgcagatctgagttg

SEQ ID NO: 278581 - DNA, 75 bp, Artificial Sequence
  Synthetic
agtgtttttgattttttctttttggttttggtgtcggattggggttgtttttctctgtggtttatatgtcttgat

SEQ ID NO: 278582 - DNA, 75 bp, Artificial Sequence
  Synthetic
tttccaattctgcagatctgagttgcaaaatcacattttttctcccaatttaactggtagccatccagtattgag

SEQ ID NO: 278583 - DNA, 75 bp, Artificial Sequence
  Synthetic
ttctctgtggtttatatgtcttgatttagcattgttagaggaagccagagcctatttcccagtaattctttggac

SEQ ID NO: 278584 - DNA, 75 bp, Artificial Sequence
  Synthetic
taaagcataccacgtcatggacattgagactggaaatgtatttaagtcttacatcgatgcgggtgacctgttcat

SEQ ID NO: 278585 - DNA, 75 bp, Artificial Sequence
  Synthetic
aactcaaagaatttcaaagttggataagtgagaggccaggatagagccctcttaatgtttggttcacaccacttc

SEQ ID NO: 278586 - DNA, 75 bp, Artificial Sequence
  Synthetic
gctgtcatgagtctgattagctgtatgtaagcaatttctttctctatggcttggcctgtgaatacctctgcaggt

SEQ ID NO: 278587 - DNA, 75 bp, Artificial Sequence
  Synthetic
tgtaagcaatttctttctctatggcttggcctgtgaatacctctgcaggtatgttcctaacagacagctctctca

SEQ ID NO: 278588 - DNA, 75 bp, Artificial Sequence
  Synthetic
agtgcatctttaatgtccagcattgaaatacgagctattgtaacatcaaaaaatgatggagaggccttaactaca

SEQ ID NO: 278589 - DNA, 75 bp, Artificial Sequence
  Synthetic
gtaacttcatattgcaactccaccagcttaaacaattctgactggcagcaatcatctcttttatcatgctctaat

SEQ ID NO: 278590 - DNA, 75 bp, Artificial Sequence
  Synthetic
tacttgcaaccgataggagcccaggtgtaaaggaagcatctttcatgataaagctttcactactgacattgttgg

SEQ ID NO: 278591 - DNA, 75 bp, Artificial Sequence
  Synthetic
agaccctgctcataaccccactccttaggtaaatcataattatttaagaaggtgattagtctttttttggcaata

SEQ ID NO: 278592 - DNA, 75 bp, Artificial Sequence
  Synthetic
ccaattctgcagatctgagttgcaaaatcacattttctctcccaatttaactggtagccatccagtgttgaaaac

SEQ ID NO: 278593 - DNA, 75 bp, Artificial Sequence
  Synthetic
acagattgcctgagattatgcagtggaatctccatacctttgtaaaggctgactggagcattatgacgcttaccg

SEQ ID NO: 278594 - DNA, 75 bp, Artificial Sequence
  Synthetic
gactggagcattatgacgcttaccgaatgggacaaagtccacagtcactcttttcaactggtccggagaagtgct

SEQ ID NO: 278595 - DNA, 75 bp, Artificial Sequence
  Synthetic
ctggcaactctaaaggccactagcaattttaacgagtcatggtatgagtataaagacgtaaaagataagaattac

SEQ ID NO: 278596 - DNA, 75 bp, Artificial Sequence
  Synthetic
acaattttaaatgttttaacaagagccatgctcgttatgagcatgtactctttaacaacgtgggacagctccagt

SEQ ID NO: 278597 - DNA, 75 bp, Artificial Sequence
  Synthetic
gattagtctttttttggcaataacagattgcctgagattgtgcagtggaatctccatacctttgtaatggctgac

SEQ ID NO: 278598 - DNA, 75 bp, Artificial Sequence
  Synthetic
acacaaagacggcacgatgatttttacaattttaaatgttttaacaagagccatgctcgttatgagcatgtactc

SEQ ID NO: 278599 - DNA, 75 bp, Artificial Sequence
  Synthetic
aggaatgacatatgtttttctaacgactcacctctagagggccttgtctactactgggagacacactcaaaaaaa

SEQ ID NO: 278600 - DNA, 75 bp, Artificial Sequence
  Synthetic
gactctagcagttcatgcatttaatgattgcatgaatgcagtagaggccagaggatgtatgcatatttgcctttt

SEQ ID NO: 278601 - DNA, 75 bp, Artificial Sequence
  Synthetic
catgactataagaaacaaggttctcagaagtgtagagttggagattctgataaaaagatgatttctaatgttaca

SEQ ID NO: 278602 - DNA, 75 bp, Artificial Sequence
  Synthetic
aagaaaggattgttcaaagcttaatagaaaccattgctaggagtataggcaggttcttcccttctgacacattgt

SEQ ID NO: 278603 - DNA, 75 bp, Artificial Sequence
  Synthetic
ataatctctctaatttctgaaatacaaaaaagcatctctgagctatcactgtcatgtggtaataatgacaattct

SEQ ID NO: 278604 - DNA, 75 bp, Artificial Sequence
  Synthetic
actggacaagtcttgacattcaatggattagaagatacaatacgaggcgactacattgtggactgtgtgactgga

SEQ ID NO: 278605 - DNA, 75 bp, Artificial Sequence
  Synthetic
ggacctgcgcaacatctgatgatgcaagaaaatggaaccaaggccactttgtaacaaaatttgcattaatgctat

SEQ ID NO: 278606 - DNA, 75 bp, Artificial Sequence
  Synthetic
ttataccagtcagacattggagtcggtgtagggctggggagaatcaaccatgatcatcagcaagtaaaaaataaa

SEQ ID NO: 278607 - DNA, 75 bp, Artificial Sequence
  Synthetic
atgttcacaaacaagtacatgatgatgaatcttcagtatctgaggatccttgatagccatatggaacttaaggtg

SEQ ID NO: 278608 - DNA, 75 bp, Artificial Sequence
  Synthetic
gcagttgttatagatgagaaagaaaaaatgatatcacttctagagactcaacaaagtgagaatgacataaagaca

SEQ ID NO: 278609 - DNA, 75 bp, Artificial Sequence
  Synthetic
gaagatcagtttgttcaagatttatttaaggcatatcatggagaggttccacagacatggatggatccaggaaag

SEQ ID NO: 278610 - DNA, 75 bp, Artificial Sequence
  Synthetic
caagtactgatgtctgaaattgaacaactgaagaatcaactatcaaaaagacgaaatgagaggggacaggagaag

SEQ ID NO: 278611 - DNA, 75 bp, Artificial Sequence
  Synthetic
tgatgcagggaatactgcacttcacttcatcactactacacactttacatcaagaatttgtgagatcgctaacct

SEQ ID NO: 278612 - DNA, 75 bp, Artificial Sequence
  Synthetic
agagatgctgaaaagctgatgtcagacctgatggctagaaattctgacttacggaatcacaatgttattctaact

SEQ ID NO: 278613 - DNA, 75 bp, Artificial Sequence
  Synthetic
ggtctatctagctatatatccctcagagaagtccacatcaaacactgattttgttatggagtacaattctgaatt

SEQ ID NO: 278614 - DNA, 75 bp, Artificial Sequence
  Synthetic
gacgaaatatctcaaataaaaaataatatcacaattcacagaaacagaaacatgatgagtactactgtggtccca

SEQ ID NO: 278615 - DNA, 75 bp, Artificial Sequence
  Synthetic
gcaatactttcggtggctctgctatcatcatcagttggtcccattacggctgcacctccagattcaactatgatc

SEQ ID NO: 278616 - DNA, 75 bp, Artificial Sequence
  Synthetic
tctaacctaatgaccgcagtcacggaggggggtggatccttctctttggcatatagcatacaacaggctcagtgc

SEQ ID NO: 278617 - DNA, 75 bp, Artificial Sequence
  Synthetic
aggggggtggatccttctctttggcatatagcatacaacaggctcagtgcactctgcactacatgctgatgggca

SEQ ID NO: 278618 - DNA, 75 bp, Artificial Sequence
  Synthetic
aatccatggcctcatgcaaaaaatagagttggcacaggaatgtacaaatatgatgaaaatgatgagtcagggtgt

SEQ ID NO: 278619 - DNA, 75 bp, Artificial Sequence
  Synthetic
atatagcatacaacaggctcagtgcactctgcactacatgctgatgggcatgggtgtcagttctctattttcaga

SEQ ID NO: 278620 - DNA, 75 bp, Artificial Sequence
  Synthetic
agaccaatcagatatggtgtttcctgcataggatttgatttcatgcttaagatggataagtatcctttctttaat

SEQ ID NO: 278621 - DNA, 75 bp, Artificial Sequence
  Synthetic
gatgagcagttggaggcttgtagcgttagcccaggcggtgcaataatattgagttcttcacttaaatgggggtcc

SEQ ID NO: 278622 - DNA, 75 bp, Artificial Sequence
  Synthetic
gcatttataggtcataaaactcctttagaatccttcgcagataaaataattgagaaagaagaagagacatgtgaa

SEQ ID NO: 278623 - DNA, 75 bp, Artificial Sequence
  Synthetic
ataggaacaaacaaagagtttaaatgttttgaggagagagcttacataaaggggacatgtccgaccaacatcaat

SEQ ID NO: 278624 - DNA, 75 bp, Artificial Sequence
  Synthetic
gcagttcattacattgacaataaaggcaagttgcgatatgtaaaatgcaaagagaatctggaaatgactgaagac

SEQ ID NO: 278625 - DNA, 75 bp, Artificial Sequence
  Synthetic
tgtgctttctgcaggaaaatcaagaagaaagctggtcagtctgttcaggtgcagaaaacttcagtaccgttacaa

SEQ ID NO: 278626 - DNA, 75 bp, Artificial Sequence
  Synthetic
gatgcaatttgtcaagagaactcagacatttactccggaccaaagatacctttcaagggagtttgtaagatcggt

SEQ ID NO: 278627 - DNA, 75 bp, Artificial Sequence
  Synthetic
ttgcagcagttagactgtatagtgtatgacagatgccagattcaggttgcacagagagtcagccacaaagaaaat

SEQ ID NO: 278628 - DNA, 75 bp, Artificial Sequence
  Synthetic
atgacagatgccagattcaggttgcacagagagtcagccacaaagaaaatacacagaccaaaattacagtatttg

SEQ ID NO: 278629 - DNA, 75 bp, Artificial Sequence
  Synthetic
ctaataaagtataaagagtgtaagtttaaaacatcatcttatgagaccatttcattcatcacactcaaagggaaa

SEQ ID NO: 278630 - DNA, 75 bp, Artificial Sequence
  Synthetic
tggtttggcacaatgaagagtaagattggctcatcaggatttgaaaatgaatggtcaaagttgaaaaccataatc

SEQ ID NO: 278631 - DNA, 75 bp, Artificial Sequence
  Synthetic
ggaaaaatttacattgagcacttgatgttaaaaaacatagaggtggtcacaaatgtttcttttgtttgctatgaa

SEQ ID NO: 278632 - DNA, 75 bp, Artificial Sequence
  Synthetic
acatggttaacagatacacctgcagcaacacttgagaagtcaccattgtcaaatcatgttcaaattaggaacttc

SEQ ID NO: 278633 - DNA, 75 bp, Artificial Sequence
  Synthetic
tgttaaaaaacatagaggtggtcacaaatgtttcttttgtttgctatgaacatgcaggtcaagatgaacaagagg

SEQ ID NO: 278634 - DNA, 75 bp, Artificial Sequence
  Synthetic
tagaacacagggccctgaagagagtatcagtcaatgattgtaagattgtggacaactctaagcagaagatttgca

SEQ ID NO: 278635 - DNA, 75 bp, Artificial Sequence
  Synthetic
ttctctagaatggaaagcaaacctagaactgtacgtgtcactggagcacctgttaagaaaagatcaggctcaagc

SEQ ID NO: 278636 - DNA, 75 bp, Artificial Sequence
  Synthetic
caggagaccacattttctgtgagaagtatgactgttctacatcttatccagatgtgacttgtatccacacaccag

SEQ ID NO: 278637 - DNA, 75 bp, Artificial Sequence
  Synthetic
aagatttccttagttattagagataatttcacaaagattggttttctccgtgattttgaagatattagctcagcc

SEQ ID NO: 278638 - DNA, 75 bp, Artificial Sequence
  Synthetic
gatcagggccattatacataaatctcatgggctcatggataaaaccccaatgtgttggctacgagagagtcttag

SEQ ID NO: 278639 - DNA, 75 bp, Artificial Sequence
  Synthetic
acaagagccttctcagttgaagtcttaaaacattttttgttttgcacactacaggggccatattctgtacaaaca

SEQ ID NO: 278640 - DNA, 75 bp, Artificial Sequence
  Synthetic
tagatagggaggttaagcagccattgcttgtaccagagcagaactgtgacacctgtgtttcagagtgtctagatg

SEQ ID NO: 278641 - DNA, 75 bp, Artificial Sequence
  Synthetic
aaatttgacttgtgctacaagatcttaagtgagtctgaagtcattggcataagagagtcagacgggaaaactagg

SEQ ID NO: 278642 - DNA, 75 bp, Artificial Sequence
  Synthetic
aaggagtacacataaaatccactggttttgaaataacatcagcagtggcctgctcacatggatcctgtatctcag

SEQ ID NO: 278643 - DNA, 75 bp, Artificial Sequence
  Synthetic
aagagagtcagacgggaaaactaggacaaatcagttggcagtatttcaaaattttgtgaacagtgaccctgatat

SEQ ID NO: 278644 - DNA, 75 bp, Artificial Sequence
  Synthetic
ctcatcaggaagcatccacatcagtaattattccatatccaggcttgttggctagtgtgggcgggagaattggga

SEQ ID NO: 278645 - DNA, 75 bp, Artificial Sequence
  Synthetic
tacacctctcacatacttctgattctgctagtgtacacatggtagtggtttgccctcccagagatagttgtgcag

SEQ ID NO: 278646 - DNA, 75 bp, Artificial Sequence
  Synthetic
tgggaaggttacttactatggacgtggagtctggcgaggagtcatggacgggtcacaaatacagatagagataga

SEQ ID NO: 278647 - DNA, 75 bp, Artificial Sequence
  Synthetic
ctcataattgcttactatgctatcatggcattctgaactatcagtgccattcaacactgagtgctatcctgactt

SEQ ID NO: 278648 - DNA, 75 bp, Artificial Sequence
  Synthetic
caataagcagggtctcccacctcagattgttgaagtctcttttgatggtagaattggaatatgggaagtgtgcag

SEQ ID NO: 278649 - DNA, 75 bp, Artificial Sequence
  Synthetic
cctttctactaattcttttcatatacactgctttttctgtgacaacaaatgttttgtatgtgctcagactaatac

SEQ ID NO: 278650 - DNA, 75 bp, Artificial Sequence
  Synthetic
aagcattagatcttggtgtgaagatgttggtgtaaagaatgatgtagatatgtcaaagcggagtcgccgtggtgc

SEQ ID NO: 278651 - DNA, 75 bp, Artificial Sequence
  Synthetic
cgaaacagctgaaaagtccagtgggatggctcaaactctttgtcaactggctactaactgctctaagaatcaaaa

SEQ ID NO: 278652 - DNA, 75 bp, Artificial Sequence
  Synthetic
tagattctggctctatgactttaaagcattcacgcaagacaaaccatttgggtgtcctgtttatgtgaccagcag

SEQ ID NO: 278653 - DNA, 75 bp, Artificial Sequence
  Synthetic
ctaggcgagtaatggggaggataaatcagagaatagggtgggttgatcatcatgatgtagagagaccaaggcaca

SEQ ID NO: 278654 - DNA, 75 bp, Artificial Sequence
  Synthetic
tagaatgacagacttcaggtctgtaagcaatgatgatataaaattcaaaataagaaaatgtactatgaacttgtt

SEQ ID NO: 278655 - DNA, 75 bp, Artificial Sequence
  Synthetic
gagaacctatgaggagattcaagacaactctattgctaactctgataatggtgacaggaggaaatgcctgctcca

SEQ ID NO: 278656 - DNA, 75 bp, Artificial Sequence
  Synthetic
cctaaagagtagtggcagagacatacatatactgacgtacacagctcatgatggagatctaagttccagcatttt

SEQ ID NO: 278657 - DNA, 75 bp, Artificial Sequence
  Synthetic
atacagtagtggccaattcgaagcaaaccagatgtgtccaagaaggatcaaacacaaagtgttctattactgcaa

SEQ ID NO: 278658 - DNA, 75 bp, Artificial Sequence
  Synthetic
taggagtccagatgattcagtctgcagattgaagaaacacttttcaaaagaacccagttcatcatgggcaagttg

SEQ ID NO: 278659 - DNA, 75 bp, Artificial Sequence
  Synthetic
aacccagttcatcatgggcaagttgccagtctctgccatttgcatttgtgcataaagtcttagagttatgcagtg

SEQ ID NO: 278660 - DNA, 75 bp, Artificial Sequence
  Synthetic
ctataactttaagggcaggtgtgattggtgctgagtcatgtttcataataaaaggccccatggaaaaccagcaga

SEQ ID NO: 278661 - DNA, 75 bp, Artificial Sequence
  Synthetic
gagtgctagtgagagatcacattgacaatgagaggctttctaagatagtacagttgtgcactgagaactctttga

SEQ ID NO: 278662 - DNA, 75 bp, Artificial Sequence
  Synthetic
aaacaatatcaattaaaaccatctctagtgagacagtatgcagagaaggttcgagtttctggaccagtttgtaca

SEQ ID NO: 278663 - DNA, 75 bp, Artificial Sequence
  Synthetic
ggacgaaggtgggcactatctattcagctctaccaaatttctccgaaggaagatcaataatagatgttgattcta

SEQ ID NO: 278664 - DNA, 75 bp, Artificial Sequence
  Synthetic
tcccatcttgtcttagttctaggagatgtcatcttgttggtgattgtgtgggtaacaaatgccagtcatggcgag

SEQ ID NO: 278665 - DNA, 75 bp, Artificial Sequence
  Synthetic
agatcaataatagatgttgattctattgttgatttaatgatagaggacatggctaaggaagacttcaatgatgct

SEQ ID NO: 278666 - DNA, 75 bp, Artificial Sequence
  Synthetic
tgatataagtgatattgatttatttggacctgcgcactataaagaggtatcagagctaaccaccatttcacaccc

SEQ ID NO: 278667 - DNA, 75 bp, Artificial Sequence
  Synthetic
atgatcagctatccagggagttttcaggagtaaaggataaccatattatgaatgaaaataaatgctttgaacaat

SEQ ID NO: 278668 - DNA, 75 bp, Artificial Sequence
  Synthetic
gtggtgcaattggctgtggttgtttcaacatcaatccttcctgcttgtatgtccatgcttatctcaagagtgcta

SEQ ID NO: 278669 - DNA, 75 bp, Artificial Sequence
  Synthetic
tctgatggatgactttgttaatgtattaatactaaaatgtggcagaaaggacattagaagatgccttgaaacagg

SEQ ID NO: 278670 - DNA, 75 bp, Artificial Sequence
  Synthetic
acattagaagatgccttgaaacaggaagatgcatgacaagaaataaagtatacatgagagatctattctcaagca

SEQ ID NO: 278671 - DNA, 75 bp, Artificial Sequence
  Synthetic
gaaatgaagcagtcagggtattctcatgttctgactgggtgcacagagtttcctttgaggtcaaaggccctgatg

SEQ ID NO: 278672 - DNA, 75 bp, Artificial Sequence
  Synthetic
tacatgagagatctattctcaagcataggtagaaatcctgacgatgtgcatgctgatgactacaatgaaagtgag

SEQ ID NO: 278673 - DNA, 75 bp, Artificial Sequence
  Synthetic
gcgagatggagttggtcacactagggagcctgggcactaagtttttaaactggggcactttgtcattatccttgg

SEQ ID NO: 278674 - DNA, 75 bp, Artificial Sequence
  Synthetic
tcagatccggatgatgatttaatcggttagagctactaatcacaaaaaagtgaataaccaaagataataaaaaat

SEQ ID NO: 278675 - DNA, 75 bp, Artificial Sequence
  Synthetic
atgcagaaggtatcagcggaaccaacagtatcagttttttggaaagtagtaaaggagggtttgctctgtacgatg

SEQ ID NO: 278676 - DNA, 75 bp, Artificial Sequence
  Synthetic
caaaaaatagcactttaagcattgtgaaagatagtttgatttcataattaacaatttagaaaaaatgggacggtc

SEQ ID NO: 278677 - DNA, 75 bp, Artificial Sequence
  Synthetic
tagcactttaagcattgtgaaagatagtttgatttcataattaacaatttagaaaaaatgggacggtctttgtgt

SEQ ID NO: 278678 - DNA, 75 bp, Artificial Sequence
  Synthetic
aaggatatagtgaaataccaagagaaggatttcttggagagataaggtgcagttctgaatccgcagccatatcag

SEQ ID NO: 278679 - DNA, 75 bp, Artificial Sequence
  Synthetic
ctcataagtcatgcattagagctcctggtttgatcaagtacaagcccatgacagatcaaatagaatgtactgcat

SEQ ID NO: 278680 - DNA, 75 bp, Artificial Sequence
  Synthetic
caacaagccaaacaaaatggttcttaaaatgtcagacaagggcaaggcaatggtgaatgagctcgtgttgaaata

SEQ ID NO: 278681 - DNA, 75 bp, Artificial Sequence
  Synthetic
ctttagtagatccatttgcaattttcctcaaaggatctcttcctcagactaggaatggacagacattcaccagta

SEQ ID NO: 278682 - DNA, 75 bp, Artificial Sequence
  Synthetic
tggtgaatgagctcgtgttgaaatacaagctcaagtctggaaacccttctcgagacgacttaactctttccagaa

SEQ ID NO: 278683 - DNA, 75 bp, Artificial Sequence
  Synthetic
caaaagacaaaaaaacagtacaggccttcaccaatggagcaataaaagcattattgtcgattaatttagatgatc

SEQ ID NO: 278684 - DNA, 75 bp, Artificial Sequence
  Synthetic
atgaaatcatctttattaataaagtgaaaagctgtgatgccacatttttaaatgttagtggatgctactcttgtg

SEQ ID NO: 278685 - DNA, 75 bp, Artificial Sequence
  Synthetic
attatggagcacatgtctgtgtgaaagtaaagtcttcggagtcagccgacttctttgcagaatcggaggacaaaa

SEQ ID NO: 278686 - DNA, 75 bp, Artificial Sequence
  Synthetic
ttctttgcagaatcggaggacaaaacaacagtcctgtcttttccaatacaatctggcacacgtgactactgtcag

SEQ ID NO: 278687 - DNA, 75 bp, Artificial Sequence
  Synthetic
cttcagatccctttgaaacaccagaggccttaatcaaactcagacaacatgtgcattccaaattggacattccaa

SEQ ID NO: 278688 - DNA, 75 bp, Artificial Sequence
  Synthetic
aacacactgtgagtcaaactccaaaaaaacaaagaaaaaacaataaaatataaaataaaacaacaaaaaaataaa

SEQ ID NO: 278689 - DNA, 75 bp, Artificial Sequence
  Synthetic
attaagggaacattagtttacatgggtgtctatgattttaggaataaaacaggtggttcttcaacagtgataaat

SEQ ID NO: 278690 - DNA, 75 bp, Artificial Sequence
  Synthetic
taaaataaaacaacaaaaaaataaaaaaacacaaaaacaaaacaaaaaacaaaaaacaaaaaacaaaaaaagaac

SEQ ID NO: 278691 - DNA, 75 bp, Artificial Sequence
  Synthetic
ccttcagaaggaacctggagcatctccaattggttttctgggcttctggactggctaggtgggcctatgaaggcc

SEQ ID NO: 278692 - DNA, 75 bp, Artificial Sequence
  Synthetic
aaaaatcaaaagacattgactcacagtcccacctgggcagcttatctgcctaggtgtgtgtgagagtgtgtttgt

SEQ ID NO: 278693 - DNA, 75 bp, Artificial Sequence
  Synthetic
atactgaagatactgggcttcattgctattgggattgtttgcttcattttgttcatgattctgattagaattgca

SEQ ID NO: 278694 - DNA, 75 bp, Artificial Sequence
  Synthetic
agttttctttgagagcgtttttgggaagttttttggtttttcttgttttttattttaagagttggattggggttt

SEQ ID NO: 278695 - DNA, 75 bp, Artificial Sequence
  Synthetic
aagttttttggtttttcttgttttttattttaagagttggattggggttttatctctttgtggtttatatgtctt

SEQ ID NO: 278696 - DNA, 75 bp, Artificial Sequence
  Synthetic
gtcaactcaataaatatcaagaagaaaaactaacaacaatacaagcacttgcaaagccaactcaaagcttacagg

SEQ ID NO: 278697 - DNA, 75 bp, Artificial Sequence
  Synthetic
agcaaacataaacagaaaacccacaccaagaagcacaggagacaatagaaaacaacaagacacagcaaagcatcc

SEQ ID NO: 278698 - DNA, 75 bp, Artificial Sequence
  Synthetic
aaaaaaccaaaccacaaaacacaaaacaacagcactcgacacaaaacacaggcacgacaaagcctggcagcacac

SEQ ID NO: 278699 - DNA, 75 bp, Artificial Sequence
  Synthetic
atgtggaaaacactcctcagccaggaaataacctttataaagcacagagtaactggcctctttacatactcatct

SEQ ID NO: 278700 - DNA, 75 bp, Artificial Sequence
  Synthetic
ctgtagtccagtcatcacatctctagtcattttcagatttcctgcaaggtgagagtatggaaaacttagttgttg

SEQ ID NO: 278701 - DNA, 75 bp, Artificial Sequence
  Synthetic
gtgagagtatggaaaacttagttgttggtttactattcattttataaatttagtgagatgtgccggtctttgtgt

SEQ ID NO: 278702 - DNA, 75 bp, Artificial Sequence
  Synthetic
acacatagctccctgaaaatttatttaatacaaaatgtcatacgaagagattgccgttcagtttgcctctgagtc

SEQ ID NO: 278703 - DNA, 75 bp, Artificial Sequence
  Synthetic
aagtaagaggccaggacagagccctcttaatgtttggttcacaccactttagtgcatctttaatgtctaacattg

SEQ ID NO: 278704 - DNA, 75 bp, Artificial Sequence
  Synthetic
gatttgatgcgaagagggtgatagctcttgtgaaagatcgtggaggtgaggactggaagcaggatgtcaagaaga

SEQ ID NO: 278705 - DNA, 75 bp, Artificial Sequence
  Synthetic
agatacgagctattgtaacatcaaaaaatgatggagagggctttatcacaagaccttgcccatatccccactcct

SEQ ID NO: 278706 - DNA, 75 bp, Artificial Sequence
  Synthetic
agaccttgcccatatccccactcctttggtaaatcataattatttaagaaggtaaccagtctatttttggcaata

SEQ ID NO: 278707 - DNA, 75 bp, Artificial Sequence
  Synthetic
tgattgttctctctcttactagaggcaacaagccaaacaaaatgattcttaaaatgtcagacaagggcaaggcaa

SEQ ID NO: 278708 - DNA, 75 bp, Artificial Sequence
  Synthetic
caacaagccaaacaaaatgattcttaaaatgtcagacaagggcaaggcaatggtgaatgagctcgtgttaaaata

SEQ ID NO: 278709 - DNA, 75 bp, Artificial Sequence
  Synthetic
acagattgtctgagattgtgcagtgggatctccatacctttgtaaaggctgactggggcattgtgacgcttaccg

SEQ ID NO: 278710 - DNA, 75 bp, Artificial Sequence
  Synthetic
ggatctccatacctttgtaaaggctgactggggcattgtgacgcttaccgaatgggacaaaatccacggttactc

SEQ ID NO: 278711 - DNA, 75 bp, Artificial Sequence
  Synthetic
caagctcaaatctggaaacccttctcgagatgacttgactctttccagaatcactgctgcttttgctggttggac

SEQ ID NO: 278712 - DNA, 75 bp, Artificial Sequence
  Synthetic
ccatggatgccatatccagcagttatcctagggcgatgatgcatcccagctttgctggactgattgaccaagagc

SEQ ID NO: 278713 - DNA, 75 bp, Artificial Sequence
  Synthetic
tttaactacgtgggatagcaccagcagaaatgacatgtgcttttctaatgactcacctctagaaggcctagttta

SEQ ID NO: 278714 - DNA, 75 bp, Artificial Sequence
  Synthetic
ttccagcagatgtgttctctgagataactcaagctcactgcttgttcatgatccaattctcaaagactatcaacc

SEQ ID NO: 278715 - DNA, 75 bp, Artificial Sequence
  Synthetic
agagatgcagagttggagattcagataaaaaaatgataactaatgtcacaataatctctctgatttctgaaatac

SEQ ID NO: 278716 - DNA, 75 bp, Artificial Sequence
  Synthetic
cctcactgagaggtttgagtaaggatgaaattgtctccagctttgagcgaccaatgcaagctgcaatcagcagta

SEQ ID NO: 278717 - DNA, 75 bp, Artificial Sequence
  Synthetic
tgaaattgtctccagctttgagcgaccaatgcaagctgcaatcagcagtacatttttaacttctgccaatagaag

SEQ ID NO: 278718 - DNA, 75 bp, Artificial Sequence
  Synthetic
aaaaaagtatctctgagttgtcactatcatgtggtaatgatgacaattctactggacaagtcttaacattcaatg

SEQ ID NO: 278719 - DNA, 75 bp, Artificial Sequence
  Synthetic
agcaatgttgaagactcttgggatcataaatgataacctaaagccctcatcttcaactgtgagtgctgcaaaagt

SEQ ID NO: 278720 - DNA, 75 bp, Artificial Sequence
  Synthetic
gattggaagacacaatacaaggtgattatattgtagactgcgtgactggcttgtatcagtcagatatcggagtcg

SEQ ID NO: 278721 - DNA, 75 bp, Artificial Sequence
  Synthetic
cttcagatccctttgaaacaccagaggccttgatgaaacctagacaatatgtgcatactaaattggacattccaa

SEQ ID NO: 278722 - DNA, 75 bp, Artificial Sequence
  Synthetic
aacacactgtgggtcaaaacaaaaaaacaaagaaaaacaataaaatataaaataaaacaacaaaaaaataaaaaa

SEQ ID NO: 278723 - DNA, 75 bp, Artificial Sequence
  Synthetic
gaatgatatcattcctagagactcaacaaagcgagaacgacataaagatgcaagtactaatgtctgaaattgaac

SEQ ID NO: 278724 - DNA, 75 bp, Artificial Sequence
  Synthetic
aacataaaaaacaaaacaaaaaaacaaacaaaaaaacaaaaacaaaaaaacgaacaaaattagaaacattgaccc

SEQ ID NO: 278725 - DNA, 75 bp, Artificial Sequence
  Synthetic
aaacaaaaaaacaaaaacaaaaaaacgaacaaaattagaaacattgacccacagtcccacctgggcagcttatct

SEQ ID NO: 278726 - DNA, 75 bp, Artificial Sequence
  Synthetic
gcctaggtgtgtgtaagagtgtgtttgtagttttctttgagagtgtttcttggggagttttttggttttcttgtg

SEQ ID NO: 278727 - DNA, 75 bp, Artificial Sequence
  Synthetic
ataacacaatccaaagaaacaaaaatgtaatgagtactactgtagtcccagcaatactttcagtggccttactgt

SEQ ID NO: 278728 - DNA, 75 bp, Artificial Sequence
  Synthetic
ttttttatttattttgaaagtcggattggggttccatctctttgtggtctatatgtcttgatttagcattgttag

SEQ ID NO: 278729 - DNA, 75 bp, Artificial Sequence
  Synthetic
tgtaatgagtactactgtagtcccagcaatactttcagtggccttactgtcatcatcaattgctcccattatggc

SEQ ID NO: 278730 - DNA, 75 bp, Artificial Sequence
  Synthetic
atacttattctggaccaaaaataccctttaaaggggtttgtaagattggtctaattaaatataaagagtgcaagt

SEQ ID NO: 278731 - DNA, 75 bp, Artificial Sequence
  Synthetic
aggaagccagagtctgtttcccagtagttctttggatgtaacttcatactgtaactccactaacttaaacaattc

SEQ ID NO: 278732 - DNA, 75 bp, Artificial Sequence
  Synthetic
ctttaaaggggtttgtaagattggtctaattaaatataaagagtgcaagtttaaaacatcttcttatgaaactgt

SEQ ID NO: 278733 - DNA, 75 bp, Artificial Sequence
  Synthetic
agttctttggatgtaacttcatactgtaactccactaacttaaacaattctgactgacagcaatcatctctttta

SEQ ID NO: 278734 - DNA, 75 bp, Artificial Sequence
  Synthetic
tgatcagttgtatgtaggcaatctctttctctatggcttgacctgtaaatacttctgcaggtatgttcctaacag

SEQ ID NO: 278735 - DNA, 75 bp, Artificial Sequence
  Synthetic
ttcacctctcgcacacttctgattctgctagtgtgcacatggtagtggtttgccctcccagagacagttgtgcag

SEQ ID NO: 278736 - DNA, 75 bp, Artificial Sequence
  Synthetic
acttctgcaggtatgttcctaacagatagctctctcatcatggtcttgtaagtgaacattaatgaatcatccaga

SEQ ID NO: 278737 - DNA, 75 bp, Artificial Sequence
  Synthetic
ccaagacccttcccaactctgcagatttgagttgcaaagtcacattttttctcccagtttaactggtaaccatcc

SEQ ID NO: 278738 - DNA, 75 bp, Artificial Sequence
  Synthetic
agtgttgagaattcaaaaattttaaaagttggataagtaagaggccaggacagagccctcttaatgtttggttca

SEQ ID NO: 278739 - DNA, 75 bp, Artificial Sequence
  Synthetic
caccactttagtgcatctttaacgtccaacattgaaatacgggctattgtgacatcaaaaaatgatggagaggcc

SEQ ID NO: 278740 - DNA, 75 bp, Artificial Sequence
  Synthetic
ccaacattgaaatacgggctattgtgacatcaaaaaatgatggagaggcctttattacaagaccttgttcatatc

SEQ ID NO: 278741 - DNA, 75 bp, Artificial Sequence
  Synthetic
aaaggaggatttgccttatatgatgaaggctacagtgagataccaagagagggatttcttggtgagataaggtgt

SEQ ID NO: 278742 - DNA, 75 bp, Artificial Sequence
  Synthetic
agaaatgggcaaacattcaccagcacaaaagacaagaagacagtccaggctttcactaatggagcgataaaagca

SEQ ID NO: 278743 - DNA, 75 bp, Artificial Sequence
  Synthetic
cgcttaccgaatgggacaaaatccacggtcactcttttcaactggttcggagaagtgctcattatgggcaactcg

SEQ ID NO: 278744 - DNA, 75 bp, Artificial Sequence
  Synthetic
acacaaagaagtcccaattacaatggaatctttactacgaaaacaaaccatcaacaatgaaggcttttttaagcc

SEQ ID NO: 278745 - DNA, 75 bp, Artificial Sequence
  Synthetic
tgaattacgtcatagtgaccatgatttactaaatgcagatttgcccacatttcttgtggagaggtcgtctaacaa

SEQ ID NO: 278746 - DNA, 75 bp, Artificial Sequence
  Synthetic
atactaaagattctgggctttattgccattgggattgtctgctttattttattcatgattctgatcagaattgca

SEQ ID NO: 278747 - DNA, 75 bp, Artificial Sequence
  Synthetic
gattgttattgacttaaaccttgattcattgaaccccaattctactgtgggatcttctcttacctctgtgataga

SEQ ID NO: 278748 - DNA, 75 bp, Artificial Sequence
  Synthetic
gataccagagaagaatctgatgaacatggttcatgacattacttttggtcatatagctgattctactgatgttaa

SEQ ID NO: 278749 - DNA, 75 bp, Artificial Sequence
  Synthetic
aataggaccatccaattccataagaacaaacacaaacaacccatatcaataagcataagaaataatagaaataca

SEQ ID NO: 278750 - DNA, 75 bp, Artificial Sequence
  Synthetic
attaggaccatccaattccataagaacaaacacaaacaacccatatcaataagcataagaaataatagaaataca

SEQ ID NO: 278751 - DNA, 75 bp, Artificial Sequence
  Synthetic
actaggaccatccaattccataagaacaaacacaaacaacccatatcaataagcataagaaataatagaaataca

SEQ ID NO: 278752 - DNA, 75 bp, Artificial Sequence
  Synthetic
agtaggaccatccaattccataagaacaaacacaaacaacccatatcaataagcataagaaataatagaaataca

SEQ ID NO: 278753 - DNA, 75 bp, Artificial Sequence
  Synthetic
gctctcttccaagtttggcatagtaggagacggttacgatcatctaagtccagacatgattgtagaaacaacatc

SEQ ID NO: 278754 - DNA, 75 bp, Artificial Sequence
  Synthetic
aaacacaacaaaacaatcggtgagacaaatcaaaaaacaaaaacacaaaacaacaacaaaacacaggcaagacaa

SEQ ID NO: 278755 - DNA, 75 bp, Artificial Sequence
  Synthetic
agggtcgtacattgttgtagagttcaccacttttagagggagtgagagaggttgcctaaatgctgcaaaggataa

SEQ ID NO: 278756 - DNA, 75 bp, Artificial Sequence
  Synthetic
agcctggcagcatgtatacagaaaccactcctcaaccaggaaacaatcctcaaagcataaaaagtgatcagtcct

SEQ ID NO: 278757 - DNA, 75 bp, Artificial Sequence
  Synthetic
atttgcaaagtaccagattgcatgtgagaacagatcaagaaatgcaccagtttcattgtatgtcattgctgtcca

SEQ ID NO: 278758 - DNA, 75 bp, Artificial Sequence
  Synthetic
tagagatgggttatggaccaatatgacaatgaatcaagaagaagtcaatgagctggtctttagatacaggatggc

SEQ ID NO: 278759 - DNA, 75 bp, Artificial Sequence
  Synthetic
gtgagagtgtagaaaacacagatgttggttcactattcattttataaacttagtgagatgtgcgggtctttgtgt

SEQ ID NO: 278760 - DNA, 75 bp, Artificial Sequence
  Synthetic
gctcagtatacatgaagaatcacgcaagatatgtccagaattgacagatgatgactcagatttgtctaaatcaga

SEQ ID NO: 278761 - DNA, 75 bp, Artificial Sequence
  Synthetic
gcgagaactgttaggcactttatcctttatagacctggactgggataaaacagagaaaacattcccaatgtttaa

SEQ ID NO: 278762 - DNA, 75 bp, Artificial Sequence
  Synthetic
acaatgagtcaggaagaggtcaatgagctggtttttagatacaggatggcacttagcatacatgaagaatcacgt

SEQ ID NO: 278763 - DNA, 75 bp, Artificial Sequence
  Synthetic
agctggtttttagatacaggatggcacttagcatacatgaagaatcacgtaagatctgcccagaactgacagatg

SEQ ID NO: 278764 - DNA, 75 bp, Artificial Sequence
  Synthetic
aaaggcagtattcgacaacttccatgtgtctccacctgatgagaactacatgagtcatataatatctaaagaact

SEQ ID NO: 278765 - DNA, 75 bp, Artificial Sequence
  Synthetic
gagagaactgctgggaacactatcttttatagacctagattggaataaaacagaaaaaatatttccaatgttcaa

SEQ ID NO: 278766 - DNA, 75 bp, Artificial Sequence
  Synthetic
cgagagatctcagtctgatctactgaaatcatctttttttcaagaaggtctcactgcagaagataggagattttt

SEQ ID NO: 278767 - DNA, 75 bp, Artificial Sequence
  Synthetic
aaatagatctgagtgtgatatcagaattaatgagtttctcaaagcatttgatagagaagaagagttgagggaccc

SEQ ID NO: 278768 - DNA, 75 bp, Artificial Sequence
  Synthetic
atagagaagaagagttgagagacccatttgactctaagtcaacagttcagattcctccttgggtattcaccgatg

SEQ ID NO: 278769 - DNA, 75 bp, Artificial Sequence
  Synthetic
ctgaagaggggaaaagtctaaccatcttaaaagttttaaaggtggaaggtgagcacccaatggcaaggttctgga

SEQ ID NO: 278770 - DNA, 75 bp, Artificial Sequence
  Synthetic
atttgattccaagtcaacaattcagattcctccctgggtgttcacggatgctgaggagggaaagggtttgtctat

SEQ ID NO: 278771 - DNA, 75 bp, Artificial Sequence
  Synthetic
tttaaaagttttaaaagtggatggtgagcatccaatggcaagattctggagacatgttataagctctgcacaatt

SEQ ID NO: 278772 - DNA, 75 bp, Artificial Sequence
  Synthetic
ccaggagtaagaaggccttttctattcaacatgacatctcaagattagaaaacttcttatacggagatagtagta

SEQ ID NO: 278773 - DNA, 75 bp, Artificial Sequence
  Synthetic
tgaacagaagaataagtaccacagagtgaaacttaatttatcttctgaggaagatgagtacctggcaactctagg

SEQ ID NO: 278774 - DNA, 75 bp, Artificial Sequence
  Synthetic
gataggtgggaaaaagatgaaggatttggcatcggtcaaagagtccaggatgaggagtaaaaaggccttctctat

SEQ ID NO: 278775 - DNA, 75 bp, Artificial Sequence
  Synthetic
ccaacatgacatctcaaggttagaaaatttcctgtacggagacagtagtaaaatatttgagacaaatgatgactt

SEQ ID NO: 278776 - DNA, 75 bp, Artificial Sequence
  Synthetic
gttctgtcctcttgctgaggactttgagctaagaatgatggcacaggcaattcatcaaccaacaatgacgagaga

SEQ ID NO: 278777 - DNA, 75 bp, Artificial Sequence
  Synthetic
ccaaggcccaaatgaaatattgaataatcatctaaaaatgctacacaccccctttgggtcatggtgtcagatggt

SEQ ID NO: 278778 - DNA, 75 bp, Artificial Sequence
  Synthetic
gagtctcataggagcagaattatcagcatctgtaaagcagcatgtgaaaccagggcagtttataataaaaaggct

SEQ ID NO: 278779 - DNA, 75 bp, Artificial Sequence
  Synthetic
gcaatcccaataacaaaatgaagattcctgaaagtcatggactaagagccaggaaacactgcaagggtccagtct

SEQ ID NO: 278780 - DNA, 75 bp, Artificial Sequence
  Synthetic
acttaactcacctttgataatggcagtgagacccacatcttctaaaagtcacatttttgtatcatttgggttgat

SEQ ID NO: 278781 - DNA, 75 bp, Artificial Sequence
  Synthetic
caaagcttatcacacgatggacattgagactggaaatgtatttaaatcatacattgatgcaggtgatctgttcat

SEQ ID NO: 278782 - DNA, 75 bp, Artificial Sequence
  Synthetic
cacagattttatatcctacaagcttagcaagctgacgaatctctgcaagtgcagctcactaatggaatgttcatc

SEQ ID NO: 278783 - DNA, 75 bp, Artificial Sequence
  Synthetic
tgatagccatatggaacttaaggtagaagatcagtttgttcaggatttatttaaggcatatcatggagaggttcc

SEQ ID NO: 278784 - DNA, 75 bp, Artificial Sequence
  Synthetic
aaacttctggatagaggcattcaactatgccatttgggactcgacaaagctccttgcaaccgacagaagccctgg

SEQ ID NO: 278785 - DNA, 75 bp, Artificial Sequence
  Synthetic
ttaggatattcaacatgaaagttcatcctgaaatgtcatactcaatggtgtgtgatatgatgcagggctctgatg

SEQ ID NO: 278786 - DNA, 75 bp, Artificial Sequence
  Synthetic
tgtaaaagaagcttctttcatgataaaactatctctattaacattgttagaagataaagctgtgactgaagagct

SEQ ID NO: 278787 - DNA, 75 bp, Artificial Sequence
  Synthetic
gcagacaatacagaggtacatagtgatggaagggtttgtttcacagccagagctacccaagccacacaagatgct

SEQ ID NO: 278788 - DNA, 75 bp, Artificial Sequence
  Synthetic
caataaggttcctggagtactgaggtcagagttacaggtcttcttattctggagagtgataaaatcaatgaagag

SEQ ID NO: 278789 - DNA, 75 bp, Artificial Sequence
  Synthetic
gatatctgagtctcccttcttgctatcaaaaagaaatggccagattagctggagtggtctgttcaatcctctctc

SEQ ID NO: 278790 - DNA, 75 bp, Artificial Sequence
  Synthetic
atatagcatacaacaggctcagtgcactctgcactacatgctaatgggaatgggtgtcagttctctattttcaga

SEQ ID NO: 278791 - DNA, 75 bp, Artificial Sequence
  Synthetic
tggcaatgatgtgagatctttgcaagcagtcataagtgcttgttataatggctactttaagaataaagaagaaga

SEQ ID NO: 278792 - DNA, 75 bp, Artificial Sequence
  Synthetic
aaccgaaccctcatcattatcaaagatgtacaaaaagatcattgaattagaacatctttgcccagaagatgataa

SEQ ID NO: 278793 - DNA, 75 bp, Artificial Sequence
  Synthetic
agctgagaaggtccatagcccaggtgttgtgtcttctttgtcgacaggcaatgcagttgcaaaagtcatggcatc

SEQ ID NO: 278794 - DNA, 75 bp, Artificial Sequence
  Synthetic
atatttggggatggctgacccagaagatcctaagatgcatgagtttagtagaagttacttaaaacagagtatcct

SEQ ID NO: 278795 - DNA, 75 bp, Artificial Sequence
  Synthetic
gtatagtttgttgcagaagatgatggcttatgatggctttgagaacaatcttgaattaacaatggaagatattct

SEQ ID NO: 278796 - DNA, 75 bp, Artificial Sequence
  Synthetic
gcatggcaaggatttgttaaaacgaatgtatggacagaacttcatggagcagattgatagacagataactcgaga

SEQ ID NO: 278797 - DNA, 75 bp, Artificial Sequence
  Synthetic
gttaggactagtaatcacaaaaaagtgaataatcaaatttaataaaaattcaaaaaatagtattttaagcattgt

SEQ ID NO: 278798 - DNA, 75 bp, Artificial Sequence
  Synthetic
agttgcatctctgagtttggaaaggctagcaactctaaaggccaccagtaatttcaacgagtcatggtatgagta

SEQ ID NO: 278799 - DNA, 75 bp, Artificial Sequence
  Synthetic
caaggatgtaaaggataaaaactataccagggagaaagtgctagtccgtatgtcagagatcgccaaggacggcaa

SEQ ID NO: 278800 - DNA, 75 bp, Artificial Sequence
  Synthetic
gactctggctattcatgcatttaatgactgcatgaatgctgtagaggctagaggctgtatgcacatttgcctttt

SEQ ID NO: 278801 - DNA, 75 bp, Artificial Sequence
  Synthetic
ttccagcagatgtgttgtctgagataacccaagctcactgcttgttcatgatccaattctcaaagaccatcaacc

SEQ ID NO: 278802 - DNA, 75 bp, Artificial Sequence
  Synthetic
taagaaacagcaacatggtggactgcgcgagatatatgtcttgggagctgaagagaggattgttcagagtttgat

SEQ ID NO: 278803 - DNA, 75 bp, Artificial Sequence
  Synthetic
agaaactattgctagaagtataggtaggttcttcccttctgacacattatgcaaccctaacaacaaaatgaagat

SEQ ID NO: 278804 - DNA, 75 bp, Artificial Sequence
  Synthetic
tcctgaaagccatggtttaagagctagaaaacactgtaaagggccagtttggacctgtgcaacatctgatgatgc

SEQ ID NO: 278805 - DNA, 75 bp, Artificial Sequence
  Synthetic
aaacaaagaaaaaaacaataaaatataaaataaaataacaaaaaaataaaaaataaaaaaacataaaaacaaaac

SEQ ID NO: 278806 - DNA, 75 bp, Artificial Sequence
  Synthetic
aaataaaaaaacataaaaacaaaacaaaaaaacaaaaaaacaaaaaaacaaaaaacgatcaaaaatcaaaagaca

SEQ ID NO: 278807 - DNA, 75 bp, Artificial Sequence
  Synthetic
gagaaagtggaatcaaggacactttgtgacgaagtttgcattaatgctctgtgagtttacacattcaaagtggtg

SEQ ID NO: 278808 - DNA, 75 bp, Artificial Sequence
  Synthetic
gccgatcatcatcaggggctgctcaatgtttacaaacaagtacatgatgatgaacctccaatatcttaggatact

SEQ ID NO: 278809 - DNA, 75 bp, Artificial Sequence
  Synthetic
gtgtgtttgtggttttctttgagagtgtttttgaggagttttttggtttttcttgtttttattttgggagtcaga

SEQ ID NO: 278810 - DNA, 75 bp, Artificial Sequence
  Synthetic
tgacagtcacatggaacttaaggtggaggatcagtttgttcaggatctatttaaggcataccatggagaggtccc

SEQ ID NO: 278811 - DNA, 75 bp, Artificial Sequence
  Synthetic
ttagggttttatctctttgtggtttatatgtcttgatttagcattgttagaggaagccagattctgtttcccagt

SEQ ID NO: 278812 - DNA, 75 bp, Artificial Sequence
  Synthetic
atatgtcttgatttagcattgttagaggaagccagattctgtttcccagtagttctttggatgtaacttcgtact

SEQ ID NO: 278813 - DNA, 75 bp, Artificial Sequence
  Synthetic
gcagacttggatggacccaggaaagacctttatcaaaacaaagacaggaatgatgcagggaatactgcatttcac

SEQ ID NO: 278814 - DNA, 75 bp, Artificial Sequence
  Synthetic
ttcatcactattgcacaccctacatcaagaatttgtgagatcacttactttcaggatatttaacatgaaagtcca

SEQ ID NO: 278815 - DNA, 75 bp, Artificial Sequence
  Synthetic
tcctgagatgtcgtactcaatggtgtgtgacatgatgcagggttccgatgacagcagcatgcttttaagtttccc

SEQ ID NO: 278816 - DNA, 75 bp, Artificial Sequence
  Synthetic
agccaaagatgagcccacaataatgaggtgtaaaatggcagcagctatctgttttcgcatgaagaagaatttagg

SEQ ID NO: 278817 - DNA, 75 bp, Artificial Sequence
  Synthetic
ccaagaccctttccaactctgcagatctgagttgcaaagtcacattttttctcccagtttaactggtaaccatcc

SEQ ID NO: 278818 - DNA, 75 bp, Artificial Sequence
  Synthetic
ggtttatttagctatatacccctcagagaaatctacgtcgaacactgactttgttatggaatataattcagaatt

SEQ ID NO: 278819 - DNA, 75 bp, Artificial Sequence
  Synthetic
cttcttccattcacagcacgttaggccaactataagatggatagcagctagttgcagcttgccggaagttgagac

SEQ ID NO: 278820 - DNA, 75 bp, Artificial Sequence
  Synthetic
attggtggcaagacaagaagaagcatccaacctaatgactgcagtcacagagggtggtggatccttctctttggc

SEQ ID NO: 278821 - DNA, 75 bp, Artificial Sequence
  Synthetic
cccactccttaggtaaatcataattatttaagaaggtaattagtctatttttggcaataacagattgtctgagat

SEQ ID NO: 278822 - DNA, 75 bp, Artificial Sequence
  Synthetic
atatagcatacaacatgctcagtgtaccttgcactacatgctaatgggcatgggtgttagttctctgttctcaga

SEQ ID NO: 278823 - DNA, 75 bp, Artificial Sequence
  Synthetic
tgtgcagtgggatctccatacctttgtaaaggctgactggggcattgtgacgcttaccgaatgggacaaaatcca

SEQ ID NO: 278824 - DNA, 75 bp, Artificial Sequence
  Synthetic
atttaagaaagctatagcaaagtggaaagaccctggattgggtttcttcttgcttgacaacccatactgtgctgg

SEQ ID NO: 278825 - DNA, 75 bp, Artificial Sequence
  Synthetic
tttaggaggtttcaggtttaacctctacaaggcaataacaagaacatcattaaaacgtctttatgcttacttcat

SEQ ID NO: 278826 - DNA, 75 bp, Artificial Sequence
  Synthetic
tgaattacgtcatagtgatcatgacttgttaaacgcagatttgcccacatttctagtggagagatcatctagtaa

SEQ ID NO: 278827 - DNA, 75 bp, Artificial Sequence
  Synthetic
gaagaaagtaagatctgcaagtgaggatgagcagttggaggcctgcagtgtaagcccaggaggtgcaataatatt

SEQ ID NO: 278828 - DNA, 75 bp, Artificial Sequence
  Synthetic
gagttcatcactaaaatggggatctagacaaaagtacctgaaattaagatcaagactgaacattcctgacaactg

SEQ ID NO: 278829 - DNA, 75 bp, Artificial Sequence
  Synthetic
gattgagttgataaatgagaatccctcagtattgtaccgagcacccagaacatcagaggaaataatgttaaggat

SEQ ID NO: 278830 - DNA, 75 bp, Artificial Sequence
  Synthetic
agctgagaaagtccatagcccaggtgttgtgtcttctctgtctacaggcaatgcagttgcaaaggtcatggcatc

SEQ ID NO: 278831 - DNA, 75 bp, Artificial Sequence
  Synthetic
ctcagtctatttcttatcagcatccatatttcaggactcaaacaaacaagaattcagtatcatggagtcaagcaa

SEQ ID NO: 278832 - DNA, 75 bp, Artificial Sequence
  Synthetic
gtatagtttgttacagaagatgatggcttatgatggtttcgagaacaatcttgaattaacaatggaagatatcct

SEQ ID NO: 278833 - DNA, 75 bp, Artificial Sequence
  Synthetic
tacagattttgtttcctataagctaagcaaactgaccaatctttgcaagtgcagctcattgatggaatgttcatc

SEQ ID NO: 278834 - DNA, 75 bp, Artificial Sequence
  Synthetic
gttcttgtttccaaacattgacgatctacagcagctggactgcatagtgcatgatagatgccaaattcaggttgc

SEQ ID NO: 278835 - DNA, 75 bp, Artificial Sequence
  Synthetic
acagagagtcagtcacaaagaaaacacccagaccaagatcacagtgtttgaagggcatcaaaatctgaagacgcc

SEQ ID NO: 278836 - DNA, 75 bp, Artificial Sequence
  Synthetic
tgcagaatacatggtttcggataaatggtttggcacaatgaaaagtaagattggctcaacgggatttgagaatga

SEQ ID NO: 278837 - DNA, 75 bp, Artificial Sequence
  Synthetic
atggtcgaagttgaagactataatcacatggttgacagatacgcctgcggcaacacttgaaaagtcaccactctc

SEQ ID NO: 278838 - DNA, 75 bp, Artificial Sequence
  Synthetic
tcctgaaatgtcatactcaatggtgtgtgacatgatgcagggctctgatgacagtagcatgcttttaagttttcc

SEQ ID NO: 278839 - DNA, 75 bp, Artificial Sequence
  Synthetic
aaatcatgttcagatcaggaacttcttctccagaatggaaagcaagcctaggactgtgcgtgtcactggagcacc

SEQ ID NO: 278840 - DNA, 75 bp, Artificial Sequence
  Synthetic
tgtcaagaaaaggtcaggctcaagcaagatctctttagttattagagacaatttcacaaaaattggcttcctccg

SEQ ID NO: 278841 - DNA, 75 bp, Artificial Sequence
  Synthetic
tgattttgaagatattagctcagccacaagagccttttcagtggaggtcttaaagcattttttgttttgcacact

SEQ ID NO: 278842 - DNA, 75 bp, Artificial Sequence
  Synthetic
acaaggcccatactcagtgcaaacaaaacttgatttgtgctacaaaattctaagtgagtctgaagtcattggcat

SEQ ID NO: 278843 - DNA, 75 bp, Artificial Sequence
  Synthetic
acatggttgacagatacacctgcagcaacacttgagaaatcaccactgacaaatcatgttcaaattaggaatttc

SEQ ID NO: 278844 - DNA, 75 bp, Artificial Sequence
  Synthetic
cagagagtcagatggaagaacaagaacaaatcagttagcaatatttcagaattttgtgaacagtgaccctgatat

SEQ ID NO: 278845 - DNA, 75 bp, Artificial Sequence
  Synthetic
aatgaatcagattgagtctataggagcagggacaataggtggttttattataccccaaaagagcaaagaagtatc

SEQ ID NO: 278846 - DNA, 75 bp, Artificial Sequence
  Synthetic
tgggaaagttgcttattatggccgtggcgtctggcgaggagtcatggatggttcccaaatacagatagagataga

SEQ ID NO: 278847 - DNA, 75 bp, Artificial Sequence
  Synthetic
cttgaagaatggtggtagagacatacatatattgacgtacacagctcatgatggagatctaagttctagcatttt

SEQ ID NO: 278848 - DNA, 75 bp, Artificial Sequence
  Synthetic
caataagttgggtctcccgccccaggttgtagaagtctcttttgatggcagaattggcatatgggaggtgtgcag

SEQ ID NO: 278849 - DNA, 75 bp, Artificial Sequence
  Synthetic
gagtattagatcttggtgtgaagatgttggggtaaagaatgatgtggacatgtcaaaacgatgtcgccgtggtgc

SEQ ID NO: 278850 - DNA, 75 bp, Artificial Sequence
  Synthetic
cagattctggctccatgactttagagcattcacgcaagacaaaccatttggatgtcccgtctatgtaaccagcag

SEQ ID NO: 278851 - DNA, 75 bp, Artificial Sequence
  Synthetic
tcgaatgacagactttaggtctgtaaccagtgatgatatcaaattcaaaataagaaaatgtaccatgaatctgtt

SEQ ID NO: 278852 - DNA, 75 bp, Artificial Sequence
  Synthetic
aagatgcatgacaagaaataaaatatacatgagagatctattctcaagcataggtagaaatcctgacgatgtgca

SEQ ID NO: 278853 - DNA, 75 bp, Artificial Sequence
  Synthetic
tctgaaaaatggtggtcgagatattcatatattgacgtacacagctcacgatggggatctaagttctagcatttt

SEQ ID NO: 278854 - DNA, 75 bp, Artificial Sequence
  Synthetic
tagaagcccggatgactcagtctgtagattaaagaagcacttttcaaaagagcctagctcgtcatgggcaagctg

SEQ ID NO: 278855 - DNA, 75 bp, Artificial Sequence
  Synthetic
tcagatccagatgatgatttgatcggttagagctactaatcacaaaaaagtgaacaaccaaagataataaaaaat

SEQ ID NO: 278856 - DNA, 75 bp, Artificial Sequence
  Synthetic
ccaatctttgccttttgccttcgtgcataaggttttggaattgtgcaatggagtgatagtgagagatcatatcga

SEQ ID NO: 278857 - DNA, 75 bp, Artificial Sequence
  Synthetic
caaaaaatagtactttaagcgttgtaaaagatagtttgatttcataattaacaatttagaaaaaatgggacggtc

SEQ ID NO: 278858 - DNA, 75 bp, Artificial Sequence
  Synthetic
tagtactttaagcgttgtaaaagatagtttgatttcataattaacaatttagaaaaaatgggacggtctttgtgt

SEQ ID NO: 278859 - DNA, 75 bp, Artificial Sequence
  Synthetic
taatgaaagactttctaagatagtgcagctatgcactgagaactcgctgagaacaaaggtaggtactatctattc

SEQ ID NO: 278860 - DNA, 75 bp, Artificial Sequence
  Synthetic
acacaaagacggcacaatgatttttacaattttaaatgttttaataagagctatgctcgtaatgagcatgtattc

SEQ ID NO: 278861 - DNA, 75 bp, Artificial Sequence
  Synthetic
agctctaccaaatttttctgaaggaagatcaataatagatgttgattcgatcgttgatctaatgatagaggacat

SEQ ID NO: 278862 - DNA, 75 bp, Artificial Sequence
  Synthetic
ggctaaggaagacttcaatgaggctgtcagaatgatggaggcagaagagccagcatcatatgagagtgaatcatt

SEQ ID NO: 278863 - DNA, 75 bp, Artificial Sequence
  Synthetic
tgatataagtgacattgacttattcgggcctgcgcactacaaagaagtgtctgagctaactaccatatcacaccc

SEQ ID NO: 278864 - DNA, 75 bp, Artificial Sequence
  Synthetic
cttaatggatgactttgtcaatgtactaatcttaaagtgcggtataaaggacattaggagatgccttgaaacagg

SEQ ID NO: 278865 - DNA, 75 bp, Artificial Sequence
  Synthetic
gagatgcatgacgagaaataaaatatacatgagagacctatattcaagcataggaagaaatcctgatgatgtgca

SEQ ID NO: 278866 - DNA, 75 bp, Artificial Sequence
  Synthetic
gcattcataggccataaaactcccttagaatcatttgctgataaaataattgagaaagaagaagaaacatgtgag

SEQ ID NO: 278867 - DNA, 75 bp, Artificial Sequence
  Synthetic
agctgacgactacaatgaaagtgaatctgatccagatgatgatttgataggataggactaccaattacaaaaatg

SEQ ID NO: 278868 - DNA, 75 bp, Artificial Sequence
  Synthetic
taagaaattttagacaatggaaaatcaaaaaatggtttcctaaacgttgtggagtatagtttgatttcatgatta

SEQ ID NO: 278869 - DNA, 75 bp, Artificial Sequence
  Synthetic
gcagaaaacttcagtctcacttcaagatgcaatttgtcaagaaaattcagacaattattctggaccaaagatacc

SEQ ID NO: 278870 - DNA, 75 bp, Artificial Sequence
  Synthetic
acacaaagctccctgaaaatttatttaatacaaaatgtcatacgaggagattgccgttcagtttgcctctgagtc

SEQ ID NO: 278871 - DNA, 75 bp, Artificial Sequence
  Synthetic
tggtttcctaaacgttgtggagtatagtttgatttcatgattaacaatttagaaaaaatgggacggtctttgtgt

SEQ ID NO: 278872 - DNA, 75 bp, Artificial Sequence
  Synthetic
tatagatgagcaagctgtcgccggttgggtgacgcattttgcttatcagggatttgatgcaaagagagtgatagc

SEQ ID NO: 278873 - DNA, 75 bp, Artificial Sequence
  Synthetic
gatttgatgcaaagagagtgatagctcttgtgaaagagcgtggaggtgaggactggaagcaggacgtcaagaaga

SEQ ID NO: 278874 - DNA, 75 bp, Artificial Sequence
  Synthetic
tggtgaatgagctagttttgaagtacaagctcaaatctgggaatccttctcgagatgacctaactctctccagaa

SEQ ID NO: 278875 - DNA, 75 bp, Artificial Sequence
  Synthetic
ctcacaattgcttactatgctatcatggtatcctaaattatcagtgccattcaacattaagtgccatcctgactt

SEQ ID NO: 278876 - DNA, 75 bp, Artificial Sequence
  Synthetic
ctatggataccatatctagcggttatcctagagcaatgatgcatcccagctttgctggtttaattgatcaagagc

SEQ ID NO: 278877 - DNA, 75 bp, Artificial Sequence
  Synthetic
tcccagcagatgtgctgtctgagataacccaagctcactgcttgttcatgattcagttctctaagactatcaacc

SEQ ID NO: 278878 - DNA, 75 bp, Artificial Sequence
  Synthetic
ccagagaataggatgggttgaccatcatgatgttgagaggccaaggcacagagaacccatgagaagattcaaaac

SEQ ID NO: 278879 - DNA, 75 bp, Artificial Sequence
  Synthetic
cctcactgagaggtctaagcaaggatgaaatagtttctagctttgagcgaccaatgcaagccgcaattagcagca

SEQ ID NO: 278880 - DNA, 75 bp, Artificial Sequence
  Synthetic
cattcttgacatctgccaacagaagagcaatgctgaagactcttgggatcataaatgacaacctgaagccttcat

SEQ ID NO: 278881 - DNA, 75 bp, Artificial Sequence
  Synthetic
agcaatgctgaagactcttgggatcataaatgacaacctgaagccttcatcctcaactgtgagtgctgcaaaagt

SEQ ID NO: 278882 - DNA, 75 bp, Artificial Sequence
  Synthetic
cttcagatccctctaggacccgaaaggccttaatacaacccagacaacatgtgcatcccaaattgaacattccaa

SEQ ID NO: 278883 - DNA, 75 bp, Artificial Sequence
  Synthetic
gaaatgaagcagttagggttttctcatgttctgattgggtacacagagtttcttttgaagtgaaaggtcctgatg

SEQ ID NO: 278884 - DNA, 75 bp, Artificial Sequence
  Synthetic
gtgcatcccaaattgaacattccaaaacagactgtgagccaagcttaaaacaaaaaacaaaaaaataaaaaaaca

SEQ ID NO: 278885 - DNA, 75 bp, Artificial Sequence
  Synthetic
tggggcaccctgtctttatccctggatgcagaaggcatcagcggaaccaacagcatcagctttctggaaagtagt

SEQ ID NO: 278886 - DNA, 75 bp, Artificial Sequence
  Synthetic
ctttagtggatccattcgcaattttccttaaaggatctcttcctcagactagaaatgggcaaacattcaccagca

SEQ ID NO: 278887 - DNA, 75 bp, Artificial Sequence
  Synthetic
cacaaaaaacataaataacaaaaaaacaacaaaaaacaaaaacaaaaaaacaaaaacaaaaacaaaaacattggc

SEQ ID NO: 278888 - DNA, 75 bp, Artificial Sequence
  Synthetic
tcacagctccacctgggcagcttgtctgcctgagtgtgtgtgagagtgtgttttttgtggtttcagtgttagtgt

SEQ ID NO: 278889 - DNA, 75 bp, Artificial Sequence
  Synthetic
ctattgtctattaatttggatgatcatgaaattatctttattaacaaagtgagaagctgtgatgcaacatttcta

SEQ ID NO: 278890 - DNA, 75 bp, Artificial Sequence
  Synthetic
gtttttgaatttttcttgttcttttcttggttgttggatttggatcacttcttatgattatatgtcttgatttag

SEQ ID NO: 278891 - DNA, 75 bp, Artificial Sequence
  Synthetic
cattgttaggggaagccagagcctatttcccagtaattctttggatgtaacctcgtattgtagctctaccagctt

SEQ ID NO: 278892 - DNA, 75 bp, Artificial Sequence
  Synthetic
atcaagggaacactggtttacatgggtgtctatgatttcagaaacaaaacaggtggttcttcaacagtagtaaat

SEQ ID NO: 278893 - DNA, 75 bp, Artificial Sequence
  Synthetic
gaataattctgactgacagcaatcatctcttttatcatgctccagtgctgtcataagtctgatcaattgtatgta

SEQ ID NO: 278894 - DNA, 75 bp, Artificial Sequence
  Synthetic
ctggttaggtgggcctatgaaggccataataaagattctgggctttattgccattggggttgtctgcttcatttt

SEQ ID NO: 278895 - DNA, 75 bp, Artificial Sequence
  Synthetic
ggcgatttctttctctatggcttggcctgtaaaaacatctgcaggaatgttcctaatagagagctctctcatcat

SEQ ID NO: 278896 - DNA, 75 bp, Artificial Sequence
  Synthetic
gcttttgtaagtgaacatcaatgagtcatccaatccaaggccttttccgattctacagatttgggtcgcaaagtc

SEQ ID NO: 278897 - DNA, 75 bp, Artificial Sequence
  Synthetic
acaaacacaaacaacccatatcaataagcataagaaacaatagaaatacaaaacacaacaaaacagtcggtgaga

SEQ ID NO: 278898 - DNA, 75 bp, Artificial Sequence
  Synthetic
acattttcgctcccagttcaactggtagccttccagtgttgagaactcaaagaatttcagagttggataagtgag

SEQ ID NO: 278899 - DNA, 75 bp, Artificial Sequence
  Synthetic
aagcataagaaacaatagaaatacaaaacacaacaaaacagtcggtgagacaaatcaaaaaaacaaaaaatacaa

SEQ ID NO: 278900 - DNA, 75 bp, Artificial Sequence
  Synthetic
aggccaggatagagccctcttaatgtttggctcacaccactttagtgcatctttaatgtctaacattgagattcg

SEQ ID NO: 278901 - DNA, 75 bp, Artificial Sequence
  Synthetic
aacaacaacaaaacacaggcgagacaaagcctggcagcatatatacagaaaccactcctcaactaggaaacaatc

SEQ ID NO: 278902 - DNA, 75 bp, Artificial Sequence
  Synthetic
accactcctcaactaggaaacaatcctcaaagcatgaaaagtgatcagtactcacgcacacttcacccatgcagt

SEQ ID NO: 278903 - DNA, 75 bp, Artificial Sequence
  Synthetic
tgctattgtgacatcaaagaatgatggagaagccctaatgacaagaccctgctcataaccccactccttaggcaa

SEQ ID NO: 278904 - DNA, 75 bp, Artificial Sequence
  Synthetic
atcataattatttaggaaagtaatcaatctatttttggcaataacagattgtctgagattatgcagtgggatctc

SEQ ID NO: 278905 - DNA, 75 bp, Artificial Sequence
  Synthetic
ccatcatacatctaatcatcttcaggtctcttgcaaggtgagagtgtagaaaacacagatattggttcactattc

SEQ ID NO: 278906 - DNA, 75 bp, Artificial Sequence
  Synthetic
catacctttgtaaagactgactggagcattgtggcgttttccaaatgggacaaagtccacggtcactcttttcaa

SEQ ID NO: 278907 - DNA, 75 bp, Artificial Sequence
  Synthetic
aaaacacagaaaaaaacaataaaatacaaaataaaacaacaaaaaaatgtaaaaaacataaaaacaaaacaaaaa

SEQ ID NO: 278908 - DNA, 75 bp, Artificial Sequence
  Synthetic
aaaaaacataaaaacaaaacaaaaaaacaaaaaaacaagaaaacaaaaaacgaacaaaaatcaaaagacattgac

SEQ ID NO: 278909 - DNA, 75 bp, Artificial Sequence
  Synthetic
gtgctcattacgggcaactcgcgagcataatagtttatgttggacatgacgaaaaaattcagggggtctttgtgt

SEQ ID NO: 278910 - DNA, 75 bp, Artificial Sequence
  Synthetic
acacaaagaagccctaaaatggataacatattaaaaaaacagatctttggtacagagcatttcataaatcctgag

SEQ ID NO: 278911 - DNA, 75 bp, Artificial Sequence
  Synthetic
ttaatacattatgatcacaacctgttcgcagtggacatacctgagtttgtcgtagacagagaaacaggaagagta

SEQ ID NO: 278912 - DNA, 75 bp, Artificial Sequence
  Synthetic
tttgtggttttctttgagagtgtttttgaggagttttttggttttccttgttttttattttgtgagtcagattgg

SEQ ID NO: 278913 - DNA, 75 bp, Artificial Sequence
  Synthetic
tgtattgacattgacttgaattcaatgaatcctgcttctactataggctcctcaatagagtctaagatatttgtc

SEQ ID NO: 278914 - DNA, 75 bp, Artificial Sequence
  Synthetic
caggataaagatcttcttaacttggttcatgacatctcttatgggcatctgtcagctgatactgacgtaaggttc

SEQ ID NO: 278915 - DNA, 75 bp, Artificial Sequence
  Synthetic
cattctaaatttggagttcttggcgatggatatgataatctcagccccgacatgattgttgagttgccgtctggc

SEQ ID NO: 278916 - DNA, 75 bp, Artificial Sequence
  Synthetic
aggatggttgtagttgagtttacgacgttcagaggaggagagagggggtgtcataatgcagccagagataagatc

SEQ ID NO: 278917 - DNA, 75 bp, Artificial Sequence
  Synthetic
tcaaaataccagatagcatgtgaaaacagaagccaaacagtccctctctcactatttgttttggcagtccacaag

SEQ ID NO: 278918 - DNA, 75 bp, Artificial Sequence
  Synthetic
gatggtgtgtggtccaatcttagattagcacaagaagatgttgatgagatagttttcagatttaggatgtcactg

SEQ ID NO: 278919 - DNA, 75 bp, Artificial Sequence
  Synthetic
tctatctatgaagaaattaggaaattgtgtcctgaggtcacaaatgatgactctgatctgtcaaagacggaacga

SEQ ID NO: 278920 - DNA, 75 bp, Artificial Sequence
  Synthetic
gaattgataggcacactaagcatgattgagatgaattggagcaagacagaaagcaagttcccctacttcaaagaa

SEQ ID NO: 278921 - DNA, 75 bp, Artificial Sequence
  Synthetic
gaattgttcttaaagtttaaagagtctcaaattgatgaagattacattggccaaataatatctgagtgtttgact

SEQ ID NO: 278922 - DNA, 75 bp, Artificial Sequence
  Synthetic
aaagcccaggacgggataataaaagattcattttttcaaaagggactctcaattgaggacaggaagtatctgaat

SEQ ID NO: 278923 - DNA, 75 bp, Artificial Sequence
  Synthetic
gtttctgagtgtgataccctcattaagagatatatagaagattatgacagacatgaaggtctcaggaatgtattc

SEQ ID NO: 278924 - DNA, 75 bp, Artificial Sequence
  Synthetic
gactcaaagtcaactatacagtttcctccctgggtgtacggagagtctgatgatggaaaaggtctggacagcttg

SEQ ID NO: 278925 - DNA, 75 bp, Artificial Sequence
  Synthetic
agaggtttaaaagttgaaggtaatcacccaatgatcagcatctgggagaaagtgatcagatctgcagaaacagaa

SEQ ID NO: 278926 - DNA, 75 bp, Artificial Sequence
  Synthetic
gaaatagagagaatgtatgatgatccagatgcggaactccaatatgcactctctggctcaattggaagagcagag

SEQ ID NO: 278927 - DNA, 75 bp, Artificial Sequence
  Synthetic
caaaagaacaaataccatagagtgagagtcatgctagatgaaaatgaaatggtttttgctgctacacttggggta

SEQ ID NO: 278928 - DNA, 75 bp, Artificial Sequence
  Synthetic
gagaacctatgagaagattcaaaacaactctattgttgactctgataatgatgactggaggaaatgcttgctcca

SEQ ID NO: 278929 - DNA, 75 bp, Artificial Sequence
  Synthetic
ggaggaaaaaaactcagggacaactacgcagtgaaagaaagtagagatagaagtaaaaaatgtttttctctaaat

SEQ ID NO: 278930 - DNA, 75 bp, Artificial Sequence
  Synthetic
catgacatatctcagcttgaggatttcatatcaaaagatcataaacatctatttaaggagtcacatgagctatgg

SEQ ID NO: 278931 - DNA, 75 bp, Artificial Sequence
  Synthetic
agcccacttagtgaagatgttcagctaaggctagcagcccaatcaatccatcagccgacgctcacaataaagcaa

SEQ ID NO: 278932 - DNA, 75 bp, Artificial Sequence
  Synthetic
ggaccaaatgaattcttgcaaaaccactgtagtcttctgagaacacctttcatgtcatggtgccaatttgtgtca

SEQ ID NO: 278933 - DNA, 75 bp, Artificial Sequence
  Synthetic
ctggtaggtgcagagctgtcagcgtctgtaaagcagcatgtgaaaccaaatcaatttgtcataaagaggctcaag

SEQ ID NO: 278934 - DNA, 75 bp, Artificial Sequence
  Synthetic
gattattattgatttgaacctcgactcattgaaccccaattcaactgtggggtcttctctaacctctgtgataga

SEQ ID NO: 278935 - DNA, 75 bp, Artificial Sequence
  Synthetic
gactctcctgtttttttactgataagacctacttcatcaaaaagtcacatctttgtgtcctttgccatagacaaa

SEQ ID NO: 278936 - DNA, 75 bp, Artificial Sequence
  Synthetic
tcatatcacatctgtgatgttgagagatcttcagtgtttaagcaatattatgatgctggagacatttttgtcaca

SEQ ID NO: 278937 - DNA, 75 bp, Artificial Sequence
  Synthetic
gactttgtgtcttttaagcttagcaagataaccaatctgtgtaagtgtcaaccacttatggagtcagcagtggca

SEQ ID NO: 278938 - DNA, 75 bp, Artificial Sequence
  Synthetic
accactttcagagggagtgaaagaggctgccttaatgccgcgaaagacaagtttgcaaagtaccaaatagcatgt

SEQ ID NO: 278939 - DNA, 75 bp, Artificial Sequence
  Synthetic
tactgggttgaatcatttgggttcaatccatgggaatctcagaagctactatcgtcagataggagtactggggtc

SEQ ID NO: 278940 - DNA, 75 bp, Artificial Sequence
  Synthetic
gagaacagatcaaggacggcaccggtttcactgtatgtcattgctgttcatagagatggattatggactaacatg

SEQ ID NO: 278941 - DNA, 75 bp, Artificial Sequence
  Synthetic
agggaatcaatgtcaatgataaaattatcattgttgactctcatggaagacaaatcagcaactgaagaattacaa

SEQ ID NO: 278942 - DNA, 75 bp, Artificial Sequence
  Synthetic
acaatgagtcaggacgaggtcaatgagttggtttttagatacaggatggcgctcagtatacatgaagaatcacgt

SEQ ID NO: 278943 - DNA, 75 bp, Artificial Sequence
  Synthetic
acactacagagatatgttatcatggaaggattcgtttcacaacctgagatgccgaagcctcacaaaatgttgagt

SEQ ID NO: 278944 - DNA, 75 bp, Artificial Sequence
  Synthetic
aagctgcccactactctacgttcagaacttcaagtctacttgttctggaggctgattaggactatgaaacgcata

SEQ ID NO: 278945 - DNA, 75 bp, Artificial Sequence
  Synthetic
gcacaaagcccattctgcatatccaaaaagcaaggacaaatctcttggagtaacttgttcaatcctctaacagga

SEQ ID NO: 278946 - DNA, 75 bp, Artificial Sequence
  Synthetic
aagtcatctttctttcaagaaggtctcactgcggaagataggagattcttgaataggtcagagtgtgacatcaaa

SEQ ID NO: 278947 - DNA, 75 bp, Artificial Sequence
  Synthetic
atcaatgaatttcttaaagcatttgatagagaagaagagttgagagacccatttgactctaagtcaacaattcag

SEQ ID NO: 278948 - DNA, 75 bp, Artificial Sequence
  Synthetic
aatgatgtgagatcattacaaccacttataagttcctgttataatggatatttcaaaaataaagaagaagagaca

SEQ ID NO: 278949 - DNA, 75 bp, Artificial Sequence
  Synthetic
gagccgtcatcactttctaaaatgtacaagaagatcatagaacttgaagacatgtgtccagatcatgatgatttt

SEQ ID NO: 278950 - DNA, 75 bp, Artificial Sequence
  Synthetic
ctgaagaggggaaaagtttaaccatattaaaagttttaaaggtggaaggtgagcacccaatggcaaggttctgga

SEQ ID NO: 278951 - DNA, 75 bp, Artificial Sequence
  Synthetic
ttaggttatgaagatccttatcgtccaggcatgcatgaattcagtaggagttatctaaagcagtgcacagaacat

SEQ ID NO: 278952 - DNA, 75 bp, Artificial Sequence
  Synthetic
gccaaatcgattctgaggaaaatgtatggacaaaatgttttagatcagatagataatcagataacacgagaggtt

SEQ ID NO: 278953 - DNA, 75 bp, Artificial Sequence
  Synthetic
cattgtctggagacataccaagagctgaacagaagaataagtaccacagagtgaaactcaatttatcttctgagg

SEQ ID NO: 278954 - DNA, 75 bp, Artificial Sequence
  Synthetic
gcttccattactttagaaagactggcaacattgaaggcgtccagcaattttgatgagtcatggtacatgtacaag

SEQ ID NO: 278955 - DNA, 75 bp, Artificial Sequence
  Synthetic
ccaggagtaagaaggccttttctattcaacatgacatctcaagattggaaaacttcttatatggagacagtagta

SEQ ID NO: 278956 - DNA, 75 bp, Artificial Sequence
  Synthetic
gacgtgaaggaaaaacaatattctagggaaaaggcaatagtcaagatgtcagagtatgctaagactgggaagaca

SEQ ID NO: 278957 - DNA, 75 bp, Artificial Sequence
  Synthetic
aaatgtttgaggcaaatgatgacttgttctgtccgcttgctgaggactttgaactaagaatgatggcacaagcga

SEQ ID NO: 278958 - DNA, 75 bp, Artificial Sequence
  Synthetic
ttggcattacaatgctttgaagagtgcatgtctaagatagaggaaagaggatgcatgcatatatgtctgttcaaa

SEQ ID NO: 278959 - DNA, 75 bp, Artificial Sequence
  Synthetic
ttcatcaaccaacaatgacgaaagatcagggcccaaatgaagtattgaggaatcatctaagattgttacataccc

SEQ ID NO: 278960 - DNA, 75 bp, Artificial Sequence
  Synthetic
aaacaacaacatggtggccttagagaaatatatgtgatgggagctgaggagaggatcgttcaatcaattgttgag

SEQ ID NO: 278961 - DNA, 75 bp, Artificial Sequence
  Synthetic
tctattgcaaagagcattgggaagtttttcccctcagacacactatgtaaccctggaaataagacaaaaatacca

SEQ ID NO: 278962 - DNA, 75 bp, Artificial Sequence
  Synthetic
gagacacacggtgtaagagcaagaatgcactgcaaggggtcagtgtggacatgtgccacctctgatgatgcccgc

SEQ ID NO: 278963 - DNA, 75 bp, Artificial Sequence
  Synthetic
atatcgatgcgggtgatctgttcatcacagattttgtttcttataaactgagcaaactaaccaatctctgcaagt

SEQ ID NO: 278964 - DNA, 75 bp, Artificial Sequence
  Synthetic
ttagtttacatgggtgtctatgatttcagaaacaaaacaggtggttcttcaacagtggtgaatccttcagaaggc

SEQ ID NO: 278965 - DNA, 75 bp, Artificial Sequence
  Synthetic
aagtggaaccagggtcattttgtcacaaagtttgctctgatgctctgtgaattcactcatcctaagtggtggcca

SEQ ID NO: 278966 - DNA, 75 bp, Artificial Sequence
  Synthetic
aaatttttggatagaagcatttaattatgcaatttgggattcaacaaaattacttgcaaccgacaggagcccagg

SEQ ID NO: 278967 - DNA, 75 bp, Artificial Sequence
  Synthetic
gtcatcattcgaggctgctccatgtttacaaacaagttcatgatgatgaacctccaatatatctcaatcctagat

SEQ ID NO: 278968 - DNA, 75 bp, Artificial Sequence
  Synthetic
cggcatagagaactcaatgtggaggatagttttgtgaatgacttattctttgcttatcatggtgagaagtcacaa

SEQ ID NO: 278969 - DNA, 75 bp, Artificial Sequence
  Synthetic
gcagacaatacagagatatgtaatgatggaagggtttgtctcacagccagaattgcctaagccacacaaaatgct

SEQ ID NO: 278970 - DNA, 75 bp, Artificial Sequence
  Synthetic
aagtggattgaaccagggtcaaccttcttaaagactaaaaccgggatgatgcaaggcatcttgcatttcacatca

SEQ ID NO: 278971 - DNA, 75 bp, Artificial Sequence
  Synthetic
caacaaagtccccggggtgctaaggtcagagttacaggtctttttattctggagagtgataaaatcaatgaagag

SEQ ID NO: 278972 - DNA, 75 bp, Artificial Sequence
  Synthetic
tctctgttgcacacaatccatcaggaatttgtgagatctctgaccttcaaaatattcaatttgaaagttcatccg

SEQ ID NO: 278973 - DNA, 75 bp, Artificial Sequence
  Synthetic
aatatctgagtctccctttttactctcaaaaagaaatggtcagataagttggagtggtttgttcaatcctctgtc

SEQ ID NO: 278974 - DNA, 75 bp, Artificial Sequence
  Synthetic
tcaaaaagaaatggtcagataagttggagtggtttgttcaatcctctgtctggcaatgatgtgagatctttgcaa

SEQ ID NO: 278975 - DNA, 75 bp, Artificial Sequence
  Synthetic
gaaatggcttatagcatagtgtgtgatatgatgcaaggatcagatgatagtagcatgatgataagctttcctgca

SEQ ID NO: 278976 - DNA, 75 bp, Artificial Sequence
  Synthetic
agagatgatattcacttctctaagtgtaagatggcagctgcactatgcttcaggataaaaaaactcctgggggtc

SEQ ID NO: 278977 - DNA, 75 bp, Artificial Sequence
  Synthetic
taccttgcaatttacccttctgaaaagtccacatcaaacacagattttgtcatggaatacaattcggaattttat

SEQ ID NO: 278978 - DNA, 75 bp, Artificial Sequence
  Synthetic
acatggcaaagacttgctcaaacgaatgtatgggcagaacttcatggaacagattgacagacagataactcgaga

SEQ ID NO: 278979 - DNA, 75 bp, Artificial Sequence
  Synthetic
tttcattctcagcatataagaccaacgattagatggattgcggcttgctgtagtttaccagaagttgagaccctt

SEQ ID NO: 278980 - DNA, 75 bp, Artificial Sequence
  Synthetic
atgtatgggcagaacttcatggaacagattgacagacagataactcgagaagttgcctctctaagcttagaaagg

SEQ ID NO: 278981 - DNA, 75 bp, Artificial Sequence
  Synthetic
gtctcgagacaagaagaggccacaaacctaatgactgcagttacggaaggaggagggtcctttgcattagctcat

SEQ ID NO: 278982 - DNA, 75 bp, Artificial Sequence
  Synthetic
attttaacgagtcatggtatgagtataaagacgtaaaagataagaattacactagagaaaaagtgctagtccgaa

SEQ ID NO: 278983 - DNA, 75 bp, Artificial Sequence
  Synthetic
tgcatccaacaggcacaatgcactctacattatattctcattgggatgggtttaagctcactgttcagtgagtac

SEQ ID NO: 278984 - DNA, 75 bp, Artificial Sequence
  Synthetic
aagaaggcgattctgaagtggaaagatcctggattaggattcttcttgctagataatccatactgttcaggccta

SEQ ID NO: 278985 - DNA, 75 bp, Artificial Sequence
  Synthetic
cgtgaaatatatgtcttgggggctgaagaaaggattgttcaaagcctaatagaaaccattgctaggagtataggt

SEQ ID NO: 278986 - DNA, 75 bp, Artificial Sequence
  Synthetic
ggtggatttagattcaacttgtttaaggcaatcacaagaacagagctgaaaaatctttactcattctttatgaag

SEQ ID NO: 278987 - DNA, 75 bp, Artificial Sequence
  Synthetic
aagaaaggattgttcaaagcctaatagaaaccattgctaggagtataggtaggttcttcccttctgatacactgt

SEQ ID NO: 278988 - DNA, 75 bp, Artificial Sequence
  Synthetic
aaaataagaagtgatgacgaggaggagggatttgcaagtaggtgtggagtgagtcctggtggagcaattgtttta

SEQ ID NO: 278989 - DNA, 75 bp, Artificial Sequence
  Synthetic
agctcagctctgaaatgggggtcaagacagaagtttgtgaagctccgagacagattgaatatcccagaaaactgg

SEQ ID NO: 278990 - DNA, 75 bp, Artificial Sequence
  Synthetic
ggacatgcgcaacatctgatgatgcgagaaaatggaaccaaggccactttgtgacaaaatttgcattaatgctat

SEQ ID NO: 278991 - DNA, 75 bp, Artificial Sequence
  Synthetic
cttgaaatgatcaatgaaaacccatctgttctttatagagcgccaaggacgggagaggaaataatcttaaggatt

SEQ ID NO: 278992 - DNA, 75 bp, Artificial Sequence
  Synthetic
gcagagaaggttcacagtccaggagttgtctcgtcattatcaacaggtaatgcagttgccaaggtcatggcttca

SEQ ID NO: 278993 - DNA, 75 bp, Artificial Sequence
  Synthetic
ttaaggcatatcatggagaggttccacagacatggatggacccaggaaagactttcattaagacaaagactggaa

SEQ ID NO: 278994 - DNA, 75 bp, Artificial Sequence
  Synthetic
tcagtgtactttctatcggccagcatcttccaagacacaggaagacaagaattttccatacttgacagaagcaag

SEQ ID NO: 278995 - DNA, 75 bp, Artificial Sequence
  Synthetic
tacagtctactacagaagatgatgcggtatgaatcctatttgtccaatgatggtctaaaagatgaagaattgctt

SEQ ID NO: 278996 - DNA, 75 bp, Artificial Sequence
  Synthetic
caagaatttgtgagatcgctaacctttaggatattcaacatgaaagtccatcctgaaatgtcatactcaatggtg

SEQ ID NO: 278997 - DNA, 75 bp, Artificial Sequence
  Synthetic
tttttatttcctaatatagatgagcttcagctccttgatcagcttgtctatgacagaggggaaatagatattgct

SEQ ID NO: 278998 - DNA, 75 bp, Artificial Sequence
  Synthetic
ccaaccataaggtggatagcagctagttgcagtctgccagaagttgagacactagtggcaagacaagaagaggcg

SEQ ID NO: 278999 - DNA, 75 bp, Artificial Sequence
  Synthetic
tataggatgagtcatagagaaaatacacagacaagagtgactgtgtttgaaggtcatcaaactttgagaatccct

SEQ ID NO: 279000 - DNA, 75 bp, Artificial Sequence
  Synthetic
gcagaaagtctagtctcagataaatggtttggcacgatgaagagcaaaataggagcaacagcttttgatcaggaa

SEQ ID NO: 279001 - DNA, 75 bp, Artificial Sequence
  Synthetic
atatagcatacaacaggctcagtgcactctgcactacatgctaatgggcatgggtgtcagttctctatttccaga

SEQ ID NO: 279002 - DNA, 75 bp, Artificial Sequence
  Synthetic
tggcatagactaaaagcaattattcactggctgaaagatgatcctgatgaaacactagaaaattctcccttatca

SEQ ID NO: 279003 - DNA, 75 bp, Artificial Sequence
  Synthetic
atttaagaaagctatagcaaaatggaaggatcctgggctaggtttcttcctacttgataatccatattgtgctgg

SEQ ID NO: 279004 - DNA, 75 bp, Artificial Sequence
  Synthetic
agccatgtgcagattcggaatttttttgctagaatggagaataagccaaggacagtgagagtcacaggagctcct

SEQ ID NO: 279005 - DNA, 75 bp, Artificial Sequence
  Synthetic
gtcaaaaagaggtcaggttctagcaaactatccatggttatcagagataatttttgtaaaaccggatttcttaga

SEQ ID NO: 279006 - DNA, 75 bp, Artificial Sequence
  Synthetic
gagttcagtgattcgcaggcaatgagtagaagtaatatagtagaaatactaaagcacttcatgttctgcatattg

SEQ ID NO: 279007 - DNA, 75 bp, Artificial Sequence
  Synthetic
caaggtccctacaccactgagactaaagaaatgcttgtcttaaaaatactaaagcaagctgatataataggcacc

SEQ ID NO: 279008 - DNA, 75 bp, Artificial Sequence
  Synthetic
tcagtattatatcgagcacccaggacatctgaagaaataatgctgaggatagcagagaaggtgcatagcccaggt

SEQ ID NO: 279009 - DNA, 75 bp, Artificial Sequence
  Synthetic
agcagagaaggtgcatagcccaggtgttgtgtcttctctgtcgacaggcaatgcagttgcaaaagtcatggcatc

SEQ ID NO: 279010 - DNA, 75 bp, Artificial Sequence
  Synthetic
agagactcagatgggaaatcaaggacaaacatattgtccatcattcagaattatgtcaattatgatcagagcata

SEQ ID NO: 279011 - DNA, 75 bp, Artificial Sequence
  Synthetic
atcagacaaatagaagatctcggagcaggaactattggaggctttctaatgccacagaagaccaaagctgaggaa

SEQ ID NO: 279012 - DNA, 75 bp, Artificial Sequence
  Synthetic
gtatagtttattgcagaagatgatggcttatgatggctttgagaataatcttgagttaacaatggaagatattct

SEQ ID NO: 279013 - DNA, 75 bp, Artificial Sequence
  Synthetic
aattccgtcttttattatggtaggggaatatggagaggagtcatggatggatcacaagtacagatagagatattc

SEQ ID NO: 279014 - DNA, 75 bp, Artificial Sequence
  Synthetic
ttgagttaacaatggaagatattcttttcttgttcccaaacattgatgatctgcagcagttagactgcatagtgt

SEQ ID NO: 279015 - DNA, 75 bp, Artificial Sequence
  Synthetic
aacaggttgggactacctcctcagataatggagatcacaactgatggcaaaacaagcatctgggaccttgcaagg

SEQ ID NO: 279016 - DNA, 75 bp, Artificial Sequence
  Synthetic
agcttaaaggtgtgggcagaggatataggagccaaaaatgatcaagatctttctgaaaaggtcagaaagaaaccc

SEQ ID NO: 279017 - DNA, 75 bp, Artificial Sequence
  Synthetic
aaattctggttatttggttttaaagcctttactgcagacaaaccgtttggatgtccagtatacgtgactgacggg

SEQ ID NO: 279018 - DNA, 75 bp, Artificial Sequence
  Synthetic
aaaatgacagacttcaggctaaggtcagatgaggaggtgaggtttaagattagaagatcaactattaatctgtat

SEQ ID NO: 279019 - DNA, 75 bp, Artificial Sequence
  Synthetic
tgattttgaagatatcagctcagccacaagagctttttcagtggaagttttaaaacattttttattttgcacact

SEQ ID NO: 279020 - DNA, 75 bp, Artificial Sequence
  Synthetic
gtcaagaattcgggaagggatgtccacatcatatcctacacagctcatgatggtgacataagccctgcatgtctt

SEQ ID NO: 279021 - DNA, 75 bp, Artificial Sequence
  Synthetic
acaagggccatactctgtgcagacaaaatatgatttgtgctataaaattttgagtgagtctgaagtcattggcat

SEQ ID NO: 279022 - DNA, 75 bp, Artificial Sequence
  Synthetic
agacaaagaagtgagttactagagagttctctcatactattcaataaagagccaagctgctcatgggtaacttgc

SEQ ID NO: 279023 - DNA, 75 bp, Artificial Sequence
  Synthetic
aagagaatcagatgggaaaaccagaacaaaccagttggcagtatttcaaaactttgtgaacagtgaccctgatat

SEQ ID NO: 279024 - DNA, 75 bp, Artificial Sequence
  Synthetic
cagtccctcccgcacgcatttgtacataagattttagacttaagtgaggggaaagtcactagaacctcaattgac

SEQ ID NO: 279025 - DNA, 75 bp, Artificial Sequence
  Synthetic
tcaagcagactatctaagataatacaggtgtgcactgaaaactccttaagagtgaaagttggaacagtgtattct

SEQ ID NO: 279026 - DNA, 75 bp, Artificial Sequence
  Synthetic
attgttgaaatctcttttgatggtaggattggaatatgggaagtgtgcagaagtattagatcttggtgtgaagat

SEQ ID NO: 279027 - DNA, 75 bp, Artificial Sequence
  Synthetic
gcattgccctctcataatgaagcatgctcaagtgttgatgtcgatgcattaatagggctgatgatagacgacatg

SEQ ID NO: 279028 - DNA, 75 bp, Artificial Sequence
  Synthetic
agtaaaaacaattttgatgcagctattgagatgatgagagaagaatctaatgtggaatacgatattgaagaattt

SEQ ID NO: 279029 - DNA, 75 bp, Artificial Sequence
  Synthetic
taaggaaatgcactatgaatctgttcttaaagaatggtggcagagacatacatatactaacgtacacagctcatg

SEQ ID NO: 279030 - DNA, 75 bp, Artificial Sequence
  Synthetic
gatgtttcagatattgatctatttggacctgctcactaccgggagacatcagaactaacaatgatttcacaccca

SEQ ID NO: 279031 - DNA, 75 bp, Artificial Sequence
  Synthetic
ctaatggatgattttataaatcaccttatatcaaaatgttcaaggaaagagattaggagatgtcttgaaaccaac

SEQ ID NO: 279032 - DNA, 75 bp, Artificial Sequence
  Synthetic
aacccagttcatcatgggcgggttgccagtctttgccattcgcctttgtgcataaagtcttagagttatgcagtg

SEQ ID NO: 279033 - DNA, 75 bp, Artificial Sequence
  Synthetic
aagtgtcagcaaaggtttctgtctcactttaaagacttatttagagcactaaatagagacccatcagagataagg

SEQ ID NO: 279034 - DNA, 75 bp, Artificial Sequence
  Synthetic
gagtactagtgagagatcacattgataacgaaaggctttctaagatagtacagttatgcactgagaactctttaa

SEQ ID NO: 279035 - DNA, 75 bp, Artificial Sequence
  Synthetic
gtagatgagctgtcatcagacagcaactcagatcttgacgatgacatgctagggtaattaagaatagaagccgtg

SEQ ID NO: 279036 - DNA, 75 bp, Artificial Sequence
  Synthetic
ggacaaaggtgggtactatctattcagccctaccaaatttctccgaagggagatcaataatagatgttgattcca

SEQ ID NO: 279037 - DNA, 75 bp, Artificial Sequence
  Synthetic
ccaaaagacgacaacccaaaaccccaaataatgccaatactcccggaccatgcaagaattaaaaaacaagccacc

SEQ ID NO: 279038 - DNA, 75 bp, Artificial Sequence
  Synthetic
ttgttgatttaatgatagaggatatggccaaggaagactttaacgatgctgttaaaatgatggaaacagaagaac

SEQ ID NO: 279039 - DNA, 75 bp, Artificial Sequence
  Synthetic
ctttaatcattaaacaaaagtatacagagtgacaacttcgattagtaatttagtaagatagggcggactttgtgt

SEQ ID NO: 279040 - DNA, 75 bp, Artificial Sequence
  Synthetic
acacaaagacggcacgatgatttttacaattttaaatgttttaacaagagccatgctcgtaatgagcatgtattc

SEQ ID NO: 279041 - DNA, 75 bp, Artificial Sequence
  Synthetic
agaaatgacatgtgcttttctaatgactcacctctagaaggcctagtttactactgggagacacactcaaaaagg

SEQ ID NO: 279042 - DNA, 75 bp, Artificial Sequence
  Synthetic
catgactataagaagcaagagtctcagagatgcagagttggagattcagacaaaaaaatgataactaatgtcaca

SEQ ID NO: 279043 - DNA, 75 bp, Artificial Sequence
  Synthetic
tcagatccggatgatgatttaatcggttagagctactaatcataaaaaagtgaataaccagagataataaaaaaa

SEQ ID NO: 279044 - DNA, 75 bp, Artificial Sequence
  Synthetic
ataatctctctgatttctgaaatacaaaaaagcatctctgagttgtcactatcatgtgtcaatgatgacaattct

SEQ ID NO: 279045 - DNA, 75 bp, Artificial Sequence
  Synthetic
caaaaaatagtattttaagcattgtaaaagatagtttgatttcatgattaacaatttagaaaaaatgggacggtc

SEQ ID NO: 279046 - DNA, 75 bp, Artificial Sequence
  Synthetic
actggacaagtcttaacattcaatggattagaagacacaatacgaggtgattacattgtagactgcgtgactggc

SEQ ID NO: 279047 - DNA, 75 bp, Artificial Sequence
  Synthetic
tagtattttaagcattgtaaaagatagtttgatttcatgattaacaatttagaaaaaatgggacggtctttgtgt

SEQ ID NO: 279048 - DNA, 75 bp, Artificial Sequence
  Synthetic
tggtcatcagcaaatgaaaaacaaagcagttgtaatagatgagaaagaaaggatgatatcactcctagagactca

SEQ ID NO: 279049 - DNA, 75 bp, Artificial Sequence
  Synthetic
aactgaagaatcaactgtcaaagaagcgaaatgagagaggccaggagaaaagagatgctgagaaggtgatgtcag

SEQ ID NO: 279050 - DNA, 75 bp, Artificial Sequence
  Synthetic
acttgatggccaggaattctgacttacggaagcataatgacattctcactgctgaaatatctcagatgaaaaata

SEQ ID NO: 279051 - DNA, 75 bp, Artificial Sequence
  Synthetic
aaaacacaatccaaagaaataaaaatacagtgagtactactgtagtcccagcaatactatcagtggccttactgt

SEQ ID NO: 279052 - DNA, 75 bp, Artificial Sequence
  Synthetic
gactgacagcaatcatctcttttatcatgctctaatgctgtcatgagtctgatcagttgtatgtaggcaatctct

SEQ ID NO: 279053 - DNA, 75 bp, Artificial Sequence
  Synthetic
aatccatggcctcatgcaaaaaatagagttggcacaggaatgtacaaatatgatgaaaatgatgactcaggctgt

SEQ ID NO: 279054 - DNA, 75 bp, Artificial Sequence
  Synthetic
gatggacaaataccctttctttaatgcattcataggtcacaaaactcccttagaatcttttgctgataaaataat

SEQ ID NO: 279055 - DNA, 75 bp, Artificial Sequence
  Synthetic
tgagaaagaagaagaaacatgtgagataggaacaaacaaagagtttaaatgtttcgaggagagagcttatataaa

SEQ ID NO: 279056 - DNA, 75 bp, Artificial Sequence
  Synthetic
ggggacatgtccgaccaacatcaatgcagtccattacattgacaataaaggcaaattgcgatatgtaaaatgtaa

SEQ ID NO: 279057 - DNA, 75 bp, Artificial Sequence
  Synthetic
ggaaaatctggaaatgactgaggattgtgctttctgtaggaaaatcaagaagaaagctggtcagtctgttcaggt

SEQ ID NO: 279058 - DNA, 75 bp, Artificial Sequence
  Synthetic
gcagaaaacttcagttccactccaggatgcaatttgtcaagaaaattcagacacttattctggaccaaagatacc

SEQ ID NO: 279059 - DNA, 75 bp, Artificial Sequence
  Synthetic
ctttaaaggggtttgcaaaattggtctaatcaaatataaagaatgcaagtttaaaacatcttcttatgagactgt

SEQ ID NO: 279060 - DNA, 75 bp, Artificial Sequence
  Synthetic
gggggggacaccaaagaccccctgaattttttcgtcatgtccaacataaactattatgctcgcgagttgcccgta

SEQ ID NO: 279061 - DNA, 75 bp, Artificial Sequence
  Synthetic
attttttcgtcatgtccaacataaactattatgctcgcgagttgcccgtaatgagcacttctccggaccagttga

SEQ ID NO: 279062 - DNA, 75 bp, Artificial Sequence
  Synthetic
ctcattcataacactcaaggagaaggggaagatttacattgagcacctaatgttgaaaaatatagaggtggttac

SEQ ID NO: 279063 - DNA, 75 bp, Artificial Sequence
  Synthetic
tgttgaaaaatatagaggtggttacgaatgtctcttttgtttgctacgaacatgtagggcaggatgagcaagagg

SEQ ID NO: 279064 - DNA, 75 bp, Artificial Sequence
  Synthetic
aaagagtgaccgtggactttgtcccatttggaaaacgccacaatgctccagtcagtctttacaaaggtatggaga

SEQ ID NO: 279065 - DNA, 75 bp, Artificial Sequence
  Synthetic
tcccactgcataatctcagacaatctgttattgccaaaaatagattgattactttcctaaataattatgatttgc

SEQ ID NO: 279066 - DNA, 75 bp, Artificial Sequence
  Synthetic
tggaacatagggctctgaagagagtatcagttaatgattgtaagattgtggacaactcaaagcagaaaatttgca

SEQ ID NO: 279067 - DNA, 75 bp, Artificial Sequence
  Synthetic
gacaactcaaagcagaaaatttgcacaggagatcacgttttctgtgaaaagtatgattgttccacatcctatcca

SEQ ID NO: 279068 - DNA, 75 bp, Artificial Sequence
  Synthetic
ctaaggagtggggttatgagcagggtcttgtcattagggcttctccatcattctttgatgtcacaatagcacgaa

SEQ ID NO: 279069 - DNA, 75 bp, Artificial Sequence
  Synthetic
tctcaatgttagacattaaagatgcactaaagtggtgtgagccaaacattaagagggctctatcctggcctctca

SEQ ID NO: 279070 - DNA, 75 bp, Artificial Sequence
  Synthetic
tagacagggaagtcaagcagccattgcttgcaccagaacagaactgtgacacctgtgtttcagagtgtctagatg

SEQ ID NO: 279071 - DNA, 75 bp, Artificial Sequence
  Synthetic
cttatccaactctgaaattctttgagttctcaacactggaaggctaccagttgaactgggagcgaaaatgtgact

SEQ ID NO: 279072 - DNA, 75 bp, Artificial Sequence
  Synthetic
acctgtgtttcagagtgtctagatgagggggtccatataaagtccactggttttgagataacatcagcagtagcc

SEQ ID NO: 279073 - DNA, 75 bp, Artificial Sequence
  Synthetic
agggggtccatataaagtccactggttttgagataacatcagcagtagcctgctcacatgggtcttgcatctcag

SEQ ID NO: 279074 - DNA, 75 bp, Artificial Sequence
  Synthetic
ttgcgacccaaatctgtagaatcggaaaaggccttggattggatgactcattgatgttcacttacaaaagcatga

SEQ ID NO: 279075 - DNA, 75 bp, Artificial Sequence
  Synthetic
ctcatcaagagccatccacatcagtaattgtcccatacccaggattgttggccagtgtgggcggaagaattggga

SEQ ID NO: 279076 - DNA, 75 bp, Artificial Sequence
  Synthetic
tgagagagctctctattaggaacattcctgcagatgtttttacaggccaagccatagagaaagaaatcgcctaca

SEQ ID NO: 279077 - DNA, 75 bp, Artificial Sequence
  Synthetic
ttcacctctcacatacttctgattctgctagtgtgcacatggtagtggtttgccctcctagagacagttgtgcag

SEQ ID NO: 279078 - DNA, 75 bp, Artificial Sequence
  Synthetic
tacaattgatcagacttatgacagcactggagcatgataaaagagatgattgctgtcagtcagaattattcaagc

SEQ ID NO: 279079 - DNA, 75 bp, Artificial Sequence
  Synthetic
tgccctcctagagacagttgtgcagctcataattgcttgctatgctatcatggcatcctaaattatcagtgccat

SEQ ID NO: 279080 - DNA, 75 bp, Artificial Sequence
  Synthetic
tggtagagctacaatacgaggttacatccaaagaattactgggaaataggctctggcttcccctaacaatgctaa

SEQ ID NO: 279081 - DNA, 75 bp, Artificial Sequence
  Synthetic
cctttctattaattctcttcatatacactgtcttttctgtgacgacaaatatattatatgtgctcagactaatac

SEQ ID NO: 279082 - DNA, 75 bp, Artificial Sequence
  Synthetic
atcaagacatataatcataagaagtgatccaaatccaacaaccaagaaaagaacaagaaaaattcaaaaacacac

SEQ ID NO: 279083 - DNA, 75 bp, Artificial Sequence
  Synthetic
taacactgaaaccacaaaaaacacactctcacacacactcaggcagacaagctgcccaggtggagctgtgagcca

SEQ ID NO: 279084 - DNA, 75 bp, Artificial Sequence
  Synthetic
atgtttttgtttttgtttttgtttttttgtttttgttttttgttgtttttttgttatttatgttttttgtgtgtt

SEQ ID NO: 279085 - DNA, 75 bp, Artificial Sequence
  Synthetic
tttttatttttttgttttttgttttaagcttggctcacagtctgttttggaatgttcaatttgggatgcacatgt

SEQ ID NO: 279086 - DNA, 75 bp, Artificial Sequence
  Synthetic
aactctattgttgactctgatcatgatgactggaggaaatgcttgctccaatacagtagtggctaactcaaagca

SEQ ID NO: 279087 - DNA, 75 bp, Artificial Sequence
  Synthetic
tgtctgggttgtattaaggcctttcgggtcctagagggatctgaagacttttgcagcactcacagttgaggatga

SEQ ID NO: 279088 - DNA, 75 bp, Artificial Sequence
  Synthetic
aaccagatgtgtacaggaaggatcaaacacaaagtgctcaatcactgcaactataactttaagggcaggtgtgat

SEQ ID NO: 279089 - DNA, 75 bp, Artificial Sequence
  Synthetic
aggcttcaggttgtcatttatgatcccaagagtcttcagcattgctcttctgttggcagatgtcaagaatgtgct

SEQ ID NO: 279090 - DNA, 75 bp, Artificial Sequence
  Synthetic
tggtgcagagtcgtgctttataataaaaggccctatggagaatcagcagaaaacaatatcaatcaaaactatctc

SEQ ID NO: 279091 - DNA, 75 bp, Artificial Sequence
  Synthetic
gctaattgcggcttgcattggtcgctcaaagctagaaactatttcatccttgcttagacctctcagtgaggggtt

SEQ ID NO: 279092 - DNA, 75 bp, Artificial Sequence
  Synthetic
cagtgagacagtatgcagagagggatcaagcttctggactagtttatatatcccatcatgtcttagctctaggag

SEQ ID NO: 279093 - DNA, 75 bp, Artificial Sequence
  Synthetic
gatagtcttagagaactgaatcatgaacaagcagtgagcttgggttatctcagacagcacatctgctgggagctc

SEQ ID NO: 279094 - DNA, 75 bp, Artificial Sequence
  Synthetic
ggcaataaatgccagtcgtggagagatgatcagctatctagggaattttcaggagtaaaggataaccatatcatg

SEQ ID NO: 279095 - DNA, 75 bp, Artificial Sequence
  Synthetic
ttgatcaattaaaccagcaaagctgggatgcatcattgctctaggataaccgctagatatggtatccatagctct

SEQ ID NO: 279096 - DNA, 75 bp, Artificial Sequence
  Synthetic
gccagtcactggcaagtactcctgaacataatcagcagcctgacatgtccaaccagcaaaagcagcagtgattct

SEQ ID NO: 279097 - DNA, 75 bp, Artificial Sequence
  Synthetic
ggagagagttaggtcatctcgagaaggattcccagatttgagcttgtacttcaaaactagctcattcaccattgc

SEQ ID NO: 279098 - DNA, 75 bp, Artificial Sequence
  Synthetic
tcttttgaggtaaaaggtcctgatggtgaaacagagctggtcacattgggaagtccaggcaccaagtttttaaac

SEQ ID NO: 279099 - DNA, 75 bp, Artificial Sequence
  Synthetic
cttgcccttgtctgacatcttgagaaccatcttgtttggcttgttacctctggtaagagagagaacaatcatctt

SEQ ID NO: 279100 - DNA, 75 bp, Artificial Sequence
  Synthetic
atgcagaaggcatcagcggaaccaacagcatcagctttctggaaagtagtaaaggaggatttgccttatacgatg

SEQ ID NO: 279101 - DNA, 75 bp, Artificial Sequence
  Synthetic
cttgacgtcctgcttccagtcctcacctccacgctctttcacaagagctatcactctctttgcatcaaatccctg

SEQ ID NO: 279102 - DNA, 75 bp, Artificial Sequence
  Synthetic
aaaggaggatttgccttatacgatgaaggctacaatgagataccaagagagggatttctaggtgagataaggtgt

SEQ ID NO: 279103 - DNA, 75 bp, Artificial Sequence
  Synthetic
tcactctctttgcatcaaatccctgataagcaaaatctgtcacccaaccggcaacagcttgctcatctatagact

SEQ ID NO: 279104 - DNA, 75 bp, Artificial Sequence
  Synthetic
aaactgaacggcaatctcctcgtatgacattttgtattaaataaattttcagggagctatgtgtcccccccccca

SEQ ID NO: 279105 - DNA, 75 bp, Artificial Sequence
  Synthetic
ctttagtggatccattcgcaattttccttaaaggatctcttcctcagactagaaatggacaaacattcaccagca

SEQ ID NO: 279106 - DNA, 75 bp, Artificial Sequence
  Synthetic
atcaagggaacattggtttgcatgggtgtctatgatttcagaaacaaaacaggtggctcttcaacagtagtaaac

SEQ ID NO: 279107 - DNA, 75 bp, Artificial Sequence
  Synthetic
gcagttgtgatagatgaaaaagaaagaatgatatcactcctagagactcaacaaagtgagaacgatataaaaatg

SEQ ID NO: 279108 - DNA, 75 bp, Artificial Sequence
  Synthetic
ccttcagaaggtgcctggagcatttcaaattggttttctggccttctagactggttaggtgggcctatgaaggcc

SEQ ID NO: 279109 - DNA, 75 bp, Artificial Sequence
  Synthetic
caagtactaatgtctgaaattgaacaactaaagaatcaactgtcaaagaagcgaaatgagagaggccaggagaag

SEQ ID NO: 279110 - DNA, 75 bp, Artificial Sequence
  Synthetic
ctggttaggtgggcctatgaaggccatactaaagattttgggctttattgccattgggattgtctgctttgtttt

SEQ ID NO: 279111 - DNA, 75 bp, Artificial Sequence
  Synthetic
aactaaagaatcaactgtcaaagaagcgaaatgagagaggccaggagaagagagatgctgagaaagtgatgtcag

SEQ ID NO: 279112 - DNA, 75 bp, Artificial Sequence
  Synthetic
acttgatggccaggaattctgacttacggaagcataatgatattctcactgctgaaatatctcagatgaaatata

SEQ ID NO: 279113 - DNA, 75 bp, Artificial Sequence
  Synthetic
gctgaaatatctcagatgaaatataataacacaatccaaagaagcaaaaatgtaatgagtactactgtagtccca

SEQ ID NO: 279114 - DNA, 75 bp, Artificial Sequence
  Synthetic
atgaagaccatccaatcccataagaaaaacataaacaacccacaccaacaagcataagaaacaataaaaatacaa

SEQ ID NO: 279115 - DNA, 75 bp, Artificial Sequence
  Synthetic
aacacaacaaaacaaacggcaagccaaatcaaaaatacaagacaacaacataacataggcaaacaaagcctggca

SEQ ID NO: 279116 - DNA, 75 bp, Artificial Sequence
  Synthetic
gcatatatgcagagaccactcctcaatcaggaaacaatcctcaaaacataaaaaaggaccggccctcatgcacac

SEQ ID NO: 279117 - DNA, 75 bp, Artificial Sequence
  Synthetic
ctttaaaggggtttgcaagattggtctaatcaaatataaagagtgcaagtttaaaacgtcttcttatgagactgt

SEQ ID NO: 279118 - DNA, 75 bp, Artificial Sequence
  Synthetic
ttcacccatgcagtctagtcatcatacatctagtcatcttcaggtctcctgcaaggtgagagtgtagaaagcaca

SEQ ID NO: 279119 - DNA, 75 bp, Artificial Sequence
  Synthetic
catgcaggtcaggatgagcaagaggtagaacacagggctctgaagagggtatcagttaatgattgtaagattgtg

SEQ ID NO: 279120 - DNA, 75 bp, Artificial Sequence
  Synthetic
gtgagagtgtagaaagcacagatgttggtttactgttcattttataaacttagtgagatgtgccggtctttgtgt

SEQ ID NO: 279121 - DNA, 75 bp, Artificial Sequence
  Synthetic
gggggggacacaaagaccccctgatttatttcacaatgtcaaaaaacaattattatgcattgcagataccttgtt

SEQ ID NO: 279122 - DNA, 75 bp, Artificial Sequence
  Synthetic
ttaccatgtcagtagggcctcttagccgacagtcagtccaatatgtgcctttcaataaacagtataattgtccag

SEQ ID NO: 279123 - DNA, 75 bp, Artificial Sequence
  Synthetic
tatccaattatagaggaatggaagtccctgttcaccacctgagacaatcatttgagtctaagcggaagctatcat

SEQ ID NO: 279124 - DNA, 75 bp, Artificial Sequence
  Synthetic
attttcttaaagattttcagatccctctcacctgggggagcatggattctcaagtcactcaaaaatctcctgagt

SEQ ID NO: 279125 - DNA, 75 bp, Artificial Sequence
  Synthetic
tctttgatacaaccatagataggatatcagaattggacattaagacttgtctacgatggtgtgagcctaatatta

SEQ ID NO: 279126 - DNA, 75 bp, Artificial Sequence
  Synthetic
agaaagccttgagctggcctcttgggtatccttccctaaagtttttttatcactcgcacgttgactcctattgtt

SEQ ID NO: 279127 - DNA, 75 bp, Artificial Sequence
  Synthetic
tcaattggagtaagaaatgtgattttgctacacagctgatgaggatgggaggaggcatgggattagacgactctc

SEQ ID NO: 279128 - DNA, 75 bp, Artificial Sequence
  Synthetic
tggtgcagagtcatgttttataataaaaggccctatggagaatcagcagaagacaatatcaatcaaaaccatctc

SEQ ID NO: 279129 - DNA, 75 bp, Artificial Sequence
  Synthetic
tactcttctcttactctaaaattgtaggtgaattatctctcagacagatcccatatgaggtgctcactggttaca

SEQ ID NO: 279130 - DNA, 75 bp, Artificial Sequence
  Synthetic
acatatctaaggagatagcttacatacaggttataaggatgctaactgccctagaatatgacctttctgatgact

SEQ ID NO: 279131 - DNA, 75 bp, Artificial Sequence
  Synthetic
gttgtcagtcaccattgtgccacatcctgttatcacagaagtctgtcatatcagagcagattttagggaataaga

SEQ ID NO: 279132 - DNA, 75 bp, Artificial Sequence
  Synthetic
agtggaaggtgataaaaagagaagaccaaacacacatgctgcctagaggggttggggacttgggaaggatgtaga

SEQ ID NO: 279133 - DNA, 75 bp, Artificial Sequence
  Synthetic
ttgttgatctcggttttatattttgtttgatttttttgtttttttgtttttgttttatttttgtttttttgtttt

SEQ ID NO: 279134 - DNA, 75 bp, Artificial Sequence
  Synthetic
ttattttggttttgttcatatttttttggttttttattttgttttattttgttactgttttttgtttttttactt

SEQ ID NO: 279135 - DNA, 75 bp, Artificial Sequence
  Synthetic
caacaatctggggatgtgatcggggactgggtggttgggcagactaaatcacaattttctgtaaactttggctgc

SEQ ID NO: 279136 - DNA, 75 bp, Artificial Sequence
  Synthetic
agctaccacagttggagaaggtttcagatttgagtttatcagaccaagagacatgagaatgtctctcctgtttcc

SEQ ID NO: 279137 - DNA, 75 bp, Artificial Sequence
  Synthetic
acaaacacaaacaacccatatcaacaagcataagaaataatagaaatacaaaacacaacaaaacaatcggctaga

SEQ ID NO: 279138 - DNA, 75 bp, Artificial Sequence
  Synthetic
aagcataagaaataatagaaatacaaaacacaacaaaacaatcggctagacaaatcaaaaaccaaaaaacacaaa

SEQ ID NO: 279139 - DNA, 75 bp, Artificial Sequence
  Synthetic
agcagtgaggaagggactgtttatggcagcctgcataggtcggtcaaaactggacacgacctcgctttttgagga

SEQ ID NO: 279140 - DNA, 75 bp, Artificial Sequence
  Synthetic
aagcctggcagcatatatacagaaaccactcctcaaccaggaaacaatcctcaaagcataaaaagtattcagtcc

SEQ ID NO: 279141 - DNA, 75 bp, Artificial Sequence
  Synthetic
tgatctcagagatggattgattgtcttagagaactgaatcatgaataagcaatgagcatgcacaatgtcttcgac

SEQ ID NO: 279142 - DNA, 75 bp, Artificial Sequence
  Synthetic
tcacgcacacttcacccatgcagtccagccatcatacatctaatcatcttcaggtctcttgcaaggtgagagtgt

SEQ ID NO: 279143 - DNA, 75 bp, Artificial Sequence
  Synthetic
cacgccttctggcagtgttgggtcaacaaggccagcgaagctgggatgcattagtgctctaggaaacttgtcaga

SEQ ID NO: 279144 - DNA, 75 bp, Artificial Sequence
  Synthetic
gtgagagtgtagaaaacacagatgttggttcactattcattttataattttagtgagatgtgccggtctttgtgt

SEQ ID NO: 279145 - DNA, 75 bp, Artificial Sequence
  Synthetic
tatagcatccattgccctgcctgttactggcagatagtcctgaacaacttcagctgcttggcaagtccaaccagc

SEQ ID NO: 279146 - DNA, 75 bp, Artificial Sequence
  Synthetic
ttctagtggagagatcatctagtaagataattattgatctaaacctcgactcattgaaccccaattcaactgtag

SEQ ID NO: 279147 - DNA, 75 bp, Artificial Sequence
  Synthetic
aaaagcagcggcaattcttgagagtgtgagatcattgcggcccggatttccagactttagcttgtacttgctgat

SEQ ID NO: 279148 - DNA, 75 bp, Artificial Sequence
  Synthetic
caagtcattcacaattttctgaccactctctgacatcttgtttagcatcttagatggcttattccctcttgttaa

SEQ ID NO: 279149 - DNA, 75 bp, Artificial Sequence
  Synthetic
tgaaaggacaatcatcttcttcacatcctccttccagtcatctcctcccctctgcttgaccaggttgatcacttg

SEQ ID NO: 279150 - DNA, 75 bp, Artificial Sequence
  Synthetic
tcttgcatcaaagccttgataagcaaactctgatacccatgctgcaattgttgtggcatcaacagattcactagc

SEQ ID NO: 279151 - DNA, 75 bp, Artificial Sequence
  Synthetic
atagagaagaagagttgagagacccatttgactctaagtcaacagttcagattcctccttgggtatttactgatg

SEQ ID NO: 279152 - DNA, 75 bp, Artificial Sequence
  Synthetic
ttcatcaaccaacaatgacgaaagatcagggcccaaatgaaatattgaagaatcatctaagattgttacacactc

SEQ ID NO: 279153 - DNA, 75 bp, Artificial Sequence
  Synthetic
cactagcaaactggattgcaatttcttcataagacatgtttgtaacttgtttgaaattttcagggagctatgtgt

SEQ ID NO: 279154 - DNA, 75 bp, Artificial Sequence
  Synthetic
acacaaagacggcacgatgatttttacaattttgaatattttaacaagagccatgctcgtgatgagcatgtattc

SEQ ID NO: 279155 - DNA, 75 bp, Artificial Sequence
  Synthetic
ccatgctcgtgatgagcatgtattctttaacaacatgggatagcaccagcagaaatgacatgtgcttctctaatg

SEQ ID NO: 279156 - DNA, 75 bp, Artificial Sequence
  Synthetic
taaagcacaccacgtcatggacattgagactggaaatgtatttaagtcttatatagatgcgggtgatctgttcat

SEQ ID NO: 279157 - DNA, 75 bp, Artificial Sequence
  Synthetic
gcaatactttcagtggccttactgtcatcatcagttgctcccattatggctgcgcctccagattcaccgatgatt

SEQ ID NO: 279158 - DNA, 75 bp, Artificial Sequence
  Synthetic
aatccatggcctcatgcaaaaaatagagttggaacagggatgtacaaatatgatgataatgatgactcaggctgt

SEQ ID NO: 279159 - DNA, 75 bp, Artificial Sequence
  Synthetic
agaccaatcagatatggagtttcatgcataggatttgactttatgctcaagatggacaaataccctttctttaat

SEQ ID NO: 279160 - DNA, 75 bp, Artificial Sequence
  Synthetic
atagggacaaacaaagagtttaaatgtttcgaggagagagcttacataaaggggacatgtccgactaacatcaat

SEQ ID NO: 279161 - DNA, 75 bp, Artificial Sequence
  Synthetic
cgtgaaatctatgtcttgggggctgaagaaaggattgttcaaagcttaatagaaactattgctaggagcataggc

SEQ ID NO: 279162 - DNA, 75 bp, Artificial Sequence
  Synthetic
ggggacatgtccgactaacatcaatgcagtccattacattgacaataaaggcaaattgcgatatgtgaaatgtaa

SEQ ID NO: 279163 - DNA, 75 bp, Artificial Sequence
  Synthetic
gcaaaaaacttcagtccctcttcaagatgcaatttgtcaggaaaattcagacaattattctggaccaaagatacc

SEQ ID NO: 279164 - DNA, 75 bp, Artificial Sequence
  Synthetic
ttaaaacgtcttcttatgagactgtctcattcataacactcaaggagaaagggaagatttatattgagcacctaa

SEQ ID NO: 279165 - DNA, 75 bp, Artificial Sequence
  Synthetic
ctcattcataacactcaaggagaaagggaagatttatattgagcacctaatgttgaaaaatatagaggtagttac

SEQ ID NO: 279166 - DNA, 75 bp, Artificial Sequence
  Synthetic
gggaagatttatattgagcacctaatgttgaaaaatatagaggtagttacgaatgtctcttttgtttgctacgaa

SEQ ID NO: 279167 - DNA, 75 bp, Artificial Sequence
  Synthetic
aaggatccagggctaggtttcttcctacttgataatccatattgtgctggcttgggaggttttaggttcaacctt

SEQ ID NO: 279168 - DNA, 75 bp, Artificial Sequence
  Synthetic
gatgagcagttggaggcttgtagcgttagcccaggcggtgcaataatattgagttcgtcacttaaatggggatct

SEQ ID NO: 279169 - DNA, 75 bp, Artificial Sequence
  Synthetic
caggagatcacgttttctgtgaaaagtatgattgttcgacatcttatccagatgttacttgtatccatgcgccag

SEQ ID NO: 279170 - DNA, 75 bp, Artificial Sequence
  Synthetic
gtatgattgttcgacatcttatccagatgttacttgtatccatgcgccaggatcaggaccattgtacataaatct

SEQ ID NO: 279171 - DNA, 75 bp, Artificial Sequence
  Synthetic
gatcaggaccattgtacataaatctcatgggctcatggataaaaccccaatgtgtgggctatgagagagtcttag

SEQ ID NO: 279172 - DNA, 75 bp, Artificial Sequence
  Synthetic
ttgacagggaagtcaagcagccactgcttgcaccagaacagaactgtgacacctgtgtttcagagtgtctagacg

SEQ ID NO: 279173 - DNA, 75 bp, Artificial Sequence
  Synthetic
agggggttcatataaagtccactggctttgagataacatcagcagtagcctgctcacatgggtcttgcatttcag

SEQ ID NO: 279174 - DNA, 75 bp, Artificial Sequence
  Synthetic
ctcatcaagaggcgtccacatcagtaattgtcccatacccaggattattggccagtgtgggcggaagaattggga

SEQ ID NO: 279175 - DNA, 75 bp, Artificial Sequence
  Synthetic
tcaacattaagtgctatcctgacttcctttctattaattctcttcatatatactgttttttctgtgacgacaaat

SEQ ID NO: 279176 - DNA, 75 bp, Artificial Sequence
  Synthetic
ggagtctggcgaggggtcatggatcccaaaatacagatagagatagataacaagcagggtcttccacctcacatc

SEQ ID NO: 279177 - DNA, 75 bp, Artificial Sequence
  Synthetic
caaaacagctaaagagtccagtgggatggctcaaactcttcatcaactggctgctaactgctctaagaatcaaaa

SEQ ID NO: 279178 - DNA, 75 bp, Artificial Sequence
  Synthetic
atggctcaaactcttcatcaactggctgctaactgctctaagaatcaaaactagaaatgttatggggaggataaa

SEQ ID NO: 279179 - DNA, 75 bp, Artificial Sequence
  Synthetic
ctgctaactgctctaagaatcaaaactagaaatgttatggggaggataaaccagagaataggatgggttgaccat

SEQ ID NO: 279180 - DNA, 75 bp, Artificial Sequence
  Synthetic
catgatgtagagagaccaaggcacagagaacctatgagaagattcaaaacaactctattgttaactctgataatg

SEQ ID NO: 279181 - DNA, 75 bp, Artificial Sequence
  Synthetic
atacagtagtagctaattcaaagcaaaccagatgtgtacaggaaggatcaaacacaaagtgctcaatcactgcaa

SEQ ID NO: 279182 - DNA, 75 bp, Artificial Sequence
  Synthetic
ggaaatgcaccatgaatctgttcttgaagaatggtggcagagatatacatatattgacgtacacagctcatgatg

SEQ ID NO: 279183 - DNA, 75 bp, Artificial Sequence
  Synthetic
tcccatcatgtcttagctctaggaggtgccatcttgttggtgattgtgtaggcaataaatgccagtcgtggagag

SEQ ID NO: 279184 - DNA, 75 bp, Artificial Sequence
  Synthetic
gtgccatcttgttggtgattgtgtaggcaataaatgccagtcgtggagagatgatcaactatctagggaattttc

SEQ ID NO: 279185 - DNA, 75 bp, Artificial Sequence
  Synthetic
atgatcaactatctagggaattttcaggagtaaaggataaccatattatgaacgaaaataaatgctttgaacagt

SEQ ID NO: 279186 - DNA, 75 bp, Artificial Sequence
  Synthetic
aggagtaaaggataaccatattatgaacgaaaataaatgctttgaacagtgtggcgcaattggttgtggttgctt

SEQ ID NO: 279187 - DNA, 75 bp, Artificial Sequence
  Synthetic
ctattgtctattaatttagatgatcatgaaattgtctttattaacaaagtgaaaagctgtgatgcaacatttcta

SEQ ID NO: 279188 - DNA, 75 bp, Artificial Sequence
  Synthetic
ggtgagagtatagaaaacacagatattggtttactgttcattttataaatttagtgagatgtgcggtctttgtgt

SEQ ID NO: 279189 - DNA, 75 bp, Artificial Sequence
  Synthetic
gatcttctctaacctctgtgatagagattccagagaagaatcttatgaacatggttcatgatataacttttggcc

SEQ ID NO: 279190 - DNA, 75 bp, Artificial Sequence
  Synthetic
tgatgactacaatgaaagtgagtcagatccggatgatgatttgatcggttagagctactaatcacaaaaaagtga

SEQ ID NO: 279191 - DNA, 75 bp, Artificial Sequence
  Synthetic
taatcacaaaaaagtgaataaccaaagacaataaaaaatcaaaaaataatactttaagcattgtaaaagatagtt

SEQ ID NO: 279192 - DNA, 75 bp, Artificial Sequence
  Synthetic
aaaacaaaaaaacaacaaaatataaaactaaacaacaaaaaacaaaaaaaacacaaaaacaaaacaaaaaaacag

SEQ ID NO: 279193 - DNA, 75 bp, Artificial Sequence
  Synthetic
aaaaacaaataaaacacaaaacgaacaaaaatcaaaaaaacattgactcacagtcccacctgggcagcttatctg

SEQ ID NO: 279194 - DNA, 75 bp, Artificial Sequence
  Synthetic
gccgattatcatcagaggctgctcaatgttcacaaacaagtacatgatgatgaatcttcagtatttgaggatcct

SEQ ID NO: 279195 - DNA, 75 bp, Artificial Sequence
  Synthetic
ccagatgtgtgtgagagtgtgtttgtggttttctttgagagtgtttttgaggagttttttggtttttcttgtttt

SEQ ID NO: 279196 - DNA, 75 bp, Artificial Sequence
  Synthetic
ggagttttttggtttttcttgtttttttattttgagagtcagattggggtttcatctctttgtggtttatatgtc

SEQ ID NO: 279197 - DNA, 75 bp, Artificial Sequence
  Synthetic
atttcacaaagattggttttctccgtgatttcgaagatataagctcagccacaagagctttctcagtggaagttt

SEQ ID NO: 279198 - DNA, 75 bp, Artificial Sequence
  Synthetic
tgatttcgaagatataagctcagccacaagagctttctcagtggaagttttaaaacattttttattttgcacact

SEQ ID NO: 279199 - DNA, 75 bp, Artificial Sequence
  Synthetic
cagattctgtttcccagtagttctttggatgtaacttcgtactgtaactctactaacttaaacaattctgactga

SEQ ID NO: 279200 - DNA, 75 bp, Artificial Sequence
  Synthetic
acaaggcccatactctgtgcagacaaaatttgatttgtgctataaaattttaagtgagtctgaagtcattggcat

SEQ ID NO: 279201 - DNA, 75 bp, Artificial Sequence
  Synthetic
aagagaatcagatgggaaaaccaggacaaaccagttggcagtgtttcaaaactttgtgaatggtgaccctgacat

SEQ ID NO: 279202 - DNA, 75 bp, Artificial Sequence
  Synthetic
aatacatcagattgagtcaataggagcaggaaccataggtggttttattataccacaaaagagcaaggaagtgtc

SEQ ID NO: 279203 - DNA, 75 bp, Artificial Sequence
  Synthetic
gcaggaaccataggtggttttattataccacaaaagagcaaggaagtgtctgggaaggtcttttattatggccgc

SEQ ID NO: 279204 - DNA, 75 bp, Artificial Sequence
  Synthetic
gttggtgtaaagaatgatgtagatatgtcaaaacgaagtagaagtggtgctagattttggctttatgactttaaa

SEQ ID NO: 279205 - DNA, 75 bp, Artificial Sequence
  Synthetic
gcattcacgcaagacaaaccatttggttgtcctgtctatgtgaccagcagtagaatgacagacttcagatctgta

SEQ ID NO: 279206 - DNA, 75 bp, Artificial Sequence
  Synthetic
gttgtcctgtctatgtgaccagcagtagaatgacagacttcagatctgtaagcaatgaagatgtaaaattcaaaa

SEQ ID NO: 279207 - DNA, 75 bp, Artificial Sequence
  Synthetic
tagaatgacagacttcagatctgtaagcaatgaagatgtaaaattcaaaataaggaaatgcactatgaatctgtt

SEQ ID NO: 279208 - DNA, 75 bp, Artificial Sequence
  Synthetic
atggagatctaagttctagcattttcaggagtccagatgactcagtctgcagattgaagaaacacttctcaaaag

SEQ ID NO: 279209 - DNA, 75 bp, Artificial Sequence
  Synthetic
aacagactgtgagccaagcttaaaacaaaaaacaaaaaaataaaaaaaccccccaaaaaacataaataacaaaaa

SEQ ID NO: 279210 - DNA, 75 bp, Artificial Sequence
  Synthetic
agcccagttcatcatgggcaagttgccagtctttgccattcgcctttgtgcataaagtcttagagttatgcagtg

SEQ ID NO: 279211 - DNA, 75 bp, Artificial Sequence
  Synthetic
acacaaagctccctgaaaatttacttaatacaaaatgtcatacgaggagattgccgttcagtttgcctctgagtc

SEQ ID NO: 279212 - DNA, 75 bp, Artificial Sequence
  Synthetic
agcaatgttgaagactcttgggatcataaatgacaacctgaagccctcatcttcaactgtgagtgctgcaaaagt

SEQ ID NO: 279213 - DNA, 75 bp, Artificial Sequence
  Synthetic
atgcattccaaattgaacattccaaacagactgtgagttaaacttaaaataaaaaacaaataaaaacaataaaaa

SEQ ID NO: 279214 - DNA, 75 bp, Artificial Sequence
  Synthetic
aaaaaacaaataaaaacaataaaaaacaaaaaacaaaacaaaaaaacaaaaaaacaaaaaaacaaaaacaaaaag

SEQ ID NO: 279215 - DNA, 75 bp, Artificial Sequence
  Synthetic
agagtgtgtttttgtagttttttgcgagagtgtttttgattttttcttttggttttggtgttggattgtagtcgt

SEQ ID NO: 279216 - DNA, 75 bp, Artificial Sequence
  Synthetic
tgctcattacgggcaactcgcgagcataatagtttatgttggacatgacgaaaaaattcaggggggtctttgtgt

SEQ ID NO: 279217 - DNA, 75 bp, Artificial Sequence
  Synthetic
acacaaagacagggcacgatgatttttacaattttaaatgttttaacaagagccatgctcgttatgagcatgtac

SEQ ID NO: 279218 - DNA, 75 bp, Artificial Sequence
  Synthetic
ccatgctcgtaatgagcatgtattctttaactacgtgggacagttccagcagaaatgacatgtgtttttctaatg

SEQ ID NO: 279219 - DNA, 75 bp, Artificial Sequence
  Synthetic
ataatctctctgatttctgaaatacaaaaaagcatctctgagttgtcactatcatgtggtaatgatgacaattct

SEQ ID NO: 279220 - DNA, 75 bp, Artificial Sequence
  Synthetic
gattggaagacacaatacgaggtgattacattgtagactgcgtgactggcttgtatcagtcagatattggagtcg

SEQ ID NO: 279221 - DNA, 75 bp, Artificial Sequence
  Synthetic
ttacattgtagactgcgtgactggcttgtatcagtcagatattggagtcggtgtggggttagggaggactcacca

SEQ ID NO: 279222 - DNA, 75 bp, Artificial Sequence
  Synthetic
gtgtggggttagggaggactcaccatgatcatcagcaagtgaaaaacaaagcagttgtgatagatgaaaaagaaa

SEQ ID NO: 279223 - DNA, 75 bp, Artificial Sequence
  Synthetic
gaatgatatcactcctagagactcaacaaagtgagaacgacataaagatgcaagtactaatgtctgagattgaac

SEQ ID NO: 279224 - DNA, 75 bp, Artificial Sequence
  Synthetic
agaaagctggtcagtctgttcaggtgcagaaaacttcagttccacttcaagatgcaatttgtcaagagaattcag

SEQ ID NO: 279225 - DNA, 75 bp, Artificial Sequence
  Synthetic
acaaatgtttcttttgtttgctatgaacatgcaggtcaagatgatgaacaagaggtagaacacagggccctgaag

SEQ ID NO: 279226 - DNA, 75 bp, Artificial Sequence
  Synthetic
acacttattctggaccaaagataccctttaaaggggtctgcaagattggtttaatcaaatataaagaatgcaagt

SEQ ID NO: 279227 - DNA, 75 bp, Artificial Sequence
  Synthetic
gtcagttaatgattgtaagattgtggacagctccaagcagaaaatttgcacaggagatcacgttttctgtgaaaa

SEQ ID NO: 279228 - DNA, 75 bp, Artificial Sequence
  Synthetic
aactctattgttgactctgataatgatgactggagggaatgcttgctccaatacagtagtagctaattcaaagca

SEQ ID NO: 279229 - DNA, 75 bp, Artificial Sequence
  Synthetic
agacaatatcaatcaaaaccatctctagtgagacagtttgcagggaggggtcaagcttctggactagtttatata

SEQ ID NO: 279230 - DNA, 75 bp, Artificial Sequence
  Synthetic
atgttctgattgggtacacagagtttcttttgaggtaaaaggtcctgatggtgaaacagagctggtcacattggg

SEQ ID NO: 279231 - DNA, 75 bp, Artificial Sequence
  Synthetic
gtgaaacagagctggtcacattgggaagcctaggcactaagtttttaaactggggcaccctgtctttatccctgg

SEQ ID NO: 279232 - DNA, 75 bp, Artificial Sequence
  Synthetic
tggtttaatcaagtacaagcccatgacagatcaaatagaatgtactgcatctttagtggatccattcgcaatttt

SEQ ID NO: 279233 - DNA, 75 bp, Artificial Sequence
  Synthetic
ctattgtctattaatttagatgatcatgaaattgtatttattaacaaagtgataagctgtgatgcaacatttcta

SEQ ID NO: 279234 - DNA, 75 bp, Artificial Sequence
  Synthetic
aatgttagtggttgctactcctgtgattatggagctcatgtctgtgtgaaagtcaaatcttcagagtcagctgat

SEQ ID NO: 279235 - DNA, 75 bp, Artificial Sequence
  Synthetic
gttttacattttcaaaaaccattagtagatgaaagactatcatattcttgtggatctgagcctaagctgatagtg

SEQ ID NO: 279236 - DNA, 75 bp, Artificial Sequence
  Synthetic
atcaagggaacattggtttacatgggtgtctatgatttcagaaacaaaacaggtggttcttcaacagtagtaaat

SEQ ID NO: 279237 - DNA, 75 bp, Artificial Sequence
  Synthetic
attcatgattctgatcagaattgcagtcaactcaataaacatcaagaagaaaaactagcaacaatgtaagtgcat

SEQ ID NO: 279238 - DNA, 75 bp, Artificial Sequence
  Synthetic
gtcaactcaataaacatcaagaagaaaaactagcaacaatgtaagtgcatacgaggaccatccaattccataaga

SEQ ID NO: 279239 - DNA, 75 bp, Artificial Sequence
  Synthetic
acaaacacaaacaacccatatcaacaagcgtaagaaacaatagaaatacaaaacacaacaaaacaatcggtaaga

SEQ ID NO: 279240 - DNA, 75 bp, Artificial Sequence
  Synthetic
caaatcaaaaaacaaaaaacacaaaacaacaacaaaacacaggcgaaacaaagcctggcagcatatatacagaaa

SEQ ID NO: 279241 - DNA, 75 bp, Artificial Sequence
  Synthetic
aagcctggcagcatatatacagaaaccactcctcaaccaagaaacaatcctcaaagcataaaaagtgatcagtct

SEQ ID NO: 279242 - DNA, 75 bp, Artificial Sequence
  Synthetic
gtgagagtgtggaaaacacagatgttggtttgctattcattttataatcttagtgagatgtgccggtctttgtgt

SEQ ID NO: 279243 - DNA, 75 bp, Artificial Sequence
  Synthetic
ttctagtggagagatcatctagtaagataattattgatttgaacctcgactcattgaaccccaattcaactgtag

SEQ ID NO: 279244 - DNA, 75 bp, Artificial Sequence
  Synthetic
gatcttctctaacctctgtgatagagataccagagaagaatcttatgaacatggttcatgatataacttttggcc

SEQ ID NO: 279245 - DNA, 75 bp, Artificial Sequence
  Synthetic
gctgtcatccaagtttggtatagttggtgatggctatgatcatctaagcccagacatgattgtcgaaacaacatc

SEQ ID NO: 279246 - DNA, 75 bp, Artificial Sequence
  Synthetic
ggtgatggctatgatcatctaagcccagacatgattgtcgaaacaacatcaggatcgtatattgttgttgagttc

SEQ ID NO: 279247 - DNA, 75 bp, Artificial Sequence
  Synthetic
cagacatgattgtcgaaacaacatcaggatcgtatattgttgttgagttcaccactttcagagggagtgagagag

SEQ ID NO: 279248 - DNA, 75 bp, Artificial Sequence
  Synthetic
gctgccttaatgctgcgaaagataagtttgcaaagtaccagatagcatgtgagaacagatcaaggacggcaccgg

SEQ ID NO: 279249 - DNA, 75 bp, Artificial Sequence
  Synthetic
atgatttttacaattttgaacgttttaacaagagccatgctcgtgatgagcatgtattctttaacaacatgggat

SEQ ID NO: 279250 - DNA, 75 bp, Artificial Sequence
  Synthetic
tgagagtatggaaaacttagttgttggtttactattcattttaataaatttagtgagatgtgccggtctttgtgt

SEQ ID NO: 279251 - DNA, 75 bp, Artificial Sequence
  Synthetic
tttcattgtatgtcatcgctgttcatagagatggattatggactaatatgacaatgagtcaggaagaggtcaatg

SEQ ID NO: 279252 - DNA, 75 bp, Artificial Sequence
  Synthetic
gtttgcaaagtaccagatagcatgtgagaacagatcaaggacggcaccggtttcattgtatgtcatcgctgttca

SEQ ID NO: 279253 - DNA, 75 bp, Artificial Sequence
  Synthetic
actcagcatacatgaagaatcacgtaagatctgcccagaactgacagatgatgattcagatctgtccaaggtaga

SEQ ID NO: 279254 - DNA, 75 bp, Artificial Sequence
  Synthetic
aaaagcggtttttgacaattttcatacatctccacctgatgagaactacatgagtcacataatatcaaaagaact

SEQ ID NO: 279255 - DNA, 75 bp, Artificial Sequence
  Synthetic
tgagtcacataatatcaaaagaactcgagagatctcaatctgatttactgaagtcatctttctttcaagaaggtc

SEQ ID NO: 279256 - DNA, 75 bp, Artificial Sequence
  Synthetic
aagtcatctttctttcaagaaggtctcactgcggaagatagaagattcttaaatagatcagagtgtgacatcaaa

SEQ ID NO: 279257 - DNA, 75 bp, Artificial Sequence
  Synthetic
tcactgcggaagatagaagattcttaaatagatcagagtgtgacatcaaaatcaatgaatttcttaaagcatttg

SEQ ID NO: 279258 - DNA, 75 bp, Artificial Sequence
  Synthetic
ggcatgttgtaagctctgcacaactggaggagattgatagaatgtatgatgatccagaagctgagttgcagtatg

SEQ ID NO: 279259 - DNA, 75 bp, Artificial Sequence
  Synthetic
tgatgtcagacttgatggccaggaattctgatttacggaagcataatgatattctcactgctgagatatctcaga

SEQ ID NO: 279260 - DNA, 75 bp, Artificial Sequence
  Synthetic
cactgtctggagacataccaagagcagagcagaagaataaataccacagagtaaaactcaacttatcttctgagg

SEQ ID NO: 279261 - DNA, 75 bp, Artificial Sequence
  Synthetic
aggatgagtacctggcaactctgggtataagtgggaagaagatgaaggatctagcatcagtcaaggagtccagag

SEQ ID NO: 279262 - DNA, 75 bp, Artificial Sequence
  Synthetic
aaatgtttgaggcaaatgatgacttgttctgcccgctttctgaggactttgaactaagaatgatggcacaagcga

SEQ ID NO: 279263 - DNA, 75 bp, Artificial Sequence
  Synthetic
caggacaatttataataaagagactgcttaattcaccattgataatggcagttaggcctacttcctccaagagtc

SEQ ID NO: 279264 - DNA, 75 bp, Artificial Sequence
  Synthetic
atatttttgtctcttttggattaattaaagcataccacgtcatggacattgagactggaaatgtatttaagtctt

SEQ ID NO: 279265 - DNA, 75 bp, Artificial Sequence
  Synthetic
taaagcataccacgtcatggacattgagactggaaatgtatttaagtcttatatcgatgcgggtgatctgttcat

SEQ ID NO: 279266 - DNA, 75 bp, Artificial Sequence
  Synthetic
gcagctcattgatggaatgttcatcaaatttttggatagaagcatttaattatgcaatttgggattcaacaaaat

SEQ ID NO: 279267 - DNA, 75 bp, Artificial Sequence
  Synthetic
aaatttttggatagaagcatttaattatgcaatttgggattcaacaaaattacttgcaaccgataggagcccggg

SEQ ID NO: 279268 - DNA, 75 bp, Artificial Sequence
  Synthetic
tgtaaaggaagcatctttcatgataaagctttcactactaacattattggaagacaaagctgtgactgaagaact

SEQ ID NO: 279269 - DNA, 75 bp, Artificial Sequence
  Synthetic
aagacaaagctgtgactgaagaactgcagacaatacagagatatataatgatggaagggtttgtctcacagccag

SEQ ID NO: 279270 - DNA, 75 bp, Artificial Sequence
  Synthetic
agctgcctaaaccacataaaatgctcaacaaagtccccggggtgctgaggtcagagctacaggtctttttattct

SEQ ID NO: 279271 - DNA, 75 bp, Artificial Sequence
  Synthetic
ggagggtgataaaatcaatgaagagaatatctgagtctccctttttactctcaaagagaaatggccagataagtt

SEQ ID NO: 279272 - DNA, 75 bp, Artificial Sequence
  Synthetic
tcaaagagaaatggccagataagttggagtggtttgttcaatcctctgtctggcaatgatgtgagatctttgcag

SEQ ID NO: 279273 - DNA, 75 bp, Artificial Sequence
  Synthetic
gcagtcataagctcttgttacaatggttattttaagaataaagaagaagaaactgagccatcatcgttatcaaag

SEQ ID NO: 279274 - DNA, 75 bp, Artificial Sequence
  Synthetic
aacatctttgcccagaagatgacaaatacttgggaatgagtgatccagaagatcctaaaatgcatgaatttagta

SEQ ID NO: 279275 - DNA, 75 bp, Artificial Sequence
  Synthetic
atacttgggaatgagtgatccagaagatcctaaaatgcatgaatttagtagaagctacttaaagcagagtatcct

SEQ ID NO: 279276 - DNA, 75 bp, Artificial Sequence
  Synthetic
atgtatgggcagaacttcatggaacagattgacagacagataactcgagaaattgcttctctaagcttggaaagg

SEQ ID NO: 279277 - DNA, 75 bp, Artificial Sequence
  Synthetic
agattgacagacagataactcgagaaattgcttctctaagcttggaaaggctggcaactttaaaggccactagca

SEQ ID NO: 279278 - DNA, 75 bp, Artificial Sequence
  Synthetic
attttaacgagtcatggtatgagtataaagacgtaaaagataagaattacactagagaaaaagtgctggtccgga

SEQ ID NO: 279279 - DNA, 75 bp, Artificial Sequence
  Synthetic
tgtcagaaattgccagagatggtaagactctagcagttcatgcatttaatgattgtatgaatgcagtagaggcca

SEQ ID NO: 279280 - DNA, 75 bp, Artificial Sequence
  Synthetic
gattgtatgaatgcagtagaggccagaggatgcatgcatatttgccttttcaagaagcagcagcatggtggattg

SEQ ID NO: 279281 - DNA, 75 bp, Artificial Sequence
  Synthetic
caagaagcagcagcatggtggattgcgtgaaatctatgtcttgggggctgaagaaaggattgttcaaagcttaat

SEQ ID NO: 279282 - DNA, 75 bp, Artificial Sequence
  Synthetic
cgtgaaatctatgtcttgggggctgaagaaaggattgttcaaagcttaatagaaaccattgctaggagtataggc

SEQ ID NO: 279283 - DNA, 75 bp, Artificial Sequence
  Synthetic
aggttcttcccttcagacacactgtgcaatcccaataacaaaatgaagattcctgaaagtcatggactaagagcc

SEQ ID NO: 279284 - DNA, 75 bp, Artificial Sequence
  Synthetic
gtgagttcacacatccaaagtggtggccgattatcatcagaggctgctcaatgttcacaaacaagtacatgatga

SEQ ID NO: 279285 - DNA, 75 bp, Artificial Sequence
  Synthetic
atgttcacaaacaagtacatgatgatgaatcttcagtatttgaggatccttgatagccatatggaacttaaggta

SEQ ID NO: 279286 - DNA, 75 bp, Artificial Sequence
  Synthetic
ttaaggcatatcatggagaggttccacagacatggatggatccaggaaagactttcattaagacaaagacaggaa

SEQ ID NO: 279287 - DNA, 75 bp, Artificial Sequence
  Synthetic
tagtagtagactccgcaagaagaagcaaacacagacaaatatgggaaaatctagtccagtttgtctgtatctgat

SEQ ID NO: 279288 - DNA, 75 bp, Artificial Sequence
  Synthetic
aacttaaaatggaatgtccgcatacaattgggttaggtcaaggccttgttgtaggctcagtagaactaccacctg

SEQ ID NO: 279289 - DNA, 75 bp, Artificial Sequence
  Synthetic
gaaattagaaagttcttgcaattttgatttgcataccagtacagcaggacaacaatcatttacaaagtggacatg

SEQ ID NO: 279290 - DNA, 75 bp, Artificial Sequence
  Synthetic
ggagacaaaaagtgatcttgcagaaaatacacaagcatcatcaacaagttttcagacaaaaagtagtgaggttaa

SEQ ID NO: 279291 - DNA, 75 bp, Artificial Sequence
  Synthetic
agaggacatattgtgtttcagggcagcttgttgaaggtgtctgctttaacccaatacatacaatggctctttccc

SEQ ID NO: 279292 - DNA, 75 bp, Artificial Sequence
  Synthetic
gcttgttgaaggtgtctgctttaacccaatacatacaatggctctttcccagcctagccatacttatgatatagt

SEQ ID NO: 279293 - DNA, 75 bp, Artificial Sequence
  Synthetic
gtcataaaaaaggtgacatctggtgatagtatgaagattgaaaaaaactttgagactcttgttcagaaaactggt

SEQ ID NO: 279294 - DNA, 75 bp, Artificial Sequence
  Synthetic
tgagactcttgttcagaaaactggttgtacagccaacagttttcaaggatactacatatgtcttgtgggaagtag

SEQ ID NO: 279295 - DNA, 75 bp, Artificial Sequence
  Synthetic
tgtacagccaacagttttcaaggatactacatatgtcttgtgggaagtagttcagaaccattgtatgttcctaca

SEQ ID NO: 279296 - DNA, 75 bp, Artificial Sequence
  Synthetic
ttttatcacgaatggcttttgcaccacatggagaagatcatgatatagaaaagaatgcaattagtgccttgcgta

SEQ ID NO: 279297 - DNA, 75 bp, Artificial Sequence
  Synthetic
accatctactgaatcatcagacacagttcaaggtattgcattttcaggtagtcctctttatacatctactggtgt

SEQ ID NO: 279298 - DNA, 75 bp, Artificial Sequence
  Synthetic
tatatttgggccccagggattatcatggaagggaaccactctgtctgtgaaaaaaagacactgcctttaacatgg

SEQ ID NO: 279299 - DNA, 75 bp, Artificial Sequence
  Synthetic
agttttttgtactttagcaggaccgggtgcagattgtgaggcatattctgagacaggtattttcaatataagttc

SEQ ID NO: 279300 - DNA, 75 bp, Artificial Sequence
  Synthetic
caaagattccgtggtgcagaacaacaaataaagtttgtctgtcaaagagtggacatggatatcactgtatattgc

SEQ ID NO: 279301 - DNA, 75 bp, Artificial Sequence
  Synthetic
aaataaagtttgtctgtcaaagagtggacatggatatcactgtatattgcaatggagtaaaaaaagtcatcctta

SEQ ID NO: 279302 - DNA, 75 bp, Artificial Sequence
  Synthetic
catttatacttttacaagcatcttttccttaatcccaggaattgcacattctcttgctgttgagctatgtgtgcc

SEQ ID NO: 279303 - DNA, 75 bp, Artificial Sequence
  Synthetic
ctcttgctgttgagctatgtgtgccaggccttcatggttgggctacagtattgcttttattaacattttgctttg

SEQ ID NO: 279304 - DNA, 75 bp, Artificial Sequence
  Synthetic
cataggaagagttgttctattggttcatgcccttattgtcttaatccatctgaagcaacaccgtctgctcttcag

SEQ ID NO: 279305 - DNA, 75 bp, Artificial Sequence
  Synthetic
gctcattttaaagtttgtaaattaacatcaaggtttcaggaaaatttaaaaaagtcactaacaatgtatgagcca

SEQ ID NO: 279306 - DNA, 75 bp, Artificial Sequence
  Synthetic
catcaaggtttcaggaaaatttaaaaaagtcactaacaatgtatgagccaatgcagggttgctatcgaacattgt

SEQ ID NO: 279307 - DNA, 75 bp, Artificial Sequence
  Synthetic
aaagtcactaacaatgtatgagccaatgcagggttgctatcgaacattgtctttgtttaggtatcgcagtagatt

SEQ ID NO: 279308 - DNA, 75 bp, Artificial Sequence
  Synthetic
ttgcttgttttagagctgattgtatgggctgctagtgcagaaacacaaaacttaaatgctggttggactgataca

SEQ ID NO: 279309 - DNA, 75 bp, Artificial Sequence
  Synthetic
gggctgctagtgcagaaacacaaaacttaaatgctggttggactgatacagcacatggatcagggattatcccga

SEQ ID NO: 279310 - DNA, 75 bp, Artificial Sequence
  Synthetic
ttcacttccatcatctgctagctatacctaccgaagacaattacagaacccggccaatgaacaagaaaaaatacc

SEQ ID NO: 279311 - DNA, 75 bp, Artificial Sequence
  Synthetic
attccatcttcagataagtaaacaggtaatccatgcagaaattcagcacttaggccattggatggatgctacatt

SEQ ID NO: 279312 - DNA, 75 bp, Artificial Sequence
  Synthetic
taggccattggatggatgctacatttaacttgaaaactgcttttcattgttatggttcatgtgaaaaatatgcct

SEQ ID NO: 279313 - DNA, 75 bp, Artificial Sequence
  Synthetic
tgttgagaaagattatgaatatgagactggttggggctgtaaccctcctgactgccctggtgtaggaacaggctg

SEQ ID NO: 279314 - DNA, 75 bp, Artificial Sequence
  Synthetic
aaattgaaatcagttggaaaggtctttaaaattgtgtctttaaggtatacaaggaaagtatgcattcaactaggc

SEQ ID NO: 279315 - DNA, 75 bp, Artificial Sequence
  Synthetic
ttaaaattgtgtctttaaggtatacaaggaaagtatgcattcaactaggcacagaacagacctgtaaaactgttg

SEQ ID NO: 279316 - DNA, 75 bp, Artificial Sequence
  Synthetic
acagtaatgattgcttgataactacatcagttaaagtgtgcttgataggaaccatttcgaaatttcaaccttctg

SEQ ID NO: 279317 - DNA, 75 bp, Artificial Sequence
  Synthetic
atcagttaaagtgtgcttgataggaaccatttcgaaatttcaaccttctgacacccttttatttcttggtcctct

SEQ ID NO: 279318 - DNA, 75 bp, Artificial Sequence
  Synthetic
caatggtgtaccactacatgtcaatttggcgatcctggagacataatgagcacaccgacaggaatgaagtgtcca

SEQ ID NO: 279319 - DNA, 75 bp, Artificial Sequence
  Synthetic
aatgtgcatttgcaacaacacctgtatgtcaatttgatggaaatacaatttcaggttataagcggatgattgcaa

SEQ ID NO: 279320 - DNA, 75 bp, Artificial Sequence
  Synthetic
atgtcaatttgatggaaatacaatttcaggttataagcggatgattgcaacaaaagattcttttcaatcatttaa

SEQ ID NO: 279321 - DNA, 75 bp, Artificial Sequence
  Synthetic
atagttcacttcgggatcacatcaatgtgattgtaagccgtgatttatcgttccaggatttgagtgaaacacctt

SEQ ID NO: 279322 - DNA, 75 bp, Artificial Sequence
  Synthetic
ttccaggatttgagtgaaacaccttgtcaaatagatttgacagcatcagctatagatggggcatggggttcagga

SEQ ID NO: 279323 - DNA, 75 bp, Artificial Sequence
  Synthetic
tttaacctcaattaaagcatgtgatgctgctatgtgttatggttctactacaaccaacttagttagagggcagaa

SEQ ID NO: 279324 - DNA, 75 bp, Artificial Sequence
  Synthetic
ggacattctggttcaaagttcatgtgctgtcatgatacgaaatgctctagcacagggttagtcgcagctgcacca

SEQ ID NO: 279325 - DNA, 75 bp, Artificial Sequence
  Synthetic
cacagggttagtcgcagctgcaccacatttaaatcgtgtgacagggtttaatcaggcagatagtgataagatttt

SEQ ID NO: 279326 - DNA, 75 bp, Artificial Sequence
  Synthetic
tcttcttatttgcattgtgttgtccgcgcaggcctagttataagaaagaacacaaaccttaaataacaattacta

SEQ ID NO: 279327 - DNA, 75 bp, Artificial Sequence
  Synthetic
ctataatcaccatatgactatctatgttctattattttatatcatgtatttcatttgatacctaactaatatata

SEQ ID NO: 279328 - DNA, 75 bp, Artificial Sequence
  Synthetic
gagcaacaacttgttgttgccagacaaaaactcaaggatgcagagagagcagtggaagtggacccggatgacgtt

SEQ ID NO: 279329 - DNA, 75 bp, Artificial Sequence
  Synthetic
aaaaactcaaggatgcagagagagcagtggaagtggacccggatgacgttaacaaaaacacactacaagcaaggc

SEQ ID NO: 279330 - DNA, 75 bp, Artificial Sequence
  Synthetic
aacaaacagtgtcagcattggaggataaactcgcagactacaagagaagaatggcagatgctgtgtcccggaaga

SEQ ID NO: 279331 - DNA, 75 bp, Artificial Sequence
  Synthetic
ccgtaaaagaaaataaaggaacacggatcaggttcaaggatgacacatcatttgaggatattaatggcatcagga

SEQ ID NO: 279332 - DNA, 75 bp, Artificial Sequence
  Synthetic
ggccaaaacatctatatgtatccatgcctacagctcagtccaccatgaaggctgaagaactcacacccggaaggt

SEQ ID NO: 279333 - DNA, 75 bp, Artificial Sequence
  Synthetic
ccctacacagatacaagtgcgtaacatcatgagtccagtgatgggagtgattggtttttctttctttgttaaaga

SEQ ID NO: 279334 - DNA, 75 bp, Artificial Sequence
  Synthetic
atcatgagtccagtgatgggagtgattggtttttctttctttgttaaagactggccagaaagaattagggagttt

SEQ ID NO: 279335 - DNA, 75 bp, Artificial Sequence
  Synthetic
gtatttacgttgctgggatggctgaattaggcgcatttttttctatcctacaagatatgaggaacactattatgg

SEQ ID NO: 279336 - DNA, 75 bp, Artificial Sequence
  Synthetic
agaaaaattaaagaagaaatcttccttctatcagtcatatttgcgccggacacaatcgatgggaattcaacttga

SEQ ID NO: 279337 - DNA, 75 bp, Artificial Sequence
  Synthetic
ttctatcagtcatatttgcgccggacacaatcgatgggaattcaacttgatcagaggataatcttactgtacatg

SEQ ID NO: 279338 - DNA, 75 bp, Artificial Sequence
  Synthetic
tactaactgtaggtatagtgtattactaatcctagattattccatatattcagggatttattgattaattgttta

SEQ ID NO: 279339 - DNA, 75 bp, Artificial Sequence
  Synthetic
aattattattatcagggttgtgagttaatgcactaatcagggtttaactggaattatacaattacaatcacatat

SEQ ID NO: 279340 - DNA, 75 bp, Artificial Sequence
  Synthetic
ttactaatgacagttatgaatgtaatatcatagtatatttttgtaatcaatatccaattagcattatatatgtat

SEQ ID NO: 279341 - DNA, 75 bp, Artificial Sequence
  Synthetic
aaggggcccaaaaaatgtgaaactgagctatccctttccttttcaccactatctctcttactttctacctcagtg

SEQ ID NO: 279342 - DNA, 75 bp, Artificial Sequence
  Synthetic
atctctcttactttctacctcagtgtacttatatatatgcaagtagcatatatataagtacacaacatactacct

SEQ ID NO: 279343 - DNA, 75 bp, Artificial Sequence
  Synthetic
tagtagtagactccttgaaaagctactacgagaaaaactggaatgagtgacttgacagatattcaagaggatatt

SEQ ID NO: 279344 - DNA, 75 bp, Artificial Sequence
  Synthetic
ctacgagaaaaactggaatgagtgacttgacagatattcaagaggatattacccgccatgaacaacagcttgttg

SEQ ID NO: 279345 - DNA, 75 bp, Artificial Sequence
  Synthetic
acccgccatgaacaacagcttgttgttgccaggcaaaaacttaaggatgcagagaaggcagtggaaatggacccg

SEQ ID NO: 279346 - DNA, 75 bp, Artificial Sequence
  Synthetic
gatgacgttaacaaaaacacactgcaagcaaggcaacagacagtgtcagcactggaagataaactcgcagacttc

SEQ ID NO: 279347 - DNA, 75 bp, Artificial Sequence
  Synthetic
aagcaaggcaacagacagtgtcagcactggaagataaactcgcagacttcaagcgaagaatggcagatgctgtgt

SEQ ID NO: 279348 - DNA, 75 bp, Artificial Sequence
  Synthetic
tactgatccaactgggattgagccagatgaccacctcaaggagcgatcaagcctgcgatatggaaatgtccttga

SEQ ID NO: 279349 - DNA, 75 bp, Artificial Sequence
  Synthetic
gatgaccacctcaaggagcgatcaagcctgcgatatggaaatgtccttgatgtgaatgccattgatatagaagaa

SEQ ID NO: 279350 - DNA, 75 bp, Artificial Sequence
  Synthetic
atacaattggagtgtatgtaatagggtttacactacctattatattgaaggccctatacatgctttctacacgtg

SEQ ID NO: 279351 - DNA, 75 bp, Artificial Sequence
  Synthetic
gtttacactacctattatattgaaggccctatacatgctttctacacgtgggagacaaactgtgaaggagaataa

SEQ ID NO: 279352 - DNA, 75 bp, Artificial Sequence
  Synthetic
gatacttcatttgaggatatcaatggcatcagacgaccaaagcacctctatgtatccatgcctacagcccaatct

SEQ ID NO: 279353 - DNA, 75 bp, Artificial Sequence
  Synthetic
gcatcagacgaccaaagcacctctatgtatccatgcctacagcccaatctaccatgaaagcagaagagcttacac

SEQ ID NO: 279354 - DNA, 75 bp, Artificial Sequence
  Synthetic
tggcttattccctacacaaattcaagtccggaatataatgagtccagtaatgggagtgattggcttctctttctt

SEQ ID NO: 279355 - DNA, 75 bp, Artificial Sequence
  Synthetic
gtccggaatataatgagtccagtaatgggagtgattggcttctctttctttgttaaggattgggcagacaggata

SEQ ID NO: 279356 - DNA, 75 bp, Artificial Sequence
  Synthetic
catttataaagccagaggttaaaccagggacaccaacacaagagattgaatttttgaagaaaaataaagtctact

SEQ ID NO: 279357 - DNA, 75 bp, Artificial Sequence
  Synthetic
agggacaccaacacaagagattgaatttttgaagaaaaataaagtctactttatggaccgccagaatgttctaga

SEQ ID NO: 279358 - DNA, 75 bp, Artificial Sequence
  Synthetic
aaattaattgactatgctgcctcaggggatccaacatcaccagataacattgaatcccctaatgcaccatgggtt

SEQ ID NO: 279359 - DNA, 75 bp, Artificial Sequence
  Synthetic
gggatccaacatcaccagataacattgaatcccctaatgcaccatgggtttttgcatgtgcacctgaccgatgtc

SEQ ID NO: 279360 - DNA, 75 bp, Artificial Sequence
  Synthetic
aatggcagaacttggtgcatttttttcaatcctgcaggatatgagaaatactataatggcctcaaagaccgtagg

SEQ ID NO: 279361 - DNA, 75 bp, Artificial Sequence
  Synthetic
tcaatcctgcaggatatgagaaatactataatggcctcaaagaccgtaggcaccgctgaagagaagcttaagaaa

SEQ ID NO: 279362 - DNA, 75 bp, Artificial Sequence
  Synthetic
tacggcggacacagtcaatgggaatccagcttgatcagaggattattctcttgtatatgcttgaatggggaaaag

SEQ ID NO: 279363 - DNA, 75 bp, Artificial Sequence
  Synthetic
ccagcttgatcagaggattattctcttgtatatgcttgaatggggaaaagagatggttgaccactttcatctggg

SEQ ID NO: 279364 - DNA, 75 bp, Artificial Sequence
  Synthetic
ggtcttgcccaggcactgattgatcagaaggtaaaggaaatatctaatcaggatccacttaagatatagaatagg

SEQ ID NO: 279365 - DNA, 75 bp, Artificial Sequence
  Synthetic
agaaggtaaaggaaatatctaatcaggatccacttaagatatagaataggtatagttaagtttacagatcagatt

SEQ ID NO: 279366 - DNA, 75 bp, Artificial Sequence
  Synthetic
tagaatgtatttagagatctactatgcactaatttgacttatacgggtattggcagcattatatcagggttaatg

SEQ ID NO: 279367 - DNA, 75 bp, Artificial Sequence
  Synthetic
gcactaatttgacttatacgggtattggcagcattatatcagggttaatgacattatcagggtttattaatcaat

SEQ ID NO: 279368 - DNA, 75 bp, Artificial Sequence
  Synthetic
aggcattatatccatattactcaggttaattataatgagaatactagtgataattatgaatgtatcatttattat

SEQ ID NO: 279369 - DNA, 75 bp, Artificial Sequence
  Synthetic
tataataggtataagtctatagtttatctttatttattgggcccaccaatgtgaaactgagctatcccctttctg

SEQ ID NO: 279370 - DNA, 75 bp, Artificial Sequence
  Synthetic
aagtagcatatatataagtacacaacatactacctcaacagactgatttcttgattgcttttcaaggagcatact

SEQ ID NO: 279371 - DNA, 75 bp, Artificial Sequence
  Synthetic
tagtagtagactccgcaagaagaagcaactacagagaaatatgggaaaaattattccagtttgtctgtacttgct

SEQ ID NO: 279372 - DNA, 75 bp, Artificial Sequence
  Synthetic
caactacagagaaatatgggaaaaattattccagtttgtctgtacttgctcttcttgtgtctgctactatggaat

SEQ ID NO: 279373 - DNA, 75 bp, Artificial Sequence
  Synthetic
ttattccagtttgtctgtacttgctcttcttgtgtctgctactatggaatagaggagatgccagaaacctaaatg

SEQ ID NO: 279374 - DNA, 75 bp, Artificial Sequence
  Synthetic
aattggtttgggtcagggcctagttattggatcagttgaattaccacctgttccattaacacaggtggagtcttt

SEQ ID NO: 279375 - DNA, 75 bp, Artificial Sequence
  Synthetic
attggatcagttgaattaccacctgttccattaacacaggtggagtctttaaaactggaaagttcatgtaatttt

SEQ ID NO: 279376 - DNA, 75 bp, Artificial Sequence
  Synthetic
aacagtcattcacaaaatggacatgggagataaaaaatgacctggcagaaaatacacaggcatcatctacaagtt

SEQ ID NO: 279377 - DNA, 75 bp, Artificial Sequence
  Synthetic
ggagataaaaaatgacctggcagaaaatacacaggcatcatctacaagttttcaaacaaagagcagtgaaataaa

SEQ ID NO: 279378 - DNA, 75 bp, Artificial Sequence
  Synthetic
ccattggtgattgagactgctgcaagaacccgaaaaacaatagcatgttttgatttgtcttgtaatcagacagca

SEQ ID NO: 279379 - DNA, 75 bp, Artificial Sequence
  Synthetic
gaacccgaaaaacaatagcatgttttgatttgtcttgtaatcagacagcatgccagcctactgtttttctaatag

SEQ ID NO: 279380 - DNA, 75 bp, Artificial Sequence
  Synthetic
aaaaagttgccttttaggtttaggtgatcagagaattcaagttaattatgaaaaaacatattgtgtttcaggtca

SEQ ID NO: 279381 - DNA, 75 bp, Artificial Sequence
  Synthetic
gatcagagaattcaagttaattatgaaaaaacatattgtgtttcaggtcagcttgttgaaggtgtctgttttaat

SEQ ID NO: 279382 - DNA, 75 bp, Artificial Sequence
  Synthetic
aacccagccatacatatgatatagtgacagtgatggtgcgttgttttttaattgtaaagaaggtttcaacaggtg

SEQ ID NO: 279383 - DNA, 75 bp, Artificial Sequence
  Synthetic
gacagtgatggtgcgttgttttttaattgtaaagaaggtttcaacaggtgatagtatgaagcttgaaaaaagctt

SEQ ID NO: 279384 - DNA, 75 bp, Artificial Sequence
  Synthetic
tgtacaggcaatggttttcaaggttattatgtctgtttggtaggaagcagttctgagccactatatattcctaca

SEQ ID NO: 279385 - DNA, 75 bp, Artificial Sequence
  Synthetic
attatgtctgtttggtaggaagcagttctgagccactatatattcctacattggatgattacaggtcagctgaga

SEQ ID NO: 279386 - DNA, 75 bp, Artificial Sequence
  Synthetic
acatggggaagatcatgatgttgaaaagaatgctattagtgcaatgagaattgttgggaaagtgacaggcaaagc

SEQ ID NO: 279387 - DNA, 75 bp, Artificial Sequence
  Synthetic
aagaatgctattagtgcaatgagaattgttgggaaagtgacaggcaaagcaccatcaactgagtcatctgataca

SEQ ID NO: 279388 - DNA, 75 bp, Artificial Sequence
  Synthetic
accctctttatacatcaactggggtcttaacagcaaaggatgatcctgtatacatttgggcacctggaattataa

SEQ ID NO: 279389 - DNA, 75 bp, Artificial Sequence
  Synthetic
cttaacagcaaaggatgatcctgtatacatttgggcacctggaattataatggaaggaaaccactctgtttgtga

SEQ ID NO: 279390 - DNA, 75 bp, Artificial Sequence
  Synthetic
actggtttcataccattaccaggagaaattgagaagacaacacagtgtacagtattctgtacattagctggacct

SEQ ID NO: 279391 - DNA, 75 bp, Artificial Sequence
  Synthetic
aaattgagaagacaacacagtgtacagtattctgtacattagctggacctggtgcagattgtgaagcatattctg

SEQ ID NO: 279392 - DNA, 75 bp, Artificial Sequence
  Synthetic
tccaacctgcttaattaaccgtgtgcagagattccgtggtgctgaacagcaaatcaaattcatttgtcagagggt

SEQ ID NO: 279393 - DNA, 75 bp, Artificial Sequence
  Synthetic
cagagattccgtggtgctgaacagcaaatcaaattcatttgtcagagggttgatatggacattacagtatactgt

SEQ ID NO: 279394 - DNA, 75 bp, Artificial Sequence
  Synthetic
ccaaaactttagtcattggacagtgtatttatacttttacaagcattttctctttaatccctggagttgctcact

SEQ ID NO: 279395 - DNA, 75 bp, Artificial Sequence
  Synthetic
tatttatacttttacaagcattttctctttaatccctggagttgctcactcactagctgtagaattatgtgtgcc

SEQ ID NO: 279396 - DNA, 75 bp, Artificial Sequence
  Synthetic
ctacttttattaacattttgctttgggtggatcttaataccatttttttctatgatattattaaaaattctaatt

SEQ ID NO: 279397 - DNA, 75 bp, Artificial Sequence
  Synthetic
ggtggatcttaataccatttttttctatgatattattaaaaattctaattgcatttgcttacttatgctcaaagt

SEQ ID NO: 279398 - DNA, 75 bp, Artificial Sequence
  Synthetic
actaatagagaaggttaaaagagaatatcaaaaaactatgggctccatggtatgtgaggtttgtcaatatgagtg

SEQ ID NO: 279399 - DNA, 75 bp, Artificial Sequence
  Synthetic
tatcaaaaaactatgggctccatggtatgtgaggtttgtcaatatgagtgtgaaactgcaaaggaactagagtca

SEQ ID NO: 279400 - DNA, 75 bp, Artificial Sequence
  Synthetic
catgtccatattgtctgaatcctgctgaagcaacaacatctgctttacaggcccattttaaggtgtgtaaactca

SEQ ID NO: 279401 - DNA, 75 bp, Artificial Sequence
  Synthetic
tgaagcaacaacatctgctttacaggcccattttaaggtgtgtaaactcacatcaaggtttcaggacaatctaag

SEQ ID NO: 279402 - DNA, 75 bp, Artificial Sequence
  Synthetic
aaacagggttgttacaggacattgtctctttttcgctatagaagcaggttttttgtgggttttaattggtgtttg

SEQ ID NO: 279403 - DNA, 75 bp, Artificial Sequence
  Synthetic
ctctttttcgctatagaagcaggttttttgtgggttttaattggtgtttgttgttagttttggaattaattgtgt

SEQ ID NO: 279404 - DNA, 75 bp, Artificial Sequence
  Synthetic
tttaaattctggatggacagatacagcacatggatctggaataatacctatgagaactgaccttgaactagattt

SEQ ID NO: 279405 - DNA, 75 bp, Artificial Sequence
  Synthetic
gcacatggatctggaataatacctatgagaactgaccttgaactagatttttctcttccatcttctgcaagttat

SEQ ID NO: 279406 - DNA, 75 bp, Artificial Sequence
  Synthetic
cagcaaatgagcaagaaaaaataccattccacttgcaaataagtaaacaggtaattcatgcagaaattcaacatt

SEQ ID NO: 279407 - DNA, 75 bp, Artificial Sequence
  Synthetic
attccacttgcaaataagtaaacaggtaattcatgcagaaattcaacatttaggtcactggatggatggcacatt

SEQ ID NO: 279408 - DNA, 75 bp, Artificial Sequence
  Synthetic
tatggctcttgtgaaaagtatgcatatccttggcaaacagcaggttgttttatagaaaaagattatgagtatgaa

SEQ ID NO: 279409 - DNA, 75 bp, Artificial Sequence
  Synthetic
atccttggcaaacagcaggttgttttatagaaaaagattatgagtatgaaagtggctggggatgtaacccacctg

SEQ ID NO: 279410 - DNA, 75 bp, Artificial Sequence
  Synthetic
tacagcctgtggtgtgtatttagataagctaaaatccgtgggtaaagcattcaaaattgtgtctttgaggtacac

SEQ ID NO: 279411 - DNA, 75 bp, Artificial Sequence
  Synthetic
aagctaaaatccgtgggtaaagcattcaaaattgtgtctttgaggtacacaaggaaagcatgtatccaacttggc

SEQ ID NO: 279412 - DNA, 75 bp, Artificial Sequence
  Synthetic
atagtaatgattgcttggtgactacatcagtcaaggtatgtttaattggaactgtgtcaaaatttcaaccatcag

SEQ ID NO: 279413 - DNA, 75 bp, Artificial Sequence
  Synthetic
atcagtcaaggtatgtttaattggaactgtgtcaaaatttcaaccatcagatactctattatttttaggtccact

SEQ ID NO: 279414 - DNA, 75 bp, Artificial Sequence
  Synthetic
caatggtgtactacaacatgtcaattcggtgatccaggggatataatgagcactccggtagggatgaagtgccct

SEQ ID NO: 279415 - DNA, 75 bp, Artificial Sequence
  Synthetic
tcggtgatccaggggatataatgagcactccggtagggatgaagtgccctgaattgagcggttcattcagaaaaa

SEQ ID NO: 279416 - DNA, 75 bp, Artificial Sequence
  Synthetic
ttgtcaatttgatgggaatactctttctgggtacaaaagaatgattgcaacaaaggattcatttcaatcattcaa

SEQ ID NO: 279417 - DNA, 75 bp, Artificial Sequence
  Synthetic
tctgggtacaaaagaatgattgcaacaaaggattcatttcaatcattcaatgttacagaaccccatatttctgca

SEQ ID NO: 279418 - DNA, 75 bp, Artificial Sequence
  Synthetic
atagttctttgagagatcatattaatgttattgtaggccgtgatctctcttttcaagacctgagtgaaacaccct

SEQ ID NO: 279419 - DNA, 75 bp, Artificial Sequence
  Synthetic
tgttattgtaggccgtgatctctcttttcaagacctgagtgaaacaccctgtcaagtagatttagcaacaacatc

SEQ ID NO: 279420 - DNA, 75 bp, Artificial Sequence
  Synthetic
gtgggttttaacttagtttgttctgtgagcctgacagagtgttctacatttttaacttcaatcaaggcatgtgac

SEQ ID NO: 279421 - DNA, 75 bp, Artificial Sequence
  Synthetic
tgagcctgacagagtgttctacatttttaacttcaatcaaggcatgtgactcagcaatgtgttatggttctacaa

SEQ ID NO: 279422 - DNA, 75 bp, Artificial Sequence
  Synthetic
tacagttcatattgtgggaaaaggtggacattctgggtctaaatttatgtgttgtcatgatacgaagtgctcaag

SEQ ID NO: 279423 - DNA, 75 bp, Artificial Sequence
  Synthetic
ggacattctgggtctaaatttatgtgttgtcatgatacgaagtgctcaagtactgggttggttgcagctgcacca

SEQ ID NO: 279424 - DNA, 75 bp, Artificial Sequence
  Synthetic
accaagcagatagtgataagatctttgatgatggtgcccctgaatgtggtatatcttgctggttcacaaaatcag

SEQ ID NO: 279425 - DNA, 75 bp, Artificial Sequence
  Synthetic
tgatgatggtgcccctgaatgtggtatatcttgctggttcacaaaatcaggagaatggattcttggagttttgaa

SEQ ID NO: 279426 - DNA, 75 bp, Artificial Sequence
  Synthetic
ctaatagcattattcatattctccatcttcctctttacattgtgttgtccacgaaggcctagttatgcaaaagaa

SEQ ID NO: 279427 - DNA, 75 bp, Artificial Sequence
  Synthetic
tcttcctctttacattgtgttgtccacgaaggcctagttatgcaaaagaacataaaccttaaacaaaagcagtta

SEQ ID NO: 279428 - DNA, 75 bp, Artificial Sequence
  Synthetic
ataatgctagtgtataaatcccctcacttctttgcttcatatcttatttagtatattacactcgatcattatata

SEQ ID NO: 279429 - DNA, 75 bp, Artificial Sequence
  Synthetic
gaaaaaaaactagctctttactaattaaattattccataccgattatgcctggacttttgttcctgcggagcata

SEQ ID NO: 279430 - DNA, 75 bp, Artificial Sequence
  Synthetic
tagtagtagactccttgaagagctactacgaaaaaaactgggatgagtgacttgacagacattcaggaggatata

SEQ ID NO: 279431 - DNA, 75 bp, Artificial Sequence
  Synthetic
cttgacagacattcaggaggatataacccgccatgaacaacagcttgttgttgccagacaaaagctcaaggatgc

SEQ ID NO: 279432 - DNA, 75 bp, Artificial Sequence
  Synthetic
acccgccatgaacaacagcttgttgttgccagacaaaagctcaaggatgcagaaaaggcggtggagatggaccca

SEQ ID NO: 279433 - DNA, 75 bp, Artificial Sequence
  Synthetic
aagcaaggcaacagacagtgtcagcactggaagacaaacttgcagacttcaagcgacaaatggcagatgctgtct

SEQ ID NO: 279434 - DNA, 75 bp, Artificial Sequence
  Synthetic
actggaagacaaacttgcagacttcaagcgacaaatggcagatgctgtctcaaggaaaaagatggatactaaacc

SEQ ID NO: 279435 - DNA, 75 bp, Artificial Sequence
  Synthetic
gatgaccatctcaaggaacgatcaagcctcagatatgggaatgtccttgatgtaaatgccattgatatagaggaa

SEQ ID NO: 279436 - DNA, 75 bp, Artificial Sequence
  Synthetic
gcctcagatatgggaatgtccttgatgtaaatgccattgatatagaggaaccaagtggtcaaacagcagactggt

SEQ ID NO: 279437 - DNA, 75 bp, Artificial Sequence
  Synthetic
ctttacacttcctattatcctgaaggccttgtatatgttgtcaacacgtgggagacaaactgtgaaagaaaacaa

SEQ ID NO: 279438 - DNA, 75 bp, Artificial Sequence
  Synthetic
gccttgtatatgttgtcaacacgtgggagacaaactgtgaaagaaaacaaaggaactcgcattcgtttcaaagat

SEQ ID NO: 279439 - DNA, 75 bp, Artificial Sequence
  Synthetic
gtatcaggagaccaaagcacctatatgtttccatgcctactgctcaatcaaccatgaaggctgaagaactgaccc

SEQ ID NO: 279440 - DNA, 75 bp, Artificial Sequence
  Synthetic
tgtttccatgcctactgctcaatcaaccatgaaggctgaagaactgacccctgggcgatttagaaccatagtatg

SEQ ID NO: 279441 - DNA, 75 bp, Artificial Sequence
  Synthetic
gtgcgtaacataatgagtcctgtaatgggagtaattggcttctcttttttcgttaaagactgggcagatcggatt

SEQ ID NO: 279442 - DNA, 75 bp, Artificial Sequence
  Synthetic
tgggagtaattggcttctcttttttcgttaaagactgggcagatcggattagagaatctatggaaaaagagtgcc

SEQ ID NO: 279443 - DNA, 75 bp, Artificial Sequence
  Synthetic
agggacaccagcccaggaaaccgaatttttaaagaggaataaaatatattttatgcaaagacaagaagtactgga

SEQ ID NO: 279444 - DNA, 75 bp, Artificial Sequence
  Synthetic
tttttaaagaggaataaaatatattttatgcaaagacaagaagtactggataagaatcatgttgctgaaattgat

SEQ ID NO: 279445 - DNA, 75 bp, Artificial Sequence
  Synthetic
gagatccaacatcaccagataacattgagtccccgaatgcaccctgggtatttgcctgtgcacctgatcggtgcc

SEQ ID NO: 279446 - DNA, 75 bp, Artificial Sequence
  Synthetic
tgagtccccgaatgcaccctgggtatttgcctgtgcacctgatcggtgcccaccgacatgtatttatgttgcagg

SEQ ID NO: 279447 - DNA, 75 bp, Artificial Sequence
  Synthetic
tccatattacaggatatgagaaataccatcatggcatctaaaactgttggtacagcagaagaaaagttaaaaaag

SEQ ID NO: 279448 - DNA, 75 bp, Artificial Sequence
  Synthetic
ccatcatggcatctaaaactgttggtacagcagaagaaaagttaaaaaagaaatcatcattttaccaatcctact

SEQ ID NO: 279449 - DNA, 75 bp, Artificial Sequence
  Synthetic
acagcttgaccaaagaattatcttattgtacatgctggaatggggaaaagaaatggttgatcattttcaccttgg

SEQ ID NO: 279450 - DNA, 75 bp, Artificial Sequence
  Synthetic
ttgtacatgctggaatggggaaaagaaatggttgatcattttcaccttggcgatgacatggatcctgaactcagg

SEQ ID NO: 279451 - DNA, 75 bp, Artificial Sequence
  Synthetic
aaaaagtgaaggaaatatctaaccaagagcccttaaaaatataaataaccaataaatgcactgataattataggt

SEQ ID NO: 279452 - DNA, 75 bp, Artificial Sequence
  Synthetic
agagcccttaaaaatataaataaccaataaatgcactgataattataggtataacaagtactaacatgcagattt

SEQ ID NO: 279453 - DNA, 75 bp, Artificial Sequence
  Synthetic
attgtttactaatttaagcatttacgggtttatcaatatattatcagggcattactaatcatcaggttaatcagg

SEQ ID NO: 279454 - DNA, 75 bp, Artificial Sequence
  Synthetic
gggtttatcaatatattatcagggcattactaatcatcaggttaatcagggtttacctggaaatagaatgtagac

SEQ ID NO: 279455 - DNA, 75 bp, Artificial Sequence
  Synthetic
aatgacaattatgaatgtactagtttaattagtcactgttccattattatcaccagcattaatttgatagattta

SEQ ID NO: 279456 - DNA, 75 bp, Artificial Sequence
  Synthetic
ggtcttaatatgtattagactcccagcattatatacttgtattttattactgttattgggcccaacaatgtgaag

SEQ ID NO: 279457 - DNA, 75 bp, Artificial Sequence
  Synthetic
tcccatcattttaaaggctttatacatgctgtcaacacgtggaagacagaccgtaaaagaaaataaaggaacacg

SEQ ID NO: 279458 - DNA, 75 bp, Artificial Sequence
  Synthetic
tttgaggatattaatggaatcagaagaccaaaacatctatatgtatccatgcctactgctcagtccaccatgaag

SEQ ID NO: 279459 - DNA, 75 bp, Artificial Sequence
  Synthetic
gaccaaaacatctatatgtatccatgcctactgctcagtccaccatgaaggctgaagaacttacacctggacggt

SEQ ID NO: 279460 - DNA, 75 bp, Artificial Sequence
  Synthetic
atcatttccatcttggcgatgatatggatcctgagttaaggggccttgcccagtcaggcactgatcagaaggtta

SEQ ID NO: 279461 - DNA, 75 bp, Artificial Sequence
  Synthetic
aaagatatgattaactcaagtttattactaattgtagatatagtgtattactaatcctagatcattccatatatt

SEQ ID NO: 279462 - DNA, 75 bp, Artificial Sequence
  Synthetic
ctaatttaaaatatacgggtttgacaattattattatcagggttttgaattaatgcactaatcagggtctaactg

SEQ ID NO: 279463 - DNA, 75 bp, Artificial Sequence
  Synthetic
aattattattatcagggttttgaattaatgcactaatcagggtctaactggaattatacaattacaattacatat

SEQ ID NO: 279464 - DNA, 75 bp, Artificial Sequence
  Synthetic
tagtagtagactccgagatagagaagtttactacaaatggagaaatacagagagatccatgagagagtaaaggaa

SEQ ID NO: 279465 - DNA, 75 bp, Artificial Sequence
  Synthetic
gtttactacaaatggagaaatacagagagatccatgagagagtaaaggaagcagtcccaggggagacatcagcag

SEQ ID NO: 279466 - DNA, 75 bp, Artificial Sequence
  Synthetic
agagatccatgagagagtaaaggaagcagtcccaggggagacatcagcagtagaatgcttagacttattagatcg

SEQ ID NO: 279467 - DNA, 75 bp, Artificial Sequence
  Synthetic
gtagatcagatgataaagcatgactggtcagacaataaagataaggaacaacccattggactagtcctactaatg

SEQ ID NO: 279468 - DNA, 75 bp, Artificial Sequence
  Synthetic
ggtcagacaataaagataaggaacaacccattggactagtcctactaatggctggtgttcccaatgatgtgatac

SEQ ID NO: 279469 - DNA, 75 bp, Artificial Sequence
  Synthetic
agggagtcctagtggccagattcttaggtcattcttcaaaatgactcctgataattacaaaattacagggaatct

SEQ ID NO: 279470 - DNA, 75 bp, Artificial Sequence
  Synthetic
aggtcattcttcaaaatgactcctgataattacaaaattacagggaatctaatagagttcattgaggtaacagta

SEQ ID NO: 279471 - DNA, 75 bp, Artificial Sequence
  Synthetic
gagaaaaaatactaaagtatcaaggagggttagaattcattgagcaattactacagatagaagcccaaaagggta

SEQ ID NO: 279472 - DNA, 75 bp, Artificial Sequence
  Synthetic
agggttagaattcattgagcaattactacagatagaagcccaaaagggtaattgtcaatctggatttaggataaa

SEQ ID NO: 279473 - DNA, 75 bp, Artificial Sequence
  Synthetic
gatggatcaaatgtctcaacacaatggcctagtaggaggaatgagggtgtggtacaggcaatgaggctgatacag

SEQ ID NO: 279474 - DNA, 75 bp, Artificial Sequence
  Synthetic
ggcctagtaggaggaatgagggtgtggtacaggcaatgaggctgatacaggcagatatcaattttgttagagaac

SEQ ID NO: 279475 - DNA, 75 bp, Artificial Sequence
  Synthetic
agcacttgaagcaatgttcaatttaaagttccatgtcacaggcccaaaagtacgaacatttgacatcccaaatta

SEQ ID NO: 279476 - DNA, 75 bp, Artificial Sequence
  Synthetic
aagttccatgtcacaggcccaaaagtacgaacatttgacatcccaaattatagacctcaacaattgtgtcagcct

SEQ ID NO: 279477 - DNA, 75 bp, Artificial Sequence
  Synthetic
gtaaaaattggcttgggactgatcatgcttttgcatttaaagaagtgactgggcaacgtgtctttaatgtattca

SEQ ID NO: 279478 - DNA, 75 bp, Artificial Sequence
  Synthetic
tgcttttgcatttaaagaagtgactgggcaacgtgtctttaatgtattcagggatgaagaagaactacatgcatc

SEQ ID NO: 279479 - DNA, 75 bp, Artificial Sequence
  Synthetic
aggaacttcctcttgtgtcaaataagcttacaagcaccatatttaccatcaacaatagcttcagaccaatatgac

SEQ ID NO: 279480 - DNA, 75 bp, Artificial Sequence
  Synthetic
gcttacaagcaccatatttaccatcaacaatagcttcagaccaatatgacacaaggttagcctgtagtgaaattt

SEQ ID NO: 279481 - DNA, 75 bp, Artificial Sequence
  Synthetic
gcaacttttagctagggatatggcctataaatacattacattagacaatgaagatatcattaattattataatcc

SEQ ID NO: 279482 - DNA, 75 bp, Artificial Sequence
  Synthetic
tataaatacattacattagacaatgaagatatcattaattattataatccgcgagtatacttcaaacctacacag

SEQ ID NO: 279483 - DNA, 75 bp, Artificial Sequence
  Synthetic
aactaaatttatctaacatggatcctaaatcaaaggcattaattgatgtaatatccaaagattcaaagaaagggg

SEQ ID NO: 279484 - DNA, 75 bp, Artificial Sequence
  Synthetic
taaatcaaaggcattaattgatgtaatatccaaagattcaaagaaaggggtttttggtgagttgattgatagtat

SEQ ID NO: 279485 - DNA, 75 bp, Artificial Sequence
  Synthetic
aatgaatgtgcaaaaactatcgagaagattctgtctgatcttgaagttaatttaggtgattctactgctgggtta

SEQ ID NO: 279486 - DNA, 75 bp, Artificial Sequence
  Synthetic
tagatgatatattaagaaaattttatgacaatgaacttgtcaagtatctgatttcagtcatacggaaaacaactg

SEQ ID NO: 279487 - DNA, 75 bp, Artificial Sequence
  Synthetic
tgatatcactgagtctttaattgcacatgcagggcttaagcgatctaagtattggtctgcccatggatatgctta

SEQ ID NO: 279488 - DNA, 75 bp, Artificial Sequence
  Synthetic
catgcagggcttaagcgatctaagtattggtctgcccatggatatgcttatggtagtgtgttattatgtattttg

SEQ ID NO: 279489 - DNA, 75 bp, Artificial Sequence
  Synthetic
gttcatttattagattttttactgtattcaaagaaggattgggtcttattgatgcagacaaccttgattcaaaag

SEQ ID NO: 279490 - DNA, 75 bp, Artificial Sequence
  Synthetic
attcaaagaaggattgggtcttattgatgcagacaaccttgattcaaaagtagagatagatggtgttacatggtg

SEQ ID NO: 279491 - DNA, 75 bp, Artificial Sequence
  Synthetic
ctaaaccgattgttagctttaaatattgcctttgagaaatctcttcttgctacggccacgtggttccaatactac

SEQ ID NO: 279492 - DNA, 75 bp, Artificial Sequence
  Synthetic
ttgcctttgagaaatctcttcttgctacggccacgtggttccaatactacacggaggaccaagggcactttcctc

SEQ ID NO: 279493 - DNA, 75 bp, Artificial Sequence
  Synthetic
tgcatttcactttctgttagctacatcccaaaaaatgaaattatgtgcaatatttgataacttgcgctacctcat

SEQ ID NO: 279494 - DNA, 75 bp, Artificial Sequence
  Synthetic
tcccaaaaaatgaaattatgtgcaatatttgataacttgcgctacctcatcccagcagttacatccacatattct

SEQ ID NO: 279495 - DNA, 75 bp, Artificial Sequence
  Synthetic
tctttgagcgaccgtttaaaagtgcactagaagtatacctgtacaacatcataaaaacattattggtgagtcttg

SEQ ID NO: 279496 - DNA, 75 bp, Artificial Sequence
  Synthetic
actagaagtatacctgtacaacatcataaaaacattattggtgagtcttgctcaaaataataaaataagatttta

SEQ ID NO: 279497 - DNA, 75 bp, Artificial Sequence
  Synthetic
actgttgatcaatcatcaataggagcaagtggagtgtacccttcactaatgtcaagggttgtctataaacattat

SEQ ID NO: 279498 - DNA, 75 bp, Artificial Sequence
  Synthetic
caagtggagtgtacccttcactaatgtcaagggttgtctataaacattatcgcagtctaatctcagaagcaacaa

SEQ ID NO: 279499 - DNA, 75 bp, Artificial Sequence
  Synthetic
tttacatggtaatcttactgaagaagctaaaattcatcttgaaacagttgagtgggctagaaaatttagagaaaa

SEQ ID NO: 279500 - DNA, 75 bp, Artificial Sequence
  Synthetic
gctaaaattcatcttgaaacagttgagtgggctagaaaatttagagaaaaagaaagagaactgggtagttacata

SEQ ID NO: 279501 - DNA, 75 bp, Artificial Sequence
  Synthetic
atgtcttaaacaatcaagtggttgttgagcaacaactcttttgccaggaggtggttgaacttgctgctcaagagt

SEQ ID NO: 279502 - DNA, 75 bp, Artificial Sequence
  Synthetic
tgagcaacaactcttttgccaggaggtggttgaacttgctgctcaagagttaaatacttatctacatgcaaagtc

SEQ ID NO: 279503 - DNA, 75 bp, Artificial Sequence
  Synthetic
aacaaacattgggataagccatactttagtcaaaccagaaatataagccttaagggtatgtcaggggcattacaa

SEQ ID NO: 279504 - DNA, 75 bp, Artificial Sequence
  Synthetic
ttagtcaaaccagaaatataagccttaagggtatgtcaggggcattacaagaagatggtcatttagctgcaagtg

SEQ ID NO: 279505 - DNA, 75 bp, Artificial Sequence
  Synthetic
tttgaatcattcacaaaataaccctacagtgctagaactttatgaacagacaaaaaaacaaaaggcacaagcaag

SEQ ID NO: 279506 - DNA, 75 bp, Artificial Sequence
  Synthetic
acagtgctagaactttatgaacagacaaaaaaacaaaaggcacaagcaaggattgtcagaaaataccagagaact

SEQ ID NO: 279507 - DNA, 75 bp, Artificial Sequence
  Synthetic
ccacactaccaactagagtgagattagagattattgaggattactatgatgctatagctagagttgtcccagaag

SEQ ID NO: 279508 - DNA, 75 bp, Artificial Sequence
  Synthetic
agagattattgaggattactatgatgctatagctagagttgtcccagaagaatacatatcatatgggggagaaag

SEQ ID NO: 279509 - DNA, 75 bp, Artificial Sequence
  Synthetic
ctggaaaaggcactcaggtgggcctcaggagaaagtgaaattcagtcttcaataggccattctataaaacttaag

SEQ ID NO: 279510 - DNA, 75 bp, Artificial Sequence
  Synthetic
caggagaaagtgaaattcagtcttcaataggccattctataaaacttaagaggaaactaatgtatgttagtgcag

SEQ ID NO: 279511 - DNA, 75 bp, Artificial Sequence
  Synthetic
caattctgcaaaatttaggaggtttacccaatccttatatgatggtttacgtgatgataaacttaaaaattgtgt

SEQ ID NO: 279512 - DNA, 75 bp, Artificial Sequence
  Synthetic
acccaatccttatatgatggtttacgtgatgataaacttaaaaattgtgtggttgatgcactaaggaatatctat

SEQ ID NO: 279513 - DNA, 75 bp, Artificial Sequence
  Synthetic
agctacataggtatattgataatatgggtgaattatctgatgaggtcttggactttttatctttttttcctaata

SEQ ID NO: 279514 - DNA, 75 bp, Artificial Sequence
  Synthetic
gggtgaattatctgatgaggtcttggactttttatctttttttcctaataaagtatctgcttcaattaaaggtaa

SEQ ID NO: 279515 - DNA, 75 bp, Artificial Sequence
  Synthetic
tgctcttcattatttggtgcagcagtgtcattgttatttaaacgtgtatgggccaaattatacccagagttagag

SEQ ID NO: 279516 - DNA, 75 bp, Artificial Sequence
  Synthetic
tgtcattgttatttaaacgtgtatgggccaaattatacccagagttagagtgtttctttgaatttgcacatcatt

SEQ ID NO: 279517 - DNA, 75 bp, Artificial Sequence
  Synthetic
ttatttagagccagtagatgatggaacagaatggtttcaatacgtgactcagcagatacaagcaggaaacttcca

SEQ ID NO: 279518 - DNA, 75 bp, Artificial Sequence
  Synthetic
acagaatggtttcaatacgtgactcagcagatacaagcaggaaacttccactggcatgctgtaaatcaagagatg

SEQ ID NO: 279519 - DNA, 75 bp, Artificial Sequence
  Synthetic
agcatattttgttaatgggttcaataaaaatatcacctaagaaaacaacagtatcccctacaaatgctgagtttc

SEQ ID NO: 279520 - DNA, 75 bp, Artificial Sequence
  Synthetic
aaaaatatcacctaagaaaacaacagtatcccctacaaatgctgagtttctatctacattctttgaaggttgtgc

SEQ ID NO: 279521 - DNA, 75 bp, Artificial Sequence
  Synthetic
ttattaggttctttatcagatttacctggattaggttactttgatgaccttgctgcagcccagagtagatgtgtt

SEQ ID NO: 279522 - DNA, 75 bp, Artificial Sequence
  Synthetic
ctggattaggttactttgatgaccttgctgcagcccagagtagatgtgttaaagcattagacatgggtgcttgcc

SEQ ID NO: 279523 - DNA, 75 bp, Artificial Sequence
  Synthetic
attatgtacgagtaaagttgagagattatatggtactgctcctgggatggtaaataacccaactgcatacttgaa

SEQ ID NO: 279524 - DNA, 75 bp, Artificial Sequence
  Synthetic
ttatatggtactgctcctgggatggtaaataacccaactgcatacttgaaagtagataggagtttaatccctata

SEQ ID NO: 279525 - DNA, 75 bp, Artificial Sequence
  Synthetic
caattatggagcttgcaacagcaggtatagggatggcagataagaatatattgaaaaatgcattcataacttata

SEQ ID NO: 279526 - DNA, 75 bp, Artificial Sequence
  Synthetic
tatagggatggcagataagaatatattgaaaaatgcattcataacttataaacatgcaaaaaaggataatgatcg

SEQ ID NO: 279527 - DNA, 75 bp, Artificial Sequence
  Synthetic
ttaatgtcattatcagatgatatatttcagcatgaccgtttaggagaatttagttttgtagggaaggttcaatgg

SEQ ID NO: 279528 - DNA, 75 bp, Artificial Sequence
  Synthetic
ttcagcatgaccgtttaggagaatttagttttgtagggaaggttcaatggaaagtattcacccctaagagcgaat

SEQ ID NO: 279529 - DNA, 75 bp, Artificial Sequence
  Synthetic
aaaatatttagaactctggagcgaacagcatccagtttatgattatattataccaagaggtagggataatttatt

SEQ ID NO: 279530 - DNA, 75 bp, Artificial Sequence
  Synthetic
cagcatccagtttatgattatattataccaagaggtagggataatttattggtatatttagttaggaaactaaat

SEQ ID NO: 279531 - DNA, 75 bp, Artificial Sequence
  Synthetic
caatgcaatcaccacttcaattaagatttcgaatgcaggcaaagcaacacatgaaagtatgcaagctagatggtg

SEQ ID NO: 279532 - DNA, 75 bp, Artificial Sequence
  Synthetic
atttcgaatgcaggcaaagcaacacatgaaagtatgcaagctagatggtgaatgggtgacatttagagaggttct

SEQ ID NO: 279533 - DNA, 75 bp, Artificial Sequence
  Synthetic
gaataccgacctactttacaagatatggaactcttccagacactagtaaattgtacattctctaaagagtatgcc

SEQ ID NO: 279534 - DNA, 75 bp, Artificial Sequence
  Synthetic
tggaactcttccagacactagtaaattgtacattctctaaagagtatgcctggagagattttttaaatgaggtgc

SEQ ID NO: 279535 - DNA, 75 bp, Artificial Sequence
  Synthetic
aattcatagaccaaaagtggctcgtacttttacagttaaagaaaaagaccaaacaatacagaatccaattacagc

SEQ ID NO: 279536 - DNA, 75 bp, Artificial Sequence
  Synthetic
acttttacagttaaagaaaaagaccaaacaatacagaatccaattacagctgtaattggctacaagtatgcaagt

SEQ ID NO: 279537 - DNA, 75 bp, Artificial Sequence
  Synthetic
tggacagtgctatccatcctgattcattgtctactgacctacaactcatgagggagggtgtgtatagagaattag

SEQ ID NO: 279538 - DNA, 75 bp, Artificial Sequence
  Synthetic
attgtctactgacctacaactcatgagggagggtgtgtatagagaattaggcctggatatcagtcaaccaaatgt

SEQ ID NO: 279539 - DNA, 75 bp, Artificial Sequence
  Synthetic
tacaaatctgggaaatcaagaattgtaattgtacaaggaaacgttgagggtacggcagaatcaatttgtagttac

SEQ ID NO: 279540 - DNA, 75 bp, Artificial Sequence
  Synthetic
taattgtacaaggaaacgttgagggtacggcagaatcaatttgtagttactggctaaagacaatgtcccttgtga

SEQ ID NO: 279541 - DNA, 75 bp, Artificial Sequence
  Synthetic
agaggtattaaaagctgtatctctatatggaaagaaagagaaagctggtgacctaacacatttagctgcaatgag

SEQ ID NO: 279542 - DNA, 75 bp, Artificial Sequence
  Synthetic
tatggaaagaaagagaaagctggtgacctaacacatttagctgcaatgaggttatgtattgaagtatggagatgg

SEQ ID NO: 279543 - DNA, 75 bp, Artificial Sequence
  Synthetic
tatcttggttaaagtacttaatgtttgagaacaagacattagagcagtggattgactcgttctgctcaagagggg

SEQ ID NO: 279544 - DNA, 75 bp, Artificial Sequence
  Synthetic
tgagaacaagacattagagcagtggattgactcgttctgctcaagaggggttttgccagttgatcctgagattca

SEQ ID NO: 279545 - DNA, 75 bp, Artificial Sequence
  Synthetic
ctgaaagggcaaaagggtttgttgcagatacaagctaataggcgggcatattcaggaaaacaatatgatgcatat

SEQ ID NO: 279546 - DNA, 75 bp, Artificial Sequence
  Synthetic
agatacaagctaataggcgggcatattcaggaaaacaatatgatgcatattgtgtgcagacatataatgaggaga

SEQ ID NO: 279547 - DNA, 75 bp, Artificial Sequence
  Synthetic
ggtaacattcaactttggtatagattgtgcacgactggagattttttgggataaaagagaatatattttagaaac

SEQ ID NO: 279548 - DNA, 75 bp, Artificial Sequence
  Synthetic
tgtgcacgactggagattttttgggataaaagagaatatattttagaaacatccataactcaacggaatgttttg

SEQ ID NO: 279549 - DNA, 75 bp, Artificial Sequence
  Synthetic
aggagttactacgctgtggtatgagattcaaaacagagcaagttaactcttcacgtagtgtagtattgtttaaaa

SEQ ID NO: 279550 - DNA, 75 bp, Artificial Sequence
  Synthetic
attcaaaacagagcaagttaactcttcacgtagtgtagtattgtttaaaacagaaagtggttttgagtggggtaa

SEQ ID NO: 279551 - DNA, 75 bp, Artificial Sequence
  Synthetic
agaaattgtactcttagaacaggcttgagagtgcggcagcctacaaacaaagcattctcaattactattcaagcc

SEQ ID NO: 279552 - DNA, 75 bp, Artificial Sequence
  Synthetic
tgagagtgcggcagcctacaaacaaagcattctcaattactattcaagccaatggtttccgagccatggctcaac

SEQ ID NO: 279553 - DNA, 75 bp, Artificial Sequence
  Synthetic
acttgctcatgcataccataatttaaaggatgtaagatatcaggcattacaggcagttgggaatgtttggttcaa

SEQ ID NO: 279554 - DNA, 75 bp, Artificial Sequence
  Synthetic
aaggatgtaagatatcaggcattacaggcagttgggaatgtttggttcaaaatgactcaacataagttgtttata

SEQ ID NO: 279555 - DNA, 75 bp, Artificial Sequence
  Synthetic
tggaaaattttatgaagggtctacctgcagcaattccccctgcagcctattctcttattatgaataaagcgaaaa

SEQ ID NO: 279556 - DNA, 75 bp, Artificial Sequence
  Synthetic
tgcagcaattccccctgcagcctattctcttattatgaataaagcgaaaatttctgttgatttattcatgtttaa

SEQ ID NO: 279557 - DNA, 75 bp, Artificial Sequence
  Synthetic
caaaatgttcttaatttagatgggatcgaggaaacatctgaaggttatacaacagttagtacaatttcaagtacg

SEQ ID NO: 279558 - DNA, 75 bp, Artificial Sequence
  Synthetic
tcgaggaaacatctgaaggttatacaacagttagtacaatttcaagtacgcaatggtcagaagaagtgagcctga

SEQ ID NO: 279559 - DNA, 75 bp, Artificial Sequence
  Synthetic
tgatgcttcccagcttgattatactattgaccttgatgatatagattttgaaacaattgatttgaaagaagatat

SEQ ID NO: 279560 - DNA, 75 bp, Artificial Sequence
  Synthetic
attgaccttgatgatatagattttgaaacaattgatttgaaagaagatattgaacattttttacaggatgagtca

SEQ ID NO: 279561 - DNA, 75 bp, Artificial Sequence
  Synthetic
aaactgaggaaactgagataagaaagttaagaggtatgattaagattcttgagcctgtaaaacttattaagagtt

SEQ ID NO: 279562 - DNA, 75 bp, Artificial Sequence
  Synthetic
gttaagaggtatgattaagattcttgagcctgtaaaacttattaagagttgggtctccaaaggtttatctataga

SEQ ID NO: 279563 - DNA, 75 bp, Artificial Sequence
  Synthetic
atcctcatgactcggtatatgtccaaacattataatttccatgcaaagcagttatctctcatggacccgtatgac

SEQ ID NO: 279564 - DNA, 75 bp, Artificial Sequence
  Synthetic
aacattataatttccatgcaaagcagttatctctcatggacccgtatgacttaactgaatttgagagtattgtca

SEQ ID NO: 279565 - DNA, 75 bp, Artificial Sequence
  Synthetic
tcgatttattgaacttgatcaagaagcccagagaaaggtcactgaagagagagtgctaccggaagatgtattacc

SEQ ID NO: 279566 - DNA, 75 bp, Artificial Sequence
  Synthetic
gctgatatcttattgaagagattgtttcctagggactcagcctcttctttttattaacagattatacttcttatt

SEQ ID NO: 279567 - DNA, 75 bp, Artificial Sequence
  Synthetic
ttcctagggactcagcctcttctttttattaacagattatacttcttattgctcttttcacggagcatactacta

SEQ ID NO: 279568 - DNA, 75 bp, Artificial Sequence
  Synthetic
ttagtccagtttgtctgtatctgcttctccagggtctattactatgtaatacaggggctgccagaaaccttaatg

SEQ ID NO: 279569 - DNA, 75 bp, Artificial Sequence
  Synthetic
tctccagggtctattactatgtaatacaggggctgccagaaaccttaatgagcttaaaatggaatgtccacatac

SEQ ID NO: 279570 - DNA, 75 bp, Artificial Sequence
  Synthetic
gtgggttcagtagaattgccatctcttccaatacagcaggtcgagacactaaagctggagagttcttgtaatttt

SEQ ID NO: 279571 - DNA, 75 bp, Artificial Sequence
  Synthetic
ttccaatacagcaggtcgagacactaaagctggagagttcttgtaattttgatctacataccagtacagcaggac

SEQ ID NO: 279572 - DNA, 75 bp, Artificial Sequence
  Synthetic
aaagctggagagttcttgtaattttgatctacataccagtacagcaggacaacaatcattcacaaaatggacatg

SEQ ID NO: 279573 - DNA, 75 bp, Artificial Sequence
  Synthetic
aacacacaggcatcatcaacaagttttcaaacaaaaagcagtgaagtgaatttgagaggattatgtttgatccct

SEQ ID NO: 279574 - DNA, 75 bp, Artificial Sequence
  Synthetic
ttcaaacaaaaagcagtgaagtgaatttgagaggattatgtttgatccctactttagtggttgaaacagcagcaa

SEQ ID NO: 279575 - DNA, 75 bp, Artificial Sequence
  Synthetic
tgacctgtcatgcaatcaaacagtgtgtcagcctactgtctatttaatgggacctatccagacttgtataacaac

SEQ ID NO: 279576 - DNA, 75 bp, Artificial Sequence
  Synthetic
gacctatccagacttgtataacaactaaaagttgtctcttgagtttaggtgatcaaaggattcaagtaaattatg

SEQ ID NO: 279577 - DNA, 75 bp, Artificial Sequence
  Synthetic
gcttgttgaaggtatctgttttaatccaatacatacaatggcactctctcaacctagtcatacatatgatataat

SEQ ID NO: 279578 - DNA, 75 bp, Artificial Sequence
  Synthetic
ccaatacatacaatggcactctctcaacctagtcatacatatgatataatgaccatgatggttcgctgtttcttg

SEQ ID NO: 279579 - DNA, 75 bp, Artificial Sequence
  Synthetic
acagtatgaagattgaaaagaactttgagactcttgttcaaaaaaatggctgcacagctaataacttccaagggt

SEQ ID NO: 279580 - DNA, 75 bp, Artificial Sequence
  Synthetic
tgagactcttgttcaaaaaaatggctgcacagctaataacttccaagggtattatatctgtcttatagggagtag

SEQ ID NO: 279581 - DNA, 75 bp, Artificial Sequence
  Synthetic
ttagatgattatcgttcagctgaagttctttcaaggatggcatttgcaccacatggtgaagatcatgatattgag

SEQ ID NO: 279582 - DNA, 75 bp, Artificial Sequence
  Synthetic
ttctttcaaggatggcatttgcaccacatggtgaagatcatgatattgagaaaaatgcagtgagtgcaatgcgta

SEQ ID NO: 279583 - DNA, 75 bp, Artificial Sequence
  Synthetic
gccatcaacagaatcatcagatacagtacaggggattgcattttcaggtagtcctctttatacatctactggtgt

SEQ ID NO: 279584 - DNA, 75 bp, Artificial Sequence
  Synthetic
gtacaggggattgcattttcaggtagtcctctttatacatctactggtgtcttgacatcaaaagatgatcctgtc

SEQ ID NO: 279585 - DNA, 75 bp, Artificial Sequence
  Synthetic
tggaaggaaaccattctatttgtgaaaagaagaccttaccccttacatggactggttttatttcattgcctggag

SEQ ID NO: 279586 - DNA, 75 bp, Artificial Sequence
  Synthetic
aaagaagaccttaccccttacatggactggttttatttcattgcctggagagattgaaaaaacaacacaatgtac

SEQ ID NO: 279587 - DNA, 75 bp, Artificial Sequence
  Synthetic
ggtgcagattgtgaagcttactctgaaacaggcatcttcaacataagttcacctacttgcttaataaatcgtgtc

SEQ ID NO: 279588 - DNA, 75 bp, Artificial Sequence
  Synthetic
aaacaggcatcttcaacataagttcacctacttgcttaataaatcgtgtccagagattccgtggttcagaacagc

SEQ ID NO: 279589 - DNA, 75 bp, Artificial Sequence
  Synthetic
ggacatggatatcactgtttactgtaatgggatgaagaaagtcattctcaccaagaccctagttattggacaatg

SEQ ID NO: 279590 - DNA, 75 bp, Artificial Sequence
  Synthetic
aatgggatgaagaaagtcattctcaccaagaccctagttattggacaatgcatttatacttttactagtattttc

SEQ ID NO: 279591 - DNA, 75 bp, Artificial Sequence
  Synthetic
cccttgctgttgaattatgtgtacctggtcttcatggttgggcaactatgctattattactaacattttgttttg

SEQ ID NO: 279592 - DNA, 75 bp, Artificial Sequence
  Synthetic
tggtcttcatggttgggcaactatgctattattactaacattttgttttggctgggtcttaataccaactataac

SEQ ID NO: 279593 - DNA, 75 bp, Artificial Sequence
  Synthetic
gcattcgcatacttatgttctaaatataacacagattcgaaattcaggatcttgattgagaaagtgaaaagagag

SEQ ID NO: 279594 - DNA, 75 bp, Artificial Sequence
  Synthetic
ataacacagattcgaaattcaggatcttgattgagaaagtgaaaagagagtaccagaaaacaatgggttcaatgg

SEQ ID NO: 279595 - DNA, 75 bp, Artificial Sequence
  Synthetic
tgagactgcaaaagaactggagtcacatagaaagagttgttccattggttcatgcccttattgtctcaatccatc

SEQ ID NO: 279596 - DNA, 75 bp, Artificial Sequence
  Synthetic
catagaaagagttgttccattggttcatgcccttattgtctcaatccatctgaggcaacaacatctgcccttcag

SEQ ID NO: 279597 - DNA, 75 bp, Artificial Sequence
  Synthetic
catcacggtttcaggagaatttaagaaagtcattaacggtatatgagcctatgcaagggtgctaccggactttat

SEQ ID NO: 279598 - DNA, 75 bp, Artificial Sequence
  Synthetic
atgcaagggtgctaccggactttatccctctttagatataggagtcggttctttgtgggtctagtctggtgcgtg

SEQ ID NO: 279599 - DNA, 75 bp, Artificial Sequence
  Synthetic
gggctgccagtgctgaaacacaaaatttaaatgcaggttggacagacacagcacatggatctggaattataccta

SEQ ID NO: 279600 - DNA, 75 bp, Artificial Sequence
  Synthetic
tttaaatgcaggttggacagacacagcacatggatctggaattatacctatgaaaactgatctggaattagactt

SEQ ID NO: 279601 - DNA, 75 bp, Artificial Sequence
  Synthetic
acatataggagacagctacaaaacccagcaaacgaacaagagaaaatcccatttcatctgcagttaagcaaacaa

SEQ ID NO: 279602 - DNA, 75 bp, Artificial Sequence
  Synthetic
taggtcattggatggatgctacatttaatcttaaaactgcatttcactgctatggctcatgtgagaagtatgctt

SEQ ID NO: 279603 - DNA, 75 bp, Artificial Sequence
  Synthetic
taatcttaaaactgcatttcactgctatggctcatgtgagaagtatgcttatccttggcagacagcaggttgttt

SEQ ID NO: 279604 - DNA, 75 bp, Artificial Sequence
  Synthetic
tatggctcatgtgagaagtatgcttatccttggcagacagcaggttgtttcatagaaaaagattatgaatatgag

SEQ ID NO: 279605 - DNA, 75 bp, Artificial Sequence
  Synthetic
attgcccaggggtagggacaggctgtactgcttgtggggtataccttgataaattaaaatcagttggaaaggttt

SEQ ID NO: 279606 - DNA, 75 bp, Artificial Sequence
  Synthetic
tactgcttgtggggtataccttgataaattaaaatcagttggaaaggttttcaaaattgtgtccttaagatacac

SEQ ID NO: 279607 - DNA, 75 bp, Artificial Sequence
  Synthetic
acagaacaaacatgtaagactgttgatagtaatgactgtctcattaccacttcagttaaagtgtgcttgataggg

SEQ ID NO: 279608 - DNA, 75 bp, Artificial Sequence
  Synthetic
atagtaatgactgtctcattaccacttcagttaaagtgtgcttgatagggaccatatcaaaattccaaccatctg

SEQ ID NO: 279609 - DNA, 75 bp, Artificial Sequence
  Synthetic
acagcagggtggtctgatatttaaacaatggtgcactacaacatgccagtttggcgatcccggggacataatgag

SEQ ID NO: 279610 - DNA, 75 bp, Artificial Sequence
  Synthetic
caatggtgcactacaacatgccagtttggcgatcccggggacataatgagcacacctacaggcatgaagtgccca

SEQ ID NO: 279611 - DNA, 75 bp, Artificial Sequence
  Synthetic
aatgtgcatttgcaacaactccagtttgccagtttgatggaaatacaatttcaggctataagaggatgattgcca

SEQ ID NO: 279612 - DNA, 75 bp, Artificial Sequence
  Synthetic
ttgccagtttgatggaaatacaatttcaggctataagaggatgattgccacaaaggattcatttcaatctttcaa

SEQ ID NO: 279613 - DNA, 75 bp, Artificial Sequence
  Synthetic
agtgcacttgaatggattgatcctgacagctcacttagggaccatattaatgtaattgtgagtcgtgatctatcc

SEQ ID NO: 279614 - DNA, 75 bp, Artificial Sequence
  Synthetic
acagctcacttagggaccatattaatgtaattgtgagtcgtgatctatccttccaagacctaagtgaaacaccat

SEQ ID NO: 279615 - DNA, 75 bp, Artificial Sequence
  Synthetic
tatagatggagcatggggttcaggagttggttttaatctggtttgtactgttagtttaacagaatgttctgcatt

SEQ ID NO: 279616 - DNA, 75 bp, Artificial Sequence
  Synthetic
ttagtttaacagaatgttctgcatttctgacatcaatcaaggcctgtgatgctgcaatgtgttatgggtccacca

SEQ ID NO: 279617 - DNA, 75 bp, Artificial Sequence
  Synthetic
taccattcatatcgtcggtaagggtgggcattctggttcaaaatttatgtgttgtcatgacacaaaatgttctag

SEQ ID NO: 279618 - DNA, 75 bp, Artificial Sequence
  Synthetic
gggcattctggttcaaaatttatgtgttgtcatgacacaaaatgttctagcaccggtctagttgcagctgcacca

SEQ ID NO: 279619 - DNA, 75 bp, Artificial Sequence
  Synthetic
atcaggctgatagtgacaaaatctttgatgatggggcaccagaatgtggtatgtcatgttggtttaaaaaatcag

SEQ ID NO: 279620 - DNA, 75 bp, Artificial Sequence
  Synthetic
tgatgatggggcaccagaatgtggtatgtcatgttggtttaaaaaatcaggtgaatggattcttggggttttgaa

SEQ ID NO: 279621 - DNA, 75 bp, Artificial Sequence
  Synthetic
tactcttattcacattatgttgtcctcgtagacctagttacaggaaagaacataagccctaagttttgcttacta

SEQ ID NO: 279622 - DNA, 75 bp, Artificial Sequence
  Synthetic
gacacaattaccatatgattaactgtattcccccatcttatatcttatataatattctttatttaatcactatat

SEQ ID NO: 279623 - DNA, 75 bp, Artificial Sequence
  Synthetic
agaaaaaaaactagcactttactaattaaattaccccataccgattatgcctggacttttgttcttgcggagcat

SEQ ID NO: 279624 - DNA, 75 bp, Artificial Sequence
  Synthetic
tagtagtagactccttgaaaaagctactacgagaacaactggaatgagtgacttgacagacatccaagaggagat

SEQ ID NO: 279625 - DNA, 75 bp, Artificial Sequence
  Synthetic
actacgagaacaactggaatgagtgacttgacagacatccaagaggagataacccgccatgagcaacaacttgtt

SEQ ID NO: 279626 - DNA, 75 bp, Artificial Sequence
  Synthetic
ctactgacccgactgggattgaacctgatgatcatctcaaggagagatcaagccttagatatggaaatgtccttg

SEQ ID NO: 279627 - DNA, 75 bp, Artificial Sequence
  Synthetic
tgatgatcatctcaaggagagatcaagccttagatatggaaatgtccttgatgtgaatgctattgacattgaaga

SEQ ID NO: 279628 - DNA, 75 bp, Artificial Sequence
  Synthetic
tatactatcggagtctatgtaatagggttcacaattcctatcattttgaaggctctatatatgttgtcaacacgt

SEQ ID NO: 279629 - DNA, 75 bp, Artificial Sequence
  Synthetic
ggctctatatatgttgtcaacacgtggaagacagactgtaaaggaaaacaaaggaacacggatcaggttcaagga

SEQ ID NO: 279630 - DNA, 75 bp, Artificial Sequence
  Synthetic
atgtatccatgcctactgcccagtccaccatgaaagctgaagaacttacacctggacggttccgtacaatagtat

SEQ ID NO: 279631 - DNA, 75 bp, Artificial Sequence
  Synthetic
atttttgaaaagaaatagagtttatttcatgacccgccaggatgttcttgacaaaaatcatgtggctgacatcga

SEQ ID NO: 279632 - DNA, 75 bp, Artificial Sequence
  Synthetic
tcgaatctcctaatgcaccatgggtatttgcttgtgcaccagatcggtgccccccaacatgtatttatgttgctg

SEQ ID NO: 279633 - DNA, 75 bp, Artificial Sequence
  Synthetic
ttccatcttacaggatatgaggaacaccattatggcatctaaaactgtgggcacagcagaagagaaactgaaaaa

SEQ ID NO: 279634 - DNA, 75 bp, Artificial Sequence
  Synthetic
accattatggcatctaaaactgtgggcacagcagaagagaaactgaaaaagaagtcctccttctatcaatcatat

SEQ ID NO: 279635 - DNA, 75 bp, Artificial Sequence
  Synthetic
ttcaacttgatcagaggataatcctactgtacatgttggaatggggaaaagaaatggtggatcatttccatcttg

SEQ ID NO: 279636 - DNA, 75 bp, Artificial Sequence
  Synthetic
actgtacatgttggaatggggaaaagaaatggtggatcatttccatcttggtgatgacatggatcctgagctaag

SEQ ID NO: 279637 - DNA, 75 bp, Artificial Sequence
  Synthetic
cagaaggtaaaagagatatcaaaccaagaacccttaaagatatgattaattcagatttattactaattgtaggta

SEQ ID NO: 279638 - DNA, 75 bp, Artificial Sequence
  Synthetic
aattgtttactaatttgaaatatacgggtttgacaattattattatcagggttttgaattaatgcactaatcagg

SEQ ID NO: 279639 - DNA, 75 bp, Artificial Sequence
  Synthetic
tacagggaattactaatgacagttatgaatttaatatcatagtatatattttgtaatcaatatccaattagcatt

SEQ ID NO: 279640 - DNA, 75 bp, Artificial Sequence
  Synthetic
tgaatttaatatcatagtatatattttgtaatcaatatccaattagcattatatacgtatagatttatattttat

SEQ ID NO: 279641 - DNA, 75 bp, Artificial Sequence
  Synthetic
tgtgaaactgagctatccctttccttttcaccactatctctcttactttctacctcagtgtacttatatatatgc

SEQ ID NO: 279642 - DNA, 75 bp, Artificial Sequence
  Synthetic
tagtagtagactccttgaaaagctactacgaaaaagactggaatgagtgacttgacagatatccaagaggatata

SEQ ID NO: 279643 - DNA, 75 bp, Artificial Sequence
  Synthetic
ttgccagacaaaaacttaaggatgcagagagagcagtggaagtggacccagatgacgttaataaaaacacactgc

SEQ ID NO: 279644 - DNA, 75 bp, Artificial Sequence
  Synthetic
agagagagcagtggaagtggacccagatgacgttaataaaaacacactgcaagccaggcaacagacagtgtcagc

SEQ ID NO: 279645 - DNA, 75 bp, Artificial Sequence
  Synthetic
tactgacccgactgggattgaacctgatgaccacctcaaggagagatcaagccttaggtatggaaatgtccttga

SEQ ID NO: 279646 - DNA, 75 bp, Artificial Sequence
  Synthetic
gatgaccacctcaaggagagatcaagccttaggtatggaaatgtccttgatgtgaatgcaattgatattgaggaa

SEQ ID NO: 279647 - DNA, 75 bp, Artificial Sequence
  Synthetic
attcacacttcctatcatccttaaagccttatacatgctttcaacgcgtgggagacagaccgtgaaagagaataa

SEQ ID NO: 279648 - DNA, 75 bp, Artificial Sequence
  Synthetic
gatacttcatttgaagacattaacggcataaggagaccaaagcatttatatgtttccatgcctactgcccagtca

SEQ ID NO: 279649 - DNA, 75 bp, Artificial Sequence
  Synthetic
gcataaggagaccaaagcatttatatgtttccatgcctactgcccagtcaactatgaaggctgaagaacttacac

SEQ ID NO: 279650 - DNA, 75 bp, Artificial Sequence
  Synthetic
tggtctcttcccaactcagattcaagttcgtaacatcatgagtccagttatgggggttattggtttttcattttt

SEQ ID NO: 279651 - DNA, 75 bp, Artificial Sequence
  Synthetic
gttcgtaacatcatgagtccagttatgggggttattggtttttcattttttgtaaaagattggtctgagagaatc

SEQ ID NO: 279652 - DNA, 75 bp, Artificial Sequence
  Synthetic
catttataaagccagaaattaaaccaggtacaccagcacaagagattgagatgttaaaaagaaataaaatctatt

SEQ ID NO: 279653 - DNA, 75 bp, Artificial Sequence
  Synthetic
caagaatcatgtggcagacattgataaactaattgactatgcagcctctggagatcccacatcacctgataacat

SEQ ID NO: 279654 - DNA, 75 bp, Artificial Sequence
  Synthetic
caccaacatgtatctatgttgcagggatggcagagcttggggcctttttttcaatattgcaagatatgagaaata

SEQ ID NO: 279655 - DNA, 75 bp, Artificial Sequence
  Synthetic
cacagctgaagagaagttaaagaaaaagtcctctttctaccaatcttatttacgccgaactcaatcaatggggat

SEQ ID NO: 279656 - DNA, 75 bp, Artificial Sequence
  Synthetic
aagtcctctttctaccaatcttatttacgccgaactcaatcaatggggattcaacttgaccaaagaattattctt

SEQ ID NO: 279657 - DNA, 75 bp, Artificial Sequence
  Synthetic
agatggtagatcatttccaccttggtgatgatatggatccagagcttagaggccttgcacaggcactgatagatc

SEQ ID NO: 279658 - DNA, 75 bp, Artificial Sequence
  Synthetic
tgatgatatggatccagagcttagaggccttgcacaggcactgatagatcaaaaggtgaaggaaatatcaaatca

SEQ ID NO: 279659 - DNA, 75 bp, Artificial Sequence
  Synthetic
aattacatatgcactgattatagatgtagtgagttactaacatgcagacaatattatattatatattcagggatc

SEQ ID NO: 279660 - DNA, 75 bp, Artificial Sequence
  Synthetic
gtagtgagttactaacatgcagacaatattatattatatattcagggatcatatgtgttagttgtttactaatca

SEQ ID NO: 279661 - DNA, 75 bp, Artificial Sequence
  Synthetic
tatcagggtcattaatcaataaactaatcagggtttaactggaaatgtagcattataagtacatattaactaata

SEQ ID NO: 279662 - DNA, 75 bp, Artificial Sequence
  Synthetic
aatcagggtttaactggaaatgtagcattataagtacatattaactaataacaatcaatacagggatcactaatg

SEQ ID NO: 279663 - DNA, 75 bp, Artificial Sequence
  Synthetic
attttataatcattacttaattagcattatttagaataaggttatattttattatttaatgggcccgaacatgtg

SEQ ID NO: 279664 - DNA, 75 bp, Artificial Sequence
  Synthetic
attatttagaataaggttatattttattatttaatgggcccgaacatgtgaaactgagctgtctttttccccttt

SEQ ID NO: 279665 - DNA, 75 bp, Artificial Sequence
  Synthetic
atatatgcaagtagcatatatataagtacacaacatactacctcaacatgctgatttcttgattgcttttcaagg

SEQ ID NO: 279666 - DNA, 75 bp, Artificial Sequence
  Synthetic
tagtagtagactccttgaaaagctactacgaaaaaaactggaatgagtgacttgacagatatccaagaggatata

SEQ ID NO: 279667 - DNA, 75 bp, Artificial Sequence
  Synthetic
ttgccagacagaaactcaaggatgcagagaaggcagtggaaatggacccagatgacgttaacaaaaatacactgc

SEQ ID NO: 279668 - DNA, 75 bp, Artificial Sequence
  Synthetic
aagcaaggcaacaaacagtgtcagcattggaggacaaactcgcagactttaagcggagaatggcagatgctgtgt

SEQ ID NO: 279669 - DNA, 75 bp, Artificial Sequence
  Synthetic
gatgaccacctcaaggagcgatcaagccttaggtatggaaatgtccttgatgtgaatgccattgatatagaagag

SEQ ID NO: 279670 - DNA, 75 bp, Artificial Sequence
  Synthetic
atacaattggagtttatgtcattggctttacactcccgattatactgaaggcactttatatgttatcaacacgag

SEQ ID NO: 279671 - DNA, 75 bp, Artificial Sequence
  Synthetic
ctttacactcccgattatactgaaggcactttatatgttatcaacacgaggaaggcagactgtaaaagaaaataa

SEQ ID NO: 279672 - DNA, 75 bp, Artificial Sequence
  Synthetic
gatacatcatttgaggacatcaatggcattagaagaccaaagcatttatatgtatccatgccaacagcccagtca

SEQ ID NO: 279673 - DNA, 75 bp, Artificial Sequence
  Synthetic
acaatgaaggcagaagagcttactcctggcaggttccggacaattgtgtgtggtctcttcccaactcaaattcaa

SEQ ID NO: 279674 - DNA, 75 bp, Artificial Sequence
  Synthetic
tgggggttataggattctctttctttgtaaaggattggtcagagagggtgagagaatttatggagaaagaatgcc

SEQ ID NO: 279675 - DNA, 75 bp, Artificial Sequence
  Synthetic
agggacacccccgcaggaggctgagttcttaaaaagaaataaggtatacttcatgcagcgtcaagatgtgctaga

SEQ ID NO: 279676 - DNA, 75 bp, Artificial Sequence
  Synthetic
tcatgcagcgtcaagatgtgctagataaaaatcatgtggcggatattgataagttgattgattacgcagcctcag

SEQ ID NO: 279677 - DNA, 75 bp, Artificial Sequence
  Synthetic
aagttgattgattacgcagcctcaggggacccaacatcacctgacaacatagaatcccctaatgcaccatgggta

SEQ ID NO: 279678 - DNA, 75 bp, Artificial Sequence
  Synthetic
tttgcatgtgctccagataggtgtccaccaacatgcatctatgttgcagggatggctgaacttggtgcctttttt

SEQ ID NO: 279679 - DNA, 75 bp, Artificial Sequence
  Synthetic
ctataatggcatccaagactgtgggcacagctgaagaaaaattgaagaagaaatcatccttttatcagtcttact

SEQ ID NO: 279680 - DNA, 75 bp, Artificial Sequence
  Synthetic
cacagctgaagaaaaattgaagaagaaatcatccttttatcagtcttacttgaggaggactcaatcaatggggat

SEQ ID NO: 279681 - DNA, 75 bp, Artificial Sequence
  Synthetic
ctatacatgcttgaatggggcaaggaaatggttgatcattttcatcttggtgatgatatggatcctgaactcaga

SEQ ID NO: 279682 - DNA, 75 bp, Artificial Sequence
  Synthetic
agaaagtgaaggaaatatctaaccaggagcccttaaaaatatgaataactattattgcactgaaatttataggca

SEQ ID NO: 279683 - DNA, 75 bp, Artificial Sequence
  Synthetic
ggagcccttaaaaatatgaataactattattgcactgaaatttataggcattataagtactaacatgcagacata

SEQ ID NO: 279684 - DNA, 75 bp, Artificial Sequence
  Synthetic
aattgtttactaatcagggtatatacgggtttgcatattaatatatcagggtttactatcagggtaactaattat

SEQ ID NO: 279685 - DNA, 75 bp, Artificial Sequence
  Synthetic
gtttactatcagggtaactaattatcagggtttattactcatcaggtttatcagggtttaactggaattcatatt

SEQ ID NO: 279686 - DNA, 75 bp, Artificial Sequence
  Synthetic
catacataatgattgtagcaaatactaatgacagttatgaatgtaattactaatacaatattgatataatctata

SEQ ID NO: 279687 - DNA, 75 bp, Artificial Sequence
  Synthetic
taatgacagttatgaatgtaattactaatacaatattgatataatctatattgattaagtaagtgtaggatttat

SEQ ID NO: 279688 - DNA, 75 bp, Artificial Sequence
  Synthetic
atcctttatttatctagtgggcccaagaatgtgaaactgagctatccttttcctttttcaccactttctttctta

SEQ ID NO: 279689 - DNA, 75 bp, Artificial Sequence
  Synthetic
agaatgtgaaactgagctatccttttcctttttcaccactttctttcttaccttctacctcagtgtacttatata

SEQ ID NO: 279690 - DNA, 75 bp, Artificial Sequence
  Synthetic
caaacacagacaaatatgggaaaatctagtccagtttgtctgtatctgattcttcagggtctattactatttggt

SEQ ID NO: 279691 - DNA, 75 bp, Artificial Sequence
  Synthetic
aacttaaaatggaatgtccgcatacaattgggttaggtcaaggtcttgttgtaggctcggtagaactaccacctg

SEQ ID NO: 279692 - DNA, 75 bp, Artificial Sequence
  Synthetic
aatacacaagcatcatcaacaagttttcagacaaaaagtagtgaggttaacttaagaggtctgtgcttgatccct

SEQ ID NO: 279693 - DNA, 75 bp, Artificial Sequence
  Synthetic
gtcataaaaaaggtgacatctggtgataatatgaagattgaaaagaactttgagactcttgttcagaaaactggt

SEQ ID NO: 279694 - DNA, 75 bp, Artificial Sequence
  Synthetic
ataatatgaagattgaaaagaactttgagactcttgttcagaaaactggttgcacagccaacggttttcaagggt

SEQ ID NO: 279695 - DNA, 75 bp, Artificial Sequence
  Synthetic
cttgatgattatcgatcagctgaggttttatcacgaatggcttttgcacctcatggagaagatcatgacatagaa

SEQ ID NO: 279696 - DNA, 75 bp, Artificial Sequence
  Synthetic
ttgctggcaaagtaacaggtaaggcaccgtctaccgaatcatcagacacagttcaaggtattgcattttcaggta

SEQ ID NO: 279697 - DNA, 75 bp, Artificial Sequence
  Synthetic
attaacagcaaaagatgatcctgtgtatatttgggccccaggtatcatcatggaaggaaaccactctgtctgtga

SEQ ID NO: 279698 - DNA, 75 bp, Artificial Sequence
  Synthetic
tatatttgggccccaggtatcatcatggaaggaaaccactctgtctgtgaaaaaaagacactgcctttaacatgg

SEQ ID NO: 279699 - DNA, 75 bp, Artificial Sequence
  Synthetic
aaataaagtttgtctgtcaaagagtagacatggatatcactgtatattgtaatggagtaaaaaaagttatcctta

SEQ ID NO: 279700 - DNA, 75 bp, Artificial Sequence
  Synthetic
aatgatactattaaaaatattgattgcatttgcatatctttgctctaaatataatacagattccaagtttaagat

SEQ ID NO: 279701 - DNA, 75 bp, Artificial Sequence
  Synthetic
ataatacagattccaagtttaagattttggttgaaaaagtaaaaaaagaatatcagaagactatgggttcaatgg

SEQ ID NO: 279702 - DNA, 75 bp, Artificial Sequence
  Synthetic
tgagactgctaaagagctagaatcacataggaagagttgttcaattggttcatgcccttattgtcttaatccatc

SEQ ID NO: 279703 - DNA, 75 bp, Artificial Sequence
  Synthetic
aaagtcactaacaatgtatgagccaatgcagggttgctatcgaacattatccttgtttaggtatcgcagtagatt

SEQ ID NO: 279704 - DNA, 75 bp, Artificial Sequence
  Synthetic
gggctgctagtgcagaaacacaaaacttaaatgctggttggactgatacagcacatggatcggggataatcccaa

SEQ ID NO: 279705 - DNA, 75 bp, Artificial Sequence
  Synthetic
ctcacttccatcatctgctagttatacctaccgtagacaattacaaaacccagccaatgaacaagaaaaaatacc

SEQ ID NO: 279706 - DNA, 75 bp, Artificial Sequence
  Synthetic
acctaccgtagacaattacaaaacccagccaatgaacaagaaaaaataccattccatctgcagataagtaaacag

SEQ ID NO: 279707 - DNA, 75 bp, Artificial Sequence
  Synthetic
actggttggggctgtaaccctcctgattgccctggtgtaggaacaggctgtactgcttgcggtgtatacctagat

SEQ ID NO: 279708 - DNA, 75 bp, Artificial Sequence
  Synthetic
ttaagattgtgtctttaagatatacaaggaaggtatgcattcaattaggcacagaacagacctgtaaaactgttg

SEQ ID NO: 279709 - DNA, 75 bp, Artificial Sequence
  Synthetic
atcagttaaagtgtgtttgataggaaccatttctaaatttcaaccttctgacacccttttattcctcggtcctct

SEQ ID NO: 279710 - DNA, 75 bp, Artificial Sequence
  Synthetic
caatggtgtaccactacatgtcaatttggtgatcctggagacataatgagcacaccaacaggaatgaagtgtcca

SEQ ID NO: 279711 - DNA, 75 bp, Artificial Sequence
  Synthetic
ttggtgatcctggagacataatgagcacaccaacaggaatgaagtgtccagaactaaatggttcatttagaaaga

SEQ ID NO: 279712 - DNA, 75 bp, Artificial Sequence
  Synthetic
caaaagattcttttcaatcatttaatgtaacagaaccacacatctctacaagtgcattggagtggattgatccag

SEQ ID NO: 279713 - DNA, 75 bp, Artificial Sequence
  Synthetic
atagttcactccgggatcacatcaatgtgatcgtaagccgtgatttatcgttccaggatttaagtgaaacacctt

SEQ ID NO: 279714 - DNA, 75 bp, Artificial Sequence
  Synthetic
tatagatggggcatggggttcaggagttggctttaatctagtttgcactgttagtttaacagaatgctctacatt

SEQ ID NO: 279715 - DNA, 75 bp, Artificial Sequence
  Synthetic
tacaatccatgttgttggtaagggtggacattctggctcaaagtttatgtgttgtcatgacacgaaatgctctag

SEQ ID NO: 279716 - DNA, 75 bp, Artificial Sequence
  Synthetic
gttgtcatgacacgaaatgctctagcaaagggttagtcgcagctgcaccacatctagatcgtgtgacagggttta

SEQ ID NO: 279717 - DNA, 75 bp, Artificial Sequence
  Synthetic
gagagtgggtccttggagtgctcaatgggaattggatggtagtggctgtattgatagcattactgatactgtcta

SEQ ID NO: 279718 - DNA, 75 bp, Artificial Sequence
  Synthetic
tgggaattggatggtagtggctgtattgatagcattactgatactgtctatcttcttatttgcattatgttgtcc

SEQ ID NO: 279719 - DNA, 75 bp, Artificial Sequence
  Synthetic
cacaaaccttaaataacaattactaatctatatgctatattctatttaccagtataatcaccatatgactatata

SEQ ID NO: 279720 - DNA, 75 bp, Artificial Sequence
  Synthetic
ttcatttgatacctaaccactatatataaaaaaaactagcactttactaattacattacctcataccgattatgc

SEQ ID NO: 279721 - DNA, 75 bp, Artificial Sequence
  Synthetic
aaactagcactttactaattacattacctcataccgattatgcctggacttttgttcttgcggagtctactacta

SEQ ID NO: 279722 - DNA, 75 bp, Artificial Sequence
  Synthetic
atgagtgacttgacagatattcaagaggatataacccgtcatgaacaacagcttgttgctgccagacaaaaactt

SEQ ID NO: 279723 - DNA, 75 bp, Artificial Sequence
  Synthetic
actaagcctgctgacccgactgggattgaacctgatgaccacctcaaggagagatcaagtcttagatatggaaat

SEQ ID NO: 279724 - DNA, 75 bp, Artificial Sequence
  Synthetic
gagatcaagtcttagatatggaaatgtccttgatgtgaatgcaattgatattgaggaaccaagcggccagacagc

SEQ ID NO: 279725 - DNA, 75 bp, Artificial Sequence
  Synthetic
gtgataggctttacacttcccatcatccttaaagctctatatatgttgtcaacacgtgggagacaaactgtgaag

SEQ ID NO: 279726 - DNA, 75 bp, Artificial Sequence
  Synthetic
ttaaagatgacacatcatttgaggacataaatggcataaggagaccaaaacacttatatgtctcaatgcctactg

SEQ ID NO: 279727 - DNA, 75 bp, Artificial Sequence
  Synthetic
cataaatggcataaggagaccaaaacacttatatgtctcaatgcctactgcccaatcaacaatgaaagcagagga

SEQ ID NO: 279728 - DNA, 75 bp, Artificial Sequence
  Synthetic
cacttatatgtctcaatgcctactgcccaatcaacaatgaaagcagaggaactcacacctggtagatttcgcaca

SEQ ID NO: 279729 - DNA, 75 bp, Artificial Sequence
  Synthetic
agatccaggttcgcaacattatgagcccagttatgggggtcataggcttctcattctttgttaaggactggccag

SEQ ID NO: 279730 - DNA, 75 bp, Artificial Sequence
  Synthetic
cccagttatgggggtcataggcttctcattctttgttaaggactggccagagaggattagagagtttatggaaaa

SEQ ID NO: 279731 - DNA, 75 bp, Artificial Sequence
  Synthetic
gttaaaccaggcacaccagcacaggagattgagatgctaaaaaagaataaaatctattttatgcatcgacaggat

SEQ ID NO: 279732 - DNA, 75 bp, Artificial Sequence
  Synthetic
agattgagatgctaaaaaagaataaaatctattttatgcatcgacaggatgtgcttgataaaaatcatgtggcag

SEQ ID NO: 279733 - DNA, 75 bp, Artificial Sequence
  Synthetic
agcctctggagatcctacgtcacctgacaatattgactctcctaatgctccatgggtatttgcctgtgctccaga

SEQ ID NO: 279734 - DNA, 75 bp, Artificial Sequence
  Synthetic
gacaatattgactctcctaatgctccatgggtatttgcctgtgctccagatcgatgccccccaacatgcatttat

SEQ ID NO: 279735 - DNA, 75 bp, Artificial Sequence
  Synthetic
ctttcttttcaatacttcaggatatgagaaacaccataatggcatcaaagactgttggaacagcagaagagaagc

SEQ ID NO: 279736 - DNA, 75 bp, Artificial Sequence
  Synthetic
gagaaacaccataatggcatcaaagactgttggaacagcagaagagaagctaaagaagaaatcctccttctatca

SEQ ID NO: 279737 - DNA, 75 bp, Artificial Sequence
  Synthetic
gacaatatcatattcagggattaaatttattaattgtttactaatttgatcatacgggtttgtaatcacagttat

SEQ ID NO: 279738 - DNA, 75 bp, Artificial Sequence
  Synthetic
tttattaattgtttactaatttgatcatacgggtttgtaatcacagttatcagggtttaaaattaatgaattaat

SEQ ID NO: 279739 - DNA, 75 bp, Artificial Sequence
  Synthetic
tataagtacatatcagctaatataacaattaatacagggaattactaataacagttatgaatgtattaagatatt

SEQ ID NO: 279740 - DNA, 75 bp, Artificial Sequence
  Synthetic
caattaatacagggaattactaataacagttatgaatgtattaagatattatatttttataatcaatatccaatt

SEQ ID NO: 279741 - DNA, 75 bp, Artificial Sequence
  Synthetic
agcattataatagtagatttttttatatattactttatttagtgggcccgaacatgtgaaactgagctatcctct

SEQ ID NO: 279742 - DNA, 75 bp, Artificial Sequence
  Synthetic
tatattactttatttagtgggcccgaacatgtgaaactgagctatcctcttccattttcaccactgtctctttca

SEQ ID NO: 279743 - DNA, 75 bp, Artificial Sequence
  Synthetic
tccattttcaccactgtctctttcactcttctacctcagtgtacttatatatatgcaagtagcatatatataagt

SEQ ID NO: 279744 - DNA, 75 bp, Artificial Sequence
  Synthetic
ctacgagaaaaactggaatgagtgacttgacagatatccaagaggatataacccgccatgaacagcagcttgttg

SEQ ID NO: 279745 - DNA, 75 bp, Artificial Sequence
  Synthetic
acccgccatgaacagcagcttgttgttgctagacaaaaacttaaagatgcagaaagagcagtggaagtggaccca

SEQ ID NO: 279746 - DNA, 75 bp, Artificial Sequence
  Synthetic
attggaggataaactcgcagactacaagagaagaatggcagatgctgtgtccaggaaaaagatggatactaaacc

SEQ ID NO: 279747 - DNA, 75 bp, Artificial Sequence
  Synthetic
gatgatcacctcaaggagagatcaagtcttaggtatggaaatgtccttgatgtgaatgcaatcgatattgaagaa

SEQ ID NO: 279748 - DNA, 75 bp, Artificial Sequence
  Synthetic
tgtgaatgcaatcgatattgaagaaccaagtggccaaacagcagattggtatacaattggagtttatgtgatagg

SEQ ID NO: 279749 - DNA, 75 bp, Artificial Sequence
  Synthetic
caggtaggtttcgcacaatagtatgtggtctatttccaactcagatccaagttcgtaacatcatgagtccagtta

SEQ ID NO: 279750 - DNA, 75 bp, Artificial Sequence
  Synthetic
tgtgaaagattggccagagagaattagagagttcatggagaaggaatgcccattcatcaagccagaagtcaaacc

SEQ ID NO: 279751 - DNA, 75 bp, Artificial Sequence
  Synthetic
atgttgaaaagaaataagatctactttatgcagcgtcaggatgtgcttgacaaaaatcatgtggcagacattgat

SEQ ID NO: 279752 - DNA, 75 bp, Artificial Sequence
  Synthetic
ttatgcagcgtcaggatgtgcttgacaaaaatcatgtggcagacattgataagttaattgactatgcagcctctg

SEQ ID NO: 279753 - DNA, 75 bp, Artificial Sequence
  Synthetic
tcaatactgcaggacatgagaaatacaataatggcatctaagactgttggcacagcagaagaaaaattgaagaaa

SEQ ID NO: 279754 - DNA, 75 bp, Artificial Sequence
  Synthetic
tacgtcggactcaatcaatgggaattcaacttgaccagagaatcatcctattgttcatgttagaatggggtaaag

SEQ ID NO: 279755 - DNA, 75 bp, Artificial Sequence
  Synthetic
tcaacttgaccagagaatcatcctattgttcatgttagaatggggtaaagagatggtggatcatttccatctcgg

SEQ ID NO: 279756 - DNA, 75 bp, Artificial Sequence
  Synthetic
ggtcttgcacaggcactgatagatcaaaaggtgaaagaaatatcaaaccaggagccattaaaaatataattactt

SEQ ID NO: 279757 - DNA, 75 bp, Artificial Sequence
  Synthetic
aaaaggtgaaagaaatatcaaaccaggagccattaaaaatataattacttaattacatatgcactgattatagat

SEQ ID NO: 279758 - DNA, 75 bp, Artificial Sequence
  Synthetic
ataagtacatatcaattaataacaatcaatacagagattactaatggcagttatgaatgtattaagatattattt

SEQ ID NO: 279759 - DNA, 75 bp, Artificial Sequence
  Synthetic
tagtagtagactccttgaaaagctactacgagaaaaactggaatgagtgacttgacagatatccaagaggatata

SEQ ID NO: 279760 - DNA, 75 bp, Artificial Sequence
  Synthetic
aagagaaggatggcagatgctgtgtccaggaaaaaaatggatactaaacctactgacccgactgggattgaacca

SEQ ID NO: 279761 - DNA, 75 bp, Artificial Sequence
  Synthetic
tgtgaacgcaattgatattgaggaaccaagtggccaaacagcagactggtatacaattggagtttatgtgatagg

SEQ ID NO: 279762 - DNA, 75 bp, Artificial Sequence
  Synthetic
gcataaggaggccaaagcatttatacgtttctatgcccactgcccagtcaaccatgaaggcagaagaactcacac

SEQ ID NO: 279763 - DNA, 75 bp, Artificial Sequence
  Synthetic
agagagttcatggaaaaggaatgcccgttcatcaagcctgaagttaaaccaggcacaccagcacaagagattgag

SEQ ID NO: 279764 - DNA, 75 bp, Artificial Sequence
  Synthetic
atgttgaaaagaaataagatttactttatgcagcgccaggatgtacttgataaaaatcatgtggcagacattgat

SEQ ID NO: 279765 - DNA, 75 bp, Artificial Sequence
  Synthetic
aagttaattgactatgcagcctctggtgaccctacgtcacctgataacattgattcccctaatgcaccatgggta

SEQ ID NO: 279766 - DNA, 75 bp, Artificial Sequence
  Synthetic
gtgaccctacgtcacctgataacattgattcccctaatgcaccatgggtattggcatgtggaccagaacgatgcc

SEQ ID NO: 279767 - DNA, 75 bp, Artificial Sequence
  Synthetic
gatggctgagcttggggcttttttttcaattctgcaggacatgagaaatacaataatggcgtctaagaccgtcgg

SEQ ID NO: 279768 - DNA, 75 bp, Artificial Sequence
  Synthetic
aagtcctttttttaccaatattacttacgccggactcactcaatggggatccaacttgaccagagaatcatccta

SEQ ID NO: 279769 - DNA, 75 bp, Artificial Sequence
  Synthetic
agagccattaataatataattacttaatcacatatgcattaattatagatagtaagttactaacatgcagacaat

SEQ ID NO: 279770 - DNA, 75 bp, Artificial Sequence
  Synthetic
aatcacatatgcattaattatagatagtaagttactaacatgcagacaatattatatattcagggatcatatgtg

SEQ ID NO: 279771 - DNA, 75 bp, Artificial Sequence
  Synthetic
tcattaattaataaactaatcagggttaaactggaaatatagcattataagtacatatcaattaataacgatcaa

SEQ ID NO: 279772 - DNA, 75 bp, Artificial Sequence
  Synthetic
gaatgtattaagatattattttataatcattgtgtagttagcattatgtagaataaggttgtattttattattta

SEQ ID NO: 279773 - DNA, 75 bp, Artificial Sequence
  Synthetic
ctgtcctttttcctttcaccactttttttcttaaaacttatttatttctacctcagtgtacttatatatatgcaa

SEQ ID NO: 279774 - DNA, 75 bp, Artificial Sequence
  Synthetic
gcagtaaatgccagaaatctgaatgaacttaaaatggaatgtccgcatacaattgggttaggtcaaggccttgtt

SEQ ID NO: 279775 - DNA, 75 bp, Artificial Sequence
  Synthetic
gactataatggttcgttgttttctggtcataaaaaaggtgacatctggtgatagtatgaagattgaaaaaaactt

SEQ ID NO: 279776 - DNA, 75 bp, Artificial Sequence
  Synthetic
agattgaaaaaacaacacagtgtacagttttttgtactttagcaggaccgggtgcagattgtgaggcatattctg

SEQ ID NO: 279777 - DNA, 75 bp, Artificial Sequence
  Synthetic
atcagttaaagtgtgcttgatagggaccatttcgaaatttcaaccttctgacacccttttattcctcggtcctct

SEQ ID NO: 279778 - DNA, 75 bp, Artificial Sequence
  Synthetic
gtgtcttgttggtttaaaaaatcaggagaatgggtccttggagtgctcaatggaaattggatggtagtagctgta

SEQ ID NO: 279779 - DNA, 75 bp, Artificial Sequence
  Synthetic
atctatatgctatattttatttactactataatcaccatatgactatctatgtcctattatcttatatcatgtgt

SEQ ID NO: 279780 - DNA, 75 bp, Artificial Sequence
  Synthetic
atgggaatacagcttgatcaaaggattatccttctatacatgttagaatggggtaaagaaatggtggatcatttc

SEQ ID NO: 279781 - DNA, 75 bp, Artificial Sequence
  Synthetic
ttatccttctatacatgttagaatggggtaaagaaatggtggatcatttccatcttggtgatgatatggatcctg

SEQ ID NO: 279782 - DNA, 75 bp, Artificial Sequence
  Synthetic
gatagatcaaaaagtgaaagagatatcaaaccaagagccattaaagatataatcatttactcaaattattaattg

SEQ ID NO: 279783 - DNA, 75 bp, Artificial Sequence
  Synthetic
ttctacctcagtgtacttatatatatgcaagtagcatatatataagtacacaacatactacctcaacatgctgat

SEQ ID NO: 279784 - DNA, 75 bp, Artificial Sequence
  Synthetic
atgagtgacttggcagacatccaagaggagataacccgccatgagcaacaacttgttgctgccagacaaaaactc

SEQ ID NO: 279785 - DNA, 75 bp, Artificial Sequence
  Synthetic
cagactacaagagaagaatggcagatgctgtgtcccggaagaaaatggatactaaacctactgacccgactggga

SEQ ID NO: 279786 - DNA, 75 bp, Artificial Sequence
  Synthetic
agatacaagttcgtaacatcatgagtccagtaatgggagtgattggtttttctttctttgttaaagactggccag

SEQ ID NO: 279787 - DNA, 75 bp, Artificial Sequence
  Synthetic
tgcctctggtgaccctacatcacctgatgacatcgaatctcctaatgcaccatgggtatttgcttgtgcaccaga

SEQ ID NO: 279788 - DNA, 75 bp, Artificial Sequence
  Synthetic
gattaattcagatttattactaattgtaggtatagtatattactaatctcagattatatcatgtattcagggatt

SEQ ID NO: 279789 - DNA, 75 bp, Artificial Sequence
  Synthetic
atatacgggtttgacaattattattatcagggttttgaattaatgcactaatcagggtttaactggaattataca

SEQ ID NO: 279790 - DNA, 75 bp, Artificial Sequence
  Synthetic
tttccttttcaccactatctctcttactttctacctcagtgtacttatatatatgcaagtagcatatatataagt

SEQ ID NO: 279791 - DNA, 75 bp, Artificial Sequence
  Synthetic
actggtagtattactgatcttgtccatactcttattcacattatgttgtcctcgtagacctagttacaggaaaga

SEQ ID NO: 279792 - DNA, 75 bp, Artificial Sequence
  Synthetic
ttatttaatcactatatagaaaaaaaactagcactttactaattaaattaccccataccgattatgcctggactt

SEQ ID NO: 279793 - DNA, 75 bp, Artificial Sequence
  Synthetic
catgaacaacaacttgttgttgccagacaaaagctcaaggatgcagaaaaggcggtggaaatggacccagatgac

SEQ ID NO: 279794 - DNA, 75 bp, Artificial Sequence
  Synthetic
ggcggtggaaatggacccagatgacgttaacaagaacacattacaagcaaggcaacaaacagtgtcagcactgga

SEQ ID NO: 279795 - DNA, 75 bp, Artificial Sequence
  Synthetic
agaatggcagatgctgtgtcccggaaaaagatggatactaagcctactgatccgactgggattgaaccggatgac

SEQ ID NO: 279796 - DNA, 75 bp, Artificial Sequence
  Synthetic
aaaagatggatactaagcctactgatccgactgggattgaaccggatgaccatcttaaagaacgatcaagcctta

SEQ ID NO: 279797 - DNA, 75 bp, Artificial Sequence
  Synthetic
tgctattgacatagaagaaccgagtggtcaaacagcagattggtatacaattggggtttatgtcataggtttcac

SEQ ID NO: 279798 - DNA, 75 bp, Artificial Sequence
  Synthetic
ggtcaaacagcagattggtatacaattggggtttatgtcataggtttcacactccctatcatcttaaaggccttg

SEQ ID NO: 279799 - DNA, 75 bp, Artificial Sequence
  Synthetic
agactgtgaaggagaacaaagggactcgcatccggttcaaagatgatacttcatttgaggacattaatggtatta

SEQ ID NO: 279800 - DNA, 75 bp, Artificial Sequence
  Synthetic
catgcccactgctcagtcaactatgaaagctgaggaattaacccctggtaggttcaggactatagtctgcggttt

SEQ ID NO: 279801 - DNA, 75 bp, Artificial Sequence
  Synthetic
aaagctgaggaattaacccctggtaggttcaggactatagtctgcggtttatttccaactcaaattcaagtacgt

SEQ ID NO: 279802 - DNA, 75 bp, Artificial Sequence
  Synthetic
tcatcggtttttctttttttgtaaaggattgggcagaacgtattagagaatttatggagaaagaatgccccttca

SEQ ID NO: 279803 - DNA, 75 bp, Artificial Sequence
  Synthetic
ggattgggcagaacgtattagagaatttatggagaaagaatgccccttcatcaaaccagaaatgaaaccagggac

SEQ ID NO: 279804 - DNA, 75 bp, Artificial Sequence
  Synthetic
aagagaaataaagtttactttatgcaacgccaagatgtattggacaaaaatcatgtggctgatattgataagtta

SEQ ID NO: 279805 - DNA, 75 bp, Artificial Sequence
  Synthetic
aacgccaagatgtattggacaaaaatcatgtggctgatattgataagttaattgattatgcagcctcaggagatc

SEQ ID NO: 279806 - DNA, 75 bp, Artificial Sequence
  Synthetic
tcctaatgccccatgggtatttgcatgtgcccctgacagatgcccaccaacttgtatttatgttgcgggaatggc

SEQ ID NO: 279807 - DNA, 75 bp, Artificial Sequence
  Synthetic
cttgtatttatgttgcgggaatggcagagttaggtgcctttttctccatattgcaggatatgagaaacaccatta

SEQ ID NO: 279808 - DNA, 75 bp, Artificial Sequence
  Synthetic
tgaggaaaaactgaaaaagaagtcatcattttatcaatcatatctacgtagaactcagtcaatgggaatacaact

SEQ ID NO: 279809 - DNA, 75 bp, Artificial Sequence
  Synthetic
tcattttatcaatcatatctacgtagaactcagtcaatgggaatacaactagaccaaagaattattctcttatat

SEQ ID NO: 279810 - DNA, 75 bp, Artificial Sequence
  Synthetic
ttgatcattttcatctgggtgatgacatggatccagaacttagaggccttgcacaagcacttattgaccaaaaag

SEQ ID NO: 279811 - DNA, 75 bp, Artificial Sequence
  Synthetic
gcacaagcacttattgaccaaaaagtaaaggaaatatccaatcaggagcccttaaaaatatgaaagaactgctaa

SEQ ID NO: 279812 - DNA, 75 bp, Artificial Sequence
  Synthetic
taaaggaaatatccaatcaggagcccttaaaaatatgaaagaactgctaatcgcaccgataatataagcataata

SEQ ID NO: 279813 - DNA, 75 bp, Artificial Sequence
  Synthetic
attcagggatatttagttaattgtttactaatttgggtatttacgggtttatatattatcatatcagggtttaaa

SEQ ID NO: 279814 - DNA, 75 bp, Artificial Sequence
  Synthetic
tactaatttgggtatttacgggtttatatattatcatatcagggtttaaatattattatcagggtttactaatca

SEQ ID NO: 279815 - DNA, 75 bp, Artificial Sequence
  Synthetic
gtaagatatcatatatatttcaatttaatcataggaatctattaatgataattatgaatgtattgtataattaag

SEQ ID NO: 279816 - DNA, 75 bp, Artificial Sequence
  Synthetic
ttaattaggtatagttaagtttgttatagtaagtgtcatagtcatatatccatatttcgttatttatttaatggg

SEQ ID NO: 279817 - DNA, 75 bp, Artificial Sequence
  Synthetic
atagtaagtgtcatagtcatatatccatatttcgttatttatttaatgggcccataaaatgtgaaactgagctgt

SEQ ID NO: 279818 - DNA, 75 bp, Artificial Sequence
  Synthetic
cccctttctttttcaccactgtctttcttaccttctacctcagtgtacttatatatatgcaagtagcatatatat

SEQ ID NO: 279819 - DNA, 75 bp, Artificial Sequence
  Synthetic
atacaattggagtttatgtgataggattcacactccctatcatccttaaggccttatacatgctttcaacgcgtg

SEQ ID NO: 279820 - DNA, 75 bp, Artificial Sequence
  Synthetic
gttcgtaacatcatgagtccagtcatgggggttattggtttttcattttttgtgaaagattggccagagagaatc

SEQ ID NO: 279821 - DNA, 75 bp, Artificial Sequence
  Synthetic
cgttcattaagccagaagttaaaccaggcacaccggcacaagagattgagatgttgaaaagaaataaaatttact

SEQ ID NO: 279822 - DNA, 75 bp, Artificial Sequence
  Synthetic
ttatgcagcgccaggatgtacttgacaaaaatcatgtggcagacattgataagttgattgactatgcagcctccg

SEQ ID NO: 279823 - DNA, 75 bp, Artificial Sequence
  Synthetic
tgattcccctaatgcaccatgggtatttgcatgtgcaccagaccgatgtccaccaacatgtatttatgttgcagg

SEQ ID NO: 279824 - DNA, 75 bp, Artificial Sequence
  Synthetic
gatggctgagcttggggcctttttttcaatactccaggacatgagaaatacaataatggcatctaagactgttgg

SEQ ID NO: 279825 - DNA, 75 bp, Artificial Sequence
  Synthetic
cactgctgaagagaagttaaagaaaaagtcctctttctaccagtcttatttacgccggactcaatcaatgggaat

SEQ ID NO: 279826 - DNA, 75 bp, Artificial Sequence
  Synthetic
ttattcatgttggaatggggtaaagagatggtggatcatttccatcttggtgatgatatggatccagagctaaga

SEQ ID NO: 279827 - DNA, 75 bp, Artificial Sequence
  Synthetic
agatggtggatcatttccatcttggtgatgatatggatccagagctaagaggtcttgcacaggcgctgatagatc

SEQ ID NO: 279828 - DNA, 75 bp, Artificial Sequence
  Synthetic
agagccgttgaaaatataattacttaattatatgcactgattatatagatagtaagtactaacatgcagacaata

SEQ ID NO: 279829 - DNA, 75 bp, Artificial Sequence
  Synthetic
ttatatattcagggatcatatgtgttagttgtttactaatcaaatatacgggtttataatcgtaagtatcagggt

SEQ ID NO: 279830 - DNA, 75 bp, Artificial Sequence
  Synthetic
acatatcaattaataatgatcagtacagggattactaatggcagttatgaatgtattaagatattattttgtaat

SEQ ID NO: 279831 - DNA, 75 bp, Artificial Sequence
  Synthetic
tttcttaaaacttatttacttctacctcagtgtacttatatatatgcaagtagcatatatataagtacacaacat

SEQ ID NO: 279832 - DNA, 75 bp, Artificial Sequence
  Synthetic
tagtagtagactccgagatagagaagtttactacaaatggagaaatacagagagatccatgagagagtgaaggag

SEQ ID NO: 279833 - DNA, 75 bp, Artificial Sequence
  Synthetic
tagagtgtttagacttattagatcggctgtatgcagttaggcatgatgttgtggatcagatgataaagcatgatt

SEQ ID NO: 279834 - DNA, 75 bp, Artificial Sequence
  Synthetic
gctggtgtcccaaatgatgtgatacaaagcatggagaaaagaattatcccagggagtccaagtggccaaattctt

SEQ ID NO: 279835 - DNA, 75 bp, Artificial Sequence
  Synthetic
aaagcatggagaaaagaattatcccagggagtccaagtggccaaattcttagatcatttttcaagatgacacctg

SEQ ID NO: 279836 - DNA, 75 bp, Artificial Sequence
  Synthetic
aatagagtttattgaggtaacagtgactgctgatgtggcgagaggtgttagggaaaaaatattaaaatatcaagg

SEQ ID NO: 279837 - DNA, 75 bp, Artificial Sequence
  Synthetic
actgctgatgtggcgagaggtgttagggaaaaaatattaaaatatcaaggaggtttggagtttattgagcaacta

SEQ ID NO: 279838 - DNA, 75 bp, Artificial Sequence
  Synthetic
attgtcaatctggattcaggataaagtttgatgtagtggctataagaactgatggatcaaatatctcaacacagt

SEQ ID NO: 279839 - DNA, 75 bp, Artificial Sequence
  Synthetic
gtttgatgtagtggctataagaactgatggatcaaatatctcaacacagtggcctagcaggaggaatgaaggtgt

SEQ ID NO: 279840 - DNA, 75 bp, Artificial Sequence
  Synthetic
gcagacattaactttgtcagagaacatttgataaaaaatgatgagagaggtgcacttgaagcaatgttcaactta

SEQ ID NO: 279841 - DNA, 75 bp, Artificial Sequence
  Synthetic
atttgataaaaaatgatgagagaggtgcacttgaagcaatgttcaacttaaaatttcatgttacaggccctaaag

SEQ ID NO: 279842 - DNA, 75 bp, Artificial Sequence
  Synthetic
caggcctcaacagttatgtcaacctgtactagaaaatctggtagattattgtaagaattggcttggaactgatca

SEQ ID NO: 279843 - DNA, 75 bp, Artificial Sequence
  Synthetic
gtactagaaaatctggtagattattgtaagaattggcttggaactgatcatgcttttgcatttaaagaagtaact

SEQ ID NO: 279844 - DNA, 75 bp, Artificial Sequence
  Synthetic
gagatgaagaagagctacatgcatctaagtatggacactcaagaaagcctaggaattttcttttatgtcaaataa

SEQ ID NO: 279845 - DNA, 75 bp, Artificial Sequence
  Synthetic
taagtatggacactcaagaaagcctaggaattttcttttatgtcaaataagtctccaagcaccatatttaccatc

SEQ ID NO: 279846 - DNA, 75 bp, Artificial Sequence
  Synthetic
acaaggttagcttgcagtgaaatcttaaaaaattatcctgagacacctttacaactgttagccagggatatggct

SEQ ID NO: 279847 - DNA, 75 bp, Artificial Sequence
  Synthetic
taaaaaattatcctgagacacctttacaactgttagccagggatatggcttacaaatacattactctagataatg

SEQ ID NO: 279848 - DNA, 75 bp, Artificial Sequence
  Synthetic
tagggtttacttcaaacccacacagaatatcaaagaaccagggacgttcaagttaaatttgtccagtatggatcc

SEQ ID NO: 279849 - DNA, 75 bp, Artificial Sequence
  Synthetic
aatatcaaagaaccagggacgttcaagttaaatttgtccagtatggatcctaagtcaaaggcattgatcgatgtc

SEQ ID NO: 279850 - DNA, 75 bp, Artificial Sequence
  Synthetic
tttttggtgaattaattgatagtattgatgtagcaagtcaggttcagcagaatgaatgtgcaaaaactgttgaaa

SEQ ID NO: 279851 - DNA, 75 bp, Artificial Sequence
  Synthetic
tgatgtagcaagtcaggttcagcagaatgaatgtgcaaaaactgttgaaaaaatcctttctgaccttgaagttaa

SEQ ID NO: 279852 - DNA, 75 bp, Artificial Sequence
  Synthetic
gaacagccaaaaagaactactggagtggatgatatcctgaggaagttttatgacaatgagcttgttaagtactta

SEQ ID NO: 279853 - DNA, 75 bp, Artificial Sequence
  Synthetic
tggatgatatcctgaggaagttttatgacaatgagcttgttaagtacttaatctcagttatacgaaaaacaactg

SEQ ID NO: 279854 - DNA, 75 bp, Artificial Sequence
  Synthetic
tgatattactgaatctcttattgcacatgcagggcttaaaaggtctaaatattggtctgctcacggctatgccta

SEQ ID NO: 279855 - DNA, 75 bp, Artificial Sequence
  Synthetic
catgcagggcttaaaaggtctaaatattggtctgctcacggctatgcctatggtagtgttttgttgtgtatttta

SEQ ID NO: 279856 - DNA, 75 bp, Artificial Sequence
  Synthetic
gttcattcattagattttttactgtattcaaggaaggactaggccttattgatgtagataatcttgattctaaag

SEQ ID NO: 279857 - DNA, 75 bp, Artificial Sequence
  Synthetic
attcaaggaaggactaggccttattgatgtagataatcttgattctaaagtagagattgatggtgtttcatggtg

SEQ ID NO: 279858 - DNA, 75 bp, Artificial Sequence
  Synthetic
ttaaatcgattattagcattaaatattgcatttgaaaagtcccttcttgctacagccacatggttccaatattac

SEQ ID NO: 279859 - DNA, 75 bp, Artificial Sequence
  Synthetic
ttgcatttgaaaagtcccttcttgctacagccacatggttccaatattacacagaggatcaagggcacttccctc

SEQ ID NO: 279860 - DNA, 75 bp, Artificial Sequence
  Synthetic
tgcattccattttcttctctccacatctcaaaagatgaagttatgtgccatatttgataatttacggtaccttat

SEQ ID NO: 279861 - DNA, 75 bp, Artificial Sequence
  Synthetic
tctcaaaagatgaagttatgtgccatatttgataatttacggtaccttattccagcagttacatctacatattct

SEQ ID NO: 279862 - DNA, 75 bp, Artificial Sequence
  Synthetic
tctttgaaagacctttcaaaagtgcattggaggtatacctgtataatattataaagacactattagttagcttag

SEQ ID NO: 279863 - DNA, 75 bp, Artificial Sequence
  Synthetic
attggaggtatacctgtataatattataaagacactattagttagcttagctcaaaataataaaataagatttta

SEQ ID NO: 279864 - DNA, 75 bp, Artificial Sequence
  Synthetic
actgttgaccaatcaacaattggggcaagtggagtttatccctcattaatgtcacgggttgtatataagcattac

SEQ ID NO: 279865 - DNA, 75 bp, Artificial Sequence
  Synthetic
caagtggagtttatccctcattaatgtcacgggttgtatataagcattaccgtagtttaatttcagaagcaacaa

SEQ ID NO: 279866 - DNA, 75 bp, Artificial Sequence
  Synthetic
actacatggtaatctcacagaagaggctaaaattcaccttgaaacagtggaatgggccagaaaatttagagaaaa

SEQ ID NO: 279867 - DNA, 75 bp, Artificial Sequence
  Synthetic
gctaaaattcaccttgaaacagtggaatgggccagaaaatttagagaaaaagaaagagaattaggtagttatata

SEQ ID NO: 279868 - DNA, 75 bp, Artificial Sequence
  Synthetic
atgtcttaaataatcaggtagttgttgagcagcaactcttttgccaagaagttgttgaattagctgcccaagaat

SEQ ID NO: 279869 - DNA, 75 bp, Artificial Sequence
  Synthetic
tgagcagcaactcttttgccaagaagttgttgaattagctgcccaagaattaaatacttacttgcatgcaaagtc

SEQ ID NO: 279870 - DNA, 75 bp, Artificial Sequence
  Synthetic
aataaacattgggataaaccatactttagtcaaaccaggaatatcagtcttaaggggatgtcaggagcattacaa

SEQ ID NO: 279871 - DNA, 75 bp, Artificial Sequence
  Synthetic
ttagtcaaaccaggaatatcagtcttaaggggatgtcaggagcattacaagaagatggtcatctggctgcaagtg

SEQ ID NO: 279872 - DNA, 75 bp, Artificial Sequence
  Synthetic
tttaaatcattcacaaaataaccctacagtattagaactttatgaacagacaaaaaaacaaagggcacaagcaag

SEQ ID NO: 279873 - DNA, 75 bp, Artificial Sequence
  Synthetic
caaaaaaacaaagggcacaagcaagaattgttaggaaataccaaaggactgaagctgatagaggtttttttataa

SEQ ID NO: 279874 - DNA, 75 bp, Artificial Sequence
  Synthetic
agaaattattgaagattattatgatgctatagctagggttgtcccagaagaatacatatcttatggaggagaaag

SEQ ID NO: 279875 - DNA, 75 bp, Artificial Sequence
  Synthetic
gctatagctagggttgtcccagaagaatacatatcttatggaggagaaagaaagatactgaacattcaacaggct

SEQ ID NO: 279876 - DNA, 75 bp, Artificial Sequence
  Synthetic
caggagagagtgaaatccagtcctcattaggtcactctataaaattaaaaagaaagctgatgtatgtaagtgcag

SEQ ID NO: 279877 - DNA, 75 bp, Artificial Sequence
  Synthetic
attaggtcactctataaaattaaaaagaaagctgatgtatgtaagtgcagatgcaactaaatggtcaccaggcga

SEQ ID NO: 279878 - DNA, 75 bp, Artificial Sequence
  Synthetic
actcaatctttatatgatggtctacgtgatgacaagcttaaaaattgtgtagttgatgccctaagaaatatttat

SEQ ID NO: 279879 - DNA, 75 bp, Artificial Sequence
  Synthetic
gtgatgacaagcttaaaaattgtgtagttgatgccctaagaaatatttatgaaactgacttttttatatctagaa

SEQ ID NO: 279880 - DNA, 75 bp, Artificial Sequence
  Synthetic
gggtgaattgtctgatgaagtcttagattttttatctttttttcctaataaagtgtctgcttcaataaaaggtaa

SEQ ID NO: 279881 - DNA, 75 bp, Artificial Sequence
  Synthetic
gattttttatctttttttcctaataaagtgtctgcttcaataaaaggtaactggctgcaaggtaatttaaacaag

SEQ ID NO: 279882 - DNA, 75 bp, Artificial Sequence
  Synthetic
tatcattattgtttaaacgtgtgtgggccaaattatatccagagttagaatgtttttttgaatttgctcatcatt

SEQ ID NO: 279883 - DNA, 75 bp, Artificial Sequence
  Synthetic
ggccaaattatatccagagttagaatgtttttttgaatttgctcatcattctgatgatgctttattcatttatgg

SEQ ID NO: 279884 - DNA, 75 bp, Artificial Sequence
  Synthetic
acagaatggtttcagtatgtgactcaacaaatacaagcagggaactttcattggcatgctgttaatcaggaaatg

SEQ ID NO: 279885 - DNA, 75 bp, Artificial Sequence
  Synthetic
aacaaatacaagcagggaactttcattggcatgctgttaatcaggaaatgtggaaaagcatgtttaatctccatg

SEQ ID NO: 279886 - DNA, 75 bp, Artificial Sequence
  Synthetic
aaaaatatcacccaagaagacaacagtatctcctacaaatgcagagtttttatctacattctttgagggttgcgc

SEQ ID NO: 279887 - DNA, 75 bp, Artificial Sequence
  Synthetic
gtatctcctacaaatgcagagtttttatctacattctttgagggttgcgcagtctctattccctttataaagatt

SEQ ID NO: 279888 - DNA, 75 bp, Artificial Sequence
  Synthetic
ctggcttaggttattttgatgaccttgctgcagctcaaagtaggtgtgtcaaggcactagatatgggtgcatgtc

SEQ ID NO: 279889 - DNA, 75 bp, Artificial Sequence
  Synthetic
tgctgcagctcaaagtaggtgtgtcaaggcactagatatgggtgcatgtcctcagcttgcacaactaggaatagt

SEQ ID NO: 279890 - DNA, 75 bp, Artificial Sequence
  Synthetic
ttatatggcactgctcctggcatggtcaataatcctactgcatacttaaaggtagacagaagtctgattcccata

SEQ ID NO: 279891 - DNA, 75 bp, Artificial Sequence
  Synthetic
tcaataatcctactgcatacttaaaggtagacagaagtctgattcccataccgttaggtggtgatggttctatgt

SEQ ID NO: 279892 - DNA, 75 bp, Artificial Sequence
  Synthetic
tatagggatggcagacaaaaatatattgaaaaatgcattcataacttacaaacatgcaaaaaaagataatgatag

SEQ ID NO: 279893 - DNA, 75 bp, Artificial Sequence
  Synthetic
ttgatgtcattgtcagatgatatattccagcatgatcgtttgggagaatttagttttgtaggtaaagttcagtgg

SEQ ID NO: 279894 - DNA, 75 bp, Artificial Sequence
  Synthetic
ttgaattttatgaccaatattcaagaaagtaccttgagctttggagtgaacaacatcctgtttatgattatatta

SEQ ID NO: 279895 - DNA, 75 bp, Artificial Sequence
  Synthetic
aaagtaccttgagctttggagtgaacaacatcctgtttatgattatattataccaagaggtagggataatctatt

SEQ ID NO: 279896 - DNA, 75 bp, Artificial Sequence
  Synthetic
gatcctagtatagtcactgcaatgacaatgcaatcaccacttcaattgaggtttcggatgcaggcaaagcaacac

SEQ ID NO: 279897 - DNA, 75 bp, Artificial Sequence
  Synthetic
caatgcaatcaccacttcaattgaggtttcggatgcaggcaaagcaacacatgaaagtatgtaagttagatggtg

SEQ ID NO: 279898 - DNA, 75 bp, Artificial Sequence
  Synthetic
tgctgctgcagatgcatttgcatcagattaccgaccaacatcacaggatatggagctctttcaaacacttgttaa

SEQ ID NO: 279899 - DNA, 75 bp, Artificial Sequence
  Synthetic
gattaccgaccaacatcacaggatatggagctctttcaaacacttgttaattgcacattttctaaagaatatgcc

SEQ ID NO: 279900 - DNA, 75 bp, Artificial Sequence
  Synthetic
aatgtgatgttttaacaacaagacaaattcatagaccaaaagttgcccgtacttttacagttaaagaaagggatc

SEQ ID NO: 279901 - DNA, 75 bp, Artificial Sequence
  Synthetic
aattcatagaccaaaagttgcccgtacttttacagttaaagaaagggatcaaacaatacaaaatcctatcacggc

SEQ ID NO: 279902 - DNA, 75 bp, Artificial Sequence
  Synthetic
aaagtagatgaaatcagtgatgttttggatagtgctattcatccggactcattgtctactgatttgcagcttatg

SEQ ID NO: 279903 - DNA, 75 bp, Artificial Sequence
  Synthetic
tggatagtgctattcatccggactcattgtctactgatttgcagcttatgagggagggtgtctacagagaattgg

SEQ ID NO: 279904 - DNA, 75 bp, Artificial Sequence
  Synthetic
gctaaagaaagttgcaccattgttgtataagtctgggaagtcaagaattgtaattgtgcaagggaatgtagaggg

SEQ ID NO: 279905 - DNA, 75 bp, Artificial Sequence
  Synthetic
tataagtctgggaagtcaagaattgtaattgtgcaagggaatgtagagggtacagctgaatcaatttgtagttat

SEQ ID NO: 279906 - DNA, 75 bp, Artificial Sequence
  Synthetic
agactataaaagtaaaaccaaaaaaagaggtcctaaaagctgtatccctttatggaaaaaaagaaaaggctggtg

SEQ ID NO: 279907 - DNA, 75 bp, Artificial Sequence
  Synthetic
agaggtcctaaaagctgtatccctttatggaaaaaaagaaaaggctggtgatctaacacacttagctgcaatgag

SEQ ID NO: 279908 - DNA, 75 bp, Artificial Sequence
  Synthetic
tgcaaagctaacgaacaggattctgtatcttggttaaagtatttaatgtttgaaaacaaaacattggaacaatgg

SEQ ID NO: 279909 - DNA, 75 bp, Artificial Sequence
  Synthetic
tatcttggttaaagtatttaatgtttgaaaacaaaacattggaacaatggatagattcattctgttcaagaggag

SEQ ID NO: 279910 - DNA, 75 bp, Artificial Sequence
  Synthetic
atgtttaggtcttcttgtgtatgacctcaagggacagaagggtctattgcaaatacaagctaataggagagcata

SEQ ID NO: 279911 - DNA, 75 bp, Artificial Sequence
  Synthetic
ctcaagggacagaagggtctattgcaaatacaagctaataggagagcatattcagggaagcagtatgatgcctat

SEQ ID NO: 279912 - DNA, 75 bp, Artificial Sequence
  Synthetic
caaaactttatgaaggggacttgagggtaacatttaattttggtatagactgtgcaagactagaaatcttttggg

SEQ ID NO: 279913 - DNA, 75 bp, Artificial Sequence
  Synthetic
ggtaacatttaattttggtatagactgtgcaagactagaaatcttttgggacaaaagagaatatattttggaaac

SEQ ID NO: 279914 - DNA, 75 bp, Artificial Sequence
  Synthetic
aagattctcatggaagaagtaactaaagaattactacgttgtggtatgagattcaagacagagcaagtcaattct

SEQ ID NO: 279915 - DNA, 75 bp, Artificial Sequence
  Synthetic
aagaattactacgttgtggtatgagattcaagacagagcaagtcaattcttcacgtagtgtagtattgtttaaga

SEQ ID NO: 279916 - DNA, 75 bp, Artificial Sequence
  Synthetic
acctaatgtaccatgtattgtttatagaaattgcacccttaggacaggattgagagtacgacagcctacaaacaa

SEQ ID NO: 279917 - DNA, 75 bp, Artificial Sequence
  Synthetic
agaaattgcacccttaggacaggattgagagtacgacagcctacaaacaaagcattctcaattactatccaggct

SEQ ID NO: 279918 - DNA, 75 bp, Artificial Sequence
  Synthetic
ttgatgaagagaatcctagatttttacttgcccatgcatatcataatttgaaggatgtaaggtatcaggcattac

SEQ ID NO: 279919 - DNA, 75 bp, Artificial Sequence
  Synthetic
aggcagtcggaaatgtgtggtttaaaatgactcaacataaactgttcataaatccaataatatctgctgggctgc

SEQ ID NO: 279920 - DNA, 75 bp, Artificial Sequence
  Synthetic
tgcagcaattcctccagcagcttactctctaattatgaacaaggcaaaaatatctgttgatttattcatgtttaa

SEQ ID NO: 279921 - DNA, 75 bp, Artificial Sequence
  Synthetic
tctctaattatgaacaaggcaaaaatatctgttgatttattcatgtttaatgagctgttagctttgattaaccca

SEQ ID NO: 279922 - DNA, 75 bp, Artificial Sequence
  Synthetic
tgagctgttagctttgattaacccacagaatgttttaaacctagatggaatagaagaaacatcagaaggtttcac

SEQ ID NO: 279923 - DNA, 75 bp, Artificial Sequence
  Synthetic
caatggtcagaagaggtaagtttaacaatggatgatagtgatgatgatgataatgcttcacagcttgattacact

SEQ ID NO: 279924 - DNA, 75 bp, Artificial Sequence
  Synthetic
cgagcatttcctacaggatgaatcagcatatactggagatctcttaattcaaactgaggaaactgagataaggaa

SEQ ID NO: 279925 - DNA, 75 bp, Artificial Sequence
  Synthetic
gcatatactggagatctcttaattcaaactgaggaaactgagataaggaagctaagaggtatgatcaaaattctt

SEQ ID NO: 279926 - DNA, 75 bp, Artificial Sequence
  Synthetic
gggtttctaaaggtttatccatagacaagatatataaccctgttaatattattctcatgacccgatacatgtcca

SEQ ID NO: 279927 - DNA, 75 bp, Artificial Sequence
  Synthetic
caagatatataaccctgttaatattattctcatgacccgatacatgtccaaacattataatttccatgcaaagca

SEQ ID NO: 279928 - DNA, 75 bp, Artificial Sequence
  Synthetic
ttaactgagtttgaaagtattgttaaaggttggggagaatgtgttaaagataggtttattgaacttgatcaggaa

SEQ ID NO: 279929 - DNA, 75 bp, Artificial Sequence
  Synthetic
aaggttggggagaatgtgttaaagataggtttattgaacttgatcaggaagcccagcggaaggttactgaagaga

SEQ ID NO: 279930 - DNA, 75 bp, Artificial Sequence
  Synthetic
agactccctcttttcatttagacatgctgatatcttattaaagagattatttcccagggactcagcctcttcttt

SEQ ID NO: 279931 - DNA, 75 bp, Artificial Sequence
  Synthetic
gctgatatcttattaaagagattatttcccagggactcagcctcttctttttattaacagattatacttcttatt

SEQ ID NO: 279932 - DNA, 75 bp, Artificial Sequence
  Synthetic
ttcccagggactcagcctcttctttttattaacagattatacttcttattgctcttttctcggagcatactacta

SEQ ID NO: 279933 - DNA, 75 bp, Artificial Sequence
  Synthetic
tagtagtagactccttgaaaagctactacgagaacaactggaatgagtgacttgacagacatccaagaggagata

SEQ ID NO: 279934 - DNA, 75 bp, Artificial Sequence
  Synthetic
attggaggataaactcgcagactataagagaagaatggcagattctgtgtcccggaaaaaaatggatactaaacc

SEQ ID NO: 279935 - DNA, 75 bp, Artificial Sequence
  Synthetic
aagagaagaatggcagattctgtgtcccggaaaaaaatggatactaaacctactgatccgactgggattgaacct

SEQ ID NO: 279936 - DNA, 75 bp, Artificial Sequence
  Synthetic
tgtaaatgccattgacatcgaagaaccaagtggtcagacagcagattggtatactattggagtctatgtaatagg

SEQ ID NO: 279937 - DNA, 75 bp, Artificial Sequence
  Synthetic
gctctatacatgttgtcaacacgtggaagacagaccataaaagaaaataagggaacacggatcaggttcaaagat

SEQ ID NO: 279938 - DNA, 75 bp, Artificial Sequence
  Synthetic
tggcttatttcctacacagatacaagtgcgtaacatcatgagtccagtaatgggagtgattggtttttctttctt

SEQ ID NO: 279939 - DNA, 75 bp, Artificial Sequence
  Synthetic
gtgcgtaacatcatgagtccagtaatgggagtgattggtttttctttctttgtcaaagactggccagagaggatt

SEQ ID NO: 279940 - DNA, 75 bp, Artificial Sequence
  Synthetic
cgggacaccagcacaggagatagaatttttgaaaagaaatagggtttatttcatgactcgccaagatgttcttga

SEQ ID NO: 279941 - DNA, 75 bp, Artificial Sequence
  Synthetic
cccctacatgcatttatgttgctgggatggctgaattgggtgcattcttttcgatcctacaggatatgaggaaca

SEQ ID NO: 279942 - DNA, 75 bp, Artificial Sequence
  Synthetic
tacagcagaagaaaaattaaaaaagaagtcctccttctatcaatcatacctacgccggacacaatcaatggggat

SEQ ID NO: 279943 - DNA, 75 bp, Artificial Sequence
  Synthetic
ctgtacatgttggagtgggggaaagaaatggtggatcatttccatcttggtgatgatatggatcctgagctaaga

SEQ ID NO: 279944 - DNA, 75 bp, Artificial Sequence
  Synthetic
ggccttgctcagtcactcatagaccagaaggtaaaagagatatcaaatcaggagcccttaaagatatgattaact

SEQ ID NO: 279945 - DNA, 75 bp, Artificial Sequence
  Synthetic
ggagcccttaaagatatgattaactcaagtttattactaattgtaggtatagtatattactaattttagattatt

SEQ ID NO: 279946 - DNA, 75 bp, Artificial Sequence
  Synthetic
ggtttgacaattattattatcagggttttgaattaatgtactaatcaggggttaactggaattatataattacaa

SEQ ID NO: 279947 - DNA, 75 bp, Artificial Sequence
  Synthetic
acagggaattactaatggcagttatgaatgtaatatcatagtatattttgtaatcaatatccaattagcattata

SEQ ID NO: 279948 - DNA, 75 bp, Artificial Sequence
  Synthetic
gaatgtaatatcatagtatattttgtaatcaatatccaattagcattatatatgtatagatttatattttattat

SEQ ID NO: 279949 - DNA, 75 bp, Artificial Sequence
  Synthetic
taatcaatatccaattagcattatatatgtatagatttatattttattattccattttaatgggcccaaacatgt

SEQ ID NO: 279950 - DNA, 75 bp, Artificial Sequence
  Synthetic
acccgccatgaacagcagcttgttgttgccagacaaaaacttaaagatgcagagagagcagtggaagtggaccca

SEQ ID NO: 279951 - DNA, 75 bp, Artificial Sequence
  Synthetic
gatgatcacctcaaggagagatcaagccttaggtatggaaatgtccttgatgtgaatgcaattgatattgaggaa

SEQ ID NO: 279952 - DNA, 75 bp, Artificial Sequence
  Synthetic
agggacacgtataaggtttaaagatgatacatcatttgaagacatcaacggcataaggaggccaaagcatttata

SEQ ID NO: 279953 - DNA, 75 bp, Artificial Sequence
  Synthetic
caataatggcatctaagactgttggcactgctgaagagaagttaaagaaaaagtcctctttctaccagtcttact

SEQ ID NO: 279954 - DNA, 75 bp, Artificial Sequence
  Synthetic
cactgctgaagagaagttaaagaaaaagtcctctttctaccagtcttacttacgccggactcaatcaatgggtat

SEQ ID NO: 279955 - DNA, 75 bp, Artificial Sequence
  Synthetic
ttgttcatgttggaatggggcaaagagatggtggatcatttccatctcggtgatgacatggatccagagctcaga

SEQ ID NO: 279956 - DNA, 75 bp, Artificial Sequence
  Synthetic
aaaaggtgaaggaaatatcaaaccaggagccattgaaaatataatcacttaattacatatgcactgattatagaa

SEQ ID NO: 279957 - DNA, 75 bp, Artificial Sequence
  Synthetic
tattatatattcagggatcatatgtgttagttgtttactaatcaaaatatacgggtttataatcataagtatcag

SEQ ID NO: 279958 - DNA, 75 bp, Artificial Sequence
  Synthetic
ggttaaactggaaatatagcattataagtacatatcaattaataacgatcagtacagggattactaatggcagtt

SEQ ID NO: 279959 - DNA, 75 bp, Artificial Sequence
  Synthetic
aagtacatatcaattaataacgatcagtacagggattactaatggcagttatgaatgtattaagatattatttta

SEQ ID NO: 279960 - DNA, 75 bp, Artificial Sequence
  Synthetic
taggataaggttgtattctattatttaatgggcccgaacatgtgaaactgagctgtcctttttccttttcaccac

SEQ ID NO: 279961 - DNA, 75 bp, Artificial Sequence
  Synthetic
tagtagtagactccgagatagagaaatttactacaaatggagaaatacagagatattcatgagagagtcaaggag

SEQ ID NO: 279962 - DNA, 75 bp, Artificial Sequence
  Synthetic
atttactacaaatggagaaatacagagatattcatgagagagtcaaggaggcagtcccaggggaaacatcagcag

SEQ ID NO: 279963 - DNA, 75 bp, Artificial Sequence
  Synthetic
agatattcatgagagagtcaaggaggcagtcccaggggaaacatcagcagtagaatgtttagatttattggatag

SEQ ID NO: 279964 - DNA, 75 bp, Artificial Sequence
  Synthetic
gtagaccagatgataaaacatgactggtctgacaataaagatagagaacagcctataggccttgtcttactaatg

SEQ ID NO: 279965 - DNA, 75 bp, Artificial Sequence
  Synthetic
ggtctgacaataaagatagagaacagcctataggccttgtcttactaatggcaggtgttccaaatgatgtaattc

SEQ ID NO: 279966 - DNA, 75 bp, Artificial Sequence
  Synthetic
aggaagtcccagtggtcagatccttagatcattttttaaaatgacacctgacaattataaaataacagggaacct

SEQ ID NO: 279967 - DNA, 75 bp, Artificial Sequence
  Synthetic
agatcattttttaaaatgacacctgacaattataaaataacagggaaccttatagagttcattgaggtcacagtg

SEQ ID NO: 279968 - DNA, 75 bp, Artificial Sequence
  Synthetic
gagagaagatattaaagtatcaagggggtttagaatttattgaacaattgttacagatagaagctcagaaaggta

SEQ ID NO: 279969 - DNA, 75 bp, Artificial Sequence
  Synthetic
gggtttagaatttattgaacaattgttacagatagaagctcagaaaggtaattgtcaatctggttttaagataaa

SEQ ID NO: 279970 - DNA, 75 bp, Artificial Sequence
  Synthetic
gatggttcaaacatatcaacacagtggcctagtagaaggaatgaaggcgttgttcaagcaatgagattaatacaa

SEQ ID NO: 279971 - DNA, 75 bp, Artificial Sequence
  Synthetic
ggcctagtagaaggaatgaaggcgttgttcaagcaatgagattaatacaagcagacattaattttgtcagagaac

SEQ ID NO: 279972 - DNA, 75 bp, Artificial Sequence
  Synthetic
agcacttgaggcaatgtttaatctaaaatttcatgtaacaggtcctaaggttcgtacatttgatattccgaatta

SEQ ID NO: 279973 - DNA, 75 bp, Artificial Sequence
  Synthetic
aaatttcatgtaacaggtcctaaggttcgtacatttgatattccgaattatagacctcagccattatgccaacct

SEQ ID NO: 279974 - DNA, 75 bp, Artificial Sequence
  Synthetic
gtaaaaattggcttggaacagatcatgcatttgcatttaaggaagtgactggtcaacgtgttttcaatgtcttta

SEQ ID NO: 279975 - DNA, 75 bp, Artificial Sequence
  Synthetic
tgcatttgcatttaaggaagtgactggtcaacgtgttttcaatgtctttagggaggaggaagaaatacatgcatc

SEQ ID NO: 279976 - DNA, 75 bp, Artificial Sequence
  Synthetic
aggaattttcttttatgtcaaattagcttgcagtcaccatatttaccatcaacaattgcatctgatcagtatgat

SEQ ID NO: 279977 - DNA, 75 bp, Artificial Sequence
  Synthetic
gcttgcagtcaccatatttaccatcaacaattgcatctgatcagtatgatacacgattagcttgtagtgaaattt

SEQ ID NO: 279978 - DNA, 75 bp, Artificial Sequence
  Synthetic
acagctattggctagagatatggcctataaatacatcacattagatcatgatgacattatcaattattataatcc

SEQ ID NO: 279979 - DNA, 75 bp, Artificial Sequence
  Synthetic
tataaatacatcacattagatcatgatgacattatcaattattataatccaagggtttactttaagccaacacag

SEQ ID NO: 279980 - DNA, 75 bp, Artificial Sequence
  Synthetic
aattgaatctatctaacatggatccaaaatcaaaagcattaattgatgtcatatcaaaggattcaaaaaaaggag

SEQ ID NO: 279981 - DNA, 75 bp, Artificial Sequence
  Synthetic
tgatgtagcaagtcaagtacagcataatgaatgctcaaaaactattgagaaaattttgtcagatttagaagttaa

SEQ ID NO: 279982 - DNA, 75 bp, Artificial Sequence
  Synthetic
gatcaacctaagaaaacaactggtgtggatgatattttaagaaaattttatgataatgagcttgttaagtacttg

SEQ ID NO: 279983 - DNA, 75 bp, Artificial Sequence
  Synthetic
tggatgatattttaagaaaattttatgataatgagcttgttaagtacttgatatctgttatacggaaaacaacag

SEQ ID NO: 279984 - DNA, 75 bp, Artificial Sequence
  Synthetic
agatattactgagtccttaattgcacatgcagggcttaaaagatctaaatactggtctgctcacggttatgcatg

SEQ ID NO: 279985 - DNA, 75 bp, Artificial Sequence
  Synthetic
catgcagggcttaaaagatctaaatactggtctgctcacggttatgcatgtggtagtgtcttattatgcatatta

SEQ ID NO: 279986 - DNA, 75 bp, Artificial Sequence
  Synthetic
gatcatttataaggttctttactgtatttaaggaaggtctaggtttaattgatacagataatcttgactctaaag

SEQ ID NO: 279987 - DNA, 75 bp, Artificial Sequence
  Synthetic
atttaaggaaggtctaggtttaattgatacagataatcttgactctaaagcagaaattgatggcgtttcatggtg

SEQ ID NO: 279988 - DNA, 75 bp, Artificial Sequence
  Synthetic
ttaaatagattactggccttgaatattgcatttgaaaaatcccttcttgccacagcaacatggtttcagtattat

SEQ ID NO: 279989 - DNA, 75 bp, Artificial Sequence
  Synthetic
ttgcatttgaaaaatcccttcttgccacagcaacatggtttcagtattatactgaagatcaaggacattttcctc

SEQ ID NO: 279990 - DNA, 75 bp, Artificial Sequence
  Synthetic
tgcattccatttccttctttctgtatcccagaagatgaaattgtgcgcaatctttgataatctccgatatttgat

SEQ ID NO: 279991 - DNA, 75 bp, Artificial Sequence
  Synthetic
tcccagaagatgaaattgtgcgcaatctttgataatctccgatatttgattccagctgtcacatctacctactct

SEQ ID NO: 279992 - DNA, 75 bp, Artificial Sequence
  Synthetic
tctttgagcggccttttaaaagtgcacttgaagtctacttatatggtattataaaagtattactagtgagcttgg

SEQ ID NO: 279993 - DNA, 75 bp, Artificial Sequence
  Synthetic
acttgaagtctacttatatggtattataaaagtattactagtgagcttggctcagaataacaaaataaggtttta

SEQ ID NO: 279994 - DNA, 75 bp, Artificial Sequence
  Synthetic
actgttgaccaatcaacgattggagcaagcggagtgtatccctctcttatgtcaagggttgtttataagcattat

SEQ ID NO: 279995 - DNA, 75 bp, Artificial Sequence
  Synthetic
caagcggagtgtatccctctcttatgtcaagggttgtttataagcattatcgcagtttaatatcagaggcaacta

SEQ ID NO: 279996 - DNA, 75 bp, Artificial Sequence
  Synthetic
attgcatggcaatcttacagaagaagctaaaatccacctagaaacagttgaatgggctagaaaatttagagagaa

SEQ ID NO: 279997 - DNA, 75 bp, Artificial Sequence
  Synthetic
gctaaaatccacctagaaacagttgaatgggctagaaaatttagagagaaagaaagagaattggggagttatata

SEQ ID NO: 279998 - DNA, 75 bp, Artificial Sequence
  Synthetic
atgttctaaataaccaagtagctgttgaacagcaacttttttgtcaagaagttgtcgaactagctgctcaagaac

SEQ ID NO: 279999 - DNA, 75 bp, Artificial Sequence
  Synthetic
tgaacagcaacttttttgtcaagaagttgtcgaactagctgctcaagaactaaacacttacttacatgccaaatc

SEQ ID NO: 280000 - DNA, 75 bp, Artificial Sequence
  Synthetic
aacaaacactgggataaaccttattttagccaaaccagaaatataagtcttaaaggtatgtcaggtgcattacag

SEQ ID NO: 280001 - DNA, 75 bp, Artificial Sequence
  Synthetic
taaaggtatgtcaggtgcattacaggaagatggtcatttagcagcaagtgtgacattaattgaagcaattcggtt

SEQ ID NO: 280002 - DNA, 75 bp, Artificial Sequence
  Synthetic
acagtacttgaactttatgagcagacaaaaaaacaaagggcacaagcaagaattgttaggaaatatcaaagaact

SEQ ID NO: 280003 - DNA, 75 bp, Artificial Sequence
  Synthetic
caaaaaaacaaagggcacaagcaagaattgttaggaaatatcaaagaactgaggctgatagaggtttttttatta

SEQ ID NO: 280004 - DNA, 75 bp, Artificial Sequence
  Synthetic
ccacactacctactagagtaagattagaaattatagaagattattatgatgctattgccaaagttgtcccagagg

SEQ ID NO: 280005 - DNA, 75 bp, Artificial Sequence
  Synthetic
gaaaatacttaatattcagcaagcccttgaaaaggcacttcgatgggcctcaggtgaaagtgaaatacagtcttc

SEQ ID NO: 280006 - DNA, 75 bp, Artificial Sequence
  Synthetic
cttgaaaaggcacttcgatgggcctcaggtgaaagtgaaatacagtcttcactaggtcattccataaaattgaaa

SEQ ID NO: 280007 - DNA, 75 bp, Artificial Sequence
  Synthetic
atgcaactaagtggtcacctggtgataactctgctaaatttagacgatttactcaatctttatatgatggactac

SEQ ID NO: 280008 - DNA, 75 bp, Artificial Sequence
  Synthetic
taactctgctaaatttagacgatttactcaatctttatatgatggactacgtgatgataaattaaaaaattgtgt

SEQ ID NO: 280009 - DNA, 75 bp, Artificial Sequence
  Synthetic
gagactgacttttttatatctagaaaattacacagatatattgataatatgggtgaattatctgatgaagtgtta

SEQ ID NO: 280010 - DNA, 75 bp, Artificial Sequence
  Synthetic
aattacacagatatattgataatatgggtgaattatctgatgaagtgttagatttcttgtcattttttccgaata

SEQ ID NO: 280011 - DNA, 75 bp, Artificial Sequence
  Synthetic
ttggttgcaaggcaatctaaacaagtgttcttcattatttggggcagcaatatcattattgtttaaacgtgtgtg

SEQ ID NO: 280012 - DNA, 75 bp, Artificial Sequence
  Synthetic
tgtttttttgaatttgcccatcattctgatgatgctttatttatttatggttatctggagcctatagatgatggt

SEQ ID NO: 280013 - DNA, 75 bp, Artificial Sequence
  Synthetic
aacaaattcaagcaggcaactttcattggcatgctgtgaatcaggagatgtggaaaagtatgtttaacctccatg

SEQ ID NO: 280014 - DNA, 75 bp, Artificial Sequence
  Synthetic
ttggcatgctgtgaatcaggagatgtggaaaagtatgtttaacctccatgaacacattttattgatgggttcaat

SEQ ID NO: 280015 - DNA, 75 bp, Artificial Sequence
  Synthetic
gtatcacctacaaatgctgaattcttgtctacattttttgaaggctgtgcagtctctattccctttataaaaatc

SEQ ID NO: 280016 - DNA, 75 bp, Artificial Sequence
  Synthetic
tgtctacattttttgaaggctgtgcagtctctattccctttataaaaatccttttaggttctctatcagatttac

SEQ ID NO: 280017 - DNA, 75 bp, Artificial Sequence
  Synthetic
aaagcactagatatgggtgcatgtccacagcttgcacagttaggaatagtgctatgtacaagtaaagttgaaagg

SEQ ID NO: 280018 - DNA, 75 bp, Artificial Sequence
  Synthetic
taaataaccctactgcatacttaaaagtggatagaaacttaatacctattcctttaggtggtgatggttctatgt

SEQ ID NO: 280019 - DNA, 75 bp, Artificial Sequence
  Synthetic
agtggatagaaacttaatacctattcctttaggtggtgatggttctatgtcaatcatggagttagcaacagctgg

SEQ ID NO: 280020 - DNA, 75 bp, Artificial Sequence
  Synthetic
ttaaaaaatgcatttataacttataagcatgctaagaaggataacgatagatacgttctgggtttatttaagttt

SEQ ID NO: 280021 - DNA, 75 bp, Artificial Sequence
  Synthetic
agcatgctaagaaggataacgatagatacgttctgggtttatttaagtttttaatgtcactatctgatgatattt

SEQ ID NO: 280022 - DNA, 75 bp, Artificial Sequence
  Synthetic
cagctttgttgggaaagttcaatggaaagtgtttacccctaaaagtgagtttgaattttatgatcaatattctag

SEQ ID NO: 280023 - DNA, 75 bp, Artificial Sequence
  Synthetic
aaagtgtttacccctaaaagtgagtttgaattttatgatcaatattctagaaaatatctagagctttggagtgaa

SEQ ID NO: 280024 - DNA, 75 bp, Artificial Sequence
  Synthetic
taccaagaggtagagataaccttttagtgtacctggtaagaaaattgaatgatcccagcatagttactgcaatga

SEQ ID NO: 280025 - DNA, 75 bp, Artificial Sequence
  Synthetic
agtgtacctggtaagaaaattgaatgatcccagcatagttactgcaatgacaatgcaatcaccattgcaattaag

SEQ ID NO: 280026 - DNA, 75 bp, Artificial Sequence
  Synthetic
atgaaggtatgtaaactaggtggtgaatgggtgacatttagagaggttcttgctgctgcagatgcatttgcgtct

SEQ ID NO: 280027 - DNA, 75 bp, Artificial Sequence
  Synthetic
aatgggtgacatttagagaggttcttgctgctgcagatgcatttgcgtctgaatatcggcctacattacaagata

SEQ ID NO: 280028 - DNA, 75 bp, Artificial Sequence
  Synthetic
ttgtacattttctaaagaatacgcatggagagactttttaaatgaagtacagtgtgatgtactaacaacaagaca

SEQ ID NO: 280029 - DNA, 75 bp, Artificial Sequence
  Synthetic
tggagagactttttaaatgaagtacagtgtgatgtactaacaacaagacaaatccatagaccaaaagttgctcgt

SEQ ID NO: 280030 - DNA, 75 bp, Artificial Sequence
  Synthetic
aaacaattcagaatcctattacagctgtaataggttataaatatgcaagtaaagtagatgagataagtgatgtat

SEQ ID NO: 280031 - DNA, 75 bp, Artificial Sequence
  Synthetic
tgtaataggttataaatatgcaagtaaagtagatgagataagtgatgtattggatagtgccttacatccagactc

SEQ ID NO: 280032 - DNA, 75 bp, Artificial Sequence
  Synthetic
agagaaggtgtatatagagaattgggacttgacattagtcaaccaaatgttttaaagaaagttgcacctctatta

SEQ ID NO: 280033 - DNA, 75 bp, Artificial Sequence
  Synthetic
gacttgacattagtcaaccaaatgttttaaagaaagttgcacctctattatataaatcagggaaatctaggatag

SEQ ID NO: 280034 - DNA, 75 bp, Artificial Sequence
  Synthetic
tacagctgagtcaatctgtagttattggctgaaaactatgtctcttgttaaaactattaaagtgaagcctaaaaa

SEQ ID NO: 280035 - DNA, 75 bp, Artificial Sequence
  Synthetic
tggctgaaaactatgtctcttgttaaaactattaaagtgaagcctaaaaaggaggtattaaaggctgtatcactt

SEQ ID NO: 280036 - DNA, 75 bp, Artificial Sequence
  Synthetic
atctgacacatttagctgcaatgagactatgtatcgaggtttggagatggtgtaaagcaaatgaacaagattcag

SEQ ID NO: 280037 - DNA, 75 bp, Artificial Sequence
  Synthetic
actatgtatcgaggtttggagatggtgtaaagcaaatgaacaagattcagtaacatggttgaaatacttggtgtt

SEQ ID NO: 280038 - DNA, 75 bp, Artificial Sequence
  Synthetic
gtagacttattttgttcaagaggggtattgcctattgacccagaaattcagtgtttaggtcttctggtatatgat

SEQ ID NO: 280039 - DNA, 75 bp, Artificial Sequence
  Synthetic
tattgcctattgacccagaaattcagtgtttaggtcttctggtatatgatcttaaagggcaaaagggtttattgc

SEQ ID NO: 280040 - DNA, 75 bp, Artificial Sequence
  Synthetic
ttcaggaaagcaatatgatgcatattgtgtgcaaacttacaatgaggaaacaaaactttatgaaggagatttaag

SEQ ID NO: 280041 - DNA, 75 bp, Artificial Sequence
  Synthetic
tgtgtgcaaacttacaatgaggaaacaaaactttatgaaggagatttaagggtaacttttaattttggtatagac

SEQ ID NO: 280042 - DNA, 75 bp, Artificial Sequence
  Synthetic
ataaaaaagagtatattttagaaacatctataactcaacggaatgttttgaaaatcttgatggaagaagtaacta

SEQ ID NO: 280043 - DNA, 75 bp, Artificial Sequence
  Synthetic
atctataactcaacggaatgttttgaaaatcttgatggaagaagtaactaaagagttgttgcgctgcggtatgag

SEQ ID NO: 280044 - DNA, 75 bp, Artificial Sequence
  Synthetic
tcaagaagtgttgtgttgtttaagacagagagtggctttgagtggggtaagcctaatgtgccctgtatagtttat

SEQ ID NO: 280045 - DNA, 75 bp, Artificial Sequence
  Synthetic
cagagagtggctttgagtggggtaagcctaatgtgccctgtatagtttataggaattgtactctccgaacaggcc

SEQ ID NO: 280046 - DNA, 75 bp, Artificial Sequence
  Synthetic
agcattctcaattacaattcaggctaatggctttagggctatggcacagcttgatgaagaaaatcctagatttct

SEQ ID NO: 280047 - DNA, 75 bp, Artificial Sequence
  Synthetic
aaggatgtgagatatcaggcattacaggcagtaggaaatgtgtggtttaaaatgacacagcataagttgtttata

SEQ ID NO: 280048 - DNA, 75 bp, Artificial Sequence
  Synthetic
aggcagtaggaaatgtgtggtttaaaatgacacagcataagttgtttataaacccgatcatatcagctggattac

SEQ ID NO: 280049 - DNA, 75 bp, Artificial Sequence
  Synthetic
tgcagcaattcccccagcagcttattctcttattatgaataaagcaaaaatttctgttgatttatttatgtttaa

SEQ ID NO: 280050 - DNA, 75 bp, Artificial Sequence
  Synthetic
tctcttattatgaataaagcaaaaatttctgttgatttatttatgtttaatgaactattagctttgataaatcca

SEQ ID NO: 280051 - DNA, 75 bp, Artificial Sequence
  Synthetic
ttgaggagacatctgaaggttttacaacagtgagcacaatctctagcacacagtggtcagaagaagtaagtttga

SEQ ID NO: 280052 - DNA, 75 bp, Artificial Sequence
  Synthetic
aacagtgagcacaatctctagcacacagtggtcagaagaagtaagtttgacactagatgatagtgatgatgatga

SEQ ID NO: 280053 - DNA, 75 bp, Artificial Sequence
  Synthetic
attgaccttgatgatatagattttgaaacaattgatctaaaggaggatattgagcattttttacaagatgaatct

SEQ ID NO: 280054 - DNA, 75 bp, Artificial Sequence
  Synthetic
aaacaattgatctaaaggaggatattgagcattttttacaagatgaatctgcttatactggagatctgttaattc

SEQ ID NO: 280055 - DNA, 75 bp, Artificial Sequence
  Synthetic
gttgaggggtatgataaaaattcttgagcctgtaaagctgataaaaagttgggtttctaaaggtttgtctattga

SEQ ID NO: 280056 - DNA, 75 bp, Artificial Sequence
  Synthetic
gagcctgtaaagctgataaaaagttgggtttctaaaggtttgtctattgataaaatatacaatcctgtaaatatt

SEQ ID NO: 280057 - DNA, 75 bp, Artificial Sequence
  Synthetic
aacattataatttccaggcaaagcagttatctctaatggatccatatgatctgactgaatttgagagtgttgtta

SEQ ID NO: 280058 - DNA, 75 bp, Artificial Sequence
  Synthetic
gttatctctaatggatccatatgatctgactgaatttgagagtgttgttaaaggctggggagagtgtgtcaagga

SEQ ID NO: 280059 - DNA, 75 bp, Artificial Sequence
  Synthetic
gctcaacgaaaagttactgaagagagagtactgcctgaggatgtactcccagactccttcttttcatttagacat

SEQ ID NO: 280060 - DNA, 75 bp, Artificial Sequence
  Synthetic
tccctagggattcagcctcttctttttattaacagattatacttcttattgctcttttctcggagcatactacta

SEQ ID NO: 280061 - DNA, 75 bp, Artificial Sequence
  Synthetic
tagtagtagactccttgaaaagctactacgagaaagtctggaatgagtgacttgacagatatccaagaggatata

SEQ ID NO: 280062 - DNA, 75 bp, Artificial Sequence
  Synthetic
gccttaggtatggaaatgtccttgatgtaaatgcaattgacattgaagaaccaagtggccaaacagcagattggt

SEQ ID NO: 280063 - DNA, 75 bp, Artificial Sequence
  Synthetic
gttcacacttcctatcatccttaaagctttatacatgctctcaacgcgtgggagacagactgtaaaggaaaataa

SEQ ID NO: 280064 - DNA, 75 bp, Artificial Sequence
  Synthetic
gctttatacatgctctcaacgcgtgggagacagactgtaaaggaaaataaggggacacgtataaggtttaaggat

SEQ ID NO: 280065 - DNA, 75 bp, Artificial Sequence
  Synthetic
gatacatcatttgaagacatcaatggcataaggagaccaaagcatttatatgtttctatgcctactgcccagtca

SEQ ID NO: 280066 - DNA, 75 bp, Artificial Sequence
  Synthetic
ctggcagatttcgcacaatagtatgtggtctttttcccactcagatccaggttcgtaacatcatgagtccagtta

SEQ ID NO: 280067 - DNA, 75 bp, Artificial Sequence
  Synthetic
tggtctttttcccactcagatccaggttcgtaacatcatgagtccagttatgggggtcattggtttttcattctt

SEQ ID NO: 280068 - DNA, 75 bp, Artificial Sequence
  Synthetic
agagagttcatggaaaaagagtgcccattcataaagcctgaagtaaaaccaggcacaccagcacaggagattgag

SEQ ID NO: 280069 - DNA, 75 bp, Artificial Sequence
  Synthetic
ttatgcagcgccaggatgtgcttgacaaaaatcatgtggcagacattgacaagttaattgactatgcagcctctg

SEQ ID NO: 280070 - DNA, 75 bp, Artificial Sequence
  Synthetic
caaaaatcatgtggcagacattgacaagttaattgactatgcagcctctggagaccctacatcacctgacaacat

SEQ ID NO: 280071 - DNA, 75 bp, Artificial Sequence
  Synthetic
caccaacatgtatctatgttgcagggatggcagagcttggggcctttttttcaatattgcaggacatgagaaaca

SEQ ID NO: 280072 - DNA, 75 bp, Artificial Sequence
  Synthetic
cacagcagaagagaaattaaagaaaaagtcttccttttaccaatcttacctgcgtcgaactcaatcaatgggaat

SEQ ID NO: 280073 - DNA, 75 bp, Artificial Sequence
  Synthetic
aagtcttccttttaccaatcttacctgcgtcgaactcaatcaatgggaattcagcttgatcaaagaattatcctc

SEQ ID NO: 280074 - DNA, 75 bp, Artificial Sequence
  Synthetic
agatggtagatcacttccatcttggtgatgatatggatccagagctcagaggtcttgcacaggcactgatagatc

SEQ ID NO: 280075 - DNA, 75 bp, Artificial Sequence
  Synthetic
aattacatatgcactgattatagatgtagtgagttgttaacatgtagacatattatatattcagggatcatatgt

SEQ ID NO: 280076 - DNA, 75 bp, Artificial Sequence
  Synthetic
gtagtgagttgttaacatgtagacatattatatattcagggatcatatgtgctagttgtttactaatcaaattat

SEQ ID NO: 280077 - DNA, 75 bp, Artificial Sequence
  Synthetic
ggttaaactagaaatgtagcattataagtacatatcaactaataacaatcaatacagggatcactaatggcagtt

SEQ ID NO: 280078 - DNA, 75 bp, Artificial Sequence
  Synthetic
taatcattatctaattagcattatgtaggttaaggttgtattttattatttaatgggcccaaacatgtgaaactg

SEQ ID NO: 280079 - DNA, 75 bp, Artificial Sequence
  Synthetic
taatgggcccaaacatgtgaaactgagctgtcctttttccttttcatcactttttttctcaaaacttattcattt

SEQ ID NO: 280080 - DNA, 75 bp, Artificial Sequence
  Synthetic
caaacacagacaaatatgggaaaatcgagtccagtttgtctgtatctgattcttcagggtctattactatttgat

SEQ ID NO: 280081 - DNA, 75 bp, Artificial Sequence
  Synthetic
cgagtccagtttgtctgtatctgattcttcagggtctattactatttgatacagtaaatgccaaaaacctgaatg

SEQ ID NO: 280082 - DNA, 75 bp, Artificial Sequence
  Synthetic
tattgggctaggtcaaggccttgttgtaggttcagtagaactaccacctgtcccaatacagcaaattgaatcctt

SEQ ID NO: 280083 - DNA, 75 bp, Artificial Sequence
  Synthetic
gtaggttcagtagaactaccacctgtcccaatacagcaaattgaatccttaaaattagagagttcttgtaatttt

SEQ ID NO: 280084 - DNA, 75 bp, Artificial Sequence
  Synthetic
aacagtcatttacaaaatggacatgggagacaaaaggtgatcttgcagaaaatacacaagcatcatcaacaagtt

SEQ ID NO: 280085 - DNA, 75 bp, Artificial Sequence
  Synthetic
ggagacaaaaggtgatcttgcagaaaatacacaagcatcatcaacaagttttcagacaaaaagtagtgaggtcaa

SEQ ID NO: 280086 - DNA, 75 bp, Artificial Sequence
  Synthetic
accctagtggttgaaacagcagcaaggatgcggaagacaatagcatgttatgacttgtcatgtaatcaaacagta

SEQ ID NO: 280087 - DNA, 75 bp, Artificial Sequence
  Synthetic
ggatgcggaagacaatagcatgttatgacttgtcatgtaatcaaacagtatgtcagcctactgtttatttaatgg

SEQ ID NO: 280088 - DNA, 75 bp, Artificial Sequence
  Synthetic
caaaagttgtcttctgggtttaggagatcaacgaatccaggtaaattatgagagaacatactgtgtttcagggca

SEQ ID NO: 280089 - DNA, 75 bp, Artificial Sequence
  Synthetic
gatcaacgaatccaggtaaattatgagagaacatactgtgtttcagggcagcttgttgaaggtgtctgcttcaac

SEQ ID NO: 280090 - DNA, 75 bp, Artificial Sequence
  Synthetic
agccaagccatacttatgatatagtgaccataatggttcgctgttttttggtcataaaaaaggtgacatctggcg

SEQ ID NO: 280091 - DNA, 75 bp, Artificial Sequence
  Synthetic
gaccataatggttcgctgttttttggtcataaaaaaggtgacatctggcgacagtatgaagattgaaaaaaactt

SEQ ID NO: 280092 - DNA, 75 bp, Artificial Sequence
  Synthetic
tgtacggccaatggttttcaaggatattacatctgtcttattgggagtagctcagagccattgtatgttcccacg

SEQ ID NO: 280093 - DNA, 75 bp, Artificial Sequence
  Synthetic
attacatctgtcttattgggagtagctcagagccattgtatgttcccacgctggatgattatcggtcagctgagg

SEQ ID NO: 280094 - DNA, 75 bp, Artificial Sequence
  Synthetic
acatggcgaagatcatgacatagaaaaaaatgcagtgagtgccttacgcattgctgggaaggttacaggtaaagc

SEQ ID NO: 280095 - DNA, 75 bp, Artificial Sequence
  Synthetic
aaaaatgcagtgagtgccttacgcattgctgggaaggttacaggtaaagcaccatccactgaatcatcagataca

SEQ ID NO: 280096 - DNA, 75 bp, Artificial Sequence
  Synthetic
gcccactctatacatctactggtgtgctgacagcaaaggatgatcctgtatatgtctgggccccaggaattatta

SEQ ID NO: 280097 - DNA, 75 bp, Artificial Sequence
  Synthetic
gctgacagcaaaggatgatcctgtatatgtctgggccccaggaattattatggagggaaaccactctgtctgtga

SEQ ID NO: 280098 - DNA, 75 bp, Artificial Sequence
  Synthetic
acagggttcatcccattacctggggagattgaaaagacaacacaatgcacggttttttgtactttagcaggacca

SEQ ID NO: 280099 - DNA, 75 bp, Artificial Sequence
  Synthetic
agattgaaaagacaacacaatgcacggttttttgtactttagcaggaccaggtgcagactgtgaagcatattctg

SEQ ID NO: 280100 - DNA, 75 bp, Artificial Sequence
  Synthetic
acctacttgcctgataaaccgtgttcaaagattccgtggtgctgaacagcaaataaaatttgtttgtcaaagagt

SEQ ID NO: 280101 - DNA, 75 bp, Artificial Sequence
  Synthetic
aatggagtaaaaaaagtcatccttactaaaaccttagttattggacagtgcatttatacttttacaagtatcttt

SEQ ID NO: 280102 - DNA, 75 bp, Artificial Sequence
  Synthetic
gctgggttctgataccaactattacaatgatcttgttaaaaatattaattgcatttgcatatctttgctctaagt

SEQ ID NO: 280103 - DNA, 75 bp, Artificial Sequence
  Synthetic
tttggttgagaaagtaaaaaaggaatatcagaaaaccatgggctcaatggtttgtgaggtatgtcagtatgagtg

SEQ ID NO: 280104 - DNA, 75 bp, Artificial Sequence
  Synthetic
tatcagaaaaccatgggctcaatggtttgtgaggtatgtcagtatgagtgtgaaactgctaaggagttagaatca

SEQ ID NO: 280105 - DNA, 75 bp, Artificial Sequence
  Synthetic
catgcccttattgccttaatccatctgaggctacaccgtctgctcttcaagctcattttaaagtttgtaaactaa

SEQ ID NO: 280106 - DNA, 75 bp, Artificial Sequence
  Synthetic
tgaggctacaccgtctgctcttcaagctcattttaaagtttgtaaactaacatcacggtttcaggaaaatttgaa

SEQ ID NO: 280107 - DNA, 75 bp, Artificial Sequence
  Synthetic
atgcagggttgttatcgaacattatctctatttaggtaccgcagtagattttttgtaggtttagtgtggtgtatg

SEQ ID NO: 280108 - DNA, 75 bp, Artificial Sequence
  Synthetic
ctctatttaggtaccgcagtagattttttgtaggtttagtgtggtgtatgttgcttgttttagagctaattgtat

SEQ ID NO: 280109 - DNA, 75 bp, Artificial Sequence
  Synthetic
cttaaatgatggttggactgatactgcacatggatcaggaataatacctatgaaggctgatcttgaactggattt

SEQ ID NO: 280110 - DNA, 75 bp, Artificial Sequence
  Synthetic
gcacatggatcaggaataatacctatgaaggctgatcttgaactggatttctcattaccttcatctgctagctat

SEQ ID NO: 280111 - DNA, 75 bp, Artificial Sequence
  Synthetic
cggcaaatgaacaagaaaaaataccatttcatttacagataagtaaacaggtgattcatgctgaaattcaacatc

SEQ ID NO: 280112 - DNA, 75 bp, Artificial Sequence
  Synthetic
atttcatttacagataagtaaacaggtgattcatgctgaaattcaacatctaggccactggatggatgctacatt

SEQ ID NO: 280113 - DNA, 75 bp, Artificial Sequence
  Synthetic
tatggttcatgtgaaaaatatgcctacccctggcaaacagcaggatgtttcgttgaaaaagattatgaatatgaa

SEQ ID NO: 280114 - DNA, 75 bp, Artificial Sequence
  Synthetic
acccctggcaaacagcaggatgtttcgttgaaaaagattatgaatatgaaactggttggggttgtaatccccctg

SEQ ID NO: 280115 - DNA, 75 bp, Artificial Sequence
  Synthetic
cactgcttgcggtgtatatctggataagttaaaatcagttggaaaggtatttaagattgtgtctttaagatatac

SEQ ID NO: 280116 - DNA, 75 bp, Artificial Sequence
  Synthetic
aagttaaaatcagttggaaaggtatttaagattgtgtctttaagatatacaaggaaagtatgcattcagttgggt

SEQ ID NO: 280117 - DNA, 75 bp, Artificial Sequence
  Synthetic
acagtaatgattgtttaataactacatcagttaaagtgtgcttgataggtaccatttcaaagttccaaccttctg

SEQ ID NO: 280118 - DNA, 75 bp, Artificial Sequence
  Synthetic
atcagttaaagtgtgcttgataggtaccatttcaaagttccaaccttctgataccctcttattcctcggtcctct

SEQ ID NO: 280119 - DNA, 75 bp, Artificial Sequence
  Synthetic
caatggtgtactactacatgtcaatttggtgatcccggagatataatgagtacacccacagggatgaagtgtcca

SEQ ID NO: 280120 - DNA, 75 bp, Artificial Sequence
  Synthetic
ttggtgatcccggagatataatgagtacacccacagggatgaagtgtccagaacttaatggttcattcagaaaaa

SEQ ID NO: 280121 - DNA, 75 bp, Artificial Sequence
  Synthetic
atgtcagtttgatgggaatacaatttcaggttataaacggatggttgcaacaaaagattcatttcaatcatttaa

SEQ ID NO: 280122 - DNA, 75 bp, Artificial Sequence
  Synthetic
tcaggttataaacggatggttgcaacaaaagattcatttcaatcatttaatgtaacagaaccacacatctctaca

SEQ ID NO: 280123 - DNA, 75 bp, Artificial Sequence
  Synthetic
atagttcacttcgggatcacatcaatgtgattgtaagccgtgatttgtcctttcaggatttaagtgaaacacctt

SEQ ID NO: 280124 - DNA, 75 bp, Artificial Sequence
  Synthetic
tgtgattgtaagccgtgatttgtcctttcaggatttaagtgaaacaccttgtcaagtggatttgacaacatcagc

SEQ ID NO: 280125 - DNA, 75 bp, Artificial Sequence
  Synthetic
gttggttttaacctggtatgtactgttagtttaacagaatgctctgcatttttaacttcaattaaggcatgtcat

SEQ ID NO: 280126 - DNA, 75 bp, Artificial Sequence
  Synthetic
ttagtttaacagaatgctctgcatttttaacttcaattaaggcatgtcatgctgctatgtgttatggttctacta

SEQ ID NO: 280127 - DNA, 75 bp, Artificial Sequence
  Synthetic
tacaattcatgttgttggtaaaggtggacattctggttcaaagtttatgtgttgtcatgacacaaagtgctctag

SEQ ID NO: 280128 - DNA, 75 bp, Artificial Sequence
  Synthetic
ggacattctggttcaaagtttatgtgttgtcatgacacaaagtgctctagtacagggttagttgcagctgcacca

SEQ ID NO: 280129 - DNA, 75 bp, Artificial Sequence
  Synthetic
atcaagctgatagtgataagatctttgatgatggcgctccagagtgtggtatgtcttgctggtttaaaaaattag

SEQ ID NO: 280130 - DNA, 75 bp, Artificial Sequence
  Synthetic
tgatgatggcgctccagagtgtggtatgtcttgctggtttaaaaaattaggagaatgggttcttggagtccttaa

SEQ ID NO: 280131 - DNA, 75 bp, Artificial Sequence
  Synthetic
ttgatagcattacttatactatccatcttcttatttgcattatgttgtccacgcaggcccagttataagaaagat

SEQ ID NO: 280132 - DNA, 75 bp, Artificial Sequence
  Synthetic
atctttatgctatattcgatttactagtgcagtcaccatatgactacctatatgccattatttcatatcatgtat

SEQ ID NO: 280133 - DNA, 75 bp, Artificial Sequence
  Synthetic
aaactagcactttactaattacattacctcatactgattatgcctggacttttgttcttgcggagtctactacta

SEQ ID NO: 280134 - DNA, 75 bp, Artificial Sequence
  Synthetic
aagccaggcaacaaacagtgtcagcactggaggataaactcgcagactacaagagaaggatggcagatgctgtgt

SEQ ID NO: 280135 - DNA, 75 bp, Artificial Sequence
  Synthetic
atacaattggagtttatgtgataggattcacacttcctatcatccttaaagccttatacatgctttcaacgcgtg

SEQ ID NO: 280136 - DNA, 75 bp, Artificial Sequence
  Synthetic
gccttatacatgctttcaacgcgtgggagacaaactgtgaaggaaaataaagggacacgtataaggtttaaggat

SEQ ID NO: 280137 - DNA, 75 bp, Artificial Sequence
  Synthetic
tgtgaaagattggccagaaagaattaaagagttcatggaaaaggaatgctcgttcattaagcctgaagttaaacc

SEQ ID NO: 280138 - DNA, 75 bp, Artificial Sequence
  Synthetic
gatggctgagcttggggcttttttttcaatactgcaggacatgagaaatacaataatggcgtctaagactgttgg

SEQ ID NO: 280139 - DNA, 75 bp, Artificial Sequence
  Synthetic
aagtcctctttctaccaatcttacttacgccggactcaatcaatggggatccaacttgaccaaagaatcatccta

SEQ ID NO: 280140 - DNA, 75 bp, Artificial Sequence
  Synthetic
aaaatgtgaaagaaatatcaaaccaagagccattaaaaatataattacttaatcacatatgcactaattatagat

SEQ ID NO: 280141 - DNA, 75 bp, Artificial Sequence
  Synthetic
agagccattaaaaatataattacttaatcacatatgcactaattatagatagtaagttactaacatgcagacaat

SEQ ID NO: 280142 - DNA, 75 bp, Artificial Sequence
  Synthetic
aatcacatatgcactaattatagatagtaagttactaacatgcagacaatattatatattcagggattatatgtg

SEQ ID NO: 280143 - DNA, 75 bp, Artificial Sequence
  Synthetic
gggtttataatcgtaagtatcagggtcattaattaataaactaatcagggttaaactggaaatatagcattataa

SEQ ID NO: 280144 - DNA, 75 bp, Artificial Sequence
  Synthetic
atcattgtctagttagcattatgtaggataaggttgtattttattatttaatgggcccgaacatgtgaaactgag

SEQ ID NO: 280145 - DNA, 75 bp, Artificial Sequence
  Synthetic
gccttagatatggaaatgtccttgatgtaaatgccattgacatcgaagaaccaagtggtcagacagcagattggt

SEQ ID NO: 280146 - DNA, 75 bp, Artificial Sequence
  Synthetic
ttttacaattcccatcattttaaaggctctatacatgttgtcaacacgtggaagacagaccgtaaaagaaaataa

SEQ ID NO: 280147 - DNA, 75 bp, Artificial Sequence
  Synthetic
ccttcataaagccagaagttaaacccgggacaccagcacaggagatagaatttttgaaaagaaacagggtttatt

SEQ ID NO: 280148 - DNA, 75 bp, Artificial Sequence
  Synthetic
taaaaatcatgtggctgacattgataagttaattgactatgctgcctctggtgaccctacatcacctgatgacat

SEQ ID NO: 280149 - DNA, 75 bp, Artificial Sequence
  Synthetic
agaaggtaaaagagatatcaaatcaggagcccttaaagatatgattgactcagtttattactaattgtaggtata

SEQ ID NO: 280150 - DNA, 75 bp, Artificial Sequence
  Synthetic
atatattcagggatttattaattaattgtttactaatttaaatatacgggtttgacaattattattatcagggtt

SEQ ID NO: 280151 - DNA, 75 bp, Artificial Sequence
  Synthetic
ttgtttactaatttaaatatacgggtttgacaattattattatcagggttttgaattaatgcactaatcaggggt

SEQ ID NO: 280152 - DNA, 75 bp, Artificial Sequence
  Synthetic
agcaaacacagacaaatatgggaaaacttagtccagtttgtttgtatctacttctccagtgtctactactagggg

SEQ ID NO: 280153 - DNA, 75 bp, Artificial Sequence
  Synthetic
acttagtccagtttgtttgtatctacttctccagtgtctactactaggggatagaggggatgccaggaacctgaa

SEQ ID NO: 280154 - DNA, 75 bp, Artificial Sequence
  Synthetic
cttctccagtgtctactactaggggatagaggggatgccaggaacctgaatgagcttaaaatggagtgcccacat

SEQ ID NO: 280155 - DNA, 75 bp, Artificial Sequence
  Synthetic
ttgttggttcagtggaattaccaccagttcccatacagcaggttgagtctttaaagctggaaagttcttgtaatt

SEQ ID NO: 280156 - DNA, 75 bp, Artificial Sequence
  Synthetic
agttcccatacagcaggttgagtctttaaagctggaaagttcttgtaattttgatttacataccagtacagcagg

SEQ ID NO: 280157 - DNA, 75 bp, Artificial Sequence
  Synthetic
tgggagataaagaatgatttggctgaaaacacgcaagcatcatcaacaagtttccagacaaaaagcagtgaggta

SEQ ID NO: 280158 - DNA, 75 bp, Artificial Sequence
  Synthetic
aaaacacgcaagcatcatcaacaagtttccagacaaaaagcagtgaggtaaatttaagaggattatgcctgatac

SEQ ID NO: 280159 - DNA, 75 bp, Artificial Sequence
  Synthetic
aaggactcggaagacaatagcctgctacgatctaacatgcaatcagacagtatgccagcccactgtctacttaat

SEQ ID NO: 280160 - DNA, 75 bp, Artificial Sequence
  Synthetic
tacgatctaacatgcaatcagacagtatgccagcccactgtctacttaatgggaccaatccagacttgtgtaaca

SEQ ID NO: 280161 - DNA, 75 bp, Artificial Sequence
  Synthetic
gtgatcaaaggattcaagtgaattatgagaagacatattgtgtgtcagggcaacttgttgaaggtgtctgtttta

SEQ ID NO: 280162 - DNA, 75 bp, Artificial Sequence
  Synthetic
tgagaagacatattgtgtgtcagggcaacttgttgaaggtgtctgttttaatcctatccatacaatggccctttc

SEQ ID NO: 280163 - DNA, 75 bp, Artificial Sequence
  Synthetic
atgacattgatggtgcgttgtttcttaattataaaaaaagtaacatcaggtgatagtatgaagattgaaaaaaac

SEQ ID NO: 280164 - DNA, 75 bp, Artificial Sequence
  Synthetic
taattataaaaaaagtaacatcaggtgatagtatgaagattgaaaaaaactttgaaactcttgtccaaaaaacag

SEQ ID NO: 280165 - DNA, 75 bp, Artificial Sequence
  Synthetic
ttattatatctgtcttataggaagtagctctgagccattgtatgtcccaacattggatgattaccggtcagctga

SEQ ID NO: 280166 - DNA, 75 bp, Artificial Sequence
  Synthetic
agctctgagccattgtatgtcccaacattggatgattaccggtcagctgaggtattatcaaggatggcctttgcc

SEQ ID NO: 280167 - DNA, 75 bp, Artificial Sequence
  Synthetic
agaaaaatgctgtaagtacaatgaggattgctggtaaagtgacaggtagggcaccttcaactgaggcctctgata

SEQ ID NO: 280168 - DNA, 75 bp, Artificial Sequence
  Synthetic
gattgctggtaaagtgacaggtagggcaccttcaactgaggcctctgatacagtgcaaggtattgctttttcagg

SEQ ID NO: 280169 - DNA, 75 bp, Artificial Sequence
  Synthetic
gttttgacagccaaagatgaccctgtatatatttgggcaccaggaattatcatggagggtaaccattctagttgt

SEQ ID NO: 280170 - DNA, 75 bp, Artificial Sequence
  Synthetic
ggacaggctttatttcattaccaggagaaatagaaaaaacaacacaatgtacagtcttttgtaccttggctggac

SEQ ID NO: 280171 - DNA, 75 bp, Artificial Sequence
  Synthetic
tgagacaggtatttttaatataagttcacctacatgtttaattaatcgtgtgcaaaggttccgtggtgcggagca

SEQ ID NO: 280172 - DNA, 75 bp, Artificial Sequence
  Synthetic
tcacctacatgtttaattaatcgtgtgcaaaggttccgtggtgcggagcaacagataaagtttgtctgtcaaaga

SEQ ID NO: 280173 - DNA, 75 bp, Artificial Sequence
  Synthetic
gtaacggcataaagaaagtaatactaacaaaaacattggttataggacaatgcatttatacattcactagtattt

SEQ ID NO: 280174 - DNA, 75 bp, Artificial Sequence
  Synthetic
aacaaaaacattggttataggacaatgcatttatacattcactagtattttttcattaatcccaggagttgctca

SEQ ID NO: 280175 - DNA, 75 bp, Artificial Sequence
  Synthetic
ccgggtcttcatggttggactactatgttgctcttattaactttttgttttggttgggtattaataccatttatc

SEQ ID NO: 280176 - DNA, 75 bp, Artificial Sequence
  Synthetic
tggttgggtattaataccatttatcaccatgatactactgaaaatactaattgcatttgcatatctttgttccaa

SEQ ID NO: 280177 - DNA, 75 bp, Artificial Sequence
  Synthetic
attctggttgagaaagtcaagaaagaataccagaaaacaatgggttcaatggtatgtgaggtttgtcaatatgag

SEQ ID NO: 280178 - DNA, 75 bp, Artificial Sequence
  Synthetic
aataccagaaaacaatgggttcaatggtatgtgaggtttgtcaatatgagtgtgaaactgccaaggaactagagt

SEQ ID NO: 280179 - DNA, 75 bp, Artificial Sequence
  Synthetic
atcatgcccatattgcctgaatccatctgaggctacaacatctgcccttcaagctcattttaaagtatgtaaact

SEQ ID NO: 280180 - DNA, 75 bp, Artificial Sequence
  Synthetic
tctgaggctacaacatctgcccttcaagctcattttaaagtatgtaaactaacatcaaggtttcaggaaaactta

SEQ ID NO: 280181 - DNA, 75 bp, Artificial Sequence
  Synthetic
caatgcagggctgttatcggactttgtcactcttccgatatagaagtaaattctttgtgggcttggtctggtgct

SEQ ID NO: 280182 - DNA, 75 bp, Artificial Sequence
  Synthetic
gtgggcagccagtgcagaaacacaaaatttaaattctgggtggactgacacagcacatggatctgggatcatacc

SEQ ID NO: 280183 - DNA, 75 bp, Artificial Sequence
  Synthetic
aatttaaattctgggtggactgacacagcacatggatctgggatcataccaatgaaaactgacctggaattagac

SEQ ID NO: 280184 - DNA, 75 bp, Artificial Sequence
  Synthetic
cagcacatggatctgggatcataccaatgaaaactgacctggaattagacttctccctaccatcctctgcaagtt

SEQ ID NO: 280185 - DNA, 75 bp, Artificial Sequence
  Synthetic
tccagcaaatgaacaagaaaaaataccatttcatttgcagataagtaaacaagtgattcatgcagaaattcaaca

SEQ ID NO: 280186 - DNA, 75 bp, Artificial Sequence
  Synthetic
ccatttcatttgcagataagtaaacaagtgattcatgcagaaattcaacatttaggccattggatggatgctaca

SEQ ID NO: 280187 - DNA, 75 bp, Artificial Sequence
  Synthetic
gctatggatcttgtgaaaagtatgcttacccttggcagacagcaggttgtttcattgaaaaggactatgagtatg

SEQ ID NO: 280188 - DNA, 75 bp, Artificial Sequence
  Synthetic
ttacccttggcagacagcaggttgtttcattgaaaaggactatgagtatgagactggttggggttgcaatccacc

SEQ ID NO: 280189 - DNA, 75 bp, Artificial Sequence
  Synthetic
tgtactgcatgtggtgtttatttagataagttaaaatcagttgggaaagtatttaagattgtatcccttaaatat

SEQ ID NO: 280190 - DNA, 75 bp, Artificial Sequence
  Synthetic
ataagttaaaatcagttgggaaagtatttaagattgtatcccttaaatatactagaaaggtatgcatccaattag

SEQ ID NO: 280191 - DNA, 75 bp, Artificial Sequence
  Synthetic
tgatagtaatgattgtctaatcactacatctgttaaggtgtgcatgattgggactatttcaaaatttcaaccctc

SEQ ID NO: 280192 - DNA, 75 bp, Artificial Sequence
  Synthetic
acatctgttaaggtgtgcatgattgggactatttcaaaatttcaaccctctgatactttattatttctaggtcct

SEQ ID NO: 280193 - DNA, 75 bp, Artificial Sequence
  Synthetic
aacaatggtgcacaacaacatgtcagtttggggatcctggagatattatgagcacacctacaggaatgaaatgtc

SEQ ID NO: 280194 - DNA, 75 bp, Artificial Sequence
  Synthetic
gtttggggatcctggagatattatgagcacacctacaggaatgaaatgtccagaattaaatggttcattcaggaa

SEQ ID NO: 280195 - DNA, 75 bp, Artificial Sequence
  Synthetic
gtatgccaatttgatgggaatacaatttcaggatataaacggatgattgcaacaaaagattctttccaatctttt

SEQ ID NO: 280196 - DNA, 75 bp, Artificial Sequence
  Synthetic
tttcaggatataaacggatgattgcaacaaaagattctttccaatcttttaatgtgacagaacctcacatttctg

SEQ ID NO: 280197 - DNA, 75 bp, Artificial Sequence
  Synthetic
tgatagctcactacgagaccatatcaatgtagttgtaggtcgtgatctatctttccaggatctcagtgaaacacc

SEQ ID NO: 280198 - DNA, 75 bp, Artificial Sequence
  Synthetic
aatgtagttgtaggtcgtgatctatctttccaggatctcagtgaaacaccctgtcaggtggatttaatgacttca

SEQ ID NO: 280199 - DNA, 75 bp, Artificial Sequence
  Synthetic
gagttggattcaatcttgtctgtactgttagcttaacagagtgttcagcatttttaacttccatcaaagcttgtg

SEQ ID NO: 280200 - DNA, 75 bp, Artificial Sequence
  Synthetic
tgttagcttaacagagtgttcagcatttttaacttccatcaaagcttgtgattcagctatgtgttatggatcaac

SEQ ID NO: 280201 - DNA, 75 bp, Artificial Sequence
  Synthetic
aatacagttcatattgttggtaagggaggtcactctggttcaaaattcatgtgttgtcatgacactaaatgttca

SEQ ID NO: 280202 - DNA, 75 bp, Artificial Sequence
  Synthetic
gaggtcactctggttcaaaattcatgtgttgtcatgacactaaatgttcaagcacaggcttagttgcagctgcac

SEQ ID NO: 280203 - DNA, 75 bp, Artificial Sequence
  Synthetic
taatcaagcagatagtgataagatatttgatgatggtgcacctgaatgtggtatgtcatgctggtttaaaaaatc

SEQ ID NO: 280204 - DNA, 75 bp, Artificial Sequence
  Synthetic
tttgatgatggtgcacctgaatgtggtatgtcatgctggtttaaaaaatcaggagaatggatactcggagtgctc

SEQ ID NO: 280205 - DNA, 75 bp, Artificial Sequence
  Synthetic
tactaattgccctattaatattatccattcttatgttcacattgtgctgtccacgtaggcctagctacaggaaag

SEQ ID NO: 280206 - DNA, 75 bp, Artificial Sequence
  Synthetic
cattcttatgttcacattgtgctgtccacgtaggcctagctacaggaaagagcataagccatgatcattaattgc

SEQ ID NO: 280207 - DNA, 75 bp, Artificial Sequence
  Synthetic
taataaaattcttgtatagttattttaaatcatttacttcgtaatatatttagtgtactgtatttaactactata

SEQ ID NO: 280208 - DNA, 75 bp, Artificial Sequence
  Synthetic
tagtgtactgtatttaactactatatagaaaaaaaactaacgctttactaattacattacctcataccgattgtg

SEQ ID NO: 280209 - DNA, 75 bp, Artificial Sequence
  Synthetic
accatgaaggcagaagaactcacaccgggtaggtttcgcacaatagtatgtggtctatttccaactcagatccaa

SEQ ID NO: 280210 - DNA, 75 bp, Artificial Sequence
  Synthetic
aagcaaggcaacaaacagtgtcagcattggaggataaactcgcagactacaagagaagaatggcagatgctgtgt

SEQ ID NO: 280211 - DNA, 75 bp, Artificial Sequence
  Synthetic
aagagaagaatggcagatgctgtgtcccggaaaaaaatggatactaaacctactgacccgactgggattgaacct

SEQ ID NO: 280212 - DNA, 75 bp, Artificial Sequence
  Synthetic
gctctatacatgttgtcaacacgtggaagacagaccgtaaaagaaaataaaggaacacggatcaggttcaaagat

SEQ ID NO: 280213 - DNA, 75 bp, Artificial Sequence
  Synthetic
gcatcaggagaccaaaacatctatatgtatccatgcctactgcccagtccaccatgaaagctgaagaacttacac

SEQ ID NO: 280214 - DNA, 75 bp, Artificial Sequence
  Synthetic
ggtttgacaattattattatcagggttttgaattaatgcactaatcaggggttaactggaattatacaattacaa

SEQ ID NO: 280215 - DNA, 75 bp, Artificial Sequence
  Synthetic
tagtagtagactccgcaagaagaagcaaatacagataaatatgggaaaacttagtccagtttgtctgtatctgct

SEQ ID NO: 280216 - DNA, 75 bp, Artificial Sequence
  Synthetic
ttagtccagtttgtctgtatctgcttctccagggtctattactattcaatacagggactgccagaaacctgaatg

SEQ ID NO: 280217 - DNA, 75 bp, Artificial Sequence
  Synthetic
tattgggttgggtcaaggccttgttgtaggatcagtggaactgccacctgtcccaatacagcaggtggaaacatt

SEQ ID NO: 280218 - DNA, 75 bp, Artificial Sequence
  Synthetic
tcccaatacagcaggtggaaacattgaagctggaaagttcttgtaattttgatttgcatactagtacagcaggac

SEQ ID NO: 280219 - DNA, 75 bp, Artificial Sequence
  Synthetic
gaagctggaaagttcttgtaattttgatttgcatactagtacagcaggacaacaggcatttacaaagtggacatg

SEQ ID NO: 280220 - DNA, 75 bp, Artificial Sequence
  Synthetic
ggaaataaaaggtgatcttgcagaaaatacacaggcatcatcaacaagttttcaaacaaaaagtagtgaagtaaa

SEQ ID NO: 280221 - DNA, 75 bp, Artificial Sequence
  Synthetic
actctagttattgagacagcagcaagaatgcggaaaacaatagcatgttatgatctatcatgtaatcaaacagta

SEQ ID NO: 280222 - DNA, 75 bp, Artificial Sequence
  Synthetic
gaatgcggaaaacaatagcatgttatgatctatcatgtaatcaaacagtatgtcagcctactgtgtatcttatgg

SEQ ID NO: 280223 - DNA, 75 bp, Artificial Sequence
  Synthetic
taagagttgtcttttgggcctaggtgatcaaagaattcaagtgaattatgaaaagacatactgtgtttcagggca

SEQ ID NO: 280224 - DNA, 75 bp, Artificial Sequence
  Synthetic
gatcaaagaattcaagtgaattatgaaaagacatactgtgtttcagggcagttggttgagggtgtctgtttcaat

SEQ ID NO: 280225 - DNA, 75 bp, Artificial Sequence
  Synthetic
aacccagtcatacttatgatatagttactatgatggttcgttgttttctagttataaaaaaggtgacatctggtg

SEQ ID NO: 280226 - DNA, 75 bp, Artificial Sequence
  Synthetic
tgagactcttgtccagaagaatggttgtacagccaatagttttcaaggttattacatctgtcttatagggagtag

SEQ ID NO: 280227 - DNA, 75 bp, Artificial Sequence
  Synthetic
tgtacagccaatagttttcaaggttattacatctgtcttatagggagtagctcagagccactgtatgtcccaaca

SEQ ID NO: 280228 - DNA, 75 bp, Artificial Sequence
  Synthetic
tcctttcaagaatggcatttgcacctcatggggaagatcatgatgttgaaaaaaatgcaataagtgccctacgta

SEQ ID NO: 280229 - DNA, 75 bp, Artificial Sequence
  Synthetic
tcatggggaagatcatgatgttgaaaaaaatgcaataagtgccctacgtattgctgggaaagtgacagggaaagc

SEQ ID NO: 280230 - DNA, 75 bp, Artificial Sequence
  Synthetic
gtacaaggtgttgcattttcaggtagtcctctttatacatctaccggggttttaacagcaaaggacgatcctgtg

SEQ ID NO: 280231 - DNA, 75 bp, Artificial Sequence
  Synthetic
gtcctctttatacatctaccggggttttaacagcaaaggacgatcctgtgtacatctgggccccgggtattatca

SEQ ID NO: 280232 - DNA, 75 bp, Artificial Sequence
  Synthetic
gaaaaagaccttacctctcacatggactgggttcatctcattgcctggagaaattgagaagacaacacaatgcac

SEQ ID NO: 280233 - DNA, 75 bp, Artificial Sequence
  Synthetic
actgggttcatctcattgcctggagaaattgagaagacaacacaatgcacagtcttctgcaccctggctggacca

SEQ ID NO: 280234 - DNA, 75 bp, Artificial Sequence
  Synthetic
aaacaggcatttttaatataagctcaccaacttgcctaatcaatcgtgtgcaaaggttccgtggtgcagagcaac

SEQ ID NO: 280235 - DNA, 75 bp, Artificial Sequence
  Synthetic
accaacttgcctaatcaatcgtgtgcaaaggttccgtggtgcagagcaacaaataaagtttgtttgtcagagagt

SEQ ID NO: 280236 - DNA, 75 bp, Artificial Sequence
  Synthetic
aatggagtcaagaaagtcattctaaccaaaaccttagttattggacagtgtatttatacatttactagtatattc

SEQ ID NO: 280237 - DNA, 75 bp, Artificial Sequence
  Synthetic
ccaaaaccttagttattggacagtgtatttatacatttactagtatattctctttaatcccaggggttgcacact

SEQ ID NO: 280238 - DNA, 75 bp, Artificial Sequence
  Synthetic
aggtcttcatggctgggcaactatgttattgttactaacattttgctttggatgggttctaataccaaccattac

SEQ ID NO: 280239 - DNA, 75 bp, Artificial Sequence
  Synthetic
ttattgttactaacattttgctttggatgggttctaataccaaccattacaatgatattgctgaaaattttaatt

SEQ ID NO: 280240 - DNA, 75 bp, Artificial Sequence
  Synthetic
ataatacagattcaaaattcaggattttgattgaaaaagtaaaaaaggaatatcagaaaacaatgggctcgatgg

SEQ ID NO: 280241 - DNA, 75 bp, Artificial Sequence
  Synthetic
tttgattgaaaaagtaaaaaaggaatatcagaaaacaatgggctcgatggtctgtgaggtgtgtcaatatgaatg

SEQ ID NO: 280242 - DNA, 75 bp, Artificial Sequence
  Synthetic
cataggaaaagctgttcaattggctcatgtccttattgtcttaacccgtctgaggcaacaacatctgccctccag

SEQ ID NO: 280243 - DNA, 75 bp, Artificial Sequence
  Synthetic
catgtccttattgtcttaacccgtctgaggcaacaacatctgccctccaggcccattttaaagtctgtaaactta

SEQ ID NO: 280244 - DNA, 75 bp, Artificial Sequence
  Synthetic
aaaatcattaacagtatatgagcccatgcagggttgttatcgcaccttatctctcttcagatatcggagtcggtt

SEQ ID NO: 280245 - DNA, 75 bp, Artificial Sequence
  Synthetic
atgcagggttgttatcgcaccttatctctcttcagatatcggagtcggttctttgttggtttagtctggtgtgtg

SEQ ID NO: 280246 - DNA, 75 bp, Artificial Sequence
  Synthetic
gggctgctagtgctgagacacagaatttgaatgcaggctggactgatacagcacatggatctgggataataccta

SEQ ID NO: 280247 - DNA, 75 bp, Artificial Sequence
  Synthetic
tttgaatgcaggctggactgatacagcacatggatctgggataatacctatgaaaactgaccttgaattggactt

SEQ ID NO: 280248 - DNA, 75 bp, Artificial Sequence
  Synthetic
acatataggagacagctacagaatccagctaatgaacaagaaaacataccatttcatctacagataagtaaacag

SEQ ID NO: 280249 - DNA, 75 bp, Artificial Sequence
  Synthetic
cagctaatgaacaagaaaacataccatttcatctacagataagtaaacaggtaatccatgcagagatacagcact

SEQ ID NO: 280250 - DNA, 75 bp, Artificial Sequence
  Synthetic
taatctaaaaactgcatttcattgttatggttcatgtgaaaaatatgcttatccttggcaaactgctggttgttt

SEQ ID NO: 280251 - DNA, 75 bp, Artificial Sequence
  Synthetic
tatggttcatgtgaaaaatatgcttatccttggcaaactgctggttgttttgtagaaaaggattatgagtatgag

SEQ ID NO: 280252 - DNA, 75 bp, Artificial Sequence
  Synthetic
attgccctggagtagggacaggctgtactgcctgtggggcctatcttgataaattaaaatcagttgggaaagtct

SEQ ID NO: 280253 - DNA, 75 bp, Artificial Sequence
  Synthetic
tactgcctgtggggcctatcttgataaattaaaatcagttgggaaagtcttcaaaattgtgtccttgaggtatac

SEQ ID NO: 280254 - DNA, 75 bp, Artificial Sequence
  Synthetic
actgaacaaacctgtaagactgttgatagtaatgactgtttaataactacttcagtcaaagtgtgtttaataggg

SEQ ID NO: 280255 - DNA, 75 bp, Artificial Sequence
  Synthetic
atagtaatgactgtttaataactacttcagtcaaagtgtgtttaatagggacaatttcaaaatttcaaccctctg

SEQ ID NO: 280256 - DNA, 75 bp, Artificial Sequence
  Synthetic
ccaacagggtggtttaatatttaagcaatggtgcactacaacatgccaatttggtgaccctggagatataatgag

SEQ ID NO: 280257 - DNA, 75 bp, Artificial Sequence
  Synthetic
cacacccacagggatgaaatgcccagatttaaatgggtcctttagaaaaaaatgtgcatttgcaacaacacctgt

SEQ ID NO: 280258 - DNA, 75 bp, Artificial Sequence
  Synthetic
tcaggatacaaaaggatgattgctacaaaggattcatttcaatctttcaatgtcacagaaccccacatatctgca

SEQ ID NO: 280259 - DNA, 75 bp, Artificial Sequence
  Synthetic
caaaggattcatttcaatctttcaatgtcacagaaccccacatatctgcaagtgcattagaatggattgatcctg

SEQ ID NO: 280260 - DNA, 75 bp, Artificial Sequence
  Synthetic
tgtaattgtaagccgtgatttatcttttcaagatttaagtgaaacaccatgccaaatagatctttcaacagcatc

SEQ ID NO: 280261 - DNA, 75 bp, Artificial Sequence
  Synthetic
tttcaagatttaagtgaaacaccatgccaaatagatctttcaacagcatccatagatggggcatggggttcaggg

SEQ ID NO: 280262 - DNA, 75 bp, Artificial Sequence
  Synthetic
ttagcttaacagagtgttctgcatttcttacttcaattaaggcatgtgatgccgcaatgtgttatggatctacta

SEQ ID NO: 280263 - DNA, 75 bp, Artificial Sequence
  Synthetic
tcttacttcaattaaggcatgtgatgccgcaatgtgttatggatctactacagctaatttagttaggggacaaaa

SEQ ID NO: 280264 - DNA, 75 bp, Artificial Sequence
  Synthetic
gggcattctggctcaaaatttatgtgttgtcatgacacaaaatgctcgaccactggccttgttgcagctgcacca

SEQ ID NO: 280265 - DNA, 75 bp, Artificial Sequence
  Synthetic
gttgtcatgacacaaaatgctcgaccactggccttgttgcagctgcaccacatttagatcgtgtgacgggataca

SEQ ID NO: 280266 - DNA, 75 bp, Artificial Sequence
  Synthetic
tgatgatggtgcaccagagtgtggtatgtcttgctggtttaaaaagtctggagaatggattcttggggtcctcaa

SEQ ID NO: 280267 - DNA, 75 bp, Artificial Sequence
  Synthetic
atgtcttgctggtttaaaaagtctggagaatggattcttggggtcctcaacggaaattggatggtagtagctgta

SEQ ID NO: 280268 - DNA, 75 bp, Artificial Sequence
  Synthetic
ttctcttgttcacattatgctgcccacgcagacctagttacagaaaagagcataaaccttagtagatagttgctc

SEQ ID NO: 280269 - DNA, 75 bp, Artificial Sequence
  Synthetic
atgtaaatagcatattaaatttactaaaagacttaatgcataaccacccatattcttttatcttttatcatatat

SEQ ID NO: 280270 - DNA, 75 bp, Artificial Sequence
  Synthetic
agaaaaaaaactagcactttactaattaaattacctcataccgattatgcctggacttttgttcttgcggagtct

SEQ ID NO: 280271 - DNA, 75 bp, Artificial Sequence
  Synthetic
tagtagtagactccgagatagagaagtttactacaaatggaaaaatacagagagattcatgagagggttaaggaa

SEQ ID NO: 280272 - DNA, 75 bp, Artificial Sequence
  Synthetic
gtttactacaaatggaaaaatacagagagattcatgagagggttaaggaagcagtcccaggagagacatcagcag

SEQ ID NO: 280273 - DNA, 75 bp, Artificial Sequence
  Synthetic
agagattcatgagagggttaaggaagcagtcccaggagagacatcagcagttgagtgtttagatctattagatag

SEQ ID NO: 280274 - DNA, 75 bp, Artificial Sequence
  Synthetic
gttgatcagatgataaaacatgactggtctgacaataaagatagggaacagcccataggtttagttcttttaatg

SEQ ID NO: 280275 - DNA, 75 bp, Artificial Sequence
  Synthetic
ggtctgacaataaagatagggaacagcccataggtttagttcttttaatggctggagtaccaaatgatgtgatcc

SEQ ID NO: 280276 - DNA, 75 bp, Artificial Sequence
  Synthetic
aggaagccctagtggtcagatactgagatcatttttcaagatgactcccgataattataaaataacagggagtct

SEQ ID NO: 280277 - DNA, 75 bp, Artificial Sequence
  Synthetic
agatcatttttcaagatgactcccgataattataaaataacagggagtctgatagagtttattgaggtgacagtt

SEQ ID NO: 280278 - DNA, 75 bp, Artificial Sequence
  Synthetic
gggaaaaggttttaaaatatcaaggaggtttagagttcattgagcaacttttgcatattgaagcccagaagggga

SEQ ID NO: 280279 - DNA, 75 bp, Artificial Sequence
  Synthetic
aggtttagagttcattgagcaacttttgcatattgaagcccagaaggggaattgccagcctggctttaaaataaa

SEQ ID NO: 280280 - DNA, 75 bp, Artificial Sequence
  Synthetic
gatggttcaaacatctctacacagtggcctagtagaagaaatgaaggtgttgttcaggcaatgaggttaatccaa

SEQ ID NO: 280281 - DNA, 75 bp, Artificial Sequence
  Synthetic
ggcctagtagaagaaatgaaggtgttgttcaggcaatgaggttaatccaagctgatataaattttgtaagagaac

SEQ ID NO: 280282 - DNA, 75 bp, Artificial Sequence
  Synthetic
ggcacttgaagcaatgtttaatctaaaatttcatgtaacaggtccaaaagtgaggacatttgatatcccaaatta

SEQ ID NO: 280283 - DNA, 75 bp, Artificial Sequence
  Synthetic
aaatttcatgtaacaggtccaaaagtgaggacatttgatatcccaaattataggccccaaccactatgtcaacca

SEQ ID NO: 280284 - DNA, 75 bp, Artificial Sequence
  Synthetic
gtaaaatttggcttgagacagatcatgcatttgcatttaaagaagtaacaggacagcgtgtattcaatgtgttta

SEQ ID NO: 280285 - DNA, 75 bp, Artificial Sequence
  Synthetic
tgcatttgcatttaaagaagtaacaggacagcgtgtattcaatgtgtttagagaagaagaagaattacatgcatc

SEQ ID NO: 280286 - DNA, 75 bp, Artificial Sequence
  Synthetic
aggaattttttgttatgccaaattagcttacaagcaccatatctaccatccactattgcctctgaccagtatgat

SEQ ID NO: 280287 - DNA, 75 bp, Artificial Sequence
  Synthetic
gcttacaagcaccatatctaccatccactattgcctctgaccagtatgatacacgttctgtttgcaatgagatac

SEQ ID NO: 280288 - DNA, 75 bp, Artificial Sequence
  Synthetic
acaactcttagcaagggacatggcctacaaatatattacattggatcacgatgatataataaattactataatcc

SEQ ID NO: 280289 - DNA, 75 bp, Artificial Sequence
  Synthetic
tacaaatatattacattggatcacgatgatataataaattactataatccacgtgtttattttaaaccaacacaa

SEQ ID NO: 280290 - DNA, 75 bp, Artificial Sequence
  Synthetic
agctaaacttatcaaacatggatccaaagtcaaaggcattaattgatttgatttcaaaagattctaaaaaaggtg

SEQ ID NO: 280291 - DNA, 75 bp, Artificial Sequence
  Synthetic
aaagtcaaaggcattaattgatttgatttcaaaagattctaaaaaaggtgtttttggtgagttaattgacagtat

SEQ ID NO: 280292 - DNA, 75 bp, Artificial Sequence
  Synthetic
aatgaatgtgctaagattattgaaaaaattctatcagatttagaagtcaatttgggtgactccacctctagtcta

SEQ ID NO: 280293 - DNA, 75 bp, Artificial Sequence
  Synthetic
aaattctatcagatttagaagtcaatttgggtgactccacctctagtctagatcaaccaaaaagaacaactggag

SEQ ID NO: 280294 - DNA, 75 bp, Artificial Sequence
  Synthetic
tgataatgaacttgttaaatatctaatctcagtgataagaaaaactactgcatggcatttaggccaccttttacg

SEQ ID NO: 280295 - DNA, 75 bp, Artificial Sequence
  Synthetic
atctcagtgataagaaaaactactgcatggcatttaggccaccttttacgtgatattacagaagcattaattgca

SEQ ID NO: 280296 - DNA, 75 bp, Artificial Sequence
  Synthetic
attggtcagcccatggttatgcctgtggtaatataatgttatgtattttaccatccaaatcacttgaggtagcag

SEQ ID NO: 280297 - DNA, 75 bp, Artificial Sequence
  Synthetic
tggtaatataatgttatgtattttaccatccaaatcacttgaggtagcaggatcttatattagattttttactgt

SEQ ID NO: 280298 - DNA, 75 bp, Artificial Sequence
  Synthetic
gatcctgacaacttagattcaaaagtagaaatagatggagtttcttggtgttttagtaagatcatcagcttagat

SEQ ID NO: 280299 - DNA, 75 bp, Artificial Sequence
  Synthetic
tagaaatagatggagtttcttggtgttttagtaagatcatcagcttagatttaaataggttattagcattaaata

SEQ ID NO: 280300 - DNA, 75 bp, Artificial Sequence
  Synthetic
aacagccacatggtttcagtactatactgaggatcaaggacattttcccctccaacatgcattaaggtctgtgtt

SEQ ID NO: 280301 - DNA, 75 bp, Artificial Sequence
  Synthetic
actgaggatcaaggacattttcccctccaacatgcattaaggtctgtgtttgcatttcatttcttgctttcaact

SEQ ID NO: 280302 - DNA, 75 bp, Artificial Sequence
  Synthetic
tttttgacaacttaaggtatttaataccagcagtcacatctacatactcaggctttgagcctttaataagaaaat

SEQ ID NO: 280303 - DNA, 75 bp, Artificial Sequence
  Synthetic
accagcagtcacatctacatactcaggctttgagcctttaataagaaaattctttgaaagaccttttaagagtgc

SEQ ID NO: 280304 - DNA, 75 bp, Artificial Sequence
  Synthetic
ataaaaacattacttgtaagtttagcacaaaataataaaattagattttattctaaagttagactactagggctt

SEQ ID NO: 280305 - DNA, 75 bp, Artificial Sequence
  Synthetic
cacaaaataataaaattagattttattctaaagttagactactagggcttacagttgatcagtctacaatagggg

SEQ ID NO: 280306 - DNA, 75 bp, Artificial Sequence
  Synthetic
gtcaagagtaatctataagcattatcggagtttaatatctgaggcaactacttgtttttttctttttgaaaaagg

SEQ ID NO: 280307 - DNA, 75 bp, Artificial Sequence
  Synthetic
cggagtttaatatctgaggcaactacttgtttttttctttttgaaaaaggcttgcatggcaatcttacagaagaa

SEQ ID NO: 280308 - DNA, 75 bp, Artificial Sequence
  Synthetic
aatgggctcgaaagtttcaagacaaagagagggaattaggaagctatgtgatggaagaaggctatcatatacagg

SEQ ID NO: 280309 - DNA, 75 bp, Artificial Sequence
  Synthetic
agagagggaattaggaagctatgtgatggaagaaggctatcatatacaggatgtattgaacaatcatataattgt

SEQ ID NO: 280310 - DNA, 75 bp, Artificial Sequence
  Synthetic
gtcgtagaacttgctgctcaagaattaaatacatacttacatgccaaatctcaggtcatggcaagtaatataatg

SEQ ID NO: 280311 - DNA, 75 bp, Artificial Sequence
  Synthetic
taaatacatacttacatgccaaatctcaggtcatggcaagtaatataatgaacaaacattgggataaaccttatt

SEQ ID NO: 280312 - DNA, 75 bp, Artificial Sequence
  Synthetic
aaaagggatgtcaggtgcactacaagaagatggtcatttagctgcaagtgtgacattgattgaagcaatccgatt

SEQ ID NO: 280313 - DNA, 75 bp, Artificial Sequence
  Synthetic
gaagatggtcatttagctgcaagtgtgacattgattgaagcaatccgatttttaaatcactcacaaaataatcca

SEQ ID NO: 280314 - DNA, 75 bp, Artificial Sequence
  Synthetic
caaagaagctaaaagctcaagcaaggattgtgcggaaataccagagaacagaagctgaccggggattttttatta

SEQ ID NO: 280315 - DNA, 75 bp, Artificial Sequence
  Synthetic
gattgtgcggaaataccagagaacagaagctgaccggggattttttattactaccttgcccactagagttagatt

SEQ ID NO: 280316 - DNA, 75 bp, Artificial Sequence
  Synthetic
gctatagccaaagttgttcctgaagagtacatatcttatggaggagaaaggaaaatattgaatatccagcaagct

SEQ ID NO: 280317 - DNA, 75 bp, Artificial Sequence
  Synthetic
agtacatatcttatggaggagaaaggaaaatattgaatatccagcaagctcttgaaaaggcacttcggtgggcat

SEQ ID NO: 280318 - DNA, 75 bp, Artificial Sequence
  Synthetic
attaggacatagtattaagttaaagaggaaattaatgtatgtaagtgcagatgcaacaaagtggtcacctggtga

SEQ ID NO: 280319 - DNA, 75 bp, Artificial Sequence
  Synthetic
aggaaattaatgtatgtaagtgcagatgcaacaaagtggtcacctggtgataattctgcaaagtttaaaagattt

SEQ ID NO: 280320 - DNA, 75 bp, Artificial Sequence
  Synthetic
gtgatgagaagttaaagaactgtgttgttgatgccttaagaaatatatatgagactgatttttttatatctagaa

SEQ ID NO: 280321 - DNA, 75 bp, Artificial Sequence
  Synthetic
tgttgatgccttaagaaatatatatgagactgatttttttatatctagaaaattacatagatatattgacaatat

SEQ ID NO: 280322 - DNA, 75 bp, Artificial Sequence
  Synthetic
gattttttatcattttttcccaataaagtgtctgcatctattaaaggcaattggttgcagggcaatctaaataag

SEQ ID NO: 280323 - DNA, 75 bp, Artificial Sequence
  Synthetic
aagtgtctgcatctattaaaggcaattggttgcagggcaatctaaataagtgttcttcactctttggggcggcaa

SEQ ID NO: 280324 - DNA, 75 bp, Artificial Sequence
  Synthetic
ggcaaaattgtatccagaattggaatgtttctttgaatttgcccaccactctgatgatgcattattcatatatgg

SEQ ID NO: 280325 - DNA, 75 bp, Artificial Sequence
  Synthetic
tgtttctttgaatttgcccaccactctgatgatgcattattcatatatggttatttagaacctgtggatgacggt

SEQ ID NO: 280326 - DNA, 75 bp, Artificial Sequence
  Synthetic
aacagatccaagcaggtaatttgcattggcatgcagttaaccaagaaatgtggaagagtatgtttaatctacatg

SEQ ID NO: 280327 - DNA, 75 bp, Artificial Sequence
  Synthetic
ttggcatgcagttaaccaagaaatgtggaagagtatgtttaatctacatgaacacatcctgttaatgggttctat

SEQ ID NO: 280328 - DNA, 75 bp, Artificial Sequence
  Synthetic
gtgtcacctactaatgctgaattcttatcaacattttttgaaggttgtgctgtgtctattccatttatcaaaatt

SEQ ID NO: 280329 - DNA, 75 bp, Artificial Sequence
  Synthetic
tatcaacattttttgaaggttgtgctgtgtctattccatttatcaaaattttattaggttcattatcagatttac

SEQ ID NO: 280330 - DNA, 75 bp, Artificial Sequence
  Synthetic
ggctgcagcacaaagtcggtgtgtaaaggcactagatatgggtgcatgtcctcagcttgcacagttagggatagt

SEQ ID NO: 280331 - DNA, 75 bp, Artificial Sequence
  Synthetic
aaggcactagatatgggtgcatgtcctcagcttgcacagttagggatagttttatgcacaagcaaagtggagaga

SEQ ID NO: 280332 - DNA, 75 bp, Artificial Sequence
  Synthetic
taaataatcctactgcttacctaaaagtagatagaaatttagtacctataccattaggtggtgatggttctatgt

SEQ ID NO: 280333 - DNA, 75 bp, Artificial Sequence
  Synthetic
agtagatagaaatttagtacctataccattaggtggtgatggttctatgtcaataatggaacttgctacagctgg

SEQ ID NO: 280334 - DNA, 75 bp, Artificial Sequence
  Synthetic
ttaaagaatgcctacatttcctataaacatgcaaaaaaagataatgataggtatattttaggtttatttaagttt

SEQ ID NO: 280335 - DNA, 75 bp, Artificial Sequence
  Synthetic
aacatgcaaaaaaagataatgataggtatattttaggtttatttaagtttttgatgtcattatctgatgatatct

SEQ ID NO: 280336 - DNA, 75 bp, Artificial Sequence
  Synthetic
tagctttgttgggaaagtacaatggaaagtgtttacccctaaaagcgagtttgagttttatgaccaatactcaag

SEQ ID NO: 280337 - DNA, 75 bp, Artificial Sequence
  Synthetic
aaagtgtttacccctaaaagcgagtttgagttttatgaccaatactcaaggaagtatttagaaatttggagtgaa

SEQ ID NO: 280338 - DNA, 75 bp, Artificial Sequence
  Synthetic
tccctagaggtagggataatcttttagtatatttagttcgaaagctaaatgaccctagtatcgttactgcaatga

SEQ ID NO: 280339 - DNA, 75 bp, Artificial Sequence
  Synthetic
agtatatttagttcgaaagctaaatgaccctagtatcgttactgcaatgacaatgcagtcacctcttcaattaag

SEQ ID NO: 280340 - DNA, 75 bp, Artificial Sequence
  Synthetic
atgaaagtatgcaagttggatggtgactgggtgacttttagagaagtcctggcagcagctgactcatttgcatct

SEQ ID NO: 280341 - DNA, 75 bp, Artificial Sequence
  Synthetic
actgggtgacttttagagaagtcctggcagcagctgactcatttgcatctacttataaacctagtactcaagata

SEQ ID NO: 280342 - DNA, 75 bp, Artificial Sequence
  Synthetic
ttgtacattttcaaaagagtatgcctggagagactttctaaatgaagtacaatgtgatgtcttaacaacaagaca

SEQ ID NO: 280343 - DNA, 75 bp, Artificial Sequence
  Synthetic
tggagagactttctaaatgaagtacaatgtgatgtcttaacaacaagacaaatccatagacctaaggtggcacgg

SEQ ID NO: 280344 - DNA, 75 bp, Artificial Sequence
  Synthetic
aaaccatacaaaatccaattacagcagtcataggatataaatatgctagcaaggtggatgaaattagtgatgtgc

SEQ ID NO: 280345 - DNA, 75 bp, Artificial Sequence
  Synthetic
agtcataggatataaatatgctagcaaggtggatgaaattagtgatgtgctagatagtgcaatacatcctgattc

SEQ ID NO: 280346 - DNA, 75 bp, Artificial Sequence
  Synthetic
agggagggtgtgtatagagaattaggactcgacataagtcagccaaatgttttaaagaaagttgcaccattgctt

SEQ ID NO: 280347 - DNA, 75 bp, Artificial Sequence
  Synthetic
gactcgacataagtcagccaaatgttttaaagaaagttgcaccattgctttataagtcaggaaagtcaaggattg

SEQ ID NO: 280348 - DNA, 75 bp, Artificial Sequence
  Synthetic
aactgcggaatctatttgtagttattggcttaagactatgtctcttgttaagactataaaagtaaaaccgaaaaa

SEQ ID NO: 280349 - DNA, 75 bp, Artificial Sequence
  Synthetic
tggcttaagactatgtctcttgttaagactataaaagtaaaaccgaaaaaggaggtattaaaagcagtctcattg

SEQ ID NO: 280350 - DNA, 75 bp, Artificial Sequence
  Synthetic
atttaacacatctagctgcaatgagattatgtattgaggtgtggaggtggtgtaaagcaaatgaacaagattcag

SEQ ID NO: 280351 - DNA, 75 bp, Artificial Sequence
  Synthetic
attatgtattgaggtgtggaggtggtgtaaagcaaatgaacaagattcagccacatggttaaagtacttaatgtt

SEQ ID NO: 280352 - DNA, 75 bp, Artificial Sequence
  Synthetic
attgactctttctgttcaaggggcgtcttacctgtcgatccggaaattcagtgtttaggcctattgatctatgat

SEQ ID NO: 280353 - DNA, 75 bp, Artificial Sequence
  Synthetic
tcttacctgtcgatccggaaattcagtgtttaggcctattgatctatgatttaaaaaaacaaaaaggattactac

SEQ ID NO: 280354 - DNA, 75 bp, Artificial Sequence
  Synthetic
ttcaggtaagcagtatgatgcttattgtgtgcaaacatataatgaagaaacaaagctttatgagggagatctccg

SEQ ID NO: 280355 - DNA, 75 bp, Artificial Sequence
  Synthetic
tgtgtgcaaacatataatgaagaaacaaagctttatgagggagatctccgggtaacatttaactttggtattgat

SEQ ID NO: 280356 - DNA, 75 bp, Artificial Sequence
  Synthetic
ataaaaaggaatacatcctagagacatcaataactcagagaaatgtattgaagattttaatggaagaggttacaa

SEQ ID NO: 280357 - DNA, 75 bp, Artificial Sequence
  Synthetic
atcaataactcagagaaatgtattgaagattttaatggaagaggttacaaaggaattattacgttgtggcatgag

SEQ ID NO: 280358 - DNA, 75 bp, Artificial Sequence
  Synthetic
tctcgaagtgtagtgttgtttaaaacagagagtggatttgaatggggtaagccaaatgtcccatgtattgtctat

SEQ ID NO: 280359 - DNA, 75 bp, Artificial Sequence
  Synthetic
cagagagtggatttgaatggggtaagccaaatgtcccatgtattgtctataggaattgtacacttagaacaggat

SEQ ID NO: 280360 - DNA, 75 bp, Artificial Sequence
  Synthetic
agcattctctattaccatacaggctaacggcttcagagccatggcacaattagatgaagaaaatcccagattcct

SEQ ID NO: 280361 - DNA, 75 bp, Artificial Sequence
  Synthetic
aacggcttcagagccatggcacaattagatgaagaaaatcccagattcctgttggcccatgcatatcataactta

SEQ ID NO: 280362 - DNA, 75 bp, Artificial Sequence
  Synthetic
aagctgttgggaatgtatggttcaaaatgacacaacataaactatttattaatccaattatttcagctgggttat

SEQ ID NO: 280363 - DNA, 75 bp, Artificial Sequence
  Synthetic
aatgacacaacataaactatttattaatccaattatttcagctgggttattagagaattttatgaagggattacc

SEQ ID NO: 280364 - DNA, 75 bp, Artificial Sequence
  Synthetic
tcattaattatgaataaagcaaaaatttctgttgatttatttatgttcaatgagctattggcattaattaatcca

SEQ ID NO: 280365 - DNA, 75 bp, Artificial Sequence
  Synthetic
tttctgttgatttatttatgttcaatgagctattggcattaattaatccaaaaaatgtattaaatctagatggta

SEQ ID NO: 280366 - DNA, 75 bp, Artificial Sequence
  Synthetic
aacagttagtacaatatctagtacacaatggtctgaagaagtcagtttaactatggatgatagtgatgatgatga

SEQ ID NO: 280367 - DNA, 75 bp, Artificial Sequence
  Synthetic
caatggtctgaagaagtcagtttaactatggatgatagtgatgatgatgaaaatagttcacaaatggattataca

SEQ ID NO: 280368 - DNA, 75 bp, Artificial Sequence
  Synthetic
aaacaattgatctgaaggaagacattgagcattttttacaggatgaatctgcttacactggagatctcttgatcc

SEQ ID NO: 280369 - DNA, 75 bp, Artificial Sequence
  Synthetic
tgagcattttttacaggatgaatctgcttacactggagatctcttgatccagactgaagagactgagataaaaaa

SEQ ID NO: 280370 - DNA, 75 bp, Artificial Sequence
  Synthetic
gaacctgtaaaattaatcaaaagttgggtttcaaaagggttatcaatagacaagatatataaccctgttaacatt

SEQ ID NO: 280371 - DNA, 75 bp, Artificial Sequence
  Synthetic
gggtttcaaaagggttatcaatagacaagatatataaccctgttaacattatccttatgactcgatacatgtcaa

SEQ ID NO: 280372 - DNA, 75 bp, Artificial Sequence
  Synthetic
gctatcattgatggatccatatgatcttactgaatttgaaagtattgtaaaaggctggggtgagtgtgttaaaga

SEQ ID NO: 280373 - DNA, 75 bp, Artificial Sequence
  Synthetic
cttactgaatttgaaagtattgtaaaaggctggggtgagtgtgttaaagatcgatttattgaattggaccaggaa

SEQ ID NO: 280374 - DNA, 75 bp, Artificial Sequence
  Synthetic
gagttctcccagaagatgtgctacccgattccttattttcattcagacatgctgatatcttgttaaagcgattat

SEQ ID NO: 280375 - DNA, 75 bp, Artificial Sequence
  Synthetic
tcccaagggattcagcctcttcattttattaacagattatatttactatcgctcttttctcggagcatactacta

SEQ ID NO: 280376 - DNA, 75 bp, Artificial Sequence
  Synthetic
tagtagtagactccgcaagaagaagcaaatacagagaaatatggaaaaaattattccagtttgtctgtatctgcc

SEQ ID NO: 280377 - DNA, 75 bp, Artificial Sequence
  Synthetic
caaatacagagaaatatggaaaaaattattccagtttgtctgtatctgcccttcttgtgtctgctactatggagt

SEQ ID NO: 280378 - DNA, 75 bp, Artificial Sequence
  Synthetic
ttattccagtttgtctgtatctgcccttcttgtgtctgctactatggagtagaggagataccagaaatctgaatg

SEQ ID NO: 280379 - DNA, 75 bp, Artificial Sequence
  Synthetic
aattggcttaggtcaaggtcttgttattggatcaattgagttgccaccagtcccactgatacaagtagagtctct

SEQ ID NO: 280380 - DNA, 75 bp, Artificial Sequence
  Synthetic
attggatcaattgagttgccaccagtcccactgatacaagtagagtctctaaaactagaaagttcatgcaatttt

SEQ ID NO: 280381 - DNA, 75 bp, Artificial Sequence
  Synthetic
agcaagcgtttacaaaatggacatgggaggtaaagagtgatctggcagagaatacacaggcatcgtcaacaagtt

SEQ ID NO: 280382 - DNA, 75 bp, Artificial Sequence
  Synthetic
ggaggtaaagagtgatctggcagagaatacacaggcatcgtcaacaagttttcaaacaaaaagtagtgaggtaaa

SEQ ID NO: 280383 - DNA, 75 bp, Artificial Sequence
  Synthetic
cctttggtgattgaaacagctgcaagaacaagaaaaacaatagcatgttttgatttatcatgtaatcaaacaaca

SEQ ID NO: 280384 - DNA, 75 bp, Artificial Sequence
  Synthetic
gaacaagaaaaacaatagcatgttttgatttatcatgtaatcaaacaacatgtcaacctactgtttttttaatgg

SEQ ID NO: 280385 - DNA, 75 bp, Artificial Sequence
  Synthetic
aaaaagttgtcttttgggtctaggtgatcaaaggattcaggttaattatgaaaaaacatattgtgtttcaggtca

SEQ ID NO: 280386 - DNA, 75 bp, Artificial Sequence
  Synthetic
gatcaaaggattcaggttaattatgaaaaaacatattgtgtttcaggtcaacttattgaaggtatttgtttcaat

SEQ ID NO: 280387 - DNA, 75 bp, Artificial Sequence
  Synthetic
aacctagtcacacatatgatatagtgactgtgatggtgcgctgctttctaattgtcaagaaggtgacaacaggtg

SEQ ID NO: 280388 - DNA, 75 bp, Artificial Sequence
  Synthetic
gactgtgatggtgcgctgctttctaattgtcaagaaggtgacaacaggtgatagcatgaaaattgaaaaaagctt

SEQ ID NO: 280389 - DNA, 75 bp, Artificial Sequence
  Synthetic
tgcacagataatggtttccaagggtattatgtttgtctaataggaagcagttcagaaccattatatataccaaca

SEQ ID NO: 280390 - DNA, 75 bp, Artificial Sequence
  Synthetic
attatgtttgtctaataggaagcagttcagaaccattatatataccaacattggatgattatagatcggctgagg

SEQ ID NO: 280391 - DNA, 75 bp, Artificial Sequence
  Synthetic
acatggagaagatcatgatattgagaagaatgccataagtgcaatgagaattgtgggcaaagtaacaggtaaagc

SEQ ID NO: 280392 - DNA, 75 bp, Artificial Sequence
  Synthetic
aagaatgccataagtgcaatgagaattgtgggcaaagtaacaggtaaagcaccatcaaccgaatcatctgacaca

SEQ ID NO: 280393 - DNA, 75 bp, Artificial Sequence
  Synthetic
atcccctttatacatcaactggggttttaacagcaaaggatgacccagtgtacgtatgggcacctggaatcatga

SEQ ID NO: 280394 - DNA, 75 bp, Artificial Sequence
  Synthetic
tttaacagcaaaggatgacccagtgtacgtatgggcacctggaatcatgatggaaggaaaccattctgtttgtga

SEQ ID NO: 280395 - DNA, 75 bp, Artificial Sequence
  Synthetic
actggtttcataccactgccaggagaaattgagaagacaacacaatgtacagtattctgcacattagcagggcca

SEQ ID NO: 280396 - DNA, 75 bp, Artificial Sequence
  Synthetic
aaattgagaagacaacacaatgtacagtattctgcacattagcagggccaggcgcagattgtgaggcatattctg

SEQ ID NO: 280397 - DNA, 75 bp, Artificial Sequence
  Synthetic
cccaacttgcttgattaaccgtgtccagagatttcgtggtgctgagcaacaaattaaatttatttgtcaaagggt

SEQ ID NO: 280398 - DNA, 75 bp, Artificial Sequence
  Synthetic
cagagatttcgtggtgctgagcaacaaattaaatttatttgtcaaagggttgacatggatattactgtatactgt

SEQ ID NO: 280399 - DNA, 75 bp, Artificial Sequence
  Synthetic
ctaaaactttagttattgggcaatgtatatatacatttaccagcatattttctttaattcctggagttgcccatt

SEQ ID NO: 280400 - DNA, 75 bp, Artificial Sequence
  Synthetic
tatatatacatttaccagcatattttctttaattcctggagttgcccattcacttgctgtagaactatgtgtgcc

SEQ ID NO: 280401 - DNA, 75 bp, Artificial Sequence
  Synthetic
ctactcttattaacattttgtttcgggtggatcttgataccattttttgccatgatattgctaaaagtattaatt

SEQ ID NO: 280402 - DNA, 75 bp, Artificial Sequence
  Synthetic
ggtggatcttgataccattttttgccatgatattgctaaaagtattaattgcacttgcttatttatgttcaaagt

SEQ ID NO: 280403 - DNA, 75 bp, Artificial Sequence
  Synthetic
cctgatagaaaaagttaagaaagaataccaaaaaactatgggctccatggtatgtgaagtctgtcagtatgagtg

SEQ ID NO: 280404 - DNA, 75 bp, Artificial Sequence
  Synthetic
taccaaaaaactatgggctccatggtatgtgaagtctgtcagtatgagtgtgaaactgcaaaggaacttgagtca

SEQ ID NO: 280405 - DNA, 75 bp, Artificial Sequence
  Synthetic
cttgtccatattgtctcaaccctgctgaagcaacaacatcagctctgcaagcccattttaaagtatgtaaactta

SEQ ID NO: 280406 - DNA, 75 bp, Artificial Sequence
  Synthetic
tgaagcaacaacatcagctctgcaagcccattttaaagtatgtaaacttacatcaaggtttcaggataatttaag

SEQ ID NO: 280407 - DNA, 75 bp, Artificial Sequence
  Synthetic
aaacagggttgctacaggacattgtctctattccgatacagaagcagattttttgtagggtttatttggtgtctg

SEQ ID NO: 280408 - DNA, 75 bp, Artificial Sequence
  Synthetic
ctctattccgatacagaagcagattttttgtagggtttatttggtgtctgctgttagttttggagttgattgtat

SEQ ID NO: 280409 - DNA, 75 bp, Artificial Sequence
  Synthetic
cctcaattctggatggacagacacagcacatggatctggagtaataccaatgcggactgaccttgaattagattt

SEQ ID NO: 280410 - DNA, 75 bp, Artificial Sequence
  Synthetic
gcacatggatctggagtaataccaatgcggactgaccttgaattagatttttctctcccatcttctgcaagttat

SEQ ID NO: 280411 - DNA, 75 bp, Artificial Sequence
  Synthetic
cagcaaatgaacaagaaaaaattccatttcacttgcagataagtaaacaagtgattcatgcagagattcaacatc

SEQ ID NO: 280412 - DNA, 75 bp, Artificial Sequence
  Synthetic
atttcacttgcagataagtaaacaagtgattcatgcagagattcaacatcttggtcactggatggatggcacatt

SEQ ID NO: 280413 - DNA, 75 bp, Artificial Sequence
  Synthetic
tatggatcttgtgaaaaatatgcatacccttggcaaacagcaggttgttttgtagagaaagactatgagtatgaa

SEQ ID NO: 280414 - DNA, 75 bp, Artificial Sequence
  Synthetic
acccttggcaaacagcaggttgttttgtagagaaagactatgagtatgaaagtggttggggatgtaacccagctg

SEQ ID NO: 280415 - DNA, 75 bp, Artificial Sequence
  Synthetic
tacagcatgtggtgtatacctggataagttgaaatcagtaggtaaagcattcaaaattgtctctttgagatatac

SEQ ID NO: 280416 - DNA, 75 bp, Artificial Sequence
  Synthetic
aagttgaaatcagtaggtaaagcattcaaaattgtctctttgagatatactaggaaggcatgtatccagctaggt

SEQ ID NO: 280417 - DNA, 75 bp, Artificial Sequence
  Synthetic
acagtaatgattgtttggtgactacatcagtaaaagtatgtttaatagggactgtgtcaaaatttcaaccatcag

SEQ ID NO: 280418 - DNA, 75 bp, Artificial Sequence
  Synthetic
atcagtaaaagtatgtttaatagggactgtgtcaaaatttcaaccatcagatactctattatttctaggtccact

SEQ ID NO: 280419 - DNA, 75 bp, Artificial Sequence
  Synthetic
caatggtgtactacaacatgtcaatttggtgatccaggggatataatgagtactcctgttggaatgaaatgtcca

SEQ ID NO: 280420 - DNA, 75 bp, Artificial Sequence
  Synthetic
ttggtgatccaggggatataatgagtactcctgttggaatgaaatgtccagaattaagtggttcatttagaaaga

SEQ ID NO: 280421 - DNA, 75 bp, Artificial Sequence
  Synthetic
ttgtcaatttgatgggaacacaatttctgggtataaaagaatgattgcaacaaaagattcattccaatcatttaa

SEQ ID NO: 280422 - DNA, 75 bp, Artificial Sequence
  Synthetic
tctgggtataaaagaatgattgcaacaaaagattcattccaatcatttaatgtaacagaacctcatatctctgca

SEQ ID NO: 280423 - DNA, 75 bp, Artificial Sequence
  Synthetic
atagctccctgagagaccacattaatgttattgtaggacgtgatctctcttttcaagatttgagtgagacacctt

SEQ ID NO: 280424 - DNA, 75 bp, Artificial Sequence
  Synthetic
tgttattgtaggacgtgatctctcttttcaagatttgagtgagacaccttgtcaagtagatctaacaacaacatc

SEQ ID NO: 280425 - DNA, 75 bp, Artificial Sequence
  Synthetic
gtaggttttaatctaatctgctctgtaagtctaacagagtgttcaacatttttgacttcaattaaagcatgtgac

SEQ ID NO: 280426 - DNA, 75 bp, Artificial Sequence
  Synthetic
taagtctaacagagtgttcaacatttttgacttcaattaaagcatgtgactcagcaatgtgttatggttctacaa

SEQ ID NO: 280427 - DNA, 75 bp, Artificial Sequence
  Synthetic
tacagttcatatcgttggaaagggaggacattcagggtctaaattcatgtgttgccatgatacaaagtgctcaag

SEQ ID NO: 280428 - DNA, 75 bp, Artificial Sequence
  Synthetic
ggacattcagggtctaaattcatgtgttgccatgatacaaagtgctcaagtactggtttagttgcagcagcaccc

SEQ ID NO: 280429 - DNA, 75 bp, Artificial Sequence
  Synthetic
atcaggcagacagtgataaaatctttgatgatggtgcccctgaatgtggtatatcttgctggtttacaaagtcag

SEQ ID NO: 280430 - DNA, 75 bp, Artificial Sequence
  Synthetic
tgatgatggtgcccctgaatgtggtatatcttgctggtttacaaagtcaggagaatggattcttggagttctgaa

SEQ ID NO: 280431 - DNA, 75 bp, Artificial Sequence
  Synthetic
ttagtggcattattcatattatccatctttctcttcacattatgctgtccacgtaggcctagttatgcaaaggaa

SEQ ID NO: 280432 - DNA, 75 bp, Artificial Sequence
  Synthetic
tctttctcttcacattatgctgtccacgtaggcctagttatgcaaaggaacataagccttaaatgagggcaatta

SEQ ID NO: 280433 - DNA, 75 bp, Artificial Sequence
  Synthetic
taatactagtatatgaattcctttatttctgtgctttatattttacttaatacattatttttaatcaatatatag

SEQ ID NO: 280434 - DNA, 75 bp, Artificial Sequence
  Synthetic
aaaaaaaactagctctttactaactaaattactccataccgattatgcctggacttttgttcctgcggagcatac

SEQ ID NO: 280435 - DNA, 75 bp, Artificial Sequence
  Synthetic
tagtagtagactccttgaagagctactacgaaaaaaactggaatgagtgacttaacagacattcaagaggatata

SEQ ID NO: 280436 - DNA, 75 bp, Artificial Sequence
  Synthetic
ctacgaaaaaaactggaatgagtgacttaacagacattcaagaggatataacccgccatgaacaacaacttgtgg

SEQ ID NO: 280437 - DNA, 75 bp, Artificial Sequence
  Synthetic
cttaacagacattcaagaggatataacccgccatgaacaacaacttgtggttgccaggcaaaagcttaaggatgc

SEQ ID NO: 280438 - DNA, 75 bp, Artificial Sequence
  Synthetic
gatgacgttaacaagaatacattgcaagccaggcaacaaacagtgtcagcattggaagacaaacttgcagactac

SEQ ID NO: 280439 - DNA, 75 bp, Artificial Sequence
  Synthetic
aagccaggcaacaaacagtgtcagcattggaagacaaacttgcagactacaagcgaagaatggcagatgctgtgt

SEQ ID NO: 280440 - DNA, 75 bp, Artificial Sequence
  Synthetic
tactgatccgactgggattgaacctgacgatcacctcaaggaacggtcaagtctcaggtatggaaatgtccttga

SEQ ID NO: 280441 - DNA, 75 bp, Artificial Sequence
  Synthetic
gacgatcacctcaaggaacggtcaagtctcaggtatggaaatgtccttgatgtgaatgccattgatatagaagag

SEQ ID NO: 280442 - DNA, 75 bp, Artificial Sequence
  Synthetic
atacaattggagtctatgtcattggctttacacttcccattatcctgaaagctctatatatgttatcaacacgtg

SEQ ID NO: 280443 - DNA, 75 bp, Artificial Sequence
  Synthetic
ctttacacttcccattatcctgaaagctctatatatgttatcaacacgtgggagacagactgtaaaggaaaataa

SEQ ID NO: 280444 - DNA, 75 bp, Artificial Sequence
  Synthetic
gatacttcatttgaggatattaatggtattaggaggccaaaacatctgtatgtgtccatgccaactgctcaatca

SEQ ID NO: 280445 - DNA, 75 bp, Artificial Sequence
  Synthetic
gtattaggaggccaaaacatctgtatgtgtccatgccaactgctcaatcaactatgaaggctgaagagctgaccc

SEQ ID NO: 280446 - DNA, 75 bp, Artificial Sequence
  Synthetic
tggcttgttcccaactcagattcaagtgcgaaacataatgagtcctgtgatgggggttataggcttttcattctt

SEQ ID NO: 280447 - DNA, 75 bp, Artificial Sequence
  Synthetic
gtgcgaaacataatgagtcctgtgatgggggttataggcttttcattctttgtcaaggattgggcagaacggatt

SEQ ID NO: 280448 - DNA, 75 bp, Artificial Sequence
  Synthetic
cctttattaaaccagaggtcaagccaggaacaccagcacaggaggctgaatttttaaagagaaataaagtctatt

SEQ ID NO: 280449 - DNA, 75 bp, Artificial Sequence
  Synthetic
aggaacaccagcacaggaggctgaatttttaaagagaaataaagtctattttatgcagcgacaggatgtactcga

SEQ ID NO: 280450 - DNA, 75 bp, Artificial Sequence
  Synthetic
aaactgattgattatgcagcttcaggagaccctacatcaccagacaacattgaatctcctaatgcaccatgggta

SEQ ID NO: 280451 - DNA, 75 bp, Artificial Sequence
  Synthetic
gagaccctacatcaccagacaacattgaatctcctaatgcaccatgggtatttgcctgtgcccctgatcgatgcc

SEQ ID NO: 280452 - DNA, 75 bp, Artificial Sequence
  Synthetic
gatggcagagttaggtgcatttttttccatattgcaggacatgagaaatactattatggcatctaagactgttgg

SEQ ID NO: 280453 - DNA, 75 bp, Artificial Sequence
  Synthetic
tccatattgcaggacatgagaaatactattatggcatctaagactgttggaacagcagaggaaaaattaaaaaag

SEQ ID NO: 280454 - DNA, 75 bp, Artificial Sequence
  Synthetic
tacgaagaactcaatcaatgggaatacaactggaccaaaggattatcttattgtatatgcttgaatggggtaaag

SEQ ID NO: 280455 - DNA, 75 bp, Artificial Sequence
  Synthetic
acaactggaccaaaggattatcttattgtatatgcttgaatggggtaaagaaatggtagaccactttcatctggg

SEQ ID NO: 280456 - DNA, 75 bp, Artificial Sequence
  Synthetic
ggtcttgcacaagcactcattgatcaaaaagtgaaagaaatatctaatcaagagcctttaaaaatatgaataagt

SEQ ID NO: 280457 - DNA, 75 bp, Artificial Sequence
  Synthetic
aaaaagtgaaagaaatatctaatcaagagcctttaaaaatatgaataagtattgattgcactgatagttatatat

SEQ ID NO: 280458 - DNA, 75 bp, Artificial Sequence
  Synthetic
caagaattcataatcatttgtttactaattggggattacgggtttaaataatatgattatatcagggtttactaa

SEQ ID NO: 280459 - DNA, 75 bp, Artificial Sequence
  Synthetic
taattggggattacgggtttaaataatatgattatatcagggtttactaatcatcaggttaatcagggtttaact

SEQ ID NO: 280460 - DNA, 75 bp, Artificial Sequence
  Synthetic
tagtttaattattaggaattactaatggcaattatgaatgtattagtataataaactgctgcttgttattgttac

SEQ ID NO: 280461 - DNA, 75 bp, Artificial Sequence
  Synthetic
cagccttaaatagatatagtaagcatttaaaattgtgaacttatatatcattatttatttagtgggcccaacaat

SEQ ID NO: 280462 - DNA, 75 bp, Artificial Sequence
  Synthetic
aagtagcatatatataagtacacaatttactacctcaacatgctgatttcttgattgcttttcaaggagcatact

SEQ ID NO: 280463 - DNA, 75 bp, Artificial Sequence
  Synthetic
gctggtgtcccaaatgatgtaatacaaagtatggaaaaaagaattattccagggagtccaagtggccaaattctt

SEQ ID NO: 280464 - DNA, 75 bp, Artificial Sequence
  Synthetic
aaagtatggaaaaaagaattattccagggagtccaagtggccaaattcttagatcattcttcaagatgacacctg

SEQ ID NO: 280465 - DNA, 75 bp, Artificial Sequence
  Synthetic
aatagagttcattgaggtaacagtaactgctgatgtggcaagaggtgttagggaaaaaatattgaaatatcaagg

SEQ ID NO: 280466 - DNA, 75 bp, Artificial Sequence
  Synthetic
gggaaaaaatattgaaatatcaaggaggcttagaattcattgagcaactattacaggtagaagcacagaaaggga

SEQ ID NO: 280467 - DNA, 75 bp, Artificial Sequence
  Synthetic
atttgatgtagtggctatcagaactgatggatcgaatatttcaacacaatggcctagtaggaggaatgaaggtgt

SEQ ID NO: 280468 - DNA, 75 bp, Artificial Sequence
  Synthetic
gatggatcgaatatttcaacacaatggcctagtaggaggaatgaaggtgttgtgcaggcaatgaggttaatacaa

SEQ ID NO: 280469 - DNA, 75 bp, Artificial Sequence
  Synthetic
atttgataaaaaatgacgaaagaggtgcacttgaagcaatgttcaatttaaaatttcatgtgacaggtcctaaag

SEQ ID NO: 280470 - DNA, 75 bp, Artificial Sequence
  Synthetic
tgcacttgaagcaatgttcaatttaaaatttcatgtgacaggtcctaaagtgcgaacatttgacattccaaatta

SEQ ID NO: 280471 - DNA, 75 bp, Artificial Sequence
  Synthetic
gtattagaaaatctagtggattattgcaagaattggcttggaaccgatcatgcttttgcatttaaagaagtgact

SEQ ID NO: 280472 - DNA, 75 bp, Artificial Sequence
  Synthetic
tgcttttgcatttaaagaagtgactggacaacgcgtcttcaatgtgtttaaagatgaagaagagctacatgcatc

SEQ ID NO: 280473 - DNA, 75 bp, Artificial Sequence
  Synthetic
agaaattttcttttatgccaaataagccttcaagcaccatatctaccatcaactatagcctctgatcaatatgat

SEQ ID NO: 280474 - DNA, 75 bp, Artificial Sequence
  Synthetic
gccttcaagcaccatatctaccatcaactatagcctctgatcaatatgatacaagattagcttgtagtgaaattt

SEQ ID NO: 280475 - DNA, 75 bp, Artificial Sequence
  Synthetic
acagttgttagccagggatatggcttacaaatatatcacactagataatgaagatatcatcaactattataatcc

SEQ ID NO: 280476 - DNA, 75 bp, Artificial Sequence
  Synthetic
tacaaatatatcacactagataatgaagatatcatcaactattataatccgagggtttacttcaaacccacacaa

SEQ ID NO: 280477 - DNA, 75 bp, Artificial Sequence
  Synthetic
aattaaatttatctagtatggatcccaagtcaaaggcattgatcgatgttatctcaaaagattcaaaaaaaggag

SEQ ID NO: 280478 - DNA, 75 bp, Artificial Sequence
  Synthetic
caagtcaaaggcattgatcgatgttatctcaaaagattcaaaaaaaggagtttttggcgaattaattgatagcat

SEQ ID NO: 280479 - DNA, 75 bp, Artificial Sequence
  Synthetic
aatgagtgtgcaaaaactattgaaaagatcctttctgaccttgaagttaatataggtgattctactgctggatta

SEQ ID NO: 280480 - DNA, 75 bp, Artificial Sequence
  Synthetic
tataggtgattctactgctggattagaacaaccaaaaagaactactggggtggatgacatcttgaggaagtttta

SEQ ID NO: 280481 - DNA, 75 bp, Artificial Sequence
  Synthetic
atctcagttatacggaaaacaactgcctggcatttaggacatctattgcgtgatattactgaatctctcattgca

SEQ ID NO: 280482 - DNA, 75 bp, Artificial Sequence
  Synthetic
tgatattactgaatctctcattgcacatgcagggcttaaaagatctaaatattggtctgctcatggctatgccta

SEQ ID NO: 280483 - DNA, 75 bp, Artificial Sequence
  Synthetic
ccatctaaatcacttgaggttgcaggttcatttattagattttttactgtattcaaggaaggacttggtcttatt

SEQ ID NO: 280484 - DNA, 75 bp, Artificial Sequence
  Synthetic
gttcatttattagattttttactgtattcaaggaaggacttggtcttattgatgtagataatcttgactctaaag

SEQ ID NO: 280485 - DNA, 75 bp, Artificial Sequence
  Synthetic
tttcagcaaaattattagtttggacttgaatcgattgttggcattaaatattgcatttgaaaaatcccttcttgc

SEQ ID NO: 280486 - DNA, 75 bp, Artificial Sequence
  Synthetic
ttgaatcgattgttggcattaaatattgcatttgaaaaatcccttcttgctacggccacatggttccaatactac

SEQ ID NO: 280487 - DNA, 75 bp, Artificial Sequence
  Synthetic
ttcagcatgcattacgatctgtctttgcattccattttcttctctccacatctcaaaagatgaagctatgtgcta

SEQ ID NO: 280488 - DNA, 75 bp, Artificial Sequence
  Synthetic
tgcattccattttcttctctccacatctcaaaagatgaagctatgtgctatatttgataatctgcgttaccttat

SEQ ID NO: 280489 - DNA, 75 bp, Artificial Sequence
  Synthetic
ggctttgaaccattgattagaaagttctttgaacgacctttcaaaagtgcattagaggtatatttgtataatatt

SEQ ID NO: 280490 - DNA, 75 bp, Artificial Sequence
  Synthetic
tctttgaacgacctttcaaaagtgcattagaggtatatttgtataatattataaagacactattagttagtttag

SEQ ID NO: 280491 - DNA, 75 bp, Artificial Sequence
  Synthetic
ttcaagggttagactcttagggttaactgtcgatcaatcaacaattggggcaagtggagtttatccttcattaat

SEQ ID NO: 280492 - DNA, 75 bp, Artificial Sequence
  Synthetic
actgtcgatcaatcaacaattggggcaagtggagtttatccttcattaatgtcacgggttgtatacaaacattac

SEQ ID NO: 280493 - DNA, 75 bp, Artificial Sequence
  Synthetic
cttgtttctttttatttgagaaaggactacatggtaatctcacagaagaagctaaaattcaccttgagacagttg

SEQ ID NO: 280494 - DNA, 75 bp, Artificial Sequence
  Synthetic
actacatggtaatctcacagaagaagctaaaattcaccttgagacagttgaatgggccagaaaatttagagagaa

SEQ ID NO: 280495 - DNA, 75 bp, Artificial Sequence
  Synthetic
atggaagaaggttatcatatacaagatgtcttaaacaatcaagtagttgttgaacagcaacttttttgtcaagaa

SEQ ID NO: 280496 - DNA, 75 bp, Artificial Sequence
  Synthetic
tgaacagcaacttttttgtcaagaagttgttgaattagctgcccaagaattaaatacttacttacatgcaaagtc

SEQ ID NO: 280497 - DNA, 75 bp, Artificial Sequence
  Synthetic
aataaacattgggacaaaccatattttagtcaaaccaggaatataagtcttaaggggatgtcaggagcattgcaa

SEQ ID NO: 280498 - DNA, 75 bp, Artificial Sequence
  Synthetic
taaggggatgtcaggagcattgcaagaggatggtcatttggctgcaagtgttactctcattgaggcaattcgctt

SEQ ID NO: 280499 - DNA, 75 bp, Artificial Sequence
  Synthetic
tttaaatcattcacaaaataaccctacagtattagaactctatgaacagacaaaaaagcaaagggcacaagcaag

SEQ ID NO: 280500 - DNA, 75 bp, Artificial Sequence
  Synthetic
gaagctgatagaggtttttttataactacactaccaactagagtaaggttagaaattattgaagattattatgat

SEQ ID NO: 280501 - DNA, 75 bp, Artificial Sequence
  Synthetic
ctacactaccaactagagtaaggttagaaattattgaagattattatgatgctatagctagggttgttccagaag

SEQ ID NO: 280502 - DNA, 75 bp, Artificial Sequence
  Synthetic
aaagattttgaacattcaacaggctttagaaaaggcactgagatgggcttcaggagaaagtgaaatccggtcctc

SEQ ID NO: 280503 - DNA, 75 bp, Artificial Sequence
  Synthetic
caggagaaagtgaaatccggtcctcactgggtcattctataaaattgaagaggaaattgatgtatgtgagtgcag

SEQ ID NO: 280504 - DNA, 75 bp, Artificial Sequence
  Synthetic
taattcagcaaaatttagaagatttactcaatccttatatgatggtttacgtgatgacaagctaaaaaattgtgt

SEQ ID NO: 280505 - DNA, 75 bp, Artificial Sequence
  Synthetic
agttgatgccctaaggaatatttatgaaactgacttttttatatccagaaaacttcataggtatattgataatat

SEQ ID NO: 280506 - DNA, 75 bp, Artificial Sequence
  Synthetic
gaaactgacttttttatatccagaaaacttcataggtatattgataatatgggtgaattatctgatgaagtccta

SEQ ID NO: 280507 - DNA, 75 bp, Artificial Sequence
  Synthetic
aagtgtctgcttccataaaaggtaactggctgcaaggtaatttaaataagtgttcttcattatttggggcagcag

SEQ ID NO: 280508 - DNA, 75 bp, Artificial Sequence
  Synthetic
ctggctgcaaggtaatttaaataagtgttcttcattatttggggcagcagtatcattattgtttaaacgtgtgtg

SEQ ID NO: 280509 - DNA, 75 bp, Artificial Sequence
  Synthetic
tgtttttttgagtttgctcatcactctgatgatgcattattcatttatggttatttagaaccagtagatgatgga

SEQ ID NO: 280510 - DNA, 75 bp, Artificial Sequence
  Synthetic
ctgatgatgcattattcatttatggttatttagaaccagtagatgatggaacagaatggtttcagtacgtgactc

SEQ ID NO: 280511 - DNA, 75 bp, Artificial Sequence
  Synthetic
ttggcatgctgtaaatcaagaaatgtggaaaagtatgtttaatctccatgagcatattttattaatgggttctat

SEQ ID NO: 280512 - DNA, 75 bp, Artificial Sequence
  Synthetic
agcatattttattaatgggttctataaaaatatcacctaaaaagacaacagtatctcctacaaatgcagaatttc

SEQ ID NO: 280513 - DNA, 75 bp, Artificial Sequence
  Synthetic
agtctctattcccttcataaagattctattgggttcactctctgatctacctggcttaggctactttgatgatct

SEQ ID NO: 280514 - DNA, 75 bp, Artificial Sequence
  Synthetic
tgctgcagctcaaagtagatgtgttaaagcattagatatgggtgcatgtcctcagcttgcacaactagggatagt

SEQ ID NO: 280515 - DNA, 75 bp, Artificial Sequence
  Synthetic
attatgtacaagtaaggttgaaagattatatggtactgctccaggtatggttaataatcctactgcatacttgaa

SEQ ID NO: 280516 - DNA, 75 bp, Artificial Sequence
  Synthetic
ccattaggtggtgatggctctatgtcaattatggagcttgccacagcaggtatagggatggcagataaaaatata

SEQ ID NO: 280517 - DNA, 75 bp, Artificial Sequence
  Synthetic
ttgatgtcattatcagatgatatattccagcatgatcgtttaggagaatttagttttgtaggtaaagttcagtgg

SEQ ID NO: 280518 - DNA, 75 bp, Artificial Sequence
  Synthetic
taccaagaggtagagataacctattagtatatttggtaaggaagttgaatgaccctagcatagttactgcaatga

SEQ ID NO: 280519 - DNA, 75 bp, Artificial Sequence
  Synthetic
caatgcaatcgccacttcaattgaggtttcgaatgcaggcgaagcaacatatgaaagtatgtaagttagatgggg

SEQ ID NO: 280520 - DNA, 75 bp, Artificial Sequence
  Synthetic
tgctgctgcagatgcatttgcatcagactatcgacctacctcacaggatatggagctctttcaaacacttgttaa

SEQ ID NO: 280521 - DNA, 75 bp, Artificial Sequence
  Synthetic
tggagctctttcaaacacttgttaattgtacattttctaaagaatatgcctggagggattttctaaatgaagtac

SEQ ID NO: 280522 - DNA, 75 bp, Artificial Sequence
  Synthetic
aattcatagaccaaaagttgcccgtactttcacagttaaagaaagggatcaaacaatacaaaatcctattacggc

SEQ ID NO: 280523 - DNA, 75 bp, Artificial Sequence
  Synthetic
actttcacagttaaagaaagggatcaaacaatacaaaatcctattacggctgtaataggttacaagtatgctagc

SEQ ID NO: 280524 - DNA, 75 bp, Artificial Sequence
  Synthetic
aaagtagatgaaatcagcgacgttttggacagtgctatccatccagactcgttgtccactgatttacagctcatg

SEQ ID NO: 280525 - DNA, 75 bp, Artificial Sequence
  Synthetic
gtcttgatattagtcaaccgaatgtgttaaagaaagttgcaccattgttgtataagtctggaaagtcaaggattg

SEQ ID NO: 280526 - DNA, 75 bp, Artificial Sequence
  Synthetic
gttaaagaaagttgcaccattgttgtataagtctggaaagtcaaggattgtaattgtgcaagggagtatagaggg

SEQ ID NO: 280527 - DNA, 75 bp, Artificial Sequence
  Synthetic
tggttgaagactatgtctcttgttaagaccataaaagtgaaaccaaaaaaagaggtcctaaaagctgtatctctt

SEQ ID NO: 280528 - DNA, 75 bp, Artificial Sequence
  Synthetic
tatggaaagaaagagaaagctggtgatttaacacatttagctgcaatgagattatgcattgaagtttggagatgg

SEQ ID NO: 280529 - DNA, 75 bp, Artificial Sequence
  Synthetic
attatgcattgaagtttggagatggtgcaaagccaatgaacaagattctgtagcttggttaaagtatttaatgtt

SEQ ID NO: 280530 - DNA, 75 bp, Artificial Sequence
  Synthetic
atagattcattctgttcaagaggagttttacctgtggatcctgagatccaatgtttaggtcttcttgtgtatgat

SEQ ID NO: 280531 - DNA, 75 bp, Artificial Sequence
  Synthetic
ttttacctgtggatcctgagatccaatgtttaggtcttcttgtgtatgatcttaaaggacaaaagggtttattgc

SEQ ID NO: 280532 - DNA, 75 bp, Artificial Sequence
  Synthetic
ttcagggaagcaatatgatgcctattgtgtgcaaacttataatgaagagacgaaactttatgaaggagatttaag

SEQ ID NO: 280533 - DNA, 75 bp, Artificial Sequence
  Synthetic
tgtgcaagattagaaatcttttgggacaaaagagaatatattctggaaacatccataacccaacgaaatgtatta

SEQ ID NO: 280534 - DNA, 75 bp, Artificial Sequence
  Synthetic
aagaattattacattgtggtatgaggtttaagacagagcaggtcaattcttcacgtagtgtggttttgtttaaaa

SEQ ID NO: 280535 - DNA, 75 bp, Artificial Sequence
  Synthetic
aagaattattactttgtggtatgaggtttaagacagagcaggtcaattcttcacgtagtgtggttttgtttaaaa

SEQ ID NO: 280536 - DNA, 75 bp, Artificial Sequence
  Synthetic
aagaattattaccttgtggtatgaggtttaagacagagcaggtcaattcttcacgtagtgtggttttgtttaaaa

SEQ ID NO: 280537 - DNA, 75 bp, Artificial Sequence
  Synthetic
aagaattattacgttgtggtatgaggtttaagacagagcaggtcaattcttcacgtagtgtggttttgtttaaaa

SEQ ID NO: 280538 - DNA, 75 bp, Artificial Sequence
  Synthetic
gtttaagacagagcaggtcaattcttcacgtagtgtggttttgtttaaaacggaaagtggttttgaatggggtaa

SEQ ID NO: 280539 - DNA, 75 bp, Artificial Sequence
  Synthetic
agaaattgtaccctcaggacagggttaagagtacgacagcctacaaacaaagcattctcaatcactatccaggct

SEQ ID NO: 280540 - DNA, 75 bp, Artificial Sequence
  Synthetic
aatggatttagagctatggcccagcttgatgaagaaaatcctagatttttacttgctcatgcatatcataattta

SEQ ID NO: 280541 - DNA, 75 bp, Artificial Sequence
  Synthetic
aggcagttggaaatgtgtggtttaaaatgactcaacataaactgttcgtaaatccgataatatctgctgggctat

SEQ ID NO: 280542 - DNA, 75 bp, Artificial Sequence
  Synthetic
tagaggaaacatcagaaggttttacaacagtcagtacaatttctagtacacaatggtcagaagaggtaagtttaa

SEQ ID NO: 280543 - DNA, 75 bp, Artificial Sequence
  Synthetic
tgagcattttttacaggatgaatcagcatatactggggatctcttaattcaaactgaagaaactgagataaggaa

SEQ ID NO: 280544 - DNA, 75 bp, Artificial Sequence
  Synthetic
gagcctgtaaggcttatcaaaagctgggtctctaaaggtttatccatagacaaaatatacaatcctgttaatatt

SEQ ID NO: 280545 - DNA, 75 bp, Artificial Sequence
  Synthetic
agcattacaatttccatgcaaagcagttgtctcttatggacccatatgatttaacagagtttgaaagtattgtta

SEQ ID NO: 280546 - DNA, 75 bp, Artificial Sequence
  Synthetic
tcggtttattgagcttgatcaagaggcccagcggaaggtcactgaagagagagtgctgcccgaagatgtactccc

SEQ ID NO: 280547 - DNA, 75 bp, Artificial Sequence
  Synthetic
ttagtccagtttgtctgtatctgcttctccagggtctattactatgtaatacagggactgccagaaacctaaatg

SEQ ID NO: 280548 - DNA, 75 bp, Artificial Sequence
  Synthetic
actctagttattgagacagcagcaaggatgcggaaaacaatagcatgctatgatctatcatgtaaccaaacagta

SEQ ID NO: 280549 - DNA, 75 bp, Artificial Sequence
  Synthetic
ggatgcggaaaacaatagcatgctatgatctatcatgtaaccaaacagtatgccaacctactgtgtatcttatgg

SEQ ID NO: 280550 - DNA, 75 bp, Artificial Sequence
  Synthetic
agcccagccatacctatgatatagttaccatgatggttcgttgttttctaattataaaaaaggtgacatctggtg

SEQ ID NO: 280551 - DNA, 75 bp, Artificial Sequence
  Synthetic
tgagactcttgttcaaaaaaacgattgtacagctaatagtttccaaggttattacatctgtttcataggaagtag

SEQ ID NO: 280552 - DNA, 75 bp, Artificial Sequence
  Synthetic
ctggatgactaccgttctgctgaagtcctttcaagaatggcgtttgcacctcatggggaagatcatgatgttgaa

SEQ ID NO: 280553 - DNA, 75 bp, Artificial Sequence
  Synthetic
tcctttcaagaatggcgtttgcacctcatggggaagatcatgatgttgaaaaaaatgcgataagtgccctacgta

SEQ ID NO: 280554 - DNA, 75 bp, Artificial Sequence
  Synthetic
accatccactgagtcttctgacacagtacagggtattgcattttcaggtagccctctttatacatctactggggt

SEQ ID NO: 280555 - DNA, 75 bp, Artificial Sequence
  Synthetic
gtacagggtattgcattttcaggtagccctctttatacatctactggggttttagcagcaaaggatgaccctgtg

SEQ ID NO: 280556 - DNA, 75 bp, Artificial Sequence
  Synthetic
tggaagggaaccactctatctgtgagaaaaagaccttacctctcacatggactggttttatttcattacctggag

SEQ ID NO: 280557 - DNA, 75 bp, Artificial Sequence
  Synthetic
gaaaaagaccttacctctcacatggactggttttatttcattacctggagaaattgagaagacaacacaatgcac

SEQ ID NO: 280558 - DNA, 75 bp, Artificial Sequence
  Synthetic
ggtgcagactgtgaagcttattctgaaacaggtatatttaatataagctcaccgacttgcttgatcaatcgtgtg

SEQ ID NO: 280559 - DNA, 75 bp, Artificial Sequence
  Synthetic
aaacaggtatatttaatataagctcaccgacttgcttgatcaatcgtgtgcagaggtttcgtggtgcagaacaac

SEQ ID NO: 280560 - DNA, 75 bp, Artificial Sequence
  Synthetic
tgatatggatatcactgtgtattgcaatggagttaagaaagttattctcaccaaaaccttagttataggacagtg

SEQ ID NO: 280561 - DNA, 75 bp, Artificial Sequence
  Synthetic
aatggagttaagaaagttattctcaccaaaaccttagttataggacagtgtatctacacatttactagtatattc

SEQ ID NO: 280562 - DNA, 75 bp, Artificial Sequence
  Synthetic
ctcttgctgttgaactatgtgtgccaggtcttcatggctgggcaactatgttattattgctaacattttgttttg

SEQ ID NO: 280563 - DNA, 75 bp, Artificial Sequence
  Synthetic
aggtcttcatggctgggcaactatgttattattgctaacattttgttttggctgggttctaataccaaccattac

SEQ ID NO: 280564 - DNA, 75 bp, Artificial Sequence
  Synthetic
gcatttgcatatctttgctctaaatataacacagattcaaaatttaggattttgattgaaaaagtaaaaaaagaa

SEQ ID NO: 280565 - DNA, 75 bp, Artificial Sequence
  Synthetic
ataacacagattcaaaatttaggattttgattgaaaaagtaaaaaaagaatatcagaaaacaatgggctcaatgg

SEQ ID NO: 280566 - DNA, 75 bp, Artificial Sequence
  Synthetic
tgaaactgcaaaggagctagaatcacataggaaaagctgttcaattggctcgtgtccttattgtctcaacccatc

SEQ ID NO: 280567 - DNA, 75 bp, Artificial Sequence
  Synthetic
cataggaaaagctgttcaattggctcgtgtccttattgtctcaacccatctgaggcaacaacatctgcccttcag

SEQ ID NO: 280568 - DNA, 75 bp, Artificial Sequence
  Synthetic
catcacgattccaggagaatttgagaaagtcattaactgtatatgagcctatgcagggttgttatcgtaccttat

SEQ ID NO: 280569 - DNA, 75 bp, Artificial Sequence
  Synthetic
aaagtcattaactgtatatgagcctatgcagggttgttatcgtaccttatccctcttcaggtatcggagtcggtt

SEQ ID NO: 280570 - DNA, 75 bp, Artificial Sequence
  Synthetic
ctattagtcttagaattgattgtatgggctgctagtgctgagacacaaaatttgaatgcaggctggactgataca

SEQ ID NO: 280571 - DNA, 75 bp, Artificial Sequence
  Synthetic
gggctgctagtgctgagacacaaaatttgaatgcaggctggactgatacagcacatggatctgggataattccta

SEQ ID NO: 280572 - DNA, 75 bp, Artificial Sequence
  Synthetic
ctctctcccttcatctgcaagctatacatataggagacagttacaaaatccagctaatgaacaagaaaacatacc

SEQ ID NO: 280573 - DNA, 75 bp, Artificial Sequence
  Synthetic
acatataggagacagttacaaaatccagctaatgaacaagaaaacataccattccatctgcagataagcaaacag

SEQ ID NO: 280574 - DNA, 75 bp, Artificial Sequence
  Synthetic
tagggcactggatggacgctacatttaatctaaaaactgcatttcattgctatggttcatgtgaaaaatatgctt

SEQ ID NO: 280575 - DNA, 75 bp, Artificial Sequence
  Synthetic
taatctaaaaactgcatttcattgctatggttcatgtgaaaaatatgcttatccttggcagactgctggttgttt

SEQ ID NO: 280576 - DNA, 75 bp, Artificial Sequence
  Synthetic
actggttggggctgtaatccacctgattgcccaggagtagggacagggtgtactgcctgtggggcctatcttgac

SEQ ID NO: 280577 - DNA, 75 bp, Artificial Sequence
  Synthetic
attgcccaggagtagggacagggtgtactgcctgtggggcctatcttgacaaattgaaatcagttgggaaagtct

SEQ ID NO: 280578 - DNA, 75 bp, Artificial Sequence
  Synthetic
caggaaagtgtgcattcagttaggtactgaacaaacttgtaagacagttgatagtaatgactgtttgataactac

SEQ ID NO: 280579 - DNA, 75 bp, Artificial Sequence
  Synthetic
atagtaatgactgtttgataactacttcagtcaaagtgtgcttaataggaacaatttcaaaatttcaaccctctg

SEQ ID NO: 280580 - DNA, 75 bp, Artificial Sequence
  Synthetic
cacacctacaggaatgaaatgtccagatctaaatggttcctttagaaagaaatgcgcatttgcaacaacacctgt

SEQ ID NO: 280581 - DNA, 75 bp, Artificial Sequence
  Synthetic
caaaggattcatttcaatcattcaatgtcacagaaccccacatatctgcaagtgcattagaatggattgaccctg

SEQ ID NO: 280582 - DNA, 75 bp, Artificial Sequence
  Synthetic
tgtaattgtaagtcgagatttatcttttcaagatttaagtgaaacaccatgccaaattgacctttcaacaacatc

SEQ ID NO: 280583 - DNA, 75 bp, Artificial Sequence
  Synthetic
tttcaagatttaagtgaaacaccatgccaaattgacctttcaacaacatccatagatggggcatggggttcagga

SEQ ID NO: 280584 - DNA, 75 bp, Artificial Sequence
  Synthetic
ttagcttaacagaatgttctgcatttcttacttcaattaaggcatgtgatgctgcaatgtgttatggatctacta

SEQ ID NO: 280585 - DNA, 75 bp, Artificial Sequence
  Synthetic
tcttacttcaattaaggcatgtgatgctgcaatgtgttatggatctactacagctaatctaattaggggacaaaa

SEQ ID NO: 280586 - DNA, 75 bp, Artificial Sequence
  Synthetic
gggcattctggctcaaaatttatgtgctgtcatgacactaagtgctctactactggtcttgttgcagctgcaccg

SEQ ID NO: 280587 - DNA, 75 bp, Artificial Sequence
  Synthetic
gctgtcatgacactaagtgctctactactggtcttgttgcagctgcaccgcatttagaccgtgtaacagggtata

SEQ ID NO: 280588 - DNA, 75 bp, Artificial Sequence
  Synthetic
tgatgatggtgcaccagagtgcggtatgtcttgctggtttaaaaaatctggagaatggattcttggagtcctcaa

SEQ ID NO: 280589 - DNA, 75 bp, Artificial Sequence
  Synthetic
atgtcttgctggtttaaaaaatctggagaatggattcttggagtcctcaatggaaattggatggtggtggctgta

SEQ ID NO: 280590 - DNA, 75 bp, Artificial Sequence
  Synthetic
tccttttgttcacattatgctgcccgcgtagaccaagttacagaaaagagcataaaccttagaagatagttattc

SEQ ID NO: 280591 - DNA, 75 bp, Artificial Sequence
  Synthetic
atgtgaatatcacatcaaatttactaacagatttaatacataattacccatattcttttatcttttatcatatat

SEQ ID NO: 280592 - DNA, 75 bp, Artificial Sequence
  Synthetic
agaaaaaaaactagcactttactaattaaattaccccatatcgattatgcctggacttttgttcctgcggagcat

SEQ ID NO: 280593 - DNA, 75 bp, Artificial Sequence
  Synthetic
tactgacccgactgggattgaacctgatgaccatctcaaggagagatcaagccttagatatggaaatgtccttga

SEQ ID NO: 280594 - DNA, 75 bp, Artificial Sequence
  Synthetic
ccaagtggtcagacagcagattggtatactattggagtctatgtgatagggtttacaattcccatcattttaaag

SEQ ID NO: 280595 - DNA, 75 bp, Artificial Sequence
  Synthetic
gtgaccctacatcacctgatgacatcgaatcccctaatgcaccatgggtatttgcttgtgcaccagatcggtgtc

SEQ ID NO: 280596 - DNA, 75 bp, Artificial Sequence
  Synthetic
aaatcctccttctatcagtcatacttgcgccggacacaatcaatgggaattcaacttgaccagagaataatccta

SEQ ID NO: 280597 - DNA, 75 bp, Artificial Sequence
  Synthetic
aaatggtggatcatttccatcttggtgatgatatggatcctgagttaaggggccttgcccagtcactcatcgatc

SEQ ID NO: 280598 - DNA, 75 bp, Artificial Sequence
  Synthetic
aagagaaggatggcagatgctgtgtcccggaaaaaaatggatactaaacctactgatccgactgggattgaacct

SEQ ID NO: 280599 - DNA, 75 bp, Artificial Sequence
  Synthetic
tgtgaatgcaattgatattgaggaaccgagtggccaaacagcagattggtatacaattggagtctatgtaatagg

SEQ ID NO: 280600 - DNA, 75 bp, Artificial Sequence
  Synthetic
atacaattggagtctatgtaataggatttacacttcccattattcttaaggctttatacatgctttcaacgcgtg

SEQ ID NO: 280601 - DNA, 75 bp, Artificial Sequence
  Synthetic
ggggacacgcataaggttcaaggatgatacatcatttgaagacatcaatggcataaggagaccaaagcatttata

SEQ ID NO: 280602 - DNA, 75 bp, Artificial Sequence
  Synthetic
gatacatcatttgaagacatcaatggcataaggagaccaaagcatttatatgtttctatgcccactgctcagtca

SEQ ID NO: 280603 - DNA, 75 bp, Artificial Sequence
  Synthetic
caggcagatttcgtacaatagtatgtggtctaattccgactcagattcaagttcgtaacatcatgagtccagtta

SEQ ID NO: 280604 - DNA, 75 bp, Artificial Sequence
  Synthetic
tggtctaattccgactcagattcaagttcgtaacatcatgagtccagttatgggggttattgggttttcattctt

SEQ ID NO: 280605 - DNA, 75 bp, Artificial Sequence
  Synthetic
agagagttcatggaaaaggagtgcccatttataaagccagaagttaagccaggtacatcagcacaagagattgag

SEQ ID NO: 280606 - DNA, 75 bp, Artificial Sequence
  Synthetic
catttataaagccagaagttaagccaggtacatcagcacaagagattgagatgttgaaaaggaataagatctatt

SEQ ID NO: 280607 - DNA, 75 bp, Artificial Sequence
  Synthetic
caaaaaccatgtggccgacattgacaagctaattgactatgcagcctctggagaccctacgtcacctgataacat

SEQ ID NO: 280608 - DNA, 75 bp, Artificial Sequence
  Synthetic
aagctaattgactatgcagcctctggagaccctacgtcacctgataacattgactcacccaatgcaccatgggtc

SEQ ID NO: 280609 - DNA, 75 bp, Artificial Sequence
  Synthetic
cgccaacatgtatctatgttgcaggaatggcagagcttggggcctttttttcaatattgcaggacatgagaaata

SEQ ID NO: 280610 - DNA, 75 bp, Artificial Sequence
  Synthetic
aatggcagagcttggggcctttttttcaatattgcaggacatgagaaatacaataatggcatctaaaactgtcgg

SEQ ID NO: 280611 - DNA, 75 bp, Artificial Sequence
  Synthetic
aaatcatccttttaccaatcttacctacgccggactcaatccatgggaattccacttgaccaaaggatcattctt

SEQ ID NO: 280612 - DNA, 75 bp, Artificial Sequence
  Synthetic
tacgccggactcaatccatgggaattccacttgaccaaaggatcattcttttattcatgttggaatggggccaag

SEQ ID NO: 280613 - DNA, 75 bp, Artificial Sequence
  Synthetic
tgatgatatggacccagaactcaggggtcttgcacaggcactgatagatcagaaggtaaaggaaatatcaaacca

SEQ ID NO: 280614 - DNA, 75 bp, Artificial Sequence
  Synthetic
ggtcttgcacaggcactgatagatcagaaggtaaaggaaatatcaaaccaggagccattgaaaatataatcttta

SEQ ID NO: 280615 - DNA, 75 bp, Artificial Sequence
  Synthetic
tagtggattattaacatgcagacaatattatatattcagggattatatgtgttagttgtttactaatcgattata

SEQ ID NO: 280616 - DNA, 75 bp, Artificial Sequence
  Synthetic
tattatatattcagggattatatgtgttagttgtttactaatcgattatacgggtttataattacgattatcagg

SEQ ID NO: 280617 - DNA, 75 bp, Artificial Sequence
  Synthetic
gttaaactgaaaatgtagccttgtaagtacatataaactataccaatcaatacagggattactaatggcagttat

SEQ ID NO: 280618 - DNA, 75 bp, Artificial Sequence
  Synthetic
atcattacctaattaatactacataggataaggttgtattctattatttaatgggcccgaacatgtgaaactgag

SEQ ID NO: 280619 - DNA, 75 bp, Artificial Sequence
  Synthetic
gtatttatgttgctgggatggctgagttaggtgcatttttttctatcctacaggatatgaggaacaccatcatgg

SEQ ID NO: 280620 - DNA, 75 bp, Artificial Sequence
  Synthetic
agaaaaattaaagaaaaaatcctccttctatcagtcatatttgcgccggacacaatcaatgggaattcaacttga

SEQ ID NO: 280621 - DNA, 75 bp, Artificial Sequence
  Synthetic
aagttaattgactatgcagcctctggtgaccctacatcacctgatgacattgaatcccctaatgcaccgtgggta

SEQ ID NO: 280622 - DNA, 75 bp, Artificial Sequence
  Synthetic
tagtagtagactccgcaagaagaagcaaacacagacaaatatgggaaaatcgagtccagtttgtctgtatctgtc

SEQ ID NO: 280623 - DNA, 75 bp, Artificial Sequence
  Synthetic
caaacacagacaaatatgggaaaatcgagtccagtttgtctgtatctgtctctgcagtgtctattactattgagt

SEQ ID NO: 280624 - DNA, 75 bp, Artificial Sequence
  Synthetic
cgagtccagtttgtctgtatctgtctctgcagtgtctattactattgagtagagtaagtgccataaacctaaatg

SEQ ID NO: 280625 - DNA, 75 bp, Artificial Sequence
  Synthetic
tattggtttaggtcaaggccttgttattggttcggtggaattgccacctgttccaatacaacaagtagagtcttt

SEQ ID NO: 280626 - DNA, 75 bp, Artificial Sequence
  Synthetic
attggttcggtggaattgccacctgttccaatacaacaagtagagtctttgaagttagagagctcctgcaatttt

SEQ ID NO: 280627 - DNA, 75 bp, Artificial Sequence
  Synthetic
agcaatcattcacaaggtggacatgggaaatgaaggatgacctagctgaaaatactcaagcatcatcaacaagtt

SEQ ID NO: 280628 - DNA, 75 bp, Artificial Sequence
  Synthetic
ggaaatgaaggatgacctagctgaaaatactcaagcatcatcaacaagttttcaaacaaagagtagtgaggtgaa

SEQ ID NO: 280629 - DNA, 75 bp, Artificial Sequence
  Synthetic
tccctagtggttgaaacagcaccacggacccggaagacaatagcatgttttgacatatcatgtaaccaaacagta

SEQ ID NO: 280630 - DNA, 75 bp, Artificial Sequence
  Synthetic
ggacccggaagacaatagcatgttttgacatatcatgtaaccaaacagtatgtcaacctactgtctatttaatag

SEQ ID NO: 280631 - DNA, 75 bp, Artificial Sequence
  Synthetic
aaaaagctgtcttttgggcttaggtgatcaaaggattcaagtgaattatgagaaaacatactgtgtctcaggtca

SEQ ID NO: 280632 - DNA, 75 bp, Artificial Sequence
  Synthetic
gatcaaaggattcaagtgaattatgagaaaacatactgtgtctcaggtcagttggttgaaggagtatgtttcaat

SEQ ID NO: 280633 - DNA, 75 bp, Artificial Sequence
  Synthetic
aacctagccatacttatgatatagtgactatgatggtgcgttgttttttggttgtgaagaaggtaacctcaggtg

SEQ ID NO: 280634 - DNA, 75 bp, Artificial Sequence
  Synthetic
gactatgatggtgcgttgttttttggttgtgaagaaggtaacctcaggtgatagtatgaaaattgaaaagaattt

SEQ ID NO: 280635 - DNA, 75 bp, Artificial Sequence
  Synthetic
tgtaatgcaaatggttttcagggctattatatctgtcttgttaggagtagctcagaaccattatatgttccgaca

SEQ ID NO: 280636 - DNA, 75 bp, Artificial Sequence
  Synthetic
attatatctgtcttgttaggagtagctcagaaccattatatgttccgacattagatgattatcggtctgctgagg

SEQ ID NO: 280637 - DNA, 75 bp, Artificial Sequence
  Synthetic
acatggagaggaccatgacattgaaagaaatgcagtaagtgccttacgcattgctggtaaggtaactggtaaagc

SEQ ID NO: 280638 - DNA, 75 bp, Artificial Sequence
  Synthetic
agaaatgcagtaagtgccttacgcattgctggtaaggtaactggtaaagcgccatccacagaagcatctgacaca

SEQ ID NO: 280639 - DNA, 75 bp, Artificial Sequence
  Synthetic
gccctctttacacatctacaggggtattaacagcaaaggataatccagtatatgtttggtcaccagggattatca

SEQ ID NO: 280640 - DNA, 75 bp, Artificial Sequence
  Synthetic
attaacagcaaaggataatccagtatatgtttggtcaccagggattatcatggaagggaatcattctgtgtgtga

SEQ ID NO: 280641 - DNA, 75 bp, Artificial Sequence
  Synthetic
actgggttcataccattacctggggagattgaaaagacatcgcagtgcacagtcttttgcactcttgcagggcca

SEQ ID NO: 280642 - DNA, 75 bp, Artificial Sequence
  Synthetic
agattgaaaagacatcgcagtgcacagtcttttgcactcttgcagggccaggtgctgattgtgaagcttactctg

SEQ ID NO: 280643 - DNA, 75 bp, Artificial Sequence
  Synthetic
acctacttgtttaatcaatcgtgtacagagattccgtggtgcagaacaacagataaaatttgtttgtcagagagt

SEQ ID NO: 280644 - DNA, 75 bp, Artificial Sequence
  Synthetic
cagagattccgtggtgcagaacaacagataaaatttgtttgtcagagagttgatatggacattactgtatattgt

SEQ ID NO: 280645 - DNA, 75 bp, Artificial Sequence
  Synthetic
ctaaaaccttagttattggacagtgcatttatacttttacaagtatcttctcactaatccctgggattgcacatt

SEQ ID NO: 280646 - DNA, 75 bp, Artificial Sequence
  Synthetic
catttatacttttacaagtatcttctcactaatccctgggattgcacattcacttgctgtagaattatgcgtgcc

SEQ ID NO: 280647 - DNA, 75 bp, Artificial Sequence
  Synthetic
ttacttttgctaactttttgctttggctggattcttatcccatttattgccatgatattactaaagatattaatt

SEQ ID NO: 280648 - DNA, 75 bp, Artificial Sequence
  Synthetic
gctggattcttatcccatttattgccatgatattactaaagatattaattgcatttgcatatttgtgttccaaat

SEQ ID NO: 280649 - DNA, 75 bp, Artificial Sequence
  Synthetic
cttgattgaaaaagtaaaaaaggaatatcagaagacgatgggttcaatggtttgtgaggtttgtcaatatgaatg

SEQ ID NO: 280650 - DNA, 75 bp, Artificial Sequence
  Synthetic
tatcagaagacgatgggttcaatggtttgtgaggtttgtcaatatgaatgtgaaaccgcaaaagaattagaatcc

SEQ ID NO: 280651 - DNA, 75 bp, Artificial Sequence
  Synthetic
cctgcccttattgtcttaatccatctgaggcaacaacatcagccctccaggctcattttaaagtgtgtaaattga

SEQ ID NO: 280652 - DNA, 75 bp, Artificial Sequence
  Synthetic
tgaggcaacaacatcagccctccaggctcattttaaagtgtgtaaattgacatcaaggtttcaggataatttaag

SEQ ID NO: 280653 - DNA, 75 bp, Artificial Sequence
  Synthetic
aagcaaggatgttatcgaacattatcccttttccgttatcggagtcgtttctttgtagggtttatctggtgtata

SEQ ID NO: 280654 - DNA, 75 bp, Artificial Sequence
  Synthetic
cccttttccgttatcggagtcgtttctttgtagggtttatctggtgtatactactggttttagaattgatcattt

SEQ ID NO: 280655 - DNA, 75 bp, Artificial Sequence
  Synthetic
tctaaactcaggttggacagatactgcacatggttcaggtgttattcccatgagaactgacttagaactggattt

SEQ ID NO: 280656 - DNA, 75 bp, Artificial Sequence
  Synthetic
gcacatggttcaggtgttattcccatgagaactgacttagaactggatttctcattaccatcatctgctagttat

SEQ ID NO: 280657 - DNA, 75 bp, Artificial Sequence
  Synthetic
ctgcaaatgaacatgaaaagataccctttcacctccaaataagtaaacaagtaatacatgctgaaatccaacatt

SEQ ID NO: 280658 - DNA, 75 bp, Artificial Sequence
  Synthetic
ctttcacctccaaataagtaaacaagtaatacatgctgaaatccaacatttaggtcattggatggatgctacatt

SEQ ID NO: 280659 - DNA, 75 bp, Artificial Sequence
  Synthetic
tatggctcatgtgaaaagtatgcctatccatggcaaacagccggttgtttttttgaaaaagactatgaatttgag

SEQ ID NO: 280660 - DNA, 75 bp, Artificial Sequence
  Synthetic
atccatggcaaacagccggttgtttttttgaaaaagactatgaatttgagactggttggggctgtaatccccctg

SEQ ID NO: 280661 - DNA, 75 bp, Artificial Sequence
  Synthetic
caccgcttgcggtgtatatctagataaactaaaatcagtggggaaagtttttgagatcatttcattaagatatac

SEQ ID NO: 280662 - DNA, 75 bp, Artificial Sequence
  Synthetic
aaactaaaatcagtggggaaagtttttgagatcatttcattaagatatacaaggaaagcatgtattcagcttggt

SEQ ID NO: 280663 - DNA, 75 bp, Artificial Sequence
  Synthetic
acagtaatgattgtctggttaccacgtcagtcaaggtatgcttgattggtactgtttcaaaatttcaaccctcag

SEQ ID NO: 280664 - DNA, 75 bp, Artificial Sequence
  Synthetic
gtcagtcaaggtatgcttgattggtactgtttcaaaatttcaaccctcagatacattattattttttggcccact

SEQ ID NO: 280665 - DNA, 75 bp, Artificial Sequence
  Synthetic
caatggtgcacaaccgcatgtcaatttggtgatcctggggatataatgagtactccagcagggatgaaatgcctg

SEQ ID NO: 280666 - DNA, 75 bp, Artificial Sequence
  Synthetic
ttggtgatcctggggatataatgagtactccagcagggatgaaatgcctggagcataatggttcattcataaaaa

SEQ ID NO: 280667 - DNA, 75 bp, Artificial Sequence
  Synthetic
atgtcagtttgacgggaacacaatatcaggatacaaacggatgattgctactaaagattctttccagtcctttaa

SEQ ID NO: 280668 - DNA, 75 bp, Artificial Sequence
  Synthetic
tcaggatacaaacggatgattgctactaaagattctttccagtcctttaatgttacagaacctcatatctctaca

SEQ ID NO: 280669 - DNA, 75 bp, Artificial Sequence
  Synthetic
atagttctcttagagatcatattaatgtgattgtcagccgtgatctttccttccaggatttgagtgaaacaccat

SEQ ID NO: 280670 - DNA, 75 bp, Artificial Sequence
  Synthetic
tgtgattgtcagccgtgatctttccttccaggatttgagtgaaacaccatgtcaagtggacttaaccacatcttc

SEQ ID NO: 280671 - DNA, 75 bp, Artificial Sequence
  Synthetic
gtcggctttaatttagtctgtactgttagtttaacagaatgcccaacttttttaacctccatcaaggcatgtgat

SEQ ID NO: 280672 - DNA, 75 bp, Artificial Sequence
  Synthetic
ttagtttaacagaatgcccaacttttttaacctccatcaaggcatgtgattctgcgatgtgttatgggtctacca

SEQ ID NO: 280673 - DNA, 75 bp, Artificial Sequence
  Synthetic
cacagtccatattgttgggaagggaggtcattctggctcaaaattcatgtgttgtcatgatacaaagtgttctag

SEQ ID NO: 280674 - DNA, 75 bp, Artificial Sequence
  Synthetic
ggtcattctggctcaaaattcatgtgttgtcatgatacaaagtgttctagtacaggtttggttgcagctgcacca

SEQ ID NO: 280675 - DNA, 75 bp, Artificial Sequence
  Synthetic
atcaagcagatagtgataagatttttgatgatggtgcaccagaatgtggcatgtcttgttggtttaaaaaatcag

SEQ ID NO: 280676 - DNA, 75 bp, Artificial Sequence
  Synthetic
tgatgatggtgcaccagaatgtggcatgtcttgttggtttaaaaaatcaggtgaatggattcttggtgtacttaa

SEQ ID NO: 280677 - DNA, 75 bp, Artificial Sequence
  Synthetic
ttgatagcatcacttatactatccatctacttgtttccattgtgctgcccccggagacccacctacacaaaagag

SEQ ID NO: 280678 - DNA, 75 bp, Artificial Sequence
  Synthetic
tctacttgtttccattgtgctgcccccggagacccacctacacaaaagagcataagccttaactgtcacttatta

SEQ ID NO: 280679 - DNA, 75 bp, Artificial Sequence
  Synthetic
aataaattttcacatagtttatactgctttccttactttataacctgtatagtatattatatttaatcactatat

SEQ ID NO: 280680 - DNA, 75 bp, Artificial Sequence
  Synthetic
tagtagtagactccgagatagagaaatttactacaaatggaaaaatatagagagattcatgagagagtcaaggag

SEQ ID NO: 280681 - DNA, 75 bp, Artificial Sequence
  Synthetic
atttactacaaatggaaaaatatagagagattcatgagagagtcaaggaggcagtcccaggggagacatcagcag

SEQ ID NO: 280682 - DNA, 75 bp, Artificial Sequence
  Synthetic
agagattcatgagagagtcaaggaggcagtcccaggggagacatcagcagtggagtgtttagatttattagatag

SEQ ID NO: 280683 - DNA, 75 bp, Artificial Sequence
  Synthetic
gtagaccagatgataaagcatgattggtctgacaataaagatagagaacagccaataggtcttgtcttactaatg

SEQ ID NO: 280684 - DNA, 75 bp, Artificial Sequence
  Synthetic
ggtctgacaataaagatagagaacagccaataggtcttgtcttactaatggcaggtgttccaaatgatgtaattc

SEQ ID NO: 280685 - DNA, 75 bp, Artificial Sequence
  Synthetic
aggaagtcctagtggtcagatccttcgatcattttttaaaatgacacctgacaattataaaataacagggaacct

SEQ ID NO: 280686 - DNA, 75 bp, Artificial Sequence
  Synthetic
cgatcattttttaaaatgacacctgacaattataaaataacagggaaccttattgagtttattgaggtcacagtg

SEQ ID NO: 280687 - DNA, 75 bp, Artificial Sequence
  Synthetic
gagaaaagatattgaagtatcaagggggtttagagtttattgagcaactgttacagatagaggctcagaaaggta

SEQ ID NO: 280688 - DNA, 75 bp, Artificial Sequence
  Synthetic
gggtttagagtttattgagcaactgttacagatagaggctcagaaaggtaattgtcaatctggttttaaaataaa

SEQ ID NO: 280689 - DNA, 75 bp, Artificial Sequence
  Synthetic
gatggttcaaacatatcaacacagtggcctagtagaaggaatgagggtgttgttcaagcaatgagactaatacaa

SEQ ID NO: 280690 - DNA, 75 bp, Artificial Sequence
  Synthetic
ggcctagtagaaggaatgagggtgttgttcaagcaatgagactaatacaagcagatattaattttgttagagaac

SEQ ID NO: 280691 - DNA, 75 bp, Artificial Sequence
  Synthetic
ggcacttgaggcaatgtttaatttaaagttccatgtaacaggtcctaaggttcgtacatttgatattccaaatta

SEQ ID NO: 280692 - DNA, 75 bp, Artificial Sequence
  Synthetic
aagttccatgtaacaggtcctaaggttcgtacatttgatattccaaattataggcctcaaccattatgtcaacct

SEQ ID NO: 280693 - DNA, 75 bp, Artificial Sequence
  Synthetic
gtaaaaattggcttgggacagatcatgcatttgcatttaaagaagtgactggccaacgtgttttcaatgttttta

SEQ ID NO: 280694 - DNA, 75 bp, Artificial Sequence
  Synthetic
tgcatttgcatttaaagaagtgactggccaacgtgttttcaatgtttttagggaggaggaagaaatacatgcatc

SEQ ID NO: 280695 - DNA, 75 bp, Artificial Sequence
  Synthetic
aggaattttcttttgtgccaaattagcttacaatcaccatatttaccatcaacaatcgcatcagaccagtatgat

SEQ ID NO: 280696 - DNA, 75 bp, Artificial Sequence
  Synthetic
gcttacaatcaccatatttaccatcaacaatcgcatcagaccagtatgatacacgattagcatgcagtgaagttt

SEQ ID NO: 280697 - DNA, 75 bp, Artificial Sequence
  Synthetic
acagctactagctagagatatggcttataaatatattacattagatcatgatgacattatcaattattataatcc

SEQ ID NO: 280698 - DNA, 75 bp, Artificial Sequence
  Synthetic
tataaatatattacattagatcatgatgacattatcaattattataatccaagagtttactttaagccaacacaa

SEQ ID NO: 280699 - DNA, 75 bp, Artificial Sequence
  Synthetic
aattgaatttatctaacatggatccaaaatcaaaggcactaattgatgtcatatcaaaggattcaaaaaaaggag

SEQ ID NO: 280700 - DNA, 75 bp, Artificial Sequence
  Synthetic
taatgtagcaagtcaagtacaacataatgaatgctcaaaaactattgagaaaattttgtcagatttggaagttaa

SEQ ID NO: 280701 - DNA, 75 bp, Artificial Sequence
  Synthetic
tggatgatattttaagaaaattttatgataatgaacttgttaagtacttgatttctgttatacggaagacaactg

SEQ ID NO: 280702 - DNA, 75 bp, Artificial Sequence
  Synthetic
ggatattactgagtccctaattgcacatgcagggcttaagagatctaaatattggtctgctcatggttatgcatg

SEQ ID NO: 280703 - DNA, 75 bp, Artificial Sequence
  Synthetic
catgcagggcttaagagatctaaatattggtctgctcatggttatgcatgtggtagtgtcttattatgcatatta

SEQ ID NO: 280704 - DNA, 75 bp, Artificial Sequence
  Synthetic
gatcatttattaggtttttcactgtgtttaaggagggtctaggtttaattgatacagataatcttgattccaaag

SEQ ID NO: 280705 - DNA, 75 bp, Artificial Sequence
  Synthetic
gtttaaggagggtctaggtttaattgatacagataatcttgattccaaagcagaaattgatggtgtttcatggtg

SEQ ID NO: 280706 - DNA, 75 bp, Artificial Sequence
  Synthetic
ttgaatagattattggccttaaatattgcatttgaaaaatctcttattgccacagcaacatggttccagtattat

SEQ ID NO: 280707 - DNA, 75 bp, Artificial Sequence
  Synthetic
ttgcatttgaaaaatctcttattgccacagcaacatggttccagtattataccgaagatcaaggacactttcctt

SEQ ID NO: 280708 - DNA, 75 bp, Artificial Sequence
  Synthetic
tgcattccattttcttctctctgtgtcccagaagatgaagttatgtgcaatttttgataatctccgatatttaat

SEQ ID NO: 280709 - DNA, 75 bp, Artificial Sequence
  Synthetic
tcccagaagatgaagttatgtgcaatttttgataatctccgatatttaattccagctgttacatctacctattct

SEQ ID NO: 280710 - DNA, 75 bp, Artificial Sequence
  Synthetic
tctttgagcggccttttaaaagtgcactcgaggtatacctgtatggtattataaaagtactactggtgagtctag

SEQ ID NO: 280711 - DNA, 75 bp, Artificial Sequence
  Synthetic
actcgaggtatacctgtatggtattataaaagtactactggtgagtctagctcagaataataaaataagatttta

SEQ ID NO: 280712 - DNA, 75 bp, Artificial Sequence
  Synthetic
actgttgaccaatcaacgattggagcaagtggagtgtatccctctcttatgtcgagggttgtttataagcattat

SEQ ID NO: 280713 - DNA, 75 bp, Artificial Sequence
  Synthetic
caagtggagtgtatccctctcttatgtcgagggttgtttataagcattatcgcagtctaatctcagaggcaacta

SEQ ID NO: 280714 - DNA, 75 bp, Artificial Sequence
  Synthetic
attacatggcaatctcacagaagaagctaaaattcatttagaaacagttgaatgggcaagaaatttcagagagaa

SEQ ID NO: 280715 - DNA, 75 bp, Artificial Sequence
  Synthetic
gctaaaattcatttagaaacagttgaatgggcaagaaatttcagagagaaggagagggaattaggtagctatata

SEQ ID NO: 280716 - DNA, 75 bp, Artificial Sequence
  Synthetic
atgttttaaacagccgggtagctgttgaacagcaacttttttgtcaagaagttgttgaattagctgcccaagaac

SEQ ID NO: 280717 - DNA, 75 bp, Artificial Sequence
  Synthetic
tgaacagcaacttttttgtcaagaagttgttgaattagctgcccaagaacttaatacatatctacatgctaaatc

SEQ ID NO: 280718 - DNA, 75 bp, Artificial Sequence
  Synthetic
aacaaacactgggataagccatattttagccagactagaaatataagtcttaaaggtatgtcaggtgcattacaa

SEQ ID NO: 280719 - DNA, 75 bp, Artificial Sequence
  Synthetic
ttagccagactagaaatataagtcttaaaggtatgtcaggtgcattacaagaagatggtcatttagctgcaagtg

SEQ ID NO: 280720 - DNA, 75 bp, Artificial Sequence
  Synthetic
tttgaaccattctcaaaataatcctacagtgcttgaactttatgagcaaacaaaaaaacaaagggcacaagcaag

SEQ ID NO: 280721 - DNA, 75 bp, Artificial Sequence
  Synthetic
gaggctgatagaggtttttttattaccacactgccaaccagggtaagattagaaattatagaagattattatgac

SEQ ID NO: 280722 - DNA, 75 bp, Artificial Sequence
  Synthetic
ccacactgccaaccagggtaagattagaaattatagaagattattatgacgctattgccaaagttgtcccagagg

SEQ ID NO: 280723 - DNA, 75 bp, Artificial Sequence
  Synthetic
cttgaaaaggcacttcgatgggcctcaggtgaaagtgaaatacaatcttcactgggtcattctataaaattaaaa

SEQ ID NO: 280724 - DNA, 75 bp, Artificial Sequence
  Synthetic
atgccaccaagtggtcacctggtgataactctgctaaatttaggcgattcactcagtctttatatgacgggttgc

SEQ ID NO: 280725 - DNA, 75 bp, Artificial Sequence
  Synthetic
taactctgctaaatttaggcgattcactcagtctttatatgacgggttgcgtgatgataaattaaaaaattgtgt

SEQ ID NO: 280726 - DNA, 75 bp, Artificial Sequence
  Synthetic
gagactgacttctttatttctaggaaattacatagatatattgacaatatgggtgaattgtctgatgaagtatta

SEQ ID NO: 280727 - DNA, 75 bp, Artificial Sequence
  Synthetic
aattacatagatatattgacaatatgggtgaattgtctgatgaagtattagattttttatcattctttccaaata

SEQ ID NO: 280728 - DNA, 75 bp, Artificial Sequence
  Synthetic
ttggttacaaggcaatctaaacaagtgttcttcattatttggagcagcaatctcattattgtttaaacgtgtatg

SEQ ID NO: 280729 - DNA, 75 bp, Artificial Sequence
  Synthetic
tgtttttttgaatttgctcatcattctgatgatgctttatttatttatggttatctagagcctgtagatgatggt

SEQ ID NO: 280730 - DNA, 75 bp, Artificial Sequence
  Synthetic
gtgtcacctacaaatgccgagttcttatctacattttttgaaggctgtgcagtctctattccttttataaaaatt

SEQ ID NO: 280731 - DNA, 75 bp, Artificial Sequence
  Synthetic
tatctacattttttgaaggctgtgcagtctctattccttttataaaaattcttttaggttctctatcagatttac

SEQ ID NO: 280732 - DNA, 75 bp, Artificial Sequence
  Synthetic
aaagcactagatatgggtgcatgtccacagctcgcacagttgggaatagtgctatgcacaagtaaagttgaaaga

SEQ ID NO: 280733 - DNA, 75 bp, Artificial Sequence
  Synthetic
taaataaccctactgcatatttgaaagtagatagaaacttaatacctatacctttaggtggtgatgggtctatgt

SEQ ID NO: 280734 - DNA, 75 bp, Artificial Sequence
  Synthetic
agtagatagaaacttaatacctatacctttaggtggtgatgggtctatgtcaatcatggagttggcaacagcagg

SEQ ID NO: 280735 - DNA, 75 bp, Artificial Sequence
  Synthetic
ttaaaaaatgcctttataacttataagcatgctaagaaggataatgataggtatgttttgggcttgttcaagttt

SEQ ID NO: 280736 - DNA, 75 bp, Artificial Sequence
  Synthetic
agcatgctaagaaggataatgataggtatgttttgggcttgttcaagtttttaatgtcattatctgatgatatat

SEQ ID NO: 280737 - DNA, 75 bp, Artificial Sequence
  Synthetic
tagttttgttgggaaagtccaatggaaagtattcactcctaaaagtgagtttgaattttatgatcaatattctag

SEQ ID NO: 280738 - DNA, 75 bp, Artificial Sequence
  Synthetic
aaagtattcactcctaaaagtgagtttgaattttatgatcaatattctaggaaatatctagaactttggagtgaa

SEQ ID NO: 280739 - DNA, 75 bp, Artificial Sequence
  Synthetic
taccaagaggcagagataatctattggtgtatttggtaagaaaattaaatgatcctagcatagtcactgcaatga

SEQ ID NO: 280740 - DNA, 75 bp, Artificial Sequence
  Synthetic
ggtgtatttggtaagaaaattaaatgatcctagcatagtcactgcaatgacaatgcaatcaccattacagttgag

SEQ ID NO: 280741 - DNA, 75 bp, Artificial Sequence
  Synthetic
atgaaagtatgtaaactggatggtgaatgggtgacatttagagaggttcttgcagcagcagatgcatttgcatct

SEQ ID NO: 280742 - DNA, 75 bp, Artificial Sequence
  Synthetic
aatgggtgacatttagagaggttcttgcagcagcagatgcatttgcatctgaatatcggcctacatcacaagata

SEQ ID NO: 280743 - DNA, 75 bp, Artificial Sequence
  Synthetic
ttgtacattttccaaggaatatgcatggagagatttcttaaacgaagtacagtgtgatgtattaacaacaagaca

SEQ ID NO: 280744 - DNA, 75 bp, Artificial Sequence
  Synthetic
tggagagatttcttaaacgaagtacagtgtgatgtattaacaacaagacaaatccatagaccaaaagtcgctcgt

SEQ ID NO: 280745 - DNA, 75 bp, Artificial Sequence
  Synthetic
agacaattcaaaatcctatcacagctgtaataggttacaaatatgcaagtaaagtggatgagataagtgatgtat

SEQ ID NO: 280746 - DNA, 75 bp, Artificial Sequence
  Synthetic
tgtaataggttacaaatatgcaagtaaagtggatgagataagtgatgtattggatagtgctatacatccggactc

SEQ ID NO: 280747 - DNA, 75 bp, Artificial Sequence
  Synthetic
gacttgacattagtcaaccaaatgtattaaagaaagttgcacctctattatataaatcaggaaaatcacgaatag

SEQ ID NO: 280748 - DNA, 75 bp, Artificial Sequence
  Synthetic
cacagctgagtcaatctgtagttattggctgaaaactatgtcccttgtcaagactattaaagtgaagcccaaaaa

SEQ ID NO: 280749 - DNA, 75 bp, Artificial Sequence
  Synthetic
tggctgaaaactatgtcccttgtcaagactattaaagtgaagcccaaaaaggaggtgctaaaggctgtatcactt

SEQ ID NO: 280750 - DNA, 75 bp, Artificial Sequence
  Synthetic
atctaacacatctagctgcaatgagactatgtattgaggtttggaggtggtgtaaagcaaatgaacaagattcag

SEQ ID NO: 280751 - DNA, 75 bp, Artificial Sequence
  Synthetic
actatgtattgaggtttggaggtggtgtaaagcaaatgaacaagattcagtaacatggttaaaatacttgatgtt

SEQ ID NO: 280752 - DNA, 75 bp, Artificial Sequence
  Synthetic
atagacttgttctgttcaagaggggtattgcctgttgatccagaaattcagtgcctaggtcttctggtatatgat

SEQ ID NO: 280753 - DNA, 75 bp, Artificial Sequence
  Synthetic
tattgcctgttgatccagaaattcagtgcctaggtcttctggtatatgatcttaaagggcaaaagggtttattac

SEQ ID NO: 280754 - DNA, 75 bp, Artificial Sequence
  Synthetic
ttcaggaaaacaatacgatgcatactgtgtacaaacttataatgaggaaacgaaactttatgaaggagatttaag

SEQ ID NO: 280755 - DNA, 75 bp, Artificial Sequence
  Synthetic
tgtgtacaaacttataatgaggaaacgaaactttatgaaggagatttaagggtgacttttaattttggtatagac

SEQ ID NO: 280756 - DNA, 75 bp, Artificial Sequence
  Synthetic
ataaaaaagagtatattttagaaacatctataactcaacgaaatgtcttaaaaatcttaatggaagaagtaacta

SEQ ID NO: 280757 - DNA, 75 bp, Artificial Sequence
  Synthetic
atctataactcaacgaaatgtcttaaaaatcttaatggaagaagtaactaaagagttgttgcgctgcggtatgag

SEQ ID NO: 280758 - DNA, 75 bp, Artificial Sequence
  Synthetic
tcaagaagtgttgtactgtttaagacagagagtggctttgagtggggtaagcctaatgtgccctgtatagtttat

SEQ ID NO: 280759 - DNA, 75 bp, Artificial Sequence
  Synthetic
cagagagtggctttgagtggggtaagcctaatgtgccctgtatagtttatagaaattgtactctccggacaggcc

SEQ ID NO: 280760 - DNA, 75 bp, Artificial Sequence
  Synthetic
ggctttctcaattacaattcaggctaatggttttagagctatggcacagcttgatgaagaaaacccaagatttct

SEQ ID NO: 280761 - DNA, 75 bp, Artificial Sequence
  Synthetic
aaggatgtaaggtatcaggcactacaggcagtagggaatgtgtggtttaaaatgacgcaacataagttatttata

SEQ ID NO: 280762 - DNA, 75 bp, Artificial Sequence
  Synthetic
aggcagtagggaatgtgtggtttaaaatgacgcaacataagttatttataaatccaatcatatcagctggactac

SEQ ID NO: 280763 - DNA, 75 bp, Artificial Sequence
  Synthetic
tcccttattatgaataaagcaaaaatttctgttgatttatttatgtttaatgaactgttagccttgataaatcca

SEQ ID NO: 280764 - DNA, 75 bp, Artificial Sequence
  Synthetic
ttgaggaaacatctgaaggtttcacaacagtaagtacaatttctagcacacagtggtcagaggaagtaagtctaa

SEQ ID NO: 280765 - DNA, 75 bp, Artificial Sequence
  Synthetic
aacagtaagtacaatttctagcacacagtggtcagaggaagtaagtctaacactagatgatagtgatgatgatga

SEQ ID NO: 280766 - DNA, 75 bp, Artificial Sequence
  Synthetic
attgatcttgatgatatagattttgaaacaattgatttaaaggaagatattgagcactttctacaagatgagtct

SEQ ID NO: 280767 - DNA, 75 bp, Artificial Sequence
  Synthetic
aaacaattgatttaaaggaagatattgagcactttctacaagatgagtctgcttatactggagatctattaattc

SEQ ID NO: 280768 - DNA, 75 bp, Artificial Sequence
  Synthetic
gttaagaggtatgataaaaattcttgagcctgtgaagttgataaaaagttgggtttctaaaggtctatctattga

SEQ ID NO: 280769 - DNA, 75 bp, Artificial Sequence
  Synthetic
gagcctgtgaagttgataaaaagttgggtttctaaaggtctatctattgataaaatatacaatcctgtgaatatt

SEQ ID NO: 280770 - DNA, 75 bp, Artificial Sequence
  Synthetic
aacattataattttcaggcaaagcaattatctctaatggatccatatgatttaactgagtttgagagtgttgtta

SEQ ID NO: 280771 - DNA, 75 bp, Artificial Sequence
  Synthetic
attatctctaatggatccatatgatttaactgagtttgagagtgttgttaaaggctggggagaatgtgttaagga

SEQ ID NO: 280772 - DNA, 75 bp, Artificial Sequence
  Synthetic
gctcaacgaaaagttactgaagagagagtgctgcctgaggatgtacttccggactctcttttttcatttagacat

SEQ ID NO: 280773 - DNA, 75 bp, Artificial Sequence
  Synthetic
ttcctagggattcagcctcttctttttattaacagattgtacttcttattgctcttatctcggagcatactacta

SEQ ID NO: 280774 - DNA, 75 bp, Artificial Sequence
  Synthetic
tagtagtagactccgcaagaagttgcaaacacagacaaatatgggaaaatctagtccagtttgtctgtatctgat

SEQ ID NO: 280775 - DNA, 75 bp, Artificial Sequence
  Synthetic
ggcccattcaaacttgcttaacaactaaaagttgtcttttgggtttaggggatcaacgaatccaggtgaattatg

SEQ ID NO: 280776 - DNA, 75 bp, Artificial Sequence
  Synthetic
atagtatgaagattgaaaaaaactttgagactcttgttcagaaaactggttgcacagccaacaattttcaaggat

SEQ ID NO: 280777 - DNA, 75 bp, Artificial Sequence
  Synthetic
ttcagaaccattgtatgttcctacacttgatgattatcgatcagctgaggttttatcacgaatggcttttgcacc

SEQ ID NO: 280778 - DNA, 75 bp, Artificial Sequence
  Synthetic
gctgggttttgataccaactatcacaatgatactgttaaaaatattgattgcatttgcatatctttgctctaaat

SEQ ID NO: 280779 - DNA, 75 bp, Artificial Sequence
  Synthetic
tatcagaagactatgggttcaatggtttgtgaagtatgccaatatgagtgtgagaccgctaaagagctagaatca

SEQ ID NO: 280780 - DNA, 75 bp, Artificial Sequence
  Synthetic
tagtagtatgctccttgaaaagctactacgagaaaaactggaatgagtgacttgacagatatccaagaggatata

SEQ ID NO: 280781 - DNA, 75 bp, Artificial Sequence
  Synthetic
gttcgtaacatcatgagtccagttatgggggttatcggtttttcattttttgtgaaagattggccagaaagaatt

SEQ ID NO: 280782 - DNA, 75 bp, Artificial Sequence
  Synthetic
tcaatactgcaggatatgagaaatacaataatggcgtctaagactgttggcacagctgaagagaagttaaagaaa

SEQ ID NO: 280783 - DNA, 75 bp, Artificial Sequence
  Synthetic
tgcgccggacccaatcaatggggatccaacttgatcagagaatcatcctattgttcatgttagagtggggtaaag

SEQ ID NO: 280784 - DNA, 75 bp, Artificial Sequence
  Synthetic
ttgttcatgttagagtggggtaaagagatggtggatcacttccatcttggtgatgacatggatccagagcttaga

SEQ ID NO: 280785 - DNA, 75 bp, Artificial Sequence
  Synthetic
ttagctgtttactaatcaaatatacgggtttataatcgtaagtatcagggtcattaattaataaactaatcaggg

SEQ ID NO: 280786 - DNA, 75 bp, Artificial Sequence
  Synthetic
gtacatatcaattaataacgatcaatacagggaatactagtggcagttatgaatgtattaagatattattttata

SEQ ID NO: 280787 - DNA, 75 bp, Artificial Sequence
  Synthetic
aaaaaactggaatgagtgatttgacagatattcaagaggatataacccgccatgaacaacaacttgttgttgcca

SEQ ID NO: 280788 - DNA, 75 bp, Artificial Sequence
  Synthetic
ggcggtggaaatggacccagatgacgttaacaaaaacacactgcaagcaaggcaacaaacagtgtcagcactgga

SEQ ID NO: 280789 - DNA, 75 bp, Artificial Sequence
  Synthetic
aaaagatggatactaagcctactgacccgactgggattgagcctgatgaccatcttaaagaacgatcaagcctca

SEQ ID NO: 280790 - DNA, 75 bp, Artificial Sequence
  Synthetic
tgccattgacatagaggaaccgagtggtcaaacagcggactggtatacgattggggtctatgtcatagggtttac

SEQ ID NO: 280791 - DNA, 75 bp, Artificial Sequence
  Synthetic
ggtcaaacagcggactggtatacgattggggtctatgtcatagggtttacacttcctatcatcttgaaggcctta

SEQ ID NO: 280792 - DNA, 75 bp, Artificial Sequence
  Synthetic
aaactgtaaaggagaacaaagggactcgcattcgatttaaagatgatacttcatttgaggatattaatggtatca

SEQ ID NO: 280793 - DNA, 75 bp, Artificial Sequence
  Synthetic
tcgcattcgatttaaagatgatacttcatttgaggatattaatggtatcaggaggccaaagcacttatatgtgtc

SEQ ID NO: 280794 - DNA, 75 bp, Artificial Sequence
  Synthetic
aaagctgaagaattaacccctggtaggttcagaactatagtatgtggcctatttccgactcaaatccaagttcgc

SEQ ID NO: 280795 - DNA, 75 bp, Artificial Sequence
  Synthetic
ggttcagaactatagtatgtggcctatttccgactcaaatccaagttcgcaacataatgagtcctgtaatgggag

SEQ ID NO: 280796 - DNA, 75 bp, Artificial Sequence
  Synthetic
agattgggcagaacgaatcagggagtttatggaaaaagaatgcccctttattaaaccagaaattaaaccaggaac

SEQ ID NO: 280797 - DNA, 75 bp, Artificial Sequence
  Synthetic
tttatggaaaaagaatgcccctttattaaaccagaaattaaaccaggaacaccagtacaggaggctgagttcttg

SEQ ID NO: 280798 - DNA, 75 bp, Artificial Sequence
  Synthetic
aacgccaagaggtattggataaaaatcatgttgctgacattgataagttaattgattatgcagcatcaggggatc

SEQ ID NO: 280799 - DNA, 75 bp, Artificial Sequence
  Synthetic
tcctaatgctccatgggtgtttgcatgtgcccctgatagatgtccaccaacttgcatttatgttgcaggaatggc

SEQ ID NO: 280800 - DNA, 75 bp, Artificial Sequence
  Synthetic
ctacaggatatgagaaataccatcatggcatccaaaactgtaggcacagctgaagagaagttaaaaaagaaatca

SEQ ID NO: 280801 - DNA, 75 bp, Artificial Sequence
  Synthetic
ggactcaatcaatggggatacaattggaccaaaggatcattctattgtatatgcttgaatggggcaaagaaatgg

SEQ ID NO: 280802 - DNA, 75 bp, Artificial Sequence
  Synthetic
tatggacccagaactcagaggccttgcacaggcacttattgatcagaaagtaaaggaaatatccaatcaagagcc

SEQ ID NO: 280803 - DNA, 75 bp, Artificial Sequence
  Synthetic
gcacaggcacttattgatcagaaagtaaaggaaatatccaatcaagagcccctaaaaatatgaataaccattaat

SEQ ID NO: 280804 - DNA, 75 bp, Artificial Sequence
  Synthetic
gtactaacatgcaggcatgtattattcagggatcatctagccaattgtttattaattttatatttacgggttcaa

SEQ ID NO: 280805 - DNA, 75 bp, Artificial Sequence
  Synthetic
tcagggatcatctagccaattgtttattaattttatatttacgggttcaaacattattatcagggtttactaatc

SEQ ID NO: 280806 - DNA, 75 bp, Artificial Sequence
  Synthetic
aatgagatattatacataatacaatttaatcataggaaattactaatgacagttatgaatgtattatataatcaa

SEQ ID NO: 280807 - DNA, 75 bp, Artificial Sequence
  Synthetic
ttaatcataggaaattactaatgacagttatgaatgtattatataatcaagtgctgctttatcattatcaccagc

SEQ ID NO: 280808 - DNA, 75 bp, Artificial Sequence
  Synthetic
ctatagtaagcatcaaatttatagatttatactttgttattatttaatgggcccatgaaatgtgaaactgagctg

SEQ ID NO: 280809 - DNA, 75 bp, Artificial Sequence
  Synthetic
ctacctcagtgtacttatatatatgcaagtagcatatatataggtacacaatttactacctcaacatgctgattt

SEQ ID NO: 280810 - DNA, 75 bp, Artificial Sequence
  Synthetic
ttcctagggactcagcctcttctttttattaacagattatacttcttattgctcttatctcggagtctactacta

SEQ ID NO: 280811 - DNA, 75 bp, Artificial Sequence
  Synthetic
tagtagtagactccgcaagaagaagcaaacacagatcaatatgggagaacttagtccagtttgtctgtatctgct

SEQ ID NO: 280812 - DNA, 75 bp, Artificial Sequence
  Synthetic
caaacacagatcaatatgggagaacttagtccagtttgtctgtatctgcttctccagggtctattactatgtaat

SEQ ID NO: 280813 - DNA, 75 bp, Artificial Sequence
  Synthetic
tagtagtagactccttgaaaagctactacgaaaaagacgggaatgagtgacttggcagatatacaagaggatata

SEQ ID NO: 280814 - DNA, 75 bp, Artificial Sequence
  Synthetic
ttgccagacagaaactcaaggatgcagagagagcagtggaggtggacccagatgacgttaacaagaacacactac

SEQ ID NO: 280815 - DNA, 75 bp, Artificial Sequence
  Synthetic
agagagagcagtggaggtggacccagatgacgttaacaagaacacactacaagcaaggcaacaaacagtgtcagc

SEQ ID NO: 280816 - DNA, 75 bp, Artificial Sequence
  Synthetic
gccttcgatatggaaatgtccttgatgtaaatgctattgacattgaagagccaagtggtcaaacagcagattggt

SEQ ID NO: 280817 - DNA, 75 bp, Artificial Sequence
  Synthetic
tgtaaatgctattgacattgaagagccaagtggtcaaacagcagattggtacactataggagtctatgtgatagg

SEQ ID NO: 280818 - DNA, 75 bp, Artificial Sequence
  Synthetic
gcattatatatgttgtcaacacgtggaaggcagactgtaaaggaaaacaaaggaacaaggataagatttaaggat

SEQ ID NO: 280819 - DNA, 75 bp, Artificial Sequence
  Synthetic
gaaggcagactgtaaaggaaaacaaaggaacaaggataagatttaaggatgatacatcatttgaggacattaatg

SEQ ID NO: 280820 - DNA, 75 bp, Artificial Sequence
  Synthetic
tgtctccatgccaactgctcaatccacaatgaaggcagaggaactcacacctgggcggttccgtacaatagtatg

SEQ ID NO: 280821 - DNA, 75 bp, Artificial Sequence
  Synthetic
acaatgaaggcagaggaactcacacctgggcggttccgtacaatagtatgtggtctgttccctactcaaatacaa

SEQ ID NO: 280822 - DNA, 75 bp, Artificial Sequence
  Synthetic
tgggggtaattggtttttccttttttgtcaaagactggccagaaagaatcaaagagtttatggagaaggaatgcc

SEQ ID NO: 280823 - DNA, 75 bp, Artificial Sequence
  Synthetic
tgtcaaagactggccagaaagaatcaaagagtttatggagaaggaatgccctttcataaaaccagaagtcaaacc

SEQ ID NO: 280824 - DNA, 75 bp, Artificial Sequence
  Synthetic
tttctgaaaaggaataaagtgtactttatgaaccgtcaggatgtccttgacaaaaatcatgttgctgacattgat

SEQ ID NO: 280825 - DNA, 75 bp, Artificial Sequence
  Synthetic
caaaaatcatgttgctgacattgataagctaattgactatgctgcctcaggagatcctacatcacctgatgacat

SEQ ID NO: 280826 - DNA, 75 bp, Artificial Sequence
  Synthetic
agagtctcctaatgcaccgtgggtatttgcttgtgcaccagatcgatgtcctccaacatgtatttatgttgcagg

SEQ ID NO: 280827 - DNA, 75 bp, Artificial Sequence
  Synthetic
tttgcttgtgcaccagatcgatgtcctccaacatgtatttatgttgcagggatggcagagctgggcgcatttttc

SEQ ID NO: 280828 - DNA, 75 bp, Artificial Sequence
  Synthetic
ccattatggcctctaagactgtaggaacagccgaagagaaattgaagaaaaaatcctcattttaccagtcatacc

SEQ ID NO: 280829 - DNA, 75 bp, Artificial Sequence
  Synthetic
aacagccgaagagaaattgaagaaaaaatcctcattttaccagtcatacctacgccggacacagtctatgggaat

SEQ ID NO: 280830 - DNA, 75 bp, Artificial Sequence
  Synthetic
ttatacatgttggaatggggaaaagaaatggtggaccacttccatcttggtgatgacatggatcctgaacttagg

SEQ ID NO: 280831 - DNA, 75 bp, Artificial Sequence
  Synthetic
aaatggtggaccacttccatcttggtgatgacatggatcctgaacttaggggtctagctcaggcattgattgatc

SEQ ID NO: 280832 - DNA, 75 bp, Artificial Sequence
  Synthetic
agagcccttaaagatatgatcatttaaagttatattactaattataggtgtagggaattactaacacttagatta

SEQ ID NO: 280833 - DNA, 75 bp, Artificial Sequence
  Synthetic
aaagttatattactaattataggtgtagggaattactaacacttagattattcatgtattcagggatcatattga

SEQ ID NO: 280834 - DNA, 75 bp, Artificial Sequence
  Synthetic
acgggttcaattattatcatcagggttatgaattaatgcactaatcagggtataactggagccatataatcataa

SEQ ID NO: 280835 - DNA, 75 bp, Artificial Sequence
  Synthetic
ttatgaattaatgcactaatcagggtataactggagccatataatcataagtacatatcatttgtagcattcagc

SEQ ID NO: 280836 - DNA, 75 bp, Artificial Sequence
  Synthetic
gaatgtattgagttaatgtattcttttaatcaatatcccattaacattatacctgtataaatttatctttgttat

SEQ ID NO: 280837 - DNA, 75 bp, Artificial Sequence
  Synthetic
agcatatatataagtacacaacatactacctcaacagactgatttcttgattgcttttcaaggagtctactacta

SEQ ID NO: 280838 - DNA, 75 bp, Artificial Sequence
  Synthetic
tagtagtagactccgagatagagaagtttactacaaatggagaaatacagagatatccatgagagggtcaaggaa

SEQ ID NO: 280839 - DNA, 75 bp, Artificial Sequence
  Synthetic
gtttactacaaatggagaaatacagagatatccatgagagggtcaaggaagcaatcccagggggaacatcagcag

SEQ ID NO: 280840 - DNA, 75 bp, Artificial Sequence
  Synthetic
agatatccatgagagggtcaaggaagcaatcccagggggaacatcagcagtagaatgcttagatctactagatcg

SEQ ID NO: 280841 - DNA, 75 bp, Artificial Sequence
  Synthetic
gtggatcagatgataaagcatgactggtctgacaacaaagataaggagcaacctattggtctagtattattgatg

SEQ ID NO: 280842 - DNA, 75 bp, Artificial Sequence
  Synthetic
ggtctgacaacaaagataaggagcaacctattggtctagtattattgatggcaggggtgccaaatgatgtgatac

SEQ ID NO: 280843 - DNA, 75 bp, Artificial Sequence
  Synthetic
agggagtcctagtgggcaaatacttagatcatttttcaaaatgaccccagataattataagataacaggaaatct

SEQ ID NO: 280844 - DNA, 75 bp, Artificial Sequence
  Synthetic
agatcatttttcaaaatgaccccagataattataagataacaggaaatctcattgagtttattgaggtgactgtg

SEQ ID NO: 280845 - DNA, 75 bp, Artificial Sequence
  Synthetic
gggagaagatattaaaatataaagggcggttagagtttatcgagcaacttctccaggtagaggcacagaaaggta

SEQ ID NO: 280846 - DNA, 75 bp, Artificial Sequence
  Synthetic
gcggttagagtttatcgagcaacttctccaggtagaggcacagaaaggtaattgccaacctgggtttaaaataaa

SEQ ID NO: 280847 - DNA, 75 bp, Artificial Sequence
  Synthetic
gatggatcaaatatctctacgcaatggcctagtaggagaaatgaaggcgttgtgcaagcaatgcgattaatacaa

SEQ ID NO: 280848 - DNA, 75 bp, Artificial Sequence
  Synthetic
ggcctagtaggagaaatgaaggcgttgtgcaagcaatgcgattaatacaagctgacattaattttgtaagagaac

SEQ ID NO: 280849 - DNA, 75 bp, Artificial Sequence
  Synthetic
agctcttgaggcaatgtttaatttaaaatttcatgttacaggtcctaaggtgcgaacatttgatattcctaatta

SEQ ID NO: 280850 - DNA, 75 bp, Artificial Sequence
  Synthetic
aaatttcatgttacaggtcctaaggtgcgaacatttgatattcctaattatagacctcagccgctatgtcagcca

SEQ ID NO: 280851 - DNA, 75 bp, Artificial Sequence
  Synthetic
tgcagaattggcttgagactgaacatgcatttgcttttaaagaggttacagggcaacgtgtctttaatgttttta

SEQ ID NO: 280852 - DNA, 75 bp, Artificial Sequence
  Synthetic
tgcatttgcttttaaagaggttacagggcaacgtgtctttaatgtttttaaagaagaagaagaattacatgcatc

SEQ ID NO: 280853 - DNA, 75 bp, Artificial Sequence
  Synthetic
aggaattttctattgtgccaaatcagcctacaagcaccatatttgccttcaaccattgcttcagaccaatatgat

SEQ ID NO: 280854 - DNA, 75 bp, Artificial Sequence
  Synthetic
gcctacaagcaccatatttgccttcaaccattgcttcagaccaatatgatactcggttagtatgtaatgaagtat

SEQ ID NO: 280855 - DNA, 75 bp, Artificial Sequence
  Synthetic
acagcttttagctagagatatggcttataaatatgtaacattagatcatgatgatattattaactattataatcc

SEQ ID NO: 280856 - DNA, 75 bp, Artificial Sequence
  Synthetic
tataaatatgtaacattagatcatgatgatattattaactattataatccgagagtttattttaaggcaacacag

SEQ ID NO: 280857 - DNA, 75 bp, Artificial Sequence
  Synthetic
agttaaatctatcaaatagggatgcaaagtcaaaggcactaattgatttaatttcaaaggattcaaaaaaaggtg

SEQ ID NO: 280858 - DNA, 75 bp, Artificial Sequence
  Synthetic
aaagtcaaaggcactaattgatttaatttcaaaggattcaaaaaaaggtgtgtttggtgagttgattgatagcat

SEQ ID NO: 280859 - DNA, 75 bp, Artificial Sequence
  Synthetic
aatgaatgtgccaagactgttgagaagatattatccgacttagaggtgaatttgggtgaatcgactgtgggttta

SEQ ID NO: 280860 - DNA, 75 bp, Artificial Sequence
  Synthetic
agatattatccgacttagaggtgaatttgggtgaatcgactgtgggtttagaccaaccaaaaagaacaacaggtg

SEQ ID NO: 280861 - DNA, 75 bp, Artificial Sequence
  Synthetic
tgataatgaacttataaaatatttaattgccgttattaggaaaacaactgcctggcatctgggccatttattacg

SEQ ID NO: 280862 - DNA, 75 bp, Artificial Sequence
  Synthetic
attgccgttattaggaaaacaactgcctggcatctgggccatttattacgtgatataacagaatctttaatagca

SEQ ID NO: 280863 - DNA, 75 bp, Artificial Sequence
  Synthetic
attggtcagctcatggttatgcttatggcagtgtacttttatgcattttaccgtctaaatcattagaagtctctg

SEQ ID NO: 280864 - DNA, 75 bp, Artificial Sequence
  Synthetic
tggcagtgtacttttatgcattttaccgtctaaatcattagaagtctctgggtcatttattaggttttttacagt

SEQ ID NO: 280865 - DNA, 75 bp, Artificial Sequence
  Synthetic
gattctgaaaaccttgactcaaaagttgatattgacggggtgacctggtgttttagtaaaattattagcctggac

SEQ ID NO: 280866 - DNA, 75 bp, Artificial Sequence
  Synthetic
ttgatattgacggggtgacctggtgttttagtaaaattattagcctggacttgaatagattgctagcattgaata

SEQ ID NO: 280867 - DNA, 75 bp, Artificial Sequence
  Synthetic
tacagcaacttggttccaatactatgctgaagatcaaggacactttccccttcaacatgctttaagatctgtttt

SEQ ID NO: 280868 - DNA, 75 bp, Artificial Sequence
  Synthetic
gctgaagatcaaggacactttccccttcaacatgctttaagatctgtttttgcattccattttctattatcccca

SEQ ID NO: 280869 - DNA, 75 bp, Artificial Sequence
  Synthetic
tctttgataacctgaggtatctgatacctgctgtaacatcgacatactcaggttttgaaccattaataagaaaat

SEQ ID NO: 280870 - DNA, 75 bp, Artificial Sequence
  Synthetic
acctgctgtaacatcgacatactcaggttttgaaccattaataagaaaattctttgaaagaccttttaaaagtgc

SEQ ID NO: 280871 - DNA, 75 bp, Artificial Sequence
  Synthetic
attaaaacactgcttgtgagtttagctcagaataataaaataagattttattctaaggttagactgttaggttta

SEQ ID NO: 280872 - DNA, 75 bp, Artificial Sequence
  Synthetic
ctcagaataataaaataagattttattctaaggttagactgttaggtttaacagtagaccagtcaacaattggag

SEQ ID NO: 280873 - DNA, 75 bp, Artificial Sequence
  Synthetic
gtcaagagttatatataaacattatcgcagtttaatatcagaaacaaccacctgttacattctatttgaaaaggg

SEQ ID NO: 280874 - DNA, 75 bp, Artificial Sequence
  Synthetic
cgcagtttaatatcagaaacaaccacctgttacattctatttgaaaagggcttacatggcaacctcacagaagag

SEQ ID NO: 280875 - DNA, 75 bp, Artificial Sequence
  Synthetic
aatgggcaagaaagttctgtgaaaaagaaaggaggttaggtagttacatcatggaggaaggttatcatatacaag

SEQ ID NO: 280876 - DNA, 75 bp, Artificial Sequence
  Synthetic
agaaaggaggttaggtagttacatcatggaggaaggttatcatatacaagatgttttaaacaatcaagttgttgt

SEQ ID NO: 280877 - DNA, 75 bp, Artificial Sequence
  Synthetic
gttgtagagttagctgcccaagaattgaacacttacttgcatgccaaatcccaggttatggctagtaatataatg

SEQ ID NO: 280878 - DNA, 75 bp, Artificial Sequence
  Synthetic
ttagtcaaactccaaatattagcttaaaagggatgtcaggtgcattacaagaagatggtcatcttgctgcaagtg

SEQ ID NO: 280879 - DNA, 75 bp, Artificial Sequence
  Synthetic
aaaagggatgtcaggtgcattacaagaagatggtcatcttgctgcaagtgttcccttaatagaagcattacgata

SEQ ID NO: 280880 - DNA, 75 bp, Artificial Sequence
  Synthetic
tgagattagagaagattattatgatgcaatagcaaaggtagtgccagaagaatatatttcttatggtggtgaaaa

SEQ ID NO: 280881 - DNA, 75 bp, Artificial Sequence
  Synthetic
gcaatagcaaaggtagtgccagaagaatatatttcttatggtggtgaaaagaaaatattaaatatcccgcaagct

SEQ ID NO: 280882 - DNA, 75 bp, Artificial Sequence
  Synthetic
caggtgaaagtgaaatccaatctacattaggtcattctatccccttaaaaagaaatttgatgtatgttagtgata

SEQ ID NO: 280883 - DNA, 75 bp, Artificial Sequence
  Synthetic
attaggtcattctatccccttaaaaagaaatttgatgtatgttagtgataatgccacaaaatggtcacctggtga

SEQ ID NO: 280884 - DNA, 75 bp, Artificial Sequence
  Synthetic
acacaatcattatatgatgggctgcgtgatgataaactaaaaaactgtgtagttgatgctttgaggaatatatat

SEQ ID NO: 280885 - DNA, 75 bp, Artificial Sequence
  Synthetic
gtgatgataaactaaaaaactgtgtagttgatgctttgaggaatatatatgagacagatttctttatatctagga

SEQ ID NO: 280886 - DNA, 75 bp, Artificial Sequence
  Synthetic
gggtgagctgtctgaggaggtattagacttcttatcatttttcccaaataaaatatctgcttcaattaaaggaaa

SEQ ID NO: 280887 - DNA, 75 bp, Artificial Sequence
  Synthetic
gacttcttatcatttttcccaaataaaatatctgcttcaattaaaggaaattggttacagggtaatttaaataaa

SEQ ID NO: 280888 - DNA, 75 bp, Artificial Sequence
  Synthetic
tatcattattatttaagcgtgtatggggcaaactatatccagaattggagtgtttctttgagtttgctcatcatt

SEQ ID NO: 280889 - DNA, 75 bp, Artificial Sequence
  Synthetic
gggcaaactatatccagaattggagtgtttctttgagtttgctcatcattctgatgatgctttatttatttatgg

SEQ ID NO: 280890 - DNA, 75 bp, Artificial Sequence
  Synthetic
acagagtggtttcaatatgtaacacaacagatacaagcaggcaacctgcactggcatgctgtaaatcaggaaatg

SEQ ID NO: 280891 - DNA, 75 bp, Artificial Sequence
  Synthetic
aacagatacaagcaggcaacctgcactggcatgctgtaaatcaggaaatgtggaaaagcatgttcaatctacacg

SEQ ID NO: 280892 - DNA, 75 bp, Artificial Sequence
  Synthetic
taagatttcaccaaaaaaaacaactgtatctcccacaaatgctgagtttttatccacattttttgagggttgtgc

SEQ ID NO: 280893 - DNA, 75 bp, Artificial Sequence
  Synthetic
gtatctcccacaaatgctgagtttttatccacattttttgagggttgtgcagtctccatacccttcataaaaata

SEQ ID NO: 280894 - DNA, 75 bp, Artificial Sequence
  Synthetic
ctggtctaggttattttgatgatcttgctgcagctcaaagtaggtgtgtaaaagctctagatatgggtgcatgcc

SEQ ID NO: 280895 - DNA, 75 bp, Artificial Sequence
  Synthetic
tgctgcagctcaaagtaggtgtgtaaaagctctagatatgggtgcatgcccacagcttgcacagttgggaatagt

SEQ ID NO: 280896 - DNA, 75 bp, Artificial Sequence
  Synthetic
ctatatggcacagttcctggaatggtaaataatcctactgcgtatctcaaagtagataggaatttaatacctatc

SEQ ID NO: 280897 - DNA, 75 bp, Artificial Sequence
  Synthetic
taaataatcctactgcgtatctcaaagtagataggaatttaatacctatccccttaggtggtgatggctccatgt

SEQ ID NO: 280898 - DNA, 75 bp, Artificial Sequence
  Synthetic
cattggtttggctgataaaacctatttaaaaaatgcatttattacatataaacatgcacggaaggataatgacag

SEQ ID NO: 280899 - DNA, 75 bp, Artificial Sequence
  Synthetic
ttaaaaaatgcatttattacatataaacatgcacggaaggataatgacagatacatcttaggtctgtttaaattt

SEQ ID NO: 280900 - DNA, 75 bp, Artificial Sequence
  Synthetic
ttcagcatgatcgcttaggggaattcagttttgtgggaaaggtccagtggaaagtctttacacccaagagtgagt

SEQ ID NO: 280901 - DNA, 75 bp, Artificial Sequence
  Synthetic
cagttttgtgggaaaggtccagtggaaagtctttacacccaagagtgagtttgaattttatgatcagtactcaag

SEQ ID NO: 280902 - DNA, 75 bp, Artificial Sequence
  Synthetic
caacatcctgtttatgactatattataccaagaggtagagataacttgttggtttacttagtcaggaaattaaat

SEQ ID NO: 280903 - DNA, 75 bp, Artificial Sequence
  Synthetic
taccaagaggtagagataacttgttggtttacttagtcaggaaattaaatgaccctagtatagttactgcaatga

SEQ ID NO: 280904 - DNA, 75 bp, Artificial Sequence
  Synthetic
atttaggatgcaagctaaacaacatatgaaagtgtgtaaattagaaggtgagtgggtcacgtttagggaagtact

SEQ ID NO: 280905 - DNA, 75 bp, Artificial Sequence
  Synthetic
atgaaagtgtgtaaattagaaggtgagtgggtcacgtttagggaagtactggctgcagcagatgcatttgcatct

SEQ ID NO: 280906 - DNA, 75 bp, Artificial Sequence
  Synthetic
tggaactctttcagacacttgtgaattgtacattttctaaagaatatgcatggagagattttttaaatgaggtcc

SEQ ID NO: 280907 - DNA, 75 bp, Artificial Sequence
  Synthetic
ttgtacattttctaaagaatatgcatggagagattttttaaatgaggtccattgtgatgttcttacaacgagaca

SEQ ID NO: 280908 - DNA, 75 bp, Artificial Sequence
  Synthetic
acattccctgtgaaagaaagagatcaaacaatacagaaccctatcactgctgtcataggttataagtatgcaagt

SEQ ID NO: 280909 - DNA, 75 bp, Artificial Sequence
  Synthetic
aaacaatacagaaccctatcactgctgtcataggttataagtatgcaagtaaagtggatgaaattagtgatgttt

SEQ ID NO: 280910 - DNA, 75 bp, Artificial Sequence
  Synthetic
tttatcaactgacttacagcttatgagagagggcgtctatagagaactaggattggatattagtcagccaaatgt

SEQ ID NO: 280911 - DNA, 75 bp, Artificial Sequence
  Synthetic
agagagggcgtctatagagaactaggattggatattagtcagccaaatgtattaaagaaagtagcaccactttta

SEQ ID NO: 280912 - DNA, 75 bp, Artificial Sequence
  Synthetic
tcattgttcaaggtaatgtagaaggtactgctgagtctatctgtagctattggcttaaaactatgtcacttgtga

SEQ ID NO: 280913 - DNA, 75 bp, Artificial Sequence
  Synthetic
tactgctgagtctatctgtagctattggcttaaaactatgtcacttgtgaagaccataaaagttaaacccaaaaa

SEQ ID NO: 280914 - DNA, 75 bp, Artificial Sequence
  Synthetic
tatggtaaaaaagaaaaggctggagatttaacacatttagccgcaatgaggttatgcatagaagtttggagatgg

SEQ ID NO: 280915 - DNA, 75 bp, Artificial Sequence
  Synthetic
atttaacacatttagccgcaatgaggttatgcatagaagtttggagatggtgtaaagcaaatgaacaagattcta

SEQ ID NO: 280916 - DNA, 75 bp, Artificial Sequence
  Synthetic
tgaaaataaaaccttggaacaatggatagattctttctgttctaggggggtattacctgttgatccagaaattca

SEQ ID NO: 280917 - DNA, 75 bp, Artificial Sequence
  Synthetic
atagattctttctgttctaggggggtattacctgttgatccagaaattcagtgtttagggctattagtgtatgat

SEQ ID NO: 280918 - DNA, 75 bp, Artificial Sequence
  Synthetic
agatacaagctaatagaagagcttattcaggcaaacagtatgatgcttattgtgttcaaacttataatgaagaaa

SEQ ID NO: 280919 - DNA, 75 bp, Artificial Sequence
  Synthetic
ttcaggcaaacagtatgatgcttattgtgttcaaacttataatgaagaaacaaaactctatgagggagatttaag

SEQ ID NO: 280920 - DNA, 75 bp, Artificial Sequence
  Synthetic
tgtgcacgtttagaaatcttctgggagaaaagagagtatatactagaaacatctgtgactcaacgaaatgtactt

SEQ ID NO: 280921 - DNA, 75 bp, Artificial Sequence
  Synthetic
agaaaagagagtatatactagaaacatctgtgactcaacgaaatgtacttaaaattcttatggaggaagtgacca

SEQ ID NO: 280922 - DNA, 75 bp, Artificial Sequence
  Synthetic
attcaaaacagagcaggttaattcttcaagaagtgttgttttgtttaagactgaaagtgggtttgaatggggcaa

SEQ ID NO: 280923 - DNA, 75 bp, Artificial Sequence
  Synthetic
tcaagaagtgttgttttgtttaagactgaaagtgggtttgaatggggcaaacctaatataccctgtattgtgtat

SEQ ID NO: 280924 - DNA, 75 bp, Artificial Sequence
  Synthetic
ttagagttagaaaacctacaaataaggcattctcaatcacaattcaagcaaatggatttagagcgatggcacagc

SEQ ID NO: 280925 - DNA, 75 bp, Artificial Sequence
  Synthetic
ggcattctcaatcacaattcaagcaaatggatttagagcgatggcacagcttgatgaagaaaatccaaggtttct

SEQ ID NO: 280926 - DNA, 75 bp, Artificial Sequence
  Synthetic
aaggatgtaaggtatcaagctttacaggccgtcgggaacatatggttcaaaatgactcaacataagttattcata

SEQ ID NO: 280927 - DNA, 75 bp, Artificial Sequence
  Synthetic
aggccgtcgggaacatatggttcaaaatgactcaacataagttattcataaatcctatcatctctggtggtcttt

SEQ ID NO: 280928 - DNA, 75 bp, Artificial Sequence
  Synthetic
tgcagccatcccgcctgcagcatattcattgattatgaataaagctaagatttctgtagatctatttatgttcaa

SEQ ID NO: 280929 - DNA, 75 bp, Artificial Sequence
  Synthetic
tcattgattatgaataaagctaagatttctgtagatctatttatgttcaatgaattgttagccctgataaaccca

SEQ ID NO: 280930 - DNA, 75 bp, Artificial Sequence
  Synthetic
ttgaggaaacatccgaaggtttcacgactgttagtacaatttctagcacccagtggtcagaagaggtaagtttaa

SEQ ID NO: 280931 - DNA, 75 bp, Artificial Sequence
  Synthetic
gactgttagtacaatttctagcacccagtggtcagaagaggtaagtttaacactggatgatagtgacgaagatga

SEQ ID NO: 280932 - DNA, 75 bp, Artificial Sequence
  Synthetic
attgatcttgacgatatcgattttgagacaatcgacctgaaagaagatattgagcattttttgcaagatgagtct

SEQ ID NO: 280933 - DNA, 75 bp, Artificial Sequence
  Synthetic
agacaatcgacctgaaagaagatattgagcattttttgcaagatgagtctgcttacacaggagatctattaattc

SEQ ID NO: 280934 - DNA, 75 bp, Artificial Sequence
  Synthetic
gctaaggggcatggtaaagattttagagcctgttaggttgataaaaagctgggtatccaagggcctttcaataga

SEQ ID NO: 280935 - DNA, 75 bp, Artificial Sequence
  Synthetic
gagcctgttaggttgataaaaagctgggtatccaagggcctttcaatagacaagatctacaatcctgtgaacatt

SEQ ID NO: 280936 - DNA, 75 bp, Artificial Sequence
  Synthetic
aacacttcaattttcatgcaaaacagttatcacttatggacccatatgatttaactgaatttgagagtattgtta

SEQ ID NO: 280937 - DNA, 75 bp, Artificial Sequence
  Synthetic
gttatcacttatggacccatatgatttaactgaatttgagagtattgttaaaggttggggtgaacttgaacagga

SEQ ID NO: 280938 - DNA, 75 bp, Artificial Sequence
  Synthetic
atggtactgcctgaagatgtattgcctgattctctattttcatttaggcatgctgatatcttattaaagagattg

SEQ ID NO: 280939 - DNA, 75 bp, Artificial Sequence
  Synthetic
tttcctagggactcagcctcttcattttattgacagattgtaccttcttttgctcttttctcggaggatactact

SEQ ID NO: 280940 - DNA, 75 bp, Artificial Sequence
  Synthetic
tagtagtagactccgcaagaagaagcaactacagagaaatatgggaaaacttagtccagtttgtctgtatctgtt

SEQ ID NO: 280941 - DNA, 75 bp, Artificial Sequence
  Synthetic
ttagtccagtttgtctgtatctgtttctgcagtgtctattactatggagtagaggaagtgccagaaacctaaatg

SEQ ID NO: 280942 - DNA, 75 bp, Artificial Sequence
  Synthetic
tctgcagtgtctattactatggagtagaggaagtgccagaaacctaaatgaacttaaaatggaatgtccacacac

SEQ ID NO: 280943 - DNA, 75 bp, Artificial Sequence
  Synthetic
attggttcagtggagttaccacctgttccagtacaacaagtagagtctttgaagttggagagttcctgtaatttt

SEQ ID NO: 280944 - DNA, 75 bp, Artificial Sequence
  Synthetic
gatttacacactagcacagcaacccagcaatcatttacaaaatggacatgggaaatgaaggatgatttagctgaa

SEQ ID NO: 280945 - DNA, 75 bp, Artificial Sequence
  Synthetic
ttcaaacaaaaagtagtgaagtgaatttaagagggttgtgtttaattccccccttagtggttgaaacagcatcac

SEQ ID NO: 280946 - DNA, 75 bp, Artificial Sequence
  Synthetic
tttaagagggttgtgtttaattccccccttagtggttgaaacagcatcacggacccggaagacgattgcttgttt

SEQ ID NO: 280947 - DNA, 75 bp, Artificial Sequence
  Synthetic
tgtcagccgactgtttacttagtaggacctatacagacatgtattacaacaaaaagctgtcttttaggtttgggt

SEQ ID NO: 280948 - DNA, 75 bp, Artificial Sequence
  Synthetic
gacctatacagacatgtattacaacaaaaagctgtcttttaggtttgggtgatcaaaggattcaagtcaattatg

SEQ ID NO: 280949 - DNA, 75 bp, Artificial Sequence
  Synthetic
gctggttgaaggggtatgttttaatcctgtacacacaatggttctttcccaacctagccatacttatgatatagt

SEQ ID NO: 280950 - DNA, 75 bp, Artificial Sequence
  Synthetic
cctgtacacacaatggttctttcccaacctagccatacttatgatatagtgaccatgatggtacggtgttttctg

SEQ ID NO: 280951 - DNA, 75 bp, Artificial Sequence
  Synthetic
atagcatgaaaattgaaaagaaccttgagactttggtccagaaaactgattgcaatgcaaatggctttcagggct

SEQ ID NO: 280952 - DNA, 75 bp, Artificial Sequence
  Synthetic
tgagactttggtccagaaaactgattgcaatgcaaatggctttcagggctattatatttgtcttgtgggaagcag

SEQ ID NO: 280953 - DNA, 75 bp, Artificial Sequence
  Synthetic
ttagatgattatcggtctgctgaagttttatcaagaatggcttttgcaccacatggagaagatcatgatattgag

SEQ ID NO: 280954 - DNA, 75 bp, Artificial Sequence
  Synthetic
ttttatcaagaatggcttttgcaccacatggagaagatcatgatattgagcgaaatgctgtgagtgctttaagaa

SEQ ID NO: 280955 - DNA, 75 bp, Artificial Sequence
  Synthetic
accgtcaactgaagcatctgacacgatacagggtatagccttttcaggcagccccctttatacatctacaggggt

SEQ ID NO: 280956 - DNA, 75 bp, Artificial Sequence
  Synthetic
atacagggtatagccttttcaggcagccccctttatacatctacaggggtattaacagcaaaggataacccggtt

SEQ ID NO: 280957 - DNA, 75 bp, Artificial Sequence
  Synthetic
tggaagggaatcattctgtatgtgaaaaaaagacattaccccttacctggactggattcataccattacctgggg

SEQ ID NO: 280958 - DNA, 75 bp, Artificial Sequence
  Synthetic
aaaaaagacattaccccttacctggactggattcataccattacctggggagattgggaaaacatcgcagtgcac

SEQ ID NO: 280959 - DNA, 75 bp, Artificial Sequence
  Synthetic
ggtgctgattgtgaagcttactctgaaactggaatttttaatataagctcacccacttgtttgatcaatcgtgca

SEQ ID NO: 280960 - DNA, 75 bp, Artificial Sequence
  Synthetic
aaactggaatttttaatataagctcacccacttgtttgatcaatcgtgcacagagatttcgtggtgcagagcaac

SEQ ID NO: 280961 - DNA, 75 bp, Artificial Sequence
  Synthetic
tgacatggacatcactgtatattgtaatggaatgaagaaagtgattctcaccaaaactctagttataggacaatg

SEQ ID NO: 280962 - DNA, 75 bp, Artificial Sequence
  Synthetic
aatggaatgaagaaagtgattctcaccaaaactctagttataggacaatgcatatatactttcactagtattttc

SEQ ID NO: 280963 - DNA, 75 bp, Artificial Sequence
  Synthetic
cacttgccgtagaattatgtgttccaggccttcatggctgggctacagtattacttttactaactttttgttttg

SEQ ID NO: 280964 - DNA, 75 bp, Artificial Sequence
  Synthetic
aggccttcatggctgggctacagtattacttttactaactttttgttttggctggatccttattccatttattgc

SEQ ID NO: 280965 - DNA, 75 bp, Artificial Sequence
  Synthetic
gcatttgcatatttgtgttcaaaatacaacacagactccaagtttaaaattctgattgagaaagtaaagaaggaa

SEQ ID NO: 280966 - DNA, 75 bp, Artificial Sequence
  Synthetic
acaacacagactccaagtttaaaattctgattgagaaagtaaagaaggaatatcaaaagacaatgggctcaatgg

SEQ ID NO: 280967 - DNA, 75 bp, Artificial Sequence
  Synthetic
tgaaacagcaaaagaattagaatctcatcggaaaagctgtccaattggctcctgcccatattgtcttaatccatc

SEQ ID NO: 280968 - DNA, 75 bp, Artificial Sequence
  Synthetic
catcggaaaagctgtccaattggctcctgcccatattgtcttaatccatctgaggcaacaacatcagcccttcag

SEQ ID NO: 280969 - DNA, 75 bp, Artificial Sequence
  Synthetic
catcaagggttcaggataatttaaggaagtcattggcagcttacgagcccaagcaaggatgttatcgaacattat

SEQ ID NO: 280970 - DNA, 75 bp, Artificial Sequence
  Synthetic
gaagtcattggcagcttacgagcccaagcaaggatgttatcgaacattatccctttttcgttaccggagccgttt

SEQ ID NO: 280971 - DNA, 75 bp, Artificial Sequence
  Synthetic
ttactggttttagaattgatcatttgggctgccagtgcagaaacacaaaatctaaactcaggatggacagatact

SEQ ID NO: 280972 - DNA, 75 bp, Artificial Sequence
  Synthetic
gggctgccagtgcagaaacacaaaatctaaactcaggatggacagatactgcacatggttcaggtattattccca

SEQ ID NO: 280973 - DNA, 75 bp, Artificial Sequence
  Synthetic
ctcactaccatcatctgcaagttacacatacagaagacagttacagaatcctgcaaatgaacatgaaaaaatacc

SEQ ID NO: 280974 - DNA, 75 bp, Artificial Sequence
  Synthetic
acatacagaagacagttacagaatcctgcaaatgaacatgaaaaaataccatttcatttacaaataagcaaacaa

SEQ ID NO: 280975 - DNA, 75 bp, Artificial Sequence
  Synthetic
taggtcattggatggatgctacttttaacttaaagacagcatttcattgttatggctcatgtgaaaagtatgcct

SEQ ID NO: 280976 - DNA, 75 bp, Artificial Sequence
  Synthetic
taacttaaagacagcatttcattgttatggctcatgtgaaaagtatgcctatccttggcaaacagctggttgttt

SEQ ID NO: 280977 - DNA, 75 bp, Artificial Sequence
  Synthetic
agtagttggggatgtaatcccccagattgcccaggtgttggaacaggttgtactgcatgtggtgtatatcttgac

SEQ ID NO: 280978 - DNA, 75 bp, Artificial Sequence
  Synthetic
attgcccaggtgttggaacaggttgtactgcatgtggtgtatatcttgacaaacttaaatcagtagggaaggttt

SEQ ID NO: 280979 - DNA, 75 bp, Artificial Sequence
  Synthetic
aaggaaagcatgtattcagcttggcactgaacagacttgtaaaagtgttgacagcaatgattgtctggtcactac

SEQ ID NO: 280980 - DNA, 75 bp, Artificial Sequence
  Synthetic
actgaacagacttgtaaaagtgttgacagcaatgattgtctggtcactacttcagttaaggtatgcctgattgga

SEQ ID NO: 280981 - DNA, 75 bp, Artificial Sequence
  Synthetic
atacattattattcttaggcccacttgagcaaggtggattaatattcaaacaatggtgtacaacaacatgtcaat

SEQ ID NO: 280982 - DNA, 75 bp, Artificial Sequence
  Synthetic
tgagcaaggtggattaatattcaaacaatggtgtacaacaacatgtcaatttggtgatcctggggatataatgag

SEQ ID NO: 280983 - DNA, 75 bp, Artificial Sequence
  Synthetic
gagcttaatgggtcatttagaaaaaaatgtgcatttgcaacaacaccagtatgccaatttgatggaaatacaata

SEQ ID NO: 280984 - DNA, 75 bp, Artificial Sequence
  Synthetic
aatgtgcatttgcaacaacaccagtatgccaatttgatggaaatacaatatctggatacaagcggatgattgcaa

SEQ ID NO: 280985 - DNA, 75 bp, Artificial Sequence
  Synthetic
tgttacagaccctcatatttctacaagtgcacttgaatggatcgatccagatagttctcttagagatcatattaa

SEQ ID NO: 280986 - DNA, 75 bp, Artificial Sequence
  Synthetic
agtgcacttgaatggatcgatccagatagttctcttagagatcatattaatgttgttgtgagtcgtgatctttct

SEQ ID NO: 280987 - DNA, 75 bp, Artificial Sequence
  Synthetic
gtcaagtagatttgaccacatcttctatagatggagcatggggttcaggtgtcggctttaatttagtctgtacag

SEQ ID NO: 280988 - DNA, 75 bp, Artificial Sequence
  Synthetic
tatagatggagcatggggttcaggtgtcggctttaatttagtctgtacagtcagtttgacagaatgctcaacttt

SEQ ID NO: 280989 - DNA, 75 bp, Artificial Sequence
  Synthetic
tctgcaatgtgttatggctctaccacaatcaacctaatgagagggcagaatacagtccatattgttggaaaagga

SEQ ID NO: 280990 - DNA, 75 bp, Artificial Sequence
  Synthetic
caatcaacctaatgagagggcagaatacagtccatattgttggaaaaggaggtcattctggttcaaaatttatgt

SEQ ID NO: 280991 - DNA, 75 bp, Artificial Sequence
  Synthetic
tacaggcctggttgcagctgcaccacatttagaccgggtaacagggtttaatcaagccgacagtgacaagatttt

SEQ ID NO: 280992 - DNA, 75 bp, Artificial Sequence
  Synthetic
catttagaccgggtaacagggtttaatcaagccgacagtgacaagatttttgatgatggtgcaccagaatgtggc

SEQ ID NO: 280993 - DNA, 75 bp, Artificial Sequence
  Synthetic
gtgaatggattcttggtgtattaaacgggaattggttagttgtggctgtactagtagcattattcatattatcca

SEQ ID NO: 280994 - DNA, 75 bp, Artificial Sequence
  Synthetic
cgggaattggttagttgtggctgtactagtagcattattcatattatccatattcttgtttaccttatgctgccc

SEQ ID NO: 280995 - DNA, 75 bp, Artificial Sequence
  Synthetic
cataagccttaactgttacttgccaatctttatactataatgcacttatcaataaactctcatatagttcattct

SEQ ID NO: 280996 - DNA, 75 bp, Artificial Sequence
  Synthetic
atctttatactataatgcacttatcaataaactctcatatagttcattctgctttctttactgtataccctgtat

SEQ ID NO: 280997 - DNA, 75 bp, Artificial Sequence
  Synthetic
agaaaaaaaactagcactttactaattaattcacttcataccgattatgcctggacttttgttcctgcggaggat

SEQ ID NO: 280998 - DNA, 75 bp, Artificial Sequence
  Synthetic
aagcaaggcaacagacagtgtcagcactggaggataaactcgcagacttcaagcgacgaatggcagatgctgtgt

SEQ ID NO: 280999 - DNA, 75 bp, Artificial Sequence
  Synthetic
gatgaccacctcaaggaacgatcaagcctgcgatatggaaatgtccttgatgtgaatgccatcgatatagaagaa

SEQ ID NO: 281000 - DNA, 75 bp, Artificial Sequence
  Synthetic
atacaattggagtgtatgtaatagggtttacactacctattattttgaaggccttatacatgctttccacacgtg

SEQ ID NO: 281001 - DNA, 75 bp, Artificial Sequence
  Synthetic
gtttacactacctattattttgaaggccttatacatgctttccacacgtgggagacaaactgttaaggagaataa

SEQ ID NO: 281002 - DNA, 75 bp, Artificial Sequence
  Synthetic
gacacttcatttgaagatatcaatggcattaggcgaccaaagcacctctatgtatctatgcctacagcccagtct

SEQ ID NO: 281003 - DNA, 75 bp, Artificial Sequence
  Synthetic
gcattaggcgaccaaagcacctctatgtatctatgcctacagcccagtctactatgaaagcagaggaacttacac

SEQ ID NO: 281004 - DNA, 75 bp, Artificial Sequence
  Synthetic
tggcttatttcctacacaaattcaagttcgaaatataatgagtccagtaatgggggtgattggcttttccttctt

SEQ ID NO: 281005 - DNA, 75 bp, Artificial Sequence
  Synthetic
gttcgaaatataatgagtccagtaatgggggtgattggcttttccttctttgttaaggactggccagacaggata

SEQ ID NO: 281006 - DNA, 75 bp, Artificial Sequence
  Synthetic
catttataaagccagaagttaaaccagggacaccaacacaggaaattgagttcttaaagaaaaataaagtttact

SEQ ID NO: 281007 - DNA, 75 bp, Artificial Sequence
  Synthetic
agggacaccaacacaggaaattgagttcttaaagaaaaataaagtttactttatggaccgccaaaatgtcctaga

SEQ ID NO: 281008 - DNA, 75 bp, Artificial Sequence
  Synthetic
aaattaattgactatgctgcctcaggggacccaacatcaccagataacattgaatctcctaatgcaccgtgggtt

SEQ ID NO: 281009 - DNA, 75 bp, Artificial Sequence
  Synthetic
gggacccaacatcaccagataacattgaatctcctaatgcaccgtgggtttttgcatgtgctcctgaccggtgtc

SEQ ID NO: 281010 - DNA, 75 bp, Artificial Sequence
  Synthetic
gatggcagaacttggtgcctttttttcaattctgcaagacatgaggaataccataatggcctcaaagaccgtagg

SEQ ID NO: 281011 - DNA, 75 bp, Artificial Sequence
  Synthetic
tcaattctgcaagacatgaggaataccataatggcctcaaagaccgtaggcacagctgaagaaaaactcaagaaa

SEQ ID NO: 281012 - DNA, 75 bp, Artificial Sequence
  Synthetic
tacggcggacacagtcaatgggaatccaacttgatcaaaggattatcctcttgtatatgcttgaatggggaaaag

SEQ ID NO: 281013 - DNA, 75 bp, Artificial Sequence
  Synthetic
ccaacttgatcaaaggattatcctcttgtatatgcttgaatggggaaaagagatggttgaccactttcacctggg

SEQ ID NO: 281014 - DNA, 75 bp, Artificial Sequence
  Synthetic
ggtcttgcccaggcattgattgatcagaaagtaaaggagatatctaatcaggatccacttaagatatagaacaag

SEQ ID NO: 281015 - DNA, 75 bp, Artificial Sequence
  Synthetic
agaaagtaaaggagatatctaatcaggatccacttaagatatagaacaagtataggtaagtttataatctagatt

SEQ ID NO: 281016 - DNA, 75 bp, Artificial Sequence
  Synthetic
tagaatgtatttagtattcaatcatgcactaatttgacttatacgggtatcggtaatattattatcagggttgat

SEQ ID NO: 281017 - DNA, 75 bp, Artificial Sequence
  Synthetic
gcactaatttgacttatacgggtatcggtaatattattatcagggttgatggtattatcagggtttattaattaa

SEQ ID NO: 281018 - DNA, 75 bp, Artificial Sequence
  Synthetic
aaggcattatatccatattactcaggttaatgataatgagaatactaatgaaagttataaatgtagcattattgt

SEQ ID NO: 281019 - DNA, 75 bp, Artificial Sequence
  Synthetic
taggataagtgtaagtttatagtttatccttatttattgggcccatcaatgtgaaactgagctatcccctttctg

SEQ ID NO: 281020 - DNA, 75 bp, Artificial Sequence
  Synthetic
aagtagcatatatataagtacacaacatactacctcaacagactgctttcttgattgcttttcaaggaggatact

SEQ ID NO: 281021 - DNA, 75 bp, Artificial Sequence
  Synthetic
tatatgttatcaacccgtgggagacagactgtgaaggagaacaaagggactcgcatccggtttaaagatgatact

SEQ ID NO: 281022 - DNA, 75 bp, Artificial Sequence
  Synthetic
taaaggaaatatccaatcaggagcccttaaaaatatgaaagaactgctaatcgtaccgatagtataagcataata

SEQ ID NO: 281023 - DNA, 75 bp, Artificial Sequence
  Synthetic
cccggaaaaaaatggatactaaacctactgacccgactgggatgaaacctgatgttcacctcaaagagagatcaa

SEQ ID NO: 281024 - DNA, 75 bp, Artificial Sequence
  Synthetic
tgtgaatgcaattgatattgaggaaccaagtggccaaacagcagattggtatacaatcggagtttatgtaatagg

SEQ ID NO: 281025 - DNA, 75 bp, Artificial Sequence
  Synthetic
ccaagtggccaaacagcagattggtatacaatcggagtttatgtaataggattcacacttcctattatccttaaa

SEQ ID NO: 281026 - DNA, 75 bp, Artificial Sequence
  Synthetic
ggagacagactgtaaaggaaaataaggggacgcgcataaggttcaaggatgatacatcatttgaagacatcaatg

SEQ ID NO: 281027 - DNA, 75 bp, Artificial Sequence
  Synthetic
gcataaggagaccaaagcatctatatgtttctatgcctactgctcaatcaactatgaaggcagaagaactcacac

SEQ ID NO: 281028 - DNA, 75 bp, Artificial Sequence
  Synthetic
gttcgtaacatcatgagtccagttatgggggttattggtttctcattttttgtcaaagattggtcagagagaatc

SEQ ID NO: 281029 - DNA, 75 bp, Artificial Sequence
  Synthetic
catttataaaaccagaagttaagccaggtacaccagcacaggagattgagatgttaagaagaaataagatctatt

SEQ ID NO: 281030 - DNA, 75 bp, Artificial Sequence
  Synthetic
aggtacaccagcacaggagattgagatgttaagaagaaataagatctatttcatgcagcgccaagatgtacttga

SEQ ID NO: 281031 - DNA, 75 bp, Artificial Sequence
  Synthetic
aagttaattgatctcgcagcttctggagaccctacatcacctgataacattgactcacccaatgcaccatgggtc

SEQ ID NO: 281032 - DNA, 75 bp, Artificial Sequence
  Synthetic
gagaccctacatcacctgataacattgactcacccaatgcaccatgggtctttgcatgtgcaccagttcgatgtc

SEQ ID NO: 281033 - DNA, 75 bp, Artificial Sequence
  Synthetic
gatggcagaacttggggcctttttttcaatattgcaggatatgaggaatacaataatggcatctaagactgtggg

SEQ ID NO: 281034 - DNA, 75 bp, Artificial Sequence
  Synthetic
tcaatattgcaggatatgaggaatacaataatggcatctaagactgtgggcactgctgaagagaaattaaagaaa

SEQ ID NO: 281035 - DNA, 75 bp, Artificial Sequence
  Synthetic
tacgccgaactcaatcgatgggaattcagcttgaccaaaggatcattctcttgttcatgttggaatggggcaaag

SEQ ID NO: 281036 - DNA, 75 bp, Artificial Sequence
  Synthetic
tcagcttgaccaaaggatcattctcttgttcatgttggaatggggcaaagagatggtagatcattttcatcttgg

SEQ ID NO: 281037 - DNA, 75 bp, Artificial Sequence
  Synthetic
ggtcttgcacaagcactgatagaccaaaaggtgaaagaaatatcaaaccaggagccattaaagatataatcattt

SEQ ID NO: 281038 - DNA, 75 bp, Artificial Sequence
  Synthetic
aatcacatatgcactgattatagatatagtgagttattaacatacagatagtttatattcagggattatatgtat

SEQ ID NO: 281039 - DNA, 75 bp, Artificial Sequence
  Synthetic
gggtttataattacaattatcagggtcattaattaacaaactaatcagggttaaactggaaatgtagcattataa

SEQ ID NO: 281040 - DNA, 75 bp, Artificial Sequence
  Synthetic
tacagggattactaatggtagttatgaatgtattaagacattatttttataatcattatataattagtaatacat

SEQ ID NO: 281041 - DNA, 75 bp, Artificial Sequence
  Synthetic
tgtaaatgctattgacattgaagagccaagtggtcaaacagcagattggtatactataggagtgtatgtgatagg

SEQ ID NO: 281042 - DNA, 75 bp, Artificial Sequence
  Synthetic
gcattatatatgttgtcgacacgtgggaggcagactgtgaaggaaaacaaggggacaagaataagatttaaggat

SEQ ID NO: 281043 - DNA, 75 bp, Artificial Sequence
  Synthetic
ggaggcagactgtgaaggaaaacaaggggacaagaataagatttaaggatgacacatcatttgaggatatcaatg

SEQ ID NO: 281044 - DNA, 75 bp, Artificial Sequence
  Synthetic
tgtatccatgccaactgctcaatctacaatgaaggcagaggaacttacacctgggcgatttcggacaatagtatg

SEQ ID NO: 281045 - DNA, 75 bp, Artificial Sequence
  Synthetic
acaatgaaggcagaggaacttacacctgggcgatttcggacaatagtatgtggtctattccctactcaaatacaa

SEQ ID NO: 281046 - DNA, 75 bp, Artificial Sequence
  Synthetic
tgggggtaattggtttttccttttttgttaaagactggccagaaaggatcaaagagtttatggagaaggaatgcc

SEQ ID NO: 281047 - DNA, 75 bp, Artificial Sequence
  Synthetic
tgttaaagactggccagaaaggatcaaagagtttatggagaaggaatgcccttttataaaaccagaagttaaacc

SEQ ID NO: 281048 - DNA, 75 bp, Artificial Sequence
  Synthetic
agagtctcccaacgcaccatgggtatttgcctgtgcaccagaccgatgtcctccaacatgcatttatgttgcagg

SEQ ID NO: 281049 - DNA, 75 bp, Artificial Sequence
  Synthetic
tttgcctgtgcaccagaccgatgtcctccaacatgcatttatgttgcagggatggcagagttgggtgcatttttc

SEQ ID NO: 281050 - DNA, 75 bp, Artificial Sequence
  Synthetic
ccattatggcctctaagactgtaggaacagctgaagagaaactgaagaaaaaatcctcattctaccaatcatacc

SEQ ID NO: 281051 - DNA, 75 bp, Artificial Sequence
  Synthetic
aacagctgaagagaaactgaagaaaaaatcctcattctaccaatcatacctacgccggacacaatctatgggaat

SEQ ID NO: 281052 - DNA, 75 bp, Artificial Sequence
  Synthetic
ctatacatgttggaatggggaaaagaaatggtggaccacttccatcttggtgatgacatggatcctgaactcagg

SEQ ID NO: 281053 - DNA, 75 bp, Artificial Sequence
  Synthetic
aaatggtggaccacttccatcttggtgatgacatggatcctgaactcaggggtcttgcccaggcattgattgatc

SEQ ID NO: 281054 - DNA, 75 bp, Artificial Sequence
  Synthetic
agagcccttaaagatatgaacatttaaagtcatgctactaattataggtatagggaattactaacatttagatta

SEQ ID NO: 281055 - DNA, 75 bp, Artificial Sequence
  Synthetic
aaagtcatgctactaattataggtatagggaattactaacatttagattattcatgtattcagggattatattga

SEQ ID NO: 281056 - DNA, 75 bp, Artificial Sequence
  Synthetic
cgggttcaaattattatcatcagggttatgaattaatgcactaatcagggtataactggagccatataattataa

SEQ ID NO: 281057 - DNA, 75 bp, Artificial Sequence
  Synthetic
caaggaattactaatgacaattatgaatgtattaagttagtgtatttttaatgatatccaattaacattatatat

SEQ ID NO: 281058 - DNA, 75 bp, Artificial Sequence
  Synthetic
aatgtattaagttagtgtatttttaatgatatccaattaacattatatatgtatgaatttatagtttgttatttt

SEQ ID NO: 281059 - DNA, 75 bp, Artificial Sequence
  Synthetic
gtgtacttatatatatgcaagtagcatatatataagtacacaacatactacctcaacagactgatttcttgattg

SEQ ID NO: 281060 - DNA, 75 bp, Artificial Sequence
  Synthetic
accatgaaggcagaagaactcacaccaggtaggtttcgtacaatagtatgtggtctatttccaactcagattcaa

SEQ ID NO: 281061 - DNA, 75 bp, Artificial Sequence
  Synthetic
agatggtggatcacttccatcttggtgatgacatggatccagagctcagaggtcttgcacaggcaatgatagacc

SEQ ID NO: 281062 - DNA, 75 bp, Artificial Sequence
  Synthetic
tgatgacatggatccagagctcagaggtcttgcacaggcaatgatagaccaaaaggtgaaagaaatatcaaacca

SEQ ID NO: 281063 - DNA, 75 bp, Artificial Sequence
  Synthetic
cccggaaaaaaatggatactaaacctactgacccgactgggattgaacctgatgatcacctcaaagagagatcaa

SEQ ID NO: 281064 - DNA, 75 bp, Artificial Sequence
  Synthetic
gcataaggagaccaaagcatctatatgtctccatgcctactgctcagtcaaccatgaaggcagaggaactcacac

SEQ ID NO: 281065 - DNA, 75 bp, Artificial Sequence
  Synthetic
tgtctccatgcctactgctcagtcaaccatgaaggcagaggaactcacaccaggcagatttcgtacaatagtatg

SEQ ID NO: 281066 - DNA, 75 bp, Artificial Sequence
  Synthetic
gttcgtaatatcgtcagtcctgttatgggggtcattggtttttcattctttgtgaaagactggtcacagagaatc

SEQ ID NO: 281067 - DNA, 75 bp, Artificial Sequence
  Synthetic
acagagttcatggaaaaggagtgcccattcataaaaccagaagttaagccaggtacaccggcacaagagattgag

SEQ ID NO: 281068 - DNA, 75 bp, Artificial Sequence
  Synthetic
tcatgcagcgccaggatgtgcttgacaaaaatcatgtggcagacattgataagtcaattgactatgcagcctctg

SEQ ID NO: 281069 - DNA, 75 bp, Artificial Sequence
  Synthetic
caaaaatcatgtggcagacattgataagtcaattgactatgcagcctctgaagaccctacatcacctgacaacat

SEQ ID NO: 281070 - DNA, 75 bp, Artificial Sequence
  Synthetic
tttgcctgtgcaccagatcggtgtccaccaacatgtatctatgttgcagggatggcagagctcggggcttttttt

SEQ ID NO: 281071 - DNA, 75 bp, Artificial Sequence
  Synthetic
caccaacatgtatctatgttgcagggatggcagagctcggggcttttttttcaatattgcaggatatgaggaata

SEQ ID NO: 281072 - DNA, 75 bp, Artificial Sequence
  Synthetic
caccgctgaagagaaattaaagaagaaatcctctttttaccaatcttacctacgtcgaactcaatcaatgggaat

SEQ ID NO: 281073 - DNA, 75 bp, Artificial Sequence
  Synthetic
aaatcctctttttaccaatcttacctacgtcgaactcaatcaatgggaattcagcttgaccaaagaatcattctc

SEQ ID NO: 281074 - DNA, 75 bp, Artificial Sequence
  Synthetic
agtcatatatgcactgatcataaatgtagtgagttactaacatgcagacaacattatatattcagggattatatg

SEQ ID NO: 281075 - DNA, 75 bp, Artificial Sequence
  Synthetic
caatacagggattactaatggcagttatgaatgtattaagatattatttttatcaccagtacttaattacctact

SEQ ID NO: 281076 - DNA, 75 bp, Artificial Sequence
  Synthetic
atttaatgggcccaaacatgtgaaactgagctgtccttttccttttcaccactttttttcttaaaactcattcat

SEQ ID NO: 281077 - DNA, 75 bp, Artificial Sequence
  Synthetic
agagagagcagtggaagtggacccagatgacgttaataaaaacacactacaagccaggcaacaaacagtgtcagc

SEQ ID NO: 281078 - DNA, 75 bp, Artificial Sequence
  Synthetic
atacaattggagtttatgtaataggattcacaatccctatcattcttaaagccttgtacatgctttcaacgcgtg

SEQ ID NO: 281079 - DNA, 75 bp, Artificial Sequence
  Synthetic
gcataagaagaccaaagcatttatatgtttccatgcccactgctcaatcaactatgaaggcagaagaactcacac

SEQ ID NO: 281080 - DNA, 75 bp, Artificial Sequence
  Synthetic
tggtctttttccaactcagatccaagttcgtaacatcatgagtccagttatgggggttattggtttctcattttt

SEQ ID NO: 281081 - DNA, 75 bp, Artificial Sequence
  Synthetic
tgtaaaagattggcctgaaaggatccgagagttcatggaaaaagaatgcccattcataaagccagaaattaagcc

SEQ ID NO: 281082 - DNA, 75 bp, Artificial Sequence
  Synthetic
cattcataaagccagaaattaagccaggtacaccagcacaggagatggagatgttgaaaaggaataagatctact

SEQ ID NO: 281083 - DNA, 75 bp, Artificial Sequence
  Synthetic
caaaaaccatgtggcagacatcgataagctaattgactatgcagcctctggaggccccacatcacctgataacat

SEQ ID NO: 281084 - DNA, 75 bp, Artificial Sequence
  Synthetic
caccaacatgtatctatgttgcagggatggcagagcttggggcctttttttcaatattacaggatatgagaaata

SEQ ID NO: 281085 - DNA, 75 bp, Artificial Sequence
  Synthetic
cacagctgaagagaagttgaagaagaagtcctctttctaccaatcttacttacgccggactcaatcaatgggaat

SEQ ID NO: 281086 - DNA, 75 bp, Artificial Sequence
  Synthetic
tacgccggactcaatcaatgggaattcagcttgaccaaagaatcattctcttgttcatgttggaatggggcaagg

SEQ ID NO: 281087 - DNA, 75 bp, Artificial Sequence
  Synthetic
tgatgatatggatccagaactcagaggtcttgcacaggcactgattgatcaaaaggtgaaggaaatatcaaacca

SEQ ID NO: 281088 - DNA, 75 bp, Artificial Sequence
  Synthetic
aatcatatatgcactgattatagatgtagtgagttactaacatgcagacaatattatatattcagggatcatatg

SEQ ID NO: 281089 - DNA, 75 bp, Artificial Sequence
  Synthetic
caatacagggactactaatggcagttatgaatgtattaagatattatttttataatcattacctaattagcatta

SEQ ID NO: 281090 - DNA, 75 bp, Artificial Sequence
  Synthetic
tatgaatgtattaagatattatttttataatcattacctaattagcattatataggataaggttgtatttcatta

SEQ ID NO: 281091 - DNA, 75 bp, Artificial Sequence
  Synthetic
tataggataaggttgtatttcattatttaatgggcccgaacatgtgaaactgagctgtctttttttccttttcac

SEQ ID NO: 281092 - DNA, 75 bp, Artificial Sequence
  Synthetic
tagtagtagactccgcaagaagaagcaaatacagaaaaatatgggaaaacttagtccagtttgtctgtatctgtt

SEQ ID NO: 281093 - DNA, 75 bp, Artificial Sequence
  Synthetic
attggttcagtggaattgccacctgttccaatacaacaagtggagtctctaaaattagaaagctcctgtaatttt

SEQ ID NO: 281094 - DNA, 75 bp, Artificial Sequence
  Synthetic
gacttacacaccagcacagcaacccagcaatcattcacaaagtggacatgggaaatgaaggatgacctagctgaa

SEQ ID NO: 281095 - DNA, 75 bp, Artificial Sequence
  Synthetic
tttaagagggttgtgtttaattccccctttagtggttgaaacagcatcacggacccggaagacaattgcttgttt

SEQ ID NO: 281096 - DNA, 75 bp, Artificial Sequence
  Synthetic
tgtcaacctactgtctatttagtaggacctatccaaacatgtattacaacaaaaagctgtcttctgggcttgggt

SEQ ID NO: 281097 - DNA, 75 bp, Artificial Sequence
  Synthetic
gacctatccaaacatgtattacaacaaaaagctgtcttctgggcttgggtgaccaaagaatccaagtaaattatg

SEQ ID NO: 281098 - DNA, 75 bp, Artificial Sequence
  Synthetic
gttgattgaaggagtgtgttttaaccctgtacacacaagggctctttcccaacctagccatacttatgatatagt

SEQ ID NO: 281099 - DNA, 75 bp, Artificial Sequence
  Synthetic
cctgtacacacaagggctctttcccaacctagccatacttatgatatagtgactatgatggtgcgttgttttttg

SEQ ID NO: 281100 - DNA, 75 bp, Artificial Sequence
  Synthetic
atagtatgaagattgaaaagaactttgagactttagtccagaagactgattgtaatgcaaatggttttcagggct

SEQ ID NO: 281101 - DNA, 75 bp, Artificial Sequence
  Synthetic
tgagactttagtccagaagactgattgtaatgcaaatggttttcagggctattatatttgtcttgtaggaagtag

SEQ ID NO: 281102 - DNA, 75 bp, Artificial Sequence
  Synthetic
ttagacgattatcggtctgctgaggttttatcaagaatggcttttgcacctcatggagaagatcatgatgttgaa

SEQ ID NO: 281103 - DNA, 75 bp, Artificial Sequence
  Synthetic
ttttatcaagaatggcttttgcacctcatggagaagatcatgatgttgaaagaaatgcagtgagtgctttaagaa

SEQ ID NO: 281104 - DNA, 75 bp, Artificial Sequence
  Synthetic
accttctacagaagcatctgacacagtacaaggcatagctttttcaggtagccccctctatacatctacaggggt

SEQ ID NO: 281105 - DNA, 75 bp, Artificial Sequence
  Synthetic
gtacaaggcatagctttttcaggtagccccctctatacatctacaggggtattgacagctaaggataacccggta

SEQ ID NO: 281106 - DNA, 75 bp, Artificial Sequence
  Synthetic
tggaaggaaaccattctgtgtgcgaaaagaagacattaccccttacatggactggattcataccattaccaggtg

SEQ ID NO: 281107 - DNA, 75 bp, Artificial Sequence
  Synthetic
aaagaagacattaccccttacatggactggattcataccattaccaggtgaaattgaaaaaacacctcagtgcac

SEQ ID NO: 281108 - DNA, 75 bp, Artificial Sequence
  Synthetic
ggtgccgattgtgaagcttactctgaaaccgggattttcaatataagctcacctacttgtttactcaatcgtgta

SEQ ID NO: 281109 - DNA, 75 bp, Artificial Sequence
  Synthetic
aaaccgggattttcaatataagctcacctacttgtttactcaatcgtgtacagagattccgtggtgcagagcaac

SEQ ID NO: 281110 - DNA, 75 bp, Artificial Sequence
  Synthetic
tgatatggacattacagtatattgtaatggtatgaaaaaagtgattctaactaaaactttagttataggccaatg

SEQ ID NO: 281111 - DNA, 75 bp, Artificial Sequence
  Synthetic
aatggtatgaaaaaagtgattctaactaaaactttagttataggccaatgcatatataccttcactagtattttc

SEQ ID NO: 281112 - DNA, 75 bp, Artificial Sequence
  Synthetic
cacttgcagtagaactatgtgttccaggccttcatggctgggctacagtgttgcttttattaaccttttgttttg

SEQ ID NO: 281113 - DNA, 75 bp, Artificial Sequence
  Synthetic
aggccttcatggctgggctacagtgttgcttttattaaccttttgttttggatggattctcattccattcattgc

SEQ ID NO: 281114 - DNA, 75 bp, Artificial Sequence
  Synthetic
gcgtttgcatatttatgttctaaatataatacagactccaagttcaaaattttgattgagaaagtaaagaaggaa

SEQ ID NO: 281115 - DNA, 75 bp, Artificial Sequence
  Synthetic
ataatacagactccaagttcaaaattttgattgagaaagtaaagaaggaatatcaaaaaacaatgggctcaatgg

SEQ ID NO: 281116 - DNA, 75 bp, Artificial Sequence
  Synthetic
tgagacagcaaaagaattagaatctcatcggaaaagctgtccaattggttcctgcccatactgtcttaatccatc

SEQ ID NO: 281117 - DNA, 75 bp, Artificial Sequence
  Synthetic
catcggaaaagctgtccaattggttcctgcccatactgtcttaatccatctgaggcaacaacatcagctcttcag

SEQ ID NO: 281118 - DNA, 75 bp, Artificial Sequence
  Synthetic
catcaaggtttcaagacaatctaaggaagtcattggcagcttatgaaccaaagcaaggatgttatcggacattat

SEQ ID NO: 281119 - DNA, 75 bp, Artificial Sequence
  Synthetic
gaagtcattggcagcttatgaaccaaagcaaggatgttatcggacattatcccttttccgttatcgaagtcgttt

SEQ ID NO: 281120 - DNA, 75 bp, Artificial Sequence
  Synthetic
ctgctggttttagaattggttatttgggctgctagtgctgaaacacaaaatctaaactcaggatggacagatact

SEQ ID NO: 281121 - DNA, 75 bp, Artificial Sequence
  Synthetic
gggctgctagtgctgaaacacaaaatctaaactcaggatggacagatactgcacatggttcaggtgttgttccca

SEQ ID NO: 281122 - DNA, 75 bp, Artificial Sequence
  Synthetic
ttcattaccatcttctgcaagttatacatacagaagacaattacagaatcctgcaaatgaacatgaaaagatacc

SEQ ID NO: 281123 - DNA, 75 bp, Artificial Sequence
  Synthetic
acatacagaagacaattacagaatcctgcaaatgaacatgaaaagataccctttcacctacaaataagcaaacaa

SEQ ID NO: 281124 - DNA, 75 bp, Artificial Sequence
  Synthetic
taggccattggatggatgctacatttaacttaaaaacagcatttcattgctatggcttatgtgaaaagtatgcct

SEQ ID NO: 281125 - DNA, 75 bp, Artificial Sequence
  Synthetic
taacttaaaaacagcatttcattgctatggcttatgtgaaaagtatgcctatccatggcagacagctggctgttt

SEQ ID NO: 281126 - DNA, 75 bp, Artificial Sequence
  Synthetic
agtggctggggttgtaatcccccagattgcccaggtattggaacaggttgcactgcctgtggtgtatatcttgat

SEQ ID NO: 281127 - DNA, 75 bp, Artificial Sequence
  Synthetic
attgcccaggtattggaacaggttgcactgcctgtggtgtatatcttgataaactcaaatcagtgggaaaggttt

SEQ ID NO: 281128 - DNA, 75 bp, Artificial Sequence
  Synthetic
aagaaaggcttgtattcaactcggcactgaacagacctgcaagagtgttgatagtaatgattgcctggtcaccac

SEQ ID NO: 281129 - DNA, 75 bp, Artificial Sequence
  Synthetic
actgaacagacctgcaagagtgttgatagtaatgattgcctggtcaccacttcaattaaagtatgcctgattggg

SEQ ID NO: 281130 - DNA, 75 bp, Artificial Sequence
  Synthetic
atacattattatttttgggcccacttgagcaaggtgggttaatatttaaacaatggtgtacaacaacatgtcaat

SEQ ID NO: 281131 - DNA, 75 bp, Artificial Sequence
  Synthetic
tgagcaaggtgggttaatatttaaacaatggtgtacaacaacatgtcaatttggtgatcccggggatataatgag

SEQ ID NO: 281132 - DNA, 75 bp, Artificial Sequence
  Synthetic
gaacttaatggttcatttaggaagaaatgtgcatttgcaacaacaccagtatgtcagtttgatggaaatacaata

SEQ ID NO: 281133 - DNA, 75 bp, Artificial Sequence
  Synthetic
aatgtgcatttgcaacaacaccagtatgtcagtttgatggaaatacaatatcaggatataagcggatgatggcta

SEQ ID NO: 281134 - DNA, 75 bp, Artificial Sequence
  Synthetic
tgtcacagaaccccatatttctacaagtgcacttgaatggattgatccggatagttctcttagagatcatattaa

SEQ ID NO: 281135 - DNA, 75 bp, Artificial Sequence
  Synthetic
agtgcacttgaatggattgatccggatagttctcttagagatcatattaatgttgttgtcagccgtgatctctca

SEQ ID NO: 281136 - DNA, 75 bp, Artificial Sequence
  Synthetic
gtcaagtagatttaactacatcttcaatagatggagcatggggttcaggtgttggctttaatttagtttgtactg

SEQ ID NO: 281137 - DNA, 75 bp, Artificial Sequence
  Synthetic
aatagatggagcatggggttcaggtgttggctttaatttagtttgtactgttagtttaacagaatgcccaacttt

SEQ ID NO: 281138 - DNA, 75 bp, Artificial Sequence
  Synthetic
tctgcaatgtgttatgggtctaccacaaccaacctagtgagaggacagaacacagtccatatcgttgggaaggga

SEQ ID NO: 281139 - DNA, 75 bp, Artificial Sequence
  Synthetic
caaccaacctagtgagaggacagaacacagtccatatcgttgggaagggaggtcattctggttcaaaattcatgt

SEQ ID NO: 281140 - DNA, 75 bp, Artificial Sequence
  Synthetic
tacaggtttgattgcagctgcaccacatttagaccgggtaacagggtttaatcaagcagatagtgataagatatt

SEQ ID NO: 281141 - DNA, 75 bp, Artificial Sequence
  Synthetic
catttagaccgggtaacagggtttaatcaagcagatagtgataagatattcgatgatggtgcaccaggatgtggc

SEQ ID NO: 281142 - DNA, 75 bp, Artificial Sequence
  Synthetic
gtgaatggattcttggtgtgttaaacggaaattggttagttgtggctgtcctaatagcactatttatattatcca

SEQ ID NO: 281143 - DNA, 75 bp, Artificial Sequence
  Synthetic
cggaaattggttagttgtggctgtcctaatagcactatttatattatccatattcttgtttaccttatgctgccc

SEQ ID NO: 281144 - DNA, 75 bp, Artificial Sequence
  Synthetic
cataagccttaactgtcatgtattgatttccacaccatattgcactcattaacaaatccccatatagttcatgct

SEQ ID NO: 281145 - DNA, 75 bp, Artificial Sequence
  Synthetic
gtatattatatttaaccaatatatagaaaaaaaactagcactttactaattaaatcacttcataccgattatgcc

SEQ ID NO: 281146 - DNA, 75 bp, Artificial Sequence
  Synthetic
tagaaaaaaaactagcactttactaattaaatcacttcataccgattatgcctggacttttgttcctgcggagtc

SEQ ID NO: 281147 - DNA, 75 bp, Artificial Sequence
  Synthetic
tgatgatatggatccagagctcagaggtcttgcacaggcactgatagatcaaaaggtgaaggaaatatcgaacca

SEQ ID NO: 281148 - DNA, 75 bp, Artificial Sequence
  Synthetic
ggtcattaattaacaaactaatcagggttaaactggaaatgtagcattataagtacatatcaactaataacaatc

SEQ ID NO: 281149 - DNA, 75 bp, Artificial Sequence
  Synthetic
tagtagtagactccgagatagagaagtttactacaaatggagaaatacagagagatccatgagagggtaaaagaa

SEQ ID NO: 281150 - DNA, 75 bp, Artificial Sequence
  Synthetic
gtttactacaaatggagaaatacagagagatccatgagagggtaaaagaagcagtccctggggaaacatcagcag

SEQ ID NO: 281151 - DNA, 75 bp, Artificial Sequence
  Synthetic
agagatccatgagagggtaaaagaagcagtccctggggaaacatcagcagtagaatgtttggacttattagatag

SEQ ID NO: 281152 - DNA, 75 bp, Artificial Sequence
  Synthetic
gtagatcaaatgataaaacatgactggtcagacaataaagacaaagaacagcctattggtcatgtgctgttaatg

SEQ ID NO: 281153 - DNA, 75 bp, Artificial Sequence
  Synthetic
ggtcagacaataaagacaaagaacagcctattggtcatgtgctgttaatggctggggttcctaatgaggtgatac

SEQ ID NO: 281154 - DNA, 75 bp, Artificial Sequence
  Synthetic
agggagtccgagtggtcagatcttgaggtcattctttaagatgacacctgataactataagatcacagggaattt

SEQ ID NO: 281155 - DNA, 75 bp, Artificial Sequence
  Synthetic
aggtcattctttaagatgacacctgataactataagatcacagggaatttaatagagttcattgaagtaacagtc

SEQ ID NO: 281156 - DNA, 75 bp, Artificial Sequence
  Synthetic
gtgaaaaacatctaaaataccaaggtggcttagagtatattgaacatttactccaagtagaggcacaaaagggga

SEQ ID NO: 281157 - DNA, 75 bp, Artificial Sequence
  Synthetic
tggcttagagtatattgaacatttactccaagtagaggcacaaaaggggaattgtcagtcaggtttccgaattaa

SEQ ID NO: 281158 - DNA, 75 bp, Artificial Sequence
  Synthetic
gatggttctaatatttccacacaatggcctagtaggagaaatgagggtgtagtacaggctatgcgacttatacag

SEQ ID NO: 281159 - DNA, 75 bp, Artificial Sequence
  Synthetic
ggcctagtaggagaaatgagggtgtagtacaggctatgcgacttatacaggcagacatcaactttgtgagggaac

SEQ ID NO: 281160 - DNA, 75 bp, Artificial Sequence
  Synthetic
tgccttggaagcaatgttcaatttgaaattccatgttacagggccaagagtgcgtacatttgacataccaaatta

SEQ ID NO: 281161 - DNA, 75 bp, Artificial Sequence
  Synthetic
aaattccatgttacagggccaagagtgcgtacatttgacataccaaattacagaccacagcaattatgtgaacca

SEQ ID NO: 281162 - DNA, 75 bp, Artificial Sequence
  Synthetic
gcaaaaattggcttcagactgatcataaatttgcatttaaggaagtgacaggacagcgtgtctacaatgtattta

SEQ ID NO: 281163 - DNA, 75 bp, Artificial Sequence
  Synthetic
taaatttgcatttaaggaagtgacaggacagcgtgtctacaatgtatttaaggatgaagaattacagcataaatc

SEQ ID NO: 281164 - DNA, 75 bp, Artificial Sequence
  Synthetic
agaaattttttgctctgtcagattgggattcaagccccttatcttccttccacgatagcatctgaccagtatgac

SEQ ID NO: 281165 - DNA, 75 bp, Artificial Sequence
  Synthetic
ggattcaagccccttatcttccttccacgatagcatctgaccagtatgacaccagaattgcatgtgctgagttgt

SEQ ID NO: 281166 - DNA, 75 bp, Artificial Sequence
  Synthetic
acagctattagcccgtgatatagcttacaagtatatcaccctagacaaggatgatatcatcaactattataaccc

SEQ ID NO: 281167 - DNA, 75 bp, Artificial Sequence
  Synthetic
tacaagtatatcaccctagacaaggatgatatcatcaactattataacccacgaatctatttcaaaccaactcag

SEQ ID NO: 281168 - DNA, 75 bp, Artificial Sequence
  Synthetic
aattgaatctttccaatatggacccaaaatcaaaggcattattggatgtgattgcaaaggattcaaaaaaaggag

SEQ ID NO: 281169 - DNA, 75 bp, Artificial Sequence
  Synthetic
aaaatcaaaggcattattggatgtgattgcaaaggattcaaaaaaaggagtttttggtgagttgattgatagcat

SEQ ID NO: 281170 - DNA, 75 bp, Artificial Sequence
  Synthetic
aatgagtgtgcaaaagtggtagaaaagattctttcagatttagaagtcaacgtcggtgagtcgaatgaagggata

SEQ ID NO: 281171 - DNA, 75 bp, Artificial Sequence
  Synthetic
agattctttcagatttagaagtcaacgtcggtgagtcgaatgaagggataggacagccgaaaaagacaacaggaa

SEQ ID NO: 281172 - DNA, 75 bp, Artificial Sequence
  Synthetic
tgataatgagcttattaaatttatggtagccataattaggaaaacaacagcttggcatttagggcatttattgcg

SEQ ID NO: 281173 - DNA, 75 bp, Artificial Sequence
  Synthetic
gtagccataattaggaaaacaacagcttggcatttagggcatttattgcgtgacattacagagtcgttgattgcc

SEQ ID NO: 281174 - DNA, 75 bp, Artificial Sequence
  Synthetic
attggtcagcacatgggtatgcctgtggaaatgtgttattatgtatattaccatcgaagtccttagaggttgctg

SEQ ID NO: 281175 - DNA, 75 bp, Artificial Sequence
  Synthetic
tggaaatgtgttattatgtatattaccatcgaagtccttagaggttgctggatcttatattagattctttacagt

SEQ ID NO: 281176 - DNA, 75 bp, Artificial Sequence
  Synthetic
gatcttgacaacttggactccaaaatagagattgatggtgttacctggtgcttcagtaagatcatcagtctcgac

SEQ ID NO: 281177 - DNA, 75 bp, Artificial Sequence
  Synthetic
tagagattgatggtgttacctggtgcttcagtaagatcatcagtctcgacttaaatcgcttattagcactaaata

SEQ ID NO: 281178 - DNA, 75 bp, Artificial Sequence
  Synthetic
cactgcaacatggtttcagtattatacagaagatcaaggccatttcccattacagcatgcactccggtcagtatt

SEQ ID NO: 281179 - DNA, 75 bp, Artificial Sequence
  Synthetic
acagaagatcaaggccatttcccattacagcatgcactccggtcagtatttgcttttcattttttgttagcaacc

SEQ ID NO: 281180 - DNA, 75 bp, Artificial Sequence
  Synthetic
tatttgataatttaaggtacctcattcctgcagtcacttcaacatattcaggctttgaaccacttatccagaagt

SEQ ID NO: 281181 - DNA, 75 bp, Artificial Sequence
  Synthetic
tcctgcagtcacttcaacatattcaggctttgaaccacttatccagaagttcttcgaaagacccttcaaaagtgc

SEQ ID NO: 281182 - DNA, 75 bp, Artificial Sequence
  Synthetic
atcaaaacattactggtgaatctagcccagaataataaaatccgattttattcaaaagttaggttattagggctt

SEQ ID NO: 281183 - DNA, 75 bp, Artificial Sequence
  Synthetic
cccagaataataaaatccgattttattcaaaagttaggttattagggcttactgtagatcaatctactataggtg

SEQ ID NO: 281184 - DNA, 75 bp, Artificial Sequence
  Synthetic
gtcaagagtcatttataagcattatcggagtttaatttcagaagcaacaacctgttttttcttgtttgaaaaggg

SEQ ID NO: 281185 - DNA, 75 bp, Artificial Sequence
  Synthetic
cggagtttaatttcagaagcaacaacctgttttttcttgtttgaaaagggccttcatggtaatttgacagaagaa

SEQ ID NO: 281186 - DNA, 75 bp, Artificial Sequence
  Synthetic
aatgggcaagaaaatttcaagagaaggaaaaaatgtttggggattatattatggaggagggttatcatcttcaag

SEQ ID NO: 281187 - DNA, 75 bp, Artificial Sequence
  Synthetic
ggaaaaaatgtttggggattatattatggaggagggttatcatcttcaagatgtcatatcaggtcatgtccaagt

SEQ ID NO: 281188 - DNA, 75 bp, Artificial Sequence
  Synthetic
gtagtagagttagctgctcaagaacttaacacatacttacatgcaaaagcccaagtaatggcagggaacatcatg

SEQ ID NO: 281189 - DNA, 75 bp, Artificial Sequence
  Synthetic
ttaacacatacttacatgcaaaagcccaagtaatggcagggaacatcatgaataaatactgggataagccttact

SEQ ID NO: 281190 - DNA, 75 bp, Artificial Sequence
  Synthetic
caaagggatgtcaggagcattacaagaggatggtcatctagctgcaagtgtaacactcattgagtccatacgata

SEQ ID NO: 281191 - DNA, 75 bp, Artificial Sequence
  Synthetic
gaggatggtcatctagctgcaagtgtaacactcattgagtccatacgataccttaatcagtcacagtacaatcca

SEQ ID NO: 281192 - DNA, 75 bp, Artificial Sequence
  Synthetic
caaaaaagcagagggcacaggcaagaatagttaggaagtaccagaggacagaggctgatcggggcttttttatca

SEQ ID NO: 281193 - DNA, 75 bp, Artificial Sequence
  Synthetic
aatagttaggaagtaccagaggacagaggctgatcggggcttttttatcaccacacttcctacaagggtaaggtt

SEQ ID NO: 281194 - DNA, 75 bp, Artificial Sequence
  Synthetic
gcaatagccaaggtggttcctgaggaatatatctcttatggtggtgagagaaaaatccttaatatccaacaagca

SEQ ID NO: 281195 - DNA, 75 bp, Artificial Sequence
  Synthetic
aatatatctcttatggtggtgagagaaaaatccttaatatccaacaagcacttgaaaaagcattgaggtgggcat

SEQ ID NO: 281196 - DNA, 75 bp, Artificial Sequence
  Synthetic
tttaggtcatacaattaaactaaaaagaaaattaatgtatgtcagtgcagatgctacaaaatggtccccaggtga

SEQ ID NO: 281197 - DNA, 75 bp, Artificial Sequence
  Synthetic
agaaaattaatgtatgtcagtgcagatgctacaaaatggtccccaggtgacaactctgctaagtttagaagattt

SEQ ID NO: 281198 - DNA, 75 bp, Artificial Sequence
  Synthetic
gcgatgacaaattgaagaattgtgttgtggatgcgttaaggaatatttacgagactgaattttttatttcaagga

SEQ ID NO: 281199 - DNA, 75 bp, Artificial Sequence
  Synthetic
tgtggatgcgttaaggaatatttacgagactgaattttttatttcaaggaaattacatagatatattgacaatat

SEQ ID NO: 281200 - DNA, 75 bp, Artificial Sequence
  Synthetic
gacttcttatctttttttcccaataaagtatcagccataataaaaggaaattggctacaaggtaatcttaataaa

SEQ ID NO: 281201 - DNA, 75 bp, Artificial Sequence
  Synthetic
aagtatcagccataataaaaggaaattggctacaaggtaatcttaataaatgttcctcattatttggtgctgctg

SEQ ID NO: 281202 - DNA, 75 bp, Artificial Sequence
  Synthetic
gaataaactgtaccctgaattagattgtttctttgaatttgcccatcattctgatgatgcattatttatatatgg

SEQ ID NO: 281203 - DNA, 75 bp, Artificial Sequence
  Synthetic
tgtttctttgaatttgcccatcattctgatgatgcattatttatatatggctatttagagccactggatgatggc

SEQ ID NO: 281204 - DNA, 75 bp, Artificial Sequence
  Synthetic
aacagatccaagcaggaaatttacattggcatgcggttaatcatgaaatgtggaaaagcatgtttaacctacatg

SEQ ID NO: 281205 - DNA, 75 bp, Artificial Sequence
  Synthetic
ttggcatgcggttaatcatgaaatgtggaaaagcatgtttaacctacatgaacatgtcttactcatgggatcaat

SEQ ID NO: 281206 - DNA, 75 bp, Artificial Sequence
  Synthetic
gtgtcacctacaaatgctgaatttttatcaacatttttcgaaggttgtgctgtttcaattccctttataaaaatt

SEQ ID NO: 281207 - DNA, 75 bp, Artificial Sequence
  Synthetic
tatcaacatttttcgaaggttgtgctgtttcaattccctttataaaaattttattgggttctttatctgatttac

SEQ ID NO: 281208 - DNA, 75 bp, Artificial Sequence
  Synthetic
agcagctgctcagagccgatgtgttaaagcaatggacatgggtgcttgcccgcagttggcacaactcggtatagt

SEQ ID NO: 281209 - DNA, 75 bp, Artificial Sequence
  Synthetic
aaagcaatggacatgggtgcttgcccgcagttggcacaactcggtatagtcttatgtacaagtaaggttgaacgg

SEQ ID NO: 281210 - DNA, 75 bp, Artificial Sequence
  Synthetic
taaataacccaactgcatatttgaaagcagatcgtaattctatacctatccctttagggggcgatgggtccatgt

SEQ ID NO: 281211 - DNA, 75 bp, Artificial Sequence
  Synthetic
agcagatcgtaattctatacctatccctttagggggcgatgggtccatgtctatcatggagctagcaacagcagg

SEQ ID NO: 281212 - DNA, 75 bp, Artificial Sequence
  Synthetic
ttaaagaatgcatttattacttacaagcacacaaagaaagaaagtgatagatatatacttgggctttttaaattt

SEQ ID NO: 281213 - DNA, 75 bp, Artificial Sequence
  Synthetic
agcacacaaagaaagaaagtgatagatatatacttgggctttttaaatttctgatgacactatcagatgacatat

SEQ ID NO: 281214 - DNA, 75 bp, Artificial Sequence
  Synthetic
tagctttgttggaaaggtacaatggaaggttttcacacctaaagcagagtttgagttttatgatcaatactctcg

SEQ ID NO: 281215 - DNA, 75 bp, Artificial Sequence
  Synthetic
aaggttttcacacctaaagcagagtttgagttttatgatcaatactctcgaaagtaccttgaactgtggactgac

SEQ ID NO: 281216 - DNA, 75 bp, Artificial Sequence
  Synthetic
ttccaagagggagagacaatctattagtatacttagtgagaaagttaaacgatccaagtattgttacagcaatga

SEQ ID NO: 281217 - DNA, 75 bp, Artificial Sequence
  Synthetic
agtatacttagtgagaaagttaaacgatccaagtattgttacagcaatgacaatgcagtcaccattacaacttag

SEQ ID NO: 281218 - DNA, 75 bp, Artificial Sequence
  Synthetic
atgaaagtctgtaagctgaatggtgattgggtgacatttagggaagtgttggcagctgcagattcatttgcatct

SEQ ID NO: 281219 - DNA, 75 bp, Artificial Sequence
  Synthetic
attgggtgacatttagggaagtgttggcagctgcagattcatttgcatctgattacaagccaacagcacaggata

SEQ ID NO: 281220 - DNA, 75 bp, Artificial Sequence
  Synthetic
ttgtaccttttctaaggagtatgcatggagggactttttgaatgaagtacaatgtgacgtactaaccacaagaca

SEQ ID NO: 281221 - DNA, 75 bp, Artificial Sequence
  Synthetic
tggagggactttttgaatgaagtacaatgtgacgtactaaccacaagacaggttcataggcctaagattgcaaga

SEQ ID NO: 281222 - DNA, 75 bp, Artificial Sequence
  Synthetic
aatctatacaaaacccgatcacagctgttattggttataagtatgcaaataaagttgacgagataagtgatgtgt

SEQ ID NO: 281223 - DNA, 75 bp, Artificial Sequence
  Synthetic
tgttattggttataagtatgcaaataaagttgacgagataagtgatgtgttagatagtgcagttcaccctgattc

SEQ ID NO: 281224 - DNA, 75 bp, Artificial Sequence
  Synthetic
agagaaggggtgtatagagaactaggcctagatataagcttaccaaatgtattgaagagagttgcacccctttta

SEQ ID NO: 281225 - DNA, 75 bp, Artificial Sequence
  Synthetic
gcctagatataagcttaccaaatgtattgaagagagttgcaccccttttatataagtccggaaaatcacgagtag

SEQ ID NO: 281226 - DNA, 75 bp, Artificial Sequence
  Synthetic
gactgcagaatctatttgtagttactggttaaaaaccatgtccttggttaaaaccataaaggtcaaacccaagaa

SEQ ID NO: 281227 - DNA, 75 bp, Artificial Sequence
  Synthetic
tggttaaaaaccatgtccttggttaaaaccataaaggtcaaacccaagaaagaagtattaaaagcagtgtctctg

SEQ ID NO: 281228 - DNA, 75 bp, Artificial Sequence
  Synthetic
acttaactcacttggcagccatgcgattgtgtatagaggtctggagatggtgcaaggctaatgaacaggatgcta

SEQ ID NO: 281229 - DNA, 75 bp, Artificial Sequence
  Synthetic
attgtgtatagaggtctggagatggtgcaaggctaatgaacaggatgctactgcatggctcaagtgtttgatgtt

SEQ ID NO: 281230 - DNA, 75 bp, Artificial Sequence
  Synthetic
attgatttcttctgttcacgaggagtattgcctgtggaccctgaaatacagtgtttgggcttgttgatttttgat

SEQ ID NO: 281231 - DNA, 75 bp, Artificial Sequence
  Synthetic
tattgcctgtggaccctgaaatacagtgtttgggcttgttgatttttgatctaaagggacaaaaggggctgttac

SEQ ID NO: 281232 - DNA, 75 bp, Artificial Sequence
  Synthetic
ttcaggtaaacaatatgatgcatattgtagtcaggtatataacgaagaaacaaaattgtatgaaggtgaccttag

SEQ ID NO: 281233 - DNA, 75 bp, Artificial Sequence
  Synthetic
tgtagtcaggtatataacgaagaaacaaaattgtatgaaggtgaccttagagtaacttttaattttgggatagac

SEQ ID NO: 281234 - DNA, 75 bp, Artificial Sequence
  Synthetic
aaaagagggaatatatcctggaaacatccattactcaaagaaatgttctaaagatcttgatggaagaagtaacaa

SEQ ID NO: 281235 - DNA, 75 bp, Artificial Sequence
  Synthetic
atccattactcaaagaaatgttctaaagatcttgatggaagaagtaacaaaggaattgttaaggtgtggaatgag

SEQ ID NO: 281236 - DNA, 75 bp, Artificial Sequence
  Synthetic
tctcgcagtgtagtgttattcaagactgaaagtggttttgaatggggaaagccaaatgtaccctgtatagtttat

SEQ ID NO: 281237 - DNA, 75 bp, Artificial Sequence
  Synthetic
ctgaaagtggttttgaatggggaaagccaaatgtaccctgtatagtttatagaaactgtgctctacggactggtt

SEQ ID NO: 281238 - DNA, 75 bp, Artificial Sequence
  Synthetic
agcctttatgataactgtgcaagctggtgggtttagagctatggcacagttggatgaagagaacccaaggttcct

SEQ ID NO: 281239 - DNA, 75 bp, Artificial Sequence
  Synthetic
ggtgggtttagagctatggcacagttggatgaagagaacccaaggttccttttagcacatgcataccataatttg

SEQ ID NO: 281240 - DNA, 75 bp, Artificial Sequence
  Synthetic
aagcagtaggtaacatctggtttaaaatgacccagcataagctatttataaatcccattatctcagcagggttgc

SEQ ID NO: 281241 - DNA, 75 bp, Artificial Sequence
  Synthetic
aatgacccagcataagctatttataaatcccattatctcagcagggttgctagaaaatttcatgaaaggcctgcc

SEQ ID NO: 281242 - DNA, 75 bp, Artificial Sequence
  Synthetic
tctttaataatgaataaagccaaaatatctgtagatttattcatgtttaatgaacttttagccttgattgacccg

SEQ ID NO: 281243 - DNA, 75 bp, Artificial Sequence
  Synthetic
tatctgtagatttattcatgtttaatgaacttttagccttgattgacccgaaaaatgttttgaatctggatggta

SEQ ID NO: 281244 - DNA, 75 bp, Artificial Sequence
  Synthetic
aacagtgagttctatttcaagtactcagtggtctgaggaggttagtttcaccttagatgatagtgatgatgatga

SEQ ID NO: 281245 - DNA, 75 bp, Artificial Sequence
  Synthetic
cagtggtctgaggaggttagtttcaccttagatgatagtgatgatgatgaatcgcagcctgattatactattgat

SEQ ID NO: 281246 - DNA, 75 bp, Artificial Sequence
  Synthetic
ttgaccttaaagaagacattgagcatttcctccaggatgagtcggcatatactggagatttactgatccaaactg

SEQ ID NO: 281247 - DNA, 75 bp, Artificial Sequence
  Synthetic
tttcctccaggatgagtcggcatatactggagatttactgatccaaactgaagagacagagataaaaaaattgcg

SEQ ID NO: 281248 - DNA, 75 bp, Artificial Sequence
  Synthetic
gtcaaactgattaaaagctgggtgtccaaaggtctttctattgacaagatttataacccagtcaatatcatttta

SEQ ID NO: 281249 - DNA, 75 bp, Artificial Sequence
  Synthetic
ccaaaggtctttctattgacaagatttataacccagtcaatatcattttaatggctcgttatatgtctaaacatt

SEQ ID NO: 281250 - DNA, 75 bp, Artificial Sequence
  Synthetic
tctcatggacccttatgatcttacagagtttgaaagtgtggttaaaggatggggagagtgtgtaaaggatcagtt

SEQ ID NO: 281251 - DNA, 75 bp, Artificial Sequence
  Synthetic
gagtttgaaagtgtggttaaaggatggggagagtgtgtaaaggatcagtttattgaatatgacagagaagctcaa

SEQ ID NO: 281252 - DNA, 75 bp, Artificial Sequence
  Synthetic
taccagaggatgttctgcctgattcattgttctcttttagacatgctgatatcttattgaaaagattattcccaa

SEQ ID NO: 281253 - DNA, 75 bp, Artificial Sequence
  Synthetic
atcttattgaaaagattattcccaaaggactcagcctcatctttctattaacaagtagttttttctatcgctctt

SEQ ID NO: 281254 - DNA, 75 bp, Artificial Sequence
  Synthetic
tagtagtagactccgcaagaagaagcaaacacagataaatatgggaaaaataagtccagtttatctgtatctgct

SEQ ID NO: 281255 - DNA, 75 bp, Artificial Sequence
  Synthetic
caaacacagataaatatgggaaaaataagtccagtttatctgtatctgctttttcagggcctactactatggagg

SEQ ID NO: 281256 - DNA, 75 bp, Artificial Sequence
  Synthetic
taagtccagtttatctgtatctgctttttcagggcctactactatggagggacggattagccagaaatcttaatg

SEQ ID NO: 281257 - DNA, 75 bp, Artificial Sequence
  Synthetic
aatcggattagggcaaggacttgtaattggctcagttgaactcccaccagtgccattacgtcaagtggagtcact

SEQ ID NO: 281258 - DNA, 75 bp, Artificial Sequence
  Synthetic
attggctcagttgaactcccaccagtgccattacgtcaagtggagtcactaaagcttgagagctcctgtaacttt

SEQ ID NO: 281259 - DNA, 75 bp, Artificial Sequence
  Synthetic
agcagtcatttacaaagtggatatgggagtcaaaaaatgatttaactgatagcacacaggcatcttccactagtt

SEQ ID NO: 281260 - DNA, 75 bp, Artificial Sequence
  Synthetic
ggagtcaaaaaatgatttaactgatagcacacaggcatcttccactagttatcagaccaagagtacagaggtaaa

SEQ ID NO: 281261 - DNA, 75 bp, Artificial Sequence
  Synthetic
acacttgtaatcgagactgcagcaaggactagaaagacaattgcctgttttgatctatcatgtaatcaaactgtc

SEQ ID NO: 281262 - DNA, 75 bp, Artificial Sequence
  Synthetic
ggactagaaagacaattgcctgttttgatctatcatgtaatcaaactgtctgtcagccaacagtgtatctgattg

SEQ ID NO: 281263 - DNA, 75 bp, Artificial Sequence
  Synthetic
caaaagttgcttaattggattaggggatcaaagaattcaggtaaactatgaaaagacttattgtgtatcaggtca

SEQ ID NO: 281264 - DNA, 75 bp, Artificial Sequence
  Synthetic
gatcaaagaattcaggtaaactatgaaaagacttattgtgtatcaggtcagcttgtagaaggggtatgctttaat

SEQ ID NO: 281265 - DNA, 75 bp, Artificial Sequence
  Synthetic
agccaagtcacacctatgatgtagtcacaatgatggtcaggtgtttcttggtagtgaagaaagtgacctctggtg

SEQ ID NO: 281266 - DNA, 75 bp, Artificial Sequence
  Synthetic
cacaatgatggtcaggtgtttcttggtagtgaagaaagtgacctctggtgacagcatgaagattgaaaaaaactt

SEQ ID NO: 281267 - DNA, 75 bp, Artificial Sequence
  Synthetic
tgctctaataataattttcaaggctattatgtgtgtcttattgggagtagctctgagccattgtatgtccctaca

SEQ ID NO: 281268 - DNA, 75 bp, Artificial Sequence
  Synthetic
attatgtgtgtcttattgggagtagctctgagccattgtatgtccctacactagatgattacaggtctgctgaaa

SEQ ID NO: 281269 - DNA, 75 bp, Artificial Sequence
  Synthetic
acatggcgaggatcatgacattgagaggaatgcaatcagtgcaatgagaattgtagggaaagttactgggaaagc

SEQ ID NO: 281270 - DNA, 75 bp, Artificial Sequence
  Synthetic
aggaatgcaatcagtgcaatgagaattgtagggaaagttactgggaaagcaccttcttctgagtcatcagataca

SEQ ID NO: 281271 - DNA, 75 bp, Artificial Sequence
  Synthetic
accctttatacacatcaaccggagtactgacatctaaagatgatcctgtgtatgtatgggcccctggtattatca

SEQ ID NO: 281272 - DNA, 75 bp, Artificial Sequence
  Synthetic
actgacatctaaagatgatcctgtgtatgtatgggcccctggtattatcatggaagggaatcattctgtgtgtga

SEQ ID NO: 281273 - DNA, 75 bp, Artificial Sequence
  Synthetic
actggttatataccactaccaggtgagattgaaaaaacaacacaatgtactgttttttgtactttggctgggcct

SEQ ID NO: 281274 - DNA, 75 bp, Artificial Sequence
  Synthetic
agattgaaaaaacaacacaatgtactgttttttgtactttggctgggcctggcgccgattgtgaagcatactcag

SEQ ID NO: 281275 - DNA, 75 bp, Artificial Sequence
  Synthetic
ccctacttgcctgatcaatagggtacaaaggttccgaggggcagaacagcagattaagtttgtgtgtcagagggt

SEQ ID NO: 281276 - DNA, 75 bp, Artificial Sequence
  Synthetic
caaaggttccgaggggcagaacagcagattaagtttgtgtgtcagagggtggacatggatatcactgtttattgc

SEQ ID NO: 281277 - DNA, 75 bp, Artificial Sequence
  Synthetic
caaagactttagttataggacaatgcatttatacctttactagtatcttttcattaatgccaggagttgctcact

SEQ ID NO: 281278 - DNA, 75 bp, Artificial Sequence
  Synthetic
catttatacctttactagtatcttttcattaatgccaggagttgctcactccttagctgttgaactatgtgttcc

SEQ ID NO: 281279 - DNA, 75 bp, Artificial Sequence
  Synthetic
ctattactgcttacattttgctttggctggatccttatacctacaatcacattgattctccttaaaatattgttg

SEQ ID NO: 281280 - DNA, 75 bp, Artificial Sequence
  Synthetic
gctggatccttatacctacaatcacattgattctccttaaaatattgttggcttttgcatatgtatgctcaaaat

SEQ ID NO: 281281 - DNA, 75 bp, Artificial Sequence
  Synthetic
cctcatagagaaagtgaagcaggaataccaaaagacaatgggttccatggtttgtgaagtttgccagcatgaatg

SEQ ID NO: 281282 - DNA, 75 bp, Artificial Sequence
  Synthetic
taccaaaagacaatgggttccatggtttgtgaagtttgccagcatgaatgtgaaactgcaaaagaactagaatca

SEQ ID NO: 281283 - DNA, 75 bp, Artificial Sequence
  Synthetic
cttgtccttattgcctaaaccctgctgaagctaccacgtctgcccttcaagcacacttcaaggtgtgtaaattaa

SEQ ID NO: 281284 - DNA, 75 bp, Artificial Sequence
  Synthetic
tgaagctaccacgtctgcccttcaagcacacttcaaggtgtgtaaattaacatctaggtttcaggaaaatttacg

SEQ ID NO: 281285 - DNA, 75 bp, Artificial Sequence
  Synthetic
aagcagggctgctataggacattgtcccttttccgttataggagcaggtgttttgtagggctgatctggtgtatc

SEQ ID NO: 281286 - DNA, 75 bp, Artificial Sequence
  Synthetic
cccttttccgttataggagcaggtgttttgtagggctgatctggtgtatcctcttaacactggaactaatcgtgt

SEQ ID NO: 281287 - DNA, 75 bp, Artificial Sequence
  Synthetic
tttaaatccaggatggacagatactgcccatggctctggaatagttccaatgaaaactgacttggaattagattt

SEQ ID NO: 281288 - DNA, 75 bp, Artificial Sequence
  Synthetic
gcccatggctctggaatagttccaatgaaaactgacttggaattagatttttctttaccatcttcagcaagttat

SEQ ID NO: 281289 - DNA, 75 bp, Artificial Sequence
  Synthetic
cagcaaatgaacaagagcaagtaccattccatctacagattgagaaacaggtaatccatgctgaaattcaacatt

SEQ ID NO: 281290 - DNA, 75 bp, Artificial Sequence
  Synthetic
attccatctacagattgagaaacaggtaatccatgctgaaattcaacatttaggtcactggatggatgcaacctt

SEQ ID NO: 281291 - DNA, 75 bp, Artificial Sequence
  Synthetic
tatggtgcatgtgagaagtatgcatacccatggcagacagctggttgttttgtggaaaaagattttgaatttgaa

SEQ ID NO: 281292 - DNA, 75 bp, Artificial Sequence
  Synthetic
acccatggcagacagctggttgttttgtggaaaaagattttgaatttgaaaatggatggggttgtaaccctcctg

SEQ ID NO: 281293 - DNA, 75 bp, Artificial Sequence
  Synthetic
tacagcatgcggggcttacttagataaattgaaatcagtcggaaaagtatttaaaattgtgtcacttcgttacac

SEQ ID NO: 281294 - DNA, 75 bp, Artificial Sequence
  Synthetic
aaattgaaatcagtcggaaaagtatttaaaattgtgtcacttcgttacacaaggaaagcatgcatacagttaggt

SEQ ID NO: 281295 - DNA, 75 bp, Artificial Sequence
  Synthetic
acagcaatgattgtttggtcactacatctgttaaagtatgccttatagggacaatatcaaagtttcaaccctctg

SEQ ID NO: 281296 - DNA, 75 bp, Artificial Sequence
  Synthetic
atctgttaaagtatgccttatagggacaatatcaaagtttcaaccctctgacacacttctcttcttaggtccttt

SEQ ID NO: 281297 - DNA, 75 bp, Artificial Sequence
  Synthetic
caatggtgcacaactacatgtcagtttggagatcctggagatattatgagcacaccgattggtatgaagtgccct

SEQ ID NO: 281298 - DNA, 75 bp, Artificial Sequence
  Synthetic
ttggagatcctggagatattatgagcacaccgattggtatgaagtgccctgaactgaatggatcttttaggaaaa

SEQ ID NO: 281299 - DNA, 75 bp, Artificial Sequence
  Synthetic
ttgccagtttgatggaaatactatttcaggatataagcggatgatagccacaaaagattcatttcaatcattcaa

SEQ ID NO: 281300 - DNA, 75 bp, Artificial Sequence
  Synthetic
tcaggatataagcggatgatagccacaaaagattcatttcaatcattcaatgttacagaaccacatatttctgcc

SEQ ID NO: 281301 - DNA, 75 bp, Artificial Sequence
  Synthetic
atagttcattgagagaccatattaacgtagttgttgggagagacctcccgtttcaagatctgagtgaaaccccat

SEQ ID NO: 281302 - DNA, 75 bp, Artificial Sequence
  Synthetic
cgtagttgttgggagagacctcccgtttcaagatctgagtgaaaccccatgtcaaattgacttgtccacatcttc

SEQ ID NO: 281303 - DNA, 75 bp, Artificial Sequence
  Synthetic
gtgggattcaaccttgtttgttcagtaagcctaacagagtgttttacatttttgaattcgataaaggcatgtgac

SEQ ID NO: 281304 - DNA, 75 bp, Artificial Sequence
  Synthetic
taagcctaacagagtgttttacatttttgaattcgataaaggcatgtgacactgccatgtgttacggatcaacca

SEQ ID NO: 281305 - DNA, 75 bp, Artificial Sequence
  Synthetic
tacagtccatgtggtaggtaagggtggacactcaggctccaagttcatgtgctgtcacgatacaaagtgctcaaa

SEQ ID NO: 281306 - DNA, 75 bp, Artificial Sequence
  Synthetic
ggacactcaggctccaagttcatgtgctgtcacgatacaaagtgctcaaacactggcttactggcagcagcacca

SEQ ID NO: 281307 - DNA, 75 bp, Artificial Sequence
  Synthetic
atcaggcagatagtgataaggtctttgatgatggagcaccagagtgtggtatgacctgttggtttaaaaaatctg

SEQ ID NO: 281308 - DNA, 75 bp, Artificial Sequence
  Synthetic
tgatgatggagcaccagagtgtggtatgacctgttggtttaaaaaatctggtgaatggatcatgggtgttctcag

SEQ ID NO: 281309 - DNA, 75 bp, Artificial Sequence
  Synthetic
ttgatcacattgcttgtattgtctatttttctgtttgccctatgctgccccagacgtgctgcatataagaaggag

SEQ ID NO: 281310 - DNA, 75 bp, Artificial Sequence
  Synthetic
tttttctgtttgccctatgctgccccagacgtgctgcatataagaaggagcataagccctaactttcatgccatt

SEQ ID NO: 281311 - DNA, 75 bp, Artificial Sequence
  Synthetic
atatatagttactaacttaactatatcatataatcccccatatatagaaaaaaaactaacactttactaatgatt

SEQ ID NO: 281312 - DNA, 75 bp, Artificial Sequence
  Synthetic
aaaaactaacactttactaatgattaattcacataccggtcatgcctggacttttgttcctgcggagtctactac

SEQ ID NO: 281313 - DNA, 75 bp, Artificial Sequence
  Synthetic
gcacaggcactcattgatcagaaagtaaaggaaatatccaatcaagagcccctaaaaatataaataaccattaat

SEQ ID NO: 281314 - DNA, 75 bp, Artificial Sequence
  Synthetic
tttctcaacttctacctcagtgtacttatatatatgcaagtagcatatatataggtacacaatttactacctcaa

SEQ ID NO: 281315 - DNA, 75 bp, Artificial Sequence
  Synthetic
gatgacgttaataaaaacacactgcaagccaggcaacagacagtgtcagcactggaggataaactcgcagactac

SEQ ID NO: 281316 - DNA, 75 bp, Artificial Sequence
  Synthetic
aagagaaggatggcagatgctgtgtcccggaaaaaaatggatactaaacctactgacccgactgggattgaacct

SEQ ID NO: 281317 - DNA, 75 bp, Artificial Sequence
  Synthetic
gccttaggtatggaaatgtccttgatgtgaatgcaattgatattgaggaaccaagtggccaaacagcagactggt

SEQ ID NO: 281318 - DNA, 75 bp, Artificial Sequence
  Synthetic
atacgattggagtttatgtaataggattcacacttcccattatccttaaagccttatacatgctttcaacacgtg

SEQ ID NO: 281319 - DNA, 75 bp, Artificial Sequence
  Synthetic
caggtagatttcgtacaatagtatgtggtctatttccaactcagattcaagtccgtaacatcatgagtccagtaa

SEQ ID NO: 281320 - DNA, 75 bp, Artificial Sequence
  Synthetic
tgtaaaggattggtcagagagaatcagagagttcatggaaaaagagtgcccattcataaagccggaggttaagcc

SEQ ID NO: 281321 - DNA, 75 bp, Artificial Sequence
  Synthetic
agagagttcatggaaaaagagtgcccattcataaagccggaggttaagccaggtaccccagcacaagaggttgag

SEQ ID NO: 281322 - DNA, 75 bp, Artificial Sequence
  Synthetic
caaaaatcatgtggcagacattgataagttaattgactatgcagcctctggagaccccacatcgccagataacat

SEQ ID NO: 281323 - DNA, 75 bp, Artificial Sequence
  Synthetic
tttgcatgtgcaccagaccgatgtccaccaacatgtatctatgttgcagggatggcggagcttggggccttcttt

SEQ ID NO: 281324 - DNA, 75 bp, Artificial Sequence
  Synthetic
caccaacatgtatctatgttgcagggatggcggagcttggggccttcttttcaattttgcaggacatgaggaata

SEQ ID NO: 281325 - DNA, 75 bp, Artificial Sequence
  Synthetic
cacagctgaagagaagttaaagaaaaaatcctccttttaccaatcttacttacgtcggactcaatcaatgggaat

SEQ ID NO: 281326 - DNA, 75 bp, Artificial Sequence
  Synthetic
aaatcctccttttaccaatcttacttacgtcggactcaatcaatgggaattcaacttgaccaaagaattattctc

SEQ ID NO: 281327 - DNA, 75 bp, Artificial Sequence
  Synthetic
agatggtagatcatttccatcttggtgatgacatggacccagagctcagaggtctggcacaggcattgatagatc

SEQ ID NO: 281328 - DNA, 75 bp, Artificial Sequence
  Synthetic
tgatgacatggacccagagctcagaggtctggcacaggcattgatagatcaaaaggtgaaggagatatcaaacca

SEQ ID NO: 281329 - DNA, 75 bp, Artificial Sequence
  Synthetic
aattacatatgcactgattgtgtagtgggttactaacatgcagacaatattatatattcagagatcatatgtgtt

SEQ ID NO: 281330 - DNA, 75 bp, Artificial Sequence
  Synthetic
tgggttactaacatgcagacaatattatatattcagagatcatatgtgttaattgtttactaatcaaattatacg

SEQ ID NO: 281331 - DNA, 75 bp, Artificial Sequence
  Synthetic
cattagttaacaaactaatcggggttaaactggaaatgtagcattataagtacatattagctaaaaacaatcaat

SEQ ID NO: 281332 - DNA, 75 bp, Artificial Sequence
  Synthetic
taaactggaaatgtagcattataagtacatattagctaaaaacaatcaatacagggattactaatggcagttatg

SEQ ID NO: 281333 - DNA, 75 bp, Artificial Sequence
  Synthetic
tcattattcagttagcactatttaggataaggttgtattctattatttaatgggcccaaacatgtgaaactgagc

SEQ ID NO: 281334 - DNA, 75 bp, Artificial Sequence
  Synthetic
gataaggttgtattctattatttaatgggcccaaacatgtgaaactgagctgtcccttttcctcttcatactttt

SEQ ID NO: 281335 - DNA, 75 bp, Artificial Sequence
  Synthetic
aagcgaagaatggcagatgctgtgtccaggaaaaagatggatactaagcctactgacccgactgggattgaacct

SEQ ID NO: 281336 - DNA, 75 bp, Artificial Sequence
  Synthetic
ctttacactcccgattatactgaaggcactctatatgttatcaacacgaggaagacagactgtgaaggaaaataa

SEQ ID NO: 281337 - DNA, 75 bp, Artificial Sequence
  Synthetic
gatacatcatttgaggacattaatggcattaggagaccaaagcatttatatgtatccatgccaacagcccagtcc

SEQ ID NO: 281338 - DNA, 75 bp, Artificial Sequence
  Synthetic
acaatgaaggcagaagagcttactcctggcaggttccggactattgtgtgtggtctcttcccaactcaaattcag

SEQ ID NO: 281339 - DNA, 75 bp, Artificial Sequence
  Synthetic
agaaagtgaaggagatatctaaccaggagcccttgaaaatatgaataactattattgcgctaaaatgtataggca

SEQ ID NO: 281340 - DNA, 75 bp, Artificial Sequence
  Synthetic
ggagcccttgaaaatatgaataactattattgcgctaaaatgtataggcattagaagtactaacatgcagacatg

SEQ ID NO: 281341 - DNA, 75 bp, Artificial Sequence
  Synthetic
catacataatgattggagcaaatactaatgacagttatgaacgtaattactaatacaacattgatataatctata

SEQ ID NO: 281342 - DNA, 75 bp, Artificial Sequence
  Synthetic
tatacaaattaagtttaggagttatatcctcttatttatctagtgggcccaagaatgtgaagctgagctgtccct

SEQ ID NO: 281343 - DNA, 75 bp, Artificial Sequence
  Synthetic
gatgatcacctcaaggagagatcaagccttaggtatggaaatgtcttcgatgtgaatgcaattgatattgaggaa

SEQ ID NO: 281344 - DNA, 75 bp, Artificial Sequence
  Synthetic
tacgggtttataattacaattatcagggtcattaattaacaaactaatcagggttaaataggaaatgtagcatta

SEQ ID NO: 281345 - DNA, 75 bp, Artificial Sequence
  Synthetic
tataggataaggttgtattttattatttaatgggcccgaacatgtgaaactgagctgtcttttttccttttcacc

SEQ ID NO: 281346 - DNA, 75 bp, Artificial Sequence
  Synthetic
tagtagtagactccttgaaaagctactacgaaaaagactggaatgagtgacttaaaagatatacaggaggacata

SEQ ID NO: 281347 - DNA, 75 bp, Artificial Sequence
  Synthetic
ctacgaaaaagactggaatgagtgacttaaaagatatacaggaggacatagcccgccatgagcaacaacttgttg

SEQ ID NO: 281348 - DNA, 75 bp, Artificial Sequence
  Synthetic
agaaaaggcagtggagatggacccagatgacgttaacaataacacactgcaagcaaggcaacaaacagtgtcagc

SEQ ID NO: 281349 - DNA, 75 bp, Artificial Sequence
  Synthetic
gatgacgttaacaataacacactgcaagcaaggcaacaaacagtgtcagcattggaggataaaattgcagacttc

SEQ ID NO: 281350 - DNA, 75 bp, Artificial Sequence
  Synthetic
cccggaaaaagatggatactaagcctgctgacccgactgggattgagcctgatgaccacctcaaggagagatcaa

SEQ ID NO: 281351 - DNA, 75 bp, Artificial Sequence
  Synthetic
tgctgacccgactgggattgagcctgatgaccacctcaaggagagatcaagtcttcgatatggaaatgtccttga

SEQ ID NO: 281352 - DNA, 75 bp, Artificial Sequence
  Synthetic
ccaagtggtcagacagcagactggtatactattggggtatacataattggatttacactgcctataatactcaaa

SEQ ID NO: 281353 - DNA, 75 bp, Artificial Sequence
  Synthetic
atactattggggtatacataattggatttacactgcctataatactcaaagccctgtacatgctgtcaacgaggg

SEQ ID NO: 281354 - DNA, 75 bp, Artificial Sequence
  Synthetic
agggacacggatccgtttcaaggatgacacttcttttgaggatgtgaatgggatcagacgaccgaaacatctcta

SEQ ID NO: 281355 - DNA, 75 bp, Artificial Sequence
  Synthetic
gacacttcttttgaggatgtgaatgggatcagacgaccgaaacatctctatgtgtcaatgccaaccgcacagtct

SEQ ID NO: 281356 - DNA, 75 bp, Artificial Sequence
  Synthetic
cagggaggttcagaacaattgtttgcggcctatttcctacacagattcaagtgagaaataccatgagccccgtaa

SEQ ID NO: 281357 - DNA, 75 bp, Artificial Sequence
  Synthetic
cggcctatttcctacacagattcaagtgagaaataccatgagccccgtaatgggagtgatcggattctccttctt

SEQ ID NO: 281358 - DNA, 75 bp, Artificial Sequence
  Synthetic
aaagaatttatggagaaagaatgtccctttataaaacctgaagtcaagcctggaacaccagcaaaggaagttgaa

SEQ ID NO: 281359 - DNA, 75 bp, Artificial Sequence
  Synthetic
cctttataaaacctgaagtcaagcctggaacaccagcaaaggaagttgaaatattaaagaggaataagatctatt

SEQ ID NO: 281360 - DNA, 75 bp, Artificial Sequence
  Synthetic
caagaatcatgtcccagatattgataaactaattgattatgcagcttcaggtgatccgacatccccagagaacat

SEQ ID NO: 281361 - DNA, 75 bp, Artificial Sequence
  Synthetic
aaactaattgattatgcagcttcaggtgatccgacatccccagagaacattgactcaccaaatgcaccatgggtg

SEQ ID NO: 281362 - DNA, 75 bp, Artificial Sequence
  Synthetic
ccccaacttgtatttatgttgcagggatggcagagctaggtgcctttttttcaatcttgcaggatatgagaaata

SEQ ID NO: 281363 - DNA, 75 bp, Artificial Sequence
  Synthetic
gatggcagagctaggtgcctttttttcaatcttgcaggatatgagaaataccatcatggcatcaaagactgtagg

SEQ ID NO: 281364 - DNA, 75 bp, Artificial Sequence
  Synthetic
aaatcatcattttaccaatcttatctgcggcgcacacagtcaatgggaatacagcttgatcaacggataatactg

SEQ ID NO: 281365 - DNA, 75 bp, Artificial Sequence
  Synthetic
tgcggcgcacacagtcaatgggaatacagcttgatcaacggataatactgttgtatatgttggaatggggaaagg

SEQ ID NO: 281366 - DNA, 75 bp, Artificial Sequence
  Synthetic
agatgatatggaccctgagctgaggagtctggcgcaggcattgattgatcagaaggttaaggagatctccaacca

SEQ ID NO: 281367 - DNA, 75 bp, Artificial Sequence
  Synthetic
agtctggcgcaggcattgattgatcagaaggttaaggagatctccaaccaggagcccttaaagatatgaataccc

SEQ ID NO: 281368 - DNA, 75 bp, Artificial Sequence
  Synthetic
gtaataggtagataagttactaacatgcagacataaataaacatgtagaaaagtgggtagagattagtataaaca

SEQ ID NO: 281369 - DNA, 75 bp, Artificial Sequence
  Synthetic
tgcagacataaataaacatgtagaaaagtgggtagagattagtataaacaaatgtagccaatatattatcaggga

SEQ ID NO: 281370 - DNA, 75 bp, Artificial Sequence
  Synthetic
ttaactggaccgtatagcattaccactaatcggacaatactactaatgacagttatgaatgtagaaatttattat

SEQ ID NO: 281371 - DNA, 75 bp, Artificial Sequence
  Synthetic
ctaatcggacaatactactaatgacagttatgaatgtagaaatttattattactgttgcagctattattgaacca

SEQ ID NO: 281372 - DNA, 75 bp, Artificial Sequence
  Synthetic
atgttatgttatttttttgttattctcattagtgggcccgtaaaatgtgaaactgagctgtccttttctttattc

SEQ ID NO: 281373 - DNA, 75 bp, Artificial Sequence
  Synthetic
tcagtgtacttatatatatgcaagtagcatatatataagtacacaaattactacctcaataagctgttttcttga

SEQ ID NO: 281374 - DNA, 75 bp, Artificial Sequence
  Synthetic
agcatatatataagtacacaaattactacctcaataagctgttttcttgattgcttttcaaggagtctactacta

SEQ ID NO: 281375 - DNA, 75 bp, Artificial Sequence
  Synthetic
aaagctgaagaattaacccctggtaggttcaggactatagtctgcggtttatttccaactcagattcaagtacgt

SEQ ID NO: 281376 - DNA, 75 bp, Artificial Sequence
  Synthetic
tcatcggtttttctttctttgtaaaggactgggcagaacgtattagggaatttatggagaaagaatgccctttca

SEQ ID NO: 281377 - DNA, 75 bp, Artificial Sequence
  Synthetic
ggactgggcagaacgtattagggaatttatggagaaagaatgccctttcatcaaaccagaaatgaaaccaggaat

SEQ ID NO: 281378 - DNA, 75 bp, Artificial Sequence
  Synthetic
cttgtatttatgttgcaggaatggcagagttaggtgcttttttctccatattgcaggatatgagaaacaccatca

SEQ ID NO: 281379 - DNA, 75 bp, Artificial Sequence
  Synthetic
tagatcattttcatctgggtgatgacatggacccggaacttagaggccttgcacaagcacttattgaccaaaaag

SEQ ID NO: 281380 - DNA, 75 bp, Artificial Sequence
  Synthetic
catggacccggaacttagaggccttgcacaagcacttattgaccaaaaagtgaaggaaatatctaatcaggagcc

SEQ ID NO: 281381 - DNA, 75 bp, Artificial Sequence
  Synthetic
ttgcactgataatataggcataataagtactaatatgaagatatacatatattcagggatatttagttaatggtt

SEQ ID NO: 281382 - DNA, 75 bp, Artificial Sequence
  Synthetic
agtactaatatgaagatatacatatattcagggatatttagttaatggtttactaatttgggtatttacgggttt

SEQ ID NO: 281383 - DNA, 75 bp, Artificial Sequence
  Synthetic
tattattgtcaggatttactaatcatcaggtaatcagggtttaactggaagtaagatatcatatatatttcaatt

SEQ ID NO: 281384 - DNA, 75 bp, Artificial Sequence
  Synthetic
taatcataggaatctattaatgacaattatgaatgtattgtatgattaagtgctgctttattattgtaaccagca

SEQ ID NO: 281385 - DNA, 75 bp, Artificial Sequence
  Synthetic
tgcagctgctcaaagcagatgtgtcaaagcactagatatgggtgcatgtccacagcttgcacagttgggaatagt

SEQ ID NO: 281386 - DNA, 75 bp, Artificial Sequence
  Synthetic
aacttaaaatggaatgtccgcatacaattggattaggtcaaggtcttgttgtaggctcagtggaactaccacctg

SEQ ID NO: 281387 - DNA, 75 bp, Artificial Sequence
  Synthetic
actttagtggttgaaacagcagcaaggatgcggaagacaatagcatgttatgacttgtcatgcaaccaaacagta

SEQ ID NO: 281388 - DNA, 75 bp, Artificial Sequence
  Synthetic
ttcagaaccattgtatgttcctacactcgatgattaccgatcagctgaggttttatcacgaatggcttttgcacc

SEQ ID NO: 281389 - DNA, 75 bp, Artificial Sequence
  Synthetic
ttttatcacgaatggcttttgcaccacatggagaagatcatgatatagaaaagaatgcaatcagtgctttgcgta

SEQ ID NO: 281390 - DNA, 75 bp, Artificial Sequence
  Synthetic
acctacttgcctgataaaccgtgtccaaagattccgtggtgcagaacaacaaataaagtttgtctgtcaaagagt

SEQ ID NO: 281391 - DNA, 75 bp, Artificial Sequence
  Synthetic
tcaggttataagcggatgattgcaacaaaagattctttccaatcatttaatgtaacagaaccacacatttctaca

SEQ ID NO: 281392 - DNA, 75 bp, Artificial Sequence
  Synthetic
atagttcacttcgggatcacatcaatgtgatcgtaagccgtgatttatcattccaggatttaagtgaaacacctt

SEQ ID NO: 281393 - DNA, 75 bp, Artificial Sequence
  Synthetic
ttagtttaacagaatgctctacatttctaacctcaattaaagcatgtgatgctgctatgtgttatggttctacta

SEQ ID NO: 281394 - DNA, 75 bp, Artificial Sequence
  Synthetic
atcaggcagatagtgataagatctttgatgatggtgctccagagtgtggtgtgtcttgttggtttaaaaaatcag

SEQ ID NO: 281395 - DNA, 75 bp, Artificial Sequence
  Synthetic
tgggaattggatggtagtggctgtattgatagcattactgatattgtctatcttcttatttgcactgtgttgccc

SEQ ID NO: 281396 - DNA, 75 bp, Artificial Sequence
  Synthetic
cacaaaccttaaataacaattactaatctagatgctatattctatttaccagtataatcaccatatgactatcta

SEQ ID NO: 281397 - DNA, 75 bp, Artificial Sequence
  Synthetic
ggggacacgtataaggtttaaggatgatacatcatttgaagacatcaatggcataagaagaccaaagcatttata

SEQ ID NO: 281398 - DNA, 75 bp, Artificial Sequence
  Synthetic
tttgcatgtgcaccagaccgatgtccaccaacatgtatctatgttgcagggatggcagagcttggggcctttttt

SEQ ID NO: 281399 - DNA, 75 bp, Artificial Sequence
  Synthetic
agaaggtaaaagagatatcaaaccaagagcccttaaagatatgattaactcaagtttattactaattgtaggtat

SEQ ID NO: 281400 - DNA, 75 bp, Artificial Sequence
  Synthetic
gctatatgcagttaggcatgatgttgtggatcagatgataaagcatgattggtctgacaataaagataaagaaca

SEQ ID NO: 281401 - DNA, 75 bp, Artificial Sequence
  Synthetic
aaagtatggaaaaaagaattattccggggagtccaagtggccaaattcttagatcattctttaagatgacacctg

SEQ ID NO: 281402 - DNA, 75 bp, Artificial Sequence
  Synthetic
aatagagtttattgaggtaacagtaactgctgatgtggcaagaggtgttagggaaaaaatattaaaatatcaagg

SEQ ID NO: 281403 - DNA, 75 bp, Artificial Sequence
  Synthetic
gggaaaaaatattaaaatatcaaggaggcttagaattcattgagcagctattgcaggtagaagcacaaaaaggta

SEQ ID NO: 281404 - DNA, 75 bp, Artificial Sequence
  Synthetic
atttgataaaaaatgacgagagaggtgcacttgaagcaatgttcaatttaaaatttcatgttacaggtcccaaag

SEQ ID NO: 281405 - DNA, 75 bp, Artificial Sequence
  Synthetic
tgcacttgaagcaatgttcaatttaaaatttcatgttacaggtcccaaagtgcgaacatttgatattccgaatta

SEQ ID NO: 281406 - DNA, 75 bp, Artificial Sequence
  Synthetic
gtgttagaaaatctagtggattattgtaagaattggcttggaactgatcatgcttttgcattcaaagaagtaact

SEQ ID NO: 281407 - DNA, 75 bp, Artificial Sequence
  Synthetic
tgcttttgcattcaaagaagtaactggacaacgtgttttcaatgtgtttagagatgaagaagagctacatgcatc

SEQ ID NO: 281408 - DNA, 75 bp, Artificial Sequence
  Synthetic
gcaattgttagccagggatatggcttacaaatatattacactagataatgaagatatcatcaactattataatcc

SEQ ID NO: 281409 - DNA, 75 bp, Artificial Sequence
  Synthetic
tacaaatatattacactagataatgaagatatcatcaactattataatccgagggtctacttcaaacccacacaa

SEQ ID NO: 281410 - DNA, 75 bp, Artificial Sequence
  Synthetic
agttaaatttatctaatatggatcctaagtcaaaggcattgattgatgttatctcaaaagattcaaaaaaaggag

SEQ ID NO: 281411 - DNA, 75 bp, Artificial Sequence
  Synthetic
taagtcaaaggcattgattgatgttatctcaaaagattcaaaaaaaggagtttttggcgaattaattgatagtat

SEQ ID NO: 281412 - DNA, 75 bp, Artificial Sequence
  Synthetic
aatgaatgtgcaaaaactattgaaaagatcctttctgaccttgaagttaatataggtgattctactgctggaata

SEQ ID NO: 281413 - DNA, 75 bp, Artificial Sequence
  Synthetic
tataggtgattctactgctggaatagaacaaccaaaaagaactactggagtagatgatatcttgaggaagtttta

SEQ ID NO: 281414 - DNA, 75 bp, Artificial Sequence
  Synthetic
ttgaatcgattgttggcattaaatattgcatttgaaaaatcccttcttgctacagctacatggttccaatattac

SEQ ID NO: 281415 - DNA, 75 bp, Artificial Sequence
  Synthetic
ttcagcatgcattgcgatctgtctttgcattccattttctcctctccacatctcaaaagatgaagctatgtgcca

SEQ ID NO: 281416 - DNA, 75 bp, Artificial Sequence
  Synthetic
tgcattccattttctcctctccacatctcaaaagatgaagctatgtgccatatttgataatctacgttatcttat

SEQ ID NO: 281417 - DNA, 75 bp, Artificial Sequence
  Synthetic
ggctttgaaccattaattagaaagttttttgaacgacctttcaaaagtgcattggaggtatacttgtataatatt

SEQ ID NO: 281418 - DNA, 75 bp, Artificial Sequence
  Synthetic
tttttgaacgacctttcaaaagtgcattggaggtatacttgtataatattataaagacactattagtcagtttag

SEQ ID NO: 281419 - DNA, 75 bp, Artificial Sequence
  Synthetic
ttcgagagtcagactcttagggttaactgttgatcaatcaacaattggggcaagtggagtttatccttcattaat

SEQ ID NO: 281420 - DNA, 75 bp, Artificial Sequence
  Synthetic
actgttgatcaatcaacaattggggcaagtggagtttatccttcattaatgtcacgggttgtgtacaaacattac

SEQ ID NO: 281421 - DNA, 75 bp, Artificial Sequence
  Synthetic
tgaacagcaacttttttgtcaagaagttgttgaattagctgcacaagaactaaatacttacttgcatgcaaagtc

SEQ ID NO: 281422 - DNA, 75 bp, Artificial Sequence
  Synthetic
tttaaatcattcacaaaacaaccctacagtattagaactttacgaacagacaaaaaaacaaagggcacaagcaag

SEQ ID NO: 281423 - DNA, 75 bp, Artificial Sequence
  Synthetic
ttagaaaaggcactgaggtgggcttcaggagaaagtgaaatccagtcctcactaggtcattctataaaattgaag

SEQ ID NO: 281424 - DNA, 75 bp, Artificial Sequence
  Synthetic
caggagaaagtgaaatccagtcctcactaggtcattctataaaattgaagaggaaattgatgtatgtgagtgcag

SEQ ID NO: 281425 - DNA, 75 bp, Artificial Sequence
  Synthetic
gaaactgacttttttatatccagaaaactgcataggtatattgataatatgggtgagttgtctgatgaagtccta

SEQ ID NO: 281426 - DNA, 75 bp, Artificial Sequence
  Synthetic
aagtatctgcttccataaaaggtaattggctgcaaggtaatttaaataaatgttcttcattatttggggcagcag

SEQ ID NO: 281427 - DNA, 75 bp, Artificial Sequence
  Synthetic
ttggctgcaaggtaatttaaataaatgttcttcattatttggggcagcagtatcgttattgtttaaacgtgtgtg

SEQ ID NO: 281428 - DNA, 75 bp, Artificial Sequence
  Synthetic
aacatattttattaatgggttctataaagatatcacctaaaaagacaacagtatcccctacaaatgcagaatttt

SEQ ID NO: 281429 - DNA, 75 bp, Artificial Sequence
  Synthetic
attatgtacgagtaaggttgaaagattatatggtactgctcctggtatggtcaataatcctactgcatacttaaa

SEQ ID NO: 281430 - DNA, 75 bp, Artificial Sequence
  Synthetic
caatcatggagcttgccacagcaggtatagggatggcagataaaaatatattaaaaaatgcattcataacttaca

SEQ ID NO: 281431 - DNA, 75 bp, Artificial Sequence
  Synthetic
atatgtgctaggattgtttaagtttttgatgtcattatcagatgatatatttcagcatgatcgtttaggagaatt

SEQ ID NO: 281432 - DNA, 75 bp, Artificial Sequence
  Synthetic
aaagtattcacccccaaaagtgagttcgaattttatgaccaatattcaagaaagtatctcgagctttggagtgaa

SEQ ID NO: 281433 - DNA, 75 bp, Artificial Sequence
  Synthetic
caatgcaatcaccactccaattgaggtttcgaatgcaggcaaagcaacatatgaaagtatgtaagttagatgggg

SEQ ID NO: 281434 - DNA, 75 bp, Artificial Sequence
  Synthetic
aaagtagatgaaatcagcgatgttttggacagtgctattcatccagactcgttgtccactgatttacagcttatg

SEQ ID NO: 281435 - DNA, 75 bp, Artificial Sequence
  Synthetic
gttaaagaaagttgcaccattgttgtataagtctggaaagtcaaggattgtaattgtgcaagggaatgtagaggg

SEQ ID NO: 281436 - DNA, 75 bp, Artificial Sequence
  Synthetic
attatgcattgaagtttggagatggtgcaaagccaatgagcaagattctgtggcttggttaaagtatctaatgtt

SEQ ID NO: 281437 - DNA, 75 bp, Artificial Sequence
  Synthetic
ttttacctgtggatcctgagatccaatgtttaggtcttcttgtgtatgatctcaaaggacaaaagggtttattac

SEQ ID NO: 281438 - DNA, 75 bp, Artificial Sequence
  Synthetic
ttcagggaagcaatatgatgcctactgtgtgcaaacctataatgaagagacaaaactttatgaaggagatttgag

SEQ ID NO: 281439 - DNA, 75 bp, Artificial Sequence
  Synthetic
tgtgcaagattagaaatcttttgggataaaagagaatatattttggaaacatccataacccaacgaaatgtatta

SEQ ID NO: 281440 - DNA, 75 bp, Artificial Sequence
  Synthetic
aggcagttggaaatgtgtggtttaaaatgactcaacataaactgttcataaatccaataatatccgctgggctac

SEQ ID NO: 281441 - DNA, 75 bp, Artificial Sequence
  Synthetic
tctttaattatgaacaaggcaaaaatatctgttgatttattcatgtttaatgagctgttagctttaattaaccca

SEQ ID NO: 281442 - DNA, 75 bp, Artificial Sequence
  Synthetic
caatggatgatagtgatgatgatgataatgcctcacagcttgattacactattgaccttgatgatatagattttg

SEQ ID NO: 281443 - DNA, 75 bp, Artificial Sequence
  Synthetic
aaggttggggagaatgtgttaaagatcggtttattgagcttgaccaggaagcccagcggaaggtcactgaagaaa

SEQ ID NO: 281444 - DNA, 75 bp, Artificial Sequence
  Synthetic
ttcccagggactcagcctcttccttttattaacagattatacttcttatcgctcttttctcggagcatactacta

SEQ ID NO: 281445 - DNA, 75 bp, Artificial Sequence
  Synthetic
acagggactgccagaaacctaaatgagcttaaaatggaatgtccacatactattgggttaggtcaaggccttgtt

SEQ ID NO: 281446 - DNA, 75 bp, Artificial Sequence
  Synthetic
aatacacaggcatcatcaacaagtttccaaacaaagagtagtgaggtaaacttaaggggactatgtctgattcca

SEQ ID NO: 281447 - DNA, 75 bp, Artificial Sequence
  Synthetic
tccaaacaaagagtagtgaggtaaacttaaggggactatgtctgattccaactctagttattgagacagcagcaa

SEQ ID NO: 281448 - DNA, 75 bp, Artificial Sequence
  Synthetic
tgatctatcatgtaatcaaacagtgtgccagcctactgtgtatcttatgggacccatccaaacttgcataacaac

SEQ ID NO: 281449 - DNA, 75 bp, Artificial Sequence
  Synthetic
tgccagcctactgtgtatcttatgggacccatccaaacttgcataacaactaagagttgccttttgggcctaggc

SEQ ID NO: 281450 - DNA, 75 bp, Artificial Sequence
  Synthetic
aaaagacatactgtgtttcagggcagttggttgaaggtgtctgttttaatccaatacatacaatggctctttctc

SEQ ID NO: 281451 - DNA, 75 bp, Artificial Sequence
  Synthetic
gttggttgaaggtgtctgttttaatccaatacatacaatggctctttctcagccaagccatacttatgatatagt

SEQ ID NO: 281452 - DNA, 75 bp, Artificial Sequence
  Synthetic
gttataaaaaaggtgacatctggtgatagtatgaagattgaaaagaattttgagactcttgtccagaaaaacggc

SEQ ID NO: 281453 - DNA, 75 bp, Artificial Sequence
  Synthetic
tgagactcttgtccagaaaaacggctgtacagctaatagttttcaaggttattacatctgtcttatcgggagtag

SEQ ID NO: 281454 - DNA, 75 bp, Artificial Sequence
  Synthetic
tcatggggaagatcatgatgttgaaaaaaatgcaataagtgccttacgtattgctggaaaagtaacagggaaagc

SEQ ID NO: 281455 - DNA, 75 bp, Artificial Sequence
  Synthetic
gtacagggtattgcattttcgggtagccctctttatacatctactggggttttaacagcaaaggatgatcctgtg

SEQ ID NO: 281456 - DNA, 75 bp, Artificial Sequence
  Synthetic
gccctctttatacatctactggggttttaacagcaaaggatgatcctgtgtacatttgggccccaggcataatca

SEQ ID NO: 281457 - DNA, 75 bp, Artificial Sequence
  Synthetic
gaaaaagaccttaccccttacatggactgggtttatctcactacctggcgaaattgaaaagacaacacaatgtac

SEQ ID NO: 281458 - DNA, 75 bp, Artificial Sequence
  Synthetic
actgggtttatctcactacctggcgaaattgaaaagacaacacaatgtacagttttctgcaccctggctggacca

SEQ ID NO: 281459 - DNA, 75 bp, Artificial Sequence
  Synthetic
aaacaggtatttttaatataagctcaccaacatgcttgattaatcgtgtacagaggttccgtggtgcagagcaac

SEQ ID NO: 281460 - DNA, 75 bp, Artificial Sequence
  Synthetic
accaacatgcttgattaatcgtgtacagaggttccgtggtgcagagcaacaaataaaatttgtttgtcagagggt

SEQ ID NO: 281461 - DNA, 75 bp, Artificial Sequence
  Synthetic
aatggagttaagaaagtcattctcaccaaaaccttagttattggacagtgtatttacacatttactagtatattc

SEQ ID NO: 281462 - DNA, 75 bp, Artificial Sequence
  Synthetic
ccaaaaccttagttattggacagtgtatttacacatttactagtatattctctttaattccaggtgttgcacatt

SEQ ID NO: 281463 - DNA, 75 bp, Artificial Sequence
  Synthetic
aggtcttcatggttgggcaaccatgttattattgctaacattttgctttggctgggttctaataccaaccattac

SEQ ID NO: 281464 - DNA, 75 bp, Artificial Sequence
  Synthetic
ttattattgctaacattttgctttggctgggttctaataccaaccattacaatgatattgctgaaaatattaatc

SEQ ID NO: 281465 - DNA, 75 bp, Artificial Sequence
  Synthetic
ataatacagattcaaaattcaggatcttgattgaaaaagtgaaaagagaatatcaaaaaacaatgggctcgatgg

SEQ ID NO: 281466 - DNA, 75 bp, Artificial Sequence
  Synthetic
cttgattgaaaaagtgaaaagagaatatcaaaaaacaatgggctcgatggtctgtgaggtatgtcaatatgagtg

SEQ ID NO: 281467 - DNA, 75 bp, Artificial Sequence
  Synthetic
cacaagaaaagctgttcaattggttcgtgtccctattgtcttaacccgtctgaggcaacaacatctgcccttcaa

SEQ ID NO: 281468 - DNA, 75 bp, Artificial Sequence
  Synthetic
cgtgtccctattgtcttaacccgtctgaggcaacaacatctgcccttcaagcccattttaaagtctgtaaactca

SEQ ID NO: 281469 - DNA, 75 bp, Artificial Sequence
  Synthetic
aaagtcattaacagtatacgagcccatgcagggttgttatcgcacattatctctctttaggtatcggagtcggtt

SEQ ID NO: 281470 - DNA, 75 bp, Artificial Sequence
  Synthetic
atgcagggttgttatcgcacattatctctctttaggtatcggagtcggttttttgttggtttagtctggtgtgtg

SEQ ID NO: 281471 - DNA, 75 bp, Artificial Sequence
  Synthetic
gggctgccagtgctgagacacagaatttgaatgcaggctggactgatacagcacacggatctgggataataccta

SEQ ID NO: 281472 - DNA, 75 bp, Artificial Sequence
  Synthetic
tttgaatgcaggctggactgatacagcacacggatctgggataatacctatgaaaactgatcttgaattggactt

SEQ ID NO: 281473 - DNA, 75 bp, Artificial Sequence
  Synthetic
acatataggagacagctacagaatccagctaatgaacaagaaaatataccatttcatctacagataagtaagcag

SEQ ID NO: 281474 - DNA, 75 bp, Artificial Sequence
  Synthetic
cagctaatgaacaagaaaatataccatttcatctacagataagtaagcaggtaattcatgcagaaatacaacatt

SEQ ID NO: 281475 - DNA, 75 bp, Artificial Sequence
  Synthetic
taatctgaagactgcatttcattgttatggttcatgtgaaaaatatgcttatccctggcagactgctggttgttt

SEQ ID NO: 281476 - DNA, 75 bp, Artificial Sequence
  Synthetic
tatggttcatgtgaaaaatatgcttatccctggcagactgctggttgttttgtagaaaaagattatgagtacgaa

SEQ ID NO: 281477 - DNA, 75 bp, Artificial Sequence
  Synthetic
attgcccaggagtagggactggctgtactgcctgtggggcctatcttgataaattaaaatcagtcgggaaagtct

SEQ ID NO: 281478 - DNA, 75 bp, Artificial Sequence
  Synthetic
tactgcctgtggggcctatcttgataaattaaaatcagtcgggaaagtcttcaaaattgtgtccttaaggtatac

SEQ ID NO: 281479 - DNA, 75 bp, Artificial Sequence
  Synthetic
actgaacaaacctgtaaaactgttgatagcaatgactgtttaataactacttcagttaaagtgtgtttaataggg

SEQ ID NO: 281480 - DNA, 75 bp, Artificial Sequence
  Synthetic
atagcaatgactgtttaataactacttcagttaaagtgtgtttaatagggacaatttcaaaatttcaaccctctg

SEQ ID NO: 281481 - DNA, 75 bp, Artificial Sequence
  Synthetic
ccaacagggtggtttaatatttaagcaatggtgcaccacaacatgtcaatttggtgaccctggagatataatgag

SEQ ID NO: 281482 - DNA, 75 bp, Artificial Sequence
  Synthetic
caatggtgcaccacaacatgtcaatttggtgaccctggagatataatgagtacacccacagggatgaaatgtccg

SEQ ID NO: 281483 - DNA, 75 bp, Artificial Sequence
  Synthetic
aatgtgcatttgcaacaacacctgtgtgccaattcgatggaaatacaatctcaggatataaaaggatgattgcta

SEQ ID NO: 281484 - DNA, 75 bp, Artificial Sequence
  Synthetic
gtgccaattcgatggaaatacaatctcaggatataaaaggatgattgctacaaaagattcattccaatctttcaa

SEQ ID NO: 281485 - DNA, 75 bp, Artificial Sequence
  Synthetic
agtgcattagaatggatcgatcctgacagttcacttcgagatcacataaatgtgattgtaagtcgtgatttatct

SEQ ID NO: 281486 - DNA, 75 bp, Artificial Sequence
  Synthetic
acagttcacttcgagatcacataaatgtgattgtaagtcgtgatttatcttttcaagatctaagtgaaacaccat

SEQ ID NO: 281487 - DNA, 75 bp, Artificial Sequence
  Synthetic
catagatggggcatggggttcaggggttggctttaatctggtttgtactgttagcttaacagaatgttctgcatt

SEQ ID NO: 281488 - DNA, 75 bp, Artificial Sequence
  Synthetic
gttggctttaatctggtttgtactgttagcttaacagaatgttctgcatttcttacttcaattaaagcatgtgat

SEQ ID NO: 281489 - DNA, 75 bp, Artificial Sequence
  Synthetic
cagctaacctaattaggggacaaaataccattcacattgttgggaagggtgggcattctggttcaaagtttatgt

SEQ ID NO: 281490 - DNA, 75 bp, Artificial Sequence
  Synthetic
taccattcacattgttgggaagggtgggcattctggttcaaagtttatgtgctgtcatgacacaaaatgctctac

SEQ ID NO: 281491 - DNA, 75 bp, Artificial Sequence
  Synthetic
catttagaccgtgtaacaggatacaatcaagcagatagtgataaaatctttgatgatggtgcaccagagtgtggt

SEQ ID NO: 281492 - DNA, 75 bp, Artificial Sequence
  Synthetic
atcaagcagatagtgataaaatctttgatgatggtgcaccagagtgtggtatgtcttgctggttcaaaaaatctg

SEQ ID NO: 281493 - DNA, 75 bp, Artificial Sequence
  Synthetic
tggaaattggatggtggtggctgtattgatagcattgttagttttatctatccttctgttcacattatgctgccc

SEQ ID NO: 281494 - DNA, 75 bp, Artificial Sequence
  Synthetic
cataaaccttagtagataattactcatttgaatatcatattaaaattactaacagacttaatatataatcaccaa

SEQ ID NO: 281495 - DNA, 75 bp, Artificial Sequence
  Synthetic
atttgaatatcatattaaaattactaacagacttaatatataatcaccaatgcactttcatctcttatcgtgtat

SEQ ID NO: 281496 - DNA, 75 bp, Artificial Sequence
  Synthetic
ctttcataaagccagaagttaagcctgggacaccagcacaggaggtagaatttttgaaaagaaatagagtttatt

SEQ ID NO: 281497 - DNA, 75 bp, Artificial Sequence
  Synthetic
tacagggaattactaatgacagttatgaatgtaatatcatagtatatttttgtaatcaatatccaattagcatta

SEQ ID NO: 281498 - DNA, 75 bp, Artificial Sequence
  Synthetic
agtttttaaaaacttcggctcggttaagtcactggttgattaagcctttattacagctaaagttgtttattattt

SEQ ID NO: 281499 - DNA, 75 bp, Artificial Sequence
  Synthetic
aacccgacacgttgtggacaagtaccgacgattcggagtaccaggagttgcaggagtttggcgcgatttcgttgg

SEQ ID NO: 281500 - DNA, 75 bp, Artificial Sequence
  Synthetic
tcgctactttattacctctggtattaacgtggcacaatgaagaagaaggagtcaggagcggtggagagagcgcgt

SEQ ID NO: 281501 - DNA, 75 bp, Artificial Sequence
  Synthetic
aggcttctccctcgggaacctgataaccaactcgacgttgctcgtcctcctagcagcgctggcattcctcgacaa

SEQ ID NO: 281502 - DNA, 75 bp, Artificial Sequence
  Synthetic
gaagtgcgcctttccgccaaccgcggcagagagggttttgccaagaaaggcaaagaccgaggaggccggcagatt

SEQ ID NO: 281503 - DNA, 75 bp, Artificial Sequence
  Synthetic
gcgtgttgtggtgctcctgctagtctgtggatacttctactacacacgtgctgatgtgggttgtggatttgatcc

SEQ ID NO: 281504 - DNA, 75 bp, Artificial Sequence
  Synthetic
ctgcgctcagatgggttcaatcccggtgggcaggatcgcggcaagcagatcaagggatctggaagacgcagggga

SEQ ID NO: 281505 - DNA, 75 bp, Artificial Sequence
  Synthetic
cgacaggaagatcatgtcgtgcggtactggtggcttcgtgtggaagagcatttcccaatggcctgtgaacgatca

SEQ ID NO: 281506 - DNA, 75 bp, Artificial Sequence
  Synthetic
ctgctgggtaagctggggctcgggtgggggtctttcctccagagagacatcatccaagccatcatgcatctggtt

SEQ ID NO: 281507 - DNA, 75 bp, Artificial Sequence
  Synthetic
ctctgtccagcttgaagacgacgctgttgtggtgtcacttgtaacggaacaactgaagaccacaaacaaggtttg

SEQ ID NO: 281508 - DNA, 75 bp, Artificial Sequence
  Synthetic
ctagtcctccatgcgttgttcatgtccattgatcagcgcttccgagcgctaacccgtcgggtgcgagcactcgaa

SEQ ID NO: 281509 - DNA, 75 bp, Artificial Sequence
  Synthetic
ccttatgtgtgaggatgtcctacaatgtgcggctgcccgaagtgttgtcaagagaatcactcacgtcaacaacga

SEQ ID NO: 281510 - DNA, 75 bp, Artificial Sequence
  Synthetic
aaccgtcgatcagcaaatcccctgctggtcgcaactcttgtttgcgcagctgtcaccttgtgcagcaccatggtg

SEQ ID NO: 281511 - DNA, 75 bp, Artificial Sequence
  Synthetic
gcttgtctatgcgaacacaaccctgtcttacgggagggtttttcctcgagtgaagaaaagtgtccatggtgtgaa

SEQ ID NO: 281512 - DNA, 75 bp, Artificial Sequence
  Synthetic
cttgacatgcaggtgtcttctgcaaagggagttcaaatcttcgaggggaagacaaaccggactgactacctgcac

SEQ ID NO: 281513 - DNA, 75 bp, Artificial Sequence
  Synthetic
gattggggacataacgatgcagctcgccttggctacccttgacggcacgctggacgacgccgaattgggacacct

SEQ ID NO: 281514 - DNA, 75 bp, Artificial Sequence
  Synthetic
ctattcaagctcccgaaagacggatgctggagtggggtgcttgtctccaaacactgccctaaggtcggagatctg

SEQ ID NO: 281515 - DNA, 75 bp, Artificial Sequence
  Synthetic
gacaagtggattcttttcacgaggaaaacaaaacgagactgttgaccacaaggttgtccgcgtcatcacgagtgg

SEQ ID NO: 281516 - DNA, 75 bp, Artificial Sequence
  Synthetic
gccaaggacttggaggcgacggattgcggttccacgtggagtgaattcacgttgcgctacaatcgatgtgtgggg

SEQ ID NO: 281517 - DNA, 75 bp, Artificial Sequence
  Synthetic
cagtgagtataagaaggtttgttctcaggcattcgcattgcagtatggctttgtgcgattttcgcgcaaggtgta

SEQ ID NO: 281518 - DNA, 75 bp, Artificial Sequence
  Synthetic
aagaagcgtgtcaagcgagcagtggaacagccaaaaacagacctactcgctgagatggagatggtgacgttcaag

SEQ ID NO: 281519 - DNA, 75 bp, Artificial Sequence
  Synthetic
cggatcaaacgtggtcgtgaaaccggttgagaaaccgagtgaagcgtgcccgacgtacctggccggttcatatgt

SEQ ID NO: 281520 - DNA, 75 bp, Artificial Sequence
  Synthetic
acgattcgtcagaataaaaccatattcatcatcgcgttgttgtgcgttgctgtggcaaaacgctggccgacttgg

SEQ ID NO: 281521 - DNA, 75 bp, Artificial Sequence
  Synthetic
taagaacgatgtcggagggtacactgatggcatgatgtggatgcgtagccgtaaggtgaatggctcatgggagat

SEQ ID NO: 281522 - DNA, 75 bp, Artificial Sequence
  Synthetic
atcgtcattgttcttgccgttggaacctggactactgtcaaaggtgagttcatcgagccattgtacacgttgaag

SEQ ID NO: 281523 - DNA, 75 bp, Artificial Sequence
  Synthetic
gttcgagcttgagacgacccaaagccaccaatgcatttggccacaggagtacacatttgatctcacgactcacaa

SEQ ID NO: 281524 - DNA, 75 bp, Artificial Sequence
  Synthetic
gctgaacaaatgacgatgatgcaaaccgttgttcgtcctgaagagggctatgtcattgccacaccaaacggactt

SEQ ID NO: 281525 - DNA, 75 bp, Artificial Sequence
  Synthetic
cgatagtacattgtttatgccagcccattacggagcgccgatgtccaaagccaaccacatccctgggtacggaac

SEQ ID NO: 281526 - DNA, 75 bp, Artificial Sequence
  Synthetic
atcgacttgcaaacaagcgctgcgatgatcatgggaggtcaatggctacgcgagttattagttgattgccaggtg

SEQ ID NO: 281527 - DNA, 75 bp, Artificial Sequence
  Synthetic
tcaacacgagttcccgtggtacaaggccgagataaaattgcggcagggaccagttcctggaactgaagtggagtc

SEQ ID NO: 281528 - DNA, 75 bp, Artificial Sequence
  Synthetic
aatgctacctactctacggatgtgtgtcctggaggatcacagctgaacatggctgagatatcctccaaagagcgg

SEQ ID NO: 281529 - DNA, 75 bp, Artificial Sequence
  Synthetic
catggactcgtgcgatggtagtggatcagcggtcaaagtggaccctgccattgcaaagaagtggtgctgcaaagg

SEQ ID NO: 281530 - DNA, 75 bp, Artificial Sequence
  Synthetic
gtttgcacgactcaaccgtacaatcgcggttgggggactggttgtttcaagtggggaattggcttcgtgggtaca

SEQ ID NO: 281531 - DNA, 75 bp, Artificial Sequence
  Synthetic
atgtttggccaatgatcgcaagcccattcacttcatcgtggatggtgacttcttttacccaatggaaatacgacc

SEQ ID NO: 281532 - DNA, 75 bp, Artificial Sequence
  Synthetic
tgcgttgagctgcactgcgacgagggatacaatgtttcgtccatcgccagatcggcggtagtcatgaacatcacg

SEQ ID NO: 281533 - DNA, 75 bp, Artificial Sequence
  Synthetic
aatgactgcgcattcaaagctcatcatcgagaacgagggtgttgaaatagacgagatggatcagatgttcccaaa

SEQ ID NO: 281534 - DNA, 75 bp, Artificial Sequence
  Synthetic
gcgactttccactcggtcagcgacacccagcaactagtgggtgacatacccatcactttccgtttcgcgaagctc

SEQ ID NO: 281535 - DNA, 75 bp, Artificial Sequence
  Synthetic
aaccgtctctccaatccctggagctgaagctttgcttcaggatttccgggacagcctgccagtagatggatcttc

SEQ ID NO: 281536 - DNA, 75 bp, Artificial Sequence
  Synthetic
ggcaacgcggccatgacctgccggttggagtctgaacaattactgctcgactattatcatgtcactggaagtaag

SEQ ID NO: 281537 - DNA, 75 bp, Artificial Sequence
  Synthetic
tcctttactggtgggcgtgcttctacacctgctaacaattcggactcgacaccgatggggccaacgcacaatcgg

SEQ ID NO: 281538 - DNA, 75 bp, Artificial Sequence
  Synthetic
caagaaggattgttcctacgctcccaggtggatagctggcccggcgtgatatcgtcggcaggaggacgggcagga

SEQ ID NO: 281539 - DNA, 75 bp, Artificial Sequence
  Synthetic
tacctggctgctattcgtagtttttggtatacctgctggaagctgggtcggttggtcgtggatgggcttgtctta

SEQ ID NO: 281540 - DNA, 75 bp, Artificial Sequence
  Synthetic
ttggagaaggttgtggtctggggagacacaaaggccaacgagatcctagtcaagcacgtcattgaacctcagctt

SEQ ID NO: 281541 - DNA, 75 bp, Artificial Sequence
  Synthetic
ctcgctcgccgctgtgcccaatggaagcgcacttcttgtgcatttttggcttgctttgcagttctcaacatcaca

SEQ ID NO: 281542 - DNA, 75 bp, Artificial Sequence
  Synthetic
aactgggacgaatccatatcaacccacgcaggctttcgcgacgtctcattttcatgtcaaataatgcttgacaag

SEQ ID NO: 281543 - DNA, 75 bp, Artificial Sequence
  Synthetic
tttgtttttcctaggttggttgttgcgcaaacgcgtcgagtcatctatcgaatacgcattaaccgtgttcgccgc

SEQ ID NO: 281544 - DNA, 75 bp, Artificial Sequence
  Synthetic
ctcgtcagtggagttttccgtgactgccaagggctaaaatcatctgttttcgtccaaagtggcttcggttacaat

SEQ ID NO: 281545 - DNA, 75 bp, Artificial Sequence
  Synthetic
cgaatgggtaattttgaaattacaaatgttgatcaaacaagcatcccacctcgagcacgtcctgttccctctgta

SEQ ID NO: 281546 - DNA, 75 bp, Artificial Sequence
  Synthetic
ggggttgtgatcacaacattgctccagccaactaatgagagttgctctctcaatatggcgtgtcatggatgtcag

SEQ ID NO: 281547 - DNA, 75 bp, Artificial Sequence
  Synthetic
cgtgaagttggcactcagtatgagatcccagtttgcccctgtggacagcatgattgccctgaattacgtggtgac

SEQ ID NO: 281548 - DNA, 75 bp, Artificial Sequence
  Synthetic
ctgctgtcgaccaagatggtcttcggagcgggaaagtctgtcgcacgagcctacgttggatgcgggaatcacacc

SEQ ID NO: 281549 - DNA, 75 bp, Artificial Sequence
  Synthetic
gcacccgttgatggcggccctggtgagcctcggtgttgccctggtgatctttgttacacacgtctgcgcgaattg

SEQ ID NO: 281550 - DNA, 75 bp, Artificial Sequence
  Synthetic
ggatcactcgttgttggaggaactgccgtcccgatagaatgcgttatgaaccccatctcgcaggggtggaggcta

SEQ ID NO: 281551 - DNA, 75 bp, Artificial Sequence
  Synthetic
gaggcggtctccaaacttgtggaagagtggacttcgggcttcgaagcgatcagctctattgggcgtgtactttgt

SEQ ID NO: 281552 - DNA, 75 bp, Artificial Sequence
  Synthetic
acgcgacacgtcgtcgacaagtatcggcgctttggaactcagggaatcgctggtgtctggcatgatttcctcggg

SEQ ID NO: 281553 - DNA, 75 bp, Artificial Sequence
  Synthetic
agtgttgtacgtggtttcagtcttactgcgattcacgggtctggagagctctgccgtcgctgtgttcctgggggg

SEQ ID NO: 281554 - DNA, 75 bp, Artificial Sequence
  Synthetic
ggcttttccataagcaatttgatcaccaactccacgctgcttgttctattggccgccctagccttcctggataaa

SEQ ID NO: 281555 - DNA, 75 bp, Artificial Sequence
  Synthetic
tctgctgatcggactagtgaccaggctggttcctccgacgaaatatgtacttgtcccggtgccgggtacgagcgt

SEQ ID NO: 281556 - DNA, 75 bp, Artificial Sequence
  Synthetic
cgtgtcgtcgtgttgctgctcgtgtgtggttatttttattacactcgggctgatgtgggatgcggatttgaccct

SEQ ID NO: 281557 - DNA, 75 bp, Artificial Sequence
  Synthetic
gccgagcaactgcgaagaatcattcacaagactaccgccaggattagaaggtgtctacggacccagtggagtgga

SEQ ID NO: 281558 - DNA, 75 bp, Artificial Sequence
  Synthetic
gaacgaaagatcatgtcctgtggtactggtggatttgtgtggaaaagcatttcccaatggcccgtcaatgaccat

SEQ ID NO: 281559 - DNA, 75 bp, Artificial Sequence
  Synthetic
attcctgaactacactgatgtgggattggtttccgttgcaatcctgatgttcacgggctgcctcggtgtgacgct

SEQ ID NO: 281560 - DNA, 75 bp, Artificial Sequence
  Synthetic
tctgttcaacttgaagacgacgcaatcatcgtatcactggttaccgaacagctaaagaccatcaacaaggtctgc

SEQ ID NO: 281561 - DNA, 75 bp, Artificial Sequence
  Synthetic
catgaacccattgttgggtatcacgtccatgctcttctgctggtttactgaagcatacgtgtggttgccgaggtt

SEQ ID NO: 281562 - DNA, 75 bp, Artificial Sequence
  Synthetic
ttagtttgtgaagatgtgctccagtgcgcagctgctcgtagtgtggttaacaggataactcacgtcaacaatgag

SEQ ID NO: 281563 - DNA, 75 bp, Artificial Sequence
  Synthetic
gatcttcggcacgagcaatcgccgctctggggtgaacgacgttctgctagcccctcctgtctacgcggacgagat

SEQ ID NO: 281564 - DNA, 75 bp, Artificial Sequence
  Synthetic
ctggtgtacgtcaacacgtccttatcgtttggtcgggtttttccacgcgtgaagaagaccgtgcatggagtgaag

SEQ ID NO: 281565 - DNA, 75 bp, Artificial Sequence
  Synthetic
tgatgttgaaagcgactttggacacataccggatggaacttacaggatagtggcccattgcacctttttcaagta

SEQ ID NO: 281566 - DNA, 75 bp, Artificial Sequence
  Synthetic
attggtgacatcaccatgcaattggctcttgcctcgctgggtggaaaattggacgagtccgagtttggtcacctg

SEQ ID NO: 281567 - DNA, 75 bp, Artificial Sequence
  Synthetic
tcacacaggagccggctatgccaaaggtggtgttttccacacactatggcatgtcacatcaggagcttgtgtcta

SEQ ID NO: 281568 - DNA, 75 bp, Artificial Sequence
  Synthetic
gctagcggatttttgtcccgcggacagaagaacgagacgaacgaccacaaggtcatccgagtagtgacgagtggc

SEQ ID NO: 281569 - DNA, 75 bp, Artificial Sequence
  Synthetic
ctgggagggcagagcggttcgtatgcactcggctgacatctaccgcgacatggcgtcgtatggtggcccatggaa

SEQ ID NO: 281570 - DNA, 75 bp, Artificial Sequence
  Synthetic
agcgagtaccaaaaagtctgtgagcaagcttttgcgctccagtacggatttgttcggttttcacggaaggtgtat

SEQ ID NO: 281571 - DNA, 75 bp, Artificial Sequence
  Synthetic
catcaccgagtcaaacgaggcatctgttattgtccgcgtggtcgaaagcgacaacagcgtatcctgcgtgcggtg

SEQ ID NO: 281572 - DNA, 75 bp, Artificial Sequence
  Synthetic
ggatccaatgtggttgtcaagcccgttgagaagccaagtgaggtctgcccgacctacctagccggctcctatgtc

SEQ ID NO: 281573 - DNA, 75 bp, Artificial Sequence
  Synthetic
ttccacggcccaactaaaaatcaatggtgaaactgtgtcggtgattggaaaggactttggacgcggctcatctgg

SEQ ID NO: 281574 - DNA, 75 bp, Artificial Sequence
  Synthetic
aagaatgacattggggggtacacagatggcatgatgtggatgcggagcaggaagataaatggcacatgggagttg

SEQ ID NO: 281575 - DNA, 75 bp, Artificial Sequence
  Synthetic
atcccccatccattctttggatggcagggttgtcggcttgtatggctatggcttccacattggatgggaatactt

SEQ ID NO: 281576 - DNA, 75 bp, Artificial Sequence
  Synthetic
tttgagcttgaaacaacccagagccatcaatgcatctggcctcaggaatacacttttgatctcaccacccacaac

SEQ ID NO: 281577 - DNA, 75 bp, Artificial Sequence
  Synthetic
ttctatcatcacaagtggagaagttgccatggccgcagaaatagccgaggaggccggttcgtcacgaagctttgt

SEQ ID NO: 281578 - DNA, 75 bp, Artificial Sequence
  Synthetic
gacagctcgttgttcatgcctgcccacttcggggcgcccatgtcgaaagccaaccacattcccggctatggaaca

SEQ ID NO: 281579 - DNA, 75 bp, Artificial Sequence
  Synthetic
ggactggcaccctggaagaggaaagacgcgcaaggtcttggttgccgaagcacaggaacacatcaaacaaacaaa

SEQ ID NO: 281580 - DNA, 75 bp, Artificial Sequence
  Synthetic
caggatgagtttccctggtacaaagctgaaataacattgcgacaaggaccggtccctggaacggaggtggaatcc

SEQ ID NO: 281581 - DNA, 75 bp, Artificial Sequence
  Synthetic
gagattgctcatcctaacaccaacacgagttgtcaaagatgaagtcatccgagcgattggtgaagcttgtccagg

SEQ ID NO: 281582 - DNA, 75 bp, Artificial Sequence
  Synthetic
atggactcatgtgatggcagcggttctgccgttaaggtagatcccgctatcgcaaagaagtggtgttgcaagtct

SEQ ID NO: 281583 - DNA, 75 bp, Artificial Sequence
  Synthetic
cgtggtcattggctcaaatctagccatgtaccggcgaaacgcagtcacggtagcatgccacgccacgctaacgca

SEQ ID NO: 281584 - DNA, 75 bp, Artificial Sequence
  Synthetic
tgcttggccaactcgcgaaagccaatccatttcattgttgatggtgactacttctacccgatggaaatccgacca

SEQ ID NO: 281585 - DNA, 75 bp, Artificial Sequence
  Synthetic
gtatgtcatggagaaaggcattgacagcatcaaattttcaaagatcataatggatgaatgccactttcttgatcc

SEQ ID NO: 281586 - DNA, 75 bp, Artificial Sequence
  Synthetic
atgacagcacactcaaagcttgtgattgagaacgagggtgtcgaaatcgatgagatggaccgaatgttcccgaag

SEQ ID NO: 281587 - DNA, 75 bp, Artificial Sequence
  Synthetic
gctgtcgattgcttgtcgtggaatcatggattaccataacgcgaagggagtcaacgtcacttacatgagcgcgac

SEQ ID NO: 281588 - DNA, 75 bp, Artificial Sequence
  Synthetic
accgtgtcacctgtgcccggagctgaagctctccttcaggatttccgggacagcctgccagtggatggttcatct

SEQ ID NO: 281589 - DNA, 75 bp, Artificial Sequence
  Synthetic
tccccccggttatcctggaagcaacggctcaaatttcaacatccaggacgtcgccatgaaattccccagggacat

SEQ ID NO: 281590 - DNA, 75 bp, Artificial Sequence
  Synthetic
cctttactggtgggcgtgctgttacatttgctaactattcgtacacgccatcggtgggcacagcgcacgattgga

SEQ ID NO: 281591 - DNA, 75 bp, Artificial Sequence
  Synthetic
aactgcggcatggatccgcaagaacgcggagggcaagacaatcgtgtttgttgccacacaacaccaggccacgtc

SEQ ID NO: 281592 - DNA, 75 bp, Artificial Sequence
  Synthetic
acatggcttctcttcgtagtatttggcattcctgttggagggtggtacgggtggtcctggattggattgtcttat

SEQ ID NO: 281593 - DNA, 75 bp, Artificial Sequence
  Synthetic
tctagcgagagatttgaaaggcgttgccttaacgcgagaaactttcgactcagccatcgccaaagcgcgaaaccc

SEQ ID NO: 281594 - DNA, 75 bp, Artificial Sequence
  Synthetic
tcactcgccgcagtgcccaatggaagcgtccttcttgtgcacttctggcttgctttacaattctcaacgtcgcat

SEQ ID NO: 281595 - DNA, 75 bp, Artificial Sequence
  Synthetic
ggaaactgaatttgtggtatccacggatattagcgaaatgggagccaatctcggagtgaaaacagtcattgacac

SEQ ID NO: 281596 - DNA, 75 bp, Artificial Sequence
  Synthetic
ttgtttctcttgggatggttgctgcgccagcgcgtcgagtcatccgtcgagtacgcatttaccgtcttcgccgtc

SEQ ID NO: 281597 - DNA, 75 bp, Artificial Sequence
  Synthetic
gcgcatagcggttaaacctgtgatgtcagaaggcggggtgatgttggagaaagtcggcatcacagaagcctcggc

SEQ ID NO: 281598 - DNA, 75 bp, Artificial Sequence
  Synthetic
gaatggctagttttgaaattacagaggctgatcaaacaagcgtctcacctcgagcacgtcctgttccctctgtac

SEQ ID NO: 281599 - DNA, 75 bp, Artificial Sequence
  Synthetic
aatccagcggcgtggaagaactggacggcgtgaagaagggcagtacatataccccatcggggttgagcttgaaca

SEQ ID NO: 281600 - DNA, 75 bp, Artificial Sequence
  Synthetic
gtgaaattggcactcaacatgaggaaccagtttgcccctgtggactcgatggtggctctgaattacgtgatggtg

SEQ ID NO: 281601 - DNA, 75 bp, Artificial Sequence
  Synthetic
tgagcccgcgaactgggcttgctggactgaggctcagatggtgcttgaccaaatgatgtgtgggccaatgcgaga

SEQ ID NO: 281602 - DNA, 75 bp, Artificial Sequence
  Synthetic
cacccgctgatggcattcctggtgagcatgggtgttgccctggtgatctttgttacacacgtctgcgtgaactgg

SEQ ID NO: 281603 - DNA, 75 bp, Artificial Sequence
  Synthetic
agaagcagagtactttcagccacttggacactaccttcttgaagaaaagggaagaacacggtttgtggagcttgt

SEQ ID NO: 281604 - DNA, 75 bp, Artificial Sequence
  Synthetic
aggcgatctccaaacttgtggaagagtgggctgagagcttcgaagcagtcggcactgttgggcgtgtacttcgca

SEQ ID NO: 281605 - DNA, 75 bp, Artificial Sequence
  Synthetic
gaagaaagagattcccatctggctcgcgtggcaatgggctaaagcttttgatcatcgtcacaccattttgttcaa

SEQ ID NO: 281606 - DNA, 75 bp, Artificial Sequence
  Synthetic
ctgttgtacgtggtctcagtcttgctacacctggcagggctggagaacactgccgccgctgtgttactgggtggc

SEQ ID NO: 281607 - DNA, 75 bp, Artificial Sequence
  Synthetic
cgggccacagcgaacgaagctcaagatccggactgaagcaggggatcacgcgtacgcccccaggttccacgacga

SEQ ID NO: 281608 - DNA, 75 bp, Artificial Sequence
  Synthetic
ctgctgatcggactgatgtccaggctggtacctccgacgaaatttgtacttgtcccggtgccgggtacgagcgtg

SEQ ID NO: 281609 - DNA, 75 bp, Artificial Sequence
  Synthetic
ccggtttgagaaatgcaacgaactggaaaagcgcacgaaattgtcaatctttctcaaacaacggagcgtcctcaa

SEQ ID NO: 281610 - DNA, 75 bp, Artificial Sequence
  Synthetic
ccgagcaactgcgaagaatcatacacgcgacttccaccaggattagaaggtgtttacgggcccaatggagttgag

SEQ ID NO: 281611 - DNA, 75 bp, Artificial Sequence
  Synthetic
ttttgatgtcctcggtgtggctcatggcctgtatgtcgcgttgacctcaatcaacatggaaatgctcggtaacac

SEQ ID NO: 281612 - DNA, 75 bp, Artificial Sequence
  Synthetic
ttcctaaactacaccgatgtgggtctggtgtccgtctcaatcttgatgtacacgggctgtctcgggttgacgtta

SEQ ID NO: 281613 - DNA, 75 bp, Artificial Sequence
  Synthetic
gtttcgcgacacaatcgaaaacctgcatgtcatatcaaatgtggacgacccttacgtctctgatttcacgatggg

SEQ ID NO: 281614 - DNA, 75 bp, Artificial Sequence
  Synthetic
gtaaatccctggctaggagttgtactcatgcttttttgctggttcaccaaggctcacgtttggctaccgaggttc

SEQ ID NO: 281615 - DNA, 75 bp, Artificial Sequence
  Synthetic
gcaatctctgaatgcttggacagcagtcctcatcggggccgccgccagtacgatcctgctgttgacagttgttgg

SEQ ID NO: 281616 - DNA, 75 bp, Artificial Sequence
  Synthetic
cttttcggtacgagcaaccaacgctctgggctgaacgacgttttgttagcccccccaatctatgctgatgaaatc

SEQ ID NO: 281617 - DNA, 75 bp, Artificial Sequence
  Synthetic
catgtacaagatagtgtgctggctgtttggacgacgacctgaccaaccaagtagcgccccgccgacgataatcac

SEQ ID NO: 281618 - DNA, 75 bp, Artificial Sequence
  Synthetic
gacgtggaaagcgactttggacacctccccgatggaacgtacagaatcgttgcacaatacctgtgtttccggtac

SEQ ID NO: 281619 - DNA, 75 bp, Artificial Sequence
  Synthetic
gtatgcacaaggtggaatttcacaacttgggtcaatggctatcgccatagctcccatgtgcgcggtcctggtcgg

SEQ ID NO: 281620 - DNA, 75 bp, Artificial Sequence
  Synthetic
cacacgggagctggatatgcgaaagacggtgtttttcacaccctctggcacgtcacatctggtgcttgcgtgtat

SEQ ID NO: 281621 - DNA, 75 bp, Artificial Sequence
  Synthetic
catccccccggttttcgtcttcatcgcggtggtcggactgttcgtgatcatgagcgttaatgcgaccaatgttca

SEQ ID NO: 281622 - DNA, 75 bp, Artificial Sequence
  Synthetic
tgggagggccgggctgtgcgaatgcactccgcagacgtttaccgagacatggcatcgtacgggggcccttggaac

SEQ ID NO: 281623 - DNA, 75 bp, Artificial Sequence
  Synthetic
tagagcttacacaggcgacacgattaccatcatcatcatcatggtttgcttggccgtcatgggcattgtcgcttg

SEQ ID NO: 281624 - DNA, 75 bp, Artificial Sequence
  Synthetic
atcaatgagtcaagtgaagcatctgtcgttgtccgagttgttgaaagtgacaacagtgtgacgtgtgtgcgttgc

SEQ ID NO: 281625 - DNA, 75 bp, Artificial Sequence
  Synthetic
ggaattggaactaatgccaaacacacgccgagatctgacccgcctaacccactatctgatggaacggagacctgc

SEQ ID NO: 281626 - DNA, 75 bp, Artificial Sequence
  Synthetic
tcaacagcacagctcaagatcaacggtgaaaacgtggctgtcataggcaaggattttgggcgcggttcttctgga

SEQ ID NO: 281627 - DNA, 75 bp, Artificial Sequence
  Synthetic
ggcgacaggcggtgttcctcgcgcaccagcggctcccacactaccgttcagcatcaccagtttacctggtgcgtt

SEQ ID NO: 281628 - DNA, 75 bp, Artificial Sequence
  Synthetic
tcacccatacactccctggatggacgcgttgttggcctgtatggctacgggtttcacatcgggtgggaatattat

SEQ ID NO: 281629 - DNA, 75 bp, Artificial Sequence
  Synthetic
gtgtgtaagttacgcaattgctggaattggtggcgtgtttgccaactgctggtccgatggccacttcctgcgagg

SEQ ID NO: 281630 - DNA, 75 bp, Artificial Sequence
  Synthetic
tctctcatcattagcggagaagtggctatggctgcagagatagctgaagccgccggatcgtcacgaaatttcgtt

SEQ ID NO: 281631 - DNA, 75 bp, Artificial Sequence
  Synthetic
actgtttgccaatgaagctcaatcggcgtccgtgattggaggagttcaagtgtcggctattgcttgggagataat

SEQ ID NO: 281632 - DNA, 75 bp, Artificial Sequence
  Synthetic
gattggcatccaggacgaggaaagacacggaaggttcttgtagcagaagcacaggatcacatcaggcaagggaag

SEQ ID NO: 281633 - DNA, 75 bp, Artificial Sequence
  Synthetic
gattcccgtggctttttcagctttcttcgccacgacgttcgttacaaagatctacggcatcctgatcggggctat

SEQ ID NO: 281634 - DNA, 75 bp, Artificial Sequence
  Synthetic
aggctgctcatcctcacacccacacgtgtcgtcaaggatgaggtcattcgagcgattggagaggcgtgcccaggt

SEQ ID NO: 281635 - DNA, 75 bp, Artificial Sequence
  Synthetic
cttcttgatcttggcgcactttgatcggaagcatgctttttcaaatcgtgcagtgaaggtacttgtggcccgaac

SEQ ID NO: 281636 - DNA, 75 bp, Artificial Sequence
  Synthetic
gttgttattggatcaaacttggccatgtatcgacggaacgctgtcaccgtggcttgccacgcaaccctcactcag

SEQ ID NO: 281637 - DNA, 75 bp, Artificial Sequence
  Synthetic
tagcaagaaggacgttgacgacgacatttccggacgagatggtttgtcccatgctagaccgacgttcttcatgac

SEQ ID NO: 281638 - DNA, 75 bp, Artificial Sequence
  Synthetic
tacgtaatggagaaagggatcgatagtatcaagttctccacgatcatcatggacgagtgtcattttcttgacccg

SEQ ID NO: 281639 - DNA, 75 bp, Artificial Sequence
  Synthetic
tcaggtgctctcttcagcgctctgggcgataactgctccctcgagcctgcacatcatggtgtttttcgccatctg

SEQ ID NO: 281640 - DNA, 75 bp, Artificial Sequence
  Synthetic
ttgtccatagcctgccgtggaatcatggaccaccacaacgcaaagggagtcaacgtcacatacatgagcgcgact

SEQ ID NO: 281641 - DNA, 75 bp, Artificial Sequence
  Synthetic
ctgcttcacgttcctgacgttccgaagaccaaacaactatctactgggcttgctagactatactggtttgttgct

SEQ ID NO: 281642 - DNA, 75 bp, Artificial Sequence
  Synthetic
ccccctggataccccggaagtaatggctcaaactacaacattgaagacatcgccatcaagttcccgcgagaaatc

SEQ ID NO: 281643 - DNA, 75 bp, Artificial Sequence
  Synthetic
cgttctgatgatcgtggttgatccagtgctactgatgttcgtcggtgctgccttggtgttctggttcatcgtaca

SEQ ID NO: 281644 - DNA, 75 bp, Artificial Sequence
  Synthetic
acagcggcatgggttcgaaagcatgccattggaaaaaccatcatctttgttgccacccaacatcaagcaacaacg

SEQ ID NO: 281645 - DNA, 75 bp, Artificial Sequence
  Synthetic
tccaaaccgtctggcaacccgctcgctggtgaagactgacacttgcggaatcgggtaccggtggaaagagatatt

SEQ ID NO: 281646 - DNA, 75 bp, Artificial Sequence
  Synthetic
cttgctaaggagctgaacggtgttgcgctaacacgtgagacgttcgacacggccatcaacaaagcgcgcagccca

SEQ ID NO: 281647 - DNA, 75 bp, Artificial Sequence
  Synthetic
gaattctcttgacaagaacgcgtttgatcagtacaggtcccgaggtgtcaatgaaacggataagggagactatgt

SEQ ID NO: 281648 - DNA, 75 bp, Artificial Sequence
  Synthetic
gacacggtttttgtcgtctctacggacataagcgaaatgggagcaaacttgggagtgaagactgtccttgacact

SEQ ID NO: 281649 - DNA, 75 bp, Artificial Sequence
  Synthetic
ttctcgaggtggcctgaagatggacgagttgctgaggaaatatcagtgggaaccgaaaggtgttgctgttgatct

SEQ ID NO: 281650 - DNA, 75 bp, Artificial Sequence
  Synthetic
cgcatcgccgtgaaaccagttttgtcagaaggtgcagtaatgctggaaaaagttggcataacggaggcctcagcg

SEQ ID NO: 281651 - DNA, 75 bp, Artificial Sequence
  Synthetic
cggatgcggaaggggaggttggagtcagcgtctggtgatggactcacggattagcgctgtccacggattcaccct

SEQ ID NO: 281652 - DNA, 75 bp, Artificial Sequence
  Synthetic
attcaacgtcgcggaagaactggaagacgtgaggaaggacagtacatctacccgttaggggttgaactcgaacat

SEQ ID NO: 281653 - DNA, 75 bp, Artificial Sequence
  Synthetic
tggaggtaacaaccgagagaacccccagccgttccggacaaaagggcataacctagccacattgaaagctggcgt

SEQ ID NO: 281654 - DNA, 75 bp, Artificial Sequence
  Synthetic
gaacccacgacgtgggcgtgctggaccgaagcgcaaatggttctcgaccaaatgctgtgcgcgccaatgcgggag

SEQ ID NO: 281655 - DNA, 75 bp, Artificial Sequence
  Synthetic
cgacgtgtatgccgagccgccaaaagattgcaacacgatcgtctgcgacattggagaaagcgattctcgtggtga

SEQ ID NO: 281656 - DNA, 75 bp, Artificial Sequence
  Synthetic
gaagctgagtacttccagccgattggacagttcctccttgaggaaaaagggagagtgcgtttcgcggagctcgtg

SEQ ID NO: 281657 - DNA, 75 bp, Artificial Sequence
  Synthetic
tgtggagcgaacccgcacgttgaaggtactgggcttgcttgagaagtggttggagcacaacccaaatgcagcttt

SEQ ID NO: 281658 - DNA, 75 bp, Artificial Sequence
  Synthetic
aaaaaggacatccccatctggttggcctggcaatgggctaaagcttttgaccatcgacacacaattctgttcaat

SEQ ID NO: 281659 - DNA, 75 bp, Artificial Sequence
  Synthetic
tgcctgcaaggtcttgtctccctatcacatcgaagtgcttcgaaaactggagacgttacaacacaagtacggagg

SEQ ID NO: 281660 - DNA, 75 bp, Artificial Sequence
  Synthetic
ggtgcaatgcggaccaagctcaagatccggactgaagcaggagatcacatgtacgctccgagatttcatgacgac

SEQ ID NO: 281661 - DNA, 75 bp, Artificial Sequence
  Synthetic
ccgggtcgttcggctgtcgtatagccggaactccaccgctgaaatgtattacatctcgggcgttcgggcaaacat

SEQ ID NO: 281662 - DNA, 75 bp, Artificial Sequence
  Synthetic
aggtttgagaaatgcaacgaactggaaaagcgaacgaagctgtcgatcttcttaaagcagcgaagcatcctcaac

SEQ ID NO: 281663 - DNA, 75 bp, Artificial Sequence
  Synthetic
tgttggctccgttttccaggttcttggagccctcctcggacgctttcgaaggaacgaccaagtgatcatcgacag

SEQ ID NO: 281664 - DNA, 75 bp, Artificial Sequence
  Synthetic
tttgatgtccttggagtggcgcacgggttgtatgttgcggtgacgtccatcaacatggagatcttcagcacctca

SEQ ID NO: 281665 - DNA, 75 bp, Artificial Sequence
  Synthetic
cccaccgaaactggaactcggcacccgcagtgaccctaggtccaaagttaagcagcaacaacctcaactcgtcgc

SEQ ID NO: 281666 - DNA, 75 bp, Artificial Sequence
  Synthetic
tttcgtgacaccattgaacatctgcacgtcatatcaaacgtagacgatccttacatctctgatttcacgatgggg

SEQ ID NO: 281667 - DNA, 75 bp, Artificial Sequence
  Synthetic
gcggcgagtgcagcggctacggaatgaaaatctgcacacctggtttgttgatcgtgaacatccttaccagtcctt

SEQ ID NO: 281668 - DNA, 75 bp, Artificial Sequence
  Synthetic
caatcgttgaatgcatggacggcagttctcattggggctgtcgccagcattttgctgttgtcggtcatgattgcc

SEQ ID NO: 281669 - DNA, 75 bp, Artificial Sequence
  Synthetic
caactaccacggatcattcgccactgacgacatttcccccggtgggcaaacggtgaatcctatgatgcggcgcat

SEQ ID NO: 281670 - DNA, 75 bp, Artificial Sequence
  Synthetic
atgtacaaagttgtctgctgggtttttggatgccgctcaagtcaagtaagcactccgcaaccaacaatcatcaac

SEQ ID NO: 281671 - DNA, 75 bp, Artificial Sequence
  Synthetic
catgtggccgtgggactttctcactcgtgtcaccacattcatgatgacggacgtgtctacgtattcgcagcaaaa

SEQ ID NO: 281672 - DNA, 75 bp, Artificial Sequence
  Synthetic
tacgcccagggaggaatttctcagttgggatcaacggctttggccatagcaccgatgtgtgctgtgctggctggg

SEQ ID NO: 281673 - DNA, 75 bp, Artificial Sequence
  Synthetic
gatccttagggagaaggtcgacacgctaacagtcgagccggacacacgcacgaggagcttgaaccggctaatcat

SEQ ID NO: 281674 - DNA, 75 bp, Artificial Sequence
  Synthetic
attcctccggcgttcgtgttcatcgctgtggttgggctgttcgtcatcatgagtgtaaacgctacaaatgtccac

SEQ ID NO: 281675 - DNA, 75 bp, Artificial Sequence
  Synthetic
gaaacatttttcacgcctgttcaagaagcgaggactacgaccccgaatcctagctccctctgactacgtcaacaa

SEQ ID NO: 281676 - DNA, 75 bp, Artificial Sequence
  Synthetic
agagcgtacacgggcgataccatcacaataatcatcattttggtttgtctaatggtgatgggggtcgtggcctgg

SEQ ID NO: 281677 - DNA, 75 bp, Artificial Sequence
  Synthetic
tgtgaagagcggagccgccgttggcggctggagctctgagatgccgtggaacggagtcaaggaggcgctagacga

SEQ ID NO: 281678 - DNA, 75 bp, Artificial Sequence
  Synthetic
gagctcgagctgatgccaaatacacggcgagacctcatgcgattggtccactttctgttcgaaaaaagtgttaag

SEQ ID NO: 281679 - DNA, 75 bp, Artificial Sequence
  Synthetic
ccccgtgttctggagcttggttgaccgagaacgggcgctgcacctgagtggcgattgtgaactttgtgtctacaa

SEQ ID NO: 281680 - DNA, 75 bp, Artificial Sequence
  Synthetic
cctgctagcggagccagtcgtgtgcctgatcctccttcattgccgttcagcatcactagcctgcctggtgctctc

SEQ ID NO: 281681 - DNA, 75 bp, Artificial Sequence
  Synthetic
caccatgggaaagaaagagaagaaaccttcatcgtttggcgaggcccgtgggtctcgcatcatctggtacatgtg

SEQ ID NO: 281682 - DNA, 75 bp, Artificial Sequence
  Synthetic
tgcgtgagttatgcgattgcaggaattggcggcgttttcgcgaattgctggtctgatggaagtttcctccgtgga

SEQ ID NO: 281683 - DNA, 75 bp, Artificial Sequence
  Synthetic
gttgggaagtaggttcctcgagtatgaagctctcgggtttctaaatgaagatcactgggttgcacgcgaaaattt

SEQ ID NO: 281684 - DNA, 75 bp, Artificial Sequence
  Synthetic
ttgtttgccaatgaagcacagtccgccaccgtaattgggggattccaagtatccgcaattgcatgggaaaccatg

SEQ ID NO: 281685 - DNA, 75 bp, Artificial Sequence
  Synthetic
tccatgtggtgttggaggtgtgggagtgaactacttcgggtactacctaaaggaaatcgcccaaaaagggcagtg

SEQ ID NO: 281686 - DNA, 75 bp, Artificial Sequence
  Synthetic
atcccggttgcgttcgcagctttcttcgggaccacgttcgtcacgaagatttacgggacattgatcggagtcatc

SEQ ID NO: 281687 - DNA, 75 bp, Artificial Sequence
  Synthetic
gctgatagctgacgatgtagccggttgggacactaagatcacggaagcagaccttgaagatgaactatggttgtt

SEQ ID NO: 281688 - DNA, 75 bp, Artificial Sequence
  Synthetic
tttttggtgcttgcctactttgaccgaaaatacgcttttaccaatcgtgctgtgaaggtgctggtggcgcgcacg

SEQ ID NO: 281689 - DNA, 75 bp, Artificial Sequence
  Synthetic
gctagacatggtgcaagatccttatcatgcgaagctcatttccagtgttttcaagcactgctacatgaacatggt

SEQ ID NO: 281690 - DNA, 75 bp, Artificial Sequence
  Synthetic
agcaagaaggacgttgatgaggacatatctggccgtgatgggttgtctcatgctcgacccacgttttacatgacc

SEQ ID NO: 281691 - DNA, 75 bp, Artificial Sequence
  Synthetic
cgccttgttcccccgcaaccaccccaagtacaggagtggcactgtttttgatgtgctgtctcgcacggatcagcg

SEQ ID NO: 281692 - DNA, 75 bp, Artificial Sequence
  Synthetic
caggttctctcagccgcgctatgggctctcacggccccgacagggatgcacattgcaatcttcggcagcatctgc

SEQ ID NO: 281693 - DNA, 75 bp, Artificial Sequence
  Synthetic
tggttccggacaagtcacaacctacgccctcaacacggtgactaatggcaagaaccaggttggacgaatgttgga

SEQ ID NO: 281694 - DNA, 75 bp, Artificial Sequence
  Synthetic
ttttacacatttctgacgttccggagacaaaacaaccacttcctagcgctgctggattacacaggtttgttgctc

SEQ ID NO: 281695 - DNA, 75 bp, Artificial Sequence
  Synthetic
agccgagggcctgctggacgcacccctaccggtaattgactcgtggctagacagcaatcttgagcatgttcttag

SEQ ID NO: 281696 - DNA, 75 bp, Artificial Sequence
  Synthetic
tcgttgatggtggtttatgagcccgggctcgtccttttcgttggacccgccctgttgttctggtttgtggctcat

SEQ ID NO: 281697 - DNA, 75 bp, Artificial Sequence
  Synthetic
ctgcatggttgtcgccggagatgatgttgttgtagcaactaacaatgatcgcttccacactagcttgacgtacat

SEQ ID NO: 281698 - DNA, 75 bp, Artificial Sequence
  Synthetic
ccaaaccgcctcgccacacgatctcttgtgaaaaccgatacatgcggcattggctatcgttggaaggaaatcctg

SEQ ID NO: 281699 - DNA, 75 bp, Artificial Sequence
  Synthetic
cacgatcacgtcgaaaacaagaaagaacctcaagccaacggagccgtctcctaggtactctagctgggagcaagt

SEQ ID NO: 281700 - DNA, 75 bp, Artificial Sequence
  Synthetic
aactctctagataagaagtctttcgaccagtacaggtctcgcggggtgaacgagacggacaagggtgactacgta

SEQ ID NO: 281701 - DNA, 75 bp, Artificial Sequence
  Synthetic
tgagttctgttcccaccatttccacgccttggtgcttagagacggacgagagattatcgctccttgccgtgacca

SEQ ID NO: 281702 - DNA, 75 bp, Artificial Sequence
  Synthetic
tctcgaggtggtttgaagatggacgagctgctgcgaaaattccaatgggaacccaagggcgcggctgttgatctc

SEQ ID NO: 281703 - DNA, 75 bp, Artificial Sequence
  Synthetic
acatgaaatcattgggagagctcggatccagaaaggaggtgtggttgacatgtcagctgccgggtgcttggccaa

SEQ ID NO: 281704 - DNA, 75 bp, Artificial Sequence
  Synthetic
ggatgtggacgaggtggctggacccagcgccttgtgatggactctcgcattagttcggtccaagggttcaccctc

SEQ ID NO: 281705 - DNA, 75 bp, Artificial Sequence
  Synthetic
agctcacgctcaaatgtgggggttgtactacttccaccggcgagacctgcggctaggattcgctgcaatcgtgtc

SEQ ID NO: 281706 - DNA, 75 bp, Artificial Sequence
  Synthetic
ggggggaacaaccgcgagaacccccaaccgttcaggacgaaagggcacaatctagctgtgttgaaagcgggggtt

SEQ ID NO: 281707 - DNA, 75 bp, Artificial Sequence
  Synthetic
ggctgttccctcgaattgggttccaacgggccgcgtctcatggtctgtgcaccagcatgctgagtggatgacaac

SEQ ID NO: 281708 - DNA, 75 bp, Artificial Sequence
  Synthetic
gatgtgtatgctgaaccaccaagagactgtaacaccatcgtttgtgacatcggagaaagtgactcccgaggtgac

SEQ ID NO: 281709 - DNA, 75 bp, Artificial Sequence
  Synthetic
acaagacatgctggaggtatggaacaccgtttggattgtgaacaacccgtggatgaggaccaaagaccttgtcaa

SEQ ID NO: 281710 - DNA, 75 bp, Artificial Sequence
  Synthetic
gtggagcggacccgcacgctgaaggtgctagccctgttggaaaaatggctggaacacaacccaaatgcggctttc

SEQ ID NO: 281711 - DNA, 75 bp, Artificial Sequence
  Synthetic
agcttggacggacatcccgtatttacctaagtcaaaggacatagcgtgcggcagtttgattggcgaacgtgacag

SEQ ID NO: 281712 - DNA, 75 bp, Artificial Sequence
  Synthetic
gcttgcaaggttttatcaccgtaccacatcgaggtgcttcgaaaactggagacgctgcaacatcgctatggagga

SEQ ID NO: 281713 - DNA, 75 bp, Artificial Sequence
  Synthetic
agcttcgtggtccaagaacatcgtggccactgttgagacagcccggaagatcatcgaacaggagaatggaagcca

SEQ ID NO: 281714 - DNA, 75 bp, Artificial Sequence
  Synthetic
agaatggttcggctgtcgtatagccggaactccacagccgagatgtattacatatcaggtcctcgtgctaacatc

SEQ ID NO: 281715 - DNA, 75 bp, Artificial Sequence
  Synthetic
gaaatttcccgatggactccaaatcctggggagatacaaagttcaccaggatcccgtgttcgggtaacctagcca

SEQ ID NO: 281716 - DNA, 75 bp, Artificial Sequence
  Synthetic
gttggctcggtatttgcggttctgggagcccttcttgggcgattccggcgcaatgatccggtgattgttgactct

SEQ ID NO: 281717 - DNA, 75 bp, Artificial Sequence
  Synthetic
tcgaaggatgctaggtaggaggtagagccgaaaactctaccatttcagcgcaaggaagggaagcttgaggctacc

SEQ ID NO: 281718 - DNA, 75 bp, Artificial Sequence
  Synthetic
ccgccaaaactggagctcggcactcgcagtgaccctcggtcgaaggtgaaacagcagcagccccaactggtcgct

SEQ ID NO: 281719 - DNA, 75 bp, Artificial Sequence
  Synthetic
ttaggtggtgacgacacctcgcccccagtctcccgggttggggataatacaacctcgttgggctactgcccccgc

SEQ ID NO: 281720 - DNA, 75 bp, Artificial Sequence
  Synthetic
cggcgggtgcaacggctgaagaatgaaaacgcgcatacttggtttgttgatcgtgagcacccttaccagtcgttc

SEQ ID NO: 281721 - DNA, 75 bp, Artificial Sequence
  Synthetic
aaggaggggtgtgtgtttcacgcccctgggagttaacgattctccggccccagttcctaggtccagggagggccc

SEQ ID NO: 281722 - DNA, 75 bp, Artificial Sequence
  Synthetic
aactaccacgggtccttcgccactgatgacatttccccgggtggccaaaccgttaatccaatgatgcgacgcatc

SEQ ID NO: 281723 - DNA, 75 bp, Artificial Sequence
  Synthetic
cgtggcgctgaaagggcgctgaacaagcttggtatcttggcaactaccactggatggtttccagcccgcgcaagg

SEQ ID NO: 281724 - DNA, 75 bp, Artificial Sequence
  Synthetic
atgtggccatgggatttcctgaaccgtgtcaccacttttatgatgacagatgtgtcaacatattcacagcagaag

SEQ ID NO: 281725 - DNA, 75 bp, Artificial Sequence
  Synthetic
aaggacacgtaaatcacgtgttcttgggagttgacgactctccgcccccagtccccaggtcagggtatgactccg

SEQ ID NO: 281726 - DNA, 75 bp, Artificial Sequence
  Synthetic
atcctccgggagaaggttgacaccctcaccattgaacctgatgcccacaccaaggacctaaaccgcctaatcatg

SEQ ID NO: 281727 - DNA, 75 bp, Artificial Sequence
  Synthetic
tggtgttgaaaggacactaaacaagcttggcatcttggcaactgccaccgcaagggagagggatcccctctcggg

SEQ ID NO: 281728 - DNA, 75 bp, Artificial Sequence
  Synthetic
aagcatttctcgcggatgttcaagaggcgagggttgcggcccaggatcctaacaccagctgactacataagcaat

SEQ ID NO: 281729 - DNA, 75 bp, Artificial Sequence
  Synthetic
tttggacgacaccccggccccagtcccccaggtcatgggaaaaactgaccccgaagtgctgcaagggcactaatc

SEQ ID NO: 281730 - DNA, 75 bp, Artificial Sequence
  Synthetic
gtcaaaagtggagcagcggtcggaggatggagtgtggagatgccttggaatggagtcaatgaggccctgaacgac

SEQ ID NO: 281731 - DNA, 75 bp, Artificial Sequence
  Synthetic
ccgaagtgctgcaagggcactaatcaccgcaaggtgagggcgcacaggatcgagtatccgggtgagtgacgccac

SEQ ID NO: 281732 - DNA, 75 bp, Artificial Sequence
  Synthetic
ccgctcttctggaatctggttgatcgagagcgtgctctgcacctgagtggtgattgtgagctgtgcgtgtacaac

SEQ ID NO: 281733 - DNA, 75 bp, Artificial Sequence
  Synthetic
ttgtgacaggcttgctcgcagcagcaaatctccaccgttaggagatttgttgtgagcattgccttgtctacgtct

SEQ ID NO: 281734 - DNA, 75 bp, Artificial Sequence
  Synthetic
accatgggaaaaaaggaaaagaaaccagcctcctttggtgaagcacgtggttctcgcattatctggtacatgtgg

SEQ ID NO: 281735 - DNA, 75 bp, Artificial Sequence
  Synthetic
ttaggaagcaggttcctggagtatgaagcccttgggttcttgaatgaggatcactgggttgcccgcgaaaacttt

SEQ ID NO: 281736 - DNA, 75 bp, Artificial Sequence
  Synthetic
ccatgtggtgttggtggtgttggagtgaattacttcgggtactacctgagggaaattgcgcagaaaggagagtgg

SEQ ID NO: 281737 - DNA, 75 bp, Artificial Sequence
  Synthetic
ttgatcgctgatgacgtcgccggatgggatacgaagatcacggaagccgacctcgaggatgagttgtggttgttg

SEQ ID NO: 281738 - DNA, 75 bp, Artificial Sequence
  Synthetic
ttggacatggtgcacgacccttaccatgccaagcttatctcaagcgtttttaagcactgctatatgaacatggtg

SEQ ID NO: 281739 - DNA, 75 bp, Artificial Sequence
  Synthetic
gccctgttcccccgcaaccaccccaagttccggagcggaacggtatacgatgtgctttcccgcacggaccaacgt

SEQ ID NO: 281740 - DNA, 75 bp, Artificial Sequence
  Synthetic
ggctcagggcaggtcacgacttacgcgctcaacacggtgacgaacggaaagaaccaggtcggacgaatgttggag

SEQ ID NO: 281741 - DNA, 75 bp, Artificial Sequence
  Synthetic
gctgaaggcctcctacatgcgagtctaccaatcgttgatgcttggctggagagcaacctggagcacatcctcggt

SEQ ID NO: 281742 - DNA, 75 bp, Artificial Sequence
  Synthetic
gctatggttgttgccggtgacgacgttgtcgtcgccacgaacaatgatcgcttccacactagcttgaactacatc

SEQ ID NO: 281743 - DNA, 75 bp, Artificial Sequence
  Synthetic
acaagcacttccaaggtcaggaagaatctcaagccaacggagccgtcccctcgctataccaactgggagcaggtt

SEQ ID NO: 281744 - DNA, 75 bp, Artificial Sequence
  Synthetic
gagttttgttcccaccactttcacgcgttggtgttgagagacggacgcgaaatcattgctccatgccgtgaccag

SEQ ID NO: 281745 - DNA, 75 bp, Artificial Sequence
  Synthetic
catgagatcattggacgagcgcggatccagaagggaggggtagtcgacatgtcggccgcgggatgccttgctaag

SEQ ID NO: 281746 - DNA, 75 bp, Artificial Sequence
  Synthetic
gctcacgcacaaatgtgggggttgtattactttcacaggcgtgatctgcgactgggctttgcggctattgtctct

SEQ ID NO: 281747 - DNA, 75 bp, Artificial Sequence
  Synthetic
gctgttccatccaactggattccaattggccgggtatcatggtcggttcaccagcacgcggagtggatgacaacg

SEQ ID NO: 281748 - DNA, 75 bp, Artificial Sequence
  Synthetic
caggatatgcttgaggtgtggaataccgtttggatcaccaacaacccatggatgatgacaaaagacttggtcaag

SEQ ID NO: 281749 - DNA, 75 bp, Artificial Sequence
  Synthetic
acatggaccgagattccatacctgcccaagtcaaaggacatcgcgtgtggaagtctcataggtgagcgggacaga

SEQ ID NO: 281750 - DNA, 75 bp, Artificial Sequence
  Synthetic
gctgcatggtcaaagaacatcatagcaactgtgcagacggctaggaaaatcatcgagcaggagagcggaggccag

SEQ ID NO: 281751 - DNA, 75 bp, Artificial Sequence
  Synthetic
aagttcgtggatggattgcagatcttgggaagatacaagatccaacaagacccagtttttggccagtgaagtggt

SEQ ID NO: 281752 - DNA, 75 bp, Artificial Sequence
  Synthetic
aggacgacgctatgacgtggaggtgagatctccacaatggcagcgcaaggaaggtgggctggatgccgccttagg

SEQ ID NO: 281753 - DNA, 75 bp, Artificial Sequence
  Synthetic
tggtgacgacacctcgcccccagtcacccaggttggggtttgtacaactacaatgggctaccgcccccgcaagga

SEQ ID NO: 281754 - DNA, 75 bp, Artificial Sequence
  Synthetic
ggaacgtgtcactggcatgttcctgggagttaacggctctccggccccagttcctagatctaggaaagatcccgt

SEQ ID NO: 281755 - DNA, 75 bp, Artificial Sequence
  Synthetic
ggcgttgtgaggacgctaaacaggcttggcatcctggactctgccactggaaattttccagcccgcgcaaggaaa

SEQ ID NO: 281756 - DNA, 75 bp, Artificial Sequence
  Synthetic
gacgtggagcagtccgcgatctttgggagttgacgactctccgcccccagtccctaggtcaaggcgtgaccccgt

SEQ ID NO: 281757 - DNA, 75 bp, Artificial Sequence
  Synthetic
ggtgttgagaggacactaaacaagcttggtatcttggcaactaccaccgcaagggaggggattcccctcgggtgt

SEQ ID NO: 281758 - DNA, 75 bp, Artificial Sequence
  Synthetic
ggacgacaccccggccccagtccccaaggtcatgggaaaaactgaccccgaagtgctgcaagggcactaatcacc

SEQ ID NO: 281759 - DNA, 75 bp, Artificial Sequence
  Synthetic
aaggtcatgggaaaaactgaccccgaagtgctgcaagggcactaatcaccgtaaggtgagggcgcacaggatcga

SEQ ID NO: 281760 - DNA, 75 bp, Artificial Sequence
  Synthetic
gtatccgggtgagtgacgccaccccccgaaatgtgtattgtgacaggcttgctcgcagcagcaaatctccaccgt

SEQ ID NO: 281761 - DNA, 75 bp, Artificial Sequence
  Synthetic
tgtgacaggcttgctcgcagcagcaaatctccaccgttaggagatttgctgtgagttttgccttgtctacgtcta

SEQ ID NO: 281762 - DNA, 75 bp, Artificial Sequence
  Synthetic
tagtttttaaaaacttcagcttggttaagtcactggttgattaagcctatctattacagctaaagttgtttataa

SEQ ID NO: 281763 - DNA, 75 bp, Artificial Sequence
  Synthetic
tttgctactttattacctctggtactaacgtggcgctatgaagaagaaggagtctggagtggtggagagaggacg

SEQ ID NO: 281764 - DNA, 75 bp, Artificial Sequence
  Synthetic
tggaacgcgtcctcctgccaatcgtggaggaggagctcctccgaagaaggagagagatcgaggaggccaaaaggt

SEQ ID NO: 281765 - DNA, 75 bp, Artificial Sequence
  Synthetic
ctcgctccctgggacttcaagctccatcggatcggaccgtggcaaacgggtcaagggactcggcggacgaaaggg

SEQ ID NO: 281766 - DNA, 75 bp, Artificial Sequence
  Synthetic
actgctcggcaagctggggctgggatgggggtcttttttacagaaagacatcatccaagccatcatgcacctggt

SEQ ID NO: 281767 - DNA, 75 bp, Artificial Sequence
  Synthetic
cctagtcctacacgccctgttcatgtccattgaccaacgctttaaggcgctcacccggcgggtgcgcgccctcga

SEQ ID NO: 281768 - DNA, 75 bp, Artificial Sequence
  Synthetic
gaatcgacgatctgccaatcccctactgctcgccactatcatctgcgcggtcgccaccttgtgtggcaccatggt

SEQ ID NO: 281769 - DNA, 75 bp, Artificial Sequence
  Synthetic
gatcgacatgcaagtgtcctccgctaaaggcgtgcaaatttacgaagggaaaacaaaccggactgactacttgca

SEQ ID NO: 281770 - DNA, 75 bp, Artificial Sequence
  Synthetic
cttgttcaagcttccaaaagatggatgttggaacggagtgctggtttccaaacactgtcctaaggtcggcgactt

SEQ ID NO: 281771 - DNA, 75 bp, Artificial Sequence
  Synthetic
ggccaaggacttggaggccactgactgcggatctacatggagcgaattcacactgcgatataatcgatgtgtggg

SEQ ID NO: 281772 - DNA, 75 bp, Artificial Sequence
  Synthetic
aaagaagcgcgtcaagcgggctaccgaacaaccgaaagcggacctacttgcggagatggagatggtaacgttcaa

SEQ ID NO: 281773 - DNA, 75 bp, Artificial Sequence
  Synthetic
gaccatccgtcaaaacaagacgattttcattatcgctctgctctgtgttgccgttgcaaagagatggcctacttg

SEQ ID NO: 281774 - DNA, 75 bp, Artificial Sequence
  Synthetic
ggtcgtcattgttcttgcaattggcacatggtctaccgtcaaaggagaatttgtggaaccattgtacacgctgaa

SEQ ID NO: 281775 - DNA, 75 bp, Artificial Sequence
  Synthetic
agcggagcgaatgaccatgatgcaaacgatcgttcgtccggaagaggggtacgttatcgctaccccaaacggact

SEQ ID NO: 281776 - DNA, 75 bp, Artificial Sequence
  Synthetic
tgttgaactgcggactagtgctgccaccatcttgggaggccaatggcttcgtgagcttctagttgactgccaggt

SEQ ID NO: 281777 - DNA, 75 bp, Artificial Sequence
  Synthetic
caatgccacctactcaacggatgtgtgtcctggaggttctcagcttaatatggcagagatatcatccaaggagcg

SEQ ID NO: 281778 - DNA, 75 bp, Artificial Sequence
  Synthetic
ggtttgcactacgcaaccgtacaaccgcgggtgggggaccggatgcttcaagtggggaattggttttgttggtac

SEQ ID NO: 281779 - DNA, 75 bp, Artificial Sequence
  Synthetic
atgcgttgaactccattgtgaagaagggtacaacgtgtcgtccattgcacgatccgccatcatcatgaacatcac

SEQ ID NO: 281780 - DNA, 75 bp, Artificial Sequence
  Synthetic
ggcgagtttccactctgtcagtgacacccagcagttgctaggtgacataccagtcaccttccgatttgctaagct

SEQ ID NO: 281781 - DNA, 75 bp, Artificial Sequence
  Synthetic
cggaaacgcggctatgacttgtcgcttggaatcagagcaactcctgcttgattattaccacgttaccggcaacaa

SEQ ID NO: 281782 - DNA, 75 bp, Artificial Sequence
  Synthetic
acgcgaaggactattcctgcggtcccaggtggacaattggcctggagtcatatcgtcttctgggggacgagctgg

SEQ ID NO: 281783 - DNA, 75 bp, Artificial Sequence
  Synthetic
attagagaaggtcgttgtttggggagacacgaaagccaatgagatattggttaaacacgtcatggaaccccagct

SEQ ID NO: 281784 - DNA, 75 bp, Artificial Sequence
  Synthetic
tgagtgggataatgccattcctacacatgcgggcttccgtgacgttgctttcgtgtgtcaaataatgctggataa

SEQ ID NO: 281785 - DNA, 75 bp, Artificial Sequence
  Synthetic
actggtcagcggagcgttccgcgattgccaaggattaaaatcatcggtgtttgttcagagtggctttggatacag

SEQ ID NO: 281786 - DNA, 75 bp, Artificial Sequence
  Synthetic
tggggttgttatcaccacgctgttgcaaccaacgaacgagagctgctcactcaacatggtgtgtcatggatgtca

SEQ ID NO: 281787 - DNA, 75 bp, Artificial Sequence
  Synthetic
gttgctatcgacgaaaatggtgtttggggctggaaaaccaacgtcccgtgccttcgtcggctgtgggaaccacac

SEQ ID NO: 281788 - DNA, 75 bp, Artificial Sequence
  Synthetic
tggttcactcttgattggcggtgcatctgtccccattgaatgtgtgatgaaccccatctctcaaggatggaggct

SEQ ID NO: 281789 - DNA, 75 bp, Artificial Sequence
  Synthetic
acacaaagacgccagctatcaagatgatgttctcacatgtactgatgctggcactgatttgtgctgtagcttgcg

SEQ ID NO: 281790 - DNA, 75 bp, Artificial Sequence
  Synthetic
atgataacccatgtctctgggagcggtttgccaactccagggatatggaattcatgactcctgttgtcaatttga

SEQ ID NO: 281791 - DNA, 75 bp, Artificial Sequence
  Synthetic
gcacctctaaaggcttgtcaatatcccaaaggatatgcatggttagtatgggaatgcactggtccagaatcttga

SEQ ID NO: 281792 - DNA, 75 bp, Artificial Sequence
  Synthetic
gtgaggcagaagaaaaagagatgaagaatctggatccattggtgatgtcaagcttgaactggagaggcacagcca

SEQ ID NO: 281793 - DNA, 75 bp, Artificial Sequence
  Synthetic
aaaccaggagctcaacatctttcaattttgacatcctggacgccattttcctgggcctcatcaacatgaccaaat

SEQ ID NO: 281794 - DNA, 75 bp, Artificial Sequence
  Synthetic
gggatgagagcagtagcagacacaggcccatccaccccgaatgcatcaaatccaaagtttgtggttttatgacag

SEQ ID NO: 281795 - DNA, 75 bp, Artificial Sequence
  Synthetic
cctctgggcctagggtcaaaacatgctctggaaagcttaggggagcagacagacatggccactgcaccaatagag

SEQ ID NO: 281796 - DNA, 75 bp, Artificial Sequence
  Synthetic
ccataccctatgaggcaacaaatgtgatctccgtcggtgtgcaacatgctcaagaggccgatcagctggatgagc

SEQ ID NO: 281797 - DNA, 75 bp, Artificial Sequence
  Synthetic
atgaagcaaagtttgtatctgaagctaggaaatcaaataaccctgacttttgcagtgttgacggagtggagatta

SEQ ID NO: 281798 - DNA, 75 bp, Artificial Sequence
  Synthetic
accagtgtgacatggcctctccagggagatggctccttttgcattatgctagcttcagactgcaggaaggaagtt

SEQ ID NO: 281799 - DNA, 75 bp, Artificial Sequence
  Synthetic
tggtatacttctctcctggtctaaatataaaatggagtcaaattgatgcacccatctccgacttcttctgcatta

SEQ ID NO: 281800 - DNA, 75 bp, Artificial Sequence
  Synthetic
atgtatccaaacacctggattcacactataggccctgcgacataaactgcactaataattgtcaaggggacgaac

SEQ ID NO: 281801 - DNA, 75 bp, Artificial Sequence
  Synthetic
tctactgctcaattcaccaatgtgagagatcagcagagtgcaaatgctcatttatagggagcaggggtgttgctc

SEQ ID NO: 281802 - DNA, 75 bp, Artificial Sequence
  Synthetic
aggtgcagattggagatcgatggttcacacctgcagttgtagggagccagcaattttatgtgaaagaggaagtcc

SEQ ID NO: 281803 - DNA, 75 bp, Artificial Sequence
  Synthetic
ctatcctacagcagccatccacagattgcacaacatgtgccatgacatgttcaactgaagggatttccatcagca

SEQ ID NO: 281804 - DNA, 75 bp, Artificial Sequence
  Synthetic
gcattaaggatgagctcaaagatgtgacagtatgtgttgaaggtttttgctcaacaagagtgagcaaggggtcta

SEQ ID NO: 281805 - DNA, 75 bp, Artificial Sequence
  Synthetic
aggtgtggaaaattgaatttcacaaccagtacccatcctctggatcaattgccctggctagaggcacaaccgtgg

SEQ ID NO: 281806 - DNA, 75 bp, Artificial Sequence
  Synthetic
gaggagaaagctttgaactaactgctgaatgcgggagaagatcaggctgtgaacaaatcaactgtctcttctgca

SEQ ID NO: 281807 - DNA, 75 bp, Artificial Sequence
  Synthetic
gggagatgttgtcaaaccctcaatgctatccttatggcaaatggctacttctctttctgatacttgccgtcttct

SEQ ID NO: 281808 - DNA, 75 bp, Artificial Sequence
  Synthetic
acatcttcattgccctcctcaggacaatcatgagaattgttatgacttgcctctcaatcctttatgggcctttca

SEQ ID NO: 281809 - DNA, 75 bp, Artificial Sequence
  Synthetic
tgattgttattaagatttcaaagtgcttgggtagattaggaaagaagaaaggtgaaagaacatatgtgagactga

SEQ ID NO: 281810 - DNA, 75 bp, Artificial Sequence
  Synthetic
tggaggcaatagatgaagagaagaaacctgatgcgcaaagacctgtgacacctgtgggaagggccagacagcctc

SEQ ID NO: 281811 - DNA, 75 bp, Artificial Sequence
  Synthetic
gcattgttctgtttattgtcttagctataatgatgcatatggctctctgctgtgatgagagcagattgatagaag

SEQ ID NO: 281812 - DNA, 75 bp, Artificial Sequence
  Synthetic
agacatctgtgacctgcactcctggatcggacaatatcttctcttgttctactaaagaggtgatcactgtcaaag

SEQ ID NO: 281813 - DNA, 75 bp, Artificial Sequence
  Synthetic
aattgagggcaggaaagacaatttgtgtcagcctgaaggggcccgggggaagtctttcaagcccaataaaaatca

SEQ ID NO: 281814 - DNA, 75 bp, Artificial Sequence
  Synthetic
aaatgcttgacatagtagggagatcagatcttctggacgtgtatttcactttcaatggccatgctaactgcaaat

SEQ ID NO: 281815 - DNA, 75 bp, Artificial Sequence
  Synthetic
ctgtccgaaggtgcagatgggcaggatcctgtggcaattcaggatgtgtgggtgtagggaaagaagactacgata

SEQ ID NO: 281816 - DNA, 75 bp, Artificial Sequence
  Synthetic
gagagttgggagaacaagattcttcagcacatcctaactggagagattgttttgatggctgcgggggggcagcat

SEQ ID NO: 281817 - DNA, 75 bp, Artificial Sequence
  Synthetic
gtgggtgcttcaatgcagcacccagctgcattttccttaagaggtatgtcactaacgctgattcaagagtcttta

SEQ ID NO: 281818 - DNA, 75 bp, Artificial Sequence
  Synthetic
aggtatttaggccttctgcatggtttttatccaccaagatagtggttgatactgcatcacacaaggaggacataa

SEQ ID NO: 281819 - DNA, 75 bp, Artificial Sequence
  Synthetic
cattgaagagtggagaagctaaagtgatcgacaaggtatccttccactacagaactgacaaaaatcttttcgctg

SEQ ID NO: 281820 - DNA, 75 bp, Artificial Sequence
  Synthetic
gaataagtatccccccaatagtgacagaagtaaagagggatgggaagcctctcagcttcttcctagaaaaccagg

SEQ ID NO: 281821 - DNA, 75 bp, Artificial Sequence
  Synthetic
gacagcacccaaaatgcaaagatgaaaactcagcaagaatttcatcagtatcaaactgcatcattgaccaaaact

SEQ ID NO: 281822 - DNA, 75 bp, Artificial Sequence
  Synthetic
ccatcacagctaatgcaagagtggatgatgtgtcttgcagaagcaatcttgtcagtatttctggaatgagtgctc

SEQ ID NO: 281823 - DNA, 75 bp, Artificial Sequence
  Synthetic
taaagcccttaccacagcgggtgggggacttcctcatagagttgcagaatgatgagcctgttctcctagcaacag

SEQ ID NO: 281824 - DNA, 75 bp, Artificial Sequence
  Synthetic
gagattcaggagtcgttgaaggagaacttcaagtggatttgtcacataagaagatatctattaaggttgacacaa

SEQ ID NO: 281825 - DNA, 75 bp, Artificial Sequence
  Synthetic
cagtttgtagaggctccatgaaggaactcaaagggtgtgtaggctgtactaaaggagcctttgtctcattagaag

SEQ ID NO: 281826 - DNA, 75 bp, Artificial Sequence
  Synthetic
tccattcaacctcagcgggatcagccagtcttcagtgtagcttaagtagttgctatatggaagttcaaaagggaa

SEQ ID NO: 281827 - DNA, 75 bp, Artificial Sequence
  Synthetic
taaacaatgtcaattgttctctcagatttgccaaggcagttgttgaagaggcgtgtgtacttgcctgctcaggat

SEQ ID NO: 281828 - DNA, 75 bp, Artificial Sequence
  Synthetic
ccaaagaacagctgatcatcaaagggaatctcataattggaggggatttcaagaagttgacagaggattcagcta

SEQ ID NO: 281829 - DNA, 75 bp, Artificial Sequence
  Synthetic
caagtttttctcatagtgactccaaggattcgagaatccatttacagacaggttttttgaactggctagacacat

SEQ ID NO: 281830 - DNA, 75 bp, Artificial Sequence
  Synthetic
tatttggcaccagcctcctagggaaaattctagggataggctttgcaattctatctccatttatcctgatcctga

SEQ ID NO: 281831 - DNA, 75 bp, Artificial Sequence
  Synthetic
ttttaaaatgggtcattaaagccataatcagaagatccagagttaggcaaggctctagacatgatgtaaacaagg

SEQ ID NO: 281832 - DNA, 75 bp, Artificial Sequence
  Synthetic
acaactaagtaatttgacctgatggatttccatctctagtcttcgggctagagagttccaatgctggcggtcttt

SEQ ID NO: 281833 - DNA, 75 bp, Artificial Sequence
  Synthetic
actaagtaatttgacctgatggatttccatctctagtcttcgggctagagagttccaatgctggcggtctttgtg

SEQ ID NO: 281834 - DNA, 75 bp, Artificial Sequence
  Synthetic
acacaaagaggccgcgaacgaatcaaagatggttgcatacactgatatccttaaggagttcggtgaggacatcat

SEQ ID NO: 281835 - DNA, 75 bp, Artificial Sequence
  Synthetic
cgatgatgaagttgttggcggattggaggcgctgtttgcctatcaaggctttgacccaaccaggatgctgaaaaa

SEQ ID NO: 281836 - DNA, 75 bp, Artificial Sequence
  Synthetic
gatggcagacattgacaaggatggctggaaagatgatgctaaagtcatcatcgtgtttgccttgacaagaggcaa

SEQ ID NO: 281837 - DNA, 75 bp, Artificial Sequence
  Synthetic
caagatgtccaaggccatggccaaaatgtcagaagagggccagacaaggttgaaggccctcaagagcaaatacag

SEQ ID NO: 281838 - DNA, 75 bp, Artificial Sequence
  Synthetic
gatgaaggagaaccctgaggcaagggatgacatcactcccacaagagtggcggctgccctacccacttggaccgt

SEQ ID NO: 281839 - DNA, 75 bp, Artificial Sequence
  Synthetic
acgagctgcaaaggccctccagaactcccttccaatgggccctgacaacatcaaagctctgtgtggtgcggatgc

SEQ ID NO: 281840 - DNA, 75 bp, Artificial Sequence
  Synthetic
tccagcagaaatatgctgtgcagcctttgccagcctgatcccgaccagtgagctgactgaaaaacaaatagagca

SEQ ID NO: 281841 - DNA, 75 bp, Artificial Sequence
  Synthetic
gctcacacatgccttttacctctggcaattctacttcacccagctgatcaacccaaaagtgagaggcaagggcaa

SEQ ID NO: 281842 - DNA, 75 bp, Artificial Sequence
  Synthetic
gaccgctgtcctccaaacttttgagaatgctgtgaaagcagcaatgaactccaccagctaccctgacaagtcccg

SEQ ID NO: 281843 - DNA, 75 bp, Artificial Sequence
  Synthetic
agtagccttcttgaagaagatcggcatcttcaacaagaagaatgaaattaacgggaacatccaagccatggcagc

SEQ ID NO: 281844 - DNA, 75 bp, Artificial Sequence
  Synthetic
agcttgggaaaaattggagtaaactgcagctccaaactctactattaatcaggcaaaattatgatcttatttaat

SEQ ID NO: 281845 - DNA, 75 bp, Artificial Sequence
  Synthetic
ttggctaaattagaccccttctctctctctgtgcaaatgcacagagagggggaaggggtcaagtagatggggagt

SEQ ID NO: 281846 - DNA, 75 bp, Artificial Sequence
  Synthetic
ccatcctgggcttaaggagtgggccaatcagatgtgaagtcagtgcagaagtagttgatcctgaatgtttcttga

SEQ ID NO: 281847 - DNA, 75 bp, Artificial Sequence
  Synthetic
gtctcaaggaagtaagtaatagactcatcacagctcaatccactcaggtaagaagcctcatcaaaaggtggacct

SEQ ID NO: 281848 - DNA, 75 bp, Artificial Sequence
  Synthetic
ttgttgacctttctgcgatctcttgaatcaaaagtctctagcagtagaattcgagtattggagccttggctggct

SEQ ID NO: 281849 - DNA, 75 bp, Artificial Sequence
  Synthetic
tcaatcctgatgtattcatcaacctgcttcctaattggcctaggcagttttactgggtaaaaccagcctaaggct

SEQ ID NO: 281850 - DNA, 75 bp, Artificial Sequence
  Synthetic
tggagcacttgcacatccacgagcccagaggtggagatgccaagcaattctagatcttttgctgctgttctaagg

SEQ ID NO: 281851 - DNA, 75 bp, Artificial Sequence
  Synthetic
taagacaaagcctgaagcaggcccaccttcattaagataggagatccactgagaacgcctagaactcccattctc

SEQ ID NO: 281852 - DNA, 75 bp, Artificial Sequence
  Synthetic
tgggctcttctgtcagccttctggttcagatcgtaaagcctatcagcaatggtactctcagagcttgactctgga

SEQ ID NO: 281853 - DNA, 75 bp, Artificial Sequence
  Synthetic
gtcgatttgactaacagcctgactagagccttccaggagtagcacctctccaagggagtaccattcccatacacc

SEQ ID NO: 281854 - DNA, 75 bp, Artificial Sequence
  Synthetic
ttcagagccagagaaatccatgaaattgaggctacaccctgaggccaccttaaagagctcctctcctgactagtc

SEQ ID NO: 281855 - DNA, 75 bp, Artificial Sequence
  Synthetic
attggtctcccctttggcagaatatcttccattgtctctaataggaagatgggcctgggcaaggacctcaccata

SEQ ID NO: 281856 - DNA, 75 bp, Artificial Sequence
  Synthetic
tggcctccatcaaggaagagagtttggatagctgcagtgccttgaaacagatctaccagttcccttggcactgga

SEQ ID NO: 281857 - DNA, 75 bp, Artificial Sequence
  Synthetic
ggatacaatgtgtgaacatcccgaatacgggtgtttgccactgacatcctccagtatcctcctataatcaaggac

SEQ ID NO: 281858 - DNA, 75 bp, Artificial Sequence
  Synthetic
ggacccaggtgaaacctcaccagacagcctaaactgtatagatctactgtcgtccattctgcggcttctctgtgt

SEQ ID NO: 281859 - DNA, 75 bp, Artificial Sequence
  Synthetic
cagcatggaaacaaggatacaggatactcgaataaactttccaaggagagatgagctaactgctgagggcattct

SEQ ID NO: 281860 - DNA, 75 bp, Artificial Sequence
  Synthetic
gtaccatgcccagcttgatgacaccactcttcctgccttcaacattcaggaaacagagtcatcgctctctcttga

SEQ ID NO: 281861 - DNA, 75 bp, Artificial Sequence
  Synthetic
gattgatgaagttcctgatagtgtcagccagattggcagcagcatagccttgggagccacaagaatagaagtcgg

SEQ ID NO: 281862 - DNA, 75 bp, Artificial Sequence
  Synthetic
ccaaatttccacactagtgcatgacttcacctttgccattgtgtctgaagatacagatgagcctctctcacgaca

SEQ ID NO: 281863 - DNA, 75 bp, Artificial Sequence
  Synthetic
ttttccggtgatgaacgacggagaagaccacctgactcctgatatgatcatcgatgtgactcaaacagaaagacg

SEQ ID NO: 281864 - DNA, 75 bp, Artificial Sequence
  Synthetic
ggttgtagagtttgccactcacaggggtgctggtcacagaggagttctgaactacttcaaccaaaaaatggagaa

SEQ ID NO: 281865 - DNA, 75 bp, Artificial Sequence
  Synthetic
gtacaaaagacccctagctctcagaagggagagaactggctggcacatcacactgtcgtgcatttctgtgggcac

SEQ ID NO: 281866 - DNA, 75 bp, Artificial Sequence
  Synthetic
agatcatgtggtctcggacttgaggcttcctcaaaatctggttgatgagcttgtctacagattccgatttgcgtg

SEQ ID NO: 281867 - DNA, 75 bp, Artificial Sequence
  Synthetic
tgcagttatggcgcaaatactagtggctttcccaggactcgcccctcaactgtcagaagaagtcacccagaatga

SEQ ID NO: 281868 - DNA, 75 bp, Artificial Sequence
  Synthetic
aagaagggggattgaatgtgtggagctcctgacgcaaaacctggtgggcgatggtccagggcctaagacaggcgt

SEQ ID NO: 281869 - DNA, 75 bp, Artificial Sequence
  Synthetic
cttccctcttggagagaaagagatccttgacaactttctcatggggagtgaggatggagaatatcttaagaccat

SEQ ID NO: 281870 - DNA, 75 bp, Artificial Sequence
  Synthetic
cttcaccaaaacctttaatgacagcttgagagaaatcaggcaggagcatgtaccagagggcatgcacaggaatgg

SEQ ID NO: 281871 - DNA, 75 bp, Artificial Sequence
  Synthetic
agcgctcaggaagaatcaaggcgaggctctaactcagatgacaaatcttcaggaggaaatgttggcagattactc

SEQ ID NO: 281872 - DNA, 75 bp, Artificial Sequence
  Synthetic
aaaacaatcgagagcaccccctgaaaacaaatacaagtccacaatcaagatacccccgtggctaatcccagcaac

SEQ ID NO: 281873 - DNA, 75 bp, Artificial Sequence
  Synthetic
caaaagagacatcaatgtgtgtcctgacccagatgacctagatggcctttctgatgagacagtgacttctcgagt

SEQ ID NO: 281874 - DNA, 75 bp, Artificial Sequence
  Synthetic
ctggaagagtgcattaacagatacattcttctcaggcaatccaggatggcaggagaatattgacagggaagtttc

SEQ ID NO: 281875 - DNA, 75 bp, Artificial Sequence
  Synthetic
attggcaagtggcatactcatcacggaggatgctgaaaacctgaagactgagtaccacagaacaaagctcaactt

SEQ ID NO: 281876 - DNA, 75 bp, Artificial Sequence
  Synthetic
aacttctcaagactgggttgctttggcaactagaggcattgagggaaaagccttaaggcacgaagatgctgtgaa

SEQ ID NO: 281877 - DNA, 75 bp, Artificial Sequence
  Synthetic
gactgcagatgaagagtctcaccagactctcagtcctctatcagacacttcaggcattgagtcctgtttggagag

SEQ ID NO: 281878 - DNA, 75 bp, Artificial Sequence
  Synthetic
taacaactggtttcaccaagctcgaagtcaaaaggaactcttgtttcaagatctggatcaactgattgagtcttc

SEQ ID NO: 281879 - DNA, 75 bp, Artificial Sequence
  Synthetic
tcttgaagtatcttgcgaatctcaaggactacgagattctgtgttaaccaccttcaagaactatagaaacaccaa

SEQ ID NO: 281880 - DNA, 75 bp, Artificial Sequence
  Synthetic
tgttgtacactgggcttgcatggtgacgcagctagcaactgaactgtccatctcagctaaacagagctgtagaaa

SEQ ID NO: 281881 - DNA, 75 bp, Artificial Sequence
  Synthetic
acatcagttcattctcaagaagcttcccaattttccagtactggtcttaataaaaacaagcaggtcaggatctca

SEQ ID NO: 281882 - DNA, 75 bp, Artificial Sequence
  Synthetic
tgtattttatagtttggctgcaaaggctagtgacatcacaggagaattggatgggcaggtgtttaaaaattatga

SEQ ID NO: 281883 - DNA, 75 bp, Artificial Sequence
  Synthetic
aagatcaggtgcctggttcatcactgaatttaactctgtgaagctctgcaagctagagaacatgattaagttgcc

SEQ ID NO: 281884 - DNA, 75 bp, Artificial Sequence
  Synthetic
catgctgataatttccatgttggcatacttccaggagactgaggagaagttggtgacaaagtatagccgtccaac

SEQ ID NO: 281885 - DNA, 75 bp, Artificial Sequence
  Synthetic
tctgttcactaggaagatgacaacactagcaatcttgacatgcttggaagacaagtcactgacagaagagctcat

SEQ ID NO: 281886 - DNA, 75 bp, Artificial Sequence
  Synthetic
caccatccaaaggtacatccagatggaaggatttgtgagtgaaccacttctgccaaaacctcataagatgttgga

SEQ ID NO: 281887 - DNA, 75 bp, Artificial Sequence
  Synthetic
gaagctgtctgtgccattgaggaccaccctccaagtctaccttttcaaacagtgcatgagtagcattagaatcat

SEQ ID NO: 281888 - DNA, 75 bp, Artificial Sequence
  Synthetic
ctcaggcagcccctttaagagactgtcaagaggaggagaagttgtctggagaggctgttttgctgggtgcttggg

SEQ ID NO: 281889 - DNA, 75 bp, Artificial Sequence
  Synthetic
catcagttgctccccagaacagatggttaattcttggtacctaggctacctgaagaacaaggacgaagacacaga

SEQ ID NO: 281890 - DNA, 75 bp, Artificial Sequence
  Synthetic
agtgaacatgctcagtgcaatgtatgaaaagatagtaaaggtggaggagaaaaggccagagaacgatgacaacct

SEQ ID NO: 281891 - DNA, 75 bp, Artificial Sequence
  Synthetic
agtgggaggggacccaataaacccaaaaatgcatgagttttcagggtctttcatcaaattcatggctagagccct

SEQ ID NO: 281892 - DNA, 75 bp, Artificial Sequence
  Synthetic
tgatgaagagatcagccaaagaagagggaggagctggagacaggatctgacagctcaattttacagatctctagg

SEQ ID NO: 281893 - DNA, 75 bp, Artificial Sequence
  Synthetic
gtcaataactctcgatcagatggccaccctaaaagccagtagcaacttctcagaagaatgggaggagtttgaaga

SEQ ID NO: 281894 - DNA, 75 bp, Artificial Sequence
  Synthetic
atctcgcatgaaggaatatcacagggtgaaagtcatagagagaattgcagacttggtcaaccagggacatactta

SEQ ID NO: 281895 - DNA, 75 bp, Artificial Sequence
  Synthetic
ctacactgactgccttggaaggtgcttcaaagtagtactagaagatggctgcatgaggatctgtctctttaaaaa

SEQ ID NO: 281896 - DNA, 75 bp, Artificial Sequence
  Synthetic
agcacaacacggaggtctaagggaaatttatgtgcttcgcctggaagaacgcatgatccaatttagcattgagct

SEQ ID NO: 281897 - DNA, 75 bp, Artificial Sequence
  Synthetic
tctagcaaggaagatcaacgaggctgttggtcatgaaaccattagtgttccttccagaaaagaagagatattgga

SEQ ID NO: 281898 - DNA, 75 bp, Artificial Sequence
  Synthetic
tacacaccaagtcagggcagcaaaagcctgtggagaaggaacaatgatcacactctgtagctcaaatgatgccag

SEQ ID NO: 281899 - DNA, 75 bp, Artificial Sequence
  Synthetic
aacctggaaccaagggcattacaccactaagtttgcattcttgatgtgtgagctcctgcctaaagaactgcatgg

SEQ ID NO: 281900 - DNA, 75 bp, Artificial Sequence
  Synthetic
cttgatctgggcctcatgtgccattttccggaggaaaaagatgatgctcaatctggactacttaaacagcattgc

SEQ ID NO: 281901 - DNA, 75 bp, Artificial Sequence
  Synthetic
aaagcataaagaggggctgcagggattcaagaagaggttgcatgatgggttttcaggcaatgatgatgtcccctg

SEQ ID NO: 281902 - DNA, 75 bp, Artificial Sequence
  Synthetic
gatcaagaagggcaagacctacatcttgactgagactggcatgatgcaggggatactacatctcacatccagcct

SEQ ID NO: 281903 - DNA, 75 bp, Artificial Sequence
  Synthetic
ctaccatgctgcttaccaagctgcaataaggaagctgattaggacaaaactgaagactctagtgggctgtaggat

SEQ ID NO: 281904 - DNA, 75 bp, Artificial Sequence
  Synthetic
cctcatagatgttattgagggctctgatgacagtgccatcatcatttctggagcagtcaaaagtggggaagagga

SEQ ID NO: 281905 - DNA, 75 bp, Artificial Sequence
  Synthetic
gattaggtttagactggcagcctcagcttgtttgctgtgggttaagcacttgggagtgtatgcagggatttacat

SEQ ID NO: 281906 - DNA, 75 bp, Artificial Sequence
  Synthetic
gtccccaaagagcaccataggttgtcttgatgtctgtgaatacaactcagagttcaggtttgcaagactaatgtg

SEQ ID NO: 281907 - DNA, 75 bp, Artificial Sequence
  Synthetic
cagacccacatttaaatgggtgtgtgccagcttgaacataccagaagtagagaagatttcagacaggcaagaagc

SEQ ID NO: 281908 - DNA, 75 bp, Artificial Sequence
  Synthetic
cttcgccaacctgctgacttcagttttggaggggggagggacatctagcctgtgctccatactacagatgtgtca

SEQ ID NO: 281909 - DNA, 75 bp, Artificial Sequence
  Synthetic
ggcttggtgtcactacattctcttaggactttggtcttcctgtgttttcaagagtataatccctcatctgatctc

SEQ ID NO: 281910 - DNA, 75 bp, Artificial Sequence
  Synthetic
tggtaagaatccagatgtgggtttttttctccttgacaacccagtgtgttctggcattctggggtttcgccacaa

SEQ ID NO: 281911 - DNA, 75 bp, Artificial Sequence
  Synthetic
cctatggaggtttgtcagaaaaactgaactctcgaacatttatgcgagaacactagacaatcgagcattggacgg

SEQ ID NO: 281912 - DNA, 75 bp, Artificial Sequence
  Synthetic
gtttgtcttgacatcaggaggaagcctttccaaaagccatttgatccgatggggagataggaagaagttagagca

SEQ ID NO: 281913 - DNA, 75 bp, Artificial Sequence
  Synthetic
gatgaaggaaaggtctggcctagtggagaactggcaagagcagactgatgatgatccaagtgtgttgtacaaaaa

SEQ ID NO: 281914 - DNA, 75 bp, Artificial Sequence
  Synthetic
cccatcaactaacaaggaagtcaagcttttgctttgcataaaaattgactctccaggggttgccgagagtctttc

SEQ ID NO: 281915 - DNA, 75 bp, Artificial Sequence
  Synthetic
taagggcaatgtgctaggcagagtcttagcctcttctgtgtatgtgctacagagaagatgcatcactgcaaagaa

SEQ ID NO: 281916 - DNA, 75 bp, Artificial Sequence
  Synthetic
aagtaaaagaaagtacaccctgatggagctggccctggagcaggatccaaattacagagcattgactctggctga

SEQ ID NO: 281917 - DNA, 75 bp, Artificial Sequence
  Synthetic
agagtctgctatttttggagacatagtgtccctggagaggaatgagaccatgtcacaaatttacagccatgctaa

SEQ ID NO: 281918 - DNA, 75 bp, Artificial Sequence
  Synthetic
tggagtactgattgctaaatcaagggagatgaggagagcaaaagttgaggtgctaagcgccgatgaaagctttag

SEQ ID NO: 281919 - DNA, 75 bp, Artificial Sequence
  Synthetic
ggctcctcctgtcaagataatgggagatgtcttctttggaacgacccgcagtcacatgggagcaaatatgcttag

SEQ ID NO: 281920 - DNA, 75 bp, Artificial Sequence
  Synthetic
cagggaactccattacctcaaggaaagcttcccttggatatctaatgacccccatgactgcttaaatcaatcacc

SEQ ID NO: 281921 - DNA, 75 bp, Artificial Sequence
  Synthetic
cttctcaagtcaagctgagatgaagactttctttgaaaaactggaacaaaaaaccagaaaggtcaggatgatagg

SEQ ID NO: 281922 - DNA, 75 bp, Artificial Sequence
  Synthetic
agcagctgtattcactagaatgggtcagacatctctagagaacctcataaggttcaacttccaaaagaattttga

SEQ ID NO: 281923 - DNA, 75 bp, Artificial Sequence
  Synthetic
actcagcaaaagtgaggtctcagattctgattactcagatgaggacgagaagttctgcagacatgttgtgaccat

SEQ ID NO: 281924 - DNA, 75 bp, Artificial Sequence
  Synthetic
gattctttctggccctttcactaatgaaaggaaagaatgcatgctcattgactttctcaagaattctagtctggg

SEQ ID NO: 281925 - DNA, 75 bp, Artificial Sequence
  Synthetic
accgccaaagcaactcctcagaagaagcaggacaaatgtactgcgggtggttcgctcctggcttgaaggtcatgc

SEQ ID NO: 281926 - DNA, 75 bp, Artificial Sequence
  Synthetic
acgaatagaagaactggtggagaaaagcatggatggcatatgtggagccttcactataaggcaaaaggtgttcaa

SEQ ID NO: 281927 - DNA, 75 bp, Artificial Sequence
  Synthetic
ggacaaaaaaggcaatgtgagttataaaggactgggagtatggacaggcagaattgaaggtacagactgcaaact

SEQ ID NO: 281928 - DNA, 75 bp, Artificial Sequence
  Synthetic
tcagattgaaagcggattcgcatctgaccaaatcttgaagcaagttgtcattgcctctgacaggagcctttctga

SEQ ID NO: 281929 - DNA, 75 bp, Artificial Sequence
  Synthetic
ctttttgcctggcttagaaagactttgcaaagaattaaaggtcatcaatcctagaaaacctttcccaataaaaga

SEQ ID NO: 281930 - DNA, 75 bp, Artificial Sequence
  Synthetic
ggctgaacgtcagaactttatcggtgctctagttgacttcaggctggagtcaagattttcaaaagcaggagctcc

SEQ ID NO: 281931 - DNA, 75 bp, Artificial Sequence
  Synthetic
agtcctattggtgcctcagcatgaggggtttctcaaggaaatgatggatagatctgacataagccttatggtaag

SEQ ID NO: 281932 - DNA, 75 bp, Artificial Sequence
  Synthetic
atcagatgtgctgaacatcagagcagatctaggagatggtagactaatcacaatgctgagttacaagtcctcagg

SEQ ID NO: 281933 - DNA, 75 bp, Artificial Sequence
  Synthetic
acaagatgctgattcagaacagggcaaccagtttttcagcaggagagaagcactctcaaaaaggtttggctgggc

SEQ ID NO: 281934 - DNA, 75 bp, Artificial Sequence
  Synthetic
tattagagaaccttatctcagttggataagccttgggccaattcctgatgctctagttccaagattgaaggagga

SEQ ID NO: 281935 - DNA, 75 bp, Artificial Sequence
  Synthetic
aatgactgggagaaggaggacagaagggattgacggagagcagctcagggatgtgtttaaaagatgttgcaaagg

SEQ ID NO: 281936 - DNA, 75 bp, Artificial Sequence
  Synthetic
gtccctaaggcggaaaggcttaaccgttggtcaatattccaacgtaagattgaggatagaagatacttcagagga

SEQ ID NO: 281937 - DNA, 75 bp, Artificial Sequence
  Synthetic
agtagacattgaccttcttgaactgctagatgaagatgttgactttggagatactttgcaatcacaaaacattca

SEQ ID NO: 281938 - DNA, 75 bp, Artificial Sequence
  Synthetic
agatctcgaggctagtatagaggaaatggaagttttgtttggggaggatgatctagaagttttcgatttcactga

SEQ ID NO: 281939 - DNA, 75 bp, Artificial Sequence
  Synthetic
agtgatctcaagatctgaccctctggcctaccatgggttctgtgatagaattattgaggattacatcaaaaggtt

SEQ ID NO: 281940 - DNA, 75 bp, Artificial Sequence
  Synthetic
gggtcatgaggccatcaggaaagccattcagaagagagaatgtacacaaagtgattaccctctagttaaaaatct

SEQ ID NO: 281941 - DNA, 75 bp, Artificial Sequence
  Synthetic
ctttgagagcattggggaaaaccctgaagagctgtcagtcctacctgacagagatgatgcatatgcctcttctgg

SEQ ID NO: 281942 - DNA, 75 bp, Artificial Sequence
  Synthetic
ctggtctcattacagaagacttatggggttgatctctttgcccttttctttaaatctaaactttctgtttttctc

SEQ ID NO: 281943 - DNA, 75 bp, Artificial Sequence
  Synthetic
aacaacaaattcacctccgcagcatcaaaccatgaacaaaacaaaaatgcctcccaagagacaaaagcccccctc

SEQ ID NO: 281944 - DNA, 75 bp, Artificial Sequence
  Synthetic
cgaaactgttagtgtgccaatggatgagactgaaccagaacaagaggaatcacatttccctgatcttccggggaa

SEQ ID NO: 281945 - DNA, 75 bp, Artificial Sequence
  Synthetic
gttcctccagtatccagttgcggggaaagatccacatccaggcatagggaggaaaggagacattcggaagaatgc

SEQ ID NO: 281946 - DNA, 75 bp, Artificial Sequence
  Synthetic
aattgccttattgtctcaagaaaggagagctcaatatcaccaagtaacagggagtttggtttttctttgcttatt

SEQ ID NO: 281947 - DNA, 75 bp, Artificial Sequence
  Synthetic
aatatcgggtcttcatcaagcatttgcatttggtggaattccggaagagtcctatttagcagcccctttccaaac

SEQ ID NO: 281948 - DNA, 75 bp, Artificial Sequence
  Synthetic
accagacggaacattacgatacgagacagcatgcttctatggctctggtgacattgacagagagcttacacaact

SEQ ID NO: 281949 - DNA, 75 bp, Artificial Sequence
  Synthetic
tgaagtatcatcaatcatgagccactgctgctcgttacttatcggtatcataattgggtcatctacgaaaattaa

SEQ ID NO: 281950 - DNA, 75 bp, Artificial Sequence
  Synthetic
ggctggagctgagcagataagaaagagatttaagaccttgatggcatcacttggaagacctgaccatggtgagac

SEQ ID NO: 281951 - DNA, 75 bp, Artificial Sequence
  Synthetic
agcaaatttactgcagctctacaatccacatatggctatcgattggtttaatagccaaagttgggttgggagctt

SEQ ID NO: 281952 - DNA, 75 bp, Artificial Sequence
  Synthetic
tgttctgggtctacttacaacggacttcgagagccctggaagggaatttatggaccagatgagacttgtagcatc

SEQ ID NO: 281953 - DNA, 75 bp, Artificial Sequence
  Synthetic
atatgcccaaatgactacatacaccactattaaagaatatctagagcaatgcatggatgctaccttgaccattcc

SEQ ID NO: 281954 - DNA, 75 bp, Artificial Sequence
  Synthetic
tgcagtttataaggagattgatgaattcttggatgttgaagaagacctgaggaggaagcacagagagatgttcaa

SEQ ID NO: 281955 - DNA, 75 bp, Artificial Sequence
  Synthetic
gtatcttggagcaatcaggcactcagacgctatcaaacttgctccaagaagttttccgaacttagcctccgctgc

SEQ ID NO: 281956 - DNA, 75 bp, Artificial Sequence
  Synthetic
tttttattggagcaagaaagagaacgctactatgactggatataaggcatcaactatacaaccaggtgcaaccgt

SEQ ID NO: 281957 - DNA, 75 bp, Artificial Sequence
  Synthetic
gaaggaagcacaactcgctcgactgaggaggagagaaattaaaagagatggggatatggaggagtttgatcttaa

SEQ ID NO: 281958 - DNA, 75 bp, Artificial Sequence
  Synthetic
ggcagcgggtataatggcgaggatcggtgttactggatatgcagaagcaaagtgaacaaacctatataaaaccat

SEQ ID NO: 281959 - DNA, 75 bp, Artificial Sequence
  Synthetic
atagatgagtgctgacgcattactcagtattgttgagcttgcacgcaggctggatggcgactcgaagagacaatc

SEQ ID NO: 281960 - DNA, 75 bp, Artificial Sequence
  Synthetic
tagtgtctccgctagaagaggacccaccgtcgacagcacatcgaaccagatcgaggtcaccaataaggaggaaga

SEQ ID NO: 281961 - DNA, 75 bp, Artificial Sequence
  Synthetic
agagtctggacaagagactgctggggtactcagtggaagagttggtggacaagatgtcagtaaatccgggcctaa

SEQ ID NO: 281962 - DNA, 75 bp, Artificial Sequence
  Synthetic
tctacgacaaagagcagctggcaacaggaagggaagcgctgtcgagtgaggagcttattaagcaattgatgggcg

SEQ ID NO: 281963 - DNA, 75 bp, Artificial Sequence
  Synthetic
agatcaagacagcaactgaggagagaaagatagaccaagaagtaatccagatgaagttcagtcatcttgagcgta

SEQ ID NO: 281964 - DNA, 75 bp, Artificial Sequence
  Synthetic
cattggaatcatatttcgagtcggtcgtgactactcaagttgagatccttgagaagctcgggcagctagattact

SEQ ID NO: 281965 - DNA, 75 bp, Artificial Sequence
  Synthetic
ccggcagtattagacaactgggtgaaaacatgaagatacttgacaagtctctcaaggccgtgacagcatctgtaa

SEQ ID NO: 281966 - DNA, 75 bp, Artificial Sequence
  Synthetic
ctctgatgactgagaaagttgatctcttgtatgggaaaatggcagtcgggacaagcaacgctccgatgattccat

SEQ ID NO: 281967 - DNA, 75 bp, Artificial Sequence
  Synthetic
catgcccacagccccaaagcatctacccaaagcttcctgagtccactgccaccgcaccagcactagacatcgtat

SEQ ID NO: 281968 - DNA, 75 bp, Artificial Sequence
  Synthetic
tctaaaaaaatcgaacctcctcaaaatggcaccaaagcatgagtacattgaacttaaggacaaggtaattgttcc

SEQ ID NO: 281969 - DNA, 75 bp, Artificial Sequence
  Synthetic
cggctggaaaactcttatgcttgagattgactttgttggtggcgcatcaagaaatcaatttgttaatttccctct

SEQ ID NO: 281970 - DNA, 75 bp, Artificial Sequence
  Synthetic
cctttcagtgaaagacgacttcagacttcctcgcgagaagagactgatcaactatctcactgttgatgcagagcc

SEQ ID NO: 281971 - DNA, 75 bp, Artificial Sequence
  Synthetic
aagcggtcacggatcagtgaacatatatctcctgtttagtgacttcttggttcagacattgaactcaatctcagt

SEQ ID NO: 281972 - DNA, 75 bp, Artificial Sequence
  Synthetic
ctacaaagacccgataaagcagcatatgtatgtacgccttactgagaaccagagtaagcatgcaattaatgctgc

SEQ ID NO: 281973 - DNA, 75 bp, Artificial Sequence
  Synthetic
cttcgatgtgcattcttatcggctcaggaatgttggagttggtccacttggtccagacatcagagctacaagccc

SEQ ID NO: 281974 - DNA, 75 bp, Artificial Sequence
  Synthetic
ttaattgcgacaccagatcgtcccctgctctgatcgacctcgagattcgacgtctgtgccataagacaaccgaga

SEQ ID NO: 281975 - DNA, 75 bp, Artificial Sequence
  Synthetic
atgtcgtttcatgcgaggtgagctaccaaaaccacactgtggaggaagtcaaggctacacttgtgtcttgttact

SEQ ID NO: 281976 - DNA, 75 bp, Artificial Sequence
  Synthetic
catatcggtgtacaacctactggggattttttggaagttacagtgctgataaaatgacatttcggtacactggaa

SEQ ID NO: 281977 - DNA, 75 bp, Artificial Sequence
  Synthetic
atgctacgacctgtaataaccaaactgttgaggaaccatatatttgtaactggtattattgttgttccaaagctg

SEQ ID NO: 281978 - DNA, 75 bp, Artificial Sequence
  Synthetic
taaacacaatttgcaggtgcacgaataacaatgtgacagttgtcatcaaatctgcaccaccatacatgtactgta

SEQ ID NO: 281979 - DNA, 75 bp, Artificial Sequence
  Synthetic
gttttggagattgtagcactgtaactaagcgtgaaattgagagaggacttgcaaagttgagtgatggtagcttgt

SEQ ID NO: 281980 - DNA, 75 bp, Artificial Sequence
  Synthetic
tgtattttaactcaacaattattcctcccgacatagtcaataccagtataaatggatctgtcctctgtaataaca

SEQ ID NO: 281981 - DNA, 75 bp, Artificial Sequence
  Synthetic
agtcaaagctagtatccttcgataagttcaggaggtcataccctcttagaaaatggaagtacaatagtcagtcta

SEQ ID NO: 281982 - DNA, 75 bp, Artificial Sequence
  Synthetic
ttaacattacatgttcgaatgactctaacatttgtccagccaaaaggcggaagagggatctatcacaagtgtcat

SEQ ID NO: 281983 - DNA, 75 bp, Artificial Sequence
  Synthetic
acgctcttcacaaaattagaccaatactagcagatgcgtgggaggattgtgagattatgcagtctttgatattag

SEQ ID NO: 281984 - DNA, 75 bp, Artificial Sequence
  Synthetic
gaatgacagggtcaaatctatttagtagttctcaattcttgaggaaatggttaaatcgtaccgacataatagggt

SEQ ID NO: 281985 - DNA, 75 bp, Artificial Sequence
  Synthetic
atgttgttggaggactaggtgttatttggcagtgctcaagggttaatgtgtcgttcctatcatggaatgagtcga

SEQ ID NO: 281986 - DNA, 75 bp, Artificial Sequence
  Synthetic
catatttcccgccagtaagctatatggataaaataatgtatctcaatgatgaggataggttgcaggactcgactc

SEQ ID NO: 281987 - DNA, 75 bp, Artificial Sequence
  Synthetic
cagaggctaagccagggcttaaaagattgctcctccacgggtcatactttctcggaaccgttgggtcaggactca

SEQ ID NO: 281988 - DNA, 75 bp, Artificial Sequence
  Synthetic
aaccaaaattggtgagttatgataggtcgacacatgactaccatttagatgaatttgatgcaatctttaatttaa

SEQ ID NO: 281989 - DNA, 75 bp, Artificial Sequence
  Synthetic
caccagaagttgatcttatatctggtcatgagacaaacccgatcaaccatgccttcggtactcagtcaggtctgc

SEQ ID NO: 281990 - DNA, 75 bp, Artificial Sequence
  Synthetic
taccgtacaccaggtcgaccaacctcacttcaaccgacacaggatctgggtgggttcatattggcctaccatcat

SEQ ID NO: 281991 - DNA, 75 bp, Artificial Sequence
  Synthetic
ttacattcttaaacccgttgggttgggttagagatatcctttcatgggcagcatggattggtgggatactttatc

SEQ ID NO: 281992 - DNA, 75 bp, Artificial Sequence
  Synthetic
ttataacactgtgtatatctcttccagccttaatcaaccggaagaggcgcctgggccggtggtcgtaatcaacag

SEQ ID NO: 281993 - DNA, 75 bp, Artificial Sequence
  Synthetic
agcagaccagacactcaagaatccattgattgggactgaagtgtccttttgtttggagtcccggttcctcaatca

SEQ ID NO: 281994 - DNA, 75 bp, Artificial Sequence
  Synthetic
tcataggcgggcactacaattgattaagccaattaatcttgaatcaaagtattattacaagttattccgactaat

SEQ ID NO: 281995 - DNA, 75 bp, Artificial Sequence
  Synthetic
caagcttaagcctgaagcatatcccgttggtgtgataataagagctgccgagtcaatattaacaattgtagtcaa

SEQ ID NO: 281996 - DNA, 75 bp, Artificial Sequence
  Synthetic
gacatggcacttagagtccatgacagaaaccctccttgctgctgtgagatacgctttaaccaacccaagggttcg

SEQ ID NO: 281997 - DNA, 75 bp, Artificial Sequence
  Synthetic
tgcactattcgataatcacatgacattccaaagaattatccgcgaagtttcttattcaagagactctgatgtagg

SEQ ID NO: 281998 - DNA, 75 bp, Artificial Sequence
  Synthetic
accagttagtattggtcagttgacaatctacttcatacaatctctaattgtaatacactggaacgaacaaagctg

SEQ ID NO: 281999 - DNA, 75 bp, Artificial Sequence
  Synthetic
tattgccacatataatcattttctagctgctgcggatactgccaagagtagatgccaccttgcgatatcagcagt

SEQ ID NO: 282000 - DNA, 75 bp, Artificial Sequence
  Synthetic
tgtatcaggagcaatccgagctgggggaccattccttgatattatttttgctatgattgacacaatagatgctat

SEQ ID NO: 282001 - DNA, 75 bp, Artificial Sequence
  Synthetic
tgttacagaacatgatgattactttaacattgtcaaatcaatttacccctatacacaaggacttgtgatggaaga

SEQ ID NO: 282002 - DNA, 75 bp, Artificial Sequence
  Synthetic
gcacaatgagactgttgaatctaacttctgtgcaatttttacaatgattccggaaaaagctccagggcttgataa

SEQ ID NO: 282003 - DNA, 75 bp, Artificial Sequence
  Synthetic
cttactaaaaaaacttgtcaagaaagatccaagactagctcttgagatagcatccgttcaaaaatcctggttctt

SEQ ID NO: 282004 - DNA, 75 bp, Artificial Sequence
  Synthetic
tccagaaatcgatatggtcaatggcccaagagagcaactaacgaaaatgagaaatgaggttgaaaccggtccatc

SEQ ID NO: 282005 - DNA, 75 bp, Artificial Sequence
  Synthetic
tctgctcaattatggtaacaaaatactgtccgtctttcgtgcagagttcatcaaagggttcattgcaaagaattc

SEQ ID NO: 282006 - DNA, 75 bp, Artificial Sequence
  Synthetic
aaaatggccacccgtagttctagaaccaggctgtccaacacaaatacgcacagccaaggaactaaacaactggag

SEQ ID NO: 282007 - DNA, 75 bp, Artificial Sequence
  Synthetic
ttcagcctttgacattaactggcactggttccggtatgtgtcgatccagaaggtatttgagctggacacagatcc

SEQ ID NO: 282008 - DNA, 75 bp, Artificial Sequence
  Synthetic
agacttcaatgacatagtcacagacaaggcagtcatcgagagtagagcatcgtggccattcgaattcaacagtgc

SEQ ID NO: 282009 - DNA, 75 bp, Artificial Sequence
  Synthetic
ggcccataggcacaaacacaaaaaaccgctcgatagaccaacagggggcaagggggtctcgaggcttgttaatgc

SEQ ID NO: 282010 - DNA, 75 bp, Artificial Sequence
  Synthetic
actaatagacggtaaactagacaacataccaaaactcttagaaccttacatggtcgggtctgtcgatatccgaga

SEQ ID NO: 282011 - DNA, 75 bp, Artificial Sequence
  Synthetic
caggatcactattttggtaccaaaagaaaaagaactcaaagttaagggtaggttcttctcgaagcagtctctcaa

SEQ ID NO: 282012 - DNA, 75 bp, Artificial Sequence
  Synthetic
cacccgtgtttaccaggtgataagtgaggcaacactaaagagggatataatgcccctaatcaggacacactcaat

SEQ ID NO: 282013 - DNA, 75 bp, Artificial Sequence
  Synthetic
gactatgggatcaactgctcttacccacttgttgaacaagctctcacacaaaatgaaaacaaaagaagcctttgt

SEQ ID NO: 282014 - DNA, 75 bp, Artificial Sequence
  Synthetic
tatcaatcttgactatagctcatggtgtaatgcattccgacccgaattgcagatgcctatttgccgtgagcttga

SEQ ID NO: 282015 - DNA, 75 bp, Artificial Sequence
  Synthetic
cagcatatatgattcctcttacttttttaggaccggttgcatgctcccctgttacacaacattcatagttcaaaa

SEQ ID NO: 282016 - DNA, 75 bp, Artificial Sequence
  Synthetic
caggttcaatcccccacttcagagtgagatgggagatccaattgaagatggagtgacttgtatccaaggagcact

SEQ ID NO: 282017 - DNA, 75 bp, Artificial Sequence
  Synthetic
aaccccaggtgagggaatgaggcagaaactgtggactataattacagggtgctgggagatgatagcacttagaga

SEQ ID NO: 282018 - DNA, 75 bp, Artificial Sequence
  Synthetic
agcagctgtccagtttgatatacttggacagggagataatcagactataataatatactcaagcacaattgagtc

SEQ ID NO: 282019 - DNA, 75 bp, Artificial Sequence
  Synthetic
taatcaatgcttggctacacgggctctcggctctttatacaagcatgcaagattagcaggacatacactcaaggt

SEQ ID NO: 282020 - DNA, 75 bp, Artificial Sequence
  Synthetic
tgaagagtgttggatctctgattgtctatacgaatatggtaagagaatgtactttcacgggatcccgatctcggg

SEQ ID NO: 282021 - DNA, 75 bp, Artificial Sequence
  Synthetic
tgcactcaagcagctatcacgtgtaacagactcaactggagaaatatttcccaacctgtattcaaaactcgcctg

SEQ ID NO: 282022 - DNA, 75 bp, Artificial Sequence
  Synthetic
cttaatttcatcctgtctcagtgctgctatgtcagacacctccccgtggatttcactaaccgcagggacaatact

SEQ ID NO: 282023 - DNA, 75 bp, Artificial Sequence
  Synthetic
atatctagtggaactatatatagagttgcctccaacaacaatgcaacaggaggacatcatagtcatcttggcact

SEQ ID NO: 282024 - DNA, 75 bp, Artificial Sequence
  Synthetic
agttggcccgatacttggagggcttccaactccagcaatgctcccaagtgtattttttagaggaatgtcagaccc

SEQ ID NO: 282025 - DNA, 75 bp, Artificial Sequence
  Synthetic
ccttccacttcagcttgcactcctcaaagaagctcttaatagtactaatgtatcattgtcacttattaacagagt

SEQ ID NO: 282026 - DNA, 75 bp, Artificial Sequence
  Synthetic
tgtaaaacttaagatttcttcttcaacagactggcttgcactggtaacggacccgacctctcttaacatatctca

SEQ ID NO: 282027 - DNA, 75 bp, Artificial Sequence
  Synthetic
actactaagacccgagagacaactccgaagatgggttgagcaagctattaaccagagtacgcactcatctcgagt

SEQ ID NO: 282028 - DNA, 75 bp, Artificial Sequence
  Synthetic
agcagatttcttcagacaacccctaactgagctggcccagatgttagcttatgacttatcgacaatgattccttt

SEQ ID NO: 282029 - DNA, 75 bp, Artificial Sequence
  Synthetic
aagacctcgtgatatgtcagcgttgtttggattatcaaatgtctcatatggactagggattattgacctattcca

SEQ ID NO: 282030 - DNA, 75 bp, Artificial Sequence
  Synthetic
gaagtcctccacagtaatctctgccaaccagactgtgcatttagaggatattgtcttggaaagcaagaggtataa

SEQ ID NO: 282031 - DNA, 75 bp, Artificial Sequence
  Synthetic
aatgagtgttgttgagagactccaagacaagtcagagggcatagatatggggccctttttggaaggatgtactta

SEQ ID NO: 282032 - DNA, 75 bp, Artificial Sequence
  Synthetic
cttggcttcaaaacgactgagagcactaacatggggaagagagttagttggggtcactatgccattcgtttcaga

SEQ ID NO: 282033 - DNA, 75 bp, Artificial Sequence
  Synthetic
acagttcagaccagtcaagtcaaaagatgccaccacctcttcctataaagatgctataatatattgcccagaaga

SEQ ID NO: 282034 - DNA, 75 bp, Artificial Sequence
  Synthetic
accattaacgccggcccatcttgataagaaagggaaacaacctttgtatcttggatcaaatacgagtgttaaggt

SEQ ID NO: 282035 - DNA, 75 bp, Artificial Sequence
  Synthetic
tcaaaaaggtgaaatcacagggttaaataagtccagagctgcaggactggtcagagacactctggtactgtgtga

SEQ ID NO: 282036 - DNA, 75 bp, Artificial Sequence
  Synthetic
gtggtataaggttagaaagatcaatgaccctaatctcagtttactattgaagaggttcttgactgagaaggggta

SEQ ID NO: 282037 - DNA, 75 bp, Artificial Sequence
  Synthetic
taatcagactcaatctctgtctgttcaagggggtacgctaacccacaggcttccatcaagaggggatagtcgcca

SEQ ID NO: 282038 - DNA, 75 bp, Artificial Sequence
  Synthetic
agggctcacgggttttataaacattattagtacatggctacgatttaccagtgactatttaacaacttactcaaa

SEQ ID NO: 282039 - DNA, 75 bp, Artificial Sequence
  Synthetic
gtctgtggacgattatactattcatttccaacatgtgtttacatatggttgtctgtatgctgactcagtgttaag

SEQ ID NO: 282040 - DNA, 75 bp, Artificial Sequence
  Synthetic
gtcctcgggtcatattcaggaaccatttcttctagaggcagcatgtagcagctgctttgagaggataacatctga

SEQ ID NO: 282041 - DNA, 75 bp, Artificial Sequence
  Synthetic
ggagtttgtcctagcttcatccccgatgtatcagggggcaccatggcttttaaggaaaacaatagcacttgacaa

SEQ ID NO: 282042 - DNA, 75 bp, Artificial Sequence
  Synthetic
cccggttcagccaggagtatgcgaccttgatccatgtgttgcagctgcttcatcaatagggcaactagtagtgcg

SEQ ID NO: 282043 - DNA, 75 bp, Artificial Sequence
  Synthetic
atcattaatatcagaaacacgctatgtaagatcatcaattacagaacacaaaacagcattcaatcttgagaggtt

SEQ ID NO: 282044 - DNA, 75 bp, Artificial Sequence
  Synthetic
ctcattggcagaccttaaaacaataccatggagtgtcacggtacagtctgcctggttgtacctcatgtcaattaa

SEQ ID NO: 282045 - DNA, 75 bp, Artificial Sequence
  Synthetic
attatcccactttgagaagaaatctcttgttgggctaattttcaaaccagatagcccaacacgaaaattcttgac

SEQ ID NO: 282046 - DNA, 75 bp, Artificial Sequence
  Synthetic
gaaggcgcttggtgattcatctatgataacacaaataatcccgattgtaaggggcctaagtgtgatttaccatag

SEQ ID NO: 282047 - DNA, 75 bp, Artificial Sequence
  Synthetic
aaatcgtggggagttgttgatgaagatcatattaatgccgctaattaatttagatgtagtggcaatggcggtagg

SEQ ID NO: 282048 - DNA, 75 bp, Artificial Sequence
  Synthetic
gaaaatgtcaagagtctactcggagatagattatacgaatgttgatttctatattgcaaggtcaagagaggtcgc

SEQ ID NO: 282049 - DNA, 75 bp, Artificial Sequence
  Synthetic
taggaagccaagtttcgttgttaatgaaaccaatgacttcaccgctacagggtttcatacagggaagtggtcgct

SEQ ID NO: 282050 - DNA, 75 bp, Artificial Sequence
  Synthetic
tgctagcagtgaaatctctatggaaatccaagcaattaaaatggggttaagaaaggaggaaataacaagaatttg

SEQ ID NO: 282051 - DNA, 75 bp, Artificial Sequence
  Synthetic
ggtttacccggaaattgacccaagtgtaccccttgacatatgtcacttaccagggataagagtattcctgatact

SEQ ID NO: 282052 - DNA, 75 bp, Artificial Sequence
  Synthetic
agcaggtgaccctgattattatgaacggattcttgacatggatatgtgtggagctgctgcatccaggattgatgt

SEQ ID NO: 282053 - DNA, 75 bp, Artificial Sequence
  Synthetic
ggtacaatcattagccttgagtagccactttggttaccatcttggcggccctgaggactcagctctgataacagt

SEQ ID NO: 282054 - DNA, 75 bp, Artificial Sequence
  Synthetic
tgaagaggttgacaaatgtgtaagatctcatcactgtcttggactagacccacccaagcttgtcatcgggaattc

SEQ ID NO: 282055 - DNA, 75 bp, Artificial Sequence
  Synthetic
tgagatttgtttagacgggatgtgttgtctccctcttggcgatccatgcccagccctgtatcctcccatgtatag

SEQ ID NO: 282056 - DNA, 75 bp, Artificial Sequence
  Synthetic
agatgcagttaaattctccaatgcgttactcaatgcatatgaattcttaattgacctaattgacatatcgtcacc

SEQ ID NO: 282057 - DNA, 75 bp, Artificial Sequence
  Synthetic
tgttgtggctgaggcacttgaggagcttgacaagctagtacaggttgcgcaatcaaattgcaaattaccaactaa

SEQ ID NO: 282058 - DNA, 75 bp, Artificial Sequence
  Synthetic
acttgtagtgacctactggttagcacctcaactgaggagaccagcaatcttggttgggtctgctccgagagggtg

SEQ ID NO: 282059 - DNA, 75 bp, Artificial Sequence
  Synthetic
gagacgatttgtggtgtcgggaagattgccatctttcttgtttgctttctggggggatgatgcctcaattatgga

SEQ ID NO: 282060 - DNA, 75 bp, Artificial Sequence
  Synthetic
tgttgttattgaccagcttccagctgagttagttaagataataatttcataaaaaaccatctgggctctttgatg

SEQ ID NO: 282061 - DNA, 75 bp, Artificial Sequence
  Synthetic
aagataataatttcataaaaaaccatctgggctctttgatggaggtttggtgctggtttgcttttgttgtagcgc

SEQ ID NO: 282062 - DNA, 75 bp, Artificial Sequence
  Synthetic
agaataatctatctagacccttccttaggaggagtgtctggaatgtctttggggagatttcatatacgccagttc

SEQ ID NO: 282063 - DNA, 75 bp, Artificial Sequence
  Synthetic
aaaaatgtaacacccctacaatggatgccgacaagattgtatttaaagtcaagaatcaggtggtctctctgaagc

SEQ ID NO: 282064 - DNA, 75 bp, Artificial Sequence
  Synthetic
tcagagttctaactgtctttttgacagaaactatacactcatgctaaaagatcttttcttgtctcgcttcaactc

SEQ ID NO: 282065 - DNA, 75 bp, Artificial Sequence
  Synthetic
ctgaaattattgtggaccaatatgagtacaagtacccggctatcaaagactctaggaagcccagtataaccttgg

SEQ ID NO: 282066 - DNA, 75 bp, Artificial Sequence
  Synthetic
actactttaaatatcaagggaggggcaagccccactatcttactcaaggatgcgatcaggaaagccctgtatgac

SEQ ID NO: 282067 - DNA, 75 bp, Artificial Sequence
  Synthetic
ggaatgaaatcatcccctctaaagggtgtttaagagttggggggagatgtcatcctcatgtgaacggggtgttct

SEQ ID NO: 282068 - DNA, 75 bp, Artificial Sequence
  Synthetic
acccttcgagagatgagccttgtgttgttcaattgtagcagtccgaagagtgagatgcaaagagctcgctcctta

SEQ ID NO: 282069 - DNA, 75 bp, Artificial Sequence
  Synthetic
gatcaccccagaatctctcgtagacatcaggcgtaccaatgtggaagggaattgggctctaacagggggtatgga

SEQ ID NO: 282070 - DNA, 75 bp, Artificial Sequence
  Synthetic
cgagttacagaggggaactctgtccaaagtggccatcattatagccatcatgatagtcttttccaatagagtgtt

SEQ ID NO: 282071 - DNA, 75 bp, Artificial Sequence
  Synthetic
cctgagtcaatcatcggattgatacaaaactctcggacaataagaagacagtttagaaaaagcctctcaagaact

SEQ ID NO: 282072 - DNA, 75 bp, Artificial Sequence
  Synthetic
ccaggtgattttgaatccctaagcggtagagaaaagtctcgacatatagggtctgctcaggggctcttgtactca

SEQ ID NO: 282073 - DNA, 75 bp, Artificial Sequence
  Synthetic
gagaccaagctgtgaggacaagtcatctcttctacacttcgagtcccgaagacctcatcccctcggggtaagggg

SEQ ID NO: 282074 - DNA, 75 bp, Artificial Sequence
  Synthetic
gcgccaactggagtaccatacctaacttcagatttctggctgggacctatgacatgtttttctcccggattgaac

SEQ ID NO: 282075 - DNA, 75 bp, Artificial Sequence
  Synthetic
cacagttgttactgcttatgaggactgctcagggttggtgtcattcacggggtttataaagcaaataaatcttac

SEQ ID NO: 282076 - DNA, 75 bp, Artificial Sequence
  Synthetic
tttcacctggactatgagaagtggaacaatcatcaaagattagagtcaacagaggatgtattttctgtcctagat

SEQ ID NO: 282077 - DNA, 75 bp, Artificial Sequence
  Synthetic
gcctacccaaccaccatgaaggaaggcaacagatcgatcttgtgttatctccaacatgtgctacgctatgagaga

SEQ ID NO: 282078 - DNA, 75 bp, Artificial Sequence
  Synthetic
tgagtgggaaatcgccatactcatcaaatgcagttggccatgtgttcaatctcattcactttgtcgggtgctaca

SEQ ID NO: 282079 - DNA, 75 bp, Artificial Sequence
  Synthetic
ttgactacagttgtttatgaactggacactctcagaggcttgtacaggtcaaaactcttatacgatacgccttga

SEQ ID NO: 282080 - DNA, 75 bp, Artificial Sequence
  Synthetic
aaaactcttatacgatacgccttgaaaaaaacaagattatgacgctgagcctctggttgtttgattgtttttttc

SEQ ID NO: 282081 - DNA, 75 bp, Artificial Sequence
  Synthetic
atctcctactccaaagggttgagagacgtttgtctaagagtatgagggttaacctgagacaaatgagttctctga

SEQ ID NO: 282082 - DNA, 75 bp, Artificial Sequence
  Synthetic
acgcttaacaacaaaatcagagaagaagcagacagcgtcagttgcaaagcaaaaatgtaacacccctacaatgga

SEQ ID NO: 282083 - DNA, 75 bp, Artificial Sequence
  Synthetic
atgaagcggctgagttgatgaggactgatacggcattggcagatgacgggaccgtcaactctgatgacgaggact

SEQ ID NO: 282084 - DNA, 75 bp, Artificial Sequence
  Synthetic
gacattcagcgattacttaaagactctttgcgaaggaccaagtgggtggatcaagaggtgcgccatgcagctaga

SEQ ID NO: 282085 - DNA, 75 bp, Artificial Sequence
  Synthetic
taaacagtttagtccagagggcagagaagtttagacctcttattcattctctaggggatttccctgtgttcataa

SEQ ID NO: 282086 - DNA, 75 bp, Artificial Sequence
  Synthetic
aactggtacaaagagacacaaggctgaaggactctacatttcactggcacctccgatgtaacaggtgtgtaaggc

SEQ ID NO: 282087 - DNA, 75 bp, Artificial Sequence
  Synthetic
gccatcgaggaaggggcatctaaactagggctgatcatcaagaaagaagagaccatgtgtagttatgactttctc

SEQ ID NO: 282088 - DNA, 75 bp, Artificial Sequence
  Synthetic
tagatagagaatctcaaaccaggaacacaagaaccaagatactagctcaaggagacaaccaggttctgtgtccga

SEQ ID NO: 282089 - DNA, 75 bp, Artificial Sequence
  Synthetic
cacatataaggaggtatgtatcagtcagctccaatcatcaagctcgacccaattcatttgctgagttcttaaaca

SEQ ID NO: 282090 - DNA, 75 bp, Artificial Sequence
  Synthetic
caacaggttgcagtctccacctcctccaacccagcccttgtctcagagcttgacataagggcactctctaagaga

SEQ ID NO: 282091 - DNA, 75 bp, Artificial Sequence
  Synthetic
tatatcgactcgcgactccttgcaaaagaccatcccttgaatccttatatcaaaactcagacatggccacccaaa

SEQ ID NO: 282092 - DNA, 75 bp, Artificial Sequence
  Synthetic
ctttgcgaaggaccaagtgggtggatcaagaggtgcgccatgcagctagaaccatgacaggagactacagcccca

SEQ ID NO: 282093 - DNA, 75 bp, Artificial Sequence
  Synthetic
caatataccgagctatcgaggaaggagcatctaaactggggctgatcatcaagaaagaagagaccatgtgtagtt

SEQ ID NO: 282094 - DNA, 75 bp, Artificial Sequence
  Synthetic
taataaagtgcgtacatacttcacgaaaaaaactaacacccctcctttcgaaccatctcaaacatgagcaagatt

SEQ ID NO: 282095 - DNA, 75 bp, Artificial Sequence
  Synthetic
tttcaaaaccctttaatctctgggttgagagtggttcagtgggcaaccggtgcccattataagcttaaacctatt

SEQ ID NO: 282096 - DNA, 75 bp, Artificial Sequence
  Synthetic
ataaagcgtactgatgtggaggggaattgggccctgacaggaggcatagaactgacaagggaccctactgtctcc

SEQ ID NO: 282097 - DNA, 75 bp, Artificial Sequence
  Synthetic
atctccaaggagagcccatagaggtagacagtctcccggaagacataagaaggcttcaactggacgaccagaaac

SEQ ID NO: 282098 - DNA, 75 bp, Artificial Sequence
  Synthetic
tcttaagccaaaggaaagagagctgaagattgaaggtcgattctttgcgttgatgtcttggaatttaagattgta

SEQ ID NO: 282099 - DNA, 75 bp, Artificial Sequence
  Synthetic
ccagtcctaccattctactcaaggatgcaatcagaaaggctctgtatgacgaggtggacaaggtggaaaattcag

SEQ ID NO: 282100 - DNA, 75 bp, Artificial Sequence
  Synthetic
gactttcagatggatgaggcagaggaccctgctctcttgttccagtcttacctggacaatgttggaattcagatg

SEQ ID NO: 282101 - DNA, 75 bp, Artificial Sequence
  Synthetic
cttcagattcctggctggaacttatgacatgtttttctccaggattgaacatctgtattcagcaattagagtggg

SEQ ID NO: 282102 - DNA, 75 bp, Artificial Sequence
  Synthetic
tgctcagggctggtatcgtttacagggttcataaaacagattaatctcaccgcaagagaagcaatactatatttc

SEQ ID NO: 282103 - DNA, 75 bp, Artificial Sequence
  Synthetic
ggtttataaagcagataaatcttactgcgagggaagcactattatatttcttccacaaaaactttgaggaggaga

SEQ ID NO: 282104 - DNA, 75 bp, Artificial Sequence
  Synthetic
acggtcaactttatcattcttccgggaaagtcttcagaagacaaagcaacccagactgtgagccgggaatttaag

SEQ ID NO: 282105 - DNA, 75 bp, Artificial Sequence
  Synthetic
agagacagctgttcctcactcttatttcatccacttccgttcactaggcttgagtggaaagtctccttattcatc

SEQ ID NO: 282106 - DNA, 75 bp, Artificial Sequence
  Synthetic
caaaatggcggcacaaactgcctctggtcctcctgctatagagtggtcctccgccaacgaagatgatgacccatc

SEQ ID NO: 282107 - DNA, 75 bp, Artificial Sequence
  Synthetic
caaagagatgggccagagtctcttgtatctcgaacgaccagatagtcaaccttgccaatataatgtcaaccgtgt

SEQ ID NO: 282108 - DNA, 75 bp, Artificial Sequence
  Synthetic
catgagatgtctgttctagggggctatcttggagaggaattcttcgggaaagggacgtttgaaagaagattcttt

SEQ ID NO: 282109 - DNA, 75 bp, Artificial Sequence
  Synthetic
aggaacttttgaaagaagattcttcagggacgagaaggaacttcaagaatatgaggcagctgaattgacaaaagc

SEQ ID NO: 282110 - DNA, 75 bp, Artificial Sequence
  Synthetic
tcaaagagtcaaagaatgtgcccagcgtgactcgcctggcccaagacggatcaaaactccctctgagatgtgtgc

SEQ ID NO: 282111 - DNA, 75 bp, Artificial Sequence
  Synthetic
tcattctggagagaaatttggctgagctcccatgaatcttggattcatgccctgtgtcaggaagcagggaaccca

SEQ ID NO: 282112 - DNA, 75 bp, Artificial Sequence
  Synthetic
tctcaagaactttagaagagtccttctacaactcagagatccacgggattaatcggatgacccagacacctcaaa

SEQ ID NO: 282113 - DNA, 75 bp, Artificial Sequence
  Synthetic
cctgacaaactaaacaagataatgcaagacgacctgaatcgttatgccttcttctgaccacgcccccaagctcag

SEQ ID NO: 282114 - DNA, 75 bp, Artificial Sequence
  Synthetic
cgcatattcggagatatgtctcagtcagttcaaatcatcaaacccgtccaggctcattcgctgagttcctaaaca

SEQ ID NO: 282115 - DNA, 75 bp, Artificial Sequence
  Synthetic
tcgcaagacttcacgacctgtacaacagacctataacctattacttcaggaagcaagtcatccgagggaatattt

SEQ ID NO: 282116 - DNA, 75 bp, Artificial Sequence
  Synthetic
agactagcttcctggctgtcagagaaccgaggggggcctgttcctagcgaaaaagtcatcatcacagccctgtct

SEQ ID NO: 282117 - DNA, 75 bp, Artificial Sequence
  Synthetic
tgtagagatgaggacactcagaagccctctctcgtgtcagctcctcctgatgatgatgatttgtggttaccccct

SEQ ID NO: 282118 - DNA, 75 bp, Artificial Sequence
  Synthetic
tgggagaaaccatcggatctcaggaacttgaccacatggaagtacttccagtcagtccaaaggaaggtgaacatg

SEQ ID NO: 282119 - DNA, 75 bp, Artificial Sequence
  Synthetic
tcgacagggtcactgggcaagggcttttagactattcaagggtcacatatgcatttcacctggactatgagaagt

SEQ ID NO: 282120 - DNA, 75 bp, Artificial Sequence
  Synthetic
tttttgcatcaacggagaagtcaaggtgtgtagtccaaacggctattcatttagaatcctaagacacattttgaa

SEQ ID NO: 282121 - DNA, 75 bp, Artificial Sequence
  Synthetic
ggtagtgaagactaccagacttgttggcagcatcaaggacctatctagagagatagaaaaacaccttcacgggta

SEQ ID NO: 282122 - DNA, 75 bp, Artificial Sequence
  Synthetic
ttcatgtggtgaaaagggctatatcgttaaaagaatctataaactggttcatcaatagaaattccaatttggctc

SEQ ID NO: 282123 - DNA, 75 bp, Artificial Sequence
  Synthetic
atcttcagggagaacctatagaagtggataatctccctgaggacatgaggcgacttcacttagacgatggacaat

SEQ ID NO: 282124 - DNA, 75 bp, Artificial Sequence
  Synthetic
ggataatctccctgaggacatgaggcgacttcacttagacgatggacaatcgcctaaccctggtgagacggccaa

SEQ ID NO: 282125 - DNA, 75 bp, Artificial Sequence
  Synthetic
cggcttcaactagatgacgacaaaccgtctgacctcggcagtatggccaaagtgggggagagcaagggtcaggaa

SEQ ID NO: 282126 - DNA, 75 bp, Artificial Sequence
  Synthetic
actacagttgcttgtaaaccggctactcccggaggcctgtacgtgataaggctcttatatgatatatcttgaaaa

SEQ ID NO: 282127 - DNA, 75 bp, Artificial Sequence
  Synthetic
gtgtgtagtccaaacggctattcatttagaatcctaagacacattttgaaatcattcgatgagatctattccggg

SEQ ID NO: 282128 - DNA, 75 bp, Artificial Sequence
  Synthetic
gctcttatatgatatatcttgaaaaaaacaagatcttgaatccgagcctctgattgcttgattgttttttccgtc

SEQ ID NO: 282129 - DNA, 75 bp, Artificial Sequence
  Synthetic
ttagaatactctcaagagatcacctgggatgatgacacagaatttgttgggttggaaatacgagtgagtgcaaga

SEQ ID NO: 282130 - DNA, 75 bp, Artificial Sequence
  Synthetic
gattcctgaaaatatggtcccagactgtcgaggagatcatatcctatgtcgcagtcaactttcccggtgtgccgg

SEQ ID NO: 282131 - DNA, 75 bp, Artificial Sequence
  Synthetic
ggtgtatcaacatgaactctagggcatgtcagttgtggtctgacatgtccctaaaaacacaaaggtctgaagagg

SEQ ID NO: 282132 - DNA, 75 bp, Artificial Sequence
  Synthetic
taccaagatcttgtaagaggattcccagaggagattatatccaatccttacaatgagatgatcataaccttgatt

SEQ ID NO: 282133 - DNA, 75 bp, Artificial Sequence
  Synthetic
aaggagacaacatccactccttctcaaagagaaggtcaatcctcgaaagccaggatggcggctcaagctgcctct

SEQ ID NO: 282134 - DNA, 75 bp, Artificial Sequence
  Synthetic
aaggatacaaaatctgcctcttctcagcgagcaagtcaaccatcaaaagttaaaatggcagcccaaactgcctct

SEQ ID NO: 282135 - DNA, 75 bp, Artificial Sequence
  Synthetic
agcgagcaagtcaaccatcaaaagttaaaatggcagcccaaactgcctctggtcctcctgctttagagtggtctg

SEQ ID NO: 282136 - DNA, 75 bp, Artificial Sequence
  Synthetic
attgctgagagcttttccaagaagtacaaatttccttcccgatcatcagggatattcttgtataactttgagcag

SEQ ID NO: 282137 - DNA, 75 bp, Artificial Sequence
  Synthetic
gtgaaaaaaactattaacatccctccaaagacccaaggaaagatgatccttcaggctcttctgcttttgcctctc

SEQ ID NO: 282138 - DNA, 75 bp, Artificial Sequence
  Synthetic
gatattcttgtataattttgagcagttaaaaatgaaccttgatgatatagttaaagaggcaaaaaatgtgccagg

SEQ ID NO: 282139 - DNA, 75 bp, Artificial Sequence
  Synthetic
tccaagctccctctgagatgtgtgctgggatgggttgccctagcacactccaaaaggttccagctgttggttgag

SEQ ID NO: 282140 - DNA, 75 bp, Artificial Sequence
  Synthetic
caagctaggcccttggagtcctatcgacatacatcatctcagctgtcctaataacttggtggtagaggacgaggg

SEQ ID NO: 282141 - DNA, 75 bp, Artificial Sequence
  Synthetic
aaagaaattccaattgttagttgagcctgataaactgaataaaatcatgcaagatgatttgaatcgctatacatc

SEQ ID NO: 282142 - DNA, 75 bp, Artificial Sequence
  Synthetic
gacatacatcatctcagctgtcctaataacttggtggtagaggacgaggggtgcaccagtctgtcagggttttct

SEQ ID NO: 282143 - DNA, 75 bp, Artificial Sequence
  Synthetic
tgggatgggttgccctagcacactccaaaaggttccagctgttggttgagcccgacaagctaaacaaaataatgc

SEQ ID NO: 282144 - DNA, 75 bp, Artificial Sequence
  Synthetic
ccacactgttgaatcagatctgatttgccacaagtctatcatgaaaaaaacgagtaacaccactgataaaatgaa

SEQ ID NO: 282145 - DNA, 75 bp, Artificial Sequence
  Synthetic
cacctgtaccggtgtagtgacagaggccgagacctacaccaacttcgttggttatgttaccacaacattcaagag

SEQ ID NO: 282146 - DNA, 75 bp, Artificial Sequence
  Synthetic
caggcaacaccactgataagatgaatttcctacgtaagatagtgaaaaactgtagagatgaggaccctcaaaagc

SEQ ID NO: 282147 - DNA, 75 bp, Artificial Sequence
  Synthetic
taacaggtggattaccctcgaggacatcagatctagatcatctctattagactacagctgcttatgagcggaaca

SEQ ID NO: 282148 - DNA, 75 bp, Artificial Sequence
  Synthetic
aaaaacaagatcccaaatcagaacctctggttgcttgattatttttttcatctttatggtttttttgttaagcgt

SEQ ID NO: 282149 - DNA, 75 bp, Artificial Sequence
  Synthetic
agaccaccaaagagtctcttattatcatatctccaagtgtggctgatttggacccatatgacaagtctcttcact

SEQ ID NO: 282150 - DNA, 75 bp, Artificial Sequence
  Synthetic
tactgctcaactaaccacgattacaccatatggatgccagaggaagcgagacttgggacatcttgtgacattttt

SEQ ID NO: 282151 - DNA, 75 bp, Artificial Sequence
  Synthetic
ctaaggggggcaaggtttgcggattcgtggatgaaaggggcttatacaagtctctgaaaggagcatgtaaactta

SEQ ID NO: 282152 - DNA, 75 bp, Artificial Sequence
  Synthetic
cgaggtaacatcttggtgccagagtcaaagagatgggccagagtctcttgcatctcgaatgaccaaatagtcaac

SEQ ID NO: 282153 - DNA, 75 bp, Artificial Sequence
  Synthetic
ccaacaagaaagtgtctcgcaaagcgggatgttcagaatgggtttgctctgctcaacaagttgcagtctccacct

SEQ ID NO: 282154 - DNA, 75 bp, Artificial Sequence
  Synthetic
cagtgccacatccaaggcaggatttggtgtattaacatgaactctagagcatgtcaactatggtctgacctgtcc

SEQ ID NO: 282155 - DNA, 75 bp, Artificial Sequence
  Synthetic
ggtgtatcaacatgaactcgagagcatgtcaactatggtctgacatgtctcttcagacacaaaggtctgaagagg

SEQ ID NO: 282156 - DNA, 75 bp, Artificial Sequence
  Synthetic
attcaaacatcggatgagactaaatggtgtcctcctgatcaattggtgaatatacatgactttcactcagacgag

SEQ ID NO: 282157 - DNA, 75 bp, Artificial Sequence
  Synthetic
atgtcaactatggtctgacctgtccctccaaacacaaaggtctgatgaggataaagattcctcagtgcttctgga

SEQ ID NO: 282158 - DNA, 75 bp, Artificial Sequence
  Synthetic
cagtgtcatatccagggcaggatctggtgtatcaacatgaactcgagagcatgtcaactatggtctgacatgtct

SEQ ID NO: 282159 - DNA, 75 bp, Artificial Sequence
  Synthetic
tagtcaagaaaagggaagaatgtctggatgcactggagtctatcatgaccactaaatccgtaagcttccgacgcc

SEQ ID NO: 282160 - DNA, 75 bp, Artificial Sequence
  Synthetic
tggacgaaaggggcttgtacaagtctctaaaaggagcatgtaaactcaagctgtgcggagttcccggactcagac

SEQ ID NO: 282161 - DNA, 75 bp, Artificial Sequence
  Synthetic
agaagctgtttatactcgaatcatgatgaatggaggtcgactaaagagatcgcatatacggagatatgtctcagt

SEQ ID NO: 282162 - DNA, 75 bp, Artificial Sequence
  Synthetic
ttcaacaagacattaatggaagccgatgctcactacaagtcagttcggacttggaatgaggtcatcccttccaag

SEQ ID NO: 282163 - DNA, 75 bp, Artificial Sequence
  Synthetic
cgcatatacggagatatgtctcagtcagttcaaatcatcaagctcgtccaaactcatttgctgagtttctaaaca

SEQ ID NO: 282164 - DNA, 75 bp, Artificial Sequence
  Synthetic
atgctcactacaagtcagttcggacttggaatgaggtcatcccttccaaggggtgcttaaaagtcggggggaggt

SEQ ID NO: 282165 - DNA, 75 bp, Artificial Sequence
  Synthetic
acgcttaacaacaaaatcaaagaagaagtagacagcatcaattgcaaagcaaaaatgtaacacccctacaatgga

SEQ ID NO: 282166 - DNA, 75 bp, Artificial Sequence
  Synthetic
gacggtactgtcttgatccctgaaatgcagtcgtccttgctccaacaacatatggagctgttggagtcctctgtg

SEQ ID NO: 282167 - DNA, 75 bp, Artificial Sequence
  Synthetic
gatcaccccaaattctcttgtggacataaaacgcaccgatgtggaagggaattgggctctaacagggggtatgga

SEQ ID NO: 282168 - DNA, 75 bp, Artificial Sequence
  Synthetic
agcttggtccttggagccctattgacatacatcaccttagctgtccaaacaatctggttgtggaggacgaggggt

SEQ ID NO: 282169 - DNA, 75 bp, Artificial Sequence
  Synthetic
tgcagtcgtccttgctccaacaacatatggagctgttggagtcctctgtgatccccctaatgcatcccttggcgg

SEQ ID NO: 282170 - DNA, 75 bp, Artificial Sequence
  Synthetic
catgagatgtctgttcttgggggttatttgggggaggagttttttggaaaagggacttttgaaagaagattcttc

SEQ ID NO: 282171 - DNA, 75 bp, Artificial Sequence
  Synthetic
catacatcaccttagctgtccaaacaatctggttgtggaggacgaggggtgcactagtctgtcagggttttctta

SEQ ID NO: 282172 - DNA, 75 bp, Artificial Sequence
  Synthetic
gtccaccttccagatgttcacaagcaggtctctggggttgaccttggtctccctagctgggggaagtatctgttg

SEQ ID NO: 282173 - DNA, 75 bp, Artificial Sequence
  Synthetic
aggtctctggggttgaccttggtctccctagctgggggaagtatctgttgatgagtgtgggtgctctggcaacac

SEQ ID NO: 282174 - DNA, 75 bp, Artificial Sequence
  Synthetic
agcattttcgcccaacacccgatgcatgtagatctgcgtacaactggaagatggcaggcgaccccagatatgagg

SEQ ID NO: 282175 - DNA, 75 bp, Artificial Sequence
  Synthetic
gaatcaatacagcgaggccatggagaatcaggaaggaaagtgtctgcaagtccccagaacgggaaagtcatatct

SEQ ID NO: 282176 - DNA, 75 bp, Artificial Sequence
  Synthetic
aatcaggaaggaaagtgtctgcaagtccccagaacgggaaagtcatatcttcctgggagctgtacaaaagtgaag

SEQ ID NO: 282177 - DNA, 75 bp, Artificial Sequence
  Synthetic
actgacaagggacccaactgtctccgaacatgcgtctttagtcggtcttctcttgagcctgtataggttgagcaa

SEQ ID NO: 282178 - DNA, 75 bp, Artificial Sequence
  Synthetic
aaggggatttcctgaagagatcatatcaaatccttacaatgaaatgatcataactctgattgacagtgatgtaga

SEQ ID NO: 282179 - DNA, 75 bp, Artificial Sequence
  Synthetic
aagattacctctctttaagatctgagagaatctcacgtctcaacagtccttcatggactccgcacaacaggatgg

SEQ ID NO: 282180 - DNA, 75 bp, Artificial Sequence
  Synthetic
tatcccccagtgtggcagatttggacccatacgacaaatcccttcactccagggtcttccccagcgggaagtgct

SEQ ID NO: 282181 - DNA, 75 bp, Artificial Sequence
  Synthetic
tagggacatcttgtgacatattcaccaatagtagagggaagagagcatccaaaggaagcaagacttgcggctttg

SEQ ID NO: 282182 - DNA, 75 bp, Artificial Sequence
  Synthetic
ttatgtagactttgataatgtgtgatgtcttctgacagtatctttgactaatggtgctctcatcccccaaggact

SEQ ID NO: 282183 - DNA, 75 bp, Artificial Sequence
  Synthetic
tgtcttctgacagtatctttgactaatggtgctctcatcccccaaggactgataccaaaggttgtggacaggcta

SEQ ID NO: 282184 - DNA, 75 bp, Artificial Sequence
  Synthetic
cttcagatttttggccggaacctacgacatgtttttctcccggattgagcatctgtattcagcaatcagagtggg

SEQ ID NO: 282185 - DNA, 75 bp, Artificial Sequence
  Synthetic
atctgatcctaaaatcctgaggcacttcaacatatgttgcagtactatgatgtatctatctaccgctttaggcga

SEQ ID NO: 282186 - DNA, 75 bp, Artificial Sequence
  Synthetic
tgtcctagagtcgacatgaaaaaaacaggcaacaccactgataaaatgaactttctacgcaagatagtgaaaaac

SEQ ID NO: 282187 - DNA, 75 bp, Artificial Sequence
  Synthetic
attttcccatcgtaaaccaaataggggttagctgagagaagcgacttgcctcctatgaaggacactagcaatagg

SEQ ID NO: 282188 - DNA, 75 bp, Artificial Sequence
  Synthetic
gtgtgtagtccaaacggctattcatttaggatcctgcggcatattttgaagtcattcgacgagatctattctgga

SEQ ID NO: 282189 - DNA, 75 bp, Artificial Sequence
  Synthetic
aaatgccgttggtcatgtgttcaatctcattcactttgtcggatgctacatgggtcaagtcagatccctcaatgc

SEQ ID NO: 282190 - DNA, 75 bp, Artificial Sequence
  Synthetic
aagtttatgatgaccccattgatccggttgagccagaggctgaacagagggggaatcccacaattcccaacatct

SEQ ID NO: 282191 - DNA, 75 bp, Artificial Sequence
  Synthetic
catgagatgtctgttctagggggctacctgggagaggaattcttcgggaaagggacctttgaaagaagattcttt

SEQ ID NO: 282192 - DNA, 75 bp, Artificial Sequence
  Synthetic
aaattaatgttggaatggctgagaacagggaataggcctctccggatgactttgacagacaattgctctaggtct

SEQ ID NO: 282193 - DNA, 75 bp, Artificial Sequence
  Synthetic
atgaagaggccgagctgacgaagactgacgtggcccttgcagatgatggaactgttaactctgatgacgaggact

SEQ ID NO: 282194 - DNA, 75 bp, Artificial Sequence
  Synthetic
ccatcaacagtattcaaggacggagatgaagcggaggactttgttgaagttcacctcccagatgttcacaaacag

SEQ ID NO: 282195 - DNA, 75 bp, Artificial Sequence
  Synthetic
tcaccttcccgatgtgcacaaacaggtctctggggttgacctgggtctcccaaactgggggaaatatgtattaat

SEQ ID NO: 282196 - DNA, 75 bp, Artificial Sequence
  Synthetic
gaagtgtataacagacttagctcagttctactccaagtcttccccaatagaaaaactactaaactgcacacttgg

SEQ ID NO: 282197 - DNA, 75 bp, Artificial Sequence
  Synthetic
gattgcaggtggtctggcagcactggttctgataatctttttgatggtatgttgtagaaggaccaagagaacgga

SEQ ID NO: 282198 - DNA, 75 bp, Artificial Sequence
  Synthetic
ctcatatacggagatatgtctcagtcagttccaatcatcaagctcgtccaggctcattcgccgagttcctaaaca

SEQ ID NO: 282199 - DNA, 75 bp, Artificial Sequence
  Synthetic
atgttgataattttcctaatgacatgttgtagaagagtcaatcgaccagactctacacaacgcagttttggaagg

SEQ ID NO: 282200 - DNA, 75 bp, Artificial Sequence
  Synthetic
gcggtatcttgctaacatatactcttcttatttattctttcatgtgatcaccctttacatgaacgccctggactg

SEQ ID NO: 282201 - DNA, 75 bp, Artificial Sequence
  Synthetic
atgggagttgtacaagagtgaaggcgatgccaggctgtgagggcaggccacctcctttatatcttgcgatcgaaa

SEQ ID NO: 282202 - DNA, 75 bp, Artificial Sequence
  Synthetic
atgggagtcatataaaagtggaggcgagactaggctgtgaggcccggttatccttttgacacttcaagtcccaaa

SEQ ID NO: 282203 - DNA, 75 bp, Artificial Sequence
  Synthetic
aaaatgtaacacccctacaatggatgccgacaagattgtattcaaagtcaataatcaggtggtctctttgaagcc

SEQ ID NO: 282204 - DNA, 75 bp, Artificial Sequence
  Synthetic
aaagacctcatgtaccaagatgaattcaagagatgaagaatgttcattaaccatctcaactgatcagacacggtc

SEQ ID NO: 282205 - DNA, 75 bp, Artificial Sequence
  Synthetic
aatcaccttcctccaggggtaggggggaatctctggtttcaatagttctccttgaactccttgcaacagtgtggg

SEQ ID NO: 282206 - DNA, 75 bp, Artificial Sequence
  Synthetic
ttcaagagtcatgagactttcattaatcatctcagtcgaccagacatggtcatgtagattctcataatacgggaa

SEQ ID NO: 282207 - DNA, 75 bp, Artificial Sequence
  Synthetic
tcaagagatgaagaatgttcattaaccatctcaactgatcagacacggtcaagtagatctttatgaagtgtgatg

SEQ ID NO: 282208 - DNA, 75 bp, Artificial Sequence
  Synthetic
catgtagattctcataatacgggaaatctcctagcagtttcagtgacaaacggtgctttcattctccaggaaccg

SEQ ID NO: 282209 - DNA, 75 bp, Artificial Sequence
  Synthetic
tagaaattacacacttatgctgaaagacctctttttgtctcggttcaattctctgctaattcttctgtcacctcc

SEQ ID NO: 282210 - DNA, 75 bp, Artificial Sequence
  Synthetic
taccaaaggtgatgggcagaataaccgatatctcaaacaactctatgactgagtccaagaagaggatatcatgag

SEQ ID NO: 282211 - DNA, 75 bp, Artificial Sequence
  Synthetic
cgatatctcaaacaactctatgactgagtccaagaagaggatatcatgagttccactgcattgggccaagtagag

SEQ ID NO: 282212 - DNA, 75 bp, Artificial Sequence
  Synthetic
tcgccggagatcatgtcttgtccatgtgcgggaactctggttatgaagtcatcaagatattggaaccatatgttg

SEQ ID NO: 282213 - DNA, 75 bp, Artificial Sequence
  Synthetic
gattcctcaagatatggtcacagaccgtagaggagattatatcctatgtcaccatcaacttccccaacccttcgg

SEQ ID NO: 282214 - DNA, 75 bp, Artificial Sequence
  Synthetic
gtctcctgatagcggactccacatgagtgagttgagaagtgcaatttgcctctcatgaaggacataagcaatagc

SEQ ID NO: 282215 - DNA, 75 bp, Artificial Sequence
  Synthetic
cacaatcatcctacatcctgacaagacatatacaattacagagggatggaccatccaagcatttcagtcaagaaa

SEQ ID NO: 282216 - DNA, 75 bp, Artificial Sequence
  Synthetic
ctgggggatttccctgcatttataagagataaggtgggtcaacttgaggggacctttggtcctagtgcaaaaagg

SEQ ID NO: 282217 - DNA, 75 bp, Artificial Sequence
  Synthetic
agagagaaagccaatcctcgaaagccaggatggcagctcaagctgcctctggtcctccagcccttgaatggtctg

SEQ ID NO: 282218 - DNA, 75 bp, Artificial Sequence
  Synthetic
ggtgctctcatcccccaaggactgataccaaaggttgcggacaagccaactgatatctcagatcactctatgctt

SEQ ID NO: 282219 - DNA, 75 bp, Artificial Sequence
  Synthetic
aaaactgtgggatggaggggccatcaacaacacctctcatcccaagaaccgtaccatgatgattgatccggggga

SEQ ID NO: 282220 - DNA, 75 bp, Artificial Sequence
  Synthetic
ttacggctgttacaggcactgggggcatccctatatagattatagaaagggtttgtcgaagctatatgatcaggt

SEQ ID NO: 282221 - DNA, 75 bp, Artificial Sequence
  Synthetic
cacaatcatcttacatcccaataaggtgtacaaaactacaaagggctgggccatccaagcttctcagtcaagaaa

SEQ ID NO: 282222 - DNA, 75 bp, Artificial Sequence
  Synthetic
acctggccaaaaggatcctccggtggggatttgataagtactccaaatggtatcttgagttgcggcttctttcaa

SEQ ID NO: 282223 - DNA, 75 bp, Artificial Sequence
  Synthetic
ctgaagatgaacctggatgatatagttaaagaggcaaaaaatgtgccaggcgtgacccgtctggcccatgacgga

SEQ ID NO: 282224 - DNA, 75 bp, Artificial Sequence
  Synthetic
acatgtttttctcccggattgagcatctatattcagcaatcagagtgggcacagttgtcactgcttatgaagact

SEQ ID NO: 282225 - DNA, 75 bp, Artificial Sequence
  Synthetic
tactggaaaggacttggtcaagtttaaagatcaaatatggggattgctgattgtgaccaaggactttgtgtactc

SEQ ID NO: 282226 - DNA, 75 bp, Artificial Sequence
  Synthetic
gggatttgataagtactccaaatggtatcttgagttgcggcttctttcaagggaccaccccctgattccttacat

SEQ ID NO: 282227 - DNA, 75 bp, Artificial Sequence
  Synthetic
aaagaaattccaattgctagttgagcctgacaaactgggcaaaatcatgcaagacgatctgaatcgctatgcatc

SEQ ID NO: 282228 - DNA, 75 bp, Artificial Sequence
  Synthetic
cgtggcacaaactcccgatcacccagatcttcgagatccctgaatcaatggacccttcggagatactagatgaca

SEQ ID NO: 282229 - DNA, 75 bp, Artificial Sequence
  Synthetic
agaaagtagatttgggttctctcaaagtgggcggaaccgctgcacagtcaatgatctctctctggttatccggag

SEQ ID NO: 282230 - DNA, 75 bp, Artificial Sequence
  Synthetic
cctgacaaactgggcaaaatcatgcaagacgatctgaatcgctatgcatcctgccaaccgagcctataagctcag

SEQ ID NO: 282231 - DNA, 75 bp, Artificial Sequence
  Synthetic
ttccccatttacacgataccagacaaacttggtccatggagtcccattgatatacatcatctcagctgtccgaac

SEQ ID NO: 282232 - DNA, 75 bp, Artificial Sequence
  Synthetic
caggcaacaccactgataagatgaactttctacgtaagatagtgaagaactgcagggatgaggacactcaaaagc

SEQ ID NO: 282233 - DNA, 75 bp, Artificial Sequence
  Synthetic
ttctattctaaatcgtcccccatagagaagctgttaaattgtacgctgggaaatagagggctgagaatcccccca

SEQ ID NO: 282234 - DNA, 75 bp, Artificial Sequence
  Synthetic
aggggagggccggtccccagtgagaaagtcattatcacagctctttccaaacctcccatcaaccctagagaattt

SEQ ID NO: 282235 - DNA, 75 bp, Artificial Sequence
  Synthetic
tcagccataaaagtgaacggattcacctgtacaggtgtggtgacagaagcagaaacctacacgaactttgttggt

SEQ ID NO: 282236 - DNA, 75 bp, Artificial Sequence
  Synthetic
cctatcaggagtgtttggctagcgacctggccagaaggatcctcaggtggggatttgataagtactccaaatggt

SEQ ID NO: 282237 - DNA, 75 bp, Artificial Sequence
  Synthetic
cctgaatacgtcccgctgaaagaactcactagcaagaaaaacatgagaaacttttgtatcaacggagaggttaaa

SEQ ID NO: 282238 - DNA, 75 bp, Artificial Sequence
  Synthetic
gagggggtattgagctgccttgagagggtcgactacgataaggcatttgggaggtatctagccaacacatattcc

SEQ ID NO: 282239 - DNA, 75 bp, Artificial Sequence
  Synthetic
tcaggatcctgcggcacattctgagatcatttgacgagatatactctgggaatcataggatgatcgggttagtca

SEQ ID NO: 282240 - DNA, 75 bp, Artificial Sequence
  Synthetic
agagacaagatatggggattgctgattgtgaccaaagactttgtgtattctcaaagttctggttgtctctttgat

SEQ ID NO: 282241 - DNA, 75 bp, Artificial Sequence
  Synthetic
ttgtgaccaaagactttgtgtattctcaaagttctggttgtctctttgatagaaattatacacttatgttaaaag

SEQ ID NO: 282242 - DNA, 75 bp, Artificial Sequence
  Synthetic
gacagggttacaggacaggggcttttagactattcgagggttacatatgcttttcacctggactatgagaagtgg

SEQ ID NO: 282243 - DNA, 75 bp, Artificial Sequence
  Synthetic
cccagagttctaactgtctttttgacagaaactacacactcatgctaaaagatcttttcttgtctcgtttcaatt

SEQ ID NO: 282244 - DNA, 75 bp, Artificial Sequence
  Synthetic
gccggacgaggatttgataatcggcctcaaacctaaggaaagggagctgaaaattgaaggtcggtttttcgcttt

SEQ ID NO: 282245 - DNA, 75 bp, Artificial Sequence
  Synthetic
agaagtcttggatctactattcagacaggtcagacctcatcgggctgtgggaggaccagatatactgtttggaca

SEQ ID NO: 282246 - DNA, 75 bp, Artificial Sequence
  Synthetic
atcaaaatattagagccatatgtagtgaatagcttagtccagagagcagaaaagtttaggcctctcattcattcc

SEQ ID NO: 282247 - DNA, 75 bp, Artificial Sequence
  Synthetic
gaggaccagatatactgtttggacatgtcaaacggccctacatgctggaacggccaagatggcgggctggagggt

SEQ ID NO: 282248 - DNA, 75 bp, Artificial Sequence
  Synthetic
ttccacctggactatgagaagtggaacaatcatcagaggctggagtcgacagaggatgtattttctgtgcttgat

SEQ ID NO: 282249 - DNA, 75 bp, Artificial Sequence
  Synthetic
acaaagactcttctctgctcttagaataatcagattatatcttgcaagtttatcaattgtttacctccggaggag

SEQ ID NO: 282250 - DNA, 75 bp, Artificial Sequence
  Synthetic
atctcagacccggaataccagaaccaagatactagcccaaggggacaaccaggtcctgtgtccaacatacatgtt

SEQ ID NO: 282251 - DNA, 75 bp, Artificial Sequence
  Synthetic
gtcgccggggctttctagagaggggcttctctacgagttggagagtatatcaagaaatgcgctttcaatataccg

SEQ ID NO: 282252 - DNA, 75 bp, Artificial Sequence
  Synthetic
gtctgtcaaaactctatgatcaagttcatatcaagaaagtgatagataagtcctaccaggagtgtttagcaagcg

SEQ ID NO: 282253 - DNA, 75 bp, Artificial Sequence
  Synthetic
ttttatccaagtcaagttgattacctttacattttaagcctctaggatgtgaaaaaaactattaacatccctcaa

SEQ ID NO: 282254 - DNA, 75 bp, Artificial Sequence
  Synthetic
aaaacccagacatggcctcccaaacatatagtagatttggtgggtgatacttggcacaagctcccgatcactcaa

SEQ ID NO: 282255 - DNA, 75 bp, Artificial Sequence
  Synthetic
acttggtccctggagcccgattgacatacatcatctcagctgtccaaacaatttggttgtggaggacgaaggatg

SEQ ID NO: 282256 - DNA, 75 bp, Artificial Sequence
  Synthetic
catctccaatgatcaaatagtcaaccttgctaatataatgtcaactgtgtccaccaatgcattgactgtagcaca

SEQ ID NO: 282257 - DNA, 75 bp, Artificial Sequence
  Synthetic
tccccatttacacaataccagacaaacttggtccctggagcccgattgacatacatcatctcagctgtccaaaca

SEQ ID NO: 282258 - DNA, 75 bp, Artificial Sequence
  Synthetic
atatagtagatttggtgggtgatacttggcacaagctcccgatcactcaaatttttgagattcccgaatctatgg

SEQ ID NO: 282259 - DNA, 75 bp, Artificial Sequence
  Synthetic
ctggcgtcgtggctatcagagaacagaggagggccggtccccagtgaaaaggtcattattacggccctttctaaa

SEQ ID NO: 282260 - DNA, 75 bp, Artificial Sequence
  Synthetic
aatcacattctttcaccagaacgaaactggcttcttggctgtcagagaatcgaggggggcctgttcctagcgaga

SEQ ID NO: 282261 - DNA, 75 bp, Artificial Sequence
  Synthetic
gaaacttacaccaactttgtcggttatgtcacaaccactttcaaaagaaagcatttccgcccaacgccagatgca

SEQ ID NO: 282262 - DNA, 75 bp, Artificial Sequence
  Synthetic
ccccctgttaatcccagagaattcctaaaatccatagacctgggaggattacctgacgaagatctgataattggt

SEQ ID NO: 282263 - DNA, 75 bp, Artificial Sequence
  Synthetic
gccgcctgtcaatccccgggagtttttgaaatctatagacctcggaggactacctgatgaagatttgataatcgg

SEQ ID NO: 282264 - DNA, 75 bp, Artificial Sequence
  Synthetic
ctggggggagtatccggaatgtctctaggaaggttccacatacgtcagttctcagatcccgtctcagaagggttg

SEQ ID NO: 282265 - DNA, 75 bp, Artificial Sequence
  Synthetic
tggccggcgaccccagatatgaggagtctctacacaatccgtaccctgactaccattggcttcggactgtgaaaa

SEQ ID NO: 282266 - DNA, 75 bp, Artificial Sequence
  Synthetic
ccaccaaagagtctcttgttatcatatccccaagcgtggcagatttggacccgtacgacaagtccctccactcaa

SEQ ID NO: 282267 - DNA, 75 bp, Artificial Sequence
  Synthetic
ttttgttatcaccgaaaagctcttagccaactacatcttgccactctttgacgcgctgaccatgacagacaactt

SEQ ID NO: 282268 - DNA, 75 bp, Artificial Sequence
  Synthetic
actgtgtcaagaagcgggaaacccagatctgggagagagaacactggagagctttactcgcctactcgaggatcc

SEQ ID NO: 282269 - DNA, 75 bp, Artificial Sequence
  Synthetic
atccccaagcgtggcagatttggacccgtacgacaagtccctccactcaagggtcttccctagcgggaagtgctt

SEQ ID NO: 282270 - DNA, 75 bp, Artificial Sequence
  Synthetic
tgaattattcgagggttacatatgcatttcacctggactatgagaagtggaacaatcaccaaagattggagtcaa

SEQ ID NO: 282271 - DNA, 75 bp, Artificial Sequence
  Synthetic
tctggaggcccgagaatccgagactagggacatcctgtgacatctttaccaacagtagagggaaaagagcatcca

SEQ ID NO: 282272 - DNA, 75 bp, Artificial Sequence
  Synthetic
cgaagatgtattttccgtacttgatcaagtgtttggactgaaaagggtgttttccagaactcacgagttctttca

SEQ ID NO: 282273 - DNA, 75 bp, Artificial Sequence
  Synthetic
atgcaattagaagagctttatatgatgaggtggacaaagtggagaactcggagtttagggaagcgatcctcttgt

SEQ ID NO: 282274 - DNA, 75 bp, Artificial Sequence
  Synthetic
agggacatcctgtgacatctttaccaacagtagagggaaaagagcatccaaggggagcaagacttgcggctttgt

SEQ ID NO: 282275 - DNA, 75 bp, Artificial Sequence
  Synthetic
ttgtttccccgattcctcagtgaactcttcagttcttccttcttggggattccggagtcaatcattgggttgata

SEQ ID NO: 282276 - DNA, 75 bp, Artificial Sequence
  Synthetic
catcctcttgaggctggacaatcacccatctttgtacataatgctcagagaaccgtctcttagaggagagatatt

SEQ ID NO: 282277 - DNA, 75 bp, Artificial Sequence
  Synthetic
tatgtggagttcttggacttagacttatagatggaacatggatagcaatgcaaacatcagaggaaaccaagtggt

SEQ ID NO: 282278 - DNA, 75 bp, Artificial Sequence
  Synthetic
caaacatcagaggaaaccaagtggtgccccccggatcagttagtgaatctgcatgactttcgctctgatgagatt

SEQ ID NO: 282279 - DNA, 75 bp, Artificial Sequence
  Synthetic
tcttcagttcttccttcttggggattccggagtcaatcattgggttgatacaaaattccagaacaattagaagac

SEQ ID NO: 282280 - DNA, 75 bp, Artificial Sequence
  Synthetic
gagattcatgggatcaaccggatgatccagactccccagagggtcggaagggtttggccctgttcctctgagagg

SEQ ID NO: 282281 - DNA, 75 bp, Artificial Sequence
  Synthetic
aagtcagtgagtttcagacgtctcagtcacttaagaaaacttgtccctgggttcggaaaagcatataccatattc

SEQ ID NO: 282282 - DNA, 75 bp, Artificial Sequence
  Synthetic
ctcctctacgagttagagagcatatcaaggaatgctctttcaatataccgggctatcgaggaaggagcatctaaa

SEQ ID NO: 282283 - DNA, 75 bp, Artificial Sequence
  Synthetic
cccactacaagtcgatccggacttggaacgaaatcatcccctcaaaagggtgtctaagagtgggagggaagtgtc

SEQ ID NO: 282284 - DNA, 75 bp, Artificial Sequence
  Synthetic
atctatgggaagacccccttgtttcgaggcaacatcttagtgcctgagtccaaaagatgggctagagtctcttgt

SEQ ID NO: 282285 - DNA, 75 bp, Artificial Sequence
  Synthetic
gggaaacccccggatatcagtgtctgtgcttccatcttttgatcagtcattcttctcgagaggtcctttaaaggg

SEQ ID NO: 282286 - DNA, 75 bp, Artificial Sequence
  Synthetic
aatcatctctcctccagcaacatatggagttgttggagtcctcggtcatccctcttatgcaccccttggcagacc

SEQ ID NO: 282287 - DNA, 75 bp, Artificial Sequence
  Synthetic
acactctcaatcattgatcaaaccgatgagggatttcttgctcatgtcagtgcaggcagttttccactacctgtt

SEQ ID NO: 282288 - DNA, 75 bp, Artificial Sequence
  Synthetic
caccttcccgatgtgcacaaactggtttcaggggtcgacctgggtctcccaaactgggggaagtacttgttaatg

SEQ ID NO: 282289 - DNA, 75 bp, Artificial Sequence
  Synthetic
cagaagatgtattttcggtcctggatcaggtgtttggattgaaaagggtgttttctaggactcatgaattttttc

SEQ ID NO: 282290 - DNA, 75 bp, Artificial Sequence
  Synthetic
tttcaggggtcgacctgggtctcccaaactgggggaagtacttgttaatgagtgtaggggtcttgattgccttga

SEQ ID NO: 282291 - DNA, 75 bp, Artificial Sequence
  Synthetic
agtggaggagatcatatcatatgtcacaatcaactttcccagtcctccgggaaggccctctgaagacaaggctac

SEQ ID NO: 282292 - DNA, 75 bp, Artificial Sequence
  Synthetic
tcagaccctgtctcagaagggctgtccttttggagagagatctggctaagctccaacgagtcgtggattcatgcg

SEQ ID NO: 282293 - DNA, 75 bp, Artificial Sequence
  Synthetic
tctgcacaacaaaagctcggagggacagggaggagggtgtcgattacttcccaaggcgggagggtcatatcttca

SEQ ID NO: 282294 - DNA, 75 bp, Artificial Sequence
  Synthetic
tctgtcctaatctcctctctcacatctctgtcagcacagacacgatgtctgacctaactcatgacgggagaaact

SEQ ID NO: 282295 - DNA, 75 bp, Artificial Sequence
  Synthetic
tcggaaggttccatatacgtcaattctcggaccctgtctctgaagggttatccttttggagagagatctggttaa

SEQ ID NO: 282296 - DNA, 75 bp, Artificial Sequence
  Synthetic
cagggaggagggtgtcgattacttcccaaggcgggagggtcatatcttcatgggagtcctataaaagtggaggcg

SEQ ID NO: 282297 - DNA, 75 bp, Artificial Sequence
  Synthetic
ccttttggagagagatctggctaagctccaacgagtcgtggattcatgcgctgtgtcaagaagcgggaaacccag

SEQ ID NO: 282298 - DNA, 75 bp, Artificial Sequence
  Synthetic
accactctgaacataagaggaggagccagtcccaccattcttctcaaggatgcgatcagaaaagccctgtatgag

SEQ ID NO: 282299 - DNA, 75 bp, Artificial Sequence
  Synthetic
atcaccttcccccgggggttggaggggggaatctctgggttcaatagtcctctttgaactccatgcaacagggta

SEQ ID NO: 282300 - DNA, 75 bp, Artificial Sequence
  Synthetic
gcggcttcaattggatgacggaaaaccatctggctttgtcgagatggccgcagcgggagaaggcaagtatcggga

SEQ ID NO: 282301 - DNA, 75 bp, Artificial Sequence
  Synthetic
ggggaatctctgggttcaatagtcctctttgaactccatgcaacagggtagattcaagagtcacgaaaccttcat

SEQ ID NO: 282302 - DNA, 75 bp, Artificial Sequence
  Synthetic
tgtttcgaagagaatatctagaatggtttctggagctgtgcctcattttcggaaacttcctgacattcgtctgag

SEQ ID NO: 282303 - DNA, 75 bp, Artificial Sequence
  Synthetic
ccagtcccaccattcttctcaaggatgcgatcagaaaagccctgtatgaggaagtagacaaagtagagaactcgg

SEQ ID NO: 282304 - DNA, 75 bp, Artificial Sequence
  Synthetic
ctcttcttaaagtccgttgaaccgttgtttcccagatttctcagtgaactattcagctcatcattcttggggatt

SEQ ID NO: 282305 - DNA, 75 bp, Artificial Sequence
  Synthetic
aaatcttctcacagtttcagtgaccaacggtgctctcattctccaggaactgataccaaaggttgtaggcaggcc

SEQ ID NO: 282306 - DNA, 75 bp, Artificial Sequence
  Synthetic
tgtttcccagatttctcagtgaactattcagctcatcattcttggggattcctgagtcaattatcgggctaatac

SEQ ID NO: 282307 - DNA, 75 bp, Artificial Sequence
  Synthetic
ggtcagcccaagggctcttgtattcaatcttggttgcgattcatgactctgggtataatgacggaaccatcttcc

SEQ ID NO: 282308 - DNA, 75 bp, Artificial Sequence
  Synthetic
gatcttctctgactttagaagctccaagatgacatatctgactctcatcacctaccagtctcatcttttgcttca

SEQ ID NO: 282309 - DNA, 75 bp, Artificial Sequence
  Synthetic
gtgtgctcggacagaggtcatagtgtgtctcctaatagtggactcaataggagtgaactgagaagtgcaatctgc

SEQ ID NO: 282310 - DNA, 75 bp, Artificial Sequence
  Synthetic
atgtagagccgcgtacaactggaagatggccggtgaccccagatatgaagagtctctacacaatccgtaccctga

SEQ ID NO: 282311 - DNA, 75 bp, Artificial Sequence
  Synthetic
ctggaagagtctttttataactcagagatccatgggatcaacaggatgacacagactccccaaagggtcggaaga

SEQ ID NO: 282312 - DNA, 75 bp, Artificial Sequence
  Synthetic
ccctagagactatttaagagggcttgcgagaggagtcttgatagggtcttcgatttgcttcttgacgagaatgac

SEQ ID NO: 282313 - DNA, 75 bp, Artificial Sequence
  Synthetic
aagcgtgcataactagaaagggctgggtcatctaagcttttctgtcgagaaaaaaactgtagattaaaagagcaa

SEQ ID NO: 282314 - DNA, 75 bp, Artificial Sequence
  Synthetic
aaaaaactgtagattaaaagagcaactagcaacacttctcatcttgagacccacatcaaaatgctagatccagga

SEQ ID NO: 282315 - DNA, 75 bp, Artificial Sequence
  Synthetic
ggggaaggaaagtcgtaggtacgacagttcctcacccttctgagatgttgggattgcttcccaaatcctccattt

SEQ ID NO: 282316 - DNA, 75 bp, Artificial Sequence
  Synthetic
gataccaaaggtggtggacacgccgaaagccatctcaaatggtgttgtgcttgaacacggatagagattgtagtg

SEQ ID NO: 282317 - DNA, 75 bp, Artificial Sequence
  Synthetic
aggagctcccactgtccctaacatcctgaggaactctgactacaatcttaactcccctttgatagaggatcctgc

SEQ ID NO: 282318 - DNA, 75 bp, Artificial Sequence
  Synthetic
gttgtgtcaagaggctgggaacccagatcttggagagagaacactcgagagcttcactcgccttctagaagatcc

SEQ ID NO: 282319 - DNA, 75 bp, Artificial Sequence
  Synthetic
cagactaatgttagagtggttgaaaacaggaaatagaccttatcgaatgactctgacagacaattgctccaggtc

SEQ ID NO: 282320 - DNA, 75 bp, Artificial Sequence
  Synthetic
actttagaagctccaagatgacgtatctgactctcatcacctaccaatctcatcttttacttcaaagggtagaaa

SEQ ID NO: 282321 - DNA, 75 bp, Artificial Sequence
  Synthetic
aaaagagccttgtctcttaaagagtctataaactggttcattacaagaaattcaaatctggcccaaaccttagtc

SEQ ID NO: 282322 - DNA, 75 bp, Artificial Sequence
  Synthetic
tgttttcaagagaacagggtctgccctgcataggttcaagtcagctagatacagtgaggggggttactctgctgt

SEQ ID NO: 282323 - DNA, 75 bp, Artificial Sequence
  Synthetic
attccaacttggctcaaactttaattagaaacattatgtctttgacaggccccgatttccctctagaagaggccc

SEQ ID NO: 282324 - DNA, 75 bp, Artificial Sequence
  Synthetic
gtgaggataccttggagtcagacgaagacattcagaggctgttaaaagactctttgcacaggactaggtgggtgg

SEQ ID NO: 282325 - DNA, 75 bp, Artificial Sequence
  Synthetic
ttgtccaaatcttctctcacacatctctgtcagtacagacacaatgtctgacttgactcatgatgggcgaaacta

SEQ ID NO: 282326 - DNA, 75 bp, Artificial Sequence
  Synthetic
tacagtgaaggagggtactcctctgtttgccctaatctcctctctcatatctctgtcagtacagacactatgtcc

SEQ ID NO: 282327 - DNA, 75 bp, Artificial Sequence
  Synthetic
aacaagaggatgtcacgcaaagcagggtgttcagagtgggtatgctctgctcagcaggttgcagtttcaacctca

SEQ ID NO: 282328 - DNA, 75 bp, Artificial Sequence
  Synthetic
ggaatagaggactgaggatacccccagagggggtgttgaattgccttgaaagggtcgactacgataaggcatttg

SEQ ID NO: 282329 - DNA, 75 bp, Artificial Sequence
  Synthetic
tttgccctaatctcctctctcatatctctgtcagtacagacactatgtccgatctgacccaagatgggaagaact

SEQ ID NO: 282330 - DNA, 75 bp, Artificial Sequence
  Synthetic
gaaggactctacctttcactggcatcttcgatgtaacaagtgtataaggcccattgatgacatcactcttgagac

SEQ ID NO: 282331 - DNA, 75 bp, Artificial Sequence
  Synthetic
accctatacatgaacgccctagactgggacgaagagaaaaccatcctagcactatggaaagacttgacctcagtg

SEQ ID NO: 282332 - DNA, 75 bp, Artificial Sequence
  Synthetic
tcagcaggttgcagtttcaacctcagcgaacccagcccctgcagccgagctagatatcaggatcctctctagaag

SEQ ID NO: 282333 - DNA, 75 bp, Artificial Sequence
  Synthetic
tttctggagccgtgcctcatttcagaaaactccctgacatccgtttgaaaccgggcgactttgaatctctaagcg

SEQ ID NO: 282334 - DNA, 75 bp, Artificial Sequence
  Synthetic
aaaactccctgacatccgtttgaaaccgggcgactttgaatctctaagcgaaaaggaaaaatctcgccatatagg

SEQ ID NO: 282335 - DNA, 75 bp, Artificial Sequence
  Synthetic
gattgtgactaaggactttgtttactctcagagctctaattgtctttttgacagaaactacacacttatgctcaa

SEQ ID NO: 282336 - DNA, 75 bp, Artificial Sequence
  Synthetic
cttgttttcaatagtttattggaagtaaacgacctgatggcgtcaggaacacatccattgcctccctcagcaatc

SEQ ID NO: 282337 - DNA, 75 bp, Artificial Sequence
  Synthetic
taaacgacctgatggcgtcaggaacacatccattgcctccctcagcaatcatgagtggaggagatgacatcatct

SEQ ID NO: 282338 - DNA, 75 bp, Artificial Sequence
  Synthetic
aacttaaccacatggaggtatttccaatcagttcaggaacaagtcaatatgtcttatgacctcatcatttgtgat

SEQ ID NO: 282339 - DNA, 75 bp, Artificial Sequence
  Synthetic
gcaagaggagtattgatagggtcctcaatttgcttcttgacaagaatgacaaatatcaacatcaatagacctctc

SEQ ID NO: 282340 - DNA, 75 bp, Artificial Sequence
  Synthetic
gcagaggtcactgatattgcatcaatcaaccgaataaccctcttaatgtctgatttcgcattgtccatagatggc

SEQ ID NO: 282341 - DNA, 75 bp, Artificial Sequence
  Synthetic
agccagctcttagaggagaaatattctctattccccagaaggttcctgcagcttacccgaccacaatgagggaag

SEQ ID NO: 282342 - DNA, 75 bp, Artificial Sequence
  Synthetic
gtttttcagagttttggatcaattcgacaacatacatgacttagtttttgtgtacggttgttacaggcattgggg

SEQ ID NO: 282343 - DNA, 75 bp, Artificial Sequence
  Synthetic
tccctctttgtatataatgctcagagaaccgtctcttagaggagagatattttctatccctcagaaaatccccgc

SEQ ID NO: 282344 - DNA, 75 bp, Artificial Sequence
  Synthetic
gacaacatacatgacttagtttttgtgtacggttgttacaggcattggggacacccttatatagattatagaaag

SEQ ID NO: 282345 - DNA, 75 bp, Artificial Sequence
  Synthetic
gctttatgcgcagacatggacatcagagctggtacagagagacacaaggctgagggactctacgtttcattggca

SEQ ID NO: 282346 - DNA, 75 bp, Artificial Sequence
  Synthetic
gtcataccaggagtgtctagcaagcgacttagccaggaggatcctcagatggggatttgacaagtactccaagtg

SEQ ID NO: 282347 - DNA, 75 bp, Artificial Sequence
  Synthetic
aaatctctccaaaagtatgagagccaacttgcgacaaatgagctctctaatgaggcaagtgctgggtgggcatgg

SEQ ID NO: 282348 - DNA, 75 bp, Artificial Sequence
  Synthetic
tcttcgggaaatgagcctcgtgttgttcaactgcagtagccccaagagtgagatgcagagagcccgctctctaaa

SEQ ID NO: 282349 - DNA, 75 bp, Artificial Sequence
  Synthetic
cccattgacgatataacactggaaacttctcagatcttcgagttcccggatgtgtcaaaaagaatatccagaatg

SEQ ID NO: 282350 - DNA, 75 bp, Artificial Sequence
  Synthetic
actttagaagtgctaaaatgacatatctgaccctcattacttaccagtctcatctcctactccagagggttgaga

SEQ ID NO: 282351 - DNA, 75 bp, Artificial Sequence
  Synthetic
taacctgcgacaaatgagttccttgatgaggcaggttctgggtggacacggagaagacaccttagagtcagatga

SEQ ID NO: 282352 - DNA, 75 bp, Artificial Sequence
  Synthetic
tgacattcaacgattactaaaagactctttgcgaaggacaagatgggtggatcaggaggtgcgccatgcagctag

SEQ ID NO: 282353 - DNA, 75 bp, Artificial Sequence
  Synthetic
atagtcttttccaatagagtgttcaatgtctcgaaaccgctgactgaacccctgttctacccgccttctgaccca

SEQ ID NO: 282354 - DNA, 75 bp, Artificial Sequence
  Synthetic
tcgcggggggcctgttcctagcgagaaggttattatcacggccctgtctaagccgcctgtcaatccccgggaatt

SEQ ID NO: 282355 - DNA, 75 bp, Artificial Sequence
  Synthetic
gatgttcggaatgggtctgctctgctcaacaggttgcagtatctacctcagctaatccggcccctgtctcggaac

SEQ ID NO: 282356 - DNA, 75 bp, Artificial Sequence
  Synthetic
gcctcaaacccaaggagcgagaattgaagattgagggccgattctttgctctaatgtcatggaatttaagattgt

SEQ ID NO: 282357 - DNA, 75 bp, Artificial Sequence
  Synthetic
gaaacaagtcattcggggaagtatttatctgtcctggagttggtctgatgacgcctcagtgtttaagagggtggc

SEQ ID NO: 282358 - DNA, 75 bp, Artificial Sequence
  Synthetic
aaatagtaaagactaccagacttgtaggaagcatagaagacctgtcaggggaagtcgagaggcaccttagagggt

SEQ ID NO: 282359 - DNA, 75 bp, Artificial Sequence
  Synthetic
tccaacatgtgctacgctatgagcgagaggtaatcacggcgtctccagagaatgactggctgtggatcttctcag

SEQ ID NO: 282360 - DNA, 75 bp, Artificial Sequence
  Synthetic
aggaagcatagaagacctgtcaggggaagtcgagaggcaccttagagggtacaacagatggatcactctcgatga

SEQ ID NO: 282361 - DNA, 75 bp, Artificial Sequence
  Synthetic
tgaatgatctgatggcttccggaacacacccattgcctccttcggcaatcatgagtggaggggatgacatcgttt

SEQ ID NO: 282362 - DNA, 75 bp, Artificial Sequence
  Synthetic
actctcgaatgaacgtacagactctgacttttagacagtgcaccctgaaaaaaacaaggtcctgattcagaacct

SEQ ID NO: 282363 - DNA, 75 bp, Artificial Sequence
  Synthetic
gacttttagacagtgcaccctgaaaaaaacaaggtcctgattcagaacctctgcttgcttgattgttttttttat

SEQ ID NO: 282364 - DNA, 75 bp, Artificial Sequence
  Synthetic
atgaggcaggtgctgggtgggcacggagaagatactttagagtccgacgacgacattcaaagattactaaaagac

SEQ ID NO: 282365 - DNA, 75 bp, Artificial Sequence
  Synthetic
aagcagacagcgtcatttgtaaagcaaaaatgtaacacccctacaatggatgccgacaagattgtgttcaaagtc

SEQ ID NO: 282366 - DNA, 75 bp, Artificial Sequence
  Synthetic
gtcttatgacctcatcatctgtgatgcagaagttactgacattgcgtctatcaaccggatcaccctgttaatgtc

SEQ ID NO: 282367 - DNA, 75 bp, Artificial Sequence
  Synthetic
tgatttcgcgttgtctatagatggaccactttgtctggtcttcaaaacttacgggactatgctggtaaacccgga

SEQ ID NO: 282368 - DNA, 75 bp, Artificial Sequence
  Synthetic
tataactcaaatgacctcatctttttcatctgagctgtacctcagattctccaaacggggaaagttcttccgaga

SEQ ID NO: 282369 - DNA, 75 bp, Artificial Sequence
  Synthetic
ttataactcaagtaacctcgtccttttcatctgagctatacctccgattctccaaacgagggaagtttttcagag

SEQ ID NO: 282370 - DNA, 75 bp, Artificial Sequence
  Synthetic
tcaaggaatgctctttcaatataccgagctatcgaggaaggagcatccaaattggggctaatcatcaagaaggaa

SEQ ID NO: 282371 - DNA, 75 bp, Artificial Sequence
  Synthetic
atgtgtgttcctatttagcagccgcaatgcaattctttgagggaacatgccctgaggactggaccagttatggaa

SEQ ID NO: 282372 - DNA, 75 bp, Artificial Sequence
  Synthetic
agacccttagacgatgaacctagaaaaaaacaagactctgaatcagaacctctggttgtttgattatttttttta

SEQ ID NO: 282373 - DNA, 75 bp, Artificial Sequence
  Synthetic
cctgaggactggaccagttatggaatattgattgcacgaaagggagacaagatcacccctgattcccttgttgag

SEQ ID NO: 282374 - DNA, 75 bp, Artificial Sequence
  Synthetic
tgacagcgatgtagagtctttcctagtccacaaaatggtggatgatctcgagttacagaggggaactctgtctaa

SEQ ID NO: 282375 - DNA, 75 bp, Artificial Sequence
  Synthetic
gctgacgagagaccccacagtctcggagcatgcatctttagtcggtttactcttaagtctgtataggttgagcaa

SEQ ID NO: 282376 - DNA, 75 bp, Artificial Sequence
  Synthetic
atacaaatacccagccatcaaggacctaaagaaacccagtatcaccctagggaaggcccccgacttaaacaaagc

SEQ ID NO: 282377 - DNA, 75 bp, Artificial Sequence
  Synthetic
tagagcagatttttgagactgccccttttgttaagatcgtggagcaccatactctgatgacaactcacaagatgt

SEQ ID NO: 282378 - DNA, 75 bp, Artificial Sequence
  Synthetic
acgtttcaaaacctttgactgaccccttgttctatcctccatctgatcctaaaatcctgaggcacttcaacatat

SEQ ID NO: 282379 - DNA, 75 bp, Artificial Sequence
  Synthetic
cttcagattcttagctggaacctacgacatgttcttctcccggattgaacatctctattcagctatcagagtggg

SEQ ID NO: 282380 - DNA, 75 bp, Artificial Sequence
  Synthetic
atctctattcagctatcagagtgggtactgttgtcactgcttacgaagattgctcaggactggtatcatttacag

SEQ ID NO: 282381 - DNA, 75 bp, Artificial Sequence
  Synthetic
cagttccaatcatcaagcacgtccaaactcctttgctgagtttctaaacaagacatactctagtgactcgtgatg

SEQ ID NO: 282382 - DNA, 75 bp, Artificial Sequence
  Synthetic
atctttttggagagagatctggttaagctctcatgagccctggattcatgcgttgtgtcaagaggctgggaatcc

SEQ ID NO: 282383 - DNA, 75 bp, Artificial Sequence
  Synthetic
tgcaagagaagcaatactatatttcttccataagaactttgaggaagagataagaagaatgttcgaaccgggtca

SEQ ID NO: 282384 - DNA, 75 bp, Artificial Sequence
  Synthetic
actcttaaacggtgcaccctgaaaaaaacaggatcaaaattctgaacctctgtcggcttgattatttttccatct

SEQ ID NO: 282385 - DNA, 75 bp, Artificial Sequence
  Synthetic
acaacaggtggatcactctcgaggatatcaaatctagatcatctctactagaatacagttgtctgtagaccggat

SEQ ID NO: 282386 - DNA, 75 bp, Artificial Sequence
  Synthetic
tactcttcttaaaatctattgaacctctatttcctcgattcctcagtgagctctttagttcgtctttcttgggaa

SEQ ID NO: 282387 - DNA, 75 bp, Artificial Sequence
  Synthetic
tgggtcaggtcaggtctcttaatgcgacagttattgccgcatgtgctccccatgaaatgtctgttcttggaggct

SEQ ID NO: 282388 - DNA, 75 bp, Artificial Sequence
  Synthetic
aattcgtgtatgatgtatcttgaaaaaaacaagatcttgaatccgagcctctggctgtttgattgtttttttatc

SEQ ID NO: 282389 - DNA, 75 bp, Artificial Sequence
  Synthetic
atttgggagaggagttcttcggaaaagggacgtttgaaaggagattcttcagagacgagaaggaacttcaggagt

SEQ ID NO: 282390 - DNA, 75 bp, Artificial Sequence
  Synthetic
acgcttaacaacaaaatcagagaagaagtagacagtgtcatcgacaaaacaaaaatgtaacacccctaaaatgga

SEQ ID NO: 282391 - DNA, 75 bp, Artificial Sequence
  Synthetic
aaaaatgtaacacccctaaaatggataccgacaagattgtatttaaagtcaaaaatcaggttgtttccttaaagc

SEQ ID NO: 282392 - DNA, 75 bp, Artificial Sequence
  Synthetic
taccgacaagattgtatttaaagtcaaaaatcaggttgtttccttaaagcctgaaatcatcgtagatcaatatga

SEQ ID NO: 282393 - DNA, 75 bp, Artificial Sequence
  Synthetic
tgagtgggaagtctccttattcatcaaatgcagttggtcatgtgttcaatctcattcactttgtcggatgctata

SEQ ID NO: 282394 - DNA, 75 bp, Artificial Sequence
  Synthetic
gaaaagctcctgacttgaacaaggcatacaagtcgattttatccggcatgaatgcagctaagctagacccagatg

SEQ ID NO: 282395 - DNA, 75 bp, Artificial Sequence
  Synthetic
ctgtggaggaaattatctcctatgtcaccatcaacttctctaatccattgggaaggtcctccgaggacaaatcca

SEQ ID NO: 282396 - DNA, 75 bp, Artificial Sequence
  Synthetic
cagttccaatcatcaagcccgtccaaactcgtttgctgagtttctaaataaaacgtattctagtgactcataaag

SEQ ID NO: 282397 - DNA, 75 bp, Artificial Sequence
  Synthetic
atacaagtcgattttatccggcatgaatgcagctaagctagacccagatgatgtgtgttcctatttggcagctgc

SEQ ID NO: 282398 - DNA, 75 bp, Artificial Sequence
  Synthetic
tcttgattgcaaggaagggagataagatcaccccaagctctcttgtagacataaaacgtactgacgtggaaggga

SEQ ID NO: 282399 - DNA, 75 bp, Artificial Sequence
  Synthetic
gaaaaaaactaacacccctcctttcgaaccatctcagacatgagcaagatcttcgtcaatccgagtgcaatcaga

SEQ ID NO: 282400 - DNA, 75 bp, Artificial Sequence
  Synthetic
gatcaccccaagctctcttgtagacataaaacgtactgacgtggaagggaactgggctttgacagggggcctgga

SEQ ID NO: 282401 - DNA, 75 bp, Artificial Sequence
  Synthetic
tgaaaagggctctctcgttaaaagagtctataaactggttcattaatagaaattccaacttggctcaaactctaa

SEQ ID NO: 282402 - DNA, 75 bp, Artificial Sequence
  Synthetic
ggttcataaagcagataaatctcactgcaagggaggcaatactatatttcttccacaaaaacttcgaggaagaga

SEQ ID NO: 282403 - DNA, 75 bp, Artificial Sequence
  Synthetic
ttctgagtctatatagactgagcaagatatctggactaaacaccggcaattacaagacaaacatttccgatcgta

SEQ ID NO: 282404 - DNA, 75 bp, Artificial Sequence
  Synthetic
catctccaaggagagcctatagaggtggacaatctccctgacgatatgaggcggcttcagctggatgacggaaaa

SEQ ID NO: 282405 - DNA, 75 bp, Artificial Sequence
  Synthetic
cagttccaatcatccagcccgcccaaattcgtttgctgagtttctaaataaaacgtattctagtgactcgtaagg

SEQ ID NO: 282406 - DNA, 75 bp, Artificial Sequence
  Synthetic
gatatctggactaaacaccggcaattacaagacaaacatttccgatcgtatggaacagatttttgagacggcccc

SEQ ID NO: 282407 - DNA, 75 bp, Artificial Sequence
  Synthetic
cttcagattcttagctggaacttatgacatgtttttctcccggattgaacatctatactcagcaataagagtggg

SEQ ID NO: 282408 - DNA, 75 bp, Artificial Sequence
  Synthetic
acctggacaatgtcggagtccagatagtcagacaaatgaggtcaggagaaagatttctcaagatctggtcacaga

SEQ ID NO: 282409 - DNA, 75 bp, Artificial Sequence
  Synthetic
agtcagacaaatgaggtcaggagaaagatttctcaagatctggtcacagaccgtagaggaaattatctcctatgt

SEQ ID NO: 282410 - DNA, 75 bp, Artificial Sequence
  Synthetic
catgagatgtctgttttagggggctacttaggggaggagttcttcgggaagggaacgttcgaaaggagattcttc

SEQ ID NO: 282411 - DNA, 75 bp, Artificial Sequence
  Synthetic
ggtttataaaacagataaatctcaccgctagggaagcaatcctttatttcttccacaagaattttgaagaggaaa

SEQ ID NO: 282412 - DNA, 75 bp, Artificial Sequence
  Synthetic
atcttcggtgcaataggtgtgtaaggcccatcgatgagataacactggagacttctcaaatctttgagttcccag

SEQ ID NO: 282413 - DNA, 75 bp, Artificial Sequence
  Synthetic
cagaagctccctgacatccgtctcagaccaggtgattttgaatctctaagtggtagagaaaagtctcgccatatc

SEQ ID NO: 282414 - DNA, 75 bp, Artificial Sequence
  Synthetic
ttcatccattttcgatctttgggcctgagtgggaaatctccatactcgtcgaatgcggttggtcacgtgttcaac

SEQ ID NO: 282415 - DNA, 75 bp, Artificial Sequence
  Synthetic
tgagtgggaaatctccatactcgtcgaatgcggttggtcacgtgttcaaccttattcactttgtcggctgctata

SEQ ID NO: 282416 - DNA, 75 bp, Artificial Sequence
  Synthetic
gattgctgagagcttttccaagaagtacaaatttccttcccggtcatcagggatattcttgtataattttgagca

SEQ ID NO: 282417 - DNA, 75 bp, Artificial Sequence
  Synthetic
catgagatgtctgttctcggaggttatttgggggaggagttctttggcaagggaacttttgagagaagattcttc

SEQ ID NO: 282418 - DNA, 75 bp, Artificial Sequence
  Synthetic
cccagactgttggcaaagaactcaaaaaggagataccgtctgcttcttctcagagagaaagtcaatcgtcaaagg

SEQ ID NO: 282419 - DNA, 75 bp, Artificial Sequence
  Synthetic
atgaagcagcagagctgacaaagacagaagtggcactagccgatgacgggacagtcaactctgatgatgaggact

SEQ ID NO: 282420 - DNA, 75 bp, Artificial Sequence
  Synthetic
tgaattgatctcaggggtgatatcatatatcctcctgaggctagataatcatccctctctgtatataatgctcag

SEQ ID NO: 282421 - DNA, 75 bp, Artificial Sequence
  Synthetic
tagttccaatcatcaagctcgccctaattcatttgctgagttcctcaataaaacatattcaaacgattcatagga

SEQ ID NO: 282422 - DNA, 75 bp, Artificial Sequence
  Synthetic
gttgaaaatgaaccttgatgacatagtcaaagagtcaaaaaatgtacccggtttgacccgtctagctcatgacgg

SEQ ID NO: 282423 - DNA, 75 bp, Artificial Sequence
  Synthetic
gaatgactggctgtggatattctcagacttcagaagtgctaaaatgacatatctgactctcatcacataccagtc

SEQ ID NO: 282424 - DNA, 75 bp, Artificial Sequence
  Synthetic
aaaaaaactaacatccctccttaagaaccatctcaaacatgagcaagatctttgttaacccaagtgcaatcaggg

SEQ ID NO: 282425 - DNA, 75 bp, Artificial Sequence
  Synthetic
aaccatctcaaacatgagcaagatctttgttaacccaagtgcaatcagggcaggcctggcagatctcgagatggc

SEQ ID NO: 282426 - DNA, 75 bp, Artificial Sequence
  Synthetic
gccagacaagctgaacaaaatcatgcaggatgatctgaaccgttatacatcttgttgaccaattctcccactcag

SEQ ID NO: 282427 - DNA, 75 bp, Artificial Sequence
  Synthetic
tcaggatcttgcggcacattctaagatcatttgatgagatatattctggaaatcacagaatgatcggattagtca

SEQ ID NO: 282428 - DNA, 75 bp, Artificial Sequence
  Synthetic
atctccaaggagaacccatagaagtggatagtcttcctgaagacatgaggaggctccaattgaataatgaaaaac

SEQ ID NO: 282429 - DNA, 75 bp, Artificial Sequence
  Synthetic
acgacattcaacgattgctaaaggactctttgcgaaggacaagatgggtggatcaagaggttcgccatgcagcca

SEQ ID NO: 282430 - DNA, 75 bp, Artificial Sequence
  Synthetic
ggatagtcttcctgaagacatgaggaggctccaattgaataatgaaaaacaatatggccttgccgaggtggacaa

SEQ ID NO: 282431 - DNA, 75 bp, Artificial Sequence
  Synthetic
agggcagatctacttagggagatctcttggggaagaaaagtggtaggcacgacagttcctcacccttctgagatg

SEQ ID NO: 282432 - DNA, 75 bp, Artificial Sequence
  Synthetic
atacaaatcagttttatcaggcatgaatgctgccaaacttgatcccgatgatgtatgttcctacttggcagcagc

SEQ ID NO: 282433 - DNA, 75 bp, Artificial Sequence
  Synthetic
accccagcctcttattccagtcgtacctggacaatgttggagttcaaatggtcagacagatgagatcaggagaga

SEQ ID NO: 282434 - DNA, 75 bp, Artificial Sequence
  Synthetic
cctggacaatgttggagttcaaatggtcagacagatgagatcaggagagagattcctcaagatatggtctcgtac

SEQ ID NO: 282435 - DNA, 75 bp, Artificial Sequence
  Synthetic
ggaggccttccgaagacaaatctactcaaactgctaatcggggactcaagagggagaccacgtcatctccttctc

SEQ ID NO: 282436 - DNA, 75 bp, Artificial Sequence
  Synthetic
tcaaactgctaatcggggactcaagagggagaccacgtcatctccttctcaacgagagaatcaatcatccaaagc

SEQ ID NO: 282437 - DNA, 75 bp, Artificial Sequence
  Synthetic
atagttagattatatcccacagattgatcacttgtttacctctggaggagagaacatacgggcttaactccaacc

SEQ ID NO: 282438 - DNA, 75 bp, Artificial Sequence
  Synthetic
tgtagggatgaggacacccagaagccctctcttgtttcggctcctccagatgacgatgacctatggcttcctccc

SEQ ID NO: 282439 - DNA, 75 bp, Artificial Sequence
  Synthetic
ccagacatcagatgaggtcaaatggtgccctcctgatcagctagtgaatctacatgaccttcactcggatgagct

SEQ ID NO: 282440 - DNA, 75 bp, Artificial Sequence
  Synthetic
ccaccaacgaggaggatgatctatctgtggaggctgagattgcccaccaaattgcagagagcttctctaagaagt

SEQ ID NO: 282441 - DNA, 75 bp, Artificial Sequence
  Synthetic
cacatccactgcccccctctgccatcatgagtgggggagatgacatcgtttccagggtgatagactttgactcga

SEQ ID NO: 282442 - DNA, 75 bp, Artificial Sequence
  Synthetic
tgtggaggctgagattgcccaccaaattgcagagagcttctctaagaagtacaaatttccctctagatcatcagg

SEQ ID NO: 282443 - DNA, 75 bp, Artificial Sequence
  Synthetic
aagacttaaggaaagatgattcctcaagttcttttgtttgttccccttctagttttctcgtcgtgttttgggaaa

SEQ ID NO: 282444 - DNA, 75 bp, Artificial Sequence
  Synthetic
tcaaggagtcaaaaaatgtgcccggtgttacccgcctggctcgtgacgggtccaagctccctctgagatgtgtgc

SEQ ID NO: 282445 - DNA, 75 bp, Artificial Sequence
  Synthetic
tgttacccgcctggctcgtgacgggtccaagctccctctgagatgtgtgcttgggtgggttgctctagccagctc

SEQ ID NO: 282446 - DNA, 75 bp, Artificial Sequence
  Synthetic
aggatgacctgaaccgttatttatctaattaatcagaccaccagcctcagtcccaccatgcaacctcatccaggg

SEQ ID NO: 282447 - DNA, 75 bp, Artificial Sequence
  Synthetic
taattaatcagaccaccagcctcagtcccaccatgcaacctcatccagggtaatccaaatttgacgtgaaaaaaa

SEQ ID NO: 282448 - DNA, 75 bp, Artificial Sequence
  Synthetic
tgcagagatgaggacaatcagaagcctcctctcgtgtctgctcccccagatgatgatgatctgtggctgccccct

SEQ ID NO: 282449 - DNA, 75 bp, Artificial Sequence
  Synthetic
ctcctctcgtgtctgctcccccagatgatgatgatctgtggctgccccctccggaatatgtcccactgagggagc

SEQ ID NO: 282450 - DNA, 75 bp, Artificial Sequence
  Synthetic
gagcgcaggcgtcctgatcgtactagtgctgatgattttcttgatgacgtgttgtaaaaggcctaatagagcgga

SEQ ID NO: 282451 - DNA, 75 bp, Artificial Sequence
  Synthetic
ctaccactggctccgaactgtcaagaccaccaaggagtcccttgtcatcatatctccgagcgttgcagatttgga

SEQ ID NO: 282452 - DNA, 75 bp, Artificial Sequence
  Synthetic
aacttacgacaaatgagttctctaatgaggcaagtgctgggcggccatggcgaagacaccttagagtcagatgag

SEQ ID NO: 282453 - DNA, 75 bp, Artificial Sequence
  Synthetic
gtatgtagtccaaatggatattcttttaggattttgcgtcacatattaaaatcatttgatgagatatattctggg

SEQ ID NO: 282454 - DNA, 75 bp, Artificial Sequence
  Synthetic
tatctccgagcgttgcagatttggacccgtacgataaatcccttcactcgagagtttttcctggcggaaaatgct

SEQ ID NO: 282455 - DNA, 75 bp, Artificial Sequence
  Synthetic
agagtttttcctggcggaaaatgctcaggaataaccgtgtcctccacttgctgctctactaaccacgactacacc

SEQ ID NO: 282456 - DNA, 75 bp, Artificial Sequence
  Synthetic
agtccacaaaatggttgatgatctcgagttacaaaggggaactctatccaaagttgctatcattatagccatcat

SEQ ID NO: 282457 - DNA, 75 bp, Artificial Sequence
  Synthetic
ctgctctactaaccacgactacaccatctggatgcctgaaaatcctagactgggaacttcatgtgacattttcac

SEQ ID NO: 282458 - DNA, 75 bp, Artificial Sequence
  Synthetic
agacatattcgagtgactcttagggtgttaaataacagggtgccggaaatctatcggttgtgtgtatccatcatg

SEQ ID NO: 282459 - DNA, 75 bp, Artificial Sequence
  Synthetic
aattgggtctataaattgagaagaactcttatcttccagtgggccgattctaggggccccttggagggggaggag

SEQ ID NO: 282460 - DNA, 75 bp, Artificial Sequence
  Synthetic
tttagactcctcgcaacagggtaagtccaagagtcacgagacttccattaatcatctcaatcgatcagacatggt

SEQ ID NO: 282461 - DNA, 75 bp, Artificial Sequence
  Synthetic
ttaggattttgcgtcacatattaaaatcatttgatgagatatattctgggaatcaaagaatggtcgggttagtta

SEQ ID NO: 282462 - DNA, 75 bp, Artificial Sequence
  Synthetic
tggatgaaagaggcttgtacaagtctctaaagggagcatgcaagctgaagctatgtggggttctaggacttagac

SEQ ID NO: 282463 - DNA, 75 bp, Artificial Sequence
  Synthetic
ctcttatcttccagtgggccgattctaggggccccttggagggggaggagttagagtactcccaggagatcacat

SEQ ID NO: 282464 - DNA, 75 bp, Artificial Sequence
  Synthetic
atctggatgcctgaaaatcctagactgggaacttcatgtgacattttcaccaatagtagagggaagagggcatca

SEQ ID NO: 282465 - DNA, 75 bp, Artificial Sequence
  Synthetic
caatgccacattcaaggtaggatttggtgcatcaatatgaactctagggcatgtcaattgtggtctgatatgtcc

SEQ ID NO: 282466 - DNA, 75 bp, Artificial Sequence
  Synthetic
ggtgcatcaatatgaactctagggcatgtcaattgtggtctgatatgtccctcaaaacacagagatctgaggagg

SEQ ID NO: 282467 - DNA, 75 bp, Artificial Sequence
  Synthetic
agttgatcaagaaaggagacctgccttataggaagaacataagcaatagatcactgtcatcttgcatctcagtaa

SEQ ID NO: 282468 - DNA, 75 bp, Artificial Sequence
  Synthetic
cctcaattgtttacctctggaggagagaacacatggacttaactccagcattcaggagcaatagaacaaaaccat

SEQ ID NO: 282469 - DNA, 75 bp, Artificial Sequence
  Synthetic
tacaacaggtggatcactcttgaagacatcagatctagatcatctttgctggagtacagctgcttgtagaccgga

SEQ ID NO: 282470 - DNA, 75 bp, Artificial Sequence
  Synthetic
tctaaagggggcatgcaagctgaagctatgtggggtctcagggcttcgacttatggatggaacatgggttgcaat

SEQ ID NO: 282471 - DNA, 75 bp, Artificial Sequence
  Synthetic
tttgcattttaagcctcttggatgtgaaaaaaactattaacatccctcgaaagacctaaggaaagatggttcttc

SEQ ID NO: 282472 - DNA, 75 bp, Artificial Sequence
  Synthetic
ccaaaccaccggtcaagagcccaagaaggagacaacatccactccttctcagagagagtgccagtcctcgaaagc

SEQ ID NO: 282473 - DNA, 75 bp, Artificial Sequence
  Synthetic
tgctctcctgatcagctagtgaatctacacgatcttcattcggatgagattgaacatcttgttgtggaggagttg

SEQ ID NO: 282474 - DNA, 75 bp, Artificial Sequence
  Synthetic
ttccctatctatacgataccagacaagctcggcccttggagccctatcgatatacatcatctcagctgtcccaac

SEQ ID NO: 282475 - DNA, 75 bp, Artificial Sequence
  Synthetic
agagagagtgccagtcctcgaaagccaggatggcggctcaaactgcctctggccttccagcccttgaacggtctg

SEQ ID NO: 282476 - DNA, 75 bp, Artificial Sequence
  Synthetic
tatacatcatctcagctgtcccaacaatctagttgtagaagacgaggggtgcaacagtctatcaggaatttctta

SEQ ID NO: 282477 - DNA, 75 bp, Artificial Sequence
  Synthetic
ccctttgatgcatcccttagcagacccgtcaacagtctttaaagacggcgacgaggcagaggactttgttgaggt

SEQ ID NO: 282478 - DNA, 75 bp, Artificial Sequence
  Synthetic
acaagtttccctctcgatcttcagggatattcttgtataattttgagcagttgaaaatgaaccttgatgatatag

SEQ ID NO: 282479 - DNA, 75 bp, Artificial Sequence
  Synthetic
tgggtcaagtcagatctctaaatgcaacggttattgctgcatgtgcccctcatgagatgtctgttctagggggct

SEQ ID NO: 282480 - DNA, 75 bp, Artificial Sequence
  Synthetic
tgagacttacaccaacttcgttggttatgtcaccaccacattcaagagaaaacactttcatccgatgccggatgc

SEQ ID NO: 282481 - DNA, 75 bp, Artificial Sequence
  Synthetic
gttgcagaaagactaatagagcagggtcaatacaacacagtcctggagagacagggaggaaagtgtcggtgactt

SEQ ID NO: 282482 - DNA, 75 bp, Artificial Sequence
  Synthetic
acagggaggaaagtgtcggtgacttctcacaacggaagggtcatatcttcatgggaatcatataaaagcggaagt

SEQ ID NO: 282483 - DNA, 75 bp, Artificial Sequence
  Synthetic
agtcccttcaaaacccatatcccgattaccactggctgcggaccgtaaaaaccaccaaggagtctcttatcatca

SEQ ID NO: 282484 - DNA, 75 bp, Artificial Sequence
  Synthetic
gggtgagaccagactgtgaagaccggtcatccctttcaagctttaagtcctaaagatcacctccccttggggtta

SEQ ID NO: 282485 - DNA, 75 bp, Artificial Sequence
  Synthetic
ctcacaacggaagggtcatatcttcatgggaatcatataaaagcggaagtgagaccaagctgtgaggacaagtca

SEQ ID NO: 282486 - DNA, 75 bp, Artificial Sequence
  Synthetic
ttaccactggctgcggaccgtaaaaaccaccaaggagtctcttatcatcatatcgcccagtgtggctgacctgga

SEQ ID NO: 282487 - DNA, 75 bp, Artificial Sequence
  Synthetic
cagggatgactatttcttctacctactgctcaactaaccacgaatacactatatggatgcccgaaaaggcaggtc

SEQ ID NO: 282488 - DNA, 75 bp, Artificial Sequence
  Synthetic
ctgctcaactaaccacgaatacactatatggatgcccgaaaaggcaggtctcgggacgtcttgtgacatatttac

SEQ ID NO: 282489 - DNA, 75 bp, Artificial Sequence
  Synthetic
tgtagggatgaggacattcaaaaaccctctcctgtgtcagcccctccagatgatgatgacctatggcttccaccc

SEQ ID NO: 282490 - DNA, 75 bp, Artificial Sequence
  Synthetic
ttcaagagtcatgagacttccattaatcatctcaaccgatcagacatggtcacgtagattcttataataaaagaa

SEQ ID NO: 282491 - DNA, 75 bp, Artificial Sequence
  Synthetic
aacatctctggatttaacagtcctccttggacttcttgcaacagggtagattcaagagtcatgagacttccatta

SEQ ID NO: 282492 - DNA, 75 bp, Artificial Sequence
  Synthetic
tggatgaaagaggcttatacaagtccttgaagggggcatgtaagctcaagctatgtggggtctccgggctcagac

SEQ ID NO: 282493 - DNA, 75 bp, Artificial Sequence
  Synthetic
cttctgtatcaacggagaggtgaaagtgtgtagcccgaatggttactcgttcaggatcctgcggcacattctgag

SEQ ID NO: 282494 - DNA, 75 bp, Artificial Sequence
  Synthetic
cttgaagggggcatgtaagctcaagctatgtggggtctccgggctcagactaatggatgggacttgggttgcaat

SEQ ID NO: 282495 - DNA, 75 bp, Artificial Sequence
  Synthetic
tcaggatcctgcggcacattctgagatcattcgacgatatatacactgggaatcataggatgattgggttagtta

SEQ ID NO: 282496 - DNA, 75 bp, Artificial Sequence
  Synthetic
tgcctctcatgaaggacataagcaatagctcacaatcatctcgcatctcagtcaagtgtgcataattataaaggg

SEQ ID NO: 282497 - DNA, 75 bp, Artificial Sequence
  Synthetic
tcccatgaaagacataagcaatagatcactatcatcttgcatctcagcaaaatgtgtatacttataaagggctgg

SEQ ID NO: 282498 - DNA, 75 bp, Artificial Sequence
  Synthetic
ggttcataaagcagataaatctcactgcaagagaagcaatactatatttcttccataagaactttgaggaagaga

SEQ ID NO: 282499 - DNA, 75 bp, Artificial Sequence
  Synthetic
tgcatgaccttcactcagatgagatagagcatcttgttgtcgaggagttggtcaagaaaagggaggagtgcttag

SEQ ID NO: 282500 - DNA, 75 bp, Artificial Sequence
  Synthetic
agagcatcttgttgtcgaggagttggtcaagaaaagggaggagtgcttagatgcattagaatctatcatgaccac

SEQ ID NO: 282501 - DNA, 75 bp, Artificial Sequence
  Synthetic
tagcaacacttctcatcttgagatttccgtcatgatgatcgatccaggagaggtttatgatgacccagttgatcc

SEQ ID NO: 282502 - DNA, 75 bp, Artificial Sequence
  Synthetic
gggatgatgatactgagttcgtcggattgcaaataagagtgagtgcaagacaatgtcatatccagggcagagtct

SEQ ID NO: 282503 - DNA, 75 bp, Artificial Sequence
  Synthetic
tgccagactaatgttagagtggctgacaacaggaaatagaccttaccggatgaccctgacagacaattgctccag

SEQ ID NO: 282504 - DNA, 75 bp, Artificial Sequence
  Synthetic
gctttgggaaagcatatacgatattcaacaaaaccttaatggaagcggacgcccactacaagtcaatcagaactt

SEQ ID NO: 282505 - DNA, 75 bp, Artificial Sequence
  Synthetic
caacaaaaccttaatggaagcggacgcccactacaagtcaatcagaacttggaatgagataatcccctcaaaagg

SEQ ID NO: 282506 - DNA, 75 bp, Artificial Sequence
  Synthetic
gtccccaggtactagactgagtaagagtggattgagaaaggagactttcattatatgaagaacataagcaataga

SEQ ID NO: 282507 - DNA, 75 bp, Artificial Sequence
  Synthetic
atcttctggcagttccagtgactaacggtgcttttaccctccaagaactgataccaaaggtggtggacaagctag

SEQ ID NO: 282508 - DNA, 75 bp, Artificial Sequence
  Synthetic
tcaacggcataatactgggtccggacgggcatgtcctgatcccagagatgcagtcgtctcttctccaacagcata

SEQ ID NO: 282509 - DNA, 75 bp, Artificial Sequence
  Synthetic
cgggcatgtcctgatcccagagatgcagtcgtctcttctccaacagcatatggaactgttggagtcttctgtgat

SEQ ID NO: 282510 - DNA, 75 bp, Artificial Sequence
  Synthetic
cctgacagacaactgctctaggtcttacaaagtcttgaaagattacttcaagaagctagatttgggatccctcaa

SEQ ID NO: 282511 - DNA, 75 bp, Artificial Sequence
  Synthetic
atagagaagctgctgaattgtacacttggaaatagagggctgaggattcccccagagggggtattaagttgcctt

SEQ ID NO: 282512 - DNA, 75 bp, Artificial Sequence
  Synthetic
gtcatctatgctttccagtcgagaaaaaaactgtagaactgaggaacaactagcaacacatctcatctcgagact

SEQ ID NO: 282513 - DNA, 75 bp, Artificial Sequence
  Synthetic
aaaaactgtagaactgaggaacaactagcaacacatctcatctcgagactttcgccatgatgattgatccaggag

SEQ ID NO: 282514 - DNA, 75 bp, Artificial Sequence
  Synthetic
atgaagcagaagacttcgttgaagttcatcttccggatgttcacaaacagatctcaggggtggatcttggcctcc

SEQ ID NO: 282515 - DNA, 75 bp, Artificial Sequence
  Synthetic
tcatcttccggatgttcacaaacagatctcaggggtggatcttggcctcccgagctggggaaagtatgtgctaat

SEQ ID NO: 282516 - DNA, 75 bp, Artificial Sequence
  Synthetic
acaaagactcttctctgcttctagaataatcagattatatcccgcaagtttatcacttgtttacctctggaggag

SEQ ID NO: 282517 - DNA, 75 bp, Artificial Sequence
  Synthetic
aaaagttattaaattgcacacttggaaatagaggactaagaatccctccagaaggagtattgagttgccttgaaa

SEQ ID NO: 282518 - DNA, 75 bp, Artificial Sequence
  Synthetic
gtttctggggggtcaacagaacaaaaccaatacaacagggtcctagagaatcagaacgaaaggtatcaattgctc

SEQ ID NO: 282519 - DNA, 75 bp, Artificial Sequence
  Synthetic
gggttgactatgataaggcattcgggaggtatcttgctaatacatattcctcttatctgtttttccacgtgatta

SEQ ID NO: 282520 - DNA, 75 bp, Artificial Sequence
  Synthetic
gatactcctggaagcctgcccatgctaagactcttgtgtgatgtatcttgaaaaaaacaagatcctaaatctgaa

SEQ ID NO: 282521 - DNA, 75 bp, Artificial Sequence
  Synthetic
cctaacggacaactgctctaggtcttacaaagtcctgaaagattattttaagaagctagatttgggatccctcaa

SEQ ID NO: 282522 - DNA, 75 bp, Artificial Sequence
  Synthetic
aatttggtcgtggaggatgaaggatgcaccaacctgtcagggttctcctacatggaacttaaagttggatacatc

SEQ ID NO: 282523 - DNA, 75 bp, Artificial Sequence
  Synthetic
cctttacattttgagcctcttggatgtgaaaaaaactattaacatccctcaaaagacttaaggaaagatggttcc

SEQ ID NO: 282524 - DNA, 75 bp, Artificial Sequence
  Synthetic
ctatggaaagatttgacctccgtagatattgggaaggacttggtaaagttcaaagatcaaatatgggggctacta

SEQ ID NO: 282525 - DNA, 75 bp, Artificial Sequence
  Synthetic
cttgatatcccagctgtgccaactatacatagccggggatcaagtcctgtccatgtgcggaaactccggttatga

SEQ ID NO: 282526 - DNA, 75 bp, Artificial Sequence
  Synthetic
tccccatcatacctcacatgcaaaagattgctcccctctgagacattggggcatctcttgccttgacaatcttcc

SEQ ID NO: 282527 - DNA, 75 bp, Artificial Sequence
  Synthetic
accaatacaacagggtcctagagaatcagaacgaaaggtatcaattgctccccagagcaggaaagttatatcttc

SEQ ID NO: 282528 - DNA, 75 bp, Artificial Sequence
  Synthetic
agcatttccgcccgacaccagatgcatgtagagccgcatacaactggaagacggctggtgatcccagatatgaag

SEQ ID NO: 282529 - DNA, 75 bp, Artificial Sequence
  Synthetic
gattgctcccctctgagacattggggcatctcttgccttgacaatcttccgtgaactctgtatagcaaggcggac

SEQ ID NO: 282530 - DNA, 75 bp, Artificial Sequence
  Synthetic
gggacccccactgttcctaacatcttgaggaactctgactataacctcaactctcctctaatagaagatcctgcc

SEQ ID NO: 282531 - DNA, 75 bp, Artificial Sequence
  Synthetic
atgtagattttgataatgtatggagtatcataataatatcagcgaccgatggtgctctcacctcctaaggaccga

SEQ ID NO: 282532 - DNA, 75 bp, Artificial Sequence
  Synthetic
gggttgactatgataaagcatttgggaggtatcttgctaatacgtattcctcctatctgtttttccacgtgatta

SEQ ID NO: 282533 - DNA, 75 bp, Artificial Sequence
  Synthetic
ttcgacaacatacatgatttggtttttgtgtacggttgttacaggcattggggccatccctatatagattataga

SEQ ID NO: 282534 - DNA, 75 bp, Artificial Sequence
  Synthetic
tagctggggatcaagttttgtccatgtgcggaaactctggttatgaagtcattaaaatactagagccatatgtcg

SEQ ID NO: 282535 - DNA, 75 bp, Artificial Sequence
  Synthetic
atatctcagttatgccaactatacatagctggggatcaagttttgtccatgtgcggaaactctggttatgaagtc

SEQ ID NO: 282536 - DNA, 75 bp, Artificial Sequence
  Synthetic
ttcttctactccaaaatgtacagggactaactgagaaaatcaaattgcctcctatgaaggacaaaaataatagat

SEQ ID NO: 282537 - DNA, 75 bp, Artificial Sequence
  Synthetic
ggatgaagagaagaccatcttagctttatggaaagatttgacctcagtggatattgggaaggacttggtcaaatt

SEQ ID NO: 282538 - DNA, 75 bp, Artificial Sequence
  Synthetic
agcgacctagccaggagaatcctcaggtgggggtttgacaagtactctaaatggtatcttgattcgcgacttctc

SEQ ID NO: 282539 - DNA, 75 bp, Artificial Sequence
  Synthetic
atttggatgcctgagaatccgagacaagggatgtcttgtgacattttcaccaatagtcgagggaagagagcatcc

SEQ ID NO: 282540 - DNA, 75 bp, Artificial Sequence
  Synthetic
aagacaaggtgagtcaacttgaagggacgtttggtcccagtgcaaaaaggttttttagagttctggatcaatttg

SEQ ID NO: 282541 - DNA, 75 bp, Artificial Sequence
  Synthetic
actaactgagaaaatcaaattgcctcctatgaaggacaaaaataatagatctcagtcatctcacatttcgatagg

SEQ ID NO: 282542 - DNA, 75 bp, Artificial Sequence
  Synthetic
aaaactgtgagatggagggacaactgacaacacctctcatcttgatagcaacaccatgatgattgatcctgggga

SEQ ID NO: 282543 - DNA, 75 bp, Artificial Sequence
  Synthetic
gacaacacctctcatcttgatagcaacaccatgatgattgatcctggggaggtttatgatgaccccgttgatcct

SEQ ID NO: 282544 - DNA, 75 bp, Artificial Sequence
  Synthetic
gtgcggaaactctggttatgaagtcattaaaatactagagccatatgtcgtaaacagtttagtccagagggcaga

SEQ ID NO: 282545 - DNA, 75 bp, Artificial Sequence
  Synthetic
gtctgtcgaagttatatgatcaagttcatatcaagaaggtgatagacaagtcctaccaggagtgtttggcaagcg

SEQ ID NO: 282546 - DNA, 75 bp, Artificial Sequence
  Synthetic
attcagccccatcctaaaaggcagagtctataaaattctaagtgctgagggggacaattttcttctagcaatgtc

SEQ ID NO: 282547 - DNA, 75 bp, Artificial Sequence
  Synthetic
gcgaaactctgactataatctcaactcccctctaatcgaggacccagctaaaatgatgttagagtggttgaaaac

SEQ ID NO: 282548 - DNA, 75 bp, Artificial Sequence
  Synthetic
tcccctctaatcgaggacccagctaaaatgatgttagagtggttgaaaacaggaaatagacctcttcgaatgact

SEQ ID NO: 282549 - DNA, 75 bp, Artificial Sequence
  Synthetic
aagacaaagtaagtcaacttgaagggacgtttggtcctagtgcaagggggttctttagagttctggatcagtttg

SEQ ID NO: 282550 - DNA, 75 bp, Artificial Sequence
  Synthetic
gaaagtggatctcgggtctatcaaagttggcggggcagcagcacaatctatgatctctctttggttatacggtgc

SEQ ID NO: 282551 - DNA, 75 bp, Artificial Sequence
  Synthetic
catggcataaactcccaatcacacaaatatttgaaatccctgaatccatggatccatcagagatactggatgaca

SEQ ID NO: 282552 - DNA, 75 bp, Artificial Sequence
  Synthetic
aatatttgaaatccctgaatccatggatccatcagagatactggatgacaagtcacactctttcaccagaacgag

SEQ ID NO: 282553 - DNA, 75 bp, Artificial Sequence
  Synthetic
gttggcggggcagcagcacaatctatgatctctctttggttatacggtgctcactccgaatcgaaccggagccga

SEQ ID NO: 282554 - DNA, 75 bp, Artificial Sequence
  Synthetic
tatattgacttgcgactccttgcaagagaccatcccttaaatccctacattaaaactcagacatggccacccaaa

SEQ ID NO: 282555 - DNA, 75 bp, Artificial Sequence
  Synthetic
aaatctgttaaactacacactcggaaatagggggctaagaattcccccagagggggtcttaaagtgtctagagag

SEQ ID NO: 282556 - DNA, 75 bp, Artificial Sequence
  Synthetic
agaggggggcctgttccaagtgagaaggtcatcattacagctttgtccaagccacctgtcaatcccagagagttt

SEQ ID NO: 282557 - DNA, 75 bp, Artificial Sequence
  Synthetic
aatagggggctaagaattcccccagagggggtcttaaagtgtctagagagagtggattatgacaaagcatttggg

SEQ ID NO: 282558 - DNA, 75 bp, Artificial Sequence
  Synthetic
tggagttattggaatcctcagttattcccctgatgcacccccttgcagacccgtccacggttttcaaggaaggcg

SEQ ID NO: 282559 - DNA, 75 bp, Artificial Sequence
  Synthetic
tgtgtagcccgaatggttactcgttcaggatcctgcggcacattctgagatcattcgacgagatatattctggga

SEQ ID NO: 282560 - DNA, 75 bp, Artificial Sequence
  Synthetic
tctttacatgaacgccttagattgggatgaggaaaagacaatcttggctctgtggagggatttgacctcagtaga

SEQ ID NO: 282561 - DNA, 75 bp, Artificial Sequence
  Synthetic
gtctcagaggttgacctgggtctcccgaactggggagagtatgtattactgagtgcagggaccctgattgccttg

SEQ ID NO: 282562 - DNA, 75 bp, Artificial Sequence
  Synthetic
ttgtttccccgatttctcagtgagcttttcagctcatccttcttggggattcctgagtcaatcattggattgata

SEQ ID NO: 282563 - DNA, 75 bp, Artificial Sequence
  Synthetic
aggggggggcctgttccaagcgagaaggtcatcattacggctttgtctaaaccacctgtcaatcccagagagttt

SEQ ID NO: 282564 - DNA, 75 bp, Artificial Sequence
  Synthetic
gatgaggaaaagacaatcttggctctgtggagggatttgacctcagtagatatggggaaggacctgatcaagttc

SEQ ID NO: 282565 - DNA, 75 bp, Artificial Sequence
  Synthetic
cgaactggggagagtatgtattactgagtgcagggaccctgattgccttgatgttgataattttcctaatgatat

SEQ ID NO: 282566 - DNA, 75 bp, Artificial Sequence
  Synthetic
gcagagctctcactgtctcttcgatcggaactatacactcatgttaaaggaccttttcttgtctcggtttaactc

SEQ ID NO: 282567 - DNA, 75 bp, Artificial Sequence
  Synthetic
acagagatgaaggtgtcggtcaccccccaaagcgggaaattcatatcttcatgggaatcatataaaagtggggat

SEQ ID NO: 282568 - DNA, 75 bp, Artificial Sequence
  Synthetic
cggaactatacactcatgttaaaggaccttttcttgtctcggtttaactctctaatgattctgctatccccccct

SEQ ID NO: 282569 - DNA, 75 bp, Artificial Sequence
  Synthetic
aacaatcaccaaaggttggagtcaacagaagatgtattttcggtcctggatcaggtgtttggattgaaaagggtg

SEQ ID NO: 282570 - DNA, 75 bp, Artificial Sequence
  Synthetic
agttcctcacccctctgagatgttgggactgcttcctaagtcctccatctcttgtacttgcggagcaacaggagg

SEQ ID NO: 282571 - DNA, 75 bp, Artificial Sequence
  Synthetic
cccaaagcgggaaattcatatcttcatgggaatcatataaaagtggggatgaagctagactgtgaaggctggtca

SEQ ID NO: 282572 - DNA, 75 bp, Artificial Sequence
  Synthetic
tgcaggggatcatgtcttgtccttgtgcgggaactctggttatgaagttataaaaatcttggaaccatatgtagt

SEQ ID NO: 282573 - DNA, 75 bp, Artificial Sequence
  Synthetic
aagtgtacataactataaagggctgggtcatctaagcatttcagtcgagaaaaaaactgtagaccaaaagaacaa

SEQ ID NO: 282574 - DNA, 75 bp, Artificial Sequence
  Synthetic
tattggggggaatctccgggttcaagagtcctccttgaactccatgcgacagagtagattcaagagtcatgagac

SEQ ID NO: 282575 - DNA, 75 bp, Artificial Sequence
  Synthetic
gagtcctccttgaactccatgcgacagagtagattcaagagtcatgagactctcattaatcctctcagttgatca

SEQ ID NO: 282576 - DNA, 75 bp, Artificial Sequence
  Synthetic
agattcaggcctctcattcattccctaggggacttccctgtattcataagggataaagtggggcaactcgaagga

SEQ ID NO: 282577 - DNA, 75 bp, Artificial Sequence
  Synthetic
caattgagtcagaggctgaacccagaggaacccccactgtccccaacatcttgaggaactctgactacaatctca

SEQ ID NO: 282578 - DNA, 75 bp, Artificial Sequence
  Synthetic
gtgcccaactgtgctttcattctccaggaactaatactaagggttgtggacgggccaagaggtatctccgatgat

SEQ ID NO: 282579 - DNA, 75 bp, Artificial Sequence
  Synthetic
tatggttgttacaggcattgggggcatccttacatagattatagaaagggtctgtcaaagttatatgaccaagtc

SEQ ID NO: 282580 - DNA, 75 bp, Artificial Sequence
  Synthetic
catagtacgtcccacgatataggactccacatgagccgattgagaaaggcaatctgcctcccatgaaggacgcaa

SEQ ID NO: 282581 - DNA, 75 bp, Artificial Sequence
  Synthetic
cttagccaaaagagtcctcaggtgggggttcgacaaatactctaaatggtatcttgatccacgactccttgcaag

SEQ ID NO: 282582 - DNA, 75 bp, Artificial Sequence
  Synthetic
gggttcgacaaatactctaaatggtatcttgatccacgactccttgcaagggatcaccccctaactccctatatt

SEQ ID NO: 282583 - DNA, 75 bp, Artificial Sequence
  Synthetic
catctacgggaaaactcctttatttcgaggcaatatcttggtaccggagtcgaagagatgggccagagtctcttg

SEQ ID NO: 282584 - DNA, 75 bp, Artificial Sequence
  Synthetic
aatgcagccaaactcgaccctgatgatgtatgctcttatctggctgccgcgatgcagttctttgagggatcatgt

SEQ ID NO: 282585 - DNA, 75 bp, Artificial Sequence
  Synthetic
ctggcacaggctcccaatcactcaaatatttgagatccccgaatcaatggacccatccgaaatattggacgacaa

SEQ ID NO: 282586 - DNA, 75 bp, Artificial Sequence
  Synthetic
aacccagaggagcccccactgtccccaacatcttgagaaactctgactacaacctcaactcccctttgatagaag

SEQ ID NO: 282587 - DNA, 75 bp, Artificial Sequence
  Synthetic
atatttgagatccccgaatcaatggacccatccgaaatattggacgacaaatcacattccttcacaaggacaaaa

SEQ ID NO: 282588 - DNA, 75 bp, Artificial Sequence
  Synthetic
attgatccaatcgagtcagaggctgaacccagaggagcccccactgtccccaacatcttgagaaactctgactac

SEQ ID NO: 282589 - DNA, 75 bp, Artificial Sequence
  Synthetic
agttattattacagctctttctaaacctcctgtcaaccccagggagtttttgaaatctatagaccttggaggact

SEQ ID NO: 282590 - DNA, 75 bp, Artificial Sequence
  Synthetic
cctcctgtcaaccccagggagtttttgaaatctatagaccttggaggactgccagacgaagatttgatcattggc

SEQ ID NO: 282591 - DNA, 75 bp, Artificial Sequence
  Synthetic
gacatgtttttctcccggattgaacatctgtattcagctattagagtaggcacagttgttactgcttatgaggac

SEQ ID NO: 282592 - DNA, 75 bp, Artificial Sequence
  Synthetic
aatgtcttggaatctaaggttatattttgttatcacagagaaactcctggctaattatgttctgccactctttga

SEQ ID NO: 282593 - DNA, 75 bp, Artificial Sequence
  Synthetic
taagaagaatgttcgagcctgggcaagagactgctgttcctcattcctatttcattcatttccgttcattgggct

SEQ ID NO: 282594 - DNA, 75 bp, Artificial Sequence
  Synthetic
aacaaagtgtttaaaaagttgatcgacagagtgactggacaagggctcctagactattcaagagttacatatgcc

SEQ ID NO: 282595 - DNA, 75 bp, Artificial Sequence
  Synthetic
cactactttaaatattaaaggaggggctagtcccactatcttactcaaggatgctatcagaaaggccctgtatga

SEQ ID NO: 282596 - DNA, 75 bp, Artificial Sequence
  Synthetic
gggacaactttcttctagcgatgtcaagaataatctatctggacccctccttagggggggtgtcaggaatgtctc

SEQ ID NO: 282597 - DNA, 75 bp, Artificial Sequence
  Synthetic
atgctatcagaaaggccctgtatgacgaggtggacaaggtggaaaactcggagtttagagaggcaattctcttgt

SEQ ID NO: 282598 - DNA, 75 bp, Artificial Sequence
  Synthetic
tgtaatcacactatacatgaatgccctagactgggacgaagaaaaaaccatcctaacattatggaaagatttgac

SEQ ID NO: 282599 - DNA, 75 bp, Artificial Sequence
  Synthetic
caagtgtttggattgaagagggtgttttccagaactcatgagttttttcagaaatcctggatatattattcagac

SEQ ID NO: 282600 - DNA, 75 bp, Artificial Sequence
  Synthetic
atgaggcagctgaattgacaaaagctgaaacggccctggcagatgacggaacagtcaattctgatgatgaggact

SEQ ID NO: 282601 - DNA, 75 bp, Artificial Sequence
  Synthetic
gtcgaatggcccgacttgctggaacggccaagacggcgggctagagggtctccgacagaaaggctggagcctagt

SEQ ID NO: 282602 - DNA, 75 bp, Artificial Sequence
  Synthetic
ggccaagacggcgggctagagggtctccgacagaaaggctggagcctagtcagcttattgatgatagatcgggag

SEQ ID NO: 282603 - DNA, 75 bp, Artificial Sequence
  Synthetic
gagattcacgggatcaaccggatgacccagacacctcaacgagttgggagggtgtggccgtgctcttctgagaga

SEQ ID NO: 282604 - DNA, 75 bp, Artificial Sequence
  Synthetic
ggtgtggccgtgctcttctgagagagcagatctcttaagagagatttcttgggggaggaaagtggtgggcacaac

SEQ ID NO: 282605 - DNA, 75 bp, Artificial Sequence
  Synthetic
agtcctatgtcccacatacatgttatcgcccgggctttctagggagggtctcctctatgagctagagagtatatc

SEQ ID NO: 282606 - DNA, 75 bp, Artificial Sequence
  Synthetic
tcgcccgggctttctagggagggtctcctctatgagctagagagtatatccaggaatgcactctccatatatcgc

SEQ ID NO: 282607 - DNA, 75 bp, Artificial Sequence
  Synthetic
tgttcctcacccctctgagatgttggggctgcttcctaagtcctctatttcctgtacttgtgggacaacaggagg

SEQ ID NO: 282608 - DNA, 75 bp, Artificial Sequence
  Synthetic
gagtggtagagaaaagtctcgccacataggatcggctcaggggctcttatattcaatcttagtggcaattcatga

SEQ ID NO: 282609 - DNA, 75 bp, Artificial Sequence
  Synthetic
aaccatgtgtagttatgacttcctcatttatgggaaaactcccttatttcggggcaacatattggtgccagagtc

SEQ ID NO: 282610 - DNA, 75 bp, Artificial Sequence
  Synthetic
gctcgcaagaggagtcttgatagggtcctcgatttgcttcttgacaagaatgacaaatatcaacattaatagacc

SEQ ID NO: 282611 - DNA, 75 bp, Artificial Sequence
  Synthetic
tcaattcgacaacatacatgacttggttttcgtgtatggttgttacaggcattgggggcacccctatatagatta

SEQ ID NO: 282612 - DNA, 75 bp, Artificial Sequence
  Synthetic
atttatgggaaaactcccttatttcggggcaacatattggtgccagagtccaaaaggtgggccagggtctcttgt

SEQ ID NO: 282613 - DNA, 75 bp, Artificial Sequence
  Synthetic
aaaaggtcaccaatgttcatgtggtgaaaagggccctatcactaaaggagtctataaactggttcatcacaagaa

SEQ ID NO: 282614 - DNA, 75 bp, Artificial Sequence
  Synthetic
taccaatgccttgactgttgcgcagcattcccagtctttaattaagccgatgagggacttcttactcatgtcagt

SEQ ID NO: 282615 - DNA, 75 bp, Artificial Sequence
  Synthetic
cctgtacctgtggtacaacaggaggaggaaatcctagggtttcagtgtctgtactcccatcattcgatcaatcat

SEQ ID NO: 282616 - DNA, 75 bp, Artificial Sequence
  Synthetic
cattcccagtctttaattaagccgatgagggacttcttactcatgtcagtacaagctgtcttccattacctgctg

SEQ ID NO: 282617 - DNA, 75 bp, Artificial Sequence
  Synthetic
tcgccaacgaagaggatgacccatctgtcgaggctgagattgctcaccagattgctgagagcttttctaagaagt

SEQ ID NO: 282618 - DNA, 75 bp, Artificial Sequence
  Synthetic
ggacaattttcttttagcaatgtccagaataatttatctagatccttcattggggggggtatctggaatgtctct

SEQ ID NO: 282619 - DNA, 75 bp, Artificial Sequence
  Synthetic
tttgccctaatctcctctctcatatctctgtaagtacagacaccatgtctgatctgacccaggatgggaagaact

SEQ ID NO: 282620 - DNA, 75 bp, Artificial Sequence
  Synthetic
ctgaaaatgaaccttgacgacatagtcaaggagtcgaaaaatgtgccaggtgtgactcgtttggcccatgacgga

SEQ ID NO: 282621 - DNA, 75 bp, Artificial Sequence
  Synthetic
ctttctggagagagatctggatgagttccaacgagtcttgggtccatgccctttgtcaggaggcaggaaacccgg

SEQ ID NO: 282622 - DNA, 75 bp, Artificial Sequence
  Synthetic
ttccaacgagtcttgggtccatgccctttgtcaggaggcaggaaacccggatctaggagagagaacactagaaag

SEQ ID NO: 282623 - DNA, 75 bp, Artificial Sequence
  Synthetic
atgtttaataattagattaaagaaaaaatagatagtgttaatggtagagtaaaaatgtaatatttttataatgga

SEQ ID NO: 282624 - DNA, 75 bp, Artificial Sequence
  Synthetic
caaacttgtgttcaacagcttgttagaggtaaatgacctaatggcttccggaacacatccactgcctccttcagc

SEQ ID NO: 282625 - DNA, 75 bp, Artificial Sequence
  Synthetic
aaaaatgtaatatttttataatggatgttgataagattgtatttaaagttaataattaggtggtttttttgaagt

SEQ ID NO: 282626 - DNA, 75 bp, Artificial Sequence
  Synthetic
gagagtttttgaaatctatagacctcggaggattgccagatgaggatttgataattggcctcaagccaaaggaac

SEQ ID NO: 282627 - DNA, 75 bp, Artificial Sequence
  Synthetic
gtgtctggagctgtgccccactttcaaaagcttcccgacatccatctgaaacccggagattttgaatctctaagt

SEQ ID NO: 282628 - DNA, 75 bp, Artificial Sequence
  Synthetic
tgcttcaagtctaccatgaaaaaaacaagcaacaccactgataaaatgaactttctacgtaagatggtaaagaac

SEQ ID NO: 282629 - DNA, 75 bp, Artificial Sequence
  Synthetic
ataattggcctcaagccaaaggaacgagaattgaagattgagggtagattctttgctctaatgtcatggaatctg

SEQ ID NO: 282630 - DNA, 75 bp, Artificial Sequence
  Synthetic
tgcaatcagaaaggctttatatgatgaggtagacaaggtggagaactcagagtttagagaggccatcctgctgtc

SEQ ID NO: 282631 - DNA, 75 bp, Artificial Sequence
  Synthetic
cttacggcagaagggctggagtctagtcagcttattgatgatagatagagaatctcaaaccaggaacacaagaac

SEQ ID NO: 282632 - DNA, 75 bp, Artificial Sequence
  Synthetic
tgtagagatgaggacacccagaagccctctctcatatcagctcctccagatgacgatgatctatggttaccccct

SEQ ID NO: 282633 - DNA, 75 bp, Artificial Sequence
  Synthetic
tctttcctcggtttcttagtgagctcttcagctcttccttcttgggaattcctgagtccatcattgggctgatac

SEQ ID NO: 282634 - DNA, 75 bp, Artificial Sequence
  Synthetic
gaaaggtttttgatttaaataaagtatataagttagttttattatgtatgagtgttgttaaatttgattttgatg

SEQ ID NO: 282635 - DNA, 75 bp, Artificial Sequence
  Synthetic
cttcagctcttccttcttgggaattcctgagtccatcattgggctgatacagaactccagaacgataagaagaca

SEQ ID NO: 282636 - DNA, 75 bp, Artificial Sequence
  Synthetic
gttcagctcaagggctcttatattcaattttggttgcaatccatgactcaggatataatgacggtaccatatttc

SEQ ID NO: 282637 - DNA, 75 bp, Artificial Sequence
  Synthetic
ttgtgattgtatgaaaaggagataagattattttaggttttttggtggagataaaatgtattgatgtagaaggga

SEQ ID NO: 282638 - DNA, 75 bp, Artificial Sequence
  Synthetic
agatccatgggatcaaccggatgacacagactcctcaaagaatagggagggtttgggcatgctcttctgagaggg

SEQ ID NO: 282639 - DNA, 75 bp, Artificial Sequence
  Synthetic
acagactcctcaaagaatagggagggtttgggcatgctcttctgagagggcagatctcctgagggaaatatcttg

SEQ ID NO: 282640 - DNA, 75 bp, Artificial Sequence
  Synthetic
atataagttagttttattatgtatgagtgttgttaaatttgattttgatgatgtatgtttttatttggtggtggt

SEQ ID NO: 282641 - DNA, 75 bp, Artificial Sequence
  Synthetic
gttttttcagaagtcctggatctattattcagacagatcagacctcatcgggttatgggaggatcaaatatactg

SEQ ID NO: 282642 - DNA, 75 bp, Artificial Sequence
  Synthetic
gattattttaggttttttggtggagataaaatgtattgatgtagaagggaattgggttttgataggaggtatgga

SEQ ID NO: 282643 - DNA, 75 bp, Artificial Sequence
  Synthetic
ttttgagtttgtataggttgagtaaaatatttgggtaaagtattggtaattataagataaatattgtagatagga

SEQ ID NO: 282644 - DNA, 75 bp, Artificial Sequence
  Synthetic
ggttacttcctaaatcctcgatttcctgcacctgtggggggacaggaaggggaaaccctcgcatatccgtgtctg

SEQ ID NO: 282645 - DNA, 75 bp, Artificial Sequence
  Synthetic
ctgcacctgtggggggacaggaaggggaaaccctcgcatatccgtgtctgtgcttccgtcttttgatcagtcttt

SEQ ID NO: 282646 - DNA, 75 bp, Artificial Sequence
  Synthetic
aatatttgggtaaagtattggtaattataagataaatattgtagataggatagagtagatttttgagatagtttt

SEQ ID NO: 282647 - DNA, 75 bp, Artificial Sequence
  Synthetic
aatgactggttgtggatcttctcggactttagaagttccaaaatgacgtacctaactctcatcacctatcagtct

SEQ ID NO: 282648 - DNA, 75 bp, Artificial Sequence
  Synthetic
gtgttaattggagtattatattaaattttagatttttggttggaatttatgatatgttttttttttggattgagt

SEQ ID NO: 282649 - DNA, 75 bp, Artificial Sequence
  Synthetic
caacccagttgttccacgcttgggagaaagtcactaatgtccatgtggtgaaaagagctctatcacttaaggagt

SEQ ID NO: 282650 - DNA, 75 bp, Artificial Sequence
  Synthetic
gaaagtcactaatgtccatgtggtgaaaagagctctatcacttaaggagtctataaactggttcattacaagaaa

SEQ ID NO: 282651 - DNA, 75 bp, Artificial Sequence
  Synthetic
gaaatctatctaagagcatgagagctaacctacgacaaatgagttctctgatgaggcaagtgctaggagggcacg

SEQ ID NO: 282652 - DNA, 75 bp, Artificial Sequence
  Synthetic
taacctacgacaaatgagttctctgatgaggcaagtgctaggagggcacggagaagataccttagaatcggacga

SEQ ID NO: 282653 - DNA, 75 bp, Artificial Sequence
  Synthetic
tataacagacctataacttattacttcagaaagcaagtcattcgagggaatatttatctttcctggagttggtcc

SEQ ID NO: 282654 - DNA, 75 bp, Artificial Sequence
  Synthetic
ggtttataaaataaattaattttattgttagagaggtaatattatattttttttataagaattttgaggaagaga

SEQ ID NO: 282655 - DNA, 75 bp, Artificial Sequence
  Synthetic
cggactttcctctagaagaagccccagtcttcaagaggacagggtctgctctgcacaggttcaaatcagccagat

SEQ ID NO: 282656 - DNA, 75 bp, Artificial Sequence
  Synthetic
agtcttcaagaggacagggtctgctctgcacaggttcaaatcagccagatacagcgaggggggttactcttccgt

SEQ ID NO: 282657 - DNA, 75 bp, Artificial Sequence
  Synthetic
atcaagaagtgcgccatgcagccagaaccatgatcggggattacagccctaacaaaaagatgtcacgcaaggcag

SEQ ID NO: 282658 - DNA, 75 bp, Artificial Sequence
  Synthetic
ttttagatttttggttggaatttatgatatgttttttttttggattgagtatttatatttagtaattagagtggg

SEQ ID NO: 282659 - DNA, 75 bp, Artificial Sequence
  Synthetic
tatacatcacctcagctgtccaaataatttagttgtggaggacgaggggtgcaccaatctatcagggttctctta

SEQ ID NO: 282660 - DNA, 75 bp, Artificial Sequence
  Synthetic
tgagtgggaaatttttttatttattaaatgttgttggttatgtgtttaattttatttattttgtaggatgttata

SEQ ID NO: 282661 - DNA, 75 bp, Artificial Sequence
  Synthetic
acctgactcacgacggtaagaactatgacttcatgttccaaccacttatgctttatgcacaaacatggacatcgg

SEQ ID NO: 282662 - DNA, 75 bp, Artificial Sequence
  Synthetic
tgacttcatgttccaaccacttatgctttatgcacaaacatggacatcggagctagtgcaaaaggacactcggtt

SEQ ID NO: 282663 - DNA, 75 bp, Artificial Sequence
  Synthetic
tgttagagaggtaatattatattttttttataagaattttgaggaagagataagaagaatgtttgagttagggta

SEQ ID NO: 282664 - DNA, 75 bp, Artificial Sequence
  Synthetic
catgtcagtacaggcagtcttccactacctgttatttagcccaatcttaaagggcagagtttacaagattctgag

SEQ ID NO: 282665 - DNA, 75 bp, Artificial Sequence
  Synthetic
aaatgttgttggttatgtgtttaattttatttattttgtaggatgttatatgggttaagttagatttttaaatgt

SEQ ID NO: 282666 - DNA, 75 bp, Artificial Sequence
  Synthetic
agggcagagtttacaagattctgagtgctgaaggggagagctttctcctagccatgtcgaggataatctatctag

SEQ ID NO: 282667 - DNA, 75 bp, Artificial Sequence
  Synthetic
ccattgacgacattaccctcgagacttcccaagttttcgagtttccggatgtttcgagacggatatccaggatgg

SEQ ID NO: 282668 - DNA, 75 bp, Artificial Sequence
  Synthetic
atttgggagaggaattttttgggaaagggatatttgaaagaagattttttagagatgagaaagaattttaagaat

SEQ ID NO: 282669 - DNA, 75 bp, Artificial Sequence
  Synthetic
atgcagggctgcatacaactggaagatggctggtgaccctagatatgaggagtctcttcaaaatccttatcctga

SEQ ID NO: 282670 - DNA, 75 bp, Artificial Sequence
  Synthetic
tctagatgatctcaatgttttcccatccctatgtctcgtggtcggggatggatcaggagggatatctagagcagt

SEQ ID NO: 282671 - DNA, 75 bp, Artificial Sequence
  Synthetic
cctagatgatctgaatgttttcccatccctatgtctcgtggtaggggacggatcaggagggatatcgagagcagt

SEQ ID NO: 282672 - DNA, 75 bp, Artificial Sequence
  Synthetic
tgaatgacctgatggcatcaggaacacatccgttgcctccctccgcaatcatgagtggaggagatgacattgtct

SEQ ID NO: 282673 - DNA, 75 bp, Artificial Sequence
  Synthetic
accgagagaagtcgcgccacatagggtcagcccaggggctcttgtactcgatcttggttgctattcatgactctg

SEQ ID NO: 282674 - DNA, 75 bp, Artificial Sequence
  Synthetic
attttttaggtgaaattagaagtttggaagttgtttatatttgaattataatgaatggaggttgattgaagagat

SEQ ID NO: 282675 - DNA, 75 bp, Artificial Sequence
  Synthetic
acccagacacctcaaagggtcgggagagtgtggccttgctcttcagagagggcagatctacttagggagatctct

SEQ ID NO: 282676 - DNA, 75 bp, Artificial Sequence
  Synthetic
ctgctcaaccaaccatgattacaccatctggatgcccgaggaaccaagactcgggacatcttgcgacatttttac

SEQ ID NO: 282677 - DNA, 75 bp, Artificial Sequence
  Synthetic
ttcccaagttttcgagtttccggatgtttcgagacggatatccaggatggtttctggagctgttccccattttca

SEQ ID NO: 282678 - DNA, 75 bp, Artificial Sequence
  Synthetic
agatatatttgagtgatttataagaagttgaataataaaatgttggaaatttatggattgtgtatatttattatg

SEQ ID NO: 282679 - DNA, 75 bp, Artificial Sequence
  Synthetic
ccagaggagtcttgataggatcttcaatctgctttttaacaagaatgacaaacattaacataaatagacctctag

SEQ ID NO: 282680 - DNA, 75 bp, Artificial Sequence
  Synthetic
gtcagcccaggggctcttgtactcgatcttggttgctattcatgactctggatacaatgatggaactatatttcc

SEQ ID NO: 282681 - DNA, 75 bp, Artificial Sequence
  Synthetic
aatctgctttttaacaagaatgacaaacattaacataaatagacctctagaattaatctccggagtgatctctta

SEQ ID NO: 282682 - DNA, 75 bp, Artificial Sequence
  Synthetic
ggaagttgtttatatttgaattataatgaatggaggttgattgaagagattgtatatatggagatatgttttagt

SEQ ID NO: 282683 - DNA, 75 bp, Artificial Sequence
  Synthetic
agttgaataataaaatgttggaaatttatggattgtgtatatttattatgaaaaaaattaatatttttttttttg

SEQ ID NO: 282684 - DNA, 75 bp, Artificial Sequence
  Synthetic
ttggtttggttgattttgagatggttgaagaaattgttgatttgattaatagaaatattgaagataattaggttt

SEQ ID NO: 282685 - DNA, 75 bp, Artificial Sequence
  Synthetic
tacatgactttcactcagacgaaatagagcatctcgtcgtggaggagttggtcaagaagagggaagagtgtttgg

SEQ ID NO: 282686 - DNA, 75 bp, Artificial Sequence
  Synthetic
agccgtcccttaggggggagatattctctatcccacaaaagatacccgctgcatacccgaccacaatgaaagagg

SEQ ID NO: 282687 - DNA, 75 bp, Artificial Sequence
  Synthetic
ctctatcccacaaaagatacccgctgcatacccgaccacaatgaaagagggcaacagatccatcctgtgttacct

SEQ ID NO: 282688 - DNA, 75 bp, Artificial Sequence
  Synthetic
tgaagaaattgttgatttgattaatagaaatattgaagataattaggtttatttttaaggggaatttatagaagt

SEQ ID NO: 282689 - DNA, 75 bp, Artificial Sequence
  Synthetic
agagcatctcgtcgtggaggagttggtcaagaagagggaagagtgtttggacgcattggagtccatcatgaccac

SEQ ID NO: 282690 - DNA, 75 bp, Artificial Sequence
  Synthetic
tgtttaattttggtgagatggttaaggtgggagaaggtaagtattgagaggatttttagatggatgaaggagagg

SEQ ID NO: 282691 - DNA, 75 bp, Artificial Sequence
  Synthetic
ccttagagagatgagccttgtgttgttcaactgcagcagccccaagagtgagatgcagagagcccgctctttaaa

SEQ ID NO: 282692 - DNA, 75 bp, Artificial Sequence
  Synthetic
atgattggttgtggatcttctcggactttcgaagctctaaaatgacatatctaaccctcatcacctatcagtctc

SEQ ID NO: 282693 - DNA, 75 bp, Artificial Sequence
  Synthetic
ttcaactgcagcagccccaagagtgagatgcagagagcccgctctttaaattatcaggatcttgtaagaggattc

SEQ ID NO: 282694 - DNA, 75 bp, Artificial Sequence
  Synthetic
ctttcgaagctctaaaatgacatatctaaccctcatcacctatcagtctcatcttttacttcagagagttgaaag

SEQ ID NO: 282695 - DNA, 75 bp, Artificial Sequence
  Synthetic
ggtgggagaaggtaagtattgagaggatttttagatggatgaaggagaggattttagttttttgttttagttata

SEQ ID NO: 282696 - DNA, 75 bp, Artificial Sequence
  Synthetic
caatcgtctctactccaacaacatatggagctgctggagtcttctgtaatccccttaatgcatcccttggcggac

SEQ ID NO: 282697 - DNA, 75 bp, Artificial Sequence
  Synthetic
tgaggcaggtgttaggggggcatggagaagacaccttagagtcagacgaggatattcagaggctgttgagagact

SEQ ID NO: 282698 - DNA, 75 bp, Artificial Sequence
  Synthetic
gattttttaagatatggttatagattgtagaagagattatattttatgttgtggttaatttttttaattttttag

SEQ ID NO: 282699 - DNA, 75 bp, Artificial Sequence
  Synthetic
agaagacaccttagagtcagacgaggatattcagaggctgttgagagactctttacgcaggacaagatgggtaga

SEQ ID NO: 282700 - DNA, 75 bp, Artificial Sequence
  Synthetic
gatgtctatcattatagctattatgatagtattctccaacagagttttcaatgtttccaaaccgctgactgatcc

SEQ ID NO: 282701 - DNA, 75 bp, Artificial Sequence
  Synthetic
tgtagaagagattatattttatgttgtggttaatttttttaattttttaggaaagtttttagaggataaattaat

SEQ ID NO: 282702 - DNA, 75 bp, Artificial Sequence
  Synthetic
agagagaaagttaatttttgaaagttaggatggtggtttaaattgtttttggttttttagtttttgaatggttgg

SEQ ID NO: 282703 - DNA, 75 bp, Artificial Sequence
  Synthetic
acaagaaggtgtcccgcaaggtgggatgctcagagtggatctgctcagcccaacaagtcgctgtttcaacctcat

SEQ ID NO: 282704 - DNA, 75 bp, Artificial Sequence
  Synthetic
atgctcagagtggatctgctcagcccaacaagtcgctgtttcaacctcattgaatcccgccccaatctctgagct

SEQ ID NO: 282705 - DNA, 75 bp, Artificial Sequence
  Synthetic
gttctgataatctgctcgatggcatgctgtagaagaaccaagcgaacagagtcaagaagacgaggctctggagag

SEQ ID NO: 282706 - DNA, 75 bp, Artificial Sequence
  Synthetic
gacagctttaggtgatgtccccagctttgcaagacttcatgatttatacaatagaccaataacttattacttcaa

SEQ ID NO: 282707 - DNA, 75 bp, Artificial Sequence
  Synthetic
tttgcaagacttcatgatttatacaatagaccaataacttattacttcaaaaagcaggtcattcgagggaatatt

SEQ ID NO: 282708 - DNA, 75 bp, Artificial Sequence
  Synthetic
ataagttttttttttgatttttagggatatttttgtataattttgagtaattgaaaatgaattttgatgatatag

SEQ ID NO: 282709 - DNA, 75 bp, Artificial Sequence
  Synthetic
tgagggtggttcagtgggcaactggggcccattacaagctcaaacccattttggatgatctcaatgtattcccat

SEQ ID NO: 282710 - DNA, 75 bp, Artificial Sequence
  Synthetic
gtcaagaagacgaggctctggagagtcagaaaagaaggtaacggcaaccccccaaactaggaaagtcatatcttc

SEQ ID NO: 282711 - DNA, 75 bp, Artificial Sequence
  Synthetic
ggcccattacaagctcaaacccattttggatgatctcaatgtattcccatcattatgtctcgtagtcggggacgg

SEQ ID NO: 282712 - DNA, 75 bp, Artificial Sequence
  Synthetic
taggatggtggtttaaattgtttttggttttttagtttttgaatggttggttattaatgaagaggatgatttatt

SEQ ID NO: 282713 - DNA, 75 bp, Artificial Sequence
  Synthetic
gatatttttgtataattttgagtaattgaaaatgaattttgatgatatagttaaagaggtaaaaaatgtattagg

SEQ ID NO: 282714 - DNA, 75 bp, Artificial Sequence
  Synthetic
tgggatgggttgttttggttaattttaagaaattttagttgttagttgaatttaataagttgagtaaaattatgt

SEQ ID NO: 282715 - DNA, 75 bp, Artificial Sequence
  Synthetic
ttgtgttcaacagcttgttggaagtgaatgacttgatggcgtcagggacacatccgttacccccctctgcaatca

SEQ ID NO: 282716 - DNA, 75 bp, Artificial Sequence
  Synthetic
gaatgacttgatggcgtcagggacacatccgttacccccctctgcaatcatgagtgggggagatgatattgtgtc

SEQ ID NO: 282717 - DNA, 75 bp, Artificial Sequence
  Synthetic
taagaaattttagttgttagttgaatttaataagttgagtaaaattatgtaagatgatttgaattgttatatatt

SEQ ID NO: 282718 - DNA, 75 bp, Artificial Sequence
  Synthetic
atgtagatttttatgatgtatgatgtattttgacagtgtcattgactaatggtgctctcatccctcaaggactga

SEQ ID NO: 282719 - DNA, 75 bp, Artificial Sequence
  Synthetic
cattggcacctccagtgcaacaggtgtgtaaggcccattgacgatataacacttgagacttctcaggtcttcgag

SEQ ID NO: 282720 - DNA, 75 bp, Artificial Sequence
  Synthetic
tgttttaaagttaatatgaaaaaaataggtaatattattgataaaatgaattttttatgtaagatagtgaaaaat

SEQ ID NO: 282721 - DNA, 75 bp, Artificial Sequence
  Synthetic
caatcatccctccttcagcaacatatggagttattggaatcctcagttattcccctgatgcaccccctggcagac

SEQ ID NO: 282722 - DNA, 75 bp, Artificial Sequence
  Synthetic
acctgacgacatggaggtacttccagtcagttcaagaacaggtgaacatgtcttatgatcttatcatttgtgacg

SEQ ID NO: 282723 - DNA, 75 bp, Artificial Sequence
  Synthetic
gacccttagacgatacacctgaaaaaaaacaaggttttgaatcagaacctctggttgtttgattatttcccccat

SEQ ID NO: 282724 - DNA, 75 bp, Artificial Sequence
  Synthetic
ctccaacacgtgctacgctatgagcgagaagtaatcacggcgtccccggagaatgactggctgtggatcttctca

SEQ ID NO: 282725 - DNA, 75 bp, Artificial Sequence
  Synthetic
aaacagacattgtcaattgcaaagcaaaaatgtaacacccctacaatggatgccgacaagattgtattcaaagtc

SEQ ID NO: 282726 - DNA, 75 bp, Artificial Sequence
  Synthetic
tttgaatatgttttgttaaaagaatttataagtaagaagaataggaggaatttttgtattaatggaggggttaaa

SEQ ID NO: 282727 - DNA, 75 bp, Artificial Sequence
  Synthetic
cactttgtctggttttcaaaacttatggaaccatgcttgtaaacccggattacagggcggttcaacacctgtcca

SEQ ID NO: 282728 - DNA, 75 bp, Artificial Sequence
  Synthetic
tattttgacagtgtcattgactaatggtgctctcatccctcaaggactgataccaaaggtggtggacagaccaac

SEQ ID NO: 282729 - DNA, 75 bp, Artificial Sequence
  Synthetic
gtcagttcaagaacaggtgaacatgtcttatgatcttatcatttgtgacgctgaggtcactgacattgcatcaat

SEQ ID NO: 282730 - DNA, 75 bp, Artificial Sequence
  Synthetic
ttgaaaaagccctgtataaccctaggaaaggctcccgatttaaataaagcatacaagtcagttttgtcaggcatg

SEQ ID NO: 282731 - DNA, 75 bp, Artificial Sequence
  Synthetic
tggaaccatgcttgtaaacccggattacagggcggttcaacacctgtccagagcatttcctatagttaccgggtt

SEQ ID NO: 282732 - DNA, 75 bp, Artificial Sequence
  Synthetic
aattataggatggttgggttagttaaagtagttattggattggttttgttaggagttttagtttttgagggtatg

SEQ ID NO: 282733 - DNA, 75 bp, Artificial Sequence
  Synthetic
ctaaacggggaaagttctttcgagatgcagaatatttgacttcttctactattcgagaaatgagtcttgtactgt

SEQ ID NO: 282734 - DNA, 75 bp, Artificial Sequence
  Synthetic
tgcagaatatttgacttcttctactattcgagaaatgagtcttgtactgtttaattgtagcagccccaaaagtga

SEQ ID NO: 282735 - DNA, 75 bp, Artificial Sequence
  Synthetic
ttataagtaagaagaataggaggaatttttgtattaatggaggggttaaagtgtgtagtttgaatggttatttgt

SEQ ID NO: 282736 - DNA, 75 bp, Artificial Sequence
  Synthetic
aagtagttattggattggttttgttaggagttttagtttttgagggtatgaattgggtatataagttgaggagaa

SEQ ID NO: 282737 - DNA, 75 bp, Artificial Sequence
  Synthetic
agcgagaaagtcaatcatctaaagccaaaatggcggcccaaaccgcctccggtccttctgctctagagtggtccg

SEQ ID NO: 282738 - DNA, 75 bp, Artificial Sequence
  Synthetic
ttggaatatttttaggagattatttgggatgataatattgagtttgttggattgtaaataagagtgagtgtaaaa

SEQ ID NO: 282739 - DNA, 75 bp, Artificial Sequence
  Synthetic
ggatgttcagaatgggtctgctctgctcaacaggttgccgtctccacctcagccaacccggcccctgtctcagag

SEQ ID NO: 282740 - DNA, 75 bp, Artificial Sequence
  Synthetic
caatgccatatccagggcaggatttggtgtatcaacatgaactctcgggcatgtcaattgtggtctgacatgtcc

SEQ ID NO: 282741 - DNA, 75 bp, Artificial Sequence
  Synthetic
ctgaagagattatatccaatccctataatgagatgattataaccctgatcgatagtgatgtggaatctttcctgg

SEQ ID NO: 282742 - DNA, 75 bp, Artificial Sequence
  Synthetic
ggtgctttcattctccaggaactgagatcaaaggttgtagacgggccaagaggtgtttcgggtgactccgtgctc

SEQ ID NO: 282743 - DNA, 75 bp, Artificial Sequence
  Synthetic
taatgagatgattataaccctgatcgatagtgatgtggaatctttcctggttcacaagatggtagatgatcttga

SEQ ID NO: 282744 - DNA, 75 bp, Artificial Sequence
  Synthetic
ttttagatataaaggtttgaagaggataaagatttttttttgtttttagaataattagattatattttgtaaatt

SEQ ID NO: 282745 - DNA, 75 bp, Artificial Sequence
  Synthetic
tagttttttccaatagggtattcaatgtctcgaaaccattgacagaccccttgttccatccgccttccgacccca

SEQ ID NO: 282746 - DNA, 75 bp, Artificial Sequence
  Synthetic
tagagcagatttttgagacagccccttttgttaaaatcgtggaacaccatactctaatgacaactcacaaaatgt

SEQ ID NO: 282747 - DNA, 75 bp, Artificial Sequence
  Synthetic
tgtctcgaaaccattgacagaccccttgttccatccgccttccgaccccaaaattttgagacattttaatatatg

SEQ ID NO: 282748 - DNA, 75 bp, Artificial Sequence
  Synthetic
gggatgataatattgagtttgttggattgtaaataagagtgagtgtaaaatagtgttatatttggggtagaattt

SEQ ID NO: 282749 - DNA, 75 bp, Artificial Sequence
  Synthetic
ataaagatttttttttgtttttagaataattagattatattttgtaaatttattatttgtttatttttggaggag

SEQ ID NO: 282750 - DNA, 75 bp, Artificial Sequence
  Synthetic
atgttatggtgttattaaattgttgtattttattaaagttaagttaattatttttatattttgatttttttggat

SEQ ID NO: 282751 - DNA, 75 bp, Artificial Sequence
  Synthetic
ttgcgaggctacacgacctgtacaacagaccaataacttactattttaagaagcaagtcatccgggggaacattt

SEQ ID NO: 282752 - DNA, 75 bp, Artificial Sequence
  Synthetic
tcagacgacgacatcaaacgattactaagagactctttgcggaggacaaagtgggttgatcaagaagtgcgccat

SEQ ID NO: 282753 - DNA, 75 bp, Artificial Sequence
  Synthetic
atctatattcagcaatcagagtgggcacagttgtcactgcttatgaagactgttcaggactggtatcatttactg

SEQ ID NO: 282754 - DNA, 75 bp, Artificial Sequence
  Synthetic
gcagctagaactatgactagagatcacagccccaacaagaaagtatctcgcaagacaggatgttcagaatgggtc

SEQ ID NO: 282755 - DNA, 75 bp, Artificial Sequence
  Synthetic
cagaccaataacttactattttaagaagcaagtcatccgggggaacatttatttatcttggagctggtcagacga

SEQ ID NO: 282756 - DNA, 75 bp, Artificial Sequence
  Synthetic
ttggtttttttattgtgttttgggaaattttttatttatatgatattagataagtttggtttttggagtttgatt

SEQ ID NO: 282757 - DNA, 75 bp, Artificial Sequence
  Synthetic
ctcactggatcaggctcatttataaaatcgtgaagactaccagacttgtaggaaatacggaagacttgtccaggg

SEQ ID NO: 282758 - DNA, 75 bp, Artificial Sequence
  Synthetic
aatcgtgaagactaccagacttgtaggaaatacggaagacttgtccagggaagtaaaaaagcacctccgagggta

SEQ ID NO: 282759 - DNA, 75 bp, Artificial Sequence
  Synthetic
tattttattaaagttaagttaattatttttatattttgatttttttggatgtgaaaaaaattattaatatttttt

SEQ ID NO: 282760 - DNA, 75 bp, Artificial Sequence
  Synthetic
aattttttatttatatgatattagataagtttggtttttggagtttgattgatatatattattttagttgtttaa

SEQ ID NO: 282761 - DNA, 75 bp, Artificial Sequence
  Synthetic
tatatggaatttaaagttggatatattttagttataaaaatgaatgggtttatttgtataggtgttgtgatggag

SEQ ID NO: 282762 - DNA, 75 bp, Artificial Sequence
  Synthetic
attatagctgcttataacccaggcactaaaaaggccacacagagactgacattcttggacaatgtaccctgaaaa

SEQ ID NO: 282763 - DNA, 75 bp, Artificial Sequence
  Synthetic
tgggtcaagtcagatccctaaatgcaacggttattgctgcatgtgctcctcatgaaatgtctgttctagggggct

SEQ ID NO: 282764 - DNA, 75 bp, Artificial Sequence
  Synthetic
attcttggacaatgtaccctgaaaaaaacaaggtccttgttcataacctctgtttgtttgattgttttttttatc

SEQ ID NO: 282765 - DNA, 75 bp, Artificial Sequence
  Synthetic
ttttagttataaaaatgaatgggtttatttgtataggtgttgtgatggaggttgaaatttatattaattttgttg

SEQ ID NO: 282766 - DNA, 75 bp, Artificial Sequence
  Synthetic
gtatgtagagttgtgtataattggaagatggttggtgattttagatatgaagagtttttatataatttgtatttt

SEQ ID NO: 282767 - DNA, 75 bp, Artificial Sequence
  Synthetic
agatggttggtgattttagatatgaagagtttttatataatttgtattttgattattattggttttgaattgtaa

SEQ ID NO: 282768 - DNA, 75 bp, Artificial Sequence
  Synthetic
gatttatatgatagatttttttatttgagggttttttttggtgggaattgtttaggagtagtggtgttttttatt

SEQ ID NO: 282769 - DNA, 75 bp, Artificial Sequence
  Synthetic
tgagggttttttttggtgggaattgtttaggagtagtggtgttttttatttattgttttattaattatgattata

SEQ ID NO: 282770 - DNA, 75 bp, Artificial Sequence
  Synthetic
atacaagtcaatcttatccggcatgaatgcagccaaacttgaccctgatgatgtatgctcttatctggcagctgc

SEQ ID NO: 282771 - DNA, 75 bp, Artificial Sequence
  Synthetic
ggactattctagggttacatatgcatttcacctggactatgagaagtggaacaatcatcaaaggttggagtcaac

SEQ ID NO: 282772 - DNA, 75 bp, Artificial Sequence
  Synthetic
aatgcagccaaacttgaccctgatgatgtatgctcttatctggcagctgcaatgcagttctttgaaggagcatgt

SEQ ID NO: 282773 - DNA, 75 bp, Artificial Sequence
  Synthetic
ttaatgtctgattttgcattgtctatagacggaccactttgcttggtcttcaaaacttacgggactatgctagta

SEQ ID NO: 282774 - DNA, 75 bp, Artificial Sequence
  Synthetic
ttcgtcaatccgagtgctatcagagccggtctggctgatcttgagatggctgaagagactgttgatctgatcaat

SEQ ID NO: 282775 - DNA, 75 bp, Artificial Sequence
  Synthetic
attaatagtagagggaagagagtatttaaagggagtgagatttgtggttttgtagatgaaagaggtttatataag

SEQ ID NO: 282776 - DNA, 75 bp, Artificial Sequence
  Synthetic
tgaagagactgttgatctgatcaatagaaacatagaagacaatcaggctcatctccagggggaacccatagaagt

SEQ ID NO: 282777 - DNA, 75 bp, Artificial Sequence
  Synthetic
ttaaagggagtgagatttgtggttttgtagatgaaagaggtttatataagtttttaaaaggagtatgtaaattta

SEQ ID NO: 282778 - DNA, 75 bp, Artificial Sequence
  Synthetic
tcctgattgcacggaagggagacaagataaccccaaattctcttgtggacataaaacgtactcatgtggaaggga

SEQ ID NO: 282779 - DNA, 75 bp, Artificial Sequence
  Synthetic
gttgacaagggaccccactgttgcagaacatgcatctctggtcggtcttctcttgagtctgtataggttgagcaa

SEQ ID NO: 282780 - DNA, 75 bp, Artificial Sequence
  Synthetic
atgtaaatattaaatgaaattaaatggtgtttttttggttagttggtgaatttgtatgatttttgtttagatgaa

SEQ ID NO: 282781 - DNA, 75 bp, Artificial Sequence
  Synthetic
ggtgtttttttggttagttggtgaatttgtatgatttttgtttagatgaaattgagtattttgttgtagaggagt

SEQ ID NO: 282782 - DNA, 75 bp, Artificial Sequence
  Synthetic
gaacatgcatctctggtcggtcttctcttgagtctgtataggttgagcaaaatatccggccaaaacaccggcaat

SEQ ID NO: 282783 - DNA, 75 bp, Artificial Sequence
  Synthetic
cctgtaattctagcttgagtctgtcatctcactggatcaggttgatttacaagatagtgaagactaccagactcg

SEQ ID NO: 282784 - DNA, 75 bp, Artificial Sequence
  Synthetic
attaagttagtgagttttagatgttttagttatttaagaaaatttgtttttgggtttggaaaagtatatattata

SEQ ID NO: 282785 - DNA, 75 bp, Artificial Sequence
  Synthetic
cgcattgactatgacagacaacttgaacaaggtgtttaagaagttgatcgacagagtcaccggacaggggctttt

SEQ ID NO: 282786 - DNA, 75 bp, Artificial Sequence
  Synthetic
ttagttatttaagaaaatttgtttttgggtttggaaaagtatatattatatttaataagattttgatggaagttg

SEQ ID NO: 282787 - DNA, 75 bp, Artificial Sequence
  Synthetic
tacaacagatggatcaccctcgaggatatccgatctagatcatccctactagactacagttgtttgtaagccgga

SEQ ID NO: 282788 - DNA, 75 bp, Artificial Sequence
  Synthetic
gacatgtttttctcccggattgaacatctgtattcagcaattagagtgggaacagttgtcactgcttatgaggac

SEQ ID NO: 282789 - DNA, 75 bp, Artificial Sequence
  Synthetic
acagagtcaccggacaggggcttttagactattcaagagtcacatacgcctttcacctggactacgagaagtgga

SEQ ID NO: 282790 - DNA, 75 bp, Artificial Sequence
  Synthetic
gggtgtttaagagttggggggaggtgttatttttatgtaaatggggtattttttaatggtataatattaggattt

SEQ ID NO: 282791 - DNA, 75 bp, Artificial Sequence
  Synthetic
aaggggacaacatccactccttctcagagagaaagccaatcctcgagagccaggatggcggctcaagctgcctct

SEQ ID NO: 282792 - DNA, 75 bp, Artificial Sequence
  Synthetic
tgcaagagaagcaatactatatttcttccacaagaatttcgaagaggagataagaaggatgtttgagccggggca

SEQ ID NO: 282793 - DNA, 75 bp, Artificial Sequence
  Synthetic
gttatttttatgtaaatggggtattttttaatggtataatattaggatttgatggtaatgttttaattttagaga

SEQ ID NO: 282794 - DNA, 75 bp, Artificial Sequence
  Synthetic
ttccacaagaatttcgaagaggagataagaaggatgtttgagccggggcaagagactgctgttcctcactcttat

SEQ ID NO: 282795 - DNA, 75 bp, Artificial Sequence
  Synthetic
agagagaaagccaatcatcgaaagccaggatggcggctcaaattgcttctggccctccagcccttgaatggtcgg

SEQ ID NO: 282796 - DNA, 75 bp, Artificial Sequence
  Synthetic
attttttttatgtattttttggtagatttgtttattgtttttaagaatggtgatgaggttgaggattttgttgaa

SEQ ID NO: 282797 - DNA, 75 bp, Artificial Sequence
  Synthetic
atttgtttattgtttttaagaatggtgatgaggttgaggattttgttgaagtttatttttttgatgtgtatgaat

SEQ ID NO: 282798 - DNA, 75 bp, Artificial Sequence
  Synthetic
aaatgcagttggtcatgtgttcaacctcattcactttgtcggatgttatatgggtcaggttagatccttaaatgc

SEQ ID NO: 282799 - DNA, 75 bp, Artificial Sequence
  Synthetic
ggaatgtttatctatcttggagctggtctggcgactcctcggtgttcaagagagtagcctgtaattctagcttga

SEQ ID NO: 282800 - DNA, 75 bp, Artificial Sequence
  Synthetic
ctcattcactttgtcggatgttatatgggtcaggttagatccttaaatgcaacggttattgccacatgtgccccg

SEQ ID NO: 282801 - DNA, 75 bp, Artificial Sequence
  Synthetic
ctgagattatcgtggatcaatatgagtacaagtaccctgctattaaggacttgaagaagcccagtatcaccctag

SEQ ID NO: 282802 - DNA, 75 bp, Artificial Sequence
  Synthetic
ttgagtgtaggggttttgattgttttgatgttgataatttttttgatgatatgttggagaagagttaattgattg

SEQ ID NO: 282803 - DNA, 75 bp, Artificial Sequence
  Synthetic
aatgctgccaagcttgatcctgatgacgtatgttcctacttagcagctgcaatgcagttcttcgaggggacgtgt

SEQ ID NO: 282804 - DNA, 75 bp, Artificial Sequence
  Synthetic
ggggacttttgagagaagattcttcagggacgagaaagaacttcaggaatatgaagcagctgaattgacgaagac

SEQ ID NO: 282805 - DNA, 75 bp, Artificial Sequence
  Synthetic
tgatgttgataatttttttgatgatatgttggagaagagttaattgattggaatttatataatataattttagag

SEQ ID NO: 282806 - DNA, 75 bp, Artificial Sequence
  Synthetic
tccaaactccccctaagatgtgtactgggatgggtcgctttggccaactctaagaaattccagttgttagtcgaa

SEQ ID NO: 282807 - DNA, 75 bp, Artificial Sequence
  Synthetic
tgggatgggtcgctttggccaactctaagaaattccagttgttagtcgaatccgacaagctgagtaaaatcatgc

SEQ ID NO: 282808 - DNA, 75 bp, Artificial Sequence
  Synthetic
ttatgggaattatataagagtgggggtgagattggattgtgagagttggttgtttttttaatgatttaagttttg

SEQ ID NO: 282809 - DNA, 75 bp, Artificial Sequence
  Synthetic
gtgagattggattgtgagagttggttgtttttttaatgatttaagttttgaagattatttttttttggggggttt

SEQ ID NO: 282810 - DNA, 75 bp, Artificial Sequence
  Synthetic
tgaggtagccttggcagatgatggaacagtcaattctgatgacgaggactacttctccagtgaaaccaggagtcc

SEQ ID NO: 282811 - DNA, 75 bp, Artificial Sequence
  Synthetic
acgtatgttcctacttagcagctgcaatgcagttcttcgaggggacgtgtcccgaagactggaccagctatggga

SEQ ID NO: 282812 - DNA, 75 bp, Artificial Sequence
  Synthetic
aatatctgggcaaaacaccggtaactataagacaaacattgcagataggatagagcagatcttcgagacagcccc

SEQ ID NO: 282813 - DNA, 75 bp, Artificial Sequence
  Synthetic
tgggtagatttaagagttatgagatttttattaatttttttagttgattaagtaagattatgtagatttttataa

SEQ ID NO: 282814 - DNA, 75 bp, Artificial Sequence
  Synthetic
ttttattaatttttttagttgattaagtaagattatgtagatttttataataggggagattttttagtagtttta

SEQ ID NO: 282815 - DNA, 75 bp, Artificial Sequence
  Synthetic
agcagaacattagaattgtggaccccaatccttcatgaaaaaaactaacacccctcctcttgaaccacttcagaa

SEQ ID NO: 282816 - DNA, 75 bp, Artificial Sequence
  Synthetic
cctctcccgcgtcagcccctctggatgacgatgacttgtggcttccaccccctgaatacgtcccgctgaaagaac

SEQ ID NO: 282817 - DNA, 75 bp, Artificial Sequence
  Synthetic
taaattatggggtgttttaggtgattttgtgtttgggtatagataaaggttatggtgtgttttatgatagtggat

SEQ ID NO: 282818 - DNA, 75 bp, Artificial Sequence
  Synthetic
tttgtgtttgggtatagataaaggttatggtgtgttttatgatagtggatttaggatgagttaattgagagaggt

SEQ ID NO: 282819 - DNA, 75 bp, Artificial Sequence
  Synthetic
acaaccaggctcatctccaaggagaacccatagaggtggacagtctccctgaagacatgagacgactccaattgg

SEQ ID NO: 282820 - DNA, 75 bp, Artificial Sequence
  Synthetic
tgcaagggaagcaatactatatttcttccacaaaaacttcgaggaagagataagaagaatgtttgagccaggaca

SEQ ID NO: 282821 - DNA, 75 bp, Artificial Sequence
  Synthetic
tttagtaaagtgtgtataattataaagtgttgggttatttaagttttttagttgagaaaaaaatagtagattaga

SEQ ID NO: 282822 - DNA, 75 bp, Artificial Sequence
  Synthetic
gaggtggacaaggtagagaactcagagtttagagaagcgatcctcctatccaagactcatagggacaacttcata

SEQ ID NO: 282823 - DNA, 75 bp, Artificial Sequence
  Synthetic
aagtgtcaggaagactttcagatggatgagggggaggaccccatcttcttgttccaatcctatctggacaatatt

SEQ ID NO: 282824 - DNA, 75 bp, Artificial Sequence
  Synthetic
agtgttgggttatttaagttttttagttgagaaaaaaatagtagattagaagaataattggtaatattttttatt

SEQ ID NO: 282825 - DNA, 75 bp, Artificial Sequence
  Synthetic
atgagggggaggaccccatcttcttgttccaatcctatctggacaatattggagttcagatagtcagacaaatga

SEQ ID NO: 282826 - DNA, 75 bp, Artificial Sequence
  Synthetic
taagaagaatgtttgagccaggacaagagacagctgttcctcactcctatttcattcactttcgttcactgggct

SEQ ID NO: 282827 - DNA, 75 bp, Artificial Sequence
  Synthetic
attgatttaattgagttagaggttgaatttagaggaatttttattgtttttaatattttgaggaattttgattat

SEQ ID NO: 282828 - DNA, 75 bp, Artificial Sequence
  Synthetic
aatttagaggaatttttattgtttttaatattttgaggaattttgattataattttaatttttttttgatagaag

SEQ ID NO: 282829 - DNA, 75 bp, Artificial Sequence
  Synthetic
atgtcctatgtcacggtcaacttccctagttcgccggggaagtcttcagaggacaaggccacccagacttccaac

SEQ ID NO: 282830 - DNA, 75 bp, Artificial Sequence
  Synthetic
acagactccccaaagggtcggaagggtctggacctgctcctcggagagggcagatctcttaagagagatctcgtg

SEQ ID NO: 282831 - DNA, 75 bp, Artificial Sequence
  Synthetic
atttgggggaggagtttttcgggaaggggacgtttgagaggagattcttcagagatgagaaggaacttcaagaat

SEQ ID NO: 282832 - DNA, 75 bp, Artificial Sequence
  Synthetic
actgtcaactctgacgatgaagactacttctccggcgaaaccagaagtccagaagctgtttatactcgaatcatg

SEQ ID NO: 282833 - DNA, 75 bp, Artificial Sequence
  Synthetic
tggatgattttaatagataattgttttaggttttttagagttttgaaagattattttaagaaggtagatttgggt

SEQ ID NO: 282834 - DNA, 75 bp, Artificial Sequence
  Synthetic
ttaggttttttagagttttgaaagattattttaagaaggtagatttgggtttttttaaggtgggtggaatggttg

SEQ ID NO: 282835 - DNA, 75 bp, Artificial Sequence
  Synthetic
cagaccgcctctggtcctcctgctctagagtggtccactgccaacgaagaggatgacatgtctgtggaggctgaa

SEQ ID NO: 282836 - DNA, 75 bp, Artificial Sequence
  Synthetic
tgacactgcactggcagatgatggaactgtcaattcggatgacgaggactacttctccggggaaaccagaagccc

SEQ ID NO: 282837 - DNA, 75 bp, Artificial Sequence
  Synthetic
ctagttcgccggggaagtcttcagaggacaaggccacccagacttccaaccgagaactcaagaaggagacagtgt

SEQ ID NO: 282838 - DNA, 75 bp, Artificial Sequence
  Synthetic
aggggcatttcaaatgactcagtgcttgggcacagaaagaagtcgtggtgtatcccctgatctgggactaaacat

SEQ ID NO: 282839 - DNA, 75 bp, Artificial Sequence
  Synthetic
aggagttggagatgtataatagatttggtttatttttattttaagttgttttttatagagaagttgttaaatttt

SEQ ID NO: 282840 - DNA, 75 bp, Artificial Sequence
  Synthetic
ggaaagcccccgacttaaacaaagcatacaagtcagttttatcaggcatgaatgccgccaaacttgatcctgatg

SEQ ID NO: 282841 - DNA, 75 bp, Artificial Sequence
  Synthetic
ccgatcatcggggatattcttgtacaattttgagcagttaaagatgaacctcgatgacatagttaaagagtcaaa

SEQ ID NO: 282842 - DNA, 75 bp, Artificial Sequence
  Synthetic
tggtttatttttattttaagttgttttttatagagaagttgttaaattttatgttaggaaatagagggttgagaa

SEQ ID NO: 282843 - DNA, 75 bp, Artificial Sequence
  Synthetic
ccggaagactggaccagctatggaatcctgattgcacgaaaaggagacaagatcaccccagattctctggtggaa

SEQ ID NO: 282844 - DNA, 75 bp, Artificial Sequence
  Synthetic
cagattttccactggaagaggctccggttttcaagagaacggggtctgccttgcataggttcaagtcagccagat

SEQ ID NO: 282845 - DNA, 75 bp, Artificial Sequence
  Synthetic
gtatttggaaggtattttgttaatatgtattttttttatttgtttttttatgtaattattttatatatgaatgtt

SEQ ID NO: 282846 - DNA, 75 bp, Artificial Sequence
  Synthetic
tgtattttttttatttgtttttttatgtaattattttatatatgaatgttttagattgggatgaagaaaagatta

SEQ ID NO: 282847 - DNA, 75 bp, Artificial Sequence
  Synthetic
ataaaataatgcaagatgacctaaaccgttatgtgccccattgactgatctctcaaactcggtcccactatacaa

SEQ ID NO: 282848 - DNA, 75 bp, Artificial Sequence
  Synthetic
ttgtccaaatcttctatctcacatctctgtcagcacagacacgatgtcagatttgactcaagacggaagaaacta

SEQ ID NO: 282849 - DNA, 75 bp, Artificial Sequence
  Synthetic
gtaaagtttaaagattaaatatggggattgttgattgtgataaaggattttgtttatttttaaagttttaattgt

SEQ ID NO: 282850 - DNA, 75 bp, Artificial Sequence
  Synthetic
atctccagggagaacctatagaggtggacaatctccctgaggacatgaagcggcttcagctggacgataaaaaac

SEQ ID NO: 282851 - DNA, 75 bp, Artificial Sequence
  Synthetic
gattgttgattgtgataaaggattttgtttatttttaaagttttaattgtttttttgatagaaattatatattta

SEQ ID NO: 282852 - DNA, 75 bp, Artificial Sequence
  Synthetic
accgtcaattctgatgacgaggattacttctccggtgagacaaggagccctgaggctgtctatactcgaatcatg

SEQ ID NO: 282853 - DNA, 75 bp, Artificial Sequence
  Synthetic
acacgcagaagtcccctctcgcatcggctcctccagacgatgatgatttgtggttaccccctccagaatatgttc

SEQ ID NO: 282854 - DNA, 75 bp, Artificial Sequence
  Synthetic
gactttctgatggatgaaggggaggatcctagcctcctcttccagtcatacctggacaatgttggagtacagata

SEQ ID NO: 282855 - DNA, 75 bp, Artificial Sequence
  Synthetic
tgcacgactttcgctcggatgagattgagcatcttgttgtagaggagttggtcaagaaaagagaggagtgtctgg

SEQ ID NO: 282856 - DNA, 75 bp, Artificial Sequence
  Synthetic
ttttttttagagttttgatatttagatgatttgatattttagttatgttagttgtatattgttggggattaagtt

SEQ ID NO: 282857 - DNA, 75 bp, Artificial Sequence
  Synthetic
ggagaagtcaaggtgtgtagtccgaacggctattcatttaggatcctgcggcatattttgaaatcatttgatgag

SEQ ID NO: 282858 - DNA, 75 bp, Artificial Sequence
  Synthetic
atgatttgatattttagttatgttagttgtatattgttggggattaagttttgtttatgtgtggaaattttggtt

SEQ ID NO: 282859 - DNA, 75 bp, Artificial Sequence
  Synthetic
gattcctcaagatatggtcacaaaccgtggaggaaatcatatcttatgtcacagtcaactttcccaaccccccag

SEQ ID NO: 282860 - DNA, 75 bp, Artificial Sequence
  Synthetic
agagtagaaaagtttaggttttttatttattttttgggagatttttttgtatttataaaagataaggtaagttaa

SEQ ID NO: 282861 - DNA, 75 bp, Artificial Sequence
  Synthetic
tttattttttgggagatttttttgtatttataaaagataaggtaagttaatttgaagagatgtttggtttttgtg

SEQ ID NO: 282862 - DNA, 75 bp, Artificial Sequence
  Synthetic
aactcatttgccgagtttctaaacaagacatattcaagtgactcgtaaggagttggacaacaagattgaaaatac

SEQ ID NO: 282863 - DNA, 75 bp, Artificial Sequence
  Synthetic
gaatgccgttggtcatgtgttcaatctcattcactttgttggatgctatatgggtcaagtcagatccctaaatgc

SEQ ID NO: 282864 - DNA, 75 bp, Artificial Sequence
  Synthetic
ttggaatactcacaggagatcacttgggatgatgatactgagttcgtcggattgcaaataagagtgagtgcaaga

SEQ ID NO: 282865 - DNA, 75 bp, Artificial Sequence
  Synthetic
aaggagacaacatctatttcttcccagagagacagtcaatcctcgaaagccaggatggtggctcaagccgcctct

SEQ ID NO: 282866 - DNA, 75 bp, Artificial Sequence
  Synthetic
cggccatgttctaatcccagagatgcaatcatccctcctccagcaacatatggagttgttggaatcctcagtcat

SEQ ID NO: 282867 - DNA, 75 bp, Artificial Sequence
  Synthetic
attgcaaataagagtgagtgcaagacaatgtcatatccagggcagaatctggtgtatcaacatgaactcaagagc

SEQ ID NO: 282868 - DNA, 75 bp, Artificial Sequence
  Synthetic
gtttttgtgtatggttgttataggtattgggggtatttatatatagattattgaaagggtttgttaaaattatat

SEQ ID NO: 282869 - DNA, 75 bp, Artificial Sequence
  Synthetic
aattgaggagaaccctcatcttccagtgggctgattccagaggccctctagagggggaagagttggaatactctc

SEQ ID NO: 282870 - DNA, 75 bp, Artificial Sequence
  Synthetic
caggatggtggctcaagccgcctctggtcccccagccctcgagtggtctgctaccaacgaggaggatgatctgtc

SEQ ID NO: 282871 - DNA, 75 bp, Artificial Sequence
  Synthetic
tgcaaacatcaaatgaaaccaaatggtgccctcccgataagttggtgaacctgcacgactttcgctcagacgaaa

SEQ ID NO: 282872 - DNA, 75 bp, Artificial Sequence
  Synthetic
tttagatggggttttgataagtattttaagtggtatttggatttatgatttttagtttgagattattttttgatt

SEQ ID NO: 282873 - DNA, 75 bp, Artificial Sequence
  Synthetic
attgggggtatttatatatagattattgaaagggtttgttaaaattatatgattaggtttatattaaaaaagtga

SEQ ID NO: 282874 - DNA, 75 bp, Artificial Sequence
  Synthetic
gagtgcaggggccctggttgccttgatgttgataatcttcttaatgacatgttgtagaagagtcaatcgaccgga

SEQ ID NO: 282875 - DNA, 75 bp, Artificial Sequence
  Synthetic
atcctgcaaattcctcaattgtttacctctggaggagagaacacatgggcttaactccaaccttcgggagcaata

SEQ ID NO: 282876 - DNA, 75 bp, Artificial Sequence
  Synthetic
cctctggaggagagaacacatgggcttaactccaaccttcgggagcaatagaacaaaaacatgttatggtgccgt

SEQ ID NO: 282877 - DNA, 75 bp, Artificial Sequence
  Synthetic
ttaagtggtatttggatttatgatttttagtttgagattattttttgattttttatattaaaatttaaatatggt

SEQ ID NO: 282878 - DNA, 75 bp, Artificial Sequence
  Synthetic
attatgtaaatttttgagatttttgaattaatggatttattagaaatattggatgataaattatatttttttatt

SEQ ID NO: 282879 - DNA, 75 bp, Artificial Sequence
  Synthetic
aattaatggatttattagaaatattggatgataaattatatttttttattagaatgagattagttttttggttgt

SEQ ID NO: 282880 - DNA, 75 bp, Artificial Sequence
  Synthetic
ccaagtcagtgagtttcagacgtctcagtcatttaagaaaacttgtccctgggtttggaaaagcatataccatat

SEQ ID NO: 282881 - DNA, 75 bp, Artificial Sequence
  Synthetic
ttaactccaaccttcgggagcaatagaacaaaaacatgttatggtgccgttgaatcgctgcattttattatagtc

SEQ ID NO: 282882 - DNA, 75 bp, Artificial Sequence
  Synthetic
ttgtttaagttgtttgttaatttttgagagtttttgaagtttatagattttggaggattgttagatgaagatttg

SEQ ID NO: 282883 - DNA, 75 bp, Artificial Sequence
  Synthetic
tgtgcctatccttatttcctcgttttgtttcggggacttccccatctacacgataccagagaaacttggcccttg

SEQ ID NO: 282884 - DNA, 75 bp, Artificial Sequence
  Synthetic
agaaacatagaagacaatcaggctcatctccaaggggaacctatcgaagtggacaaccttcctgaggacatgagg

SEQ ID NO: 282885 - DNA, 75 bp, Artificial Sequence
  Synthetic
gagagtttttgaagtttatagattttggaggattgttagatgaagatttgataattggttttaagttaaaggaat

SEQ ID NO: 282886 - DNA, 75 bp, Artificial Sequence
  Synthetic
cctctcttgtgtcagctcctccagatgacgatgacctatggctccctccccctgaatatgttccgctgaaagaac

SEQ ID NO: 282887 - DNA, 75 bp, Artificial Sequence
  Synthetic
tgtttcggggacttccccatctacacgataccagagaaacttggcccttggagtcccatcgacatacatcatctc

SEQ ID NO: 282888 - DNA, 75 bp, Artificial Sequence
  Synthetic
agattgtattttgttattattgaaaaatttttggttaattatattttgttattttttgatgtgttgattatgata

SEQ ID NO: 282889 - DNA, 75 bp, Artificial Sequence
  Synthetic
ggcgggggaaggcaagtatcgagaggactttcagatggatgaaggagaggatcctagcctcctgttccagtcgta

SEQ ID NO: 282890 - DNA, 75 bp, Artificial Sequence
  Synthetic
aatttttggttaattatattttgttattttttgatgtgttgattatgatagataatttgaataaggtgtttaaaa

SEQ ID NO: 282891 - DNA, 75 bp, Artificial Sequence
  Synthetic
agggttttcttacatggagctgaaggtgggatacatctctgccataaaggtgaatgggttcacctgtaccggtgt

SEQ ID NO: 282892 - DNA, 75 bp, Artificial Sequence
  Synthetic
ccgaactgggggaagtatgtattactgagtgcaggggccctgactgccttgatgttgataattttcctgatgaca

SEQ ID NO: 282893 - DNA, 75 bp, Artificial Sequence
  Synthetic
cgtttaagaggaagcacttccgtccgatgccagatgcatgcagagccgcatacaactggaagacagccggtgatc

SEQ ID NO: 282894 - DNA, 75 bp, Artificial Sequence
  Synthetic
atatatgtattttatttggattatgaaaagtggaataattattaaagattagagttaatagaggatgtatttttt

SEQ ID NO: 282895 - DNA, 75 bp, Artificial Sequence
  Synthetic
acttgacaacatggaggtacttccaatcagtccaagagcaggtgaatatgtcttatgacctcatcatttgtgatg

SEQ ID NO: 282896 - DNA, 75 bp, Artificial Sequence
  Synthetic
aacctacgcaacacaatctcagagggacagggagggaggtgtcagtcactccccaaagcgggaagatcatatctt

SEQ ID NO: 282897 - DNA, 75 bp, Artificial Sequence
  Synthetic
ggcaacacttctcatcctgaagcccacatcaagatgctggatccaggagaagtctatgatgaccccattgatcca

SEQ ID NO: 282898 - DNA, 75 bp, Artificial Sequence
  Synthetic
cggacagtaaaaaccaccaaagagtctctcgttatcatatcaccaagtgtggctgatttggatccctacgataaa

SEQ ID NO: 282899 - DNA, 75 bp, Artificial Sequence
  Synthetic
tttctacgcaagatagtgaaaaactgtagggatgaggacacccagaagccctcccctgtatcggctcctcccgat

SEQ ID NO: 282900 - DNA, 75 bp, Artificial Sequence
  Synthetic
tatttagatagattagattttattgggttatgggaggattaaatatattgtttagatgtgtttaatggtttaatt

SEQ ID NO: 282901 - DNA, 75 bp, Artificial Sequence
  Synthetic
gagtgcaggggccctgattgccttgatgttgataattttcctaataacatgttgcagaagagtcaatcgaccaga

SEQ ID NO: 282902 - DNA, 75 bp, Artificial Sequence
  Synthetic
gattcctcaagatatggtcacagaccgtagaggagattatatcctatgtcactgtcaactttcccaaccctctcg

SEQ ID NO: 282903 - DNA, 75 bp, Artificial Sequence
  Synthetic
agtagaggctgagatcgctcaccagattgctgaaagcttttccaagaagtacaagtttccctctcgatcctcagg

SEQ ID NO: 282904 - DNA, 75 bp, Artificial Sequence
  Synthetic
cctccttgaactccatgcaactgggtagattcaagagtcatgagattttcattaatcctctcagttgatcaagca

SEQ ID NO: 282905 - DNA, 75 bp, Artificial Sequence
  Synthetic
ggttatgggaggattaaatatattgtttagatgtgtttaatggtttaatttgttggaatggttaggatggtgggt

SEQ ID NO: 282906 - DNA, 75 bp, Artificial Sequence
  Synthetic
gatagagaattttaaattaggaatataagaattaaagtattagtttaaggagataattaggttttatgtttgata

SEQ ID NO: 282907 - DNA, 75 bp, Artificial Sequence
  Synthetic
taagaattaaagtattagtttaaggagataattaggttttatgtttgatatatatgttgttgttagggttatttt

SEQ ID NO: 282908 - DNA, 75 bp, Artificial Sequence
  Synthetic
ggagatcttctagcagtttcagtgactaacggtactttcattctccaggaactgacaccaacagttgtagacaaa

SEQ ID NO: 282909 - DNA, 75 bp, Artificial Sequence
  Synthetic
cttgcggattcgttgatgaaaggggtttatataagtctctcaaaggggcatgtaagctcaaactgtgcggagttt

SEQ ID NO: 282910 - DNA, 75 bp, Artificial Sequence
  Synthetic
tgatttctctttggttatatggtgcccactctgaatcaaacaggagccggagatgtataactgaattggctcatt

SEQ ID NO: 282911 - DNA, 75 bp, Artificial Sequence
  Synthetic
tgggatgggtcgctttggccaactctaaaaaattccaattgttagtcgaagccgacaagctaagtagaatcatgc

SEQ ID NO: 282912 - DNA, 75 bp, Artificial Sequence
  Synthetic
atatatagagttgttgaggaaggggtatttaaattagggttgattattaagaaagaagagattatgtgtagttat

SEQ ID NO: 282913 - DNA, 75 bp, Artificial Sequence
  Synthetic
gaggccaaatggtgctctactgatcaactggtgaatatacatgatattcgctcggatgagatagaacatcttgtt

SEQ ID NO: 282914 - DNA, 75 bp, Artificial Sequence
  Synthetic
atgtgaaaaaaactgtcaacatccctcaaaagacttaaggaatgatgattcctcaagctcttttgtttgtgcccc

SEQ ID NO: 282915 - DNA, 75 bp, Artificial Sequence
  Synthetic
tggaatactctcaagagatcacttgggatgatgatactgagtttgtcggattacaaataagagtgagtgcaagac

SEQ ID NO: 282916 - DNA, 75 bp, Artificial Sequence
  Synthetic
tccctctagataataaaatctgagatgtcctagagtcgacatgaaaaaaacaggcaacaccactgataaaatgaa

SEQ ID NO: 282917 - DNA, 75 bp, Artificial Sequence
  Synthetic
tatttaaattagggttgattattaagaaagaagagattatgtgtagttatgatttttttatttatggaaaaattt

SEQ ID NO: 282918 - DNA, 75 bp, Artificial Sequence
  Synthetic
gttttttgtgtttttaatgattaaatagttaattttgttaatataatgttgatagtgtttattaatgtgttaata

SEQ ID NO: 282919 - DNA, 75 bp, Artificial Sequence
  Synthetic
ttattctatcctccatctgatcccaaaatcctgagacacttcaacatatgctgcagtaccatgatgtacttgtca

SEQ ID NO: 282920 - DNA, 75 bp, Artificial Sequence
  Synthetic
tagttaattttgttaatataatgttgatagtgtttattaatgtgttaatagtggtataatatttttaatttttga

SEQ ID NO: 282921 - DNA, 75 bp, Artificial Sequence
  Synthetic
ttcctcccgtgaaggacataagcagtagctcacaatcatctcgcgtctcagcaaagtgtgcataattataaagtg

SEQ ID NO: 282922 - DNA, 75 bp, Artificial Sequence
  Synthetic
aactggtgaatatacatgatattcgctcggatgagatagaacatcttgttgtagaggagttggtcaagaagaggg

SEQ ID NO: 282923 - DNA, 75 bp, Artificial Sequence
  Synthetic
atcattcgacgagatatactctgggaatcataggatgattgggttagtcaaagttgttattggactagctttgtc

SEQ ID NO: 282924 - DNA, 75 bp, Artificial Sequence
  Synthetic
tatttgttatttagtttaattttaaagggaagagtttataagattttgagtgttgaaggggagagttttttttta

SEQ ID NO: 282925 - DNA, 75 bp, Artificial Sequence
  Synthetic
ggaggaaggtgtcatccccatgagaacggagtgtttttcaatggtataattctgggtcctgatgggagtgtcttg

SEQ ID NO: 282926 - DNA, 75 bp, Artificial Sequence
  Synthetic
agaaagcatttccgcccaacaccagatgcatgtcgagctgcttacaactggaaaatggccggtgaccccagatat

SEQ ID NO: 282927 - DNA, 75 bp, Artificial Sequence
  Synthetic
tttatcaaaatctgattgattacctttgcattttcagcctcttggatgtgaaaaaaacttttaacacccctcaaa

SEQ ID NO: 282928 - DNA, 75 bp, Artificial Sequence
  Synthetic
atctgtcctggagttggtccgatgacgccgcagtgtttaagagggtggcttgcaactctagcttgagtctttcat

SEQ ID NO: 282929 - DNA, 75 bp, Artificial Sequence
  Synthetic
tgatagtttttagattttgtttttgaagggttatttttttggagagagatttggttaagtttttatgagttttgg

SEQ ID NO: 282930 - DNA, 75 bp, Artificial Sequence
  Synthetic
aggtggagaagcaccttcgaagatacaacaggtggatcaccctcaaagacatcagatccagatcatctctgttgg

SEQ ID NO: 282931 - DNA, 75 bp, Artificial Sequence
  Synthetic
agggaagagtttataagattttgagtgttgaaggggagagtttttttttagttatgttaaggataatttatttag

SEQ ID NO: 282932 - DNA, 75 bp, Artificial Sequence
  Synthetic
atcatatccccaagtgtagcagacctagatccatatgacaaatcccttcactcgagggtctttcctagcgggaag

SEQ ID NO: 282933 - DNA, 75 bp, Artificial Sequence
  Synthetic
aagggttatttttttggagagagatttggttaagtttttatgagttttggatttatgtgttgtgttaagaggttg

SEQ ID NO: 282934 - DNA, 75 bp, Artificial Sequence
  Synthetic
tagatccatatgacaaatcccttcactcgagggtctttcctagcgggaagtgtttgggaataacaatatcatcta

SEQ ID NO: 282935 - DNA, 75 bp, Artificial Sequence
  Synthetic
gaagattttattattttaaatattagaggaggggttagttttattattttatttaaggatgtaattagaaaggtt

SEQ ID NO: 282936 - DNA, 75 bp, Artificial Sequence
  Synthetic
aaaaaactggatcagaattccgaacctctgtcggcttgattgtttttccatctttattgtttttttgttaagcgt

SEQ ID NO: 282937 - DNA, 75 bp, Artificial Sequence
  Synthetic
caccaacctgtcaggattctcctacatggaactcaaagtagggtacatttcagccataaaagtgaacgggttcac

SEQ ID NO: 282938 - DNA, 75 bp, Artificial Sequence
  Synthetic
gtatgtgatgatgagtgcaggtgctctggcgatcctaatgctgacaatcttcttgatgacatgttgcagaagagc

SEQ ID NO: 282939 - DNA, 75 bp, Artificial Sequence
  Synthetic
gagagggttgattatgataatgcatttggaaggtatcttgccaacacgtattcctcttacttgttcttccatgta

SEQ ID NO: 282940 - DNA, 75 bp, Artificial Sequence
  Synthetic
gaggaggggttagttttattattttatttaaggatgtaattagaaaggttttatatgatgaggtggataaggtgg

SEQ ID NO: 282941 - DNA, 75 bp, Artificial Sequence
  Synthetic
cctaccaagagtgtttagcaagcgacctagccaggaggatccttagatggggatttgataagtactccaagtggt

SEQ ID NO: 282942 - DNA, 75 bp, Artificial Sequence
  Synthetic
aattttatattttttttaatatttgttgagtttttgtttttttgattttttagtgagttatttagtttgtttttt

SEQ ID NO: 282943 - DNA, 75 bp, Artificial Sequence
  Synthetic
agtcatgtcttcatgggagtcatacaaaagtggaggtgagactagtctgtaagggcgggtcatcccctccatgcc

SEQ ID NO: 282944 - DNA, 75 bp, Artificial Sequence
  Synthetic
atgtatgttcctacttggcagcagcaatgcagttctttgaggggacatgtccggaagactggaccagctatggaa

SEQ ID NO: 282945 - DNA, 75 bp, Artificial Sequence
  Synthetic
ggtttttccattgtgtttcgggaaattccctatttacacgataccagacaaacttggtccctggagcccgattga

SEQ ID NO: 282946 - DNA, 75 bp, Artificial Sequence
  Synthetic
agtctttgaagggggcatgcaagctcaaattatgtggggttctaggacttagacttatggacggaacgtgggtcg

SEQ ID NO: 282947 - DNA, 75 bp, Artificial Sequence
  Synthetic
ttaaaaattttagaagaatttttttataatttagagatttatgggattagttggatgatttagatattttagagg

SEQ ID NO: 282948 - DNA, 75 bp, Artificial Sequence
  Synthetic
aacagggtagattcaagggtcaagatactttcatcaatcatctcaactgatcagctacagtgaagtagactctga

SEQ ID NO: 282949 - DNA, 75 bp, Artificial Sequence
  Synthetic
ttgacagaaactacacacttatgctaaaagatcttttcttgtctcgcttcaactccttaatggtcttgctctctc

SEQ ID NO: 282950 - DNA, 75 bp, Artificial Sequence
  Synthetic
ttgagtttttgtttttttgattttttagtgagttatttagtttgttttttttgggaatttttgagttaattattg

SEQ ID NO: 282951 - DNA, 75 bp, Artificial Sequence
  Synthetic
ataatttagagatttatgggattagttggatgatttagatattttagagggttgggggggtgtggttttgttttt

SEQ ID NO: 282952 - DNA, 75 bp, Artificial Sequence
  Synthetic
tactttcatcaatcatctcaactgatcagctacagtgaagtagactctgataatacatgacatcttctgacggta

SEQ ID NO: 282953 - DNA, 75 bp, Artificial Sequence
  Synthetic
ggtatgatagttttttatttttttgagatgttggggttattttttaagttttttattttttgtatttgtggagta

SEQ ID NO: 282954 - DNA, 75 bp, Artificial Sequence
  Synthetic
agttattatcacggccttgtctaagccgcctgtcaatccccgagagtttttgaagtctatagacctcggaggatt

SEQ ID NO: 282955 - DNA, 75 bp, Artificial Sequence
  Synthetic
tctggatgcctgaaaatccgagactagggacctcttgtgacattttcaccaatagcagagggaagagggcatcca

SEQ ID NO: 282956 - DNA, 75 bp, Artificial Sequence
  Synthetic
ggacaatccaactgatatctcagacgactctgtgcttacgcttgggtaaaggccatagcaaggtcctctgcaata

SEQ ID NO: 282957 - DNA, 75 bp, Artificial Sequence
  Synthetic
aggggtgtctgagagttggagggaggtgtcatccccatgtaaacggagtgttttttaacggcataatactgggcc

SEQ ID NO: 282958 - DNA, 75 bp, Artificial Sequence
  Synthetic
agatgttggggttattttttaagttttttattttttgtatttgtggagtaataggaggaggtaattttagagttt

SEQ ID NO: 282959 - DNA, 75 bp, Artificial Sequence
  Synthetic
ttaaaggggtatttgggtttgtttatttttatgttgatttagttattttatgtatgggaaaaagttattaatgtt

SEQ ID NO: 282960 - DNA, 75 bp, Artificial Sequence
  Synthetic
agatcagacctcattgggttatgggaggatcaaatatattgcttggatatgtccaacgggccaacctgctggaat

SEQ ID NO: 282961 - DNA, 75 bp, Artificial Sequence
  Synthetic
catccagatggggtgtgcataactacaaagggctgggccatcaaagctttccagtcaagaaaaaaactatggagg

SEQ ID NO: 282962 - DNA, 75 bp, Artificial Sequence
  Synthetic
tttttatgttgatttagttattttatgtatgggaaaaagttattaatgtttatgtggtgaagagagttttattgt

SEQ ID NO: 282963 - DNA, 75 bp, Artificial Sequence
  Synthetic
cgcactgaccatgacagacaacctgaacaaggtgtttaaaaagttgatcgacagggtcaccgggcaagggctttt

SEQ ID NO: 282964 - DNA, 75 bp, Artificial Sequence
  Synthetic
ggacgaaagaggcttgtacaagtctctaaaaggagcatgcaaattgaagctatgtggagttcttggacttagact

SEQ ID NO: 282965 - DNA, 75 bp, Artificial Sequence
  Synthetic
acagggtcaccgggcaagggcttttggactattcgagggtcacatatgcatttcacctggactatgagaagtgga

SEQ ID NO: 282966 - DNA, 75 bp, Artificial Sequence
  Synthetic
attttaattaggaatattgtgtttttgataggttttgatttttttttagaggaggtttttgtttttaaaaggatg

SEQ ID NO: 282967 - DNA, 75 bp, Artificial Sequence
  Synthetic
cccattgatccaattgagtcagaggctgagccgagagggaaccccaccactcccaatatcttgagaaactctgac

SEQ ID NO: 282968 - DNA, 75 bp, Artificial Sequence
  Synthetic
tgataggttttgatttttttttagaggaggtttttgtttttaaaaggatggggttagttttgtataggtttaagt

SEQ ID NO: 282969 - DNA, 75 bp, Artificial Sequence
  Synthetic
taataattgcaggggtattgattgccatgatattgacaatcttcctaatgacatgttgtggaagaggtaatcgac

SEQ ID NO: 282970 - DNA, 75 bp, Artificial Sequence
  Synthetic
aagatcctgccaaattaatgttagaatggttgaagacaggaaataggcctctccggatgactgtgacggacaatt

SEQ ID NO: 282971 - DNA, 75 bp, Artificial Sequence
  Synthetic
ttttatatttttgttagtatagatattatgtttgatttgatttaagatgggaagaattatgattttatgttttag

SEQ ID NO: 282972 - DNA, 75 bp, Artificial Sequence
  Synthetic
ttatgtttgatttgatttaagatgggaagaattatgattttatgttttagttattgatgttttatgtatagatat

SEQ ID NO: 282973 - DNA, 75 bp, Artificial Sequence
  Synthetic
ctatgtggagttcttggacttagacttatggatggaacgtgggtcgcgatgcagacatcggatgagaccaaatgg

SEQ ID NO: 282974 - DNA, 75 bp, Artificial Sequence
  Synthetic
ggatctctcaaagtgggtggatctgcagcacaatctatgatctctctttggttgtatggtgctcactctgaatca

SEQ ID NO: 282975 - DNA, 75 bp, Artificial Sequence
  Synthetic
cctcgtgggagtcatataaaagcgggggtgagaccagactgtgaaggccggtcatcccttccaaacttcaagtcc

SEQ ID NO: 282976 - DNA, 75 bp, Artificial Sequence
  Synthetic
catgatattgacaatcttcctaatgacatgttgtggaagaggtaatcgacccaagtccacacaacacagtcttgg

SEQ ID NO: 282977 - DNA, 75 bp, Artificial Sequence
  Synthetic
tattggtatttttaatgtaataggtgtgtgagatttattgatgatgtgattttggagattttttagatttttgag

SEQ ID NO: 282978 - DNA, 75 bp, Artificial Sequence
  Synthetic
gtgtgagatttattgatgatgtgattttggagattttttagatttttgagtttttggatgtgttgaaaagaatat

SEQ ID NO: 282979 - DNA, 75 bp, Artificial Sequence
  Synthetic
gggtgagaccagactgtgaaggccggtcatcccttccaaacttcaagtcccgaagatcgcctcccctcggggcta

SEQ ID NO: 282980 - DNA, 75 bp, Artificial Sequence
  Synthetic
gcccgagaccaccccttgactccttatatcaaaacccaaacatggccacccaaacatattgtagacttggtgggg

SEQ ID NO: 282981 - DNA, 75 bp, Artificial Sequence
  Synthetic
aggcttaagagtcatgagactttcattaatcatctccgttaatcagacaaggtcgtgtagattcttcaaatacaa

SEQ ID NO: 282982 - DNA, 75 bp, Artificial Sequence
  Synthetic
ctgtcttgagagggtcgattacgacaaagcgtttgggaggtatttggctaacatatactcctcttatttgttctt

SEQ ID NO: 282983 - DNA, 75 bp, Artificial Sequence
  Synthetic
tgtttgagattaggagattttgaatttttaagtggtagagaaaagttttattatattggattagtttaggggttt

SEQ ID NO: 282984 - DNA, 75 bp, Artificial Sequence
  Synthetic
ttttaagtggtagagaaaagttttattatattggattagtttaggggtttttatatttaattttagtggtaattt

SEQ ID NO: 282985 - DNA, 75 bp, Artificial Sequence
  Synthetic
catccgcatgtgaacggggtgtttttcaatggtataatattggggcctgacggccatgttctaatcccagagatg

SEQ ID NO: 282986 - DNA, 75 bp, Artificial Sequence
  Synthetic
aaagcgtttgggaggtatttggctaacatatactcctcttatttgttctttcatgtgatcaccctctatatgaac

SEQ ID NO: 282987 - DNA, 75 bp, Artificial Sequence
  Synthetic
catgggttacctcagatcacttcgcgttcgggcacggacagagatcatggtgagtcccctgacagtagactcaac

SEQ ID NO: 282988 - DNA, 75 bp, Artificial Sequence
  Synthetic
aacctctgtagatatcgggaaggacttggtcaagttcaaagatcagatatggggactgttagttgtgaccaaaga

SEQ ID NO: 282989 - DNA, 75 bp, Artificial Sequence
  Synthetic
aaggttttttttagagattatttgagagggtttgtaaggggagtattgataggatttttgatttgttttttgatg

SEQ ID NO: 282990 - DNA, 75 bp, Artificial Sequence
  Synthetic
gagggtttgtaaggggagtattgataggatttttgatttgttttttgatgagaatgataaatattaatattaata

SEQ ID NO: 282991 - DNA, 75 bp, Artificial Sequence
  Synthetic
ttggtcaagttcaaagatcagatatggggactgttagttgtgaccaaagattttgtgtactcccagagttctaac

SEQ ID NO: 282992 - DNA, 75 bp, Artificial Sequence
  Synthetic
aagctgggggaagtatgtgctgatgagtgtaggcactctgattgcactgatgttgatgattctcttgacgacgtg

SEQ ID NO: 282993 - DNA, 75 bp, Artificial Sequence
  Synthetic
taaagtgtgcataattataaagggctgggtcatctaagcttttccgtcgagaaaaaaactgtaggccggaagaac

SEQ ID NO: 282994 - DNA, 75 bp, Artificial Sequence
  Synthetic
tcggttcaactctctgatgattctcctctctcctccagagcccagatattcagatgacctgatatctcaactgtg

SEQ ID NO: 282995 - DNA, 75 bp, Artificial Sequence
  Synthetic
gataattatttttttttgtatataatgtttagagaattgttttttagagaagagatattttttattttttagaaa

SEQ ID NO: 282996 - DNA, 75 bp, Artificial Sequence
  Synthetic
tgtttagagaattgttttttagagaagagatattttttattttttagaaaatttttgttgtttatttaattatta

SEQ ID NO: 282997 - DNA, 75 bp, Artificial Sequence
  Synthetic
ccagctatacattgccggagatcaggtcctgtccatgtgcggaaattctggctatgaagtcattaaaatattgga

SEQ ID NO: 282998 - DNA, 75 bp, Artificial Sequence
  Synthetic
gttgtagaagagtcaatcgaccagaatctacgcaacgctgtcttggagggacagggagaaaggtgtcagttactt

SEQ ID NO: 282999 - DNA, 75 bp, Artificial Sequence
  Synthetic
tccaattgagtcagaggctgagtctagaggggcccccactgtccctaacatcttgaggaattctgattacaatct

SEQ ID NO: 283000 - DNA, 75 bp, Artificial Sequence
  Synthetic
atgtagattctcataatacaagagatcttctagcagttccagtgaccaacggtgcttccaccctccaagaactga

SEQ ID NO: 283001 - DNA, 75 bp, Artificial Sequence
  Synthetic
tatgagtgagaggtaattatggtgtttttagagaatgattggttatggatttttttagattttagaagtgttaaa

SEQ ID NO: 283002 - DNA, 75 bp, Artificial Sequence
  Synthetic
ttttagagaatgattggttatggatttttttagattttagaagtgttaaaatgatgtatttaatttttattattt

SEQ ID NO: 283003 - DNA, 75 bp, Artificial Sequence
  Synthetic
tgggatgggttgctttggccaattcaaagaaattccaattgttagtcgagcctgataaactgaataaaatcatgc

SEQ ID NO: 283004 - DNA, 75 bp, Artificial Sequence
  Synthetic
aaacggggaacagacctcaccgaatgaccctgacggacaattgctccaggtcttacaaagttctgaaagattatt

SEQ ID NO: 283005 - DNA, 75 bp, Artificial Sequence
  Synthetic
gcgcaaaaaggttcttcaaggctctagatcaatttgacaatatacatgacttagtctttgtatacggttgttata

SEQ ID NO: 283006 - DNA, 75 bp, Artificial Sequence
  Synthetic
tcttctagcagttccagtgaccaacggtgcttccaccctccaagaactgatgccaagggcggtggacaggtcaag

SEQ ID NO: 283007 - DNA, 75 bp, Artificial Sequence
  Synthetic
atgagagataatttgtgataattgagttttttgatgaggtaggtgttgggtgggtatggagaagatattttagag

SEQ ID NO: 283008 - DNA, 75 bp, Artificial Sequence
  Synthetic
caaagtgggtgggactgctgcacaggcaatgatttccctctggttatatggtgcccactctgaatcgagcagaag

SEQ ID NO: 283009 - DNA, 75 bp, Artificial Sequence
  Synthetic
tcatctcagttgatcaaacaaggtcatgtagattctcaaaacacgggaaatcttctagcagtttcagtgatcaac

SEQ ID NO: 283010 - DNA, 75 bp, Artificial Sequence
  Synthetic
gttttttgatgaggtaggtgttgggtgggtatggagaagatattttagagttagatgataatatttaatgattat

SEQ ID NO: 283011 - DNA, 75 bp, Artificial Sequence
  Synthetic
acagagccgtcgaggaaggggcatctaagctagggctgatcatcaagaaagaagagaccatgtgtagttatgact

SEQ ID NO: 283012 - DNA, 75 bp, Artificial Sequence
  Synthetic
gtagttagaattatgattggagattatagttttaataagaaggtgttttgtaaggtaggatgtttagaatgggtt

SEQ ID NO: 283013 - DNA, 75 bp, Artificial Sequence
  Synthetic
aggtgttttggatgactccgtgcttgggcacggacagaggtcatagtacgtcccatgacagcggacccaacatga

SEQ ID NO: 283014 - DNA, 75 bp, Artificial Sequence
  Synthetic
attcaaagtggtatcttgatttgcgacttcttgcggaagaccaccccctgactccttatattaaaacccagacct

SEQ ID NO: 283015 - DNA, 75 bp, Artificial Sequence
  Synthetic
agagggtcgattatgataaggcatttgggagatatctggctaacacatattcctcttatttatttttccatgtga

SEQ ID NO: 283016 - DNA, 75 bp, Artificial Sequence
  Synthetic
atagttttaataagaaggtgttttgtaaggtaggatgtttagaatgggtttgttttgtttaataggttgtagttt

SEQ ID NO: 283017 - DNA, 75 bp, Artificial Sequence
  Synthetic
gagctcccactgtccccaacatcctgaggaactctgactataatctcaactcccctctaatagaagatcctgcca

SEQ ID NO: 283018 - DNA, 75 bp, Artificial Sequence
  Synthetic
tttaagaggttttagaattttttgattttgggtttgagagtggtttagtgggtaattggtgtttattataagttt

SEQ ID NO: 283019 - DNA, 75 bp, Artificial Sequence
  Synthetic
ccgatcacccagatattcgagatccccgaatcaatggacccatctgagatactagatgataaatcacactctttt

SEQ ID NO: 283020 - DNA, 75 bp, Artificial Sequence
  Synthetic
ttttgggtttgagagtggtttagtgggtaattggtgtttattataagtttaagtttattttagatgattttaatg

SEQ ID NO: 283021 - DNA, 75 bp, Artificial Sequence
  Synthetic
tggatatcgggaaggacttggtcaagttcaaagatcaaatatggggactactaattgtgacaaaagactttgttt

SEQ ID NO: 283022 - DNA, 75 bp, Artificial Sequence
  Synthetic
ccgaatcaatggacccatctgagatactagatgataaatcacactcttttactagaacaaaactggcgtcatggc

SEQ ID NO: 283023 - DNA, 75 bp, Artificial Sequence
  Synthetic
gctctttctaagcctcctgtcaaccccagagaattcttaaaatctatagaccttggaggattgccagacgaggat

SEQ ID NO: 283024 - DNA, 75 bp, Artificial Sequence
  Synthetic
agggtagtttttaatatgtttttagatgttaagtttgtgtttaatagttttttagaggtgaatgatttgatggtt

SEQ ID NO: 283025 - DNA, 75 bp, Artificial Sequence
  Synthetic
atgttaagtttgtgtttaatagttttttagaggtgaatgatttgatggtttttggaatatatttattgttttttt

SEQ ID NO: 283026 - DNA, 75 bp, Artificial Sequence
  Synthetic
tgacagaaactacacactcatgctaaaagacctcttcttgtctcgtttcaattccctgatgattttactttctcc

SEQ ID NO: 283027 - DNA, 75 bp, Artificial Sequence
  Synthetic
tctattccaagtcttcacccatagagaagttgttaaattgcacacttgggaatagaggactaagaattcccccag

SEQ ID NO: 283028 - DNA, 75 bp, Artificial Sequence
  Synthetic
gaagttgttaaattgcacacttgggaatagaggactaagaattcccccagaaggggtgttgagttgccttgaaag

SEQ ID NO: 283029 - DNA, 75 bp, Artificial Sequence
  Synthetic
gatttaatttgggaaaaattgtttgatttgagaaatttggttatttggaaatatttttagttagtttaaaagtag

SEQ ID NO: 283030 - DNA, 75 bp, Artificial Sequence
  Synthetic
acatagctggggatcaagtcctttccatgtgtggaaactctggttatgacgttatcaagatactggagccctatg

SEQ ID NO: 283031 - DNA, 75 bp, Artificial Sequence
  Synthetic
gccactcttcgatgcattgactatgacagataacttgaacaaagtgttcaaaaagctgatcgacagagtcaccgg

SEQ ID NO: 283032 - DNA, 75 bp, Artificial Sequence
  Synthetic
tcgtgaacagcctcgtccagagggcggaaaagtttaggcccctcattcactccctgggagacttccctgtattta

SEQ ID NO: 283033 - DNA, 75 bp, Artificial Sequence
  Synthetic
tgttttcaaaaggacagggtcagccttgcataggttcaagtctgccagatacagcgaaggagggtattcttctgt

SEQ ID NO: 283034 - DNA, 75 bp, Artificial Sequence
  Synthetic
aggtatcttgccaatacatattcttcttatctgttttttcatgtgatcaccctgtacatgaatgccctagattgg

SEQ ID NO: 283035 - DNA, 75 bp, Artificial Sequence
  Synthetic
ttaatgtttgattttgtattgtttatagatggattattttatttggtttttaaaatttatgggattatgttagta

SEQ ID NO: 283036 - DNA, 75 bp, Artificial Sequence
  Synthetic
atttgagaaatttggttatttggaaatatttttagttagtttaaaagtaggttaatatgttttatgattttatta

SEQ ID NO: 283037 - DNA, 75 bp, Artificial Sequence
  Synthetic
atgacgaggtggacaaggtggaaaattcagagtttcgagaggcaatcctgttgtccaagacccatagagataatt

SEQ ID NO: 283038 - DNA, 75 bp, Artificial Sequence
  Synthetic
tagatggattattttatttggtttttaaaatttatgggattatgttagtaaatttaaattataaggttatttaat

SEQ ID NO: 283039 - DNA, 75 bp, Artificial Sequence
  Synthetic
gctggaatcgacagaggatgtattttctgtacttgatcgagtgttcggattgaggagggtgttctccagaactca

SEQ ID NO: 283040 - DNA, 75 bp, Artificial Sequence
  Synthetic
agtcaataataaggtggtctctctgaagcctgaaattatcgtggaccaatatgagtacaagtacccggctatcaa

SEQ ID NO: 283041 - DNA, 75 bp, Artificial Sequence
  Synthetic
ttgttttttttatttgagttttatttttgattttttaaatgagggaagttttttagagatgttgagtatttgatt

SEQ ID NO: 283042 - DNA, 75 bp, Artificial Sequence
  Synthetic
tttgattttttaaatgagggaagttttttagagatgttgagtatttgattttttttattttttgagaaatgagtt

SEQ ID NO: 283043 - DNA, 75 bp, Artificial Sequence
  Synthetic
cctatacatgaatgctctggactgggacgaagagaaaaccatcctggcattatggaaagatttaacctcagtgga

SEQ ID NO: 283044 - DNA, 75 bp, Artificial Sequence
  Synthetic
gaccaccaaagaatctctcgttatcatatcccctagtgtggcagatttggacccatacgacaaatcccttcactc

SEQ ID NO: 283045 - DNA, 75 bp, Artificial Sequence
  Synthetic
tggtatcttgattcacgacttctcgcccgcgaccaccctttgactccctacatcaaaacccagacatggccaccc

SEQ ID NO: 283046 - DNA, 75 bp, Artificial Sequence
  Synthetic
tttttgaattattaggattttgtgagaggattttttgaagaaattatattaaatttttataatgagatgattata

SEQ ID NO: 283047 - DNA, 75 bp, Artificial Sequence
  Synthetic
ctggagtctggttagtctattaatgatagatcgtgagtctcaaaccaggaacacaagaactaagatactagctca

SEQ ID NO: 283048 - DNA, 75 bp, Artificial Sequence
  Synthetic
agaaactatacactcatgctgaaagatcttttcttgtctcgcttcaactccttaatgatattgctttctcccccc

SEQ ID NO: 283049 - DNA, 75 bp, Artificial Sequence
  Synthetic
ccaggtgattttgaatctctaagtggtagagaaaagtctcgccatataggatcagctcagggactcttatactca

SEQ ID NO: 283050 - DNA, 75 bp, Artificial Sequence
  Synthetic
atacttggcataggcttccaataacgcaaatttttgaaatccctgagtcaatggatccgtcagaaatactggatg

SEQ ID NO: 283051 - DNA, 75 bp, Artificial Sequence
  Synthetic
gaggattttttgaagaaattatattaaatttttataatgagatgattataattttgattgatagtgatgtagaat

SEQ ID NO: 283052 - DNA, 75 bp, Artificial Sequence
  Synthetic
ttgtttaaagtggttattattatagttattatgatagttttttttaatagagtttttaatgtttttaaattttta

SEQ ID NO: 283053 - DNA, 75 bp, Artificial Sequence
  Synthetic
ttattatgatagttttttttaatagagtttttaatgtttttaaatttttaattgattttttgttttatttattgt

SEQ ID NO: 283054 - DNA, 75 bp, Artificial Sequence
  Synthetic
tcagagttctaactgtctttttgacagaaactatacactcatgctgaaagatcttttcttgtctcgcttcaactc

SEQ ID NO: 283055 - DNA, 75 bp, Artificial Sequence
  Synthetic
aaagaaggaagagaccatgtgcagctatgactttctcatctatgggaaaactcctttatttcgaggtaacatcct

SEQ ID NO: 283056 - DNA, 75 bp, Artificial Sequence
  Synthetic
taagccgcccgtcaatcccagagaattcttaaaatctattgacctcggaggattgcctaatgaggacttgataat

SEQ ID NO: 283057 - DNA, 75 bp, Artificial Sequence
  Synthetic
tcatttttttcacgaggccccctaaagggatacttgggctcgtccacctctatgtcgacccagctattccatgca

SEQ ID NO: 283058 - DNA, 75 bp, Artificial Sequence
  Synthetic
tatttatttattgttttaggtgatgtttttagttttgtaagattttatgatttgtataatagatttataatttat

SEQ ID NO: 283059 - DNA, 75 bp, Artificial Sequence
  Synthetic
agattgtcaatcttgccaatataatgtcaacggtctccacaaatgcattgactgtagctcaacactctcagtcct

SEQ ID NO: 283060 - DNA, 75 bp, Artificial Sequence
  Synthetic
tttttagttttgtaagattttatgatttgtataatagatttataatttattattttagaaagtaagttattttag

SEQ ID NO: 283061 - DNA, 75 bp, Artificial Sequence
  Synthetic
acattgactcacgatttcttcctaaagatcatcccttgactccgtacatcaagactcagacatggccacccaaac

SEQ ID NO: 283062 - DNA, 75 bp, Artificial Sequence
  Synthetic
agggtagtttgtaattttagtttgagtttgttattttattggattaggttgatttataagatagtgaagattatt

SEQ ID NO: 283063 - DNA, 75 bp, Artificial Sequence
  Synthetic
cattacttgttgtttagtcccattttaaagggcagagtttacaagatcttgggtgctgaaggggacaatttcctg

SEQ ID NO: 283064 - DNA, 75 bp, Artificial Sequence
  Synthetic
atggcacaagctcccaatcacacagatatttgagatccctgagtcaatggacccatcagaaatactagatgacaa

SEQ ID NO: 283065 - DNA, 75 bp, Artificial Sequence
  Synthetic
ttttggactattcaagggtcacatatgcttttcaccttgactatgagaaatggaacaatcatcaaagattggagt

SEQ ID NO: 283066 - DNA, 75 bp, Artificial Sequence
  Synthetic
cctcgccaggaggatcctcagatggggatttgataagtactccaagtggtatctggattctcgatttcttgcccg

SEQ ID NO: 283067 - DNA, 75 bp, Artificial Sequence
  Synthetic
cagccttgcataggttcaagtctgccagatacagcgaaggagggtattcttctgtctgcccgaacctcctctctc

SEQ ID NO: 283068 - DNA, 75 bp, Artificial Sequence
  Synthetic
ttagagaatattagatttagattatttttattagattatagttgtttgtgtattggatatttttggaagtttgtt

SEQ ID NO: 283069 - DNA, 75 bp, Artificial Sequence
  Synthetic
gtttgttattttattggattaggttgatttataagatagtgaagattattagatttgttggtagtattaaggatt

SEQ ID NO: 283070 - DNA, 75 bp, Artificial Sequence
  Synthetic
tgcttttcaccttgactatgagaaatggaacaatcatcaaagattggagtcgacagaagatgtgttttccgtcct

SEQ ID NO: 283071 - DNA, 75 bp, Artificial Sequence
  Synthetic
atcagagctggtacagagagacacaaggctaagagactctacgtttcattggcacctccgatgcaacaggtgtgt

SEQ ID NO: 283072 - DNA, 75 bp, Artificial Sequence
  Synthetic
ttttgaaaaaaataagattttaaatttgaatttttagttgtttgattgttttttttatttttgttgtttatttgt

SEQ ID NO: 283073 - DNA, 75 bp, Artificial Sequence
  Synthetic
ttcaaaagtcctggatctactattcagacagatcagaccttatcgggttatgggaagatcagatatattgcttag

SEQ ID NO: 283074 - DNA, 75 bp, Artificial Sequence
  Synthetic
cagggaaccccgacttgggagagagaacattggaaagctttactcgcctgctcgaggatcccaccactctgaaca

SEQ ID NO: 283075 - DNA, 75 bp, Artificial Sequence
  Synthetic
cccatctacagttttcaaggacggtgatgaggctgaggactttgttgaagttcaccttcccgatgtgcacaaaca

SEQ ID NO: 283076 - DNA, 75 bp, Artificial Sequence
  Synthetic
ggtttagatttaagattttgttttttttaaaatatattatataagagttttagtatgggtaggtttttaggagta

SEQ ID NO: 283077 - DNA, 75 bp, Artificial Sequence
  Synthetic
atgtttaataaataaataataaaaatgagaaaaataattaaataattagaggtttagatttaagattttgttttt

SEQ ID NO: 283078 - DNA, 75 bp, Artificial Sequence
  Synthetic
tttaaaatatattatataagagttttagtatgggtaggtttttaggagtatttgatgtataggtaattgtagttt

SEQ ID NO: 283079 - DNA, 75 bp, Artificial Sequence
  Synthetic
agacagatcagaccttatcgggttatgggaagatcagatatattgcttagatatgtccaatggcccgacctgctg

SEQ ID NO: 283080 - DNA, 75 bp, Artificial Sequence
  Synthetic
gccagatgaggacttgataattggcctcaagccaaaggaacgagaattgaagattgaaggtcgattctttgctct

SEQ ID NO: 283081 - DNA, 75 bp, Artificial Sequence
  Synthetic
tttatgaaggtgtttttttatttttttggatagatttttgatgttgttaatgagtttggtagtttttattatttt

SEQ ID NO: 283082 - DNA, 75 bp, Artificial Sequence
  Synthetic
gttgtcgccaggactatctcaagaagggctcctctatgagttggagagtatatcaaggaatgcgctttcaatata

SEQ ID NO: 283083 - DNA, 75 bp, Artificial Sequence
  Synthetic
ctgtggagcctttgtttcctcgatttctcagtgagcttttcagttcgtctttcctggggattcctgagtcgatca

SEQ ID NO: 283084 - DNA, 75 bp, Artificial Sequence
  Synthetic
cagggccatcgaggaaggagcatctaagctggggctgatcatcaagaaagaagagaccatgtgtagttacgactt

SEQ ID NO: 283085 - DNA, 75 bp, Artificial Sequence
  Synthetic
ttggatagatttttgatgttgttaatgagtttggtagtttttattattttgtaaattaatttgatttagtgagat

SEQ ID NO: 283086 - DNA, 75 bp, Artificial Sequence
  Synthetic
gaagtcctggatctattattcagatagatcagacctcatcggtctatgggaggaccaaatatactgcttagacat

SEQ ID NO: 283087 - DNA, 75 bp, Artificial Sequence
  Synthetic
gttggattaattttaagatagataaatgttttttagaatgatttgttttttgaagtaataagttataggtttgtt

SEQ ID NO: 283088 - DNA, 75 bp, Artificial Sequence
  Synthetic
atgttttttagaatgatttgttttttgaagtaataagttataggtttgttatataggttgtgaagttttgtgaag

SEQ ID NO: 283089 - DNA, 75 bp, Artificial Sequence
  Synthetic
acaacactctcaatctctgatcaaaccgatgagggactttctgctcatgtcagtacaggcagtctttcactacct

SEQ ID NO: 283090 - DNA, 75 bp, Artificial Sequence
  Synthetic
tatgttgaagtgttttaggattttgggattagatggtggatagaataaggggttagttaggggtttggaaatgtt

SEQ ID NO: 283091 - DNA, 75 bp, Artificial Sequence
  Synthetic
atcctcaatttcctgtacttgcggagtgacaggaggtggaaatcctagaatatcagtgtctgtgctcccatcttt

SEQ ID NO: 283092 - DNA, 75 bp, Artificial Sequence
  Synthetic
ggattagatggtggatagaataaggggttagttaggggtttggaaatgttgaagattttgttggagaaaattatt

SEQ ID NO: 283093 - DNA, 75 bp, Artificial Sequence
  Synthetic
cagtacaggcagtctttcactacctgttgtttagcccaattttgaagggcagagtttataagattctaagtgctg

SEQ ID NO: 283094 - DNA, 75 bp, Artificial Sequence
  Synthetic
gcaggcatggacagaggttatagtgtgtctcctgatagcggactttacatgagtgagttgagaagtgcaatttgc

SEQ ID NO: 283095 - DNA, 75 bp, Artificial Sequence
  Synthetic
cgtacctatccctcattacttaccagtctcatcttctactccagagggttgagagaaacctatctaagagtatga

SEQ ID NO: 283096 - DNA, 75 bp, Artificial Sequence
  Synthetic
aagattatttattattttgtggattagaaaagattttatattattgttaattagagttatgattattttattgta

SEQ ID NO: 283097 - DNA, 75 bp, Artificial Sequence
  Synthetic
agaaaagattttatattattgttaattagagttatgattattttattgtaaggatttgatatgatttttttagga

SEQ ID NO: 283098 - DNA, 75 bp, Artificial Sequence
  Synthetic
ctcttggaaggttccatatacgtcaattttcagaccctgtctctgaagggctgtctttctggagggagatctggt

SEQ ID NO: 283099 - DNA, 75 bp, Artificial Sequence
  Synthetic
gaggaccccgcactcttgttccagtcttacctggacaatgttggaattcaaatggtcagacaaatgaggtcagga

SEQ ID NO: 283100 - DNA, 75 bp, Artificial Sequence
  Synthetic
atttttggggttgttataattgaataatataaggtttattttttgaagggtggaagaggttaagtatttagtatt

SEQ ID NO: 283101 - DNA, 75 bp, Artificial Sequence
  Synthetic
ggtcatctaagcttttcagtcgagaaaaaaactggagatcgagagagcaaccagcaacacttctcatcctgagac

SEQ ID NO: 283102 - DNA, 75 bp, Artificial Sequence
  Synthetic
acagggtctgccttgcacagattcaagtcagccaggtacagtgaaggggggtactcttccatctgtccaaatctc

SEQ ID NO: 283103 - DNA, 75 bp, Artificial Sequence
  Synthetic
aatataaggtttattttttgaagggtggaagaggttaagtatttagtatttttgaaaaattttttttgtttggag

SEQ ID NO: 283104 - DNA, 75 bp, Artificial Sequence
  Synthetic
caattgagtcagaggccgaacctagaggagcccccactgtccccaacatcctgaggaactctgactataatctca

SEQ ID NO: 283105 - DNA, 75 bp, Artificial Sequence
  Synthetic
ttttgtgattgaggggaatgtttttgataggtgttgaatagttttgtagtttggatttattagtatagttttata

SEQ ID NO: 283106 - DNA, 75 bp, Artificial Sequence
  Synthetic
tgtccaagacccatagagataactttatactcttcttaaaatctgttgagcctttgtttcctcgatttcttagtg

SEQ ID NO: 283107 - DNA, 75 bp, Artificial Sequence
  Synthetic
gataggtgttgaatagttttgtagtttggatttattagtatagttttataagttttgaagattaaatagagtggt

SEQ ID NO: 283108 - DNA, 75 bp, Artificial Sequence
  Synthetic
acaggaaacagaccttatcgaatgactctgacagacaattgttccaggtcttacaaagttttgaaagattatttc

SEQ ID NO: 283109 - DNA, 75 bp, Artificial Sequence
  Synthetic
agaataatctatttagacccatccttggggggagtgtctgggatgtccctggggagattccatatacgtcagttc

SEQ ID NO: 283110 - DNA, 75 bp, Artificial Sequence
  Synthetic
tttcattggcatctccgatgcggaaagtgtataaggcccattgatgatatcacccttgagacgtctcagatattc

SEQ ID NO: 283111 - DNA, 75 bp, Artificial Sequence
  Synthetic
agatgtaatgttagtaatttttgtattgtaaataatgaggttataggatatgttgatttgtttttggattgattg

SEQ ID NO: 283112 - DNA, 75 bp, Artificial Sequence
  Synthetic
cccatctctctgccttgtagttggggacgggtcaggggggatatcaagggcagtcctcaacatgtttccagatgc

SEQ ID NO: 283113 - DNA, 75 bp, Artificial Sequence
  Synthetic
aactttagaagagtccttttacaactcagagatccatgggatcaatcggatgacccagacacctcaacgggtcgg

SEQ ID NO: 283114 - DNA, 75 bp, Artificial Sequence
  Synthetic
ttgtaaataatgaggttataggatatgttgatttgtttttggattgattggaagtatttttaggtagttaagttt

SEQ ID NO: 283115 - DNA, 75 bp, Artificial Sequence
  Synthetic
gcctcattttcgaaaacttcctgatattcgtttaaaaccgggtgacttcgaatctctaagtggcaaggagagatc

SEQ ID NO: 283116 - DNA, 75 bp, Artificial Sequence
  Synthetic
gatgatattattttttttttttatgattgttgaaggaggtagtggatgtgttttggaagttattaggttatttat

SEQ ID NO: 283117 - DNA, 75 bp, Artificial Sequence
  Synthetic
attgttgaaggaggtagtggatgtgttttggaagttattaggttatttatttttaaaagattgttgaatataagt

SEQ ID NO: 283118 - DNA, 75 bp, Artificial Sequence
  Synthetic
gtctccagagtgatagatcttgactcaatctgggaaaaaccgtccgacttgagaaacttggcaacctggaaatac

SEQ ID NO: 283119 - DNA, 75 bp, Artificial Sequence
  Synthetic
ttcatgactctgggtataatgatggaaccatattccctgttaacatatatagcaaggtatcccctagagactatt

SEQ ID NO: 283120 - DNA, 75 bp, Artificial Sequence
  Synthetic
gtttttaattataaggtagagagatgggaaaatattgagattatttagaataggtttaagtttataatgagtatt

SEQ ID NO: 283121 - DNA, 75 bp, Artificial Sequence
  Synthetic
gggaaaatattgagattatttagaataggtttaagtttataatgagtattggttgtttattgaattatttttaag

SEQ ID NO: 283122 - DNA, 75 bp, Artificial Sequence
  Synthetic
tatttccccgatttcttagtgagctcttcagctcatccttcttggggattcctgagtcaatcattggattgatac

SEQ ID NO: 283123 - DNA, 75 bp, Artificial Sequence
  Synthetic
agagacgagaaagaacttcaagaatatgaggcggctgaactaacaaagtccgacgtggcactggcagatgacgga

SEQ ID NO: 283124 - DNA, 75 bp, Artificial Sequence
  Synthetic
ttttgagataggggttgggtttgttgaggtagagattgtaatttgttgagtagagtagatttattttgaatattt

SEQ ID NO: 283125 - DNA, 75 bp, Artificial Sequence
  Synthetic
aggagagatattttctattccccagaaggtccccgctgcttacccgaccacgatgaaggagggcaacagatccat

SEQ ID NO: 283126 - DNA, 75 bp, Artificial Sequence
  Synthetic
gaggtagagattgtaatttgttgagtagagtagatttattttgaatattttattttatgggatatttttttgttg

SEQ ID NO: 283127 - DNA, 75 bp, Artificial Sequence
  Synthetic
ctcttcttaaaatctgttgagcctctgtttcctcgatttctcagtgagctcttcagttcgtctttcttgggaatc

SEQ ID NO: 283128 - DNA, 75 bp, Artificial Sequence
  Synthetic
gtcaagagcgttcccctcggtcacagggtttatcacccaagtaacttcgtctttttcatctgagctctacctccg

SEQ ID NO: 283129 - DNA, 75 bp, Artificial Sequence
  Synthetic
tatttattttgttttttgtaaagagttttttagtagttgttgaatgttgttgtttgattttaaggtatttttttt

SEQ ID NO: 283130 - DNA, 75 bp, Artificial Sequence
  Synthetic
ttttttagtagttgttgaatgttgttgtttgattttaaggtattttttttgtgtttgtttagtatttgttttatt

SEQ ID NO: 283131 - DNA, 75 bp, Artificial Sequence
  Synthetic
gatgctttatgcgcaaacatggacatcagagctggtacaaagagacacaaggctgagagactccacgtttcattg

SEQ ID NO: 283132 - DNA, 75 bp, Artificial Sequence
  Synthetic
tttaattttttggagtagaagatgagattggtaagtaatgagggttaggtatgttattttggtatttttaaagtt

SEQ ID NO: 283133 - DNA, 75 bp, Artificial Sequence
  Synthetic
ggactttcggtcccagtgcaaaaaggttttttagggttctggatcaattcgacaacatacatgacttagtttttg

SEQ ID NO: 283134 - DNA, 75 bp, Artificial Sequence
  Synthetic
gattggtaagtaatgagggttaggtatgttattttggtatttttaaagtttgaaaagatttatagttagttattt

SEQ ID NO: 283135 - DNA, 75 bp, Artificial Sequence
  Synthetic
agacttctcagatcttcgaatttccggatgtgtcgagaagaatatctagaatggtttctggagctgtgcctcact

SEQ ID NO: 283136 - DNA, 75 bp, Artificial Sequence
  Synthetic
ataatataagattgatttgttgtttttttttatagtggttggataagtggtggggattttttgagggatagaaaa

SEQ ID NO: 283137 - DNA, 75 bp, Artificial Sequence
  Synthetic
ttttttatagtggttggataagtggtggggattttttgagggatagaaaatattttttttttaaaagatggtttt

SEQ ID NO: 283138 - DNA, 75 bp, Artificial Sequence
  Synthetic
acgcaaagcagggtgttcagaatgggtatgctctgctcaacaggttgcggtttcaacctcagcgaacccagcccc

SEQ ID NO: 283139 - DNA, 75 bp, Artificial Sequence
  Synthetic
tagcttcgcaagacttcacgacctgtataacagacctataacttattacttcagaaagcaagtcattcgagggaa

SEQ ID NO: 283140 - DNA, 75 bp, Artificial Sequence
  Synthetic
tgagattatttttgagattaatttaagaggtttattaatattgatatttgttatttttgttaagaagtaaattga

SEQ ID NO: 283141 - DNA, 75 bp, Artificial Sequence
  Synthetic
tcaaaacccaaacatggccacccaaacacatagtagacttggtgggggatacctggcacaagctcccgatcacgc

SEQ ID NO: 283142 - DNA, 75 bp, Artificial Sequence
  Synthetic
agaggtttattaatattgatatttgttatttttgttaagaagtaaattgaggattttattaatattttttttgtg

SEQ ID NO: 283143 - DNA, 75 bp, Artificial Sequence
  Synthetic
cttaaacctattctggatgatctcaatgtcttcccatctctatgtcttgtggttggggatggatcaggggggatc

SEQ ID NO: 283144 - DNA, 75 bp, Artificial Sequence
  Synthetic
gtcatctcactggatcaggttgatttacaagatagtgaagactaccagactcgttggcagcatcaaggatctatc

SEQ ID NO: 283145 - DNA, 75 bp, Artificial Sequence
  Synthetic
gaagatggttttattattgtattttgagttgtgaattgttattaagattgagtataagagtttttgagttgattt

SEQ ID NO: 283146 - DNA, 75 bp, Artificial Sequence
  Synthetic
gagttgtgaattgttattaagattgagtataagagtttttgagttgatttgatatggtgagatttttttttattg

SEQ ID NO: 283147 - DNA, 75 bp, Artificial Sequence
  Synthetic
gcgtcaggaacacatccgttgcccccctcagcaatcatgagtgggggagatgacatcatatccagagtgattgac

SEQ ID NO: 283148 - DNA, 75 bp, Artificial Sequence
  Synthetic
aggatatcagatctagatcatccctactagactacagttgcctgtgaaccggatactcctggaagcctgcccatg

SEQ ID NO: 283149 - DNA, 75 bp, Artificial Sequence
  Synthetic
gaagtgaggtatagttttagaaattattttggatattttttttgatatatttggaaatttgaagatttgagaggt

SEQ ID NO: 283150 - DNA, 75 bp, Artificial Sequence
  Synthetic
gaaatacttccagtcagtccaagagcaagtaaatatgtcttatgacctcatcgtttgtgatgcagaggtgactga

SEQ ID NO: 283151 - DNA, 75 bp, Artificial Sequence
  Synthetic
gcgggaggtgatcacggcatctcctgagaatgactggttgtggatcttctcagactttagaagtgccaaaatgac

SEQ ID NO: 283152 - DNA, 75 bp, Artificial Sequence
  Synthetic
gaaaaaaacaagatcctaaatctgaacctttggttgtttgattgtttttctcatttttgttgtttatttgttaag

SEQ ID NO: 283153 - DNA, 75 bp, Artificial Sequence
  Synthetic
tcgtttgtgatgcagaggtgactgacatcgcgtcaatcaaccgaataaccctgctaatgtctgatttcgcattgt

SEQ ID NO: 283154 - DNA, 75 bp, Artificial Sequence
  Synthetic
attttggatattttttttgatatatttggaaatttgaagatttgagaggtttttagggttatgttgttaatgggt

SEQ ID NO: 283155 - DNA, 75 bp, Artificial Sequence
  Synthetic
ttttgtgtttttttgtattagttttgatgtttatgtttgtgtataaagtattaatggttggaatatgaaattgta

SEQ ID NO: 283156 - DNA, 75 bp, Artificial Sequence
  Synthetic
gtaaatcctgaatacagagcaattcaacatctatccagagcatttcctgcggtcactggattcataactcaggtg

SEQ ID NO: 283157 - DNA, 75 bp, Artificial Sequence
  Synthetic
gatgtttatgtttgtgtataaagtattaatggttggaatatgaaattgtagttttttttgttttgggttaaatta

SEQ ID NO: 283158 - DNA, 75 bp, Artificial Sequence
  Synthetic
ttgatgaggcaggtactgggggggcatggggaagatactttagagtcagacgatgatgttcaacgactattaaaa

SEQ ID NO: 283159 - DNA, 75 bp, Artificial Sequence
  Synthetic
gtacaagtaccctgctatcaaagatttgaaaaagccctgtataaccctagggaaagcccccgacttaaacaaagc

SEQ ID NO: 283160 - DNA, 75 bp, Artificial Sequence
  Synthetic
cagactttagaagtgccaaaatgacatacctgaccctcattacttaccagtctcaccttctacttcagagggttg

SEQ ID NO: 283161 - DNA, 75 bp, Artificial Sequence
  Synthetic
agaagaatatttttttttgttgtatttggtagatttgaatttatgtaaggttgattttgtttttttgaaaatagg

SEQ ID NO: 283162 - DNA, 75 bp, Artificial Sequence
  Synthetic
atgtatgttcctacttggcagcggcaatgcagttctttgaggggacgtgtccagaggactggaccagctatggaa

SEQ ID NO: 283163 - DNA, 75 bp, Artificial Sequence
  Synthetic
gactctttgcgaaggacaaggtgggtcgatcaggaagtccgccatgcagccagaaccatgacaggggactatagt

SEQ ID NO: 283164 - DNA, 75 bp, Artificial Sequence
  Synthetic
ttggtagatttgaatttatgtaaggttgattttgtttttttgaaaataggggttttttttagagggaaattaggg

SEQ ID NO: 283165 - DNA, 75 bp, Artificial Sequence
  Synthetic
gccttgtattgttcaactgtagcagccccaagagtgagatgcaaagagcccgctctctgaactaccaagatcttg

SEQ ID NO: 283166 - DNA, 75 bp, Artificial Sequence
  Synthetic
ccccaagagtgagatgcaaagagcccgctctctgaactaccaagatcttgtgagaggatttccagatgaaataat

SEQ ID NO: 283167 - DNA, 75 bp, Artificial Sequence
  Synthetic
ccaacatgttctgcgatatgagcgagaggttattacagcatccccagagaatgattggttgtggatcttctcgga

SEQ ID NO: 283168 - DNA, 75 bp, Artificial Sequence
  Synthetic
tttagtaatgaattagtttatagatttttttaatgatagagttttttttattatatgaatattagtgattttttt

SEQ ID NO: 283169 - DNA, 75 bp, Artificial Sequence
  Synthetic
ttttttaatgatagagttttttttattatatgaatattagtgatttttttttatgtatggaatagttgggttgat

SEQ ID NO: 283170 - DNA, 75 bp, Artificial Sequence
  Synthetic
ggatgatctggagttacagcgaggaactttgtctaaagtctctatcattatagcaattatgatagtcttctccaa

SEQ ID NO: 283171 - DNA, 75 bp, Artificial Sequence
  Synthetic
ctggtgctcattataaacttaagcctattctagatgatctcaacgtcttcccatctctatgtctagtagtcggag

SEQ ID NO: 283172 - DNA, 75 bp, Artificial Sequence
  Synthetic
tgattgattaaaagatgggagtattgatatagaaattttaggattgtttttttttgttgttttataagtgtaaga

SEQ ID NO: 283173 - DNA, 75 bp, Artificial Sequence
  Synthetic
gatatagaaattttaggattgtttttttttgttgttttataagtgtaagaaatagaggatttgggaagtaatttt

SEQ ID NO: 283174 - DNA, 75 bp, Artificial Sequence
  Synthetic
catctgatcctaaaatcctgagacacttcaacatatgctgcagtactatgatgtacttgtccacagctttagggg

SEQ ID NO: 283175 - DNA, 75 bp, Artificial Sequence
  Synthetic
ttctcagatcttcgagttcccggatgtgtcaaagaggatatccagaatggtttccggagccgtgcctcactttca

SEQ ID NO: 283176 - DNA, 75 bp, Artificial Sequence
  Synthetic
gacattcaaaggctattgaaggattctctgcgcagaacgaggtgggtggaccaagaagtgcgccatgcagccaga

SEQ ID NO: 283177 - DNA, 75 bp, Artificial Sequence
  Synthetic
atgtatccagctttgcaagacttcatgaactgtacaacaggcccataacctattatttcaggaagcaagtcatcc

SEQ ID NO: 283178 - DNA, 75 bp, Artificial Sequence
  Synthetic
agagatttttttaagtagatttgttttttttgaagagtaaggttatatttttttaattttttgaggtgtttgggt

SEQ ID NO: 283179 - DNA, 75 bp, Artificial Sequence
  Synthetic
ttttttgaagagtaaggttatatttttttaattttttgaggtgtttgggttatttgattaattttgtggattttt

SEQ ID NO: 283180 - DNA, 75 bp, Artificial Sequence
  Synthetic
cgcaagagaagcaatactatacttcttccacaagaactttgaggaagagataagaagaatgttcgagccagggca

SEQ ID NO: 283181 - DNA, 75 bp, Artificial Sequence
  Synthetic
gacgcagaagttactgacattgcatctatcaatagaataaccttgttgatgtcggatttcgcattgtctatagac

SEQ ID NO: 283182 - DNA, 75 bp, Artificial Sequence
  Synthetic
tttttttattgtttgggagttttgtattagtttaatgattgatttggggatttttaaaaaagatgaattgaatag

SEQ ID NO: 283183 - DNA, 75 bp, Artificial Sequence
  Synthetic
tgagagtggtccagtgggcaactggtgcccattataaactcaagcccattctagacgatcttaatgttttcccat

SEQ ID NO: 283184 - DNA, 75 bp, Artificial Sequence
  Synthetic
ccttcgagggtacaaccggtggattaccctcgatgacattaggtccagatcatctcttctggattatagctgctt

SEQ ID NO: 283185 - DNA, 75 bp, Artificial Sequence
  Synthetic
attagtttaatgattgatttggggatttttaaaaaagatgaattgaatagtttattgagaaattgaggaaataga

SEQ ID NO: 283186 - DNA, 75 bp, Artificial Sequence
  Synthetic
taataggattgttttttgaaattttgagttttttattttgtttattttgttatataaagtttttttgattgtatt

SEQ ID NO: 283187 - DNA, 75 bp, Artificial Sequence
  Synthetic
gagttttttattttgtttattttgttatataaagtttttttgattgtatttttgagtagaatggtaggattggtt

SEQ ID NO: 283188 - DNA, 75 bp, Artificial Sequence
  Synthetic
gtaccctgaaaaaaacgagatcccaattcatgacctctgttttttagactgtttttcccatctttattgtttttt

SEQ ID NO: 283189 - DNA, 75 bp, Artificial Sequence
  Synthetic
atcaggagggatatcaagggcagttctcaacatgtttccagacgccaagcttgtgttcaacagtcttttagaggt

SEQ ID NO: 283190 - DNA, 75 bp, Artificial Sequence
  Synthetic
ttgttcaattgtagcagcccaaagagtgagatgcagagagctcgctccttaaattatcaagatcttgtaaggggg

SEQ ID NO: 283191 - DNA, 75 bp, Artificial Sequence
  Synthetic
tttgagtgttttttttttaagatttgggtttttagttttttgatataatgtgtgaatttaggatttgtgggagtt

SEQ ID NO: 283192 - DNA, 75 bp, Artificial Sequence
  Synthetic
gggtttttagttttttgatataatgtgtgaatttaggatttgtgggagtttaattagatttttttttagaaggat

SEQ ID NO: 283193 - DNA, 75 bp, Artificial Sequence
  Synthetic
ggatattttagatattttttttaaagaaggatttagatagattatttttgatatggttaggagaaagtttttttt

SEQ ID NO: 283194 - DNA, 75 bp, Artificial Sequence
  Synthetic
gaaggatttagatagattatttttgatatggttaggagaaagtttttttttttagtgtttagaattttgtaaatt

SEQ ID NO: 283195 - DNA, 75 bp, Artificial Sequence
  Synthetic
atgaatggaggtcgactaaagaaatcgcatatacggaggtatgtctcagtcagttcaaatcatcaagctcgtcca

SEQ ID NO: 283196 - DNA, 75 bp, Artificial Sequence
  Synthetic
tgatatgagtagaaaattttttattggtttgattaaagattgagagtgttgtgttattgttagtgtgttggtgga

SEQ ID NO: 283197 - DNA, 75 bp, Artificial Sequence
  Synthetic
cgggactatgctagtaaacccagactataaggctattcaacacctgtcaagagcattcccctcagtcacagggtt

SEQ ID NO: 283198 - DNA, 75 bp, Artificial Sequence
  Synthetic
ggtttgattaaagattgagagtgttgtgttattgttagtgtgttggtggatattgttgatattatattggtgagg

SEQ ID NO: 283199 - DNA, 75 bp, Artificial Sequence
  Synthetic
tataacccaagtgacttcgtccttctcatctgagctatacctccgattttccaaacgagggaagttttttagaga

SEQ ID NO: 283200 - DNA, 75 bp, Artificial Sequence
  Synthetic
tttaggtattaatatgttatttttaaataaaggggtttttttatagatgaggaagttataattatatatggtttt

SEQ ID NO: 283201 - DNA, 75 bp, Artificial Sequence
  Synthetic
aataaaggggtttttttatagatgaggaagttataattatatatggtttttttttttttgatgattagttttagt

SEQ ID NO: 283202 - DNA, 75 bp, Artificial Sequence
  Synthetic
tcatctcattggatcagattgatttacaaaatagtaaaaaccactagactgattggaagtattgaagacctatca

SEQ ID NO: 283203 - DNA, 75 bp, Artificial Sequence
  Synthetic
acaaaatagtaaaaaccactagactgattggaagtattgaagacctatcaggagagattgaaaaacaccttcagg

SEQ ID NO: 283204 - DNA, 75 bp, Artificial Sequence
  Synthetic
tatgttttttaatttatagaggagttttttttgagatagttttggtgataatatatatgttggatataaaatttg

SEQ ID NO: 283205 - DNA, 75 bp, Artificial Sequence
  Synthetic
tttttttgagatagttttggtgataatatatatgttggatataaaatttggttgtttttttgagttagtattttg

SEQ ID NO: 283206 - DNA, 75 bp, Artificial Sequence
  Synthetic
cctggacaatgttggagtccaaatagtcagacaaatgaggtcaggagagagattcctcaagatatggtcacagac

SEQ ID NO: 283207 - DNA, 75 bp, Artificial Sequence
  Synthetic
gtcagacaaatgaggtcaggagagagattcctcaagatatggtcacagaccgtagaagagattatatcctatgtc

SEQ ID NO: 283208 - DNA, 75 bp, Artificial Sequence
  Synthetic
ctagattacagctgcttgtgaattggacactctcagaggcttgtacaagctaagacttttgtattatgtaccttg

SEQ ID NO: 283209 - DNA, 75 bp, Artificial Sequence
  Synthetic
taagacttttgtattatgtaccttgaaaaaaacaagatcttgactccgagcctctgattgtttgattgttttttc

SEQ ID NO: 283210 - DNA, 75 bp, Artificial Sequence
  Synthetic
tagattttagtttttttgttgtaagttttttagtttgttattttggttattttaataggttgggttgttggatgt

SEQ ID NO: 283211 - DNA, 75 bp, Artificial Sequence
  Synthetic
gaaggtcctcagaggacaagtcaacccaaactcctggtcgagaccccaagaaggagacaacatccactccttctc

SEQ ID NO: 283212 - DNA, 75 bp, Artificial Sequence
  Synthetic
ttttttagtttgttattttggttattttaataggttgggttgttggatgtatttaagtagtatatttgatttttt

SEQ ID NO: 283213 - DNA, 75 bp, Artificial Sequence
  Synthetic
atataagtacccagctatcaaagatctgaagaaacccagtatctccctagggaaggctcccgacttaaacaaagc

SEQ ID NO: 283214 - DNA, 75 bp, Artificial Sequence
  Synthetic
aaccatgatgattgatccaggggaggtttatgatgaccccattgatccgattgagtcagaggctgagccgagagg

SEQ ID NO: 283215 - DNA, 75 bp, Artificial Sequence
  Synthetic
aaaaaatttgtgtgttttagaaaatattttttttaatttaaatatttgatttaggatagaaaatatattttttgt

SEQ ID NO: 283216 - DNA, 75 bp, Artificial Sequence
  Synthetic
attttttttaatttaaatatttgatttaggatagaaaatatattttttgttgattttaatttttgatggttgttt

SEQ ID NO: 283217 - DNA, 75 bp, Artificial Sequence
  Synthetic
acaagtttccctctcggtcctcagggatattcttatataattttgagcagttgaagatgaacctcgatgatatag

SEQ ID NO: 283218 - DNA, 75 bp, Artificial Sequence
  Synthetic
aagtttttgtttggtgattttgttgattagttttttaaatattttgtttaggttgtttgttatagttagtgtgtt

SEQ ID NO: 283219 - DNA, 75 bp, Artificial Sequence
  Synthetic
attagttttttaaatattttgtttaggttgtttgttatagttagtgtgttaaaaagtggtaagatgtagttggtt

SEQ ID NO: 283220 - DNA, 75 bp, Artificial Sequence
  Synthetic
agagctggtacagagagacataaggctgagagattctacgtttcattggcaccttcggtgcaacaggtgtgtaag

SEQ ID NO: 283221 - DNA, 75 bp, Artificial Sequence
  Synthetic
cggaaatagagggctgagaatccccccagaaggggtcctaagttgtcttgaaagggtcgattacgataaaacatt

SEQ ID NO: 283222 - DNA, 75 bp, Artificial Sequence
  Synthetic
agtaaagaattgatttttaatttttaatttttgtttttttggtttgaggttaattattaagtttttatttggtaa

SEQ ID NO: 283223 - DNA, 75 bp, Artificial Sequence
  Synthetic
atgtatcaaaaaggatatccagaatggtttctggggcagtgcctcattttcagaagcttcccgacatccgtctca

SEQ ID NO: 283224 - DNA, 75 bp, Artificial Sequence
  Synthetic
aaaaacaagatcttgaatccgatcctctggttgtttgattgtttttttcatctttattgtttttttgttaagcgt

SEQ ID NO: 283225 - DNA, 75 bp, Artificial Sequence
  Synthetic
aatttttgtttttttggtttgaggttaattattaagtttttatttggtaattttttgaggtttatagattttaga

SEQ ID NO: 283226 - DNA, 75 bp, Artificial Sequence
  Synthetic
agttgacgagggaccccactgtgtctgagcatgcgtctttagttggtcttctcttgagtctttataggttgagca

SEQ ID NO: 283227 - DNA, 75 bp, Artificial Sequence
  Synthetic
tttgttaggaataggttttttttggttttttgatagttaagaagttagttttgttttggtgaaagaatgtgattt

SEQ ID NO: 283228 - DNA, 75 bp, Artificial Sequence
  Synthetic
ttttttgatagttaagaagttagttttgttttggtgaaagaatgtgatttgttatttaatatttttgatggattt

SEQ ID NO: 283229 - DNA, 75 bp, Artificial Sequence
  Synthetic
aaatatcgggacaaaacaccggcaactacaagacaaacattgcggacaggatagagcagattttcgagactgccc

SEQ ID NO: 283230 - DNA, 75 bp, Artificial Sequence
  Synthetic
tgtattcaatagcttgttagaagtaaatgacctaatggcgtcaggaacacatccgttgcccccctcagcaatcat

SEQ ID NO: 283231 - DNA, 75 bp, Artificial Sequence
  Synthetic
attttttattaaatttataatatgtttgggtggttatgtttgggttttgatataaggagttaaggggtggttttg

SEQ ID NO: 283232 - DNA, 75 bp, Artificial Sequence
  Synthetic
ttgggtggttatgtttgggttttgatataaggagttaaggggtggttttgggttaggaattgtgaatttagatat

SEQ ID NO: 283233 - DNA, 75 bp, Artificial Sequence
  Synthetic
ttccacaagaactttgaagaagaaataagaagaatgtttgagcctggacaagagactgctgttcctcattcttat

SEQ ID NO: 283234 - DNA, 75 bp, Artificial Sequence
  Synthetic
gtttgttaagtatttttggtaggatttatttattatttttttaatgtgaatttgattatatagttttgatagatt

SEQ ID NO: 283235 - DNA, 75 bp, Artificial Sequence
  Synthetic
ttatttattatttttttaatgtgaatttgattatatagttttgatagatttttttgataatttatatatgggtgt

SEQ ID NO: 283236 - DNA, 75 bp, Artificial Sequence
  Synthetic
gaattgatttagagttttaaagaatttttttgtataggaattgaatgtttttttgagttgatttattttgttttt

SEQ ID NO: 283237 - DNA, 75 bp, Artificial Sequence
  Synthetic
ttttttgtataggaattgaatgtttttttgagttgatttattttgttttttataaatataggaaagttttttaag

SEQ ID NO: 283238 - DNA, 75 bp, Artificial Sequence
  Synthetic
gatatatggttttaatattttgatgattttatagttggagtttttatatatagataagatttgatttttagtaat

SEQ ID NO: 283239 - DNA, 75 bp, Artificial Sequence
  Synthetic
attttatagttggagtttttatatatagataagatttgatttttagtaatgtatagttggtatagttgagatatt

SEQ ID NO: 283240 - DNA, 75 bp, Artificial Sequence
  Synthetic
acttctccagtgaaaccaggagtccagaggcagtttacactcgaatcatgatgaatggaggtagactaaaaagat

SEQ ID NO: 283241 - DNA, 75 bp, Artificial Sequence
  Synthetic
cacacataaggaggtatgtctcagtcagctctaatcatcaaactcgccctaactcgtttgctgaatttttaaaca

SEQ ID NO: 283242 - DNA, 75 bp, Artificial Sequence
  Synthetic
ttttatcaaagtcaagttaattacctttacattttgagcctcttggatgtgaaaaaaactattaacatccctcaa

SEQ ID NO: 283243 - DNA, 75 bp, Artificial Sequence
  Synthetic
acttatggatggaacatgggtcgcgatgcaaacatcaaatgaaaccaaatggtgccctcccgatcagttggtgaa

SEQ ID NO: 283244 - DNA, 75 bp, Artificial Sequence
  Synthetic
gttgaagtgagataagaaaagattttttagtataagtgtgtagtttttgttaaaaagataattggaattttggga

SEQ ID NO: 283245 - DNA, 75 bp, Artificial Sequence
  Synthetic
cctgtacaggtgtggtgacagaagcagaaacctacactaactttgttggttatgtcaccaccacgtttaagagaa

SEQ ID NO: 283246 - DNA, 75 bp, Artificial Sequence
  Synthetic
gtgcagagccgcatacaactggaagatggctggtgaccccaggtatgaagagtctctgcacaatccgtaccctga

SEQ ID NO: 283247 - DNA, 75 bp, Artificial Sequence
  Synthetic
caacaagaaagtgtctcgcaaggcaggatgttcggaatgggtctgctctgctcaacaggttgcagtctctacctc

SEQ ID NO: 283248 - DNA, 75 bp, Artificial Sequence
  Synthetic
aaaacttaaggaaagatggttcctcaggcgcttttgttggtaccccttctgggtttttcattgtgtttcgggaaa

SEQ ID NO: 283249 - DNA, 75 bp, Artificial Sequence
  Synthetic
tattgaggttaaatttttttataatgttaggatggttttttttttattttagtttagggtgtttatgtataaggt

SEQ ID NO: 283250 - DNA, 75 bp, Artificial Sequence
  Synthetic
tttagtataagtgtgtagtttttgttaaaaagataattggaattttgggagtaaataaagttttttgttatgatt

SEQ ID NO: 283251 - DNA, 75 bp, Artificial Sequence
  Synthetic
gttaggatggttttttttttattttagtttagggtgtttatgtataaggtgattatatggaagaataagtaagag

SEQ ID NO: 283252 - DNA, 75 bp, Artificial Sequence
  Synthetic
aacacggatgaattgtatgcacccttcatgaaaaaaaccaacacccctcctgttgaaccacctcagacatgagca

SEQ ID NO: 283253 - DNA, 75 bp, Artificial Sequence
  Synthetic
tttaaggtaatttaatattttttttggggggatttttagttttttattttttagtgtgagatttaatagtttttt

SEQ ID NO: 283254 - DNA, 75 bp, Artificial Sequence
  Synthetic
cggcttcaactagatgatgacaaaccgtctggccttggcagtatcgccgaaggaggggaaagcaaatgtcaggaa

SEQ ID NO: 283255 - DNA, 75 bp, Artificial Sequence
  Synthetic
ggggggatttttagttttttattttttagtgtgagatttaatagtttttttatgggggatgatttggaatagaaa

SEQ ID NO: 283256 - DNA, 75 bp, Artificial Sequence
  Synthetic
ttatcacttgtttacctctggaggagagaacatacgggcttaactccaacctttgggagcaatagaacaaaaata

SEQ ID NO: 283257 - DNA, 75 bp, Artificial Sequence
  Synthetic
actgtcaattctgatgacgaggactatttctctggtgagaccaggagtcctgaggctgtctatactcgaatcatg

SEQ ID NO: 283258 - DNA, 75 bp, Artificial Sequence
  Synthetic
cctggacaatgttggaattcaaatagtcagacaaatgaagtcaggggggagattcctgaaaatatggtctcagac

SEQ ID NO: 283259 - DNA, 75 bp, Artificial Sequence
  Synthetic
attatataattagagagaaattattgattgtgtagttattttgtttattttgagggaatttaaatttattttttt

SEQ ID NO: 283260 - DNA, 75 bp, Artificial Sequence
  Synthetic
gtcagacaaatgaagtcaggggggagattcctgaaaatatggtctcagaccgtcgaggagatcatatcctatgtc

SEQ ID NO: 283261 - DNA, 75 bp, Artificial Sequence
  Synthetic
accaccaaggagtctctcgttatcatatccccaagtgtggcagatttggacccatatgacaaatcccttcactcg

SEQ ID NO: 283262 - DNA, 75 bp, Artificial Sequence
  Synthetic
gattgtgtagttattttgtttattttgagggaatttaaatttatttttttgaaataattttttaaaattttgaaa

SEQ ID NO: 283263 - DNA, 75 bp, Artificial Sequence
  Synthetic
cccatatgacaaatcccttcactcgagggtcttccctagtggaaagtgctcaggaataacggtgtcttctaccta

SEQ ID NO: 283264 - DNA, 75 bp, Artificial Sequence
  Synthetic
gattcctgaaaatatggtctcagaccgtcgaggagatcatatcctatgtcacagtcaacttctctggtgcgccgg

SEQ ID NO: 283265 - DNA, 75 bp, Artificial Sequence
  Synthetic
ttttaattattttaatattagtttagtaggattttttattaaaggagagttgagattgtagttagagttttttaa

SEQ ID NO: 283266 - DNA, 75 bp, Artificial Sequence
  Synthetic
aaagagacaaagtctgcttcttctcagcgagcaggtcaatcctcaaaagtcaaaatggcagcccaaactgtctcc

SEQ ID NO: 283267 - DNA, 75 bp, Artificial Sequence
  Synthetic
ctgctcaactaaccacgattacaccatttggatgcccgaaaatctgagactgggaacgtcttgtgacatttttac

SEQ ID NO: 283268 - DNA, 75 bp, Artificial Sequence
  Synthetic
tgggaggatcaaatatactgtttggacatgtcaaacggcccgacatgctggaacggccaagatggcgggctagag

SEQ ID NO: 283269 - DNA, 75 bp, Artificial Sequence
  Synthetic
gtaggattttttattaaaggagagttgagattgtagttagagttttttaagatgttggggatagtgggggttttt

SEQ ID NO: 283270 - DNA, 75 bp, Artificial Sequence
  Synthetic
taaagggcagagtttacaagatcttgggtgctgaaggggacaatttcctgctagccatgtctagaataatctatt

SEQ ID NO: 283271 - DNA, 75 bp, Artificial Sequence
  Synthetic
tttaggattgagtattttgaagtaggttttaggatgagaagtgttgttagttgtttttttgatttattgtttttt

SEQ ID NO: 283272 - DNA, 75 bp, Artificial Sequence
  Synthetic
tggttagcttattaatgatagatcgtgaatctcagaccaggaacacaagaactaagatactagcccagggggaca

SEQ ID NO: 283273 - DNA, 75 bp, Artificial Sequence
  Synthetic
acaaatttccttcccgatcatcagggatattcttgtataactttgagcagttgaaaatgaaccttgacgatatag

SEQ ID NO: 283274 - DNA, 75 bp, Artificial Sequence
  Synthetic
gttttaggatgagaagtgttgttagttgtttttttgatttattgttttttttttgattgaaaagtttagatgatt

SEQ ID NO: 283275 - DNA, 75 bp, Artificial Sequence
  Synthetic
agatttctcaagatctggtcacagaccgtagaggaaattatctcctatgtcacagtcaacttctctaccccgtca

SEQ ID NO: 283276 - DNA, 75 bp, Artificial Sequence
  Synthetic
ttattgtttgtgttttttatgggaggaagattgttttttttaattaatttattttgagtttgttattatggaata

SEQ ID NO: 283277 - DNA, 75 bp, Artificial Sequence
  Synthetic
gaagattgttttttttaattaatttattttgagtttgttattatggaatatattatgatttttgtttgtgtttaa

SEQ ID NO: 283278 - DNA, 75 bp, Artificial Sequence
  Synthetic
catgtagattcttataataaaagaaatcttctagcagttccagtgactaacggtgcttttaccctccaagaactg

SEQ ID NO: 283279 - DNA, 75 bp, Artificial Sequence
  Synthetic
tctctaatcacaccctcaggctctgccacactatgcagtcagatctgatctgctccaagtctgccatgaaaaaaa

SEQ ID NO: 283280 - DNA, 75 bp, Artificial Sequence
  Synthetic
agtttttggagaatgaaagtattgttagttattgaaattgttagaagattttttttattatgagaatttatatga

SEQ ID NO: 283281 - DNA, 75 bp, Artificial Sequence
  Synthetic
tagttattgaaattgttagaagattttttttattatgagaatttatatgattttgtttgattaattgagaggatt

SEQ ID NO: 283282 - DNA, 75 bp, Artificial Sequence
  Synthetic
tcaatggtataatattagggcctgacggccatgttctaatcccagagatgcaatcatccctcctccagcaacata

SEQ ID NO: 283283 - DNA, 75 bp, Artificial Sequence
  Synthetic
aggattattgaatttaggtttttttttaaaaagaattttttaaggggaggtgatttttaggatttggattgttga

SEQ ID NO: 283284 - DNA, 75 bp, Artificial Sequence
  Synthetic
ccggaatatgttccattgaaggagctcgcaggcaagaagaacatgagaaatttttgcatcaatggggaagtcaaa

SEQ ID NO: 283285 - DNA, 75 bp, Artificial Sequence
  Synthetic
aaaactgtagaactaaagagcaactagcaacacttctcatcttgagattcccgtcatgatgatcgatccagggga

SEQ ID NO: 283286 - DNA, 75 bp, Artificial Sequence
  Synthetic
tagagttgttggaatcctcggttattcccctgatgcaccccctggcagacccatccacagttttcaaagacggtg

SEQ ID NO: 283287 - DNA, 75 bp, Artificial Sequence
  Synthetic
ttaaaaagaattttttaaggggaggtgatttttaggatttggattgttgaaaggatggttagtttttatagtttg

SEQ ID NO: 283288 - DNA, 75 bp, Artificial Sequence
  Synthetic
ttggggagtgattgatatttttttttttgtttttttgagattgtgttgtgtaggttttgattgattgattttttt

SEQ ID NO: 283289 - DNA, 75 bp, Artificial Sequence
  Synthetic
tattctgaattcgacatgaaaaaaacaggcaacaccactgataaaatgaactttctacgtaaaatagtgaaaaac

SEQ ID NO: 283290 - DNA, 75 bp, Artificial Sequence
  Synthetic
gtgccctcctgatcaactagtgaatctacatgactttcattcagatgagattgaacatcttgttgtggaggagtt

SEQ ID NO: 283291 - DNA, 75 bp, Artificial Sequence
  Synthetic
ctaacagacaactgctctagatcttataaagtcttgaaagattatttcaagaagctagatttgggatctctcaaa

SEQ ID NO: 283292 - DNA, 75 bp, Artificial Sequence
  Synthetic
atcattcgatgagatttattctgggaatcaaagaatgatcgggttggtcaaagttgttgttggattggcgttatc

SEQ ID NO: 283293 - DNA, 75 bp, Artificial Sequence
  Synthetic
aagttgttgttggattggcgttatcaggggctccagttcctgagggaatgaactgggtatacaaattgagaagaa

SEQ ID NO: 283294 - DNA, 75 bp, Artificial Sequence
  Synthetic
gtttgggagatttaagttaatttttgagatttgtttgtgtatattgggaaggtgaattttaataaaatttttagt

SEQ ID NO: 283295 - DNA, 75 bp, Artificial Sequence
  Synthetic
aaaaacaagatcttgaatccgagcctctggctgtttgattgttttttttatctttattgtttttttgttaagcgt

SEQ ID NO: 283296 - DNA, 75 bp, Artificial Sequence
  Synthetic
tttgtttttttgagattgtgttgtgtaggttttgattgattgatttttttttagtatgttattaggaaaattatt

SEQ ID NO: 283297 - DNA, 75 bp, Artificial Sequence
  Synthetic
gagatttgtttgtgtatattgggaaggtgaattttaataaaatttttagttttgttattgtttttgaaaatggta

SEQ ID NO: 283298 - DNA, 75 bp, Artificial Sequence
  Synthetic
tgctcactacaaatcggtccgaacttggaatgagatcatcccctcgaaagggtgtttaagagtcggggggagatg

SEQ ID NO: 283299 - DNA, 75 bp, Artificial Sequence
  Synthetic
caatgccatatccaaggcaggatttggtgtattaacatgaactctcgagcatgtcagctatggtctgacctatcc

SEQ ID NO: 283300 - DNA, 75 bp, Artificial Sequence
  Synthetic
ttttatatgttgttggaggagggatgattgtatttttgggattaagatattgttgttaggttttaatattatatt

SEQ ID NO: 283301 - DNA, 75 bp, Artificial Sequence
  Synthetic
atgtcagctatggtctgacctatccctccaaacacagaggtctgatgaagataaagattcttcagtgcttctgga

SEQ ID NO: 283302 - DNA, 75 bp, Artificial Sequence
  Synthetic
gattgtatttttgggattaagatattgttgttaggttttaatattatattattgaaaaatattttgtttatatga

SEQ ID NO: 283303 - DNA, 75 bp, Artificial Sequence
  Synthetic
atttgtattcagcaattagagtgggaacagtcgtcactgcttatgaggactgctcagggttggtgtcgtttacag

SEQ ID NO: 283304 - DNA, 75 bp, Artificial Sequence
  Synthetic
attttaagttttgattgatttgtagtgagtattggtttttattaaggttttgttgaatatggtatatgttttttt

SEQ ID NO: 283305 - DNA, 75 bp, Artificial Sequence
  Synthetic
tgagtattggtttttattaaggttttgttgaatatggtatatgtttttttaaatttagggataagtttttttaaa

SEQ ID NO: 283306 - DNA, 75 bp, Artificial Sequence
  Synthetic
tactgaaggttgtagacgggccgagaggaattgcagatgactccatgcctgggcgcggacagaggtcatagtgag

SEQ ID NO: 283307 - DNA, 75 bp, Artificial Sequence
  Synthetic
gaaaaaaactattaacatccctcaaaagacgtaaggaaagatgatctttcaggctcttccgtttgtgcctctcct

SEQ ID NO: 283308 - DNA, 75 bp, Artificial Sequence
  Synthetic
tgtatttagatatttttttttttttttgattaatttttttataataaggtgtttaattttgtttgagtgaaagtt

SEQ ID NO: 283309 - DNA, 75 bp, Artificial Sequence
  Synthetic
gatgttgatgattttcctaatgacgtgttgccgaaggactaatagagcagaatcaatacaacacagtcttggaga

SEQ ID NO: 283310 - DNA, 75 bp, Artificial Sequence
  Synthetic
ttccccatctacacgataccagacaagctcggtccctggagccctatcgacatacatcacctcagctgtccaaat

SEQ ID NO: 283311 - DNA, 75 bp, Artificial Sequence
  Synthetic
atccttatatagactatagaaagggtctgtcgaagttatacgatcaagttcatatcaagaaggtgatagacaagt

SEQ ID NO: 283312 - DNA, 75 bp, Artificial Sequence
  Synthetic
ttgattaatttttttataataaggtgtttaattttgtttgagtgaaagttgtgtaaatttattaattgattggga

SEQ ID NO: 283313 - DNA, 75 bp, Artificial Sequence
  Synthetic
gcaccagcctatcagggttctcttacatggaacttaaggtgggatacatctcggccataaaggtgaatgggttca

SEQ ID NO: 283314 - DNA, 75 bp, Artificial Sequence
  Synthetic
tataagtttaagttttagaattttatataatttgagtttgtatgttttttttaaagatttatataggtttttttt

SEQ ID NO: 283315 - DNA, 75 bp, Artificial Sequence
  Synthetic
tataatttgagtttgtatgttttttttaaagatttatataggttttttttatttataaagttgtaagttttattt

SEQ ID NO: 283316 - DNA, 75 bp, Artificial Sequence
  Synthetic
acatcaagatgctagatccaggagaggtctatgatgaccccattgatccagtcgagtcagaggctgaacccagag

SEQ ID NO: 283317 - DNA, 75 bp, Artificial Sequence
  Synthetic
tatgtcaccaccacattcaagaggaaacattttcgccctataccagatgcatgcagggctgcatacaactggaag

SEQ ID NO: 283318 - DNA, 75 bp, Artificial Sequence
  Synthetic
ttttagttttggatttttgggtatttaaatggtgtaattgtggttagtggagtagtaggtagaagatattgttat

SEQ ID NO: 283319 - DNA, 75 bp, Artificial Sequence
  Synthetic
aatcatctcaatcgatcagacatggtcatgtagattcttataacacaagaaatcttctagcagttccagtgacca

SEQ ID NO: 283320 - DNA, 75 bp, Artificial Sequence
  Synthetic
taaatggtgtaattgtggttagtggagtagtaggtagaagatattgttatttttgagtaatttttgttagggaag

SEQ ID NO: 283321 - DNA, 75 bp, Artificial Sequence
  Synthetic
gtaccactggctacggaccgtaaagaccaccaaggagtctcttatcatcatatccccgagtgtggctgatttgga

SEQ ID NO: 283322 - DNA, 75 bp, Artificial Sequence
  Synthetic
accaccaaggagtctcttatcatcatatccccgagtgtggctgatttggacccatacaacaaatctcttcattct

SEQ ID NO: 283323 - DNA, 75 bp, Artificial Sequence
  Synthetic
agggaatagaccttatcggatgactctgacggacaattgctccaggtcttacaaagtgttaaaagattatttcaa

SEQ ID NO: 283324 - DNA, 75 bp, Artificial Sequence
  Synthetic
agatatgataatgagagattttttggtggtttttatagtttgaagttagtggtagttagggtatggattgtgtag

SEQ ID NO: 283325 - DNA, 75 bp, Artificial Sequence
  Synthetic
gtggtttttatagtttgaagttagtggtagttagggtatggattgtgtagagattttttatatttggggttattg

SEQ ID NO: 283326 - DNA, 75 bp, Artificial Sequence
  Synthetic
agtcccccgatattagactgggtaagagtctgttaagaaagaatacttgcctcctatgaaggacataagcaatag

SEQ ID NO: 283327 - DNA, 75 bp, Artificial Sequence
  Synthetic
atgtttttttttgaatgtggttgtgatataattaatgaagttagtgtaggttttagtttttgttataatgtttgt

SEQ ID NO: 283328 - DNA, 75 bp, Artificial Sequence
  Synthetic
atataattaatgaagttagtgtaggttttagtttttgttataatgtttgtgtaagtgaatttgtttatttttatg

SEQ ID NO: 283329 - DNA, 75 bp, Artificial Sequence
  Synthetic
taggatgggttgctctagccaattccaaaaagttccaactgttggttgagcctgacaagctaaacaaaataatgc

SEQ ID NO: 283330 - DNA, 75 bp, Artificial Sequence
  Synthetic
cttatttgtttttccatgtaatcaccctatacatgaatgccctagactgggacgaagaaaaaaccatcttagcat

SEQ ID NO: 283331 - DNA, 75 bp, Artificial Sequence
  Synthetic
ggtgtattttttgttttttattattaaattgtttgggtagttgaggtgatgtatgttaattgggttttagggatt

SEQ ID NO: 283332 - DNA, 75 bp, Artificial Sequence
  Synthetic
aaattgtttgggtagttgaggtgatgtatgttaattgggttttagggattaagtttgtttggtattgtgtaaata

SEQ ID NO: 283333 - DNA, 75 bp, Artificial Sequence
  Synthetic
cggacatgttctaatcccagagatgcaatcgtccctcctccaccagcatatggaattgttggagtcctcagtcat

SEQ ID NO: 283334 - DNA, 75 bp, Artificial Sequence
  Synthetic
agtttgaggaattatttttttttgagttttttgagggatgttaatagttttttttatatttaagaggattaaaat

SEQ ID NO: 283335 - DNA, 75 bp, Artificial Sequence
  Synthetic
agaaactatacacttatgctaaaagatcttttcttgtctcgcttcaactccttaatgatcttgctctctcccccc

SEQ ID NO: 283336 - DNA, 75 bp, Artificial Sequence
  Synthetic
tagggctgatcatcaagaaggaagagaccatgtgtagctatgactttctcatctatgggaaaactcctttatttc

SEQ ID NO: 283337 - DNA, 75 bp, Artificial Sequence
  Synthetic
aagtgggtggaactgcagcccagtcaatgatctccctttggttgtatggtgctcactctgaatcaaacaggagcc

SEQ ID NO: 283338 - DNA, 75 bp, Artificial Sequence
  Synthetic
gttttttgagggatgttaatagttttttttatatttaagaggattaaaatgtaaaggtaattaatttgattttga

SEQ ID NO: 283339 - DNA, 75 bp, Artificial Sequence
  Synthetic
gtgtttgaaagtcagagagaggtgtcatcctcctgtggacggagtgttcttcaatggcataattctgggtccgga

SEQ ID NO: 283340 - DNA, 75 bp, Artificial Sequence
  Synthetic
ttttaagggttggagttgagtttatatgtttttttttttagaggtaaataagtgataaatttgtgggatataatt

SEQ ID NO: 283341 - DNA, 75 bp, Artificial Sequence
  Synthetic
tcaatggcataattctgggtccggacgggaacgtcttgatacctgagatgcaatcgtctctacttcagcaacata

SEQ ID NO: 283342 - DNA, 75 bp, Artificial Sequence
  Synthetic
atgtttttttttttagaggtaaataagtgataaatttgtgggatataatttgattattttagaagtagagaggaa

SEQ ID NO: 283343 - DNA, 75 bp, Artificial Sequence
  Synthetic
cagtttaggcctcttattcattccttgggagactttcctgtatttataaaagacaaggtgagtcagcttgaaggg

SEQ ID NO: 283344 - DNA, 75 bp, Artificial Sequence
  Synthetic
ttgatttgtttttgagtttatgttgatatattagattttgttttggatatgatattgttttgtatttatttttat

SEQ ID NO: 283345 - DNA, 75 bp, Artificial Sequence
  Synthetic
ctcacaacggaagggtcatatcttcatgggaatcatataaaagcggaggtgagaccaagctgtgaggacaagtca

SEQ ID NO: 283346 - DNA, 75 bp, Artificial Sequence
  Synthetic
atatattagattttgttttggatatgatattgttttgtatttatttttatttgtaatttgatgaatttagtatta

SEQ ID NO: 283347 - DNA, 75 bp, Artificial Sequence
  Synthetic
tttatggaaagacttgacgtcagttgatgttgggaaagacttagtcaagttcaaagatcaaatatggggactact

SEQ ID NO: 283348 - DNA, 75 bp, Artificial Sequence
  Synthetic
gtttttggaattagtttattggaagataagggttttttttaatttgtatatttagtttatgtttttagggattgg

SEQ ID NO: 283349 - DNA, 75 bp, Artificial Sequence
  Synthetic
aattgtgacgaaggactttgtgtactctcagagttctaattgtctttttgacaggaactatacacttatgctgaa

SEQ ID NO: 283350 - DNA, 75 bp, Artificial Sequence
  Synthetic
gatcgcaggtggcctagcgacactagctctgataatcttctcgatggcatgttgtagaagggccaagcgaacaga

SEQ ID NO: 283351 - DNA, 75 bp, Artificial Sequence
  Synthetic
ataagggttttttttaatttgtatatttagtttatgtttttagggattggagtttttgataaagttagtttaata

SEQ ID NO: 283352 - DNA, 75 bp, Artificial Sequence
  Synthetic
cctaccaagagtgtttagcaagcgacctagccagaagaatcctcagatggggatttgataagtactccaagtggt

SEQ ID NO: 283353 - DNA, 75 bp, Artificial Sequence
  Synthetic
cccagacgagaaaagtcgtatcttcatgggagttgtacaagagtgaaggcgatgccaggctgtgagggcaggcca

SEQ ID NO: 283354 - DNA, 75 bp, Artificial Sequence
  Synthetic
gaatgattttagaatgtgttgtaggattttgaatgagtaattatttgggttatatattttaatttttttgttgat

SEQ ID NO: 283355 - DNA, 75 bp, Artificial Sequence
  Synthetic
agatcaccccttgactccttatatcaaaacccagacatggccacccaaacatatagtagacttggtgggggatac

SEQ ID NO: 283356 - DNA, 75 bp, Artificial Sequence
  Synthetic
attttgaatgagtaattatttgggttatatattttaatttttttgttgatataaaagttttttttgttttttttg

SEQ ID NO: 283357 - DNA, 75 bp, Artificial Sequence
  Synthetic
aattggctatcttggaggtctgagggactctctcattctgaaggcccttcacagacttcatgtaacaagataagt

SEQ ID NO: 283358 - DNA, 75 bp, Artificial Sequence
  Synthetic
attgttatttagaggggttgatatgggagagggtttttgagtgtttttgtttttgtaattttttattattttatg

SEQ ID NO: 283359 - DNA, 75 bp, Artificial Sequence
  Synthetic
ggagagggtttttgagtgtttttgtttttgtaattttttattattttatgtagaaagtttattttattagtggtg

SEQ ID NO: 283360 - DNA, 75 bp, Artificial Sequence
  Synthetic
gaggggggcctgttcctagtgagaaagttattatcacggccttgtctaagccgcctgtcaatccccgagagtttt

SEQ ID NO: 283361 - DNA, 75 bp, Artificial Sequence
  Synthetic
agagggattgagtggagaggtttggttagtaagatgtatagtgatttaagttattttgtatgattttatttagtt

SEQ ID NO: 283362 - DNA, 75 bp, Artificial Sequence
  Synthetic
ttagtaagatgtatagtgatttaagttattttgtatgattttatttagtttgttggatttgattaataattggaa

SEQ ID NO: 283363 - DNA, 75 bp, Artificial Sequence
  Synthetic
agattagttgagagagacgacttacatcctatgaaggacacaagcaataggtcacaatcatcttacatcctgata

SEQ ID NO: 283364 - DNA, 75 bp, Artificial Sequence
  Synthetic
atcctatgaaggacacaagcaataggtcacaatcatcttacatcctgataaggtgtttataactacaaagggata

SEQ ID NO: 283365 - DNA, 75 bp, Artificial Sequence
  Synthetic
ggggatttgacaagtactctaaatggtatattgactcacgattgctccccagagaccaccccttgactccttata

SEQ ID NO: 283366 - DNA, 75 bp, Artificial Sequence
  Synthetic
gtgcttgagcgtcggagggaggtgtcatcctcatgtaaacggagtgtttttcaatggtataattctgggtccgga

SEQ ID NO: 283367 - DNA, 75 bp, Artificial Sequence
  Synthetic
gtttggatttgttatgggttaaatgggttatatttggtatattttttgtttttttaattatattattaaggttta

SEQ ID NO: 283368 - DNA, 75 bp, Artificial Sequence
  Synthetic
ggaagctgtttatactcgaatcatgatgaatggaggtcgactaaagagatcgcacatacggagatatgtctcagt

SEQ ID NO: 283369 - DNA, 75 bp, Artificial Sequence
  Synthetic
ggttatatttggtatattttttgtttttttaattatattattaaggtttatttttaattgtttaaaattatataa

SEQ ID NO: 283370 - DNA, 75 bp, Artificial Sequence
  Synthetic
acaatcatcaaagattagagtcaacagaggatgtgttctctgtcctggatcaggtgtttggattgaagagagtgt

SEQ ID NO: 283371 - DNA, 75 bp, Artificial Sequence
  Synthetic
ttgtaatttggtgagtgattttagtttttattgatagattattttttttattggtggttgattatttaagggttg

SEQ ID NO: 283372 - DNA, 75 bp, Artificial Sequence
  Synthetic
agggaaccccaccatccccaacatcttaagaaactctgactacaacctcaactctcctctaatagaagactcagc

SEQ ID NO: 283373 - DNA, 75 bp, Artificial Sequence
  Synthetic
tttctagaacacatgagttttttcagaagtcctggatctattattcagacagatcagacctcattgggttatggg

SEQ ID NO: 283374 - DNA, 75 bp, Artificial Sequence
  Synthetic
ttttattgatagattattttttttattggtggttgattatttaagggttggagggttagaagtagtttgagttgt

SEQ ID NO: 283375 - DNA, 75 bp, Artificial Sequence
  Synthetic
cccagagttcaaattgtctttttgacaggaactatacacttatgctgaaagacctttttttatctcgtttcaact

SEQ ID NO: 283376 - DNA, 75 bp, Artificial Sequence
  Synthetic
ttttttttttgagtttttggttggtagtttgggttgatttattttttgaagatttttttggagggttgggaaagt

SEQ ID NO: 283377 - DNA, 75 bp, Artificial Sequence
  Synthetic
agtttgggttgatttattttttgaagatttttttggagggttgggaaagttgattgtgatataggatataatttt

SEQ ID NO: 283378 - DNA, 75 bp, Artificial Sequence
  Synthetic
attttggttgcaatccatgactcaggatataatgatgggaccattttccctgtcaacatatacagcaaggtatca

SEQ ID NO: 283379 - DNA, 75 bp, Artificial Sequence
  Synthetic
gtttgattatttggattttaatattgtttaggtatgattggaataggaggttaggatttttttttttatttattt

SEQ ID NO: 283380 - DNA, 75 bp, Artificial Sequence
  Synthetic
gaaagtgtataacagacttggcccagttctactccaagtcttcccccatagaaaaactcttaaactgtacgctcg

SEQ ID NO: 283381 - DNA, 75 bp, Artificial Sequence
  Synthetic
gtttaggtatgattggaataggaggttaggatttttttttttatttatttgaaagtttttttgatatttgttttt

SEQ ID NO: 283382 - DNA, 75 bp, Artificial Sequence
  Synthetic
cttacaatgaaatgatcataactctgattgatagtgatgtagaatctttcctggttcacaagatggtagatgatc

SEQ ID NO: 283383 - DNA, 75 bp, Artificial Sequence
  Synthetic
gacgtttggtcccagtgcaaaaaggttttttagagttctggatcaatttgacaacatacatgacctggtttttgt

SEQ ID NO: 283384 - DNA, 75 bp, Artificial Sequence
  Synthetic
gaagttgttttatatttttagggagattgtttatttttatgggttttttttggagatgagtttgattgtttttga

SEQ ID NO: 283385 - DNA, 75 bp, Artificial Sequence
  Synthetic
attgtttatttttatgggttttttttggagatgagtttgattgtttttgatatttttattgattagattaatagt

SEQ ID NO: 283386 - DNA, 75 bp, Artificial Sequence
  Synthetic
gacaacacttctcatcctaagaattgcaccatgatgattgatccaggggaggtttatgatgaccccattgatcca

SEQ ID NO: 283387 - DNA, 75 bp, Artificial Sequence
  Synthetic
tgataaagattttgtttatgtttggggtggtttgaaaggaggggtgttagttttttttatgatggatatatataa

SEQ ID NO: 283388 - DNA, 75 bp, Artificial Sequence
  Synthetic
ggtggtttgaaaggaggggtgttagttttttttatgatggatatatataatttgtagatttttggtattttgtta

SEQ ID NO: 283389 - DNA, 75 bp, Artificial Sequence
  Synthetic
atagaaactatacacttatgctgaaagacctcttcttgtctcggttcaactccctcatgattcttctttctcctc

SEQ ID NO: 283390 - DNA, 75 bp, Artificial Sequence
  Synthetic
tctcctctgatagaggatccagccaagttgatgttagaatggttgaaaacaggaaataggcctctccggatgact

SEQ ID NO: 283391 - DNA, 75 bp, Artificial Sequence
  Synthetic
atgagtttggatgagtttgatgattggaattgattgagatatatttttgtatgtgtgatttttttagttgatttt

SEQ ID NO: 283392 - DNA, 75 bp, Artificial Sequence
  Synthetic
atcgccggagatcatgtcttgtccatgtgcgggaactctggatatgaggtcatcaagatattggagccttatgtt

SEQ ID NO: 283393 - DNA, 75 bp, Artificial Sequence
  Synthetic
ggaattgattgagatatatttttgtatgtgtgatttttttagttgatttttatttattatgatttgagtataaat

SEQ ID NO: 283394 - DNA, 75 bp, Artificial Sequence
  Synthetic
tgatctccctttggctgtatggtgcccactctgaatcaaacaggagccggaagtgtataactgacttggctcagt

SEQ ID NO: 283395 - DNA, 75 bp, Artificial Sequence
  Synthetic
tgatagttttattatttgttagtgttatgttagtttttgttagtttagttgttttgtatttttgaagtttttttt

SEQ ID NO: 283396 - DNA, 75 bp, Artificial Sequence
  Synthetic
ttgtgtcaagaggctgggaacccagatcttggagagagaacacttgagagcttcactcgccttctagaagatcct

SEQ ID NO: 283397 - DNA, 75 bp, Artificial Sequence
  Synthetic
tatgttagtttttgttagtttagttgttttgtatttttgaagtttttttttatttttgaagaatttttttttaaa

SEQ ID NO: 283398 - DNA, 75 bp, Artificial Sequence
  Synthetic
aatagagggatgagaatccccccagagggggtcctaaattgtcttgaaagggtcgattacgacaaagcatttggg

SEQ ID NO: 283399 - DNA, 75 bp, Artificial Sequence
  Synthetic
gctaattatatcttgccactctttgatgctctgactatgacagacaacctgaacaaggtgtttaagaagctgatt

SEQ ID NO: 283400 - DNA, 75 bp, Artificial Sequence
  Synthetic
gaacaaggtgtttaagaagctgattgacagggtgactgggcaagggcttttggactattcaagggttacatatgc

SEQ ID NO: 283401 - DNA, 75 bp, Artificial Sequence
  Synthetic
ttttatgaggagtatatgtagtaataattgttgtatttagggatttgatttgatttatatagtattttataaagt

SEQ ID NO: 283402 - DNA, 75 bp, Artificial Sequence
  Synthetic
gaagtggacaaggtggaaaattcagagtttcgagaggcgatcctgttgtccaagacccatagagataacttcata

SEQ ID NO: 283403 - DNA, 75 bp, Artificial Sequence
  Synthetic
aattgttgtatttagggatttgatttgatttatatagtattttataaagtgaatgagattgaatatgtgattaat

SEQ ID NO: 283404 - DNA, 75 bp, Artificial Sequence
  Synthetic
atcttggagagagaacacttgagagcttcactcgccttctagaagatcctaccaccttaaatataaaaggaggtg

SEQ ID NO: 283405 - DNA, 75 bp, Artificial Sequence
  Synthetic
cagatcagaccttatcgggttatgggaggaccaaatatactgcttggacatgtccaatggcccgacctgctggaa

SEQ ID NO: 283406 - DNA, 75 bp, Artificial Sequence
  Synthetic
cttcagttcgtctttcttgggaatccccgagtcaatcatcggactgatacaaaactcccggacgataagaaggca

SEQ ID NO: 283407 - DNA, 75 bp, Artificial Sequence
  Synthetic
ggatgaaataagagtgaggaatagttgttttttgttttggtttaaatattttttttattttttttttaaagtttt

SEQ ID NO: 283408 - DNA, 75 bp, Artificial Sequence
  Synthetic
tgttttttgttttggtttaaatattttttttattttttttttaaagtttttgtggaagaaatatagtattgtttt

SEQ ID NO: 283409 - DNA, 75 bp, Artificial Sequence
  Synthetic
ttgaatagtttttataagtagtgataattgtgtttattttgattgttgaatatagatgtttaatttgggagaaaa

SEQ ID NO: 283410 - DNA, 75 bp, Artificial Sequence
  Synthetic
ggacccatcggaaatactcgatgacaaatcacactctttcactagaacaagattagcgtcatggttgtcagagaa

SEQ ID NO: 283411 - DNA, 75 bp, Artificial Sequence
  Synthetic
aattgtgtttattttgattgttgaatatagatgtttaatttgggagaaaaatatgttataggttttggttaaaaa

SEQ ID NO: 283412 - DNA, 75 bp, Artificial Sequence
  Synthetic
gggaagaaaagtggtaggcacgacagttcctcacccctctgagatgttggggttacttcccaaatcttccatctc

SEQ ID NO: 283413 - DNA, 75 bp, Artificial Sequence
  Synthetic
gagcattcccctcagtcacaggatttataacccagatgacctcgtctttttcatctgagctatatctccgattct

SEQ ID NO: 283414 - DNA, 75 bp, Artificial Sequence
  Synthetic
ttagagtatggtgttttatgattttaataaaaggggttgttttaaaaatttgttttattttgtttgtaatgtttg

SEQ ID NO: 283415 - DNA, 75 bp, Artificial Sequence
  Synthetic
aataaaaggggttgttttaaaaatttgttttattttgtttgtaatgtttgttttatagttattagtgttttgttt

SEQ ID NO: 283416 - DNA, 75 bp, Artificial Sequence
  Synthetic
tactcccatccttcgatcagtcatttttttcacgaggtcccctaaagggatacttgggctcgtccacctctatgt

SEQ ID NO: 283417 - DNA, 75 bp, Artificial Sequence
  Synthetic
aaaaattgagggtcgattttttgctttaatgtcttggaatttgaggttgtactttgtcatcacagaaaagctcct

SEQ ID NO: 283418 - DNA, 75 bp, Artificial Sequence
  Synthetic
tacttgggctcgtccacctctatgtcaacccagctattccatgcatgggaaaaagtcactaatgttcatgtggtg

SEQ ID NO: 283419 - DNA, 75 bp, Artificial Sequence
  Synthetic
aaaagtcactaatgttcatgtggtgaaaagggctctatcgttaaaagaatctataaactggttcattactagaaa

SEQ ID NO: 283420 - DNA, 75 bp, Artificial Sequence
  Synthetic
tatgtttagggatagtggggttttttgttagttttatgttttttgttagagtttaatttttttttatattagtat

SEQ ID NO: 283421 - DNA, 75 bp, Artificial Sequence
  Synthetic
tgttagttttatgttttttgttagagtttaatttttttttatattagtatgttttatttttattagagaatttgg

SEQ ID NO: 283422 - DNA, 75 bp, Artificial Sequence
  Synthetic
tttttggatatgtttttttaaaaaattgtattgttgttgttaaataggaatatatattgttaggattaagtttgg

SEQ ID NO: 283423 - DNA, 75 bp, Artificial Sequence
  Synthetic
ttgtattgttgttgttaaataggaatatatattgttaggattaagtttggtggtgtttatgtatgataaaattga

SEQ ID NO: 283424 - DNA, 75 bp, Artificial Sequence
  Synthetic
ctgctaaccgaactcttaaactcagtccctctagatgataaaatctgagatgtcctaaagtcaatatgaaaaaaa

SEQ ID NO: 283425 - DNA, 75 bp, Artificial Sequence
  Synthetic
gttttccagaactcatgagttttttcagaagtcctggatctattattcggacagatctgacctcattgggttatg

SEQ ID NO: 283426 - DNA, 75 bp, Artificial Sequence
  Synthetic
acagcgaaggagggtattcttctgtttgcccgaacctcctctctcatatctctgttagtacagacactatgtctg

SEQ ID NO: 283427 - DNA, 75 bp, Artificial Sequence
  Synthetic
tttttaaatttttgatggtagggtatttgtatttatattgatttatgataattttaggttttaaagagattattt

SEQ ID NO: 283428 - DNA, 75 bp, Artificial Sequence
  Synthetic
agctggtacagagagacacaaggctgagagactctacgtttcattggcacctccggtgcaacagatgtgtaaggc

SEQ ID NO: 283429 - DNA, 75 bp, Artificial Sequence
  Synthetic
tttgagacaaaagggctggagtctggtcagtttgttaatgatagaccgtgagtctcagacaaggaatacaaggac

SEQ ID NO: 283430 - DNA, 75 bp, Artificial Sequence
  Synthetic
gttggtatttattgtagaggtgttatatttttgttttgttattgatgttgtttgttttttttttgatttggttgt

SEQ ID NO: 283431 - DNA, 75 bp, Artificial Sequence
  Synthetic
agtttagaaaaagtctctcaagaactttagaggagtcattttacaactcggagattcacgggatcaaccggatga

SEQ ID NO: 283432 - DNA, 75 bp, Artificial Sequence
  Synthetic
acgcttaacaaccagatcaaagaaaaaacagacagcgtcaatggcagagcaaaaatgtaacacctctacaatgga

SEQ ID NO: 283433 - DNA, 75 bp, Artificial Sequence
  Synthetic
cgagaggagtcttgataggatcctcgatttgcttcttgacaagaatgacaaatatcaacattaatagacctcttg

SEQ ID NO: 283434 - DNA, 75 bp, Artificial Sequence
  Synthetic
tactctacgagttggagagcatatcaagaaatgcgctctcaatatatcgtgccattgaggagggggcatccaaac

SEQ ID NO: 283435 - DNA, 75 bp, Artificial Sequence
  Synthetic
tgatttgacccaggacgggaagaactatgatttcatgttccagcccttgatgctttatgcgcagacatggacatc

SEQ ID NO: 283436 - DNA, 75 bp, Artificial Sequence
  Synthetic
atctccaacgaccaaattgtcaaccttgccaacataatgtcaacggtatccaccaatgcattgactgtagcacaa

SEQ ID NO: 283437 - DNA, 75 bp, Artificial Sequence
  Synthetic
aagaacaactggcaacacttctcatcctgagacctacttcaagatgctcgatcctggagaggtctatgatgaccc

SEQ ID NO: 283438 - DNA, 75 bp, Artificial Sequence
  Synthetic
gaggtgatcacggcgtctccagagaatgactggctgtggatcttctcggactttaggagtgctaaaatgacgtac

SEQ ID NO: 283439 - DNA, 75 bp, Artificial Sequence
  Synthetic
gaatttgtctaagagtatgagagctaacctgcgacaaatgagttctttgatgaggcaggtgctgggtgggcacgg

SEQ ID NO: 283440 - DNA, 75 bp, Artificial Sequence
  Synthetic
gaactagtacaaagggacaccaggctgaaggattctacgtttcactggcaccttcgatgtaacaagtgtgtaagg

SEQ ID NO: 283441 - DNA, 75 bp, Artificial Sequence
  Synthetic
tgaaggattctacgtttcactggcaccttcgatgtaacaagtgtgtaaggcccatagatgatatcacactggaga

SEQ ID NO: 283442 - DNA, 75 bp, Artificial Sequence
  Synthetic
cctcccagatctttgagtttccagatgtgtcaaaaagaatatctaggatggtgtctggagctgtgccccactttc

SEQ ID NO: 283443 - DNA, 75 bp, Artificial Sequence
  Synthetic
tccaagactcatagggacaactttatactcttcttgaaatctgtcgagcctttgtttccccgatttctcagtgaa

SEQ ID NO: 283444 - DNA, 75 bp, Artificial Sequence
  Synthetic
atgttcagaatgggtctgctctgctcaacaggttgcagtctccacctcagcaaacccagcccctgtctcagagct

SEQ ID NO: 283445 - DNA, 75 bp, Artificial Sequence
  Synthetic
agagagaaagccaatcctcgaaagccaggatggcggctcaaactgcttctggccctccagcccttgaatggtcgg

SEQ ID NO: 283446 - DNA, 75 bp, Artificial Sequence
  Synthetic
acaaaattccagaacaataagacgacagttcagaaggagtctttcaagaacattggaggagtctttttataactc

SEQ ID NO: 283447 - DNA, 75 bp, Artificial Sequence
  Synthetic
tacttgggctcatcaacttccatgtcgacccagctgttccacgcctgggagaaagtcaccaatgttcatgtggtg

SEQ ID NO: 283448 - DNA, 75 bp, Artificial Sequence
  Synthetic
cgacccagctgttccacgcctgggagaaagtcaccaatgttcatgtggtgaaaagagctctgtcactcaaggaat

SEQ ID NO: 283449 - DNA, 75 bp, Artificial Sequence
  Synthetic
cttaacatgtttccagatgctaagcttgtgttcaacagcctcttagaggtgaatgatctgatggcttccggaaca

SEQ ID NO: 283450 - DNA, 75 bp, Artificial Sequence
  Synthetic
agggttacttccgaaatcttcgatctcttgctcctgtggggtgactggaagcggaaatcctcggatatcagtgtc

SEQ ID NO: 283451 - DNA, 75 bp, Artificial Sequence
  Synthetic
ctctctgcgtagaacgaggtgggtggatcaagaagtgcgccatgcagccagaactatgacgggggattacagccc

SEQ ID NO: 283452 - DNA, 75 bp, Artificial Sequence
  Synthetic
gctaacccagcccctgtttcagagcttgacataaggaccctctctaagaagtttcagaaccctcttatctcaggc

SEQ ID NO: 283453 - DNA, 75 bp, Artificial Sequence
  Synthetic
atttgactcatgatgggaaaaactatgactttatgtttcaacccttgatgctttatgcgcaaacatggacatcgg

SEQ ID NO: 283454 - DNA, 75 bp, Artificial Sequence
  Synthetic
tataaggctattcagcacctgtcaagagcgttcccctcagtcacagggtttataacccaagtgacttcgtccttt

SEQ ID NO: 283455 - DNA, 75 bp, Artificial Sequence
  Synthetic
atcaattcgacaacatacatgacttggtttttgtgtatggctgttacaggcattgggggcacccatatatagatt

SEQ ID NO: 283456 - DNA, 75 bp, Artificial Sequence
  Synthetic
tcaatcggataacactgttgatgtctgacttcgcattgtccatagatggcccgctttatctggttttcaaaactt

SEQ ID NO: 283457 - DNA, 75 bp, Artificial Sequence
  Synthetic
atatcgagctattcaacacctgtcgagggcattcccctcagtcacaggatttataacccagatgacctcgtcttt

SEQ ID NO: 283458 - DNA, 75 bp, Artificial Sequence
  Synthetic
cgaactggtacaaaaagacacacggctgaaggactctacttttcattggcatcttcgatgtaacaagtgtataag

SEQ ID NO: 283459 - DNA, 75 bp, Artificial Sequence
  Synthetic
tccaagtggtatctggattcacgattcctagcccgagaccaccccttgactccttatatcaaaacccaaacatgg

SEQ ID NO: 283460 - DNA, 75 bp, Artificial Sequence
  Synthetic
tccttatatcaaaacccaaacatggccacccaaacatattgtagacttggtgggggatacatggcacaagctccc

SEQ ID NO: 283461 - DNA, 75 bp, Artificial Sequence
  Synthetic
gacagtgatgtagaatctttcttagtccacaagatggtggatgatcttgagttacagaggggaaccctgtctaaa

SEQ ID NO: 283462 - DNA, 75 bp, Artificial Sequence
  Synthetic
gaggtaatcacagcatccccggagaatgactggttgtggatcttctcggactttagaagctccaagatgacatat

SEQ ID NO: 283463 - DNA, 75 bp, Artificial Sequence
  Synthetic
ttgcagtactatgatgtatctatctaccgctttaggcgacgtccctagcttcgcaagacttcacgacctgtataa

SEQ ID NO: 283464 - DNA, 75 bp, Artificial Sequence
  Synthetic
accgctttaggcgacgtccctagcttcgcaagacttcacgacctgtataacagacctataacttattacttcaga

SEQ ID NO: 283465 - DNA, 75 bp, Artificial Sequence
  Synthetic
atgtttccaaaccgctgactgatcctttgttctacccaccatctgaccctaaaatcttgaggcacttcaacatat

SEQ ID NO: 283466 - DNA, 75 bp, Artificial Sequence
  Synthetic
aaagcatttccgcccaacaccagatgcatgtagagccgcgtacaactggaagatggccggtgaccccagatatga

SEQ ID NO: 283467 - DNA, 75 bp, Artificial Sequence
  Synthetic
atctatcttggagttggtctgacgacacctcagtgttcaagagagtagcctgtaattccagcttgagtctatcgt

SEQ ID NO: 283468 - DNA, 75 bp, Artificial Sequence
  Synthetic
ggcagcatcgaggacttatctggagaggtggaaagacaccttcatgggtacaacaggtggatcaccctagaggat

SEQ ID NO: 283469 - DNA, 75 bp, Artificial Sequence
  Synthetic
ttttcccgtccctctgtcttgtagttggggacgggtcaggggggatatcaagggcagttctcaacatgtttccag

SEQ ID NO: 283470 - DNA, 75 bp, Artificial Sequence
  Synthetic
tggggacgggtcaggggggatatcaagggcagttctcaacatgtttccagatgctaagcttgtgttcaacagcct

SEQ ID NO: 283471 - DNA, 75 bp, Artificial Sequence
  Synthetic
gagaggcaataacggcgtctccggagaatgagtggttgtggatattctcagactttaggagctctaagatgacat

SEQ ID NO: 283472 - DNA, 75 bp, Artificial Sequence
  Synthetic
gaagttgaacgacaccttcaagggtataacaggtggatcaccctcgaagacctcagatctagatcttctctacta

SEQ ID NO: 283473 - DNA, 75 bp, Artificial Sequence
  Synthetic
tctcgaaaaaaacaagaacttgaatccggacctctggctgtttgattgtttcttttgtctttgttgtttgtttgt

SEQ ID NO: 283474 - DNA, 75 bp, Artificial Sequence
  Synthetic
tgagagtagttcagtgggcgacaggggcccattataagctcaaacccattctggatgatctcaatgtcttcccat

SEQ ID NO: 283475 - DNA, 75 bp, Artificial Sequence
  Synthetic
ctggatgatctcaatgtcttcccatccctatgtcttgttgtcggggatggatcaggggggatatcaagagcggta

SEQ ID NO: 283476 - DNA, 75 bp, Artificial Sequence
  Synthetic
gacccttagacgatgcacctagaaaaaaacaagactctgaatcagaacctctgattgtttgattatttttttgtc

SEQ ID NO: 283477 - DNA, 75 bp, Artificial Sequence
  Synthetic
aaaaatgtaacacccctacaatggatgccgacaagattgtatttaaagtcaagaatcaggtggtctccttgaagc

SEQ ID NO: 283478 - DNA, 75 bp, Artificial Sequence
  Synthetic
ctgagatcatcgtggaccaatatgagtacaagtacccggcaatcaaggactcgaggaagcccagtataaccttag

SEQ ID NO: 283479 - DNA, 75 bp, Artificial Sequence
  Synthetic
tcctgatagcacggaggggagacaagatcaccccaaattctcttgtggacataagacgcaccgatgtggaaggga

SEQ ID NO: 283480 - DNA, 75 bp, Artificial Sequence
  Synthetic
ctggacatcagaaccctctctaggaggcttcaaaacccattaatctcaggcctgagagttgttcagtgggctacg

SEQ ID NO: 283481 - DNA, 75 bp, Artificial Sequence
  Synthetic
aatatcaggacagaacactggcaattacaagacaaacattgcagacagaatagagcaaattttcgagacagcccc

SEQ ID NO: 283482 - DNA, 75 bp, Artificial Sequence
  Synthetic
cacatccattacccccttcagcaatcatgagcggaggagatgacatcatctccagggtaattgactttgactcta

SEQ ID NO: 283483 - DNA, 75 bp, Artificial Sequence
  Synthetic
aagcaagtcatccgggggaatgtttatctgtcctggagttggtccgatgacacttcagtatttaagagggtggcc

SEQ ID NO: 283484 - DNA, 75 bp, Artificial Sequence
  Synthetic
tcctgatagcacggaagggcgacaaaatcaccccaggctctcttgtggatatcagacgtactaatgtggaaggga

SEQ ID NO: 283485 - DNA, 75 bp, Artificial Sequence
  Synthetic
cagtcagtccaagagcaggtgaatatgtcttatgacctcatcatttgtgatgcagaggtcactgacattgcatca

SEQ ID NO: 283486 - DNA, 75 bp, Artificial Sequence
  Synthetic
tgctcagggttggtgtcttttacagggttcataaagcaaataaatctcactgcaagagaagcgctgctatacttc

SEQ ID NO: 283487 - DNA, 75 bp, Artificial Sequence
  Synthetic
tgcaagagaagcgctgctatacttcttccacaagaacttcgaagaagagataagaaggatgtttgagccggggca

SEQ ID NO: 283488 - DNA, 75 bp, Artificial Sequence
  Synthetic
cccactttatttggttttcaaaacttacggcaccatgctggtaaatccggactacaaggcaattcaacatctatc

SEQ ID NO: 283489 - DNA, 75 bp, Artificial Sequence
  Synthetic
actttgatgacaacccacaaaatgtgcgccaactggagtactataccgaacttcagattcctagccggaacctat

SEQ ID NO: 283490 - DNA, 75 bp, Artificial Sequence
  Synthetic
gaatgcggttggtcatgttttcaacctcattcactttgttggatgttacatgggccaagtgagatctctgaatgc

SEQ ID NO: 283491 - DNA, 75 bp, Artificial Sequence
  Synthetic
cttcagattcctagccggaacctatgacatgtttttctcccggattgaacatctgtattcagctattagggtagg

SEQ ID NO: 283492 - DNA, 75 bp, Artificial Sequence
  Synthetic
acttaggggaggagttttttggaaaagggacttttgagagaagattcttcagggatgagaaagaacttcaagaat

SEQ ID NO: 283493 - DNA, 75 bp, Artificial Sequence
  Synthetic
aggaactgacaccaacagttgtagacaaaccacggggtgtctcaggtgattctgcgcttgggcacagacaaaggt

SEQ ID NO: 283494 - DNA, 75 bp, Artificial Sequence
  Synthetic
taagaaggcagtttagaaagagtctctcaaaaactttagaagaatccttctacaactcagagatccacgggatta

SEQ ID NO: 283495 - DNA, 75 bp, Artificial Sequence
  Synthetic
accgtcaactctgatgatgaggactacttctcaagtgaaaccaggagtcctgaggcggtttacacccgaatcatg

SEQ ID NO: 283496 - DNA, 75 bp, Artificial Sequence
  Synthetic
acttctcaagtgaaaccaggagtcctgaggcggtttacacccgaatcatgatgaatggaagtcgattgaaaagat

SEQ ID NO: 283497 - DNA, 75 bp, Artificial Sequence
  Synthetic
gatcaccccagattctcttgtagacataaaacgtactcatgtggaagggaattgggctctaacagggggtatgga

SEQ ID NO: 283498 - DNA, 75 bp, Artificial Sequence
  Synthetic
cacacataaggaggtatgtctcagtcagctccaatcatcaggcccgtcctaactcattcgctgaatttttgaaca

SEQ ID NO: 283499 - DNA, 75 bp, Artificial Sequence
  Synthetic
cagctccaatcatcaggcccgtcctaactcattcgctgaatttttgaacaagacatactcaagtgattcttaaag

SEQ ID NO: 283500 - DNA, 75 bp, Artificial Sequence
  Synthetic
accgtcaactctgatgatgaggattacttttctggtgagaccaggagtcctgaagctgtttatactcggatcatg

SEQ ID NO: 283501 - DNA, 75 bp, Artificial Sequence
  Synthetic
aactctaattaggaacattatgtctctgacaggccctgatttccctctagaggaggcccctgttttcaaaaggac

SEQ ID NO: 283502 - DNA, 75 bp, Artificial Sequence
  Synthetic
ttccacaagaactttgaggaagagataagaagaatgtttgagcctgggcaggaaaccgcagttcctcattcctat

SEQ ID NO: 283503 - DNA, 75 bp, Artificial Sequence
  Synthetic
cgtcgaggagatcatatcctatgtcacggtcaacttctccagtctaccggggaagtccacagaagacaaagccac

SEQ ID NO: 283504 - DNA, 75 bp, Artificial Sequence
  Synthetic
aaatgcagttggtcacgtgttcaacctcattcactttgttggatgttatatgggtcaagtgagatctttgaatgc

SEQ ID NO: 283505 - DNA, 75 bp, Artificial Sequence
  Synthetic
agcaagacagtcaatcatccaagaccagaatggcggctcaaaccgcctctggtcctcctgctctagaatggtcca

SEQ ID NO: 283506 - DNA, 75 bp, Artificial Sequence
  Synthetic
ccagaccgccagccgtgaacccaagaaagagactgtgtctgccccctctcagcgagacagtcaaccatccaagat

SEQ ID NO: 283507 - DNA, 75 bp, Artificial Sequence
  Synthetic
ggtcctcctgctctagaatggtccaccgccaatgaagaggatgatccatctgtagaggctgaaattgctcatcag

SEQ ID NO: 283508 - DNA, 75 bp, Artificial Sequence
  Synthetic
acaaattcccttctcgatcatcagggatatttctgtacaattttgagcagttgaagatgaaccttgacgacatag

SEQ ID NO: 283509 - DNA, 75 bp, Artificial Sequence
  Synthetic
cttatactcaatcttagtggcaattcacgactcaggatacaatgatggaaccatcttccctgtcaacatatacgg

SEQ ID NO: 283510 - DNA, 75 bp, Artificial Sequence
  Synthetic
aattccttcgctgagtttctaaacaagacatactcgagtgattcataaagaactaaacaacaagactgtagacac

SEQ ID NO: 283511 - DNA, 75 bp, Artificial Sequence
  Synthetic
aagaatgacaaatatcaatattaatagacctcttgaattgatctcaggggtaatctcatatattctcctgaggct

SEQ ID NO: 283512 - DNA, 75 bp, Artificial Sequence
  Synthetic
caggcaacaccactgataagatgaacttcctgcgcaagatagtgaagacctgtagagatgaggacacccaaaaac

SEQ ID NO: 283513 - DNA, 75 bp, Artificial Sequence
  Synthetic
tgctccaaattccatatgaaaaaaacaggcaacaccactgataagatgaacttcctgcgcaagatagtgaagacc

SEQ ID NO: 283514 - DNA, 75 bp, Artificial Sequence
  Synthetic
tgtagagatgaggacgcccagaaaccccctctcgtgtcggctcctccagatgatgatgacctgtggttaccccct

SEQ ID NO: 283515 - DNA, 75 bp, Artificial Sequence
  Synthetic
cctgagtatgttccgctgaaggaactcacgggcaagaaaaatatgagaaacttttgcgtgaacggagaagtcaag

SEQ ID NO: 283516 - DNA, 75 bp, Artificial Sequence
  Synthetic
tcacgggcaagaaaaatatgagaaacttttgcgtgaacggagaagtcaaggtatgcggtccaaacggttattcgt

SEQ ID NO: 283517 - DNA, 75 bp, Artificial Sequence
  Synthetic
cggcttcaattagacgatgaaaaactatctggcctcggcgagatggccaaagcaggggaaagcaaatgtcaggaa

SEQ ID NO: 283518 - DNA, 75 bp, Artificial Sequence
  Synthetic
acgcttaacaacaaaatcacagaagaagtagacaggatcgtctgcaaaacgaaaatgtaacacccctacaatgga

SEQ ID NO: 283519 - DNA, 75 bp, Artificial Sequence
  Synthetic
gattcctcaagatatggtctcagaccgtcgaggagataatatcctatgttacggtcaacttccccgatctgtcgg

SEQ ID NO: 283520 - DNA, 75 bp, Artificial Sequence
  Synthetic
tgccgacaagattgtgttcaagatcaataatcaaattgtctctctgaagcccgaaattattgtcgaccaatatga

SEQ ID NO: 283521 - DNA, 75 bp, Artificial Sequence
  Synthetic
aataatcaaattgtctctctgaagcccgaaattattgtcgaccaatatgagtacaagtacccagccatcaaagac

SEQ ID NO: 283522 - DNA, 75 bp, Artificial Sequence
  Synthetic
taggggccctcttgaaggggaggagttagaatactcccaggagatcacctgggatgatgatacagagtttgtcgg

SEQ ID NO: 283523 - DNA, 75 bp, Artificial Sequence
  Synthetic
aaggagacagtgtctgcttcttctcagcgagaaagtcaatcatctaaaaccaaaatggcggcccaaaccgcctcc

SEQ ID NO: 283524 - DNA, 75 bp, Artificial Sequence
  Synthetic
gggatgatgatacagagtttgtcggattggagatacgagtgagtgctagacaatgtcatatccagggaaggattt

SEQ ID NO: 283525 - DNA, 75 bp, Artificial Sequence
  Synthetic
atacaagtcaattttgtctggtatgaatgcagctaagcttgaccccgacgatgtatgctcttatttagcagccgc

SEQ ID NO: 283526 - DNA, 75 bp, Artificial Sequence
  Synthetic
aatgcagctaagcttgaccccgacgatgtatgctcttatttagcagccgcaatgcaattttttgaaggaacatgt

SEQ ID NO: 283527 - DNA, 75 bp, Artificial Sequence
  Synthetic
tatggctgttacaggcattgggggcatccttacatagattatagaaagggtttgtcgaagctatatgatcaagtc

SEQ ID NO: 283528 - DNA, 75 bp, Artificial Sequence
  Synthetic
ataaagattcttcagtgcttctggaatagtccaattatatcctaaaaattcctcaattgtatacctctggaggag

SEQ ID NO: 283529 - DNA, 75 bp, Artificial Sequence
  Synthetic
attgctgagagcttctccaagaagtacaaatttccctcccgatcatcagggatattcttgtacaactttgagcag

SEQ ID NO: 283530 - DNA, 75 bp, Artificial Sequence
  Synthetic
aattactccaaattctcttgtggatataaaacgtactgatgtagaagggaattgggctctaacagggggcttgga

SEQ ID NO: 283531 - DNA, 75 bp, Artificial Sequence
  Synthetic
ctttgctctaatgtcatggaatctaagattgtattttgtcatcactgaaaaactcttggccaactacatcttgcc

SEQ ID NO: 283532 - DNA, 75 bp, Artificial Sequence
  Synthetic
cgtgacccgcttagcccatgatggatccaaactccctctgagatgtgtgctggggtgggttgctctagccaattc

SEQ ID NO: 283533 - DNA, 75 bp, Artificial Sequence
  Synthetic
ttcgggagcaatagaacaaaaaacatgctatggtgccgttgaatcgctgcattttatcagagtcaaatatataac

SEQ ID NO: 283534 - DNA, 75 bp, Artificial Sequence
  Synthetic
aaggatctcaggaaaaatgatccctcaggctcttctgtttgtgcctctcctgattccctcgctgtgtctcgggga

SEQ ID NO: 283535 - DNA, 75 bp, Artificial Sequence
  Synthetic
tcttgagtctgtacagattgagcaaaatatctggtcagaacaccggaaattacaagacaaatatcgcagatcgta

SEQ ID NO: 283536 - DNA, 75 bp, Artificial Sequence
  Synthetic
cccgacaagctaaataaaataatgcaagacgacctgaaccgttatgtgtcaaactgacaaacctctcaaactcag

SEQ ID NO: 283537 - DNA, 75 bp, Artificial Sequence
  Synthetic
aatatctggtcagaacaccggaaattacaagacaaatatcgcagatcgtatagagcagatcttcgagacggcccc

SEQ ID NO: 283538 - DNA, 75 bp, Artificial Sequence
  Synthetic
tgaaatctatagaccttggaggactgccggacgaagatttgataatcggcctcaaacctaaggaaagggagctga

SEQ ID NO: 283539 - DNA, 75 bp, Artificial Sequence
  Synthetic
caggcaacaccactgataaaatgaactttctacgcaagatagtgaagaactgtagagatgaggacactcagaagt

SEQ ID NO: 283540 - DNA, 75 bp, Artificial Sequence
  Synthetic
gtgctaactggagcaccataccgaacttcagattcttagctggaacttacgacatgtttttctcccggattgaac

SEQ ID NO: 283541 - DNA, 75 bp, Artificial Sequence
  Synthetic
cctctcttgtatcggctcctccagatgatgatgatctgtggttaccccctccggaatatgttccgttgaaggagc

SEQ ID NO: 283542 - DNA, 75 bp, Artificial Sequence
  Synthetic
acttgtaccggtgttgtgacagaagccgagacctacaccaactttgtcggttatgtcaccaccacattcaagaga

SEQ ID NO: 283543 - DNA, 75 bp, Artificial Sequence
  Synthetic
atatggaactaaaggtgggatacatctctgccataaaggtgaacgggttcacttgtaccggtgttgtgacagaag

SEQ ID NO: 283544 - DNA, 75 bp, Artificial Sequence
  Synthetic
tctccagaactcatgagttttttcaaaagtcttggatctattattcagacagatccgacctcatcgggttgtggg

SEQ ID NO: 283545 - DNA, 75 bp, Artificial Sequence
  Synthetic
ttccacaagaactttgaagaagagataaggaggatgtttgaaccgggacaagagaccgcagttcctcactcctat

SEQ ID NO: 283546 - DNA, 75 bp, Artificial Sequence
  Synthetic
gctattgaggagggggcatccaaactggggctcatcataaagaaggaagagaccatgtgtagctatgactttctc

SEQ ID NO: 283547 - DNA, 75 bp, Artificial Sequence
  Synthetic
gatggccggtgatcccagatatgaagattctcttcaaaatccttatcctgattaccattggctacggaccgtaaa

SEQ ID NO: 283548 - DNA, 75 bp, Artificial Sequence
  Synthetic
gattctcttcaaaatccttatcctgattaccattggctacggaccgtaaagaccaccaaggagtcgctcgttatt

SEQ ID NO: 283549 - DNA, 75 bp, Artificial Sequence
  Synthetic
taaggaggatgtttgaaccgggacaagagaccgcagttcctcactcctatttcatccacttccggtctttgggcc

SEQ ID NO: 283550 - DNA, 75 bp, Artificial Sequence
  Synthetic
ccgagacctacacaaactttgtaggttatgtcactaccacattcaagagaaagcacttccgcccgatgccagatg

SEQ ID NO: 283551 - DNA, 75 bp, Artificial Sequence
  Synthetic
ctcattcattttgttggatgttatatgggtcaagtgaggtctttgaacgccacagttattgcaacatgtgctcca

SEQ ID NO: 283552 - DNA, 75 bp, Artificial Sequence
  Synthetic
tgggtcaagtgaggtctttgaacgccacagttattgcaacatgtgctccacatgagatgtctgttcttggaggtt

SEQ ID NO: 283553 - DNA, 75 bp, Artificial Sequence
  Synthetic
gtggatgaaaggggcttatacaagtctctcaaaggagcatgcaaactcaagctgtgcggagtccccgggattagg

SEQ ID NO: 283554 - DNA, 75 bp, Artificial Sequence
  Synthetic
aactctgattgacagtgatgtagaatcttttctagtccacaagatggtggatgatcttgagttacagaggggaac

SEQ ID NO: 283555 - DNA, 75 bp, Artificial Sequence
  Synthetic
agagacgagaaagaacttcaggaatacgaggcagcagagttgacaaagactgaagccgctctggcagatgacgga

SEQ ID NO: 283556 - DNA, 75 bp, Artificial Sequence
  Synthetic
actgctcaaccaaccatgattacaccatctggatgcccgtagaaccaagacttggaacatcttgtgatattttta

SEQ ID NO: 283557 - DNA, 75 bp, Artificial Sequence
  Synthetic
atgtcagttgtggtctgacatgtctcttcaaacacaaagatctgatgaggacaaagactcttcaatgctgctgga

SEQ ID NO: 283558 - DNA, 75 bp, Artificial Sequence
  Synthetic
ctttactcgccttctcgaggatcctactaccctaaatattaaaggaggggccagtcctaccattcttctcaaaga

SEQ ID NO: 283559 - DNA, 75 bp, Artificial Sequence
  Synthetic
acgaggcagcagagttgacaaagactgaagccgctctggcagatgacggaacagtcgactctgacgacgaagact

SEQ ID NO: 283560 - DNA, 75 bp, Artificial Sequence
  Synthetic
ccagtcctaccattcttctcaaagatgcaatcagaaaagccctatatgatgaggtagacaaagtggagaactcag

SEQ ID NO: 283561 - DNA, 75 bp, Artificial Sequence
  Synthetic
gatgcactggagtccatcatgaccaccaaatcagtgagcttcagacgtctcagccacttgaggaagcttgttcct

SEQ ID NO: 283562 - DNA, 75 bp, Artificial Sequence
  Synthetic
atgaatggaggccgactcaaaagatcgcacataagaagatatgtctcagtcagttccaatcatcaagcccgcccc

SEQ ID NO: 283563 - DNA, 75 bp, Artificial Sequence
  Synthetic
agtttagagaagcgatcctcttgtccaagacccatagggataactttatacttttcttgaagtctgtggagcctt

SEQ ID NO: 283564 - DNA, 75 bp, Artificial Sequence
  Synthetic
gggtttgggaaggcatacaccatattcaacaagaccttaatggaagctgatgctcattacaagtcagttaagact

SEQ ID NO: 283565 - DNA, 75 bp, Artificial Sequence
  Synthetic
gtgccctcctgatcgattagtgaatctacacgactttcactcggatgaactagaacatcttgttgtagaggaatt

SEQ ID NO: 283566 - DNA, 75 bp, Artificial Sequence
  Synthetic
tttacattttgagcctcttggatgtgaaaaaaactattaacatccctcaaaagatctaagaaaagatgatccctc

SEQ ID NO: 283567 - DNA, 75 bp, Artificial Sequence
  Synthetic
cactaaattgtgtacttccttcatgaaaaaaactaacacccctccttttgaaccatcccgaacatgagcaagatc

SEQ ID NO: 283568 - DNA, 75 bp, Artificial Sequence
  Synthetic
tagaacatcttgttgtagaggaattgatcaagaggagggaaaattgtctagatgcactggagtccatcatgacca

SEQ ID NO: 283569 - DNA, 75 bp, Artificial Sequence
  Synthetic
cgcacataagaagatatgtctcagtcagttccaatcatcaagcccgccccaactcgttcgctgagtttctaaaca

SEQ ID NO: 283570 - DNA, 75 bp, Artificial Sequence
  Synthetic
aaaaaaactaacacccctccttttgaaccatcccgaacatgagcaagatcttcgtcaaccctagcgcgatcaggg

SEQ ID NO: 283571 - DNA, 75 bp, Artificial Sequence
  Synthetic
ttccccatctacacgataccagaaaaactaggcccttggagtcccatcgacatacatcacctcagttgccctaac

SEQ ID NO: 283572 - DNA, 75 bp, Artificial Sequence
  Synthetic
aggaacatcgaagataatcaggcccatcttcaaggagaacccatagaggtagacagtctccctgatgacatgaga

SEQ ID NO: 283573 - DNA, 75 bp, Artificial Sequence
  Synthetic
gcaacagtctgtcagggttttcttacatggaactgaaggtgggatacatctcttccataaaagtgaatgggttca

SEQ ID NO: 283574 - DNA, 75 bp, Artificial Sequence
  Synthetic
cggcttcaattagatgatgaaaagtcttctggtcttggcgaggcagccaaggcaggggagagcaagtgtcaggat

SEQ ID NO: 283575 - DNA, 75 bp, Artificial Sequence
  Synthetic
tcacccccctgtgaacggagtattcttcaatggtataattttgggtccagatggaaatgttctgatccctgagat

SEQ ID NO: 283576 - DNA, 75 bp, Artificial Sequence
  Synthetic
atggagctgttagagtcttctgttatccctctgatgcatcccttggcggacccatcaacagtcttcaaggaaggt

SEQ ID NO: 283577 - DNA, 75 bp, Artificial Sequence
  Synthetic
acgcttaacgacaaaatcagagaagaagtagacagtgtcgtttacagagcaaaaatgtaacacccctacaatgga

SEQ ID NO: 283578 - DNA, 75 bp, Artificial Sequence
  Synthetic
gattcctcaagatatggtctcagacagtggaggagatcatatcatatgtcacagtcaactttcccagtcctccgg

SEQ ID NO: 283579 - DNA, 75 bp, Artificial Sequence
  Synthetic
agtggaggagatcatatcatatgtcacagtcaactttcccagtcctccggggaagccctctgaagacaaggccac

SEQ ID NO: 283580 - DNA, 75 bp, Artificial Sequence
  Synthetic
ttaccattggctacgaacagtaaaaaccaccaaagagtctcttgttattatatcgccaagtgtggctgatctgga

SEQ ID NO: 283581 - DNA, 75 bp, Artificial Sequence
  Synthetic
cccatcaacagtcttcaaggaaggtgatgaggcggaagactttgttgaggttcatcttccagatgtccacaaaca

SEQ ID NO: 283582 - DNA, 75 bp, Artificial Sequence
  Synthetic
aacgggaaagtcaatcatccaaagtcaaaatggcagctcaaacagcctctggccctcatgcattagaatggtctg

SEQ ID NO: 283583 - DNA, 75 bp, Artificial Sequence
  Synthetic
gatctcttggggaagaaaagtggtaggcacgacagttcctcacccttctgagatgttggggttacttcccaagtc

SEQ ID NO: 283584 - DNA, 75 bp, Artificial Sequence
  Synthetic
tgggaataacaatctcttccacctactgctccactaaccatgattacactatctggatgcctgaagaggcaagac

SEQ ID NO: 283585 - DNA, 75 bp, Artificial Sequence
  Synthetic
atctggatgcctgaagaggcaagacttggaacctcttgtgacatttttactaacagcaaagggaagagagcatcc

SEQ ID NO: 283586 - DNA, 75 bp, Artificial Sequence
  Synthetic
caaaatggcagctcaaacagcctctggccctcatgcattagaatggtctgccgccaatgaggaagaagatctgtc

SEQ ID NO: 283587 - DNA, 75 bp, Artificial Sequence
  Synthetic
tggtgctctcatccctcaaggactgataccaaaggtcatgaacaatccaaatggaaactcagataactctctgct

SEQ ID NO: 283588 - DNA, 75 bp, Artificial Sequence
  Synthetic
acaaattcccatccagatcttccgggatattcttgtataattttgagcagctaaagatgaaccttgatgacatag

SEQ ID NO: 283589 - DNA, 75 bp, Artificial Sequence
  Synthetic
tgagactgggctgtgaaggtgagtcatccccttcacactatgcatttagaagattgcatctctttgagatttgag

SEQ ID NO: 283590 - DNA, 75 bp, Artificial Sequence
  Synthetic
tctaaaaggggcatgcaaacttaaactgtgcggagttcctggacttagacttatggatggaacttgggtctcaat

SEQ ID NO: 283591 - DNA, 75 bp, Artificial Sequence
  Synthetic
gatattcttgtataattttgagcagctaaagatgaaccttgatgacatagtcaaagagtcaaagaatgtgccagg

SEQ ID NO: 283592 - DNA, 75 bp, Artificial Sequence
  Synthetic
ggatcctatcttcttgacagttcctcatggaccctgtgcaactggatagacttaagagtgaagaaactttcatta

SEQ ID NO: 283593 - DNA, 75 bp, Artificial Sequence
  Synthetic
tcgggtgggttgctctagccagttccaggaagttccagattctggttgagcctgacaagctaaacaaaataatgc

SEQ ID NO: 283594 - DNA, 75 bp, Artificial Sequence
  Synthetic
caggaagttccagattctggttgagcctgacaagctaaacaaaataatgcaagatgacttgaaccgttatgtgtc

SEQ ID NO: 283595 - DNA, 75 bp, Artificial Sequence
  Synthetic
atcatctcaactaattaagcacagtcatgttgattctggtaatatatgacgtcctctgacagtatcatttactaa

SEQ ID NO: 283596 - DNA, 75 bp, Artificial Sequence
  Synthetic
tgatcgagccccaacgtgaaaaaaacaggcaacaccactgatacaatgaacttcctacgcaaaatagtgaaaaat

SEQ ID NO: 283597 - DNA, 75 bp, Artificial Sequence
  Synthetic
caggcaacaccactgatacaatgaacttcctacgcaaaatagtgaaaaattgcagagatgaggacaccaataagc

SEQ ID NO: 283598 - DNA, 75 bp, Artificial Sequence
  Synthetic
gtgcctaagcgtcggagggaggtgctaccctcatgtgagcggagtgtttttcaatggtataattctgggtccgga

SEQ ID NO: 283599 - DNA, 75 bp, Artificial Sequence
  Synthetic
ctgggccatccaagcctttcagtcaagaaaaaaactgtggaatggaggagtaattgacaacacttctcctcctga

SEQ ID NO: 283600 - DNA, 75 bp, Artificial Sequence
  Synthetic
ccagaatatgtccccttgaaggagctcacaggaaagaaaaacatgagaaacttctgcattaacggggaagtcaaa

SEQ ID NO: 283601 - DNA, 75 bp, Artificial Sequence
  Synthetic
agaaaaaaactgtggaatggaggagtaattgacaacacttctcctcctgacaacggcactatgatgattgatcca

SEQ ID NO: 283602 - DNA, 75 bp, Artificial Sequence
  Synthetic
tcacaggaaagaaaaacatgagaaacttctgcattaacggggaagtcaaagtatgcagtccaaatggatactctt

SEQ ID NO: 283603 - DNA, 75 bp, Artificial Sequence
  Synthetic
aatcaaagaatgatcggattggttaaagttgttgttggactggccttgtcgggagccccggtccctgagggtatg

SEQ ID NO: 283604 - DNA, 75 bp, Artificial Sequence
  Synthetic
atgaggcggaggactttgttgaggttcaccttccggacgttaaagaacaggtctcaggggttgacctcggtctcc

SEQ ID NO: 283605 - DNA, 75 bp, Artificial Sequence
  Synthetic
aagttgttgttggactggccttgtcgggagccccggtccctgagggtatgaactgggtttataaattgagaagaa

SEQ ID NO: 283606 - DNA, 75 bp, Artificial Sequence
  Synthetic
ccatcaacagtcttcaaggacggtgatgaggcggaggactttgttgaggttcaccttccggacgttaaagaacag

SEQ ID NO: 283607 - DNA, 75 bp, Artificial Sequence
  Synthetic
aaaacagggaataggccactccggatgaccttgacagacaactgctctaggtcttacaaagttctgaaagattac

SEQ ID NO: 283608 - DNA, 75 bp, Artificial Sequence
  Synthetic
agagttgattatgataaagcatttgggaggtatctggccaacatatactcttcttatttattctttcatgtgatc

SEQ ID NO: 283609 - DNA, 75 bp, Artificial Sequence
  Synthetic
ttggaatactctcaagagattacatgggatgatgatacagagttcgtcgggctgcaaatgcgggtaagtgcaagg

SEQ ID NO: 283610 - DNA, 75 bp, Artificial Sequence
  Synthetic
gttgcagaagggccaatagaacaaaatcaatacaacaaggtcctagggagtcaggaaggaaagtatcagttcctc

SEQ ID NO: 283611 - DNA, 75 bp, Artificial Sequence
  Synthetic
atcaatacaacaaggtcctagggagtcaggaaggaaagtatcagttcctccccaaaacgggaaagtcatatcttc

SEQ ID NO: 283612 - DNA, 75 bp, Artificial Sequence
  Synthetic
atgtcaactgtggtctgacatgtcccttcaaacacagaggtctgatgaggataaagactcttccgtgcttttgga

SEQ ID NO: 283613 - DNA, 75 bp, Artificial Sequence
  Synthetic
gccggaagtgtataactgacttggctcagttttattccaagtcctcccctatagaaaagctgttgaactgcacac

SEQ ID NO: 283614 - DNA, 75 bp, Artificial Sequence
  Synthetic
tctcctctgtaccttgtgttcagaagatcgcctctctttgagatcaggggggatctcttgacttaacagtccttc

SEQ ID NO: 283615 - DNA, 75 bp, Artificial Sequence
  Synthetic
cttcaaacacagaggtctgatgaggataaagactcttccgtgcttttggagtagttacagtacatcccacaagtt

SEQ ID NO: 283616 - DNA, 75 bp, Artificial Sequence
  Synthetic
caggtttggctgatctagagatggcagaggaaactgtagatctaatcgctaggaacatcgaggacaatcaggctc

SEQ ID NO: 283617 - DNA, 75 bp, Artificial Sequence
  Synthetic
gatcgcctctctttgagatcaggggggatctcttgacttaacagtccttcatggactccgcgcaacggggtaggt

SEQ ID NO: 283618 - DNA, 75 bp, Artificial Sequence
  Synthetic
aggaacatcgaggacaatcaggctcatctccaaggagaacccatagaggtggacagtctccctgaagacatgaga

SEQ ID NO: 283619 - DNA, 75 bp, Artificial Sequence
  Synthetic
gttatggtgccgttgaatcgctgcattttatcagagtcaacttaactacacttgcattttaagcctcttagatgt

SEQ ID NO: 283620 - DNA, 75 bp, Artificial Sequence
  Synthetic
atgtagattctgatagtgtatgatatcttctgactgtatctgtgaccaatggtgctctcatctcccagggattga

SEQ ID NO: 283621 - DNA, 75 bp, Artificial Sequence
  Synthetic
atcaccctttatatgaacgccttggactgggatgaggagaaaaccatcctagcactgtggagagacataacatca

SEQ ID NO: 283622 - DNA, 75 bp, Artificial Sequence
  Synthetic
tcttctgactgtatctgtgaccaatggtgctctcatctcccagggattgataccaaaggttgtggacaatccaac

SEQ ID NO: 283623 - DNA, 75 bp, Artificial Sequence
  Synthetic
tcaagagtcgagaaactttcattaatcatctcaactgatcatacacagtcatgtagattttgataaagtatgatg

SEQ ID NO: 283624 - DNA, 75 bp, Artificial Sequence
  Synthetic
aagctctcctatttgtgcctcttctgatcccaccagtgtgcctggggaagttcccgatctacacaatcccagaca

SEQ ID NO: 283625 - DNA, 75 bp, Artificial Sequence
  Synthetic
gatcccaccagtgtgcctggggaagttcccgatctacacaatcccagacaagctaggtccttggagtcctattga

SEQ ID NO: 283626 - DNA, 75 bp, Artificial Sequence
  Synthetic
ttcctctacaatagactgaataggggttaactgagagaagtgatttgcctcctatgaaggacacaagcaatagat

SEQ ID NO: 283627 - DNA, 75 bp, Artificial Sequence
  Synthetic
cctatgaaggacacaagcaatagattataatcatcttgcatcccgataaggtgtgcacaactacaaggggtcggg

SEQ ID NO: 283628 - DNA, 75 bp, Artificial Sequence
  Synthetic
ctccagagcccagatattcagatgacctgatatcccagttgtgtcaactgtatatcgccggagatcaagttttgt

SEQ ID NO: 283629 - DNA, 75 bp, Artificial Sequence
  Synthetic
gcagtaatctatcagggttttcttacatggaattgaaggtaggatatatttctgccataaaagtggacggattca

SEQ ID NO: 283630 - DNA, 75 bp, Artificial Sequence
  Synthetic
catggaattgaaggtaggatatatttctgccataaaagtggacggattcacttgcactggcgtggttacagaagc

SEQ ID NO: 283631 - DNA, 75 bp, Artificial Sequence
  Synthetic
agtcatcaaaatattagagccatacgttgtgaacagcttggttcagagggcagagaaatttaggcctctcattca

SEQ ID NO: 283632 - DNA, 75 bp, Artificial Sequence
  Synthetic
acaatcatcaaagattggagtcaacagaggatgtgttctctgtcttggatcaagtgtttggattgaaaagggtgt

SEQ ID NO: 283633 - DNA, 75 bp, Artificial Sequence
  Synthetic
cagagaaatttaggcctctcattcactctctgggggatttccctgtgtttataagagataaggtgggtcagcttg

SEQ ID NO: 283634 - DNA, 75 bp, Artificial Sequence
  Synthetic
aacacttccgcccgatgcctgatgcctgcagatctgcatataactggaaaatagcaggtgatcccaggtatgaag

SEQ ID NO: 283635 - DNA, 75 bp, Artificial Sequence
  Synthetic
gcaccatgatgatcgatccaggggaggtttatgatgaccccattgatccaattgagccagatgctgagccaagag

SEQ ID NO: 283636 - DNA, 75 bp, Artificial Sequence
  Synthetic
gtatcttgattcacgacttctctcaagagaccaccccctgattccttatataaggactcaaacgtggcctcccaa

SEQ ID NO: 283637 - DNA, 75 bp, Artificial Sequence
  Synthetic
ctgcagatctgcatataactggaaaatagcaggtgatcccaggtatgaagagtcccttcatactccttatcctga

SEQ ID NO: 283638 - DNA, 75 bp, Artificial Sequence
  Synthetic
agttaatgttagaatggttaaaaacaggaaataggcctctccggatgactctaacagacaattgctctagatctt

SEQ ID NO: 283639 - DNA, 75 bp, Artificial Sequence
  Synthetic
tatcaccaagtgtggctgacctggacccatatgacaagtcccttcattcaatggttttccctaatgggaaatgtt

SEQ ID NO: 283640 - DNA, 75 bp, Artificial Sequence
  Synthetic
cccatatgacaagtcccttcattcaatggttttccctaatgggaaatgttcgggaataacggtctactctactta

SEQ ID NO: 283641 - DNA, 75 bp, Artificial Sequence
  Synthetic
taagtcctatcaagagtgtttggcaagcgacctggccagaaggatcctcaggtggggatttgataagtattccaa

SEQ ID NO: 283642 - DNA, 75 bp, Artificial Sequence
  Synthetic
tcgggacatcctgtgacatctttaccaacagcagggggaagagggcatccaaaggaggcaggacttgcggatttg

SEQ ID NO: 283643 - DNA, 75 bp, Artificial Sequence
  Synthetic
aaagtcatcatcacggctctttccaaacctccggtcaaccccagagaattcctaaaatctatagaccttggagga

SEQ ID NO: 283644 - DNA, 75 bp, Artificial Sequence
  Synthetic
caacagcagggggaagagggcatccaaaggaggcaggacttgcggatttgtggatgaaagaggcttgtataagtc

SEQ ID NO: 283645 - DNA, 75 bp, Artificial Sequence
  Synthetic
atataaagactcaaacatggcctcccaaacacatagtagatttggtgggggacacatggcataagctccctatca

SEQ ID NO: 283646 - DNA, 75 bp, Artificial Sequence
  Synthetic
tcatggatgggacttgggccacaatccagacaccggaagagaccaaatggtgttctcccgaccagctggtgaatc

SEQ ID NO: 283647 - DNA, 75 bp, Artificial Sequence
  Synthetic
ccagacaccggaagagaccaaatggtgttctcccgaccagctggtgaatctgcatgattttcattcagatgagat

SEQ ID NO: 283648 - DNA, 75 bp, Artificial Sequence
  Synthetic
cctttacatgaacgccttggactgggatgaggagaagaccatcctggcactgtggagggatttgacctcagtaga

SEQ ID NO: 283649 - DNA, 75 bp, Artificial Sequence
  Synthetic
agggatgtttgaaagaaggttcttcagagatgagaaggagcttcaagaatatgaggcggctgaactgacaaagac

SEQ ID NO: 283650 - DNA, 75 bp, Artificial Sequence
  Synthetic
tgaacaaggtgttcaagaagctgattgacagagttactggacagggacttttagactattcaagggttacatatg

SEQ ID NO: 283651 - DNA, 75 bp, Artificial Sequence
  Synthetic
atacactagagtctattatgaccactaaatcagtcagtttcagacgtctcagccacttgaggaaacttgttcctg

SEQ ID NO: 283652 - DNA, 75 bp, Artificial Sequence
  Synthetic
tcggtctcaagcctaaggaaagggagctaaaaattgaaggtcggttctttgcattgatgtcctggaatctgaggt

SEQ ID NO: 283653 - DNA, 75 bp, Artificial Sequence
  Synthetic
caacaagaccttgatggaggctgatgcccactacaagtcggtgcggacttggaacgagattatcccctcaaaagg

SEQ ID NO: 283654 - DNA, 75 bp, Artificial Sequence
  Synthetic
aactgggtatacaaattgaggagaacacttatcttccaatgggctgattctaggggccctcttgaaggggaggag

SEQ ID NO: 283655 - DNA, 75 bp, Artificial Sequence
  Synthetic
ggaacgagattatcccctcaaaagggtgtctgagagtgggagggagatgtcatcctcatgtgaatggagtgttct

SEQ ID NO: 283656 - DNA, 75 bp, Artificial Sequence
  Synthetic
gtgtctgagagtgggagggagatgtcatcctcatgtgaatggagtgttcttcaatggtgtgattatgggtcctga

SEQ ID NO: 283657 - DNA, 75 bp, Artificial Sequence
  Synthetic
aaatccttacaatgagatgatcataactctgattgacagtgatgtagaatcttttctagtccacaagatggtgga

SEQ ID NO: 283658 - DNA, 75 bp, Artificial Sequence
  Synthetic
tggagctgctggagtcgtctgtaatccccctaatacatcctctggcagacccatccacagtcttcaaagacaatg

SEQ ID NO: 283659 - DNA, 75 bp, Artificial Sequence
  Synthetic
ccccctaatacatcctctggcagacccatccacagtcttcaaagacaatgatgaggctgaggactttgttgaagt

SEQ ID NO: 283660 - DNA, 75 bp, Artificial Sequence
  Synthetic
agataaggtgggtcaacttgaaggaacatttggtcctagtgcaaagaggttcttcaaggctctagatcaattcga

SEQ ID NO: 283661 - DNA, 75 bp, Artificial Sequence
  Synthetic
tgtcgccagggctctcaagagaagggcttctctacgagttggagagcatatccagaaatgctctctcaatctatc

SEQ ID NO: 283662 - DNA, 75 bp, Artificial Sequence
  Synthetic
ccagctggggaaggtatttggtgatgattgccggtgctctgatgactctaactctggtaatcttcttgatgatat

SEQ ID NO: 283663 - DNA, 75 bp, Artificial Sequence
  Synthetic
cagacaggtctgacctcatcgggttgtgggaggatcaaatatactgtctggacatgtcaaacggcccgacgtgct

SEQ ID NO: 283664 - DNA, 75 bp, Artificial Sequence
  Synthetic
cttgtcgaagctatacgatcaagtccacatcaagaaggtgatagataagtcctatcaggagtgtttggcaagcga

SEQ ID NO: 283665 - DNA, 75 bp, Artificial Sequence
  Synthetic
gattgccggtgctctgatgactctaactctggtaatcttcttgatgatatgttgcaggagagtcaacaaagcagg

SEQ ID NO: 283666 - DNA, 75 bp, Artificial Sequence
  Synthetic
cccagaacgggaaggtcatatcttcatgggagtcctataagagtggaagcgaaactcggctgtgagggcatgtta

SEQ ID NO: 283667 - DNA, 75 bp, Artificial Sequence
  Synthetic
atgggagtcctataagagtggaagcgaaactcggctgtgagggcatgttatttcctctatgccttgtgttcagaa

SEQ ID NO: 283668 - DNA, 75 bp, Artificial Sequence
  Synthetic
agcttggcccctggagcccgatcgacatacatcatctcagctgtcccaacaatttggttgtggaagacgaagggt

SEQ ID NO: 283669 - DNA, 75 bp, Artificial Sequence
  Synthetic
gattcctcaagatatggtcaaagaccgtagaggagattatatcctatgtcacggtcaactttcccaaccctccag

SEQ ID NO: 283670 - DNA, 75 bp, Artificial Sequence
  Synthetic
cttcactgactctgtacgaaggggtggattaagaaaatgagggatttttcattaatcatcttgactaatcggaca

SEQ ID NO: 283671 - DNA, 75 bp, Artificial Sequence
  Synthetic
caaattggggctcatcataaagaaagaagagaccatgtgtagctatgactttctcatctacggaaaaacccctct

SEQ ID NO: 283672 - DNA, 75 bp, Artificial Sequence
  Synthetic
atattcgagatcccagaatcaatggacccatctgagatattagatgataaatcacactcctttactagaacaaga

SEQ ID NO: 283673 - DNA, 75 bp, Artificial Sequence
  Synthetic
tagtcatgtggatcctgataatgtataaagtatctcaacagcatcagcgactaatggtgctatcaccttccaagg

SEQ ID NO: 283674 - DNA, 75 bp, Artificial Sequence
  Synthetic
acagactactggccgagagctcaagaaggagacaacatctactcctcctcagagagaaagccagccttcaaaagc

SEQ ID NO: 283675 - DNA, 75 bp, Artificial Sequence
  Synthetic
ggtcattatcacggctctttccaggcctcctgtcaaccccagagaattcttgaaatccatagaccttggaggatt

SEQ ID NO: 283676 - DNA, 75 bp, Artificial Sequence
  Synthetic
gaggagggccggtccccagcgaaaaggtcattatcacggctctttccaggcctcctgtcaaccccagagaattct

SEQ ID NO: 283677 - DNA, 75 bp, Artificial Sequence
  Synthetic
tgttttagcttgggcaaagcctaggacaagtccctctagaccaaacaggggtcaactgagagaagtgatttgcct

SEQ ID NO: 283678 - DNA, 75 bp, Artificial Sequence
  Synthetic
cctatgaaggacacaagtaatggatcataatcatctcacatccgagtaaggtgtgcataaccggagaggcctgag

SEQ ID NO: 283679 - DNA, 75 bp, Artificial Sequence
  Synthetic
cagagtttacaaaatcctgagtacagagggggacaattttcttctagccatgtctaggatcatctatttagaccc

SEQ ID NO: 283680 - DNA, 75 bp, Artificial Sequence
  Synthetic
tgtctaggatcatctatttagacccctcattggggggagtgtctgggatgtcccttggaaggttccacatacgtc

SEQ ID NO: 283681 - DNA, 75 bp, Artificial Sequence
  Synthetic
aacaccacttctcatcctgagaactgtaccataatgattgacccaggggatgtttacgatgaccctgttgatctg

SEQ ID NO: 283682 - DNA, 75 bp, Artificial Sequence
  Synthetic
ggccagtcctaccattcttctcaaagatgcaattaggagagctttatatgatgaggtagacaaagtggagaactc

SEQ ID NO: 283683 - DNA, 75 bp, Artificial Sequence
  Synthetic
tcccttggaaggttccacatacgtcagttctcggatcctgtttcagaagggttgtctttttggagggagatctgg

SEQ ID NO: 283684 - DNA, 75 bp, Artificial Sequence
  Synthetic
gtaccataatgattgacccaggggatgtttacgatgaccctgttgatctgattgaatcagaggtcgagccaaaag

SEQ ID NO: 283685 - DNA, 75 bp, Artificial Sequence
  Synthetic
tccctctagatgataaaaactgaaatgtcctggagtcgacatgaaaaaaacaggcaacaccactgataaaatgaa

SEQ ID NO: 283686 - DNA, 75 bp, Artificial Sequence
  Synthetic
tcccctttaattgaagatccagctaaattgatgttggaatggttgaaaacaggaaacagacctctccggatgact

SEQ ID NO: 283687 - DNA, 75 bp, Artificial Sequence
  Synthetic
ctttctacgtaagatagtgaaaaactgtagggatgaggacactcaaaagccctctcctgtgtcagcccctccgga

SEQ ID NO: 283688 - DNA, 75 bp, Artificial Sequence
  Synthetic
tctccagaactcatgagttttttcagaagtcttggatctattactcagatagatccgacctcatcgggctgtggg

SEQ ID NO: 283689 - DNA, 75 bp, Artificial Sequence
  Synthetic
gagagcttcactcgcctgctagaggaccccactaccctgaatatcaagggaggggccagtcctaccattcttctc

SEQ ID NO: 283690 - DNA, 75 bp, Artificial Sequence
  Synthetic
ctgacagacaactgttccaggtcttacaaagttctgaaagattatttcaagaaagtggacttaggatctctcaaa

SEQ ID NO: 283691 - DNA, 75 bp, Artificial Sequence
  Synthetic
gaagtcttggatctattactcagatagatccgacctcatcgggctgtgggaggatcaaatatactgtttagacat

SEQ ID NO: 283692 - DNA, 75 bp, Artificial Sequence
  Synthetic
gtgggtggagctgcagcacaatccatgatctctctctggctacacggtgctcactctgaatcaaccaggagccgg

SEQ ID NO: 283693 - DNA, 75 bp, Artificial Sequence
  Synthetic
tgatctctctctggctacacggtgctcactctgaatcaaccaggagccggaaatgtataactgacttagcccagt

SEQ ID NO: 283694 - DNA, 75 bp, Artificial Sequence
  Synthetic
ttatacttttcttaaagtctgtcgagcctctgttccctcgatttctcagtgaactatttagttcttcctttttag

SEQ ID NO: 283695 - DNA, 75 bp, Artificial Sequence
  Synthetic
ggattcctgagtcaatcattgggttgatacagaactccagaacaataagaagacagtttcggaggagtctctcaa

SEQ ID NO: 283696 - DNA, 75 bp, Artificial Sequence
  Synthetic
aatagagggctgagaatccccccagaaggggtacttagctgtctagagagggtggattacgataaagcatttgga

SEQ ID NO: 283697 - DNA, 75 bp, Artificial Sequence
  Synthetic
tcgccggggctatctcgagaggggcttctctacgagttggagagcatatcaaggaatgcgctctcaatatatcgt

SEQ ID NO: 283698 - DNA, 75 bp, Artificial Sequence
  Synthetic
aaggggtacttagctgtctagagagggtggattacgataaagcatttggaaggtatctggctaacatatattctt

SEQ ID NO: 283699 - DNA, 75 bp, Artificial Sequence
  Synthetic
ctcagagatccatgggattaaccggatgacccagactccccaaagggtcggaagggtatggccttgctcctctga

SEQ ID NO: 283700 - DNA, 75 bp, Artificial Sequence
  Synthetic
gatgaggagaaaaccatcctcgcactgtggagggacttaacctcagtagacacgggaaaggacttggtcaagttt

SEQ ID NO: 283701 - DNA, 75 bp, Artificial Sequence
  Synthetic
tgaaaagagccctgtcactcaaggaatctataaactggttcattaccagaaactcaaatctggcccaaactctga

SEQ ID NO: 283702 - DNA, 75 bp, Artificial Sequence
  Synthetic
caacagtccctcacccctctgagatgttggggttgatcccaaagtcctctatttcctgcacttgtggagcatcgg

SEQ ID NO: 283703 - DNA, 75 bp, Artificial Sequence
  Synthetic
aactcaaatctggcccaaactctgattagaaacataatgtctctgacaggcccggactttccactagaagaagcc

SEQ ID NO: 283704 - DNA, 75 bp, Artificial Sequence
  Synthetic
cacgggaaaggacttggtcaagtttaaagatcaaatatgggggcatctgattgtgaccaaagacttcatatattc

SEQ ID NO: 283705 - DNA, 75 bp, Artificial Sequence
  Synthetic
tgagggactttttactcatgtcagtacaagctgtcttccattacttgttgtttagccccatcttgaaaggtagag

SEQ ID NO: 283706 - DNA, 75 bp, Artificial Sequence
  Synthetic
accttttcttatctcggttcaactctctaatgattttgctatccccccctgaaccacgatactctgatgatttga

SEQ ID NO: 283707 - DNA, 75 bp, Artificial Sequence
  Synthetic
tctaatgattttgctatccccccctgaaccacgatactctgatgatttgatatctctactgtgtcagctatacat

SEQ ID NO: 283708 - DNA, 75 bp, Artificial Sequence
  Synthetic
catgtcgacccagctattccacgcatgggagaaagtcacaaatgttcatgtggtgaaaagagccctgtcactcaa

SEQ ID NO: 283709 - DNA, 75 bp, Artificial Sequence
  Synthetic
taaaaatcttggagccttacgttgtgaacagtttagtcaatagagcggagagatttaggcctctcatccattctt

SEQ ID NO: 283710 - DNA, 75 bp, Artificial Sequence
  Synthetic
gaacagtttagtcaatagagcggagagatttaggcctctcatccattctttaggagatttcccttcatttataag

SEQ ID NO: 283711 - DNA, 75 bp, Artificial Sequence
  Synthetic
ctttctggagagagatttggctaagttccaatgaatcttggattcatgctctgtgtcaagaagcaggaaacccag

SEQ ID NO: 283712 - DNA, 75 bp, Artificial Sequence
  Synthetic
gatcctatcttcttgacagtccttcgtggaccctgtgcaacaggatggactcaagagtcaagaaactttcatcaa

SEQ ID NO: 283713 - DNA, 75 bp, Artificial Sequence
  Synthetic
caagcttggcccctggagcccgattgatatacaccatctcagctgtccaaataacttggtcgtggaggacgaagg

SEQ ID NO: 283714 - DNA, 75 bp, Artificial Sequence
  Synthetic
tttttaaggttctagaccaattcgacaacatacatgatttagtttttgtatatggctgttataggcactgggggc

SEQ ID NO: 283715 - DNA, 75 bp, Artificial Sequence
  Synthetic
cttcactcgcttgcttgaggatcccactaccctaaatattaagggaggggccagtcctaccattcttctcaaaga

SEQ ID NO: 283716 - DNA, 75 bp, Artificial Sequence
  Synthetic
caacatacatgatttagtttttgtatatggctgttataggcactgggggcacccttatatagattacaggagggg

SEQ ID NO: 283717 - DNA, 75 bp, Artificial Sequence
  Synthetic
aactatgactttatgtttcaaccgttgatgctttatgcacagacatggacatccgaactggtgcaaaaggacaca

SEQ ID NO: 283718 - DNA, 75 bp, Artificial Sequence
  Synthetic
tgcaatcagaaaggccctgtatgatgaggtagacaaggtggagaactcagagtttagggaagcgatcctcttgtc

SEQ ID NO: 283719 - DNA, 75 bp, Artificial Sequence
  Synthetic
cacttgtacaggtgttgtgacagaggcagaaacttacaccaactttgtcggttatgtcacaaccacattcaagag

SEQ ID NO: 283720 - DNA, 75 bp, Artificial Sequence
  Synthetic
cttatcaggagtgtttggcgagtgatctggccaagaggatcctcaggtggggatttgataaatactccaagtggt

SEQ ID NO: 283721 - DNA, 75 bp, Artificial Sequence
  Synthetic
tctggccaagaggatcctcaggtggggatttgataaatactccaagtggtatcttgatccgagacttttagcaaa

SEQ ID NO: 283722 - DNA, 75 bp, Artificial Sequence
  Synthetic
tgtttccccgatttctcagtgaactcttcagttcatctttcttggggattcctgagtcaatcattgggttgatac

SEQ ID NO: 283723 - DNA, 75 bp, Artificial Sequence
  Synthetic
atatcgtagatttagtaggtgacacctggcacaggcttccaatcacacaaatcttcgagatccctgagtcaatgg

SEQ ID NO: 283724 - DNA, 75 bp, Artificial Sequence
  Synthetic
ctggcacaggcttccaatcacacaaatcttcgagatccctgagtcaatggacccatctgagatattggatgataa

SEQ ID NO: 283725 - DNA, 75 bp, Artificial Sequence
  Synthetic
caaacatcaacatcaacagacctctcgaactgatctcaggagtgatttcatatatcctcttaagactggataatc

SEQ ID NO: 283726 - DNA, 75 bp, Artificial Sequence
  Synthetic
gtttaggaggagtctctcgagaaccttggaagagtccttttataactcagagatccatgggatcaatcggatgac

SEQ ID NO: 283727 - DNA, 75 bp, Artificial Sequence
  Synthetic
tactgctcaactaaccatgattacaccatttggatgcccgagaatccgagactagggacatcttgtgacattttt

SEQ ID NO: 283728 - DNA, 75 bp, Artificial Sequence
  Synthetic
gtccctcacccctctgagatgttggggttgcttcccaaatcctcgatttcctgcacttgtggagtaacaggaggt

SEQ ID NO: 283729 - DNA, 75 bp, Artificial Sequence
  Synthetic
cttcagcatgtattgcgctacgaacgagaagcaatcacagcatctccggagaatgactggttatggatattctca

SEQ ID NO: 283730 - DNA, 75 bp, Artificial Sequence
  Synthetic
gaggaggacctgttcccagcgagaaggtcattattacagctctttctaagccccctgtcaaccccagagaattct

SEQ ID NO: 283731 - DNA, 75 bp, Artificial Sequence
  Synthetic
ggtcattattacagctctttctaagccccctgtcaaccccagagaattcttgaaatctatagacctgggagggtt

SEQ ID NO: 283732 - DNA, 75 bp, Artificial Sequence
  Synthetic
tgcttccttctttcgatcattcattcttttcgagaggctctctaaaggggtacctgggctcatcaacttccatgt

SEQ ID NO: 283733 - DNA, 75 bp, Artificial Sequence
  Synthetic
aaatcgagggccggtttttcgccttgatgtcttggaatctgagattatattttgttatcacagagaagcttttgg

SEQ ID NO: 283734 - DNA, 75 bp, Artificial Sequence
  Synthetic
aaagagtggatctaggatctctcaaagttggcggggctgctgcacagtcgatgatctctctttggctgtacggtg

SEQ ID NO: 283735 - DNA, 75 bp, Artificial Sequence
  Synthetic
gatgtcttggaatctgagattatattttgttatcacagagaagcttttggccaattacatcttgccactgtttga

SEQ ID NO: 283736 - DNA, 75 bp, Artificial Sequence
  Synthetic
aaaagagctctgtctcttaaggaatctataaactggttcatcacaagaaactcaaatctggcccaaactttgatt

SEQ ID NO: 283737 - DNA, 75 bp, Artificial Sequence
  Synthetic
ggtgaagacaccctagagtcagacgaagacatccaaaggctgctgaaagactccttacgcaggacaaggtgggtg

SEQ ID NO: 283738 - DNA, 75 bp, Artificial Sequence
  Synthetic
acagagtcaccggacaggggctcttagattattcaagagtcacatatgctttccatctagactatgaaaagtgga

SEQ ID NO: 283739 - DNA, 75 bp, Artificial Sequence
  Synthetic
ggagaatgactggttatggatattctcagactttagaagctctaagatgacatacctgactctgatcacctacca

SEQ ID NO: 283740 - DNA, 75 bp, Artificial Sequence
  Synthetic
ttccatctagactatgaaaagtggaacaatcatcagaggctggaatcgactgaggatgtgttctctgtacttgat

SEQ ID NO: 283741 - DNA, 75 bp, Artificial Sequence
  Synthetic
tcttatttattctttcacgtgatcaccctttacatgaacgccttggactgggatgaggagaagaccatcctagca

SEQ ID NO: 283742 - DNA, 75 bp, Artificial Sequence
  Synthetic
aaagtcttggatatactactcagacagatccgatctcattggattgtgggaggaccagatatattgtttagacat

SEQ ID NO: 283743 - DNA, 75 bp, Artificial Sequence
  Synthetic
gtcaaatggtccgacttgctggaacggccaagatggcgggctggagggtctacgacagaagggctggagcctggt

SEQ ID NO: 283744 - DNA, 75 bp, Artificial Sequence
  Synthetic
ggggcccattacaagctcaaacctattctggatgatctcaatgtattcccatccctatgtcttgtagtcggggat

SEQ ID NO: 283745 - DNA, 75 bp, Artificial Sequence
  Synthetic
gtcatcctcatgtgaacggagtatttttcaatggtataatattggggcctgacggccatgttctaatcccagaaa

SEQ ID NO: 283746 - DNA, 75 bp, Artificial Sequence
  Synthetic
gcagggtgttcagagtgggtctgctctgcgcagcaggttgctgtttcaacctctgcaaacccagctcctgcttct

SEQ ID NO: 283747 - DNA, 75 bp, Artificial Sequence
  Synthetic
agatacttgcccagggtgacaaccaggttctatgcccgacgtacatgttgtcacctgggctttctagagagggac

SEQ ID NO: 283748 - DNA, 75 bp, Artificial Sequence
  Synthetic
tttctggagctgtgcctcattttcgaaaacttcctgatattcgtttaaaaccgggtgacttcgaatctctaagtg

SEQ ID NO: 283749 - DNA, 75 bp, Artificial Sequence
  Synthetic
gtctcaagaaggatatccaggatggtttctggagctgtgcctcattttcgaaaacttcctgatattcgtttaaaa

SEQ ID NO: 283750 - DNA, 75 bp, Artificial Sequence
  Synthetic
aatgccgccaaacttgatcctgatgatgtatgttcttacttggcagcatcaatgcagtttttcgaggggacatgt

SEQ ID NO: 283751 - DNA, 75 bp, Artificial Sequence
  Synthetic
ggttctatgcccgacgtacatgttgtcacctgggctttctagagagggacttctctatgagttggagagtatctc

SEQ ID NO: 283752 - DNA, 75 bp, Artificial Sequence
  Synthetic
tggggctcatcataaagaaagaagaaaccatgtgtagctatgattttctcatctatggaaaaacccctttatttc

SEQ ID NO: 283753 - DNA, 75 bp, Artificial Sequence
  Synthetic
tgatgttgataattttcctaatgacatgttgcggaagagtcaatcgatcagaatctaagcaacgcagtcttggtg

SEQ ID NO: 283754 - DNA, 75 bp, Artificial Sequence
  Synthetic
gattaccccagattctcttgtggagataaagcgcactgatgtagaagggaattgggccttgacaggaggcatgga

SEQ ID NO: 283755 - DNA, 75 bp, Artificial Sequence
  Synthetic
gatggatcagggggaatatcgagagcagtactcaacatgtttccggatgctaagcttgtattcaatagcttgttg

SEQ ID NO: 283756 - DNA, 75 bp, Artificial Sequence
  Synthetic
aaccatgtgtagctatgattttctcatctatggaaaaacccctttatttcgaggcaacattctagtgcctgagtc

SEQ ID NO: 283757 - DNA, 75 bp, Artificial Sequence
  Synthetic
atgttgcggaagagtcaatcgatcagaatctaagcaacgcagtcttggtgggacggggaggaaggtgtctgtcac

SEQ ID NO: 283758 - DNA, 75 bp, Artificial Sequence
  Synthetic
ttgcaaatataatgtcaacagtgtccaccaacgccttgactgtcgcacaacactcccagtctttgattaagccga

SEQ ID NO: 283759 - DNA, 75 bp, Artificial Sequence
  Synthetic
gtgaaaccagactgtgaaggccggccatccttttgacgtttcaagtcctgaagacaacctcctctcgggggtggg

SEQ ID NO: 283760 - DNA, 75 bp, Artificial Sequence
  Synthetic
catccttttgacgtttcaagtcctgaagacaacctcctctcgggggtggggggaatctctggatccaataatcct

SEQ ID NO: 283761 - DNA, 75 bp, Artificial Sequence
  Synthetic
tttagccccatcttaaagagcagagtttacaggattttgggcgctgagggagacggttttcttttagctatgtcg

SEQ ID NO: 283762 - DNA, 75 bp, Artificial Sequence
  Synthetic
ttctattccccaaaaagttcccgctgcttacccgaccacgatgaaagaaggtaacagatccattctgtgctacct

SEQ ID NO: 283763 - DNA, 75 bp, Artificial Sequence
  Synthetic
ggttcataaagcagatcaatctcactgcaaaggaggcaatactatatttcttccataagaactttgaggaagaga

SEQ ID NO: 283764 - DNA, 75 bp, Artificial Sequence
  Synthetic
tcaatcaaccgaataaccttgctaatgtctgattttgcattgtcgatagacggcccactatacctggttttcaag

SEQ ID NO: 283765 - DNA, 75 bp, Artificial Sequence
  Synthetic
aggaaggttccacatacgtcagttctcagatcccgtctccgaagggttatctttctggagagaaatctggctgag

SEQ ID NO: 283766 - DNA, 75 bp, Artificial Sequence
  Synthetic
gaggcaatcactgcatctccggagaatgactggttgtggatcttctcggactttagaagctccaagatgacatat

SEQ ID NO: 283767 - DNA, 75 bp, Artificial Sequence
  Synthetic
agggttgtttcagatgacacggtacttgggtacagaaagaggccgtagtgtgccccctgatagcggactcaacat

SEQ ID NO: 283768 - DNA, 75 bp, Artificial Sequence
  Synthetic
ttgggtacagaaagaggccgtagtgtgccccctgatagcggactcaacatgagttgattaagaaaggctatatgc

SEQ ID NO: 283769 - DNA, 75 bp, Artificial Sequence
  Synthetic
gtccagagcatttcccgcggtcacgggattcataactcagatgacatcgtctttctcatctgagctatacctcag

SEQ ID NO: 283770 - DNA, 75 bp, Artificial Sequence
  Synthetic
atctgggagagaggacactggaaagttttactcgccttctagaggaccccaccactttgaatataaaaggaggag

SEQ ID NO: 283771 - DNA, 75 bp, Artificial Sequence
  Synthetic
aatcacactctttcactagaacaagactcgcgtcatggctgtcagaaaacagagggggacctgtccccagtgaga

SEQ ID NO: 283772 - DNA, 75 bp, Artificial Sequence
  Synthetic
accactttgaatataaaaggaggagctagtcccaccattcttctcaaggatgcaatcagaagggccctgtacgat

SEQ ID NO: 283773 - DNA, 75 bp, Artificial Sequence
  Synthetic
ctaccctccgagaaatgagccttgtattattcaattgtagtagccccaagagcgagatgcagagggcccgatctc

SEQ ID NO: 283774 - DNA, 75 bp, Artificial Sequence
  Synthetic
aaagacccatagggacaattttatactttttttgaagtctgtggagccactctttcctcggtttctcagtgaact

SEQ ID NO: 283775 - DNA, 75 bp, Artificial Sequence
  Synthetic
gtgttcggaatgggtctgctctgctcaacaggttgcggtttcaacctcagctaacccagcccctgtctccgagct

SEQ ID NO: 283776 - DNA, 75 bp, Artificial Sequence
  Synthetic
atgaacggaggtcgactaaagagatcgcatatacggagatatgtctcagtcagttccaatcatcaagcccgtcca

SEQ ID NO: 283777 - DNA, 75 bp, Artificial Sequence
  Synthetic
tgctgcagtaccatgatgtacttgtccactgccttgggggatgtgcccagctttgcgagacttcatgacctgtac

SEQ ID NO: 283778 - DNA, 75 bp, Artificial Sequence
  Synthetic
agggacatttgaaagaaggttcttcagagatgagaaagaactccaagagcacgaggcggctgaactaacaaagat

SEQ ID NO: 283779 - DNA, 75 bp, Artificial Sequence
  Synthetic
ctttttttgaagtctgtggagccactctttcctcggtttctcagtgaactcttcagctcatccttcttggggatc

SEQ ID NO: 283780 - DNA, 75 bp, Artificial Sequence
  Synthetic
gtttaggaggagtctttcaagaacattagaagagtccttttacaattcagagatccacgggatcaaccggatgac

SEQ ID NO: 283781 - DNA, 75 bp, Artificial Sequence
  Synthetic
agctcattataagctcaaacctattttggatgatctcaatgtcttcccatccctatgtctggtggtaggggatgg

SEQ ID NO: 283782 - DNA, 75 bp, Artificial Sequence
  Synthetic
caggctaatgttagaatggctgaagacagggaacagaccttaccggatgactttgacagacaattgttccaggtc

SEQ ID NO: 283783 - DNA, 75 bp, Artificial Sequence
  Synthetic
ttagaagagtccttttacaattcagagatccacgggatcaaccggatgacacagactcctcagagaataggaagg

SEQ ID NO: 283784 - DNA, 75 bp, Artificial Sequence
  Synthetic
caacaggttgcggtttcaacctcagctaacccagcccctgtctccgagctggacatcagggccctctccaagaga

SEQ ID NO: 283785 - DNA, 75 bp, Artificial Sequence
  Synthetic
ttggatgatctcaatgtcttcccatccctatgtctggtggtaggggatggatcaggagggatatcaagagcggta

SEQ ID NO: 283786 - DNA, 75 bp, Artificial Sequence
  Synthetic
gggaagaaaggtggttggaacgactgtccctcacccctccgagatgctagggttacttcctaagtcctcgatctc

SEQ ID NO: 283787 - DNA, 75 bp, Artificial Sequence
  Synthetic
cagctttgcgagacttcatgacctgtacaacagacccataacctattatttcaagaaacaagtcattcgggggaa

SEQ ID NO: 283788 - DNA, 75 bp, Artificial Sequence
  Synthetic
gtccctcacccctccgagatgctagggttacttcctaagtcctcgatctcctgcacttgtggggtgacaagaggg

SEQ ID NO: 283789 - DNA, 75 bp, Artificial Sequence
  Synthetic
agaggtcttggatctattattcagacaggtccgaccttatcgggttgtgggaggatcagatatactgtctggaca

SEQ ID NO: 283790 - DNA, 75 bp, Artificial Sequence
  Synthetic
cagttccaatcatcaagctcgtccaaattcattcgccgagtttctgaacaagacgtattcgagtgactcataaga

SEQ ID NO: 283791 - DNA, 75 bp, Artificial Sequence
  Synthetic
tggcttgcaactccagcttgagtctctcttctcactggatcaggctgatctacaaaatagtaaagactaccagac

SEQ ID NO: 283792 - DNA, 75 bp, Artificial Sequence
  Synthetic
cttttccagaggccctttgaagggatatctgggctcatccacatctatgtcaacccagttgttccatgcctggga

SEQ ID NO: 283793 - DNA, 75 bp, Artificial Sequence
  Synthetic
gaaaatgtaacacctctacaatggataccgacaaaattgtattcaaagtcaataaccaggttgtctctctaaaac

SEQ ID NO: 283794 - DNA, 75 bp, Artificial Sequence
  Synthetic
ttgttggacgcctagaggacctgtccagggaaatcgagaagcatcttcgagggtacaacaggtggatcacacttg

SEQ ID NO: 283795 - DNA, 75 bp, Artificial Sequence
  Synthetic
aaggagacaacatccactccctctcagagagaaagccaatcctcgaaagccaggatggcagctcaagctgcctct

SEQ ID NO: 283796 - DNA, 75 bp, Artificial Sequence
  Synthetic
ctgaaattattgtagatcaatatgagtacaaatacccggctatcaaagacttaaaaaagcccagtatctccctgg

SEQ ID NO: 283797 - DNA, 75 bp, Artificial Sequence
  Synthetic
ctctaacttggcccaaaccctgattagaaacataatgtctctgacaggtccagactttcccctggaagaagcccc

SEQ ID NO: 283798 - DNA, 75 bp, Artificial Sequence
  Synthetic
acgcttaacaacaaaatcagagaagaagtagacagtatcatctacaaaaagaaaatgtaacacctctacaatgga

SEQ ID NO: 283799 - DNA, 75 bp, Artificial Sequence
  Synthetic
gggcactctagagagaatgtataaactggtaatcttgaacggtacactgtgaaaaaaactggatcccaatcctta

SEQ ID NO: 283800 - DNA, 75 bp, Artificial Sequence
  Synthetic
tacagagcaattcaacacctatctagagcatttcctgcggtcactggatttataactcaggtgacctcgtctttc

SEQ ID NO: 283801 - DNA, 75 bp, Artificial Sequence
  Synthetic
aatgcagctaagctagaccctgacgatgtgtgctcttacttggcagctgcaatgcagttctttgaaggaacatgt

SEQ ID NO: 283802 - DNA, 75 bp, Artificial Sequence
  Synthetic
acagcgaagggggttattcttccgtttgtcccaatctcctctctcacatttctgtcagcacagacacgatgtctg

SEQ ID NO: 283803 - DNA, 75 bp, Artificial Sequence
  Synthetic
agatcttttcttgtctcgcttcaactccttaatgattttgctttctccccctgagccccgatactcagatgactt

SEQ ID NO: 283804 - DNA, 75 bp, Artificial Sequence
  Synthetic
cctggacaacgttggggtccaaatagtcagacaaatgaggtcaggagaaagattcctcaagatatggtcacagac

SEQ ID NO: 283805 - DNA, 75 bp, Artificial Sequence
  Synthetic
cttcgagaaatgagcctggtattgttcaactgtagcagccccaagagtgagatgcagagagcccgctctctaaac

SEQ ID NO: 283806 - DNA, 75 bp, Artificial Sequence
  Synthetic
ctggtaatcttgaacggtacactgtgaaaaaaactggatcccaatccttaacctctatttgcttgattatttttc

SEQ ID NO: 283807 - DNA, 75 bp, Artificial Sequence
  Synthetic
ataaaacgtacagatgtagaagggaactgggctctaacaggaggaatggagttgactagggatcccaccattcca

SEQ ID NO: 283808 - DNA, 75 bp, Artificial Sequence
  Synthetic
cttgccaatataatgtcaacagtatccaccaatgcattgactgtagcacaacactctcagtctttgattaagccg

SEQ ID NO: 283809 - DNA, 75 bp, Artificial Sequence
  Synthetic
tgattttatgttccagccattgatgctttatgcgcagacttggacatcggagctagtgcaaaaagacgctcggct

SEQ ID NO: 283810 - DNA, 75 bp, Artificial Sequence
  Synthetic
gaacatgcatctttggttggtcttctcctgagtttgtatcgattgagcaaaatatccggacagaacacaggcaat

SEQ ID NO: 283811 - DNA, 75 bp, Artificial Sequence
  Synthetic
ccatcgacgatattacccttgagacctctcagatctttgagttcccggatgtttcaagaaggatatctagaatgg

SEQ ID NO: 283812 - DNA, 75 bp, Artificial Sequence
  Synthetic
aaaagtttaggcctctcatccactccttgggggactttcctgtgttcataaaagacaaggtgagtcaacttgaag

SEQ ID NO: 283813 - DNA, 75 bp, Artificial Sequence
  Synthetic
tgtggaggagatcatatcctatgtaacagtcaactttcccaacccttcaggaaggtctttggaggacaaatcaac

SEQ ID NO: 283814 - DNA, 75 bp, Artificial Sequence
  Synthetic
ctctcagatctttgagttcccggatgtttcaagaaggatatctagaatggtctccggggcagtaccacattttca

SEQ ID NO: 283815 - DNA, 75 bp, Artificial Sequence
  Synthetic
ctttgtgaagatcgtggaacatcacactttgatgacaactcacaaaatgtgcgctaactggagcaccataccgaa

SEQ ID NO: 283816 - DNA, 75 bp, Artificial Sequence
  Synthetic
gatagtgatgtagaatctttcctagttcacaagatggtagatgatctggagttacagagaggaactctgtccaaa

SEQ ID NO: 283817 - DNA, 75 bp, Artificial Sequence
  Synthetic
acaaagagaggtcgcgccatatagggtctgcccaagggctcttgtattcaatcttggttgcaattcacgactctg

SEQ ID NO: 283818 - DNA, 75 bp, Artificial Sequence
  Synthetic
aaatcttgagacacttcaacatatgctgcagtaccatgatgtacttgtccacagccttaggggatgtgcccagct

SEQ ID NO: 283819 - DNA, 75 bp, Artificial Sequence
  Synthetic
aactgggtatacaaactgaggagaacccttatcttccagtgggctgattccaggggccctcttgaaggggaggag

SEQ ID NO: 283820 - DNA, 75 bp, Artificial Sequence
  Synthetic
gacatgtttttctctcggattgaacatctatattcagcaatcagagtgggtacagttgtcactgcttacgaggac

SEQ ID NO: 283821 - DNA, 75 bp, Artificial Sequence
  Synthetic
ggtataatgatggcaccattttccctgttaacatatatagcaaggtctctccgagagactatctaagagggctcg

SEQ ID NO: 283822 - DNA, 75 bp, Artificial Sequence
  Synthetic
tgggctctgacaggaggcatggaactgacaagggaccccactgtctccgagcatgcatctttagttggtctcctc

SEQ ID NO: 283823 - DNA, 75 bp, Artificial Sequence
  Synthetic
agcacaggaagcaatactttatttcttccacaaaaattttgagggagagataagaagaatgtttgagccgggaca

SEQ ID NO: 283824 - DNA, 75 bp, Artificial Sequence
  Synthetic
aacatcaacatcaacaggcctcttgagcttatatcaggagtgatttcgtacatcctcttgagattggacaatcac

SEQ ID NO: 283825 - DNA, 75 bp, Artificial Sequence
  Synthetic
tgcaactctagcttgagtctctcatctcactggattaggctgatttacaaaatagtaaagacaactagacttgtc

SEQ ID NO: 283826 - DNA, 75 bp, Artificial Sequence
  Synthetic
agcttatatcaggagtgatttcgtacatcctcttgagattggacaatcacccgtctttatacatcatgcttagag

SEQ ID NO: 283827 - DNA, 75 bp, Artificial Sequence
  Synthetic
ctcactggattaggctgatttacaaaatagtaaagacaactagacttgtcggaagcatagaagacctatccgggg

SEQ ID NO: 283828 - DNA, 75 bp, Artificial Sequence
  Synthetic
tgagtgggaaatctccatattcgtcaagtgcagttggtcacgtgttcaacctcattcactttgtcggatgctata

SEQ ID NO: 283829 - DNA, 75 bp, Artificial Sequence
  Synthetic
tccttctagacaataaaatctgaggtgtcctagagtcaacatgaaaaaaacgggcaacatcactgacaaaatgaa

SEQ ID NO: 283830 - DNA, 75 bp, Artificial Sequence
  Synthetic
gcttacccgaccacgatgaaagagggcaatagatctatcttgtgttacctccaacacgtgctgcgttatgaacga

SEQ ID NO: 283831 - DNA, 75 bp, Artificial Sequence
  Synthetic
attagatctagatcatctcttctagattatagctgcttgtaatctaggctctctcgaaggaatgtatggaccaag

SEQ ID NO: 283832 - DNA, 75 bp, Artificial Sequence
  Synthetic
catgagatgtctgttctcgggggttatttgggggaggagttctttggccaggggacttttgagagaagattcttc

SEQ ID NO: 283833 - DNA, 75 bp, Artificial Sequence
  Synthetic
aaggtcatcatcacggccctgtctaagccgcctgtcaatcctcgagagtttttgaaatctatcgacctcggaggg

SEQ ID NO: 283834 - DNA, 75 bp, Artificial Sequence
  Synthetic
ttttagaagttccaaaatgacatatctaaccctcatcacataccagtctcacctcttacttcagagagttgagaa

SEQ ID NO: 283835 - DNA, 75 bp, Artificial Sequence
  Synthetic
actcttggacagtgtaccctgaaaaaaacgagatcctgattcatgacctctttttgcttgattgtttttcccatc

SEQ ID NO: 283836 - DNA, 75 bp, Artificial Sequence
  Synthetic
atgaagcagcagagttgacaaagactgaggtcgctctggcagacgacggaacagtcaattctgacgacgaagact

SEQ ID NO: 283837 - DNA, 75 bp, Artificial Sequence
  Synthetic
acagtcaattctgacgacgaagactacttctctggtgaaaccaggagtccagaggcggtctatactcggatcatg

SEQ ID NO: 283838 - DNA, 75 bp, Artificial Sequence
  Synthetic
gcagatctcttaagagagatttcgtgggggaggaaggtggtcggcacaacagtccctcacccctctgagatgtta

SEQ ID NO: 283839 - DNA, 75 bp, Artificial Sequence
  Synthetic
aacctacgacagatgagttctctaatgaggcaagtgctgggcggccatggcgaagacaccttagagtcggacgag

SEQ ID NO: 283840 - DNA, 75 bp, Artificial Sequence
  Synthetic
acttctctggtgaaaccaggagtccagaggcggtctatactcggatcatgatccatgggggccgactcaaaagat

SEQ ID NO: 283841 - DNA, 75 bp, Artificial Sequence
  Synthetic
tcaagaggtgcgccatgcagcaaaaaccatgaccgggggttatagccccaacaagaagacatcccgcaaagcggg

SEQ ID NO: 283842 - DNA, 75 bp, Artificial Sequence
  Synthetic
aattcatttgctgaatttctaaacaagacatattctaacgacccgtagggagtcgaacttcaagattgtcaacaa

SEQ ID NO: 283843 - DNA, 75 bp, Artificial Sequence
  Synthetic
gggaaaccctcgaatatcggtatctgtgcttccatcttttgatcagtcattcttctcaagaggtcccctgaaggg

SEQ ID NO: 283844 - DNA, 75 bp, Artificial Sequence
  Synthetic
accatgaccgggggttatagccccaacaagaagacatcccgcaaagcgggatgttcagaatgggtttgctctgcc

SEQ ID NO: 283845 - DNA, 75 bp, Artificial Sequence
  Synthetic
agatgagaaagaacttcaagaatatgaggcggccgaactgacgaagactgatgtagcgctggcagatgatggaac

SEQ ID NO: 283846 - DNA, 75 bp, Artificial Sequence
  Synthetic
atgcactagagtccatcatgaccaccaagtcagtgagtttcagacgtctcagtcacttaagaaaacttgtccctg

SEQ ID NO: 283847 - DNA, 75 bp, Artificial Sequence
  Synthetic
agacatcagggccctctccaaaaggcttcagaacccgttgatctctggtctgagagtggttcaatgggcaacagg

SEQ ID NO: 283848 - DNA, 75 bp, Artificial Sequence
  Synthetic
aaccatcccaagcatgagcaagatttttgtcaacccaagtgcgatccgggccggccttgctgacctagagatggc

SEQ ID NO: 283849 - DNA, 75 bp, Artificial Sequence
  Synthetic
cttcagaacccgttgatctctggtctgagagtggttcaatgggcaacaggtgcccattacaagctcaagcctatt

SEQ ID NO: 283850 - DNA, 75 bp, Artificial Sequence
  Synthetic
gaatggaggtagactgaagagatcgcatatacggagatatgtctcagtcagttccaatcatcaagcccgtccaaa

SEQ ID NO: 283851 - DNA, 75 bp, Artificial Sequence
  Synthetic
atctccaaggagagcctatagaagtagatagtctgcccgatgacatgagacggctccacttggatgatgaaaaac

SEQ ID NO: 283852 - DNA, 75 bp, Artificial Sequence
  Synthetic
atcaggggggatctcaagggccgtgctcaacatgttcccagatgccaggcttgtattcaacagcttgctggaagt

SEQ ID NO: 283853 - DNA, 75 bp, Artificial Sequence
  Synthetic
agatagtctgcccgatgacatgagacggctccacttggatgatgaaaaaccgtctggttttgacaaggtgacaaa

SEQ ID NO: 283854 - DNA, 75 bp, Artificial Sequence
  Synthetic
tacagtgaggggggttactcttccgtttgtccgaatctcctctctcatatctctgtcagcacagacacgatgtct

SEQ ID NO: 283855 - DNA, 75 bp, Artificial Sequence
  Synthetic
ctcaacatgttcccagatgccaggcttgtattcaacagcttgctggaagtgaatgatttgatggcgtcaggaaca

SEQ ID NO: 283856 - DNA, 75 bp, Artificial Sequence
  Synthetic
accccagcctcttgttccagtcatacctggataatgtcggagttcaaatagtcaggcaaatgaggtcaggagaga

SEQ ID NO: 283857 - DNA, 75 bp, Artificial Sequence
  Synthetic
cagagtgattgactttgattccatctgggagaaaccttcggacctgaggaacctgaccacttggaggtatttcca

SEQ ID NO: 283858 - DNA, 75 bp, Artificial Sequence
  Synthetic
tgggagaaaccttcggacctgaggaacctgaccacttggaggtatttccagtctgttcaggaacaagtgaatatg

SEQ ID NO: 283859 - DNA, 75 bp, Artificial Sequence
  Synthetic
ggtctggccgatcttgagatggctgaagagactgtcgatctgatcaatagaaacatagaagacaatcaggctcat

SEQ ID NO: 283860 - DNA, 75 bp, Artificial Sequence
  Synthetic
tgtggaggagatcatatcctatgtcatgatcaatttcccaggctctttggggaggccttctgaagacaaggccac

SEQ ID NO: 283861 - DNA, 75 bp, Artificial Sequence
  Synthetic
gatttcttcattgtgtttcgggaagtttcccatttacacgataccggacaaactaggtccttggagcccaattga

SEQ ID NO: 283862 - DNA, 75 bp, Artificial Sequence
  Synthetic
caacaggataactctgctaatgtctgactttgcattgtcgatagacggcccactttatttggtattcaaaactta

SEQ ID NO: 283863 - DNA, 75 bp, Artificial Sequence
  Synthetic
atgggagtcatataaaagtgggggtgagactagattgtaaaaattggtcatcctttcgacgcttccagttttgaa

SEQ ID NO: 283864 - DNA, 75 bp, Artificial Sequence
  Synthetic
tccaaccttggtgagatggccaatgtgggggaaggcaagtatcgagaggactttcagatggatgaaggagaggac

SEQ ID NO: 283865 - DNA, 75 bp, Artificial Sequence
  Synthetic
aactcgaaggtcaatcatccaaagcgagagcggcagcccaaactgcctccggtccacctgccctagaatggtctg

SEQ ID NO: 283866 - DNA, 75 bp, Artificial Sequence
  Synthetic
gactttgcattgtcgatagacggcccactttatttggtattcaaaacttacggaactatgcttgtgaatccggat

SEQ ID NO: 283867 - DNA, 75 bp, Artificial Sequence
  Synthetic
tataactcagatgacatcatccttctcatccgagctatacctaagattctctaaacggggaaagttctttcgaga

SEQ ID NO: 283868 - DNA, 75 bp, Artificial Sequence
  Synthetic
tcatccgagctatacctaagattctctaaacggggaaagttctttcgagatgcagaatatttaacctcctctacc

SEQ ID NO: 283869 - DNA, 75 bp, Artificial Sequence
  Synthetic
tcgaggagattatatcctacgtcacggtcaactttcctagtcctccaggaaggtcttcggaggataaatcaactc

SEQ ID NO: 283870 - DNA, 75 bp, Artificial Sequence
  Synthetic
tcccagagactatttaagagggctagcgagaggagtcttgatagggtcttcgatttgcttcttgaccaggatgac

SEQ ID NO: 283871 - DNA, 75 bp, Artificial Sequence
  Synthetic
ttaaagatgaaccttgatgacatagtcaaggaatcaaaaaatgtgcctggtgttacccgcttggcccatgaaggg

SEQ ID NO: 283872 - DNA, 75 bp, Artificial Sequence
  Synthetic
gatgcagagagcccgctcattaaattaccaggacttagtcagaggatttcccgaggaaatcatatctaaccccta

SEQ ID NO: 283873 - DNA, 75 bp, Artificial Sequence
  Synthetic
ccgaggaaatcatatctaacccctataatgagatgatcataactctgatcgacagcgatgtagaatctttccttg

SEQ ID NO: 283874 - DNA, 75 bp, Artificial Sequence
  Synthetic
cagaaagttccagctgctggtcgagcctgacaagctaaataaaataatgcaagacgacctaaaccgttatttgtc

SEQ ID NO: 283875 - DNA, 75 bp, Artificial Sequence
  Synthetic
tgtcctaaagtcaacatgaaaaaaacaggcaacaccactgataaaatgaactttctacgtaagatagtgaaaaac

SEQ ID NO: 283876 - DNA, 75 bp, Artificial Sequence
  Synthetic
attacagcgaggaactttgtccaaagtctctatcatcatagccatagtgatagtcttctctaacagggtgttcaa

SEQ ID NO: 283877 - DNA, 75 bp, Artificial Sequence
  Synthetic
tcccattatgcaatcaaatccagtctgatccaaagtcaacgtgaaaaaaacaggcaacaccactaatacaatgaa

SEQ ID NO: 283878 - DNA, 75 bp, Artificial Sequence
  Synthetic
ctgcctgactaaccatgaatacaccatttggatgccagagaatctgagactagggacgtcttgtgacattttcac

SEQ ID NO: 283879 - DNA, 75 bp, Artificial Sequence
  Synthetic
tagtcttctctaacagggtgttcaatgtctcaaaacctctgacagaccctttattctatcctccatctgacccca

SEQ ID NO: 283880 - DNA, 75 bp, Artificial Sequence
  Synthetic
tttctatcccccaaaaggttcctgctgcttacccgactacaatgaaagaaggtaacagatccatcctgtgctatc

SEQ ID NO: 283881 - DNA, 75 bp, Artificial Sequence
  Synthetic
atttggatgccagagaatctgagactagggacgtcttgtgacattttcactaatagcagaggtaagagagcatcc

SEQ ID NO: 283882 - DNA, 75 bp, Artificial Sequence
  Synthetic
cttctctcgcatcggcccccccagatgatgatgatctgtggttgccccctccagaatatgtcccattgaaggagc

SEQ ID NO: 283883 - DNA, 75 bp, Artificial Sequence
  Synthetic
accgccttgggggatgtgcccagctttgcgagacttcatgacctgtacaacagaccgataatttattatttcaag

SEQ ID NO: 283884 - DNA, 75 bp, Artificial Sequence
  Synthetic
ggatgggtcgctttggccaattctaagaaatttcaattgctagtcgaggctgacaagctaagtaaaatcatgcaa

SEQ ID NO: 283885 - DNA, 75 bp, Artificial Sequence
  Synthetic
tgatgatgatctgtggttgccccctccagaatatgtcccattgaaggagctcacagggaagaagaacatgagaaa

SEQ ID NO: 283886 - DNA, 75 bp, Artificial Sequence
  Synthetic
tactcttcctaaaatctgttgaacctctgttccctcgatttctcagtgagctcttcagttcgtcttttttgggaa

SEQ ID NO: 283887 - DNA, 75 bp, Artificial Sequence
  Synthetic
ttaggatcctgcgtcacattctgaaatcgtttgatgagatctattccggaaatcaaagaatgattgggttagtca

SEQ ID NO: 283888 - DNA, 75 bp, Artificial Sequence
  Synthetic
cacctcagtgttcaagagggtggcttgcaactctagcctgagtctttcctcccactggatcagactgatttacaa

SEQ ID NO: 283889 - DNA, 75 bp, Artificial Sequence
  Synthetic
cagtttagaaagagtctctcaagaactttagaagagtccttctacaactcggagatccacgggattaatcggatg

SEQ ID NO: 283890 - DNA, 75 bp, Artificial Sequence
  Synthetic
atcgtttgatgagatctattccggaaatcaaagaatgattgggttagtcaaagttgtggtcggattggccttgtc

SEQ ID NO: 283891 - DNA, 75 bp, Artificial Sequence
  Synthetic
agataaagaagcaccttcgaggatacaacagatggatcactttagatgatgttaaatccagatcatccctcctag

SEQ ID NO: 283892 - DNA, 75 bp, Artificial Sequence
  Synthetic
ctcttattttccaatgggcagactctaggggtcctctggaaggggaagagttggagtactctcaggaaattaggt

SEQ ID NO: 283893 - DNA, 75 bp, Artificial Sequence
  Synthetic
taggggtcctctggaaggggaagagttggagtactctcaggaaattaggtgggacgatgacaccgaatttgtagg

SEQ ID NO: 283894 - DNA, 75 bp, Artificial Sequence
  Synthetic
acgatgacctgtggcttccacctcctgaatacgtcccgctgaaagagctcacaagcaagaagaacatgaggaact

SEQ ID NO: 283895 - DNA, 75 bp, Artificial Sequence
  Synthetic
caacaaaaccttgatggaggctgatgctcactacaagtcagttcggacctggaacgagattatcccatctaaagg

SEQ ID NO: 283896 - DNA, 75 bp, Artificial Sequence
  Synthetic
attcttgaagggtgtaccctgaaaaaaacgagacactgattcattacctctatttgcttgattatttctcctttt

SEQ ID NO: 283897 - DNA, 75 bp, Artificial Sequence
  Synthetic
tcaacgggataatactgggacctgacggccatgttctaatcccagagatgcaatcatctctcctccagcaacata

SEQ ID NO: 283898 - DNA, 75 bp, Artificial Sequence
  Synthetic
ggtgcattaacatgaactctagagcatgtcaattgtggtctgatatgtcccttcaaactcatagatctgaggagg

SEQ ID NO: 283899 - DNA, 75 bp, Artificial Sequence
  Synthetic
atgtcaattgtggtctgatatgtcccttcaaactcatagatctgaggaggacaaagactcctcagtccttctaga

SEQ ID NO: 283900 - DNA, 75 bp, Artificial Sequence
  Synthetic
cttatcttccagtgggctgattccaggggccctcttgaaggagaggagttggaatattctcaagagatcacttgg

SEQ ID NO: 283901 - DNA, 75 bp, Artificial Sequence
  Synthetic
gtctcaggggttgacttgggtctcccgaactgggggaagtatatattagtgagtgctggggctctgattgccttg

SEQ ID NO: 283902 - DNA, 75 bp, Artificial Sequence
  Synthetic
ataagacgtaccaatgtggaagggagttgggctctaacagggggtatggagttgacaagagatcccactgttcca

SEQ ID NO: 283903 - DNA, 75 bp, Artificial Sequence
  Synthetic
caacatacatgacttagtctttgtgtatggctgttacaggcattgggggcacccctatatagattatagaaaggg

SEQ ID NO: 283904 - DNA, 75 bp, Artificial Sequence
  Synthetic
attgcactttaagcctcttggatgtgaaaaaaactattaacatccctcaaaagacctgaggaaagatggtccctt

SEQ ID NO: 283905 - DNA, 75 bp, Artificial Sequence
  Synthetic
atccacacaacacagccttggagaaacagagagaaagatgtcagtcactccccaaagcgggaagatcatatcttc

SEQ ID NO: 283906 - DNA, 75 bp, Artificial Sequence
  Synthetic
gtcctatgaccttatcatttgtgatgcggaggtcactgacattgcatcaatcaaccgaataaccctgctaatgtc

SEQ ID NO: 283907 - DNA, 75 bp, Artificial Sequence
  Synthetic
acagagagaaagatgtcagtcactccccaaagcgggaagatcatatcttcctgggagtcatataagagtggaggt

SEQ ID NO: 283908 - DNA, 75 bp, Artificial Sequence
  Synthetic
ttccctatctacacaataccagacaagcctggtccttggagtcctatcgacatacatcatctcagttgtcccaat

SEQ ID NO: 283909 - DNA, 75 bp, Artificial Sequence
  Synthetic
catacatcatctcagttgtcccaataatcttgttgtggaagacgaggggtgtaatagtctgtcggggttttctta

SEQ ID NO: 283910 - DNA, 75 bp, Artificial Sequence
  Synthetic
atggcacaagctcccgatcacgcaaatctttgagattcctgaatcaatggacccgtcagaaatactggatgataa

SEQ ID NO: 283911 - DNA, 75 bp, Artificial Sequence
  Synthetic
tgagcgggaagtctccatactcatcaaatgcggttggtcatgttttcaacctcattcactttgttggatgttaca

SEQ ID NO: 283912 - DNA, 75 bp, Artificial Sequence
  Synthetic
tcttctagcagtttcagtgaccaaaggtgctttcattttccaagagctaataccaaaggttgtggacaggccaga

SEQ ID NO: 283913 - DNA, 75 bp, Artificial Sequence
  Synthetic
cgagacctacactaacttcgttggttatgtcaccaccacattcaagagaaaacactttcgcccgatgcccgatgc

SEQ ID NO: 283914 - DNA, 75 bp, Artificial Sequence
  Synthetic
taccaaaggttgtggacaggccagagggtgtttcggatgactccgtacccgggcatggacagaggtcatagtgcg

SEQ ID NO: 283915 - DNA, 75 bp, Artificial Sequence
  Synthetic
gaccaggtgattttgaatctctaagtggtagagaaaagtctcgccatatagggtcggctcaggggctcttatact

SEQ ID NO: 283916 - DNA, 75 bp, Artificial Sequence
  Synthetic
agtcccttcacaacccataccctgattatcattggctgcggacagttaaaaccaccaaggagtctctaatcatca

SEQ ID NO: 283917 - DNA, 75 bp, Artificial Sequence
  Synthetic
acttggttgtggaggatgaaggatgtaccaacctgtcagggttctcctacatggagcttaaagtgggatacatct

SEQ ID NO: 283918 - DNA, 75 bp, Artificial Sequence
  Synthetic
tctcgccaagtgtggctgacctagatccgtatgacaaatcccttcattcaaggatttttcctggggggaaatgca

SEQ ID NO: 283919 - DNA, 75 bp, Artificial Sequence
  Synthetic
cgggtctaacagtctcttccacctactgctcgaccaaccatgactacaccatctggatgcctgaaaaagcagggc

SEQ ID NO: 283920 - DNA, 75 bp, Artificial Sequence
  Synthetic
aggaacatcgaggataatcaggctcatctccaaggagaacctatagaggtggacagtctccccgaagacatgaga

SEQ ID NO: 283921 - DNA, 75 bp, Artificial Sequence
  Synthetic
ctgctcgaccaaccatgactacaccatctggatgcctgaaaaagcagggctcgggacatcttgtgacatcttcac

SEQ ID NO: 283922 - DNA, 75 bp, Artificial Sequence
  Synthetic
tggacgagagaggtttgtataagtccttgaaaggagcttgtaagctcaagctgtgcggagtttctgggcttagac

SEQ ID NO: 283923 - DNA, 75 bp, Artificial Sequence
  Synthetic
cagcttattgatgatagatagagaatctcagaccaggaacacaagaaccaagatactagctcaaggagacaacca

SEQ ID NO: 283924 - DNA, 75 bp, Artificial Sequence
  Synthetic
ccaccaaggaatctctcgtgatcatatctccaagtgtggcagacttggatccatatgacaaatcccttcactcga

SEQ ID NO: 283925 - DNA, 75 bp, Artificial Sequence
  Synthetic
ctgtgcggagtttctgggcttagacttatagatggaacttgggttgcgattcagacattggatgaaaccaaatgg

SEQ ID NO: 283926 - DNA, 75 bp, Artificial Sequence
  Synthetic
tgcatgacttccactcggatgagcttgagcatcttgttgtagaggagttggttagaaagagggaggaatgtctgg

SEQ ID NO: 283927 - DNA, 75 bp, Artificial Sequence
  Synthetic
tgagcatcttgttgtagaggagttggttagaaagagggaggaatgtctggatgcattagaatccatcatgaccac

SEQ ID NO: 283928 - DNA, 75 bp, Artificial Sequence
  Synthetic
ggtttgggaaggcatacaccatattcaacaaaaccctaatggaggccgatgcccactacaagtccgttcggactt

SEQ ID NO: 283929 - DNA, 75 bp, Artificial Sequence
  Synthetic
ccgctaatgaagaggatgatccatctgtagaggctgaaattgctcatcagattgccgagagcttctccaaaaagt

SEQ ID NO: 283930 - DNA, 75 bp, Artificial Sequence
  Synthetic
atgacattcaacgattactaaaagactcgctgcgaaggacaaggtgggtggatcaggaggtgcgccacgcagcta

SEQ ID NO: 283931 - DNA, 75 bp, Artificial Sequence
  Synthetic
caacaaaaccctaatggaggccgatgcccactacaagtccgttcggacttggagcgagatcatcccctcaaaagg

SEQ ID NO: 283932 - DNA, 75 bp, Artificial Sequence
  Synthetic
aaaaaacgggatcccaattcttaacctctatttgcttgattgtttttccatctttattgtttttttgttaagcgt

SEQ ID NO: 283933 - DNA, 75 bp, Artificial Sequence
  Synthetic
ggttgattatgataaggcgtttgggaggtatctggccaacacatattcctcttacctgtttttccatgtgatcac

SEQ ID NO: 283934 - DNA, 75 bp, Artificial Sequence
  Synthetic
tcaatggcatcattctaggtccggacgggcatgtgttgatcccagaaatgcagtcatcccttctccaacaacatg

SEQ ID NO: 283935 - DNA, 75 bp, Artificial Sequence
  Synthetic
cgggcatgtgttgatcccagaaatgcagtcatcccttctccaacaacatgtggaactgttggagtcctccgtgat

SEQ ID NO: 283936 - DNA, 75 bp, Artificial Sequence
  Synthetic
gcacgactttcgctcggacgagattgagcatctcgttgtagaggagttggtcaagaaaagagaggagtgtctgga

SEQ ID NO: 283937 - DNA, 75 bp, Artificial Sequence
  Synthetic
caagaagttccagctgttagttgagcccgacaagctaaataaaataatgcaagacgacctgaaccgttacgcatt

SEQ ID NO: 283938 - DNA, 75 bp, Artificial Sequence
  Synthetic
acgaggcagaggattttgttgaggttcatctcccagatgttcacaaacagatctcaggggtggacctaggcctcc

SEQ ID NO: 283939 - DNA, 75 bp, Artificial Sequence
  Synthetic
aatgctgccaagcttgaccctgatgatgtatgttcctacttagcagctgcgatgcagttctttgaagggacatgt

SEQ ID NO: 283940 - DNA, 75 bp, Artificial Sequence
  Synthetic
gaatgagatcatcccctcaaaagggtgtttaagagttggagggaggtgtcatcctcatgtgaacggggtgttttt

SEQ ID NO: 283941 - DNA, 75 bp, Artificial Sequence
  Synthetic
caagctggggaaagtatatgctgatgattgcaggtgctctaacgactctaatgctgttcatcttcttgatgacat

SEQ ID NO: 283942 - DNA, 75 bp, Artificial Sequence
  Synthetic
atcctcatgtgaacggggtgtttttcaatggtataatactggggcctgatggccatgttctaatcccagaaatgc

SEQ ID NO: 283943 - DNA, 75 bp, Artificial Sequence
  Synthetic
aatcagagaatgatcgggttggtcaaagttgtcgttggattggcgttgtcaggagccccagtcccggagggtatg

SEQ ID NO: 283944 - DNA, 75 bp, Artificial Sequence
  Synthetic
gattgcaggtgctctaacgactctaatgctgttcatcttcttgatgacatgttgcaaaagggtcaacaggacaaa

SEQ ID NO: 283945 - DNA, 75 bp, Artificial Sequence
  Synthetic
caatggtataatactggggcctgatggccatgttctaatcccagaaatgcaatcatccctcctccagcaacatat

SEQ ID NO: 283946 - DNA, 75 bp, Artificial Sequence
  Synthetic
cccaaaacaaaaaagtcgtatcttcatgggagtcttacaagagcggaggcgagaccaagctgtaaggagggctgc

SEQ ID NO: 283947 - DNA, 75 bp, Artificial Sequence
  Synthetic
tgaggctgaggattttgttgaagttcacctccccgatgtgcacaagcaggtctcaggagttgatctgggtctccc

SEQ ID NO: 283948 - DNA, 75 bp, Artificial Sequence
  Synthetic
actgttcccctctgatacatggaagaatatcctgccttgacaatcccccacggactctgtccaacagggtaaatt

SEQ ID NO: 283949 - DNA, 75 bp, Artificial Sequence
  Synthetic
aaactgggggaagtatgtgttgatgagtgcaggagtcctgattgccctgatgttgataatttttctaatgacatg

SEQ ID NO: 283950 - DNA, 75 bp, Artificial Sequence
  Synthetic
cgcactgactatgacagacaacctgaacaaggtgtttaaaaagttgatcgacagggtcactgggcaagggctttt

SEQ ID NO: 283951 - DNA, 75 bp, Artificial Sequence
  Synthetic
gtgccaattggagtactataccaaacttcagattcttggcagggacctacgacatgtttttctcccggattgagc

SEQ ID NO: 283952 - DNA, 75 bp, Artificial Sequence
  Synthetic
ggtggactttgatgatgtatgaagcatttttacagtatcagcgactaatggtgctctcaccctctaaggactggt

SEQ ID NO: 283953 - DNA, 75 bp, Artificial Sequence
  Synthetic
gacatgtttttctcccggattgagcacctgtattcagcaatcagagtaggcacggtagtcactgcttatgaggac

SEQ ID NO: 283954 - DNA, 75 bp, Artificial Sequence
  Synthetic
ctataaactggttcattactagaaactccaacttggctcaaactctgattaggaacattatgtctctgacaggcc

SEQ ID NO: 283955 - DNA, 75 bp, Artificial Sequence
  Synthetic
atttttacagtatcagcgactaatggtgctctcaccctctaaggactggtactaaaggtagcggacaggctgacc

SEQ ID NO: 283956 - DNA, 75 bp, Artificial Sequence
  Synthetic
ggatttgataagtactctaagtggtatctagattctagattcttagcccaagaccaccccttgactccttatata

SEQ ID NO: 283957 - DNA, 75 bp, Artificial Sequence
  Synthetic
tcctctgccttaaactaaaacagtgatcagctgagaaaactgatttgcctcctatgaaggacacaagcaatagat

SEQ ID NO: 283958 - DNA, 75 bp, Artificial Sequence
  Synthetic
ataacctcctctcggggttggggggaacctctggatccaatagtcctccttgaactccattcaacagggtagatt

SEQ ID NO: 283959 - DNA, 75 bp, Artificial Sequence
  Synthetic
gatgccgagtacttgacctcttccacccttcgagagatgagccttgtgttattcaattgtagcagccccaaaagt

SEQ ID NO: 283960 - DNA, 75 bp, Artificial Sequence
  Synthetic
cctatgaaggacacaagcaatagatcacaatcatttcacatcccaataagttgtgcataactacaaagggctggg

SEQ ID NO: 283961 - DNA, 75 bp, Artificial Sequence
  Synthetic
catctcagttgatcagacatggtcgtatagattctcataatacgggagatcttctagcagtttcagtgaccaacg

SEQ ID NO: 283962 - DNA, 75 bp, Artificial Sequence
  Synthetic
aacaacacttctcatcctgaacacttcaccatgatgattgatccaggggaggtttatgatgaccccatcgatcca

SEQ ID NO: 283963 - DNA, 75 bp, Artificial Sequence
  Synthetic
ctcatccactttgttggatgctacatggggcaggtaagatccctgaatgccacggtcattgctggatgtgctcct

SEQ ID NO: 283964 - DNA, 75 bp, Artificial Sequence
  Synthetic
accaaaggttgtggacaggccaaggggtgttttgaatgactctatggttgggcgcagaaagaggtcatggtgtac

SEQ ID NO: 283965 - DNA, 75 bp, Artificial Sequence
  Synthetic
gtcgagtctgagagtgagccaagaggaaactccaatatccccaacatcttgcgaaattctgactacaatctcaac

SEQ ID NO: 283966 - DNA, 75 bp, Artificial Sequence
  Synthetic
gggaacgttcgaaaggagattcttcagagacgaaaaagaacttcaagaatatgagacggcagaattgacaaagac

SEQ ID NO: 283967 - DNA, 75 bp, Artificial Sequence
  Synthetic
tcatgaaggacataagcaatagctcataatcattttgcatttcagtaaagtgtacataattataaagggctgggt

SEQ ID NO: 283968 - DNA, 75 bp, Artificial Sequence
  Synthetic
agctgatgttagagtggctgagaacaggaaatagacctctccggatgaccctgaccgacaattgttctcggtctt

SEQ ID NO: 283969 - DNA, 75 bp, Artificial Sequence
  Synthetic
tgtacataattataaagggctgggtcatctaagcatttcagtcgagaaaaaaactgtaaaccagaagagcaacta

SEQ ID NO: 283970 - DNA, 75 bp, Artificial Sequence
  Synthetic
actgtcaattcggatgacgaggactacttctccggtgaaaccagaagcccagaagctgtttatgctcgaatcatg

SEQ ID NO: 283971 - DNA, 75 bp, Artificial Sequence
  Synthetic
aacagacctataacttattacttcagaaagcaagttattcgagggaatatttatctatcttggagttggtccgac

SEQ ID NO: 283972 - DNA, 75 bp, Artificial Sequence
  Synthetic
gtgggcggagctgcagcacaatctatgatctctctttggttatatggtgctcactctgaatcaaataggagcagg

SEQ ID NO: 283973 - DNA, 75 bp, Artificial Sequence
  Synthetic
ttctatccctcagaaaatccccgctgcttatccaaccactatgaaagaaggcaacagatcgatcttgtgttatct

SEQ ID NO: 283974 - DNA, 75 bp, Artificial Sequence
  Synthetic
gcttatccaaccactatgaaagaaggcaacagatcgatcttgtgttatctccaacatgtgctacgctatgagcga

SEQ ID NO: 283975 - DNA, 75 bp, Artificial Sequence
  Synthetic
gaagctgttaaacttcacactcgggaacagagggttgagaatcccccctgagggagtcttaagctgtcttgagag

SEQ ID NO: 283976 - DNA, 75 bp, Artificial Sequence
  Synthetic
gaagcttcctgatatccgtctgagaccaggtgattttgaatctctaagtggtagagaaaagtctcgccatatagg

SEQ ID NO: 283977 - DNA, 75 bp, Artificial Sequence
  Synthetic
ctacagattgcgtatatccttcatgaaaaaaactaacacccctccttttgaaccatcccaaatatgagcaaaatc

SEQ ID NO: 283978 - DNA, 75 bp, Artificial Sequence
  Synthetic
ggtggattacgataaggcatttgggaggtatttggccaatatatattcctcctatttgttctttcatgtgattac

SEQ ID NO: 283979 - DNA, 75 bp, Artificial Sequence
  Synthetic
tacaacagatggatcaccctcgaagatatcagatctagatcatccctgctagactacagttgtttgtgagcctga

SEQ ID NO: 283980 - DNA, 75 bp, Artificial Sequence
  Synthetic
caaagtcttgaaagattatttcaaaaaggtagatctgggctctctcagagtgggtggaactgctgcacagtcaat

SEQ ID NO: 283981 - DNA, 75 bp, Artificial Sequence
  Synthetic
tgtggagggaattgacatcagtggatatgggaaaggacttggtcaagtttaaagatcagatatggggacttctga

SEQ ID NO: 283982 - DNA, 75 bp, Artificial Sequence
  Synthetic
tatgggaaaggacttggtcaagtttaaagatcagatatggggacttctgattgtgactaaagacttcatatattc

SEQ ID NO: 283983 - DNA, 75 bp, Artificial Sequence
  Synthetic
acagagggctgagaatccccccagagggggtgttaagttgcctggagagggtcgattatgataaagcatttggga

SEQ ID NO: 283984 - DNA, 75 bp, Artificial Sequence
  Synthetic
ctgagattatcgtggatcaatatgagtacaagtaccctgctatcaaagatttgaaaaagccctgtataaccctag

SEQ ID NO: 283985 - DNA, 75 bp, Artificial Sequence
  Synthetic
acctttttttgtcccggttcaactctctgatgattttgctgtcccccccggaacccagatactcagatgacttga

SEQ ID NO: 283986 - DNA, 75 bp, Artificial Sequence
  Synthetic
tctgatgattttgctgtcccccccggaacccagatactcagatgacttgatatctcagctgtgtcagctgtacat

SEQ ID NO: 283987 - DNA, 75 bp, Artificial Sequence
  Synthetic
ggaaggcccccgacttgaacaaagcatacaaatcagttctgtcaggcatgaatgccgccaaactagatcccgatg

SEQ ID NO: 283988 - DNA, 75 bp, Artificial Sequence
  Synthetic
gatttctcaagatatggtcacaaaccgtggaggaaatcatatcttatgtcacggtcaactttcctaaccctccag

SEQ ID NO: 283989 - DNA, 75 bp, Artificial Sequence
  Synthetic
ttatttgtttttccatgtaatcaccttatacatgaatgccctagactgggacgaggaaaaaaccatcctagcatt

SEQ ID NO: 283990 - DNA, 75 bp, Artificial Sequence
  Synthetic
taaaaatcttggagccgtatgttgtaaacagcttggtctatagagcggaaaaattcaggcctcttattcactctc

SEQ ID NO: 283991 - DNA, 75 bp, Artificial Sequence
  Synthetic
aaacagcttggtctatagagcggaaaaattcaggcctcttattcactctctgggggacttccctgtttttataaa

SEQ ID NO: 283992 - DNA, 75 bp, Artificial Sequence
  Synthetic
tctttaaagtcttggatcaattcgacaacatacatgatttggtctttgtatacggttgttacaggcattgggggc

SEQ ID NO: 283993 - DNA, 75 bp, Artificial Sequence
  Synthetic
caacatacatgatttggtctttgtatacggttgttacaggcattgggggcacccttacatagactatagaaaggg

SEQ ID NO: 283994 - DNA, 75 bp, Artificial Sequence
  Synthetic
gatgatctccctttggctatacggtgcccattctgaatcaaataggagccggaagtgtataactgacttggctca

SEQ ID NO: 283995 - DNA, 75 bp, Artificial Sequence
  Synthetic
acaagtttccctctcgatcatctgggatatttttgtataactttgagcagttaaaaatgaaccttgatgacatag

SEQ ID NO: 283996 - DNA, 75 bp, Artificial Sequence
  Synthetic
atctcaactgtgccagctatacatcgctggagatcaagtcttgtccatgtgtgggaactccggctatgaagtcat

SEQ ID NO: 283997 - DNA, 75 bp, Artificial Sequence
  Synthetic
cctatcaggagtgtttagcgagtgacctggccaaaagaatcctcaggtgggggttcgacaaatactccaaatggt

SEQ ID NO: 283998 - DNA, 75 bp, Artificial Sequence
  Synthetic
cctggccaaaagaatcctcaggtgggggttcgacaaatactccaaatggtatctagatccacgacttcttgcgag

SEQ ID NO: 283999 - DNA, 75 bp, Artificial Sequence
  Synthetic
accctaatgacaactcacaaaatgtgtgctaactggagtactataccaaatttcagatttttggccggaacctac

SEQ ID NO: 284000 - DNA, 75 bp, Artificial Sequence
  Synthetic
gctggagatcaagtcttgtccatgtgtgggaactccggctatgaagtcatcaagatattggagccatatgttgtg

SEQ ID NO: 284001 - DNA, 75 bp, Artificial Sequence
  Synthetic
atatagtggatttggtaggtgatacctggcatagactcccgatcacccagatcttcgagatccctgaatcaatgg

SEQ ID NO: 284002 - DNA, 75 bp, Artificial Sequence
  Synthetic
ctggcatagactcccgatcacccagatcttcgagatccctgaatcaatggacccatcagagattttagatgacaa

SEQ ID NO: 284003 - DNA, 75 bp, Artificial Sequence
  Synthetic
gaggaggaccggttccaagcgagaaggtcattattacggctctctccaaaccgcctgtcaaccctagagagtttt

SEQ ID NO: 284004 - DNA, 75 bp, Artificial Sequence
  Synthetic
ggtcattattacggctctctccaaaccgcctgtcaaccctagagagtttttgaaatctatagaccttggggggct

SEQ ID NO: 284005 - DNA, 75 bp, Artificial Sequence
  Synthetic
tgggtcaagtcagatccctaaatgcaacggttattgccgcatgtgctcctcatgagatgtctgttctagggggct

SEQ ID NO: 284006 - DNA, 75 bp, Artificial Sequence
  Synthetic
agatcgaaggccgattttttgctttaatgtcttggaatttaaggctatacttcgttattacagagaagctcctgg

SEQ ID NO: 284007 - DNA, 75 bp, Artificial Sequence
  Synthetic
ttcgttattacagagaagctcctggccaattatatattaccactctttgatgcattaaccatgaccgacaatctg

SEQ ID NO: 284008 - DNA, 75 bp, Artificial Sequence
  Synthetic
agattattcgagggttacatatgcttttcacttggactatgagaagtggaacaatcatcagagactagaatcgac

SEQ ID NO: 284009 - DNA, 75 bp, Artificial Sequence
  Synthetic
tttcacttggactatgagaagtggaacaatcatcagagactagaatcgactgaggatgtattctccgtccttgat

SEQ ID NO: 284010 - DNA, 75 bp, Artificial Sequence
  Synthetic
acttctccggggaaaccagaagtccagaagctgtctataccaagataatgatgaatggaggtcgactaaagagat

SEQ ID NO: 284011 - DNA, 75 bp, Artificial Sequence
  Synthetic
gaaatctatagacctcggaggattgccagatgaggacttgataatcggcctcaaaccaaaggaacgagagttgaa

SEQ ID NO: 284012 - DNA, 75 bp, Artificial Sequence
  Synthetic
tcctgattgcacggaagggagacaagatcactccaaattctcttgtggacatcaaacgtactaatgtggaaggga

SEQ ID NO: 284013 - DNA, 75 bp, Artificial Sequence
  Synthetic
gaagtcttggatatattactcagatagatctgatcttataggattgtgggaggaccagatatactgtttagacat

SEQ ID NO: 284014 - DNA, 75 bp, Artificial Sequence
  Synthetic
ttgtcatcaccgagaagcttttggccaactacatcttgccactttttgacgcgctgaccatgacagacaacctga

SEQ ID NO: 284015 - DNA, 75 bp, Artificial Sequence
  Synthetic
tcctcccttctttcgatcagtcatttttttcaagaggccccctgaagggatacttgggctcttccacctccatgt

SEQ ID NO: 284016 - DNA, 75 bp, Artificial Sequence
  Synthetic
gagcatgcatcgttagttggtcttctcttgagtctgtatagattgagcaaaatatctggacagaacactggcaat

SEQ ID NO: 284017 - DNA, 75 bp, Artificial Sequence
  Synthetic
caactacatcttgccactttttgacgcgctgaccatgacagacaacctgaataaggtgtttaagaaattgattga

SEQ ID NO: 284018 - DNA, 75 bp, Artificial Sequence
  Synthetic
tacgacagaagggctggagcctggtcagcctactgatgatagatcgagagtctcagaccaggaacacaagaacta

SEQ ID NO: 284019 - DNA, 75 bp, Artificial Sequence
  Synthetic
ctataaactggttcatcaccagaaattccaacttggctcaaactctaattaggaacattatgtctctgacaggcc

SEQ ID NO: 284020 - DNA, 75 bp, Artificial Sequence
  Synthetic
ctattgattgtgtatatccatcatgaaaaaaactaacacccctccttttgaaccatcccaaacatgagcaagatc

SEQ ID NO: 284021 - DNA, 75 bp, Artificial Sequence
  Synthetic
tttgggagcaatagaacaaaaaaacatatgtaatggtgccattaaatcgctgcattttatcaaagtcaaaccaat

SEQ ID NO: 284022 - DNA, 75 bp, Artificial Sequence
  Synthetic
tttttcaagaggccccctgaagggatacttgggctcttccacctccatgtcgacccagttgttccacgcatggga

SEQ ID NO: 284023 - DNA, 75 bp, Artificial Sequence
  Synthetic
tcgcctgggctttctagagagggcctcctctacgagttggagagtatatcaagaaacgcactctcaatatatcga

SEQ ID NO: 284024 - DNA, 75 bp, Artificial Sequence
  Synthetic
agaaatatagaagacaatcaggctcatctccagggggagcctatagaagtggacaatctccctgaggacatgagg

SEQ ID NO: 284025 - DNA, 75 bp, Artificial Sequence
  Synthetic
gatcaccccggattctcttgtggacataagacgtactgatgtggaagggaattgggctctaacagggggcatgga

SEQ ID NO: 284026 - DNA, 75 bp, Artificial Sequence
  Synthetic
gccatcgaggaaggggcatctaaactggggctcattataaagaaggaggaaacaatgtgcagctatgactttctc

SEQ ID NO: 284027 - DNA, 75 bp, Artificial Sequence
  Synthetic
tggggctcattataaagaaggaggaaacaatgtgcagctatgactttctcatttatggaaaaactcccttatttc

SEQ ID NO: 284028 - DNA, 75 bp, Artificial Sequence
  Synthetic
tcttgagtttatataggttgagcaaaatctctggacagaataccggcaattacaagacaaacatcgcggatagaa

SEQ ID NO: 284029 - DNA, 75 bp, Artificial Sequence
  Synthetic
aatctctggacagaataccggcaattacaagacaaacatcgcggatagaatagagcagattttcgagacagcccc

SEQ ID NO: 284030 - DNA, 75 bp, Artificial Sequence
  Synthetic
atctctaacgaccaaatagtcaacctcgctaatataatgtcaacagtgtctactaatgctttgactgttgctcaa

SEQ ID NO: 284031 - DNA, 75 bp, Artificial Sequence
  Synthetic
cctacatggagcttaaggtgggatacatctcggccataaaagtaaacgggttcacgtgcacaggtgtggtgacag

SEQ ID NO: 284032 - DNA, 75 bp, Artificial Sequence
  Synthetic
tagagcagattttcgagacagccccctttgcaaagattgtagaacatcatactttgatgacgacccacaaaatgt

SEQ ID NO: 284033 - DNA, 75 bp, Artificial Sequence
  Synthetic
tactaatgctttgactgttgctcaacactctcagtctttgattaaaccgatgagggactttctgcttatgtcagt

SEQ ID NO: 284034 - DNA, 75 bp, Artificial Sequence
  Synthetic
gcgctaactggagtaccataccaaatttcagattcctggctggaacttatgacatgtttttctcccggattgaac

SEQ ID NO: 284035 - DNA, 75 bp, Artificial Sequence
  Synthetic
tttagccccattttaaaaggcagagtttacaaaatactgagtgctgatggggatcattttcttttagctatgtct

SEQ ID NO: 284036 - DNA, 75 bp, Artificial Sequence
  Synthetic
ctcattcactttgtgggatgttatatgggtcaagtaagatctttaaatgcaacggttattgctgcatgtgccccg

SEQ ID NO: 284037 - DNA, 75 bp, Artificial Sequence
  Synthetic
tttacaaaatactgagtgctgatggggatcattttcttttagctatgtctagaatagtttaccttgacccctcat

SEQ ID NO: 284038 - DNA, 75 bp, Artificial Sequence
  Synthetic
gtcggctcaggggctcttgtactcaattttggtggcaattcatgactcaggatacaatgatgggaccatatttcc

SEQ ID NO: 284039 - DNA, 75 bp, Artificial Sequence
  Synthetic
gtgtcaaagaggatatccagaatggtttccggagccgtgcctcactttcaaaaacttcctgatatccgtttgaga

SEQ ID NO: 284040 - DNA, 75 bp, Artificial Sequence
  Synthetic
agggacgagaaagaactgcaggaatatgaggcagctgagtcaacaaagactgatgtggccttggcagatgacgga

SEQ ID NO: 284041 - DNA, 75 bp, Artificial Sequence
  Synthetic
tcagacccggtctctgaggggttatctttttggagagagatttggttaagttcaaatgagtcttggatccatgca

SEQ ID NO: 284042 - DNA, 75 bp, Artificial Sequence
  Synthetic
cacagttgtcactgcttatgaggactgctcaggactggtgtcatttacagggtttataaagcaaataaatctcac

SEQ ID NO: 284043 - DNA, 75 bp, Artificial Sequence
  Synthetic
tgggtcaagtaagatctttaaatgcaacggttattgctgcatgtgccccgcatgagatgtctgttctcgggggtt

SEQ ID NO: 284044 - DNA, 75 bp, Artificial Sequence
  Synthetic
gatttgcttcttgacaagaatgacaaatatcaacattaatagacctcttgaattgatctcaggggtaatttcata

SEQ ID NO: 284045 - DNA, 75 bp, Artificial Sequence
  Synthetic
atttgggagagagaacactggaaagcttcacacgccttctcgaggatcccactaccctaaatataaaaggagggg

SEQ ID NO: 284046 - DNA, 75 bp, Artificial Sequence
  Synthetic
aattgatctcaggggtaatttcatatatccttctgaggctggatgatcatccctctttgtatataatgctcagag

SEQ ID NO: 284047 - DNA, 75 bp, Artificial Sequence
  Synthetic
gaagtcgataaggtggagaactccgagtttagagaagcaatcctcttgtctaagacccatagggacaactttata

SEQ ID NO: 284048 - DNA, 75 bp, Artificial Sequence
  Synthetic
ggataatctatctagatccttctttgggaggggtgtccggaatgtctcttggaaggttccatatacgtcagttct

SEQ ID NO: 284049 - DNA, 75 bp, Artificial Sequence
  Synthetic
taataaattgtgtacatccttcacgaaaaaaactaacacccctcctcttgaaccatctcagacatgagcaagatt

SEQ ID NO: 284050 - DNA, 75 bp, Artificial Sequence
  Synthetic
agtttagagaagcaatcctcttgtctaagacccatagggacaactttatacttttcttgagatctgttgagcctc

SEQ ID NO: 284051 - DNA, 75 bp, Artificial Sequence
  Synthetic
gcaacagatcgatcttgtgttatctacaacatgtgctacgctatgaaagagatgtaatcacagcgtctccagaaa

SEQ ID NO: 284052 - DNA, 75 bp, Artificial Sequence
  Synthetic
aaccatctcagacatgagcaagatttttgtcaaccccagtgcgatccgggcgggcctagctaacctagagatggc

SEQ ID NO: 284053 - DNA, 75 bp, Artificial Sequence
  Synthetic
cctgaatcgattattgggctgattcaaaattctagaacgataagaagacagtttaggaagaacctctctagaacc

SEQ ID NO: 284054 - DNA, 75 bp, Artificial Sequence
  Synthetic
ctgaccctcatcacttaccagtctcacctcctactccaaagggttgagagaagtttgtctaagagtatgagagtt

SEQ ID NO: 284055 - DNA, 75 bp, Artificial Sequence
  Synthetic
acttctccagtgaaaccaggagtccagaagcagtttacacacgaatcatgatgaatggaggtagactaaaaagat

SEQ ID NO: 284056 - DNA, 75 bp, Artificial Sequence
  Synthetic
atctccaaggagaacccatagaggtggacagtctccccgaagacatgaaacggcttcaattggaagacgagaaac

SEQ ID NO: 284057 - DNA, 75 bp, Artificial Sequence
  Synthetic
aaaattctagaacgataagaagacagtttaggaagaacctctctagaaccttagaagagtccttctataactcag

SEQ ID NO: 284058 - DNA, 75 bp, Artificial Sequence
  Synthetic
cacacataaggaggtatgtctcagtcagctctaatcatcaaactcgccctaactcgtttgcggagtttttaaaca

SEQ ID NO: 284059 - DNA, 75 bp, Artificial Sequence
  Synthetic
gtttgggcctgctcttctgagagggcagatctcctaagagaaatctcgtgggggagaaaggtggttggtacaacc

SEQ ID NO: 284060 - DNA, 75 bp, Artificial Sequence
  Synthetic
tctcagccacttgagaaaacttgtccctgggttcgggaaggcatacaccatattcaacaaaaccttgatggaagc

SEQ ID NO: 284061 - DNA, 75 bp, Artificial Sequence
  Synthetic
tattcaacaaaaccttgatggaagcagatgctcattacaagtcagtccgaacctggaatgagatcatcccctcca

SEQ ID NO: 284062 - DNA, 75 bp, Artificial Sequence
  Synthetic
atcccgccctcttgttccagtcgtacctggataatgttggagttcatatggtcagacaaatgaggtcaggagaga

SEQ ID NO: 284063 - DNA, 75 bp, Artificial Sequence
  Synthetic
attccctcgatttctcagtgagctcttcagttcatcttttttgggaatccccgagtcaatcattggactgataca

SEQ ID NO: 284064 - DNA, 75 bp, Artificial Sequence
  Synthetic
atgaggtagacaaagtggagaactcagagttcagagaagcgatcctcttgtctaagactcatagagataacttta

SEQ ID NO: 284065 - DNA, 75 bp, Artificial Sequence
  Synthetic
ggaaatcctcgaatatcagtgtctgtactcccgtcctttgatcagtcgttcttttccagaggccctctgaaggga

SEQ ID NO: 284066 - DNA, 75 bp, Artificial Sequence
  Synthetic
cagatctcctaagagaaatctcgtgggggagaaaggtggttggtacaaccgtccctcacccctctgagatgttgg

SEQ ID NO: 284067 - DNA, 75 bp, Artificial Sequence
  Synthetic
ccaacccagcccctgtctcagagctcgacataagggccctatctaagagatttcaaaaccctttaatctctggac

SEQ ID NO: 284068 - DNA, 75 bp, Artificial Sequence
  Synthetic
ggaagtcttccgaagacaaagctacccagactgtcaaccgggagctcaagaaggggacagtgtctgtttcttctc

SEQ ID NO: 284069 - DNA, 75 bp, Artificial Sequence
  Synthetic
aggaacatcgaggacaatcaggctcatctccaaggagatcccatagaggtggacagtctccccgaagacatgaga

SEQ ID NO: 284070 - DNA, 75 bp, Artificial Sequence
  Synthetic
tgaagagactgtagatctcatcgctaggaacatcgaggacaatcaggctcatctccaaggagatcccatagaggt

SEQ ID NO: 284071 - DNA, 75 bp, Artificial Sequence
  Synthetic
aaaagggccctttcactcaaagagtccataaattggttcgtcacaagaaactccaatttggctcaaactttaatc

SEQ ID NO: 284072 - DNA, 75 bp, Artificial Sequence
  Synthetic
agcgagaaagtcaattatctaaagccaaaatggtggcccaaaccgcctccggtcctccagctctggagtggtctg

SEQ ID NO: 284073 - DNA, 75 bp, Artificial Sequence
  Synthetic
cgtctggccttggcagtatagccaaagcaggggaaagcaaatgtcaggaagactttcaaatggatgaggcagagg

SEQ ID NO: 284074 - DNA, 75 bp, Artificial Sequence
  Synthetic
acaaatttcaggtgttgacctgggtctccctagctggggaaagtatgttttggtgagtgcaggggtcttggttgt

SEQ ID NO: 284075 - DNA, 75 bp, Artificial Sequence
  Synthetic
ccctctgtcttgtagttggggacggctcaggaggaatctcgaggacagtcctaaacatgtttccagatgctaagc

SEQ ID NO: 284076 - DNA, 75 bp, Artificial Sequence
  Synthetic
cgtctttaagagaacaggatcagctctgcacaggttcaagtcagctaggtacagtgaagggggttattcctccgt

SEQ ID NO: 284077 - DNA, 75 bp, Artificial Sequence
  Synthetic
ctgcacaggttcaagtcagctaggtacagtgaagggggttattcctccgtctgtcccaatctcctctctcatatt

SEQ ID NO: 284078 - DNA, 75 bp, Artificial Sequence
  Synthetic
acagtgaagggggttattcctccgtctgtcccaatctcctctctcatatttccgtcagcacagacacgatgtctg

SEQ ID NO: 284079 - DNA, 75 bp, Artificial Sequence
  Synthetic
tgagtggaggggatgacatcgtttccagagtgatagactttgactcaatctgggaaaaaccgtccgacctgagga

SEQ ID NO: 284080 - DNA, 75 bp, Artificial Sequence
  Synthetic
ccaagtctacacaacacagtctcggagggacagggaggaaggtgtcggtcacttcccaaagcgggaaggtcatat

SEQ ID NO: 284081 - DNA, 75 bp, Artificial Sequence
  Synthetic
acttaggctcgtctacctccatgtcgacccagctattccatgcatgggaaaaagtcactaatgttcatgtggtga

SEQ ID NO: 284082 - DNA, 75 bp, Artificial Sequence
  Synthetic
tcagactgttggccgcgaagtcgcgaaggagacaaagtcggcctcttctcagcgagcaagtcaaccctcaaaagt

SEQ ID NO: 284083 - DNA, 75 bp, Artificial Sequence
  Synthetic
ctttacgcacaaacatggacatcagaactggtgcagaaggacatacggctgagagactccacctttcactggcat

SEQ ID NO: 284084 - DNA, 75 bp, Artificial Sequence
  Synthetic
gtctgtccaaaaacaggtcaacatgtcctatgatctcattatttgtgatgcagaggtaactgacattgcatccat

SEQ ID NO: 284085 - DNA, 75 bp, Artificial Sequence
  Synthetic
gggggaaatctctgggttcaatagtcctccctaaactccgtgtaacagggtagattcaagagtcacgagacctcc

SEQ ID NO: 284086 - DNA, 75 bp, Artificial Sequence
  Synthetic
catacatcatctcagctgcccaaacaatttggttgtggaggacgaaggatgcaccaacctgtcagggttctccta

SEQ ID NO: 284087 - DNA, 75 bp, Artificial Sequence
  Synthetic
aatttggttgtggaggacgaaggatgcaccaacctgtcagggttctcctacatggaacttaaagttggatacatc

SEQ ID NO: 284088 - DNA, 75 bp, Artificial Sequence
  Synthetic
cgggactatgctagtaaacccagactataaggctattcaacacctgtcaagagcgttcccctcagtcacagggtt

SEQ ID NO: 284089 - DNA, 75 bp, Artificial Sequence
  Synthetic
gtttcgaaaaggatatctaggatggtctctggagcagtgcctcactttcaaaaactccctgatattcgtctaaga

SEQ ID NO: 284090 - DNA, 75 bp, Artificial Sequence
  Synthetic
tcgccaacgaagaggatgacccatctgtcgaggctgagattgctcaccagattgccgagagcttttctaagaagt

SEQ ID NO: 284091 - DNA, 75 bp, Artificial Sequence
  Synthetic
cctccctaaactccgtgtaacagggtagattcaagagtcacgagacctccatcaatcatctcagttgatcagaca

SEQ ID NO: 284092 - DNA, 75 bp, Artificial Sequence
  Synthetic
aactggtgcagaaggacatacggctgagagactccacctttcactggcatcttcgatgcaataagtgtataaggt

SEQ ID NO: 284093 - DNA, 75 bp, Artificial Sequence
  Synthetic
tctctggagcagtgcctcactttcaaaaactccctgatattcgtctaagacccggagactttgagtctctaagtg

SEQ ID NO: 284094 - DNA, 75 bp, Artificial Sequence
  Synthetic
atcctggttgcgatccacgactctgggtacaacgatggaaccatttttcctgtcaacatatatagcaaggtctcc

SEQ ID NO: 284095 - DNA, 75 bp, Artificial Sequence
  Synthetic
gctagtacagagagatacaaggttgagagattctacgtttcactggcaccttcggtgcaacaggtgtgtgaggcc

SEQ ID NO: 284096 - DNA, 75 bp, Artificial Sequence
  Synthetic
ggtacaacgatggaaccatttttcctgtcaacatatatagcaaggtctccccgagagactatttaagaggtctcg

SEQ ID NO: 284097 - DNA, 75 bp, Artificial Sequence
  Synthetic
caaaaaattccagctgttggttgagcccgacaagctaaacaaaataatgcaagatgacctaaaccgttatgcgtc

SEQ ID NO: 284098 - DNA, 75 bp, Artificial Sequence
  Synthetic
tcagccataaaggtgaacgggttcacttgcacaggcgttgtgacagaagctgaaacctacactaactttgtaggt

SEQ ID NO: 284099 - DNA, 75 bp, Artificial Sequence
  Synthetic
ctatcattggcttcgaactgtaaaaaccaccaaggagtctctcgttatcatatccccgagtgtggcggatttaga

SEQ ID NO: 284100 - DNA, 75 bp, Artificial Sequence
  Synthetic
aacatcaacatcaacagaccccttgaactaatctcaggagtgatctcatacatcctccttagattagataatcac

SEQ ID NO: 284101 - DNA, 75 bp, Artificial Sequence
  Synthetic
cctctctcttgtcggcccctccagatgatgatgacttgtggttaccccctccggaatatgttccgctgaaggagc

SEQ ID NO: 284102 - DNA, 75 bp, Artificial Sequence
  Synthetic
caactggcaacacttctcatcctcagacctagatcaagatgcttgatccaggagaggtctatgatgaccccgttg

SEQ ID NO: 284103 - DNA, 75 bp, Artificial Sequence
  Synthetic
ctcccagagactatttaagagggctcgcgagaggagtcttgatagggtcttcgatttgcttcttaacaagaatga

SEQ ID NO: 284104 - DNA, 75 bp, Artificial Sequence
  Synthetic
ttctattccacaaaagatccccgccgcttacccaaccacaatgaaagagggcaacagatctatcctgtgttacct

SEQ ID NO: 284105 - DNA, 75 bp, Artificial Sequence
  Synthetic
tagaggggcccccactgttcccaacatcttgaggaactctgattacaacctcaattctcctttgatagaagaccc

SEQ ID NO: 284106 - DNA, 75 bp, Artificial Sequence
  Synthetic
cctctctcatatcagctcctccagatgacgatgacctatggttaccccctccggaatatgttccgttgaaggagc

SEQ ID NO: 284107 - DNA, 75 bp, Artificial Sequence
  Synthetic
tcggctcaggggctattatactcaatcttggtagcaattcacgactcaggatacaatgacgggaccatcttccct

SEQ ID NO: 284108 - DNA, 75 bp, Artificial Sequence
  Synthetic
gaggtaattacggcatccccggaaaatgattggttatggatcttctctgacttcagaagttccaagatgacctat

SEQ ID NO: 284109 - DNA, 75 bp, Artificial Sequence
  Synthetic
taggggccctctagaaggggaggagttagaatactctcaggagattacctgggacgacgatgccgaatttgttgg

SEQ ID NO: 284110 - DNA, 75 bp, Artificial Sequence
  Synthetic
ttatgtggagttcttggacttagactcatggatggaacatgggttgcgatgcaaacatcagatgagaccaaatgg

SEQ ID NO: 284111 - DNA, 75 bp, Artificial Sequence
  Synthetic
gaatctctctaaaagtatgagggccaacctacgacagatgagctctctcatgagacaagtgttgggcgggcatgg

SEQ ID NO: 284112 - DNA, 75 bp, Artificial Sequence
  Synthetic
ctcactggatcaggttgatttacaagatagtaaagactacccgacttgttggcagcattgaggacctatccagag

SEQ ID NO: 284113 - DNA, 75 bp, Artificial Sequence
  Synthetic
tctatccctcagaaaatccccgctgcttacccaaccactatgaaagaaggcaatagatcgatcttgtgttaccta

SEQ ID NO: 284114 - DNA, 75 bp, Artificial Sequence
  Synthetic
ccaacttacgacaaatgagctccctgatgaggcaggtgctgggtggtcatggtgaagacaccctagaatcagacg

SEQ ID NO: 284115 - DNA, 75 bp, Artificial Sequence
  Synthetic
cattacgtaggacaagatgggtagaccaagaggtgcgtcatgcagccagagccatgacagggggttatagcccca

SEQ ID NO: 284116 - DNA, 75 bp, Artificial Sequence
  Synthetic
ttggaatattctcaggagattacctgggatgatgatgcggagtttgtcggattggaaataagagtgagtgcaaga

SEQ ID NO: 284117 - DNA, 75 bp, Artificial Sequence
  Synthetic
atcagatctagatcatccctactagactacagttgcttataaacttgatattccaggaggcctgtacacgatgag

SEQ ID NO: 284118 - DNA, 75 bp, Artificial Sequence
  Synthetic
tgaaaaaaacaattaacatccctcaaaagacctaaggaaagatgatccctcaggctcttttgtctgtgcctcttc

SEQ ID NO: 284119 - DNA, 75 bp, Artificial Sequence
  Synthetic
ttcctcttatttgtttttccacgttatcaccctatacatgaatgccctagactgggatgaggaaaagactatcct

SEQ ID NO: 284120 - DNA, 75 bp, Artificial Sequence
  Synthetic
caaatccagcccctgtctctgagctggacatcagggctctctccaaaagacttcaaaacccgttgatttcaggtc

SEQ ID NO: 284121 - DNA, 75 bp, Artificial Sequence
  Synthetic
atgtcagctatggtctgacctatccctccaaactcaaaggtctgatgaggataaggattcttcagtgcttctgga

SEQ ID NO: 284122 - DNA, 75 bp, Artificial Sequence
  Synthetic
caccctcatgtgaacggggtgtttttcaatggtataatattagggcctgacggccatgttctaatccccgagatg

SEQ ID NO: 284123 - DNA, 75 bp, Artificial Sequence
  Synthetic
gctcttggacgatgtatcttgaaaaaaacaggatcttgaatccaagcctctggttgtttgattgttttttttgtc

SEQ ID NO: 284124 - DNA, 75 bp, Artificial Sequence
  Synthetic
tgattggttgtggatcttctcagactttagaagtgccaaaatgacgtacctaacccttatcacttaccagtctca

SEQ ID NO: 284125 - DNA, 75 bp, Artificial Sequence
  Synthetic
agagcacacgggcttgaccccaactttcaggagcaatagaacaaaaatatgtcatggtgccgttgaatcgctgca

SEQ ID NO: 284126 - DNA, 75 bp, Artificial Sequence
  Synthetic
ccttatgtcttgtggtcggagacgggtcaggggggatttcaagggctgtactcaatatgtttccggacgctaggc

SEQ ID NO: 284127 - DNA, 75 bp, Artificial Sequence
  Synthetic
ggacatcagggctctctccaaaagacttcaaaacccgttgatttcaggtctgagagttgttcagtgggcaacagg

SEQ ID NO: 284128 - DNA, 75 bp, Artificial Sequence
  Synthetic
gtcaggggggatttcaagggctgtactcaatatgtttccggacgctaggctcgtgttcaacagcctgttggaagt

SEQ ID NO: 284129 - DNA, 75 bp, Artificial Sequence
  Synthetic
ttcaggagcaatagaacaaaaatatgtcatggtgccgttgaatcgctgcattttgtcagagtagactctattact

SEQ ID NO: 284130 - DNA, 75 bp, Artificial Sequence
  Synthetic
gaaaaaaactatcaacatccctcaaaagacctaaggaaagatgatccttcaggcccttctgtttgtgcctctcct

SEQ ID NO: 284131 - DNA, 75 bp, Artificial Sequence
  Synthetic
aacaggttgcagtctccacctcagccaacccggcccctatctcagaacttgacattagggccctctctaagaggt

SEQ ID NO: 284132 - DNA, 75 bp, Artificial Sequence
  Synthetic
tgagcggaggggatgatatcatatctagggtgattgactttgactccatctgggaaaagccttctgacttaagga

SEQ ID NO: 284133 - DNA, 75 bp, Artificial Sequence
  Synthetic
attaccattggctaaggactgtaaaaaccaccaaagaatcccttattatcatatcgccaagtgtggctgatttgg

SEQ ID NO: 284134 - DNA, 75 bp, Artificial Sequence
  Synthetic
tccctctagacaataaagtccgagatgtcctagagtcaacatgaaaaaaacaggcaacaccactgataaaatgaa

SEQ ID NO: 284135 - DNA, 75 bp, Artificial Sequence
  Synthetic
acttgacgacatggaggtacttccagtcagttcaagaacaggtgaatatgtcctatgatcttattatttgtgacg

SEQ ID NO: 284136 - DNA, 75 bp, Artificial Sequence
  Synthetic
acagggaggaaggtgtcggtcacttcccaaagcgggaaggtcatatcttcatgggagtcatataaaagtgggggt

SEQ ID NO: 284137 - DNA, 75 bp, Artificial Sequence
  Synthetic
cagaaaagtttaggcctctcattcactccctgggagactttcctgtatttataaaagataaggtaagtcaactcg

SEQ ID NO: 284138 - DNA, 75 bp, Artificial Sequence
  Synthetic
ttccccatctacacaataccagacaagcttggtccttggagccccatcgatatacatcacctcagctgtccaaat

SEQ ID NO: 284139 - DNA, 75 bp, Artificial Sequence
  Synthetic
aaccaccaaagaatcccttattatcatatcgccaagtgtggctgatttggacccctacgacaaatctcttcattc

SEQ ID NO: 284140 - DNA, 75 bp, Artificial Sequence
  Synthetic
cgaactgggggaaatatgtattgctgagtgcaggaaccctgattgctttgatgttgataatttttctaatgacat

SEQ ID NO: 284141 - DNA, 75 bp, Artificial Sequence
  Synthetic
cactttatttagttttcaaaacttatggaaccatgctcgtgaatcctgattacagagccgttcaacatctgtcca

SEQ ID NO: 284142 - DNA, 75 bp, Artificial Sequence
  Synthetic
tggaaccatgctcgtgaatcctgattacagagccgttcaacatctgtccagagcatttcccacagtcacaggatt

SEQ ID NO: 284143 - DNA, 75 bp, Artificial Sequence
  Synthetic
ttgtgtacggttgttacaggcattggggccatccctatatagattatagaaagggtctgtcgaaactatatgatc

SEQ ID NO: 284144 - DNA, 75 bp, Artificial Sequence
  Synthetic
gagactagactgtaaaaactggtcatccttttgatgcttcaagttctgaaggtcacctccccttggggttggggg

SEQ ID NO: 284145 - DNA, 75 bp, Artificial Sequence
  Synthetic
gtcagttcaagaacaggtgaatatgtcctatgatcttattatttgtgacgcagaggtcactgacaggacatcaat

SEQ ID NO: 284146 - DNA, 75 bp, Artificial Sequence
  Synthetic
attaccaagatcttgtaaggggatttccagatgagatcatatccaatccttacaatgaaatgatcataaccctga

SEQ ID NO: 284147 - DNA, 75 bp, Artificial Sequence
  Synthetic
ctaaaaggggaaaatttttccgagatgcagaatacttgacttcttctactattagggagatgagccttgtattgt

SEQ ID NO: 284148 - DNA, 75 bp, Artificial Sequence
  Synthetic
aatctacgcaacgcagtcttagagggacagggaggaatgtgtcagtcacctcccaaagcgggaaattcatacctt

SEQ ID NO: 284149 - DNA, 75 bp, Artificial Sequence
  Synthetic
ggtgctttcattctccagaaactgacatcaaaggtagtagacgggccaagaggtattccggatgactccgtgctt

SEQ ID NO: 284150 - DNA, 75 bp, Artificial Sequence
  Synthetic
catcaaaggtagtagacgggccaagaggtattccggatgactccgtgcttgggcacagacagaggtcatagtacg

SEQ ID NO: 284151 - DNA, 75 bp, Artificial Sequence
  Synthetic
gagttgcagcgaggaaccttgtctaaagtttcaattattgtagctataatgatagtcttttccaatagggtgttc

SEQ ID NO: 284152 - DNA, 75 bp, Artificial Sequence
  Synthetic
taaacatatagtagacttggtaggagatacgtggcataagctcccgataacgcagatctttgaaattcctgaatc

SEQ ID NO: 284153 - DNA, 75 bp, Artificial Sequence
  Synthetic
ctgaggagatcatatccaacccatataatgagatgatcataactctgattgacagtgatgtggaatctttcctgg

SEQ ID NO: 284154 - DNA, 75 bp, Artificial Sequence
  Synthetic
tttcatgatagcagactcaacatgagtcgattgagaaagacaatctgcctccaatgaaggacataagcaatagct

SEQ ID NO: 284155 - DNA, 75 bp, Artificial Sequence
  Synthetic
acaaagctattcaacatctgtctagagcgttcccatcagttacagggtttataacccaagtgacatcgtccttct

SEQ ID NO: 284156 - DNA, 75 bp, Artificial Sequence
  Synthetic
gggtttggaaaggcatatactatattcaacaaaaccttgatggaggctgatgctcactacaagtcagttcggact

SEQ ID NO: 284157 - DNA, 75 bp, Artificial Sequence
  Synthetic
tgcagaatacttgacttcttctactattagggagatgagccttgtattgttcaactgcagcagcccaaaaagtga

SEQ ID NO: 284158 - DNA, 75 bp, Artificial Sequence
  Synthetic
gaacagaggggggcctgttcccagcgagaaggtcattatcactgccttgtctaagccgcccgtcaatcccagaga

SEQ ID NO: 284159 - DNA, 75 bp, Artificial Sequence
  Synthetic
gtatccattatcgtagccatcatgatagtcttttccaacagggtgtttaatgtctcgaaaccgttgactgaccct

SEQ ID NO: 284160 - DNA, 75 bp, Artificial Sequence
  Synthetic
tggatgaaaggggcttgtacaagtctctaaaaggagcatgtaaactcaagctgtgcggagttctaggacttagac

SEQ ID NO: 284161 - DNA, 75 bp, Artificial Sequence
  Synthetic
ttattcaatccgccatctgaccccaaaatcttgagacacttcaatatttgctgcagtaccatgatgtacttgtct

SEQ ID NO: 284162 - DNA, 75 bp, Artificial Sequence
  Synthetic
ttcaatggtataattttgggtccggatgggcatatcctgattccggagatgcaatcatccctcctccaacagcat

SEQ ID NO: 284163 - DNA, 75 bp, Artificial Sequence
  Synthetic
aaatcttgagacacttcaatatttgctgcagtaccatgatgtacttgtctactgctctgggggatgttccaagct

SEQ ID NO: 284164 - DNA, 75 bp, Artificial Sequence
  Synthetic
cacgatcatcttgcatctcagcaaattgtgcataattataaagggctgggtcatctaagcttttcagtcgagaaa

SEQ ID NO: 284165 - DNA, 75 bp, Artificial Sequence
  Synthetic
gactaatgttagaatggttgaaaacagggaatagaccttatcggatgactctgacagacaattgctccaggtctt

SEQ ID NO: 284166 - DNA, 75 bp, Artificial Sequence
  Synthetic
aagaaagttatccgagggaacatttatttatcctggagttggtctgacgacacctcagtgttcaaaagggtggct

SEQ ID NO: 284167 - DNA, 75 bp, Artificial Sequence
  Synthetic
atgcattggagtccatcatgaccaccaaatctgtaagttttagacgtctcagctatttgagaaaacttgtccctg

SEQ ID NO: 284168 - DNA, 75 bp, Artificial Sequence
  Synthetic
ttcaccttccggacgttcaccaacaggtctcaggggttgacctcggtctcccagactgggggaagtatgtgctga

SEQ ID NO: 284169 - DNA, 75 bp, Artificial Sequence
  Synthetic
tgcaattctagtttgagcctctcggctcactggataaggctgatttacaaaatagtgaagactaccagacttgta

SEQ ID NO: 284170 - DNA, 75 bp, Artificial Sequence
  Synthetic
cttttggactactcgagggtcacatacgctttccaccttgactatgagaagtggaacaatcatcaaagattggag

SEQ ID NO: 284171 - DNA, 75 bp, Artificial Sequence
  Synthetic
caacaagactttgatggaggctgacgcccactacaagtcagttcggacttggaacgagatcatcccctcaaaagg

SEQ ID NO: 284172 - DNA, 75 bp, Artificial Sequence
  Synthetic
gaagagtccctacacaatccataccccgactaccactggcttcgaactgtaagaaccaccaaagagtccctcatt

SEQ ID NO: 284173 - DNA, 75 bp, Artificial Sequence
  Synthetic
tgttgcagaagggtcaagagaacagaatcagtacaacaaggtcttggtgagtcaggaaggaaagtgtcggtagct

SEQ ID NO: 284174 - DNA, 75 bp, Artificial Sequence
  Synthetic
aggtcgaaaagcaccttcgagggtacaacaggtggatcaccctagacgacataaaatccaggtcatctcttctag

SEQ ID NO: 284175 - DNA, 75 bp, Artificial Sequence
  Synthetic
gcccactacaagtcagttcggacttggaacgagatcatcccctcaaaagggtgtttgaaagtcagagagaggtgt

SEQ ID NO: 284176 - DNA, 75 bp, Artificial Sequence
  Synthetic
aatcagtacaacaaggtcttggtgagtcaggaaggaaagtgtcggtagctccccaaaacggaaaagtcatgtcct

SEQ ID NO: 284177 - DNA, 75 bp, Artificial Sequence
  Synthetic
cagatagatcggacctcatcgggttgtgggaggatcagatatattgcttagatatgtccaacggcccgacttgct

SEQ ID NO: 284178 - DNA, 75 bp, Artificial Sequence
  Synthetic
caatcgtctctacttcaacaacatatggagctgttggagtcttctgtgatccccctaatgaatcccttggcggac

SEQ ID NO: 284179 - DNA, 75 bp, Artificial Sequence
  Synthetic
atctcctccgtaccttgcgtgtggatgatcatctctcctctagatctggggagatctcttgttttgacagtcctc

SEQ ID NO: 284180 - DNA, 75 bp, Artificial Sequence
  Synthetic
acgcttaacaacaagactaagaaggaggtcgacatcgtatcctacaagtccaaaatgtaacacccgtacaatgga

SEQ ID NO: 284181 - DNA, 75 bp, Artificial Sequence
  Synthetic
tgatcatctctcctctagatctggggagatctcttgttttgacagtcctctatggacttcgtgcgacaaggtaaa

SEQ ID NO: 284182 - DNA, 75 bp, Artificial Sequence
  Synthetic
tcacctcccagatgttcacaaacagatctcaggggttgaccttggtctcccgagttgggggaaatatctcctgat

SEQ ID NO: 284183 - DNA, 75 bp, Artificial Sequence
  Synthetic
catcgggaaggacttggtcaagttcaaagatcaaatatggggactgctgattgtgacaaaggactttgtttattc

SEQ ID NO: 284184 - DNA, 75 bp, Artificial Sequence
  Synthetic
catgtagattttgatgatgtatgatttcttctgacagtatcagtgactaatggtgctctcatttcctaaggactg

SEQ ID NO: 284185 - DNA, 75 bp, Artificial Sequence
  Synthetic
ggtagaacgacacctccatagctacaacagatggatcactctcgaggatatcagatctagatcatccctcctaga

SEQ ID NO: 284186 - DNA, 75 bp, Artificial Sequence
  Synthetic
aagtagacagtgtcgtctacaaagcaaaaatgtaacacccctacaatggatgccgacaagattgtattcaaagtc

SEQ ID NO: 284187 - DNA, 75 bp, Artificial Sequence
  Synthetic
aacgccgtcaaacttgatcccgatgatgattgttcctacttggcagccgcaatggagttctttgaggggacgtgt

SEQ ID NO: 284188 - DNA, 75 bp, Artificial Sequence
  Synthetic
tgaacttgggcagagaccataacaagttcccctacacttgactaaataagggttagctgagggaagcgagttgcc

SEQ ID NO: 284189 - DNA, 75 bp, Artificial Sequence
  Synthetic
cccagactaggaaagtcgtatcttcatgggagttatacaagagtgaaggcgatgccaggctgtgatggcgggcca

SEQ ID NO: 284190 - DNA, 75 bp, Artificial Sequence
  Synthetic
atgattgttcctacttggcagccgcaatggagttctttgaggggacgtgtcccgaagactggaccagctatggaa

SEQ ID NO: 284191 - DNA, 75 bp, Artificial Sequence
  Synthetic
tggagtactctcaagagatcacctgggatgacgatacggagtttgtcggattgcaaataagagtgagtgcaagac

SEQ ID NO: 284192 - DNA, 75 bp, Artificial Sequence
  Synthetic
tctccttagtatcttgcgatcaaaagactgcctacctttgagatctgggggactctctcatcttgaaggcccttc

SEQ ID NO: 284193 - DNA, 75 bp, Artificial Sequence
  Synthetic
gactgcctacctttgagatctgggggactctctcatcttgaaggcccttcacatacttcatgtaacaaaacaagt

SEQ ID NO: 284194 - DNA, 75 bp, Artificial Sequence
  Synthetic
aatgcagccaagctcgaccctgatgatgtatgctcttatctagcagctgcaatgcagttctttgagggagcatgt

SEQ ID NO: 284195 - DNA, 75 bp, Artificial Sequence
  Synthetic
aatgacaagggaccccacgggctctgagcatacatctttggtcggtcttctcgtaagtctgtataggttgagcaa

SEQ ID NO: 284196 - DNA, 75 bp, Artificial Sequence
  Synthetic
accgatgagggactttctgctcatgtcagtacaggcagtctttcactacctgttgtttagcccaatcttgaaagg

SEQ ID NO: 284197 - DNA, 75 bp, Artificial Sequence
  Synthetic
tcagtacaggcagtctttcactacctgttgtttagcccaatcttgaaaggcagagtttacaagattttaagtgct

SEQ ID NO: 284198 - DNA, 75 bp, Artificial Sequence
  Synthetic
aaaaactgtggaatggaggagtaattagcaacacttctcatccttagaactacaccatgatgcttgatccagggg

SEQ ID NO: 284199 - DNA, 75 bp, Artificial Sequence
  Synthetic
tatggctgttacaggcattgggggcacccctatatagattatcgaaagggtctgtcaaaactatatgatcaagtt

SEQ ID NO: 284200 - DNA, 75 bp, Artificial Sequence
  Synthetic
tgccatctcaaacaactctatgattgagtccaagcagaggccatcgcgagttccactgcattagaccaggtagag

SEQ ID NO: 284201 - DNA, 75 bp, Artificial Sequence
  Synthetic
ttctctgggaggagtgtctggaatgtctcttggaaggttccatatacgtcaattctcagatcctgtctctgaagg

SEQ ID NO: 284202 - DNA, 75 bp, Artificial Sequence
  Synthetic
ttccactgcattagaccaggtagagattagtcgagaaagacgatttgcctcctatgaaggacacaagcaataggt

SEQ ID NO: 284203 - DNA, 75 bp, Artificial Sequence
  Synthetic
attagtcgagaaagacgatttgcctcctatgaaggacacaagcaataggtcataatcatcttacatcctgataag

SEQ ID NO: 284204 - DNA, 75 bp, Artificial Sequence
  Synthetic
gagcatgcatctttggttggtcttctcttgagtctgtataggttgagcaaaatatctggacagaacaccggcaat

SEQ ID NO: 284205 - DNA, 75 bp, Artificial Sequence
  Synthetic
tacaaagttctgaaggattacttcaagaaggtggatctagggtctatcaaagtgggtggagctgctgcacaatct

SEQ ID NO: 284206 - DNA, 75 bp, Artificial Sequence
  Synthetic
acgcgttatgtcaagaggccgggaacccagatctcggagagaggacactcgagagcttcactcgccttctggagg

SEQ ID NO: 284207 - DNA, 75 bp, Artificial Sequence
  Synthetic
atgatctccctttggctgcacggtgcccattcggaatcaaataggagccggaagtgtataactgacttggttcag

SEQ ID NO: 284208 - DNA, 75 bp, Artificial Sequence
  Synthetic
tacaagacaaacatcgcagacaggatagagcagattttcgaaacagccccttttgcaaagatcgtagaacatcat

SEQ ID NO: 284209 - DNA, 75 bp, Artificial Sequence
  Synthetic
gcgctaactggagtaccataccgaacttcagattcctagccgggacctatgacatgtttttctcccggattgaac

SEQ ID NO: 284210 - DNA, 75 bp, Artificial Sequence
  Synthetic
atggcacaagctcccgatcacgcaaatctttgagattcctgaatcaatggacccgtcagaaatattggatgataa

SEQ ID NO: 284211 - DNA, 75 bp, Artificial Sequence
  Synthetic
tgttcaggactggtatcatttacagggttcataaagcagatcaatctcaccgctagggaggcaatactttacttc

SEQ ID NO: 284212 - DNA, 75 bp, Artificial Sequence
  Synthetic
ttgtctaagacccatagggataactttatacttttcttaaaatctgttgagcctctttttcctcgattcctcagt

SEQ ID NO: 284213 - DNA, 75 bp, Artificial Sequence
  Synthetic
aagaaactctgactacaacctcaactctcctctgatagaagactcggccaaattgatgttggaatggttgaaaac

SEQ ID NO: 284214 - DNA, 75 bp, Artificial Sequence
  Synthetic
tgctcagggttggtgtcatttacagggtttataaaacaaataaatctcactgcgagagaagcactactatatttc

SEQ ID NO: 284215 - DNA, 75 bp, Artificial Sequence
  Synthetic
tgcgagagaagcactactatatttcttccacaagaactttgaagaagagataagaagaatgtttgagccggggca

SEQ ID NO: 284216 - DNA, 75 bp, Artificial Sequence
  Synthetic
gatacagaactctcggacaataagaaggcagtttagaaggagtctatcaagaactttagaagagtccttttacaa

SEQ ID NO: 284217 - DNA, 75 bp, Artificial Sequence
  Synthetic
aggaacatttgaaagaagattcttcagagatgagaaagaacttcaagaatacgaggcggctgaactgacaaagac

SEQ ID NO: 284218 - DNA, 75 bp, Artificial Sequence
  Synthetic
ggagggtgtggccttgctcctccgagagggcagacctcttaagggagatctcttggggaagaaaagtagtaggca

SEQ ID NO: 284219 - DNA, 75 bp, Artificial Sequence
  Synthetic
gaccttttcttgtctcggttcaactctttgatgattcttctttcccctcctgaacccagatattcagatgacctg

SEQ ID NO: 284220 - DNA, 75 bp, Artificial Sequence
  Synthetic
ctttgatgattcttctttcccctcctgaacccagatattcagatgacctgatatctcaactgtgtcagttatata

SEQ ID NO: 284221 - DNA, 75 bp, Artificial Sequence
  Synthetic
aatagagggctgagaatccccccagagggggtcctaagctgtcttgagagggtcgattacgataaagcatttggg

SEQ ID NO: 284222 - DNA, 75 bp, Artificial Sequence
  Synthetic
cggtatttggctaacatatattcctcttatttattctttcacgtgatcactctttacatgaatgccttggattgg

SEQ ID NO: 284223 - DNA, 75 bp, Artificial Sequence
  Synthetic
tgaagtagccttggctgatgacggaaccgtcaattctgatgacgaggactacttctctagtgagaccaggagtcc

SEQ ID NO: 284224 - DNA, 75 bp, Artificial Sequence
  Synthetic
atcaaaatattggagccatacgttgtgaatagcctagtccagagggcagaaaaatttaggcctctcattcattcc

SEQ ID NO: 284225 - DNA, 75 bp, Artificial Sequence
  Synthetic
atccgtactcccgtctttcgatcagtcattcttctcacgaggccctctaaaagggtacttgggctcgtccacctc

SEQ ID NO: 284226 - DNA, 75 bp, Artificial Sequence
  Synthetic
aaaatttaggcctctcattcattccctaggggacttccctgtatttataaaagataaggtgggtcagcttgaagg

SEQ ID NO: 284227 - DNA, 75 bp, Artificial Sequence
  Synthetic
ggggaggcaaccctagagtctcggtatccgtactcccgtctttcgatcagtcattcttctcacgaggccctctaa

SEQ ID NO: 284228 - DNA, 75 bp, Artificial Sequence
  Synthetic
ccgacttcacttggatgatggaaaatcgtccgaccttggtaagatgtccaaggcgggggagggcaagcatcaaga

SEQ ID NO: 284229 - DNA, 75 bp, Artificial Sequence
  Synthetic
agaaattccaacttggctcaaactctaattagaaacatcatgtctctaacaggtcctgactttcctctagaagaa

SEQ ID NO: 284230 - DNA, 75 bp, Artificial Sequence
  Synthetic
agaaactatacacttatgttgaaagacctttttttgtctcggttcaactccctaatgattctcctttctcctccg

SEQ ID NO: 284231 - DNA, 75 bp, Artificial Sequence
  Synthetic
acaacatacatgacttagtctttgtgtacggctgtacagggcattgggggcatccttacatagattatagaaagg

SEQ ID NO: 284232 - DNA, 75 bp, Artificial Sequence
  Synthetic
tatcttgatccacgacttcttgcaagggaccaccctctaactccctatattaaaacccaaacgtggcctcccaaa

SEQ ID NO: 284233 - DNA, 75 bp, Artificial Sequence
  Synthetic
gccatcgaggaaggggcatctaaactagggctgatcatcaagaaagaagagaccatgtgcagttatgactttctc

SEQ ID NO: 284234 - DNA, 75 bp, Artificial Sequence
  Synthetic
atctccaaggagatcccatagaggtggacaatctccccgaagacatgagaaggcttcaattagacgatgaaaaac

SEQ ID NO: 284235 - DNA, 75 bp, Artificial Sequence
  Synthetic
agattcaggcctctcattcattccttaggagatttccccgcatttataagagataaggtgggtcaacttgaggga

SEQ ID NO: 284236 - DNA, 75 bp, Artificial Sequence
  Synthetic
atctatgggaaaactcccttgtttcgaggcaacatattggtgcctgaatccaaaagatgggccagagtctcttgc

SEQ ID NO: 284237 - DNA, 75 bp, Artificial Sequence
  Synthetic
ggcaccttcggtgcaacaggtgtgtaaggcccattgatgatatcacactggagacttctcagatctttgagtttc

SEQ ID NO: 284238 - DNA, 75 bp, Artificial Sequence
  Synthetic
gagacttctcagatctttgagtttccggacgtgtcaaaaagaatatctagaatggtttctggagctgtgccccac

SEQ ID NO: 284239 - DNA, 75 bp, Artificial Sequence
  Synthetic
atccttacatagattatagaaaggggttgtcaaagctatatgatcaagtccatatcaagaaggtcatagataaat

SEQ ID NO: 284240 - DNA, 75 bp, Artificial Sequence
  Synthetic
acctcctgtcaacccaagagaatttttgaagtctatagaccttggaggattgccggacgaggatctgataatcgg

SEQ ID NO: 284241 - DNA, 75 bp, Artificial Sequence
  Synthetic
cgtcgaagagatcatatcctatgtcatggtcaacttccccagtctgccggggaagtcttcagaagataaagctac

SEQ ID NO: 284242 - DNA, 75 bp, Artificial Sequence
  Synthetic
ataggatcggctcaagggcttctatattcaatcttagtggcaattcatgactcaggatacaatgatggcaccatc

SEQ ID NO: 284243 - DNA, 75 bp, Artificial Sequence
  Synthetic
ggatttgacaagtactccaaatggtatcttgattcgcgacttctttctagggatcaccccctgactccctatatc

SEQ ID NO: 284244 - DNA, 75 bp, Artificial Sequence
  Synthetic
tcagactgccaaccgggaactcaagaaggagacagtgtctgcttcttctcagcgagaaagtcaatcatctaaagc

SEQ ID NO: 284245 - DNA, 75 bp, Artificial Sequence
  Synthetic
tgtaactctagcttgagtctgtcatctcactggatcaggttgatttacaagatagtgaagacccttaaaagagat

SEQ ID NO: 284246 - DNA, 75 bp, Artificial Sequence
  Synthetic
agcgagaaagtcaatcatctaaagccaaaatggcggctcaaaccgcctccggtccttctgctctagagtggtccg

SEQ ID NO: 284247 - DNA, 75 bp, Artificial Sequence
  Synthetic
ttggcataagctcccgatcacccaaatttttgagatccccgaatcaatggacccatcggaaatactcgatgacaa

SEQ ID NO: 284248 - DNA, 75 bp, Artificial Sequence
  Synthetic
tgactaatatcaacattaatagacctcttgaattgatctccggggtaatctcatatatcctcctgagactagata

SEQ ID NO: 284249 - DNA, 75 bp, Artificial Sequence
  Synthetic
acccatcggaaatactcgatgacaaatcacactcgttcactagaacaaaattagcgtcatggctatcagagaaca

SEQ ID NO: 284250 - DNA, 75 bp, Artificial Sequence
  Synthetic
ccctctcctgtgtcagcccctccggatgacgacgacctgtggcttccaccccctgaatacgtcccgctgaaagaa

SEQ ID NO: 284251 - DNA, 75 bp, Artificial Sequence
  Synthetic
gatattcttgtataactttgagcagttgaaaatgaatctcgatgacatagtcaaagagtcgaaaaatgtgccaag

SEQ ID NO: 284252 - DNA, 75 bp, Artificial Sequence
  Synthetic
ccccctgttaatcccagagaattcctgaaatctatagatcttggaggattgcctgatgaagatttgataattggc

SEQ ID NO: 284253 - DNA, 75 bp, Artificial Sequence
  Synthetic
tgtcaaacggcccgacatgctggaacggtcaagatggcgggctagagggtttgcgacagaaaggttggagtctgg

SEQ ID NO: 284254 - DNA, 75 bp, Artificial Sequence
  Synthetic
agactattcaagagtcacatacgcctttcacctggattacgagaagtggaataatcatcagcggctggagtcgac

SEQ ID NO: 284255 - DNA, 75 bp, Artificial Sequence
  Synthetic
cctctctcgtgtcagctcccccagatgatgatgacttgtggttaccccctccagaatatgttccgttgaaggagc

SEQ ID NO: 284256 - DNA, 75 bp, Artificial Sequence
  Synthetic
tgaggatgtattctctgtactagatcaagtgttcggacttagaagggtgttttccagaactcatgagttttttca

SEQ ID NO: 284257 - DNA, 75 bp, Artificial Sequence
  Synthetic
ctgctcaacaggttgcagtctccacctcagctaacccagcccctgtctcagagcttgacataagggccctctcca

SEQ ID NO: 284258 - DNA, 75 bp, Artificial Sequence
  Synthetic
agatctgacctcattgggttgtgggaagatcaaatatattgtctggacatgtcaggcggtccgacatgttggaat

SEQ ID NO: 284259 - DNA, 75 bp, Artificial Sequence
  Synthetic
gtcaggcggtccgacatgttggaatggtcaagatggcgggctagagggtttgagacaaaagggctggagtctggt

SEQ ID NO: 284260 - DNA, 75 bp, Artificial Sequence
  Synthetic
ggtcaagatggcgggctagagggtttgagacaaaagggctggagtctggtcagtctgttgatgatagaccgtgaa

SEQ ID NO: 284261 - DNA, 75 bp, Artificial Sequence
  Synthetic
tgagacaaaagggctggagtctggtcagtctgttgatgatagaccgtgaatctcagaccaggaacacaaggacta

SEQ ID NO: 284262 - DNA, 75 bp, Artificial Sequence
  Synthetic
tctcagaccaggaacacaaggactaagatattagcccagggggacaatcaggttctttgcccgacatatatgttg

SEQ ID NO: 284263 - DNA, 75 bp, Artificial Sequence
  Synthetic
tcccataatagcagactcaacatgagtcgattgagaaaggcaatctgcctccaatgaaggacataagcaatagct

SEQ ID NO: 284264 - DNA, 75 bp, Artificial Sequence
  Synthetic
gatgggtcgggtgggatatcaagggcagtactcaacatgtttccagacgccaaacttgtgttcaacagcttgtta

SEQ ID NO: 284265 - DNA, 75 bp, Artificial Sequence
  Synthetic
aaaagggctctatcgctaaaagaatctataaactggttcattactagaaactctaacttggctcaaactctgatt

SEQ ID NO: 284266 - DNA, 75 bp, Artificial Sequence
  Synthetic
aagaaatgctctctcaatataccgtgccatcgaggagggggcgtccaaactggggctcattataaagaaggaaga

SEQ ID NO: 284267 - DNA, 75 bp, Artificial Sequence
  Synthetic
tggggctcattataaagaaggaagagaccatgtgcagttatgatttcctcatctatggaaagacccccctgtttc

SEQ ID NO: 284268 - DNA, 75 bp, Artificial Sequence
  Synthetic
ttggggggagtatctggaatgtctctcggaagatttcacatacgtcagttctcagaccctgtctcagaagggttg

SEQ ID NO: 284269 - DNA, 75 bp, Artificial Sequence
  Synthetic
accgtcaactctgatgatgaggattacttctctggtgaaaccaggagtcctgaagctgtttatactcggatcatg

SEQ ID NO: 284270 - DNA, 75 bp, Artificial Sequence
  Synthetic
cagaaacctacaccaactttgtcggttatgtcaccaccacatttaagagaaaacacttccgcccgatgccaggat

SEQ ID NO: 284271 - DNA, 75 bp, Artificial Sequence
  Synthetic
caaaagatgggctagagtctcttgtatctccaatgaccagatagtcaaccttgccaatataatgtcaacagtatc

SEQ ID NO: 284272 - DNA, 75 bp, Artificial Sequence
  Synthetic
atctccaatgaccagatagtcaaccttgccaatataatgtcaacagtatctaccaatgccttgactgtggcacaa

SEQ ID NO: 284273 - DNA, 75 bp, Artificial Sequence
  Synthetic
ggtgtattaacatgaactctcgggcatgtcaattgtggtctgacatgtcccttcaaacacaaaggtctgaggagg

SEQ ID NO: 284274 - DNA, 75 bp, Artificial Sequence
  Synthetic
tctatcaatagaataaccttgttgatgtccgatttcgcattgtctatagacggacccctttatttagttttcaaa

SEQ ID NO: 284275 - DNA, 75 bp, Artificial Sequence
  Synthetic
gccagtcctaccattctcctcaaagatgcaatcagaaaggccttatatgatgaggtagacaaggtggagaactca

SEQ ID NO: 284276 - DNA, 75 bp, Artificial Sequence
  Synthetic
tcaagctgtattccattacctgctgtttagccctatcctgaagggcagagtttacaagatcttgagtgcagaggg

SEQ ID NO: 284277 - DNA, 75 bp, Artificial Sequence
  Synthetic
tttagccctatcctgaagggcagagtttacaagatcttgagtgcagagggggacaactttcttctagctatgtct

SEQ ID NO: 284278 - DNA, 75 bp, Artificial Sequence
  Synthetic
ggacaactttcttctagctatgtctagaatcatttatctagacccctctttgggaggagtatctggaatgtctct

SEQ ID NO: 284279 - DNA, 75 bp, Artificial Sequence
  Synthetic
attttccaaacgagggaaattcttccgagatgcagagtacttaacctcctccacccttcgagagatgagcctggt

SEQ ID NO: 284280 - DNA, 75 bp, Artificial Sequence
  Synthetic
cggaaggttccacatacgtcagttctctgatcctgtctcagaagggctgtccttttggagagagatctggctaag

SEQ ID NO: 284281 - DNA, 75 bp, Artificial Sequence
  Synthetic
agtgagatgcagagagctcgctccttaaattatcaagatcttgtaaggggatttcccgaagagatcatatcaaat

SEQ ID NO: 284282 - DNA, 75 bp, Artificial Sequence
  Synthetic
atctaggagagagaacactggagagctttactcgtctgctcgaagatcctactactctgaatattaaaggagggg

SEQ ID NO: 284283 - DNA, 75 bp, Artificial Sequence
  Synthetic
ctttactcgtctgctcgaagatcctactactctgaatattaaaggaggggctagtcccactattcttctcaagga

SEQ ID NO: 284284 - DNA, 75 bp, Artificial Sequence
  Synthetic
ggtttggccgtgctcttctgagagggcagatctcttaagagaaatctcgtgggggagaaaggtggtcggcacaac

SEQ ID NO: 284285 - DNA, 75 bp, Artificial Sequence
  Synthetic
aatatcaacattaatagacctcttgaattgatctcaggggtaatttcatatatcctcctgaggctggataatcac

SEQ ID NO: 284286 - DNA, 75 bp, Artificial Sequence
  Synthetic
aacactttcgccctatgccagatgcatgcagagctgcatacaattggaagatggccggtgatcctagatatgaag

SEQ ID NO: 284287 - DNA, 75 bp, Artificial Sequence
  Synthetic
aattgatctcaggggtaatttcatatatcctcctgaggctggataatcacccctccttgtacataatgctcagag

SEQ ID NO: 284288 - DNA, 75 bp, Artificial Sequence
  Synthetic
cctgcacttgcggagcaacaggagggggggatcctcgaatatcagtgtctgtgcttccatcttttgaccagtcat

SEQ ID NO: 284289 - DNA, 75 bp, Artificial Sequence
  Synthetic
tcagaaagcaggtcattcgagggaatatttatctttcttggagttggtccgatgatactgcggtgttcaaaaggg

SEQ ID NO: 284290 - DNA, 75 bp, Artificial Sequence
  Synthetic
aaacttgtctaagggtatgagggctaacctgcgacaaatgagctctttgatgaggcaggtgcttggtgggcatgg

SEQ ID NO: 284291 - DNA, 75 bp, Artificial Sequence
  Synthetic
atcatctcactggatcaggttgatttacaagatagtgaaaaccaccagactggttggaagcattgaggacctatc

SEQ ID NO: 284292 - DNA, 75 bp, Artificial Sequence
  Synthetic
tacttgggctcatccacctccatgtcgactcagctattccacgcatgggagaaagtcactaatgttcacgtggtg

SEQ ID NO: 284293 - DNA, 75 bp, Artificial Sequence
  Synthetic
gaaaaaaacaagatcttgactctgagcctctggttgtttgattgttttttttatctttattgtttttttgttaag

SEQ ID NO: 284294 - DNA, 75 bp, Artificial Sequence
  Synthetic
gaaagtcactaatgttcacgtggtgaaaagagccttatctcttaaagagtctataaactggtttatcacaagaaa

SEQ ID NO: 284295 - DNA, 75 bp, Artificial Sequence
  Synthetic
cagcaggtggcagtctctacctcagcaaacccagcccctgtctcagagctcgacataagggccctctctaagagg

SEQ ID NO: 284296 - DNA, 75 bp, Artificial Sequence
  Synthetic
agccacttgagaaaacttgttcctgggtttggaaaggcatatactatattcaacaagaccttaatggaagctgat

SEQ ID NO: 284297 - DNA, 75 bp, Artificial Sequence
  Synthetic
cctctcaaatcttcgagttcccggatgtttcaagaaggatatctaggatggtttctggagctgtgcctcatttta

SEQ ID NO: 284298 - DNA, 75 bp, Artificial Sequence
  Synthetic
gaaaacttccggacattcgtttgagaccgggtgacttcgaatctctaagtggtaaggagaagtcacgccatatag

SEQ ID NO: 284299 - DNA, 75 bp, Artificial Sequence
  Synthetic
gtgcctaaaagtcggagggaggtgtcatcctcatgtggacggagtgttcttcaatggtataattctgggtccgga

SEQ ID NO: 284300 - DNA, 75 bp, Artificial Sequence
  Synthetic
ctcaacatgtttccagatgccaagcttgtgttcaacagccttttagaggtgaatgatctgatggcttccggaaca

SEQ ID NO: 284301 - DNA, 75 bp, Artificial Sequence
  Synthetic
tctgtcagcacagacacgatgtcggatttgactcatgatggaagaaactatgacttcatgttccaaccattgatg

SEQ ID NO: 284302 - DNA, 75 bp, Artificial Sequence
  Synthetic
atacaagtcagttttatcaggtttgaatgctgccaagcttgatcctgatgatgtatgttcctacttagcagctgc

SEQ ID NO: 284303 - DNA, 75 bp, Artificial Sequence
  Synthetic
caatcgtccctacttcaacaacatgtggagctgttggagtcctctgtaatccctctaatgcatcccttggcagac

SEQ ID NO: 284304 - DNA, 75 bp, Artificial Sequence
  Synthetic
ctgttaacatatatagcaaggtttcccctagagactatttgagagggctcgcgagaggggtcttgatagggtcct

SEQ ID NO: 284305 - DNA, 75 bp, Artificial Sequence
  Synthetic
ttctcaggtcttcgattttccggatgtttcaagaagaatttctagaatggtttctggagccgtgcctcatttccg

SEQ ID NO: 284306 - DNA, 75 bp, Artificial Sequence
  Synthetic
gtttcaagaagaatttctagaatggtttctggagccgtgcctcatttccgaaaactccctgatatccgtttaagg

SEQ ID NO: 284307 - DNA, 75 bp, Artificial Sequence
  Synthetic
gactttgcattgtctatagatggaccactgtgtttggtctttaaaacttacgggaccatgctagtgaacccagac

SEQ ID NO: 284308 - DNA, 75 bp, Artificial Sequence
  Synthetic
tttctattccccaaaaagtccccgctgcttacccgaccacgatgaaggaaggtaatagatctgttctgtgctacc

SEQ ID NO: 284309 - DNA, 75 bp, Artificial Sequence
  Synthetic
ccgggcgactttgaatctctaagtggaaaggagaagtctcgccatatagggtcagcccaggggctcttgtactca

SEQ ID NO: 284310 - DNA, 75 bp, Artificial Sequence
  Synthetic
cccaagacgggaaagtcatatcttcatgggagttgtacaagagtggaggcgagaccaggctgtgagggcaggtca

SEQ ID NO: 284311 - DNA, 75 bp, Artificial Sequence
  Synthetic
cttcagattcctggcagggacctacgacatgtttttctcccggattgagcacctgtattcagcgatcagagtagg

SEQ ID NO: 284312 - DNA, 75 bp, Artificial Sequence
  Synthetic
gagaccaggctgtgagggcaggtcatcccctccataccttgcgttcagaaagttgactctctttgagacctgagg

SEQ ID NO: 284313 - DNA, 75 bp, Artificial Sequence
  Synthetic
atgggagttgtacaagagtggaggcgagaccaggctgtgagggcaggtcatcccctccataccttgcgttcagaa

SEQ ID NO: 284314 - DNA, 75 bp, Artificial Sequence
  Synthetic
cctagagactatttacgagggctcgcgagaggagttttgatcgggtcttcgatttgcttcctgacaagaatgaca

SEQ ID NO: 284315 - DNA, 75 bp, Artificial Sequence
  Synthetic
gatttgcttcctgacaagaatgacaaacattaacatcaataggcctcttgaactgatctctggagtgatttctta

SEQ ID NO: 284316 - DNA, 75 bp, Artificial Sequence
  Synthetic
tcaagagtcaagaaactttcatcaatcatctcaactgatcagacacagtcatgtagattctgataatgtatgatg

SEQ ID NO: 284317 - DNA, 75 bp, Artificial Sequence
  Synthetic
tcaattgcagcagccccaagagtgagatgcagagagctcgttccttgaactatcaagatcttgtaaggggatttc

SEQ ID NO: 284318 - DNA, 75 bp, Artificial Sequence
  Synthetic
atgtagattctgataatgtatgatgtcttctgacagtatcattgattaatggtgctctcatcccctacggactga

SEQ ID NO: 284319 - DNA, 75 bp, Artificial Sequence
  Synthetic
ccatccttgtatattatgctcagagagccatctcttcgaggagagatattctctattccccaaaaagttcctgca

SEQ ID NO: 284320 - DNA, 75 bp, Artificial Sequence
  Synthetic
tgagtgggaagtccccttattcatcaaatgcagttggtcatgtgttcaatctcattcactttgttggatgctaca

SEQ ID NO: 284321 - DNA, 75 bp, Artificial Sequence
  Synthetic
atgaggcaggtgctaggtgggcatggtgaagacaccttagagtcagatgaagacattcagaggttgttgagagac

SEQ ID NO: 284322 - DNA, 75 bp, Artificial Sequence
  Synthetic
agccatctcttcgaggagagatattctctattccccaaaaagttcctgcagcttacccaaccacaatgagagaag

SEQ ID NO: 284323 - DNA, 75 bp, Artificial Sequence
  Synthetic
gcttacccaaccacaatgagagaaggtaacagatccattctgtgttacctccaacatgtgctgcgctatgaacga

SEQ ID NO: 284324 - DNA, 75 bp, Artificial Sequence
  Synthetic
tcagcaggtggcagtttcaacttcagcaaacccagctcctgtctcagagctggacatcagggccctctccaaaag

SEQ ID NO: 284325 - DNA, 75 bp, Artificial Sequence
  Synthetic
tacatggaactcaaagtaggatacatctcagccataaaagtgaacggcttcacttgtacaggtgtggtcacagaa

SEQ ID NO: 284326 - DNA, 75 bp, Artificial Sequence
  Synthetic
aaatctctccaaaagtatgagaaccaacttgcgacaaatgagctctctaatgaggcaagttttgggtgggcatgg

SEQ ID NO: 284327 - DNA, 75 bp, Artificial Sequence
  Synthetic
aaagcacttccgcccaacacccgatgcgtgtagggccgcatacaactggaaaatggctggcgaccccagatatga

SEQ ID NO: 284328 - DNA, 75 bp, Artificial Sequence
  Synthetic
ggtttatgatgaccccattgatccgattgagtcagaggctgagccgagagggaaccccaccatccccaacatctt

SEQ ID NO: 284329 - DNA, 75 bp, Artificial Sequence
  Synthetic
ggaaccccaccatccccaacatcttaagaaactctgactacaacctcaactcccctctaatagaggatccagcca

SEQ ID NO: 284330 - DNA, 75 bp, Artificial Sequence
  Synthetic
ccaggaagtacgccatgcagcgaggaccatggtaggatgttatagccccagcaagaggatgtcacgcaaagccgg

SEQ ID NO: 284331 - DNA, 75 bp, Artificial Sequence
  Synthetic
ctcactggatcaggttgatttacaagatagtgaagactaccagactcgttggtagcatcgaggacctatccggag

SEQ ID NO: 284332 - DNA, 75 bp, Artificial Sequence
  Synthetic
ctttgcgtaggactaggtgggtagaccaggaagtacgccatgcagcgaggaccatggtaggatgttatagcccca

SEQ ID NO: 284333 - DNA, 75 bp, Artificial Sequence
  Synthetic
ggtagcatcgaggacctatccggagagatagaaagacacctccatgggtacaacaggtggatcaccctcaaggat

SEQ ID NO: 284334 - DNA, 75 bp, Artificial Sequence
  Synthetic
accatggtaggatgttatagccccagcaagaggatgtcacgcaaagccgggtgttcagaatgggtctgctctgct

SEQ ID NO: 284335 - DNA, 75 bp, Artificial Sequence
  Synthetic
tccccagaagcctgcacatcctaagacttttgtgtgatgtatcttgaaaaaaacaagatcttgaatccgagcctc

SEQ ID NO: 284336 - DNA, 75 bp, Artificial Sequence
  Synthetic
ccttatgccttgtagttggggatgggtcaggtgggatatcaagagcggtactcaacatgtttccggatgccaggc

SEQ ID NO: 284337 - DNA, 75 bp, Artificial Sequence
  Synthetic
agagcatttcctgcggtcactggattcataactcagatgacctcgtctttctcatcagagctatacctcagattc

SEQ ID NO: 284338 - DNA, 75 bp, Artificial Sequence
  Synthetic
gtcagacaaatgagatcaggagagagatttctcaagatatggtcacaaaccgtggaggaaatcatatcttatgtc

SEQ ID NO: 284339 - DNA, 75 bp, Artificial Sequence
  Synthetic
catccattacccccttcagccatcatgagcggaggagatgacattatctccagggtgattgactttgactctatc

SEQ ID NO: 284340 - DNA, 75 bp, Artificial Sequence
  Synthetic
tactggaaaggatttggtcaagtttaaagatcaaatatggggattgctgattgtgaccaaggatttcgtgtactc

SEQ ID NO: 284341 - DNA, 75 bp, Artificial Sequence
  Synthetic
ggtcctccagcccttgaatggtctgctaccaacgaagaggatgatctatcagtggaagctgagattgctcaccaa

SEQ ID NO: 284342 - DNA, 75 bp, Artificial Sequence
  Synthetic
acatatagtagacttggtaggggatacgtggcacaagcttccgatcacgcaaatctttgagattcctgaatcaat

SEQ ID NO: 284343 - DNA, 75 bp, Artificial Sequence
  Synthetic
gattttgcattgtctatagacggcccactctatctggttttcaaaacttacggcaccatgctggtaaatccggac

SEQ ID NO: 284344 - DNA, 75 bp, Artificial Sequence
  Synthetic
acaagtttccctctcgatcatctgggatatttttgtataactttgagcagttgaaaatgaaccttgatgacatag

SEQ ID NO: 284345 - DNA, 75 bp, Artificial Sequence
  Synthetic
tacaaagctattcaacatctgtctagagcttttcctgtagtcactgggtttataactcaggtgacctcctctttc

SEQ ID NO: 284346 - DNA, 75 bp, Artificial Sequence
  Synthetic
tatctcagctgtgtcagctatatatcgcaggagatcacgtcttgtccatgtgcgggaactctggttatgaagtca

SEQ ID NO: 284347 - DNA, 75 bp, Artificial Sequence
  Synthetic
tcatccgagttatacctcagattctccaaacgggggaagttcttccgagatgcagaatatctgacttcctctgct

SEQ ID NO: 284348 - DNA, 75 bp, Artificial Sequence
  Synthetic
tcaactgtagcagtcccaagagcgagatgcagagagcccgctccttaaattaccaggatcttgtaagaggctttc

SEQ ID NO: 284349 - DNA, 75 bp, Artificial Sequence
  Synthetic
acacttcagtgtttaagagggtggcttgcaactctagcttgagtctctcatctcactggatcaggctgatttaca

SEQ ID NO: 284350 - DNA, 75 bp, Artificial Sequence
  Synthetic
gacagtgatgtagagtcttttctggtccacaagatggtagatgatctagaattacagcgaggtactttgtctaaa

SEQ ID NO: 284351 - DNA, 75 bp, Artificial Sequence
  Synthetic
caacatacacgacttagtctttgtatacggctgttacaggcattgggggcatccttacatagattatagaaaggg

SEQ ID NO: 284352 - DNA, 75 bp, Artificial Sequence
  Synthetic
ttgcaactctagcttgagtctctcatctcactggatcaggctgatttacaagatagtaaagaccactagacttgt

SEQ ID NO: 284353 - DNA, 75 bp, Artificial Sequence
  Synthetic
tccacaagatggtagatgatctagaattacagcgaggtactttgtctaaagtttccattattatagctatcatga

SEQ ID NO: 284354 - DNA, 75 bp, Artificial Sequence
  Synthetic
tctcactggatcaggctgatttacaagatagtaaagaccactagacttgtcggaaggatagaagacctgtccaag

SEQ ID NO: 284355 - DNA, 75 bp, Artificial Sequence
  Synthetic
cattaggtccagatcatctcttttagattatagctgcttgtaaaactaggcgttcttgagggaatgtaccaacta

SEQ ID NO: 284356 - DNA, 75 bp, Artificial Sequence
  Synthetic
atcgttcgacgagatatattccgggaatcacaggatgatcgggttggtcaaggttgtcattggactggctttgtc

SEQ ID NO: 284357 - DNA, 75 bp, Artificial Sequence
  Synthetic
agatttttggacggtgcaccctgaaaaaaacaagatcacgattcataacctctgcttgcttgagtgtttttccat

SEQ ID NO: 284358 - DNA, 75 bp, Artificial Sequence
  Synthetic
ttgcaagacttcatgatctatacaacagacccataacttattatttcatgaaacaagtcattcgggggaatactt

SEQ ID NO: 284359 - DNA, 75 bp, Artificial Sequence
  Synthetic
ctttgggctccgtgcaacagggtaaattcatgagtcaagagactttcattaatcatctcaatcgatcagatgtgg

SEQ ID NO: 284360 - DNA, 75 bp, Artificial Sequence
  Synthetic
taggggcccccttgagggggaggaattggaatactctcaagagatcacttgggacgatgataccgaattcgttgg

SEQ ID NO: 284361 - DNA, 75 bp, Artificial Sequence
  Synthetic
ggaagtatagaggatctgtccaaggaggtggagaagcaccttcgaagatacaacaggtggatcaccctcaaagac

SEQ ID NO: 284362 - DNA, 75 bp, Artificial Sequence
  Synthetic
ggtgtattaacatgaactcgagagcatgtcaattatggtctgacatgtctcttcagacacaaaggtctgaagaag

SEQ ID NO: 284363 - DNA, 75 bp, Artificial Sequence
  Synthetic
caacaggtggatcaccctcaaagacatcagatccagatcatctctgttagattatagctgcttataaaccaagtg

SEQ ID NO: 284364 - DNA, 75 bp, Artificial Sequence
  Synthetic
tgtcctttgatacaagactgaacaggagtcaactgagagaagcaatttacctcctatgaaggacacaagcaatag

SEQ ID NO: 284365 - DNA, 75 bp, Artificial Sequence
  Synthetic
cccgtctaccgttttcaaggacggtgacgaggctgaggattttgttgaagttcaccttcccgatgtgcacaaaca

SEQ ID NO: 284366 - DNA, 75 bp, Artificial Sequence
  Synthetic
actagggctgatcatcaaaaaagaagagaccatgtgcagttatgactttctcatctatgggaaaactcccttgtt

SEQ ID NO: 284367 - DNA, 75 bp, Artificial Sequence
  Synthetic
aagatcaaatatggggattgctgattgtgaccaaagatttcgtgtactcccaaagttctggctgcctctttgata

SEQ ID NO: 284368 - DNA, 75 bp, Artificial Sequence
  Synthetic
agactattcaagggttacatacgcctttcacctggactatgagaagtggaacaatcatcagaggctggaatcgac

SEQ ID NO: 284369 - DNA, 75 bp, Artificial Sequence
  Synthetic
gacaaacttggtccctggagcccgattgacatacatcatctcagctgtccaaacaacctggttgtggaagatgaa

SEQ ID NO: 284370 - DNA, 75 bp, Artificial Sequence
  Synthetic
atcatatccccaagtgtagcggacctggacccatacgacaaatcccttcattcgagggtctttcctagcgggaag

SEQ ID NO: 284371 - DNA, 75 bp, Artificial Sequence
  Synthetic
ttctctacgagttggagagcatatcaagaaatgctctgtcaatataccgtgctattgaggagggggcatccaaac

SEQ ID NO: 284372 - DNA, 75 bp, Artificial Sequence
  Synthetic
cacaatctggatgcctgagaatccgagactggggacatcttgtgacatctttaccaacagtagagggaagagagc

SEQ ID NO: 284373 - DNA, 75 bp, Artificial Sequence
  Synthetic
gaccatgtgtagctatgactttctcatctatggaaaaacccctctgtttcgaggtaacattttggtgcctgagtc

SEQ ID NO: 284374 - DNA, 75 bp, Artificial Sequence
  Synthetic
tggggcttatcataaagaaggaagagaccatgtgtagctatgactttctcatctatggaaaaacccctctgtttc

SEQ ID NO: 284375 - DNA, 75 bp, Artificial Sequence
  Synthetic
tccaagacccatagagacaacttcatactcttcttaaaatctgttgagcctctgtttcctcgatttctcagtgag

SEQ ID NO: 284376 - DNA, 75 bp, Artificial Sequence
  Synthetic
gacatgtttttctcccgggttgagcatctatattcagcaatcagagggggcacggtcgtcaccgcttatgaagac

SEQ ID NO: 284377 - DNA, 75 bp, Artificial Sequence
  Synthetic
atttccaacgaccaaatagtcaatcttgccaatataatgtcaacggtatccacaaatgcattgactgtagcacaa

SEQ ID NO: 284378 - DNA, 75 bp, Artificial Sequence
  Synthetic
agtctttgaaaggggcatgcaaactcaagttgtgtggagttctcggccttagacttatggatggaacgtgggttg

SEQ ID NO: 284379 - DNA, 75 bp, Artificial Sequence
  Synthetic
ttgccaatataatgtcaacggtatccacaaatgcattgactgtagcacaacactctcagtctttgattaaaccga

SEQ ID NO: 284380 - DNA, 75 bp, Artificial Sequence
  Synthetic
acaaaactcccggacaatcagaaggcaatttagaaagagtctctcaagaactttagaagaatccttctacaactc

SEQ ID NO: 284381 - DNA, 75 bp, Artificial Sequence
  Synthetic
cactctcagtctttgattaaaccgatgagggactttttgcttatgtcagtacaagccgttttccattacttgctg

SEQ ID NO: 284382 - DNA, 75 bp, Artificial Sequence
  Synthetic
tgagggactttttgcttatgtcagtacaagccgttttccattacttgctgtttagccccatcttgaaaggcagag

SEQ ID NO: 284383 - DNA, 75 bp, Artificial Sequence
  Synthetic
atgctaagactcttgtgtgatgtatcttgaaaaaaacaagatcttaaatcagaacctctggttgtttgattgttt

SEQ ID NO: 284384 - DNA, 75 bp, Artificial Sequence
  Synthetic
catgagatgtctgttttagggggctatctgggagaggaattcttcgggaaaggaacattcgagagaagattcttc

SEQ ID NO: 284385 - DNA, 75 bp, Artificial Sequence
  Synthetic
gttttttagagttctggatcaattcgacaacatacatgacttggtttttgtatacggctgctacaggcattgggg

SEQ ID NO: 284386 - DNA, 75 bp, Artificial Sequence
  Synthetic
caggtgatttcgaatctctaagcggtaaggagaagtcgcgccatatagggtcggcccaagggctcttgtattcaa

SEQ ID NO: 284387 - DNA, 75 bp, Artificial Sequence
  Synthetic
tgaagagactgttgatctgatcaacaagaacatagaagacaatcaggctcatctccagggagaacccatagaggt

SEQ ID NO: 284388 - DNA, 75 bp, Artificial Sequence
  Synthetic
atctccagggagaacccatagaagtggacaatctccctgaggacatgcggcgacttcacctggatgatggaaaat

SEQ ID NO: 284389 - DNA, 75 bp, Artificial Sequence
  Synthetic
gtccctcacccctctgagatgttggggctacttccaaagtcctcgatctcatgcacttgtggagtagcaggaggg

SEQ ID NO: 284390 - DNA, 75 bp, Artificial Sequence
  Synthetic
atcctcttgaggctggacaatcacccatccttgtacataatgctcagagagccatctcttagaggagagatattt

SEQ ID NO: 284391 - DNA, 75 bp, Artificial Sequence
  Synthetic
ccaacggtgctttcatcctccaggggtcgataccaaaggttgtggacaggtcgagggttacctcagatgactccg

SEQ ID NO: 284392 - DNA, 75 bp, Artificial Sequence
  Synthetic
tgactctcatcacctaccagtctcatcttttacttcagagggttgagaaaaatctctccaaaagtatgagggcca

SEQ ID NO: 284393 - DNA, 75 bp, Artificial Sequence
  Synthetic
gcctcaagccaaaagagagagagctgaagattgaaggtcgattttttgctttgatgtcttggaatctaagattgt

SEQ ID NO: 284394 - DNA, 75 bp, Artificial Sequence
  Synthetic
caatcttagtggcaattcacgactcaggatacaatgatggaaccatcttccctgtcaacatatacggcaaagttt

SEQ ID NO: 284395 - DNA, 75 bp, Artificial Sequence
  Synthetic
cgacccagctattccacgcctgggagaaagtcactaatgttcatgtggtgaaaagagccctgtcactcaaggaat

SEQ ID NO: 284396 - DNA, 75 bp, Artificial Sequence
  Synthetic
gaaggtcctcagaggacaaatcaacccagactactggtcgagagcctaagaaagagacaatatccactcctcctc

SEQ ID NO: 284397 - DNA, 75 bp, Artificial Sequence
  Synthetic
acagaagatgttttttctgttttagatcaggtgtttggattgaaacgggtgttttctagaactcatgagtttttt

SEQ ID NO: 284398 - DNA, 75 bp, Artificial Sequence
  Synthetic
tctaaactccctctaagatgtgtactgggatgggttggtctggccaactctaaaaagttccagttgttagtcgag

SEQ ID NO: 284399 - DNA, 75 bp, Artificial Sequence
  Synthetic
tctgtcagcacagacacgatgtcagacttgactcatgatgggagaaactatgactttatgtttcaaccgttgatg

SEQ ID NO: 284400 - DNA, 75 bp, Artificial Sequence
  Synthetic
tgtattcaacagcttgttagaagtaaatgacctgatggcgtcaggaacacatccgttgcccccctcagcaatcat

SEQ ID NO: 284401 - DNA, 75 bp, Artificial Sequence
  Synthetic
atgtccaatggcccgacttgctggaacggccaagatggtgggctggaggggttacgacaaaaaggctggagtctg

SEQ ID NO: 284402 - DNA, 75 bp, Artificial Sequence
  Synthetic
ccattgatgatattacccttgagacttctcaggtcttcgagttcccggatgtttcaagaagaatatctagaatgg

SEQ ID NO: 284403 - DNA, 75 bp, Artificial Sequence
  Synthetic
tcaaagtgggtggaactgctgcacagtcaatgatttccctctggttatatggtgcccactccgaatcaaacagaa

SEQ ID NO: 284404 - DNA, 75 bp, Artificial Sequence
  Synthetic
ctaacctgcaacaactgagttctttgatgaggcaggtgctgggtgggcatggagaggatactttagagtcatacg

SEQ ID NO: 284405 - DNA, 75 bp, Artificial Sequence
  Synthetic
tctaaaagatgggccagggtgtcttgcatctccaatgaccaaatagtaaacctcgctaatataatgtcgacagtc

SEQ ID NO: 284406 - DNA, 75 bp, Artificial Sequence
  Synthetic
atttggatgcccgagaatccgagaccagggacgtcttgtgacatttttgccagtagcagagggaagagagcatcc

SEQ ID NO: 284407 - DNA, 75 bp, Artificial Sequence
  Synthetic
ttacagcgaggaactttgtctaaagtttctattattatagccatcgtgatagtcttctccaatagggtgttcaat

SEQ ID NO: 284408 - DNA, 75 bp, Artificial Sequence
  Synthetic
ccctcatcttccaatgggctgattctaggggccctcttgagggggaggaattggaatactctcaagagatcactt

SEQ ID NO: 284409 - DNA, 75 bp, Artificial Sequence
  Synthetic
aggagctccggtccctgagggcatgaactgggtatacaaactgaggagaacccttatcttccagtgggctgattc

SEQ ID NO: 284410 - DNA, 75 bp, Artificial Sequence
  Synthetic
atgcatgtcgagctgcttacaactggaagatggccggtgaccccagatatgaagaatctctgcacaatccgtacc

SEQ ID NO: 284411 - DNA, 75 bp, Artificial Sequence
  Synthetic
taaagatcaaatatggggagtgctaattgtgactaaagattttgtgtactcacagagttctaactgcctctttga

SEQ ID NO: 284412 - DNA, 75 bp, Artificial Sequence
  Synthetic
gaagatggccggtgaccccagatatgaagaatctctgcacaatccgtacccggactaccactggctcagaaccgt

SEQ ID NO: 284413 - DNA, 75 bp, Artificial Sequence
  Synthetic
acaagagaatgtcacgcaaagcagggtgttcagagtgggtctgctctgctcaacaggttgcagtttcaacctcag

SEQ ID NO: 284414 - DNA, 75 bp, Artificial Sequence
  Synthetic
tttacattttgagcctcttggatgtgaaaaaaactattaacatccctcaaaagacttaagggaaaatggttcctc

SEQ ID NO: 284415 - DNA, 75 bp, Artificial Sequence
  Synthetic
ggacatcagggccctctctagaaggcttcaaaacccgttgatctcgggcctgagagtggttcagtgggcgacagg

SEQ ID NO: 284416 - DNA, 75 bp, Artificial Sequence
  Synthetic
ggagatccatgggatcaaccggatgactcagacaccgcaaagggtcgggagagtgtggccttgctcttcagagag

SEQ ID NO: 284417 - DNA, 75 bp, Artificial Sequence
  Synthetic
gacaaatcacactctttcaccagaacgagactagcctcttggttgtcagagaacagaggggggcctgttcccagc

SEQ ID NO: 284418 - DNA, 75 bp, Artificial Sequence
  Synthetic
ctggatggtctcaatgtattcccgtccttatgtctggtggtcggggatggatcaggggggatatcaagagcggtg

SEQ ID NO: 284419 - DNA, 75 bp, Artificial Sequence
  Synthetic
gaggcaatcctagagtttcagtgtctgtgctcccgtccttcgatcaatcatttttttcacgaggccccctaaagg

SEQ ID NO: 284420 - DNA, 75 bp, Artificial Sequence
  Synthetic
gatagttttctccaacagagtcttcaacatttctaagcccttggctgaccccttgttctatccaccgtctgatcc

SEQ ID NO: 284421 - DNA, 75 bp, Artificial Sequence
  Synthetic
tcctatgacctcatcatttgtgatgcagaggtcactgacattgcatcaatcaaccgaataaccctgctaatgtct

SEQ ID NO: 284422 - DNA, 75 bp, Artificial Sequence
  Synthetic
agtctctacacaatccgtaccctgactaccattggcttcgaactgtaaaaaccaccaaggagtctctcgttatca

SEQ ID NO: 284423 - DNA, 75 bp, Artificial Sequence
  Synthetic
tagatcaagtgtttggactaaaaagggtgttttcccgaacacacgagttttttcagaagtcctggatctactact

SEQ ID NO: 284424 - DNA, 75 bp, Artificial Sequence
  Synthetic
gagcgtttcctgcggtcactggatttataactcagatgacttcttctttctcatccgagctatacctcagattct

SEQ ID NO: 284425 - DNA, 75 bp, Artificial Sequence
  Synthetic
ctagtcagcctattaatgatagatagagaatcccaaaccaggaacactagaaccaagatattagctcaaggggac

SEQ ID NO: 284426 - DNA, 75 bp, Artificial Sequence
  Synthetic
cttcgagaaatgagcctagtactgttcaactgtagcagccccaagagcgagatgcagagagcccgctctctaaat

SEQ ID NO: 284427 - DNA, 75 bp, Artificial Sequence
  Synthetic
tcaactgtagcagccccaagagcgagatgcagagagcccgctctctaaattaccaggatcttgtaagaggatttc

SEQ ID NO: 284428 - DNA, 75 bp, Artificial Sequence
  Synthetic
agactacagctgcttgtaaaccaggcattcccagaggtctgcacatgctgagactcttttgtgatgtgtctcgaa

SEQ ID NO: 284429 - DNA, 75 bp, Artificial Sequence
  Synthetic
acctcccagattttcgagttcccggatgtgtctaaacgaatatctaggatggtttctggagctgtccctcacttt

SEQ ID NO: 284430 - DNA, 75 bp, Artificial Sequence
  Synthetic
actgccttgggggatgtgcccagcttcgcgagacttcatgacctgtacaacagacccataacttattatttcagg

SEQ ID NO: 284431 - DNA, 75 bp, Artificial Sequence
  Synthetic
tggagttgttggaatcctcagttattcccctgatgcaccccctggcagacccgtccacagttttcaaggaaggtg

SEQ ID NO: 284432 - DNA, 75 bp, Artificial Sequence
  Synthetic
aagggatacctgggctcatccacttccatgtcgacccagctattccacgcctgggagaaagtcaccaatgttcat

SEQ ID NO: 284433 - DNA, 75 bp, Artificial Sequence
  Synthetic
gagttcaggggctctgattgccttgatgttgataattttcctactgacatgttgtagaagagtcaatcgaccaga

SEQ ID NO: 284434 - DNA, 75 bp, Artificial Sequence
  Synthetic
atcctaccactttaaatatcaaaggaggggctagtcccaccatcttactcaaggatgcaatcaggaaggctctgt

SEQ ID NO: 284435 - DNA, 75 bp, Artificial Sequence
  Synthetic
actctttgacggtgcaacctgaaaaaaacaagatcctgattcataacctctgtttgcttgattgtttttccatct

SEQ ID NO: 284436 - DNA, 75 bp, Artificial Sequence
  Synthetic
acgcttaacaacaaaatcagagaagaagcagacagtgtcatttgcaaagcaaaaatgtaacacccctacaatgga

SEQ ID NO: 284437 - DNA, 75 bp, Artificial Sequence
  Synthetic
aagcagacagtgtcatttgcaaagcaaaaatgtaacacccctacaatggatgccgacaagattgtattcaaagtc

SEQ ID NO: 284438 - DNA, 75 bp, Artificial Sequence
  Synthetic
tgccgacaagattgtattcaaagtcaataatcaggtggtttccttgaagccagagattatcgtggatcagtatga

SEQ ID NO: 284439 - DNA, 75 bp, Artificial Sequence
  Synthetic
ggaaggctcctgacctgaataaagcatacaagtcagtcctgtctggcatgaacgctgccaagcttgatcctgatg

SEQ ID NO: 284440 - DNA, 75 bp, Artificial Sequence
  Synthetic
atacaagtcagtcctgtctggcatgaacgctgccaagcttgatcctgatgatgtgtgttcctacttggcagctgc

SEQ ID NO: 284441 - DNA, 75 bp, Artificial Sequence
  Synthetic
ttgtggacaggccgagaggtatttcggacgactccgtgcctgggcgtggacagaggtcatagtgagccccatgat

SEQ ID NO: 284442 - DNA, 75 bp, Artificial Sequence
  Synthetic
tcttgattgcacgaaaaggagacaagatcactcctgattctcttgtagagataaaacgtactgatgtagaaggta

SEQ ID NO: 284443 - DNA, 75 bp, Artificial Sequence
  Synthetic
acctttttctgtctcggttcaactctctaatgattcttctttctcctccagaacccagatattcagatgacctga

SEQ ID NO: 284444 - DNA, 75 bp, Artificial Sequence
  Synthetic
aagggtacttgggctcgtccacctccatgtcgacccagctattccatgcctgggaaaaagtcactaatgttcatg

SEQ ID NO: 284445 - DNA, 75 bp, Artificial Sequence
  Synthetic
gatcactcctgattctcttgtagagataaaacgtactgatgtagaaggtaattgggcactgacgggaggtatgga

SEQ ID NO: 284446 - DNA, 75 bp, Artificial Sequence
  Synthetic
agaaattccaacttggctcaaactctaattagaaacatcatgtctctgacaggccctgatttccctctagaagaa

SEQ ID NO: 284447 - DNA, 75 bp, Artificial Sequence
  Synthetic
gtgaatgacttgatggcatccggaacacatccactgcctccctcagcaatcatgagtggcggagatgacattgtc

SEQ ID NO: 284448 - DNA, 75 bp, Artificial Sequence
  Synthetic
tagaatggttgaaaacagggaatagaccttatcggatgactctgacagacaattgttccaggtcttacaaagttt

SEQ ID NO: 284449 - DNA, 75 bp, Artificial Sequence
  Synthetic
gacatgtttttctctcggattgagcatttgtactcagctataagagtgggtacagttgtcactgcttatgaagac

SEQ ID NO: 284450 - DNA, 75 bp, Artificial Sequence
  Synthetic
agtctcatcttttacttcagagggttgagaaaaatctctctaaaagtatgagggccaacttacgacaaatgagct

SEQ ID NO: 284451 - DNA, 75 bp, Artificial Sequence
  Synthetic
taaactggggctgatcatcaagaaggaagagaccatgtgtagttacgacttcctcatctatgggaagactccttt

SEQ ID NO: 284452 - DNA, 75 bp, Artificial Sequence
  Synthetic
taagttgccttgagagggtcgattatgataaggcatttgggaggtatcttgccaacacgtattcctcttatttgt

SEQ ID NO: 284453 - DNA, 75 bp, Artificial Sequence
  Synthetic
atgaggcagctgagctgatgaagactgacgtagcactggcagacgacggaaccgtcaattctgatgacgaggatt

SEQ ID NO: 284454 - DNA, 75 bp, Artificial Sequence
  Synthetic
atattctctatccctcagaagatccctgctgcttatccgaccactatgaaagaaggcaacagatcaattttgtgt

SEQ ID NO: 284455 - DNA, 75 bp, Artificial Sequence
  Synthetic
cagttctaaccatcaagcccgcccaaactcatttgccgagtttctaagcaagacatattcaagtgactcgtaaag

SEQ ID NO: 284456 - DNA, 75 bp, Artificial Sequence
  Synthetic
gtctcatctcctacttcagagggttgagagaaatttgtctaagagtatgagagctaacttgcgacaaatgagttc

SEQ ID NO: 284457 - DNA, 75 bp, Artificial Sequence
  Synthetic
gagagaaatttgtctaagagtatgagagctaacttgcgacaaatgagttccttgatgaggcaggtgttgggaggg

SEQ ID NO: 284458 - DNA, 75 bp, Artificial Sequence
  Synthetic
agactctctgcgaaggacaaggtgggttgatcaggaagtccgccatgcagctagaaccatgacaggagattatag

SEQ ID NO: 284459 - DNA, 75 bp, Artificial Sequence
  Synthetic
agaaatagagaggcatcttcaaggatataacaggtggatcaccctcgaggacataagatccagatcatctctact

SEQ ID NO: 284460 - DNA, 75 bp, Artificial Sequence
  Synthetic
tacagacattgggggcacccctatatagattatcgaaagggtctatcgaaactatatgatcaagttcacattaag

SEQ ID NO: 284461 - DNA, 75 bp, Artificial Sequence
  Synthetic
catctccagggagaacccatagaagtggataatctccccgaagacatgaggcgacttcagctggatgacggaaaa

SEQ ID NO: 284462 - DNA, 75 bp, Artificial Sequence
  Synthetic
gtgatgcagaggtcactgacattgcatcaatcaaccgaataaccctgctaatgtctgattttgcattgtccatag

SEQ ID NO: 284463 - DNA, 75 bp, Artificial Sequence
  Synthetic
tcaacaagaccttgatggaggctgatgctcactacaagtcagtccggacttggaatgagatcatcccctcaaaag

SEQ ID NO: 284464 - DNA, 75 bp, Artificial Sequence
  Synthetic
gaaaaaaacaagatcttgactctgaacctctggttgtttgattgttttttttatctttgttgtttatttgttaag

SEQ ID NO: 284465 - DNA, 75 bp, Artificial Sequence
  Synthetic
aaaaaacaagatcccaagtcagaacctctgattgtttgattgttttttctatttttattgtttttttgttaagcg

SEQ ID NO: 284466 - DNA, 75 bp, Artificial Sequence
  Synthetic
acctagacaatgttggagtccaaatagtcagacagatgaggtcaggagagagattcctcaagatctggtcacaaa

SEQ ID NO: 284467 - DNA, 75 bp, Artificial Sequence
  Synthetic
gcgacttcagctggatgacggaaaaccgtctggcctcagtgagatagctactgcggtagaaagcaagtataggga

SEQ ID NO: 284468 - DNA, 75 bp, Artificial Sequence
  Synthetic
gaggtgaatgacctaatggcttccggaacacatccactgcctccttcagcaatcatgagcggaggagacgacatt

SEQ ID NO: 284469 - DNA, 75 bp, Artificial Sequence
  Synthetic
cccgaatggaggctcaaactgcctctggtcctccagctctcgaatggtctgcaaccaacgaagaggatgatctat

SEQ ID NO: 284470 - DNA, 75 bp, Artificial Sequence
  Synthetic
ggtctcaggggttgacctgggcctcccaaactgggggaagtatgtattactgagtgcaggggccctgattgcctt

SEQ ID NO: 284471 - DNA, 75 bp, Artificial Sequence
  Synthetic
caatctgggaaaaaccgtcagacctgagaaacttgacaacctggaaatacttccagtcagtccaaaaacaggtaa

SEQ ID NO: 284472 - DNA, 75 bp, Artificial Sequence
  Synthetic
tgagtgcaggggccctgattgccttaatgttgatgatctttctaatgacatgctgtagaaaagtcaatcgaccag

SEQ ID NO: 284473 - DNA, 75 bp, Artificial Sequence
  Synthetic
gattgctgagagcttttccaagaaatacaagttcccatcccggtcatcagggatattcttgtacaattttgagca

SEQ ID NO: 284474 - DNA, 75 bp, Artificial Sequence
  Synthetic
gttaaaaatgaacctcgacgatatagtcaaagagtcaaaaaatgtgccaggtgtgacgcgtttagcccgtgaagg

SEQ ID NO: 284475 - DNA, 75 bp, Artificial Sequence
  Synthetic
gtcgagagcgttcccctcagtcacaggatttataactcaagtaacttcgtcattttcatctgagctctatcttcg

SEQ ID NO: 284476 - DNA, 75 bp, Artificial Sequence
  Synthetic
ggatttataactcaagtaacttcgtcattttcatctgagctctatcttcgattttccaaacgagggaaatttttc

SEQ ID NO: 284477 - DNA, 75 bp, Artificial Sequence
  Synthetic
gtgtgacgcgtttagcccgtgaaggatccaagctccctctaagatgtgtactgggatgggtcgctctggcaaact

SEQ ID NO: 284478 - DNA, 75 bp, Artificial Sequence
  Synthetic
cgcgagagaggcaatcctatatttcttccacaagaactttgaggaagaaataagaagaatgttcgagccagggca

SEQ ID NO: 284479 - DNA, 75 bp, Artificial Sequence
  Synthetic
gccggaaaagctgaataaaatcatgcaggatgatctgaaccgttatacatcctgctgacagatttttaaactcag

SEQ ID NO: 284480 - DNA, 75 bp, Artificial Sequence
  Synthetic
cctgctgacagatttttaaactcagttctgttagacgataaagcctgaactgttccggacccgacatgaaaaaaa

SEQ ID NO: 284481 - DNA, 75 bp, Artificial Sequence
  Synthetic
tgagtggaaagtctccctattcatcaaatgcagttggtcatgtgttcaatctcattcactttgttggatgttata

SEQ ID NO: 284482 - DNA, 75 bp, Artificial Sequence
  Synthetic
cccaacctgctggaatggccaggacggcgggctagagggcttacggcagaagggctggagtctagtcagcttatt

SEQ ID NO: 284483 - DNA, 75 bp, Artificial Sequence
  Synthetic
tgatgatgacctgtggctgcctcctcctgaatatgtcccgttgaaagaactcacaggcaagaaaaacatgaggaa

SEQ ID NO: 284484 - DNA, 75 bp, Artificial Sequence
  Synthetic
tcacaggcaagaaaaacatgaggaacttctgtgtcaatggagaggtcaaagtgtgcagtcccaacggctactcgt

SEQ ID NO: 284485 - DNA, 75 bp, Artificial Sequence
  Synthetic
tcctaagatcctgaggcacttcaacatatgttgcagtactatgatgtatctatctaccgctctaggcgatgtccc

SEQ ID NO: 284486 - DNA, 75 bp, Artificial Sequence
  Synthetic
cttctgtgtcaatggagaggtcaaagtgtgcagtcccaacggctactcgtttaggatcctgcggcacattctaag

SEQ ID NO: 284487 - DNA, 75 bp, Artificial Sequence
  Synthetic
tgagcatgcatctttagtcggtcttctcttgagtctgtataggttgagcaagatatcaggacaaaacaccggtaa

SEQ ID NO: 284488 - DNA, 75 bp, Artificial Sequence
  Synthetic
aggtagtcattggactggctttatcaggagctccagtccctgagggcatgaattgggtatacaaattgaggagaa

SEQ ID NO: 284489 - DNA, 75 bp, Artificial Sequence
  Synthetic
gaaaaaaactaacacccctccttttgaaccatcccaaacatgagcaagatctttgtcaatccgagtgcaatcaga

SEQ ID NO: 284490 - DNA, 75 bp, Artificial Sequence
  Synthetic
ctttgtcaatccgagtgcaatcagagccggtttggctgatctcgaaatggctgaggagactgttgatctaatcaa

SEQ ID NO: 284491 - DNA, 75 bp, Artificial Sequence
  Synthetic
caatgtcatatccaaggcagagtatggtgtatcaacatgaattctagagcctgtcaactatggtctgacatgtct

SEQ ID NO: 284492 - DNA, 75 bp, Artificial Sequence
  Synthetic
atctccaaggggaacccatagaagtggacaatctccctgaggatatggggcgacttcacctggatgatggaaaat

SEQ ID NO: 284493 - DNA, 75 bp, Artificial Sequence
  Synthetic
acgcttaacaacaaaatcagagaagaagcagacagcgtcatttgcaaagcaaaaatgtaacacccctacaatgga

SEQ ID NO: 284494 - DNA, 75 bp, Artificial Sequence
  Synthetic
ataaagactcttccctgctcctagaatagttagattatatcccacagatttgtcacttttttacctctggaggag

SEQ ID NO: 284495 - DNA, 75 bp, Artificial Sequence
  Synthetic
tcatatacgtcaattctcagaccctgtctctgaagggttgtccttctggagagagatctggttaagctcccacga

SEQ ID NO: 284496 - DNA, 75 bp, Artificial Sequence
  Synthetic
gtctctgaagggttgtccttctggagagagatctggttaagctcccacgagtcctggattcacgcgttgtgtcaa

SEQ ID NO: 284497 - DNA, 75 bp, Artificial Sequence
  Synthetic
ggaaagcccccgatttaaacaaagcatacaagtcagttttatcaggcatgaatgctgccaagcttgatcctgacg

SEQ ID NO: 284498 - DNA, 75 bp, Artificial Sequence
  Synthetic
ggttttctcatcgtgcttcgggaaattccccatctacacgataccagacaaactcggcccttggagtcctattga

SEQ ID NO: 284499 - DNA, 75 bp, Artificial Sequence
  Synthetic
ccttctagaagatcctaccaccttaaatataaaaggaggtgccagtcctaccattctactcaaggatgcaatcag

SEQ ID NO: 284500 - DNA, 75 bp, Artificial Sequence
  Synthetic
cctgaagactggaccagctatggaatcttgattgcaagaaagggagacaagattaccccagattctcttgtggag

SEQ ID NO: 284501 - DNA, 75 bp, Artificial Sequence
  Synthetic
gattaccccagattctcttgtggagatcaagcgtacagatatagaaggaaactgggctctaacaggaggtatgga

SEQ ID NO: 284502 - DNA, 75 bp, Artificial Sequence
  Synthetic
tcagccataaaagtgaacgggttcacttgcacgggtgtggtgacagaagcagagacctacacaaactttgtcggc

SEQ ID NO: 284503 - DNA, 75 bp, Artificial Sequence
  Synthetic
aatatcaggacaaaacacaggcaactacaagacaaacattgcagatcggatagagcagatttttgagacagcccc

SEQ ID NO: 284504 - DNA, 75 bp, Artificial Sequence
  Synthetic
agcacttccgcccgacacctgatgcctgcagagcagcatataactggaagatggcaggtgaccccagatatgagg

SEQ ID NO: 284505 - DNA, 75 bp, Artificial Sequence
  Synthetic
caggaataacggtgtcttctacctactgctctactaaccatgactacaccatctggatgcctgagaatcccagac

SEQ ID NO: 284506 - DNA, 75 bp, Artificial Sequence
  Synthetic
gcgctaattggagtaccataccgaacttccgattcttggccggaacatacgacatgtatttctcccggattgagc

SEQ ID NO: 284507 - DNA, 75 bp, Artificial Sequence
  Synthetic
ggattaatcggatgacccagacacctcaaagggtcgggagggtgtggccttgctcttcagagagggcagatctac

SEQ ID NO: 284508 - DNA, 75 bp, Artificial Sequence
  Synthetic
accaccaaggagtctcttgttatcatatctccgagtgtgtcggacttagacccgtacgataaatctcttcattcc

SEQ ID NO: 284509 - DNA, 75 bp, Artificial Sequence
  Synthetic
cttccgattcttggccggaacatacgacatgtatttctcccggattgagcatctatattcagctatcagagtggg

SEQ ID NO: 284510 - DNA, 75 bp, Artificial Sequence
  Synthetic
tcagggagatctcttggggaagaaaagtggtaggcacgacagttccccacccttctgagatgttggggttacttc

SEQ ID NO: 284511 - DNA, 75 bp, Artificial Sequence
  Synthetic
tgcaagagaagcaatactatatttcttccacaagaactttgaagaagagatacgaagaatgttcgagccagggca

SEQ ID NO: 284512 - DNA, 75 bp, Artificial Sequence
  Synthetic
tgagcgggaagtccccgtattcgtcaaatgcagtaggtcatgtattcaatctcattcactttgttggatgttata

SEQ ID NO: 284513 - DNA, 75 bp, Artificial Sequence
  Synthetic
ctatgtggagttcttggacttagacttatggacggaacatgggttgcgattcaaacatctgatgaggccaaatgg

SEQ ID NO: 284514 - DNA, 75 bp, Artificial Sequence
  Synthetic
catgagatgtctgtcctagggggttatctaggggaagagttttttggaaagggcacatttgaaagaagattcttt

SEQ ID NO: 284515 - DNA, 75 bp, Artificial Sequence
  Synthetic
tgaacatcttgttgtggaagagttagtaaagaaaagagaagagtgtctagatgcactggagtctatcatgaccac

SEQ ID NO: 284516 - DNA, 75 bp, Artificial Sequence
  Synthetic
tgagaccagactgtgaggactggccgtcctttcaacgatccaagtcctgaagatcacctccccttggggggttct

SEQ ID NO: 284517 - DNA, 75 bp, Artificial Sequence
  Synthetic
atctaggggaagagttttttggaaagggcacatttgaaagaagattctttagagacgaaaaagaactccaagaat

SEQ ID NO: 284518 - DNA, 75 bp, Artificial Sequence
  Synthetic
atgcactggagtctatcatgaccaccaagtccgtaagtttcagacgcctcagtcacttgaggaagctcgtccccg

SEQ ID NO: 284519 - DNA, 75 bp, Artificial Sequence
  Synthetic
caacaaaaccttgatggaggctgatgctcactacaaatcagtccgtacatggaatgagatcatcccctctaaagg

SEQ ID NO: 284520 - DNA, 75 bp, Artificial Sequence
  Synthetic
tttgcattttcagcctcttggatgtgaaaaaaacttttaacacccctcaaaaaaactcaaggaaagatgattcct

SEQ ID NO: 284521 - DNA, 75 bp, Artificial Sequence
  Synthetic
cagacatggacatcagagctggtacagagagacacaaggctgagggactctacgtttcattggcacctccggtgt

SEQ ID NO: 284522 - DNA, 75 bp, Artificial Sequence
  Synthetic
cagttccaatcatcaagctcgcccaaactcatttgctgagtttctaaacaaaacatattctagtgactcataaag

SEQ ID NO: 284523 - DNA, 75 bp, Artificial Sequence
  Synthetic
tcaatggtatcatcctgggtcctgatggacatgttctaatcccagagatgcagtcatctctccttcaacagcata

SEQ ID NO: 284524 - DNA, 75 bp, Artificial Sequence
  Synthetic
agttgaatcacaggattctaggaaacgacaacttgtgtacatccttcatgaaaaaaactaacacctctccttgcg

SEQ ID NO: 284525 - DNA, 75 bp, Artificial Sequence
  Synthetic
cttcgagttcccggatgtgtcaaaaagaatatccagaatggtttctggggctgtgcctcacttccagagacttcc

SEQ ID NO: 284526 - DNA, 75 bp, Artificial Sequence
  Synthetic
acgaggcggaagattttgtcgaggttcaccttccggatgtccacaagcaggtctcgggagttgatctcggtctcc

SEQ ID NO: 284527 - DNA, 75 bp, Artificial Sequence
  Synthetic
gtctcgggagttgatctcggtctcccaagctgggggaagtatgtgctgatgagtgtaggcgctatgattgcactg

SEQ ID NO: 284528 - DNA, 75 bp, Artificial Sequence
  Synthetic
ggataatcttcccgatgacatgaggcggcttcagctggaagacgggaaaccgtccaactttggtgagatagccga

SEQ ID NO: 284529 - DNA, 75 bp, Artificial Sequence
  Synthetic
atgttgatgattttcctgatgacgtgttgcagaaaagctaacggagcagaaacaatacaacaccgtctcggagag

SEQ ID NO: 284530 - DNA, 75 bp, Artificial Sequence
  Synthetic
acgggaaggaaagtgtctgtcacctcccaaagcgggagggtcatatcttcctgggagtcgtataaaagcgggggt

SEQ ID NO: 284531 - DNA, 75 bp, Artificial Sequence
  Synthetic
aacatcttgaggaactctgactacaatctcaactctcctttgatagaagatcctgctagactaatgttagaatgg

SEQ ID NO: 284532 - DNA, 75 bp, Artificial Sequence
  Synthetic
tcttgataggatcctcgatttgcttcttgacaagaatgacaaatatcaacatcaatagacctcttgagttgatct

SEQ ID NO: 284533 - DNA, 75 bp, Artificial Sequence
  Synthetic
gagaccaagctgtagatacaagccatctcctctagatctcacattccaacaatcatatccccttgtgatgaaggg

SEQ ID NO: 284534 - DNA, 75 bp, Artificial Sequence
  Synthetic
gtcagacaaatgaggtcaggagagagattcctcaaaatatggtcacagacggtggaagagattatatcttacgtc

SEQ ID NO: 284535 - DNA, 75 bp, Artificial Sequence
  Synthetic
ttcaagagtcacaagactttcattaatcatctcaatcgatcagatatggttgtgtagattctcataatacaagag

SEQ ID NO: 284536 - DNA, 75 bp, Artificial Sequence
  Synthetic
atcatctcaatcgatcagatatggttgtgtagattctcataatacaagagatcttctagcagttccagtgaccaa

SEQ ID NO: 284537 - DNA, 75 bp, Artificial Sequence
  Synthetic
ccagactaccggccgagagcctaagaaagagacgacactctcttcttctcagagggaaagccaatcctcgaaagc

SEQ ID NO: 284538 - DNA, 75 bp, Artificial Sequence
  Synthetic
aaagagacgacactctcttcttctcagagggaaagccaatcctcgaaagccaagatggtggctcaaactgcctct

SEQ ID NO: 284539 - DNA, 75 bp, Artificial Sequence
  Synthetic
agtagaggctgagatcgctcaccagattgctgaaagcttctccaagaagtacaagtttccctccagatcatcagg

SEQ ID NO: 284540 - DNA, 75 bp, Artificial Sequence
  Synthetic
atatccagatactagactgggtaagagttgatcaagaaaggaaacttgcctcctatgaaggacagaagcaataga

SEQ ID NO: 284541 - DNA, 75 bp, Artificial Sequence
  Synthetic
tcctatgaaggacagaagcaatagatcactatcaccttgcatctcagcaaagtgtgtacaattataaagggctgg

SEQ ID NO: 284542 - DNA, 75 bp, Artificial Sequence
  Synthetic
tttagagtctgacgacgacattcaaagattactaaaagactctttgcagagaacaaggtgggtggatcaagaggt

SEQ ID NO: 284543 - DNA, 75 bp, Artificial Sequence
  Synthetic
tcactatcaccttgcatctcagcaaagtgtgtacaattataaagggctgggtcatctacgcttttcagtcgagaa

SEQ ID NO: 284544 - DNA, 75 bp, Artificial Sequence
  Synthetic
gtacaggcagtctttcactacctgttatttagcccaatcttaaagggcagagtttacaagattctgagtgctgag

SEQ ID NO: 284545 - DNA, 75 bp, Artificial Sequence
  Synthetic
tgtgacccgtttagcccatgacgggtccaagctccctctgagatgtgtactggggtgggttgctctagctaactc

SEQ ID NO: 284546 - DNA, 75 bp, Artificial Sequence
  Synthetic
tagtaacacttctcatcttcaggccctcaccatgttgatcgattcaggagaagtttatgatgacccggtggatcc

SEQ ID NO: 284547 - DNA, 75 bp, Artificial Sequence
  Synthetic
caagagattccagctgttagttgaacccgacaagctaaacaaagtcatgcaagatgatctaaatcgttacacatc

SEQ ID NO: 284548 - DNA, 75 bp, Artificial Sequence
  Synthetic
agattactaaaagactctttgcagagaacaaggtgggtggatcaagaggtgcgccatgcagccagaaccatgacc

SEQ ID NO: 284549 - DNA, 75 bp, Artificial Sequence
  Synthetic
caggaataacggtgtcttctacctactgctcaactaaccacgattacaccatttggatgcctgagaatccgagac

SEQ ID NO: 284550 - DNA, 75 bp, Artificial Sequence
  Synthetic
tgttctaaattcaacatgaaaaaaacaggcaacaccactgataaaatgaatttcatacgcaagatagtgaaaaac

SEQ ID NO: 284551 - DNA, 75 bp, Artificial Sequence
  Synthetic
caggcaacaccactgataaaatgaatttcatacgcaagatagtgaaaaactgtagagatgaggacacccaaaagc

SEQ ID NO: 284552 - DNA, 75 bp, Artificial Sequence
  Synthetic
agtaggtggaactgcagcccagtcgatgatctctctctggttatatggtgcccactctgaatcaaacaggagccg

SEQ ID NO: 284553 - DNA, 75 bp, Artificial Sequence
  Synthetic
cccgaatacgtcccgctgaaagaactcacgggcaagaagaacatgaggaacttttgtatcaacggagaagtgaga

SEQ ID NO: 284554 - DNA, 75 bp, Artificial Sequence
  Synthetic
gtgtgcagtccgaatggttactcattcaggatcctgcggcacattctgagatcattcgacgagatatattccgga

SEQ ID NO: 284555 - DNA, 75 bp, Artificial Sequence
  Synthetic
aaaacaggtcaacatgtcttatgacctcattatttgtgatgcagaagtcactgacattgcatctatcaaccggat

SEQ ID NO: 284556 - DNA, 75 bp, Artificial Sequence
  Synthetic
gacgggaaggaaagtgtctgtcacctcccaaagcgggagggtcatatcttcctgggagtcatataaaagcggggg

SEQ ID NO: 284557 - DNA, 75 bp, Artificial Sequence
  Synthetic
tagaggccctctcgagggggaggaattggaatactctcaagagatcacttgggacgacgacactgaatttgtcgg

SEQ ID NO: 284558 - DNA, 75 bp, Artificial Sequence
  Synthetic
ggaagaagagaagactattttagctttatggaaagatttgacttcagtcgatattggaaaagatttagttaagtt

SEQ ID NO: 284559 - DNA, 75 bp, Artificial Sequence
  Synthetic
agaggggggcctgttcctagtgagaaggtcattatcacagctctgtccaagccgcctgtcaatcccagagagttc

SEQ ID NO: 284560 - DNA, 75 bp, Artificial Sequence
  Synthetic
atgaggctgaggattttgtggaagttcaccttcctgatgtgcacaaacaggtctcaggggttgacctgggtctcc

SEQ ID NO: 284561 - DNA, 75 bp, Artificial Sequence
  Synthetic
attaaaatactggaaccatatgtcgtgaacagcttagtccagagggcagagaagttcaggcctctcatccattct

SEQ ID NO: 284562 - DNA, 75 bp, Artificial Sequence
  Synthetic
gagtgcagggaccctgattgccttgatgttgataatttttctaatgacgtgttgtagaagagtcaatcgaccaga

SEQ ID NO: 284563 - DNA, 75 bp, Artificial Sequence
  Synthetic
aacattcggtcctagtgcaaaaaggttttttagagttctggatcagttcgacaacatacatgacctggtctttgt

SEQ ID NO: 284564 - DNA, 75 bp, Artificial Sequence
  Synthetic
catacatcatctcagctgtccaaacaatttggttgtggaggacgagggatgcaccaacctgtcaggattttccta

SEQ ID NO: 284565 - DNA, 75 bp, Artificial Sequence
  Synthetic
tgatttgactcaagacgggaagaactatgatttcatgttccagccattgatgctttatgcgcagacatggacatc

SEQ ID NO: 284566 - DNA, 75 bp, Artificial Sequence
  Synthetic
cctgtacaggcgtggtgacggaggcagaaacttatactaatttcgtcggttatgtcaccaccacgttcaggagaa

SEQ ID NO: 284567 - DNA, 75 bp, Artificial Sequence
  Synthetic
cagattgatgttagaatggttaaagacagggaatagaccttaccggatgaccttaacagacaactgctctaggtc

SEQ ID NO: 284568 - DNA, 75 bp, Artificial Sequence
  Synthetic
attcgagggaatatttatctatcttggagttggtctgatgacacctcagtgttcaagagagtagcttgtaattcc

SEQ ID NO: 284569 - DNA, 75 bp, Artificial Sequence
  Synthetic
agcactttcgccctacaccagacgcgtgcagggccgcgtacaaccggaagttggccggtgaccctagatatgaag

SEQ ID NO: 284570 - DNA, 75 bp, Artificial Sequence
  Synthetic
agtctttgcacaacccataccctgactatcattggctccgaacggtaaaaaccactaaggagtccctcgttatta

SEQ ID NO: 284571 - DNA, 75 bp, Artificial Sequence
  Synthetic
gatatttgagatccctgagtcaatggacccatcagaaatactagatgacaagtcacactccttcaccagaacgag

SEQ ID NO: 284572 - DNA, 75 bp, Artificial Sequence
  Synthetic
ctatcattggctccgaacggtaaaaaccactaaggagtccctcgttattatatctccgagtgtggcagatttaga

SEQ ID NO: 284573 - DNA, 75 bp, Artificial Sequence
  Synthetic
atgagggactttctgcttatgtcagtgcaggcagtctttcactacttgctgttcagccccatcttaaagggtaga

SEQ ID NO: 284574 - DNA, 75 bp, Artificial Sequence
  Synthetic
aggtcatcatcacagctctgtctaaaccacctgtcaatccgagggagtttttaaaatctatcgaccttggaggat

SEQ ID NO: 284575 - DNA, 75 bp, Artificial Sequence
  Synthetic
agaaggggtgttgagttgccttgaaagagttgactatgataaggcattcgggaggtatcttgccaatacatattc

SEQ ID NO: 284576 - DNA, 75 bp, Artificial Sequence
  Synthetic
cggggataaccgtgtcctccacctactgccctaccaaccatgattacaccatctggatgccagagaatccgagac

SEQ ID NO: 284577 - DNA, 75 bp, Artificial Sequence
  Synthetic
cgatgtgtcttgaaaaaaacaagatctggaatccgaacctctggctgtttgattgttttttccatctttattgtt

SEQ ID NO: 284578 - DNA, 75 bp, Artificial Sequence
  Synthetic
ctgccctaccaaccatgattacaccatctggatgccagagaatccgagactggggacatcttgtgacatttttgt

SEQ ID NO: 284579 - DNA, 75 bp, Artificial Sequence
  Synthetic
accacctgtcaatccgagggagtttttaaaatctatcgaccttggaggattgcctgatgaagacttgataattgg

SEQ ID NO: 284580 - DNA, 75 bp, Artificial Sequence
  Synthetic
tggatgaaagaggtctgtacaagtctctaaaaggggcatgcaaactcaagctatgtggggttctcggactcagac

SEQ ID NO: 284581 - DNA, 75 bp, Artificial Sequence
  Synthetic
tctaaaaggggcatgcaaactcaagctatgtggggttctcggactcagacttatggatggaacatgggtcgcaat

SEQ ID NO: 284582 - DNA, 75 bp, Artificial Sequence
  Synthetic
gctaattatatcttgccactctttgatgcactgactatgacagacaatctgaacaaggtgttcaagaagttgatt

SEQ ID NO: 284583 - DNA, 75 bp, Artificial Sequence
  Synthetic
cctatacatgaatgccctagactgggacgaagaaaaaaccattctagcattatggaaagatttaacctcggtgga

SEQ ID NO: 284584 - DNA, 75 bp, Artificial Sequence
  Synthetic
tacatgattttcgctcagatgagatcgaacatcttgttgtggaggagttggttaagaagagagaagaatgtctag

SEQ ID NO: 284585 - DNA, 75 bp, Artificial Sequence
  Synthetic
cgaacatcttgttgtggaggagttggttaagaagagagaagaatgtctagatgcactggaatccatcatgaccac

SEQ ID NO: 284586 - DNA, 75 bp, Artificial Sequence
  Synthetic
gactttagaagtgctaaaatgacgtacctgaccctcattacttaccagtctcatctcctactccagagagttgag

SEQ ID NO: 284587 - DNA, 75 bp, Artificial Sequence
  Synthetic
ggttcggaaaggcatacaccatattcaacaaaaccctgatggaagctgatgctcactacaagtcagtccggacct

SEQ ID NO: 284588 - DNA, 75 bp, Artificial Sequence
  Synthetic
cattaaaatattagaaccatatgtagtgaacagcttagtccaaagggcagaaaagttcaggcctctcattcattc

SEQ ID NO: 284589 - DNA, 75 bp, Artificial Sequence
  Synthetic
caacaaaaccctgatggaagctgatgctcactacaagtcagtccggacctgggatgaaatcatcccctcaaaagg

SEQ ID NO: 284590 - DNA, 75 bp, Artificial Sequence
  Synthetic
ctcagagttcaaattgtctttttgacaggaactatacacttatgctgaaagacctttttttatctcgtttcaact

SEQ ID NO: 284591 - DNA, 75 bp, Artificial Sequence
  Synthetic
tcttgagtctgtataggttgagcaaaatatctggacagaacaccggcaattacaagacaaacatcgcagatagaa

SEQ ID NO: 284592 - DNA, 75 bp, Artificial Sequence
  Synthetic
ttgcggcagaagggctggagtctggttagcctattaatgatagacagagagtctcaaaccagaaacacaagaacc

SEQ ID NO: 284593 - DNA, 75 bp, Artificial Sequence
  Synthetic
ttaatggtattatactgggtcctgatggtcatgttctaatcccagaaatgcaatcatccctccttcagcagcata

SEQ ID NO: 284594 - DNA, 75 bp, Artificial Sequence
  Synthetic
tacaagacaaacatcgcagatagaatagagcagattttcgagacggccccctttgtaaagattgtagaacatcat

SEQ ID NO: 284595 - DNA, 75 bp, Artificial Sequence
  Synthetic
ctttgtaaagattgtagaacatcataccttgatgacaacccacaaaatgtgtgctaactggagtaccataccgaa

SEQ ID NO: 284596 - DNA, 75 bp, Artificial Sequence
  Synthetic
aggttctatgtccaacatatatgttgtcacctgggctatccagagagggacttctctatgagttggagagcatat

SEQ ID NO: 284597 - DNA, 75 bp, Artificial Sequence
  Synthetic
caatcatccctccttcagcagcatatggagttgttggagtcctcagttatccctctaatgcaccccttggcagac

SEQ ID NO: 284598 - DNA, 75 bp, Artificial Sequence
  Synthetic
ctcaaggatgcaatcagaaaggctttatatgacgaggtggacaaggtggagaattcagagtttcgagaggcaatc

SEQ ID NO: 284599 - DNA, 75 bp, Artificial Sequence
  Synthetic
gcatcttcctgatgtgcacaaacaaatctcaggggttgatttgggcctcccaaactgggggaaatatgttctaat

SEQ ID NO: 284600 - DNA, 75 bp, Artificial Sequence
  Synthetic
ctagggttgattatcaagaaggaagagaccatgtgtagttacgactttctcatctatgggaagacccctttgttt

SEQ ID NO: 284601 - DNA, 75 bp, Artificial Sequence
  Synthetic
atctcaggggttgatttgggcctcccaaactgggggaaatatgttctaatgagtgcaggtgctctgattgccctg

SEQ ID NO: 284602 - DNA, 75 bp, Artificial Sequence
  Synthetic
catctatgggaagacccctttgtttaggggcaatatcctagtacctgagtcaaaaagatgggccagagtctcttg

SEQ ID NO: 284603 - DNA, 75 bp, Artificial Sequence
  Synthetic
tgcaagagaagcaatactatatttcttccacaagaactttgaggaagagataagaagaatgtttgagccggggca

SEQ ID NO: 284604 - DNA, 75 bp, Artificial Sequence
  Synthetic
atccacacagcatagtctcagagaaacagggagaaaagtgtcggtcacttcccaaaacgggaaggtaatatcttc

SEQ ID NO: 284605 - DNA, 75 bp, Artificial Sequence
  Synthetic
cttgccaatataatgtcaacggtgtccacaaatgcattaactgtggcacaacactcccagtccttgatcaagcca

SEQ ID NO: 284606 - DNA, 75 bp, Artificial Sequence
  Synthetic
tttgtcatcaccgaaaagctcttggctaactacatcttgccactttttgacgcactgactatgacagacaacctg

SEQ ID NO: 284607 - DNA, 75 bp, Artificial Sequence
  Synthetic
acactcccagtccttgatcaagccaatgagggactttctgcttatgtcagtccaggcagtttttcactatttgtt

SEQ ID NO: 284608 - DNA, 75 bp, Artificial Sequence
  Synthetic
acagggagaaaagtgtcggtcacttcccaaaacgggaaggtaatatcttcatgggaatcatataagaacggaggc

SEQ ID NO: 284609 - DNA, 75 bp, Artificial Sequence
  Synthetic
catgagtggaggagatgacatcgtttccagagtgatagattttgactcaatctgggaaaaaccgtctgacctgag

SEQ ID NO: 284610 - DNA, 75 bp, Artificial Sequence
  Synthetic
ggttgctttcccttggggttagggggaatctttgggcttgacggtcctcccctagctctggatgacagggtagat

SEQ ID NO: 284611 - DNA, 75 bp, Artificial Sequence
  Synthetic
gtttacaagattttaagtgctgaaggtgacaatttccttctagctatgtcaagaataatctatttagacccatcc

SEQ ID NO: 284612 - DNA, 75 bp, Artificial Sequence
  Synthetic
gaatctttgggcttgacggtcctcccctagctctggatgacagggtagatttaaaagtcacgagactttcattaa

SEQ ID NO: 284613 - DNA, 75 bp, Artificial Sequence
  Synthetic
taagaagaatgtttgagccggggcaggaaaccgcagttcctcactcctatttcatccatttccgttcattgggcc

SEQ ID NO: 284614 - DNA, 75 bp, Artificial Sequence
  Synthetic
aggaacttttgagagaagattctttagagacgagaaggagcttcaggaatatgaggcagctgaattaacgaagac

SEQ ID NO: 284615 - DNA, 75 bp, Artificial Sequence
  Synthetic
tgcagaagttactgacattgaatctatcaaccggataaccctgttaatgtctgattttgcattgtctatagacgg

SEQ ID NO: 284616 - DNA, 75 bp, Artificial Sequence
  Synthetic
tcttctagcagtttcagtgaccaaaggtgctttcatcctccaggaactgataccaaaggttggagacaggccaag

SEQ ID NO: 284617 - DNA, 75 bp, Artificial Sequence
  Synthetic
ctgatgtcttggaacctaagattgtactttgttatcaccgaaaagctcttagctaattatatcttgccactcttt

SEQ ID NO: 284618 - DNA, 75 bp, Artificial Sequence
  Synthetic
gctcccatgagtcttggattcacgccttgtgtcaggaggcggggaatccagatcttggagagagaacactcgaga

SEQ ID NO: 284619 - DNA, 75 bp, Artificial Sequence
  Synthetic
acagtcaattccgacgatgaggactacttctctagtgagactcggagtccagaagctgtttatactcgaattatg

SEQ ID NO: 284620 - DNA, 75 bp, Artificial Sequence
  Synthetic
cttgtgtcaggaggcggggaatccagatcttggagagagaacactcgagagcttcactcggcttctagaggaccc

SEQ ID NO: 284621 - DNA, 75 bp, Artificial Sequence
  Synthetic
tcgcctgggctgtctcgagaggggctcctctatgagttagagagcatatcaaggaatgcactttcaatataccga

SEQ ID NO: 284622 - DNA, 75 bp, Artificial Sequence
  Synthetic
cacacataaggagatatgtctcagttagttccaatcatcaagctcgccctaattcattcgctgagtttctaaaca

SEQ ID NO: 284623 - DNA, 75 bp, Artificial Sequence
  Synthetic
ttcaattgaggaaggcgatttgcctccgatgaaggacataagcaatagcccacaatcatcttgcatcttaacaaa

SEQ ID NO: 284624 - DNA, 75 bp, Artificial Sequence
  Synthetic
ggtgctttcatcctccaggaactgataccaaaggttggagacaggccaagggatattttggatgaccccgtgctt

SEQ ID NO: 284625 - DNA, 75 bp, Artificial Sequence
  Synthetic
cacaatcatcttgcatcttaacaaagtatgtatgattataaagggctgggtcatctacgcttttcagtcaagaaa

SEQ ID NO: 284626 - DNA, 75 bp, Artificial Sequence
  Synthetic
ggttgaacaacaggattgtgaatgctaataaatcttgtacatcattcatgaaaaaaactaacacccctcctcttg

SEQ ID NO: 284627 - DNA, 75 bp, Artificial Sequence
  Synthetic
ggcaacacttctcatcttgagacgtccatcaagatgctcgatccaggagaggtctatgatgaccccgttgaccca

SEQ ID NO: 284628 - DNA, 75 bp, Artificial Sequence
  Synthetic
ccatcaagatgctcgatccaggagaggtctatgatgaccccgttgacccaattgagtcagaggctgagtctagag

SEQ ID NO: 284629 - DNA, 75 bp, Artificial Sequence
  Synthetic
tttagcccgatcttaaagggcagagtttacaagattttgaacgcagaaggggagagctttctcctggccatgtcg

SEQ ID NO: 284630 - DNA, 75 bp, Artificial Sequence
  Synthetic
ctcatatttctgttagtacagacaccatgtctgatttgacccaagacgggaagaactacgatttcatgttccagc

SEQ ID NO: 284631 - DNA, 75 bp, Artificial Sequence
  Synthetic
agtttagaagaagtctctcacgaactttggaggagtctttttacaactcagagattcatgggatcaacaggatga

SEQ ID NO: 284632 - DNA, 75 bp, Artificial Sequence
  Synthetic
tctcctttaatagaagatcctgccaggctgatgttagattggttgaaaacagggaataggcctcaccggatgacc

SEQ ID NO: 284633 - DNA, 75 bp, Artificial Sequence
  Synthetic
ggctgatgttagattggttgaaaacagggaataggcctcaccggatgaccctgacggacaattgttctaggtctt

SEQ ID NO: 284634 - DNA, 75 bp, Artificial Sequence
  Synthetic
cggcttcaattggacgatgaaaaaccatctggcctcggtggggtggtcaaagcaagagagatcaagtgtcaggaa

SEQ ID NO: 284635 - DNA, 75 bp, Artificial Sequence
  Synthetic
gcagatctcttgagggaaatctcttgggggaggaaagtggtaggtaccacggtgcctcacccttctgagatgttg

SEQ ID NO: 284636 - DNA, 75 bp, Artificial Sequence
  Synthetic
gtgggcggaattgcagcacagtcgatgatttctctttggttatatggtgcccattctgaatcgaacagaagtagg

SEQ ID NO: 284637 - DNA, 75 bp, Artificial Sequence
  Synthetic
cctggacaatgttggagttcaaatagtcagacaaatgaggtcaggagagagattcctcaagatatggtctcagac

SEQ ID NO: 284638 - DNA, 75 bp, Artificial Sequence
  Synthetic
cttgcacttgtggaaccacaggaggagaaaatcccagagtttcagtatctgtgctcccatcctttgatcaatcat

SEQ ID NO: 284639 - DNA, 75 bp, Artificial Sequence
  Synthetic
tgatttctctttggttatatggtgcccattctgaatcgaacagaagtaggagatgcataactgacttaacccatt

SEQ ID NO: 284640 - DNA, 75 bp, Artificial Sequence
  Synthetic
gtatttgggctcatcaacctccatgtctactcagctgtttcatgcgtgggaaaaggtcaccaatgttcatgtggt

SEQ ID NO: 284641 - DNA, 75 bp, Artificial Sequence
  Synthetic
aatagagggctgagaatccctccggagggggtgttaagttgccttgaaagggttgactacgataaggcattcggc

SEQ ID NO: 284642 - DNA, 75 bp, Artificial Sequence
  Synthetic
ggaagtcttcagaagacaaggctacccagactgcaaaccgagagctcaaaaaggagacagtgtctccttcctctc

SEQ ID NO: 284643 - DNA, 75 bp, Artificial Sequence
  Synthetic
tcagcaggttgcagtctccacctcggctaacccagcccctgtctcagagcttgacataagggccctctccaggag

SEQ ID NO: 284644 - DNA, 75 bp, Artificial Sequence
  Synthetic
cctgtacatgaatgctctagactgggatgaagaaaagaccatcttagcgttatggaaggatttgacctcagtgga

SEQ ID NO: 284645 - DNA, 75 bp, Artificial Sequence
  Synthetic
ggtcctcctgctctagagtggtcagctgccaacgaagaggatgacttatccgtggaggctgaaatcgctcaccag

SEQ ID NO: 284646 - DNA, 75 bp, Artificial Sequence
  Synthetic
cgtggaggctgaaatcgctcaccagattgctgagagcttctccaagaagtacaaattcccctcccgatcatctgg

SEQ ID NO: 284647 - DNA, 75 bp, Artificial Sequence
  Synthetic
taggaacataatgtctctgacaggccctgatttccctttggaggaggctcctgttttcaaaaggacagggtctgc

SEQ ID NO: 284648 - DNA, 75 bp, Artificial Sequence
  Synthetic
aaagatcaaatatggggactactaattgtgacaaaggactttgtgtactctcaaagttccaattgtctatttgac

SEQ ID NO: 284649 - DNA, 75 bp, Artificial Sequence
  Synthetic
gatattcttgtataattttgagcaattaaaaatgaaccttgatgacatagttaaggagtcaaaaactgtgccggg

SEQ ID NO: 284650 - DNA, 75 bp, Artificial Sequence
  Synthetic
tatgccccaatctcctctctcatatctccgtaagtacagacactatgtctgacttgacccaggacggaaagaact

SEQ ID NO: 284651 - DNA, 75 bp, Artificial Sequence
  Synthetic
gacttgacccaggacggaaagaactatgatttcatgttccagcccttgatgctttatgcgcaaacatggacatct

SEQ ID NO: 284652 - DNA, 75 bp, Artificial Sequence
  Synthetic
tctgatgatcttgctttccccccctgaaccccggtattcggacgacttgatatctcaactgtgccagttatacat

SEQ ID NO: 284653 - DNA, 75 bp, Artificial Sequence
  Synthetic
gaaccccggtattcggacgacttgatatctcaactgtgccagttatacattgcaggggatcaagtcctgtccatg

SEQ ID NO: 284654 - DNA, 75 bp, Artificial Sequence
  Synthetic
cctgacaagctaaacaaaataatgcaagatgacctgaaccgttacgtgtcctactaaccagcccctcaaacctgg

SEQ ID NO: 284655 - DNA, 75 bp, Artificial Sequence
  Synthetic
gaacagcccagtacagagggcagaaaaattcagacctctcattcattccctaggagacttccccgtgtttataaa

SEQ ID NO: 284656 - DNA, 75 bp, Artificial Sequence
  Synthetic
aaattcagacctctcattcattccctaggagacttccccgtgtttataaaggataaggtgagtcagcttgagggg

SEQ ID NO: 284657 - DNA, 75 bp, Artificial Sequence
  Synthetic
gacgctatcagaaaagccctgtatgatgaagtggacaaggtggagaactcagagtttagagaggcaatcctcttg

SEQ ID NO: 284658 - DNA, 75 bp, Artificial Sequence
  Synthetic
agaaacttcctgatatccgtctgaaaccaggagattttgaatctctaagtggcagggagaaatctcgtcacatag

SEQ ID NO: 284659 - DNA, 75 bp, Artificial Sequence
  Synthetic
accaggagattttgaatctctaagtggcagggagaaatctcgtcacataggttcggctcaagggctcttatattc

SEQ ID NO: 284660 - DNA, 75 bp, Artificial Sequence
  Synthetic
tgcttcaaatacaccatgaaaaaaacaggcaacaccactgataagatgaactttctacgcaagatagtgaagaac

SEQ ID NO: 284661 - DNA, 75 bp, Artificial Sequence
  Synthetic
caatatacatgacttagtcttcgtgtatggctgttacaggcactggggccatccctatatagattatagaaaggg

SEQ ID NO: 284662 - DNA, 75 bp, Artificial Sequence
  Synthetic
tgatgatgatctgtggttaccccctccggaatatgttccattaaaggaattaacgggcaagaaaaacatgagaaa

SEQ ID NO: 284663 - DNA, 75 bp, Artificial Sequence
  Synthetic
tatggctgttacaggcactggggccatccctatatagattatagaaagggtctgtcaaagctatacgatcaagtc

SEQ ID NO: 284664 - DNA, 75 bp, Artificial Sequence
  Synthetic
gctctgctcaacaggttgcagtctctacctcagcaaacccggcccctgtctcggagcttgacataagggccctct

SEQ ID NO: 284665 - DNA, 75 bp, Artificial Sequence
  Synthetic
gcaagaggggtcctgatagggtcatcgatctgtttcttgaccagaatgaccaacatcaacataaatagacctctt

SEQ ID NO: 284666 - DNA, 75 bp, Artificial Sequence
  Synthetic
atcatttgatgagatttattctggaaatcaaagaatgatcgggttagtcaaagttgttgttggactggcattgtc

SEQ ID NO: 284667 - DNA, 75 bp, Artificial Sequence
  Synthetic
cctagccaggaggatcctccggtggggatttgacaagtactctaaatggtatcttgattcgcgatttcttgccaa

SEQ ID NO: 284668 - DNA, 75 bp, Artificial Sequence
  Synthetic
tgatgaggctgaggattttgttgaagttcacctccccgatgtacacaaacaggtctcagaagttgacctgggtct

SEQ ID NO: 284669 - DNA, 75 bp, Artificial Sequence
  Synthetic
aaaactcagacatggccacccaaacatatcgtagacttggtgggggatacgtggcataggctcccgatcacccag

SEQ ID NO: 284670 - DNA, 75 bp, Artificial Sequence
  Synthetic
cagctctaatcatcaagcccgtccaaactcatttgccgagtttctaaacaagacatactctagtgactcataaag

SEQ ID NO: 284671 - DNA, 75 bp, Artificial Sequence
  Synthetic
ctagcctcttggctgtcagagaatagaggggggcctgttcccagcgagaaggttatcatcacggccctttcaaag

SEQ ID NO: 284672 - DNA, 75 bp, Artificial Sequence
  Synthetic
agaggttattacagcatccccagagaatgattggttgtggatcttctcggacttcagaagttctaaaatgacgta

SEQ ID NO: 284673 - DNA, 75 bp, Artificial Sequence
  Synthetic
atgtcaattgtgggctgacatgtctctccaaacacaaagatctgatgagaataaagactcttcagtgcttctgga

SEQ ID NO: 284674 - DNA, 75 bp, Artificial Sequence
  Synthetic
gcctgacgaagacttgataattggtctcaaaccaaaggaacgagaacttaagatcgagggtcgattttttgcctt

SEQ ID NO: 284675 - DNA, 75 bp, Artificial Sequence
  Synthetic
atgaggcaagtactaggagggcatggagaggacaccttagaatctgacgatgacattcaaaggctattgaaggat

SEQ ID NO: 284676 - DNA, 75 bp, Artificial Sequence
  Synthetic
ccaattacatcttgccactttttgatgcgctgactatgacagataacctgaacaaggtgttcaaaaaattgattg

SEQ ID NO: 284677 - DNA, 75 bp, Artificial Sequence
  Synthetic
tttccattttgagcttcttagatgtgaaaaaaactagtaacatccctcgaaagatctaaggaaaaatgatccctc

SEQ ID NO: 284678 - DNA, 75 bp, Artificial Sequence
  Synthetic
tgcgctgactatgacagataacctgaacaaggtgttcaaaaaattgattgacagggtcactgggcaggggctttt

SEQ ID NO: 284679 - DNA, 75 bp, Artificial Sequence
  Synthetic
aacaagaaggtgtcgcgcaaggcggggtgttcggagtgggtttgctctgctcagcaggttgcagtctccacctca

SEQ ID NO: 284680 - DNA, 75 bp, Artificial Sequence
  Synthetic
cttccacccttcgagaaatgagccttgtgttattcaattgtagcagccccaagagtgagatgcagagagctcgtt

SEQ ID NO: 284681 - DNA, 75 bp, Artificial Sequence
  Synthetic
tatacatcatctcagctgccctaacaatctggtggtggaggacgagggatgtaccactttgtcagggttttctta

SEQ ID NO: 284682 - DNA, 75 bp, Artificial Sequence
  Synthetic
acctccgatgtaacaggtgtgtaaggcccatcgacgatatcatactggagacctctcaggtattcgagtttccgg

SEQ ID NO: 284683 - DNA, 75 bp, Artificial Sequence
  Synthetic
cctcaacatgtttccggatgccaaacttgtattcaacagcttgttggaggtaaatgacctgatggcatctgggac

SEQ ID NO: 284684 - DNA, 75 bp, Artificial Sequence
  Synthetic
tacggcagaagggctggagtttggttagcttgttaatgatagacagagaatctcaaaccaggaacacaagaacta

SEQ ID NO: 284685 - DNA, 75 bp, Artificial Sequence
  Synthetic
cagagtgatagattttgactcaatctgggaaaagccgtccgacctgagaaacttggccacctggagatacttcca

SEQ ID NO: 284686 - DNA, 75 bp, Artificial Sequence
  Synthetic
ccagagtagtggactttgaatcaatctgggaaaaaccgtcagatctgaggaacttgaccacctggaagtacttcc

SEQ ID NO: 284687 - DNA, 75 bp, Artificial Sequence
  Synthetic
tcgccgggactgtcacaggaggggcttctctatgagttagaaagcatatcaagaaatgcactctcgatataccga

SEQ ID NO: 284688 - DNA, 75 bp, Artificial Sequence
  Synthetic
ttctctatgagttagaaagcatatcaagaaatgcactctcgatataccgagctatcgaagaaggagcatctaaac

SEQ ID NO: 284689 - DNA, 75 bp, Artificial Sequence
  Synthetic
ctgctccaccaaccatgattacactatctggatgcccgaagaagctagactcgggacatcttgtgacatttttac

SEQ ID NO: 284690 - DNA, 75 bp, Artificial Sequence
  Synthetic
atctatgggaagacccctttgtttcgaggtaacatcctggtacctgaatccaagagatgggcccgagtctcctgc

SEQ ID NO: 284691 - DNA, 75 bp, Artificial Sequence
  Synthetic
tcgggacatcttgtgacatttttaccaacagcagagggaaaagagcatctaaggggggcaggacttgcggatttg

SEQ ID NO: 284692 - DNA, 75 bp, Artificial Sequence
  Synthetic
caagagatgggcccgagtctcctgcatctctaatgaccagatagttaaccttgccaatataatgtcaacagtgtc

SEQ ID NO: 284693 - DNA, 75 bp, Artificial Sequence
  Synthetic
gggcaatcgatccattttgtgttatctccaacatgttctacgatatgagcgagatgttatcacagcatccccgga

SEQ ID NO: 284694 - DNA, 75 bp, Artificial Sequence
  Synthetic
ttgttctatccgccatctgatcccaaaatcctgaggcacttcaacatatgttgcagtactatgatgtatctatct

SEQ ID NO: 284695 - DNA, 75 bp, Artificial Sequence
  Synthetic
ctgtgcggagttcctggacttagacttatggatggaacttgggtttcaattcaggcatcagatgagaccaagtgg

SEQ ID NO: 284696 - DNA, 75 bp, Artificial Sequence
  Synthetic
tgagggactttctgcttatgtcagtgcaggcagtctttcactacttgttattcagcccaattttaaaaggcagag

SEQ ID NO: 284697 - DNA, 75 bp, Artificial Sequence
  Synthetic
agaataatctatctagatccatctttagggggagtgtcggggatgccgctcgggaggttccacatacgccagttc

SEQ ID NO: 284698 - DNA, 75 bp, Artificial Sequence
  Synthetic
agaacatctagtcgtagaggagttggtcaaaaggagggaagaatgtctggatgcactggagtccattgtgaccac

SEQ ID NO: 284699 - DNA, 75 bp, Artificial Sequence
  Synthetic
acgcttaacaaccagatcaaagaaaaaatagacattgtcaactacaaagcagatatgtaacacccctacaatgga

SEQ ID NO: 284700 - DNA, 75 bp, Artificial Sequence
  Synthetic
tagggggagtgtcggggatgccgctcgggaggttccacatacgccagttctcagaccctgtctctgaagggttat

SEQ ID NO: 284701 - DNA, 75 bp, Artificial Sequence
  Synthetic
agggacctttgaaagaagattctttagggatgaaaaagagcttcgagaatatgaagcggccgagatgacgaagac

SEQ ID NO: 284702 - DNA, 75 bp, Artificial Sequence
  Synthetic
ctgtgccaagaggccgggaacccggatctcggggagagaacactcgagagcttcactcgccttcttgaagatccc

SEQ ID NO: 284703 - DNA, 75 bp, Artificial Sequence
  Synthetic
atctcggggagagaacactcgagagcttcactcgccttcttgaagatcccaccactttgaatattaaaggagggg

SEQ ID NO: 284704 - DNA, 75 bp, Artificial Sequence
  Synthetic
cttgttctatccaccatctgaccccaagatcttgaggcacttcaatatctgctgcagtactatgatgtatctatc

SEQ ID NO: 284705 - DNA, 75 bp, Artificial Sequence
  Synthetic
gaggtggacaaggtagagaattcagagttcagagaggcaatccttctgtctaaaactcacagagataacttcata

SEQ ID NO: 284706 - DNA, 75 bp, Artificial Sequence
  Synthetic
cgcatatacggagatacgtctcagtcagttctaatcatcaagcccgtccaggctcattcgccgagttcctaaaca

SEQ ID NO: 284707 - DNA, 75 bp, Artificial Sequence
  Synthetic
agttcagagaggcaatccttctgtctaaaactcacagagataacttcatactcttcttgaaatcagtcgagcccc

SEQ ID NO: 284708 - DNA, 75 bp, Artificial Sequence
  Synthetic
acacctcagtattcaagagggtggcctgcaactctagcttgagtctgtcatctcactggatcaggctgatttaca

SEQ ID NO: 284709 - DNA, 75 bp, Artificial Sequence
  Synthetic
cctgagtcgattatagggctgatacagaactcccggactataagacggcagttcagaaagagtctctcaagaact

SEQ ID NO: 284710 - DNA, 75 bp, Artificial Sequence
  Synthetic
tcaccttccagacgttcaagaacaggtctcaggggttgacctcggtctcccaaactgggggaagtacgtgctgat

SEQ ID NO: 284711 - DNA, 75 bp, Artificial Sequence
  Synthetic
agaactcccggactataagacggcagttcagaaagagtctctcaagaactttggaagagtccttctacaactcag

SEQ ID NO: 284712 - DNA, 75 bp, Artificial Sequence
  Synthetic
ctgcaactctagcttgagtctgtcatctcactggatcaggctgatttacaagatagtgaagaccactagactcat

SEQ ID NO: 284713 - DNA, 75 bp, Artificial Sequence
  Synthetic
gttgtagaagggctaataaaacaaaatcaatacaacaaggtcttggggggtcaggaaggaaagtatcggtctctc

SEQ ID NO: 284714 - DNA, 75 bp, Artificial Sequence
  Synthetic
gtgtggccctgctcttcggaaagggcagatctcttaagggaaatctcctggggaagaaaagtggtgggcacgaca

SEQ ID NO: 284715 - DNA, 75 bp, Artificial Sequence
  Synthetic
cagcttcacttagacgatagacaatcatccaaccttggtgagatggccaaggtgggggaaagcaaatatcgagag

SEQ ID NO: 284716 - DNA, 75 bp, Artificial Sequence
  Synthetic
atcaatacaacaaggtcttggggggtcaggaaggaaagtatcggtctctccccaaaacgggaaagtcatatcttc

SEQ ID NO: 284717 - DNA, 75 bp, Artificial Sequence
  Synthetic
cagatctcttaagggaaatctcctggggaagaaaagtggtgggcacgacagttccccacccctcagagatgttgg

SEQ ID NO: 284718 - DNA, 75 bp, Artificial Sequence
  Synthetic
aaaaaacgaaatctcaagtcagaacctctagctgtttgattattttttccatctttattgtttttttgttaagcg

SEQ ID NO: 284719 - DNA, 75 bp, Artificial Sequence
  Synthetic
tgtcttatgacctaatcatttgtgacgcagaggttactgacattgcatcaattaatcggataacactgttgatgt

SEQ ID NO: 284720 - DNA, 75 bp, Artificial Sequence
  Synthetic
tctcctctatgccttgcgttcaaaacattgcatctcttagagatcagggggaatctcttgattcgacagtccttc

SEQ ID NO: 284721 - DNA, 75 bp, Artificial Sequence
  Synthetic
ggtaacccgagagtttcggtgtctgtactcccgtcctttgatcagtcatttttttcacgaggccctctaaagggg

SEQ ID NO: 284722 - DNA, 75 bp, Artificial Sequence
  Synthetic
cattgcatctcttagagatcagggggaatctcttgattcgacagtccttcatggactccatgccacggggtagat

SEQ ID NO: 284723 - DNA, 75 bp, Artificial Sequence
  Synthetic
atgcagattctgacaatgtatgatatcttcagatggtgtcagtgaccaatggtgccctcatcccccagggactga

SEQ ID NO: 284724 - DNA, 75 bp, Artificial Sequence
  Synthetic
aaaagtcaccaatgttcatgtagtgagacgggccttatcattaaaagagtctataaactggttcatcacgaggaa

SEQ ID NO: 284725 - DNA, 75 bp, Artificial Sequence
  Synthetic
tcttcagatggtgtcagtgaccaatggtgccctcatcccccagggactgataccaaatgttgtggacggtccaat

SEQ ID NO: 284726 - DNA, 75 bp, Artificial Sequence
  Synthetic
tttcatccgagctgtacctcagattctccaagcgagggaaatttttccgagacgctgagtacttgacttcttcta

SEQ ID NO: 284727 - DNA, 75 bp, Artificial Sequence
  Synthetic
ttcccttacaatagactaaacaggggttgactgagagaagtgattcgcctcctatgaagggcacaagcaatagat

SEQ ID NO: 284728 - DNA, 75 bp, Artificial Sequence
  Synthetic
tgttttcaaaaggacagggtcagccttgcataggttcaaatctgccagatacagtgaaggaggatactcttctgt

SEQ ID NO: 284729 - DNA, 75 bp, Artificial Sequence
  Synthetic
gtgtgtacaactctaaagggatggaccatccaatcctttcagttaagaaaaaaactgtggaatggagaagtaatt

SEQ ID NO: 284730 - DNA, 75 bp, Artificial Sequence
  Synthetic
acttgacccaagacgggagaaactatgacttcatgtttcagccattgatgctttacgcgcagacatggacatcag

SEQ ID NO: 284731 - DNA, 75 bp, Artificial Sequence
  Synthetic
gaattacagagaggaactctgtctaaaatgtctatcattatagccattatgatagttttctctaatagagttttc

SEQ ID NO: 284732 - DNA, 75 bp, Artificial Sequence
  Synthetic
gagggactctacatttcattggcaccttcggtgtaacaggtgtgtaaggcctatcgatgatatcacgttggagac

SEQ ID NO: 284733 - DNA, 75 bp, Artificial Sequence
  Synthetic
tttgtaaagatcgtagaacatcatactttgatgacaacccacaaaatgtgcgctaactggagtaccataccgaac

SEQ ID NO: 284734 - DNA, 75 bp, Artificial Sequence
  Synthetic
ggaatcccaccattcctaacatcttaagaaactctgactacaatcttaactctcctctgatagaggatccagcca

SEQ ID NO: 284735 - DNA, 75 bp, Artificial Sequence
  Synthetic
aaagaaattccaattgttagtcgagcccgataaactgagtaaaatcatgcaagacgatttgaatcgctatgcatc

SEQ ID NO: 284736 - DNA, 75 bp, Artificial Sequence
  Synthetic
acatgtttttctcccggattgaacatctatattcagcgattagagtgggcacagttgtcactgcttatgaggact

SEQ ID NO: 284737 - DNA, 75 bp, Artificial Sequence
  Synthetic
tttccggagctgtgcctcactttcaaaaacttcctgatatccgtcttaaaccaggtgattttgagtctctaagtg

SEQ ID NO: 284738 - DNA, 75 bp, Artificial Sequence
  Synthetic
agttgatgttagaatggttgaaaacaggaaataggcctctccgaatgactctgacagacaattgttctagatctt

SEQ ID NO: 284739 - DNA, 75 bp, Artificial Sequence
  Synthetic
attttagttgcaattcatgactcgggatacaatgatggaacaatattccctgttaacatatacggcaaggtctcc

SEQ ID NO: 284740 - DNA, 75 bp, Artificial Sequence
  Synthetic
gtgggcggagctgcagcacaatctatgatctccctttggctgtacggtgcccactctgaatcaaacaggagccgg

SEQ ID NO: 284741 - DNA, 75 bp, Artificial Sequence
  Synthetic
gatacaatgatggaacaatattccctgttaacatatacggcaaggtctcccctagggactacttgagggggcttg

SEQ ID NO: 284742 - DNA, 75 bp, Artificial Sequence
  Synthetic
gaccatgtgtagctatgactttctcatctatgggaaaactccattgtttcgaggtaacatcttagtgcctgagtc

SEQ ID NO: 284743 - DNA, 75 bp, Artificial Sequence
  Synthetic
aatgcagttggtcatgtgttcaacctcattcactttgttggatgttatatgggtcaggtgagatctctgaatgca

SEQ ID NO: 284744 - DNA, 75 bp, Artificial Sequence
  Synthetic
aatatcaacataaatagacctctcgaactgatctcaggggtaatctcctatatcctcctgaggttggatgatcac

SEQ ID NO: 284745 - DNA, 75 bp, Artificial Sequence
  Synthetic
aactgatctcaggggtaatctcctatatcctcctgaggttggatgatcacccatctttgtatataatgctaagag

SEQ ID NO: 284746 - DNA, 75 bp, Artificial Sequence
  Synthetic
tttgggggaggagttttttggaaaagggacttttgagagaagattcttcagggacgagaaagaacttcaggaata

SEQ ID NO: 284747 - DNA, 75 bp, Artificial Sequence
  Synthetic
gcttatccgactacaatgaaagaagggaacagatcgattttatgttatctccaacatgtgttgcgctatgagcga

SEQ ID NO: 284748 - DNA, 75 bp, Artificial Sequence
  Synthetic
tctttacatgaacgccttggactgggatgaggagaagaccatcctagcactgtggagggatctaacctcagtgga

SEQ ID NO: 284749 - DNA, 75 bp, Artificial Sequence
  Synthetic
aagcagacagcgtcaattgcaaagcaaaaatgtaacacccctacaatggatgccgacaagattgtattcaaagtc

SEQ ID NO: 284750 - DNA, 75 bp, Artificial Sequence
  Synthetic
ttagaggagtccttttacaactcagagatccatgggatcaaccggatgactcagacacctcagcgagttgggagg

SEQ ID NO: 284751 - DNA, 75 bp, Artificial Sequence
  Synthetic
ttgtgaccaaggattttgtgtactcccagagttctaactgtctctttgatagaaattatacgcttatgctgaaag

SEQ ID NO: 284752 - DNA, 75 bp, Artificial Sequence
  Synthetic
cttctctagtgagaccaggagtccggaggcagtctacactcgaatcatgatgaatggaggtagactgaaaagatc

SEQ ID NO: 284753 - DNA, 75 bp, Artificial Sequence
  Synthetic
ttgaccctcattacctaccagtctcatctcctacttcaaagggttgagaggaacttgtctaaaagtatgagagcc

SEQ ID NO: 284754 - DNA, 75 bp, Artificial Sequence
  Synthetic
ggaacagatcgattttatgttatctccaacatgtgttgcgctatgagcgagaagtgattacagcatctccggaaa

SEQ ID NO: 284755 - DNA, 75 bp, Artificial Sequence
  Synthetic
tctgatgattctcctttcccctccagaacccagatattcagacgacctaatatctcagctgtgtcagctatacat

SEQ ID NO: 284756 - DNA, 75 bp, Artificial Sequence
  Synthetic
agctccaatcatcaagctcgccccaactcattcgccgagtttttaaacaagacatactcgagtgattcgtaaaaa

SEQ ID NO: 284757 - DNA, 75 bp, Artificial Sequence
  Synthetic
cttgggagcaatagaacaaaaacatgttatggtgccattaatccgccgtattttatcaaagtcaagttgattacc

SEQ ID NO: 284758 - DNA, 75 bp, Artificial Sequence
  Synthetic
agaggatacattggagtcagatgacgacattcaaagactcttgaaagactccctacgaagaacaaggtgggtgga

SEQ ID NO: 284759 - DNA, 75 bp, Artificial Sequence
  Synthetic
gacattcaaagactcttgaaagactccctacgaagaacaaggtgggtggatcaagaagtgcgccatgcagctaga

SEQ ID NO: 284760 - DNA, 75 bp, Artificial Sequence
  Synthetic
agctctcttgtttgtaccccttctggttttttcattgtgtttcgggaagttccccatttacacaataccagacaa

SEQ ID NO: 284761 - DNA, 75 bp, Artificial Sequence
  Synthetic
tgatttcatgttccagcccttgatgctttatgcgcaaacatggacatctgaactagtacaaagggacaccaggct

SEQ ID NO: 284762 - DNA, 75 bp, Artificial Sequence
  Synthetic
tgagagtggttcagtgggcgactggggcccattataagcttaagcctattctagatgatctcaatgtcttcccat

SEQ ID NO: 284763 - DNA, 75 bp, Artificial Sequence
  Synthetic
ctagatgatctcaatgtcttcccatctctctgtcttgtagtgggggatgggtcaggggggatatcaagggcagtg

SEQ ID NO: 284764 - DNA, 75 bp, Artificial Sequence
  Synthetic
cctatcaggagtgcttggcaagtgaccttgccagaagaatcctcaggtggggatttgataaatattccaagtggt

SEQ ID NO: 284765 - DNA, 75 bp, Artificial Sequence
  Synthetic
atcttgatttgagacttcttgcgagggaccaccccctgattccttatatcaaaacccaaacatggcctccaaaac

SEQ ID NO: 284766 - DNA, 75 bp, Artificial Sequence
  Synthetic
gaacgatctgatggcttccggtacgcatccgctaccaccttctgcaatcatgagcggaggagatgacatcgtctc

SEQ ID NO: 284767 - DNA, 75 bp, Artificial Sequence
  Synthetic
atttggccacatggaaatatttccagtcagttcaaaaacaggtaaacatgtcttatgacctcatcatctgtgatg

SEQ ID NO: 284768 - DNA, 75 bp, Artificial Sequence
  Synthetic
gtcagttcaaaaacaggtaaacatgtcttatgacctcatcatctgtgatgcagaagtcaccgacattacgtctat

SEQ ID NO: 284769 - DNA, 75 bp, Artificial Sequence
  Synthetic
acccatctgagatactagatgataaatcacactcttttactagaacaaggctcgcatcatggctatctgagaaca

SEQ ID NO: 284770 - DNA, 75 bp, Artificial Sequence
  Synthetic
catgaaatgtcagttctcggaggctatttgggagaggagttttttggaaaggggacgtttgaaagacgattcttt

SEQ ID NO: 284771 - DNA, 75 bp, Artificial Sequence
  Synthetic
cactttatctggtcttcaaaacctatggaactatgctagtgaacccagactacaaagcaattcaacacctgtcaa

SEQ ID NO: 284772 - DNA, 75 bp, Artificial Sequence
  Synthetic
tataactcagatgacgtcatccttttcatcagagatatacctccgattctctaaacggggaaaatttttccgaga

SEQ ID NO: 284773 - DNA, 75 bp, Artificial Sequence
  Synthetic
ttaaagggagcatgcaaactcaagttatgcggagttcttggacttagacttgtggatggaacatggatagcgatg

SEQ ID NO: 284774 - DNA, 75 bp, Artificial Sequence
  Synthetic
tggaactatgctggtaaatccagaatatagagcaattcaacacctgtcaagggcattcccttcagtcacaggatt

SEQ ID NO: 284775 - DNA, 75 bp, Artificial Sequence
  Synthetic
tatcataataatatcagcgaccgatggtgctctcacctcctaaggaccgataccaaaggttgtagacaggccgaa

SEQ ID NO: 284776 - DNA, 75 bp, Artificial Sequence
  Synthetic
atctccagggagaacccatagaggtggacaatctccctgaagacatgaggcggctccatctggacgatgagaagc

SEQ ID NO: 284777 - DNA, 75 bp, Artificial Sequence
  Synthetic
ctgaagagatcatatcaaatccttacaacgaaatgatcataactttaattgacagtgatgtagaatctttcctgg

SEQ ID NO: 284778 - DNA, 75 bp, Artificial Sequence
  Synthetic
gacagtgatgtggaatccttcctggttcataagatggtggatgatctcgaattacaaagagggactctatctaaa

SEQ ID NO: 284779 - DNA, 75 bp, Artificial Sequence
  Synthetic
gaagtcttggatctattactcagacagatccgacctcattggtttatgggaggatcaaatatactgtctagacat

SEQ ID NO: 284780 - DNA, 75 bp, Artificial Sequence
  Synthetic
atgtctatcattatagccatcatgatagttttctccaatagggttttcaatgtttccaaaccactgactgatcct

SEQ ID NO: 284781 - DNA, 75 bp, Artificial Sequence
  Synthetic
tagttttctccaatagggttttcaatgtttccaaaccactgactgatcctttgttctatccgccatctgacccca

SEQ ID NO: 284782 - DNA, 75 bp, Artificial Sequence
  Synthetic
tagcttgttaatgatagatcgtgaatctcagaccagaaacacaagaaccaagatactagctcagggtgacaacca

SEQ ID NO: 284783 - DNA, 75 bp, Artificial Sequence
  Synthetic
acagccttgggcgatgtccccagctttgcaagacttcatgatctatacaatagacctattacatactatttcaga

SEQ ID NO: 284784 - DNA, 75 bp, Artificial Sequence
  Synthetic
acggtcaactttcctaaccctccagggaggtcttcggaggacaagtcaacccagacaactggtcgagaactcaag

SEQ ID NO: 284785 - DNA, 75 bp, Artificial Sequence
  Synthetic
ggagttgttggagtcctcagtcgtccctcttatgcaccccttggcagacccatctacagttttcaaggatggaga

SEQ ID NO: 284786 - DNA, 75 bp, Artificial Sequence
  Synthetic
tagacctattacatactatttcagaaagcaggttattcgaggaaatatttacctgtcttggagttggtctgatga

SEQ ID NO: 284787 - DNA, 75 bp, Artificial Sequence
  Synthetic
cctcttatgcaccccttggcagacccatctacagttttcaaggatggagatgaggctgaagattttattgaagtt

SEQ ID NO: 284788 - DNA, 75 bp, Artificial Sequence
  Synthetic
aagaaatgcgctctcaatatatcgtgccattgaggagggggcatccaaactggggctcatcataaagaaggaaga

SEQ ID NO: 284789 - DNA, 75 bp, Artificial Sequence
  Synthetic
cccattggatccggctgatttacaagattgtaaagaccaccagactcatcggaagaatcgaggatctatctgggg

SEQ ID NO: 284790 - DNA, 75 bp, Artificial Sequence
  Synthetic
agactgggggaagtacgtgttgatgagtgcaggggtcttgattgccttgatgctgataatttctctaatgacatg

SEQ ID NO: 284791 - DNA, 75 bp, Artificial Sequence
  Synthetic
gattgtaaagaccaccagactcatcggaagaatcgaggatctatctggggaagtcgagagacaccttcgcgggta

SEQ ID NO: 284792 - DNA, 75 bp, Artificial Sequence
  Synthetic
aataatcaggtggtctccttgaagcccgagatcattgtagatcaatatgaatacaaatatccggccatcaaagat

SEQ ID NO: 284793 - DNA, 75 bp, Artificial Sequence
  Synthetic
agtgcaggggtcttgattgccttgatgctgataatttctctaatgacatgttgtagaggagtccatcgaccaaac

SEQ ID NO: 284794 - DNA, 75 bp, Artificial Sequence
  Synthetic
taaaaagttccagttgttagtcgagcccgacaagctaaataaaatcatgcaagacgatctgaatcgctatacatc

SEQ ID NO: 284795 - DNA, 75 bp, Artificial Sequence
  Synthetic
actacagctgcttataaactgagcaccttcaaaggcctacacatgctaagacccttatgaactgcaccctgaaaa

SEQ ID NO: 284796 - DNA, 75 bp, Artificial Sequence
  Synthetic
ccaaagcgggaaggtcatatcttcatgggagtcctataaaagtgggggggagactagactgtgaggatcggttat

SEQ ID NO: 284797 - DNA, 75 bp, Artificial Sequence
  Synthetic
gatcacccccgattccctcgtagatataagacgtactgacgttgaagggaattgggccctgacgggaggtatgga

SEQ ID NO: 284798 - DNA, 75 bp, Artificial Sequence
  Synthetic
acccttatgaactgcaccctgaaaaaaacgagatcttaaatccgatcctctggctgtttgattgttttttccatc

SEQ ID NO: 284799 - DNA, 75 bp, Artificial Sequence
  Synthetic
tgggagtcctataaaagtgggggggagactagactgtgaggatcggttattcttttgacacctcaagtcctgaaa

SEQ ID NO: 284800 - DNA, 75 bp, Artificial Sequence
  Synthetic
tttgaaatccatgcaacagggtagattcaagaatcataagaccttcatccatcaccccagtcgaccagtcatggt

SEQ ID NO: 284801 - DNA, 75 bp, Artificial Sequence
  Synthetic
tcacaagcaaaaagaacatgaggaacttttgcatcaacggagaggttaaagtgtgtagcccaaatggttactcgt

SEQ ID NO: 284802 - DNA, 75 bp, Artificial Sequence
  Synthetic
tcgggagcaatagaacaaaaatatgttatggtgccgttgaatcgctgcattttatcagagtcaaatctataacct

SEQ ID NO: 284803 - DNA, 75 bp, Artificial Sequence
  Synthetic
agaataatctatttggacccctccttagggggagtgtctgggatgtctcttggaaggttccacatacgtcagttc

SEQ ID NO: 284804 - DNA, 75 bp, Artificial Sequence
  Synthetic
tggaaggttccacatacgtcagttctcagatcctgtctcagaagggttgtctttctggagagagatctggctaag

SEQ ID NO: 284805 - DNA, 75 bp, Artificial Sequence
  Synthetic
tgctcagggctagtatcatttacagggttcataaagcagataaatctcactgcaagagaggcaatactatatttc

SEQ ID NO: 284806 - DNA, 75 bp, Artificial Sequence
  Synthetic
ataccaaaggttgtgggcaggccagggggtgtttcggatgaatccgtgagtgtgcttggacagaggtcacagtgt

SEQ ID NO: 284807 - DNA, 75 bp, Artificial Sequence
  Synthetic
aggctcttttgtttgtaccccttttggttttctcattgtgcttcgggaaattccccatctacacgataccagaca

SEQ ID NO: 284808 - DNA, 75 bp, Artificial Sequence
  Synthetic
agagaccgctgttcctcattcctatttcattcacttccgatcattgggcctgagtggaaagtcaccgtattcatc

SEQ ID NO: 284809 - DNA, 75 bp, Artificial Sequence
  Synthetic
tgtgcttggacagaggtcacagtgtgtctcctgataacggacccaacaggagtgaactgagaattgcaatctgcc

SEQ ID NO: 284810 - DNA, 75 bp, Artificial Sequence
  Synthetic
ttcaagaatcataagaccttcatccatcaccccagtcgaccagtcatggttatgtagattctcataatgagggaa

SEQ ID NO: 284811 - DNA, 75 bp, Artificial Sequence
  Synthetic
actactctgaatatcaaaggaggggctagccctaccattcttctcaaagatgcaatcagaaaagccctgtatgat

SEQ ID NO: 284812 - DNA, 75 bp, Artificial Sequence
  Synthetic
tcttctcttgagtctgtataggttgagcaaaatatctggacagaacaccggcaattacaagacaaacatcgcaga

SEQ ID NO: 284813 - DNA, 75 bp, Artificial Sequence
  Synthetic
aaaaactgtagatcaaaagagcaactggcaacacttctcatcttgagacttacatcaaaatgttagatcctggag

SEQ ID NO: 284814 - DNA, 75 bp, Artificial Sequence
  Synthetic
ctcttcttgaaatctgtggagcctttgtttcctcgatttctcagtgaactcttcagctcatctttcctggggatt

SEQ ID NO: 284815 - DNA, 75 bp, Artificial Sequence
  Synthetic
atcatactttgatgacaacccacaaaatgtgcgctaactggagtaccataccgaacttcagattcctagccggga

SEQ ID NO: 284816 - DNA, 75 bp, Artificial Sequence
  Synthetic
tatctccgagtgtgtcggacttagacccgtacgataaatctcttcattccagagtttttcccagcggtaaatgct

SEQ ID NO: 284817 - DNA, 75 bp, Artificial Sequence
  Synthetic
gtttaggaggagtctctcgagaaacttagaggagtccttttataactcagagatccatgggctcaatcggatgac

SEQ ID NO: 284818 - DNA, 75 bp, Artificial Sequence
  Synthetic
ccatacgacaaatcccttcattcaagagttttccctggtgggaagtgtttgggaataacaatctcttctacctac

SEQ ID NO: 284819 - DNA, 75 bp, Artificial Sequence
  Synthetic
cagatctccttagagaaatctcgtgggggaggaaggtggtcggcacaacagtccctcacccctctgagatgttgg

SEQ ID NO: 284820 - DNA, 75 bp, Artificial Sequence
  Synthetic
tggacccatatgacaaatcccttcattcgagggtctttcctagcgggaagtgctcgggaataacaatatcatcta

SEQ ID NO: 284821 - DNA, 75 bp, Artificial Sequence
  Synthetic
ggttgcttcccaagtcctcgatttcctgcacttgtggagtcacagggggtggaaatcctagaatatcagtgtctg

SEQ ID NO: 284822 - DNA, 75 bp, Artificial Sequence
  Synthetic
cccaaactgctgggggagagctcaagagagaaaccccatcggcatcttcccagagaaagagccagtccttgaaag

SEQ ID NO: 284823 - DNA, 75 bp, Artificial Sequence
  Synthetic
agaagctgttaaattgcacgctagggaatagagggctgagaatacccccaaagggggtgttgagttgccttgaga

SEQ ID NO: 284824 - DNA, 75 bp, Artificial Sequence
  Synthetic
gaatagagggctgagaatacccccaaagggggtgttgagttgccttgagagggtcgactatgataaggcatttgg

SEQ ID NO: 284825 - DNA, 75 bp, Artificial Sequence
  Synthetic
cgacccagctgttccacgcctgggagaaagtcaccaatgttcatgtggtgaaaagagctctgtcactcaaagaat

SEQ ID NO: 284826 - DNA, 75 bp, Artificial Sequence
  Synthetic
cagacatcagatgaaaccaaatggtgcccttctgatcaattggtaaatctacatgactttcactcagatgagata

SEQ ID NO: 284827 - DNA, 75 bp, Artificial Sequence
  Synthetic
aaaagagctctgtcactcaaagaatctataaactggttcattgctagaaactcaaatttggcacaaactttgatc

SEQ ID NO: 284828 - DNA, 75 bp, Artificial Sequence
  Synthetic
atattgggaaggacttagtcaagttcaaagatcaaatatggggattgctgattgtgactaaggactttgtttact

SEQ ID NO: 284829 - DNA, 75 bp, Artificial Sequence
  Synthetic
gtatcagtactcccgtcctttgatcagtcatttttttcacgaggccccctaaagggatacttgggctcgtccacc

SEQ ID NO: 284830 - DNA, 75 bp, Artificial Sequence
  Synthetic
aaatccgtaagcttcagacgtcttagccacttgagaaaacttgttcctgggtttggaaaggcatatactatattc

SEQ ID NO: 284831 - DNA, 75 bp, Artificial Sequence
  Synthetic
tcatgatgaatggaggtagactgaaaagatcacacataaggaggtatgtctcagtcagctccaatcatcaagctc

SEQ ID NO: 284832 - DNA, 75 bp, Artificial Sequence
  Synthetic
tgactttatgtttcaacccttgatgctttatgcgcaaacatggacatcggaactggtgcagagagacacacggct

SEQ ID NO: 284833 - DNA, 75 bp, Artificial Sequence
  Synthetic
ctcttatttgtttttccatgtaatcaccttatacatgaatgctctagactgggacgaggaaaaaaccatcctagc

SEQ ID NO: 284834 - DNA, 75 bp, Artificial Sequence
  Synthetic
cttcgatgcaacaagtgcataaggcccatcgatgatatcatccttgagacttctcaggtcttcgagttcccagat

SEQ ID NO: 284835 - DNA, 75 bp, Artificial Sequence
  Synthetic
tgaacagcttagtccaaagagcagaaaagttcaggcctctcattcattcattgggagactttcctgtatttataa

SEQ ID NO: 284836 - DNA, 75 bp, Artificial Sequence
  Synthetic
ccatcgatgatatcatccttgagacttctcaggtcttcgagttcccagatgtttcaagaaggatatctaggatgg

SEQ ID NO: 284837 - DNA, 75 bp, Artificial Sequence
  Synthetic
ccaggtgacttcgaatctctaagtgatagggagaagtcacgacatatagggtcggcccaagggctcttgtattca

SEQ ID NO: 284838 - DNA, 75 bp, Artificial Sequence
  Synthetic
ggtataatgatggaaccatatttcctgtcaacatatacagcaaggtctcccctagagattatctgagagggcttg

SEQ ID NO: 284839 - DNA, 75 bp, Artificial Sequence
  Synthetic
tctcttctagatctcacattccaaaaatcatatccccttgtgatgaaggggacatttctggattcaacagtcctc

SEQ ID NO: 284840 - DNA, 75 bp, Artificial Sequence
  Synthetic
gagacatttcagacaatgttgtgtttgaacgcaaacagagatcgtagtggatatccagatactagactgggtaag

SEQ ID NO: 284841 - DNA, 75 bp, Artificial Sequence
  Synthetic
cctccggtccttctgctctagagtggtccgctgccaacgaagaggatgacccatctgtggaggctgaaattgctc

SEQ ID NO: 284842 - DNA, 75 bp, Artificial Sequence
  Synthetic
cgaggggggcccgttcctagtgaaaaggttattatcacggcactgtctaagccgcctgtcaatccccgggagttt

SEQ ID NO: 284843 - DNA, 75 bp, Artificial Sequence
  Synthetic
ctttgtcatcaccgaaaagctcttggccaactacatcctgccactctttgacgcactgacaatgacggacaactt

SEQ ID NO: 284844 - DNA, 75 bp, Artificial Sequence
  Synthetic
acaagaagatgccacgcaaggcagggtgttcagaatgggtctgctctgctcaacaggttgcggtttcaacctcag

SEQ ID NO: 284845 - DNA, 75 bp, Artificial Sequence
  Synthetic
tgacctgctccaaatctaacatgaaaaaaacaggcaacaccactgataaaatgaactttctgcgcaagatagtga

SEQ ID NO: 284846 - DNA, 75 bp, Artificial Sequence
  Synthetic
aaaaacaggcaacaccactgataaaatgaactttctgcgcaagatagtgaagaactgtagagatgagaaaactca

SEQ ID NO: 284847 - DNA, 75 bp, Artificial Sequence
  Synthetic
atattggaaaagatttagtcaagttcaaagatcaaatatggggggtgttaattgtgacgaaggactttgtgtact

SEQ ID NO: 284848 - DNA, 75 bp, Artificial Sequence
  Synthetic
tattctcagagttctaactgtctttttgacagaaactacacacttatgctgaaagaccttttcttgtctcgtttc

SEQ ID NO: 284849 - DNA, 75 bp, Artificial Sequence
  Synthetic
cagatcagacctcatcgggttatgggaggatcaaatatactgcttggatatgtccaacggcccaacatgctggaa

SEQ ID NO: 284850 - DNA, 75 bp, Artificial Sequence
  Synthetic
gacctttttttgtctcgcttcaactctttgatgattctgctttctccccctgaaccccgatattcagacgacctg

SEQ ID NO: 284851 - DNA, 75 bp, Artificial Sequence
  Synthetic
cagggtgattgactttgactccatctgggaaaaaccttctgacttgaggaacttgaccacatggaaatacttcca

SEQ ID NO: 284852 - DNA, 75 bp, Artificial Sequence
  Synthetic
aatatcccagctatgccagctttacatcgctggggatcaagtcttgtctatgtgtgggaactccggttatgaagt

SEQ ID NO: 284853 - DNA, 75 bp, Artificial Sequence
  Synthetic
agaagttgttaaactgcacacttggaaatagaggactgaaaatccccccagaaggggtgttaagttgccttgaaa

SEQ ID NO: 284854 - DNA, 75 bp, Artificial Sequence
  Synthetic
atttctaaagtctatcgatctcggaggactgcctgacgaagacttgataatcggcctcaagccaaaggaacgaga

SEQ ID NO: 284855 - DNA, 75 bp, Artificial Sequence
  Synthetic
gggagagctttctcctagccatgtcaaggataatctatctagatccttctttgggaggggtgtctggaatgtctc

SEQ ID NO: 284856 - DNA, 75 bp, Artificial Sequence
  Synthetic
gccctgatgtcatggaatctaagattgtattttgttatcactgaaaagcttttggccaactacatcctgccactt

SEQ ID NO: 284857 - DNA, 75 bp, Artificial Sequence
  Synthetic
tgtattttgttatcactgaaaagcttttggccaactacatcctgccactttttgatgcattgactatgacagaca

SEQ ID NO: 284858 - DNA, 75 bp, Artificial Sequence
  Synthetic
ccctcaggctcttctgtatgtgcctctcctgatctcctcgttgtgtttcgggggattccccatctacacgatacc

SEQ ID NO: 284859 - DNA, 75 bp, Artificial Sequence
  Synthetic
tgtctcaaaaccgctgactgaccctttattttatccgccatccgatcctaaaatcttgagacactttaacatatg

SEQ ID NO: 284860 - DNA, 75 bp, Artificial Sequence
  Synthetic
ttgtcgaagctatatgatcaagtccacatcaagaaggtgatagataaatcctatcaggagtgtttggctagcgac

SEQ ID NO: 284861 - DNA, 75 bp, Artificial Sequence
  Synthetic
tggcacaagctcccgatcacccagatcttcgagatccctgaatcaatggacccatctgaaatactagatgataaa

SEQ ID NO: 284862 - DNA, 75 bp, Artificial Sequence
  Synthetic
taaagaccaccaaagagtctcttattatcatatctccaagtgtagcggatttggacccatacgacaaatcccttc

SEQ ID NO: 284863 - DNA, 75 bp, Artificial Sequence
  Synthetic
caacaggtggatcaccctcgatgacattaggtccagatcatctcttctagattatagctgcttgtgaaataggct

SEQ ID NO: 284864 - DNA, 75 bp, Artificial Sequence
  Synthetic
aaaaacaagatcctgatccgtaacctctgtttacttgattgtgtttttcatctttattgtttttttgttaagcgt

SEQ ID NO: 284865 - DNA, 75 bp, Artificial Sequence
  Synthetic
tgccgacaagattgtattcaaagtcaataatcaggtggtctctttgaagcctgagattatcgtggatcagtatga

SEQ ID NO: 284866 - DNA, 75 bp, Artificial Sequence
  Synthetic
actgggctctggcaggaggcatggaactgacaagggaccccactgtctctgagcatgcatctttggtcggtcttc

SEQ ID NO: 284867 - DNA, 75 bp, Artificial Sequence
  Synthetic
gagcatgcatctttggtcggtcttctcttgagtctgtataggttgagcaaaatatcaggacaaaacaccggtaac

SEQ ID NO: 284868 - DNA, 75 bp, Artificial Sequence
  Synthetic
tgagagactctacgtttcattggcatcttcggtgcaacaggtgtgtaaggcccatagatgagataacactggaga

SEQ ID NO: 284869 - DNA, 75 bp, Artificial Sequence
  Synthetic
ctcagaccaggaacacaagaactaagatactagcccagggggacaaccaggttctatgtccgacatatatgttgt

SEQ ID NO: 284870 - DNA, 75 bp, Artificial Sequence
  Synthetic
aagatacagcgagggagggtattcctctgtctgccccaatctcctctcacatatttctgttagtacagacactat

SEQ ID NO: 284871 - DNA, 75 bp, Artificial Sequence
  Synthetic
gaaatctgtcgaagagcatgagaactaacctgcgacagatgagttccctgatgaggcaagtactaggagggcatg

SEQ ID NO: 284872 - DNA, 75 bp, Artificial Sequence
  Synthetic
gacaattttcttctagctatgtctagaatcatctatttagacccctcattggggggagtatctggaatgtctctt

SEQ ID NO: 284873 - DNA, 75 bp, Artificial Sequence
  Synthetic
tttctggagagagatctggctaagctctaatgagtcttggattcatgcgctgtgtcaagaagcaggaaacccaga

SEQ ID NO: 284874 - DNA, 75 bp, Artificial Sequence
  Synthetic
tctagacgatctcaatgttttcccatccctatgtctagtggtaggagatggatcggggggaatatcgagagcagt

SEQ ID NO: 284875 - DNA, 75 bp, Artificial Sequence
  Synthetic
tgcctcctatgaaggacatgagcaatagatcacaatcatcttacatcccgataaggtgtgcaaaactacaaaggg

SEQ ID NO: 284876 - DNA, 75 bp, Artificial Sequence
  Synthetic
gaaacttgtctaaaagtatgagggctaatctgcgacagatgagttccttgatgaggcaggttctgggtggccatg

SEQ ID NO: 284877 - DNA, 75 bp, Artificial Sequence
  Synthetic
ttttcttgaagtctgttgagcctttgtttccccgatttctcagtgaactcttcagttcatccttcttggggattc

SEQ ID NO: 284878 - DNA, 75 bp, Artificial Sequence
  Synthetic
tgtctgattttgcattgtctatagacgggcccctttgtttagttttcaaaacttacgggactatgctagtaaacc

SEQ ID NO: 284879 - DNA, 75 bp, Artificial Sequence
  Synthetic
gccgacaagctgaataaaatcatgcaagacgatttgaaccgctatacatcctgctaaccgaacttttaaactcag

SEQ ID NO: 284880 - DNA, 75 bp, Artificial Sequence
  Synthetic
gttccaaaatcccttgatctcgggcttgagagtggttcaatgggcaactggcgcccactacaaactcaaacctat

SEQ ID NO: 284881 - DNA, 75 bp, Artificial Sequence
  Synthetic
ttaccaagatcttgtaagaggattccctgaggagattatatctaacccttacaatgagatgatcataaccctgat

SEQ ID NO: 284882 - DNA, 75 bp, Artificial Sequence
  Synthetic
cctggtccacaagatggtggatgatcttgagttacagaggggaactctgtccaaagtggctatcattatagccat

SEQ ID NO: 284883 - DNA, 75 bp, Artificial Sequence
  Synthetic
tgcacttgtggagtagcaggagggggaaatcctcgaatatcagtgtctgtgctcccatcttttgatcagtcattt

SEQ ID NO: 284884 - DNA, 75 bp, Artificial Sequence
  Synthetic
ctgtaactccagcctaagtctgtcgtctcactggatcaggctgatctacaagatagtaaagaccaccaggcttgt

SEQ ID NO: 284885 - DNA, 75 bp, Artificial Sequence
  Synthetic
tttgcaaggcttcatgacttgtacaatagacctataacttattatttcaaaaagcaagtcattcgagggaatatt

SEQ ID NO: 284886 - DNA, 75 bp, Artificial Sequence
  Synthetic
ataacaggtggatcacccttgaggacatcaggtccagatcatctctgctagactacagttgcttatgagctggag

SEQ ID NO: 284887 - DNA, 75 bp, Artificial Sequence
  Synthetic
ttcaattgcagcagccccaaaagtgagatgcagagagctcgttccttgaactatcaagatcttgtaaggggattt

SEQ ID NO: 284888 - DNA, 75 bp, Artificial Sequence
  Synthetic
agtcatcaaaatattggagccatacgttgtgaacagcttggtccagagggcagaaaagtttaggcctctcattca

SEQ ID NO: 284889 - DNA, 75 bp, Artificial Sequence
  Synthetic
ggggcatccttacatagattatagaaagggtttgtcgaagctatatgatcaagtccacatcaagaaggtgataga

SEQ ID NO: 284890 - DNA, 75 bp, Artificial Sequence
  Synthetic
atacaaatacccagccatcaaagatttgaagaagcccagcattaccttggggaaggctccagacttaaacaaggc

SEQ ID NO: 284891 - DNA, 75 bp, Artificial Sequence
  Synthetic
accatctcttagaggagagatattttctattccccaaaaagttcccgctgcttacccgaccacgatgaaagaagg

SEQ ID NO: 284892 - DNA, 75 bp, Artificial Sequence
  Synthetic
aggtaattaagactaccagactcgttggcagcatcgaggacctgtccagagaggtggaaaggcaccttcatgggt

SEQ ID NO: 284893 - DNA, 75 bp, Artificial Sequence
  Synthetic
caagtcagtgagtttcagacgtctcagtcatttaagaaaacttgtccctgggttcggaaaagcatacaccatatt

SEQ ID NO: 284894 - DNA, 75 bp, Artificial Sequence
  Synthetic
acaacaggtggatcactctcgaggatatcagatctaggtcatctttgctagaatacagttgcttgtagaccggat

SEQ ID NO: 284895 - DNA, 75 bp, Artificial Sequence
  Synthetic
tcctgattgcacgaaaaggagacaagatcacccctgattcccttgtagatataaaacgtactgacgtagaaggga

SEQ ID NO: 284896 - DNA, 75 bp, Artificial Sequence
  Synthetic
ccaaacctcctgtcaaccccagagagttcctgaaatctatagaccttggaggactgccggacgaagatttgataa

SEQ ID NO: 284897 - DNA, 75 bp, Artificial Sequence
  Synthetic
gtctcaggggttgacctgggtctcccgaactgggggaaatatgtattactgagtgcaggaaccctgattgccttg

SEQ ID NO: 284898 - DNA, 75 bp, Artificial Sequence
  Synthetic
ctttattaagatcgtggaacatcacactctgatgacaactcataagatgtgtgccaactggagcaccataccaaa

SEQ ID NO: 284899 - DNA, 75 bp, Artificial Sequence
  Synthetic
ctgtagaagaaattgtctcctatgtcatgactaacttccccaacccatcgggaaagtcttcggaggacaagtcca

SEQ ID NO: 284900 - DNA, 75 bp, Artificial Sequence
  Synthetic
gtctacgaaacgcagtctcggagggacagggaggaaggtgtcggtcacttcccaaagcgggaaggtcatatcttc

SEQ ID NO: 284901 - DNA, 75 bp, Artificial Sequence
  Synthetic
caaagagagagccaatcctcgaaagcccgaatggcggctcaaactgcctctggtcctccagctctcgagtggtct

SEQ ID NO: 284902 - DNA, 75 bp, Artificial Sequence
  Synthetic
ttcaaaacccgttgatctcgggcctgagagtggttcagtgggcgacaggggcccattataaactcaaacctattc

SEQ ID NO: 284903 - DNA, 75 bp, Artificial Sequence
  Synthetic
ttccacaagaactttgaggaagagataagaagaatgttcgaaccggggcaggagactgctgttcctcattcctat

SEQ ID NO: 284904 - DNA, 75 bp, Artificial Sequence
  Synthetic
aaccaggttctatgtccgacatatatgttgtcaccggggctctctagagagggacttctctacgagttggagagc

SEQ ID NO: 284905 - DNA, 75 bp, Artificial Sequence
  Synthetic
aggcaacaccactgataagatgaacttcctgcgcaagatagtgaaaaactgtagggatgaggacacccagaagcc

SEQ ID NO: 284906 - DNA, 75 bp, Artificial Sequence
  Synthetic
cacacataaggagatatgtttcggtcagttccaaccaccaagcccgtccaaattcgttcgccgagtttctaaata

SEQ ID NO: 284907 - DNA, 75 bp, Artificial Sequence
  Synthetic
gaaagtagatttgggttctctcaaagtgggcggaactgctgcacagtcaatgatttctctctggttatatggtgc

SEQ ID NO: 284908 - DNA, 75 bp, Artificial Sequence
  Synthetic
tccccatttacacgataccagacaaactcggtccctggagtcccattgatatacatcacctcagctgtccgaata

SEQ ID NO: 284909 - DNA, 75 bp, Artificial Sequence
  Synthetic
acatgaggcggcttcagttggatgacggaaaatcgtctagcctcaatgagatggccacggcaggagaaagcaaat

SEQ ID NO: 284910 - DNA, 75 bp, Artificial Sequence
  Synthetic
taccaatctgtcaggattctcatacatggaacttaaagtaggatacatttcagccataaaggtgaacgggttcac

SEQ ID NO: 284911 - DNA, 75 bp, Artificial Sequence
  Synthetic
aggagagagattccttaagatctggtcacagaccgtagaggaaattatctcctatgtcacagtcaactttcccaa

SEQ ID NO: 284912 - DNA, 75 bp, Artificial Sequence
  Synthetic
agccatctcttagaggagagatattttctattccccaaaaagttcccgctgcttacccgaccacgatgaaagaag

SEQ ID NO: 284913 - DNA, 75 bp, Artificial Sequence
  Synthetic
acccctatatagattatcgaaagggtctgtcaaaactatatgatcaggttcacattaagaaagtgatagataagt

SEQ ID NO: 284914 - DNA, 75 bp, Artificial Sequence
  Synthetic
aactcaagaaggagacaccgtctgcgtcttctcagagagaaagccaattttcgaaggctcgaatgatggctcaaa

SEQ ID NO: 284915 - DNA, 75 bp, Artificial Sequence
  Synthetic
gtcttctcagagagaaagccaattttcgaaggctcgaatgatggctcaaactgcctctggtcctccagctctcga

SEQ ID NO: 284916 - DNA, 75 bp, Artificial Sequence
  Synthetic
ggggacctcttgtgatattttcaccaatagcagagggaagagagcatccaaagggagcaagacctgtggatttgt

SEQ ID NO: 284917 - DNA, 75 bp, Artificial Sequence
  Synthetic
ctcaccagattgctgaaagtttttctaagaagtacaagttcccctcccggtcatcagggatattcttatacaact

SEQ ID NO: 284918 - DNA, 75 bp, Artificial Sequence
  Synthetic
ttagatccagatcatctcttttagattatagctgcttgtaaactaggcattctcgagggaatatacagactaaga

SEQ ID NO: 284919 - DNA, 75 bp, Artificial Sequence
  Synthetic
atcacattctttcaccagaacaagactagcttcttggctgtcagagaaccgaggggggcctgttcctagcgagaa

SEQ ID NO: 284920 - DNA, 75 bp, Artificial Sequence
  Synthetic
gtgcctggtgtgacccgtctggctcatgacagatctaaaatccctctaagatgtgtcctggggtgggttgctctg

SEQ ID NO: 284921 - DNA, 75 bp, Artificial Sequence
  Synthetic
ttatccccctgatgcaccctttagcagacccgtctacagttttcaaggacggtgatgaagcagaggattttgttg

SEQ ID NO: 284922 - DNA, 75 bp, Artificial Sequence
  Synthetic
tgggatgggtcgctctggccaattcaaagaaattccaattgttagtcgaagccgacaagctgaataaaatcatgc

SEQ ID NO: 284923 - DNA, 75 bp, Artificial Sequence
  Synthetic
ccttcgatgtaacaagtgtgtaaggcccatagatgatatcacactggagaccccccagatctttgagtttccaga

SEQ ID NO: 284924 - DNA, 75 bp, Artificial Sequence
  Synthetic
ggccatgtcttaatcccggaaatgcagtcatctctccttcagcagcatatggagttgttggaatcctcggtcatc

SEQ ID NO: 284925 - DNA, 75 bp, Artificial Sequence
  Synthetic
aatcatgcaagatgatctgaaccgttatacatcctgctgaccaatttttacactcaggctcactagacatttgag

SEQ ID NO: 284926 - DNA, 75 bp, Artificial Sequence
  Synthetic
gaaaaactgtagggatgaggatacccaaaaacccttctctgcatctgctcccccagatgacgacgacctgtggct

SEQ ID NO: 284927 - DNA, 75 bp, Artificial Sequence
  Synthetic
cagcttattgatgatagatagagaatctcaaaccaggaacacaagaactaagatactagctcaaggagacaacca

SEQ ID NO: 284928 - DNA, 75 bp, Artificial Sequence
  Synthetic
tgggatgggtcgctctggccaattcaaagaaattccaattgttggttgaagccgacaagctaaacaaagtcatgc

SEQ ID NO: 284929 - DNA, 75 bp, Artificial Sequence
  Synthetic
acagttgtcactgcttatgaggactgctcagggttggtgtcatttacagggtttataaagcaaataaatctcact

SEQ ID NO: 284930 - DNA, 75 bp, Artificial Sequence
  Synthetic
acatctctggattcgacggtcctccttggactccttgcaacagggtagattcaagattcttgagacctccattaa

SEQ ID NO: 284931 - DNA, 75 bp, Artificial Sequence
  Synthetic
ttagtcaaggttgttattggactggccttatcaggggctccagtccccgagggcatgaactgggtgtacaaattg

SEQ ID NO: 284932 - DNA, 75 bp, Artificial Sequence
  Synthetic
tgctcgggcacggacagaggttatagtgggtcccctgacagcagactcaacatgagtcaactgagcagggcgatc

SEQ ID NO: 284933 - DNA, 75 bp, Artificial Sequence
  Synthetic
gaggtaacatattggtgcctgaatccaaaagatgggccagagtctcttgcatctctaacgaccaaatagtcaacc

SEQ ID NO: 284934 - DNA, 75 bp, Artificial Sequence
  Synthetic
ggcttcaattagacgatgaaaaaccatctggcctcggcgggatggccaaggtaggggagagcaagtgtcaggaag

SEQ ID NO: 284935 - DNA, 75 bp, Artificial Sequence
  Synthetic
agggtttggtgtatcaacatgaattctagagcgtgtcagttgtggtccgacatgtctcttcagacacaaaggtca

SEQ ID NO: 284936 - DNA, 75 bp, Artificial Sequence
  Synthetic
tcagacaaatgaggtcaggagagagattcctcaagatatggtctcagaccgtcgaagagatcatatcctatgtca

SEQ ID NO: 284937 - DNA, 75 bp, Artificial Sequence
  Synthetic
tctcctctaatagaggatccggccaaattaatgttagaatggttgaagacaggaaatagaccttaccgaatgacc

SEQ ID NO: 284938 - DNA, 75 bp, Artificial Sequence
  Synthetic
acaaagtcctgaaggattacttcaagaaggtagatctgggttccctcaaagtgggtggaaccgcagcccagtcaa

SEQ ID NO: 284939 - DNA, 75 bp, Artificial Sequence
  Synthetic
tgtttcctcgatttctcagtgagctcttcagctcgtcctttttgggaatccctgagtcaatcattggactgatac

SEQ ID NO: 284940 - DNA, 75 bp, Artificial Sequence
  Synthetic
tggatgtgaaaaaaactattaacatccctcaaaagacttaaggaaaaatgattccccaagctcttctgtttgtgc

SEQ ID NO: 284941 - DNA, 75 bp, Artificial Sequence
  Synthetic
tctattccaagtcttcccccatagagaagctgttgaattgcacacttggaaatagaggactaagaatccctccag

SEQ ID NO: 284942 - DNA, 75 bp, Artificial Sequence
  Synthetic
agaacacacgggcttaactccaacccttgggagcaatagaacaaaaacatgttatggtgccattaaaccgctgca

SEQ ID NO: 284943 - DNA, 75 bp, Artificial Sequence
  Synthetic
ggggtgggttgctctagccaaatccaaaaagttccagctgttagttgagcccgacaagctaaataaaataatgca

SEQ ID NO: 284944 - DNA, 75 bp, Artificial Sequence
  Synthetic
agttgactatgataaggcatttggaaggtatctctccaacacgtattcctcttatctgttcttccacgtgattac

SEQ ID NO: 284945 - DNA, 75 bp, Artificial Sequence
  Synthetic
ccagacaaactcggtccatggagtcccattgacatacatcatctcagctgtccaaacaatttggttgtggaggat

SEQ ID NO: 284946 - DNA, 75 bp, Artificial Sequence
  Synthetic
atacatctcagccattaaagtgaatggattcacctgtacaggtgtggtgacggaagcagagacctacactaactt

SEQ ID NO: 284947 - DNA, 75 bp, Artificial Sequence
  Synthetic
ggatataatgatgggaccatcttccctgtcaacatatacagcaaggtatcacctagagactatttaagagggctt

SEQ ID NO: 284948 - DNA, 75 bp, Artificial Sequence
  Synthetic
ttttgtgtcaatggagaagtcaaggtgtgtagtccaaacggctattcatttaggatcctgcggcatattttgaaa

SEQ ID NO: 284949 - DNA, 75 bp, Artificial Sequence
  Synthetic
tgtgtagtccaaacggctattcatttaggatcctgcggcatattttgaaatcattcgacgagatctattctggaa

SEQ ID NO: 284950 - DNA, 75 bp, Artificial Sequence
  Synthetic
accctgactaccattggcttcggactgtaaagaccaccaaggagtcccttgttatcatatctccaagtgtggcag

SEQ ID NO: 284951 - DNA, 75 bp, Artificial Sequence
  Synthetic
aatgccatatccagggcaggatttggtgtattaacatgaactctcgggcatgtcaattgtggtctgacatgtccc

SEQ ID NO: 284952 - DNA, 75 bp, Artificial Sequence
  Synthetic
gaacagcttagtccagagggcagaaaagtttaggcccctcatccactctttgggggactttcctgtttttataaa

SEQ ID NO: 284953 - DNA, 75 bp, Artificial Sequence
  Synthetic
ttgtgtacggttgttatagccattggggccatccctatatagattatagaaagggtctgtcaaaactatatgacc

SEQ ID NO: 284954 - DNA, 75 bp, Artificial Sequence
  Synthetic
ctacctactgctctactaaccacgactacaccatctggatgcctgagaatcccagactggggacttcttgtgaca

SEQ ID NO: 284955 - DNA, 75 bp, Artificial Sequence
  Synthetic
gggtttgtggatgagagaggcctgtacaagtctctaaaaggggcatgcaaactaaaactatgtggggttcttggg

SEQ ID NO: 284956 - DNA, 75 bp, Artificial Sequence
  Synthetic
tctgtcaaagttatatgatcaggttcatatcaagaaggtgatagacaagtcctaccaggagtgtttggcgagcga

SEQ ID NO: 284957 - DNA, 75 bp, Artificial Sequence
  Synthetic
taaaatctatcgacctcggagggttacccgatgaagacttgataattggcctcaagccgaaggaaagggagctga

SEQ ID NO: 284958 - DNA, 75 bp, Artificial Sequence
  Synthetic
tctggatgcctgaagaagcaagactcgggacatcttgtgacatttttaccaacagcagagggaagagagcatcca

SEQ ID NO: 284959 - DNA, 75 bp, Artificial Sequence
  Synthetic
ctaaagggtgcttaagagttggggggagatgtcatcctcatgtgaatggggtgttcttcaatggtatcatactgg

SEQ ID NO: 284960 - DNA, 75 bp, Artificial Sequence
  Synthetic
cagcacatggaattgttggagtcctcagtcatcccattgatgcatcccttagcagacccatcaacgatttttaag

SEQ ID NO: 284961 - DNA, 75 bp, Artificial Sequence
  Synthetic
cagtcatcccattgatgcatcccttagcagacccatcaacgatttttaaggacggtgacgaggcggaggactttg

SEQ ID NO: 284962 - DNA, 75 bp, Artificial Sequence
  Synthetic
ggtctcccaaactgggggaagtatgtgctaatgagcgcaggtgctctgattgcattgatgttgatgattttctta

SEQ ID NO: 284963 - DNA, 75 bp, Artificial Sequence
  Synthetic
tcaccttcccgatgtgcacaaacaggtctcaggggttgacctgggtctcccgaactgggggaagtatgtattact

SEQ ID NO: 284964 - DNA, 75 bp, Artificial Sequence
  Synthetic
tgcattgatgttgatgattttcttaatgacgtgttgcaggaagactgatagaacaggatcaacacaccacagtcc

SEQ ID NO: 284965 - DNA, 75 bp, Artificial Sequence
  Synthetic
cgaactgggggaagtatgtattactaagtgcgggaaccctgattgtcttgatgttgataattttcctaatgacat

SEQ ID NO: 284966 - DNA, 75 bp, Artificial Sequence
  Synthetic
tgagagtggttcagtgggcaaccggcgcccattataagcttaagcccattctagatgatctcaatgttttcccat

SEQ ID NO: 284967 - DNA, 75 bp, Artificial Sequence
  Synthetic
tagcttcatgggagtcatacaagagcggaggtgaaaccaggctgtgagggcaagtcatctcttctatacttcgag

SEQ ID NO: 284968 - DNA, 75 bp, Artificial Sequence
  Synthetic
caaactgggggaagtatgtgctgataagtgcaggtgctctgactgcattaatgttgatgattttcttaatgacgt

SEQ ID NO: 284969 - DNA, 75 bp, Artificial Sequence
  Synthetic
aagtgcaggtgctctgactgcattaatgttgatgattttcttaatgacgtgttgcagaaagactaatagagcaga

SEQ ID NO: 284970 - DNA, 75 bp, Artificial Sequence
  Synthetic
gaccatgtgtagctatgactttctcatctacgggaaaactcctttgtttcgaggtaacatcttggtgcctgagtc

SEQ ID NO: 284971 - DNA, 75 bp, Artificial Sequence
  Synthetic
atgggagtcatataaaagtgggagtgagactagactgtgagggctggtcatcctttcgacgcttcaagtttcgaa

SEQ ID NO: 284972 - DNA, 75 bp, Artificial Sequence
  Synthetic
taagagaaatcttctagcagttccagtgactaacggtgcttttaccctccacgaaccgatgccaaaggtggtaga

SEQ ID NO: 284973 - DNA, 75 bp, Artificial Sequence
  Synthetic
attcaagagtcatgagactttcattaatcatctcagttgatcaaataaggtcatgtagattctcattaagacggg

SEQ ID NO: 284974 - DNA, 75 bp, Artificial Sequence
  Synthetic
gatatcccagataactctatgcttgaatttgagcagaggctacagcaagttcccttacattagaccaaataagag

SEQ ID NO: 284975 - DNA, 75 bp, Artificial Sequence
  Synthetic
tgtattgggtccccagatatcagactgggtaagagtggattgagaaaggagacttacttcctataaaggacataa

SEQ ID NO: 284976 - DNA, 75 bp, Artificial Sequence
  Synthetic
tgataccaaaagttgtggacgggccaagaggtgtttctgatgactccgtgattgggcacggatagaggtcatggt

SEQ ID NO: 284977 - DNA, 75 bp, Artificial Sequence
  Synthetic
tgggtaagagtggattgagaaaggagacttacttcctataaaggacataagcaatagatcaccatcatcttgcat

SEQ ID NO: 284978 - DNA, 75 bp, Artificial Sequence
  Synthetic
aaactgtggaatggaggagtaattaacaacacttctcatcctgagaactgaaccatgatgattgatccaggggag

SEQ ID NO: 284979 - DNA, 75 bp, Artificial Sequence
  Synthetic
cctcccatgaaggacataagcaatagctcacaatcatctcacatctcagaaaggtgtgcataattataaagggct

SEQ ID NO: 284980 - DNA, 75 bp, Artificial Sequence
  Synthetic
gggtcatctaagcttttcagtcgagaaaaaaactgtagatcaaaagagcaactggcaacacttctcatcctgaga

SEQ ID NO: 284981 - DNA, 75 bp, Artificial Sequence
  Synthetic
cccactctgaatcaaacaggagccggaggtgtataactgacttggcccatttttattccaagtcatcccccatag

SEQ ID NO: 284982 - DNA, 75 bp, Artificial Sequence
  Synthetic
gatcctgccaaattgatgctggaatggttgaagacggggaatagaccttaccgaatgaccctaacagacaactgt

SEQ ID NO: 284983 - DNA, 75 bp, Artificial Sequence
  Synthetic
gatctccctttggctgtacggtgcctactctgaatcgaacaggagccggaagtgtataaccgatttggctcagtt

SEQ ID NO: 284984 - DNA, 75 bp, Artificial Sequence
  Synthetic
ggtatctggctaacatatactcctcttatttattctttcacgtgatcaccctgtacatgaacgccttggactggg

SEQ ID NO: 284985 - DNA, 75 bp, Artificial Sequence
  Synthetic
cccccatagagaaactattaaattgcacactcggaaatagaggactaagagtccctcctgagggtgtgttgagtt

SEQ ID NO: 284986 - DNA, 75 bp, Artificial Sequence
  Synthetic
ggcagcatcgaggacctatccggagaggtggaaagacaccttcatgggtacaacaggtggatcaccctcaaggat

SEQ ID NO: 284987 - DNA, 75 bp, Artificial Sequence
  Synthetic
ggaaatagagggctgagaatccccccagagggggtgttaagttgccttgagagggtcgattatgataaggcattt

SEQ ID NO: 284988 - DNA, 75 bp, Artificial Sequence
  Synthetic
aacccagatattcagatgacctgatatctcagctgtgtcagctatatatcgcaggagatcacgtcttgtccatgt

SEQ ID NO: 284989 - DNA, 75 bp, Artificial Sequence
  Synthetic
gccacctgtcaatcccagagagtttttaaaatctattgatctcgggggattgcctgacgaagacttgataattgg

SEQ ID NO: 284990 - DNA, 75 bp, Artificial Sequence
  Synthetic
ccataaactggttcatcacaagaaactcgaatttggctcagactctgattagaaacatcatgtctctaacgggcc

SEQ ID NO: 284991 - DNA, 75 bp, Artificial Sequence
  Synthetic
ctgattttcctctagaagaggcccctgtgttcaaaaggacagggtcagcattgcataggttcaagtccgctagat

SEQ ID NO: 284992 - DNA, 75 bp, Artificial Sequence
  Synthetic
ttcaaagatcaaatatggggattgctgattgtgacaaaggactttgtttactcccagagttctaactgtcttttt

SEQ ID NO: 284993 - DNA, 75 bp, Artificial Sequence
  Synthetic
ttgaagaagcccagtataaccttaggaaaagcccctgacttgaacaaagcatacaaatcagttttatccggcatg

SEQ ID NO: 284994 - DNA, 75 bp, Artificial Sequence
  Synthetic
aactgtacattgccggggatcaagtcttgtccatgtgcggaaactctggttatgaagtcatcaaaatattagagc

SEQ ID NO: 284995 - DNA, 75 bp, Artificial Sequence
  Synthetic
gaaaagcccctgacttgaacaaagcatacaaatcagttttatccggcatgaatgcagccaagctagaccctggag

SEQ ID NO: 284996 - DNA, 75 bp, Artificial Sequence
  Synthetic
tcttcgagatccccgaatcaatggacccatctgaaatactagatgataaatcacactctttcactagaacaagac

SEQ ID NO: 284997 - DNA, 75 bp, Artificial Sequence
  Synthetic
attcattctctaggggacttccctgtgttcataaaagacaaagtgagtcaactcgaagggacatttggtcctagt

SEQ ID NO: 284998 - DNA, 75 bp, Artificial Sequence
  Synthetic
cctgacgactggaccagttacggaatcttgatagctcgaaagggagataagatcactccggattctcttgtggac

SEQ ID NO: 284999 - DNA, 75 bp, Artificial Sequence
  Synthetic
ctatcgattgtgtatatccatcatgaaaaaaactaacacccctcctttcgaaccatccccaaatatgagcaagat

SEQ ID NO: 285000 - DNA, 75 bp, Artificial Sequence
  Synthetic
aattgaaggtcggtttttcgccttaatgtcctggaatctgaggttgtattttgtcatcacagagaagctcctagc

SEQ ID NO: 285001 - DNA, 75 bp, Artificial Sequence
  Synthetic
gatcactccggattctcttgtggacataagacgtactaatgtggaaggaaattgggctctgacagggggcatgga

SEQ ID NO: 285002 - DNA, 75 bp, Artificial Sequence
  Synthetic
atagaaagggtctgtcgaagctatatgatcaggttcacatcaagaaggtgatagacaagtcctaccaagaatgct

SEQ ID NO: 285003 - DNA, 75 bp, Artificial Sequence
  Synthetic
agttgatctcaggcgtgatctcatatatcctcttgaggctggataatcacccatctttgtacataatgctcagag

SEQ ID NO: 285004 - DNA, 75 bp, Artificial Sequence
  Synthetic
ttttgtgaagatagtagaacatcatactttgatgacaacccacaaaatgtgcgccaactggagtactataccgaa

SEQ ID NO: 285005 - DNA, 75 bp, Artificial Sequence
  Synthetic
atcttctacttcagagggttgaaagaaatctgtcgaagagtatgagagctaacctgcgacagatgagttccttga

SEQ ID NO: 285006 - DNA, 75 bp, Artificial Sequence
  Synthetic
cctgatttccctctagaagaggcccctgtgttcaagagaacagggtcagccttgcataggttcaaatctgccaga

SEQ ID NO: 285007 - DNA, 75 bp, Artificial Sequence
  Synthetic
cgagagtttttaaagtctattgacctcgggggattggccgacgaagacctgataattggtctcaagccgaaggaa

SEQ ID NO: 285008 - DNA, 75 bp, Artificial Sequence
  Synthetic
accgaggggggcctgttcctagcgagaaagttatcatcacggccctgtctaagccgcctgtcaatccccgagagt

SEQ ID NO: 285009 - DNA, 75 bp, Artificial Sequence
  Synthetic
ggcctcaagccgaaggagcgagaattgaagattgagggtcgattttttgctctaatgtcttggaatctaaggttg

SEQ ID NO: 285010 - DNA, 75 bp, Artificial Sequence
  Synthetic
atcagggggaatatcgagagcagtactcaacatgtttccagatgccaggcttgtattcaacagcttgttggaggt

SEQ ID NO: 285011 - DNA, 75 bp, Artificial Sequence
  Synthetic
tcatcacttgtatacctctggaagagagaatatacgggcttaactccaaccattgggggcaatagaacagaaata

SEQ ID NO: 285012 - DNA, 75 bp, Artificial Sequence
  Synthetic
agggacttttgagagaagattcttcagggacgagaaggagcttcaggaatatgaggcagctgaattgacaaagac

SEQ ID NO: 285013 - DNA, 75 bp, Artificial Sequence
  Synthetic
tttctataccccaaaaaattccagccgcttacccgactacaatgaaggaaggcaatagatctattttgtgttacc

SEQ ID NO: 285014 - DNA, 75 bp, Artificial Sequence
  Synthetic
caagctcttttgcttgtaccccttctgggtttttctttgtgtttcgggaaattccctatttacacgataccagac

SEQ ID NO: 285015 - DNA, 75 bp, Artificial Sequence
  Synthetic
agttttttcagaagtcttggatctattattccgacagatcagaccttattgggttatgggaggaccaaatatact

SEQ ID NO: 285016 - DNA, 75 bp, Artificial Sequence
  Synthetic
acacttggtccctggagcccgatcgatatacatcatctcagttgcccaaacaatttggttgtggaggatgaagga

SEQ ID NO: 285017 - DNA, 75 bp, Artificial Sequence
  Synthetic
gggttatgggaggaccaaatatactgtttagacatgtccaacggaccgacctgctggaatggtcaggatggcggg

SEQ ID NO: 285018 - DNA, 75 bp, Artificial Sequence
  Synthetic
cagctccaatcatcaagctcgccccaattcgttcgctgagtttttaaacaagacatactcgagtgattcatgaag

SEQ ID NO: 285019 - DNA, 75 bp, Artificial Sequence
  Synthetic
gggtacaacaggtggattacccttgaagatatcagatgtagatcatctctacttgattacagctgcttgtgaact

SEQ ID NO: 285020 - DNA, 75 bp, Artificial Sequence
  Synthetic
cagaaacctacactaactttgttggttatgtcaccaccacgttcaaaagaaagcatttccgcccaacaccagatg

SEQ ID NO: 285021 - DNA, 75 bp, Artificial Sequence
  Synthetic
ttatgtcaccaccacgttcaaaagaaagcatttccgcccaacaccagatgcatgtagagccgcgtacaactggaa

SEQ ID NO: 285022 - DNA, 75 bp, Artificial Sequence
  Synthetic
tatataccgagctatagaggaaggagcatccaaactagggctgattatcaagaaagaggaaaccatgtgtagcta

SEQ ID NO: 285023 - DNA, 75 bp, Artificial Sequence
  Synthetic
ggaacataatgtctctaacaggcccagacttcccgctggaagaggcccctgtcttcaagaggacagggtctgccc

SEQ ID NO: 285024 - DNA, 75 bp, Artificial Sequence
  Synthetic
ggacaatcttcccgaagacatgagacggcttcaattagatgatgaaaaaccatctgacctcggcggcaaagccaa

SEQ ID NO: 285025 - DNA, 75 bp, Artificial Sequence
  Synthetic
accctgccctcttgttccagtcgtacctggacaatgttggaattcaaatcgtcagacagatgaggtcaggagaga

SEQ ID NO: 285026 - DNA, 75 bp, Artificial Sequence
  Synthetic
cctggacaatgttggaattcaaatcgtcagacagatgaggtcaggagagagattcttgaagatatggtctcagac

SEQ ID NO: 285027 - DNA, 75 bp, Artificial Sequence
  Synthetic
agtctcttgcatctcgaacgaccagatagtcaaccttgccaatataatgtcaacggtgtccactaatgcattgac

SEQ ID NO: 285028 - DNA, 75 bp, Artificial Sequence
  Synthetic
cgacagtgacgtagaatctttcctggttcacaagatggtagacgatctagaattacagagaggaactctgtctaa

SEQ ID NO: 285029 - DNA, 75 bp, Artificial Sequence
  Synthetic
ttatgtctgtacaagcagtctttcactacctgctgttcagcccaatcttgaaaggcagagtttacaagattttga

SEQ ID NO: 285030 - DNA, 75 bp, Artificial Sequence
  Synthetic
ggaaatcctcagaggagaaagctacccagacttccagccgggaactcaagaaggagacagtgtctgcttcttctc

SEQ ID NO: 285031 - DNA, 75 bp, Artificial Sequence
  Synthetic
tggaatgagatcatcccctcaaaagggtgtttgagagttggagggaggtgtcatcctcatgtaaacggggtattt

SEQ ID NO: 285032 - DNA, 75 bp, Artificial Sequence
  Synthetic
agcgagaaattcaaccattaaaagccaaaatggcagctcaaaccacctccggtcctcctgctctcgagtggtctg

SEQ ID NO: 285033 - DNA, 75 bp, Artificial Sequence
  Synthetic
ggtctcaggggttgacctgggtctcccgaactggggggagtatgtattactgagtgcagggaccttaattgcctt

SEQ ID NO: 285034 - DNA, 75 bp, Artificial Sequence
  Synthetic
gatccttccttagggggagtgtcgggaatgtccctcgggagattccatatacgtcagttctcagatcccgtctct

SEQ ID NO: 285035 - DNA, 75 bp, Artificial Sequence
  Synthetic
tttggctgagctcccatgagtcttggattcatgccctgtgtcaggaggcaggaaacccagacctcggagagagaa

SEQ ID NO: 285036 - DNA, 75 bp, Artificial Sequence
  Synthetic
acaaatttccttcccgatcatcggggatcttcctgtataactttgagcagttgaagatgaaccttgatgacatag

SEQ ID NO: 285037 - DNA, 75 bp, Artificial Sequence
  Synthetic
gtacaagtacccggcaatcaaagactcgaggaagcccagtataaccttaggaaaagcccctgacttgaacaaagc

SEQ ID NO: 285038 - DNA, 75 bp, Artificial Sequence
  Synthetic
gccgtctcttagaggagagatattttctattccccaaaaagttcccgctgcttacccgaccacgatgaaagaagg

SEQ ID NO: 285039 - DNA, 75 bp, Artificial Sequence
  Synthetic
tttagaagctccaagatgacgtatctgactctcatcacctaccagtctcatcttttacttcagagggttgagaaa

SEQ ID NO: 285040 - DNA, 75 bp, Artificial Sequence
  Synthetic
tccaaactccctctgagatgtgtgctggggtgggttgccctagccaactccaaaaagttccagctgttggttgag

SEQ ID NO: 285041 - DNA, 75 bp, Artificial Sequence
  Synthetic
aaaggaggggctagtccgaccatcttacttaaagatgcaatcagaaaagccctgtatgacgaagtggacaaagta

SEQ ID NO: 285042 - DNA, 75 bp, Artificial Sequence
  Synthetic
atgtatgctcttatctagcagctgcaatgcagttctttgagggagcatgtcccgatgactgggttagctacggaa

SEQ ID NO: 285043 - DNA, 75 bp, Artificial Sequence
  Synthetic
gaaaactcggagtttagagaggcaatcctcttgtccaagacccatagggataactttatactgtttttgaaatct

SEQ ID NO: 285044 - DNA, 75 bp, Artificial Sequence
  Synthetic
cctctatcatatcagctcctccagatgatgatgatctgtggttaccccctccggaatatgttccgttgaaggagc

SEQ ID NO: 285045 - DNA, 75 bp, Artificial Sequence
  Synthetic
ctcaagaactttagaggagtcattttacaactcagagattcacgggatcaatcggatgacccagacacctcagcg

SEQ ID NO: 285046 - DNA, 75 bp, Artificial Sequence
  Synthetic
atgtgtgctcttacttggcagctgcaatgcagttctttgaaggaacatgtccagaagactggactagctatggaa

SEQ ID NO: 285047 - DNA, 75 bp, Artificial Sequence
  Synthetic
gtgctaattggagtactataccgaatttcagatttttggccggaacctacgacatgtttttctcccggattgagc

SEQ ID NO: 285048 - DNA, 75 bp, Artificial Sequence
  Synthetic
agatttcgtgggggaggaaagtggtgggcacgacagttcctcacccttctgagatgttgggactgattcccaagt

SEQ ID NO: 285049 - DNA, 75 bp, Artificial Sequence
  Synthetic
atcattcgatgagatttattctggaaatcaaagaatgatcgggttggtcaaagttgttgtcggattggcgttgtc

SEQ ID NO: 285050 - DNA, 75 bp, Artificial Sequence
  Synthetic
gggcacgacagttcctcacccttctgagatgttgggactgattcccaagtcttccatctcctgtacttgtggaat

SEQ ID NO: 285051 - DNA, 75 bp, Artificial Sequence
  Synthetic
tttcagatttttggccggaacctacgacatgtttttctcccggattgagcatctatattcagcgatcagagtggg

SEQ ID NO: 285052 - DNA, 75 bp, Artificial Sequence
  Synthetic
atcaatcatttttctcacgaggccctctaaaagggtacctgggctcatccacctccatgtcgacccagctgttcc

SEQ ID NO: 285053 - DNA, 75 bp, Artificial Sequence
  Synthetic
tctaaaagggtacctgggctcatccacctccatgtcgacccagctgttccatgcttgggaaaaagtcaccaatgt

SEQ ID NO: 285054 - DNA, 75 bp, Artificial Sequence
  Synthetic
tctccctaactgggggaagtatgttttggtaagtgcaggggtcctgatcgccttgatgttgataatttttctaat

SEQ ID NO: 285055 - DNA, 75 bp, Artificial Sequence
  Synthetic
ttggtaagtgcaggggtcctgatcgccttgatgttgataatttttctaatgacatgttgcggaagagtcaatcga

SEQ ID NO: 285056 - DNA, 75 bp, Artificial Sequence
  Synthetic
tcactagaaactcgaacttggctcagactctaattaggaacatcatgtcattgacaggtcctgatttccccctgg

SEQ ID NO: 285057 - DNA, 75 bp, Artificial Sequence
  Synthetic
gactctaattaggaacatcatgtcattgacaggtcctgatttccccctggaggaagcccctgtgttcaaaagaac

SEQ ID NO: 285058 - DNA, 75 bp, Artificial Sequence
  Synthetic
ggtgtatcaacatgaactctcgggcatgtcaattatggtccgacatgtctcttcaaacgcaaaaatctgaagagg

SEQ ID NO: 285059 - DNA, 75 bp, Artificial Sequence
  Synthetic
attcttctgtgtgccctaatctcctctctcacatctctgtgagtacagataccatgtctgatctgacccaggacg

SEQ ID NO: 285060 - DNA, 75 bp, Artificial Sequence
  Synthetic
agagcacaggggcttgactccagtcttcaggagcaatagaacaaaaatatgtcatggtgccgttgaatagctgca

SEQ ID NO: 285061 - DNA, 75 bp, Artificial Sequence
  Synthetic
aacttgacaacatggaagtacttccagtcagtccaaagaaaggttaacatgtcttatgacctcatcatttgtgat

SEQ ID NO: 285062 - DNA, 75 bp, Artificial Sequence
  Synthetic
gaaaaaaactattaacatccctcaaaaaaacctaaggaaagatgatccttcaggctcttctgtttgtgcctctcc

SEQ ID NO: 285063 - DNA, 75 bp, Artificial Sequence
  Synthetic
cctgccttatgtttacgtctgccaaatacgacaaaagacggtattcttctgtctgcccaaacctcctctctcata

SEQ ID NO: 285064 - DNA, 75 bp, Artificial Sequence
  Synthetic
agacatattcgagtgactcataaggagctgaataacatggtgccgggaatctattgattgtgtatatccatcatg

SEQ ID NO: 285065 - DNA, 75 bp, Artificial Sequence
  Synthetic
ctcactttcaaaaacttccagatatacgtctaaaacccggagattttgaatctctgagtggcagggagaaatctc

SEQ ID NO: 285066 - DNA, 75 bp, Artificial Sequence
  Synthetic
acatacatcatctcagttgtcctaacaatttggttgtggaggacgaggggtgtacaagtctgtcagggttttctt

SEQ ID NO: 285067 - DNA, 75 bp, Artificial Sequence
  Synthetic
cagaaagatttaggcccctcattcactccctgggagacttccctgcgtttataaaagataaggtaagtcagctcg

SEQ ID NO: 285068 - DNA, 75 bp, Artificial Sequence
  Synthetic
catgactctggatataatgatggcaccatattccctgtcaacatatatggcaaggtatcccctagagactattta

SEQ ID NO: 285069 - DNA, 75 bp, Artificial Sequence
  Synthetic
acctgtacaggtgttgtgacagaagctgagacctacaccaactttgttggttatgtcaccaccacattcaagagg

SEQ ID NO: 285070 - DNA, 75 bp, Artificial Sequence
  Synthetic
ctgagattatcgtggatcaatatgagtacaagtaccctgccatcaaggatttgaaaaagccttgtatcaccctag

SEQ ID NO: 285071 - DNA, 75 bp, Artificial Sequence
  Synthetic
aaacattttcgccctacgcccgacgcatgcagggctgcctacaactggaaggtggccggtgatcctagatatgag

SEQ ID NO: 285072 - DNA, 75 bp, Artificial Sequence
  Synthetic
aatgccgccaaacttgatccggatgatgtatgctcctacttggcagcagcaatgcagttctttgaggggacatgt

SEQ ID NO: 285073 - DNA, 75 bp, Artificial Sequence
  Synthetic
gatacatggcataagctcccaataacacagatctttgaaatccctgagtcaatggatccgtcagaaatactagat

SEQ ID NO: 285074 - DNA, 75 bp, Artificial Sequence
  Synthetic
cgtagaagaaattatatcctatgtcacggtcaacttccccaacccctcaggaaggtcctcagaggataaatcgac

SEQ ID NO: 285075 - DNA, 75 bp, Artificial Sequence
  Synthetic
gaccaccaaggagtctcttatcatcatatctccaagtgtggctgatttggacccatacgacaaatcccttcattc

SEQ ID NO: 285076 - DNA, 75 bp, Artificial Sequence
  Synthetic
gctctgatgtcatggaacctaagattgtattttgttatcaccgagaagcttttggccaactacatcctgccactc

SEQ ID NO: 285077 - DNA, 75 bp, Artificial Sequence
  Synthetic
ggataatcacccgtctttgtacgtaatgctccgagagccgtctcttagaggagagatattttctataccccaaaa

SEQ ID NO: 285078 - DNA, 75 bp, Artificial Sequence
  Synthetic
atatctccaagtgtggctgatttggacccatacgacaaatcccttcattccagagtgttccctagtgggaagtgt

SEQ ID NO: 285079 - DNA, 75 bp, Artificial Sequence
  Synthetic
agagagaaagccaatcctcgaaagccaggatggcggctcaagctgcctctggccctccagcccttgaatggtcgg

SEQ ID NO: 285080 - DNA, 75 bp, Artificial Sequence
  Synthetic
tgtgttacctccaacacgtgctgcgctatgagcgagaggttattacagcatcccctgagaatgactggttgtgga

SEQ ID NO: 285081 - DNA, 75 bp, Artificial Sequence
  Synthetic
catctggatgcccgaagaagcgagactcgggacatcttgtgacatctttaccaacagcaaagggaagaaagcctc

SEQ ID NO: 285082 - DNA, 75 bp, Artificial Sequence
  Synthetic
agaatgactggctgtggatcttctcagactttagaagtgccaaaatgacgtacctgaccctcattacttaccagt

SEQ ID NO: 285083 - DNA, 75 bp, Artificial Sequence
  Synthetic
tcctgagtctgtacaggttgagcaaaatatcaggacagaacactggtaactataagacaaacattgcagatagga

SEQ ID NO: 285084 - DNA, 75 bp, Artificial Sequence
  Synthetic
taaagggggcaggacttgcggattcgtggatgaaaggggcctgtataagtctttaaaaggagcctgtaaactcaa

SEQ ID NO: 285085 - DNA, 75 bp, Artificial Sequence
  Synthetic
acaagtttccctctcgatcttcagggatattcttgtataattttgagcaattgaaaatgaaccttgatgatatag

SEQ ID NO: 285086 - DNA, 75 bp, Artificial Sequence
  Synthetic
gggttgaaagaaatctatccaagagcatgagagctaacctaagacagatgagttccttgatgaggcaggtgctag

SEQ ID NO: 285087 - DNA, 75 bp, Artificial Sequence
  Synthetic
actctaatgacaactcacaaaatgtgtgctaattggagtactataccgaacttcagatttttggccggaacctac

SEQ ID NO: 285088 - DNA, 75 bp, Artificial Sequence
  Synthetic
catgagagctaacctaagacagatgagttccttgatgaggcaggtgctaggagggcacggagaggacactttaga

SEQ ID NO: 285089 - DNA, 75 bp, Artificial Sequence
  Synthetic
ctatgagcgagaggttattacagcatcccctgagaatgactggttgtggattttctctgactttagaagctccaa

SEQ ID NO: 285090 - DNA, 75 bp, Artificial Sequence
  Synthetic
gtttttcaatggtataattttgggtccagacgggaatgtcctgatccctgagatgcaatcgtctttactccaaca

SEQ ID NO: 285091 - DNA, 75 bp, Artificial Sequence
  Synthetic
gcaaggcaggatgttcagagtgggtttgctccgctcagcaggttgcagtctccacctctgctaatccggcccctg

SEQ ID NO: 285092 - DNA, 75 bp, Artificial Sequence
  Synthetic
agggacttttgagagaaggttcttcagagacgagaaagaacttcaggaatatgaggcagctgaatcaactaagac

SEQ ID NO: 285093 - DNA, 75 bp, Artificial Sequence
  Synthetic
taattagaaacattatgtctctaacaggccccgatttccctctcgaagaggcccctgtctttaaaagaacagggt

SEQ ID NO: 285094 - DNA, 75 bp, Artificial Sequence
  Synthetic
ttctattataagtcctcccccatagaaaagctgttaaactgcacactcggaaatagagggctaaaaacccccccc

SEQ ID NO: 285095 - DNA, 75 bp, Artificial Sequence
  Synthetic
atctccggcttgagagtggttcagtgggcaactggtgcccattataagctcaagcccattttagatgatctcaat

SEQ ID NO: 285096 - DNA, 75 bp, Artificial Sequence
  Synthetic
gcccctgtctttaaaagaacagggtcagcattgcacaggttcaagtctgccagatacagcgagggggggtattcc

SEQ ID NO: 285097 - DNA, 75 bp, Artificial Sequence
  Synthetic
caagcccattttagatgatctcaatgtcttcccgtccctatgtctcgtggttggagatggatcgggggggatatc

SEQ ID NO: 285098 - DNA, 75 bp, Artificial Sequence
  Synthetic
cccatcaacagtcttcaaggacggtgatgaggcggaggattttgttgaagttcaccttccggatgttcacaagca

SEQ ID NO: 285099 - DNA, 75 bp, Artificial Sequence
  Synthetic
tcagcaatcatgagtggaggagatgacattgtctccagagtgatagactttgactcaatctgggagaaaccatca

SEQ ID NO: 285100 - DNA, 75 bp, Artificial Sequence
  Synthetic
aactgggtatacaaactgaggagaacccttatcttccagtgggctgattccaggggccctcttgagggggaggag

SEQ ID NO: 285101 - DNA, 75 bp, Artificial Sequence
  Synthetic
tgattgcaggtgctctggctggactaattctgataatcttcttgatggcatgttgtagaagggccaagagaacag

SEQ ID NO: 285102 - DNA, 75 bp, Artificial Sequence
  Synthetic
aattctgataatcttcttgatggcatgttgtagaagggccaagagaacagagtcaagacgacgaggttctgggga

SEQ ID NO: 285103 - DNA, 75 bp, Artificial Sequence
  Synthetic
atgaatggaggtcgactgaagagatctcatatacggagatatgtctcagtcagttccaatcatcaagcccgtcca

SEQ ID NO: 285104 - DNA, 75 bp, Artificial Sequence
  Synthetic
tctgatgtctgactttgcactgtccatagaaggcccgctttatctggtcttcaaaacttacggaactatgctagt

SEQ ID NO: 285105 - DNA, 75 bp, Artificial Sequence
  Synthetic
aactcattcgccgaatttttaaacaagacgtattcgaatgactcataaggagttgattgacagggtgccggaaat

SEQ ID NO: 285106 - DNA, 75 bp, Artificial Sequence
  Synthetic
catgggagttgtacaagagtgaaggcgagaccgggctgtgagggcatgccatctcctctataccatgcgttcaga

SEQ ID NO: 285107 - DNA, 75 bp, Artificial Sequence
  Synthetic
cgagaccgggctgtgagggcatgccatctcctctataccatgcgttcagaagattgctgatctttcagatcggaa

SEQ ID NO: 285108 - DNA, 75 bp, Artificial Sequence
  Synthetic
cttaagagtcgagaaacgtccattaatcatctcaactgatcagacacagtcatgtagatttttataatgtatgat

SEQ ID NO: 285109 - DNA, 75 bp, Artificial Sequence
  Synthetic
atcatctcaactgatcagacacagtcatgtagatttttataatgtatgatgtcctctgacagtatcattgaccaa

SEQ ID NO: 285110 - DNA, 75 bp, Artificial Sequence
  Synthetic
cttgtgttgttcaactgtagcagccccaagagtgagatgcagagagcccgctctttgaattatcaagatcttgta

SEQ ID NO: 285111 - DNA, 75 bp, Artificial Sequence
  Synthetic
agaaacatagaagacaatcaggctcatctccagggagaacccatagaagtggacaacctccctgaggacatgaag

SEQ ID NO: 285112 - DNA, 75 bp, Artificial Sequence
  Synthetic
ctgatctcccaaataactctatgattgagttttggtaaaggccatcgtaagttctatggcattagaccaaatcga

SEQ ID NO: 285113 - DNA, 75 bp, Artificial Sequence
  Synthetic
gtacaagtacccggctatcaaggacttgaaaaagcccagtataaccttaggaaaagcccctgacttgaacaaagc

SEQ ID NO: 285114 - DNA, 75 bp, Artificial Sequence
  Synthetic
tgagttttggtaaaggccatcgtaagttctatggcattagaccaaatcgagattagttgagagaagcgacttgcc

SEQ ID NO: 285115 - DNA, 75 bp, Artificial Sequence
  Synthetic
ggtgtgcataactacaaagggctggaccatccaagccttctagtcaggaaaaaaactgtagaagggaggggtaat

SEQ ID NO: 285116 - DNA, 75 bp, Artificial Sequence
  Synthetic
gattcctcaagatatggtcacagaccgtagaggaaattgtatcctatgtcacggtcaactttcctaaccctccaa

SEQ ID NO: 285117 - DNA, 75 bp, Artificial Sequence
  Synthetic
atggccggtgaccccagatatgaagagtctctacacaatccgtaccctgactaccactggcttcgaactgtaaaa

SEQ ID NO: 285118 - DNA, 75 bp, Artificial Sequence
  Synthetic
gtccccagctttgcaagacttcatgacttatacaatagaccaataacctattatttcaaaaagcaggtcattcga

SEQ ID NO: 285119 - DNA, 75 bp, Artificial Sequence
  Synthetic
atgagggactttctgcttatgtcagtacaagctgtcttccattacttgctgtttagtcccatcttgaaaggcaga

SEQ ID NO: 285120 - DNA, 75 bp, Artificial Sequence
  Synthetic
gtgctaactggagtaccataccaaacttcagattcttggctggaacctacgacatgtttttctcccggattgagc

SEQ ID NO: 285121 - DNA, 75 bp, Artificial Sequence
  Synthetic
cagggaataggcctcttcggatgactttgacagacaattgctctaggtcatacagagttttgaaagattacttca

SEQ ID NO: 285122 - DNA, 75 bp, Artificial Sequence
  Synthetic
tctcgaagacatcagatctagatcatctctactggactacagctgcttataagctgaacactgctagaggtttat

SEQ ID NO: 285123 - DNA, 75 bp, Artificial Sequence
  Synthetic
tccaaaatccccctgagatgtgtactgggatgggtcgctttggctaattccaaaaaattccaattactagtcgag

SEQ ID NO: 285124 - DNA, 75 bp, Artificial Sequence
  Synthetic
aagactctcgtgtgatgtgtcttgaaaaaaacaagatcttgaatcagagcctctggctgtttgattgttttttct

SEQ ID NO: 285125 - DNA, 75 bp, Artificial Sequence
  Synthetic
tagatgaaagaggcctgtataagtctctaaagggagcatgtaaactcaagttatgtggagttcttggacttagac

SEQ ID NO: 285126 - DNA, 75 bp, Artificial Sequence
  Synthetic
atgatctccctttggctgtacggtgcctactctgaatcgaacaggagccggaagtgtataaccgacttggctcaa

SEQ ID NO: 285127 - DNA, 75 bp, Artificial Sequence
  Synthetic
aaaaacgagatcccgaatcagaacctctggttgtttgattattttttttatctttattgtttttttgttaagcgt

SEQ ID NO: 285128 - DNA, 75 bp, Artificial Sequence
  Synthetic
ctgctaaccgagttttcgaactcagtccctccagataatgaaaactgagatgttatggagtagacatgaaaaaaa

SEQ ID NO: 285129 - DNA, 75 bp, Artificial Sequence
  Synthetic
tgtagggatgaggacactcaaaagccctctcctgtgtcagcccctccggatgacgatgacctgtggcttccacct

SEQ ID NO: 285130 - DNA, 75 bp, Artificial Sequence
  Synthetic
ctgtggaaggatttaacatcaatcgatacggggaaggacttggtcaagtttaaagatcaaatatggggattgctg

SEQ ID NO: 285131 - DNA, 75 bp, Artificial Sequence
  Synthetic
gacctttttttgtctcggttcaactctctaatgattcttctttctcctccggaacccagatattcagatgacctg

SEQ ID NO: 285132 - DNA, 75 bp, Artificial Sequence
  Synthetic
ctaggagatttccctgcatttataagagataaggtgggtcaacttgagggaacatttggtcctagtgcaaaaagg

SEQ ID NO: 285133 - DNA, 75 bp, Artificial Sequence
  Synthetic
gggatgatgatactgaattcgtcggattgcaaataagagtgagcgcaagacaatgtcatattcaaggcaggatct

SEQ ID NO: 285134 - DNA, 75 bp, Artificial Sequence
  Synthetic
aacatttggtcctagtgcaaaaaggttcttcaaggttctggatcaattcgacaacatacacgacttagtctttgt

SEQ ID NO: 285135 - DNA, 75 bp, Artificial Sequence
  Synthetic
atgtcaactatggtctgacatgtctcttcagacacaaaggtctgaagaggacaaagactcttctctgcttctaga

SEQ ID NO: 285136 - DNA, 75 bp, Artificial Sequence
  Synthetic
ataatcagattatatcctgcaagtttatcacttgtttacctctggaggagagagcatacaggcttgactccgatc

SEQ ID NO: 285137 - DNA, 75 bp, Artificial Sequence
  Synthetic
ttgaactccatgcaacagggtagattcaagagtcatgagactttcattaatcatctcagttgatcaaacaaggtc

SEQ ID NO: 285138 - DNA, 75 bp, Artificial Sequence
  Synthetic
tcaagagtcatgagactttcattaatcatctcagttgatcaaacaaggtcatgttgattctcataatacgggaaa

SEQ ID NO: 285139 - DNA, 75 bp, Artificial Sequence
  Synthetic
gtgtgacccgtttagctcatgatggatctaaactccctctaagatgtgtactggggtgggttgccctagccaact

SEQ ID NO: 285140 - DNA, 75 bp, Artificial Sequence
  Synthetic
acaaattcccctcccggtcatcagggatattcttgtataattttgagcagttgaaaatgaaccttgatgacatag

SEQ ID NO: 285141 - DNA, 75 bp, Artificial Sequence
  Synthetic
gatcttcgagatccccgaatcaatggacccgtccgagatactcgatgataaatcacactctttcactagaacaaa

SEQ ID NO: 285142 - DNA, 75 bp, Artificial Sequence
  Synthetic
gggcacagacagaggtcatagtacgtcccataatagcagactcaacatgagtcgattgagaaaggcaatctgcct

SEQ ID NO: 285143 - DNA, 75 bp, Artificial Sequence
  Synthetic
gatcaggggggatatcaagagcggtactcaacatgtttccggatgccaggcttgtattcaatagcttattggaag

SEQ ID NO: 285144 - DNA, 75 bp, Artificial Sequence
  Synthetic
attgctgagagcttttccaagaagtacaaattcccttcccgatcgtcagggatattcttgtataactttgagcag

SEQ ID NO: 285145 - DNA, 75 bp, Artificial Sequence
  Synthetic
gatattcttgtataactttgagcagttaaaaatgaaccttgatgacatagtcaaagagtcaaaaaatgttccaag

SEQ ID NO: 285146 - DNA, 75 bp, Artificial Sequence
  Synthetic
cctactgctcaactaaccatgattacaccatttggatgcccgagaatccgagaccaaggacaccttgtgacattt

SEQ ID NO: 285147 - DNA, 75 bp, Artificial Sequence
  Synthetic
tcacactatgcaatcaaatctgacctgctccaagtccaacatgaaaaaaacgggcaacaccactgataaaatgaa

SEQ ID NO: 285148 - DNA, 75 bp, Artificial Sequence
  Synthetic
tgtcagacggcccgacatgctggaacggccaagatggcggcctagagggtctgcgtcaaaagggctggagtctgg

SEQ ID NO: 285149 - DNA, 75 bp, Artificial Sequence
  Synthetic
aatttggttgtggaggacgaggggtgcaccagtctgtcagggttttcttacatggaactgaaggtgggatacatc

SEQ ID NO: 285150 - DNA, 75 bp, Artificial Sequence
  Synthetic
gcaccagtctgtcagggttttcttacatggaactgaaggtgggatacatctctgccataaaggtgaacgggttca

SEQ ID NO: 285151 - DNA, 75 bp, Artificial Sequence
  Synthetic
agacttatggatggaacatgggtcgcgatgcaaacatcagatgagaccaaatggtgccctccagatcagttggtg

SEQ ID NO: 285152 - DNA, 75 bp, Artificial Sequence
  Synthetic
aagatattagcccagggggacaaccaggttctgtgcccaacgtatatgttgtcaccggggctctccagagagggg

SEQ ID NO: 285153 - DNA, 75 bp, Artificial Sequence
  Synthetic
agaaactatacacttatgctaaaagatcttttcttgtctcgcttcaactctttaatgatcctgctttctcccccc

SEQ ID NO: 285154 - DNA, 75 bp, Artificial Sequence
  Synthetic
tgccattgaggaaggggcatccaaactagggctcattataaagaaggaagagaccatgtgtagttatgactttct

SEQ ID NO: 285155 - DNA, 75 bp, Artificial Sequence
  Synthetic
tctcactggatcaggctgatttacaagatagtgaagaccactagactcatcggaagtgtcgaagatctatcaaga

SEQ ID NO: 285156 - DNA, 75 bp, Artificial Sequence
  Synthetic
tattcaacaaaaccttgatggaggctgatgctcactacaagtcagtccggacctggaatgagatcatcccctcaa

SEQ ID NO: 285157 - DNA, 75 bp, Artificial Sequence
  Synthetic
attggaaatacgagtgagtgcaagacaatgccatatccagggcaggatttggtgtatcaatatgaactctcgggc

SEQ ID NO: 285158 - DNA, 75 bp, Artificial Sequence
  Synthetic
tttttcaatggtataatattagggcctgacggccatgtcctaatcccagagatgcaatcatccctcctccagcaa

SEQ ID NO: 285159 - DNA, 75 bp, Artificial Sequence
  Synthetic
ttatccccctgatgcaccccctggcagacccttctacagttttcaaagaaggtgatgaggctgaggattttgttg

SEQ ID NO: 285160 - DNA, 75 bp, Artificial Sequence
  Synthetic
caacatacatgacttggtttttgtgtatggctgttacaggcattgggggcacccctatatagattatcgaaaggg

SEQ ID NO: 285161 - DNA, 75 bp, Artificial Sequence
  Synthetic
ctcccgaactggggaaagtatgtattgatgactgcaggggccatgattggcctggtgttgatattttccctaatg

SEQ ID NO: 285162 - DNA, 75 bp, Artificial Sequence
  Synthetic
gttctaatgagtcatggattcacgcgttgtgtcaagaagcgggaaacccagatctgggggagagaacactagaga

SEQ ID NO: 285163 - DNA, 75 bp, Artificial Sequence
  Synthetic
ggctttgacaagtactccaagtggtatctggattctcgattccttgcccgagaccatcctttgactccttatatc

SEQ ID NO: 285164 - DNA, 75 bp, Artificial Sequence
  Synthetic
agggacagggaggaatgtgtcagtcacttcccaaagcggaaaagtcataccttcatgggaatcatataagagtgg

SEQ ID NO: 285165 - DNA, 75 bp, Artificial Sequence
  Synthetic
ctgataccaaaggttgtggacaggccaaggggtacttcggatgactctgtgcttgggcacagaaagaggtcgtag

SEQ ID NO: 285166 - DNA, 75 bp, Artificial Sequence
  Synthetic
gccggtttggctgatctggagatggccgaggagactgttgatctgatcaataggaacatagaagacaatcaggct

SEQ ID NO: 285167 - DNA, 75 bp, Artificial Sequence
  Synthetic
tgtgccccccgatagcggactcgacatgaatcaactaagaaaggcaatctgcctcccatgatggacataagcaat

SEQ ID NO: 285168 - DNA, 75 bp, Artificial Sequence
  Synthetic
aattacagagaggaactctatctaagatgtctatcattatagctattatgatagttttctccaacagagttttca

SEQ ID NO: 285169 - DNA, 75 bp, Artificial Sequence
  Synthetic
gcagatctcctaagagagatctcatgggggaggaaggtggttggtactacggttcctcacccctctgaaatgttg

SEQ ID NO: 285170 - DNA, 75 bp, Artificial Sequence
  Synthetic
aactagcaacacttctcatccagagacccatatcaagatgctagatccgggagaggtttatgatgaccctattga

SEQ ID NO: 285171 - DNA, 75 bp, Artificial Sequence
  Synthetic
tcgacccagctattccacgcatgggagaaagtcaccaacgttcatgttgtgaaaagagccctgtctcttaaagag

SEQ ID NO: 285172 - DNA, 75 bp, Artificial Sequence
  Synthetic
gaaaagcccctgacttgaacaaagcatacaagtcaattttgtctggcatgaatgcagccaagctcgaccctgatg

SEQ ID NO: 285173 - DNA, 75 bp, Artificial Sequence
  Synthetic
tagaaacataatgtctctgacaggtccagactttccgctggaagaggcccctgttttcaagagaacagggtctgc

SEQ ID NO: 285174 - DNA, 75 bp, Artificial Sequence
  Synthetic
tcttacaaagttttgaaagattatttcaagaaagtagatttgggttctctcaaagtgggcggaactgctgcacag

SEQ ID NO: 285175 - DNA, 75 bp, Artificial Sequence
  Synthetic
ctgttttcaagagaacagggtctgccttgcatagattcaagtcagccaggtacagtgaggggggttactcttctg

SEQ ID NO: 285176 - DNA, 75 bp, Artificial Sequence
  Synthetic
gatcaccccaaattctcttgtggatataagacgtactaatgtggaagggaattgggctctaacagggggtatgga

SEQ ID NO: 285177 - DNA, 75 bp, Artificial Sequence
  Synthetic
ccggagatgtataaccgacttggcccatttctattccaagtcatcccccatagagaagctattgaattgtacgtt

SEQ ID NO: 285178 - DNA, 75 bp, Artificial Sequence
  Synthetic
tgatgatgacctatggctgccccctcctgaatatgttccgttgaaagaactcacaggcaagaaaaacatgaggaa

SEQ ID NO: 285179 - DNA, 75 bp, Artificial Sequence
  Synthetic
atgacttcatgtttcaaccgctgatgctttatgcgcaaacatggacgtcggaactggtgcaaaaagacatacggc

SEQ ID NO: 285180 - DNA, 75 bp, Artificial Sequence
  Synthetic
caaaagatgggccagagtctcttgcatctctaacgaccaaatagtcaacctcgccaatataatgtcgacagtgtc

SEQ ID NO: 285181 - DNA, 75 bp, Artificial Sequence
  Synthetic
gcattatggaaagatataacctcagtggataccgagaaggacttggtcaaattcaaagatcaaatatggggactg

SEQ ID NO: 285182 - DNA, 75 bp, Artificial Sequence
  Synthetic
ggtgtatcaacatgaattctagagcatgtcaattgtggtctgacatgtctcttcagacacaaaggtctgaggagg

SEQ ID NO: 285183 - DNA, 75 bp, Artificial Sequence
  Synthetic
gaaaacttcctgatattcgtttaaaaccgggtgacttcgaatctctgagcggtaaggagaagtctcgccatatag

SEQ ID NO: 285184 - DNA, 75 bp, Artificial Sequence
  Synthetic
taagaaggatgtttgagccggggcaggagactgcagttcctcactcttatttcatccattttcgttcgttgggcc

SEQ ID NO: 285185 - DNA, 75 bp, Artificial Sequence
  Synthetic
ccctgagccccgatactcagatgacttaatatctcagctgtgccagctatacatcgctggggatcaagtcttgtc

SEQ ID NO: 285186 - DNA, 75 bp, Artificial Sequence
  Synthetic
atcttctagcagtttctgtgaccaacggtgctttcattcttcaggaactgataccaaaggttgtggacaggccga

SEQ ID NO: 285187 - DNA, 75 bp, Artificial Sequence
  Synthetic
aaacgcagttggtcacgttttcaacctcattcactttgttggatgttacatgggtcaagtgagatctttgaatgc

SEQ ID NO: 285188 - DNA, 75 bp, Artificial Sequence
  Synthetic
ctcccatgagtcctggattcacgcgttgtgtcaagaggctgggaacccagatcttggagagagaacactcgagag

SEQ ID NO: 285189 - DNA, 75 bp, Artificial Sequence
  Synthetic
tgcttatccgactacgatgaaagaaggtaacagatccattctgtgctatctccaacatgtgctgcgctatgaacg

SEQ ID NO: 285190 - DNA, 75 bp, Artificial Sequence
  Synthetic
taagacccatagagataacttcatactctttttaaaatctgttgagcctctgtttcctcgatttctcagtgaact

SEQ ID NO: 285191 - DNA, 75 bp, Artificial Sequence
  Synthetic
aattcattcgctgagtttttgaacaagacatactcaagtgattcttaaagaatggaacaacaggattgtgaacat

SEQ ID NO: 285192 - DNA, 75 bp, Artificial Sequence
  Synthetic
gtgaagacaccttggagtcagacgaagacattcagaggctgttaaaagactctttgcgcaggacaaggtgggtag

SEQ ID NO: 285193 - DNA, 75 bp, Artificial Sequence
  Synthetic
gttcctcacccttctgagatgttggggttacttcccaagtcttccatttcttgcacttgtggaacaacaggagga

SEQ ID NO: 285194 - DNA, 75 bp, Artificial Sequence
  Synthetic
aggaaataggcctctccggatgactctgacagacaattgctctaggtcttacaaagttttgaaagattacttcaa

SEQ ID NO: 285195 - DNA, 75 bp, Artificial Sequence
  Synthetic
gctccaaaatccattgatctcgggcctgagggtggttcagtgggcgacaggggcccactataagctcaaacctat

SEQ ID NO: 285196 - DNA, 75 bp, Artificial Sequence
  Synthetic
tttttcacgaggtcccctaaagggatacttgggctcgtccacctccgtgtcaacccagctattccatgcatggga

SEQ ID NO: 285197 - DNA, 75 bp, Artificial Sequence
  Synthetic
tacttgggctcgtccacctccgtgtcaacccagctattccatgcatgggaaaaagtaactaatgttcatgtggtg

SEQ ID NO: 285198 - DNA, 75 bp, Artificial Sequence
  Synthetic
ttgaagatcgagggccgattctttgctctaatgtcatggaatctaagattatattttgtcatcaccgaaaagctc

SEQ ID NO: 285199 - DNA, 75 bp, Artificial Sequence
  Synthetic
tggaacaatcatcaaagattggagtcaacagaggatgtattttctgtcctagatcaggtgtttggattgaagagg

SEQ ID NO: 285200 - DNA, 75 bp, Artificial Sequence
  Synthetic
caaaatggcggctcaaaccgcctctggtcctcctgctctagaatggtctactgctaatgaggaggatgatccatc

SEQ ID NO: 285201 - DNA, 75 bp, Artificial Sequence
  Synthetic
gcagaggtcactgacattgcgtccatcaaccgaataaccctgcttatgtctgattttgcattgtctatagatggt

SEQ ID NO: 285202 - DNA, 75 bp, Artificial Sequence
  Synthetic
tcaaccgaataaccctgcttatgtctgattttgcattgtctatagatggtccactttatttggttttcaaaactt

SEQ ID NO: 285203 - DNA, 75 bp, Artificial Sequence
  Synthetic
ttctcagatcttcgagttcccagatgtgtcaaaaagaatatccagaatggtttctggggccgtacctcatttcca

SEQ ID NO: 285204 - DNA, 75 bp, Artificial Sequence
  Synthetic
aaagtttaggcctctcatccattccttgggggatttccctgtatttataagagataaagtgagtcaacttgaagg

SEQ ID NO: 285205 - DNA, 75 bp, Artificial Sequence
  Synthetic
agagcgtttcctgcagtcaccgggttcataactcagatgacctcctctttctcatccgaactatacctcagattc

SEQ ID NO: 285206 - DNA, 75 bp, Artificial Sequence
  Synthetic
tcttagagaaatgagccttgtattattcaactgtagcagccccaaaagtgagatgcagagggcccgctctctcaa

SEQ ID NO: 285207 - DNA, 75 bp, Artificial Sequence
  Synthetic
tcacactatgcaataaaatctggcctgctccaaattccatatgaaaaaaacaggcaacaccactgataagatgaa

SEQ ID NO: 285208 - DNA, 75 bp, Artificial Sequence
  Synthetic
tgatagtgatgtagaatctttcttggttcacaagatggtagatgatctagaattacagcgaggaactttgtccaa

SEQ ID NO: 285209 - DNA, 75 bp, Artificial Sequence
  Synthetic
aatccaaaagatgggcccgagtctcttgcatctctaacgaccaaatagtcaacctcgccaatataatgtcgacag

SEQ ID NO: 285210 - DNA, 75 bp, Artificial Sequence
  Synthetic
ccggagtatattccgctgaaggatatcacgggcaagaaaaacatgagaaacttttgcgttaacggagaagtcaag

SEQ ID NO: 285211 - DNA, 75 bp, Artificial Sequence
  Synthetic
tcacgggcaagaaaaacatgagaaacttttgcgttaacggagaagtcaaggtgtgcggtccaaacggttattcgt

SEQ ID NO: 285212 - DNA, 75 bp, Artificial Sequence
  Synthetic
cctatgagggattttctgctcatgtcagtacaggcagttttccactacctgttgtttagcccaatcctaaaaggc

SEQ ID NO: 285213 - DNA, 75 bp, Artificial Sequence
  Synthetic
agagtttataagattctgagtgctgaaggggagagctttctcctagccatgtcgcggataatctacctagatcct

SEQ ID NO: 285214 - DNA, 75 bp, Artificial Sequence
  Synthetic
agaagatactttggagtcagacgacgacatccaacgattgctaaaagactctttgcgaaggacaaggtgggtgga

SEQ ID NO: 285215 - DNA, 75 bp, Artificial Sequence
  Synthetic
gaggtgtataactgacttggcccacttctattccaagtcctcccccatagaaaagttattaaattgcacacttgg

SEQ ID NO: 285216 - DNA, 75 bp, Artificial Sequence
  Synthetic
tctcactggatcaggttgatctacaaaatagtaaagaccaccagacttgttggaagaatagaagacctgtccagg

SEQ ID NO: 285217 - DNA, 75 bp, Artificial Sequence
  Synthetic
attgggctctaacagggggcatggagttgacaagggaccctactgtttcagagcatgcatctctggttggccttc

SEQ ID NO: 285218 - DNA, 75 bp, Artificial Sequence
  Synthetic
caatgtcatatccagggaaggatctggtgtattaacatgaactctcgggcatgtcaattttggtccgacatgtct

SEQ ID NO: 285219 - DNA, 75 bp, Artificial Sequence
  Synthetic
catcagatccagatcatctctattagattatagctgtttatgaactgtgcactctcaagggaatatacagaccaa

SEQ ID NO: 285220 - DNA, 75 bp, Artificial Sequence
  Synthetic
gatgtcctggaatctgaggttgtattttgtcatcacagagaagctcctagccaattatatcttgccactttttga

SEQ ID NO: 285221 - DNA, 75 bp, Artificial Sequence
  Synthetic
aactcctggacagtacaccttgaaaaaaacaaggtccaaattcagaacctctgtctgattgactgtttttccatc

SEQ ID NO: 285222 - DNA, 75 bp, Artificial Sequence
  Synthetic
cgcccattataagcttaagcccattctagacgatctcaatgttttcccatccctctgtcttgtagttggggacgg

SEQ ID NO: 285223 - DNA, 75 bp, Artificial Sequence
  Synthetic
agactattcaagggttacatatgcttttcacctggactatgagaagtggaacaatcatcagaggctggagtcgac

SEQ ID NO: 285224 - DNA, 75 bp, Artificial Sequence
  Synthetic
ggcagtttagaaagagtctctcaagaactttagaagagtccttctacaactcagagatccacgggattaatcgga

SEQ ID NO: 285225 - DNA, 75 bp, Artificial Sequence
  Synthetic
cagagtgatagattttgactcaatctgggaaaaaccgtctgacctgagaaacttggccacctggagatacttcca

SEQ ID NO: 285226 - DNA, 75 bp, Artificial Sequence
  Synthetic
acttggccacctggagatacttccagtcagtccaaaaacaggtcaacatgtcttatgacctcattatttgtgatg

SEQ ID NO: 285227 - DNA, 75 bp, Artificial Sequence
  Synthetic
aagggtgtggccttgctcttcagagagggcagatctacttagggagatctcttgggggaggaaagtggtaggcac

SEQ ID NO: 285228 - DNA, 75 bp, Artificial Sequence
  Synthetic
agctattgaggaaggagcgtccaaactaggattaatcatcaagaaggaggagactatgtgcagctacgatttcct

SEQ ID NO: 285229 - DNA, 75 bp, Artificial Sequence
  Synthetic
caacgagatgtatacatctctcatgaaaaaaactaacacccctcctttcgaaccgtctcagacatgagcaagatt

SEQ ID NO: 285230 - DNA, 75 bp, Artificial Sequence
  Synthetic
tccacaagatggtggatgatcttgagttacagaggggaactctgtctaaagtggctatcattatagccatcatga

SEQ ID NO: 285231 - DNA, 75 bp, Artificial Sequence
  Synthetic
cccctacgacaagtcccttcattcaagagttttccccagtgggaagtgtttggggataacagtctcctctaccta

SEQ ID NO: 285232 - DNA, 75 bp, Artificial Sequence
  Synthetic
ccaccaacgccttaactgtcgctcaacattcccaatctttgatcaagccgatgagggacttcttgttgatgtcag

SEQ ID NO: 285233 - DNA, 75 bp, Artificial Sequence
  Synthetic
ctgctcaactaaccatgattacaccatctggatgcccgtagaagcaagacttgggacatcttgtgatatttttac

SEQ ID NO: 285234 - DNA, 75 bp, Artificial Sequence
  Synthetic
atctggatgcccgtagaagcaagacttgggacatcttgtgatatttttaccaacagcaaagggaagaaagcatct

SEQ ID NO: 285235 - DNA, 75 bp, Artificial Sequence
  Synthetic
ttgttctatccgccgtctgatcccaaaatcctgaggcacttcaacatatgttgcagtaccatgatgtatctatct

SEQ ID NO: 285236 - DNA, 75 bp, Artificial Sequence
  Synthetic
aaatcctgaggcacttcaacatatgttgcagtaccatgatgtatctatctaccgctttaggcgacgtccccagct

SEQ ID NO: 285237 - DNA, 75 bp, Artificial Sequence
  Synthetic
tctgatttgacccaaaacgggaagaactatgatttcatgtttcagccattgatgctttatgcgcaaacatggaca

SEQ ID NO: 285238 - DNA, 75 bp, Artificial Sequence
  Synthetic
tctgaaaggagcatgcaaactcaagctatgcggagtccccgggctcaggctaatggatggaacctgggtctcaat

SEQ ID NO: 285239 - DNA, 75 bp, Artificial Sequence
  Synthetic
ccagacatcagatgatattaaatggtgccctcctgatcaattggtgaatctacatgactttcactcagatgaaat

SEQ ID NO: 285240 - DNA, 75 bp, Artificial Sequence
  Synthetic
tcagactgttggccgcgaagtcgtgaaggagacaaagtctgcatcctctcagcgagctagtcaaccctcaaaaat

SEQ ID NO: 285241 - DNA, 75 bp, Artificial Sequence
  Synthetic
aggtggaaagacaccttcatgggtacaacaggtggatcaccctcaaggatatcagatctagatcatctctattag

SEQ ID NO: 285242 - DNA, 75 bp, Artificial Sequence
  Synthetic
ttatggatggaacatgggtcgcgattcagacatcagatgagatcaaatggtgctctcctgatcagctagtaaatc

SEQ ID NO: 285243 - DNA, 75 bp, Artificial Sequence
  Synthetic
ggtttgggaaggcatacaccatattcaacaataccttaatggaagctgatgctcattacaagtcagttcggactt

SEQ ID NO: 285244 - DNA, 75 bp, Artificial Sequence
  Synthetic
acttttgtgtgatgcatcttgaaaaaaacaagatcttgaatctgagcctctggctgtttgattgtttctttcatc

SEQ ID NO: 285245 - DNA, 75 bp, Artificial Sequence
  Synthetic
ctcaatcttagtagcaattcacgactcaggatacaatgatgggaccatcttccctgtcaacatatacggcaaagt

SEQ ID NO: 285246 - DNA, 75 bp, Artificial Sequence
  Synthetic
tcaatggtataattttgggtccagatgggaatgttctgatccctgagatgcaatcgtccctgcttcaacaacata

SEQ ID NO: 285247 - DNA, 75 bp, Artificial Sequence
  Synthetic
caaaaaattccagctgctggttgagcctgacaagctaaacaaaataatgcaagatgacctgaaccgttatgcgcc

SEQ ID NO: 285248 - DNA, 75 bp, Artificial Sequence
  Synthetic
ccatcaacagtcttcaaggacggtgatgaggcggaagattttgttgaggttcatcttccggatgttcacaaacag

SEQ ID NO: 285249 - DNA, 75 bp, Artificial Sequence
  Synthetic
tcatcttccggatgttcacaaacaggtctcggagattgaccttggtctcccgagttgggggaagtatctgttgat

SEQ ID NO: 285250 - DNA, 75 bp, Artificial Sequence
  Synthetic
gctgtagaagggccaataggacagaatcaacacagagaggtcgtagggagtcaggagggaaagtgtcagtagccc

SEQ ID NO: 285251 - DNA, 75 bp, Artificial Sequence
  Synthetic
tcacgggcaagaagaacatgagaaacttttgcatcaatggggaagtcaaagtgtgtagtccaaacggctactcat

SEQ ID NO: 285252 - DNA, 75 bp, Artificial Sequence
  Synthetic
acagtgaaggggggtactcttctgtttgtccaaatctcctctctcacatctctgtcagcacagacacgatgtcag

SEQ ID NO: 285253 - DNA, 75 bp, Artificial Sequence
  Synthetic
aggggttctatcttcttgacagtccttcacggactttgtgcaacagggtggacttaagagtcaagagactttcat

SEQ ID NO: 285254 - DNA, 75 bp, Artificial Sequence
  Synthetic
aggttgttgttggattagcgttgtcaggggccccggttcctgagggcatgaactgggtatacaaactgaggagaa

SEQ ID NO: 285255 - DNA, 75 bp, Artificial Sequence
  Synthetic
acgtcctctgacagtatcatttactaatggtgctctcatcccccaaggactgataccaaaggtcatgaacaatcc

SEQ ID NO: 285256 - DNA, 75 bp, Artificial Sequence
  Synthetic
gaaagactccacctttcattggcatcttcgatgtaacaagtgcataaggcccatcgatgatattacccttgagac

SEQ ID NO: 285257 - DNA, 75 bp, Artificial Sequence
  Synthetic
atgttcccctacattagaccaaataggggtttagttgaaagaaccgacttgcctcctatgaaggacacaagcaat

SEQ ID NO: 285258 - DNA, 75 bp, Artificial Sequence
  Synthetic
agattcctcaagatttggtcacagactgtagaggaaattgtctcctatgtcatgactaacttccctaacccgtcg

SEQ ID NO: 285259 - DNA, 75 bp, Artificial Sequence
  Synthetic
aacacatccactgcctccttcagcaatcatgagtggaggagatgacatcatctccagagtgatagactttgactc

SEQ ID NO: 285260 - DNA, 75 bp, Artificial Sequence
  Synthetic
aattaacaacacttctcctcctgataacggcaccatgatgattgatccaggggaggtttatgatgacccgattga

SEQ ID NO: 285261 - DNA, 75 bp, Artificial Sequence
  Synthetic
tatctgggctcatccacatctatgtcaacccagttgttccatgcctgggagaaagttactaatgttcatgtggtg

SEQ ID NO: 285262 - DNA, 75 bp, Artificial Sequence
  Synthetic
ctgtagaggcggagattgcccaccagattgctgagagcttctccaagaaatacaaattcccctccaggtcatcag

SEQ ID NO: 285263 - DNA, 75 bp, Artificial Sequence
  Synthetic
agggggaatcctaccattcccaacatcttaagaaactctgattacaacctcaattctcctctaatagaggatcca

SEQ ID NO: 285264 - DNA, 75 bp, Artificial Sequence
  Synthetic
tcttaagaaactctgattacaacctcaattctcctctaatagaggatccagcaagattaatgttagaatggttga

SEQ ID NO: 285265 - DNA, 75 bp, Artificial Sequence
  Synthetic
tctcacaaagttctgaaagattacttcaaaaaggtggatctaggatctctcaaagttggaggggctgctgcacag

SEQ ID NO: 285266 - DNA, 75 bp, Artificial Sequence
  Synthetic
aaaaaaacttttaacatccctcaaaagacttaaggaaagatgatccctcaggctcttctgtttgtaccccttctg

SEQ ID NO: 285267 - DNA, 75 bp, Artificial Sequence
  Synthetic
actctctaatgattcttctctctcctccggagcccagatattcagatgacctgatatctcaattgtgtcaactgt

SEQ ID NO: 285268 - DNA, 75 bp, Artificial Sequence
  Synthetic
atcaggagggatatcaagagtggtactcaacatgtttccggatgccagacttgtattcaatagcttgttagaagt

SEQ ID NO: 285269 - DNA, 75 bp, Artificial Sequence
  Synthetic
agatgagagaggcttgtacaaatctctaaaaggagcatgcaaactgaagctgtgcggagttcttggacttagact

SEQ ID NO: 285270 - DNA, 75 bp, Artificial Sequence
  Synthetic
ctagattacagttgtttgtaagccggatattaccgaaagcctgtgcatgctaaaattcttgtatgatgcatcttg

SEQ ID NO: 285271 - DNA, 75 bp, Artificial Sequence
  Synthetic
gtcacttgaggaaacttgtgcctgggtttggaaaagcatacaccatattcaacaagaccttgatggaggctgatg

SEQ ID NO: 285272 - DNA, 75 bp, Artificial Sequence
  Synthetic
caaaacgggggaagttctttcgggatgcagaatatttgacctcttctactcttcgagaaatgagccttgtactgt

SEQ ID NO: 285273 - DNA, 75 bp, Artificial Sequence
  Synthetic
gctgtagaagagccaagcgaacagagtcaagaagacgaggctctggagagtcaggaaagaaggtaaatgcaaccc

SEQ ID NO: 285274 - DNA, 75 bp, Artificial Sequence
  Synthetic
ttgtgagagcaagtcatccctaccataactagtgctcaaaaagttgcctctcttcaagatttgggggagtctttt

SEQ ID NO: 285275 - DNA, 75 bp, Artificial Sequence
  Synthetic
cgaggcggaggattttgttgaggtacaccttccagatgtgcataagcaggtctcaggggttgatctcggtctccc

SEQ ID NO: 285276 - DNA, 75 bp, Artificial Sequence
  Synthetic
cacggtcaacttccctaacccctcgggaaggtcttcggaagataaatctacccagaccgctgggagagaactcaa

SEQ ID NO: 285277 - DNA, 75 bp, Artificial Sequence
  Synthetic
gacagtgatgtagaatctttcctggttcacaagatggtagatgatctagagttacagcgaggaactttgtctaaa

SEQ ID NO: 285278 - DNA, 75 bp, Artificial Sequence
  Synthetic
gatgccaggctgtgagggcgggccatatccttaatatcttgcgatcggaagactgcctacctttgagatctgggg

SEQ ID NO: 285279 - DNA, 75 bp, Artificial Sequence
  Synthetic
aacagagggggacctgtccccagtgagaaagtcattattacggctctttccaaacctccggtcaaccccagagaa

SEQ ID NO: 285280 - DNA, 75 bp, Artificial Sequence
  Synthetic
tatccttaatatcttgcgatcggaagactgcctacctttgagatctggggtactctctcatcttgatggcccttc

SEQ ID NO: 285281 - DNA, 75 bp, Artificial Sequence
  Synthetic
tgtctcgaaaccgctgactgaccctttattctatccgccatctgatcccaaaatcttgagacacttcaacatatg

SEQ ID NO: 285282 - DNA, 75 bp, Artificial Sequence
  Synthetic
ccatttcagctgatccaatacagtcatgtagatttttatgatgtaggatgtattttgatagtgtcattgactaat

SEQ ID NO: 285283 - DNA, 75 bp, Artificial Sequence
  Synthetic
cagacccataacttattatttcaggaaacaagtcattcgggggaatatttatctgtcatggagttggtctgatga

SEQ ID NO: 285284 - DNA, 75 bp, Artificial Sequence
  Synthetic
tcttctagcagttccagtgaccaacggtgcttttatcctccaagaactgataccaaaggtggtggacaggcctag

SEQ ID NO: 285285 - DNA, 75 bp, Artificial Sequence
  Synthetic
attagttgagaaatacgatttgcctcctatgaaggacacaagcaataggtcacaatcatcctacatcctgatagg

SEQ ID NO: 285286 - DNA, 75 bp, Artificial Sequence
  Synthetic
agcaacacttctcatcttgagactctcaccatgatgattgatccaggagaggtttatgatgacccggttgatccg

SEQ ID NO: 285287 - DNA, 75 bp, Artificial Sequence
  Synthetic
attatagctgcttgtaaactaggcattctcgagggaatgtacagactaagactctttgacggtgcaacctgaaaa

SEQ ID NO: 285288 - DNA, 75 bp, Artificial Sequence
  Synthetic
tgggaggatcagatatactgtctggacatgtcaaacggcccgacatgttggaatggccaagatggagggctagag

SEQ ID NO: 285289 - DNA, 75 bp, Artificial Sequence
  Synthetic
ggactcccactgtccctaacatcttgaggaactctgactataatctcaactctcctctaatagaggatcctgcca

SEQ ID NO: 285290 - DNA, 75 bp, Artificial Sequence
  Synthetic
tggttagtttgttaatgatagatcgtgagtcccagaccagaaacacaagaactaagatactagcccagggggaca

SEQ ID NO: 285291 - DNA, 75 bp, Artificial Sequence
  Synthetic
cttcaaacacaaaggtctgaggaggataaagattcttcagtgcttctggaatagtctaattacatcctaaaaatt

SEQ ID NO: 285292 - DNA, 75 bp, Artificial Sequence
  Synthetic
atcaggttttgtgtccgacatatatgctgtcgccggggctctcaagagaagggcttctctacgagttagagagca

SEQ ID NO: 285293 - DNA, 75 bp, Artificial Sequence
  Synthetic
ataacaggtggatcaccttcgaggacataagatccagatcatctttactggactatagctgcttatgaactgaat

SEQ ID NO: 285294 - DNA, 75 bp, Artificial Sequence
  Synthetic
gaagttagatctgggttccctcaaagtgggtggaaccgcagcccagtcaatgatctccctctggttatatggcgc

SEQ ID NO: 285295 - DNA, 75 bp, Artificial Sequence
  Synthetic
tgatctccctttggctgtacggtgcatattctgaatcgaacagaagccgaaagtgtataacagacttggcccagt

SEQ ID NO: 285296 - DNA, 75 bp, Artificial Sequence
  Synthetic
gagggggtgttaagttgccttgagagggtcgattatgataaggcatttgggaggtatctggccaacacgtattcc

SEQ ID NO: 285297 - DNA, 75 bp, Artificial Sequence
  Synthetic
agttgatcgacagggtcactgggcaagggcttttggactattcaagggtcacatatgcatttcatctggactatg

SEQ ID NO: 285298 - DNA, 75 bp, Artificial Sequence
  Synthetic
tgcgctgtgtcaagaagcaggaaacccagatctgggagagagaacattggagagcttcactcgcctgctagagga

SEQ ID NO: 285299 - DNA, 75 bp, Artificial Sequence
  Synthetic
tatacttttcttaaagtccgttgagcctttgttcccccgatttctcagcgaactctttagttcttcctttttagg

SEQ ID NO: 285300 - DNA, 75 bp, Artificial Sequence
  Synthetic
tttcacctggactatgagaagtggaacaatcatcaaaggttggagtcaacagaagatgtattttctgtcctagat

SEQ ID NO: 285301 - DNA, 75 bp, Artificial Sequence
  Synthetic
ggatcaccccctgactccttatatcaaaactcagacatggcctcccaaacatatagtggatttggtgggtgacac

SEQ ID NO: 285302 - DNA, 75 bp, Artificial Sequence
  Synthetic
tggacatgttctaatcccagagatgcagtcgtctctccttcaacagcatatggagttgttggaatcctcggtaat

SEQ ID NO: 285303 - DNA, 75 bp, Artificial Sequence
  Synthetic
caagctgggggaagtatgtgctgatgagtgtaggcgctatgattgcactaatgttgacgattttcttgacgacgt

SEQ ID NO: 285304 - DNA, 75 bp, Artificial Sequence
  Synthetic
ctcgcgagaggagtcttgatagggtcttcgatttgcttcttgacaagaatgacaaacatcaacatcaacagacct

SEQ ID NO: 285305 - DNA, 75 bp, Artificial Sequence
  Synthetic
tgaacacaaacagagatcgtagtggatatccagatactagactgggtaagagttgattaagaaaggaaacttgcc

SEQ ID NO: 285306 - DNA, 75 bp, Artificial Sequence
  Synthetic
ctcaccatgttgatcgattcaggagaagtttatgatgacccggtggatccaattgagtcagaggccgaacctaga

SEQ ID NO: 285307 - DNA, 75 bp, Artificial Sequence
  Synthetic
aagtcaataatcaggtggtctctttgaagcctgagattatcgtggatcaatatgagtacaagtaccctgccatca

SEQ ID NO: 285308 - DNA, 75 bp, Artificial Sequence
  Synthetic
caccaatgcattgactgtagcacaacactctcaatccctgatcaagccgatgagggactttctacttatgtcagt

SEQ ID NO: 285309 - DNA, 75 bp, Artificial Sequence
  Synthetic
tggatcaagaagtgcgccatgctgcaagaactatgacagggagttacagccccaataggagggtgtcacgcaaag

SEQ ID NO: 285310 - DNA, 75 bp, Artificial Sequence
  Synthetic
gcagcaatgcagttctttgaggggacatgtccggaagactggaccagctatggaatcctgattgcacgaaaagga

SEQ ID NO: 285311 - DNA, 75 bp, Artificial Sequence
  Synthetic
cagggtgttcagagtgggtctgctctgctcaacaggttgctgtttcaacctctgcaaacccagctcctgcttcag

SEQ ID NO: 285312 - DNA, 75 bp, Artificial Sequence
  Synthetic
ggttacttccgaaatcttcgatctcctgctcctgtggggtgactggaaggggaaatcctcgaatatctgtgtctg

SEQ ID NO: 285313 - DNA, 75 bp, Artificial Sequence
  Synthetic
cagcaggttgcagtctccacctcggctaacccagcccctgtttcagagcttgacataagggctctctcccagagg

SEQ ID NO: 285314 - DNA, 75 bp, Artificial Sequence
  Synthetic
gcaccttttgttaagatcgtggaacaccataccctaatgacaactcacaagatgtgtgctaattggagtactata

SEQ ID NO: 285315 - DNA, 75 bp, Artificial Sequence
  Synthetic
atcatgagtgggggagatgatatcatctccagggtaattgactttgattccatctgggagaagccttctgacttg

SEQ ID NO: 285316 - DNA, 75 bp, Artificial Sequence
  Synthetic
gacttcgcattgtcaatagacggcccactgtatctggtctccaaaactcacgaaactacgccggtagatccagaa

SEQ ID NO: 285317 - DNA, 75 bp, Artificial Sequence
  Synthetic
gtctgtcgaagctatatgatcaagttcatatcaagaaggtgatagacaagtcctaccaggagtgcttggcgagcg

SEQ ID NO: 285318 - DNA, 75 bp, Artificial Sequence
  Synthetic
tccagagcatttcccgcggtcacgggattcataactcagatgacatcatctttctcatctgagctatacctcaga

SEQ ID NO: 285319 - DNA, 75 bp, Artificial Sequence
  Synthetic
acagtgaaggaggatattcttctgtttgccctaatctcctctctcatatctctgtaagtacagacaccatgtctg

SEQ ID NO: 285320 - DNA, 75 bp, Artificial Sequence
  Synthetic
ataagtttccctctcgatcctcagggatactcttgtataattttgagcaattgaaaatgaaccttgatgatatag

SEQ ID NO: 285321 - DNA, 75 bp, Artificial Sequence
  Synthetic
cacttcagtatttaaaagggtggcctgtaactctagcttgagtctgtcatctcactggatcaggttgatttacaa

SEQ ID NO: 285322 - DNA, 75 bp, Artificial Sequence
  Synthetic
tgtaactctagcttgagtctgtcatctcactggatcaggttgatttacaagatagtaaagaccgtcggaagaagc

SEQ ID NO: 285323 - DNA, 75 bp, Artificial Sequence
  Synthetic
gaggcaataacagcatcaccggagaatgaatggttgtggatattctcagactttagaagctctaagatgacgtat

SEQ ID NO: 285324 - DNA, 75 bp, Artificial Sequence
  Synthetic
tcatgaaaaaaactaacactcctcctttaaaaccatcccaaatatgagcaagatctttgttaatccgagtgcaat

SEQ ID NO: 285325 - DNA, 75 bp, Artificial Sequence
  Synthetic
agctttgcgagacttcatgacctgtacaacagacccataacttattatttcaggaaacaagtcattcgggggaat

SEQ ID NO: 285326 - DNA, 75 bp, Artificial Sequence
  Synthetic
ggtataacaggtggatcacccttgatgacatcagatctagatcatctctcttggattatagttgcctgtaaattg

SEQ ID NO: 285327 - DNA, 75 bp, Artificial Sequence
  Synthetic
agatccgaccttatcgggttatgggaggatcaaatatactgtttggacatgtcaaacggcccgacatgctggaac

SEQ ID NO: 285328 - DNA, 75 bp, Artificial Sequence
  Synthetic
tcaagaaggagacaacgtctgctttctctcagagagaaagccaaccttcgaaagctaggatggtggctcaagttg

SEQ ID NO: 285329 - DNA, 75 bp, Artificial Sequence
  Synthetic
ctcaacatgttcccagatgccaggcttgtattcaacagcttgttggaggtgaatgacctgatggcatcaggaaca

SEQ ID NO: 285330 - DNA, 75 bp, Artificial Sequence
  Synthetic
tcgaggctgacaagctaagcaaaatcatgcaagatgatttgaatcgctatacatcctgctaaccgagttttcgaa

SEQ ID NO: 285331 - DNA, 75 bp, Artificial Sequence
  Synthetic
atcatttgatgagatatattctggaaatcacagaatgatcggattagtcaaggtcgtcattggactggctttatc

SEQ ID NO: 285332 - DNA, 75 bp, Artificial Sequence
  Synthetic
gtttaggaggagtctctcaagaacattggaagagtccttttataactcagagatccatgggatcaaccggatgac

SEQ ID NO: 285333 - DNA, 75 bp, Artificial Sequence
  Synthetic
actctaatttggcgcagactttaattaggaacataatgtctctgacaggccctgatttccctctggaggaggctc

SEQ ID NO: 285334 - DNA, 75 bp, Artificial Sequence
  Synthetic
ttaaagcgtgtagcccaaatggttactcattcaggattttgcggcacattctgagatcattcaacgagatatact

SEQ ID NO: 285335 - DNA, 75 bp, Artificial Sequence
  Synthetic
cgacttcacttggacgatggaaagtcgtccaaccttggtgagatgaccgagaagaggggaaacaagtatcgagag

SEQ ID NO: 285336 - DNA, 75 bp, Artificial Sequence
  Synthetic
tgtaactctagcttgagtctgtcatctcactggatcaggctgatttacaagatagtgaagaccactagactcatc

SEQ ID NO: 285337 - DNA, 75 bp, Artificial Sequence
  Synthetic
taacaggtggatcaccctcgaagacctcagatctagatcttctctactagactacagctgcttataaactggacc

SEQ ID NO: 285338 - DNA, 75 bp, Artificial Sequence
  Synthetic
ctgtcaacatatatggcaaggtttcccccagagactatttaagagggcttgcaagaggggtcctgatagggtcgt

SEQ ID NO: 285339 - DNA, 75 bp, Artificial Sequence
  Synthetic
acgcttaacaacaagatcaaagaagaagcagacagtgtcagttgcaaagcaaaaatgtaacacccctacaatgga

SEQ ID NO: 285340 - DNA, 75 bp, Artificial Sequence
  Synthetic
aatctatcgattgtgtatatccatcatgaaaaaaactaacacccctcctttcgaaccatcccaaatatgagcaag

SEQ ID NO: 285341 - DNA, 75 bp, Artificial Sequence
  Synthetic
atgaaaaaaactaacacccctcctttcgaaccatcccaaatatgagcaagattttcgtcaatccgagtgctatca

SEQ ID NO: 285342 - DNA, 75 bp, Artificial Sequence
  Synthetic
cccatctttatacataatgctcagagagccgtctcttagaggagagatattttcaataccccagaaaattcccgc

SEQ ID NO: 285343 - DNA, 75 bp, Artificial Sequence
  Synthetic
cccctggtatagtgtacagattgagactcctagacggtgcaccctgaaaaaaactggatcagaattccgaacctc

SEQ ID NO: 285344 - DNA, 75 bp, Artificial Sequence
  Synthetic
tggtgtatcaacatgaattctagaacatgtcaactatggtctgacatgtctcttcagacacaaaggtcggaggag

SEQ ID NO: 285345 - DNA, 75 bp, Artificial Sequence
  Synthetic
gaggactttcagatggatgaaggagaggatcctagcctcctgttccagtcatacctggacaatgttggagtccaa

SEQ ID NO: 285346 - DNA, 75 bp, Artificial Sequence
  Synthetic
aggatcctagcctcctgttccagtcatacctggacaatgttggagtccaaatagtcagacaaatgaggtcaggag

SEQ ID NO: 285347 - DNA, 75 bp, Artificial Sequence
  Synthetic
ttgatataagggccctctccaagaagtttcaaaaccctcttatctcgggcttgagagttgtccagtgggcaactg

SEQ ID NO: 285348 - DNA, 75 bp, Artificial Sequence
  Synthetic
atgagtggcggcgatgacattatctccagagtagtggactttgactcaatctgggaaaagccgtcagatctgagg

SEQ ID NO: 285349 - DNA, 75 bp, Artificial Sequence
  Synthetic
ctgctaccaatgaggaggatgatctatcagtagaggctgagatcgctcaccagattgctgaaagcttttccaaga

SEQ ID NO: 285350 - DNA, 75 bp, Artificial Sequence
  Synthetic
aatgctgccaagcttgatcctgatgatgtatgttcctacttagcagccgcaatgcagttctttgaggggacatgt

SEQ ID NO: 285351 - DNA, 75 bp, Artificial Sequence
  Synthetic
tggcaccatgcttgtaaatccggactacagagcaattcaacacctatccagagcgtttcctgcggtcactggatt

SEQ ID NO: 285352 - DNA, 75 bp, Artificial Sequence
  Synthetic
tctggccctccagctcttgaatggtctgctaccaatgaggaggatgatctatcagtagaggctgagatcgctcac

SEQ ID NO: 285353 - DNA, 75 bp, Artificial Sequence
  Synthetic
ctgatgactggaccagctatggaatcctgatagcacggaagggagacaagatcaccccaaattctcttgtggaca

SEQ ID NO: 285354 - DNA, 75 bp, Artificial Sequence
  Synthetic
gattaccccggattctctcgtggagataaagcgtactgatgtagaaggaaattgggctttgactggaggaatgga

SEQ ID NO: 285355 - DNA, 75 bp, Artificial Sequence
  Synthetic
gcagaggtcactgacattgcatcaattaatcggataacactgttgatgtcggactttgcattatccatagatggt

SEQ ID NO: 285356 - DNA, 75 bp, Artificial Sequence
  Synthetic
tagttaaggaggcaaaaaatgtgccgggcgtgacccgtttggctcatgatggatccaaactccccctaagatgtg

SEQ ID NO: 285357 - DNA, 75 bp, Artificial Sequence
  Synthetic
tactgggatgggttgctttggccaattccaagaaattccaattgctagtagaggccgacaagctaagtaaaatca

SEQ ID NO: 285358 - DNA, 75 bp, Artificial Sequence
  Synthetic
atatagagcgattcaacacctatcgagagcgttcccttcagtcacaggatttataacccaagtgacctcgtcttt

SEQ ID NO: 285359 - DNA, 75 bp, Artificial Sequence
  Synthetic
taccaagatcttgtgagaggatttccagatgagatcatatccaatccttacaatgaaatgatcataactctgatt

SEQ ID NO: 285360 - DNA, 75 bp, Artificial Sequence
  Synthetic
gaggccgacaagctaagtaaaatcatgcaggatgatttgaatcgctatgcatcctgctaaccgaacttttagatt

SEQ ID NO: 285361 - DNA, 75 bp, Artificial Sequence
  Synthetic
atcctgctaaccgaacttttagattcggcccttctagataataaaatctgagatgtcccatagtcgacatgaaaa

SEQ ID NO: 285362 - DNA, 75 bp, Artificial Sequence
  Synthetic
gtgaatttgcacgactttcgctcagacgagattgagcatctcgttgtggaggagttagtcaagaaaagagaggaa

SEQ ID NO: 285363 - DNA, 75 bp, Artificial Sequence
  Synthetic
aactcacaagcaagaagaacatgaggaacttttgtatcaacggggaggtcaaagtgtgtagcccaaatggttact

SEQ ID NO: 285364 - DNA, 75 bp, Artificial Sequence
  Synthetic
aggtggggatttgataagtactccaaatggtatcttgactcgagacttctttcgagggaccaccccctgactcct

SEQ ID NO: 285365 - DNA, 75 bp, Artificial Sequence
  Synthetic
aagaagaatgtttgagccggggcaagagactgcagttcctcactcctatttcatccattttcgttcgttgggcct

SEQ ID NO: 285366 - DNA, 75 bp, Artificial Sequence
  Synthetic
ttcgagggaccaccccctgactccttatattaaaacccagacatggcctcccaaacatatagtagatttggtggg

SEQ ID NO: 285367 - DNA, 75 bp, Artificial Sequence
  Synthetic
aaagtgtgtagcccaaatggttactcgttcaggatcctgcggcacattttgagatcatttgacgagatatattct

SEQ ID NO: 285368 - DNA, 75 bp, Artificial Sequence
  Synthetic
ctatagattgtgtatatccttcatgaaaaaaactaacacccctccttttgaaccatcccaaatatgagcaaaatc

SEQ ID NO: 285369 - DNA, 75 bp, Artificial Sequence
  Synthetic
tcattcactttgttggatgttatatgggtcaagtgagatctctgaatgcaacagtgattgccacatgtgccccgc

SEQ ID NO: 285370 - DNA, 75 bp, Artificial Sequence
  Synthetic
agcatgtcagctatggtctgacatgtctcttcagacccaaaggtccgaagaggacaaagactcctctctgcttct

SEQ ID NO: 285371 - DNA, 75 bp, Artificial Sequence
  Synthetic
aatatcaggacaaaacactggtaactataagacaaacatcgcagataggatagagcagattttcgagacagcccc

SEQ ID NO: 285372 - DNA, 75 bp, Artificial Sequence
  Synthetic
aaaaacgaaatctcaagtcagaacctctagctgtttgattactttttccatctttattgtttttttgttaagcgt

SEQ ID NO: 285373 - DNA, 75 bp, Artificial Sequence
  Synthetic
catgttatggtgccattaaaccgctgcattttatcaaagtcaagttaattacctttacattttgagcctcttgga

SEQ ID NO: 285374 - DNA, 75 bp, Artificial Sequence
  Synthetic
gtgcaaattggagtactataccaaacttcagatttttggccggaacctacgacatgtttttctcacggattgagc

SEQ ID NO: 285375 - DNA, 75 bp, Artificial Sequence
  Synthetic
ttggggggaatctttggatccagtagtcctccttgaactccgtccaacagagtagattcaagagtcataagactt

SEQ ID NO: 285376 - DNA, 75 bp, Artificial Sequence
  Synthetic
caaaaaattccagttgttagtcgagcccgacaagttaaataaaattatgcaagacgatctgaatcgctatgtatc

SEQ ID NO: 285377 - DNA, 75 bp, Artificial Sequence
  Synthetic
caagagacttaaggaaagatggttcctctagttcttttgtttgtaccccttctggtttttccattgtgttccggg

SEQ ID NO: 285378 - DNA, 75 bp, Artificial Sequence
  Synthetic
gacaatctccccgaagacatgagacggcttcaattagacgatgaaaaaccatctggccccgacgggacaaccaag

SEQ ID NO: 285379 - DNA, 75 bp, Artificial Sequence
  Synthetic
attgggatgggtcgctttggctaattctaagaaattccaactgttagtcgaggccgacaaattaaacaaaatcat

SEQ ID NO: 285380 - DNA, 75 bp, Artificial Sequence
  Synthetic
aatcacagaatgatcgggttagtcaaggttgttattggactggctctctcaggagcccccgtcccagagggcatg

SEQ ID NO: 285381 - DNA, 75 bp, Artificial Sequence
  Synthetic
agtccctctagataatgacatctgggatgtcctagagtcgacatgaaaaaaacaggcaacaccactgataaaatg

SEQ ID NO: 285382 - DNA, 75 bp, Artificial Sequence
  Synthetic
tgccctcctgatcagctagtaaatctacacgactttcactcggatgagattgaacatcttgttgtggaggagttg

SEQ ID NO: 285383 - DNA, 75 bp, Artificial Sequence
  Synthetic
aacaggcaacaccactgataaaatgaactttctacgtaagatagtgaaaaactgtagggatgaggacactcaaaa

SEQ ID NO: 285384 - DNA, 75 bp, Artificial Sequence
  Synthetic
gatgtcctagagtcgacatgaaaaaaacaggcaacaccactgataaaatgaactttctacgtaagatagtgaaaa

SEQ ID NO: 285385 - DNA, 75 bp, Artificial Sequence
  Synthetic
actgtagggatgaggacactcaaaaaccctctcccgtgtcagcccctccggatgacgatgacctgtggctcccac

SEQ ID NO: 285386 - DNA, 75 bp, Artificial Sequence
  Synthetic
tcgagggtctttcctagtggaaagtgttcagggataacagtgtcttctacctattgctcaactaaccatgattac

SEQ ID NO: 285387 - DNA, 75 bp, Artificial Sequence
  Synthetic
agttgaatgaccgggtgccggaaacatgttgattgcgtatatccgtcatgaaaaaaactaacacccctcctttcg

SEQ ID NO: 285388 - DNA, 75 bp, Artificial Sequence
  Synthetic
gtctctaaaaggagcatgcaaactcaagttatgtggagttcttggacttagacttatggatggaacatgggtcgc

SEQ ID NO: 285389 - DNA, 75 bp, Artificial Sequence
  Synthetic
ctgggatgatgatacagagtttgtcggattgcaaataagagtgagtgcaagacagtgtcacatccagggtagaat

SEQ ID NO: 285390 - DNA, 75 bp, Artificial Sequence
  Synthetic
aattgagcatcttgttgtagaggagttggtcaagaaaagagaggagtgtctggatgcactagagtccatcatgac

SEQ ID NO: 285391 - DNA, 75 bp, Artificial Sequence
  Synthetic
ttggtcaagaaaagagaggagtgtctggatgcactagagtccatcatgaccaccaagtcagtgagtttcagacgt

SEQ ID NO: 285392 - DNA, 75 bp, Artificial Sequence
  Synthetic
attcaacaagaccttgatggaggctgatgctcactacaagtcagtccggacttggaatgagatcatcccctcaaa

SEQ ID NO: 285393 - DNA, 75 bp, Artificial Sequence
  Synthetic
tgtagaggagattatatcctatgtcacggtcaactttcccaatcctccaggaaggtcttcggaggacaaatcgac

SEQ ID NO: 285394 - DNA, 75 bp, Artificial Sequence
  Synthetic
gagactggggacatcttgtgacatctttaccaatagtagagggaagagagcatccaaagggagcaagacttgcgg

SEQ ID NO: 285395 - DNA, 75 bp, Artificial Sequence
  Synthetic
aggttctatgtccgacatatatgctgtctcctgggctgtcgagagaggggcttctctatgaattggagagcatat

SEQ ID NO: 285396 - DNA, 75 bp, Artificial Sequence
  Synthetic
gattcctcaagatatggtcccagaccgtcgaggagatcatatcctatgtcacggtcaacttctccagtctgccag

SEQ ID NO: 285397 - DNA, 75 bp, Artificial Sequence
  Synthetic
agagagaaagccaaccctctaaagcccggatggcagctcaatccgcctctggtcctccagcccttgaatggactg

SEQ ID NO: 285398 - DNA, 75 bp, Artificial Sequence
  Synthetic
atatggagctgttggaatcctcagttattcccctgatgcaccccctggcagacccgtctacagtttttaaggacg

SEQ ID NO: 285399 - DNA, 75 bp, Artificial Sequence
  Synthetic
gacccgtctacagtttttaaggacggtgatgaggctgaggattttgttgaggttcaccttcccgatgtgcacaaa

SEQ ID NO: 285400 - DNA, 75 bp, Artificial Sequence
  Synthetic
ccaaactgccagccgtgaacccaagaaagagactgtgtctgctccctctcagcgagacagtcaatcatccaagac

SEQ ID NO: 285401 - DNA, 75 bp, Artificial Sequence
  Synthetic
acaagtttccctctcgatcctcaggaatattcttgtataattttgagcaattgaagatgaaccttgatgatatag

SEQ ID NO: 285402 - DNA, 75 bp, Artificial Sequence
  Synthetic
actgagtgcaggggccctgattgccttgatgttgatgatctttctaatgacgtgttgtagaaaatttaatcgacc

SEQ ID NO: 285403 - DNA, 75 bp, Artificial Sequence
  Synthetic
cctgatggccatgttctaatcccagagatgcaatcgtccctccttcagcagcatatggagttgttggaatcctca

SEQ ID NO: 285404 - DNA, 75 bp, Artificial Sequence
  Synthetic
attcgacaacatacatgacttagtatttgtgtatggctgttacagacattgggggcacccctatatagattatcg

SEQ ID NO: 285405 - DNA, 75 bp, Artificial Sequence
  Synthetic
cgtgacccgtttggcccatgatggatccaagctccctctgagatgtgtgttggggtgggttgccctagccaaatc

SEQ ID NO: 285406 - DNA, 75 bp, Artificial Sequence
  Synthetic
cgagggtcttccctagcggaaaatgctcaggaataacggtgtcttctacctactgttcaactaaccatgattaca

SEQ ID NO: 285407 - DNA, 75 bp, Artificial Sequence
  Synthetic
ggctcttctctttgtgcctctcctgatttcctcgttgtgtttcgggggattccccatctacacgatacctgacaa

SEQ ID NO: 285408 - DNA, 75 bp, Artificial Sequence
  Synthetic
aaatcttccagcagtttcggtgaccaacggtgctttcattctccaagaactggtaccaaaggttgtagacgggcc

SEQ ID NO: 285409 - DNA, 75 bp, Artificial Sequence
  Synthetic
attggcctcaaaccaaaggaacgggagttgaagatcgagggccgattctttgctctaatgtcatggaatctaaga

SEQ ID NO: 285410 - DNA, 75 bp, Artificial Sequence
  Synthetic
actggcaacacttctcatcctgaaacccacatcaagatgctagatccaggagaggtctatgatgaccccattgat

SEQ ID NO: 285411 - DNA, 75 bp, Artificial Sequence
  Synthetic
taaaagaatctataaactggttcattactagaaattccaacttggctcaaactctaattaagaacattatgtctc

SEQ ID NO: 285412 - DNA, 75 bp, Artificial Sequence
  Synthetic
gggtgtttaaaagtaggggggaggtgtcatcctcatgtgaacggggtgtttttcaacggtgtaatattagggcct

SEQ ID NO: 285413 - DNA, 75 bp, Artificial Sequence
  Synthetic
tggtttttccattgtgtttcgggaaattccccatttacacaataccagacaaactcggtccctggagcccgattg

SEQ ID NO: 285414 - DNA, 75 bp, Artificial Sequence
  Synthetic
aggggggcaggacttgcggattcgtggacgaaaggggtttgtataagtctctaaaaggggcatgtaaacttaagc

SEQ ID NO: 285415 - DNA, 75 bp, Artificial Sequence
  Synthetic
tatggagttgttggaatcctcggttatccctttgatgcaccccctggcagacccgtctacagttttcaaggacgg

SEQ ID NO: 285416 - DNA, 75 bp, Artificial Sequence
  Synthetic
atgttgtagaaaagttaatcgaccagaacctacgcaacgcagtctcgaaggaaaagggaggaaagtatcgatcac

SEQ ID NO: 285417 - DNA, 75 bp, Artificial Sequence
  Synthetic
aaatccgtaagcttcagacgtctcagccacttgagaaaacttgttcctgggtttggaaaggcatatactatattc

SEQ ID NO: 285418 - DNA, 75 bp, Artificial Sequence
  Synthetic
ttcccaaagtgggaaggtcatatcgtcatgggagtcatataaaagcgggggtgagaccagactgtgaaggctggt

SEQ ID NO: 285419 - DNA, 75 bp, Artificial Sequence
  Synthetic
gaacgagatcatcccctcaaaagggtgcctaaaagtcggagggaggtgtcatcctcatgtggacggagtgttttt

SEQ ID NO: 285420 - DNA, 75 bp, Artificial Sequence
  Synthetic
aaaatcacatccccttggggttggggggaacctctgagttcaatagtcctccttgaactccatataacagggtag

SEQ ID NO: 285421 - DNA, 75 bp, Artificial Sequence
  Synthetic
tcaacctcgccaatataatgtcgacagtatccaccaatgcgctgacagtggcacaacactctcaatctctgatca

SEQ ID NO: 285422 - DNA, 75 bp, Artificial Sequence
  Synthetic
ggtttcggatgttgaccttggtcttccgagttgggggaagtatctgttgatgagtgcaggtgctctggcaatact

SEQ ID NO: 285423 - DNA, 75 bp, Artificial Sequence
  Synthetic
cctctgatgcatcccttggcagacccatcaacagtcttcaaggacggtgatgaagcggaggactttgttgaggtt

SEQ ID NO: 285424 - DNA, 75 bp, Artificial Sequence
  Synthetic
gatctgctagcagtttcagtgaccaacggtgctttcattctccaaggcctgacaccagaggttgcggacatgcca

SEQ ID NO: 285425 - DNA, 75 bp, Artificial Sequence
  Synthetic
gatcaacacagagaggtcatagggaatcaggagggaaaatgtcagtagcacctcaaaatgggaagatcatatcct

SEQ ID NO: 285426 - DNA, 75 bp, Artificial Sequence
  Synthetic
tctcaggggttgaccttggtctcccaaactgggggaagtatctgctgatgagtgcaggtgctctggctacactaa

SEQ ID NO: 285427 - DNA, 75 bp, Artificial Sequence
  Synthetic
cttctttgggaggggtgtctggaatgtctctcgggaggttccatatacgtcagttctcagaccctgtctctgaag

SEQ ID NO: 285428 - DNA, 75 bp, Artificial Sequence
  Synthetic
gttatgcggagtccttggacttagactgatggatggaacatgggtcgcgatgcagacatcagatgaaaccaaatg

SEQ ID NO: 285429 - DNA, 75 bp, Artificial Sequence
  Synthetic
tgctgacaatcttcttaataacatgttgcagaagagtcgataaaacagaatcaatacaacgaggtcccggggagt

SEQ ID NO: 285430 - DNA, 75 bp, Artificial Sequence
  Synthetic
agtcccatgatgacggactcaacatgagttaattgagaacggcaacccgcctcccataaaagacataaacaacag

SEQ ID NO: 285431 - DNA, 75 bp, Artificial Sequence
  Synthetic
cacggttgttactgcttatgaagactgttcaggtctggtatcgtttactgggttcataaagcagatcaatctcac

SEQ ID NO: 285432 - DNA, 75 bp, Artificial Sequence
  Synthetic
agatcgaatctctttgagatctgagggatcctatctccttgacagtccctcatggaccctgtgcaactggataga

SEQ ID NO: 285433 - DNA, 75 bp, Artificial Sequence
  Synthetic
accccgatcttggagagagaacactcgagagcttcactcgccttttagaagatcctactaccttaaatatcaaag

SEQ ID NO: 285434 - DNA, 75 bp, Artificial Sequence
  Synthetic
ttgagcatctcgttgtagaggagttggtcaagaaaagagaggagtgtctggatgcactagagtccatcatgacca

SEQ ID NO: 285435 - DNA, 75 bp, Artificial Sequence
  Synthetic
agaccaggctgtgagggcaggacatcccctccataccttgcgttcagaaaattgcctctctttaagatctgaggg

SEQ ID NO: 285436 - DNA, 75 bp, Artificial Sequence
  Synthetic
ctcccataaaagacataaacaacagctcacaatcatcttacatctcagcaaagtgtgcataattataaagggcta

SEQ ID NO: 285437 - DNA, 75 bp, Artificial Sequence
  Synthetic
tggggatttgacaagtactccaagtggtatctggattcgcgattccttgcccgagaccaccccttgactccttat

SEQ ID NO: 285438 - DNA, 75 bp, Artificial Sequence
  Synthetic
tggtgctctcatcccctaaggactgataccaaaggtcatgaacaatccaaatggaaactcagataactctatgtt

SEQ ID NO: 285439 - DNA, 75 bp, Artificial Sequence
  Synthetic
ggcacccctatatagattatcgaaagggtctatcgaagctatatgatcaagttcacattaagaaagtgatagata

SEQ ID NO: 285440 - DNA, 75 bp, Artificial Sequence
  Synthetic
ggtttagttgagagaagcgacttgcctcctatgaaggacacaagcaatagatcacaatcatcttacatcccgatg

SEQ ID NO: 285441 - DNA, 75 bp, Artificial Sequence
  Synthetic
tgatacaaaactcccggacaataagaaggcagtttagaaagagtctctcaagaactttagaagagtccttctaca

SEQ ID NO: 285442 - DNA, 75 bp, Artificial Sequence
  Synthetic
gatatctcaaatcactctatgcttgagtttgagcagaggccacggcaagttcccctacattagaccaaataggag

SEQ ID NO: 285443 - DNA, 75 bp, Artificial Sequence
  Synthetic
atagatcgtgagtctcaaaccaggaacacaagaactaagatactagctcagggggacaatcaggttctatgtcca

SEQ ID NO: 285444 - DNA, 75 bp, Artificial Sequence
  Synthetic
acttctccggtgaaaccagaagtccagaagctgtttatactcgaatcatgatgaatggaggtcgactaaagagat

SEQ ID NO: 285445 - DNA, 75 bp, Artificial Sequence
  Synthetic
gagtctaaaagatgggcccgagtctcttgcatctctaatgaccaaatagtcaacctagccaatataatgtcgaca

SEQ ID NO: 285446 - DNA, 75 bp, Artificial Sequence
  Synthetic
agttgaataacagtgtgccagaaatctatcgattgtgtatatccatcatgaaaaaaactaacacccctcctttcg

SEQ ID NO: 285447 - DNA, 75 bp, Artificial Sequence
  Synthetic
attatggaaagatttaacctcagtggacatcgggaaggacttggtcaagttcaaagatcaaatatggggactgct

SEQ ID NO: 285448 - DNA, 75 bp, Artificial Sequence
  Synthetic
attgatgttagaatggttgaaaacaggaaataggcctctccggatgactctgacagacaattgctctaggtctta

SEQ ID NO: 285449 - DNA, 75 bp, Artificial Sequence
  Synthetic
ggaaataggcctctccggatgactctgacagacaattgctctaggtcttacaaagttttgagagattacttcaag

SEQ ID NO: 285450 - DNA, 75 bp, Artificial Sequence
  Synthetic
gcgtttcacctggactatgagaagtggaacaatcatcaaagattagagtcaacagaggacgtgttctctgtcctg

SEQ ID NO: 285451 - DNA, 75 bp, Artificial Sequence
  Synthetic
ggcccctgttttcaaacggacagggtcagccttgcataggttcaagtctgccagatacagtgaaggagggtattc

SEQ ID NO: 285452 - DNA, 75 bp, Artificial Sequence
  Synthetic
tactctgaatcaaacaggagccggaagtgtataaccgacttggctcagttctattccaagtcttcccccatagaa

SEQ ID NO: 285453 - DNA, 75 bp, Artificial Sequence
  Synthetic
ccgaaccccgatactcagatgacttaatatctcagctgtgccagctgtacattgctggagatcaagtcttgtcta

SEQ ID NO: 285454 - DNA, 75 bp, Artificial Sequence
  Synthetic
ataccaaaggctgtggacaggcctaggggtgtttcgaatgaccctatgcttgggcgcagaaagaggtcgtggtgt

SEQ ID NO: 285455 - DNA, 75 bp, Artificial Sequence
  Synthetic
gattcctcaagatatggtcacagaccgtagaagagattatatcctatgtcacggtcaactttcccaaccctccag

SEQ ID NO: 285456 - DNA, 75 bp, Artificial Sequence
  Synthetic
aaaagtttaggcctctcattcattccttgggagactttcctgtatttataaaagacaaggtgagtcagcttgaag

SEQ ID NO: 285457 - DNA, 75 bp, Artificial Sequence
  Synthetic
aaggagacaacatccactccttcccagagagaaagccaatcttcgaaagccaggatggcggctcaagctgcctct

SEQ ID NO: 285458 - DNA, 75 bp, Artificial Sequence
  Synthetic
gagcatttcctgcggtcactggatttataactcaggtgacctcgtctttctcatccgagctatacctccggttct

SEQ ID NO: 285459 - DNA, 75 bp, Artificial Sequence
  Synthetic
tgaggcccattgatgatataacactggaaacttctcagatcttcgagttcccggatgtgtcaaaaaggatatcca

SEQ ID NO: 285460 - DNA, 75 bp, Artificial Sequence
  Synthetic
gacaacatacacgacctggtctttgtatatggctgttacagacattgggggcatccttatattgattataggaag

SEQ ID NO: 285461 - DNA, 75 bp, Artificial Sequence
  Synthetic
attgctgaaagcttttccaagaagtacaagtttccctctcgatcttcagggatattcttgtataattttgagcag

SEQ ID NO: 285462 - DNA, 75 bp, Artificial Sequence
  Synthetic
aggtctatgatgaccctattgatccaatcgagtcagaggctgaacccagaggagcccccactgtccccaacatct

SEQ ID NO: 285463 - DNA, 75 bp, Artificial Sequence
  Synthetic
gccgacaagctaagtaaaatcatgcaggatgatttgaatcgctatgcatcctgctaactgaacttttaaatgtgg

SEQ ID NO: 285464 - DNA, 75 bp, Artificial Sequence
  Synthetic
agccgcctgtcaatccccgagagtttttgaaatctatagacctcggaggattgccagatgaggacttgataattg

SEQ ID NO: 285465 - DNA, 75 bp, Artificial Sequence
  Synthetic
cagatcttggagagagaacactcgagagcttcactcgccttctagaagatcctaccaccttaaatataaaaggag

SEQ ID NO: 285466 - DNA, 75 bp, Artificial Sequence
  Synthetic
ggacgaggaaaaaaccatcttagcattatggaaggatttaacctcagtggataccgggaaggacttggtcaagtt

SEQ ID NO: 285467 - DNA, 75 bp, Artificial Sequence
  Synthetic
agtctcacctcctactccagagggttgagagaaacttgtctaagagtatgagagctactctgcgacaaatgagtt

SEQ ID NO: 285468 - DNA, 75 bp, Artificial Sequence
  Synthetic
tgagagaaacttgtctaagagtatgagagctactctgcgacaaatgagttccttaatgaggcaagtgctgggtgg

SEQ ID NO: 285469 - DNA, 75 bp, Artificial Sequence
  Synthetic
aaagggctttatcgttaaaagaatctataaactggttcatcaacagaaattccaatttggctcagactctaatta

SEQ ID NO: 285470 - DNA, 75 bp, Artificial Sequence
  Synthetic
gagaaacttggcaacctggaaatactttcaatcagtccaaagacaggtaaacatgtcttatgacctcataatttg

SEQ ID NO: 285471 - DNA, 75 bp, Artificial Sequence
  Synthetic
tggcataagctcccgatcactcagatcttcgagatccccgaatcaatggacccatcggaaattctagatgataaa

SEQ ID NO: 285472 - DNA, 75 bp, Artificial Sequence
  Synthetic
aggagggccggttcccagcgagaaggtcattattacagctctttccaaacctcctgtcaaccccagagaattctt

SEQ ID NO: 285473 - DNA, 75 bp, Artificial Sequence
  Synthetic
tcgctggagatcaagtcttgtctatgtgtggaaactccggctatgaagtcatcaagatacttgagccatatgttg

SEQ ID NO: 285474 - DNA, 75 bp, Artificial Sequence
  Synthetic
ttaggagactttcctgtattcataagagacaaggtgaatcaactcgaggggactttcggtcccagtgcaaaaagg

SEQ ID NO: 285475 - DNA, 75 bp, Artificial Sequence
  Synthetic
ggaggtgaatgatctgatggcttccggaacacatccactgcctccttcagcaatcatgagtggaggagatgacat

SEQ ID NO: 285476 - DNA, 75 bp, Artificial Sequence
  Synthetic
ttccccatttacacgataccagacaaacttggcccttggagcccaattgacatacatcatctcagctgcccaaac

SEQ ID NO: 285477 - DNA, 75 bp, Artificial Sequence
  Synthetic
gaggatgtattttctgtgcttgatcaagtgtttggattgaagagggtgttctccagaactcatgagttttttcag

SEQ ID NO: 285478 - DNA, 75 bp, Artificial Sequence
  Synthetic
agatctgggagagagaacattggagagcttcactcgcctgctcgaggaccccactaccctgaatattaagggagg

SEQ ID NO: 285479 - DNA, 75 bp, Artificial Sequence
  Synthetic
aaattccaacttagctcaaactctaattaggaacattatgtctctgacaggtcctgatttccctctagaggaggc

SEQ ID NO: 285480 - DNA, 75 bp, Artificial Sequence
  Synthetic
agagtttagagaagcgatcctcttgtctaagactcatagagataactttatacttttcttaaagtctgtcgagcc

SEQ ID NO: 285481 - DNA, 75 bp, Artificial Sequence
  Synthetic
gacccgtcagaaatactggatgacaagtcacactctttcactagaacaagactagcttcttggctgtcagagaac

SEQ ID NO: 285482 - DNA, 75 bp, Artificial Sequence
  Synthetic
ctcagactaggaacacgaggactaagatactagcccagggagataaccaggttctatgtccgacatatatgttgt

SEQ ID NO: 285483 - DNA, 75 bp, Artificial Sequence
  Synthetic
ctacgatttcatgtttcagccattgatgctttatgcgcagacatggacatcagagctggtacagagagacacaag

SEQ ID NO: 285484 - DNA, 75 bp, Artificial Sequence
  Synthetic
gatgtgtcaaaaagaatatccagaatggtttctggggctgtgcctcacttccagaagcttcctgatatccgtctg

SEQ ID NO: 285485 - DNA, 75 bp, Artificial Sequence
  Synthetic
tagagcagattttcgagactgccccctttgtaaagatcgtagaacaccatactctgatgacaactcacaagatgt

SEQ ID NO: 285486 - DNA, 75 bp, Artificial Sequence
  Synthetic
ccctgtcaacatttacggcaaagtctcccctagagattacttgagagggcttgcgagaggagtcttgataggatc

SEQ ID NO: 285487 - DNA, 75 bp, Artificial Sequence
  Synthetic
ctcgatttgtttcttgacaagaatgacaaatatcaacattaatagacctcttgagttgatatcaggagtaatctc

SEQ ID NO: 285488 - DNA, 75 bp, Artificial Sequence
  Synthetic
attttctatccctcaaaaaatccccgccgcttacccgactactatgaaagaaggcaatagatcgatcttgtgtta

SEQ ID NO: 285489 - DNA, 75 bp, Artificial Sequence
  Synthetic
tggcaaggagaagtctcgccatatagggtcagcccaaggactcttgtattcaatcttggttgcgattcatgactc

SEQ ID NO: 285490 - DNA, 75 bp, Artificial Sequence
  Synthetic
atgaggctgaggattttgttgaggttcaccttcctgatgtgcacaaacaggtctcaggggttgacctgggcctcc

SEQ ID NO: 285491 - DNA, 75 bp, Artificial Sequence
  Synthetic
tggaagagtccttttataactcagagatccatgggatcaaccggatgacccaaactccccaaagggtcggaaggg

SEQ ID NO: 285492 - DNA, 75 bp, Artificial Sequence
  Synthetic
ttgaagaaacccagtatcactctagggaaagctcctgacttaaacaaggcatacaagtcagtcctgtctggcatg

SEQ ID NO: 285493 - DNA, 75 bp, Artificial Sequence
  Synthetic
cccaaagcgggaaggttatatcttcatgggagtcatataagagtgggggtgagactagactgtgaaggctggtca

SEQ ID NO: 285494 - DNA, 75 bp, Artificial Sequence
  Synthetic
gcttgacataagggccctctctaagaggtttcaaaaccctctgatctcgggcctgagagtggttcagtgggcaac

SEQ ID NO: 285495 - DNA, 75 bp, Artificial Sequence
  Synthetic
ttctcgagaggccctctgaagggatacctgggctcatccacttccatgtcgacccagctattccacgcctgggag

SEQ ID NO: 285496 - DNA, 75 bp, Artificial Sequence
  Synthetic
tcttgagtctttataggttgagcaaaatatcgggacaaaacacaggtaactacaaaacaaacattgcggacagga

SEQ ID NO: 285497 - DNA, 75 bp, Artificial Sequence
  Synthetic
aggtatttcgaatgactccgtggctgggcacagacaggtgtcacagtgagtcccgtgacaacggactcagtatga

SEQ ID NO: 285498 - DNA, 75 bp, Artificial Sequence
  Synthetic
gtcttcaagaggacagggtctgccctgcataggttcaagtcagccagatacagtgaaggggggtactcttctgtt

SEQ ID NO: 285499 - DNA, 75 bp, Artificial Sequence
  Synthetic
actctgatgacaactcacaagatgtgcgctaactggagtaccataccgaacttcagattcttagctggaacctac

SEQ ID NO: 285500 - DNA, 75 bp, Artificial Sequence
  Synthetic
cccatgaaggacataagcaatagctcacaatcatcttgcatctcagcaaagtgtgcataattataaagggctggg

SEQ ID NO: 285501 - DNA, 75 bp, Artificial Sequence
  Synthetic
cacaatcatcttgcatctcagcaaagtgtgcataattataaagggctgggtcatctaagcttttcagtcgagaaa

SEQ ID NO: 285502 - DNA, 75 bp, Artificial Sequence
  Synthetic
gacatgtttttctcccggattgaacatctgtattcagctattagagtaggtacagttgtcactgcttatgaagac

SEQ ID NO: 285503 - DNA, 75 bp, Artificial Sequence
  Synthetic
atctgtattcagctattagagtaggtacagttgtcactgcttatgaagactgctcagggctagtatcgtttacgg

SEQ ID NO: 285504 - DNA, 75 bp, Artificial Sequence
  Synthetic
cttgactcatgatgggagaaattatgactttatgtttcaaccgttgatgctttatgcacaaacatggacatcaga

SEQ ID NO: 285505 - DNA, 75 bp, Artificial Sequence
  Synthetic
gaccactttatttggtcttcaaaacttacgggactatgctagtaaacccagactataaggctattcaacacctgt

SEQ ID NO: 285506 - DNA, 75 bp, Artificial Sequence
  Synthetic
tctccaaacgagggaagttttttagagatgccgagtacttgacctcttccacccttcgggagatgagccttgtgt

SEQ ID NO: 285507 - DNA, 75 bp, Artificial Sequence
  Synthetic
tgtagggatgaggacactcaaaaaccctctcctgtgtcagcccctccggatgacgatgacctgtggcttccaccc

SEQ ID NO: 285508 - DNA, 75 bp, Artificial Sequence
  Synthetic
ccactctgaatcaaacaggagccggagatgtataacagacttggcccatttctattccaagtcatcccccataga

SEQ ID NO: 285509 - DNA, 75 bp, Artificial Sequence
  Synthetic
acttgggggaggagttttttgggaaggggacgtttgaaagaagattcttcagagatgagaaagaacttcaagagt

SEQ ID NO: 285510 - DNA, 75 bp, Artificial Sequence
  Synthetic
ttccccatctacacgataccagacaaacttggcccttggagtcccattgatatacatcatctcagttgccctaac

SEQ ID NO: 285511 - DNA, 75 bp, Artificial Sequence
  Synthetic
tctgccccaaccttctctctcatatttctgtgagcacagacactatgtctgatttgacccaggacgggaagaact

SEQ ID NO: 285512 - DNA, 75 bp, Artificial Sequence
  Synthetic
tttatctatcttggagttggtctgatgacacctctgtgttcaagagagtagcctgtaattccagcttgagtctat

SEQ ID NO: 285513 - DNA, 75 bp, Artificial Sequence
  Synthetic
gagaggtggaaagacaccttcatgggtacaacaggtggatcaccctcgaggatatcagatctagatcatctctac

SEQ ID NO: 285514 - DNA, 75 bp, Artificial Sequence
  Synthetic
gaacagtttagtccagagagcagaaaagtttaggcctcttattcattccttgggagactttcctgtatttataaa

SEQ ID NO: 285515 - DNA, 75 bp, Artificial Sequence
  Synthetic
cttctcagatcttcgagttcccggatgtgtcaaaaaggatatccagaatggtttctggagccgtgcctcactttc

SEQ ID NO: 285516 - DNA, 75 bp, Artificial Sequence
  Synthetic
ctatgacaggatgttacagccccaacaagaggatgtcacgcaaagcagggtgttcagagtgggtctgctctgctc

SEQ ID NO: 285517 - DNA, 75 bp, Artificial Sequence
  Synthetic
gtacaacaggtggatcaccctcgaggatatcagatctagatcatctctactggactacagctgcttgtaaaccga

SEQ ID NO: 285518 - DNA, 75 bp, Artificial Sequence
  Synthetic
aaaactctggtacgatgtatcttgaaaaaaacaagatcttgaatccgaacctctggctgtttgattttttttatc

SEQ ID NO: 285519 - DNA, 75 bp, Artificial Sequence
  Synthetic
agaccaccccttgactccttatatcaaaacccagacatggccacccaaacatatagtagacttggtgggggatac

SEQ ID NO: 285520 - DNA, 75 bp, Artificial Sequence
  Synthetic
atatcctcctgaggctggataatcatccctctttgtatataatgcttagagaaccgtctcttagaggagagatat

SEQ ID NO: 285521 - DNA, 75 bp, Artificial Sequence
  Synthetic
atctttgagattcctgaatcaatggacccgtcagaaatactggatgacaaatcacattctttcaccagaacaaga

SEQ ID NO: 285522 - DNA, 75 bp, Artificial Sequence
  Synthetic
gtacaagtacccggctatcaaagacctgaagaagcccagtataaccttaggaaaagctcctgatttgaacaaagc

SEQ ID NO: 285523 - DNA, 75 bp, Artificial Sequence
  Synthetic
attgccgagagcttctccaagaaatacaaatttccctccaggtcatccgggatattcttgtataactttgaacag

SEQ ID NO: 285524 - DNA, 75 bp, Artificial Sequence
  Synthetic
cccgatgactggaccagctatggaatcctgatagctcggaagggagataagatcaccccggattctcttgtggac

SEQ ID NO: 285525 - DNA, 75 bp, Artificial Sequence
  Synthetic
cctgaccctcattacttaccagtctcatctcctactccagagggttgagagaaacttgtctaagagtatgagagc

SEQ ID NO: 285526 - DNA, 75 bp, Artificial Sequence
  Synthetic
gatcaccccggattctcttgtggacataaggcgtactaatgtggaagggaattgggctttaacagggggtatgga

SEQ ID NO: 285527 - DNA, 75 bp, Artificial Sequence
  Synthetic
ataaagcgtactgatgtagaagggaattgggctctgacaggaggcatggaactgacaagggaccccactgtctct

SEQ ID NO: 285528 - DNA, 75 bp, Artificial Sequence
  Synthetic
gagtgtaggcgctatgattgcactgatgttgatgattttcttgatgacgtgttgcagaaaagctaatggagcaga

SEQ ID NO: 285529 - DNA, 75 bp, Artificial Sequence
  Synthetic
ccagacaagttgaacaaaattatgcaggatgatctaaaccgttatacatcctgctgaccgaattttaatactcag

SEQ ID NO: 285530 - DNA, 75 bp, Artificial Sequence
  Synthetic
aaaaaggggaaagttctttcgggatgcagaatatttgacctcttctactcttcgagaaatgagtcttgtactgtt

SEQ ID NO: 285531 - DNA, 75 bp, Artificial Sequence
  Synthetic
tacaagacaaacatcgcggatagaatagagcaaattttcgagacagctccctttacaaagatcgtagaacatcat

SEQ ID NO: 285532 - DNA, 75 bp, Artificial Sequence
  Synthetic
atctgtattcagcgattagagtaggcacagttgtcactgcttatgaggattgctcaggactggtgtcatttacag

SEQ ID NO: 285533 - DNA, 75 bp, Artificial Sequence
  Synthetic
tgctcaggactggtatcgtttacagggttcataaagcagatcaatctcaccgcaagagaagcaatactatatttc

SEQ ID NO: 285534 - DNA, 75 bp, Artificial Sequence
  Synthetic
gcgcccattataaacttaagcctattttggatgatctaaatgttttcccgtccctctgtcttgtagttggagacg

SEQ ID NO: 285535 - DNA, 75 bp, Artificial Sequence
  Synthetic
ttcattcacttccgttcactaggcttgagtgggaagtctccttattcatcaaatgccgtcggtcatgtgttcaat

SEQ ID NO: 285536 - DNA, 75 bp, Artificial Sequence
  Synthetic
aagatagtgaagactaccagactcgttggcagcgccgaggacctatccggagaggtggaaagacaccttcatggg

SEQ ID NO: 285537 - DNA, 75 bp, Artificial Sequence
  Synthetic
aaatgccgtcggtcatgtgttcaatctcattcactttgttggatgctatatgggtcaagtcagatctctaaatgc

SEQ ID NO: 285538 - DNA, 75 bp, Artificial Sequence
  Synthetic
taagaagaatgtttgagcctgggcaagagactgctgttcctcattcctatttcatccattttcgttcattgggct

SEQ ID NO: 285539 - DNA, 75 bp, Artificial Sequence
  Synthetic
agaatcttgtgtgatgtgtcttgaaaaaaacaagatcttgaatctgagcctctggttgtttgattgtttttccca

SEQ ID NO: 285540 - DNA, 75 bp, Artificial Sequence
  Synthetic
catgagatgtctgttcttgggggctatttgggagaggagttttttggaaaaggaacttttgaaaggagattcttc

SEQ ID NO: 285541 - DNA, 75 bp, Artificial Sequence
  Synthetic
aggaacttttgaaaggagattcttcagggacgagaaggagcttcaggaatatgaggcagctgaattgacaaaagc

SEQ ID NO: 285542 - DNA, 75 bp, Artificial Sequence
  Synthetic
ggtagagaggcaccttcgagggtacaataggtggatcaccctagatgacattagatccagatcatctcttttaga

SEQ ID NO: 285543 - DNA, 75 bp, Artificial Sequence
  Synthetic
attgcaaataagagtgagtgcaagacaatgtcacatccagggcagactctggtgtatcaacatgaactcgagagc

SEQ ID NO: 285544 - DNA, 75 bp, Artificial Sequence
  Synthetic
tgggaggggtgtctggaatgtctcttggaaggtttcatatacgccaattctcagaccctgtctctgaagggttat

SEQ ID NO: 285545 - DNA, 75 bp, Artificial Sequence
  Synthetic
agaaacatagaagacaatcaggctcatctccagggagaacccatagaagtggacaatctccctgaggacatgagg

SEQ ID NO: 285546 - DNA, 75 bp, Artificial Sequence
  Synthetic
cggcttcaactagatgacgacaaaccgtctgactttggcagtatcgccaaagtaggggaaagcaggtgtcaggaa

SEQ ID NO: 285547 - DNA, 75 bp, Artificial Sequence
  Synthetic
atatctcagctatgccagctgtatattgccggggatcaagtattgtccatgtgtggaaactccggttatgaagtc

SEQ ID NO: 285548 - DNA, 75 bp, Artificial Sequence
  Synthetic
tactgctttaggcgatgtccccagcttcgcaagactccatgacctgtacaacagacctataacttactacttcag

SEQ ID NO: 285549 - DNA, 75 bp, Artificial Sequence
  Synthetic
ttatcattggctccggactgtaaaaaccaccaaagagtcctttgttatcatatctccaagtgtggcagatctaga

SEQ ID NO: 285550 - DNA, 75 bp, Artificial Sequence
  Synthetic
tcagactgctggccgtgaactctcgaaggagacaaagtctgcttcttctcagcgagcaagtcaaccattaaaagt

SEQ ID NO: 285551 - DNA, 75 bp, Artificial Sequence
  Synthetic
ttgaagaagccctgtataaccctagggaaagcccccgacttaaacaaagcatacaagtcagttttatcaggcatg

SEQ ID NO: 285552 - DNA, 75 bp, Artificial Sequence
  Synthetic
gactcttgtatgatgcatcttgaaaaaaacaggatcttgaatctgagcctctggttgcttgattgtttttcccat

SEQ ID NO: 285553 - DNA, 75 bp, Artificial Sequence
  Synthetic
tgccctcctgaccagctagtgaatctacatgactttcattcagatgagattgaacatcttgttgtggaggagttg

SEQ ID NO: 285554 - DNA, 75 bp, Artificial Sequence
  Synthetic
aagatgacttggatcgctacacatcatgctaaccgagtcttcgaattcattccctctagataatgaaaactgaga

SEQ ID NO: 285555 - DNA, 75 bp, Artificial Sequence
  Synthetic
tccaaactccctctgagatgtgtgctgggatgggttgccctggcaaattccaaaaagttccagctgttggttgag

SEQ ID NO: 285556 - DNA, 75 bp, Artificial Sequence
  Synthetic
gtcaagaaaagggaagagtgtctagatgcactggagtccatcatgaccaccaagtccgtgagtttccgacgtctc

SEQ ID NO: 285557 - DNA, 75 bp, Artificial Sequence
  Synthetic
tgcctgacgaagacttgataattggcctcaagccgaaggagagagagctgaaaatcgagggtcgattttttgcct

SEQ ID NO: 285558 - DNA, 75 bp, Artificial Sequence
  Synthetic
cctgacaagctaaacaagataatgcaagatgacctgaaccgctatgtgtctctctgatcacaccccccggctctg

SEQ ID NO: 285559 - DNA, 75 bp, Artificial Sequence
  Synthetic
caataagaccttgatggaggctgatgctcactacaaatcggtccggacttggaacgagatcatcccctctaaagg

SEQ ID NO: 285560 - DNA, 75 bp, Artificial Sequence
  Synthetic
gctcactacaaatcggtccggacttggaacgagatcatcccctctaaagggtgtttgagagttggaggcagatgt

SEQ ID NO: 285561 - DNA, 75 bp, Artificial Sequence
  Synthetic
atcgatacaacacagtcttggagagacagggaggaaagtgtcggtaacctcccaaagcgggagggtcatatcttc

SEQ ID NO: 285562 - DNA, 75 bp, Artificial Sequence
  Synthetic
ctctcattttccaatgggctgattccagaggccctctagaaggggaggaattggaatactctcaggagattacct

SEQ ID NO: 285563 - DNA, 75 bp, Artificial Sequence
  Synthetic
cccaaagcgggagggtcatatcttcatgggagtcatacaaaagcggaggtgagaccaagctgtaagggcaggtca

SEQ ID NO: 285564 - DNA, 75 bp, Artificial Sequence
  Synthetic
ggtttttccattgtgtttcgggaaattccctatctacacgataccagacaaactcggaccctggagcccgattga

SEQ ID NO: 285565 - DNA, 75 bp, Artificial Sequence
  Synthetic
gtgggctgattccagaggccctctagagggggaagagttggaatactctcaggaaattacctgggatgatgatac

SEQ ID NO: 285566 - DNA, 75 bp, Artificial Sequence
  Synthetic
tatcctcctgaggttagataatcacccctccttgtacataatgctccgagaaccgtctcttagaggagaaatatt

SEQ ID NO: 285567 - DNA, 75 bp, Artificial Sequence
  Synthetic
atcttctagcagttccagtgactaacggtgcttttaccctccaagaactgacaccaaaggtgatggacagaccta

SEQ ID NO: 285568 - DNA, 75 bp, Artificial Sequence
  Synthetic
gatattcttgtataactttgagcagttgaagatgaaccttgatgatatagttaaggaggcaaaaaatgtgccagg

SEQ ID NO: 285569 - DNA, 75 bp, Artificial Sequence
  Synthetic
tgaggaacttttgtatcaatggagaggtcaaagtgtgcagtccgaacggctattcgttcaggatcctgcggcaca

SEQ ID NO: 285570 - DNA, 75 bp, Artificial Sequence
  Synthetic
gcccccagatactagactgggtaagagtctgttaagaaagaatacttgcctcctatgaaggacataagcaataga

SEQ ID NO: 285571 - DNA, 75 bp, Artificial Sequence
  Synthetic
aagacctaaagaaagatgatctttcaggctcttctatttgtgcctctcctaatttcttcgttgtgtcttgggaaa

SEQ ID NO: 285572 - DNA, 75 bp, Artificial Sequence
  Synthetic
gtcattcatgattttcagtcgagaaaaaaactatagaacagaaggacaactagcaacacttctcatcttgagact

SEQ ID NO: 285573 - DNA, 75 bp, Artificial Sequence
  Synthetic
cacttgcacaggtgttgtgacagaggcagaaacctacaccaactttgttggttatgtcacaaccacattcaagag

SEQ ID NO: 285574 - DNA, 75 bp, Artificial Sequence
  Synthetic
agcctgcgacaaatgagttctttaatgaggcaggtgctgggtgggcacggagaagatactttagagtccgacgac

SEQ ID NO: 285575 - DNA, 75 bp, Artificial Sequence
  Synthetic
aggtctatgatgacccggtagatccgattgagtcagaggctgaacccagagggactcccactgtccccaacatct

SEQ ID NO: 285576 - DNA, 75 bp, Artificial Sequence
  Synthetic
agggcaggatttggtgtattaacatgaactctcgggcttgtcaattgtggtctgacatgtctcttcaaacacaaa

SEQ ID NO: 285577 - DNA, 75 bp, Artificial Sequence
  Synthetic
atgttcagaatgggtctgctctgctcaacaggttgcagtctccacctcggcaaacccagcccctgtctcagagct

SEQ ID NO: 285578 - DNA, 75 bp, Artificial Sequence
  Synthetic
cctgtactggtgtcgtgactgaggctgagacttacaccaactttgttggttatgtcaccaccacattcaagagaa

SEQ ID NO: 285579 - DNA, 75 bp, Artificial Sequence
  Synthetic
ctcactccgaatcaaacaggagccgaaaatgtatgactgacttagcccatttctattccaagtcttcccccatag

SEQ ID NO: 285580 - DNA, 75 bp, Artificial Sequence
  Synthetic
tggatgaaaggggcttgtataagtctctaaagggagcatgtaaactcaagctgtgcggagtttccggacttagac

SEQ ID NO: 285581 - DNA, 75 bp, Artificial Sequence
  Synthetic
tctaaagggagcatgtaaactcaagctgtgcggagtttccggacttagacttatggatggaacttgggttacaat

SEQ ID NO: 285582 - DNA, 75 bp, Artificial Sequence
  Synthetic
aaatgcagttggtcatgtgttcaatctcatccactttgtcggatgctatatgggacaagtgagatctctgaatgc

SEQ ID NO: 285583 - DNA, 75 bp, Artificial Sequence
  Synthetic
gattttgcattgtctatagacggaccactttatttggtcttcaaaacttacgggactatgctagtgaacccagac

SEQ ID NO: 285584 - DNA, 75 bp, Artificial Sequence
  Synthetic
tacatgactttcactcagatgaaatagagcatctcgtcgtggaggaattggttaagaagagggaggagtgtttgg

SEQ ID NO: 285585 - DNA, 75 bp, Artificial Sequence
  Synthetic
ctgctcgactaaccacgattacaccatttggatgcccgagaatccgagactagggacatcttgtgacatttttac

SEQ ID NO: 285586 - DNA, 75 bp, Artificial Sequence
  Synthetic
agagcatctcgtcgtggaggaattggttaagaagagggaggagtgtttggatgcattagagtccatcatgaccac

SEQ ID NO: 285587 - DNA, 75 bp, Artificial Sequence
  Synthetic
ccaaacgagggaagttttttagagatgctgagtacttgacctcttccacccttcgggagatgagccttgtgttat

SEQ ID NO: 285588 - DNA, 75 bp, Artificial Sequence
  Synthetic
tgagccccggtattcagacgatctgatatcccaactttgccaactatacatcgccggagatcaagtattgtctat

SEQ ID NO: 285589 - DNA, 75 bp, Artificial Sequence
  Synthetic
cctaaccctcatcacttatcagtctcatcttctacttcagagggttgaaagaaatctgtcaaagagcatgagaac

SEQ ID NO: 285590 - DNA, 75 bp, Artificial Sequence
  Synthetic
ttatgtggagttcttggacttagacttatggatggaacatgggttgcgatgcaaacatcagatgagaccaaatgg

SEQ ID NO: 285591 - DNA, 75 bp, Artificial Sequence
  Synthetic
gtgtggaaattcgggttatgaagtcattaagatactggaaccctatgtcgtgaacagcttagtccagagggcaga

SEQ ID NO: 285592 - DNA, 75 bp, Artificial Sequence
  Synthetic
gcccactacaagtcagttcggacttggaatgagatcatcccctcaaaaggatgtttgaaagtcagtgataggtgt

SEQ ID NO: 285593 - DNA, 75 bp, Artificial Sequence
  Synthetic
cgggaatgtcttgatacctgaaatgcaatcgtccctacttcaacaacatatggagctgttggagtcctctgtaat

SEQ ID NO: 285594 - DNA, 75 bp, Artificial Sequence
  Synthetic
tagttttctccaacagagtcttcaatgtttccaaacccttgactgaccccctgttctatccaccgtctgatccta

SEQ ID NO: 285595 - DNA, 75 bp, Artificial Sequence
  Synthetic
gtatggctgttataggcattgggggcatccttatatagattatagaaagggtctgtcaaagttatatgatcaggt

SEQ ID NO: 285596 - DNA, 75 bp, Artificial Sequence
  Synthetic
tgatgttgataattttcctgatgacatgttgcagaagagtcaatcgaccagaatctacacaaagcaatcttggag

SEQ ID NO: 285597 - DNA, 75 bp, Artificial Sequence
  Synthetic
acgaagcggaggactttgttgaagttcacctcccggatgttcacaaacagatctcaggggttgacctcggtctcc

SEQ ID NO: 285598 - DNA, 75 bp, Artificial Sequence
  Synthetic
cagtcgagaaaaaaactgtggaactgaagaacaattagcaacacttctcatcttgagattttcatcatgatgatc

SEQ ID NO: 285599 - DNA, 75 bp, Artificial Sequence
  Synthetic
gttctgataatcttcttgatggcatgttgtagaagaaccaagagaacagaatcaagacggcgaggctctggggaa

SEQ ID NO: 285600 - DNA, 75 bp, Artificial Sequence
  Synthetic
gttgtagaagaaccaagagaacagaatcaagacggcgaggctctggggaatcaggagagaaggtattggcaactc

SEQ ID NO: 285601 - DNA, 75 bp, Artificial Sequence
  Synthetic
aactaacacctctcgtacgattctgcagtttgctagcaggaccggtacataactataaagggctgggtcatctaa

SEQ ID NO: 285602 - DNA, 75 bp, Artificial Sequence
  Synthetic
catggcataagctcccaatcacacagatatttgagatccctgagtcaatggatccttcagaaatactagatgaca

SEQ ID NO: 285603 - DNA, 75 bp, Artificial Sequence
  Synthetic
gatgccaggctgtgagggcgggccatctcctttatatcttgcaatcaggagattgcccatctttgagacccgaga

SEQ ID NO: 285604 - DNA, 75 bp, Artificial Sequence
  Synthetic
tctcctttatatcttgcaatcaggagattgcccatctttgagacccgagagactctcccattttgaaagtcattc

SEQ ID NO: 285605 - DNA, 75 bp, Artificial Sequence
  Synthetic
ccatctcaactgatcagacacagtcatgtagatttttatgaggtgtgatgtcttctgatagtatcattgactaat

SEQ ID NO: 285606 - DNA, 75 bp, Artificial Sequence
  Synthetic
acacccctacaatggatgccgacaagattgtattcaaagtcaataatcaggtggtctctttgaagcctgagatta

SEQ ID NO: 285607 - DNA, 75 bp, Artificial Sequence
  Synthetic
atgtagatttttatgaggtgtgatgtcttctgatagtatcattgactaatggtgctctcatcctccaaggaccga

SEQ ID NO: 285608 - DNA, 75 bp, Artificial Sequence
  Synthetic
tcgtggatcaatatgagtacaagtaccctgccatcaaagatttgaaaaagccctgtataaccctaggaaaggctc

SEQ ID NO: 285609 - DNA, 75 bp, Artificial Sequence
  Synthetic
ccttcgagagatgagccttgttttattcaactgtagcagccccaagagtgagatgcagagagctcgctctttgaa

SEQ ID NO: 285610 - DNA, 75 bp, Artificial Sequence
  Synthetic
gagcccaagcagaggctatcatgagttccactgcattggaccaagtagagattatttgaaaaagacgatttgcct

SEQ ID NO: 285611 - DNA, 75 bp, Artificial Sequence
  Synthetic
cctatgaaggacataagcaataggtcacaatcatcctacatcccaacaaggcgtatataactacaaagggatgga

SEQ ID NO: 285612 - DNA, 75 bp, Artificial Sequence
  Synthetic
ggtttttgacgaccccgtagatccgattgagttggaggccgagtcgagagggaaccccgccatccccaacatctt

SEQ ID NO: 285613 - DNA, 75 bp, Artificial Sequence
  Synthetic
ggccaacacgtattcctcttatctgtttttccatgtaattaccttatacatgaatgccctagactgggaagagga

SEQ ID NO: 285614 - DNA, 75 bp, Artificial Sequence
  Synthetic
tgtataggttgagcaaaatatccgggcaaaacactggtaactataagacaaacattgcagacaggatagagcaga

SEQ ID NO: 285615 - DNA, 75 bp, Artificial Sequence
  Synthetic
gaggaccaaatatactgcttggatatgtctaacggcccgacctgctggaatggccaagatggcgggctggaaggc

SEQ ID NO: 285616 - DNA, 75 bp, Artificial Sequence
  Synthetic
tggccaagatggcgggctggaaggcttacgacagaaaggctggagtctggtcagcctgttaatgatagacagaga

SEQ ID NO: 285617 - DNA, 75 bp, Artificial Sequence
  Synthetic
tttttgagacagccccttttgttaaaatcgtggaacaccatactctaatgacaactcacaaaatgtgtgctaatt

SEQ ID NO: 285618 - DNA, 75 bp, Artificial Sequence
  Synthetic
agacgacctgatatctcagttgtgccaactgtacattgccggggatcaagtcttgtccatgtgcggaaactccgg

SEQ ID NO: 285619 - DNA, 75 bp, Artificial Sequence
  Synthetic
ctgacagacaactgctctaggtcttacaaagtcctgaaagattatttcaagaaggtagacctaggatctatcaaa

SEQ ID NO: 285620 - DNA, 75 bp, Artificial Sequence
  Synthetic
aagttctatgtccaacatatatgttatcgcctgggctgtcgagggaggggcttctttatgaactggagagtatat

SEQ ID NO: 285621 - DNA, 75 bp, Artificial Sequence
  Synthetic
agctatcgaggagggagcagcaaagctagggctgattatcaagaaggaagagaccatgtgtagctatgactttct

SEQ ID NO: 285622 - DNA, 75 bp, Artificial Sequence
  Synthetic
ctagggctgattatcaagaaggaagagaccatgtgtagctatgactttctcatctacgggaaaactccattattt

SEQ ID NO: 285623 - DNA, 75 bp, Artificial Sequence
  Synthetic
ggcaatactatatttcttccacaagaactttgaggaagagataagaagaatgtttgagccagggcaggagacagc

SEQ ID NO: 285624 - DNA, 75 bp, Artificial Sequence
  Synthetic
ctccaagtggtatattgactcgagactccttgcaagagaccatcccttgactccttatgtcaaaactcaaacatg

SEQ ID NO: 285625 - DNA, 75 bp, Artificial Sequence
  Synthetic
tctgttctagggggctatctgggagaggaattcttcgggaaagggacatttgaaagaagattcttcagagatgag

SEQ ID NO: 285626 - DNA, 75 bp, Artificial Sequence
  Synthetic
atttagtccaatcttaaagggcagagtttacaagattctgagtgctgaaggggagagctttctcctagccatgtc

SEQ ID NO: 285627 - DNA, 75 bp, Artificial Sequence
  Synthetic
cagctctaatcatcaaactcgccctaactcgtttgcggagtttttaaacaaaacatactcgagtgactcgtgagg

SEQ ID NO: 285628 - DNA, 75 bp, Artificial Sequence
  Synthetic
gaaggatcctcagatggggatttgacaagtactccaagtggtatctagattcgagattccttgcccgagaccacc

SEQ ID NO: 285629 - DNA, 75 bp, Artificial Sequence
  Synthetic
cgcaggagatcacgtcttgtccatgtgcggaaactctggatatgaggtcatcaaaatactggagccttatgttgt

SEQ ID NO: 285630 - DNA, 75 bp, Artificial Sequence
  Synthetic
aacatggccacccaaacatatagtagacttggtgggggacacatggcacaagctcccgatcacgcagatctttga

SEQ ID NO: 285631 - DNA, 75 bp, Artificial Sequence
  Synthetic
gtgtatatccatcatgaaaaaaactaacacccctcctttcgaaccatcccaaacatgagcaagatctttgtcaat

SEQ ID NO: 285632 - DNA, 75 bp, Artificial Sequence
  Synthetic
caatatacacgacttagtctttgtgtacggctgttacaggcattggggacatccttacatagattatagaaaggg

SEQ ID NO: 285633 - DNA, 75 bp, Artificial Sequence
  Synthetic
gagttcagagaggcaatcctcttgtccaaaacccatagggataattttatacttttcttgaaatctgttgagcct

SEQ ID NO: 285634 - DNA, 75 bp, Artificial Sequence
  Synthetic
tacggctgttacaggcattggggacatccttacatagattatagaaagggtttgacaaagctatatgatcaagtc

SEQ ID NO: 285635 - DNA, 75 bp, Artificial Sequence
  Synthetic
ttacatatgctttccatttggactatgaaaaatggaacaatcatcaaaggttggagtcgacagaagatgtattct

SEQ ID NO: 285636 - DNA, 75 bp, Artificial Sequence
  Synthetic
agtttagaaaaagcctctcaagaactttggaggagtctttttacaactcagagatccatgggatcaaccgaatga

SEQ ID NO: 285637 - DNA, 75 bp, Artificial Sequence
  Synthetic
aaaacccagacatggcctcccaaacatatagtggatttggtgggtgacacttggcacaagctcccaatcactcag

SEQ ID NO: 285638 - DNA, 75 bp, Artificial Sequence
  Synthetic
gagttttttcagaagtcttggatctattattccgacagatcagacctcattgggttacgggaggaccaaatatac

SEQ ID NO: 285639 - DNA, 75 bp, Artificial Sequence
  Synthetic
gcagatcttttgagggaaatctcttgggggaggaaagtagtgggtacaacagttccccacccttctgagatgttg

SEQ ID NO: 285640 - DNA, 75 bp, Artificial Sequence
  Synthetic
tcctctatgagttagagagcatatcaaggaatgcactttcaatataccgagccatcgaagaaggggcatctaaac

SEQ ID NO: 285641 - DNA, 75 bp, Artificial Sequence
  Synthetic
atcacactccttcactagaacaagactggcgtcatggctatcggagaacagaggagggccagttcccagtgaaaa

SEQ ID NO: 285642 - DNA, 75 bp, Artificial Sequence
  Synthetic
tttcccaaccctccaggaaagtcttcagaggataaatcaacccagactactggccgagagctcaagaaggagaca

SEQ ID NO: 285643 - DNA, 75 bp, Artificial Sequence
  Synthetic
ttttttcacgaggccctctaaaaggatacttgggatcatccacctccatgtcgacccagctgttccatgcctggg

SEQ ID NO: 285644 - DNA, 75 bp, Artificial Sequence
  Synthetic
ccccctgtcaatcccagagaattcctaaaatctatagaccttggaggattacctgacgaagatttgataattggt

SEQ ID NO: 285645 - DNA, 75 bp, Artificial Sequence
  Synthetic
gatgtcctggaatttgaggttgtattttgtcatcacagaaaaactcctcgcgaattatatcttgccactttttga

SEQ ID NO: 285646 - DNA, 75 bp, Artificial Sequence
  Synthetic
tgatgatagatagagaatctcaaaccaggaacacaagaaccaagatactagctcaaggagacaaccaggttctgt

SEQ ID NO: 285647 - DNA, 75 bp, Artificial Sequence
  Synthetic
agtttctccaaaaaatataagtttccctctcgatcctcagggatactcttgtataattttgagcaattgaaaatg

SEQ ID NO: 285648 - DNA, 75 bp, Artificial Sequence
  Synthetic
caggaacacaagaaccaagatactagctcaaggagacaaccaggttctgtgtccgacatacatgttgtcaccggg

SEQ ID NO: 285649 - DNA, 75 bp, Artificial Sequence
  Synthetic
tacagtgaggggggatattcttctgtatgccccaatctcctctctcatatctccgtaagtacagacaccatgtct

SEQ ID NO: 285650 - DNA, 75 bp, Artificial Sequence
  Synthetic
caagtgtttggactgaaaagggtgttttccagaactcatgagttttttcagaagtcctgggtctattattcagat

SEQ ID NO: 285651 - DNA, 75 bp, Artificial Sequence
  Synthetic
atgatttcatgttccagcccttgatgctttatgcgcagacatggacctccgaactggtacaaagagacacaaggc

SEQ ID NO: 285652 - DNA, 75 bp, Artificial Sequence
  Synthetic
ccttcgatgtaacaggtgtgtaaggccaatcgacgatatcacactggagacctctcaggtcttcgagtttccgga

SEQ ID NO: 285653 - DNA, 75 bp, Artificial Sequence
  Synthetic
aagatcaaatatactgtctagacatgtcagtcggtccgacatgttggaacggccaagatggcgggctagagggtt

SEQ ID NO: 285654 - DNA, 75 bp, Artificial Sequence
  Synthetic
aaaaactccctgatatccgcctgaaacctggagattttgaatctttaagtggtagggaaaaatcccgtcacatag

SEQ ID NO: 285655 - DNA, 75 bp, Artificial Sequence
  Synthetic
ggtctgctcaagggctcctatattcgatcttggtcgcaatacatgactcaggatacaatgacggaactatcttcc

SEQ ID NO: 285656 - DNA, 75 bp, Artificial Sequence
  Synthetic
gatcttggtcgcaatacatgactcaggatacaatgacggaactatcttccctgtcaacatatatggcaaggtctc

SEQ ID NO: 285657 - DNA, 75 bp, Artificial Sequence
  Synthetic
ggatacaatgacggaactatcttccctgtcaacatatatggcaaggtctctcctagagactatttgagggggctc

SEQ ID NO: 285658 - DNA, 75 bp, Artificial Sequence
  Synthetic
gagttgatctcaggcgtgatctcatatatcctcttgaggctggataatcacccctccttgtacataatgtctaga

SEQ ID NO: 285659 - DNA, 75 bp, Artificial Sequence
  Synthetic
tccagtgggctgattccaggggccctcttgaaggggaggagttggaatactctcaggagatcacttgggatgatg

SEQ ID NO: 285660 - DNA, 75 bp, Artificial Sequence
  Synthetic
taccaatgccttgactgtagcacaacactctcaatctctaatcaagccgatgagggactttttacttatgtcagt

SEQ ID NO: 285661 - DNA, 75 bp, Artificial Sequence
  Synthetic
ttacagaggggaactctgtccaaagtggctatcattatatccatcatgatcggtttttccaatagagtcttcaat

SEQ ID NO: 285662 - DNA, 75 bp, Artificial Sequence
  Synthetic
ctgatttccctctagaggaggcccctgttttcaaaaggacagggtcagccttgcataggttcaagtctgccagat

SEQ ID NO: 285663 - DNA, 75 bp, Artificial Sequence
  Synthetic
tccaacatgtgctgcgctatgagcgagaggttattacagcatctccagagaatgactggttgtggatcttctcag

SEQ ID NO: 285664 - DNA, 75 bp, Artificial Sequence
  Synthetic
ctcttctacctactgctccactaatcatgattacactatctggatgcccgaggaagcaagacttggaacgtcttg

SEQ ID NO: 285665 - DNA, 75 bp, Artificial Sequence
  Synthetic
gatcattcaatgagctctattctggaaatcaaagaatgattgggctagtcaaggttgttgttggattggcgttgt

SEQ ID NO: 285666 - DNA, 75 bp, Artificial Sequence
  Synthetic
tcagatcctgtctcagaagggctgtccttttggagagagatctggctgagctccaatgagtcgtggattcacgca

SEQ ID NO: 285667 - DNA, 75 bp, Artificial Sequence
  Synthetic
gaactgggtatacaaattgaggagaaccctaattttccaatgggctgattccagaggccctctagaaggggagga

SEQ ID NO: 285668 - DNA, 75 bp, Artificial Sequence
  Synthetic
tgacattcaaaggctattaaaggactctctgcgtagaacgaggtgggtggatcaagaagtgcgccatgcagccag

SEQ ID NO: 285669 - DNA, 75 bp, Artificial Sequence
  Synthetic
ctttactcgtctgctcgaagatcctaccactctgaatattagaggaggagccagtcccaccattcttctaaagga

SEQ ID NO: 285670 - DNA, 75 bp, Artificial Sequence
  Synthetic
accactctgaatattagaggaggagccagtcccaccattcttctaaaggatgcgatcagaaaagccctgtatgat

SEQ ID NO: 285671 - DNA, 75 bp, Artificial Sequence
  Synthetic
tccttcgatcagtcatttttttcacgaggtcccctaaagggatacttgggctcgtccacctccatgtcaacccag

SEQ ID NO: 285672 - DNA, 75 bp, Artificial Sequence
  Synthetic
caagacccatagggacaactttatcctctttttgaaatctgtcgagcctttgtttccccgattcctcagtgaact

SEQ ID NO: 285673 - DNA, 75 bp, Artificial Sequence
  Synthetic
ctcgtccacctccatgtcaacccagctattccatgcatgggaaaaagtcactaatgttcatgtggtgaaaagggc

SEQ ID NO: 285674 - DNA, 75 bp, Artificial Sequence
  Synthetic
gtttcagaaccctctcatctcgggattaagagtggttcagtgggcgactggtgctcattataaacttaagccaat

SEQ ID NO: 285675 - DNA, 75 bp, Artificial Sequence
  Synthetic
cctgagtcaattatcgggttgatacagaactctagaacaataagaagacagtttagaaagagtctttcaagaaca

SEQ ID NO: 285676 - DNA, 75 bp, Artificial Sequence
  Synthetic
accatgactggagattacagccccaacaagaaagtgtctcgcaaggcaggatgttcagaatgggtctgctctgct

SEQ ID NO: 285677 - DNA, 75 bp, Artificial Sequence
  Synthetic
gggaaggaaggtggttggtaccacagtgcctcatccctccgaaatgttggggttacttccgaaatcctcgatctc

SEQ ID NO: 285678 - DNA, 75 bp, Artificial Sequence
  Synthetic
caagacgggaagaactatgatttcatgtttcagccattgatgctttatgcgcaaacatggacatcagagctggta

SEQ ID NO: 285679 - DNA, 75 bp, Artificial Sequence
  Synthetic
gtcttatgacctcattatttgcgatgcagaagttactgacatagcatcaattaatcggataacactgttgatgtc

SEQ ID NO: 285680 - DNA, 75 bp, Artificial Sequence
  Synthetic
caacagatgtgtaaggcccattgaggatataacactggaaacttctcagatcttcgagttcccggatgtgtcaaa

SEQ ID NO: 285681 - DNA, 75 bp, Artificial Sequence
  Synthetic
gaaggtcaccaatgttcacgttgtgaaaagagccttgtctcttaaagagtctataaactggttcattacaaggaa

SEQ ID NO: 285682 - DNA, 75 bp, Artificial Sequence
  Synthetic
atatagagcaattcaacacctgtcaagggcattcccttcagtcacaggatttataacccagatgacttcgtcctt

SEQ ID NO: 285683 - DNA, 75 bp, Artificial Sequence
  Synthetic
cagattttccgctagaagaggctcctgttttcaagagaacggggtctgccctgcataggttcaagtcagccagat

SEQ ID NO: 285684 - DNA, 75 bp, Artificial Sequence
  Synthetic
ctagaatgaccaacatcaacatcaataggcctcttgaattgatctcaggtgtgatctcatatatcctcctgagac

SEQ ID NO: 285685 - DNA, 75 bp, Artificial Sequence
  Synthetic
gaccactaaggagtctcttatcatcatatctccgagtgtggctgatttagacccatacgacaaatcccttcattc

SEQ ID NO: 285686 - DNA, 75 bp, Artificial Sequence
  Synthetic
atttgactcatgatggaagaaactatgacttcatgttccaaccgttgatgctttacgcgcaaacatggacgtcgg

SEQ ID NO: 285687 - DNA, 75 bp, Artificial Sequence
  Synthetic
ctttacgcgcaaacatggacgtcggagctggtacaaaaagacacccggctgaaggactctacttatcactggcat

SEQ ID NO: 285688 - DNA, 75 bp, Artificial Sequence
  Synthetic
ctctaaaaggagcatgtaaactcaagctgtgcggagttctcggacttagacttatggatggaacctgggtttcaa

SEQ ID NO: 285689 - DNA, 75 bp, Artificial Sequence
  Synthetic
atgtctctaaaccattgacggaccctttgttttatccaccatctgaccccaaaatcttgaggcacttcaacatat

SEQ ID NO: 285690 - DNA, 75 bp, Artificial Sequence
  Synthetic
gctgcagtacaatgatgtatttggcaactgctctaggtgatgtccccagctttgctaggcttcatgacttgtaca

SEQ ID NO: 285691 - DNA, 75 bp, Artificial Sequence
  Synthetic
gtcagcccaagggctcttgtattcaatcctagtggcaatccatgactccgggtacaacgatggaaccattttccc

SEQ ID NO: 285692 - DNA, 75 bp, Artificial Sequence
  Synthetic
gaagcaggttattcgagggagtatttatctgtcttggagttggtctgatgatacctctgtgttcaagagggtggc

SEQ ID NO: 285693 - DNA, 75 bp, Artificial Sequence
  Synthetic
aagggtctgtcaaaactatatgatcaggttcaccttaaaaaagtgatagataagtcctaccaggagtgcttagca

SEQ ID NO: 285694 - DNA, 75 bp, Artificial Sequence
  Synthetic
gggtttggaaaggcatacactatattcaacaagactttgatggaggctgacgcccactacaagtcagttcggact

SEQ ID NO: 285695 - DNA, 75 bp, Artificial Sequence
  Synthetic
agatagtgaagaccactagactcatcgggagcattgaagacttatctggagaggtggtgagacatcttcaagggt

SEQ ID NO: 285696 - DNA, 75 bp, Artificial Sequence
  Synthetic
agccagctcttcgaggagaaatattctctattccccaaaaagttcctgcagcttacccgaccacaatgagagagg

SEQ ID NO: 285697 - DNA, 75 bp, Artificial Sequence
  Synthetic
aaaaacaagatcccaaatcagaacctctggttgcttgattgtttttttcatttttgttgtttatttgttaagcgt

SEQ ID NO: 285698 - DNA, 75 bp, Artificial Sequence
  Synthetic
tgtcgaggctgagattgctcaccagattgccgagagcttttctaagaagtacaaatttccttcccgatcatcagg

SEQ ID NO: 285699 - DNA, 75 bp, Artificial Sequence
  Synthetic
aacttgcgacaaatgagctctctaatgaggcaagtgttgggtggccatggcgaagataccttggagtcagatgaa

SEQ ID NO: 285700 - DNA, 75 bp, Artificial Sequence
  Synthetic
atgatagcggactcaggatgagttaattgagagaggcagtcttcctcccgtgaaggacataagcagtagctcaca

SEQ ID NO: 285701 - DNA, 75 bp, Artificial Sequence
  Synthetic
ccaggaagtgcgccatgcagcgaggaccatgacaggatgttatagccccaacaagaggatgtctcgcaaggctgg

SEQ ID NO: 285702 - DNA, 75 bp, Artificial Sequence
  Synthetic
catgggagttatacaagagtgaaggcgatgccagtctgtgagggcgggccatctccttaatatcttgcgatcaga

SEQ ID NO: 285703 - DNA, 75 bp, Artificial Sequence
  Synthetic
acctggagatacttccagtcagttcaaaagcaggtcaacatgtcgtatgacctcattatttgtgatgcagaagtt

SEQ ID NO: 285704 - DNA, 75 bp, Artificial Sequence
  Synthetic
aatatctggacagaacaccggcaattacaagacaaacatcgcagataggatagagcagatttttgaaacagcccc

SEQ ID NO: 285705 - DNA, 75 bp, Artificial Sequence
  Synthetic
cacatacttcatgtaataaaataagttcaagagtcagaaaacattcattagccatctcagctgatcaaaaacagt

SEQ ID NO: 285706 - DNA, 75 bp, Artificial Sequence
  Synthetic
cagcaggtagcggtttctacctcagcgaacccggcccctgcttccgagctggacatcaggaccctctctagaaga

SEQ ID NO: 285707 - DNA, 75 bp, Artificial Sequence
  Synthetic
ctttgatagaagatcctgctagactaatgttagaatggttaaaaacagggaatagaccttatcggatgactctaa

SEQ ID NO: 285708 - DNA, 75 bp, Artificial Sequence
  Synthetic
aaaaactgtgaaatgtaggggcaatcagcaacacttctcatcccaagaactgcaccatgatgattgatccgggag

SEQ ID NO: 285709 - DNA, 75 bp, Artificial Sequence
  Synthetic
cagcaacacttctcatcccaagaactgcaccatgatgattgatccgggagaggtttttgacgaccccatcgatcc

SEQ ID NO: 285710 - DNA, 75 bp, Artificial Sequence
  Synthetic
acggagtgtttttcaatggtataattctgggtcctgatgggagtgtcttgatcccggagatgcaatcttccctac

SEQ ID NO: 285711 - DNA, 75 bp, Artificial Sequence
  Synthetic
cactttatttggtttttaaaacttatggcaccatgctggtgaatccagactacaaagcaattcaacatttatcta

SEQ ID NO: 285712 - DNA, 75 bp, Artificial Sequence
  Synthetic
cagggaatagacctctccggatgactctgacagacaattgctctaggtcttacaaagtcttgaaagattatttca

SEQ ID NO: 285713 - DNA, 75 bp, Artificial Sequence
  Synthetic
agttccaattgtctttttgacagaaactacacacttatgctaaaagatcttttcttgtctcgcttcaactcctta

SEQ ID NO: 285714 - DNA, 75 bp, Artificial Sequence
  Synthetic
tgttcaagagggtagcctgtaattctagcttgagtctgtcatctcactggatcaggttgatttacaagatagtga

SEQ ID NO: 285715 - DNA, 75 bp, Artificial Sequence
  Synthetic
tccacaagatggtagatgatctagagttacagcgtggaactttgtctaaagtttctattattttagccatcatga

SEQ ID NO: 285716 - DNA, 75 bp, Artificial Sequence
  Synthetic
atgttggaaaggacttggtcaagtttaaagataaaatatgggggttgctgattgtgaccaaagattttgtgtatt

SEQ ID NO: 285717 - DNA, 75 bp, Artificial Sequence
  Synthetic
actgccttaggggatgtgcctagctttgcaagacttcatgatctatataacagacccataacttattatttcatg

SEQ ID NO: 285718 - DNA, 75 bp, Artificial Sequence
  Synthetic
ttgcaagacttcatgatctatataacagacccataacttattatttcatgaaacaagtcatacgaggaaaaactt

SEQ ID NO: 285719 - DNA, 75 bp, Artificial Sequence
  Synthetic
cccttggcaaacccatcaacggtcttcaaggatggtgacgaggcggaggactttgttgaagttcaccttccagac

SEQ ID NO: 285720 - DNA, 75 bp, Artificial Sequence
  Synthetic
gtgtgggaattctggatatgaggtcatcaaaatattggaaccttatgttgtgaacagcttagttcagagagcaga

SEQ ID NO: 285721 - DNA, 75 bp, Artificial Sequence
  Synthetic
caacaggtggatcaccctcaaagacatcagatccagatcatctctgttggattatagctgcttataaactaatca

SEQ ID NO: 285722 - DNA, 75 bp, Artificial Sequence
  Synthetic
atgggagtcatataaaagtgggggtgagactagactgtaaaagctggtcatcctttcgacgcttcaagttctgaa

SEQ ID NO: 285723 - DNA, 75 bp, Artificial Sequence
  Synthetic
acttggccagaaggatcctcaggtggggatttgacaagtactccaaatggtatcttgattcgcgacttctttcaa

SEQ ID NO: 285724 - DNA, 75 bp, Artificial Sequence
  Synthetic
aataatcaggtggtctccttgaagcccgagattattgtagatcagtatgagtacaagtacccggctatcaaggac

SEQ ID NO: 285725 - DNA, 75 bp, Artificial Sequence
  Synthetic
atacaagtctgtcttatcgggcatgaatgctgccaagcttgatcctgatgatgtgtgctcctatttggcagctgc

SEQ ID NO: 285726 - DNA, 75 bp, Artificial Sequence
  Synthetic
aggtgtttaaaaagctgatcgacagggtcaccgggcaagggcttttggactattcaagggtcacatatgcatttc

SEQ ID NO: 285727 - DNA, 75 bp, Artificial Sequence
  Synthetic
tttttaccaacagcagagggaagagagcatccaaggggggcaagacctgcggattcgtggacgaaaggggcttgt

SEQ ID NO: 285728 - DNA, 75 bp, Artificial Sequence
  Synthetic
tcctgattgcacgaaaaggggacaagatcactccagattctcttgtggagataaaacgtactgatgtagagggga

SEQ ID NO: 285729 - DNA, 75 bp, Artificial Sequence
  Synthetic
ggattcgtggacgaaaggggcttgtacaagtctctaaaaggagcatgtaaacttaagctgtgcggagttcccgga

SEQ ID NO: 285730 - DNA, 75 bp, Artificial Sequence
  Synthetic
gatcactccagattctcttgtggagataaaacgtactgatgtagaggggaattgggctctgacaggaggaatgga

SEQ ID NO: 285731 - DNA, 75 bp, Artificial Sequence
  Synthetic
ctggcgatcctaatgctgacaatcttcttgatgacatgttgcagaagagctaatagaacaagatcaacacaacga

SEQ ID NO: 285732 - DNA, 75 bp, Artificial Sequence
  Synthetic
ttttgagtctgtatcggctgagcaaaatatcggggcagaacaccggcaactacaaaacaaacattgcagatagga

SEQ ID NO: 285733 - DNA, 75 bp, Artificial Sequence
  Synthetic
atatacatcatctcagctgtccgaacaatctggttgtggaagatgaaggatgcaccaatctgtctggattttcct

SEQ ID NO: 285734 - DNA, 75 bp, Artificial Sequence
  Synthetic
acagagtcaccggacaggggcttttggactattcaagggttacatacgcctttcatctggactatgagaagtgga

SEQ ID NO: 285735 - DNA, 75 bp, Artificial Sequence
  Synthetic
aggaacattatgtctctgacaggccctgacttccctctagaagaggcccctgttttcaaaaggacagggtcagcc

SEQ ID NO: 285736 - DNA, 75 bp, Artificial Sequence
  Synthetic
cagggctatctcaagaggggctcctctatgaattggagagaatatcaaggaatgcactttcgatatacagagccg

SEQ ID NO: 285737 - DNA, 75 bp, Artificial Sequence
  Synthetic
cacagttgtcactgcttatgaagactgctcagggctggtatcgtttacagggttcataaagcaaataaatcttac

SEQ ID NO: 285738 - DNA, 75 bp, Artificial Sequence
  Synthetic
tgctcagggctggtatcgtttacagggttcataaagcaaataaatcttactgcgagagaagcgatactgtatttc

SEQ ID NO: 285739 - DNA, 75 bp, Artificial Sequence
  Synthetic
cagatctcctaagagagatctcatgggggaggaaggtggtcggaacaacagtccctcacccctctgagatgttgg

SEQ ID NO: 285740 - DNA, 75 bp, Artificial Sequence
  Synthetic
ggagaccgccgttcctcactcttatttcatccactttcgttcattgggcttgagcgggaagtccccgtattcatc

SEQ ID NO: 285741 - DNA, 75 bp, Artificial Sequence
  Synthetic
tgagcgggaagtccccgtattcatcaaatgcagttggccacgtgtttaatctcatccactttgttggatgttata

SEQ ID NO: 285742 - DNA, 75 bp, Artificial Sequence
  Synthetic
tgaaatctatagatctcggaggactgccagatgaggacttgataattggcctcaagccgaaggaacgagaactga

SEQ ID NO: 285743 - DNA, 75 bp, Artificial Sequence
  Synthetic
caatataatgtcgacagtgtccaccaatgcgctaacagtggcacaacactctcaatctttgatcaaaccgatgag

SEQ ID NO: 285744 - DNA, 75 bp, Artificial Sequence
  Synthetic
atcattcgacgagatatattctgggaatcacagaatgatcgggctagtcaaggttgttgtcggactggctttgtc

SEQ ID NO: 285745 - DNA, 75 bp, Artificial Sequence
  Synthetic
tgctaatgagtgcaggtgctctggcaacactaatgctgacaatctttttaatgacatgttgcagaagagctaatc

SEQ ID NO: 285746 - DNA, 75 bp, Artificial Sequence
  Synthetic
gtcaccggggctttccagagaggggcttctctacgagctggagagcatatcgagaaatgctctctcaatataccg

SEQ ID NO: 285747 - DNA, 75 bp, Artificial Sequence
  Synthetic
atttgggggaggagttttttggaaaagggacattcgaaagaagattcttcagagatgagaaagaactccaagaat

SEQ ID NO: 285748 - DNA, 75 bp, Artificial Sequence
  Synthetic
aaaagtggaggtgagactagtctgtaagggcgggtcatcccctccatgccttgcctccataagatagcctctttt

SEQ ID NO: 285749 - DNA, 75 bp, Artificial Sequence
  Synthetic
cagttccaatcatcaagcccgcccaaactcattcgctgagtttctaaacaagacatactctaacgactcatgagg

SEQ ID NO: 285750 - DNA, 75 bp, Artificial Sequence
  Synthetic
tcatctgagctataccttcgattctccaaacgagggaagtttttcagagatgccgagtacttgacctcttccacc

SEQ ID NO: 285751 - DNA, 75 bp, Artificial Sequence
  Synthetic
caaagtccgtgagtttcagacgtcttagtcatttgaggaagctagtccctgggtttggaaaggcgtataccatat

SEQ ID NO: 285752 - DNA, 75 bp, Artificial Sequence
  Synthetic
aaaaaactaacacccctcctttcgaatcattccaaacatgagcaagatctttgtcaatcctggtgcactcagagc

SEQ ID NO: 285753 - DNA, 75 bp, Artificial Sequence
  Synthetic
atcattccaaacatgagcaagatctttgtcaatcctggtgcactcagagctggtctagctgatctcgagatggcc

SEQ ID NO: 285754 - DNA, 75 bp, Artificial Sequence
  Synthetic
tactcccgtcctttgatcagtcgttcttttccagaggccctctgaagggatacctgggctcatccacatctatgt

SEQ ID NO: 285755 - DNA, 75 bp, Artificial Sequence
  Synthetic
tctccagggagaacccatagaggtagacaatctcccagaagacatgaagcgacttcagctagatgatgataaaca

SEQ ID NO: 285756 - DNA, 75 bp, Artificial Sequence
  Synthetic
gacaatctcccagaagacatgaagcgacttcagctagatgatgataaacagtccggcctgagcgaaatggccaag

SEQ ID NO: 285757 - DNA, 75 bp, Artificial Sequence
  Synthetic
ggctgggccatccaagcttttcagtcaagaaaaaaactgtggaatggaggagtaattaacaacacttctcatcct

SEQ ID NO: 285758 - DNA, 75 bp, Artificial Sequence
  Synthetic
tcctgccctcttgttccagtcatatctggacaatgtcggagtccagatagttagacaaatgagatcaggagagcg

SEQ ID NO: 285759 - DNA, 75 bp, Artificial Sequence
  Synthetic
ctggacaatgtcggagtccagatagttagacaaatgagatcaggagagcggttcctcaaaatatggtcacagact

SEQ ID NO: 285760 - DNA, 75 bp, Artificial Sequence
  Synthetic
acgcttaacaacaaaaccaaagaagaagtatacagcgtcatttgcaaagcaaaaatgtaacacctctacaatgga

SEQ ID NO: 285761 - DNA, 75 bp, Artificial Sequence
  Synthetic
gaggtcttcagaggacaagtctacccaaactgccacccgagagctcaagaaagagacaacatctatgtcttctca

SEQ ID NO: 285762 - DNA, 75 bp, Artificial Sequence
  Synthetic
gtcctccagctctcgactggtctgccaccaacgaagaggatgatctgtctgtggaggcagaaatcgctcaccaaa

SEQ ID NO: 285763 - DNA, 75 bp, Artificial Sequence
  Synthetic
agacctcatctcctcggggtaaggggaacatctctggatttaacagtcctccttggacttcttgcaacagggtag

SEQ ID NO: 285764 - DNA, 75 bp, Artificial Sequence
  Synthetic
tcgctgagagcttttccaagaagtataaattcccatcccggtcatcagggatattcttatataattttgagcagt

SEQ ID NO: 285765 - DNA, 75 bp, Artificial Sequence
  Synthetic
ccttggacttcttgcaacagggtagattcaagagtcatgagacttccattaatcatctcaaccgatcagacatgg

SEQ ID NO: 285766 - DNA, 75 bp, Artificial Sequence
  Synthetic
cgatttcatgttccagccattgatgctctatgcgcagacatggacatcagagctggtacagagagacacaaggct

SEQ ID NO: 285767 - DNA, 75 bp, Artificial Sequence
  Synthetic
gtgactcgtctggcccatgacggatccaaactccctttaagatgtgtactggggtgggttgctctggccaattct

SEQ ID NO: 285768 - DNA, 75 bp, Artificial Sequence
  Synthetic
tcctgattgcaagaaaaggagacaagatcaccccaaattctctggtggaaataaaacgcaatgatgtagaaggga

SEQ ID NO: 285769 - DNA, 75 bp, Artificial Sequence
  Synthetic
aaaaagttccagttgttggtcgagcctgataggctaaacaaaatcatgcaagatgacctgaaccgttatgcatcc

SEQ ID NO: 285770 - DNA, 75 bp, Artificial Sequence
  Synthetic
gttctagactcaacatgaaaaaaacaggtaacaccactgataagatgaactttctccgcaagatcgtgaaaaatt

SEQ ID NO: 285771 - DNA, 75 bp, Artificial Sequence
  Synthetic
ctcgcccgtgtctgcccctccggatgacgatgatctgtggttgcctcctcctgaatatatccctttgaaagaact

SEQ ID NO: 285772 - DNA, 75 bp, Artificial Sequence
  Synthetic
gactctgtgcttacgcttgggtaaaggccatagcaaggtcctctgcaatagatcgggtgggggttgactgagaga

SEQ ID NO: 285773 - DNA, 75 bp, Artificial Sequence
  Synthetic
tgttcagggctggtatcgtttactgggttcataaagcagatcaatctcaccgcaagagaagcaatattgtacttt

SEQ ID NO: 285774 - DNA, 75 bp, Artificial Sequence
  Synthetic
tgtgtagtccaaacggttactcgtttaggatcctgcggcacatcctgagatcgttcgacgagatatactccggga

SEQ ID NO: 285775 - DNA, 75 bp, Artificial Sequence
  Synthetic
taggatcctgcggcacatcctgagatcgttcgacgagatatactccgggaatcatagaatgatcgggttagtcaa

SEQ ID NO: 285776 - DNA, 75 bp, Artificial Sequence
  Synthetic
attgggtatataaattgaggagaactctcatcttccagtgggctgactctagaggccctcttgaaggggaggaat

SEQ ID NO: 285777 - DNA, 75 bp, Artificial Sequence
  Synthetic
ctttgcgaaggacaaggtgggtagatcaagaggtgcgccatgcagctagaaccatgactggagattacagcccca

SEQ ID NO: 285778 - DNA, 75 bp, Artificial Sequence
  Synthetic
ctgcagataagggttagtgcgagacaatgccatatccaaggtaggatctggtgtatcaacatgaattctagagca

SEQ ID NO: 285779 - DNA, 75 bp, Artificial Sequence
  Synthetic
agagatgagaaagaacttcaagaatacgaggcagctgaactgacaaagactgacgtggcattggcagatgatgga

SEQ ID NO: 285780 - DNA, 75 bp, Artificial Sequence
  Synthetic
gggtacaatgatggaaccattttccctgtcaacatatacagcaaggtctcccctagagactatttacgagggctc

SEQ ID NO: 285781 - DNA, 75 bp, Artificial Sequence
  Synthetic
cccaaacatatagtagatttggtgggcgacacctggcacaagctcccgatcacccagatcttcgagatccccgaa

SEQ ID NO: 285782 - DNA, 75 bp, Artificial Sequence
  Synthetic
cgcatatacggagatatgtctcagtcagttccaatcatcaagcccgtccaaactcattcgccgagtttctaaaca

SEQ ID NO: 285783 - DNA, 75 bp, Artificial Sequence
  Synthetic
aatatcggggcaaaacaccggtaactataagacaaacattgcagataggatagagcaaattttcgagacagcccc

SEQ ID NO: 285784 - DNA, 75 bp, Artificial Sequence
  Synthetic
tccacaagatggtggatgatctcgagttacagaggggaactctgtctaaagtggctatcattatagccatcatga

SEQ ID NO: 285785 - DNA, 75 bp, Artificial Sequence
  Synthetic
tagagcaaattttcgagacagccccttttattaaaatcgtggaacatcacactctgatgacgactcacaagatgt

SEQ ID NO: 285786 - DNA, 75 bp, Artificial Sequence
  Synthetic
ttccccatttacacgataccagacaagcttggtccatggagtcccattgatatacatcatctcagctgtccaaac

SEQ ID NO: 285787 - DNA, 75 bp, Artificial Sequence
  Synthetic
ttttagattcttggctgggacctacgacatgtttttctcccggattgagcatttatactcagcgatcagagtggg

SEQ ID NO: 285788 - DNA, 75 bp, Artificial Sequence
  Synthetic
caaagggctgggccatcaaagctttccagtcaagaaaaaaactatggaggggagaaggaattggcaacacttctc

SEQ ID NO: 285789 - DNA, 75 bp, Artificial Sequence
  Synthetic
tagaaacatagaagacaatcaggctcacctccagggagaacctatagaagtggacagtctccctgaggacatgag

SEQ ID NO: 285790 - DNA, 75 bp, Artificial Sequence
  Synthetic
gttgtattttgtcatcacagagaagctcctagccaattatatcttgccactttttgatgcactgactatgacaga

SEQ ID NO: 285791 - DNA, 75 bp, Artificial Sequence
  Synthetic
tcgccttaatgtcctggaatctgaggttgtattttgtcatcacagagaagctcctagccaattatatcttgccac

SEQ ID NO: 285792 - DNA, 75 bp, Artificial Sequence
  Synthetic
aagcgggggagggcaggcaccaagaggaccctcagatggatgaaggagaagatcctagcctcctgttccagtcgt

SEQ ID NO: 285793 - DNA, 75 bp, Artificial Sequence
  Synthetic
tgagtgggaagtccccttattcgtcaaatgcagttggtcatgtgttcaatctcattcactttgtcggatgttata

SEQ ID NO: 285794 - DNA, 75 bp, Artificial Sequence
  Synthetic
tgttgataagattgtatttaaagttaataattaggtggtttttttgaagtttgagattattgtggattaatatga

SEQ ID NO: 285795 - DNA, 75 bp, Artificial Sequence
  Synthetic
agtcagacaaatgaggtcaggagaaagattcctcaaaatatggtcacagaccgtggaagagattatatcctatgt

SEQ ID NO: 285796 - DNA, 75 bp, Artificial Sequence
  Synthetic
agcaagaggatgtcacgcaaagccgggtgttcagagtgggtctgctctgctcagcaggttgcagtttcgacctca

SEQ ID NO: 285797 - DNA, 75 bp, Artificial Sequence
  Synthetic
gggaggaaatgatatcgtctccagagtgatagatcttgactcaatctgggaaaaaccgtccgacttgagaaactt

SEQ ID NO: 285798 - DNA, 75 bp, Artificial Sequence
  Synthetic
ggaaggtcttcagaagataagtcaacccagaccactagtcaagagcccaagaaggagacaacatccactccttct

SEQ ID NO: 285799 - DNA, 75 bp, Artificial Sequence
  Synthetic
accaccaaggagtctcttgttataatatccccgagcgtggcagatttggacccatatgacaaatcccttcactcg

SEQ ID NO: 285800 - DNA, 75 bp, Artificial Sequence
  Synthetic
tatccccgagcgtggcagatttggacccatatgacaaatcccttcactcgagagtttttcccggcggaaagtgct

SEQ ID NO: 285801 - DNA, 75 bp, Artificial Sequence
  Synthetic
atgagacggctgaattgacaaagactgacgtggcgctggcagatgacggaacggtcaactcggatgacgaggact

SEQ ID NO: 285802 - DNA, 75 bp, Artificial Sequence
  Synthetic
atctggatgcctgagaatccaagactcgggacatcttgtgacatcttcgtcaacagcagagggaagagggcgtcc

SEQ ID NO: 285803 - DNA, 75 bp, Artificial Sequence
  Synthetic
gcttcaaaacccattgatctcaggcctgagagtggttcaatgggcgacaggggctcattacaagctcaaacccat

SEQ ID NO: 285804 - DNA, 75 bp, Artificial Sequence
  Synthetic
gtttttctggtgaaaccagaagccccgaagctgtttatgcccgaatcatgatgaatggaggtcgactaaagagat

SEQ ID NO: 285805 - DNA, 75 bp, Artificial Sequence
  Synthetic
tcgggacatcttgtgacatcttcgtcaacagcagagggaagagggcgtccaaggggggcaagacttgtgggtttg

SEQ ID NO: 285806 - DNA, 75 bp, Artificial Sequence
  Synthetic
ggtcaggtgggatatcaagagcggtactcaacatgtttccggatgccaggcttgtattcaatagcctattagaag

SEQ ID NO: 285807 - DNA, 75 bp, Artificial Sequence
  Synthetic
cgcacatacggagatatgtttcagtcagctccaatcaccaagctcgtccgaactcatttgccgagtttctaaaca

SEQ ID NO: 285808 - DNA, 75 bp, Artificial Sequence
  Synthetic
aggctattcaacacctgtcaagagcgttcccctcggtcacagggtttatcacccaagtaacttcgtctttttcat

SEQ ID NO: 285809 - DNA, 75 bp, Artificial Sequence
  Synthetic
ttgtgtggggtgcctggacttagacttatggacggaacgtgggtcgcgattcagacgtcagatgagaccaaatgg

SEQ ID NO: 285810 - DNA, 75 bp, Artificial Sequence
  Synthetic
ttatggacggaacgtgggtcgcgattcagacgtcagatgagaccaaatggtgcccccctgatcagttagtaaatc

SEQ ID NO: 285811 - DNA, 75 bp, Artificial Sequence
  Synthetic
tccaaactggggcttatcataaagaaggaagagaccatgtgtagctatgactttctcatctatggaaagacccct

SEQ ID NO: 285812 - DNA, 75 bp, Artificial Sequence
  Synthetic
gttaaggaagcaaaaaatgtgccaggcgtaacccgtttggcccatgacggatccaaactccccctaagatgtgta

SEQ ID NO: 285813 - DNA, 75 bp, Artificial Sequence
  Synthetic
gtcaagaaaagagaagagtgcctagacgcgctggagtccatcatgaccaccaagtctgtaagtttcagacgtctc

SEQ ID NO: 285814 - DNA, 75 bp, Artificial Sequence
  Synthetic
ctaagaaattccaattgttagtcgaagccaacaagctaaataaaatcatgcaagatgatttgaatcgctatgcat

SEQ ID NO: 285815 - DNA, 75 bp, Artificial Sequence
  Synthetic
agccaacaagctaaataaaatcatgcaagatgatttgaatcgctatgcatcttgctaaccgaactcttaaactca

SEQ ID NO: 285816 - DNA, 75 bp, Artificial Sequence
  Synthetic
ggtttgggaaagcatatactatattcaacaaaaccttgatggaggctgatgctcactataagtcggtccggactt

SEQ ID NO: 285817 - DNA, 75 bp, Artificial Sequence
  Synthetic
acgggcaacaccactgacaaaatgaacattctgcgtaagatagtgaaaaactgtaaggatgaggacactcaaaaa

SEQ ID NO: 285818 - DNA, 75 bp, Artificial Sequence
  Synthetic
cttgctgtttagccccatcttgaaaggcagagtttacaagatcctgagtgccgaaggggacaattttcttctagc

SEQ ID NO: 285819 - DNA, 75 bp, Artificial Sequence
  Synthetic
cagaggggaactctgtctaaagtggctatcattatagccatcatgatagttttctccaacagagtcttcaacgtt

SEQ ID NO: 285820 - DNA, 75 bp, Artificial Sequence
  Synthetic
gtgtttgagagtaggaggaagatgtcatcctcatgtgaatggggtattttttaatggtataatattgggccctga

SEQ ID NO: 285821 - DNA, 75 bp, Artificial Sequence
  Synthetic
agcgggggaaggcaagtatcgggaagactttcagatggatgaaggggaggaccctaacgtcctcttccagtcata

SEQ ID NO: 285822 - DNA, 75 bp, Artificial Sequence
  Synthetic
catcctcatgtgaatggggtattttttaatggtataatattgggccctgatggccatgttctgatcccagagatg

SEQ ID NO: 285823 - DNA, 75 bp, Artificial Sequence
  Synthetic
ccccttaatgcatccattggcagacccgtcaacagttttcaaggatggtgatgaggcggaagactttgttgaggt

SEQ ID NO: 285824 - DNA, 75 bp, Artificial Sequence
  Synthetic
ggaggaccaaatatactgcttggatatgtccaatggcccgacctgctggaatggccaagacggcgggctggaagg

SEQ ID NO: 285825 - DNA, 75 bp, Artificial Sequence
  Synthetic
ccagactactggccgagaactcaagaaggagactacatccatttcttcccagagagacagccaatcttcgaaagc

SEQ ID NO: 285826 - DNA, 75 bp, Artificial Sequence
  Synthetic
ccagctgggggaagtatgtgttgatgagtgcaggtattctgacaacactgatgttgatgatcttcttgatgactt

SEQ ID NO: 285827 - DNA, 75 bp, Artificial Sequence
  Synthetic
aaggagactacatccatttcttcccagagagacagccaatcttcgaaagccaggatggcggctcaagctgcctcc

SEQ ID NO: 285828 - DNA, 75 bp, Artificial Sequence
  Synthetic
accctcatcttccagtgggctgattccaggggccctcttgaaggggaagaactggaacactctcaggagatcact

SEQ ID NO: 285829 - DNA, 75 bp, Artificial Sequence
  Synthetic
caggttctatgtccgacatatatgctgtcccctgggctgtcgagagaggggcttctctatgaattggagagcata

SEQ ID NO: 285830 - DNA, 75 bp, Artificial Sequence
  Synthetic
gcagggaggaaagtatctgtcacctcccagaacgggagggtcatatcctcctgggagtcatataaaagcggaggt

SEQ ID NO: 285831 - DNA, 75 bp, Artificial Sequence
  Synthetic
agtggaagctgagattgctcaccaaattgctgaaagcttttccaagaaatacaagtttccctctcgatcatcagg

SEQ ID NO: 285832 - DNA, 75 bp, Artificial Sequence
  Synthetic
acaatgtcatatccaaggcagaatctggtgtatcaacacgaactcgagagcatgtcaactatggtctgacatgtc

SEQ ID NO: 285833 - DNA, 75 bp, Artificial Sequence
  Synthetic
ctgggagtcatataaaagcggaggtgaaaccaggctgtgatggcaggtcatctcttctgtacttcgggtcaggag

SEQ ID NO: 285834 - DNA, 75 bp, Artificial Sequence
  Synthetic
ttaaaaatgaacctcgatgacatagttaaagaggcaaaaaatgtgccaggtgttgcccgtctagcccatgatgga

SEQ ID NO: 285835 - DNA, 75 bp, Artificial Sequence
  Synthetic
acgtatcgaagccgctgactgaccctttattctatcctccatctgatcccaaaatcctgagacacttcaacatat

SEQ ID NO: 285836 - DNA, 75 bp, Artificial Sequence
  Synthetic
gacaaagactcctctcttcttctagaataatcagactgtatcccgcgggttcatcacttgtatacctctggaaga

SEQ ID NO: 285837 - DNA, 75 bp, Artificial Sequence
  Synthetic
acagacccataacttattatttcatgaaacaggtcattcgggggaatacttatctgtcctggagttggtccgatg

SEQ ID NO: 285838 - DNA, 75 bp, Artificial Sequence
  Synthetic
aacgggggaaagcaagtgtcaggaagactttcagatggatgaggcggaggaccccgccctattgttccagtcata

SEQ ID NO: 285839 - DNA, 75 bp, Artificial Sequence
  Synthetic
ttgcaactctagcttgagtctttcatctcactggatcaggctgatatacaaaatagtaaagaccaccagacttag

SEQ ID NO: 285840 - DNA, 75 bp, Artificial Sequence
  Synthetic
ggacatctcggatgattacctgtttgagcatggatggaggctatagtatgccccttgatacaaagctgaacagga

SEQ ID NO: 285841 - DNA, 75 bp, Artificial Sequence
  Synthetic
tgaaaaaaactattaacatccctcaaaagacttagggaaagatggttccgcaagctcttctgcttgtacccattc

SEQ ID NO: 285842 - DNA, 75 bp, Artificial Sequence
  Synthetic
aggagggggaaatcctcgaatatcagtgtctgtgctcccatcttttgatcagtcatttttttcgagaggccctct

SEQ ID NO: 285843 - DNA, 75 bp, Artificial Sequence
  Synthetic
aggctgagacttacactaactttgtcggttatgttaccaccacgttcaagagaaagcatttccgcccaacaccag

SEQ ID NO: 285844 - DNA, 75 bp, Artificial Sequence
  Synthetic
cacgatcatctcgcatcttagcaaagcgtgcataattacaaagggctgggtcatctaagcttttcagccgagaaa

SEQ ID NO: 285845 - DNA, 75 bp, Artificial Sequence
  Synthetic
ccggaatatgtcccgctgaaagaactcacaggcaagaagaacatgaggaacttttgcatcaacggagaagttaaa

SEQ ID NO: 285846 - DNA, 75 bp, Artificial Sequence
  Synthetic
tccatgtcgacccagctattccacgcctgggagaaagtcaccaatgttcatgtggtgaaaagagccctgtcactc

SEQ ID NO: 285847 - DNA, 75 bp, Artificial Sequence
  Synthetic
aatatcaggacaaaacaccggtaactataagacaaacattgcagataggatagagcagatttttgagacagcccc

SEQ ID NO: 285848 - DNA, 75 bp, Artificial Sequence
  Synthetic
gcgtgcataattacaaagggctgggtcatctaagcttttcagccgagaaaaaaactgcaggacataaggccagct

SEQ ID NO: 285849 - DNA, 75 bp, Artificial Sequence
  Synthetic
agtctacgatgaccctgttgatccgattgagtcagaggctgagcctagaggaacctccactgtacctaacatatt

SEQ ID NO: 285850 - DNA, 75 bp, Artificial Sequence
  Synthetic
aggagcccccgtcccagagggcatgaactgggtatacaaattgaggagaacccttatcttccagtgggccgactc

SEQ ID NO: 285851 - DNA, 75 bp, Artificial Sequence
  Synthetic
aaggaactccgactataatctcaactctcctttgatagaggatcctgccatactaatgttagaatggttaaaaac

SEQ ID NO: 285852 - DNA, 75 bp, Artificial Sequence
  Synthetic
ctgacagataactgctctagatcttataaggttctgaaagattacttcaagaaggttgatctgggcgctctcaaa

SEQ ID NO: 285853 - DNA, 75 bp, Artificial Sequence
  Synthetic
ttggaatactctcaagaaatcacttgggatgacgacaccgaatttgttggattgcaaataagagtaagtgcaaga

SEQ ID NO: 285854 - DNA, 75 bp, Artificial Sequence
  Synthetic
ataaggttctgaaagattacttcaagaaggttgatctgggcgctctcaaagtgggcggaactgcagcacaatcta

SEQ ID NO: 285855 - DNA, 75 bp, Artificial Sequence
  Synthetic
aggtgcataactgacctggcccacttctattctaaatcttcccccatagagaagctgctaaactgtacgcttgga

SEQ ID NO: 285856 - DNA, 75 bp, Artificial Sequence
  Synthetic
actgctcaactaaccacgattacaccgtttggatgcctgaaattctgagactagggacatcttgtgacattttta

SEQ ID NO: 285857 - DNA, 75 bp, Artificial Sequence
  Synthetic
ctagggacatcttgtgacatttttaccaatagtagagggaagagagcatccaaggggagcaagacctgtggcttt

SEQ ID NO: 285858 - DNA, 75 bp, Artificial Sequence
  Synthetic
tctattctaaatcttcccccatagagaagctgctaaactgtacgcttggaaacagaggactgaggatcccctcgg

SEQ ID NO: 285859 - DNA, 75 bp, Artificial Sequence
  Synthetic
gtagatgaaagaggcctatataagtctctaaaaggcgcatgcaaactcaagttgtgtggagttcttggacttaga

SEQ ID NO: 285860 - DNA, 75 bp, Artificial Sequence
  Synthetic
aggtatttagccaatacatattcttcttacttgttcttccatgtaatcaccctatacatgaatgccttagactgg

SEQ ID NO: 285861 - DNA, 75 bp, Artificial Sequence
  Synthetic
cttacttgttcttccatgtaatcaccctatacatgaatgccttagactgggatgaggaaaagaccattctggcat

SEQ ID NO: 285862 - DNA, 75 bp, Artificial Sequence
  Synthetic
cttatggacggaacatgggtcgcgatgcagacatcaaatgagaccaaatggtgtcctcccgatcagttggttaat

SEQ ID NO: 285863 - DNA, 75 bp, Artificial Sequence
  Synthetic
aaagatcagatatgggggctattaatcgtgacaaaagactttgtatactctcaaagttctaattgtctttttgac

SEQ ID NO: 285864 - DNA, 75 bp, Artificial Sequence
  Synthetic
tcgtgacaaaagactttgtatactctcaaagttctaattgtctttttgaccggaactatacgcttatgttgaaag

SEQ ID NO: 285865 - DNA, 75 bp, Artificial Sequence
  Synthetic
tcctacatggaacttaaagtgggatacatttcggccataaaagtgaacgggttcacgtgcacaggtgtggtgaca

SEQ ID NO: 285866 - DNA, 75 bp, Artificial Sequence
  Synthetic
gaaccccgatattcagacgatttgatatctcagctgtgccagttgtacattgcaggggatcaggtcttgtccatg

SEQ ID NO: 285867 - DNA, 75 bp, Artificial Sequence
  Synthetic
tatctcagctgtgccagttgtacattgcaggggatcaggtcttgtccatgtgcggaaactcgggttatgaggtca

SEQ ID NO: 285868 - DNA, 75 bp, Artificial Sequence
  Synthetic
gctatctccaacacgtgttgcgctacgaacgagaggcaatcacagcatctccagagaatgactggttgtggatct

SEQ ID NO: 285869 - DNA, 75 bp, Artificial Sequence
  Synthetic
catcatatccccaagtgtagcggacctggacccatacgataaatcccttcactctagagtctttcctaacggaaa

SEQ ID NO: 285870 - DNA, 75 bp, Artificial Sequence
  Synthetic
caacatacacgacttggtttttgtatacggctgctacaggcattggggacatccttatatagattacaggaaagg

SEQ ID NO: 285871 - DNA, 75 bp, Artificial Sequence
  Synthetic
aaaaaaactaacacccctccttttgaaccatctcagacatgagcaagatctttgtcaacccaagtgcaatcaggg

SEQ ID NO: 285872 - DNA, 75 bp, Artificial Sequence
  Synthetic
acctactgccctaccaaccatgattacactatctggctccctgagaatccaagactggggacatcttgtgacatc

SEQ ID NO: 285873 - DNA, 75 bp, Artificial Sequence
  Synthetic
cttaccaggaatgtttggcaagcgacctggccagaaggatccttcggtggggatttgacaagtactccaagtggt

SEQ ID NO: 285874 - DNA, 75 bp, Artificial Sequence
  Synthetic
cctggccagaaggatccttcggtggggatttgacaagtactccaagtggtatcttgactcgcgacttcttgctag

SEQ ID NO: 285875 - DNA, 75 bp, Artificial Sequence
  Synthetic
taagtgcagggaccttgattgccttgatgttgataattttcctaatgacatgttgtagaaaagtcgatcggccag

SEQ ID NO: 285876 - DNA, 75 bp, Artificial Sequence
  Synthetic
tcccaaagcgggaaattcataccttcatgggagtcgtataaaagtgggggtgagactggactgtgaagatttgtc

SEQ ID NO: 285877 - DNA, 75 bp, Artificial Sequence
  Synthetic
aagtcattgaaaggggcatgcaaacttaagttgtgtggggtccttggacttagacttatggatggaacgtgggtc

SEQ ID NO: 285878 - DNA, 75 bp, Artificial Sequence
  Synthetic
acatagtagatctggtaggggatacgtggcacaagcttccgattacacagatatttgagatccctgaatccatgg

SEQ ID NO: 285879 - DNA, 75 bp, Artificial Sequence
  Synthetic
gggaatctctgagttcaatagtcctccttgaactccattcaacagggtggattcaaaagtcatgagactttcatt

SEQ ID NO: 285880 - DNA, 75 bp, Artificial Sequence
  Synthetic
tgcaagaggagtcttaatagggtcctcaatttgcttcttgactagaatgaccaacatcaacatcaataggcctct

SEQ ID NO: 285881 - DNA, 75 bp, Artificial Sequence
  Synthetic
ctggcctcctggctgtctgagaacagaggagggcctgttcctagcgaaaaggtcattatcacggctctgtccaaa

SEQ ID NO: 285882 - DNA, 75 bp, Artificial Sequence
  Synthetic
aatcatctcagttgatcaaacaaggtcatgtagattctcataattcgggaaatcttctagtagtttcagtgaccg

SEQ ID NO: 285883 - DNA, 75 bp, Artificial Sequence
  Synthetic
gggatggatcaggggggatatcaagagcggtacttaacatgtttccggatgccaggcttgtattcaatagcttgt

SEQ ID NO: 285884 - DNA, 75 bp, Artificial Sequence
  Synthetic
ggtcattatcacggctctgtccaaaccacctgtcaatcccagagagtttctaaagtctattgacctcggaggatt

SEQ ID NO: 285885 - DNA, 75 bp, Artificial Sequence
  Synthetic
gaggagggcctgttcctagcgaaaaggtcattatcacggctctgtccaaaccacctgtcaatcccagagagtttc

SEQ ID NO: 285886 - DNA, 75 bp, Artificial Sequence
  Synthetic
agaggtatttctgatgactccgtgcgtgggcccggacagaggtcatagtacgtcccatgatagcggactcagcat

SEQ ID NO: 285887 - DNA, 75 bp, Artificial Sequence
  Synthetic
gcaatcatgagcggaggagatgacatcatctccagggtaattgattttgactccatctgggagaaaccttctgac

SEQ ID NO: 285888 - DNA, 75 bp, Artificial Sequence
  Synthetic
tgcactaactatgaccgataacctgaacaaggtgttcaaaaagttgattgatagagttactggtcaagggctttt

SEQ ID NO: 285889 - DNA, 75 bp, Artificial Sequence
  Synthetic
ctcacaatcatcttgcatctcagcgaagtgtgcataattataaaggggctagatcatctaagcttttcagttgag

SEQ ID NO: 285890 - DNA, 75 bp, Artificial Sequence
  Synthetic
gtttttcaacggtataatcctgggtcctgacggccatgttctaatcccagagatgcaatcgtccctccttcagca

SEQ ID NO: 285891 - DNA, 75 bp, Artificial Sequence
  Synthetic
caggaataacggtgtcttctacctactgctcaactaaccatgattacaccatttggatgcctgagaatccgagac

SEQ ID NO: 285892 - DNA, 75 bp, Artificial Sequence
  Synthetic
aatgtctgattttgcattgtccatagatggcccactttacctggtcttcaaaacttatggtaccatgcttgtaaa

SEQ ID NO: 285893 - DNA, 75 bp, Artificial Sequence
  Synthetic
acatatggagttgttggaatcctcagttatccccctgatgcaccctttagcagacccgtctacagttttcaagga

SEQ ID NO: 285894 - DNA, 75 bp, Artificial Sequence
  Synthetic
aaaaaaactgtagatcgagatagcaactggcaacacctctcatcctgaaacctacatcaagatgctagacccagg

SEQ ID NO: 285895 - DNA, 75 bp, Artificial Sequence
  Synthetic
aacaaggtgttcaaaaagttgattgatagagttactggtcaagggcttttggattattcgagagttacttatgct

SEQ ID NO: 285896 - DNA, 75 bp, Artificial Sequence
  Synthetic
caggtgtttggattgaaacgggtgttttctagaactcatgagttttttcaaaagtcgtggatctattattcagac

SEQ ID NO: 285897 - DNA, 75 bp, Artificial Sequence
  Synthetic
gttatccccctgatgcaccctttagcagacccgtctacagttttcaaggatggtgatgaagcagagaattttgtg

SEQ ID NO: 285898 - DNA, 75 bp, Artificial Sequence
  Synthetic
catggaccctgtgccactggatagacttaagagtgaagaaactttcattaatcatctcaactaattaagcacagt

SEQ ID NO: 285899 - DNA, 75 bp, Artificial Sequence
  Synthetic
aactccccaaagcggaaaggttatatcttcatgggagtcatacaaaagcggaggtgggaccagactgtgaaggca

SEQ ID NO: 285900 - DNA, 75 bp, Artificial Sequence
  Synthetic
tcccagactaggaacacaagaaccaagatactggctcaaggagacaatcaggttctatgtccgacatatatgttg

SEQ ID NO: 285901 - DNA, 75 bp, Artificial Sequence
  Synthetic
tcttcatgggagtcatacaaaagcggaggtgggaccagactgtgaaggcagatcattccctccaagctttaagtc

SEQ ID NO: 285902 - DNA, 75 bp, Artificial Sequence
  Synthetic
ttctggatgatctcaatgtttttccatccttatgtcttgtggtcggagacgggtcagggggaatatcgcgagcag

SEQ ID NO: 285903 - DNA, 75 bp, Artificial Sequence
  Synthetic
cctccttaaactccgtgcaacagggtaaattcaagagtcacgagactttcattaatcatctccgttgatcaaaca

SEQ ID NO: 285904 - DNA, 75 bp, Artificial Sequence
  Synthetic
ttctctatgaattagagagtatatcgagaaatgcgctctccatatatcgagctattgaggaaggagcgtccaaac

SEQ ID NO: 285905 - DNA, 75 bp, Artificial Sequence
  Synthetic
gctattgaggaaggagcgtccaaactgggattaatcatcaagaaggaggagaccatgtgtagctatgacttcctt

SEQ ID NO: 285906 - DNA, 75 bp, Artificial Sequence
  Synthetic
gtgaatgacctgatggcatccggaacacatccattgcctccctcagcaatcatgagtggaggagatgaaattgtc

SEQ ID NO: 285907 - DNA, 75 bp, Artificial Sequence
  Synthetic
agaaatcttctagtagtttcagtgactaacggtgctttcatcctccagggatcgataccaaaggttgcggacggg

SEQ ID NO: 285908 - DNA, 75 bp, Artificial Sequence
  Synthetic
atcgataccaaaggttgcggacgggtcaagggttacttcagatgactccgtgctagggcgtggagagaggttata

SEQ ID NO: 285909 - DNA, 75 bp, Artificial Sequence
  Synthetic
taccaacgctttaactgtagctcaacactcccaatctttgatcaagccgatgagggacttcttgttgatgtcagt

SEQ ID NO: 285910 - DNA, 75 bp, Artificial Sequence
  Synthetic
acagggaggaaggtgtcggtcacctcccaaagcgggaaggtcatatcttcatgggagtcatataaaagtgggggt

SEQ ID NO: 285911 - DNA, 75 bp, Artificial Sequence
  Synthetic
catgagtagatagagcagggcgatttgcccctcatgaaggacataagcaatagcttacaatcatcctgcatctca

SEQ ID NO: 285912 - DNA, 75 bp, Artificial Sequence
  Synthetic
ctctcatctcactggatcaggctgatctacaaaatagtgaagaccaccagacttgtcggaaggatagaagacctg

SEQ ID NO: 285913 - DNA, 75 bp, Artificial Sequence
  Synthetic
tatataagatcttaagtgctgaaggagacaattttctcctagctatgtcgagaataatctatctagacccttctt

SEQ ID NO: 285914 - DNA, 75 bp, Artificial Sequence
  Synthetic
ctgacttcgcattgtccatagatggcccgctttatctggttttcaaaacttatggaaccaagctggtaaatccag

SEQ ID NO: 285915 - DNA, 75 bp, Artificial Sequence
  Synthetic
agacaattttctcctagctatgtcgagaataatctatctagacccttctttgggaggagtgtctggaatgtctct

SEQ ID NO: 285916 - DNA, 75 bp, Artificial Sequence
  Synthetic
cctcaattgtttacctctggaggagagagcacatgggcttgactccaaccttcaggagcaatagaacaaaaatat

SEQ ID NO: 285917 - DNA, 75 bp, Artificial Sequence
  Synthetic
ggagaggtctatgatgaccccgttgatccgattgagtcagaggctgagcctagaggggctccaactgtccccaac

SEQ ID NO: 285918 - DNA, 75 bp, Artificial Sequence
  Synthetic
ccttctggagagagatttggctgagttccaatgaatcctggattcatgcactttgtcaagaagcagggaacccgg

SEQ ID NO: 285919 - DNA, 75 bp, Artificial Sequence
  Synthetic
gttatggtgccgttgaatcgctgcattttatcagagtcaaatctattacctttacattttaagcttctcggatgt

SEQ ID NO: 285920 - DNA, 75 bp, Artificial Sequence
  Synthetic
tcaattctcctttaatagaggatcctgccagactaatgttagagtggctaaaaacaggaaatagaccttaccgga

SEQ ID NO: 285921 - DNA, 75 bp, Artificial Sequence
  Synthetic
ctgaaaaaaacaagatcctgattcataacctctgtttgcttgattgtttttccatctttattgtttttttgttaa

SEQ ID NO: 285922 - DNA, 75 bp, Artificial Sequence
  Synthetic
acgcttaacaacaaaatcagagaagaagcagacagcatcagttgcaaagcaaatatgtaacacccctacaatgga

SEQ ID NO: 285923 - DNA, 75 bp, Artificial Sequence
  Synthetic
ttccaatgaatcctggattcatgcactttgtcaagaagcagggaacccggatctcggagagagaacacttgagag

SEQ ID NO: 285924 - DNA, 75 bp, Artificial Sequence
  Synthetic
ctagccccaccatcttactcaaggatgctatcaggaaagcattgtacgatgaggtggacaaggtggaaaactctg

SEQ ID NO: 285925 - DNA, 75 bp, Artificial Sequence
  Synthetic
ttcaagaaagtggatttgggttctctcaaagtgggtggaactgctgcacagtcaatgatttccctctggttatat

SEQ ID NO: 285926 - DNA, 75 bp, Artificial Sequence
  Synthetic
tgctatcaggaaagcattgtacgatgaggtggacaaggtggaaaactctgaatttagagaggcaatcctcttgtc

SEQ ID NO: 285927 - DNA, 75 bp, Artificial Sequence
  Synthetic
ctgagattatcgtggatcaatatgagtacaaataccctgctatcaaagacctgaaaaagccctgcataaccctag

SEQ ID NO: 285928 - DNA, 75 bp, Artificial Sequence
  Synthetic
ggttttttaaagttctggatcaattcgacaacatacatgatttggttttcgtgtatggttgttacaggcattggg

SEQ ID NO: 285929 - DNA, 75 bp, Artificial Sequence
  Synthetic
tgtttccccgatttctcagcgagcttttcagttcttccttcttggggattcctgaatcaatcatcggattgatac

SEQ ID NO: 285930 - DNA, 75 bp, Artificial Sequence
  Synthetic
ccatttctattccaagtcgtcccccatagagaagctgttgaattgtacacttggaaatagagggctgaggatccc

SEQ ID NO: 285931 - DNA, 75 bp, Artificial Sequence
  Synthetic
aatgctgccaaacttgatcctgatgatgtatgctcctacttggcggctgcaatgcagttctttgagggaacatgt

SEQ ID NO: 285932 - DNA, 75 bp, Artificial Sequence
  Synthetic
cttgtaccggtgttgtgacagaagccgagacctacaccaactttgttggttatgtcaccaccacattcaagagaa

SEQ ID NO: 285933 - DNA, 75 bp, Artificial Sequence
  Synthetic
cgacctagccaggaggatccttagatggggatttgataagtactctaagtggtatctggattctcgattcctcgc

SEQ ID NO: 285934 - DNA, 75 bp, Artificial Sequence
  Synthetic
ttgggagatatctggccaacacgtattcctcttatttgtttttccacgttatcactctgtacatgaatgccttag

SEQ ID NO: 285935 - DNA, 75 bp, Artificial Sequence
  Synthetic
tcctgattgcgcgaaaaggagacaagatcactcctgattctctagtggagataaagcggactgatgtggagggga

SEQ ID NO: 285936 - DNA, 75 bp, Artificial Sequence
  Synthetic
atgcagagctgcatacaactggaagatggccggtgatcctagatatgaagagtctcttcaaaatccttatcctga

SEQ ID NO: 285937 - DNA, 75 bp, Artificial Sequence
  Synthetic
cctgaatcaatcatcggattgatacagaattcccggacgataagaagacagtttaggaagagtctctcgaggacc

SEQ ID NO: 285938 - DNA, 75 bp, Artificial Sequence
  Synthetic
ggcattatggagagagttgacctcagtggatatcgggaaggacttggtcaagttcaaagatcaaatatggggact

SEQ ID NO: 285939 - DNA, 75 bp, Artificial Sequence
  Synthetic
cagacctcctaagggagatctcctgggggaggaaagtggtaggtacaacggttccccacccttctgaaatgttgg

SEQ ID NO: 285940 - DNA, 75 bp, Artificial Sequence
  Synthetic
tattctcagagttctaactgccttttcgacagaaactacacacttatgctaaaagacctttttttgtctcgattc

SEQ ID NO: 285941 - DNA, 75 bp, Artificial Sequence
  Synthetic
gaacaatcatcagaggctggaatcaacagaggatgtattttctgtacttgatcaagtgtttggattgaaaagggt

SEQ ID NO: 285942 - DNA, 75 bp, Artificial Sequence
  Synthetic
tacttgggttcgtctacctctatgtcaacccagctgtttcatgcttgggaaaaagtcaccaatgttcatgtggta

SEQ ID NO: 285943 - DNA, 75 bp, Artificial Sequence
  Synthetic
caacccagctgtttcatgcttgggaaaaagtcaccaatgttcatgtggtaaaaagagctttgtcgctaaaagaat

SEQ ID NO: 285944 - DNA, 75 bp, Artificial Sequence
  Synthetic
tctaatgtcatggaatctaagattgtattttgttatcaccgaaaagctcttggctaactacatcttgccactttt

SEQ ID NO: 285945 - DNA, 75 bp, Artificial Sequence
  Synthetic
cgcgggggatcaagtcttgtccatgtgtggaaactccggctatgaagtcatcaaaatattggagccatatgtcgt

SEQ ID NO: 285946 - DNA, 75 bp, Artificial Sequence
  Synthetic
cttgatatcccagctgtgccaactatacatagctggagatcaagtcctgtccatgtgcggaaactctggttatga

SEQ ID NO: 285947 - DNA, 75 bp, Artificial Sequence
  Synthetic
agggatatttgaaagaagattttttagagatgagaaagaattttaagaatatgaggtggttgaattgataaagat

SEQ ID NO: 285948 - DNA, 75 bp, Artificial Sequence
  Synthetic
agaaacattgtgtccctgacaggtcctgatttccctctggaagaagccccagttttcaaaagaacagggtcggcc

SEQ ID NO: 285949 - DNA, 75 bp, Artificial Sequence
  Synthetic
agttttcaaaagaacagggtcggccttacacaggttcaagtccgccaggtatagcgagggagggtattcttctgt

SEQ ID NO: 285950 - DNA, 75 bp, Artificial Sequence
  Synthetic
acatacatcatctcagctgtcctaataacttggttgtagaggacgaggggtgcactagcttgtcagggttttctt

SEQ ID NO: 285951 - DNA, 75 bp, Artificial Sequence
  Synthetic
ttgtgtatggctgttacaggcattggggccatccctatatagattacagaaagggtctgtcgaaactgtatgatc

SEQ ID NO: 285952 - DNA, 75 bp, Artificial Sequence
  Synthetic
atttgacccaagacggtaaaaactacgactttatgttccagccactgatgctttatgctcagacttggacatcag

SEQ ID NO: 285953 - DNA, 75 bp, Artificial Sequence
  Synthetic
ggtgctctcatccctcaaggactgataccaaaggtggtggacagaccaactgccatctcaaacaactctatgatt

SEQ ID NO: 285954 - DNA, 75 bp, Artificial Sequence
  Synthetic
ctttatgctcagacttggacatcagagctggtacaaagagacacaaggttgaaagactctacgtttcattggcat

SEQ ID NO: 285955 - DNA, 75 bp, Artificial Sequence
  Synthetic
agcgacctagccagaaggatcctcaggtgggggttcgacaagtactctaaatggtatctcgattcgagatttctc

SEQ ID NO: 285956 - DNA, 75 bp, Artificial Sequence
  Synthetic
catgagatgtctgttctagggggatatttgggagaggaattcttcgggaaaggtacatttgaaagaaggttcttc

SEQ ID NO: 285957 - DNA, 75 bp, Artificial Sequence
  Synthetic
ggtgggggttcgacaagtactctaaatggtatctcgattcgagatttctcagccgagatcaccccttgactccct

SEQ ID NO: 285958 - DNA, 75 bp, Artificial Sequence
  Synthetic
ccaggtgactttgaatctctaagtggtagagaaaagtctcgccacatagggtcggctcaggggctcttatattca

SEQ ID NO: 285959 - DNA, 75 bp, Artificial Sequence
  Synthetic
ggctcctctatgagttggagagcatatcaaggaatgcactttcaatataccgagccatcgaggaaggggcatcta

SEQ ID NO: 285960 - DNA, 75 bp, Artificial Sequence
  Synthetic
gtcggctcaggggctcttatattcaattttggtggcaattcatgactcaggatataatgatggaaccatctttcc

SEQ ID NO: 285961 - DNA, 75 bp, Artificial Sequence
  Synthetic
gagtgcaggtgctctagcaacactaatactgactatcttcctagtgacatgttgcagaagagttgatagaacaag

SEQ ID NO: 285962 - DNA, 75 bp, Artificial Sequence
  Synthetic
actgtcaactccgacgacgaggattacttctccggtgaggccagaagtccagaagctgtctatgctcgaatcatg

SEQ ID NO: 285963 - DNA, 75 bp, Artificial Sequence
  Synthetic
cagttccaatcatcaagcccgtccgaactcatttgctgagtttctaaacaagacgtattctagtgattcataagg

SEQ ID NO: 285964 - DNA, 75 bp, Artificial Sequence
  Synthetic
ctaagccacccgtcaaccccagagaatttttaaagtctatcgatctcggagggttgcctgatgaggacttgataa

SEQ ID NO: 285965 - DNA, 75 bp, Artificial Sequence
  Synthetic
aactcatttgctgagtttctaaacaagacgtattctagtgattcataaggagttgaatgacaaggtgccaaggat

SEQ ID NO: 285966 - DNA, 75 bp, Artificial Sequence
  Synthetic
gggttgcctgatgaggacttgataattggtcttaaaccaaaggaaagagaactaaaaattgagggtcgatttttt

SEQ ID NO: 285967 - DNA, 75 bp, Artificial Sequence
  Synthetic
atctaaaagatgggccagagtctcctgcatctctaacgaccaaatagtcaacctcgccaatataatgtcgacagt

SEQ ID NO: 285968 - DNA, 75 bp, Artificial Sequence
  Synthetic
gatttgcttcttaacaagaatgacaaacatcaacatcaacagacctctcgaattgatctcgggggtgatctcata

SEQ ID NO: 285969 - DNA, 75 bp, Artificial Sequence
  Synthetic
atggactccgtgcaacagagtgaaatcaagagtcgagaaactttcattaatcatctcaactgatcatacacagtc

SEQ ID NO: 285970 - DNA, 75 bp, Artificial Sequence
  Synthetic
caacactctcaatctctgatcaagccgatgagggattttctgctcatgtcagtacaggcagtcttccactacctg

SEQ ID NO: 285971 - DNA, 75 bp, Artificial Sequence
  Synthetic
agccatctcttagaggagagatcttttctatcccccagaaaatcccagctgcatatccaactacaatgaaggagg

SEQ ID NO: 285972 - DNA, 75 bp, Artificial Sequence
  Synthetic
tttgtcaatccgagtgcaatcagagccggtctggccgatcttgagatggccgaagagactgttgatctgatcaac

SEQ ID NO: 285973 - DNA, 75 bp, Artificial Sequence
  Synthetic
atttgaacaaggtgtttaaaaagttgattgacagagttactggacaaggacttttagactactcgagggttacat

SEQ ID NO: 285974 - DNA, 75 bp, Artificial Sequence
  Synthetic
ttctatcccccagaaaatcccagctgcatatccaactacaatgaaggagggcaatagatctattctttgctacct

SEQ ID NO: 285975 - DNA, 75 bp, Artificial Sequence
  Synthetic
ggggaaatcctcgaatatcagtgtccgtgcttccatcttttgaccagtcatttttctcaagaggccccctgaagg

SEQ ID NO: 285976 - DNA, 75 bp, Artificial Sequence
  Synthetic
tatcagaggttgtggacaagccaactgatatcttagataactctacgcttgagcttgagcagaggccatagcaag

SEQ ID NO: 285977 - DNA, 75 bp, Artificial Sequence
  Synthetic
acgactggttgtggatcttctcggacttcagaagctccaaaatgacatacctgactctcatcacttatcagtctc

SEQ ID NO: 285978 - DNA, 75 bp, Artificial Sequence
  Synthetic
ttccactacattagaccaaatgggatttagttgagagaagtgatttgcctcctatgaaggacataagcaataggt

SEQ ID NO: 285979 - DNA, 75 bp, Artificial Sequence
  Synthetic
ctgactctcatcacttatcagtctcatcttttgcttcaaaggattgaaagaaatctgtccaagagtatgaggtca

SEQ ID NO: 285980 - DNA, 75 bp, Artificial Sequence
  Synthetic
ccagtcccaccattctactaaaggatgcaatcagaaaggctttgtatgacgaggtggacaaggtggaaaattcag

SEQ ID NO: 285981 - DNA, 75 bp, Artificial Sequence
  Synthetic
gattcctcaagatatggtcacaaactgtagaggagatcatatcctatgtcacggtcaactttcctaaccctccag

SEQ ID NO: 285982 - DNA, 75 bp, Artificial Sequence
  Synthetic
tgaggactccttagactcagacgaagacatccaaagactgttaaaagactcactgcgaagaactaggtgggtaga

SEQ ID NO: 285983 - DNA, 75 bp, Artificial Sequence
  Synthetic
atgggaggatcagatatattgcttagatatgtccaacggtccgacctgttggaatggtcaagacggtgggctaga

SEQ ID NO: 285984 - DNA, 75 bp, Artificial Sequence
  Synthetic
cctgagtcaatcattggattgatacaaaactcccggacgataagaaggcagtttagaaaaagtctctcaagaact

SEQ ID NO: 285985 - DNA, 75 bp, Artificial Sequence
  Synthetic
gacatccaaagactgttaaaagactcactgcgaagaactaggtgggtagatcaagaagtccgccatgcagctaga

SEQ ID NO: 285986 - DNA, 75 bp, Artificial Sequence
  Synthetic
tgtagaggagatcatatcctatgtcacggtcaactttcctaaccctccaggaagttcttcagaagataaatcaac

SEQ ID NO: 285987 - DNA, 75 bp, Artificial Sequence
  Synthetic
agagagaaagccaaccctcgaaagccaagatggtggcccaagttgcctctggtcctcccgcccttgaatggtctg

SEQ ID NO: 285988 - DNA, 75 bp, Artificial Sequence
  Synthetic
atgttcagagtgggtctgctccgctcagcaagttgccgtctcaacctcagccaacccggccccggtttccgagct

SEQ ID NO: 285989 - DNA, 75 bp, Artificial Sequence
  Synthetic
cagcaagttgccgtctcaacctcagccaacccggccccggtttccgagctggacataagggccctctccaagagg

SEQ ID NO: 285990 - DNA, 75 bp, Artificial Sequence
  Synthetic
cttgtactggtgtcgtgacagaagccgagacctacaccaactttgttggttatgtcaccaccacattcaagagaa

SEQ ID NO: 285991 - DNA, 75 bp, Artificial Sequence
  Synthetic
caagatggtggcccaagttgcctctggtcctcccgcccttgaatggtctgccaccaatgaggaggataatctatc

SEQ ID NO: 285992 - DNA, 75 bp, Artificial Sequence
  Synthetic
cctaccaccttaaatataaagggaggtgccagtcctaccattctactaaaggatgcaatcagaaaggctttgtat

SEQ ID NO: 285993 - DNA, 75 bp, Artificial Sequence
  Synthetic
aagtgtataaccgacttggctcagttctattccaagtcttcccccatagaaaaactgttaaactacacactcgga

SEQ ID NO: 285994 - DNA, 75 bp, Artificial Sequence
  Synthetic
cgcccattacaagcttaaacctattctggatgatctcaatgttttcccgtccctgtgtctcgtggttggagatgg

SEQ ID NO: 285995 - DNA, 75 bp, Artificial Sequence
  Synthetic
ctggatgatctcaatgttttcccgtccctgtgtctcgtggttggagatggatcggggggaatatcaagagcagta

SEQ ID NO: 285996 - DNA, 75 bp, Artificial Sequence
  Synthetic
tccaaaatccctctaagatgtgtactgggatgggtcgctttggccaattctaagaaattccaattattagtcgag

SEQ ID NO: 285997 - DNA, 75 bp, Artificial Sequence
  Synthetic
acagcgaaggagggtattcttctgtttgccccaacctcctctctcatatctctgttagtacagacactatgtctg

SEQ ID NO: 285998 - DNA, 75 bp, Artificial Sequence
  Synthetic
taagaaattccaattattagtcgaggccgacaagctaagtaaaattatgcaagatgatttgaatcgctatacatc

SEQ ID NO: 285999 - DNA, 75 bp, Artificial Sequence
  Synthetic
cttgcatctctaatgatcaaatagtcaacctagccaatataatgtcgacagtatccaccaatgcgctgacagtag

SEQ ID NO: 286000 - DNA, 75 bp, Artificial Sequence
  Synthetic
ttcttgcacttgtggagcaacaggaggaggcaatcctagagtttctgtatcagtactcccgtccttcgatcagtc

SEQ ID NO: 286001 - DNA, 75 bp, Artificial Sequence
  Synthetic
tcagtacaggcagtctttcactacctgttatttagcccaatcttaaaaggcagagtttacaagattctaagtgct

SEQ ID NO: 286002 - DNA, 75 bp, Artificial Sequence
  Synthetic
tccctctagacaacaaaaactgagatgtcctgaagtcgacatgaaaaaaacaggcaacaccactgataaaatgaa

SEQ ID NO: 286003 - DNA, 75 bp, Artificial Sequence
  Synthetic
gagtctctctaaaagtatgagggccaacttacgacagatgagctctctcatgagacaggtattgggcgggcatgg

SEQ ID NO: 286004 - DNA, 75 bp, Artificial Sequence
  Synthetic
tcaaagttctggctgtctctttgatagaaactatacacttatgctgaaagacctctttttgtctcggttcaactc

SEQ ID NO: 286005 - DNA, 75 bp, Artificial Sequence
  Synthetic
cagaagtcaccgacattgcatcaattaaccggataaccttgttgatgtctgatttcgcattgtctatagatggtc

SEQ ID NO: 286006 - DNA, 75 bp, Artificial Sequence
  Synthetic
tacagagcaattcaacacttgtctagggcattcccctcagtcacaggatttataactcaaatgacttcatctttc

SEQ ID NO: 286007 - DNA, 75 bp, Artificial Sequence
  Synthetic
gggcattcccctcagtcacaggatttataactcaaatgacttcatctttctcatccgagttatacctcagattct

SEQ ID NO: 286008 - DNA, 75 bp, Artificial Sequence
  Synthetic
cctgagagtggttcaatgggcgacaggggcccattacaagctcaaacctattctggatgatctcaatgtcttccc

SEQ ID NO: 286009 - DNA, 75 bp, Artificial Sequence
  Synthetic
cttcgagagatgagtcttgtgttgttcaattgtagcagccccaagagtgaaatgcagagagcccgttctctaaat

SEQ ID NO: 286010 - DNA, 75 bp, Artificial Sequence
  Synthetic
ctcagagtttagagaggcaatcctgttgtccaaggctcatagagataactttatacttttcttgaaatccgttga

SEQ ID NO: 286011 - DNA, 75 bp, Artificial Sequence
  Synthetic
tcaagaggtgcgccatgcagctagaaccatgactggagattacagccccaacaagaaagtgtctcgtaaggcagg

SEQ ID NO: 286012 - DNA, 75 bp, Artificial Sequence
  Synthetic
tatcaagatcttgtaagagggtttccagaagaaattatatccaatccttacaacgagatgatcattactctaatt

SEQ ID NO: 286013 - DNA, 75 bp, Artificial Sequence
  Synthetic
aactgggtatacaaattgaggagaacccttatcttccagtgggccgattccaggggccctcttgagggggaggaa

SEQ ID NO: 286014 - DNA, 75 bp, Artificial Sequence
  Synthetic
atgctttatgcgcagacatggacatcagagctagtacagagagacacaaggctgagagactccacatttcattgg

SEQ ID NO: 286015 - DNA, 75 bp, Artificial Sequence
  Synthetic
ggatccctgagtctatcattggactgatacagaactctcggacaataagaaggcagtttcgaaggagtctgtcaa

SEQ ID NO: 286016 - DNA, 75 bp, Artificial Sequence
  Synthetic
gacttctcagatcttcgagtttccagatgtgtcaaaaaggatatccagaatggtttccggggctgtgcctcactt

SEQ ID NO: 286017 - DNA, 75 bp, Artificial Sequence
  Synthetic
ctcagagattcatgggattaatcgaatgactcagacaccgcaaagggtcgggagggtgtggccctgctcctctga

SEQ ID NO: 286018 - DNA, 75 bp, Artificial Sequence
  Synthetic
tgtctctaagccattgactgaccctttgttctacccgccatcagatcccaaaatcttaagacacttcaacatatg

SEQ ID NO: 286019 - DNA, 75 bp, Artificial Sequence
  Synthetic
agaacatacgggcttaactccaacccttgggagcaatagaacaaaaaacatgttatggtgccattaaaccgctgc

SEQ ID NO: 286020 - DNA, 75 bp, Artificial Sequence
  Synthetic
tatggtaccatgcttgtaaatccggactacagagcaattcaacacctgtccagagcatttcccgcggtcacggga

SEQ ID NO: 286021 - DNA, 75 bp, Artificial Sequence
  Synthetic
ttgcgagacttcatgacctgtacaacagacccataacttattacttcaggaagcaagttatccgagggagcattt

SEQ ID NO: 286022 - DNA, 75 bp, Artificial Sequence
  Synthetic
gttggggttacttcccaagtcttccatttcttgctcttgtggagcaacaggaggaggcaaccctagagtttcggt

SEQ ID NO: 286023 - DNA, 75 bp, Artificial Sequence
  Synthetic
gaggagggccggtccccagcgagaaggtcattattacggctctttccaaacctcctgtcaaccccagagaattct

SEQ ID NO: 286024 - DNA, 75 bp, Artificial Sequence
  Synthetic
ggtcattattacggctctttccaaacctcctgtcaaccccagagaattcttgaaatctatagaccttggaggatt

SEQ ID NO: 286025 - DNA, 75 bp, Artificial Sequence
  Synthetic
cacttcagtgtttaaaagggtggcctgtaactctagtttgagtctgtcatctcattggattagattaatttacaa

SEQ ID NO: 286026 - DNA, 75 bp, Artificial Sequence
  Synthetic
agggtcggctcagggactcttgtactcaatcttagtggcaactcatgactcaggatacaatgatggaaccatctt

SEQ ID NO: 286027 - DNA, 75 bp, Artificial Sequence
  Synthetic
tgggagaaagtcactaacgttcatgtggtcaaaagggccttatcattaaaagaatctataaactggttcattaca

SEQ ID NO: 286028 - DNA, 75 bp, Artificial Sequence
  Synthetic
gacatacaccatctcagctgtccaaataacttggttgtggaggacgaaggatgtaacaacctgtcagggttctcc

SEQ ID NO: 286029 - DNA, 75 bp, Artificial Sequence
  Synthetic
attttggggggcttatacacgatgcgactcttagatgatacttctagaaaaaaacaagatcccaagtcagaacct

SEQ ID NO: 286030 - DNA, 75 bp, Artificial Sequence
  Synthetic
caagtgtttggattgaagagggtgttctccagaactcatgagttctttcagaagtcttggatctattattcagac

SEQ ID NO: 286031 - DNA, 75 bp, Artificial Sequence
  Synthetic
ttggaagcctagaagacttgtccagggaaatagagaagcaccttcgggggtataacaggtggatcacactggatg

SEQ ID NO: 286032 - DNA, 75 bp, Artificial Sequence
  Synthetic
tgatgaggcaggtgcttggtgggcatggagaggatactttagagtcagacgacgacatccaaaggttactaaaag

SEQ ID NO: 286033 - DNA, 75 bp, Artificial Sequence
  Synthetic
catatccccaagtgtggcagatttagatccatatgacaaatcccttcactcgagggtcttccctagcggaaaatg

SEQ ID NO: 286034 - DNA, 75 bp, Artificial Sequence
  Synthetic
gggatgttcagaatgggtttgctctgctcaacaggttgcagtctccacctcagcaaacccagcccctgtctcaga

SEQ ID NO: 286035 - DNA, 75 bp, Artificial Sequence
  Synthetic
ccatttggatgcccgagaatccgagactagggacatcttgtgacattttcaccaatagcagagggaagagagcat

SEQ ID NO: 286036 - DNA, 75 bp, Artificial Sequence
  Synthetic
gctcaacaggttgcagtctccacctcagcaaacccagcccctgtctcagagcttgacataagggccctctctaag

SEQ ID NO: 286037 - DNA, 75 bp, Artificial Sequence
  Synthetic
ataggatcggctcaggggctcttatattcaatcttagtggcaattcatgactccggatacaatgatgggaccatc

SEQ ID NO: 286038 - DNA, 75 bp, Artificial Sequence
  Synthetic
gcctgagagtggttcagtgggcaactggcgcccattataagcttaaacccattctagacgatctcaaggttttcc

SEQ ID NO: 286039 - DNA, 75 bp, Artificial Sequence
  Synthetic
attcaatcttagtggcaattcatgactccggatacaatgatgggaccatcttccctgtcaacatatacggcaaag

SEQ ID NO: 286040 - DNA, 75 bp, Artificial Sequence
  Synthetic
tcctgattgcacggaggggagacaagatcactccagattctcttgtagacataaaacgtactcatgtggaaggga

SEQ ID NO: 286041 - DNA, 75 bp, Artificial Sequence
  Synthetic
tctgcacgactttcgctcggacgagattgaacatcttgttgtggaggagttggtcaagaaaagagaggagtgtct

SEQ ID NO: 286042 - DNA, 75 bp, Artificial Sequence
  Synthetic
tcatgagtggaggagatgacatcgtttccagagtgatagattttgactccatctgggaaaaaccgtctgacctga

SEQ ID NO: 286043 - DNA, 75 bp, Artificial Sequence
  Synthetic
aactggtgcaaaaggacacacggctgaaagactccacctttcattggcatcttcgatgtaacaagtgcataaggc

SEQ ID NO: 286044 - DNA, 75 bp, Artificial Sequence
  Synthetic
aatagggggctgagaatccctccagagggggtcctaagttgtcttgaaagggtcgattacgataaaacatttggg

SEQ ID NO: 286045 - DNA, 75 bp, Artificial Sequence
  Synthetic
ttaatcatctccgttaatcagacaaggtcgtgtagattcttcaaatacaagaagtcctcgagcagtttcagtgac

SEQ ID NO: 286046 - DNA, 75 bp, Artificial Sequence
  Synthetic
atgtcttttgacctcattatttgtgatgcagaagttactgacattgcatctatcaaccagataactctgttaatg

SEQ ID NO: 286047 - DNA, 75 bp, Artificial Sequence
  Synthetic
ctctaatgagtcttggattcatgcgctgtgtcaagaagcaggaaacccagatctgggagagagaacactggagag

SEQ ID NO: 286048 - DNA, 75 bp, Artificial Sequence
  Synthetic
atgactggttgtggatcttctcagactttagaagctccaagatgacatatctgactctcatcacctaccagtctc

SEQ ID NO: 286049 - DNA, 75 bp, Artificial Sequence
  Synthetic
aataatcaggtggtctctttgaagcctgagattatcgtggatcaatatgagtacaagtaccctgctatcaaagat

SEQ ID NO: 286050 - DNA, 75 bp, Artificial Sequence
  Synthetic
gtcccatctcctccttcagagggttgagagaaatttgtctaagagcatgagagctaacctacgacaaatgagttc

SEQ ID NO: 286051 - DNA, 75 bp, Artificial Sequence
  Synthetic
gagcatgcatccctagttggtcttctcttgagtctttacaggttaagcaaaatatctggacaaaacaccggcaat

SEQ ID NO: 286052 - DNA, 75 bp, Artificial Sequence
  Synthetic
acccttctacagttttcaaagaaggtgacgaggctgaggattttgttgaagttcacctccccgacgtacacaaac

SEQ ID NO: 286053 - DNA, 75 bp, Artificial Sequence
  Synthetic
acgatgacgttcaacgactgttaaaagactctttgcggagaacaaggtgggttgatcaggaagtccgccatgcag

SEQ ID NO: 286054 - DNA, 75 bp, Artificial Sequence
  Synthetic
atgagtgcaggggccctgattgccctgatgttgataattttcctaatgacatgttgcagaagagtcaatcgacca

SEQ ID NO: 286055 - DNA, 75 bp, Artificial Sequence
  Synthetic
tcccaacaagaaagtgtctcgcaaggcaggatgttctgaatgggtttgctctgcacaacaggttgccgtttccac

SEQ ID NO: 286056 - DNA, 75 bp, Artificial Sequence
  Synthetic
gatatgtttttctcgcgggttgaacatctgtattcagcaattagagtgggtacagttgtaacagcctatgaggac

SEQ ID NO: 286057 - DNA, 75 bp, Artificial Sequence
  Synthetic
tcctgattgcaagaaaaggagacaagatcaccccagattccctcgtggagataaagcgtacggatgtagaaggga

SEQ ID NO: 286058 - DNA, 75 bp, Artificial Sequence
  Synthetic
agaggttccaaaaccccttgatctcaggcctgagagtagttcagtgggcaactggcgctcattataagcttaagc

SEQ ID NO: 286059 - DNA, 75 bp, Artificial Sequence
  Synthetic
tcttgagtctgtataggttgagcaaaatatcagggcaaaacaccggtaactataagacaaacattgcagatagga

SEQ ID NO: 286060 - DNA, 75 bp, Artificial Sequence
  Synthetic
atgaatggaggtagactaaaaagatcacacataaggagatatgtctcagttagttccaatcatcaagctcgccct

SEQ ID NO: 286061 - DNA, 75 bp, Artificial Sequence
  Synthetic
ctatcctagatgatctcaatgttttcccatccctatgtctggtagttggagatgggtcggggggaatatcaaggg

SEQ ID NO: 286062 - DNA, 75 bp, Artificial Sequence
  Synthetic
gggaatccctggatccaattgtcctccttgaactccatccaacagggtaaattcaagagtcgtgagactttcatt

SEQ ID NO: 286063 - DNA, 75 bp, Artificial Sequence
  Synthetic
tagagcagatttttgagactgccccttttgtcaaaattgtggaacaccatactctaatgacgactcacaaaatgt

SEQ ID NO: 286064 - DNA, 75 bp, Artificial Sequence
  Synthetic
tgagtgggaaatctccgtattcatcaaatgcagttggtcacgtgttcaacctcattcactttgttggatgttata

SEQ ID NO: 286065 - DNA, 75 bp, Artificial Sequence
  Synthetic
tctaccgctttgggtgacgtccctagcttcacaagacttcacgacctgtataacagacctataacttattacttc

SEQ ID NO: 286066 - DNA, 75 bp, Artificial Sequence
  Synthetic
agttgaacaacagagttgtaaacactaataaattgtttacatccttcaagaaaaaaactaacacccctcctgttg

SEQ ID NO: 286067 - DNA, 75 bp, Artificial Sequence
  Synthetic
gcttcacaagacttcacgacctgtataacagacctataacttattacttcagaaaacaagtcattcgagggaata

SEQ ID NO: 286068 - DNA, 75 bp, Artificial Sequence
  Synthetic
cacagttgtcactgcttatgaagactgctcagggctggtatcgtttacagggttcataaagcagatcaatctcac

SEQ ID NO: 286069 - DNA, 75 bp, Artificial Sequence
  Synthetic
gataccagagagtgtggacaagccaaggggcatttcaaatgactcagtgcttgggcacagaaagaagtcgtggtg

SEQ ID NO: 286070 - DNA, 75 bp, Artificial Sequence
  Synthetic
gcctgtaactctagcttgagtctgtcatctcactggatcaggttgatttacaagatagtgaagactaccagactc

SEQ ID NO: 286071 - DNA, 75 bp, Artificial Sequence
  Synthetic
atctccaaggagaacccatagaggtggacagtctccctgaggacatgagacggcttcaattagacgatgaaaaac

SEQ ID NO: 286072 - DNA, 75 bp, Artificial Sequence
  Synthetic
atgaggcagctgaagcaacgaagactgaaatagccttggcggatgacggaacagtcaattctgatgatgaggact

SEQ ID NO: 286073 - DNA, 75 bp, Artificial Sequence
  Synthetic
catctcactggatcaggttgatttacaagatagtgaagactaccagactcgtaggcaacattgaggacctatcca

SEQ ID NO: 286074 - DNA, 75 bp, Artificial Sequence
  Synthetic
tgtctgatttcgcattgtctatagacggaccactttatttggtcttcaagacttatgggactatgctagtaaacc

SEQ ID NO: 286075 - DNA, 75 bp, Artificial Sequence
  Synthetic
cgcagaggagagcaaatgtcaggaagattttcagatggatgaaggggaggaccccgccctcttattccagtcata

SEQ ID NO: 286076 - DNA, 75 bp, Artificial Sequence
  Synthetic
gacatcagatccagatcatctttattagactacagctgcttgtaaaccaggcattcccggatgtctgcacatgct

SEQ ID NO: 286077 - DNA, 75 bp, Artificial Sequence
  Synthetic
cagactataaagcgattcaacacttgtcaagagcgttcccttcagtcacaggatttataactcaagttacttcat

SEQ ID NO: 286078 - DNA, 75 bp, Artificial Sequence
  Synthetic
ggaggcagtttatactcgaatcatgatgaatgggggtagattaaaaagatcacacataaggagatatgtctcagt

SEQ ID NO: 286079 - DNA, 75 bp, Artificial Sequence
  Synthetic
ccatatcaagatgctagatccgggagaggtctatgatgaccctattgatccaatcgagtcagaggccgaacccag

SEQ ID NO: 286080 - DNA, 75 bp, Artificial Sequence
  Synthetic
ataaagcgtactgatgtagaaggaaattgggctctgacaggaggcatggaactgactagggaccccactgtctct

SEQ ID NO: 286081 - DNA, 75 bp, Artificial Sequence
  Synthetic
gagactcttgggtgatgtgtctcgaaaaaaacaagatcttgaatctggacctctggctgtttgattgtttctttt

SEQ ID NO: 286082 - DNA, 75 bp, Artificial Sequence
  Synthetic
gaggtctatgatgaccctattgatccaatcgagtcagaggccgaacccagaggagcccccactgtcccaaacatc

SEQ ID NO: 286083 - DNA, 75 bp, Artificial Sequence
  Synthetic
cacacataaggagatatgtctcagtcagttccaatcatcaagctcgccctaattcgttcgctgagtttctaagta

SEQ ID NO: 286084 - DNA, 75 bp, Artificial Sequence
  Synthetic
cgtcgaggagatcatatcctatgtcaaggtcaacttccccagtctgtccgagaaatctttagaagacaaagctac

SEQ ID NO: 286085 - DNA, 75 bp, Artificial Sequence
  Synthetic
atctaggagaggagttcttcgggaaaggaacattcgaaagaagattcttccgagatgagaaagaacttcaagaac

SEQ ID NO: 286086 - DNA, 75 bp, Artificial Sequence
  Synthetic
acagggaacagaccttatcggatgactctgacagacaattgctccaggtcttacaaagttttgaaagattatttc

SEQ ID NO: 286087 - DNA, 75 bp, Artificial Sequence
  Synthetic
agcgagaaagtcaatcatccaaagccaaaatggcggctcaaaccgcttctggtcctcctgctctagagtggtctg

SEQ ID NO: 286088 - DNA, 75 bp, Artificial Sequence
  Synthetic
cgaggggggtcttgatagggtcttcgatttgcttcttgacaagaatgacaaacattaacatcaatagacctcttg

SEQ ID NO: 286089 - DNA, 75 bp, Artificial Sequence
  Synthetic
ctctgacagacaattgctccaggtcttacaaagttttgaaagattatttcaagaaagtagatttgggttctctca

SEQ ID NO: 286090 - DNA, 75 bp, Artificial Sequence
  Synthetic
aaccatctcagacatgagcaagatttttgttaacccaagtgcaatcagggcaggcttggctgatctggagatggc

SEQ ID NO: 286091 - DNA, 75 bp, Artificial Sequence
  Synthetic
attgctgagagcttttctaagaagtacaagtttccatcccgatcttcggggatattcttgtataactttgagcaa

SEQ ID NO: 286092 - DNA, 75 bp, Artificial Sequence
  Synthetic
gcccactctgagtcgaacaggagtcggagatgcatagccgaattagctcatttctattccaagtcatcccccata

SEQ ID NO: 286093 - DNA, 75 bp, Artificial Sequence
  Synthetic
ggacagtcttcctgaagacatgagacggcttcagttagacgatgaaaaaccatctggcctcggtgtgattgccaa

SEQ ID NO: 286094 - DNA, 75 bp, Artificial Sequence
  Synthetic
accccgccctcttgttccagtcgtacctagacaatattggagttcaaatggtcagacaaatgagatcaggagaga

SEQ ID NO: 286095 - DNA, 75 bp, Artificial Sequence
  Synthetic
cctagacaatattggagttcaaatggtcagacaaatgagatcaggagagaggttcctcaagatatggtctcagac

SEQ ID NO: 286096 - DNA, 75 bp, Artificial Sequence
  Synthetic
cctgataagctaaataaaataatgcaagacgacctgaaccgttatgtgtctcactgaccagaccctcaaactcag

SEQ ID NO: 286097 - DNA, 75 bp, Artificial Sequence
  Synthetic
ggaaagcctcagaagacaaggctacccagactgccaaccaggaactcaagaaaaagacaatgtctgtttcttctc

SEQ ID NO: 286098 - DNA, 75 bp, Artificial Sequence
  Synthetic
atctccaaggggaacccatagaagtggacaatctccctgaggacatgaggcgacttcatttggacgatggtaaat

SEQ ID NO: 286099 - DNA, 75 bp, Artificial Sequence
  Synthetic
agcgagaaagtaaatcatctaaagctaaaatggcggcccaaaccgcctccggtcctcctgctctagaatggtccg

SEQ ID NO: 286100 - DNA, 75 bp, Artificial Sequence
  Synthetic
ctttctacgcaagatagtgaagaactgtagagatgaggacactcagaagtcctctatcgtgtcggctcctccgga

SEQ ID NO: 286101 - DNA, 75 bp, Artificial Sequence
  Synthetic
tggttggaagcattgaggacctatcaggagaggtagagagacaccttcgtggatacaacaggtggattaccctcg

SEQ ID NO: 286102 - DNA, 75 bp, Artificial Sequence
  Synthetic
attgctgagagcttctctaagaagtacaaattcccctctcgatcatcagggatattcttgtataattttgagcag

SEQ ID NO: 286103 - DNA, 75 bp, Artificial Sequence
  Synthetic
actaaactacagctgtttgtgaactaaacactctaagaggcttgtacaggtcaagactcttatacgatgtacctt

SEQ ID NO: 286104 - DNA, 75 bp, Artificial Sequence
  Synthetic
tcaccggcagaaaaaacatgagaaacttctgcgttaatggagaagtcaaggtgtgcagtccaaacggctattcat

SEQ ID NO: 286105 - DNA, 75 bp, Artificial Sequence
  Synthetic
tcaagactcttatacgatgtaccttgaaaaaaacaagatcttgacactgagcctctggttggttgattgtttttt

SEQ ID NO: 286106 - DNA, 75 bp, Artificial Sequence
  Synthetic
tccttaatgattttgctttctccccccgagccccgatactcggatgatttgatatctcagctatgccagttatac

SEQ ID NO: 286107 - DNA, 75 bp, Artificial Sequence
  Synthetic
gatattcttgtataattttgagcagttgaagatgaaccttgatgacatcgttaaggagtcgaaaaatgtgccaag

SEQ ID NO: 286108 - DNA, 75 bp, Artificial Sequence
  Synthetic
gtgtgcagtccaaacggctattcatttaggatcctgaggcatattttgaaatcattcgatgagatttattctggg

SEQ ID NO: 286109 - DNA, 75 bp, Artificial Sequence
  Synthetic
tggggtgggttgctctagccaactccaaaaagttccagctgttagttgagcctgacaagctaaacaaaataatgc

SEQ ID NO: 286110 - DNA, 75 bp, Artificial Sequence
  Synthetic
aggagccccagtccctgaaggaatgaactgggtgtacaaattgaggagaactcttatcttccagtgggctgattc

SEQ ID NO: 286111 - DNA, 75 bp, Artificial Sequence
  Synthetic
caggatggcggctcaagctgcctctggtcctccagcccttgaatggtctgctaccaacgaagaggatgatctatc

SEQ ID NO: 286112 - DNA, 75 bp, Artificial Sequence
  Synthetic
ctcttatcttccagtgggctgattctaggggccctctagaaggggaggagttagaatactctcaggaaattacct

SEQ ID NO: 286113 - DNA, 75 bp, Artificial Sequence
  Synthetic
caaaaagttccagctgttagttgagcctgacaagctaaacaaaataatgcaagacgacctgaatcgttatgtgtt

SEQ ID NO: 286114 - DNA, 75 bp, Artificial Sequence
  Synthetic
gacaacatacatgacctagtttttgtgtatggctgttacagacactggggccacccctatatagattatcgaaag

SEQ ID NO: 286115 - DNA, 75 bp, Artificial Sequence
  Synthetic
cctgacaagctaaacaaaataatgcaagacgacctgaatcgttatgtgttctgctgaccaaaccctcaaactcag

SEQ ID NO: 286116 - DNA, 75 bp, Artificial Sequence
  Synthetic
caggcaacaccactgataaaatgaactttctacgcaagatagtaaagaactgtagagatgaggacactcagaagc

SEQ ID NO: 286117 - DNA, 75 bp, Artificial Sequence
  Synthetic
tgtagagatgaggacactcagaagccctctttcgtgtcggctcctccagatgatgatgacttgtggttaccccct

SEQ ID NO: 286118 - DNA, 75 bp, Artificial Sequence
  Synthetic
tgggagaaaccttctgacttgaggaacttgaccacatggagatacttccagtcagtccaagaacaagtaaacatg

SEQ ID NO: 286119 - DNA, 75 bp, Artificial Sequence
  Synthetic
gcggcttcagctggatgacggaaaaccatctggccttaacgagatggccgcggcaggagaaagcaagtatcggga

SEQ ID NO: 286120 - DNA, 75 bp, Artificial Sequence
  Synthetic
tctcgggtaagaaaaacatgagaaacttttgtataaatggagaggtcaaagtgtgtagtccgaatggctattcat

SEQ ID NO: 286121 - DNA, 75 bp, Artificial Sequence
  Synthetic
gtgtgtagtccgaatggctattcatttaggatcctgaggcacattttgaaatcattcgatgagatctattctgga

SEQ ID NO: 286122 - DNA, 75 bp, Artificial Sequence
  Synthetic
gatcaccccaaattctcttgtggacataaaacgcactagtgtggaagggaattgggctttgacagggggtatgga

SEQ ID NO: 286123 - DNA, 75 bp, Artificial Sequence
  Synthetic
tcaaaacccagacatggccccccaaacatatagtagacttggtgggggatacatggcacaaactcccgataacgc

SEQ ID NO: 286124 - DNA, 75 bp, Artificial Sequence
  Synthetic
ttttatcagagtcaaatcaattacctttgcattttgagcctctcggatgtgaaaaaaactattaacatccctcga

SEQ ID NO: 286125 - DNA, 75 bp, Artificial Sequence
  Synthetic
aggagccccagtcccggagggcatgaactgggtatacaaattgaggagaactcttatcttccagtgggctgattc

SEQ ID NO: 286126 - DNA, 75 bp, Artificial Sequence
  Synthetic
gattagcttcttggctgtcagagaaccgaggagggcctgttcctagtgagaaggtcattatcacagccctgtcca

SEQ ID NO: 286127 - DNA, 75 bp, Artificial Sequence
  Synthetic
ctcttatcttccagtgggctgattctaggggccctctagagggggaggagttagaatactctcaggaaattacct

SEQ ID NO: 286128 - DNA, 75 bp, Artificial Sequence
  Synthetic
gatttcctcattgtgtttcggaaaatttccaatctatacgatacccgaaaaactcgggccttggagtcccattga

SEQ ID NO: 286129 - DNA, 75 bp, Artificial Sequence
  Synthetic
ctttctacgcaagatagtgaaaaactgtagggatgaggacactcaaaagtcctctcctgtgtcagctcccccaga

SEQ ID NO: 286130 - DNA, 75 bp, Artificial Sequence
  Synthetic
ggtgtatcaacatgaactctagggcatgtcaactatggtctgacatgtcccttcaaacacaaaggtctgaggagg

SEQ ID NO: 286131 - DNA, 75 bp, Artificial Sequence
  Synthetic
atctgtattcagcaatcagagtaggcacagttgttactgcttatgaggactgctcagggctagtgtcatttacag

SEQ ID NO: 286132 - DNA, 75 bp, Artificial Sequence
  Synthetic
agccaactacatcctgccgctttttgatgcactaactatgacagacaacctgaacaaggtgtttaaaaagttgat

SEQ ID NO: 286133 - DNA, 75 bp, Artificial Sequence
  Synthetic
aggagctccagtccctgagggcatgaactgggtatacaaattgaggagaacccttatcttccagtgggctgattc

SEQ ID NO: 286134 - DNA, 75 bp, Artificial Sequence
  Synthetic
gatgcactaactatgacagacaacctgaacaaggtgtttaaaaagttgatcgacagagtcactggacaagggctt

SEQ ID NO: 286135 - DNA, 75 bp, Artificial Sequence
  Synthetic
ctaagaagttccagctattagttgagccagacaagttgaacaaagtcatgcaggatgatctgaaccgttatacat

SEQ ID NO: 286136 - DNA, 75 bp, Artificial Sequence
  Synthetic
agtctcttcacaatccttatcctgattaccattggctacggaccgtaaaaaccaccaaagagtctcttgttatca

SEQ ID NO: 286137 - DNA, 75 bp, Artificial Sequence
  Synthetic
gaaaaaaactatcaacatccctcaaaagacttaaggaaacatgatccctcaggctcttctgtttgtgccttttct

SEQ ID NO: 286138 - DNA, 75 bp, Artificial Sequence
  Synthetic
accaccaaagagtctcttgttatcatatcgccaagtgtggctgatttggacccatacgataaatcccttcattca

SEQ ID NO: 286139 - DNA, 75 bp, Artificial Sequence
  Synthetic
cagaagtcctggatctattattcagataggtcagacctcattgggttatggggggatcaaatatattgcttggat

SEQ ID NO: 286140 - DNA, 75 bp, Artificial Sequence
  Synthetic
catgagatgtctgttctagggggttatttgggggaggagttctttgggaaaggaacctttgagagaagattcttc

SEQ ID NO: 286141 - DNA, 75 bp, Artificial Sequence
  Synthetic
tgcaactctagcttgagtctctcatctcactggatcaggttgatctacaaaatagtaaagaccaccagacttgtc

SEQ ID NO: 286142 - DNA, 75 bp, Artificial Sequence
  Synthetic
agctcggcccttggagtcccatcgacatacatcatctcagctgtcctaacaatttggttgtggaggacgagggtt

SEQ ID NO: 286143 - DNA, 75 bp, Artificial Sequence
  Synthetic
agaacacacgggcttaactccaaccctcgggagcaatagaacaaaaacatgttatggtgccattaaaccgctgca

SEQ ID NO: 286144 - DNA, 75 bp, Artificial Sequence
  Synthetic
taggtaatattattgataaaatgaattttttatgtaagatagtgaaaaattgtagggatgaggatatttaaaaat

SEQ ID NO: 286145 - DNA, 75 bp, Artificial Sequence
  Synthetic
atctggatgcctgaagaggcaagactcgggacatcttgtgacatttttacaaccagcaaagggaagagagcatct

SEQ ID NO: 286146 - DNA, 75 bp, Artificial Sequence
  Synthetic
tctaaaaggagcatgcaaacttaagttgtgcggagttcttggacttagacttatggatggaacctgggtttcaat

SEQ ID NO: 286147 - DNA, 75 bp, Artificial Sequence
  Synthetic
gaaaaaaactgtcaacatccctcaaacgacttaaggaaagatggttcctcaagctcttttgtttgtaccccttct

SEQ ID NO: 286148 - DNA, 75 bp, Artificial Sequence
  Synthetic
ttgtgcggagttcttggacttagacttatggatggaacctgggtttcaattcagacaccaggtgaaaccaaatgg

SEQ ID NO: 286149 - DNA, 75 bp, Artificial Sequence
  Synthetic
aaaaatgtaacacccctacaatggatgccgacaagattgtatttaaggtcaataatcaggtggtttctctgaagc

SEQ ID NO: 286150 - DNA, 75 bp, Artificial Sequence
  Synthetic
agagcatctcgtcgcagaggagttggtcaaaaagagggaagaatgtttggatgcactggagtccatcatgaccac

SEQ ID NO: 286151 - DNA, 75 bp, Artificial Sequence
  Synthetic
gagaccatgtgtagttatgactttctcatatatgggaaaactcccttgtttcgaggcaacatattagtgcctgag

SEQ ID NO: 286152 - DNA, 75 bp, Artificial Sequence
  Synthetic
aaaaaaactaacacccctccttttgaaccatctcagacatgagcaagatttttgtcaacccaagtgcgatcaggg

SEQ ID NO: 286153 - DNA, 75 bp, Artificial Sequence
  Synthetic
aaccatctcagacatgagcaagatttttgtcaacccaagtgcgatcagggcaggtttggctgatctagagatggc

SEQ ID NO: 286154 - DNA, 75 bp, Artificial Sequence
  Synthetic
accaccaaagaatctcttgttatcatatcgccgagtgtggctgatttggacccatatgacaaatcccttcattca

SEQ ID NO: 286155 - DNA, 75 bp, Artificial Sequence
  Synthetic
tcgaagaagcccagtataaccttaggaaaagcccctgacttgaacaaagcatacaagtcaattttatccggcatg

SEQ ID NO: 286156 - DNA, 75 bp, Artificial Sequence
  Synthetic
atctgggagaggaattcttcgggaaaggaacattcgaaagaagattcttcagagatgagaaagaacttcaagaat

SEQ ID NO: 286157 - DNA, 75 bp, Artificial Sequence
  Synthetic
gctcactacaagtcagttcggacctggaacgaggtcatcccctcaaaagggtgcctaagcgtcggagggaggtgt

SEQ ID NO: 286158 - DNA, 75 bp, Artificial Sequence
  Synthetic
atctggatgcccgaagaagcaagactcgggacatcttgtgacatttttaccaacagcaaagggaagagggcatct

SEQ ID NO: 286159 - DNA, 75 bp, Artificial Sequence
  Synthetic
aatgcagttctttgagggagcatgtcctgatgactggaccagctatggaatcctgattgcacggaagggagacaa

SEQ ID NO: 286160 - DNA, 75 bp, Artificial Sequence
  Synthetic
cggcttcaattagaagatgaaaagtcatcaggttttggcggaatggccaaggcaggggaaagcaagtgtcaggaa

SEQ ID NO: 286161 - DNA, 75 bp, Artificial Sequence
  Synthetic
atggcaggtgacccaagatatgaggaatctctacacaatccgtaccctgattaccattggctccggactgtgaaa

SEQ ID NO: 286162 - DNA, 75 bp, Artificial Sequence
  Synthetic
tggatgaaaggggcttatataagtctctaaaaggggcatgtaaacttaagctgtgcggagttcctggacttagac

SEQ ID NO: 286163 - DNA, 75 bp, Artificial Sequence
  Synthetic
cagtcgtccctactccaacagcatatggaactgctggagtcctctgtaatccccctgatgcatcccttggcagac

SEQ ID NO: 286164 - DNA, 75 bp, Artificial Sequence
  Synthetic
ctgtgcggagttcctggacttagacttatggatggaacgtgggtcgctattcagacaccaggtgagaccaaatgg

SEQ ID NO: 286165 - DNA, 75 bp, Artificial Sequence
  Synthetic
cttgcacaggcgttgtgacagaggcagaaacctacaccaattttgtgggttatgttacaaccacattcaaaagaa

SEQ ID NO: 286166 - DNA, 75 bp, Artificial Sequence
  Synthetic
ggaacgaggtcatcccctcaaaagggtgcctaagcgtcggagggaggtgtcatcctcatgtgaatggagtgttct

SEQ ID NO: 286167 - DNA, 75 bp, Artificial Sequence
  Synthetic
tgctctcctgatcagctggtaaatctacatgactttcgttcagatgagatagaacatctcgtcgtggaggagttg

SEQ ID NO: 286168 - DNA, 75 bp, Artificial Sequence
  Synthetic
tggaactgctggagtcctctgtaatccccctgatgcatcccttggcagacccatcaacagtcttcaaagacggtg

SEQ ID NO: 286169 - DNA, 75 bp, Artificial Sequence
  Synthetic
gtctcaggagttgatcttggtctcccaaactgggggaagtatttgctgatgattgcaggtgctctggcaacccta

SEQ ID NO: 286170 - DNA, 75 bp, Artificial Sequence
  Synthetic
ggaagtcttcagaagataaggctacacagaccaccagccgggaactcaagaaagagactgtgtctgcttcttcac

SEQ ID NO: 286171 - DNA, 75 bp, Artificial Sequence
  Synthetic
agaacatctcgtcgtggaggagttgatcaagaagagagaagaatgtctagatgcactagagtccatcatgaccac

SEQ ID NO: 286172 - DNA, 75 bp, Artificial Sequence
  Synthetic
ctaccaccttaaatatcaagggaggggccagccctaccatcttactcaaggatgctatcagaaaggctctgtacg

SEQ ID NO: 286173 - DNA, 75 bp, Artificial Sequence
  Synthetic
caaactgggggaagtatttgctgatgattgcaggtgctctggcaaccctaatgctgacaatcttcctaatgacat

SEQ ID NO: 286174 - DNA, 75 bp, Artificial Sequence
  Synthetic
ggtttggaaaggcatacactatattcaacaaaaccttgatggaggctgatgctcactacaagtcagttcggactt

SEQ ID NO: 286175 - DNA, 75 bp, Artificial Sequence
  Synthetic
tcaggaaggaaagtgtcagttactccccaaagcgggaaagttatatcttcatgggagtcgtataagagtggaggc

SEQ ID NO: 286176 - DNA, 75 bp, Artificial Sequence
  Synthetic
cccaaagcgggaaagttatatcttcatgggagtcgtataagagtggaggcgagaccaggctgtgagggcgggtcg

SEQ ID NO: 286177 - DNA, 75 bp, Artificial Sequence
  Synthetic
tctaagacccatagagacaacttcatactctttttaaaatctgttgagcccctcttccctagatttctcagtgag

SEQ ID NO: 286178 - DNA, 75 bp, Artificial Sequence
  Synthetic
tcctttcgacgcttcaagtcctgaagatcacctccccctggggctggggggaatctctgggttcaatagtcctcc

SEQ ID NO: 286179 - DNA, 75 bp, Artificial Sequence
  Synthetic
acaaattcccttccagatcgtcagggatattcctgtataattttgagcagctaaaaatgaaccttgatgacatag

SEQ ID NO: 286180 - DNA, 75 bp, Artificial Sequence
  Synthetic
cctcttccctagatttctcagtgagctcttcagttcatctttcttgggaatcccagaatcaatcatcggactaat

SEQ ID NO: 286181 - DNA, 75 bp, Artificial Sequence
  Synthetic
ggaattctttgcttcaacagtccttcatggaccccaggtaacagggtagattcaaaagtcgagaaactttcatta

SEQ ID NO: 286182 - DNA, 75 bp, Artificial Sequence
  Synthetic
tggacatgtcctgattccagagatgcaatcgtccctcctccaacagcatatggagctgttggaatcctctgtaat

SEQ ID NO: 286183 - DNA, 75 bp, Artificial Sequence
  Synthetic
catggaccccaggtaacagggtagattcaaaagtcgagaaactttcattaatcatctccactgatcagacatagt

SEQ ID NO: 286184 - DNA, 75 bp, Artificial Sequence
  Synthetic
ctttagaagagtccttctacaactcggagatccacgggattaatcggatgacccaaacacctcaaagggtcggaa

SEQ ID NO: 286185 - DNA, 75 bp, Artificial Sequence
  Synthetic
caaaaagttccagctgttagttgagcccgacaagctaaacaaagtaatgcaagatgacctgaaccgttatgcgct

SEQ ID NO: 286186 - DNA, 75 bp, Artificial Sequence
  Synthetic
tcaccttccggacgttcacaagcaggtctcaggggtcgatcttggtctcccaaactgggggaaatatgtgctgat

SEQ ID NO: 286187 - DNA, 75 bp, Artificial Sequence
  Synthetic
ataccaaaggttgtggacaagccaactgatatctcagatgactctgtgcttgagtttaggcagaggccttagcac

SEQ ID NO: 286188 - DNA, 75 bp, Artificial Sequence
  Synthetic
tcccatgacagcggactcagcatgagtttattgagaaaggcaatctgcctaccatgaaggacataagcaatagct

SEQ ID NO: 286189 - DNA, 75 bp, Artificial Sequence
  Synthetic
tgggggagaaaagtggtaggcacgacagtccctcacccctctgagatgttggggtcacttcctaaatcctccatc

SEQ ID NO: 286190 - DNA, 75 bp, Artificial Sequence
  Synthetic
agtcatttgaggaagctagtccctgggtttggaaaggcgtataccatattcaacaaaaccttgatggaagctgat

SEQ ID NO: 286191 - DNA, 75 bp, Artificial Sequence
  Synthetic
gttgcagaagggttaacagaacaaaaccaaaacaacaaagtcttggggagtcaggaaggaaagtatcggttactc

SEQ ID NO: 286192 - DNA, 75 bp, Artificial Sequence
  Synthetic
atgaagcagctgaattgacgaagactgaggtagccttggcagatgacggaacagtcaattctgatgatgaggact

SEQ ID NO: 286193 - DNA, 75 bp, Artificial Sequence
  Synthetic
tcctatgaaggatataagcaatagatcacaatcatcttacatcccgataaggtgtgcacagctacaacgggccga

SEQ ID NO: 286194 - DNA, 75 bp, Artificial Sequence
  Synthetic
accaaaacaacaaagtcttggggagtcaggaaggaaagtatcggttactcctcaaaatgggaaggtcatgtcttc

SEQ ID NO: 286195 - DNA, 75 bp, Artificial Sequence
  Synthetic
catcctcatgtgaacggggtgttttttaatggtataatactagggcctgacggccatgttctaatcccggaaatg

SEQ ID NO: 286196 - DNA, 75 bp, Artificial Sequence
  Synthetic
gagaaactctgactacaatctcaactcccctttgatagaagaccctgcgagactaatgttggaatggttgaaaac

SEQ ID NO: 286197 - DNA, 75 bp, Artificial Sequence
  Synthetic
tctcctccatatcttgcgttcagaagatcacctctcttctagatctgggggaatctcttgttttgacagtccttt

SEQ ID NO: 286198 - DNA, 75 bp, Artificial Sequence
  Synthetic
tcacgggcaagaaaaacatgagaaacttttgtgtcaatggagaagtcaaggtgtgtagtccaaatggatattcat

SEQ ID NO: 286199 - DNA, 75 bp, Artificial Sequence
  Synthetic
aaaaactgtggaacggagaagtaattgacaacacttctcatcctgagtacctcaccatgatgattgatccgggag

SEQ ID NO: 286200 - DNA, 75 bp, Artificial Sequence
  Synthetic
gatcacctctcttctagatctgggggaatctcttgttttgacagtcctttgtggactccgtgctacaaggcaaaa

SEQ ID NO: 286201 - DNA, 75 bp, Artificial Sequence
  Synthetic
ctttctacgcaagatagtgaagaactgtagagatgaggacactcagaagccccctctcgtgtcagctcctccaga

SEQ ID NO: 286202 - DNA, 75 bp, Artificial Sequence
  Synthetic
aagttgtcgttggattggcgttgtcaggagccccagtccctgagggcatgaactgggtatacaaattgaggagaa

SEQ ID NO: 286203 - DNA, 75 bp, Artificial Sequence
  Synthetic
tacgtaggttctgataatgtatgacgtcttctgacagtgtcagtgaccaatggtgctctcatcccccatggactg

SEQ ID NO: 286204 - DNA, 75 bp, Artificial Sequence
  Synthetic
tcgctaggaatatagaagataatcaagcccatctccagggggatcccatagaggtggacagtctccctgaagata

SEQ ID NO: 286205 - DNA, 75 bp, Artificial Sequence
  Synthetic
ataccaaaggttgtggacaaaccaaccgatatctcagataattctaggcttgagccggggcagggaccgtggcta

SEQ ID NO: 286206 - DNA, 75 bp, Artificial Sequence
  Synthetic
gagaccagactgtgaaagctgacaatcctttcgacgcttcaagtcctgaagatcacctcccctagggggttgggg

SEQ ID NO: 286207 - DNA, 75 bp, Artificial Sequence
  Synthetic
gggatgatgatacagaattcgtcggactggaaatacgagtgagtgcaagacaatgccacatccaaggcaggattt

SEQ ID NO: 286208 - DNA, 75 bp, Artificial Sequence
  Synthetic
tatgatttcatgttccagccattgatgctttatgcacaaacatggacatcagagctggtacagagagatacaagg

SEQ ID NO: 286209 - DNA, 75 bp, Artificial Sequence
  Synthetic
atgggaatcatataaaagcggaggtgagactaagctgtgaggacaagtcatctcttctacacttcgagtccgaag

SEQ ID NO: 286210 - DNA, 75 bp, Artificial Sequence
  Synthetic
cggcttcaattagacgatgcaaaatcatctggccctggcgagatggccaaagcaggggaaagcaagtttcaggaa

SEQ ID NO: 286211 - DNA, 75 bp, Artificial Sequence
  Synthetic
ggttagctgagggaagcgatttgcctcctatgaaggacataagcaatagatcacaatcatcttacatcccgataa

SEQ ID NO: 286212 - DNA, 75 bp, Artificial Sequence
  Synthetic
gcccattgacgatacaacactggaaacttctcaaatcttcgagtttccagatgtgtcaaaaaggatatccaggat

SEQ ID NO: 286213 - DNA, 75 bp, Artificial Sequence
  Synthetic
acttctcaaatcttcgagtttccagatgtgtcaaaaaggatatccaggatggtatctggagccgtccctcacttt

SEQ ID NO: 286214 - DNA, 75 bp, Artificial Sequence
  Synthetic
ctccctgggagactttcctgtatttataaaagataaggtaagtcaactcgaggggacttttggccccagtgcaaa

SEQ ID NO: 286215 - DNA, 75 bp, Artificial Sequence
  Synthetic
gggtcgattacgacaaagcctttgggaggtatctggctaacatatactcctcttatttattctttcacgtgatta

SEQ ID NO: 286216 - DNA, 75 bp, Artificial Sequence
  Synthetic
gaggtatctggctaacatatactcctcttatttattctttcacgtgattaccctttacatgaacgccctggattg

SEQ ID NO: 286217 - DNA, 75 bp, Artificial Sequence
  Synthetic
atcttctggcagtttcagtgaccaacggtgctttcattctccaagaactgatactaaaggttgtggacaagtcaa

SEQ ID NO: 286218 - DNA, 75 bp, Artificial Sequence
  Synthetic
gggaacccaaccattcccaacatcttaagaaactctgactacaatctcaactctcctctaatagaggatccagcc

SEQ ID NO: 286219 - DNA, 75 bp, Artificial Sequence
  Synthetic
attttctgatagcagattcaacatggattaattgagaaaggcaatctgccttccatgatgaacacaagcaataga

SEQ ID NO: 286220 - DNA, 75 bp, Artificial Sequence
  Synthetic
gattcctcaagatatggtctcagactgtagaagagatcatatcctatgtcacggtcaacttccctgatctgtcgg

SEQ ID NO: 286221 - DNA, 75 bp, Artificial Sequence
  Synthetic
gaaaaaaactattaacatccctcaacagatctaaggaaagatgatctctcaggctttcctgtatgtccctctctt

SEQ ID NO: 286222 - DNA, 75 bp, Artificial Sequence
  Synthetic
tatctcagctgtgccagctatacatcgctggggatcaggtcttgtccatgtgtggaaactccggctatgaagtca

SEQ ID NO: 286223 - DNA, 75 bp, Artificial Sequence
  Synthetic
atattggaaaggacttggttaagtttaaagatcaaatatggggagtgctaattgtgactaaagattttgtgtact

SEQ ID NO: 286224 - DNA, 75 bp, Artificial Sequence
  Synthetic
cgcaagaggggtcttgatagggtcttcgatttgcttcttgacacgaatgacaaacatcaacattaacagacctct

SEQ ID NO: 286225 - DNA, 75 bp, Artificial Sequence
  Synthetic
tttaacagacaattgctctaggtcttacaaaattttgaaggattatttcaagaaagtggatataggatctatcaa

SEQ ID NO: 286226 - DNA, 75 bp, Artificial Sequence
  Synthetic
caaacatcaacattaacagacctcttgaattgatttcaggagtgatatcatatatccttctgagactggataatc

SEQ ID NO: 286227 - DNA, 75 bp, Artificial Sequence
  Synthetic
catacatcatctcagctgtcctaataacttggttgtggaggatgagggatgcaccagtctgtcaggattttctta

SEQ ID NO: 286228 - DNA, 75 bp, Artificial Sequence
  Synthetic
ctctaataatcctcctttctcctccggaatccagatattcagatgacctgatatctcagctgtgtcaactatata

SEQ ID NO: 286229 - DNA, 75 bp, Artificial Sequence
  Synthetic
ttccatgatgaacacaagcaatagatcataatcatcttacatctctgcaaagtgtgcataactacaaagggctgg

SEQ ID NO: 286230 - DNA, 75 bp, Artificial Sequence
  Synthetic
cagatctaaggaaagatgatctctcaggctttcctgtatgtccctctcttaatttcctcgttgtgtttcgggaaa

SEQ ID NO: 286231 - DNA, 75 bp, Artificial Sequence
  Synthetic
gtgtgggaactctggttatgaggtcattaagatattagagccgtacgttgtgaatagcctagtccagagggcaga

SEQ ID NO: 286232 - DNA, 75 bp, Artificial Sequence
  Synthetic
ctcccctttaatagaagaccctgccagactaatgctagaatggttgaaaacagggaatagaccttaccgaatgac

SEQ ID NO: 286233 - DNA, 75 bp, Artificial Sequence
  Synthetic
tctgctataaaggtgaacggattcacttgtaccggcgttgtgacagaagccgagacctacactaattttgtgggt

SEQ ID NO: 286234 - DNA, 75 bp, Artificial Sequence
  Synthetic
gaggtatctggttaacatatactcctcttacttattctttcacgtgatcaccctttacatgaacgccttggactg

SEQ ID NO: 286235 - DNA, 75 bp, Artificial Sequence
  Synthetic
cctgacaagctaaataaaataatgcaagacgatctgaaccgttatgtatcacactgatcaacctctcaaattcag

SEQ ID NO: 286236 - DNA, 75 bp, Artificial Sequence
  Synthetic
ccctttacatgaacgccttggactgggatgaggagaagaccattctagcactgtggagggatttaacctcaatag

SEQ ID NO: 286237 - DNA, 75 bp, Artificial Sequence
  Synthetic
ttacagttggctacggaccgtaaagaccaccaaagagtctcttgttatcatatctccaagtgtggctgatttgga

SEQ ID NO: 286238 - DNA, 75 bp, Artificial Sequence
  Synthetic
atataggaaaggacttggtcaagtttaaagatcaaatatggggattgctaattgtgaccaaggattttgtgtact

SEQ ID NO: 286239 - DNA, 75 bp, Artificial Sequence
  Synthetic
accaccaaagagtctcttgttatcatatctccaagtgtggctgatttggacccatacgacaaatcccttcactca

SEQ ID NO: 286240 - DNA, 75 bp, Artificial Sequence
  Synthetic
tcttatcaggagtgtttggcaagcgaccttgccaaaaggatcctcaggtggggatttgataaatactccaagtgg

SEQ ID NO: 286241 - DNA, 75 bp, Artificial Sequence
  Synthetic
ctgctcaactaaccatgattacactatctggatgcccgaagaagcaagactcgggacatcttgtgacatttttac

SEQ ID NO: 286242 - DNA, 75 bp, Artificial Sequence
  Synthetic
gggtcgattatgataaggcatttgggaggtatctggccaacacgtattcctcttatttgtttttccatgtaatca

SEQ ID NO: 286243 - DNA, 75 bp, Artificial Sequence
  Synthetic
atatcccagctgtgtcagctatatatcgctggagatcatgtcttgtctatgtgcgggaactctggttatgaggtc

SEQ ID NO: 286244 - DNA, 75 bp, Artificial Sequence
  Synthetic
tggatgaaaggggcctgtacaagtctctaagaggagcatgtaaacttaagctgtgtggggttccgggacttagac

SEQ ID NO: 286245 - DNA, 75 bp, Artificial Sequence
  Synthetic
tctaagaggagcatgtaaacttaagctgtgtggggttccgggacttagactgatggatggaacctgggtctcaat

SEQ ID NO: 286246 - DNA, 75 bp, Artificial Sequence
  Synthetic
gatcttcgagatccccgagtcaatggacccatctgaaatactggatgacaaatcacattcttttactagaacaag

SEQ ID NO: 286247 - DNA, 75 bp, Artificial Sequence
  Synthetic
cctgagagtggttcagtgggcaaccggcgcccactataagcttaagccgattctcgatgatctaaatgttttccc

SEQ ID NO: 286248 - DNA, 75 bp, Artificial Sequence
  Synthetic
tacatgattttcactcagatgagatagaacatctcgtcgtggaggagttggtcaagaagagggaagaatgtctgg

SEQ ID NO: 286249 - DNA, 75 bp, Artificial Sequence
  Synthetic
cagaaactatacacttatgctaaaagatcttttcttgtctcgcttcaactccctgatgattctgctttctccccc

SEQ ID NO: 286250 - DNA, 75 bp, Artificial Sequence
  Synthetic
gcctcctgtcaaccccagagaattcttgaaatccatagacctgggaggattgccagacgaggatctgataatcgg

SEQ ID NO: 286251 - DNA, 75 bp, Artificial Sequence
  Synthetic
ttgccggggatcaggtcttgtccatgtgcgggaactccggctatgaagtcatcaaaatactggagccatacgtcg

SEQ ID NO: 286252 - DNA, 75 bp, Artificial Sequence
  Synthetic
tgatgtcttggaatctgagattatattttgtcatcactgagaagctcctagccaattacatcttaccactttttg

SEQ ID NO: 286253 - DNA, 75 bp, Artificial Sequence
  Synthetic
ttttgtcatcactgagaagctcctagccaattacatcttaccactttttgacgcactgaccatgacagataactt

SEQ ID NO: 286254 - DNA, 75 bp, Artificial Sequence
  Synthetic
gggatttgacaagtattccaaatggtatattgattcaagactcctctcaaaggaccaccccctaactccttatat

SEQ ID NO: 286255 - DNA, 75 bp, Artificial Sequence
  Synthetic
gaagtttaggcctctcattcactctttgggagactttcctatatttataagagacaaggtgaatcagctcgaagg

SEQ ID NO: 286256 - DNA, 75 bp, Artificial Sequence
  Synthetic
catccccatgtggacggagtgtttttcaatggtataattttgggtccagacggaaatgtcttaatccctgagatg

SEQ ID NO: 286257 - DNA, 75 bp, Artificial Sequence
  Synthetic
tggagctgttggagtcttctgtaatccccctaatgcatcccttggcagacccatcaacagtcttcaaggacggtg

SEQ ID NO: 286258 - DNA, 75 bp, Artificial Sequence
  Synthetic
acgtttggtcccagtgcaaaaaggttttttagagctctggatcaatttgacaacatacatgatctggtttttgtg

SEQ ID NO: 286259 - DNA, 75 bp, Artificial Sequence
  Synthetic
ccatcaacagtcttcaaggacggtgatgaggcggaagactttgttgaagttcaccttccagatattcacaaacag

SEQ ID NO: 286260 - DNA, 75 bp, Artificial Sequence
  Synthetic
tcacattaagaaagtgatagataagtcctaccaggagtgtttagcaagcgacctagccaggaggatcctcagatg

SEQ ID NO: 286261 - DNA, 75 bp, Artificial Sequence
  Synthetic
gcctcctgtcaaccccagggaatttctgaaatctatagacctgggaggattgccggacgaggatttgataatcgg

SEQ ID NO: 286262 - DNA, 75 bp, Artificial Sequence
  Synthetic
gagtgcaggtgctctggcaatattattgttaacaatcttcttaatgacatgttgcagaagggtcaatagaacaga

SEQ ID NO: 286263 - DNA, 75 bp, Artificial Sequence
  Synthetic
gatgccgagtacttgacttcttccacccttcgggagatgagcctcgtgttattcaattgtagcagtcccaagagt

SEQ ID NO: 286264 - DNA, 75 bp, Artificial Sequence
  Synthetic
ttgttaacaatcttcttaatgacatgttgcagaagggtcaatagaacagaatcagcacagcgagatcctggagag

SEQ ID NO: 286265 - DNA, 75 bp, Artificial Sequence
  Synthetic
acctcctactccaaagggttgagagaagtttgtctaagagtatgagagttaacctgagacagatgggttctctga

SEQ ID NO: 286266 - DNA, 75 bp, Artificial Sequence
  Synthetic
catggcacaagctcccgatcacgcagatctttgagattcccgaatcaatggacccgtcagaaatactggatgaca

SEQ ID NO: 286267 - DNA, 75 bp, Artificial Sequence
  Synthetic
tatgtcaccaccacattcaagagaaaacacttccgcccgatgccagatgcatgcagagctgcatacaactggaag

SEQ ID NO: 286268 - DNA, 75 bp, Artificial Sequence
  Synthetic
tgagacctacaccaactttgttggttatgtcaccaccacattcaagagaaaacacttccgcccgatgccagatgc

SEQ ID NO: 286269 - DNA, 75 bp, Artificial Sequence
  Synthetic
acgcactgactatgacagacaacttgaacaaagtgtttaaaaagctgatcgacagagtcaccggacaggggcttt

SEQ ID NO: 286270 - DNA, 75 bp, Artificial Sequence
  Synthetic
ttgggagttgtacaagagtggaggcgatactaggctgtgagggcgggtcatctcctccacacattgctttcagaa

SEQ ID NO: 286271 - DNA, 75 bp, Artificial Sequence
  Synthetic
gccaattatatcttgccactttttgacgcactgactatgacagacaacttgaacaaagtgtttaaaaagctgatc

SEQ ID NO: 286272 - DNA, 75 bp, Artificial Sequence
  Synthetic
aggtcattattacggctctgtctaagcctcctgtgaatccccgggagtttttgaaatctatagacctcggaggat

SEQ ID NO: 286273 - DNA, 75 bp, Artificial Sequence
  Synthetic
aagtggctatcattatatctatcatgatcgttttttctaatagagtcttcaatgtttccaaacccttgactgacc

SEQ ID NO: 286274 - DNA, 75 bp, Artificial Sequence
  Synthetic
gtcacactctttcaccagaacgagactagcctcctggctgtcagagaacagaggggggcctgttccaagcgagaa

SEQ ID NO: 286275 - DNA, 75 bp, Artificial Sequence
  Synthetic
tcaagagtcgagaaactctcattaatcatctcaactgattagacacagtcctgtaggttctgataaggtatgatg

SEQ ID NO: 286276 - DNA, 75 bp, Artificial Sequence
  Synthetic
catctatgggaaaactcctttatttcgaggtaacattttggtgcctgagtcgaaaagatgggctagagtctcttg

SEQ ID NO: 286277 - DNA, 75 bp, Artificial Sequence
  Synthetic
gatactaggctgtgagggcgggtcatctcctccacacattgctttcagaaaattgcttctcttttagagctgaga

SEQ ID NO: 286278 - DNA, 75 bp, Artificial Sequence
  Synthetic
tcatctcaactgattagacacagtcctgtaggttctgataaggtatgatgtattcggacagtatcattgactaat

SEQ ID NO: 286279 - DNA, 75 bp, Artificial Sequence
  Synthetic
gatacgtggcataagctcccgataacgcagatctttgaaattcctgaatcaatggatccatcagaaatactggat

SEQ ID NO: 286280 - DNA, 75 bp, Artificial Sequence
  Synthetic
tgacatctcatacaactctatgcttgactttgggcagaggccatagcaagttcctcctacattagactaaatagg

SEQ ID NO: 286281 - DNA, 75 bp, Artificial Sequence
  Synthetic
gactttgggcagaggccatagcaagttcctcctacattagactaaataggggttagttgagagaagcgacttgcc

SEQ ID NO: 286282 - DNA, 75 bp, Artificial Sequence
  Synthetic
cctccggtccctctgctctagagtggtccgcggccaacaaagaagatgacccatctgtggaggctgaaattgctc

SEQ ID NO: 286283 - DNA, 75 bp, Artificial Sequence
  Synthetic
ttcgttatcaccgaaaagctcctagctaattatatcttgccactctttgatgctctgactatgacagacaacctg

SEQ ID NO: 286284 - DNA, 75 bp, Artificial Sequence
  Synthetic
gacaccttagtgttcaagcgggtagcctgtaattccagcttgagtctttcatctcattggatcaggttgatttac

SEQ ID NO: 286285 - DNA, 75 bp, Artificial Sequence
  Synthetic
ttttgttaaactcgtggaacaccatacactaatgacaactcacaaaatgtgtgctaattggaataccataccgaa

SEQ ID NO: 286286 - DNA, 75 bp, Artificial Sequence
  Synthetic
ggtatgcaagactacaaagggctgggccatccaagcttcttagtcaagaaaaaaacagtggaatggaggaataat

SEQ ID NO: 286287 - DNA, 75 bp, Artificial Sequence
  Synthetic
aaaatactagctcagggagacaaccaagttctgtgtccgacatatatgctgtcgccggggctctctcgagagggg

SEQ ID NO: 286288 - DNA, 75 bp, Artificial Sequence
  Synthetic
aaaagtcttggatctattattcagacagatcagacctcattggattacgggaggatcaaatatactgtttggata

SEQ ID NO: 286289 - DNA, 75 bp, Artificial Sequence
  Synthetic
tgccatcgaggaaggggcatccaaactggggctcatcataaagaaggaagagaccatgtgtagctatgactttct

SEQ ID NO: 286290 - DNA, 75 bp, Artificial Sequence
  Synthetic
ccaaaagatgggctagggtctcctgtatctccaacgaccagatagtcaaccttgccaatataatgtcaactgtat

SEQ ID NO: 286291 - DNA, 75 bp, Artificial Sequence
  Synthetic
atgcaatcaggaaggccctatatgatgaggttgacaaggtggaaaactcagaatttagggaagcgatcctcttat

SEQ ID NO: 286292 - DNA, 75 bp, Artificial Sequence
  Synthetic
agggtctttcgaaactgtatgatcaagttcacattaagaaagtgatagacaagtcttaccaggagtgtctggcga

SEQ ID NO: 286293 - DNA, 75 bp, Artificial Sequence
  Synthetic
cagcctattaatgatagacagagaatctcaaaccaggaacacgagaaccaaaatactagctcaaggggataacca

SEQ ID NO: 286294 - DNA, 75 bp, Artificial Sequence
  Synthetic
cccactctgaatctaacaggagccggaagtgtataaccgacttggctcaattttactccaagtcttcccccatag

SEQ ID NO: 286295 - DNA, 75 bp, Artificial Sequence
  Synthetic
ccccctaatgcatcccttggcaaacccatcaacagtcttcaaggacggtgatgaggcggaggactttgttgaagt

SEQ ID NO: 286296 - DNA, 75 bp, Artificial Sequence
  Synthetic
aaaagctgttaaactgcacactcggaaatagagggctgagaatccctccagagggggttctaagttgtcttgaaa

SEQ ID NO: 286297 - DNA, 75 bp, Artificial Sequence
  Synthetic
ccatcaacagtcttcaaggacggtgatgaggcggaggactttgttgaagttcacctcccggacattcaagaacag

SEQ ID NO: 286298 - DNA, 75 bp, Artificial Sequence
  Synthetic
ctcagactgttggcaaagaactcaagaaggagacaccgtctgcttcttctcaaagagaaagtcaatcttcgaaag

SEQ ID NO: 286299 - DNA, 75 bp, Artificial Sequence
  Synthetic
ctcagatcctgtctcagaagggttgtccttctggagagagatatggctgagctccagtgagtcttgggttcatgc

SEQ ID NO: 286300 - DNA, 75 bp, Artificial Sequence
  Synthetic
gcgaccaatgaagaagatgacttatccgtagaggcagagatcgctcatcagattgctgagagcttttccaagaag

SEQ ID NO: 286301 - DNA, 75 bp, Artificial Sequence
  Synthetic
aaaaagatgggccagagtctcttgcatctcgaacgaccagatagtcaaccttgccaatataatgtcaacagtgtc

SEQ ID NO: 286302 - DNA, 75 bp, Artificial Sequence
  Synthetic
gagtgcaggcgctctggctatcctactgctgacaatcttcttaatgacatgttgcataaggaccaatagaacaaa

SEQ ID NO: 286303 - DNA, 75 bp, Artificial Sequence
  Synthetic
ctgctgacaatcttcttaatgacatgttgcataaggaccaatagaacaaaatcaatacaacaaggtcctggggag

SEQ ID NO: 286304 - DNA, 75 bp, Artificial Sequence
  Synthetic
atgggagtcattcaagagcggaggcgaaaccggcctgtgagggcgggtcatctcctctataccctgcattcagaa

SEQ ID NO: 286305 - DNA, 75 bp, Artificial Sequence
  Synthetic
tgatgatgacctatggctgccccctcctgaatatgttccgttgaaagaactcacgggcaagaaaaacatgaggaa

SEQ ID NO: 286306 - DNA, 75 bp, Artificial Sequence
  Synthetic
gaaaccggcctgtgagggcgggtcatctcctctataccctgcattcagaagatagtctctcttcgaggtcagggg

SEQ ID NO: 286307 - DNA, 75 bp, Artificial Sequence
  Synthetic
tttacaagattttgagcgcagaaggggacaactttcttctagcgatgtcaaggataatctatctagacccctcct

SEQ ID NO: 286308 - DNA, 75 bp, Artificial Sequence
  Synthetic
actcttcttgaaatctgttgagcctttgttcccccgatttctcagtgagctcttcagttcatcattcctggggat

SEQ ID NO: 286309 - DNA, 75 bp, Artificial Sequence
  Synthetic
tctttctggagggagatctggttaagctctcacgagtcctggattcacgcgttgtgtcaagaggccgggaaccca

SEQ ID NO: 286310 - DNA, 75 bp, Artificial Sequence
  Synthetic
ctcttatcttccaatgggctgattccaggggccctcttgagggggaggagttggaatactctcaagaaatcacct

SEQ ID NO: 286311 - DNA, 75 bp, Artificial Sequence
  Synthetic
gttgtgtcaagaggccgggaacccagatctcggagagcgaacactcgacagtttcactcgtcttctagaggatcc

SEQ ID NO: 286312 - DNA, 75 bp, Artificial Sequence
  Synthetic
ttggaatactctcaagaaatcacctgggatgacgatactgagtttgtcggattgcaaataagagtgagcgcaaga

SEQ ID NO: 286313 - DNA, 75 bp, Artificial Sequence
  Synthetic
ttaaaagtcgagaaacttccattaatcatctcaactgatcggacacatttatgtagattctgataatgtatgata

SEQ ID NO: 286314 - DNA, 75 bp, Artificial Sequence
  Synthetic
caggggccctcttgagggggaggagttggaatactctcaagaaatcacctgggatgacgatactgagtttgtcgg

SEQ ID NO: 286315 - DNA, 75 bp, Artificial Sequence
  Synthetic
aaaatttaggcctctcattcattccctgggggatttctctgtatttataagagataaggtgggtcaactcgaggg

SEQ ID NO: 286316 - DNA, 75 bp, Artificial Sequence
  Synthetic
tgatatctcagatgactctgtgctcgagattgggcagaagccatagcaatttcccttacaagagactaaataggg

SEQ ID NO: 286317 - DNA, 75 bp, Artificial Sequence
  Synthetic
ctgggggatttctctgtatttataagagataaggtgggtcaactcgagggaacgtttggtcctagtgcgaaaagg

SEQ ID NO: 286318 - DNA, 75 bp, Artificial Sequence
  Synthetic
cgacataagggccctatctaagagatttcaaaaccctttaatctctggactgagagtggttcagtgggcaaccgg

SEQ ID NO: 286319 - DNA, 75 bp, Artificial Sequence
  Synthetic
ggggaaggaaggtggtcggcacaacagttcctcacccctctgagatgttggggttgattcccaaatcctctattt

SEQ ID NO: 286320 - DNA, 75 bp, Artificial Sequence
  Synthetic
tcatctcaactgatcggacacatttatgtagattctgataatgtatgatatcttccgacggtatcagtgatcaat

SEQ ID NO: 286321 - DNA, 75 bp, Artificial Sequence
  Synthetic
gagattgggcagaagccatagcaatttcccttacaagagactaaataggggtcaattgagagaagtgatttgcct

SEQ ID NO: 286322 - DNA, 75 bp, Artificial Sequence
  Synthetic
gtgtgcataactaaaaggggccgggccatccaagcctttcagtcaagaaaaaaactgtggaatagagaagtaatt

SEQ ID NO: 286323 - DNA, 75 bp, Artificial Sequence
  Synthetic
cttggaagagtccttttataactcagagatccatgggatcaaccggatgacccagactccccagagggtcgggag

SEQ ID NO: 286324 - DNA, 75 bp, Artificial Sequence
  Synthetic
tgttcccccgattcctcagtgagcttttcagctcgtccttcttggggatccctgagtcaatcattggattgatac

SEQ ID NO: 286325 - DNA, 75 bp, Artificial Sequence
  Synthetic
accttgccagaaggatcctcaggtggggatttgacaagtactctaaatggtatcttgatttgcgacttctttcga

SEQ ID NO: 286326 - DNA, 75 bp, Artificial Sequence
  Synthetic
cctgagtcaatcattggattgatacaaaactcgcggacgataagaagacagtttagaaaaagtctctcaagaact

SEQ ID NO: 286327 - DNA, 75 bp, Artificial Sequence
  Synthetic
agaaagtcaccaatgttcatgtggtgaaaagagctctgtcactcaaggaatctataaactggttcattacaagag

SEQ ID NO: 286328 - DNA, 75 bp, Artificial Sequence
  Synthetic
tgtttcaaggaggatatctaggatggtttctggagctgtgcctcattttcgaaagcttcctgatattcgtctgag

SEQ ID NO: 286329 - DNA, 75 bp, Artificial Sequence
  Synthetic
gaaaagagctctgtcactcaaggaatctataaactggttcattacaagagactcaaatttggcccaaactttgat

SEQ ID NO: 286330 - DNA, 75 bp, Artificial Sequence
  Synthetic
taggaacataatgtctctgacaggcccagattttcctctggaagaggcccctgtcttcaagaggacagggtctgc

SEQ ID NO: 286331 - DNA, 75 bp, Artificial Sequence
  Synthetic
gatcttcgagatccccgaatcaatggacccatctgagatactagatgataaatcacactctttcactagaacaag

SEQ ID NO: 286332 - DNA, 75 bp, Artificial Sequence
  Synthetic
aggaaataggcccctccggatgactctgacagacaactgctctagatcttacaaagtattgaaggattacttcaa

SEQ ID NO: 286333 - DNA, 75 bp, Artificial Sequence
  Synthetic
aatcacactctttcactagaacaagactagcgtcgtggctatcagagaacagaggagggccggtccccagcgaga

SEQ ID NO: 286334 - DNA, 75 bp, Artificial Sequence
  Synthetic
atgactttatgtttcagccgttgatgctttatgcgcaaacatggacatcagaactggtgcaaaaagatacacggc

SEQ ID NO: 286335 - DNA, 75 bp, Artificial Sequence
  Synthetic
gctttatgcgcaaacatggacatcagaactggtgcaaaaagatacacggctgaaagattctacctttcactggca

SEQ ID NO: 286336 - DNA, 75 bp, Artificial Sequence
  Synthetic
gatttcgcattgtctatagatggaccactttatttggtcttcaaaacttacgggactatgctagtaaacccagac

SEQ ID NO: 286337 - DNA, 75 bp, Artificial Sequence
  Synthetic
ggtcgattacgataaagcatttgggaggtatctggctaacatatattcctcttatttattctttcacgtgatcac

SEQ ID NO: 286338 - DNA, 75 bp, Artificial Sequence
  Synthetic
cctctcagatcttcgagttcccagatgtctcaagaaggatatctaggatggtttctggagctgtgcctcatttca

SEQ ID NO: 286339 - DNA, 75 bp, Artificial Sequence
  Synthetic
gtttctggagctgtgcctcatttcagaaagcttcctgatattcgtttgagaccaggtgacttcgaatctctaagt

SEQ ID NO: 286340 - DNA, 75 bp, Artificial Sequence
  Synthetic
tagactattcaagggttacatacgcttttcacctggactatgagaagtggaacaatcatcagaggctggaatcga

SEQ ID NO: 286341 - DNA, 75 bp, Artificial Sequence
  Synthetic
ttttcacctggactatgagaagtggaacaatcatcagaggctggaatcgacagaggatgtattttctgtacttga

SEQ ID NO: 286342 - DNA, 75 bp, Artificial Sequence
  Synthetic
gggacaactttcttctggcgatgtcaaggataatctatctagacccctccttagggggagtgtcaggaatgtctc

SEQ ID NO: 286343 - DNA, 75 bp, Artificial Sequence
  Synthetic
gagttggtacagagagacacaaggctgagagactctacttttcactggcaccttcggtgcaacaggtgtgtgagg

SEQ ID NO: 286344 - DNA, 75 bp, Artificial Sequence
  Synthetic
cttctcagatcttcgagttcccggatgtttcgaaaagaatatccagaatggtctcgggggctgttcctcactttc

SEQ ID NO: 286345 - DNA, 75 bp, Artificial Sequence
  Synthetic
tctttgcgcaggacaaggtgggtggatcaggaagtgcgccatgcagcgagaactatgacagggagttacagcccc

SEQ ID NO: 286346 - DNA, 75 bp, Artificial Sequence
  Synthetic
cggtcaagatggtgggctagaggggttgcgacagaaaggttggagtctggtcagtttattaatgatagatcgtga

SEQ ID NO: 286347 - DNA, 75 bp, Artificial Sequence
  Synthetic
ggtgttcagaatgggtctgctctgctcagcaggttgcggtttcaacctctgctaacccagcccctgtctccgagc

SEQ ID NO: 286348 - DNA, 75 bp, Artificial Sequence
  Synthetic
tgtaattccagcttgagtctatcgtctcactggatcaggttgatttacaagatagtgaagactaccagactcgtc

SEQ ID NO: 286349 - DNA, 75 bp, Artificial Sequence
  Synthetic
aaaatcttgaggcacttcaacatatgctgcagtacaatgatgtatctgtcgacagctttaggtgatgtccccagc

SEQ ID NO: 286350 - DNA, 75 bp, Artificial Sequence
  Synthetic
aaactatgtgcagttatgactttctcatctatggaaagacccccttgtttcgaggtaacattttagttcctgagt

SEQ ID NO: 286351 - DNA, 75 bp, Artificial Sequence
  Synthetic
cgaggtaacattttagttcctgagtccaagagatgggctcgagtctcctgtatctccaacgaccaaatagtcaac

SEQ ID NO: 286352 - DNA, 75 bp, Artificial Sequence
  Synthetic
actttagaagctctaagatgacatatctgactctcatcacctaccagtctcatctgttacttcagaaggttgaga

SEQ ID NO: 286353 - DNA, 75 bp, Artificial Sequence
  Synthetic
atcttgatttgagactccttgcgagagaccaccccctgattccttatatcaaaacccagacatggcctccaaaac

SEQ ID NO: 286354 - DNA, 75 bp, Artificial Sequence
  Synthetic
atgaggcaggtgctgggtggccatggtgaagacaccttagagtcagacgaagacatccagaggctgttaagagac

SEQ ID NO: 286355 - DNA, 75 bp, Artificial Sequence
  Synthetic
aaaaacaagatcttgaatccgaacctctggctgtttgattgttttttccatctttattgtttttttgttaagcgt

SEQ ID NO: 286356 - DNA, 75 bp, Artificial Sequence
  Synthetic
aaaaacaagactctgaatcagaacctctggttgtttgattattttttttatctttattgtttttttgttaagcgt

SEQ ID NO: 286357 - DNA, 75 bp, Artificial Sequence
  Synthetic
aactatgacaggagtttacagccccaccaagaagatgtcacgcaaagccgggtgttcagaatgggtctgctctgc

SEQ ID NO: 286358 - DNA, 75 bp, Artificial Sequence
  Synthetic
accaagaagatgtcacgcaaagccgggtgttcagaatgggtctgctctgcacagcaggttgcggtttcgacctca

SEQ ID NO: 286359 - DNA, 75 bp, Artificial Sequence
  Synthetic
aatatctggacagaacaccggcaattacaagacaaacatcgcagacaggatagagcagatttttgaaacagcccc

SEQ ID NO: 286360 - DNA, 75 bp, Artificial Sequence
  Synthetic
atggtacgatgcttgtaaatccagattacagagcaattcaacacttatccagagcatttcctgcggtcactggat

SEQ ID NO: 286361 - DNA, 75 bp, Artificial Sequence
  Synthetic
gggcccattataagctcaaacctattctggatgatctcaatgtctttccatctctatgtcttgtggtcggggatg

SEQ ID NO: 286362 - DNA, 75 bp, Artificial Sequence
  Synthetic
gctttactcgcctgctcgaggatccaactaccctaaatattaaaggaggggctagtcccaccatccttctcaaag

SEQ ID NO: 286363 - DNA, 75 bp, Artificial Sequence
  Synthetic
ctcgtattcaacagcctgttagaagtaaatgacctgatggcatcaggaacacatccgttgcccccctcagcaatc

SEQ ID NO: 286364 - DNA, 75 bp, Artificial Sequence
  Synthetic
taaatgacctgatggcatcaggaacacatccgttgcccccctcagcaatcatgagtggaggagatgacatcatat

SEQ ID NO: 286365 - DNA, 75 bp, Artificial Sequence
  Synthetic
ctatcaagatcttgtaagaggatttcctgacgagatcatatccaacccttacaacgaaatgatcataactctgat

SEQ ID NO: 286366 - DNA, 75 bp, Artificial Sequence
  Synthetic
gcgcccattataagctcaagcctattctagatgatctcaatgctttcccatccctctgtctggtagttggggacg

SEQ ID NO: 286367 - DNA, 75 bp, Artificial Sequence
  Synthetic
tcttcagttcgtccttcttgggaattcctgagtcaattattgggttgatacaaaactctagaacaataagaagac

SEQ ID NO: 286368 - DNA, 75 bp, Artificial Sequence
  Synthetic
tctagatgatctcaatgctttcccatccctctgtctggtagttggggacggttcaggagggatctccagggcagt

SEQ ID NO: 286369 - DNA, 75 bp, Artificial Sequence
  Synthetic
attaccattggctacggactgtaaagaccaccaaggagtctcttatcatcatatctccaagtgtggctgatttgg

SEQ ID NO: 286370 - DNA, 75 bp, Artificial Sequence
  Synthetic
tgcgacagaaaggctggagtctggttagcttgttaatgatagatcgtgaatctcagaccagaaacacaagaacta

SEQ ID NO: 286371 - DNA, 75 bp, Artificial Sequence
  Synthetic
ggtttggccctgctcctctgagagggcagatctcctaagagagatctcgtgggggaggaaggtggtaggcacaac

SEQ ID NO: 286372 - DNA, 75 bp, Artificial Sequence
  Synthetic
tctcagaccagaaacacaagaactaagatattagctcaaggggacaatcaggttctgtgtccgacgtacatgttg

SEQ ID NO: 286373 - DNA, 75 bp, Artificial Sequence
  Synthetic
gggaaatcctcgaatatcagtgtctgtgcttccatcttttgatcagtcatttttctcgagaggccctctgaaggg

SEQ ID NO: 286374 - DNA, 75 bp, Artificial Sequence
  Synthetic
tgggagaaaccatcagacctgaggaacttgacaacatggaagtacttccagtcagtccagagaaaggttaacatg

SEQ ID NO: 286375 - DNA, 75 bp, Artificial Sequence
  Synthetic
acctggacaatgttggagtccagatagtcagacaaatgaggtcaggagaaagatttctcaagatctggtcacaga

SEQ ID NO: 286376 - DNA, 75 bp, Artificial Sequence
  Synthetic
atgaagcggaggactttgttgaggttcaccttccggacattcacaaacaggtctcaggggtcgaccttggtctcc

SEQ ID NO: 286377 - DNA, 75 bp, Artificial Sequence
  Synthetic
tggggctcatcataaagaaggaggagaccatgtgcagttatgactttctcatctacgggaaaactcctttatttc

SEQ ID NO: 286378 - DNA, 75 bp, Artificial Sequence
  Synthetic
acaacaggtggatcaccctcgatgacattagatcccgatcgtcccttttggattatagctgcttgtgaactatgc

SEQ ID NO: 286379 - DNA, 75 bp, Artificial Sequence
  Synthetic
ggctcttggactgtgtatcctgaaaaaaccgagatcctgattcagaacctctgtttgcttgattttttttctttt

SEQ ID NO: 286380 - DNA, 75 bp, Artificial Sequence
  Synthetic
aagatcttgagacacttcaacatatgctgcggcaccatgatgtacttgtctaccgccttaggggatgtgcccagc

SEQ ID NO: 286381 - DNA, 75 bp, Artificial Sequence
  Synthetic
tttagccccatcttgaaaggtagagtttacaagatcctgagtgccgagggggacaattttcttctagctatgtct

SEQ ID NO: 286382 - DNA, 75 bp, Artificial Sequence
  Synthetic
tttacaagatcctgagtgccgagggggacaattttcttctagctatgtctagaataatctatttagacccctcct

SEQ ID NO: 286383 - DNA, 75 bp, Artificial Sequence
  Synthetic
atgactttatgtttcaaccggtgatgctttatgcgcaaacatggacgtcagaactggtgcaaaaagacacacggt

SEQ ID NO: 286384 - DNA, 75 bp, Artificial Sequence
  Synthetic
gaagcaagtcatccgggggagtgtttacctgtcctggagttggtctgatgacacttcagtgtttaaaagggtggc

SEQ ID NO: 286385 - DNA, 75 bp, Artificial Sequence
  Synthetic
agtagctatcattatagccatcatgatagttttctccaatagagtctttaacgtttccaaacctttgactgatcc

SEQ ID NO: 286386 - DNA, 75 bp, Artificial Sequence
  Synthetic
ttgcaactctagcttgagtctctcatctcactggatcaggttgatttacaaaatagtgaagaccaccagacttgt

SEQ ID NO: 286387 - DNA, 75 bp, Artificial Sequence
  Synthetic
atagttttctccaatagagtctttaacgtttccaaacctttgactgatcctttattctatccaccatctgatccc

SEQ ID NO: 286388 - DNA, 75 bp, Artificial Sequence
  Synthetic
taccgctttaggagacgtccctagcttcgcgaggcttcatgacctgtacaacaggcctataacttattacttcag

SEQ ID NO: 286389 - DNA, 75 bp, Artificial Sequence
  Synthetic
acaacagatggatcaccctcgatgacattagatcccgatcatctctgttagattatagctgcttgtaagactaag

SEQ ID NO: 286390 - DNA, 75 bp, Artificial Sequence
  Synthetic
gaaaacttcccgatattcgtttgagaccgggtgatttcgaatctctaagcggtaaggagaaatcacgtcatatag

SEQ ID NO: 286391 - DNA, 75 bp, Artificial Sequence
  Synthetic
gggtacaatgatggaactattttccctgtcaacatatatagcaaggtttcccctagagactatttgagagggctc

SEQ ID NO: 286392 - DNA, 75 bp, Artificial Sequence
  Synthetic
acgcttaacaacaagactaagaaagagagcgacatcgtagcctacaagtccaaaaagtaacacccgtacaatgga

SEQ ID NO: 286393 - DNA, 75 bp, Artificial Sequence
  Synthetic
agatagtgaagactaccagactcgttggcagcatcaaggacctatctggagagatagaaagacaccttcatgggt

SEQ ID NO: 286394 - DNA, 75 bp, Artificial Sequence
  Synthetic
ctaagactcttgtgtgatgtatcttgaaaaaaacaagatcctaaatctgaacctttggttgtttgattgtttttc

SEQ ID NO: 286395 - DNA, 75 bp, Artificial Sequence
  Synthetic
gactacagttgcttgtaaactggatattcccggacgcctgtacacgataagacccttgtatgatatatcttgaaa

SEQ ID NO: 286396 - DNA, 75 bp, Artificial Sequence
  Synthetic
acatcctcttgagactggacaatcacccctctttgtacataatgctcagagagccttctctcagaggagagatat

SEQ ID NO: 286397 - DNA, 75 bp, Artificial Sequence
  Synthetic
gtttggccctgctcctctgagagggcagatctcctaagagagatctcttgggggaggaaggtggtcggcacaaca

SEQ ID NO: 286398 - DNA, 75 bp, Artificial Sequence
  Synthetic
cttttagaggtttgtaggtactaagacccttagacgatgcacctagaaaaaaacaagactctgaatcagaacctc

SEQ ID NO: 286399 - DNA, 75 bp, Artificial Sequence
  Synthetic
ggttacttccaaagtcctcgatctcatgcacttgtggagtagcaggagggggaaatcctcgaatatcagtgtctg

SEQ ID NO: 286400 - DNA, 75 bp, Artificial Sequence
  Synthetic
atttctctggtgagaccaggagtcctgaggctgtctatactcgaatcatgatgaatggaggtcgattaaagagat

SEQ ID NO: 286401 - DNA, 75 bp, Artificial Sequence
  Synthetic
catcttttgcttcagagggttgagaaaaacctctccaaaagtatgagagccaatttacgacaaatgagctctctc

SEQ ID NO: 286402 - DNA, 75 bp, Artificial Sequence
  Synthetic
gggaagacaccttagagtcagacgaagacattcaaaggctgttgaaagactctttgcgcaggacaaaatgggtag

SEQ ID NO: 286403 - DNA, 75 bp, Artificial Sequence
  Synthetic
ctataaattggtttatcacaagaaactcaaatttggcccaaactttgattagaaacataatgtctctgacaggcc

SEQ ID NO: 286404 - DNA, 75 bp, Artificial Sequence
  Synthetic
aaccatcccaaatatgagcaagatctttgttaatccgagtgcaatcagagccggtctggccgatcttgagatggc

SEQ ID NO: 286405 - DNA, 75 bp, Artificial Sequence
  Synthetic
tggagataaagcgtactgatgtagaagggaattgggctctgacaggaggcatggaactgacaagggaccccactg

SEQ ID NO: 286406 - DNA, 75 bp, Artificial Sequence
  Synthetic
cagattttcccttggaagaagcccctgtcttcaagaggacaggatccgccctgcataggtttaagtcagccagat

SEQ ID NO: 286407 - DNA, 75 bp, Artificial Sequence
  Synthetic
gcgaacccagctcccgcctccgaattggacatcagggctctctctagaaggcttcaaaacccgttgatctctggc

SEQ ID NO: 286408 - DNA, 75 bp, Artificial Sequence
  Synthetic
cttcgatgcaacaagtgcataaggcctatcgatgacattactcttgagacttctcaggtcttcgagttcccggat

SEQ ID NO: 286409 - DNA, 75 bp, Artificial Sequence
  Synthetic
ccgagattattgtggatcaatatgaatacaaatatccggccatcaaagacttgaagaaacccagtatcaccctag

SEQ ID NO: 286410 - DNA, 75 bp, Artificial Sequence
  Synthetic
aatttgaccacatggaggtacttccaatcagtccaaaaacaggtgaacatgtcctatgacctcatcatttgtgat

SEQ ID NO: 286411 - DNA, 75 bp, Artificial Sequence
  Synthetic
atcttggttgcgattcatgactctgggtacaatgatggaaccatattccctgtcaacatatatagcaaggtctcc

SEQ ID NO: 286412 - DNA, 75 bp, Artificial Sequence
  Synthetic
tgtcaacatatatagcaaggtctcccccagagactatttgagagggctcgcgagaggagtcctgatagggtcttc

SEQ ID NO: 286413 - DNA, 75 bp, Artificial Sequence
  Synthetic
aacattaacatcaatagacctcttgaactgatctcaggagtgatttcatacatcctcttgagactggacaatcac

SEQ ID NO: 286414 - DNA, 75 bp, Artificial Sequence
  Synthetic
tcttgattgcacgaaaaggagacaaaatcacccctgattctcttgtagatataaaacgtactgatgtggaaggga

SEQ ID NO: 286415 - DNA, 75 bp, Artificial Sequence
  Synthetic
aactgatctcaggagtgatttcatacatcctcttgagactggacaatcacccatctctgtacataatgctcagag

SEQ ID NO: 286416 - DNA, 75 bp, Artificial Sequence
  Synthetic
tcatcactcagatgacctcgtctttctcatccgaaatatacctcagattctcaaaacgagggaagttctttcgag

SEQ ID NO: 286417 - DNA, 75 bp, Artificial Sequence
  Synthetic
gcaacagatctattctgtgctacctccaacacgtgttgcgctacgaacgagaggcaatcacagcatctccggaga

SEQ ID NO: 286418 - DNA, 75 bp, Artificial Sequence
  Synthetic
cctgaatatgtcccgctgaaagaactcacaagcaagaagaacatgaggaacttttgtatcaacggagaggttaaa

SEQ ID NO: 286419 - DNA, 75 bp, Artificial Sequence
  Synthetic
ttatcaagatcttgtaagaggatttccagatgagatcatatccaacccttacagtgaaatgatcataaccctgat

SEQ ID NO: 286420 - DNA, 75 bp, Artificial Sequence
  Synthetic
aaatctctccaaaagtatgagagccaacctacgacaaatgagctctctaatgaggcaggtgctgggtgggcatgg

SEQ ID NO: 286421 - DNA, 75 bp, Artificial Sequence
  Synthetic
taaggagttgaatgacagggtgccagaaatccatagattgtgtatatccatcatgaaaaaaactaacactcctcc

SEQ ID NO: 286422 - DNA, 75 bp, Artificial Sequence
  Synthetic
cacctccagggagaacctatagaagtggacagtctccctgaggacatgagccgacttcacttggatgatggaaaa

SEQ ID NO: 286423 - DNA, 75 bp, Artificial Sequence
  Synthetic
attgcaaataagagtgagtgcaagacaatgtcatattcaaggcaggatctggtgtatcaacatgaactcgagagc

SEQ ID NO: 286424 - DNA, 75 bp, Artificial Sequence
  Synthetic
ttcatccacttccgttcattaggtctaagtggaaagtcaccatattcatcaaatgcagttggtcacgtgttcaat

SEQ ID NO: 286425 - DNA, 75 bp, Artificial Sequence
  Synthetic
ggacagtctccccgaagacatgaaacggcttcaattggaagacgagaaaccttctggcctcggcgagatggccaa

SEQ ID NO: 286426 - DNA, 75 bp, Artificial Sequence
  Synthetic
gaaacaagtcattcgggggaatacttatctgtcttggagttggtccgatgacacctcagtgtttaagagggtggc

SEQ ID NO: 286427 - DNA, 75 bp, Artificial Sequence
  Synthetic
gagaggactttcagatggatgagggagaggaccccaacctcctgttccaatcgtacctggacaatgttggagtcc

SEQ ID NO: 286428 - DNA, 75 bp, Artificial Sequence
  Synthetic
aacggttattgccacatgtgccccccatgagatgtctgttctgggaggctacttgggagaggagttttttgggaa

SEQ ID NO: 286429 - DNA, 75 bp, Artificial Sequence
  Synthetic
aaatagtaaagaccaccagacttgtcggaagcgtagaagacttgtctggggaagtggagaagcaccttagagggt

SEQ ID NO: 286430 - DNA, 75 bp, Artificial Sequence
  Synthetic
cagaccgtagaggaaattatatcctatgtcacggtcaactttcctaaccctccaggaaggtcttcagaggataaa

SEQ ID NO: 286431 - DNA, 75 bp, Artificial Sequence
  Synthetic
atgtcacggtcaactttcctaaccctccaggaaggtcttcagaggataaatcaacccaaactactggccgggagc

SEQ ID NO: 286432 - DNA, 75 bp, Artificial Sequence
  Synthetic
cggaagcgtagaagacttgtctggggaagtggagaagcaccttagagggtacaacaggtggatcacccttgatga

SEQ ID NO: 286433 - DNA, 75 bp, Artificial Sequence
  Synthetic
attctcgagggaatatacagactgagactcttggacggtgcaccctgaaaaaaacgaaatcttaattcattgcct

SEQ ID NO: 286434 - DNA, 75 bp, Artificial Sequence
  Synthetic
gactcttggacggtgcaccctgaaaaaaacgaaatcttaattcattgcctctgtttgcttgattgtttttccatc

SEQ ID NO: 286435 - DNA, 75 bp, Artificial Sequence
  Synthetic
cctctggccctccatcccttgaattgtctgccaccaatgaagaggatgatctatcagtagaggctgagatcgctc

SEQ ID NO: 286436 - DNA, 75 bp, Artificial Sequence
  Synthetic
aactcatttgccgagtttctaaacaagacatactctagtgactcataaagaactgaacaacaagattgaaaagaa

SEQ ID NO: 286437 - DNA, 75 bp, Artificial Sequence
  Synthetic
tcaggaatattcttgtataattttgagcaactgaagatgaaccttgatgacatagttaaagaggcaaaaaatgta

SEQ ID NO: 286438 - DNA, 75 bp, Artificial Sequence
  Synthetic
gaaccatcccaaccatgagcaagatcttcgtaaatccgagtgcaatcagggccggcctggctgaccttgagatgg

SEQ ID NO: 286439 - DNA, 75 bp, Artificial Sequence
  Synthetic
ccgggcgtgacccgtctggcccatgatggatccaaaatccccctaagatgtgtactgggatgggtcgctttggcc

SEQ ID NO: 286440 - DNA, 75 bp, Artificial Sequence
  Synthetic
catctccagggagagcccatagaagtggacaatctccctgaggacatgaggcggcttcagttagatgatgggaag

SEQ ID NO: 286441 - DNA, 75 bp, Artificial Sequence
  Synthetic
cctggataatgttggagttcatatggtcagacaaatgaggtcaggagagaggttcctcaagatatggtctcatac

SEQ ID NO: 286442 - DNA, 75 bp, Artificial Sequence
  Synthetic
gagcatgcatccttggtcggtcttctcttgagtttgtataggttgagcaaaatatcaggacagaacactggcaat

SEQ ID NO: 286443 - DNA, 75 bp, Artificial Sequence
  Synthetic
tagtcttctccaacagggtgttcaatgtctcaaaaccgctgactgaccctttattctatccgccatctgatccca

SEQ ID NO: 286444 - DNA, 75 bp, Artificial Sequence
  Synthetic
gaaggaaaccccttcggcttcttctcagagagagagccaatcctcgaaagcccgaatggcggctcaaactgcctc

SEQ ID NO: 286445 - DNA, 75 bp, Artificial Sequence
  Synthetic
ttcaggagcaatagaacaaaaacatgttatggtgccgttgaatcgctgcattttatcagagtcaaatcaattaca

SEQ ID NO: 286446 - DNA, 75 bp, Artificial Sequence
  Synthetic
gatcaccccagattctctggtggagataaagcgtactgatgtcgaagggaattgggctctgacaggaggcgtgga

SEQ ID NO: 286447 - DNA, 75 bp, Artificial Sequence
  Synthetic
gtcaaagagtcaaaaaatgtcccaggtgtgacccgtttagctcatgatggatctaaactccctctaagatgtgta

SEQ ID NO: 286448 - DNA, 75 bp, Artificial Sequence
  Synthetic
ctcactggattaggctaatttacaagatagtaaagacaactagacttgtcggaaacatagaagacctgtccgggg

SEQ ID NO: 286449 - DNA, 75 bp, Artificial Sequence
  Synthetic
gatctggtgtatcaacatgaactcgagagcatgtcaactatggtctgacatgtctcttcagacacaaaggtctga

SEQ ID NO: 286450 - DNA, 75 bp, Artificial Sequence
  Synthetic
gccagaaaagttgaataaaattatgcaggatgatttaaaccgttatacgtcctgctgacaattttcaaactcagg

SEQ ID NO: 286451 - DNA, 75 bp, Artificial Sequence
  Synthetic
attcgatccagatcatctcttctagattacagctgcttgtaaactaggctctctctaaggaatgtgcggaccaag

SEQ ID NO: 286452 - DNA, 75 bp, Artificial Sequence
  Synthetic
aagtttatcacttgtttacctctggaggagagaacatacgggcttaactccaatccttgggagcaatagaacaaa

SEQ ID NO: 286453 - DNA, 75 bp, Artificial Sequence
  Synthetic
actcttggacggtgtatcctgaaaaaaacaggatcctaattcataacctctttttacttgattgtttttccatct

SEQ ID NO: 286454 - DNA, 75 bp, Artificial Sequence
  Synthetic
cccttctacagttttcaaagagggtgatgaggctgaggattttgttgaagttcacctccccgatgtgcataaaca

SEQ ID NO: 286455 - DNA, 75 bp, Artificial Sequence
  Synthetic
aggcaacaccactgataaaatgaactttctacgcaagatagtgaaaaactgtagggatgaggacacccagaagcc

SEQ ID NO: 286456 - DNA, 75 bp, Artificial Sequence
  Synthetic
ctcccctgtatctgctcctccagatgatgatgacttgtggctgccccctcctgaatatgtcccgttgaaagaact

SEQ ID NO: 286457 - DNA, 75 bp, Artificial Sequence
  Synthetic
ccagacaaacttggtccctggagccctattgacatacaccatctcagctgtccaaataacctggttgtggaggac

SEQ ID NO: 286458 - DNA, 75 bp, Artificial Sequence
  Synthetic
ttccacaagaactttgaggaagagataagaagaatgttcgagccagggcaggagacagctgttcctcactcttat

SEQ ID NO: 286459 - DNA, 75 bp, Artificial Sequence
  Synthetic
tgtgcagtccaaacggctactcgttcaagatcctacggcatattctgagatcatttgatgagatatattctggaa

SEQ ID NO: 286460 - DNA, 75 bp, Artificial Sequence
  Synthetic
tcccagagcgggaaggtcatatcttcatgggagtcatataagagtggaggtgagacccgactgtgagggccggcc

SEQ ID NO: 286461 - DNA, 75 bp, Artificial Sequence
  Synthetic
caataaattatgtacatccttcatgaaaaaaactaacacccctcctttcgaaccatctcagacatgagcaagatt

SEQ ID NO: 286462 - DNA, 75 bp, Artificial Sequence
  Synthetic
atacatctcagccataaaagtgaacgggttcacttgcacaggtgttgtgacagaggcagaaacctacaccaactt

SEQ ID NO: 286463 - DNA, 75 bp, Artificial Sequence
  Synthetic
ggagctccagtccctgagggcatgaactgggtgtataaattgaggagaactcttatcttccaatgggctgattct

SEQ ID NO: 286464 - DNA, 75 bp, Artificial Sequence
  Synthetic
cctcgatttgcttcttgacacgaatgacaaatattaacattaacagacctcttgaattgatctcaggggtaattt

SEQ ID NO: 286465 - DNA, 75 bp, Artificial Sequence
  Synthetic
cagaggcagaaacctacaccaactttgttggttatgtcacaaccacattcaagagaaagcatttccgccccaccc

SEQ ID NO: 286466 - DNA, 75 bp, Artificial Sequence
  Synthetic
ctggaagatggccggtgaccccagatatgaagagtctctacacaatccgtaccccgactaccattggcttcgaac

SEQ ID NO: 286467 - DNA, 75 bp, Artificial Sequence
  Synthetic
ttcaagagtcgtgagactttcattaatcatctcagtcgatcagacaaggtcatgtaaattctcataatacgggaa

SEQ ID NO: 286468 - DNA, 75 bp, Artificial Sequence
  Synthetic
aggaacattgaggataatcaggctcatctccaaggagaacctatagaggtggacagtcttcccgaggatataaga

SEQ ID NO: 286469 - DNA, 75 bp, Artificial Sequence
  Synthetic
accccgactaccattggcttcgaactgtaaaaaccaccaaagagtctctcgttatcatatccccaagtgtgacag

SEQ ID NO: 286470 - DNA, 75 bp, Artificial Sequence
  Synthetic
ataccaaagggtgtggacaagccaagggaggattttttcttaaatgactcagtgcttgggcacagaaagaggtcg

SEQ ID NO: 286471 - DNA, 75 bp, Artificial Sequence
  Synthetic
gggaggattttttcttaaatgactcagtgcttgggcacagaaagaggtcgtagtgtatcccctgatcgaggactc

SEQ ID NO: 286472 - DNA, 75 bp, Artificial Sequence
  Synthetic
ctgagactagggacatcttgtgacatttttaccaatagcagagggaagagggcatccaaaggaggcaagacttgc

SEQ ID NO: 286473 - DNA, 75 bp, Artificial Sequence
  Synthetic
agtagctcataatcatattgcgtctcagtgaagtgtacataactataaagggctgggtcatctaagcatttcaat

SEQ ID NO: 286474 - DNA, 75 bp, Artificial Sequence
  Synthetic
cgcatatacggagatatgtctcagtcagttctaatcatcaaacccgtccaaactcgtttgctgagtttctaaaca

SEQ ID NO: 286475 - DNA, 75 bp, Artificial Sequence
  Synthetic
ggcctgagagtggttcagtgggcaaccggtgcccattataagcttaagcctattctagatgatctaaatgttttc

SEQ ID NO: 286476 - DNA, 75 bp, Artificial Sequence
  Synthetic
atacatcatctcagctgtccgaataatttggttatggaggatgaaggatgtaccaatctgtcagggttctcatac

SEQ ID NO: 286477 - DNA, 75 bp, Artificial Sequence
  Synthetic
tggggtgggttgccctagccaaatccaagaagttccagctgttagttgagcccgacaagctgaataaaataatgc

SEQ ID NO: 286478 - DNA, 75 bp, Artificial Sequence
  Synthetic
acgtctcagtcacttgagaaaacttgtccctgggtttggaaaagcatataccatattcaacaaaaccttgatgga

SEQ ID NO: 286479 - DNA, 75 bp, Artificial Sequence
  Synthetic
cttccaaccttggtgagatggccaaggtgggagaaggcaagtaccgggaggactttcaaatggatgaaggagagg

SEQ ID NO: 286480 - DNA, 75 bp, Artificial Sequence
  Synthetic
gattgcaggtgctctaatgactctaatgttgttcatcttcttgatgacatgttgcagaagagtcaacaggacgga

SEQ ID NO: 286481 - DNA, 75 bp, Artificial Sequence
  Synthetic
cccaaaacagaaaagttatatcttcatgggagtcttacaagagcggaggcgagaccaagctgtgaggagggcttc

SEQ ID NO: 286482 - DNA, 75 bp, Artificial Sequence
  Synthetic
actgctcccccccaatacatggaagaacaccctgccttgacaatcccccacggactctgtccaacagggtaaatt

SEQ ID NO: 286483 - DNA, 75 bp, Artificial Sequence
  Synthetic
atttttatagtatcagcgactaatggtgctctcaccctctaaggactggtaccaaaggttgtggacaagctgacc

SEQ ID NO: 286484 - DNA, 75 bp, Artificial Sequence
  Synthetic
gtaattacattatacatgaatgccctagactgggacgaggagaaaaccatcctagcgttatggaaagatttaaac

SEQ ID NO: 286485 - DNA, 75 bp, Artificial Sequence
  Synthetic
cctggacaacgttggaattcaaatggtcagacaaatgaggtcaggagagagattcctcaagatatggtctcagac

SEQ ID NO: 286486 - DNA, 75 bp, Artificial Sequence
  Synthetic
catcttcatgggagtcatataagagtggaggcgagaccagactgtgaaggccggtcatccttttgacaattcaag

SEQ ID NO: 286487 - DNA, 75 bp, Artificial Sequence
  Synthetic
gtcctccttgaactccatccaacagggtagatttaagagtcatgagactttcattaatcatctcagttgatcaga

SEQ ID NO: 286488 - DNA, 75 bp, Artificial Sequence
  Synthetic
cgaagttatcaaaatattggagccatatgtcgtgaacagtttggtccagagggcagagaagtttaggcctctcat

SEQ ID NO: 286489 - DNA, 75 bp, Artificial Sequence
  Synthetic
tcattaatcatctcagttgatcagacatggtcgtgtagattctcataacacgggagatcttctagcagtttcagt

SEQ ID NO: 286490 - DNA, 75 bp, Artificial Sequence
  Synthetic
acatacatcatctcagctgtcccaacaatctggttgcagaaaacgacgggtgcaccagtctgtcagggttttcct

SEQ ID NO: 286491 - DNA, 75 bp, Artificial Sequence
  Synthetic
gtgcttgggcacagaaagaggtcgtagtttgccccttgatagcagattcaacatgaattaactaagaaaggcgat

SEQ ID NO: 286492 - DNA, 75 bp, Artificial Sequence
  Synthetic
caacggtatcatcctgggccctgacggccatgtcctgatcccggaaatgcagtcatccctcctccagcagcatat

SEQ ID NO: 286493 - DNA, 75 bp, Artificial Sequence
  Synthetic
cctgacaagctaaataagataatgcaagacgacctgaatcgttatgtgttctgttgaccacaccctcaggctcag

SEQ ID NO: 286494 - DNA, 75 bp, Artificial Sequence
  Synthetic
gctgggtcatctaagcatttcagtcgagaaaaaaactgtagaccaaaagaacaactaacaacacttctcatcccg

SEQ ID NO: 286495 - DNA, 75 bp, Artificial Sequence
  Synthetic
gatgacaaatcacactctttcaccaggacaagattagcttcttggctgtcagagaaccgaggagggcctgttcct

SEQ ID NO: 286496 - DNA, 75 bp, Artificial Sequence
  Synthetic
agaggactgccggatgaggacttgataattggcctcaaaccgaaggaacgagagttgaagattgagggtcgattc

SEQ ID NO: 286497 - DNA, 75 bp, Artificial Sequence
  Synthetic
ctctcctatatttcaggtcccgaagatctcacccccttgagataagggggacatctctggattcgatggtcctcc

SEQ ID NO: 286498 - DNA, 75 bp, Artificial Sequence
  Synthetic
tcttctagcagttccagtgaccaacggtgcttttatcctccaagagctgatactgaaggtgatggacaggccttg

SEQ ID NO: 286499 - DNA, 75 bp, Artificial Sequence
  Synthetic
gaagtggaacaatcatcaaagattggagtcaacagaagatgttttttctgtcctagatcatgtgttcggattgaa

SEQ ID NO: 286500 - DNA, 75 bp, Artificial Sequence
  Synthetic
gcaccaacctgtcagggttttcctacatggaacttaaagttggatacatctcagccataaaagtgaacgggttca

SEQ ID NO: 286501 - DNA, 75 bp, Artificial Sequence
  Synthetic
cctatgaaggacataagcaatagatcaccgtcatcttgcatttcagcaaattttgcataattataaagggctggg

SEQ ID NO: 286502 - DNA, 75 bp, Artificial Sequence
  Synthetic
tatctcagctgtgccagctatacatcgctggggatcaagtcttgtccttgtgtgggaactccggctatgaagtca

SEQ ID NO: 286503 - DNA, 75 bp, Artificial Sequence
  Synthetic
ttagtgcaggtgctttggcaatactgattctggcgatcgtcttaataatatgttgtaggagggttaataagacag

SEQ ID NO: 286504 - DNA, 75 bp, Artificial Sequence
  Synthetic
ccgagatcattgtagatcaatatgaatacaaatatccggccatcaaagatttgaagaaaccgagtatcaccctag

SEQ ID NO: 286505 - DNA, 75 bp, Artificial Sequence
  Synthetic
tgggagactttcctatgtttataaaagacaaggtgaatcaacttgaagggactttcggtcccagtgcaaaaaggt

SEQ ID NO: 286506 - DNA, 75 bp, Artificial Sequence
  Synthetic
cctcaaaacgggaagatcatatcctcatgggagttgtacaaaagtgaaagtgagactgggctgtgaaggtgagtc

SEQ ID NO: 286507 - DNA, 75 bp, Artificial Sequence
  Synthetic
aatgctgccaagcttgatccggatgatgtgtgctcctacttagcagctgcaatgcaattttttgaagggacatgc

SEQ ID NO: 286508 - DNA, 75 bp, Artificial Sequence
  Synthetic
agtatatcaaggaatgcactctcaatataccgagctatcgaggaaggagcatctaaactggggctgatcatcaag

SEQ ID NO: 286509 - DNA, 75 bp, Artificial Sequence
  Synthetic
tagggacgtcttgtgacatttttaccaatagcagagggaagagagcatccaaagggagtaagacttgcggctttg

SEQ ID NO: 286510 - DNA, 75 bp, Artificial Sequence
  Synthetic
agttaatgttggaatggttaaagacgggaaatagaccttaccgaatgaccctgacagacaactgctctaggtctt

SEQ ID NO: 286511 - DNA, 75 bp, Artificial Sequence
  Synthetic
catgggagttgtacaaaagtgaaagtgagactgggctgtgaaggtgagtcatccccttcacaccatgcatttaga

SEQ ID NO: 286512 - DNA, 75 bp, Artificial Sequence
  Synthetic
gtaggtggaaccgcagcccagtcaatgatctccctctggttatatggcgctcactctgagtcaaacaggagccgg

SEQ ID NO: 286513 - DNA, 75 bp, Artificial Sequence
  Synthetic
agtcaacctcgccaatataatgtcgacagtatctaccaatgcgctaacagtggcacagcactctcaatctctgat

SEQ ID NO: 286514 - DNA, 75 bp, Artificial Sequence
  Synthetic
ttatgtggagttctaggacttaaacttatggatgggacatgggtcgcgatgcaaacatcagatgagaccaaatgg

SEQ ID NO: 286515 - DNA, 75 bp, Artificial Sequence
  Synthetic
gaagctgttgaattgcacacttggaaatagaggactaagaatccctcctgaaggggtgttaagttgtcttgaaag

SEQ ID NO: 286516 - DNA, 75 bp, Artificial Sequence
  Synthetic
gagcatgcgtccttagttggtcttctcttgagtctgtataggttgagcaaaatatcaggacaaaacaccggcaac

SEQ ID NO: 286517 - DNA, 75 bp, Artificial Sequence
  Synthetic
tcttgagtctgtataggttgagcaaaatatcaggacaaaacaccggcaactacaagacaaacattgcagatagga

SEQ ID NO: 286518 - DNA, 75 bp, Artificial Sequence
  Synthetic
actctgatgacaactcacaagatgtgtgctaactggagtaccataccgaacttcagattcttggctggaacttac

SEQ ID NO: 286519 - DNA, 75 bp, Artificial Sequence
  Synthetic
aaagatcaaatatggggactactaattgtgacgaaggactttgtgtactcccagagttcaaactgtctttttgac

SEQ ID NO: 286520 - DNA, 75 bp, Artificial Sequence
  Synthetic
aggaactatacacttatgctaaaagacctttttttgtctcgtttcaactctctaatgattttgctttctccccct

SEQ ID NO: 286521 - DNA, 75 bp, Artificial Sequence
  Synthetic
cgaactgggggaagtatgtatcactgagtgcaggggccttgatagccttgatgttgataattctcctaataacat

SEQ ID NO: 286522 - DNA, 75 bp, Artificial Sequence
  Synthetic
tgggtcaagtcagatctctcaatgccacagttattgccgcctgtgccccccatgagatgtctgttctgggaggct

SEQ ID NO: 286523 - DNA, 75 bp, Artificial Sequence
  Synthetic
acattcggtcccagtgcaaaaaggttctttcgggttttggatcagttcgacaacatccaggatctagtcttcgtg

SEQ ID NO: 286524 - DNA, 75 bp, Artificial Sequence
  Synthetic
tgcttacccaaccacgatgaaggagggtaatagatctatcttgtgttacctccaacatgtgctgcgctatgagcg

SEQ ID NO: 286525 - DNA, 75 bp, Artificial Sequence
  Synthetic
caggtgtttggattgaagagggtgttttctagaacacacgagttttttcagaagtcctggatctattattcagac

SEQ ID NO: 286526 - DNA, 75 bp, Artificial Sequence
  Synthetic
agagatgagaaagaacttcaagagtatgaggcagctgagtcgactaaaactgatgtggcattggcagacgacgga

SEQ ID NO: 286527 - DNA, 75 bp, Artificial Sequence
  Synthetic
aaagagaggaaagtatcggtcacttctcaaagcgggaaggtcatatcttcatgggagtcatataaaagtgggggt

SEQ ID NO: 286528 - DNA, 75 bp, Artificial Sequence
  Synthetic
ttcttatttattctttcatgtgatcaccctttatatgaacgccttggactgggatgaggagaagaccatcctagc

SEQ ID NO: 286529 - DNA, 75 bp, Artificial Sequence
  Synthetic
gatcacctccccttggggttggggggaatctctgggttcaatagtcctccttgaactccatgcaacagggtagat

SEQ ID NO: 286530 - DNA, 75 bp, Artificial Sequence
  Synthetic
acttttccggtgagaccaggagtcctgaagctgtctatacgcgaatcatgatgaacggaggtcgactaaagagat

SEQ ID NO: 286531 - DNA, 75 bp, Artificial Sequence
  Synthetic
gatacaggaaaagacttggtcaagtttaaggatcagatatggggattgctgattgtgaccaaagattttgtgtac

SEQ ID NO: 286532 - DNA, 75 bp, Artificial Sequence
  Synthetic
atattgactcgcgacttctccccagagaccaccccctgactccttatatcaaaactcagacatggccacccaaac

SEQ ID NO: 286533 - DNA, 75 bp, Artificial Sequence
  Synthetic
gattgtgaccaaagattttgtgtactcccaaagctctggctgcctctttgatagaaactatacacttatgctgaa

SEQ ID NO: 286534 - DNA, 75 bp, Artificial Sequence
  Synthetic
cagttccaatcatcaagcacgtccaaactcctttgccgagtttttaagcaagacgtactctagtgactcgtgatg

SEQ ID NO: 286535 - DNA, 75 bp, Artificial Sequence
  Synthetic
tctgtcaaagctatatgatcaggttcatatcaagaaggtgatagataagtcctaccaggagtgtttggctagcga

SEQ ID NO: 286536 - DNA, 75 bp, Artificial Sequence
  Synthetic
atggcataagctcccaatcacacagatatttgagatccctgagtcaatggacccctcagagatattagatgacaa

SEQ ID NO: 286537 - DNA, 75 bp, Artificial Sequence
  Synthetic
ctccatgtcaacccagctgttccatgcatgggaaaaagtcactaatgttcatgtggtgaaaagggctctatcgtt

SEQ ID NO: 286538 - DNA, 75 bp, Artificial Sequence
  Synthetic
taccaaaggttgtggactggccaaggagtgtgtcggatgtctccgtgcttgggcatggacagaggtcataatgtg

SEQ ID NO: 286539 - DNA, 75 bp, Artificial Sequence
  Synthetic
gaaccatctcaaacatgagcaagatcttcgtcaatccgagtgcaatcagagccggtttggctgatctcgagatgg

SEQ ID NO: 286540 - DNA, 75 bp, Artificial Sequence
  Synthetic
atggatgccgacaagattgtattcaaagttaacaatcaggtggtctctctgaagcccgagattatcgtggaccaa

SEQ ID NO: 286541 - DNA, 75 bp, Artificial Sequence
  Synthetic
gaggggggcctgttccgagtgagaaggtcattatcacagctctgtccaaaccgcctgtcaaccccagagagttct

SEQ ID NO: 286542 - DNA, 75 bp, Artificial Sequence
  Synthetic
cttaggaaaatctcctgacttgaataaggcatataaatcgattttgtctggcatgaatgcggctaagcttgatcc

SEQ ID NO: 286543 - DNA, 75 bp, Artificial Sequence
  Synthetic
aaggcatataaatcgattttgtctggcatgaatgcggctaagcttgatcctgatgatgtgtgctcctatttggcc

SEQ ID NO: 286544 - DNA, 75 bp, Artificial Sequence
  Synthetic
catctccagggggagcccatagaagtggacaatctccctgaggacatgaggcggcttcaactggaagacggaaag

SEQ ID NO: 286545 - DNA, 75 bp, Artificial Sequence
  Synthetic
tggaatccttatagctcggagaggggacaaaatcactcccgactctcttgtggatgtaaaacggactaatgtgga

SEQ ID NO: 286546 - DNA, 75 bp, Artificial Sequence
  Synthetic
gacaaaatcactcccgactctcttgtggatgtaaaacggactaatgtggaggggaattgggctctaacagggggc

SEQ ID NO: 286547 - DNA, 75 bp, Artificial Sequence
  Synthetic
ggacttccagatggatgaaggagaagatccagccctcctgttccagtcgtacctggacaatgttggggttcaaat

SEQ ID NO: 286548 - DNA, 75 bp, Artificial Sequence
  Synthetic
tcttcttttgagtctgtacaggctgagcaagatatctggacagaacactggcaactacaagacaaacattgcaga

SEQ ID NO: 286549 - DNA, 75 bp, Artificial Sequence
  Synthetic
ctgtggaggagattatctcctatgtcaccatcaacttttctaatccattgggaaagtcctcagaggacaaatcca

SEQ ID NO: 286550 - DNA, 75 bp, Artificial Sequence
  Synthetic
agggaatagaccttatcggatgactctgacagacaattgctccaggtcttacaaagttttgaaagattattttaa

SEQ ID NO: 286551 - DNA, 75 bp, Artificial Sequence
  Synthetic
gttccatatacgtcagttctcagaccctgtctctgaagggttgtcattctggagagagatctggttaagctccca

SEQ ID NO: 286552 - DNA, 75 bp, Artificial Sequence
  Synthetic
agaagatgtattttctgtcctagatcaggtgtttggattaaaaagggtgttctcgaggactcatgagtttttcca

SEQ ID NO: 286553 - DNA, 75 bp, Artificial Sequence
  Synthetic
agcaagatatctggacagaacactggcaactacaagacaaacattgcagatagaatagagcagatcttcgagacg

SEQ ID NO: 286554 - DNA, 75 bp, Artificial Sequence
  Synthetic
cccggacggaggttcatccgacctctggtcctccagctcttgaatggtctgctaccaacgaagaagacgacctat

SEQ ID NO: 286555 - DNA, 75 bp, Artificial Sequence
  Synthetic
gctaccaacgaagaagacgacctatcagtggaggcggagatcgctcaccagattgctgaaagcttttccaagaaa

SEQ ID NO: 286556 - DNA, 75 bp, Artificial Sequence
  Synthetic
gtccgacggcccgacctgctggaatggccaagatggcgggctggaaggcttacggcagaaaggctggagtctggt

SEQ ID NO: 286557 - DNA, 75 bp, Artificial Sequence
  Synthetic
cacagggtttataaagcagatcaacctcactgcgagagaagcattactatacttcttccacaaaaattttgagga

SEQ ID NO: 286558 - DNA, 75 bp, Artificial Sequence
  Synthetic
aaaaattgaaggtcggttctttgcattgatgtcctggaatctgaggttatattttgtcatcacagagaagctctt

SEQ ID NO: 286559 - DNA, 75 bp, Artificial Sequence
  Synthetic
gttgaaaatgaaccttgacgacatagtcaaggagtcaaagaatgtaccgggtataacccatttggctcatgatgg

SEQ ID NO: 286560 - DNA, 75 bp, Artificial Sequence
  Synthetic
agatattggcacaaggagataaccaggttctatgtccgacatacatgctatcgcctgggctgtcgagagaggggc

SEQ ID NO: 286561 - DNA, 75 bp, Artificial Sequence
  Synthetic
acttcttccacaaaaattttgaggaggagataagaagaatgtttgagccgggacaagaaactgcagttcctcact

SEQ ID NO: 286562 - DNA, 75 bp, Artificial Sequence
  Synthetic
ctaagaagttccagctgttggttgagccagacaagttgaataaaatcatgcaagatgatctgaatcgttacacat

SEQ ID NO: 286563 - DNA, 75 bp, Artificial Sequence
  Synthetic
gccagacaagttgaataaaatcatgcaagatgatctgaatcgttacacatcctgctgacagtttttgaactctgg

SEQ ID NO: 286564 - DNA, 75 bp, Artificial Sequence
  Synthetic
tcaacctcattcactttgtcggatgttatatgggtcaagtgagatccttgaatgcgacagttatcgccacatgtg

SEQ ID NO: 286565 - DNA, 75 bp, Artificial Sequence
  Synthetic
gagtccttctacaactcagagatccacgggattaatcggatgacccagacacctcaaagggtcgggagagtgtgg

SEQ ID NO: 286566 - DNA, 75 bp, Artificial Sequence
  Synthetic
tttctgcgcaagataatgaaaaactgtagggatgaggacacccagaagccctctcctgtgtcggctcctccagat

SEQ ID NO: 286567 - DNA, 75 bp, Artificial Sequence
  Synthetic
tcttcagagacgagaaagaactccaggaatatgaggcagctgaattaactaagactgagatcgccttggcggacg

SEQ ID NO: 286568 - DNA, 75 bp, Artificial Sequence
  Synthetic
ttgtggagcaacagggggaggcaatcctagagtttctgtatcagtactcccgtccttcgatcagtcatttttttc

SEQ ID NO: 286569 - DNA, 75 bp, Artificial Sequence
  Synthetic
cctagagtttctgtatcagtactcccgtccttcgatcagtcatttttttcacgaggtcccctaaagggatacttg

SEQ ID NO: 286570 - DNA, 75 bp, Artificial Sequence
  Synthetic
cacgggcaagaaaaacatgaggaacttctgtatcaatggagaggtcagggtgtgcagtccgactggctattcgtt

SEQ ID NO: 286571 - DNA, 75 bp, Artificial Sequence
  Synthetic
agtcctgaagcagtttacacccgaatcatgatgaatggaggcagactgaaaaggtcacatataaggaggtatgtc

SEQ ID NO: 286572 - DNA, 75 bp, Artificial Sequence
  Synthetic
tgtgcagtccgactggctattcgttcaggatcttacggcatattctaagatcatttgatgagatatattcaggga

SEQ ID NO: 286573 - DNA, 75 bp, Artificial Sequence
  Synthetic
tcatgatgaatggaggcagactgaaaaggtcacatataaggaggtatgtctcagtaagctccaatcatcaagccc

SEQ ID NO: 286574 - DNA, 75 bp, Artificial Sequence
  Synthetic
ggggagatttcatatacgccagttctcagatcctgtctcggagggattgtccttctggagagagatctggctgag

SEQ ID NO: 286575 - DNA, 75 bp, Artificial Sequence
  Synthetic
ggagccccagtcccagagggcatgaactgggtatacaaattgaggagaactctcatcttccaatgggctgattcc

SEQ ID NO: 286576 - DNA, 75 bp, Artificial Sequence
  Synthetic
ccttctggagagagatctggctgagctctcacgaatcttggattcacgccttgtgtcaggaggcagggaaccctg

SEQ ID NO: 286577 - DNA, 75 bp, Artificial Sequence
  Synthetic
taaaaagttgaacaacaagattgtaaacacggatgaattgtatgcacccttcatgaaaaaaaccaacacccctcc

SEQ ID NO: 286578 - DNA, 75 bp, Artificial Sequence
  Synthetic
actgggtatacaaattgaggagaactctcatcttccaatgggctgattccaggggccccctcgagggggaggagt

SEQ ID NO: 286579 - DNA, 75 bp, Artificial Sequence
  Synthetic
tccaagagatgggccagggtctcctgtatctctaacgaccaaatagtcaaccttgccaatataatgtcgacagta

SEQ ID NO: 286580 - DNA, 75 bp, Artificial Sequence
  Synthetic
cctaccaggagtgtttagcaagtgacctagccagaagaatcctcagatggggatttgataagtactccaagtggt

SEQ ID NO: 286581 - DNA, 75 bp, Artificial Sequence
  Synthetic
ttgcagatgagagtgagtgcacgacaatgtcatatccagggcagggtatggtgcatcaacatgaattctagggca

SEQ ID NO: 286582 - DNA, 75 bp, Artificial Sequence
  Synthetic
tccaccaatgcattgactgtagcacaacactctcaatccttgattaagccgatgagggactttcttcttatgtca

SEQ ID NO: 286583 - DNA, 75 bp, Artificial Sequence
  Synthetic
atggcagaggagactgtagatctgatcgctaggaatatagaagataatcaagcccatctccagggggatcccata

SEQ ID NO: 286584 - DNA, 75 bp, Artificial Sequence
  Synthetic
cgagccccactatcttactcaaggatgcgatcaggaaagccctgtatgacgaggtagataaggtggaaaactctg

SEQ ID NO: 286585 - DNA, 75 bp, Artificial Sequence
  Synthetic
aatgtcatatccagggcagggtatggtgcatcaacatgaattctagggcatgtcagttatggtctgacatgtctc

SEQ ID NO: 286586 - DNA, 75 bp, Artificial Sequence
  Synthetic
gggcagttctcaacatgtttccagatgctaagcttgtgttcaacagcttattagaggtgaacgatctgatggctt

SEQ ID NO: 286587 - DNA, 75 bp, Artificial Sequence
  Synthetic
cttttcttgaaatctgttgaacctctgtttccacgattccttagtgagcttttcagctcatccttcttggggatt

SEQ ID NO: 286588 - DNA, 75 bp, Artificial Sequence
  Synthetic
tagtcagattatatcccacagacttaccacttgtttacctctagaggagggagcacacgggcttaactccagcct

SEQ ID NO: 286589 - DNA, 75 bp, Artificial Sequence
  Synthetic
accaaagtagaggacagtatatttcaggaggactttcggatggacgaaggagaggacccagctctgttattccag

SEQ ID NO: 286590 - DNA, 75 bp, Artificial Sequence
  Synthetic
ttagaggtgaacgatctgatggcttctggaacacatccattgcctccttccgcaatcatgagtggaggggatgac

SEQ ID NO: 286591 - DNA, 75 bp, Artificial Sequence
  Synthetic
tttcagctcatccttcttggggattcctgagtcaatcatcggattgatacaaaactcccggacaataaggaggca

SEQ ID NO: 286592 - DNA, 75 bp, Artificial Sequence
  Synthetic
ttttatcaaaatcagattaattacctttacattttaaacctcgcggatgtgaaaaaaactcttaacatccctcaa

SEQ ID NO: 286593 - DNA, 75 bp, Artificial Sequence
  Synthetic
cgaaccgtcgaggagatcatatcctatgtcacggtcaacttccccaatccatcgaggagatcttcagaggacaaa

SEQ ID NO: 286594 - DNA, 75 bp, Artificial Sequence
  Synthetic
ctagcctcttggctgtcagagaaccgaggggggcccgttcccagcgagaaagttatcatcacggccttgtccaag

SEQ ID NO: 286595 - DNA, 75 bp, Artificial Sequence
  Synthetic
aagacttaaagaaagatgattcctcaggctcttctgtttgtaccctttctgggttttccgttgtgtcttgggaag

SEQ ID NO: 286596 - DNA, 75 bp, Artificial Sequence
  Synthetic
aggaggactttcggatggacgaaggagaggacccagctctgttattccagctgtacctagacaatgttggagttc

SEQ ID NO: 286597 - DNA, 75 bp, Artificial Sequence
  Synthetic
atgtcacggtcaacttccccaatccatcgaggagatcttcagaggacaaagccacccagactgccggccgggagc

SEQ ID NO: 286598 - DNA, 75 bp, Artificial Sequence
  Synthetic
agattgagggtcgattctttgctctaatgtcatggaatctaagattgtattttgtcatcaccgaaaagctcttgg

SEQ ID NO: 286599 - DNA, 75 bp, Artificial Sequence
  Synthetic
atgatgggaccatcttccctgtcaacatatacggcaaagtttcccctagagactatttgagagggctcgcaagag

SEQ ID NO: 286600 - DNA, 75 bp, Artificial Sequence
  Synthetic
tatacatcacctcagctgtccgaataatatggtcgtggaggacgaaggatgtaccaacctgtcagggttctcata

SEQ ID NO: 286601 - DNA, 75 bp, Artificial Sequence
  Synthetic
aaagccaaaatggcggcccaaactgcctccggtccctctgctctagagtggtccgcggccaacaaagaagatgac

SEQ ID NO: 286602 - DNA, 75 bp, Artificial Sequence
  Synthetic
gactgcttcctaagtcctccatctcttgtacttgcggagcaacaggaggagggaatcctagagtctcagtgtctg

SEQ ID NO: 286603 - DNA, 75 bp, Artificial Sequence
  Synthetic
aaaacttacgggactatgctagtaaacccagactataaagctattcaacatctgtcaagagcatttccttcggtc

SEQ ID NO: 286604 - DNA, 75 bp, Artificial Sequence
  Synthetic
cgtccttctcgtctgaactatacctccggttctccaaacgagggaaattttttagggatgccgagtacttgactt

SEQ ID NO: 286605 - DNA, 75 bp, Artificial Sequence
  Synthetic
tcagggatatttctatataattttgaacaattaaagatgaaccttgacgacatagtcaaagagtctaagaatgtg

SEQ ID NO: 286606 - DNA, 75 bp, Artificial Sequence
  Synthetic
agagacctataccaactttgttggctatgtcactaccacgtttaagagaaagcactttcgtccgatgccggatgc

SEQ ID NO: 286607 - DNA, 75 bp, Artificial Sequence
  Synthetic
aatatggtcgtggaggacgaaggatgtaccaacctgtcagggttctcatacatggaactcaaagtaggatacatt

SEQ ID NO: 286608 - DNA, 75 bp, Artificial Sequence
  Synthetic
ctcttagaggagagatattctctatccctcagaaaatccccgccgcttacccaaccactatgaaagaaggcaaca

SEQ ID NO: 286609 - DNA, 75 bp, Artificial Sequence
  Synthetic
ccctcagaaaatccccgccgcttacccaaccactatgaaagaaggcaacagatcgatcttgtgttacctccaaca

SEQ ID NO: 286610 - DNA, 75 bp, Artificial Sequence
  Synthetic
tacttgggatcctccacctccatgtcgacccagctgttccatgcttgggagaaggtcaccaatgttcatgtggtg

SEQ ID NO: 286611 - DNA, 75 bp, Artificial Sequence
  Synthetic
agtctttgcataatccttatcctgactatcattggcttcggactgtaaagactaccaaagagtccctagttatca

SEQ ID NO: 286612 - DNA, 75 bp, Artificial Sequence
  Synthetic
ttgaacccgacaagctgaataaaataatgcaggatgatctgaaccgttatgcatccctctaatcactcccctgac

SEQ ID NO: 286613 - DNA, 75 bp, Artificial Sequence
  Synthetic
ctcgaatttagctcagactctgattagaaacatcatgtctctgacaggccctgattttcctatagaagaggcccc

SEQ ID NO: 286614 - DNA, 75 bp, Artificial Sequence
  Synthetic
gtcagttcaagaacgagtgaatatgtcctatgatcttattatttgtgacgcagaggtcactgacatcgcatcagt

SEQ ID NO: 286615 - DNA, 75 bp, Artificial Sequence
  Synthetic
acagtgaaggggggtattcctctgtgtgccccaatctcctctctcatatctccgtaagtacagacaccatgtctg

SEQ ID NO: 286616 - DNA, 75 bp, Artificial Sequence
  Synthetic
cccgtatgataaatctcttcattctagcgtttttcctggtgggaaatgctcaggaataacagtgtcctctactta

SEQ ID NO: 286617 - DNA, 75 bp, Artificial Sequence
  Synthetic
aaaaacagacaacaccactgataaaatgaactttctacgcaagatagtgaagaactgtagagatgagaacgccca

SEQ ID NO: 286618 - DNA, 75 bp, Artificial Sequence
  Synthetic
tctcaaaccaggaacacaagaaccaaaatactagctcaaggagacaaccaggttctatgtccgacatatatgttg

SEQ ID NO: 286619 - DNA, 75 bp, Artificial Sequence
  Synthetic
agcgtttttcctggtgggaaatgctcaggaataacagtgtcctctacttactgttctaccaaccatgattacacc

SEQ ID NO: 286620 - DNA, 75 bp, Artificial Sequence
  Synthetic
atgaactttctacgcaagatagtgaagaactgtagagatgagaacgcccagaagccctcttttgtgtcggctcct

SEQ ID NO: 286621 - DNA, 75 bp, Artificial Sequence
  Synthetic
ctatagtaaagggaagagagcatccaaagagagcaagacatgtggatttgtagatgagaggggcttgtacaagtc

SEQ ID NO: 286622 - DNA, 75 bp, Artificial Sequence
  Synthetic
caacgattactaaaagactctttgcgaaggacaaggtgggtagatcaagaggtgcgccatgcagctagaaccatg

SEQ ID NO: 286623 - DNA, 75 bp, Artificial Sequence
  Synthetic
agatctcacgggcaagaaaaacatgagaaacttctgcatcaacggggaagtcaaggtgtgtagtccgaatggcta

SEQ ID NO: 286624 - DNA, 75 bp, Artificial Sequence
  Synthetic
aaagagagcaagacatgtggatttgtagatgagaggggcttgtacaagtctttgaaaggagcatgtaaactgaag

SEQ ID NO: 286625 - DNA, 75 bp, Artificial Sequence
  Synthetic
agaaacttctgcatcaacggggaagtcaaggtgtgtagtccgaatggctattcattcaggattttgcggcacatt

SEQ ID NO: 286626 - DNA, 75 bp, Artificial Sequence
  Synthetic
gtgtcaaaaagaatatctaggatggtctctggagctgtgcctcacttccaaagactccctgatatccgcttgaaa

SEQ ID NO: 286627 - DNA, 75 bp, Artificial Sequence
  Synthetic
ggtaaaggttgttgttggattggtgctgtcaggagcaccagtccccgagggcatgaattgggtatacaaattgag

SEQ ID NO: 286628 - DNA, 75 bp, Artificial Sequence
  Synthetic
ctgtcaggagcaccagtccccgagggcatgaattgggtatacaaattgaggagaactcttatattccagtgggct

SEQ ID NO: 286629 - DNA, 75 bp, Artificial Sequence
  Synthetic
gtcaagaaacgggaggagtgtttagatgcactagagtccatcatgaccaccaagtcagtgagtttcagacgtctt

SEQ ID NO: 286630 - DNA, 75 bp, Artificial Sequence
  Synthetic
caccaatgcgctaacagtggcacaacactctcaatctttgatcaaaccgatgagggattttctacttatgtcagt

SEQ ID NO: 286631 - DNA, 75 bp, Artificial Sequence
  Synthetic
cacttgggatgacgatacagagtttgtcggattagaaataagagtgagtgcgaggcagtgccatatccagggcag

SEQ ID NO: 286632 - DNA, 75 bp, Artificial Sequence
  Synthetic
gtcggattagaaataagagtgagtgcgaggcagtgccatatccagggcaggatttggtgtatcaacatgaattct

SEQ ID NO: 286633 - DNA, 75 bp, Artificial Sequence
  Synthetic
aggtagaaaagcaccttcgagggtacaacaggtggattaccctagacgacgtaaaatctagatcatctcttctag

SEQ ID NO: 286634 - DNA, 75 bp, Artificial Sequence
  Synthetic
catctgctttttgaccagaatgactaatatcaatattaacaggcctctcgagttgatatcaggcgtgatctcata

SEQ ID NO: 286635 - DNA, 75 bp, Artificial Sequence
  Synthetic
acccattgatgatattacccttgatacctctcaggtcttcgagttcccggacgtttcaagaaggatatctagaat

SEQ ID NO: 286636 - DNA, 75 bp, Artificial Sequence
  Synthetic
gctcactacaaatcggtcaggacttggaatgagatcatcccctctaaagggtgtttaaaagttggaggtagatgt

SEQ ID NO: 286637 - DNA, 75 bp, Artificial Sequence
  Synthetic
acctctcaggtcttcgagttcccggacgtttcaagaaggatatctagaatggtttctggagcagtgcctcatttt

SEQ ID NO: 286638 - DNA, 75 bp, Artificial Sequence
  Synthetic
caccttgggacggtatgccctgaaaaaaacaagaccctgatccgtaacctctgtttgcttgatggttttttttgt

SEQ ID NO: 286639 - DNA, 75 bp, Artificial Sequence
  Synthetic
cggccatgttctaatcccggagatgcaatcgtccctcctccagcagcatatggagttgttagaatcctctgtcat

SEQ ID NO: 286640 - DNA, 75 bp, Artificial Sequence
  Synthetic
ggaggacaaagactcctcagtgctgctggaatagtcacactacatcctaaagattcctcaattacttacctctgg

SEQ ID NO: 286641 - DNA, 75 bp, Artificial Sequence
  Synthetic
ctggaatagtcacactacatcctaaagattcctcaattacttacctctggaggagagaacacacgggcttgactc

SEQ ID NO: 286642 - DNA, 75 bp, Artificial Sequence
  Synthetic
ccatctttgtacataatgctcagagaaccatctcttagaggagagatattttctataccccagaagattccagct

SEQ ID NO: 286643 - DNA, 75 bp, Artificial Sequence
  Synthetic
ctgcattttatcagaacctgttctattacctttgcatctcaagcttctaggatgtgaaaaaaactattaacatct

SEQ ID NO: 286644 - DNA, 75 bp, Artificial Sequence
  Synthetic
ttacctttgcatctcaagcttctaggatgtgaaaaaaactattaacatctctcaaaagatctaaggaaggatgat

SEQ ID NO: 286645 - DNA, 75 bp, Artificial Sequence
  Synthetic
gagcgcaggcgtcttgatcgtactagtgttgatgattttcttgatgatgtgttgtaaaaagcctaatagagcgga

SEQ ID NO: 286646 - DNA, 75 bp, Artificial Sequence
  Synthetic
ggaaattccccatctataccataccagataagctcggcccttggagtcccatcgacatacaccacctcagctgtc

SEQ ID NO: 286647 - DNA, 75 bp, Artificial Sequence
  Synthetic
tcccttcggtcacagggtttataacccaagtaacttcgtccttttcttctgagctatacctccggttctccaaac

SEQ ID NO: 286648 - DNA, 75 bp, Artificial Sequence
  Synthetic
agataagctcggcccttggagtcccatcgacatacaccacctcagctgtcccaataatttgctcgcggaggatga

SEQ ID NO: 286649 - DNA, 75 bp, Artificial Sequence
  Synthetic
acccttctttgtacataatgctcagagagccctctctcagaggagagatattttctattccccaaaaggttcccg

SEQ ID NO: 286650 - DNA, 75 bp, Artificial Sequence
  Synthetic
ctcaaggcgggagagtcatatcttcatgggagtcatataaaaacggaggtgagaccaagctgtaagagtaggcca

SEQ ID NO: 286651 - DNA, 75 bp, Artificial Sequence
  Synthetic
acatttccgccataagagtaaacgggttcacttgtaccggtgtcgtgacagaagctgaaacctacaccaacttcg

SEQ ID NO: 286652 - DNA, 75 bp, Artificial Sequence
  Synthetic
gttcacttgtaccggtgtcgtgacagaagctgaaacctacaccaacttcgtcggttatgtcaccaccacgttcag

SEQ ID NO: 286653 - DNA, 75 bp, Artificial Sequence
  Synthetic
gacatctctggattcaacagtcttctttagactcctcgcaacagggtaagtccaagagtcacgagatttccatta

SEQ ID NO: 286654 - DNA, 75 bp, Artificial Sequence
  Synthetic
cagcaggttgctgtttccacctctgctaatccagcccctgtctcagagcttgacataagggccctctccaagagg

SEQ ID NO: 286655 - DNA, 75 bp, Artificial Sequence
  Synthetic
ctaatccagcccctgtctcagagcttgacataagggccctctccaagaggtttcagaaccctctcatctcggggt

SEQ ID NO: 286656 - DNA, 75 bp, Artificial Sequence
  Synthetic
ggaagatggccggagatcctagatatgaggagtctcttcaaaatccttatcccgattaccattggctgaggactg

SEQ ID NO: 286657 - DNA, 75 bp, Artificial Sequence
  Synthetic
tgaggagtctcttcaaaatccttatcccgattaccattggctgaggactgtaaaaacagctaaagagtccctcgt

SEQ ID NO: 286658 - DNA, 75 bp, Artificial Sequence
  Synthetic
gattcctcaagatatggtcacagaccgtagaagagattatatcctatgtcacggtcaactttcccaacccttcag

SEQ ID NO: 286659 - DNA, 75 bp, Artificial Sequence
  Synthetic
cggtgctttcaccctccaagaacagataccaaaggtggtgaacaaaccggaggatatctcagataacgttgtgtt

SEQ ID NO: 286660 - DNA, 75 bp, Artificial Sequence
  Synthetic
cggtgctttcaccctccaagaacagataccaaaggtggtgaacaaaccggtggatatctcagataacgttgtgtt

SEQ ID NO: 286661 - DNA, 75 bp, Artificial Sequence
  Synthetic
cggtgctttcaccctccaagaacagataccaaaggtggtgaacaaaccggcggatatctcagataacgttgtgtt

SEQ ID NO: 286662 - DNA, 75 bp, Artificial Sequence
  Synthetic
cggtgctttcaccctccaagaacagataccaaaggtggtgaacaaaccgggggatatctcagataacgttgtgtt

SEQ ID NO: 286663 - DNA, 75 bp, Artificial Sequence
  Synthetic
tttcagaaccctctcatctcggggttaagggtggttcagtgggcaactggtgcccattataaactcaagcccatt

SEQ ID NO: 286664 - DNA, 75 bp, Artificial Sequence
  Synthetic
caaacctttgactgaccccttgttctatcccccatctgatcctaaaatcctgaggcacttcaacatatgttgcag

SEQ ID NO: 286665 - DNA, 75 bp, Artificial Sequence
  Synthetic
attctagggtcttccccaacgggaagtgtctgggaataacggtctcttccacttattgttcaaccaaccatggtt

SEQ ID NO: 286666 - DNA, 75 bp, Artificial Sequence
  Synthetic
gtgtctgggaataacggtctcttccacttattgttcaaccaaccatggttataccatctggatgcctgaagaggc

SEQ ID NO: 286667 - DNA, 75 bp, Artificial Sequence
  Synthetic
ttacgtcaccaccacattcaagagaaaacacttccgccctatgccggatgcatgcagagccgcatataactggaa

SEQ ID NO: 286668 - DNA, 75 bp, Artificial Sequence
  Synthetic
cctctaaggggggccggacttgcggatttgtggatgaaaggggattgtacaagtctctgaagggggcgtgcaagc

SEQ ID NO: 286669 - DNA, 75 bp, Artificial Sequence
  Synthetic
aaaaactataaaactgaaagacaactaacaacacttctcatcttgagactctcaccatgatgattgacccaggag

SEQ ID NO: 286670 - DNA, 75 bp, Artificial Sequence
  Synthetic
acttgaccacatggaagtacttccagtcagtccaaaaaaaggtgaacatgtcttatgacctcatcatttgtgatg

SEQ ID NO: 286671 - DNA, 75 bp, Artificial Sequence
  Synthetic
tctagcttgagtctgtcatctcactggatcaggttgatttacaagatagtgaagactaccagactcgttggcagc

SEQ ID NO: 286672 - DNA, 75 bp, Artificial Sequence
  Synthetic
atttgtggatgaaaggggattgtacaagtctctgaagggggcgtgcaagctcaagctatgcggagttcctgggct

SEQ ID NO: 286673 - DNA, 75 bp, Artificial Sequence
  Synthetic
agtggtgcccctctgatcaattggtaaatctacatgacttccactcggatgaaatagaacatctggttgtggagg

SEQ ID NO: 286674 - DNA, 75 bp, Artificial Sequence
  Synthetic
tgacgtagcactggcagatgatggaactgtcaactccgacgacgaggactacttctccggtgagaccagaagtcc

SEQ ID NO: 286675 - DNA, 75 bp, Artificial Sequence
  Synthetic
catgggtacaacagatggatcaccctcgaggatatccgatctagatcatccctactagactacagttgtttgtaa

SEQ ID NO: 286676 - DNA, 75 bp, Artificial Sequence
  Synthetic
ctctcctctaatagaggatcctgccaaattaatgttggagtggttgaagacgggaaatagaccttaccgtataac

SEQ ID NO: 286677 - DNA, 75 bp, Artificial Sequence
  Synthetic
aaatctacatgacttccactcggatgaaatagaacatctggttgtggaggagctggttaagaaaagagaagaatg

SEQ ID NO: 286678 - DNA, 75 bp, Artificial Sequence
  Synthetic
gtctcagccatctgagaaaactcgtcccagggtttggaaaggcctataccatattcaataagactttaatggaag

SEQ ID NO: 286679 - DNA, 75 bp, Artificial Sequence
  Synthetic
agaagttagacttggattccctcaaggtgggtggaactgcagcccaatcaatgatctccctctggttatatggtg

SEQ ID NO: 286680 - DNA, 75 bp, Artificial Sequence
  Synthetic
ccaagcgaggaaaatttttccgagatgctgagtatttaacttcttctacccttcgagagatgagccttgtcttgt

SEQ ID NO: 286681 - DNA, 75 bp, Artificial Sequence
  Synthetic
ctattgaagatataacactggagacttctcagatctttgagttcccggatgtgtcaaaaaggatatccagaatgg

SEQ ID NO: 286682 - DNA, 75 bp, Artificial Sequence
  Synthetic
tcagccataaaagtgaacgggttcacttgcacgggcgttgtgacagaggcagaaacctacactaactttgttggt

SEQ ID NO: 286683 - DNA, 75 bp, Artificial Sequence
  Synthetic
ctatagattgtgtatatccatcatgaaaaaaactaacacccctcctttcgaaccatcccaaatatgagcaaaatc

SEQ ID NO: 286684 - DNA, 75 bp, Artificial Sequence
  Synthetic
ggtgggtggaactgcagcccaatcaatgatctccctctggttatatggtgctcactctgagtcaaacaggagccg

SEQ ID NO: 286685 - DNA, 75 bp, Artificial Sequence
  Synthetic
gtagagaaaagtctcgccatatagggtcggctcaggggctcttatactcaatcttagtggcaattcatgactcag

SEQ ID NO: 286686 - DNA, 75 bp, Artificial Sequence
  Synthetic
gtcggctcaggggctcttatactcaatcttagtggcaattcatgactcaggatacaatgatggaaccatcttccc

SEQ ID NO: 286687 - DNA, 75 bp, Artificial Sequence
  Synthetic
cccagggtttggaaaggcctataccatattcaataagactttaatggaagccgatgctcactacaaatcgatccg

SEQ ID NO: 286688 - DNA, 75 bp, Artificial Sequence
  Synthetic
aaatagaggactgaaaattcccccagaaggggtgttaagttgtcttgaaagagtcgactatgacaaggcgtttgg

SEQ ID NO: 286689 - DNA, 75 bp, Artificial Sequence
  Synthetic
ggacaatcttcctgaggacatgaggcgacttcacctggatgatgggaaatcgtccaaccttggtgagatggccaa

SEQ ID NO: 286690 - DNA, 75 bp, Artificial Sequence
  Synthetic
tgtcaacatatacggcaaagtttcccctagagactatttgagagggctcgcaagaggagtcttgataggatcctc

SEQ ID NO: 286691 - DNA, 75 bp, Artificial Sequence
  Synthetic
ccttgtacatgaatgccctagattgggatgaagaaaagaccatcttagctttatggagagatctgacatcagtgg

SEQ ID NO: 286692 - DNA, 75 bp, Artificial Sequence
  Synthetic
ccgatccgttaacagtcttcaaagatgatgatgaggcagaggactttgttgaggttcatctccctgatattcaca

SEQ ID NO: 286693 - DNA, 75 bp, Artificial Sequence
  Synthetic
ggatgaagaaaagaccatcttagctttatggagagatctgacatcagtggatgttgggaaggacttagtaaagtt

SEQ ID NO: 286694 - DNA, 75 bp, Artificial Sequence
  Synthetic
ttgttctatccaccatctgaccccaaaatcttgaggcacttcaacatatgctgcagtacaatgatgtatctggca

SEQ ID NO: 286695 - DNA, 75 bp, Artificial Sequence
  Synthetic
tgatgatgaggcagaggactttgttgaggttcatctccctgatattcacagccagatatcaggggttgaccttgg

SEQ ID NO: 286696 - DNA, 75 bp, Artificial Sequence
  Synthetic
cgctaataataacaatcttcttaatgacgtgttgcagaggagcggatagaacaaaatcaataccacgaggttttg

SEQ ID NO: 286697 - DNA, 75 bp, Artificial Sequence
  Synthetic
ctcagagttctaattgtctttttgacaggaactatacactcatgttgaaggacctcttcttgtctcgtttcaact

SEQ ID NO: 286698 - DNA, 75 bp, Artificial Sequence
  Synthetic
gacgtgttgcagaggagcggatagaacaaaatcaataccacgaggttttgaaggttctggaaagaaaatattggc

SEQ ID NO: 286699 - DNA, 75 bp, Artificial Sequence
  Synthetic
gaggagagaccaagttgtgaccaagttgtgagagcaagtcatccctaccataactagtgctcaaaaagttgcctc

SEQ ID NO: 286700 - DNA, 75 bp, Artificial Sequence
  Synthetic
tgtaactctagcttgagtctgtcgtctcactggatcaggctgatctacaaaatagtgaagaccactagactcagc

SEQ ID NO: 286701 - DNA, 75 bp, Artificial Sequence
  Synthetic
ctttattctacccgccatctgatcccaaaatcttgagacacttcaacatatgctgcagtaccatgatgtacttgt

SEQ ID NO: 286702 - DNA, 75 bp, Artificial Sequence
  Synthetic
atgtagattctcataatacgggaaatcttctagcagtttcagtgaccaacggtgctttcattctccaagaactgg

SEQ ID NO: 286703 - DNA, 75 bp, Artificial Sequence
  Synthetic
atcaagatattggaaccatatgttgtgaatagcttagtccaaagggcagaaaagtttaggcctctcatccattcc

SEQ ID NO: 286704 - DNA, 75 bp, Artificial Sequence
  Synthetic
ggatttgataagtactccaagtggtatctggattctcgatttcttgcccgagaccaccccctaactccttatatc

SEQ ID NO: 286705 - DNA, 75 bp, Artificial Sequence
  Synthetic
taacaggtggattaccctcgaggacatcaaatctagatcatctctactggactacagttgcttatgaactgaaca

SEQ ID NO: 286706 - DNA, 75 bp, Artificial Sequence
  Synthetic
taagaagaatgtttgagccggggcaggagactgcagttcctcactcctatttcatccattttcgttccttgggct

SEQ ID NO: 286707 - DNA, 75 bp, Artificial Sequence
  Synthetic
gacattcggtcccagcgcaaagaagttctttgaggttctggatcaattcgacaacatccatgacctggtcttcgt

SEQ ID NO: 286708 - DNA, 75 bp, Artificial Sequence
  Synthetic
acctttcattaatcatcacaactgctcggacatagtcatgtagattctgataatgtgtgagaccttctggcggtg

SEQ ID NO: 286709 - DNA, 75 bp, Artificial Sequence
  Synthetic
ttctttgaggttctggatcaattcgacaacatccatgacctggtcttcgtatatggttgctacagacattggggg

SEQ ID NO: 286710 - DNA, 75 bp, Artificial Sequence
  Synthetic
tcggacatagtcatgtagattctgataatgtgtgagaccttctggcggtgtcattgatcaacggtgctctcatac

SEQ ID NO: 286711 - DNA, 75 bp, Artificial Sequence
  Synthetic
agccctatggctgggcctgaacagaggctatagcaagcttccccatattagaccaaatagaggtagataggaaga

SEQ ID NO: 286712 - DNA, 75 bp, Artificial Sequence
  Synthetic
gaaacagacagtgtcatttgcaaaacaaaaatgtaacacccctacaatggatgccgacaagattgtattcagagt

SEQ ID NO: 286713 - DNA, 75 bp, Artificial Sequence
  Synthetic
tacaacaggtggatcacacttgatgacatcagatctagatcatctcttttagattatagttgcctgtaaatcggg

SEQ ID NO: 286714 - DNA, 75 bp, Artificial Sequence
  Synthetic
tcatatcaagaaggtgatagacaagtcttaccaggagtgtttggcaagcgacttagccagaaggatccttaggtg

SEQ ID NO: 286715 - DNA, 75 bp, Artificial Sequence
  Synthetic
ggctatagcaagcttccccatattagaccaaatagaggtagataggaagaggccgcttgcctcctccgacggacc

SEQ ID NO: 286716 - DNA, 75 bp, Artificial Sequence
  Synthetic
gggatttgacaagtactctaagtggtatattgactcacgacgtctccccagagaccaccccttgactccttacat

SEQ ID NO: 286717 - DNA, 75 bp, Artificial Sequence
  Synthetic
cagagggctatgccatccaagctttccaatcgagaaaaaaactatagaacggaggagtaattgacaacacctctt

SEQ ID NO: 286718 - DNA, 75 bp, Artificial Sequence
  Synthetic
atgaagcggctgaattgactaggaccgaagcagccttggcagatgacgggactgtcaactctgatgacgaggact

SEQ ID NO: 286719 - DNA, 75 bp, Artificial Sequence
  Synthetic
ccaatcgagaaaaaaactatagaacggaggagtaattgacaacacctcttatcccgagaacctcaccatgatgat

SEQ ID NO: 286720 - DNA, 75 bp, Artificial Sequence
  Synthetic
catggcatagactcccgatcacacagatatttgagattcctgaatcaatggatccctcagaaatcctggatgaca

SEQ ID NO: 286721 - DNA, 75 bp, Artificial Sequence
  Synthetic
gatatttgagattcctgaatcaatggatccctcagaaatcctggatgacaagtcgcactctttcaccagaacgag

SEQ ID NO: 286722 - DNA, 75 bp, Artificial Sequence
  Synthetic
ctgagccgagagggaaccccaccatccctaacatattaaggaactctgactacaacctaaactctcccctaatag

SEQ ID NO: 286723 - DNA, 75 bp, Artificial Sequence
  Synthetic
ccctaacatattaaggaactctgactacaacctaaactctcccctaatagaggatccagccaagttgatgctgga

SEQ ID NO: 286724 - DNA, 75 bp, Artificial Sequence
  Synthetic
gtgtgtagcccgaatggttactcgttcaggatcctgcggcacattctgagatcattcgacgagatatactctggg

SEQ ID NO: 286725 - DNA, 75 bp, Artificial Sequence
  Synthetic
aggttattatcacggctctgtccaagccgcctgtcaaccccagagagtttttaaaatctatcgatctcggggggt

SEQ ID NO: 286726 - DNA, 75 bp, Artificial Sequence
  Synthetic
gtgccaggtcttacaaagttttgaaagattatttcaagaaagttgatctaggatctctcaaggttgggggagccg

SEQ ID NO: 286727 - DNA, 75 bp, Artificial Sequence
  Synthetic
aaaaaactaacacccctccttttgaaccatctcagacatgagcaagatttttgtcaacccgagtgcaatcagggc

SEQ ID NO: 286728 - DNA, 75 bp, Artificial Sequence
  Synthetic
cctcaagccaaaggaaagggagctgaagattgagggtcgattttttgctctgatgtcttggaatctaagattgta

SEQ ID NO: 286729 - DNA, 75 bp, Artificial Sequence
  Synthetic
tcctgattgcacgaaaaggagacaagatcaccccagattctctggtggaaataaagcgtactgatgtagaaggga

SEQ ID NO: 286730 - DNA, 75 bp, Artificial Sequence
  Synthetic
cagaagttactgacattgcatctatcaaccggataaccctgttaatgtctgatttcgcattgtctatagatggac

SEQ ID NO: 286731 - DNA, 75 bp, Artificial Sequence
  Synthetic
agattatttcaagaaagttgatctaggatctctcaaggttgggggagccgcagcgcaatctatgatttccctttg

SEQ ID NO: 286732 - DNA, 75 bp, Artificial Sequence
  Synthetic
gaaacattgaggacaatcaggctcatctccaaggagagcccatagaggtagacagtctcccggaagacataagaa

SEQ ID NO: 286733 - DNA, 75 bp, Artificial Sequence
  Synthetic
atgcactaactatgacagacaatctgaacaaggtgtttaaaaagttgatcgatagagtgaccggacaagggcttt

SEQ ID NO: 286734 - DNA, 75 bp, Artificial Sequence
  Synthetic
acttggctcagttttattccaagtcttcccccatagaaaagctgttaaactacacactcgggaatagaggactga

SEQ ID NO: 286735 - DNA, 75 bp, Artificial Sequence
  Synthetic
ttcccccatagaaaagctgttaaactacacactcgggaatagaggactgaaaatcccccccgagggggtcttaag

SEQ ID NO: 286736 - DNA, 75 bp, Artificial Sequence
  Synthetic
tctccaaggagagcccatagaggtagacagtctcccggaagacataagaaggcttcaattagatgatcagaaacc

SEQ ID NO: 286737 - DNA, 75 bp, Artificial Sequence
  Synthetic
tataacccaagtgacttcgtccttttcatctgagctataccttcgattctccaaacgagggaagttttttagaga

SEQ ID NO: 286738 - DNA, 75 bp, Artificial Sequence
  Synthetic
aacaatcatcaaaggttggaatcaacagaggatgtattttctgttttagatcaggtcttcggattgaagagggtg

SEQ ID NO: 286739 - DNA, 75 bp, Artificial Sequence
  Synthetic
acacatattcctcttatctattcttccacgtgatcatcctttacatgaatgccttggactgggaggaagagaaga

SEQ ID NO: 286740 - DNA, 75 bp, Artificial Sequence
  Synthetic
ttttcgaggactcatgagttttttcagaagtcctggatctactattctgacagatcagatctcatcgggttatgg

SEQ ID NO: 286741 - DNA, 75 bp, Artificial Sequence
  Synthetic
gttgaagagatcatatcctatgtcacggtcaactttatcattcttccgggaaagtctttagaagacaaagcaact

SEQ ID NO: 286742 - DNA, 75 bp, Artificial Sequence
  Synthetic
ttagtcaagtttaaggataaaatatgggggtcgctgattgtgaccaaggatttcgtgtactctcagagttcgggc

SEQ ID NO: 286743 - DNA, 75 bp, Artificial Sequence
  Synthetic
cggtcaactttatcattcttccgggaaagtctttagaagacaaagcaactcagactgcaagccgggaactcaaga

SEQ ID NO: 286744 - DNA, 75 bp, Artificial Sequence
  Synthetic
caaatgcagttggtcacgtgttcaatctcattcactttgttggatgctatatgggtcaagtcagatctcttaatg

SEQ ID NO: 286745 - DNA, 75 bp, Artificial Sequence
  Synthetic
ctacggcagaaaggctggagtctggtcagcctattgatgatagacagagaatcccaaactaggaacacaagaacc

SEQ ID NO: 286746 - DNA, 75 bp, Artificial Sequence
  Synthetic
tcagcctattgatgatagacagagaatcccaaactaggaacacaagaaccaagatattggctcaaggagacaacc

SEQ ID NO: 286747 - DNA, 75 bp, Artificial Sequence
  Synthetic
ggagacagctgttcctcactcttatttcattcacttccgttcactaggcttgagtgggaagtctccttattcatc

SEQ ID NO: 286748 - DNA, 75 bp, Artificial Sequence
  Synthetic
cgcaagagaagcaatattatacttcttccataagaactttgaagaagagataagaagaatgtttgagccagggca

SEQ ID NO: 286749 - DNA, 75 bp, Artificial Sequence
  Synthetic
taggtttaactctctaatgattcttctttctcctccagaacccagatattcagatgacctgatatctcaactatg

SEQ ID NO: 286750 - DNA, 75 bp, Artificial Sequence
  Synthetic
cttctctatgagctagagagcatatcaagaaatgctctctcaatctaccgagccatcgaagaaggggcatccaag

SEQ ID NO: 286751 - DNA, 75 bp, Artificial Sequence
  Synthetic
gttatgaagttatcaaaatattggagccgtacgttgtgaacagcctagtccagagagcagaaaagttcaggcctc

SEQ ID NO: 286752 - DNA, 75 bp, Artificial Sequence
  Synthetic
gccgtacgttgtgaacagcctagtccagagagcagaaaagttcaggcctctaatccattctctgggggacttccc

SEQ ID NO: 286753 - DNA, 75 bp, Artificial Sequence
  Synthetic
ttgcaagacttcacgacctgtataacagacctataacttattacttcagaaagcaagtcattcgagggaatattt

SEQ ID NO: 286754 - DNA, 75 bp, Artificial Sequence
  Synthetic
aaccgtcaactctgatgatgaagactatttctccggtgaaaccaggagtccggaagctgtctatactcgaatcat

SEQ ID NO: 286755 - DNA, 75 bp, Artificial Sequence
  Synthetic
catgagatgtctgttctagggggctatctgggagaggaattcttcgggaaaggaacattcgaaagaagattcttc

SEQ ID NO: 286756 - DNA, 75 bp, Artificial Sequence
  Synthetic
gtgcaaaaaggttcttcaaagttctagatcagtttgacaatatacatgacttggtctttgtgtacggctgttaca

SEQ ID NO: 286757 - DNA, 75 bp, Artificial Sequence
  Synthetic
tatctccaagtgtggcagatttggacccatatgacaaatcccttcactcgagggtcttccctagcggaaaatgct

SEQ ID NO: 286758 - DNA, 75 bp, Artificial Sequence
  Synthetic
tgacgtggcattggcagatgatggaactgtcaactctgatgacgaggactacttctccggtgaaaccagaagtcc

SEQ ID NO: 286759 - DNA, 75 bp, Artificial Sequence
  Synthetic
ccaccaacgcattaactgtggctcaacattctcaatctctgatcaagccgatgagggactttctgcttatgtcag

SEQ ID NO: 286760 - DNA, 75 bp, Artificial Sequence
  Synthetic
aaactcatttgccgagtttctaaacaagacgtactctagtgactcgtaaagaattgaacaacaagattgaaaaga

SEQ ID NO: 286761 - DNA, 75 bp, Artificial Sequence
  Synthetic
cagttccaatcatcaagcccgtccaaactcattcgccgagtttctaaacaagacatattcgagtgactcataagg

SEQ ID NO: 286762 - DNA, 75 bp, Artificial Sequence
  Synthetic
tgatagacaagtcctatcaggaatgtttggcaagtgacctggccagaaggatcctcaggtggggattcgacaaat

SEQ ID NO: 286763 - DNA, 75 bp, Artificial Sequence
  Synthetic
attcagccccatcctaaaaggcagagtttataaaattctaagtgctgagggggacagttttcttttagcaatgtc

SEQ ID NO: 286764 - DNA, 75 bp, Artificial Sequence
  Synthetic
aggtggaaagacaccttcatgggtataataggtggatcacccttgaggatatcagatctagatcatctctattgg

SEQ ID NO: 286765 - DNA, 75 bp, Artificial Sequence
  Synthetic
ctgacaaactaaataaaataatgcaagacgatctgaatcgttatgcgttcttctgactacgcccccaagctctgt

SEQ ID NO: 286766 - DNA, 75 bp, Artificial Sequence
  Synthetic
gtagggatgaggacactcagaagccctctctcgtgtcagctcctcccgatgatgatgatttatggttgccccctc

SEQ ID NO: 286767 - DNA, 75 bp, Artificial Sequence
  Synthetic
ggcctcccaaacatatagtcgatctggtgggtgacacttggcacaggcttccaatcacccagattttcgagatcc

SEQ ID NO: 286768 - DNA, 75 bp, Artificial Sequence
  Synthetic
tttggcaagtgacctggccagaaggatcctcaggtggggattcgacaaatactccaagtggtatcttgatttacg

SEQ ID NO: 286769 - DNA, 75 bp, Artificial Sequence
  Synthetic
ccggtctggccgatcttgagatggctgaagagactgttgatctgatcaatagaaacatagaagacaatcaggctc

SEQ ID NO: 286770 - DNA, 75 bp, Artificial Sequence
  Synthetic
ccaatcacccagattttcgagatccctgagtcaatggatccatctgagatattagatgacaaatcgcactctttc

SEQ ID NO: 286771 - DNA, 75 bp, Artificial Sequence
  Synthetic
cctgtgtcaggaagcagggaatccagatcttggagagaggacactggagagcttcactcggcttttagaggatcc

SEQ ID NO: 286772 - DNA, 75 bp, Artificial Sequence
  Synthetic
ggacaatctccctgaggacatgaggcgacttcacttggatgatggaaaatcgtccaacctcggtgagatggccaa

SEQ ID NO: 286773 - DNA, 75 bp, Artificial Sequence
  Synthetic
gcttcactcggcttttagaggatcccactactttaaatatcaagggaggggctagccccaccatcttactcaaag

SEQ ID NO: 286774 - DNA, 75 bp, Artificial Sequence
  Synthetic
aggactttcagatggatgaaggggaggatcctggcctcttgttccagtcatacctggaaaatgttggagtccaaa

SEQ ID NO: 286775 - DNA, 75 bp, Artificial Sequence
  Synthetic
agttgttataggattggcgttgtcaggagccccagtccctgagggcatgaactgggtttacaaattgaggagaac

SEQ ID NO: 286776 - DNA, 75 bp, Artificial Sequence
  Synthetic
ccagagaattcctgaaatctatagatcttggaggactgccggatgaggatttgataattggcctcaaacccaagg

SEQ ID NO: 286777 - DNA, 75 bp, Artificial Sequence
  Synthetic
atcctagcctcctgttccagtcgtacttggacaacgttggagtccaaatagtcagacaaatgaggtcaggagaaa

SEQ ID NO: 286778 - DNA, 75 bp, Artificial Sequence
  Synthetic
ggaatgaggtcatcccttcaaaagggtgtttaaaagtgggggggaggtgtcatcctcatgtgaacggggtgtttt

SEQ ID NO: 286779 - DNA, 75 bp, Artificial Sequence
  Synthetic
tgaagtagataaggtagagaattcagaatttagagaggcaatcctcttgtccaagacccatagggacaattttat

SEQ ID NO: 286780 - DNA, 75 bp, Artificial Sequence
  Synthetic
agaaggaagctccatcggcttcttctcagagagagaaccaatcctcaaaagcccgaatggcagctcaaactgcct

SEQ ID NO: 286781 - DNA, 75 bp, Artificial Sequence
  Synthetic
gaaggtcttcagaggataaatcaacccaaaccactggtcgagagcccaagaaggagacaacatccactccttctc

SEQ ID NO: 286782 - DNA, 75 bp, Artificial Sequence
  Synthetic
gattcctcaagatatggtctcagaccgtcgaggagatcatatcctatgtcatggtcaacttccccagtctgccgg

SEQ ID NO: 286783 - DNA, 75 bp, Artificial Sequence
  Synthetic
gagatccatgggatcaacaggatgacccagacaccccaacgagtagggagggtttggccctgctcttcggagagg

SEQ ID NO: 286784 - DNA, 75 bp, Artificial Sequence
  Synthetic
gtctcgggggttgacctgggtctcccaaactgggggaagtatgtatcactgagtgcaggggccttgattgccttg

SEQ ID NO: 286785 - DNA, 75 bp, Artificial Sequence
  Synthetic
tgagttttttcaaaagtcttggatctattactcagacagatccgacctcattgggttatgggaggatcaaatata

SEQ ID NO: 286786 - DNA, 75 bp, Artificial Sequence
  Synthetic
agactcttgcgcgatgtatcttgaaaaaaacaagatcttgaatccgaacctctggttgtttgattgtttttttca

SEQ ID NO: 286787 - DNA, 75 bp, Artificial Sequence
  Synthetic
ctcagagatccatgggatcaaccggatgacccagactccccaaagggtcggaagggtttggccctgctcctctga

SEQ ID NO: 286788 - DNA, 75 bp, Artificial Sequence
  Synthetic
tgaaaaaaactattaacatctctccaaagacctaagaaaagatgatccctcaggctcttttgtctttgcttctcc

SEQ ID NO: 286789 - DNA, 75 bp, Artificial Sequence
  Synthetic
ttgaaaatgaaccttgatgatatagtcaaggaggcaaaaaatgtgccaggcgtgacccgtttggcccatgacgga

SEQ ID NO: 286790 - DNA, 75 bp, Artificial Sequence
  Synthetic
tccaaactccccctaagatgtgtactgggatgggtcgctctggccaattcaaagaaattccaattgttagtcgaa

SEQ ID NO: 286791 - DNA, 75 bp, Artificial Sequence
  Synthetic
agccagacaagttgaataaagttatgcaggatgatctaaatcgttatacatcttgctgacaatttttaaactcag

SEQ ID NO: 286792 - DNA, 75 bp, Artificial Sequence
  Synthetic
atacttgggctcatctacctcgatgtcaacccagctattccacgcttgggagaaagtcactaatgttcatgtggt

SEQ ID NO: 286793 - DNA, 75 bp, Artificial Sequence
  Synthetic
ctggagtctggtcagcttgttgatgatagatcgtgagtcccagaccaggaacacaaggactaagatcctagcgca

SEQ ID NO: 286794 - DNA, 75 bp, Artificial Sequence
  Synthetic
cctgaaattatcgtggatcaatatgagtacaagtaccctgcgatcaaggacttgaaaaagcccagtattacccta

SEQ ID NO: 286795 - DNA, 75 bp, Artificial Sequence
  Synthetic
aggagacaaccaagttctgtgtccgacatacatgttgtcgccggggctctctagagaggggcttctttatgagtt

SEQ ID NO: 286796 - DNA, 75 bp, Artificial Sequence
  Synthetic
tcaacccagctattccacgcttgggagaaagtcactaatgttcatgtggtgaaaagggctctatcactaaaggag

SEQ ID NO: 286797 - DNA, 75 bp, Artificial Sequence
  Synthetic
tgacgatgacctgtggcttccaccccctgaatacgtcccgctgaaagaactcacaagcaagaagaacatgaggaa

SEQ ID NO: 286798 - DNA, 75 bp, Artificial Sequence
  Synthetic
tagaaacatcatgtccttgacaggccctgacttccctctagaagaagccccagtcttcaaaagaacagggtcagc

SEQ ID NO: 286799 - DNA, 75 bp, Artificial Sequence
  Synthetic
atgtagattctcataatacgggaaatcttctagcagtttcagtgaccaacggtgctttcattctccaaggcctga

SEQ ID NO: 286800 - DNA, 75 bp, Artificial Sequence
  Synthetic
tcatctcagttgatcaaacaaggtcatgtagattctcataatacgggaaatcttctagcagtttcagtgaccaac

SEQ ID NO: 286801 - DNA, 75 bp, Artificial Sequence
  Synthetic
cctgaatatgtcccgctgaaagaactcacgggcaagaagaacatgaggaacttctgcatcaatggtgaggtcaag

SEQ ID NO: 286802 - DNA, 75 bp, Artificial Sequence
  Synthetic
taccaaaggttgcgaacaggccaaggggtgcttcggatgtctccgtgcttgggcatggacagaggtcatagtgtg

SEQ ID NO: 286803 - DNA, 75 bp, Artificial Sequence
  Synthetic
cctgacttccctctagaagaagccccagtcttcaaaagaacagggtcagccttgcataggttcaagtctgcaaga

SEQ ID NO: 286804 - DNA, 75 bp, Artificial Sequence
  Synthetic
agatcaccccggattctcttgtggagataaagcgtactgatgtagaagggaattgggctttgacgggaggaatgg

SEQ ID NO: 286805 - DNA, 75 bp, Artificial Sequence
  Synthetic
atccgtaagtacagacaccatgtctgatttgactcaagatgggaagaattatgatttcatgttccagcccttgat

SEQ ID NO: 286806 - DNA, 75 bp, Artificial Sequence
  Synthetic
gataaagcgtactgatgtagaagggaattgggctttgacgggaggaatggaactgacgagggaccccactgttcc

SEQ ID NO: 286807 - DNA, 75 bp, Artificial Sequence
  Synthetic
gctttatgcgcagacgtggacatccgagctagtacagagagacacgaggctgaaagactccacgtttcactggca

SEQ ID NO: 286808 - DNA, 75 bp, Artificial Sequence
  Synthetic
agagtctcttgtatctctaacgaccagatagttaatctcgccaatataatgtcaacggtatccaccaatgcattg

SEQ ID NO: 286809 - DNA, 75 bp, Artificial Sequence
  Synthetic
gtcaacggtatccaccaatgcattgactgttgcccagcactcacagtccttgatcaagccaatgagggacttctt

SEQ ID NO: 286810 - DNA, 75 bp, Artificial Sequence
  Synthetic
ttgggaataacaatctcttctacctactgctcaactaatcatgattacaccatctggatgcccgaggaagcgaga

SEQ ID NO: 286811 - DNA, 75 bp, Artificial Sequence
  Synthetic
cctcccagatctttgagtttccggatgtgtctaagagaatatcccggatggtctctggagctgtgcctcacttcc

SEQ ID NO: 286812 - DNA, 75 bp, Artificial Sequence
  Synthetic
aaaagtggaataattattaaagattagagttaatagaggatgtattttttgttttagattaagtgtttggattga

SEQ ID NO: 286813 - DNA, 75 bp, Artificial Sequence
  Synthetic
gggatgacgatactgagtttgtcggattgcagataagagtgagtgcaagacaatgtcatatccagggtagggtat

SEQ ID NO: 286814 - DNA, 75 bp, Artificial Sequence
  Synthetic
agaagcttcctgatatccatctgagaccaggggatttcgaatctctgagcggcagagaaaaatctcgtcacatag

SEQ ID NO: 286815 - DNA, 75 bp, Artificial Sequence
  Synthetic
atacgccagttctcagatccagtgtcagaagggctgtccttttggagagagatctggctcagttccaatgagtct

SEQ ID NO: 286816 - DNA, 75 bp, Artificial Sequence
  Synthetic
cagaagggctgtccttttggagagagatctggctcagttccaatgagtcttggatccatgcgctatgtcaagagg

SEQ ID NO: 286817 - DNA, 75 bp, Artificial Sequence
  Synthetic
actgctcaactaatcatgattacaccatctggatgcccgaggaagcgagacttgggacatcttgtgacattttta

SEQ ID NO: 286818 - DNA, 75 bp, Artificial Sequence
  Synthetic
tgaaaggtagagtttacaaggtcctgagtgctgagggggacaattttctcctagctatgtctagaataatttatt

SEQ ID NO: 286819 - DNA, 75 bp, Artificial Sequence
  Synthetic
ggatacaatgatgggaccatttttcctatcaacatatatggcaaggtctcccccagagactatttacggggactc

SEQ ID NO: 286820 - DNA, 75 bp, Artificial Sequence
  Synthetic
gaaaaaaactattaacatccctcaaaagacttaaggaaagatggttcctcaggctcttttgtttgtaccccttct

SEQ ID NO: 286821 - DNA, 75 bp, Artificial Sequence
  Synthetic
ctcgaggatcctacgacattgaacattaagggaggggctagtcctactattcttctcaaagatgcaatccgaaag

SEQ ID NO: 286822 - DNA, 75 bp, Artificial Sequence
  Synthetic
ctatcaacatatatggcaaggtctcccccagagactatttacggggactcgcaagaggagtcctgatagggtctt

SEQ ID NO: 286823 - DNA, 75 bp, Artificial Sequence
  Synthetic
tagaacatctcattgtggaggagctagtcaagaaaagggaagaatgtctagatgcactggagtctatcatgacca

SEQ ID NO: 286824 - DNA, 75 bp, Artificial Sequence
  Synthetic
ttaagggaggggctagtcctactattcttctcaaagatgcaatccgaaaggctttgtatgatgaggttgacaagg

SEQ ID NO: 286825 - DNA, 75 bp, Artificial Sequence
  Synthetic
gaattgatttcaggtgtgatctcatatattcttttgaggctggataatcacccgtctttgtacataatgctcaga

SEQ ID NO: 286826 - DNA, 75 bp, Artificial Sequence
  Synthetic
atattcttttgaggctggataatcacccgtctttgtacataatgctcagagagccatctctgagaggagagatat

SEQ ID NO: 286827 - DNA, 75 bp, Artificial Sequence
  Synthetic
gacaactttattctcttcttgaagtctgttgagccgctgtttccccgatttctcagtgaactcttcagctcatcc

SEQ ID NO: 286828 - DNA, 75 bp, Artificial Sequence
  Synthetic
catggaacttaaagttggatacatctcagccataaaagtgaacgggttcacttgcacaggcgttgtgacagaggc

SEQ ID NO: 286829 - DNA, 75 bp, Artificial Sequence
  Synthetic
tcaacaaaaccttaatggaagctgatgcccactacaagtcggttcggacttggaatgagatcatcccttccaagg

SEQ ID NO: 286830 - DNA, 75 bp, Artificial Sequence
  Synthetic
caacagtcattgctccatgtgctccccacgagatgtctgttttagggggctatctgggagaggaattttttggaa

SEQ ID NO: 286831 - DNA, 75 bp, Artificial Sequence
  Synthetic
ggcaatagatctattttgtgttatctccaacacgtgttgcgctatgaaagagaggttatcactgcatctccggag

SEQ ID NO: 286832 - DNA, 75 bp, Artificial Sequence
  Synthetic
cttatttgtttttccatgtaatcaccctatacatgaatgccctagactgggacgaagagaaaaccatcttagcat

SEQ ID NO: 286833 - DNA, 75 bp, Artificial Sequence
  Synthetic
gataagaagacagttcaggagaagtctctcaagaacactagaagagtccttctataactctgaaatccacgggat

SEQ ID NO: 286834 - DNA, 75 bp, Artificial Sequence
  Synthetic
tccaacacgtgttgcgctatgaaagagaggttatcactgcatctccggagaatgattggttgtggatcttctcag

SEQ ID NO: 286835 - DNA, 75 bp, Artificial Sequence
  Synthetic
tgcccactacaagtcggttcggacttggaatgagatcatcccttccaaggggtgcctaaaagtcggaggtatgtg

SEQ ID NO: 286836 - DNA, 75 bp, Artificial Sequence
  Synthetic
gcaatcgtccttgctccaacaacatatggagctgttggagtcctctgtgatccccctgatgcaccccttagcgga

SEQ ID NO: 286837 - DNA, 75 bp, Artificial Sequence
  Synthetic
tatcttctacttcagagggttgaaagaaatctgtcgaagaacatgagagataacttgcgacagatgagttctctg

SEQ ID NO: 286838 - DNA, 75 bp, Artificial Sequence
  Synthetic
gaaatctgtcgaagaacatgagagataacttgcgacagatgagttctctgatgaggcaggtactaggagggcatg

SEQ ID NO: 286839 - DNA, 75 bp, Artificial Sequence
  Synthetic
agatccgacctcatcgggttgtgggaggatcaaatatactgtctggacatgtcaaacggcccgacatgctggaac

SEQ ID NO: 286840 - DNA, 75 bp, Artificial Sequence
  Synthetic
ccgagatgctggggctacttccaaagtcctcaatttcatgcaattgcggatcgactagaggagggaatcctcgaa

SEQ ID NO: 286841 - DNA, 75 bp, Artificial Sequence
  Synthetic
ttcaccttccagatgttcacaagcaaatctcaggggttgaccttggtctccctagctgggggaagtatctgttga

SEQ ID NO: 286842 - DNA, 75 bp, Artificial Sequence
  Synthetic
aatctcaggggttgaccttggtctccctagctgggggaagtatctgttgataagtgcaggtgctctggcaacact

SEQ ID NO: 286843 - DNA, 75 bp, Artificial Sequence
  Synthetic
atggcaggtgaccccagatatgaagagtctctgcacaatccctatcctgattatcattggctccggactgtaaaa

SEQ ID NO: 286844 - DNA, 75 bp, Artificial Sequence
  Synthetic
tctctgcgtaggacgaggtgggtggatcaagaggtgcgtcacgcagctagaactatgactgggaattacagcccc

SEQ ID NO: 286845 - DNA, 75 bp, Artificial Sequence
  Synthetic
atcaagaggtgcgtcacgcagctagaactatgactgggaattacagccccaacaagaagatgtcccgcaaggcag

SEQ ID NO: 286846 - DNA, 75 bp, Artificial Sequence
  Synthetic
aatcaatacagcgaggtcatggagaatcagaaaggaaagtgtctgtaagtccccaaaacgggagagtcatatcct

SEQ ID NO: 286847 - DNA, 75 bp, Artificial Sequence
  Synthetic
atcagaaaggaaagtgtctgtaagtccccaaaacgggagagtcatatcctcctgggagctgtacaaaagtggagg

SEQ ID NO: 286848 - DNA, 75 bp, Artificial Sequence
  Synthetic
tcaaatccggcccctgtctctgagcttgacataagggccctcgctaaaaggtttcaaaaccctcttatctcaggc

SEQ ID NO: 286849 - DNA, 75 bp, Artificial Sequence
  Synthetic
ggtataatgatggaaccattttccctgtcaacatttatagcaaggtctcccctagagactatttacgagggctcg

SEQ ID NO: 286850 - DNA, 75 bp, Artificial Sequence
  Synthetic
cagacgctgatcaggaacataatatctttgacgggcccggactttcctttggaagaagcccctgtcttcaagaga

SEQ ID NO: 286851 - DNA, 75 bp, Artificial Sequence
  Synthetic
gggttacctctctctaggatctgatagaacctcatatttcaacagtccttcatggactccgcacaacaggatgga

SEQ ID NO: 286852 - DNA, 75 bp, Artificial Sequence
  Synthetic
tttagatgatctcaacgttttcccatccctatgtctcgtggttggggacgggtcaggggggatatctagagcagt

SEQ ID NO: 286853 - DNA, 75 bp, Artificial Sequence
  Synthetic
gagaccagtctgtgaaggctggtcatcctttcaatgcctcaagtcctgaagatcacacccccttggggttggggg

SEQ ID NO: 286854 - DNA, 75 bp, Artificial Sequence
  Synthetic
gtattcctctgtttgtccaaatctcctctcccacatctctgttagtaccgacacgatgtctgacttgactcaaga

SEQ ID NO: 286855 - DNA, 75 bp, Artificial Sequence
  Synthetic
cctcctaaccttggcggggtgactaaagcgggggaaggcaagtaccgagaagattttcagatggatgaaggggag

SEQ ID NO: 286856 - DNA, 75 bp, Artificial Sequence
  Synthetic
catatagatttcgataatgtatgatgtcttctgacggtatcttcgaccaatggtgctctcatcccccgaggactg

SEQ ID NO: 286857 - DNA, 75 bp, Artificial Sequence
  Synthetic
tgaatgacctaatggcatccggaacacatcccttgcctccctcagcaatcatgagcggaggagatgacattgtct

SEQ ID NO: 286858 - DNA, 75 bp, Artificial Sequence
  Synthetic
gtcttctgacggtatcttcgaccaatggtgctctcatcccccgaggactgataccaaaggttgtggacaggccaa

SEQ ID NO: 286859 - DNA, 75 bp, Artificial Sequence
  Synthetic
ctctcccacatctctgttagtaccgacacgatgtctgacttgactcaagatgggaggaactatgattttatgttt

SEQ ID NO: 286860 - DNA, 75 bp, Artificial Sequence
  Synthetic
ggacactcggctgaaggactccacctttcattggcatctccgatgtaacaagtgcataaggcacatcgatgacat

SEQ ID NO: 286861 - DNA, 75 bp, Artificial Sequence
  Synthetic
catcctcatgtgaacggggtgtttttcaatggtataatattgggacctgacggccatgttctaatcccagagatg

SEQ ID NO: 286862 - DNA, 75 bp, Artificial Sequence
  Synthetic
aatttgaccacatggaagtacttccaatcagtccaaaataaggtgaacatgtcttatgacctcatcatttgtgat

SEQ ID NO: 286863 - DNA, 75 bp, Artificial Sequence
  Synthetic
caagtccgtgagtttcagacgtctcagtcacttgaggaagcttgtgcctggatttggaaaagcatacaccatatt

SEQ ID NO: 286864 - DNA, 75 bp, Artificial Sequence
  Synthetic
tatctaggatggtctctggggctgtgcctcacttccggaaacttcctgatgttcgtttgaagtcgggtgacttcg

SEQ ID NO: 286865 - DNA, 75 bp, Artificial Sequence
  Synthetic
ttaatcggataactctcttgatgtctgactttgcattatccatagatggcccgctttatctggtcttcaagactt

SEQ ID NO: 286866 - DNA, 75 bp, Artificial Sequence
  Synthetic
tggaattattggaatcctcagttattcccctgatgcacccccttgcagacccgtccacagttttcaaggacggtg

SEQ ID NO: 286867 - DNA, 75 bp, Artificial Sequence
  Synthetic
gcctcacttccggaaacttcctgatgttcgtttgaagtcgggtgacttcgagtcactgagcggtaaggagaggtc

SEQ ID NO: 286868 - DNA, 75 bp, Artificial Sequence
  Synthetic
agagcgttcccctcagtcacaggattcataacccagatgacctcgtccttctcatctgagctgtatctccgattc

SEQ ID NO: 286869 - DNA, 75 bp, Artificial Sequence
  Synthetic
ctcatgactctggatataatgatgggaccatctttcctgtcaacatatatagtaaggtatcccctagagattatc

SEQ ID NO: 286870 - DNA, 75 bp, Artificial Sequence
  Synthetic
gaccatctttcctgtcaacatatatagtaaggtatcccctagagattatctgagaggacttgcgagaggggtctt

SEQ ID NO: 286871 - DNA, 75 bp, Artificial Sequence
  Synthetic
atgctgagtacctgacctcttccacccttcgagagatgagtctcgtcttgttcaactgtagcagccctaagagtg

SEQ ID NO: 286872 - DNA, 75 bp, Artificial Sequence
  Synthetic
atagacctcttgagctgatctctggggtgatctcatacatcttattgagactggataaccatccatcattgtaca

SEQ ID NO: 286873 - DNA, 75 bp, Artificial Sequence
  Synthetic
cccaaagcgggaaggtcatatcttcatgggagtcgtataaaagtgggggtgagactaggctgtgaaggccggtca

SEQ ID NO: 286874 - DNA, 75 bp, Artificial Sequence
  Synthetic
ctggataaccatccatcattgtacataatgctcagggagccatctcttaggggagagatattttctattcctcag

SEQ ID NO: 286875 - DNA, 75 bp, Artificial Sequence
  Synthetic
ccagaggagattatatccaatccttacaatgagatgatcataaccctgattgacagtgatgtggaatctttcttg

SEQ ID NO: 286876 - DNA, 75 bp, Artificial Sequence
  Synthetic
gaaagtggatctaggatctctcaaggtgggcggatctgctgcccaatctatgatttccctttggctgtacggtgc

SEQ ID NO: 286877 - DNA, 75 bp, Artificial Sequence
  Synthetic
acaatgagatgatcataaccctgattgacagtgatgtggaatctttcttggttcacaagatggtagacgatctgg

SEQ ID NO: 286878 - DNA, 75 bp, Artificial Sequence
  Synthetic
acgaggtggaggattttgttgaggttcaccttcaggatgtgcataagcaggtctcaggggttgatctcggtctcc

SEQ ID NO: 286879 - DNA, 75 bp, Artificial Sequence
  Synthetic
tctattccaagtcttcccccatagaaaaactactaaactgcacactcggaaatcgagggctgagaatccccccag

SEQ ID NO: 286880 - DNA, 75 bp, Artificial Sequence
  Synthetic
atagttttctccaatagagttttcaatgtttctaagccattgaccgaccccctgttctatccaccgtcagacccc

SEQ ID NO: 286881 - DNA, 75 bp, Artificial Sequence
  Synthetic
ttagttttctccaatagagttttcaatgtttctaagccattgaccgaccccctgttctatccaccgtcagacccc

SEQ ID NO: 286882 - DNA, 75 bp, Artificial Sequence
  Synthetic
ctagttttctccaatagagttttcaatgtttctaagccattgaccgaccccctgttctatccaccgtcagacccc

SEQ ID NO: 286883 - DNA, 75 bp, Artificial Sequence
  Synthetic
gtagttttctccaatagagttttcaatgtttctaagccattgaccgaccccctgttctatccaccgtcagacccc

SEQ ID NO: 286884 - DNA, 75 bp, Artificial Sequence
  Synthetic
aaatcttctagcagtttcagtgaccaacggtgctttcattctccaggaactgataccaaaggttgtggacgggcc

SEQ ID NO: 286885 - DNA, 75 bp, Artificial Sequence
  Synthetic
cccaaagcgggagggtcatatcttcatgggagtcatataaaagcggaggtgagaccaagctgtaaaggcaggtca

SEQ ID NO: 286886 - DNA, 75 bp, Artificial Sequence
  Synthetic
tgataccaaaggttgtggacgggccaaggggtgtttctgatgactccgtgattgagcacggacagaggtcatagt

SEQ ID NO: 286887 - DNA, 75 bp, Artificial Sequence
  Synthetic
tctccttcatatttcaagtcccgaggatcccatccccttgaggtgaaggggacatctctggattcaatggtcctc

SEQ ID NO: 286888 - DNA, 75 bp, Artificial Sequence
  Synthetic
gacggctctgggtgatgtccccagctttgcaaggcttcatgacttgtataatagacctataacttattactttaa

SEQ ID NO: 286889 - DNA, 75 bp, Artificial Sequence
  Synthetic
tgagttcactaatgagacaagtattaggtgggcatggtgaggacactctggagtcagatgaagacattcaaaggc

SEQ ID NO: 286890 - DNA, 75 bp, Artificial Sequence
  Synthetic
tttgcaaggcttcatgacttgtataatagacctataacttattactttaagaaacaagtcattcgagggaacatc

SEQ ID NO: 286891 - DNA, 75 bp, Artificial Sequence
  Synthetic
agatcagtttgacaatatacatgacttggtctttgtgtacggctgttacaggcattggggccatccttacataga

SEQ ID NO: 286892 - DNA, 75 bp, Artificial Sequence
  Synthetic
aggtgggcatggtgaggacactctggagtcagatgaagacattcaaaggctgttaaaagactctttacgtagaac

SEQ ID NO: 286893 - DNA, 75 bp, Artificial Sequence
  Synthetic
acacctcagtgttcaagagagtagcctgtaactctagcttaagtctgtcgtctcactggatcaggctgatctaca

SEQ ID NO: 286894 - DNA, 75 bp, Artificial Sequence
  Synthetic
gttacagtcccaacaagaaagtgtcgcgcaaagcagggtgttcagaatgggtctgctctgctcagcaggttgcgg

SEQ ID NO: 286895 - DNA, 75 bp, Artificial Sequence
  Synthetic
gcgcaaagcagggtgttcagaatgggtctgctctgctcagcaggttgcggtctcgacttcgtcaaacccggcccc

SEQ ID NO: 286896 - DNA, 75 bp, Artificial Sequence
  Synthetic
agaaactatacactcatgctgaaagacctctttttgtctcggttcaactctctgctgattcttctttcacctccg

SEQ ID NO: 286897 - DNA, 75 bp, Artificial Sequence
  Synthetic
ataataggtggatcacccttgctgacatcagatctagatcatctctactagattacagctgcctataaaatgaac

SEQ ID NO: 286898 - DNA, 75 bp, Artificial Sequence
  Synthetic
taatctccggcctgagagtggttcaatgggcgacaggagctcattataagctcaagcccattctcgacaacctca

SEQ ID NO: 286899 - DNA, 75 bp, Artificial Sequence
  Synthetic
atgggcgacaggagctcattataagctcaagcccattctcgacaacctcaccgtgttcccctccctatgtcttgt

SEQ ID NO: 286900 - DNA, 75 bp, Artificial Sequence
  Synthetic
aaaaacgagatcccaaatcagaacctctgattgtttgatcattttttttgtctttattgtttttttgttaagcgt

SEQ ID NO: 286901 - DNA, 75 bp, Artificial Sequence
  Synthetic
aaatttaggcctctcattcattccctgggagatttccctgcatttataagagataaggtgggtcaacttgagggg

SEQ ID NO: 286902 - DNA, 75 bp, Artificial Sequence
  Synthetic
catgtcaactatggtctgacatgtctcttcagacacaaaggtctgaagaggacaaagactcctctctgcttctag

SEQ ID NO: 286903 - DNA, 75 bp, Artificial Sequence
  Synthetic
cagatgccaggcttgtattcaacagcttattagaagtgaacgacctgatggcgtcggggacacacccgttgcccc

SEQ ID NO: 286904 - DNA, 75 bp, Artificial Sequence
  Synthetic
tgatgttatctcccgggtaattgactttgactctatatgggagaaaccctcggacctgaggaatttgaccacatg

SEQ ID NO: 286905 - DNA, 75 bp, Artificial Sequence
  Synthetic
agacgtattcgagtgactcataagaagttgaacaatagggtgccggaggtctatggattgtgtatatccatcatg

SEQ ID NO: 286906 - DNA, 75 bp, Artificial Sequence
  Synthetic
gatgtgaaaaaaactattaacatccctcaaagacttaagaaaagatggttcctcaagctcttttgttcgtacccc

SEQ ID NO: 286907 - DNA, 75 bp, Artificial Sequence
  Synthetic
aaattaatgttagaatggttgaagacaggaaatagaccttaccggatgactttgacagacaacagctctaggtct

SEQ ID NO: 286908 - DNA, 75 bp, Artificial Sequence
  Synthetic
aatgcaattcttcgaggggacatgccccgaagactggaatagctacgggatcttgattgcacgaaaaggagacaa

SEQ ID NO: 286909 - DNA, 75 bp, Artificial Sequence
  Synthetic
cccgaagactggaatagctacgggatcttgattgcacgaaaaggagacaaaatcacccctgactctcttgtagac

SEQ ID NO: 286910 - DNA, 75 bp, Artificial Sequence
  Synthetic
tcatctgtgatgcagaggtcactgacatcgcatcaatcaaccgaataaccctgctaatgtctgactttgctctat

SEQ ID NO: 286911 - DNA, 75 bp, Artificial Sequence
  Synthetic
gagcatgcatctttagttggtcttctcttgagtctttataggttgagcaaaatatcgggacaaaacacaggcaac

SEQ ID NO: 286912 - DNA, 75 bp, Artificial Sequence
  Synthetic
gtaaactctgactacagagcgattcaacacttatccagagcattcccttcagttactggattcataactcagatg

SEQ ID NO: 286913 - DNA, 75 bp, Artificial Sequence
  Synthetic
aacacttatccagagcattcccttcagttactggattcataactcagatgacctcttctttttcatccgaactat

SEQ ID NO: 286914 - DNA, 75 bp, Artificial Sequence
  Synthetic
gcgccaactggagtaccataccgaacttcagattcttagctggaacctacgacatgtttttctcccggattgaac

SEQ ID NO: 286915 - DNA, 75 bp, Artificial Sequence
  Synthetic
acatcctctacccttagagaaatgagtcttgtgctgttcaactgtagcagccctaagagtgagatgcagagagct

SEQ ID NO: 286916 - DNA, 75 bp, Artificial Sequence
  Synthetic
tcttatctgttcttccacgtgattaccctgtacatgaatgccctagactgggatgaagagaagaccatcttagct

SEQ ID NO: 286917 - DNA, 75 bp, Artificial Sequence
  Synthetic
ggggagggccggtccccagcgagaaggtcgttatcacagctctctccaaacctcctatcaaccccagagaattct

SEQ ID NO: 286918 - DNA, 75 bp, Artificial Sequence
  Synthetic
gtcttgtgctgttcaactgtagcagccctaagagtgagatgcagagagctcgctctttaaattaccaagaccttg

SEQ ID NO: 286919 - DNA, 75 bp, Artificial Sequence
  Synthetic
catcgctggggatcaagtcttgtctatgtgtggaaactccggctatgaagtcattaaaatattggagccatatgt

SEQ ID NO: 286920 - DNA, 75 bp, Artificial Sequence
  Synthetic
ctcaaaccgaaagaaagggagctgaaaatcgaaggtcggtttttcgctttgatgtcttggaatctgaggttgtat

SEQ ID NO: 286921 - DNA, 75 bp, Artificial Sequence
  Synthetic
ataaccttgattgacagcgatgtagaatctttcctggtccacaagatggtcgacgatctagagttacagcgaggg

SEQ ID NO: 286922 - DNA, 75 bp, Artificial Sequence
  Synthetic
gaaggtctttggaagataaatcaacccagactactggccgagagcccaagaaggagacaacatctactcattctc

SEQ ID NO: 286923 - DNA, 75 bp, Artificial Sequence
  Synthetic
atcatatccccgagtgtagcggacctggacccatatgataaatcccttcactcgagggtcttccccgacggaaag

SEQ ID NO: 286924 - DNA, 75 bp, Artificial Sequence
  Synthetic
cgacgatctagagttacagcgagggactttgtctaaagtctctattatcatagccatcgtaatagtcttctccaa

SEQ ID NO: 286925 - DNA, 75 bp, Artificial Sequence
  Synthetic
ccagactactggccgagagcccaagaaggagacaacatctactcattctcagagagagagccaatccttgaaagc

SEQ ID NO: 286926 - DNA, 75 bp, Artificial Sequence
  Synthetic
ggttttttagggttctggatcaattcgacaacatacatgacttggttttcgtgtacggctgttacaggcattggg

SEQ ID NO: 286927 - DNA, 75 bp, Artificial Sequence
  Synthetic
atatcccaactttgccaactatacattgcaggagatcaagtattgtccatgtgtggaaattcgggttatgaagtc

SEQ ID NO: 286928 - DNA, 75 bp, Artificial Sequence
  Synthetic
cgaaccccggtattcagacgacctgatatcccaactttgccaactatacattgcaggagatcaagtattgtccat

SEQ ID NO: 286929 - DNA, 75 bp, Artificial Sequence
  Synthetic
acttgggagaggagttttttgggaaggggacgtttgaaagaagattcttcagagatgagaaagaacttcaagagt

SEQ ID NO: 286930 - DNA, 75 bp, Artificial Sequence
  Synthetic
acaaattcccttctcgatcctcaggtatattcttgtataattttgaacagttgaaaatgaaccttgatgatatag

SEQ ID NO: 286931 - DNA, 75 bp, Artificial Sequence
  Synthetic
caagtgtttggattaaagagggtgttctccagaactcatgagttttttcagaagtcttggatctactattcagac

SEQ ID NO: 286932 - DNA, 75 bp, Artificial Sequence
  Synthetic
atgtccccagctttgcgagacttcatgacttgtacaacagacctataacttattacttcaggaaacaagtaattc

SEQ ID NO: 286933 - DNA, 75 bp, Artificial Sequence
  Synthetic
gaagtttaggcccctcatccactctttgggggactttcccgtttttataaaggacaaagtgaatcaactcgaggg

SEQ ID NO: 286934 - DNA, 75 bp, Artificial Sequence
  Synthetic
ctaccaatgaggaggatgatctctcaatagaggccgagatcgctcaccagattgctgaaagcttttccaagaagt

SEQ ID NO: 286935 - DNA, 75 bp, Artificial Sequence
  Synthetic
aagagggtggcttgcaactccagcttgagtctctcatctcactggatcaggttgatctacaaaataataaagacc

SEQ ID NO: 286936 - DNA, 75 bp, Artificial Sequence
  Synthetic
aatctacacgactttcgctcggacgagatcgaacatctcgttgtggaggagttggtcaagaaaagagaggagtgt

SEQ ID NO: 286937 - DNA, 75 bp, Artificial Sequence
  Synthetic
acaacatacatgacctagtctttgtgtatggctgttatagacattgggggcatccttatatagattataggaagg

SEQ ID NO: 286938 - DNA, 75 bp, Artificial Sequence
  Synthetic
tgggatgggttgccttggccagttctaagaaattccaactgttagtcgagcctgacaagctaaacaaaatcatgc

SEQ ID NO: 286939 - DNA, 75 bp, Artificial Sequence
  Synthetic
catccttatatagattataggaagggtctgtcaaagctatacgatcaagttcatatcaaaaaggtgatagataaa

SEQ ID NO: 286940 - DNA, 75 bp, Artificial Sequence
  Synthetic
atgatcaaatatactgtttggacatgtcaaacggaccgacatgctggaacggccaagatggcggactggagggtc

SEQ ID NO: 286941 - DNA, 75 bp, Artificial Sequence
  Synthetic
accctggatgatattagatccagatcatctctcctggattacagttgtttgtagactaggcgcccttgagaagat

SEQ ID NO: 286942 - DNA, 75 bp, Artificial Sequence
  Synthetic
tgtcctagagtcgacatgaaaaaaacaggcaacaccactaataaaatgaattttctacgtaaaatagtgagaaac

SEQ ID NO: 286943 - DNA, 75 bp, Artificial Sequence
  Synthetic
gtagactaggcgcccttgagaagatgtattgaccaccattcttgtagggtacaccctgaaaaaaacaagatctca

SEQ ID NO: 286944 - DNA, 75 bp, Artificial Sequence
  Synthetic
taagaaattccaactgttagtcgagcctgacaagctaaacaaaatcatgcaagatgatttgaatcgctatgcatc

SEQ ID NO: 286945 - DNA, 75 bp, Artificial Sequence
  Synthetic
tgagtctctcatctcactggatcaggttgatctacaaaataataaagaccaccaggttggttggaagcataaatg

SEQ ID NO: 286946 - DNA, 75 bp, Artificial Sequence
  Synthetic
catctcctgtgtcagcccctccggacgacgatgacctgtggcttccacctcctgagtacgtcccgctgaaagaac

SEQ ID NO: 286947 - DNA, 75 bp, Artificial Sequence
  Synthetic
tggggctcatcataaaaaaggaagagaccatgtgtagctatgactttctcatttacggaaaaacccctctattcc

SEQ ID NO: 286948 - DNA, 75 bp, Artificial Sequence
  Synthetic
gtgtgtagcccgaatggttactcgtttaagatcctgcggcacattctaagatccttcgacgagatatactctgga

SEQ ID NO: 286949 - DNA, 75 bp, Artificial Sequence
  Synthetic
ttatccccctgatgcaccctttagcagatccgtctacagttttcaaggatgatgatgaggcagaggattttgttg

SEQ ID NO: 286950 - DNA, 75 bp, Artificial Sequence
  Synthetic
atccttcgacgagatatactctggaaatcatagaatgattgggctggtcaaggttgttattggactagccttgtc

SEQ ID NO: 286951 - DNA, 75 bp, Artificial Sequence
  Synthetic
caccaatgcattgactgtcgcacaacactctcagtctttgattaagccgatgagggattttttactcatgtcagt

SEQ ID NO: 286952 - DNA, 75 bp, Artificial Sequence
  Synthetic
tgagggattttttactcatgtcagtgcaagctgtcttccattacttgctgttcagccccatcctaaaaggcagag

SEQ ID NO: 286953 - DNA, 75 bp, Artificial Sequence
  Synthetic
ttcagccccatcctaaaaggcagagtttacaaagtcctgagtgctgaaggggacaattttcttctagctatgtcc

SEQ ID NO: 286954 - DNA, 75 bp, Artificial Sequence
  Synthetic
ctgtagaggaaattgtctcctatgtcatgactaacttccccaacccatctggaaggtcttcggaggacaagtcta

SEQ ID NO: 286955 - DNA, 75 bp, Artificial Sequence
  Synthetic
aacctgcgacaaatgagttccttgatgaggcaggtgctgggtgggcacggagaagataccttagagtcagacgac

SEQ ID NO: 286956 - DNA, 75 bp, Artificial Sequence
  Synthetic
acctcccaaagcggaaaggttatatcttcatgggagtcatataaaagcgggggtgagaccagactgtgaaagccg

SEQ ID NO: 286957 - DNA, 75 bp, Artificial Sequence
  Synthetic
cttcatgggagtcatataaaagcgggggtgagaccagactgtgaaagccggtcactccctccaagctttaagttt

SEQ ID NO: 286958 - DNA, 75 bp, Artificial Sequence
  Synthetic
gaacaaggtgtttaaaaagttgattgatcgagtaaccgggcaagggctcttggactactcacgggttacatacgc

SEQ ID NO: 286959 - DNA, 75 bp, Artificial Sequence
  Synthetic
tgcaattagaagagccctatatgatgaggtggacaaagtggagaactcagagtttagagaagctatcctcctgtc

SEQ ID NO: 286960 - DNA, 75 bp, Artificial Sequence
  Synthetic
tttatcaatgtcaagttaattacctttacattttgagcctcttgggtgtgaaaaaaactattaacatccctcaac

SEQ ID NO: 286961 - DNA, 75 bp, Artificial Sequence
  Synthetic
tggacaagatggcgggctggaaggcttacggcagaaaggctggagtctggtcagcctattgatgatagaccgaga

SEQ ID NO: 286962 - DNA, 75 bp, Artificial Sequence
  Synthetic
gattttatcactgtgttccggggaattccccatttacacgataccagacaaactgggtccttggagccctattga

SEQ ID NO: 286963 - DNA, 75 bp, Artificial Sequence
  Synthetic
gccagacaagttgaacaaaattatgcaggatgatctaaaccgttatacatcctgctgacaattttcacactcagg

SEQ ID NO: 286964 - DNA, 75 bp, Artificial Sequence
  Synthetic
cttcagttcttctttcttggggattccagagtcaatcattgggttgatacaaaactcccgaacaatacgaagaca

SEQ ID NO: 286965 - DNA, 75 bp, Artificial Sequence
  Synthetic
aggttctatgtccgacatatatgttgtctcctgggctgtcgagagaagggcttctttatgaactggagagcatat

SEQ ID NO: 286966 - DNA, 75 bp, Artificial Sequence
  Synthetic
aaagtgtacataattataaagggctgggtcatctaagcttttctgtcgagaaaaaaactgtgggccagaagagca

SEQ ID NO: 286967 - DNA, 75 bp, Artificial Sequence
  Synthetic
gctctgaattcgacatgaaaaaaacaggcaacaccactgataagatgaacttcctacgcaagatagtgaaaaact

SEQ ID NO: 286968 - DNA, 75 bp, Artificial Sequence
  Synthetic
gtctcctgggctgtcgagagaagggcttctttatgaactggagagcatatcaagaaatgccctatcaatataccg

SEQ ID NO: 286969 - DNA, 75 bp, Artificial Sequence
  Synthetic
agaggtctatgatgaccccgttgatccaattgagtcagaggctgagcctagaggggccccaactgtccccaacat

SEQ ID NO: 286970 - DNA, 75 bp, Artificial Sequence
  Synthetic
gtccctcacccttctgagatgttagggttgcttccaaaatcctcgatctcctgcacttgtggagtaacaggagag

SEQ ID NO: 286971 - DNA, 75 bp, Artificial Sequence
  Synthetic
agtccctgcacaatccgtaccccgactaccattggcttcgaactgtgaagaccaccaaagagtctctcgttatca

SEQ ID NO: 286972 - DNA, 75 bp, Artificial Sequence
  Synthetic
ccaccaacgccttaactgtggcacaacactctcaatctttgatcaagcctatgagagactttttgcttatgtcag

SEQ ID NO: 286973 - DNA, 75 bp, Artificial Sequence
  Synthetic
atgagagactttttgcttatgtcagtgcaggcagtctttcattacttgctgtttagccccatcttaaaaggcaga

SEQ ID NO: 286974 - DNA, 75 bp, Artificial Sequence
  Synthetic
gaaagtcaccaatgttcatgtagtgaaaagagccctgtcactcaaagaatctattaactggttcattacaagaaa

SEQ ID NO: 286975 - DNA, 75 bp, Artificial Sequence
  Synthetic
agagtatttcctagtggaaagtgctcggggataactgtgtcttctacctactgcttaactaaccatgattacacc

SEQ ID NO: 286976 - DNA, 75 bp, Artificial Sequence
  Synthetic
atttggatgccagagaatctaagactagggacatcttgtgacatttttactaatagtcgagggaagagagcatcc

SEQ ID NO: 286977 - DNA, 75 bp, Artificial Sequence
  Synthetic
cggacttcccgctggaagaggctcctgtcttcaagaggacagggtctgctctgcataggttcaagtcagccaggt

SEQ ID NO: 286978 - DNA, 75 bp, Artificial Sequence
  Synthetic
cagagtttcgagaggcaatcctgttgtccaagacccatagagataacttcatactcttcttaaaatctgttgagc

SEQ ID NO: 286979 - DNA, 75 bp, Artificial Sequence
  Synthetic
cctgaaaggagcatgcaaactcaagttatgtggtgttcttggacttagactcatggatgggacatgggtcgcaat

SEQ ID NO: 286980 - DNA, 75 bp, Artificial Sequence
  Synthetic
aactggtgcaaaaggacactcggctgaaggactccacctttcattggcatcttcgatgtaacaagtgtataaggc

SEQ ID NO: 286981 - DNA, 75 bp, Artificial Sequence
  Synthetic
ttgggagcaatagaacaaaaatatgttatggtgccattaaaccgctgcattttatcaaaatcagattaattacct

SEQ ID NO: 286982 - DNA, 75 bp, Artificial Sequence
  Synthetic
actttagaagaatccttctacaactcagagatccacgggatcaatcggatgacccagacacctcaaagggtcggg

SEQ ID NO: 286983 - DNA, 75 bp, Artificial Sequence
  Synthetic
aagcaagtcattcgagggaatatttatttatcttggagttggtccgacgacacctcagtgttcaagagggtagcc

SEQ ID NO: 286984 - DNA, 75 bp, Artificial Sequence
  Synthetic
ttcaaagatcaaatatggggactactaatcgtgactaaagactttgtttactctcagagttctaactgcattttt

SEQ ID NO: 286985 - DNA, 75 bp, Artificial Sequence
  Synthetic
taagaaactccgactacaatctcaactctcctctaatagaggatccagccaggctaatgttagaatggctgaaga

SEQ ID NO: 286986 - DNA, 75 bp, Artificial Sequence
  Synthetic
ctgtttccccgatttcttagtgagcttttcagttcatccttcttggggattccggagtcaatcatcggattgata

SEQ ID NO: 286987 - DNA, 75 bp, Artificial Sequence
  Synthetic
ttccctgatgatcctgctttctcccccagaaccccgatattcagatgacctgatatcccagctgtgccagctata

SEQ ID NO: 286988 - DNA, 75 bp, Artificial Sequence
  Synthetic
caatcatccctcctccagcaacatgtggagttgttggaatcctccgttatccccctgatgcaccccttggcagac

SEQ ID NO: 286989 - DNA, 75 bp, Artificial Sequence
  Synthetic
atgtcaccaccacgtttaagagaaagcactttcgaccaacaccggatgcgtgcagatccgcatacaattggaaga

SEQ ID NO: 286990 - DNA, 75 bp, Artificial Sequence
  Synthetic
tcatcttcctgatgtgcacaaacaggtctccggggtcgacctgggtctcccgaactggggcaagtatgcattagt

SEQ ID NO: 286991 - DNA, 75 bp, Artificial Sequence
  Synthetic
ccatctttgtacataatgctcagagagccatctcttagaggagagatattttctattccccagaaagttcctgct

SEQ ID NO: 286992 - DNA, 75 bp, Artificial Sequence
  Synthetic
gtctccggggtcgacctgggtctcccgaactggggcaagtatgcattagtgagtgcgggagccctgactgccttg

SEQ ID NO: 286993 - DNA, 75 bp, Artificial Sequence
  Synthetic
ccttttcaagaggccctctaaagggatacctgggatcatctacctccatgtcaacccagctattccatgcttggg

SEQ ID NO: 286994 - DNA, 75 bp, Artificial Sequence
  Synthetic
ggacgatgaaaaattgtccaaccttggtgagatggttagggtgggcgaaggcaagtatcgagaggactttcagat

SEQ ID NO: 286995 - DNA, 75 bp, Artificial Sequence
  Synthetic
ccgtacgataaatcccttcattcgagagtttttcctagaggaaaatgctcaggaataacggtgtcttctacctac

SEQ ID NO: 286996 - DNA, 75 bp, Artificial Sequence
  Synthetic
atctacgcaacgcagtcctggagggacaaggagaaaggtgtctgtcgcttctcaaagcgggaaggtcatagcttc

SEQ ID NO: 286997 - DNA, 75 bp, Artificial Sequence
  Synthetic
ctcaaagcgggaaggtcatagcttcttgggaggcatataaaagtggatgtgaaaccaaaatgtgagagttggtca

SEQ ID NO: 286998 - DNA, 75 bp, Artificial Sequence
  Synthetic
tgggggtttgacaagtactctaagtggtatcttgattcgcgatttctcgcccgagatcaccccttaactccctat

SEQ ID NO: 286999 - DNA, 75 bp, Artificial Sequence
  Synthetic
tgagacaagtgctgggtgggcatggtgaggataccttggagtcagacgaagacattcagaggctgttaaaagact

SEQ ID NO: 287000 - DNA, 75 bp, Artificial Sequence
  Synthetic
gccgggagctcaagaaggagacaacatccattctttctcaaagagaaagccaaccttcaaaagccggaatggtgg

SEQ ID NO: 287001 - DNA, 75 bp, Artificial Sequence
  Synthetic
taaatcacattctttcaccagaacgaggctagtctcttggttgtcagagaacagaggagggcctgttcccagcga

SEQ ID NO: 287002 - DNA, 75 bp, Artificial Sequence
  Synthetic
ggtgctttcattctccaggagctaataccaaaggttggggacagtccagggggtgtttagaatgactccgcactt

SEQ ID NO: 287003 - DNA, 75 bp, Artificial Sequence
  Synthetic
gaacatcttgttgtggaggagttggtcaagaaaagggaagagtgtctagatgcactggagtccatcatgaccacc

SEQ ID NO: 287004 - DNA, 75 bp, Artificial Sequence
  Synthetic
gggttcagagtgggtatgctctgctcagcaggttgcagtttcaacatcagcgaacccagcccctgcagccgagct

SEQ ID NO: 287005 - DNA, 75 bp, Artificial Sequence
  Synthetic
taccaaaggttggggacagtccagggggtgtttagaatgactccgcacttgggcacagaaagaggtcatagcata

SEQ ID NO: 287006 - DNA, 75 bp, Artificial Sequence
  Synthetic
cccatgaaggacatgagcaatagctcacaatcatcttgcatctcagcaaagtgtacatacctacaaagggctggg

SEQ ID NO: 287007 - DNA, 75 bp, Artificial Sequence
  Synthetic
tgagagtagttcagtgggcaacaggggcccattataagctcaagcccattctggatgatctcaatgtatttccat

SEQ ID NO: 287008 - DNA, 75 bp, Artificial Sequence
  Synthetic
cacaatcatcttgcatctcagcaaagtgtacatacctacaaagggctgggtcatctaagcttttcagtcgagaaa

SEQ ID NO: 287009 - DNA, 75 bp, Artificial Sequence
  Synthetic
ggcccattataagctcaagcccattctggatgatctcaatgtatttccatccctgtgccttgtagtcggggatgg

SEQ ID NO: 287010 - DNA, 75 bp, Artificial Sequence
  Synthetic
ttgatagagtcactggacaaggacttttagactattcgagggttacatacgcttttcacctcgactatgagaagt

SEQ ID NO: 287011 - DNA, 75 bp, Artificial Sequence
  Synthetic
gagaaccgtctcttagaggagaaatattttctatccctcagaaaatccccgccgcttatccaaccactatgaaag

SEQ ID NO: 287012 - DNA, 75 bp, Artificial Sequence
  Synthetic
acatcaagatgctagatccaggagaagtctatgatgaccccattgatccaattgagtcggaggctgaacctagag

SEQ ID NO: 287013 - DNA, 75 bp, Artificial Sequence
  Synthetic
ctgtcaacatatatggcaaggtctcccctagagactatttaagggggcttgcaagaggagttctaatagggtcgt

SEQ ID NO: 287014 - DNA, 75 bp, Artificial Sequence
  Synthetic
gatcaggtgtttggactaaaaagggtgttctccagaacacacgagttttttcagaagtcctggatctactactca

SEQ ID NO: 287015 - DNA, 75 bp, Artificial Sequence
  Synthetic
catcaacggtttttaaagatggtgacgaggcggaggattttgttgaggttcaccttccagatgtgcataagcagg

SEQ ID NO: 287016 - DNA, 75 bp, Artificial Sequence
  Synthetic
gagttgatctcaggtgtgatctcatatatcctcttgaggctggataatcacccatctttgtacataatgctcaga

SEQ ID NO: 287017 - DNA, 75 bp, Artificial Sequence
  Synthetic
tgttgatgattttcttaatgacgtgttgccgaaggaccaatagagcagaatcaatacaacacagtcttggagaga

SEQ ID NO: 287018 - DNA, 75 bp, Artificial Sequence
  Synthetic
gacgacatccaacgattactaaaagactctttgcgaaggacaaggtgggtggatcaagaggtgcgccatgcagct

SEQ ID NO: 287019 - DNA, 75 bp, Artificial Sequence
  Synthetic
actctttgcgaaggacaaggtgggtggatcaagaggtgcgccatgcagctagaaccatgactggagattacagcc

SEQ ID NO: 287020 - DNA, 75 bp, Artificial Sequence
  Synthetic
ggctcctctatgagttggagagcatatcaaggaatgcgctttcaatatatcgggctatcgaggaaggagcatcta

SEQ ID NO: 287021 - DNA, 75 bp, Artificial Sequence
  Synthetic
tacagagccattcaacacttatccagagcgtttcccgcagtcactggattcataacccagatgacctcatctttc

SEQ ID NO: 287022 - DNA, 75 bp, Artificial Sequence
  Synthetic
ggatgtataactgacttggcccatttctactccaagtcatcccccatagagaagctgttaaattgtacgctaatg

SEQ ID NO: 287023 - DNA, 75 bp, Artificial Sequence
  Synthetic
aggatgttcagaatgggtctgctctgctcaacaggttgcagtctccacctcagcaaacccagcccctgtctcaga

SEQ ID NO: 287024 - DNA, 75 bp, Artificial Sequence
  Synthetic
gagcgtttcccgcagtcactggattcataacccagatgacctcatctttctcatccgagctgtacctcagattct

SEQ ID NO: 287025 - DNA, 75 bp, Artificial Sequence
  Synthetic
gtctctattattatagccatcatgatagtcttttccaatagagtgttcaatgtctcgaaaccgatgactgaacct

SEQ ID NO: 287026 - DNA, 75 bp, Artificial Sequence
  Synthetic
gtttcagaaccctctcatctcgggattaagagtggttcagtgggcaactggtgcccattataaactcaagcccat

SEQ ID NO: 287027 - DNA, 75 bp, Artificial Sequence
  Synthetic
tcaagatcttggagccgtatgttgtgaacagtctagtccatagagcagaaaagtttaggcctctcattcactctt

SEQ ID NO: 287028 - DNA, 75 bp, Artificial Sequence
  Synthetic
gaacagtctagtccatagagcagaaaagtttaggcctctcattcactctttgggagactttccagtattcataaa

SEQ ID NO: 287029 - DNA, 75 bp, Artificial Sequence
  Synthetic
tgtctttctggagagaaatctggttgagctcccatgagtcttggattcacgcattgtgtcaagaggccgggaacc

SEQ ID NO: 287030 - DNA, 75 bp, Artificial Sequence
  Synthetic
tctttagggttctggatcaattcgacaacatacatgacctagtgtttgtgtacggctgctacaggcattgggggc

SEQ ID NO: 287031 - DNA, 75 bp, Artificial Sequence
  Synthetic
ccaagaggtgcgtcatgcagccagagccatgacagggggttatagccccaataagaagatgtctcgcaaagcggg

SEQ ID NO: 287032 - DNA, 75 bp, Artificial Sequence
  Synthetic
acccttatatagattatcgaaagggtctttcgaaactgtatgatcaagttcacattaagaaagtgatagacaagt

SEQ ID NO: 287033 - DNA, 75 bp, Artificial Sequence
  Synthetic
gacgaggtggacaaggtagaaaactcagagtttagagaggcaatcctgttgtctaagactcatagagataacttt

SEQ ID NO: 287034 - DNA, 75 bp, Artificial Sequence
  Synthetic
aatagtgaagaccaccagacttgtaggaagcatagaaaacctgtccggagaagtcgagaggcaccttagagggta

SEQ ID NO: 287035 - DNA, 75 bp, Artificial Sequence
  Synthetic
cagagtttagagaggcaatcctgttgtctaagactcatagagataactttatactattcctaaaatctgttgaac

SEQ ID NO: 287036 - DNA, 75 bp, Artificial Sequence
  Synthetic
gtcttatgacctcatcatttgtgatgcagaagtcactgacatagcatcaatcaatcggataacactgttgatgtc

SEQ ID NO: 287037 - DNA, 75 bp, Artificial Sequence
  Synthetic
attatagctgcctgtaacctaaatgctctcgaaggaatgtacagactccgactcttagacaatgcaccctgaaaa

SEQ ID NO: 287038 - DNA, 75 bp, Artificial Sequence
  Synthetic
ggatttgataagtactctaagtggtatctggattcaagattcctagcccaagaccaccccttgattccttacatt

SEQ ID NO: 287039 - DNA, 75 bp, Artificial Sequence
  Synthetic
actcttagacaatgcaccctgaaaaaaacgaggtcccaattcatgacctctgtttacttgattgttttttttgtc

SEQ ID NO: 287040 - DNA, 75 bp, Artificial Sequence
  Synthetic
aactatcaagatcttgtaaggggatttcctgaagaaatcatatcaaatccttacaatgagatgatcataactctg

SEQ ID NO: 287041 - DNA, 75 bp, Artificial Sequence
  Synthetic
cgacttcgcattgtcaatagacggcccactgtatctggtcttcaaaacttatggaactatgctggtaaatccaga

SEQ ID NO: 287042 - DNA, 75 bp, Artificial Sequence
  Synthetic
actttagaagagtccttttacaactcagaaattcatggaattaatcgaatgactcagaccccgcaaagagtcggg

SEQ ID NO: 287043 - DNA, 75 bp, Artificial Sequence
  Synthetic
gcagaagtcactgacatagcatcaatcaatcggataacactgttgatgtccgacttcgcattgtcaatagacggc

SEQ ID NO: 287044 - DNA, 75 bp, Artificial Sequence
  Synthetic
atctggattcaagattcctagcccaagaccaccccttgattccttacattaaaacccaaacatggccacccaaac

SEQ ID NO: 287045 - DNA, 75 bp, Artificial Sequence
  Synthetic
gtgtgacagatttggacccatatgacaaatcccttcactcaagggtcttccctggcggaaagtgctcaggaataa

SEQ ID NO: 287046 - DNA, 75 bp, Artificial Sequence
  Synthetic
tccaagcgaggaaaattcttccgagatgccgagtacttaacttcttctacccttcgagagatgagcctcgtcttg

SEQ ID NO: 287047 - DNA, 75 bp, Artificial Sequence
  Synthetic
ctagcttcttggctgtcagagaaccgaggggggcctgttcctagcgagaaggttattatcacagccctgtctaag

SEQ ID NO: 287048 - DNA, 75 bp, Artificial Sequence
  Synthetic
ataaaacgtactgatgtagaagggaattgggccttgacgggaggtatggagctgacgagagaccccacagtctca

SEQ ID NO: 287049 - DNA, 75 bp, Artificial Sequence
  Synthetic
tgatagttttctctaacagagtcttcaacgtttccaaacccttgactgaccccttgttctatccaccgtctgatc

SEQ ID NO: 287050 - DNA, 75 bp, Artificial Sequence
  Synthetic
gttcataagatggtagatgacctagaattacaaagagggactttatctaagatggctgtcattatagccattatg

SEQ ID NO: 287051 - DNA, 75 bp, Artificial Sequence
  Synthetic
caatagtagagggaagagagcatccaaagggagtaagacctgcggctttgtagatgaaagaggcctgtataagtc

SEQ ID NO: 287052 - DNA, 75 bp, Artificial Sequence
  Synthetic
aaagggagtaagacctgcggctttgtagatgaaagaggcctgtataagtctctaaaaggagcatgcaaactcaag

SEQ ID NO: 287053 - DNA, 75 bp, Artificial Sequence
  Synthetic
tagatgaaagaggcctgtataagtctctaaaaggagcatgcaaactcaagttatgtggagttcttggacttagac

SEQ ID NO: 287054 - DNA, 75 bp, Artificial Sequence
  Synthetic
ggacaaggtgagtcaactcgaggggacattcggtcccagtgcaaaaaggttttttcgggtattggatcagttcga

SEQ ID NO: 287055 - DNA, 75 bp, Artificial Sequence
  Synthetic
aagcatataccatattcaacaaaaccttgatggaggctgatgctcactacaagtcagtccggacctggaatgaga

SEQ ID NO: 287056 - DNA, 75 bp, Artificial Sequence
  Synthetic
gtacaacaggtggatcaccctcgaggatatcagatctagatcatctttattagactacagctgcttgtaaacctg

SEQ ID NO: 287057 - DNA, 75 bp, Artificial Sequence
  Synthetic
aagatcaaatatactgcttggatatgtccgacggcccaacctgctggaatggccaagacggtgggctagagggct

SEQ ID NO: 287058 - DNA, 75 bp, Artificial Sequence
  Synthetic
ctgcaactctagtttgagtctgtcgtctcattggatcaggcttgtttacaagatagtgaagaccaccagacttgt

SEQ ID NO: 287059 - DNA, 75 bp, Artificial Sequence
  Synthetic
gacgtgtcaagaagaatatctagaatggtttctggagcggttcctcactttcagaaacttcccgatatccgcctt

SEQ ID NO: 287060 - DNA, 75 bp, Artificial Sequence
  Synthetic
gcaccccctggcagacccttctacagttttcaaagaaggtgatgaggctgaggattttgttgaagttcacctccc

SEQ ID NO: 287061 - DNA, 75 bp, Artificial Sequence
  Synthetic
aaggaatgcactgtcgatataccgtgctatagaggaaggagcatctaaactagggcttatcatcaagaaggaaga

SEQ ID NO: 287062 - DNA, 75 bp, Artificial Sequence
  Synthetic
atctccaatgaccaaatagtcaaccttgccaatataatgtcgacagtatcaactaatgcgctgacagtagctcaa

SEQ ID NO: 287063 - DNA, 75 bp, Artificial Sequence
  Synthetic
aatgtgtcagtcacttcccaaagcggaaaagtcataccttcatgggaatcatataagagtggaggtgagaccagg

SEQ ID NO: 287064 - DNA, 75 bp, Artificial Sequence
  Synthetic
cgcatatacggagatatgtctcagtcagttccaatcatcaagcccgtcccaactcattcgccgagtttctaaaca

SEQ ID NO: 287065 - DNA, 75 bp, Artificial Sequence
  Synthetic
cccaaagcgggaaagtcatatcttcatgggagtcatataaaagtgggggtgagactagactgtgagggttggtca

SEQ ID NO: 287066 - DNA, 75 bp, Artificial Sequence
  Synthetic
aggataatctatctagatccatctttgggaggggtatctggaatgtctcttggaagattccatatacgtcagttt

SEQ ID NO: 287067 - DNA, 75 bp, Artificial Sequence
  Synthetic
tgcgctgactatgacagacaacctgaacaaggtgtttaaaaagttgatcgatcgagtaaccgggcaagggctttt

SEQ ID NO: 287068 - DNA, 75 bp, Artificial Sequence
  Synthetic
gaatctctgggctcaatagtcctccttgaactccatgcaacagggtagattcaagagtcatgagactttcattaa

SEQ ID NO: 287069 - DNA, 75 bp, Artificial Sequence
  Synthetic
tgatcaggaagtccgccatgcagctagaaccatgacgggggactatagtcccaacaagaaagtgtctcgcaaggc

SEQ ID NO: 287070 - DNA, 75 bp, Artificial Sequence
  Synthetic
acaggagccggagatgtataaccgacttggcccatttctattccaagtcatcccccatagagaagctgttgaatt

SEQ ID NO: 287071 - DNA, 75 bp, Artificial Sequence
  Synthetic
caatagtagagggaagagagcatccaaagggggcaagacttgtggatttgtggatgaaagaggcttgtacaagtc

SEQ ID NO: 287072 - DNA, 75 bp, Artificial Sequence
  Synthetic
gtgggcggaaccgctgcacagtcaatgatttctctctggttatatggtgcccactctgaatcaaacaggagccgg

SEQ ID NO: 287073 - DNA, 75 bp, Artificial Sequence
  Synthetic
tgatttctctctggttatatggtgcccactctgaatcaaacaggagccggagatgtataacagacttggcccatt

SEQ ID NO: 287074 - DNA, 75 bp, Artificial Sequence
  Synthetic
gggactgctgattgtgacaaaggactttgtttactctcagagttctaactgtctttttgacagaaactatacact

SEQ ID NO: 287075 - DNA, 75 bp, Artificial Sequence
  Synthetic
atttcgaacgaccaaatagtcaacctcgccaatataatgtcgacagtgtccaccaacgctttaactgtggcacaa

SEQ ID NO: 287076 - DNA, 75 bp, Artificial Sequence
  Synthetic
cactctcaatctttgatcaagccgatgagggactttctgcttatgtcagtgcaggcagtctttcactacttgctg

SEQ ID NO: 287077 - DNA, 75 bp, Artificial Sequence
  Synthetic
gacctaataaataacaccacaaaagacataactaaattgaagttagcacttgacaagtatggggttgatttgcca

SEQ ID NO: 287078 - DNA, 75 bp, Artificial Sequence
  Synthetic
gctctgtcattccggtgaccttgcacgccagttttatcaccccttccctcttgtaacttagaagaattaaactca

SEQ ID NO: 287079 - DNA, 75 bp, Artificial Sequence
  Synthetic
ataacatcattaaacaaaagaagagaagtgaacctgtagcagtgatgatacatggctcaccaggaactggcaagt

SEQ ID NO: 287080 - DNA, 75 bp, Artificial Sequence
  Synthetic
ccccggtcaaagttgatatgcttcaccaaggcaaaaacaacagcgatcgttatccgcaagatgcctacgcaaagc

SEQ ID NO: 287081 - DNA, 75 bp, Artificial Sequence
  Synthetic
ttagagtagtgtatggaaatctattttcttctttccacaaaaatcctggagtagtcacaggatctgctgtagggt

SEQ ID NO: 287082 - DNA, 75 bp, Artificial Sequence
  Synthetic
tgttgtcataatggatgatatcatgcagaatcctgatggtgaagacatgtcactgttctgccaaatggtatctag

SEQ ID NO: 287083 - DNA, 75 bp, Artificial Sequence
  Synthetic
ttggtttgaagctcttaaacaagttttaagaaacttgtcatttgaagacaaacttatagacagattgtgtaaatc

SEQ ID NO: 287084 - DNA, 75 bp, Artificial Sequence
  Synthetic
cagcctgcgtggctgcctgcacacccttacgggtgtgaagccaaatattggacaaggtgtgaagagccccgtgtg

SEQ ID NO: 287085 - DNA, 75 bp, Artificial Sequence
  Synthetic
aaagcatatattcagagacacatactatgaagttgaaggtggagtgccctcaggctgttcaggaactagcatatt

SEQ ID NO: 287086 - DNA, 75 bp, Artificial Sequence
  Synthetic
cccactatcacatctctgcaggccatgaataggcgattcttccttgatttagatattgtagtccatgaaaattat

SEQ ID NO: 287087 - DNA, 75 bp, Artificial Sequence
  Synthetic
tgggaccgactactttgggtgtccgtgtttctcttttttcctttttaattctgcttatggtgacaatatatagtg

SEQ ID NO: 287088 - DNA, 75 bp, Artificial Sequence
  Synthetic
gttattttttcctacaaataccctttagacatggaggcaattgctacagaaggaaacaaatacggtctaaccatc

SEQ ID NO: 287089 - DNA, 75 bp, Artificial Sequence
  Synthetic
aagcagtcacattcaaagatcgcaacacctgcttaaattattcactaagtcaaatttacaatttgatcttagaag

SEQ ID NO: 287090 - DNA, 75 bp, Artificial Sequence
  Synthetic
acatcaattattttaaagatgctgcatctagtggagcatctaagcttgaattttcccaagacccgagtaaattta

SEQ ID NO: 287091 - DNA, 75 bp, Artificial Sequence
  Synthetic
ttcatccaacattcccagtttctgaaattcatgagtccattagatggactaagaaaccttcacaaatgcaggagc

SEQ ID NO: 287092 - DNA, 75 bp, Artificial Sequence
  Synthetic
acgctctgtaaaaacaccagaagtcattaaatattgtgaaaacaataagtggattattccagctgaatgcaaaat

SEQ ID NO: 287093 - DNA, 75 bp, Artificial Sequence
  Synthetic
aggggattccacgatcacttcacaagatgtggcaaatgcagttgtgggatatggtgtgtggccgcattatttgac

SEQ ID NO: 287094 - DNA, 75 bp, Artificial Sequence
  Synthetic
gcgtgagcgctggacgcgcgctatatatccctccatatgagctactcctgcatgagtggtatgaaaaattctgaa

SEQ ID NO: 287095 - DNA, 75 bp, Artificial Sequence
  Synthetic
ttccaaggtccatactcgggtgaaccaaaacctaaaactagggtccctgagaggagggtggtcgcacagggtcct

SEQ ID NO: 287096 - DNA, 75 bp, Artificial Sequence
  Synthetic
acctggatctcccacagggagtggtactctgttattacggtaactttgtatgccagttttatcctccccacccct

SEQ ID NO: 287097 - DNA, 75 bp, Artificial Sequence
  Synthetic
ggctggtggtggaagttaccagatgcactcaaggatatggggatatttggtcaaaatatgtattaccatttcctg

SEQ ID NO: 287098 - DNA, 75 bp, Artificial Sequence
  Synthetic
tgccagttttatcctccccacccctatgtaacttagaagttttacataaagaccaataggtagtaatcatccaga

SEQ ID NO: 287099 - DNA, 75 bp, Artificial Sequence
  Synthetic
tgctcccaactcatgctgaccccagtagtatgatttatgtgaatgggattgctactaaagtcaaagattcatatg

SEQ ID NO: 287100 - DNA, 75 bp, Artificial Sequence
  Synthetic
ttacttaaggtcaagcacttctgtttccccggttgatgttgatatgctccaacagggcaaaaacaacagaaatcg

SEQ ID NO: 287101 - DNA, 75 bp, Artificial Sequence
  Synthetic
cacacaaaggtaatgttaatactggatacaattacacacaccctggtgaaaccggtagagatgtcggcacggaag

SEQ ID NO: 287102 - DNA, 75 bp, Artificial Sequence
  Synthetic
agatgattatcctgagtgtaatttggcacttgtagcaaaccaaccagaaccaactatcattaatgttggagatgt

SEQ ID NO: 287103 - DNA, 75 bp, Artificial Sequence
  Synthetic
tctaagaagtaataactctgcaactttaatactaccctatgtgaatgctgttcctatggattctatgcttagaca

SEQ ID NO: 287104 - DNA, 75 bp, Artificial Sequence
  Synthetic
aagatagggcaaattatgggaatacatgtgggtggtaatggtagggatggcttctcagcaatgttactcagatct

SEQ ID NO: 287105 - DNA, 75 bp, Artificial Sequence
  Synthetic
gagttttcaggagcacgtgcaagaagtcagggattaccagtgctcatgactcctggctctggccagtttatgaca

SEQ ID NO: 287106 - DNA, 75 bp, Artificial Sequence
  Synthetic
ttgacaccatgggcgcacaggtatctagacaaaatgttggaactcactccacacaaaattctgtatcaaatggat

SEQ ID NO: 287107 - DNA, 75 bp, Artificial Sequence
  Synthetic
gtgttttctttgatgtctttgaagggactaaggagcctgctgtgttgactgaaagagatccccgtctgacaactg

SEQ ID NO: 287108 - DNA, 75 bp, Artificial Sequence
  Synthetic
gtacacacctagtatgggatgtggggttacaatccactgcctccctggtagtaccatgggttagtgctagtcatt

SEQ ID NO: 287109 - DNA, 75 bp, Artificial Sequence
  Synthetic
ttgacactattattccaatcaacaatatatcttcaaacacaactagtgtgaacatgtactctctcgtgttgacga

SEQ ID NO: 287110 - DNA, 75 bp, Artificial Sequence
  Synthetic
agttaaagatgttttggaaaaaggaataccaacactacaatcacctacagtggaagcctgcgggtactctgatag

SEQ ID NO: 287111 - DNA, 75 bp, Artificial Sequence
  Synthetic
gacacttgatattgaccctacaaaaatatctttggaagagagtgtttttggcactgagggtttggaagctcttga

SEQ ID NO: 287112 - DNA, 75 bp, Artificial Sequence
  Synthetic
ttggactggtagtctacgattcagtttcatgttctgtggttcagctggcacaacactcaagctgctgattgccta

SEQ ID NO: 287113 - DNA, 75 bp, Artificial Sequence
  Synthetic
gatgctactgcaattgataaaccctctcgccttgacacatcttccaataggttttacaccttaaagagtataatt

SEQ ID NO: 287114 - DNA, 75 bp, Artificial Sequence
  Synthetic
cttgacaaatatggtgtagacctgcccatggttacatttcttaaagatgagctcagaaagaaagagaaaatagct

SEQ ID NO: 287115 - DNA, 75 bp, Artificial Sequence
  Synthetic
gtaccatgggtcagtgcaagccattacagaaacacaacacctgacaaattctcacaagccgggtatataacatgt

SEQ ID NO: 287116 - DNA, 75 bp, Artificial Sequence
  Synthetic
gtgggtatacagtgcatgtacagtgtaatgcaactaaattccatcaaggtacactgattgttgcaatgatacctg

SEQ ID NO: 287117 - DNA, 75 bp, Artificial Sequence
  Synthetic
cttaggtaggtcaggatgtatagctatgatagaattcagtacaagtagtgataaagatgaacatgataaaattgg

SEQ ID NO: 287118 - DNA, 75 bp, Artificial Sequence
  Synthetic
gcattataacaggatctgcagtgggatgtgatcctgaaacattttggtcaaagatcccagtcatgcttgatggag

SEQ ID NO: 287119 - DNA, 75 bp, Artificial Sequence
  Synthetic
gggacacaaatctgcataaacagataggggctataacccaaaatccagttgagaaatacattgatggtgtattga

SEQ ID NO: 287120 - DNA, 75 bp, Artificial Sequence
  Synthetic
gtatctcggtcaacagcccacagaagagtactggctcaattttgatggcacattattagggaacatcacgatatt

SEQ ID NO: 287121 - DNA, 75 bp, Artificial Sequence
  Synthetic
cagattaattgacagattatgtaaatcaaaacacatattcagagacacatattatgaagttgaaggaggtgtacc

SEQ ID NO: 287122 - DNA, 75 bp, Artificial Sequence
  Synthetic
acaacctgaggatatgattgaaacacgctatgtacaaaacactcaaacaagggatgaaatgagcattgaaagctt

SEQ ID NO: 287123 - DNA, 75 bp, Artificial Sequence
  Synthetic
tggagtctggtaataatcccaatctgtcctcttgaaacaatgagcactatcaccacagtacctatcacaatttcc

SEQ ID NO: 287124 - DNA, 75 bp, Artificial Sequence
  Synthetic
cttaaaataatagcatatggtgatgatgtcatcttctcatataaatacccactagatatggaagcaattgcatct

SEQ ID NO: 287125 - DNA, 75 bp, Artificial Sequence
  Synthetic
aaagaaatggcacaaataagaaggaaatttgaactatttacttatgttagatttgattcagaaataactttagta

SEQ ID NO: 287126 - DNA, 75 bp, Artificial Sequence
  Synthetic
actaccaatctccgtgcgcgttgccgtggtaccatccaactaaagaaatctttattcctggtgaagtcaagaatt

SEQ ID NO: 287127 - DNA, 75 bp, Artificial Sequence
  Synthetic
gacaagatgcaaaatatcctttcctaatacatcctacatttcctgtttctgaaatacatgaatcaatcaggtgga

SEQ ID NO: 287128 - DNA, 75 bp, Artificial Sequence
  Synthetic
tttggcaatcaggaactaatgcatctatattctggcaacatggtcaaccctaccctcgattctcacttccatttc

SEQ ID NO: 287129 - DNA, 75 bp, Artificial Sequence
  Synthetic
tgatcaggataagatattttcccttagaacggatattgcttcacagcctctagccactactctaattggtgaaat

SEQ ID NO: 287130 - DNA, 75 bp, Artificial Sequence
  Synthetic
cagtgttagcgctggacgtgcactgtatatccctccttacgagcttcttttgcatgagtggtatgaaaaatttta

SEQ ID NO: 287131 - DNA, 75 bp, Artificial Sequence
  Synthetic
ctccaggattgtgactgaggagcacaagacacaggttaacatcactactagagtgtaccacaaagcaaaacatgt

SEQ ID NO: 287132 - DNA, 75 bp, Artificial Sequence
  Synthetic
gatagatatttccccatcaaagttaccccacatgattggtatgaaattcaagagtcagagtattacccaaaacac

SEQ ID NO: 287133 - DNA, 75 bp, Artificial Sequence
  Synthetic
cctggtattgctgagcctacaacaaggaaggatgcaatgttgggtactcatgttatatgggatataggtttgcaa

SEQ ID NO: 287134 - DNA, 75 bp, Artificial Sequence
  Synthetic
gttaggaatagccccagagacattgtcacagtaggacctagtgacatgtatgtgcatgttggaaacctaatctat

SEQ ID NO: 287135 - DNA, 75 bp, Artificial Sequence
  Synthetic
ctggattagtaataccacctgaaaccccccccacggccagattactgtgcttcgtatccgggtgtaaagacttct

SEQ ID NO: 287136 - DNA, 75 bp, Artificial Sequence
  Synthetic
gtggcgatggtcatgttgctttcattgaccttaggaaatttcaatgtgctgaagaacaagggttatctgattatg

SEQ ID NO: 287137 - DNA, 75 bp, Artificial Sequence
  Synthetic
atatcccaacttgtgattgcacagacgcaacttattactgcaaacataaaaatagatactatccaatcaaagtaa

SEQ ID NO: 287138 - DNA, 75 bp, Artificial Sequence
  Synthetic
agttgttccaaacattaacagtagtcaccctactacatcaaactctgctccggcattagatgctgcagaaacagg

SEQ ID NO: 287139 - DNA, 75 bp, Artificial Sequence
  Synthetic
cggtggcaagttattatgcaagcatggtgttataggtattataacagctggtggtgaaggccatgtggcgtttat

SEQ ID NO: 287140 - DNA, 75 bp, Artificial Sequence
  Synthetic
tcaggatgtatacacgagtctaaattagaacttgagcttgcacactatgataaaaagaactttaccacatggaat

SEQ ID NO: 287141 - DNA, 75 bp, Artificial Sequence
  Synthetic
ggatgacatcatgcaaaatccagatggtgaggacatgtctttattctgccagatggtatcaagtgtgacatttat

SEQ ID NO: 287142 - DNA, 75 bp, Artificial Sequence
  Synthetic
gaacaagtaaatgctattaacccaatcaataatatcagcaaaaaactagtcaaatggctacttaggatagtttct

SEQ ID NO: 287143 - DNA, 75 bp, Artificial Sequence
  Synthetic
tcagccaagatatcggacacattacaatgcagtatatgtatgttccacctggcgctccaattcccgagagcagaa

SEQ ID NO: 287144 - DNA, 75 bp, Artificial Sequence
  Synthetic
aaaagttttgtaaatggacacaattgaactatgttcacaaagaatcagattcatggctaaagaaatttacagaaa

SEQ ID NO: 287145 - DNA, 75 bp, Artificial Sequence
  Synthetic
ttattacatgttctatgatggatacaatgagggaggcacaaattatggtacagtgagcacaaacaacatgggcac

SEQ ID NO: 287146 - DNA, 75 bp, Artificial Sequence
  Synthetic
ctcttgtattccggtacgcttgcacgccagttttgtcacccccccctacattgtaacttagaagattaacacaaa

SEQ ID NO: 287147 - DNA, 75 bp, Artificial Sequence
  Synthetic
atatctgagtgagttgaagaaattaaatttattggaaaaacagattgagaacctacgtggtgcagacacaaggac

SEQ ID NO: 287148 - DNA, 75 bp, Artificial Sequence
  Synthetic
ccacctagggcgcttgagtatacccgtgctcatcgcaccaattttaaaattgatggcagggaagttaaatcaagg

SEQ ID NO: 287149 - DNA, 75 bp, Artificial Sequence
  Synthetic
gttatccgcaaggtgcctacgggaaacccagtagcattctttatttgatctggttggttgctcagccgttaaacc

SEQ ID NO: 287150 - DNA, 75 bp, Artificial Sequence
  Synthetic
aataaatgcaataatattattaaacaaaagaaaagaagtgaaccagttgctgtcatgatacacggcccgcctgga

SEQ ID NO: 287151 - DNA, 75 bp, Artificial Sequence
  Synthetic
tgcatgattccatcttagtatcttactcatcagatttaatcatttaccgaacaaacactgtaggtgatgattata

SEQ ID NO: 287152 - DNA, 75 bp, Artificial Sequence
  Synthetic
caaagacagggtgcgaagagtctactgtgctcaccttgattcctccggcccctgaatgtggctaatcctaacccc

SEQ ID NO: 287153 - DNA, 75 bp, Artificial Sequence
  Synthetic
atcaacagagtgtggtcataatggatgacatcatgcaaaatccagatggagaggatatgtccttattctgtcaga

SEQ ID NO: 287154 - DNA, 75 bp, Artificial Sequence
  Synthetic
aagtgagtattaccctaagcatatacagtacaatctgctaattggtgaaggaccttgtgagccaggtgactgtgg

SEQ ID NO: 287155 - DNA, 75 bp, Artificial Sequence
  Synthetic
atatgcttatggtgacaattatacggatatagttgtcatcatgggcgctcaagtctcaaggcagaatgttggtac

SEQ ID NO: 287156 - DNA, 75 bp, Artificial Sequence
  Synthetic
tctcacccctccaactatcacctcactatctgcaatgaacagaagatttttcctagatttggatatagtagtgca

SEQ ID NO: 287157 - DNA, 75 bp, Artificial Sequence
  Synthetic
gagcagggaattacagattatatacacatgttgggtgaagcatttggaaatggatttgtagatagtgtcaaagag

SEQ ID NO: 287158 - DNA, 75 bp, Artificial Sequence
  Synthetic
ttttctcaagacccaagtaaatttacagacccagtcaaagatgttttaaccaagggtatcccaaccctacagtca

SEQ ID NO: 287159 - DNA, 75 bp, Artificial Sequence
  Synthetic
aatgtagtgtctatagtaggtgttatctatataatttataaattgttttgtacactccaaggtccatactcagga

SEQ ID NO: 287160 - DNA, 75 bp, Artificial Sequence
  Synthetic
catgtgcaagccataaatccaatcggtaatattagcaaaaaaattattaaatggatgttgagagtaatatcagca

SEQ ID NO: 287161 - DNA, 75 bp, Artificial Sequence
  Synthetic
atatgtggtaaggctgtttcatttagagatagaaatacctgtcaagaatattcacttagtcagatttataacatg

SEQ ID NO: 287162 - DNA, 75 bp, Artificial Sequence
  Synthetic
atggagtttggcctacttatttagattcaaaggatgcctcagctatagataagcccacacaaccagatacttctg

SEQ ID NO: 287163 - DNA, 75 bp, Artificial Sequence
  Synthetic
aattttgcaaggggacacaacttagttatatacataaggagtcagattcatggttgaaaaaattcactgaggcat

SEQ ID NO: 287164 - DNA, 75 bp, Artificial Sequence
  Synthetic
cagatttgttacaatcagttagaacaccagaggttattaaatattgtgaggagaataaatgggtaattccagcag

SEQ ID NO: 287165 - DNA, 75 bp, Artificial Sequence
  Synthetic
tgaaaacatgttctaccatgcacttggtaggtctggttacctaattcatgttcagtgcaatgcaagtaaatttca

SEQ ID NO: 287166 - DNA, 75 bp, Artificial Sequence
  Synthetic
tttaaatgaacttaaaaaactaagcctgtatgagaaacaagttgagagtttgagagtggcagatattaagacaca

SEQ ID NO: 287167 - DNA, 75 bp, Artificial Sequence
  Synthetic
gttttgcacacttcaaggcccatattctggtgaacccaaacccaaaacaaaaaccccagaaagaagagttgttgc

SEQ ID NO: 287168 - DNA, 75 bp, Artificial Sequence
  Synthetic
actggaagagtcatagcaacaaccacagacaaacagacaagacagccatcgtttgacagttggctcaattgtaat

SEQ ID NO: 287169 - DNA, 75 bp, Artificial Sequence
  Synthetic
aaatgcaacaatattattaaacaaaagaagagatgtgaaccagtagctatagtcattcatggaccacctggtgct

SEQ ID NO: 287170 - DNA, 75 bp, Artificial Sequence
  Synthetic
agagtcatgatattgcctactcatgctgaccctggaaagacaattcaaatcaatggaattaatactaatgttact

SEQ ID NO: 287171 - DNA, 75 bp, Artificial Sequence
  Synthetic
ccatggattccatgttaagacataataattggtcattactaatagtgcctgtatcagaactaagaggtgacacca

SEQ ID NO: 287172 - DNA, 75 bp, Artificial Sequence
  Synthetic
agcaaagtgtagtcattatggatgacattatgcaaaatccagctggagatgatatgactttgttttgtcaaatgg

SEQ ID NO: 287173 - DNA, 75 bp, Artificial Sequence
  Synthetic
cagaaagagaagatgattacccagattgtaatttagctctagttgcaaatcaaccagaaccaactatcatcaatg

SEQ ID NO: 287174 - DNA, 75 bp, Artificial Sequence
  Synthetic
aggatcaggacaattcttgacaactgatgacatgcaatcaccatcagttttaccttacttccactcaacacaaga

SEQ ID NO: 287175 - DNA, 75 bp, Artificial Sequence
  Synthetic
ggcaccacctacaatcacctcacttcctgctatgaatagaagattctttttagatttagatataatagtgcatga

SEQ ID NO: 287176 - DNA, 75 bp, Artificial Sequence
  Synthetic
ggtcttatacaaaataggcaacattctaggtatacatgtaggtggtaatggaaaagatggattctcagcaacttt

SEQ ID NO: 287177 - DNA, 75 bp, Artificial Sequence
  Synthetic
atgtatgctctaccacttacacgacagaatacaccagctgctgaactctttgcaatgccagtcgacattacatct

SEQ ID NO: 287178 - DNA, 75 bp, Artificial Sequence
  Synthetic
cccttatgtttcattagggattaaaaagaaagatctcatagataagagaacaaaagacatcacaaaactcaagaa

SEQ ID NO: 287179 - DNA, 75 bp, Artificial Sequence
  Synthetic
tgcggcaaagcagtttctttcaaagaccgcaatacctgcaacaaatatactctagcacaaatctacaatataatg

SEQ ID NO: 287180 - DNA, 75 bp, Artificial Sequence
  Synthetic
ttacaaccaagtgtcttctatgatgtgtttgaagggaccaaagaaccagcagtgttaacagacaaggatccacgt

SEQ ID NO: 287181 - DNA, 75 bp, Artificial Sequence
  Synthetic
atgagcttagaaagaaagaaaaaataagggacgggaaaactagagttatagaagccaatagtgtgaatgatactg

SEQ ID NO: 287182 - DNA, 75 bp, Artificial Sequence
  Synthetic
cctcactcaagcttcttctagcatatactccacctggagtgagtaaaccaaccagtaggagagaagctatgctgg

SEQ ID NO: 287183 - DNA, 75 bp, Artificial Sequence
  Synthetic
acttacttcaagccgtcagaactcctgaagtcattaagtactgtgaagagaataagtgggttattccagcagagt

SEQ ID NO: 287184 - DNA, 75 bp, Artificial Sequence
  Synthetic
cccaattaatgacacttgatattgacccaaggaacatgaccctcgaagatagtgtatttggagccgatggtcttg

SEQ ID NO: 287185 - DNA, 75 bp, Artificial Sequence
  Synthetic
gtcaaccatacctcttatgttagatggagaatgtctaatggcttttgattactcaaattatgatggtagtttaca

SEQ ID NO: 287186 - DNA, 75 bp, Artificial Sequence
  Synthetic
ctcaaaagctggttatgtgacatgctggtatcagacaaatttcatcacagcaccaaacacaccacctacagctga

SEQ ID NO: 287187 - DNA, 75 bp, Artificial Sequence
  Synthetic
ctgcacattacaaggaccttattcaggagaacccaaacccaaaactaagattccagaacggcgtgtggtggctca

SEQ ID NO: 287188 - DNA, 75 bp, Artificial Sequence
  Synthetic
caaaatagcactagataaatatggagtagatctacctatggttactttccttaaagatgagctcagaaagaaagg

SEQ ID NO: 287189 - DNA, 75 bp, Artificial Sequence
  Synthetic
gaacaatttgcagaagcagtccttgatcaagtattagtagttccaaacactcgacccagcgatgggttgattgca

SEQ ID NO: 287190 - DNA, 75 bp, Artificial Sequence
  Synthetic
atcatgattgtaccaacacacgctgatccgggaaaggaaatccagattgatggcataactacaaaagtaactgat

SEQ ID NO: 287191 - DNA, 75 bp, Artificial Sequence
  Synthetic
agaaatcctggaattgtcaccggctccgcagtagggtgcgatcctgagactttttggtcaaaaattcctgtgatg

SEQ ID NO: 287192 - DNA, 75 bp, Artificial Sequence
  Synthetic
gacatgaaacctccattgaatcttttttgggtagggctggatgtgtggccactattagtttagacattaaccatg

SEQ ID NO: 287193 - DNA, 75 bp, Artificial Sequence
  Synthetic
gtaatgaagatgattacccagattgtaatttagccttattagcaaaccaacctgaacctaccataattaatgttg

SEQ ID NO: 287194 - DNA, 75 bp, Artificial Sequence
  Synthetic
aatttgaaccaaagttaattgatagactatgtaattcaaagcatatttacagagattcatactatgaagttgaag

SEQ ID NO: 287195 - DNA, 75 bp, Artificial Sequence
  Synthetic
cgaaataacaatagtaccatgtgttgctgccacagaaggtaacttgggacacattgttgtgcaatacatgtttgt

SEQ ID NO: 287196 - DNA, 75 bp, Artificial Sequence
  Synthetic
gctatacaaaattggacaggtgctggggatacatgtaggtggaaatggtagagatgggttctcagctatgttact

SEQ ID NO: 287197 - DNA, 75 bp, Artificial Sequence
  Synthetic
cctggataaactcaaaattatagcttatggagatgatgtaatattttcttacaagtatgttttggatatggaggc

SEQ ID NO: 287198 - DNA, 75 bp, Artificial Sequence
  Synthetic
ttttctatacctttctcaagtatagcttcagcttactacatgttttatgatggatacgacactgatggcacagat

SEQ ID NO: 287199 - DNA, 75 bp, Artificial Sequence
  Synthetic
caacccagtgtgttctatgatgtattccctggttcaaaagaacctgccgtattatctgaaaaagacactagattg

SEQ ID NO: 287200 - DNA, 75 bp, Artificial Sequence
  Synthetic
actctattattccggtaattttgtacgccagttttatcaccccttcccccgtaacttagaagtttgaaacaaaag

SEQ ID NO: 287201 - DNA, 75 bp, Artificial Sequence
  Synthetic
agaggtttcaaacaggatacaaaatattctttcttggttcacccaacatttccagtcaaagaaattcatgagtca

SEQ ID NO: 287202 - DNA, 75 bp, Artificial Sequence
  Synthetic
atctaaaagctaaacacatcaaggcatggtgtcccagacctccaagagcagtcacatataaccatacatataatc

SEQ ID NO: 287203 - DNA, 75 bp, Artificial Sequence
  Synthetic
aattaatcactcttgatatcaatccaagccctattacgcttgaagacagtgtctttggtacagatggtctggaag

SEQ ID NO: 287204 - DNA, 75 bp, Artificial Sequence
  Synthetic
tatccgcaaagtgcctacgcaaagcctagtagtatcttgaaaagcatgtggttggttgctccgctgtaccccaca

SEQ ID NO: 287205 - DNA, 75 bp, Artificial Sequence
  Synthetic
ggaagatacgcagcgtcagcgctggacgcgcgctgtatattcctccttatgaaatgctgctgcatgagtggtatg

SEQ ID NO: 287206 - DNA, 75 bp, Artificial Sequence
  Synthetic
tttatacagaaattaccatctcactccagaaaaggaactgaaagaagcatgccaaattgtatatactgcagatct

SEQ ID NO: 287207 - DNA, 75 bp, Artificial Sequence
  Synthetic
acgcgcgctgtatattcctccttatgaaatgctgctgcatgagtggtatgaaaaattctgatttatgtatatata

SEQ ID NO: 287208 - DNA, 75 bp, Artificial Sequence
  Synthetic
agaagcaattgataaatatggagttgatttaccaatggttactttcttaaaggatgagcttagaaaaccagagaa

SEQ ID NO: 287209 - DNA, 75 bp, Artificial Sequence
  Synthetic
acactattattacggtaattttgtacgccagttttataacccttccccttttgtaacttagaagtttgaacttga

SEQ ID NO: 287210 - DNA, 75 bp, Artificial Sequence
  Synthetic
atcaaagtagaataccatagctactacaccatccagaaatcagattattatccaaaacatatacagtatgatata

SEQ ID NO: 287211 - DNA, 75 bp, Artificial Sequence
  Synthetic
gtgcatgcaatccagcatgtggctagtcgtaatgagcaattgcgggatgggaccaactactttgggtgtccgtgt

SEQ ID NO: 287212 - DNA, 75 bp, Artificial Sequence
  Synthetic
gaccaataggtggtgatcaaccagatcgccaaaggtcaagcacttctgtttccccggtcaacattgatatgctcc

SEQ ID NO: 287213 - DNA, 75 bp, Artificial Sequence
  Synthetic
aatccaggaattgtcactggatcagcagtgggttgtgatcctgaaactttttggtcaaaaataccagcaatgctg

SEQ ID NO: 287214 - DNA, 75 bp, Artificial Sequence
  Synthetic
tcaacacaaaacacagtatcaaatggatctagtttaaattattttaatataaattatttcaaagatgcagcatct

SEQ ID NO: 287215 - DNA, 75 bp, Artificial Sequence
  Synthetic
tagcatttactgatttgaggaagtatagaatggtagaggctgaggagcaaggtataacagattatgttaaatcct

SEQ ID NO: 287216 - DNA, 75 bp, Artificial Sequence
  Synthetic
tcaatccaatgttaatagacaggttatgtaaatctaagcatatatttaaaaatacatactatgaagttgagggag

SEQ ID NO: 287217 - DNA, 75 bp, Artificial Sequence
  Synthetic
acaaggtgtgaagagccccgtgtgctcactttgagtcctccggcccctgaatgtggctaaccttaaccctgcagc

SEQ ID NO: 287218 - DNA, 75 bp, Artificial Sequence
  Synthetic
aatcagagtaatatcagcactagtgatagcagtgcgtagccaaggggatccagcaacactatcagctactctact

SEQ ID NO: 287219 - DNA, 75 bp, Artificial Sequence
  Synthetic
cagtggaagcctgtggttattcagataggatcatacagataactagaggtgattcaacaataacatcacaagatg

SEQ ID NO: 287220 - DNA, 75 bp, Artificial Sequence
  Synthetic
atgtggctaaccttaaccctgcagctagtgcatacaaaccagtatgtggctagtcgtaatgagcaattgcgggac

SEQ ID NO: 287221 - DNA, 75 bp, Artificial Sequence
  Synthetic
agataagcttaaaataattgcttacggtgatgatgtgatattttcatacatttatgaattggatatggaagccat

SEQ ID NO: 287222 - DNA, 75 bp, Artificial Sequence
  Synthetic
caggttttacactttggaaagtaaaatatggacaggtacctcacagggttggtggtggaagttgccagatgcgct

SEQ ID NO: 287223 - DNA, 75 bp, Artificial Sequence
  Synthetic
atattgttaccatgggtgcacaagtctccagacagaatgttggtacgcattccacacagaatatggtttcaaatg

SEQ ID NO: 287224 - DNA, 75 bp, Artificial Sequence
  Synthetic
aagaaatttactgaaatgtgcaatgcagccagaggcttagaatggatagggtgtaagatttcaaaattcattgac

SEQ ID NO: 287225 - DNA, 75 bp, Artificial Sequence
  Synthetic
ggatttaaacaagatgaaaagtacaactttttaattcatcccacttttcctgagaatgagatatttgaatcaatt

SEQ ID NO: 287226 - DNA, 75 bp, Artificial Sequence
  Synthetic
ggaactttgttagtagttatgataccagagcatcaattggcaagcgcacacaccggcaatgttacagctggttac

SEQ ID NO: 287227 - DNA, 75 bp, Artificial Sequence
  Synthetic
cccagtcaaggatgttcttgaaaagggaatcccaactttacaatctcctacagtagaagcatgtggttactcaga

SEQ ID NO: 287228 - DNA, 75 bp, Artificial Sequence
  Synthetic
atgcaacagttaagcaacaagaagattatctcaaagaaatggaagagatgttggacatttcaaataaactattac

SEQ ID NO: 287229 - DNA, 75 bp, Artificial Sequence
  Synthetic
aaatacgcagtgttagcgctggacgcatgctgtatattcctccatatgatttgctcttgcatgagtggtatgaga

SEQ ID NO: 287230 - DNA, 75 bp, Artificial Sequence
  Synthetic
ccttattaggcaatgctttaatatttcctcaccagttcatcaatttgaggagtaataattctgcaactattatag

SEQ ID NO: 287231 - DNA, 75 bp, Artificial Sequence
  Synthetic
aaagatgctactgccattgataaacccacgcagccagacacctcatcaaatagattttatacactagagagtaaa

SEQ ID NO: 287232 - DNA, 75 bp, Artificial Sequence
  Synthetic
tcatggagatccagggtcagggaaatcagtgtgcacaaacatccttgcccgcatgataactaatccatcagacat

SEQ ID NO: 287233 - DNA, 75 bp, Artificial Sequence
  Synthetic
actctattattccggtaatcttgtacgccagttttataccccctaaccccttgtaacttagaagttaagcacata

SEQ ID NO: 287234 - DNA, 75 bp, Artificial Sequence
  Synthetic
gaccaataggcggtggccacccaggtcgctaacggtcaagcacttctgttttcccggttaagattgatacgctcc

SEQ ID NO: 287235 - DNA, 75 bp, Artificial Sequence
  Synthetic
cagcgccttggttccaataactatatccattagtccaatgtttgctgaattttctggagcaagagctaagaccat

SEQ ID NO: 287236 - DNA, 75 bp, Artificial Sequence
  Synthetic
gaagtggttatactgtgcacgttcagtgcaacgctagtaaattccaccaagggactttattaattatgatgatac

SEQ ID NO: 287237 - DNA, 75 bp, Artificial Sequence
  Synthetic
agcaccttctgccaaatggtttcctcagttaattatgtagtgccaatggctgatctaccagataagggtaccctg

SEQ ID NO: 287238 - DNA, 75 bp, Artificial Sequence
  Synthetic
aacttcacacatcctggtgagttaggtagggaagttggtaacagacgcaacccccatgacaaccttccaagtgat

SEQ ID NO: 287239 - DNA, 75 bp, Artificial Sequence
  Synthetic
cctactaaggaaattctgatcccaggtgaggttaaaaatttaatagaaatgtgccaagttgatacattaattccc

SEQ ID NO: 287240 - DNA, 75 bp, Artificial Sequence
  Synthetic
taactgttaaggtgaaccccagatatcaggaagcaggaaaactaaatctggactgtgcattaaaaccatgcaatc

SEQ ID NO: 287241 - DNA, 75 bp, Artificial Sequence
  Synthetic
tcccttatgtgaatgctgttccaatggattcaatgcttagacataataattggagtttagtgataattccaattt

SEQ ID NO: 287242 - DNA, 75 bp, Artificial Sequence
  Synthetic
atattgcctcacaacctctttcaagtactatgattggagaaatagctagctactttacacattggactggaagct

SEQ ID NO: 287243 - DNA, 75 bp, Artificial Sequence
  Synthetic
aatatacaatcaagtagtaaatgaacacaaccgcagattaaacgtgtcaaaacacatggaagcaattttccaggg

SEQ ID NO: 287244 - DNA, 75 bp, Artificial Sequence
  Synthetic
agctgcctcacaaggcctcccaatttatatgacacctggctcaggccagttcatgacaactgatgactttcaatc

SEQ ID NO: 287245 - DNA, 75 bp, Artificial Sequence
  Synthetic
gggtcaagtttgaattattttaacataaattattttaaggatgctgcatccagtggagcctcaaaacttgaattt

SEQ ID NO: 287246 - DNA, 75 bp, Artificial Sequence
  Synthetic
attattcctgctgacatcagtattgagagagaattgaatctggtaaatctttcaatatcaattctggcaaatcta

SEQ ID NO: 287247 - DNA, 75 bp, Artificial Sequence
  Synthetic
agccatgcttggtactcacatagtttgggatgtggggttacaatcaaccgtgtcacttgttgttccgtgggttag

SEQ ID NO: 287248 - DNA, 75 bp, Artificial Sequence
  Synthetic
attaacaatacaatgcagaatttaaggaaggtaaatatgtacaccatacaattgtccagtcaaacagaaatggcc

SEQ ID NO: 287249 - DNA, 75 bp, Artificial Sequence
  Synthetic
atagaataatgcagattacaagaggtgattctacaataacatcacaagatgtagccaatgcagttataggttatg

SEQ ID NO: 287250 - DNA, 75 bp, Artificial Sequence
  Synthetic
aaagagtggtagtacaaggtccttctactgaatttggcctaagtttaataaaacataacacatgtattgtagaaa

SEQ ID NO: 287251 - DNA, 75 bp, Artificial Sequence
  Synthetic
aatacagcagacatgttatgttttgtgtcagcgtgtaaagacttctgtctgcgcatggccagagacacagacatg

SEQ ID NO: 287252 - DNA, 75 bp, Artificial Sequence
  Synthetic
tgcgtttcagctttatgttttgtggcacagcaaacaccaccctcaaattacttttggcatacacaccaccaggca

SEQ ID NO: 287253 - DNA, 75 bp, Artificial Sequence
  Synthetic
aacatggcatgctgattctaagggatggtggtggaagttaccagatgcacttaaagatatgggtatatttggaga

SEQ ID NO: 287254 - DNA, 75 bp, Artificial Sequence
  Synthetic
aacagaagtgttggactcttacgatttgtacaacaaagaaggagtaaaattagaaatcacagttctgatcttatc

SEQ ID NO: 287255 - DNA, 75 bp, Artificial Sequence
  Synthetic
caagcacctcaaactctgctccaatccttgatgctgctgaaactggccacactagtaatgtgcaacctgaagata

SEQ ID NO: 287256 - DNA, 75 bp, Artificial Sequence
  Synthetic
tgccagccattttagatacacatctagggatgaacattcagcagctgggtatataacgtgttggtatcaaacaaa

SEQ ID NO: 287257 - DNA, 75 bp, Artificial Sequence
  Synthetic
ccagaacaccaattggcaaatgcagattctactaaggtgggagctgggtataattatacacatcctggtgaacga

SEQ ID NO: 287258 - DNA, 75 bp, Artificial Sequence
  Synthetic
cagatactggaggtcggagatgttgtctcttatggcaatatactcttgagtggtaataacaccgccagaatgctc

SEQ ID NO: 287259 - DNA, 75 bp, Artificial Sequence
  Synthetic
tgtaagtaaaatgaaaaattataatgagcacacttttgacaaatggcaaataaccctacaggaaatggcccaaat

SEQ ID NO: 287260 - DNA, 75 bp, Artificial Sequence
  Synthetic
catattcaagatgatgctatcacacaaaatccagttgaaaactatgtggaagaggttcttaatgaagtcttagta

SEQ ID NO: 287261 - DNA, 75 bp, Artificial Sequence
  Synthetic
tatttccacaccaatttattaatcttaggagcaacaactctgcaacaataatagttccttatgtaaatgctgttc

SEQ ID NO: 287262 - DNA, 75 bp, Artificial Sequence
  Synthetic
tctcagccatgttacttaaaagatatttcaaccaacaacaaggtcagataattctaaagaaaccagtcaaggaag

SEQ ID NO: 287263 - DNA, 75 bp, Artificial Sequence
  Synthetic
atgcagtacatgtatgtgccacctggagctccagttccaacaaaaagggatgattttgcatggcaatcaggcaca

SEQ ID NO: 287264 - DNA, 75 bp, Artificial Sequence
  Synthetic
caattgaaactcgctacgtgcaaacatcacaaacaagagatgaaatgagcattgaaagtttccttggtaggtcag

SEQ ID NO: 287265 - DNA, 75 bp, Artificial Sequence
  Synthetic
atcaataagtccaatgtttgctgagttctctggagcgcgagcaaggcctacaagagctgcttcacaaggcttacc

SEQ ID NO: 287266 - DNA, 75 bp, Artificial Sequence
  Synthetic
aaaagacccccggttggaagtagacttgaactcctctcttttttcaaaatatgctggaaatgttaatttagaaat

SEQ ID NO: 287267 - DNA, 75 bp, Artificial Sequence
  Synthetic
atggtgatacacatgattcacactatggtactactgtaattaaccacatgggtacactttgtatgaggatagtta

SEQ ID NO: 287268 - DNA, 75 bp, Artificial Sequence
  Synthetic
atttgaaatgttcacatatgtaagatttgattcagaagtgaccatagttccatgcattgcaggacatggtagtga

SEQ ID NO: 287269 - DNA, 75 bp, Artificial Sequence
  Synthetic
ccaggagaagtcaaaaatctaatagagatgtgccaagttgacacacttatccccattaacaacacaaataacaat

SEQ ID NO: 287270 - DNA, 75 bp, Artificial Sequence
  Synthetic
acagataacttagaagccttggatttaaatactagtgcaggatttccctatgtggctttgggaattaagaagaag

SEQ ID NO: 287271 - DNA, 75 bp, Artificial Sequence
  Synthetic
cacacatagtcactctacaaattacaaaccacatgagggtgatgtaaagattttcattagacccagagatgatcc

SEQ ID NO: 287272 - DNA, 75 bp, Artificial Sequence
  Synthetic
attttctggcaacatggacaaccctttccaagatttacattaccctttttgagtgtcgcatccgcttattacatg

SEQ ID NO: 287273 - DNA, 75 bp, Artificial Sequence
  Synthetic
taaacactatgcttggccaaattgccagctatttcacacactggactggtagcttgcgctttagttttatgtttt

SEQ ID NO: 287274 - DNA, 75 bp, Artificial Sequence
  Synthetic
tcagaacaccagaaaaaataaagttaggaaaaactagggtaatagaagcaagtagtttaaatgatactattcata

SEQ ID NO: 287275 - DNA, 75 bp, Artificial Sequence
  Synthetic
ttggtgtcatattcttcagatttagtcatttaccgaacaaacactacaggtaatgactacatccccacctgtgat

SEQ ID NO: 287276 - DNA, 75 bp, Artificial Sequence
  Synthetic
aagctcataaagttgaaatcacaaccaatatttaccataaggccaaacatgtaaaggcatggtgtcctaggccac

SEQ ID NO: 287277 - DNA, 75 bp, Artificial Sequence
  Synthetic
agtctgggatgtcgggttacaatcaacagtatctttagtagttccatgggttagttctagtcactttagatacac

SEQ ID NO: 287278 - DNA, 75 bp, Artificial Sequence
  Synthetic
aattcctccaatgctgggtgatgggtgtgtgatggcatttgattatacaaattatgatggaagtttacatccaat

SEQ ID NO: 287279 - DNA, 75 bp, Artificial Sequence
  Synthetic
ctaaacatatccaatacaatcttttaataggtgagggaccatgtgaaccaggtgactgtggaggaaaactattat

SEQ ID NO: 287280 - DNA, 75 bp, Artificial Sequence
  Synthetic
cacagcaggaccaagtgatctgtttgtacatgtaggtaatctaatatatagaaatttacacttgttcaactcaga

SEQ ID NO: 287281 - DNA, 75 bp, Artificial Sequence
  Synthetic
tttgtgtcagcttgtaaagacttttgtttgcgcatggctagggacacagacatgcatgttcagagtgaagctatt

SEQ ID NO: 287282 - DNA, 75 bp, Artificial Sequence
  Synthetic
tatgaagttgatggaggaatgccatctgggtgtgcaggtacttcaatcttcaactcaatgatcaataacatcata

SEQ ID NO: 287283 - DNA, 75 bp, Artificial Sequence
  Synthetic
tgactatgtccacatgctgggtgaagcttttggcatgggttttgttgacagtgttaaggatcaaataaatgctat

SEQ ID NO: 287284 - DNA, 75 bp, Artificial Sequence
  Synthetic
gctacttactattgtaaacataaagataggtattatccaattgttgtcaccagtcatgattggtatgaaattcaa

SEQ ID NO: 287285 - DNA, 75 bp, Artificial Sequence
  Synthetic
caattctagatgctgctgaaactggacatactagcaatgtgcaaccagaggataccattgaaactcgttatgttc

SEQ ID NO: 287286 - DNA, 75 bp, Artificial Sequence
  Synthetic
tagacatggcttatttagcccaaattggagaaaaatatggtttaaaaatgacacctgcagacaagtcagatacat

SEQ ID NO: 287287 - DNA, 75 bp, Artificial Sequence
  Synthetic
attatagcaacattaactttaattggatgctcaggttccccatggaggttcctcaaggaaaaattttgcaaatgg

SEQ ID NO: 287288 - DNA, 75 bp, Artificial Sequence
  Synthetic
gagtgattggaataataacagcaggtggggaagggcatgtggcattcatcgatctcagacaattccactgtgcag

SEQ ID NO: 287289 - DNA, 75 bp, Artificial Sequence
  Synthetic
aagatttaaaacatggaatatcaatttacaagaaatggctcaaattaggagaaagtttgagatgtttacatatgt

SEQ ID NO: 287290 - DNA, 75 bp, Artificial Sequence
  Synthetic
tatctatgaatcaatcagatggacaaagaatcccagatgtttacaggagcatgtgctcagtttggctcacttatg

SEQ ID NO: 287291 - DNA, 75 bp, Artificial Sequence
  Synthetic
tatcaaagttcattgaatggatgaaatcaatgcttcctcaagcccagcttaaggttaaatacttaagtgaactta

SEQ ID NO: 287292 - DNA, 75 bp, Artificial Sequence
  Synthetic
taataacatcagtaagaagataatcaagtggttactcaggataatttctgcaatggttataatcattagaaattc

SEQ ID NO: 287293 - DNA, 75 bp, Artificial Sequence
  Synthetic
ccattgccaacagacagaaaacactttgcatggcaatcaagtactaatgcatcaatattttggcaacatggacaa

SEQ ID NO: 287294 - DNA, 75 bp, Artificial Sequence
  Synthetic
gtcttgtaaatttcttccactttatgctagtgaggctaaaagaattaaaattttacataataaatgcaatgccat

SEQ ID NO: 287295 - DNA, 75 bp, Artificial Sequence
  Synthetic
caacatctgttgggaagaacctatacataccatcttatgatgtactactttatgagtggtatgagaaattttaag

SEQ ID NO: 287296 - DNA, 75 bp, Artificial Sequence
  Synthetic
actctgttattacggtaactttgtacgccagttttatctcccttcccccatgtaacttagaagtttttcacaaag

SEQ ID NO: 287297 - DNA, 75 bp, Artificial Sequence
  Synthetic
aattacatacataaggaatctgattcatggcttaagaagtttactgaaatgtgtaatgcagctagaggtttggaa

SEQ ID NO: 287298 - DNA, 75 bp, Artificial Sequence
  Synthetic
ccactgtggttaaccgtatgggagcactgtgcatgagaattgtcacaaataaacaagtccatgatgttgaggtta

SEQ ID NO: 287299 - DNA, 75 bp, Artificial Sequence
  Synthetic
acaagtgacagtgatatttattctttacctcctgatcctaaatattttgatggatatgatcaacaaagtgtggtt

SEQ ID NO: 287300 - DNA, 75 bp, Artificial Sequence
  Synthetic
gctttctagaaaaacaaatagaatatctgagggttgctgattcccaaacacaggaaaagattaaatgtgagattg

SEQ ID NO: 287301 - DNA, 75 bp, Artificial Sequence
  Synthetic
gtagacctggcagatgaggctagaaataccccactggcgacagtgttctagcctgcgtggctgcctgcacaccct

SEQ ID NO: 287302 - DNA, 75 bp, Artificial Sequence
  Synthetic
cagtgataatgttgacatctttatacaaccaagaaacagtttaaaaacagctggaccaagtgacatgtatgtcca

SEQ ID NO: 287303 - DNA, 75 bp, Artificial Sequence
  Synthetic
ctgataagggaaaaccctttgactcaagatttgtgttgtgtagcactaatcacaatttgttagcaccccccacaa

SEQ ID NO: 287304 - DNA, 75 bp, Artificial Sequence
  Synthetic
aaggtgtgaagagccccgtgtgctcgctttgagtcctccggcccctgaatgtggctaaccttaaccctgcagcta

SEQ ID NO: 287305 - DNA, 75 bp, Artificial Sequence
  Synthetic
aaggaaaaggtgtgaaccagttgcagttgctatacatggtgagcccggtactggtaagtccatgaccacaaactt

SEQ ID NO: 287306 - DNA, 75 bp, Artificial Sequence
  Synthetic
aacacaacaggtaatgactatattcctacttgtgattgcactgatgctacgtattactgtaaacataaggataga

SEQ ID NO: 287307 - DNA, 75 bp, Artificial Sequence
  Synthetic
tgcttttaaaccatgtgatgtagatgcaaaaattggaaatgcacggtgttgtccatttatctgtggaaaagctgt

SEQ ID NO: 287308 - DNA, 75 bp, Artificial Sequence
  Synthetic
atggtgacaatatatacaatatatatattggcaccatgggtgcacaggtttcaagacaaaatgttggaactcact

SEQ ID NO: 287309 - DNA, 75 bp, Artificial Sequence
  Synthetic
gatattatgcaaaatccaagtggggaggatatgaccttgttttgccaaatggtatccagtgttacatttatacca

SEQ ID NO: 287310 - DNA, 75 bp, Artificial Sequence
  Synthetic
catgtgaaccaggtgattgcggtggaaaactactatgcaaacatggagtaattgggatagtaactgcaggtggag

SEQ ID NO: 287311 - DNA, 75 bp, Artificial Sequence
  Synthetic
atggcagcaattttccaagggcccatttcacttgatggacccccaccggcagcaataagtgacctactacaatca

SEQ ID NO: 287312 - DNA, 75 bp, Artificial Sequence
  Synthetic
acaagatcctagtaaatttactgacccagttaaggatgttttggaaaagggaataccaacactacagtcccccac

SEQ ID NO: 287313 - DNA, 75 bp, Artificial Sequence
  Synthetic
taccggctatgaacagaaggttctttttagatttagatattatagtatgtgataaatataaagatccacaaggaa

SEQ ID NO: 287314 - DNA, 75 bp, Artificial Sequence
  Synthetic
taccggctatgaacagaaggttctttttagatttagatattttagtatgtgataaatataaagatccacaaggaa

SEQ ID NO: 287315 - DNA, 75 bp, Artificial Sequence
  Synthetic
taccggctatgaacagaaggttctttttagatttagatattctagtatgtgataaatataaagatccacaaggaa

SEQ ID NO: 287316 - DNA, 75 bp, Artificial Sequence
  Synthetic
taccggctatgaacagaaggttctttttagatttagatattgtagtatgtgataaatataaagatccacaaggaa

SEQ ID NO: 287317 - DNA, 75 bp, Artificial Sequence
  Synthetic
ttttgttgacagtgttaaagagcaaataaatgctattaatccaattaataacattagcaagaaaataattaaatg

SEQ ID NO: 287318 - DNA, 75 bp, Artificial Sequence
  Synthetic
ttacaatcattgcaaacatcattagtatatctgggattatctatgtcatatacaaactgttttgcacactgcagg

SEQ ID NO: 287319 - DNA, 75 bp, Artificial Sequence
  Synthetic
gtttggccacattatctatcctccaaggatgcctctgcaattgataaaccctctcaaccagatacatcttctaat

SEQ ID NO: 287320 - DNA, 75 bp, Artificial Sequence
  Synthetic
ggatcgcaataattgtcaaacttatactctggcacaagtgtacaatcaaatacttgctgaagacaagagacgtag

SEQ ID NO: 287321 - DNA, 75 bp, Artificial Sequence
  Synthetic
ccttggagatttctcaaggaaaaattttgtaaatggacccaattaaattacatacataaagaatctgattcatgg

SEQ ID NO: 287322 - DNA, 75 bp, Artificial Sequence
  Synthetic
taactcatgtgttgtaaccacaaataatggaaagtttacaggattaggtatttatgatagaacattgattatacc

SEQ ID NO: 287323 - DNA, 75 bp, Artificial Sequence
  Synthetic
acatgttttatcattacctgggtaggagtggatacacaatacatgtgcagtgtaatgctagtaaatttcaccagg

SEQ ID NO: 287324 - DNA, 75 bp, Artificial Sequence
  Synthetic
ccagaggtcattaaatattgtgaggataacaaatggatagtgccaactgagtgtaagattgagagagatcttaat

SEQ ID NO: 287325 - DNA, 75 bp, Artificial Sequence
  Synthetic
aagctcaacttaaggttaagtatttgagtgagcttaaaaaattaaactttcttgagaagcagatggaacacctta

SEQ ID NO: 287326 - DNA, 75 bp, Artificial Sequence
  Synthetic
atcacagtacttaaattgaagagaaatgaaaaattcaaagatattagaaagtatataccagaaaatgaggatgat

SEQ ID NO: 287327 - DNA, 75 bp, Artificial Sequence
  Synthetic
cttgagaagcagatggaacaccttagagttgctgactctcaaactcaggaaaaaattaagcatgagattgacact

SEQ ID NO: 287328 - DNA, 75 bp, Artificial Sequence
  Synthetic
cagggaagttaaagctgagacgagattgaatcctgatctacaacctactgaagagtattggctaaactttgatgg

SEQ ID NO: 287329 - DNA, 75 bp, Artificial Sequence
  Synthetic
caggtgagcccaagcctaaaaccaagataccagaaagaagagtggtagctcaaggtccagaggaagaatttggta

SEQ ID NO: 287330 - DNA, 75 bp, Artificial Sequence
  Synthetic
accaaacagctagaatgctaaaatacaactatccaacaaaatcaggctattgtggtggcattttgtacaaaattg

SEQ ID NO: 287331 - DNA, 75 bp, Artificial Sequence
  Synthetic
atggattcaatgcggagccacaataattggagtttggtaataataccaatatgtccccttgagacatcaagtgca

SEQ ID NO: 287332 - DNA, 75 bp, Artificial Sequence
  Synthetic
agatccaggtaatgaaatacaaatagatggtatcacaactaaggtagaagattcttacgatctgttcaataaaga

SEQ ID NO: 287333 - DNA, 75 bp, Artificial Sequence
  Synthetic
cactaaaaccacacttgaatgtaacttacccagcattcatacaccaagtaaaaccaagttacagcccagtgtatt

SEQ ID NO: 287334 - DNA, 75 bp, Artificial Sequence
  Synthetic
catgcagaatccaagtggtgaggatatgaccttattttgtcaaatggtgtctagtgttacattcatacccccaat

SEQ ID NO: 287335 - DNA, 75 bp, Artificial Sequence
  Synthetic
gttcaggacagtttttgacaacagatgatttccaatccccatgtgcacttccctggtatcacccaactaaggaaa

SEQ ID NO: 287336 - DNA, 75 bp, Artificial Sequence
  Synthetic
tgcaatttggctttatctgctaatcaaccagaaaccacaataatcaatgttggggatgtagtgtcatatggaaat

SEQ ID NO: 287337 - DNA, 75 bp, Artificial Sequence
  Synthetic
ggaaatgaacattgtgttttaaacgatcatattagggtagctgtttcacattattcggctcaactaattactttg

SEQ ID NO: 287338 - DNA, 75 bp, Artificial Sequence
  Synthetic
gctatgaatagaagattcttttttgacctagatattgtagtgtgtgacaagtacaaagacccacaagggaaactc

SEQ ID NO: 287339 - DNA, 75 bp, Artificial Sequence
  Synthetic
gtattctgttgtattgcaatcatcaattaatgcaccagataagatcttctctattcgaacagatgttgcttccca

SEQ ID NO: 287340 - DNA, 75 bp, Artificial Sequence
  Synthetic
tagggattcatgttggtggtaatggaagggatggatttgcagccatgctactaagatcatatttttcagaaacac

SEQ ID NO: 287341 - DNA, 75 bp, Artificial Sequence
  Synthetic
ctatgggtattaagaagagggatctgatcaataaacaaactaaagatgtaacaaaacttaaaatggcactggata

SEQ ID NO: 287342 - DNA, 75 bp, Artificial Sequence
  Synthetic
gcaatacttgccaaacttataccttggcacaggtgtataaccaaatacttgttgaagacaaaaggcgcaggcaag

SEQ ID NO: 287343 - DNA, 75 bp, Artificial Sequence
  Synthetic
actgttaagcttttgttggcatacacaccacctggtatcgcagaacccaccacaagaaaggatgcaatgctaggc

SEQ ID NO: 287344 - DNA, 75 bp, Artificial Sequence
  Synthetic
tttccctggtagtaaagaaccagctgtactttcagaacacgactctaggttagaagttgatttcaaacaagcttt

SEQ ID NO: 287345 - DNA, 75 bp, Artificial Sequence
  Synthetic
tgtaaatgatactgtactatttaggacaacttttggtaacctattttctaagtttcatttaaacccaggaattgt

SEQ ID NO: 287346 - DNA, 75 bp, Artificial Sequence
  Synthetic
agtaattagatattgtgaagagaataaatggatagtgccagctgagtgtaaaattgaaagagaccttaatatagc

SEQ ID NO: 287347 - DNA, 75 bp, Artificial Sequence
  Synthetic
catctgggtacataacatgctggtatcagactagattagtcattccacctcagaccccaccaacagctagattgt

SEQ ID NO: 287348 - DNA, 75 bp, Artificial Sequence
  Synthetic
ccaaatccaatctcattagaggatagcgtttttggtgcggaaggtttagaagcacttgaccttactaccagtgct

SEQ ID NO: 287349 - DNA, 75 bp, Artificial Sequence
  Synthetic
gatggaagtatacatcctatttggtttcaagctcttaaagaagtgttaaccaatttatcttttgatgctagttta

SEQ ID NO: 287350 - DNA, 75 bp, Artificial Sequence
  Synthetic
gagcctaaaccaaaaactaaaataccagagaggagagttgtggctcagggtccagaagaagaatttggcagatca

SEQ ID NO: 287351 - DNA, 75 bp, Artificial Sequence
  Synthetic
ttatatagatgaagttcttaatgaagttttagttgtcccaaatattaatagtagtaaccccacaacatcaaattc

SEQ ID NO: 287352 - DNA, 75 bp, Artificial Sequence
  Synthetic
ttgacttgcccatggtcacatttcttaaagatgaacttaggaaaaaagagaaaattgccactggaaagacacgtg

SEQ ID NO: 287353 - DNA, 75 bp, Artificial Sequence
  Synthetic
caatgattaacaacatcattattaggacgctggtattggatgcttataaaaacatagatttagataaattgaaga

SEQ ID NO: 287354 - DNA, 75 bp, Artificial Sequence
  Synthetic
ctggtaatgagatacagattgatggaattgcaactaaagtagaagattcctatgacttatataataaagatggag

SEQ ID NO: 287355 - DNA, 75 bp, Artificial Sequence
  Synthetic
gaaatgagtttagagagttttcttggcagatcaggatgcatacatgaatctaaattagaggttacacttgcaaat

SEQ ID NO: 287356 - DNA, 75 bp, Artificial Sequence
  Synthetic
tgcagtaggttgtgacccagaaactttttggtcaaaaataccagtaatgttaaatggcgagtgcataatggcatt

SEQ ID NO: 287357 - DNA, 75 bp, Artificial Sequence
  Synthetic
tgctgacaaatccaattgcttcaaacaacttgattatgataatgtgacatttttaaagagaggatttaggcaaga

SEQ ID NO: 287358 - DNA, 75 bp, Artificial Sequence
  Synthetic
tttggccttatctgctaatcaaccagaaacgactataattaatgtaggagatgtagtatcttatggtaatatctt

SEQ ID NO: 287359 - DNA, 75 bp, Artificial Sequence
  Synthetic
aaataaccctagttccatgcatttccgcccttagtcaggacattggacacatcacaatgcaatacatgtatgttc

SEQ ID NO: 287360 - DNA, 75 bp, Artificial Sequence
  Synthetic
aagaatccatacggtggactaagaaaccatctcagatgcaagaacacgtcttatcactgtgtcatttaatgtggc

SEQ ID NO: 287361 - DNA, 75 bp, Artificial Sequence
  Synthetic
ttatgcaggtctaaacacatttttaaaaatgtatattatgaggtagaagggggggtgccatcaggttgttctgga

SEQ ID NO: 287362 - DNA, 75 bp, Artificial Sequence
  Synthetic
atccatgttggaggaaacgggagggatggattcgctgccatgctgttacgatcttacttttctgaaacacagggt

SEQ ID NO: 287363 - DNA, 75 bp, Artificial Sequence
  Synthetic
ttccttacctttcctaagtgtggcatctgcttattacatgttttatgatgggtatgatgaacaagatcaaaacta

SEQ ID NO: 287364 - DNA, 75 bp, Artificial Sequence
  Synthetic
ttctgcatgagtggtatgaaaaattttaaattgtttagatatagaaatattaaacagttagttttttagttttat

SEQ ID NO: 287365 - DNA, 75 bp, Artificial Sequence
  Synthetic
atggagatgatgttatcttttcttataaatatcaattagacatggaagtgattgcaaaggaaggcattaagtatg

SEQ ID NO: 287366 - DNA, 75 bp, Artificial Sequence
  Synthetic
ctggtagtaaagaaccagctgtcctcacaagtaatgatcctagattagaggtagactttaaagaggctttgtttt

SEQ ID NO: 287367 - DNA, 75 bp, Artificial Sequence
  Synthetic
ctctgttatttcggtaaccttgtacgccagttttatctcccctcccccaattgtaacttagaagcaatacacaag

SEQ ID NO: 287368 - DNA, 75 bp, Artificial Sequence
  Synthetic
gctaaacatgtcaaggcatggtgtccacgcccacccagagcgcttgagtatactcgtgctcatcgcactaatttt

SEQ ID NO: 287369 - DNA, 75 bp, Artificial Sequence
  Synthetic
tcacttaaggtcaagcacttctgtttccccggtctgagttgatatgctctaacagggcaaaaacaagtcagatcg

SEQ ID NO: 287370 - DNA, 75 bp, Artificial Sequence
  Synthetic
ttcatttctgatacatccaatttttccaattgatgaaattcatgagtccattcgatggactaagaaaccatctca

SEQ ID NO: 287371 - DNA, 75 bp, Artificial Sequence
  Synthetic
ccaattgatgaaattcatgagtccattcgatggactaagaaaccatctcagatgcaagaacacgttctgtcactg

SEQ ID NO: 287372 - DNA, 75 bp, Artificial Sequence
  Synthetic
acctatatccttagaagagagtgtttttggtatagaaggcctggaggcattagatcttaacactagtgcaggatt

SEQ ID NO: 287373 - DNA, 75 bp, Artificial Sequence
  Synthetic
atagaaatcttcatcttttcaactctgagatgcatgaatctattttggtatcttattcatcagatttaatcattt

SEQ ID NO: 287374 - DNA, 75 bp, Artificial Sequence
  Synthetic
agcctgcgtggctgcctgcacacccttatgggtgtgaagccatatatttgacaaggtgtgaagagccccgtgtgc

SEQ ID NO: 287375 - DNA, 75 bp, Artificial Sequence
  Synthetic
atctgcttttgcatgaatggtatgaaaaattttaagttgtttagatatagaaataataaacaattagttttttag

SEQ ID NO: 287376 - DNA, 75 bp, Artificial Sequence
  Synthetic
ttacccatggtaactttccttaaggatgagcttagaaagaaggagaagatccgtgctggaaagacccgtgtaatt

SEQ ID NO: 287377 - DNA, 75 bp, Artificial Sequence
  Synthetic
tacaagccatgactggtatgaaatacaggaaagtgagtactatcccaaacacatacagtacaatttgttgattgg

SEQ ID NO: 287378 - DNA, 75 bp, Artificial Sequence
  Synthetic
ccagattacttaaggtcaagcacttctgtttccccggtcaatgttgatatgctccaacagggcaaaaacaactgc

SEQ ID NO: 287379 - DNA, 75 bp, Artificial Sequence
  Synthetic
tgggatgtgacccagaaacattttggtcaaaaataccagtcatgttggatggagagtgtataatggcctttgact

SEQ ID NO: 287380 - DNA, 75 bp, Artificial Sequence
  Synthetic
ttatggtgacaatatatatatagcatatatattgacaccatgggcgctcaggtatccagacagaatgttggaact

SEQ ID NO: 287381 - DNA, 75 bp, Artificial Sequence
  Synthetic
attgaccttagacacttccattgtgctgaagaacaaggggttacagattatatacatatgctaggagaagcattt

SEQ ID NO: 287382 - DNA, 75 bp, Artificial Sequence
  Synthetic
tagatccaaacatatcttcaaaaacacatattatgaggttgagggtggggttccatcaggttgttctggtactag

SEQ ID NO: 287383 - DNA, 75 bp, Artificial Sequence
  Synthetic
tctcacaagatcctagcaagtttactgacccagtcaaagatgtgctagaaaaaggcattccaacactacagtcac

SEQ ID NO: 287384 - DNA, 75 bp, Artificial Sequence
  Synthetic
cagcaatggtcataataattagaaactcttctgacccccaaactatattagcaacactcacactgattgggtgtt

SEQ ID NO: 287385 - DNA, 75 bp, Artificial Sequence
  Synthetic
ggatgggaccgactactttgggtgtccgtgtttcactttttacttataattgcttatggtgacaatatatatata

SEQ ID NO: 287386 - DNA, 75 bp, Artificial Sequence
  Synthetic
gatgatgtaattttttcctacaaatatcaacttgacatggaagcaattgccaaagaaggtatcaaatatgggcta

SEQ ID NO: 287387 - DNA, 75 bp, Artificial Sequence
  Synthetic
tggtgtatggccacactatttaacaccacaagacgccactgccatagacaaaccatctagaccagatacttcttc

SEQ ID NO: 287388 - DNA, 75 bp, Artificial Sequence
  Synthetic
agcatgcaatgcagctagagggcttgaatggatagggaataagatatctaaatttattgaatggatgaagtcgat

SEQ ID NO: 287389 - DNA, 75 bp, Artificial Sequence
  Synthetic
tcctgatacacccaacatttccaattgaagaaattcaagagtccatacgatggacaaagaaaccatctcaaatgc

SEQ ID NO: 287390 - DNA, 75 bp, Artificial Sequence
  Synthetic
gaaaatatgttttatcactttcttggcaggagtggttacacagtgcatgttcagtgtaatgcaagcaagtttcat

SEQ ID NO: 287391 - DNA, 75 bp, Artificial Sequence
  Synthetic
tggacaaagaaaccatctcaaatgcaggaacacgtgctatcattgtgtcacttaatgtggcataatggcagagat

SEQ ID NO: 287392 - DNA, 75 bp, Artificial Sequence
  Synthetic
acacaagaaaaaattaaaatggaaatagacactttacatgatttgtcacgtaaatttctacctttgtatgcaagt

SEQ ID NO: 287393 - DNA, 75 bp, Artificial Sequence
  Synthetic
atggtgtttggccacactatctatcctctaaagatgcttctgcaattgacaagccttcccgcccagacacatctt

SEQ ID NO: 287394 - DNA, 75 bp, Artificial Sequence
  Synthetic
caggtagagatgttagcctttcaagatcagaaaatacagaaaaacaacctagcgatgataactggcttaattttg

SEQ ID NO: 287395 - DNA, 75 bp, Artificial Sequence
  Synthetic
gtgctggcaaatctataacaacaaatttcctggccaaaatgataactaatgatagtgacatatactctctacctc

SEQ ID NO: 287396 - DNA, 75 bp, Artificial Sequence
  Synthetic
gctctgttatttcggtaaccttgcacgccagttttatcaccccttccccacgtaacttagaagcttttaaacaca

SEQ ID NO: 287397 - DNA, 75 bp, Artificial Sequence
  Synthetic
tgaaaatatgttttaccactacttgggcagaagtggttatacaatacatgtacagtgtaatgctagtaaattcca

SEQ ID NO: 287398 - DNA, 75 bp, Artificial Sequence
  Synthetic
ccccatggactcaatgcttagacataacaactggagtctagtaattatccccatatgtcccttggaagctaatgg

SEQ ID NO: 287399 - DNA, 75 bp, Artificial Sequence
  Synthetic
cgtgaaaggtcaagcacttctgtatccccggtcaatgttgatatgctcctccagggcaaaaacaacagcgatcgt

SEQ ID NO: 287400 - DNA, 75 bp, Artificial Sequence
  Synthetic
cgtgaaaggtcaagcacttctgtttccccggtcaatgttgatatgctcctccagggcaaaaacaacagcgatcgt

SEQ ID NO: 287401 - DNA, 75 bp, Artificial Sequence
  Synthetic
cgtgaaaggtcaagcacttctgtctccccggtcaatgttgatatgctcctccagggcaaaaacaacagcgatcgt

SEQ ID NO: 287402 - DNA, 75 bp, Artificial Sequence
  Synthetic
cgtgaaaggtcaagcacttctgtgtccccggtcaatgttgatatgctcctccagggcaaaaacaacagcgatcgt

SEQ ID NO: 287403 - DNA, 75 bp, Artificial Sequence
  Synthetic
aatggtttctagtgttacatttataccaccaatggctgatctaccagataaaggcaaggcttttgattctaggtt

SEQ ID NO: 287404 - DNA, 75 bp, Artificial Sequence
  Synthetic
cactccatggtgatgtaaatgttggttataaatacactcacccaggagaagcagggagagaggtcaaaagtgaca

SEQ ID NO: 287405 - DNA, 75 bp, Artificial Sequence
  Synthetic
acaccaggatctggtcagtttatgacaacagatgattaccagtctcctagtgctttaccttggttccaccctact

SEQ ID NO: 287406 - DNA, 75 bp, Artificial Sequence
  Synthetic
aaattccccactggcgacagtgttctagcctgcgtggctgcctgcacaccctaacgggtgtgaagcccagtattg

SEQ ID NO: 287407 - DNA, 75 bp, Artificial Sequence
  Synthetic
catgataacttcaaagatccacagggcaaacttaatgtggcagcagcgtttcgaccatgtgatgtagataataga

SEQ ID NO: 287408 - DNA, 75 bp, Artificial Sequence
  Synthetic
cctgagaagcaacaactctgctacaataattgctccatatgttaatgcagttcccatggattcaatgcgcagcca

SEQ ID NO: 287409 - DNA, 75 bp, Artificial Sequence
  Synthetic
tagatatgtattcagtaattttaggccaagaaacaacaccagctaaagaaatatttgcaatcaaagtggacattg

SEQ ID NO: 287410 - DNA, 75 bp, Artificial Sequence
  Synthetic
atggtcgtaatgagcaattgcaggatgggaccgactactttgggtgtccgtgtttctcttttttccttatatttg

SEQ ID NO: 287411 - DNA, 75 bp, Artificial Sequence
  Synthetic
atggtcgtaatgagcaattgctggatgggaccgactactttgggtgtccgtgtttctcttttttccttatatttg

SEQ ID NO: 287412 - DNA, 75 bp, Artificial Sequence
  Synthetic
atggtcgtaatgagcaattgccggatgggaccgactactttgggtgtccgtgtttctcttttttccttatatttg

SEQ ID NO: 287413 - DNA, 75 bp, Artificial Sequence
  Synthetic
atggtcgtaatgagcaattgcgggatgggaccgactactttgggtgtccgtgtttctcttttttccttatatttg

SEQ ID NO: 287414 - DNA, 75 bp, Artificial Sequence
  Synthetic
taatgattgaagaagacagacggagaagacaagtggttgatgtcatgacagctatattccaagggccaattgata

SEQ ID NO: 287415 - DNA, 75 bp, Artificial Sequence
  Synthetic
aatatcaataagtcccatgtgtgcagagttttctggagcacgtgccaaaagccagggtctaccagttttcatcac

SEQ ID NO: 287416 - DNA, 75 bp, Artificial Sequence
  Synthetic
taatactacacttaaattattattggcctacacaccccctggtattgaaaaaccacagagcagaaaagatgctat

SEQ ID NO: 287417 - DNA, 75 bp, Artificial Sequence
  Synthetic
cgctcccctggtatcacccaaccaaggaaatatccatcccaggtgaggtgaaaaacttagttgaaatatgtcaag

SEQ ID NO: 287418 - DNA, 75 bp, Artificial Sequence
  Synthetic
atggttctagtttaaatttcttcaacatcaactactttaaggacgcagcctctagtggggcgtctaaattagagt

SEQ ID NO: 287419 - DNA, 75 bp, Artificial Sequence
  Synthetic
agaatgcaagatagaaaaggagttgaacttggctaacacaatcataacaatcattgcaaatgttattggtatggc

SEQ ID NO: 287420 - DNA, 75 bp, Artificial Sequence
  Synthetic
acttactcacaagcaggatacataacatgttggtatcaaactaatttaattgtgcctccaaatacaccaaccact

SEQ ID NO: 287421 - DNA, 75 bp, Artificial Sequence
  Synthetic
cttttcaatcaaaacagatgtagcctctcagccactagctaccactctaattggtgaaatatccagctattacac

SEQ ID NO: 287422 - DNA, 75 bp, Artificial Sequence
  Synthetic
tgacaggattattcaaattacaagaggagactctaccataacatcacaagatgttgcaaacgcagttgttgggta

SEQ ID NO: 287423 - DNA, 75 bp, Artificial Sequence
  Synthetic
acacagggaccagaggaggaatttgggatgtctttaattaaacataactcatgtgttattacaacagaaaatggg

SEQ ID NO: 287424 - DNA, 75 bp, Artificial Sequence
  Synthetic
acactactgttaaactcttactagcctatacaccgcctggtattagagagcctactacaagaagagaagcaatgt

SEQ ID NO: 287425 - DNA, 75 bp, Artificial Sequence
  Synthetic
cagtagaaaattttgtagatgaagttttaaatgaagttttagtagttccaaacatcaaacaaagtcaggcaacaa

SEQ ID NO: 287426 - DNA, 75 bp, Artificial Sequence
  Synthetic
aaaatatgggcatctaattcaaagggttggtggtggaaattaccagatgcccttaaagacatgggtatatttggt

SEQ ID NO: 287427 - DNA, 75 bp, Artificial Sequence
  Synthetic
ttgactcatatgacctatacaacaagaatgggataaagctagaaataacagtacttaaattagatagaaatgaaa

SEQ ID NO: 287428 - DNA, 75 bp, Artificial Sequence
  Synthetic
atctacagcaggatacataacatgctggtatcaaaccagattagtaattccacctcaaactccacccacagctag

SEQ ID NO: 287429 - DNA, 75 bp, Artificial Sequence
  Synthetic
aacacgtgatgagatgagtcttgagagcttcttaggaaggtcaggttgtattcatatctcagaactgattgtaga

SEQ ID NO: 287430 - DNA, 75 bp, Artificial Sequence
  Synthetic
taccagaacaccaattggctagtgcgggcagaggcaatgtggctgctggatataattacacacaccctggtgaga

SEQ ID NO: 287431 - DNA, 75 bp, Artificial Sequence
  Synthetic
tgttggagatgttgtatcctatggcaatatactgctcagtggcaaccaaacggctagaatgcttaaatacagtta

SEQ ID NO: 287432 - DNA, 75 bp, Artificial Sequence
  Synthetic
tgggccaatagagcaaaatcctgttgaacactacatagatgaggtccttaatgaggttttagtagttccaaatat

SEQ ID NO: 287433 - DNA, 75 bp, Artificial Sequence
  Synthetic
tttgactctgaagtgacattagttccctcaatagcagcccagggcgaggacgtgggtcatgttgtaatgcaatat

SEQ ID NO: 287434 - DNA, 75 bp, Artificial Sequence
  Synthetic
catattcccccatcaattcattaatttgagaagcaacaattctgcaaccttaatacttccatatgttaatgctgt

SEQ ID NO: 287435 - DNA, 75 bp, Artificial Sequence
  Synthetic
ttactcagatcctatttcactgatgttcagggccaaataacgttatcaaagaagaccagtgaatgtaacctaccc

SEQ ID NO: 287436 - DNA, 75 bp, Artificial Sequence
  Synthetic
acccaaggttctctttacctttcttaagcatagcctcagcatactacatgttttatgatgggtatgatggtgatc

SEQ ID NO: 287437 - DNA, 75 bp, Artificial Sequence
  Synthetic
tcttggtagatcagggtgcatacatgaatctaaactggaggtcacgcttacaaattacaatgaaaacaatttcaa

SEQ ID NO: 287438 - DNA, 75 bp, Artificial Sequence
  Synthetic
atatccatcagtcccatgtttgctgagttctctggagctcgtgcaagaagccaggggttgcccgttctactgaca

SEQ ID NO: 287439 - DNA, 75 bp, Artificial Sequence
  Synthetic
ggttacaagttgatttcaatgaagcactattttctaaatacaaagggaatacagattgctccattaatgaccaca

SEQ ID NO: 287440 - DNA, 75 bp, Artificial Sequence
  Synthetic
cagagtgtaccacaaagccaagcatgttaaagcctggtgtcctagaccaccaagagccattgagtatacacacac

SEQ ID NO: 287441 - DNA, 75 bp, Artificial Sequence
  Synthetic
atttctgcacttagtgaggacattggacatgttactatgcaatacatgtatgtaccaccaggtgcacctgtacca

SEQ ID NO: 287442 - DNA, 75 bp, Artificial Sequence
  Synthetic
ggaacctatcagagttatgtcaagttgacactattatcccaatcaaccacacaacgtcaactacctctagtgtga

SEQ ID NO: 287443 - DNA, 75 bp, Artificial Sequence
  Synthetic
agaggctcttgatttgaacactagcgcaggatttccatatattgcaatgggagttaaaaagagagatttaataaa

SEQ ID NO: 287444 - DNA, 75 bp, Artificial Sequence
  Synthetic
tatgtacatgtagggaacctcatttatagaaatctacacctctttaattcagacatgcatgatagtattctagtc

SEQ ID NO: 287445 - DNA, 75 bp, Artificial Sequence
  Synthetic
ggaaatctccagctactttacaaactggactggtagcctacgtttcagtcttatgttttgtggctctgcaggaac

SEQ ID NO: 287446 - DNA, 75 bp, Artificial Sequence
  Synthetic
gaaaaggtaattaaaggtaaaactagagttattgaagctagtagtgtgaatgataccctattatttagaacaact

SEQ ID NO: 287447 - DNA, 75 bp, Artificial Sequence
  Synthetic
atatggggtcattatgttctagaatagtgacagagaaacacattcataatatgcatattatgacaagaatctatc

SEQ ID NO: 287448 - DNA, 75 bp, Artificial Sequence
  Synthetic
aaaatagatattacccaattaaagttactagccatgattggtatgaaatccaagagagtgagtattaccctaaac

SEQ ID NO: 287449 - DNA, 75 bp, Artificial Sequence
  Synthetic
gtgcccgcgcccacccagagcacttgaatatactcgtgctcaccgcactaattttaagattcaaaataaagatat

SEQ ID NO: 287450 - DNA, 75 bp, Artificial Sequence
  Synthetic
ctgcagtccactatatcaatgatagtgccttggattagtgctagtcactttagaaacaccacaccagacactttc

SEQ ID NO: 287451 - DNA, 75 bp, Artificial Sequence
  Synthetic
ctgcagtccactatatcaatgatagtgccttggattagtgcttgtcactttagaaacaccacaccagacactttc

SEQ ID NO: 287452 - DNA, 75 bp, Artificial Sequence
  Synthetic
ctgcagtccactatatcaatgatagtgccttggattagtgctcgtcactttagaaacaccacaccagacactttc

SEQ ID NO: 287453 - DNA, 75 bp, Artificial Sequence
  Synthetic
ctgcagtccactatatcaatgatagtgccttggattagtgctggtcactttagaaacaccacaccagacactttc

SEQ ID NO: 287454 - DNA, 75 bp, Artificial Sequence
  Synthetic
tgttggatgataaatgtattatggcttttgattatacaaattatgatggtagtatacaccctatttggtttgaag

SEQ ID NO: 287455 - DNA, 75 bp, Artificial Sequence
  Synthetic
aggaggagaaggccatgttgcattcattgatcttagacactttcactgtgctgaagaacagggcataactgacta

SEQ ID NO: 287456 - DNA, 75 bp, Artificial Sequence
  Synthetic
aactctgaaatgcatgaatctatactggtatcctactcatcagatttaatcatctaccgaacaaacaccataggt

SEQ ID NO: 287457 - DNA, 75 bp, Artificial Sequence
  Synthetic
aagacttttgcttacgtatggctagggatacaaacttgcacaagcaaataggggccatcacccaaaaccctgtag

SEQ ID NO: 287458 - DNA, 75 bp, Artificial Sequence
  Synthetic
gggaggtgtaccatctgggtgttcaggtactagtatttttaacactatgatcaataatattatcataaggacctt

SEQ ID NO: 287459 - DNA, 75 bp, Artificial Sequence
  Synthetic
gatgattatattccctcttgtgattgtacccaggctacatactattgtaaacataaaaatagatatttcccaata

SEQ ID NO: 287460 - DNA, 75 bp, Artificial Sequence
  Synthetic
atcaaatggttactcagaataatatcagcaatggttataattataagaaattcctctgaccctcaaacgataata

SEQ ID NO: 287461 - DNA, 75 bp, Artificial Sequence
  Synthetic
tgaaactggacacacaagcaatgtgcagccagaagacatgatagaaacacgctatgtgttaaattcacaaactag

SEQ ID NO: 287462 - DNA, 75 bp, Artificial Sequence
  Synthetic
gctatagcaatagagggtgttaaatatggtttgactataactcctgctgataaatctaacacatttgtaaaatta

SEQ ID NO: 287463 - DNA, 75 bp, Artificial Sequence
  Synthetic
attcatggcttaagaaatttactgaaatgtgtaatgcagctaaaggcttagagtggattggtaataaaatctcta

SEQ ID NO: 287464 - DNA, 75 bp, Artificial Sequence
  Synthetic
tttaacatatggcaaattaaccttaaagagatggctcagataagaaggaagtttgagctatttacatatctcagg

SEQ ID NO: 287465 - DNA, 75 bp, Artificial Sequence
  Synthetic
catttggaaatggattcgtagatagtgtaaaagaacacatacatgccattaacccagttggaaatattagcaaaa

SEQ ID NO: 287466 - DNA, 75 bp, Artificial Sequence
  Synthetic
ccatcagatggacaaagaaaccatcacaaatgcatgaacatgtgttgtctctgtgtcacttaatgtggcacaatg

SEQ ID NO: 287467 - DNA, 75 bp, Artificial Sequence
  Synthetic
tgtaaaagaacacatacatgccattaacccagttggaaatattagcaaaaagatcattaaatggatgctaaggat

SEQ ID NO: 287468 - DNA, 75 bp, Artificial Sequence
  Synthetic
acatcttagagttgcagattctgctacacaggaaaagataaagtgtgaaatagacacattacatgatctctcttg

SEQ ID NO: 287469 - DNA, 75 bp, Artificial Sequence
  Synthetic
ggtcgtgcactgtacatccctccgtatgatttgcttttgcatgagtggtatgaaaaattttaaagatatagaaat

SEQ ID NO: 287470 - DNA, 75 bp, Artificial Sequence
  Synthetic
aacctgaaaagagagatgactacacatggcaatctggcactaatgcatctgttttctggcagcatggtcaacctt

SEQ ID NO: 287471 - DNA, 75 bp, Artificial Sequence
  Synthetic
ttaaaagaaaaattttgtaaatggacacaacttaattatatacataaagaatcagactcatggttgaagaaattc

SEQ ID NO: 287472 - DNA, 75 bp, Artificial Sequence
  Synthetic
ttaaaactgggttcaggttgatcccacctgaacctcccaagcggagtagtactctgttatttcggtaactttgta

SEQ ID NO: 287473 - DNA, 75 bp, Artificial Sequence
  Synthetic
gctgttgttatacatggtgagcccgggacaggaaagtcaatgacaacaaatttcttggcaagaatgataactaat

SEQ ID NO: 287474 - DNA, 75 bp, Artificial Sequence
  Synthetic
aacaaatgatatgggcacactgtgctctaggattgtgactgaagaacaccagacacaagtcaaaattacaactag

SEQ ID NO: 287475 - DNA, 75 bp, Artificial Sequence
  Synthetic
ccccggtcaacgttgatatgctccaacagggcaaaaacaactgagatcgttatccgcaaagtgcctacgcaaagc

SEQ ID NO: 287476 - DNA, 75 bp, Artificial Sequence
  Synthetic
aggtgaagtacttaaatgaacttaaaaaattaagtctgtatgaaaagcaagttgaaagtcttagaatagcagatg

SEQ ID NO: 287477 - DNA, 75 bp, Artificial Sequence
  Synthetic
gagaagacatgactttgttttgtcagatggtatcgagtgtcacctttatacctccaatggctgatttgccggata

SEQ ID NO: 287478 - DNA, 75 bp, Artificial Sequence
  Synthetic
taagaacacaagaaaagatcaagatggaaattgacactttacatgacttatcatgcaaatttctgccattgtatg

SEQ ID NO: 287479 - DNA, 75 bp, Artificial Sequence
  Synthetic
gtagacctggcagatgaggctagaaactccccactggcgacagtgttctagcctgcgtggctgcctgcacaccct

SEQ ID NO: 287480 - DNA, 75 bp, Artificial Sequence
  Synthetic
ggggattacacactacctatcccaacaagagccaaccctagacaaattttgaatgtagggccaagtgacatgtac

SEQ ID NO: 287481 - DNA, 75 bp, Artificial Sequence
  Synthetic
actttgagtcctccggcccctgaatgtggctaaccttaaccctgcagctagagtgcacaatccagtgtatttcta

SEQ ID NO: 287482 - DNA, 75 bp, Artificial Sequence
  Synthetic
acctggtgctggaaaatcaataacaacaaattttttagccaggatgataactaatgatagtgatatatactcttt

SEQ ID NO: 287483 - DNA, 75 bp, Artificial Sequence
  Synthetic
tttcatggatttagacattatagttaatgataagtataaagatgcccagggcaaactcaatgtatctgcagcctt

SEQ ID NO: 287484 - DNA, 75 bp, Artificial Sequence
  Synthetic
gaacaaacactacaggtgatgattacattccaacatgtgactgtactgatgcaacctactattgcaaacacaaaa

SEQ ID NO: 287485 - DNA, 75 bp, Artificial Sequence
  Synthetic
acaaattttttagccaggatgataactaatgatagtgatatatactctttacccccagatccaaaatattttgat

SEQ ID NO: 287486 - DNA, 75 bp, Artificial Sequence
  Synthetic
ttgcttatggtgacaatatattgaattatatattgacaccatgggcgctcaggtatctagacagaatgttggtac

SEQ ID NO: 287487 - DNA, 75 bp, Artificial Sequence
  Synthetic
ttctctttagcgcaggtctataaccaaattcttgatgaagacaaaagacgtaggcaagtcatagacgttatgtct

SEQ ID NO: 287488 - DNA, 75 bp, Artificial Sequence
  Synthetic
gggaccctgtgaacctggagactgtggtggtaaattactgtgtaaacatggagtaataggtatcattacagctgg

SEQ ID NO: 287489 - DNA, 75 bp, Artificial Sequence
  Synthetic
ttttcacaagatccaagcaagttcacagacccagtaaaggatgtacttgagaaaggcataccaaccttacaatca

SEQ ID NO: 287490 - DNA, 75 bp, Artificial Sequence
  Synthetic
tagtgcatgataatttcaaggactcacagggcaaacttaatgtagcagcagccttccaaccatgcgacgtggaca

SEQ ID NO: 287491 - DNA, 75 bp, Artificial Sequence
  Synthetic
aacaaaacaaatggataattccagctgagtgtaaaatagaaagagatctaaatgtggcaaatacaatcataacaa

SEQ ID NO: 287492 - DNA, 75 bp, Artificial Sequence
  Synthetic
aatggatttgttgacagtgttagggagcaagttaatgcaatcaacccaatcaataatatcagcaagaaattggtt

SEQ ID NO: 287493 - DNA, 75 bp, Artificial Sequence
  Synthetic
atggtgtatggccacactacttgacaccagaggatgctactgcaatagataaaccttctcaccccgacacttcat

SEQ ID NO: 287494 - DNA, 75 bp, Artificial Sequence
  Synthetic
taacataatgcttgaagaagacaaacgcaggagacaagtggttgatgttatgtcagctattttccagggaccaat

SEQ ID NO: 287495 - DNA, 75 bp, Artificial Sequence
  Synthetic
aagaatgccggagagaagggtagtggctcagggaccagaagaggaatttggtaggtcacttatcaagcataattc

SEQ ID NO: 287496 - DNA, 75 bp, Artificial Sequence
  Synthetic
ggtctccttggcgttttcttaaagaaaaattctgtaaatggacccagcttaattatgtgcataaagaatcagatt

SEQ ID NO: 287497 - DNA, 75 bp, Artificial Sequence
  Synthetic
tcagaatatgtattatcacttccttggaagaagtggatacacagtgcatgtacaatgtaactctagtaaatttca

SEQ ID NO: 287498 - DNA, 75 bp, Artificial Sequence
  Synthetic
attgatggcatcactacaggagtggaagattcatatgatttgttcaacaaggatggtgtcaagttagaaatcact

SEQ ID NO: 287499 - DNA, 75 bp, Artificial Sequence
  Synthetic
agttaaatttagctaatacaatcataacaatcattgccaatgttattagtatagcaggtattatatatgttatct

SEQ ID NO: 287500 - DNA, 75 bp, Artificial Sequence
  Synthetic
gccacaggcccagctcaaggttaagtatctcagtgaattaaagaaattaaatttactagagaaacaaattgaaaa

SEQ ID NO: 287501 - DNA, 75 bp, Artificial Sequence
  Synthetic
gctgggagggatgtgagtataaccaatcgtgatcatgttagtagacaaccaagtgacgaaaattggttaaatttt

SEQ ID NO: 287502 - DNA, 75 bp, Artificial Sequence
  Synthetic
atcaaccagaaactaccataattaatgtaggagatgtagtatcatatggtaatattttacttagtggaaaccaaa

SEQ ID NO: 287503 - DNA, 75 bp, Artificial Sequence
  Synthetic
atttggaatgtccttaatcaaacacaattcatgtgtgatcacaacagacaatggaaagtttacaggtcttggaat

SEQ ID NO: 287504 - DNA, 75 bp, Artificial Sequence
  Synthetic
gcaaagagaattaaggttttaaataacaagtgtaacaatgtaatcaaacagaagaaaaggagtgaaccagttgcc

SEQ ID NO: 287505 - DNA, 75 bp, Artificial Sequence
  Synthetic
gcaaagagaattaaggttttatataacaagtgtaacaatgtaatcaaacagaagaaaaggagtgaaccagttgcc

SEQ ID NO: 287506 - DNA, 75 bp, Artificial Sequence
  Synthetic
gcaaagagaattaaggttttacataacaagtgtaacaatgtaatcaaacagaagaaaaggagtgaaccagttgcc

SEQ ID NO: 287507 - DNA, 75 bp, Artificial Sequence
  Synthetic
gcaaagagaattaaggttttagataacaagtgtaacaatgtaatcaaacagaagaaaaggagtgaaccagttgcc

SEQ ID NO: 287508 - DNA, 75 bp, Artificial Sequence
  Synthetic
ttccaatggattccatgctaagacacaataattggagcttggttattatacctatttgccagttagaagttgtgg

SEQ ID NO: 287509 - DNA, 75 bp, Artificial Sequence
  Synthetic
tggaagagacgggtttgctgctatgttgctgagatcctacttttctgaagcacaaggtcagataatcagctccaa

SEQ ID NO: 287510 - DNA, 75 bp, Artificial Sequence
  Synthetic
aataaagatggtataaagttggagataacagtccttaaattagataggaatgagaaatttagagacatcagaaaa

SEQ ID NO: 287511 - DNA, 75 bp, Artificial Sequence
  Synthetic
atcctaagtattttgatggatatgatcaacagagtgttgttataatggatgacatcatgcaaaatccagatgggg

SEQ ID NO: 287512 - DNA, 75 bp, Artificial Sequence
  Synthetic
taacagtccttaaattagataggaatgagaaatttagagacatcagaaaatatataccaaataatgaagatgact

SEQ ID NO: 287513 - DNA, 75 bp, Artificial Sequence
  Synthetic
gactccgggctccggtcaatttatgaccactgatgattatcaatcaccaagtgcattgccatggtttcacccaac

SEQ ID NO: 287514 - DNA, 75 bp, Artificial Sequence
  Synthetic
gctgtactttcaagcaatgaccctagattagaagttgattttgaaaaagctctcttctctaaatataaaggaaat

SEQ ID NO: 287515 - DNA, 75 bp, Artificial Sequence
  Synthetic
cttttgcagtactaatcactcacttttagctcccccaactattacttcattgtctgcaatgaatagaagattttt

SEQ ID NO: 287516 - DNA, 75 bp, Artificial Sequence
  Synthetic
ataaacatgtacacagtattgctagaaaggaaagatgatttgatgcaggaggttttctccataagagttgacatt

SEQ ID NO: 287517 - DNA, 75 bp, Artificial Sequence
  Synthetic
aaagtgtttttggtatagaaggactggaagcacttgatctcaacaccagtgcaggttttccttatgttgctatgg

SEQ ID NO: 287518 - DNA, 75 bp, Artificial Sequence
  Synthetic
tcaaagaaaactagtgagtgtaatctccccagtatacatagtccatccaaaacaaaattgcaacccagtattttc

SEQ ID NO: 287519 - DNA, 75 bp, Artificial Sequence
  Synthetic
ggcaacgctaagtgttgtccatttatatgcggcaaagccgtatcatttaaagatagaaatacttgccaagaatac

SEQ ID NO: 287520 - DNA, 75 bp, Artificial Sequence
  Synthetic
ctaatacaacactgaaattattacttgcatacactccaccaggcattgctaaaccatcaaacagaaaggaagcaa

SEQ ID NO: 287521 - DNA, 75 bp, Artificial Sequence
  Synthetic
cctcaaagatgaacttaggaaaaaagaaaaaatatctgctggaaaaactcgtgtcattgaagctagtagtgtgaa

SEQ ID NO: 287522 - DNA, 75 bp, Artificial Sequence
  Synthetic
gaaacacaaactgttctatgaatgatcacataaagattgcatcttcacactatgcagctcagttaattactttag

SEQ ID NO: 287523 - DNA, 75 bp, Artificial Sequence
  Synthetic
atgaaccacctcctccagccattgatgatctcttacaatcagttcgaacaccagaagtgattaaatattgtgagg

SEQ ID NO: 287524 - DNA, 75 bp, Artificial Sequence
  Synthetic
atgaaccacctcctccagccattgttgatctcttacaatcagttcgaacaccagaagtgattaaatattgtgagg

SEQ ID NO: 287525 - DNA, 75 bp, Artificial Sequence
  Synthetic
atgaaccacctcctccagccattgctgatctcttacaatcagttcgaacaccagaagtgattaaatattgtgagg

SEQ ID NO: 287526 - DNA, 75 bp, Artificial Sequence
  Synthetic
atgaaccacctcctccagccattggtgatctcttacaatcagttcgaacaccagaagtgattaaatattgtgagg

SEQ ID NO: 287527 - DNA, 75 bp, Artificial Sequence
  Synthetic
atgtaccacctcctccagccattgatgatctcttacaatcagttcgaacaccagaagtgattaaatattgtgagg

SEQ ID NO: 287528 - DNA, 75 bp, Artificial Sequence
  Synthetic
atgtaccacctcctccagccattgttgatctcttacaatcagttcgaacaccagaagtgattaaatattgtgagg

SEQ ID NO: 287529 - DNA, 75 bp, Artificial Sequence
  Synthetic
atgtaccacctcctccagccattgctgatctcttacaatcagttcgaacaccagaagtgattaaatattgtgagg

SEQ ID NO: 287530 - DNA, 75 bp, Artificial Sequence
  Synthetic
atgtaccacctcctccagccattggtgatctcttacaatcagttcgaacaccagaagtgattaaatattgtgagg

SEQ ID NO: 287531 - DNA, 75 bp, Artificial Sequence
  Synthetic
atgcaccacctcctccagccattgatgatctcttacaatcagttcgaacaccagaagtgattaaatattgtgagg

SEQ ID NO: 287532 - DNA, 75 bp, Artificial Sequence
  Synthetic
atgcaccacctcctccagccattgttgatctcttacaatcagttcgaacaccagaagtgattaaatattgtgagg

SEQ ID NO: 287533 - DNA, 75 bp, Artificial Sequence
  Synthetic
atgcaccacctcctccagccattgctgatctcttacaatcagttcgaacaccagaagtgattaaatattgtgagg

SEQ ID NO: 287534 - DNA, 75 bp, Artificial Sequence
  Synthetic
atgcaccacctcctccagccattggtgatctcttacaatcagttcgaacaccagaagtgattaaatattgtgagg

SEQ ID NO: 287535 - DNA, 75 bp, Artificial Sequence
  Synthetic
atggaccacctcctccagccattgatgatctcttacaatcagttcgaacaccagaagtgattaaatattgtgagg

SEQ ID NO: 287536 - DNA, 75 bp, Artificial Sequence
  Synthetic
atggaccacctcctccagccattgttgatctcttacaatcagttcgaacaccagaagtgattaaatattgtgagg

SEQ ID NO: 287537 - DNA, 75 bp, Artificial Sequence
  Synthetic
atggaccacctcctccagccattgctgatctcttacaatcagttcgaacaccagaagtgattaaatattgtgagg

SEQ ID NO: 287538 - DNA, 75 bp, Artificial Sequence
  Synthetic
atggaccacctcctccagccattggtgatctcttacaatcagttcgaacaccagaagtgattaaatattgtgagg

SEQ ID NO: 287539 - DNA, 75 bp, Artificial Sequence
  Synthetic
cacattttcctcagcaggttacatctcatgttggtatcaaacaaaccttgtggtcccaccaaatacaccaacaac

SEQ ID NO: 287540 - DNA, 75 bp, Artificial Sequence
  Synthetic
gtattttggtcaaaaataccagtaatgttagatggagattgtataatggcatttgattacacaaattatgatggt

SEQ ID NO: 287541 - DNA, 75 bp, Artificial Sequence
  Synthetic
aatgggtataaagaagagggatttaataaacaacaagaccaaagatataagtaaacttagggaggcaattgacaa

SEQ ID NO: 287542 - DNA, 75 bp, Artificial Sequence
  Synthetic
cattatatttgtgatctacaaattattttgtactcttcaaggtccatattctggtgaacccaaacccaaaactaa

SEQ ID NO: 287543 - DNA, 75 bp, Artificial Sequence
  Synthetic
ccagtggagaattacatagatgaagtgttaaatgaggttctagtagttccaaacattaaggagagtcactcaagc

SEQ ID NO: 287544 - DNA, 75 bp, Artificial Sequence
  Synthetic
ttaagaatgtttattatgaggttgaggggggcgttccatcaggatgttctgggactagcatttttaatactatga

SEQ ID NO: 287545 - DNA, 75 bp, Artificial Sequence
  Synthetic
aactagagtcattgaggctagtagtgtgaatgatactctgctatttagaacaacttttgggaatcttttttcaaa

SEQ ID NO: 287546 - DNA, 75 bp, Artificial Sequence
  Synthetic
tttacaggcttaggtatctatgacagggtcatgatactaccaacacatgctgatcctggaaagataattcaagtg

SEQ ID NO: 287547 - DNA, 75 bp, Artificial Sequence
  Synthetic
caacttttgggaatcttttttcaaaatttcatctaaatcctggaattgtcactggatcagcagtcgggtgtgacc

SEQ ID NO: 287548 - DNA, 75 bp, Artificial Sequence
  Synthetic
agaccagagatgaaatgagtattgagagcttccttggtagatcagggtgtgtccatatttctgatttgaaaatac

SEQ ID NO: 287549 - DNA, 75 bp, Artificial Sequence
  Synthetic
atacaaatatcagctagacatggaagcaattgcgcaggaaggtgttaagtatggactgacaataactcctgctga

SEQ ID NO: 287550 - DNA, 75 bp, Artificial Sequence
  Synthetic
atggcctttgattatacgaattatgatggtagcatacaccccatttggtttgaagcccttaaacaagtattgatg

SEQ ID NO: 287551 - DNA, 75 bp, Artificial Sequence
  Synthetic
tcagagatatacggaagtatataccagagagagaagacgattacccagactgtaacctggctttggttgcaaacc

SEQ ID NO: 287552 - DNA, 75 bp, Artificial Sequence
  Synthetic
tgtaaggtttgattcagaaataacacttgtaccatgcattgcagcaaagagtgataacatcggtcatgttgtcat

SEQ ID NO: 287553 - DNA, 75 bp, Artificial Sequence
  Synthetic
tttccaattgaagaaatctatgagtccatccgatggacaaaaaatccatctcagatgcaggaacatgttttgtca

SEQ ID NO: 287554 - DNA, 75 bp, Artificial Sequence
  Synthetic
gctcaggtactagtatttttaacacaatgattaataatattattataaggactttggtgttagatgcctataaaa

SEQ ID NO: 287555 - DNA, 75 bp, Artificial Sequence
  Synthetic
cactaaatcaggatattgtggaggagttttatacaaaattggtaacatcttaggtatacatgtgggtggtaatgg

SEQ ID NO: 287556 - DNA, 75 bp, Artificial Sequence
  Synthetic
ccatccgatggacaaaaaatccatctcagatgcaggaacatgttttgtcattgtgtcatttaatgtggcataatg

SEQ ID NO: 287557 - DNA, 75 bp, Artificial Sequence
  Synthetic
aattgcatatggtgatgatgttatattctcatatatatatgaattggacatggaagctatagcagtagagggcac

SEQ ID NO: 287558 - DNA, 75 bp, Artificial Sequence
  Synthetic
caaccttaccccagattttctttgccttttctcagcattgcatctgcttactacatgttctatgatggatatgat

SEQ ID NO: 287559 - DNA, 75 bp, Artificial Sequence
  Synthetic
atacacacaccaagtaaaactaagttacaacccagtgtcttttatgaagtgtttgagggcactaaagaaccagca

SEQ ID NO: 287560 - DNA, 75 bp, Artificial Sequence
  Synthetic
tgctctgttattccggtaactttgcacgccaattttataaccccttcccccatgtaacttagaagttttgcacac

SEQ ID NO: 287561 - DNA, 75 bp, Artificial Sequence
  Synthetic
gagaaatacaacttcttgatacaccctacatttcctgagagtgaaatatttgaatccatcaggtggacaaagaag

SEQ ID NO: 287562 - DNA, 75 bp, Artificial Sequence
  Synthetic
ttacaactagagtgtatcacaaagctaaacatgtaaaggcttggtgccccagaccccctagagcagtggaatata

SEQ ID NO: 287563 - DNA, 75 bp, Artificial Sequence
  Synthetic
ctgtataaggtcaagcacttctgtctccccggtcgacgttgatatgcttcaacaaggcaaaaacaacagagatcg

SEQ ID NO: 287564 - DNA, 75 bp, Artificial Sequence
  Synthetic
aagttgctgttgcacactactcagctcaattaatgacactagaaattgattcaagaaacatgagcttggaagata

SEQ ID NO: 287565 - DNA, 75 bp, Artificial Sequence
  Synthetic
tgatatgtatgttcatgtgggtaacctgatatatagaaatctgcatttatttaactcagaagccaatgattcagt

SEQ ID NO: 287566 - DNA, 75 bp, Artificial Sequence
  Synthetic
gagcgctggtcgtgcactgtacatccctccatatgatttgcttttgcatgagtggtatgaaaaattttaaactga

SEQ ID NO: 287567 - DNA, 75 bp, Artificial Sequence
  Synthetic
ttattccggtaactttgtacgccagtttttccctcccctccccatccttttacgtaacttagaagttttaaatac

SEQ ID NO: 287568 - DNA, 75 bp, Artificial Sequence
  Synthetic
cagcacaaaagacatatctaaacttaaattggctttggataaatatggagtagacttacccatggtcactttcct

SEQ ID NO: 287569 - DNA, 75 bp, Artificial Sequence
  Synthetic
gttgtctaaggtcaagcacttctgtttccccggttgatgttgatatgctccaacagggcaaaaacaacagatacc

SEQ ID NO: 287570 - DNA, 75 bp, Artificial Sequence
  Synthetic
agacacaaaaatagatactatccaattgaagtcacaagtcatgattggtatgagatacaagaaagtgaatattat

SEQ ID NO: 287571 - DNA, 75 bp, Artificial Sequence
  Synthetic
atgggaccgactactttgggtgtccgtgtttcatgttttactttatgatttgcttatggtgacaatatatagtga

SEQ ID NO: 287572 - DNA, 75 bp, Artificial Sequence
  Synthetic
ggtaacctattctcagctttccacaaaaatcctgggattgttacaggttctgcagtggggtgcgatcctgaaact

SEQ ID NO: 287573 - DNA, 75 bp, Artificial Sequence
  Synthetic
gcagtagaccttgcagatgaggctggacattccccactggtaacagtggtccagcctgcgtggctgcctgcgcac

SEQ ID NO: 287574 - DNA, 75 bp, Artificial Sequence
  Synthetic
taacagctggtggtgaagggcatgtggcattcatagatcttagacactttcattgtgcagaggaacagggtgtga

SEQ ID NO: 287575 - DNA, 75 bp, Artificial Sequence
  Synthetic
tcggacagggtgtgaagagccgcgtgtgctcactttgagtcctccggcccctgaatgcggctaaccttaaacctg

SEQ ID NO: 287576 - DNA, 75 bp, Artificial Sequence
  Synthetic
tatcaattattttaaggatgctgcttccagtggagcatctaaattagaattttcacaagatcccagcaaattcac

SEQ ID NO: 287577 - DNA, 75 bp, Artificial Sequence
  Synthetic
tcaaaatgattttacataatcttgaatttgaacccaaattgattgatagactttgcaactctaaacacatttata

SEQ ID NO: 287578 - DNA, 75 bp, Artificial Sequence
  Synthetic
aaagatagttaaatggatgctaagaattatatcagcaatggttataataataagaaacagttctgacccacaaac

SEQ ID NO: 287579 - DNA, 75 bp, Artificial Sequence
  Synthetic
ggatgggaccgactactttgggtgtccgtgtttcactttttcctttattaattgcttatggtgacaatatatata

SEQ ID NO: 287580 - DNA, 75 bp, Artificial Sequence
  Synthetic
ggagattccacgattacatcacaagatgtggcaaatgctgttgtagggtatggagtatggcctcattacctatct

SEQ ID NO: 287581 - DNA, 75 bp, Artificial Sequence
  Synthetic
tttagatgcatataagcacatagacttagacaagctcaaaattatagcatatggggatgatgtgatcttttcata

SEQ ID NO: 287582 - DNA, 75 bp, Artificial Sequence
  Synthetic
ttaatataaattacttcaaggatgctgcctcaagtggtgcatctagattagatttctctcaagatccaagcaaat

SEQ ID NO: 287583 - DNA, 75 bp, Artificial Sequence
  Synthetic
gaatcagactcttggcttaaaaaatttactgaaatgtgtaatgcagcaagaggtttagaatggatagggaacaag

SEQ ID NO: 287584 - DNA, 75 bp, Artificial Sequence
  Synthetic
gttggtggtggaaattacctgatgcactcaaagatatgggagtttttggacaaaatatgtattaccatttccttg

SEQ ID NO: 287585 - DNA, 75 bp, Artificial Sequence
  Synthetic
tatgatactgtcacatttcttaaaagaggctttaaacaggatataaaatacccatttttagtccacccaacattt

SEQ ID NO: 287586 - DNA, 75 bp, Artificial Sequence
  Synthetic
cagaggagattcaacaatcacatctcaagatgtagcaaatgctgtggttgggtatggggtctggccgcattactt

SEQ ID NO: 287587 - DNA, 75 bp, Artificial Sequence
  Synthetic
agattgaaaatctgcgaggtgctgacacaaaaacgcaggacaaaataaagtttgagattgacacgctacatgatc

SEQ ID NO: 287588 - DNA, 75 bp, Artificial Sequence
  Synthetic
agagaaaggaaatgttaatactggctacaactacacacaccctggtgaaactggtagggatgttggaaaggacag

SEQ ID NO: 287589 - DNA, 75 bp, Artificial Sequence
  Synthetic
gagatgtttacagcgagtttgaacggaagatacgcagtgtcagcgcaggtcgcgcactgtacatcccgccttatg

SEQ ID NO: 287590 - DNA, 75 bp, Artificial Sequence
  Synthetic
cgcgcactgtacatcccgccttatgagctgttactgcatgagtggtatgaaaaattttaattatcagatatagaa

SEQ ID NO: 287591 - DNA, 75 bp, Artificial Sequence
  Synthetic
aaaggatggtggtggaaattaccagatgctcttaaagacatgggtatttttggagaaaatatgtattatcatttc

SEQ ID NO: 287592 - DNA, 75 bp, Artificial Sequence
  Synthetic
accagtagcaataatgatacatggtcctccagggactggcaaatcaataacaactagttttcttgccagaatgat

SEQ ID NO: 287593 - DNA, 75 bp, Artificial Sequence
  Synthetic
ttaaaactggatctgggttgttcccacctggatctcctacatggagttgtactctattattccggtaatcttgta

SEQ ID NO: 287594 - DNA, 75 bp, Artificial Sequence
  Synthetic
aggagtaataactctgcaacactaatcctcccatatgttaatgctgtgcccatggactctatgcttagacacaat

SEQ ID NO: 287595 - DNA, 75 bp, Artificial Sequence
  Synthetic
gtgcaaaacacggaagtgtgactgctggttacaaactcacacacccaggtgaggctggcagagatgtaagtcaag

SEQ ID NO: 287596 - DNA, 75 bp, Artificial Sequence
  Synthetic
cctggtggtgaagatatgtcactattttgtcagatggtttcaagtgtaacttttattcctccaatggctgatctg

SEQ ID NO: 287597 - DNA, 75 bp, Artificial Sequence
  Synthetic
tccccggtttaaattgatacgctccaccagggcgaaaacaatttaaatcgttatccgcaaaatgactacgcaaag

SEQ ID NO: 287598 - DNA, 75 bp, Artificial Sequence
  Synthetic
tctctggagcacgagcccgtagccagggattaccagtattgatgactccaggttctggtcaattcatgacaactg

SEQ ID NO: 287599 - DNA, 75 bp, Artificial Sequence
  Synthetic
ccttaggagtaataattctgcaactctaatagtaccatatgtaaatgctgtgccaatggattcaatgcttcgaca

SEQ ID NO: 287600 - DNA, 75 bp, Artificial Sequence
  Synthetic
gaaggttctttttagatttagatattgtgattcatgataattataaggacaatcaaggaaaattggacgtatcaa

SEQ ID NO: 287601 - DNA, 75 bp, Artificial Sequence
  Synthetic
tacaattataccaattaactacacatcagcaaatacaactagtgttaacatgtacactgtggtgctagacaaagg

SEQ ID NO: 287602 - DNA, 75 bp, Artificial Sequence
  Synthetic
caaggtgtgaagagccccgtgtgctcattttgagtcctccggcccctgaatgtggctaaccttaaccctgcagct

SEQ ID NO: 287603 - DNA, 75 bp, Artificial Sequence
  Synthetic
gctgaattttctggtgcaagagcaaaaaacattaaacaaggattacctgtacatataactccaggatctgggcaa

SEQ ID NO: 287604 - DNA, 75 bp, Artificial Sequence
  Synthetic
agtgcatgcaatccagcatgttgctagtcgtaatgagcaattgcgggatgggaccaactactttgggtgtccgtg

SEQ ID NO: 287605 - DNA, 75 bp, Artificial Sequence
  Synthetic
ccaagcttattctctcagtcggatttataacatgataatggaagaggacaagcgccgtaggaatgtggtagatgt

SEQ ID NO: 287606 - DNA, 75 bp, Artificial Sequence
  Synthetic
actggcagcttgagatttagcctcatgttttgtggaacagctggcaccacactcaaactactagttgcatacaca

SEQ ID NO: 287607 - DNA, 75 bp, Artificial Sequence
  Synthetic
ggaccaactactttgggtgtccgtgtttcactttttccttttatttgcttatggtgacaatatatatagtacata

SEQ ID NO: 287608 - DNA, 75 bp, Artificial Sequence
  Synthetic
tgtgtcaagttgataccttgattccagtcaataatgtgggtaacaatgttggaaatgtcagtatgtacactgtac

SEQ ID NO: 287609 - DNA, 75 bp, Artificial Sequence
  Synthetic
tactgtgaagacaataaatggatgttacctgcagattgtaaaatagagagagacttaaatcttgctaacagtata

SEQ ID NO: 287610 - DNA, 75 bp, Artificial Sequence
  Synthetic
taaattactttaaggatgctgcatcaagtggagcctcaaaacttgaattttctcaagatcctagcaaattcactg

SEQ ID NO: 287611 - DNA, 75 bp, Artificial Sequence
  Synthetic
ggtgttagttgttcccaatatcaatgagagtcaccctagtacttcaaattcagctcctgcattggacgctgcaga

SEQ ID NO: 287612 - DNA, 75 bp, Artificial Sequence
  Synthetic
caatcgaccatatcaatgattgtgccctgggttagtgctagtcatttcagaaacaccacaccagacaaattttca

SEQ ID NO: 287613 - DNA, 75 bp, Artificial Sequence
  Synthetic
caatcgaccatatcaatgattgtgccctgggttagtgctagtcatttcagaaacaccacaccagacaaattttct

SEQ ID NO: 287614 - DNA, 75 bp, Artificial Sequence
  Synthetic
caatcgaccatatcaatgattgtgccctgggttagtgctagtcatttcagaaacaccacaccagacaaattttcc

SEQ ID NO: 287615 - DNA, 75 bp, Artificial Sequence
  Synthetic
caatcgaccatatcaatgattgtgccctgggttagtgctagtcatttcagaaacaccacaccagacaaattttcg

SEQ ID NO: 287616 - DNA, 75 bp, Artificial Sequence
  Synthetic
gacaggacacacaagtactgttcaacctgaagacatgattgaaacacgatatgtccaaacatcacaaactagaga

SEQ ID NO: 287617 - DNA, 75 bp, Artificial Sequence
  Synthetic
ctattacacccattggactggcagtctgcgatttagttttatgttttgtgggactgcaaacacaacacttaaatt

SEQ ID NO: 287618 - DNA, 75 bp, Artificial Sequence
  Synthetic
ctaaaacaaagatcccagaaagaagggttgtagcacaaggccctgaagaagaatttggacgctccttgatcaaac

SEQ ID NO: 287619 - DNA, 75 bp, Artificial Sequence
  Synthetic
tgactccacaataacatctcaagatgtggctaatgcagttataggttatggagtctggccacactatctgagtgc

SEQ ID NO: 287620 - DNA, 75 bp, Artificial Sequence
  Synthetic
tcatggccaataagtataaaggagatggcacaaataagaagaaagtttgagcttttcacgtatgtgagatttgat

SEQ ID NO: 287621 - DNA, 75 bp, Artificial Sequence
  Synthetic
atatctcttgttgtaccatgggtgagtgccagccacttcaggttaactgcagataataaatactccatggctggt

SEQ ID NO: 287622 - DNA, 75 bp, Artificial Sequence
  Synthetic
agttcaagttgatgggataaacacaaatgttctagatgcctatgatttacacaacaaagatggaataaaacttga

SEQ ID NO: 287623 - DNA, 75 bp, Artificial Sequence
  Synthetic
tggtggtggaaattgccagatgcacttaaagatatgggcatatttggagaaaatatgtattatcattaccttggc

SEQ ID NO: 287624 - DNA, 75 bp, Artificial Sequence
  Synthetic
gcttttcacttcctttcttaagcatagcctcagcctattacatgttttatgatggttatgatggtgatgttcccg

SEQ ID NO: 287625 - DNA, 75 bp, Artificial Sequence
  Synthetic
tcagaaatcactctagtgccttgcatagcctctcaaaatagtgatattggacatgtagtgatgcagtacatgtat

SEQ ID NO: 287626 - DNA, 75 bp, Artificial Sequence
  Synthetic
aatgcaatgctagtaagtttcatcaaggaacattactggtagtgatgatacctgagcaccaactggcaagtgtag

SEQ ID NO: 287627 - DNA, 75 bp, Artificial Sequence
  Synthetic
tacgaatggcaagggatacagatttacacatacaaagtggtccaatagagcaaaatccagtagaaaactacattg

SEQ ID NO: 287628 - DNA, 75 bp, Artificial Sequence
  Synthetic
gtagcaaaccaagtagagccaactataataagtgtaggtgatgtaatctcatatggtaacatactactgagtgga

SEQ ID NO: 287629 - DNA, 75 bp, Artificial Sequence
  Synthetic
atatcacaaagctaaacatgtaaaggcatggtgcccacgaccccctagagctgtgggctacacacacacacatgt

SEQ ID NO: 287630 - DNA, 75 bp, Artificial Sequence
  Synthetic
tgacaattggctcaactttgatggcaccttactgggtaatgttcttatattcccacaccaatttatcaatttaag

SEQ ID NO: 287631 - DNA, 75 bp, Artificial Sequence
  Synthetic
caccagtaatgttcaaccagaagatgctatagagacaaggtatgttataacatcacaaacaagagatgagatgag

SEQ ID NO: 287632 - DNA, 75 bp, Artificial Sequence
  Synthetic
gcggtaatggaagagatggtttttctgcaatgctccttagatcatattttagtgaaactcaaggccaaataacat

SEQ ID NO: 287633 - DNA, 75 bp, Artificial Sequence
  Synthetic
catgttggaaacttaatatataggaatttacatctctttaattctgatgtccatgactctatcttagtgtcttac

SEQ ID NO: 287634 - DNA, 75 bp, Artificial Sequence
  Synthetic
agtgaattacaagcagagaatgccactaatgtcacggtccctattactgtatcaattagtccaatgtttgctgaa

SEQ ID NO: 287635 - DNA, 75 bp, Artificial Sequence
  Synthetic
aaaatcacactacaggaaatggcacagattaggagaaaatttgaattgtttacatatgtcaggtttgactcagaa

SEQ ID NO: 287636 - DNA, 75 bp, Artificial Sequence
  Synthetic
ggaaccagctgtattgtcagaaaaggacccacgacttagtgttgattttaaaacagctttattttctaaatacaa

SEQ ID NO: 287637 - DNA, 75 bp, Artificial Sequence
  Synthetic
ggtactacccaataaaagtgactagccatgattggtatgaaatacaagagagtgaatattatcccaaacacattc

SEQ ID NO: 287638 - DNA, 75 bp, Artificial Sequence
  Synthetic
catgcttggggaagcctttggtagtgggtttgtagacagtgttaaggatcaaattaatgcaataaatcctataaa

SEQ ID NO: 287639 - DNA, 75 bp, Artificial Sequence
  Synthetic
gaaacgatttctcatggcaatcaggcaccaatatgtcaatattctggcaacatggacagccatttcctagatttt

SEQ ID NO: 287640 - DNA, 75 bp, Artificial Sequence
  Synthetic
ttggaagatagtgtgtttgggaccgatggtcttgaagcactggacttaaatactagtgcaggatttccatatatc

SEQ ID NO: 287641 - DNA, 75 bp, Artificial Sequence
  Synthetic
aatcaccttcagccttaccatggtatcacccaaccaaagaaattttaattccaggagaagtaaaaaatttaatag

SEQ ID NO: 287642 - DNA, 75 bp, Artificial Sequence
  Synthetic
agcccagcaggtttttgccattaaagtggatattgcttcacaacctttagcaaatacaatgcttgggcaaattgc

SEQ ID NO: 287643 - DNA, 75 bp, Artificial Sequence
  Synthetic
tatgggtactatatgctcaagaatagttacagaaaaacagaaacattctgttgtcatcacaacacacatatatca

SEQ ID NO: 287644 - DNA, 75 bp, Artificial Sequence
  Synthetic
taacttttttaaaagatgaactcaggaaaaaagagaaaatttcagctggcaaaacaagagtgattgaggctagta

SEQ ID NO: 287645 - DNA, 75 bp, Artificial Sequence
  Synthetic
cttacattaataggttgttcagggtcaccatggcggtttcttaaagagaagttctgcaaatggacacaactgcat

SEQ ID NO: 287646 - DNA, 75 bp, Artificial Sequence
  Synthetic
ggtattgggaagccagaaactagaaaacaggctatgcttggtacacatatagtttgggatgttgggttgcaatca

SEQ ID NO: 287647 - DNA, 75 bp, Artificial Sequence
  Synthetic
acaacagccatagtccgcagaaacactataacaactgctgggcccagtgatctatatgtgcatgtaggtaactta

SEQ ID NO: 287648 - DNA, 75 bp, Artificial Sequence
  Synthetic
tccagaaacattttggtcgaagatccctgtgatgttagatggtgattgtataatggcctttgattacaccaatta

SEQ ID NO: 287649 - DNA, 75 bp, Artificial Sequence
  Synthetic
ttgaatggatgaagtccatgttacctcaggcccaattgaaagtcaagtaccttaatgaactgaaaaaattgagtt

SEQ ID NO: 287650 - DNA, 75 bp, Artificial Sequence
  Synthetic
cacaacttgtcttccctccaaacactccaaatacagctgatatgttgtgttttgtatcagcttgcaaagatttct

SEQ ID NO: 287651 - DNA, 75 bp, Artificial Sequence
  Synthetic
atgattatattcccaattgtaactgcactgaggctacttattattgtagacacaaaaataggtattacccaataa

SEQ ID NO: 287652 - DNA, 75 bp, Artificial Sequence
  Synthetic
catatttttaaggacacatattatgaggttgaaggtggtgtaccatcaggttgttctggaactagtatatttaat

SEQ ID NO: 287653 - DNA, 75 bp, Artificial Sequence
  Synthetic
tcttcctttgtatgctagtgaagcaaagaggatcaaggttctgtataataaatgcaataacataattaaacagaa

SEQ ID NO: 287654 - DNA, 75 bp, Artificial Sequence
  Synthetic
agttgtgcctaacatcagggagagccacccaagcacgtccaactctgcaccaatcttggatgctgctgagactgg

SEQ ID NO: 287655 - DNA, 75 bp, Artificial Sequence
  Synthetic
tgattgtggtggaaaacttctttgtagacatggtgtcattggcataatcacagcaggtggtgaaggtcatgtagc

SEQ ID NO: 287656 - DNA, 75 bp, Artificial Sequence
  Synthetic
tattttcttacaaatacaatttggacatggaagtaattgcagctgaaggacttaaatatgggttaactataacac

SEQ ID NO: 287657 - DNA, 75 bp, Artificial Sequence
  Synthetic
gacatttattcgctgccaccagatcccaaatattttgatggatatgaccagcagagtgtggttattatggatgat

SEQ ID NO: 287658 - DNA, 75 bp, Artificial Sequence
  Synthetic
tcaggatgtatacatgtttcaacaataaaagcaaatcaggcacatgacgccaagttcgataaatggaatgttaac

SEQ ID NO: 287659 - DNA, 75 bp, Artificial Sequence
  Synthetic
gttaaagaacaaataaatgcaataaatccaatcaataacattagtaagaaggttattaagtggctacttagaata

SEQ ID NO: 287660 - DNA, 75 bp, Artificial Sequence
  Synthetic
cccaacctttcctattcaggaaatacatgaatctattagatggactaagaaaccctcacaaatgcaggaacatgt

SEQ ID NO: 287661 - DNA, 75 bp, Artificial Sequence
  Synthetic
aaccatttgactctcgttttgtcttctgcagcacaaatcaatctctcctagccccaccaactatcacttcactct

SEQ ID NO: 287662 - DNA, 75 bp, Artificial Sequence
  Synthetic
atgatataggtcacatagttatgcagtacatgtatgtaccacctggagctccagtaccaaatgacagaaatcatt

SEQ ID NO: 287663 - DNA, 75 bp, Artificial Sequence
  Synthetic
tcaaagaaaagttttgcaaatggacccaattaacttatatccacaaagagtctgattcatggcttaagaaattca

SEQ ID NO: 287664 - DNA, 75 bp, Artificial Sequence
  Synthetic
atgtgatgtggacgcaaaaataggtaatgcaaaatgctgtccattcatatgtggtaaggctgtgtcttttaaaga

SEQ ID NO: 287665 - DNA, 75 bp, Artificial Sequence
  Synthetic
ttaaaactggatctgggttgttcccacccagatcacctacatggtgttgtacactattattacggtaattttgta

SEQ ID NO: 287666 - DNA, 75 bp, Artificial Sequence
  Synthetic
gagcgctggtcgcgcactgtatattcccccttacgaactccttcagcatgagtggtatgaaaaattttaattata

SEQ ID NO: 287667 - DNA, 75 bp, Artificial Sequence
  Synthetic
acactattattacggtaattttgtacgccagttttatatccccttccccaaatgtaacttagaagcaatgcaaac

SEQ ID NO: 287668 - DNA, 75 bp, Artificial Sequence
  Synthetic
catgttttatgatggttacaatggaggtgatcatacagcaacttatggcaccacagtggttaaccggatggggac

SEQ ID NO: 287669 - DNA, 75 bp, Artificial Sequence
  Synthetic
agttaaatacttgaatgaaataaagaaactcagtttgcttgaaaaacagattgaaaatctacgtgcggcagatag

SEQ ID NO: 287670 - DNA, 75 bp, Artificial Sequence
  Synthetic
tttcaaggaccaatcactatggatgccccaccaccacctgcaatagcagacttgttgcaatcagttagaacccca

SEQ ID NO: 287671 - DNA, 75 bp, Artificial Sequence
  Synthetic
ccaccaagagttgtcccatacaagtatgttggcctaactaattacacacttaaagaagaagatacagttgtggaa

SEQ ID NO: 287672 - DNA, 75 bp, Artificial Sequence
  Synthetic
ctttataataaatgttccaatataattaaacaaagaaagagaagtgaaccggtggcggtgatgatacatggacca

SEQ ID NO: 287673 - DNA, 75 bp, Artificial Sequence
  Synthetic
caaatgttattagtatagctggcattatttttgttatttataagctgttttgcacactccaaggtccatattctg

SEQ ID NO: 287674 - DNA, 75 bp, Artificial Sequence
  Synthetic
attcaatcctaatatcatattcatcagatttagtcatttatcgaacaaacaccacaggtaatgactatatcccta

SEQ ID NO: 287675 - DNA, 75 bp, Artificial Sequence
  Synthetic
gttatgacaatcagagtgttgtaatcatggatgatattatgcaaaatccagatggagaagacatgacactatttt

SEQ ID NO: 287676 - DNA, 75 bp, Artificial Sequence
  Synthetic
tgttaccacagataatggaaaatttacaggcttaggtatacatgataaaaccatgatcataccaacacatgctga

SEQ ID NO: 287677 - DNA, 75 bp, Artificial Sequence
  Synthetic
tgaatgtggctaaccttaaacctgcagccagtgcacacaaaccagtgtgtagctggtcgtaatgagcaattgcgg

SEQ ID NO: 287678 - DNA, 75 bp, Artificial Sequence
  Synthetic
tgcttatggtgacaatatatatagcacatatatattgttatcatgggcgctcaagtgtctagacagaatgttggt

SEQ ID NO: 287679 - DNA, 75 bp, Artificial Sequence
  Synthetic
tatcccatcaaagtcactagtcatgattggtatgagatacaagaaagtgaatactatccaaaacacatccagtat

SEQ ID NO: 287680 - DNA, 75 bp, Artificial Sequence
  Synthetic
aaattagacaggaatgaaaaatttagagacatacgaaaatacatcccagagaaggaagatgattacccagattgt

SEQ ID NO: 287681 - DNA, 75 bp, Artificial Sequence
  Synthetic
ctcgcttttagccccacctactatatcttcattacccgcaatgaatagaagatttttctttgacttagatattgt

SEQ ID NO: 287682 - DNA, 75 bp, Artificial Sequence
  Synthetic
tcaagtgtctagacagaatgttggtacacactcaacacaaaactcagtgtcaaatggctctagtctcaattattt

SEQ ID NO: 287683 - DNA, 75 bp, Artificial Sequence
  Synthetic
gtcatgtagcattcattgatctcaggcaattccattgtgcagatgaacaaggaataactgattacatccacatgt

SEQ ID NO: 287684 - DNA, 75 bp, Artificial Sequence
  Synthetic
aataacatgagtttggaggacagtgtgtttggctcagagggattagaagctctagacttaaacaccagtgcaggt

SEQ ID NO: 287685 - DNA, 75 bp, Artificial Sequence
  Synthetic
gaaaaaggtatccctactttgcaatctccctctgttgaagcttgtgggtattcagataggataattcaaatcacc

SEQ ID NO: 287686 - DNA, 75 bp, Artificial Sequence
  Synthetic
ccatttgtatgtggtaaggcagtgacattcaaagatcgcagcacttgctcaacatacaccttagctcaagtttac

SEQ ID NO: 287687 - DNA, 75 bp, Artificial Sequence
  Synthetic
tgttgatagtgtcaaggaacaaataaatgccattaacccaattaacaatattagcaagaaaataattaaatggct

SEQ ID NO: 287688 - DNA, 75 bp, Artificial Sequence
  Synthetic
atttacccatggttactttcctcaaagatgaacttagaaagaaagaaaagatatcttctgggaaaactcgtgtca

SEQ ID NO: 287689 - DNA, 75 bp, Artificial Sequence
  Synthetic
acaaaccaactcaaccagacacatcatcaaatagattttacaccttggacagtaaaatgtgggatagtaactcca

SEQ ID NO: 287690 - DNA, 75 bp, Artificial Sequence
  Synthetic
ctatagcagatctgttacaatcagttagaacacctgaggtaatcaagtactgtcaagataataaatgggtcattc

SEQ ID NO: 287691 - DNA, 75 bp, Artificial Sequence
  Synthetic
tggagatttcttaaagagaaattctgtaaatggacccaattaaattatatacataaggagtctgactcatggctt

SEQ ID NO: 287692 - DNA, 75 bp, Artificial Sequence
  Synthetic
agttggatgtgatccagaaaccttctggtcaaaaatccctgttatgttagatggtgagtgcataatggcttttga

SEQ ID NO: 287693 - DNA, 75 bp, Artificial Sequence
  Synthetic
tgtgcaatgcaatgctagcaaattccaccaaggcactttattggtgactatgataccagaacatcaattggccac

SEQ ID NO: 287694 - DNA, 75 bp, Artificial Sequence
  Synthetic
taaattgttttgttcattacaaggaccatactcaggtgaacctaaacctaaaaccaaagtacctgaaagaagagt

SEQ ID NO: 287695 - DNA, 75 bp, Artificial Sequence
  Synthetic
tggatgaaatctatgctccctcaagctcagcttaaggtaaaatacttaagtgagcttaaaaaattaagtttcctt

SEQ ID NO: 287696 - DNA, 75 bp, Artificial Sequence
  Synthetic
gcccaagaaggcagtaaatatggattaaccattacaccagctgacaaatctgaaactttcaagaagcttgattac

SEQ ID NO: 287697 - DNA, 75 bp, Artificial Sequence
  Synthetic
gatgacaattggctgaattttgatggcacacttttaggtaatttgttaatcttcccccatcaatttattaattta

SEQ ID NO: 287698 - DNA, 75 bp, Artificial Sequence
  Synthetic
catgacagaattctaatcatcccaacacatgctgatccaggtagagaggtccaagttaatggtgtccacactaag

SEQ ID NO: 287699 - DNA, 75 bp, Artificial Sequence
  Synthetic
cactttatgctagtgaagcaaagagaatcaagatattgcacaataagtgtagtacaataattaaacaaaggaaaa

SEQ ID NO: 287700 - DNA, 75 bp, Artificial Sequence
  Synthetic
gatggacaaagaaaccctcacaaatgcatgagcatgttctctcattgtgtcatctaatgtggcataatggctacg

SEQ ID NO: 287701 - DNA, 75 bp, Artificial Sequence
  Synthetic
tttgtcaacttcaaagtaacaatacatccaatattgtccccatcactgtttctattagtccaatgtttgctgagt

SEQ ID NO: 287702 - DNA, 75 bp, Artificial Sequence
  Synthetic
atatacctgaaacagaagacgattatccagaatgcaatttggcactttcagctaatcaagatgaaccaactataa

SEQ ID NO: 287703 - DNA, 75 bp, Artificial Sequence
  Synthetic
atactccttaccacctgaccccaaatattttgatggatatgaccaacaaagtgtggttataatggatgatgttat

SEQ ID NO: 287704 - DNA, 75 bp, Artificial Sequence
  Synthetic
aggcttatagagacttcgaacggaagatacgcagtgttagcgctggacgcgcactgtacatccctccctacgaag

SEQ ID NO: 287705 - DNA, 75 bp, Artificial Sequence
  Synthetic
aatgaggtgttagttgttcccaatatcaatgagagtcaccctagtacttcaaattcagctcctgcattggacgct

SEQ ID NO: 287706 - DNA, 75 bp, Artificial Sequence
  Synthetic
tgcattaccctggtatcacccaacaaaagagatttttataccaggcgaagttaagaatctaattgaaatgtgtca

SEQ ID NO: 287707 - DNA, 75 bp, Artificial Sequence
  Synthetic
tggaggggtactatataaaattggtcaaattctaggtattcatgtgggtggaaatggaagggatggtttttcagc

SEQ ID NO: 287708 - DNA, 75 bp, Artificial Sequence
  Synthetic
tttgactcacgatttgtactatgtagtactaatcataatatgttagcacctcccacaatcacttcattgccagcc

SEQ ID NO: 287709 - DNA, 75 bp, Artificial Sequence
  Synthetic
aacacattcagtataacctcttgattggtgaaggcccatgtgaaccaggagattgtggtgggaaacttctttgca

SEQ ID NO: 287710 - DNA, 75 bp, Artificial Sequence
  Synthetic
tattactcagtggaaatcaaactgcaagaatgcttaaatataactacccaactaaatcaggatactgtggggggg

SEQ ID NO: 287711 - DNA, 75 bp, Artificial Sequence
  Synthetic
aatgacacttgacatagactcaaataacatgagtttggaggacagtgtgtttggctcagagggattagaagctct

SEQ ID NO: 287712 - DNA, 75 bp, Artificial Sequence
  Synthetic
aacccaggctaattgataggttatgcaactccaagcacatatataaagactcatactatgaggttgaaggggggg

SEQ ID NO: 287713 - DNA, 75 bp, Artificial Sequence
  Synthetic
gtttttgcaattaaggtggatatcgcatcacatccactggccacaaccttaattggagagattgccagttacttc

SEQ ID NO: 287714 - DNA, 75 bp, Artificial Sequence
  Synthetic
accaaacttcagcctagtgtattttatgatgtcttcccaggctctaaggaaccagctgtgctcacagataatgac

SEQ ID NO: 287715 - DNA, 75 bp, Artificial Sequence
  Synthetic
gtatcagctgcctttcaaccctgtgatgtggatataaagattggaaatgctcgttgttgtccatttatctgtggc

SEQ ID NO: 287716 - DNA, 75 bp, Artificial Sequence
  Synthetic
ctcttgatatggaagcaattgcccaagaaggcagtaaatatggattaaccattacaccagctgacaaatctgaaa

SEQ ID NO: 287717 - DNA, 75 bp, Artificial Sequence
  Synthetic
aggtatcacagactatatacacatgcttggggaagcctttggtagtgggtttgtagacagtgttaaggatcaaat

SEQ ID NO: 287718 - DNA, 75 bp, Artificial Sequence
  Synthetic
ttgatgttatggcagcaattttccagggtcccattactcttgaagggcctccacctgcagcaataaatgatctat

SEQ ID NO: 287719 - DNA, 75 bp, Artificial Sequence
  Synthetic
actcagcacaattaatgacactagatattgattccaggccaatagcattggaagatagcgtgtttgggatagaag

SEQ ID NO: 287720 - DNA, 75 bp, Artificial Sequence
  Synthetic
aacccaaaaataggaaagaggcaatgttaggaacacatgttgtatgggatgtgggcttgcagtcaacagtatctt

SEQ ID NO: 287721 - DNA, 75 bp, Artificial Sequence
  Synthetic
tgttccaccgaatacaccaaacactgctgagatgttgtgttttgtatctggttgcaaggatttttgtttacgtat

SEQ ID NO: 287722 - DNA, 75 bp, Artificial Sequence
  Synthetic
caggcttaaagaggctctagataaatatggagttgacttacccatgatcactttcttaaaagacgagcttaggaa

SEQ ID NO: 287723 - DNA, 75 bp, Artificial Sequence
  Synthetic
caccatcatttcaattattgctaatatcatcagtatttctggaattatttatgtaatatataaacttttctgtac

SEQ ID NO: 287724 - DNA, 75 bp, Artificial Sequence
  Synthetic
aatatcaatgaaagtcaccctacaacatccaatgcagctcctgttctagatgcagctgaaaccggacatactagc

SEQ ID NO: 287725 - DNA, 75 bp, Artificial Sequence
  Synthetic
tttcatttaaacccaggcgttgttactggctctgcagtagggtgtgaccctgagactttctggtctaaaatccca

SEQ ID NO: 287726 - DNA, 75 bp, Artificial Sequence
  Synthetic
attaaacataattcatgtgttgtgtcaactcagaatggtaaatttacaggtttaggaatttatgatagaacacta

SEQ ID NO: 287727 - DNA, 75 bp, Artificial Sequence
  Synthetic
ttcatgagtctatactggatatcaaagaggattataacactcaaagttttactaagtggaaaatcaacttacaag

SEQ ID NO: 287728 - DNA, 75 bp, Artificial Sequence
  Synthetic
atttatctttccaatctaatttaattgatagattgtgttattccaagcacttgtttaaatcaacatattatgaag

SEQ ID NO: 287729 - DNA, 75 bp, Artificial Sequence
  Synthetic
agctggagatcacagtcttaaaacttaagaggaatgagaagttcaaggacattagaaaatacataccagaaaatg

SEQ ID NO: 287730 - DNA, 75 bp, Artificial Sequence
  Synthetic
aagtggtaatcagactgctagaatgcttaaatataattacccaacaaaatcaggttactgtggtggtattttgta

SEQ ID NO: 287731 - DNA, 75 bp, Artificial Sequence
  Synthetic
tattgatctggacaagcttaaaataattgcatatggtgatgatgtgattttctcttataaatatactctagatat

SEQ ID NO: 287732 - DNA, 75 bp, Artificial Sequence
  Synthetic
tggtcacatagtcatgcaatatatgtatgtaccaccaggggcacctattccaacaaccagagaagattatgcttg

SEQ ID NO: 287733 - DNA, 75 bp, Artificial Sequence
  Synthetic
tggtggtggaaattacctgatgctttaaaggacatgggaatatttggacaaaatatgtattaccactttcttggt

SEQ ID NO: 287734 - DNA, 75 bp, Artificial Sequence
  Synthetic
tatgatgggtatgatggagacacttaccaatccagatacgggactgtggttaccaatgatatggggacactgtgt

SEQ ID NO: 287735 - DNA, 75 bp, Artificial Sequence
  Synthetic
cttaaacgtggttttaagcaagatgaaagacatacattccttattcatcctacattcccagtggaagagatacat

SEQ ID NO: 287736 - DNA, 75 bp, Artificial Sequence
  Synthetic
ataattacttccaaatctacaagtgaatgtggtctgcctagcattcacacaccaagcaaaaccaagttgcagcct

SEQ ID NO: 287737 - DNA, 75 bp, Artificial Sequence
  Synthetic
aaaggggcaatgttactgctggatacaatttcacacatcctggtgagcctggtagagaggttggaaaacccaatc

SEQ ID NO: 287738 - DNA, 75 bp, Artificial Sequence
  Synthetic
gagctgtacaatacacacacacccatgtgactaattacaaactagaaacagatgttcacaccagtgtagccataa

SEQ ID NO: 287739 - DNA, 75 bp, Artificial Sequence
  Synthetic
tctctagtaagatacgcagtgtcagcgctggacgtgcactgtatatcccaccttatgatctgttgaaacatgaat

SEQ ID NO: 287740 - DNA, 75 bp, Artificial Sequence
  Synthetic
aatataaaggtaacaatcagtgtactatgaatgatcatatcagggtggccatctcccattattcagcacaactga

SEQ ID NO: 287741 - DNA, 75 bp, Artificial Sequence
  Synthetic
cgctggacgtgcactgtatatcccaccttatgatctgttgaaacatgaatggtatgaaaaattttagatatagaa

SEQ ID NO: 287742 - DNA, 75 bp, Artificial Sequence
  Synthetic
ttaaaactggatcatggttgttcccaccatgattacctacgggtgtagtatacttgtatcccggtacatttatac

SEQ ID NO: 287743 - DNA, 75 bp, Artificial Sequence
  Synthetic
gccagttttataacccccaccccaaatgtaacttagaagcatgtacacaatgatcaatagggtggtggctatcca

SEQ ID NO: 287744 - DNA, 75 bp, Artificial Sequence
  Synthetic
tgactccatcttggtctcttactcatcagatttagtcatataccgaacaaacacacaaggtgatgattatatccc

SEQ ID NO: 287745 - DNA, 75 bp, Artificial Sequence
  Synthetic
ttacatatccatgggtatcaagaaaagagatttaatcaacaaacaaactaaggatgtgacaaaactcaaaatggc

SEQ ID NO: 287746 - DNA, 75 bp, Artificial Sequence
  Synthetic
agtcatctaagatcaagcacttctgtctccccggtgagtgtgaatatgctttacccaaggcaaaagctaatctca

SEQ ID NO: 287747 - DNA, 75 bp, Artificial Sequence
  Synthetic
agagatatctatacctggacaggtaagaaacttaatagaaatgtgtcaagtagataccatcatacctataaacaa

SEQ ID NO: 287748 - DNA, 75 bp, Artificial Sequence
  Synthetic
gagtattacccaaaacacattcagtacaatctgttgataggtgagggaccatgtgagccaggtgattgtggtggg

SEQ ID NO: 287749 - DNA, 75 bp, Artificial Sequence
  Synthetic
tgctggaaagactcgtgtgattgaagccagtagtgtaaatgatactatactgttcaggacaacttttggcaatct

SEQ ID NO: 287750 - DNA, 75 bp, Artificial Sequence
  Synthetic
agaaacttaatagaaatgtgtcaagtagataccatcatacctataaacaacactggaaccaacactacgagcatt

SEQ ID NO: 287751 - DNA, 75 bp, Artificial Sequence
  Synthetic
gggctaggcatacctcactggtaacagtggcctagcccgcgtggctgcctgcacaccttcgggtgtgaagccata

SEQ ID NO: 287752 - DNA, 75 bp, Artificial Sequence
  Synthetic
gaatgtataatggcttttgattacacaaattatgatggaagtatacaccctatctggttccaagctttaaaggaa

SEQ ID NO: 287753 - DNA, 75 bp, Artificial Sequence
  Synthetic
aagggataactgattacatacacatgcttggtgaagcttttggaagtggatttgtagacagtgttaaagagcaga

SEQ ID NO: 287754 - DNA, 75 bp, Artificial Sequence
  Synthetic
tgtctatggtcgtaatgggtaactacgggatggaaccaactactttgggtgtccgtgtttcttgtttttctttaa

SEQ ID NO: 287755 - DNA, 75 bp, Artificial Sequence
  Synthetic
cagctttaatagatagactgtgtagatctaagcatatttttaaaaatacatattatgaggttgaaggaggaatcc

SEQ ID NO: 287756 - DNA, 75 bp, Artificial Sequence
  Synthetic
tccacaaactataattgccactcttacactaattggatgcaatggctcaccatggagatttcttaaagagaaatt

SEQ ID NO: 287757 - DNA, 75 bp, Artificial Sequence
  Synthetic
cggtttgcagtcaactatatccatggtggtgccctgggttagtgctagtcattttagaaacacaaccccggataa

SEQ ID NO: 287758 - DNA, 75 bp, Artificial Sequence
  Synthetic
cttataaaaacattgatttggacaaattaaagattctagcctatggggatgatgtgatcttttcttataaatatc

SEQ ID NO: 287759 - DNA, 75 bp, Artificial Sequence
  Synthetic
aatggctcaagtctgaattattttaacatcaactacttcaaagatgcagcatcaagtggagcgtcaagattggat

SEQ ID NO: 287760 - DNA, 75 bp, Artificial Sequence
  Synthetic
ggcaacaaaatttctaagtttattgattggatgaaatccatgctacctcaggcccaacttaaggttaagtatttg

SEQ ID NO: 287761 - DNA, 75 bp, Artificial Sequence
  Synthetic
tgtgacatttttgaaaaggggatttagacaggatgaaaaacataattttctaatacaccctacatttccagtaga

SEQ ID NO: 287762 - DNA, 75 bp, Artificial Sequence
  Synthetic
cagacaggataatacagataacaagaggaaactcaacaataacatcacaagatgtagcaaatgcagttgttgggt

SEQ ID NO: 287763 - DNA, 75 bp, Artificial Sequence
  Synthetic
tacatgatttatcttgtaaatttctacccttgtatgctagtgaagcaaaaaggattaaagtgttgtaccataaat

SEQ ID NO: 287764 - DNA, 75 bp, Artificial Sequence
  Synthetic
tacaagcagtttgaggatcggatacgtagtgtcagcgccggtcgtgcactatatatccctccttatgacttgctt

SEQ ID NO: 287765 - DNA, 75 bp, Artificial Sequence
  Synthetic
tacaagctgtttgaggatcggatacgtagtgtcagcgccggtcgtgcactatatatccctccttatgacttgctt

SEQ ID NO: 287766 - DNA, 75 bp, Artificial Sequence
  Synthetic
tacaagccgtttgaggatcggatacgtagtgtcagcgccggtcgtgcactatatatccctccttatgacttgctt

SEQ ID NO: 287767 - DNA, 75 bp, Artificial Sequence
  Synthetic
tacaagcggtttgaggatcggatacgtagtgtcagcgccggtcgtgcactatatatccctccttatgacttgctt

SEQ ID NO: 287768 - DNA, 75 bp, Artificial Sequence
  Synthetic
taaagagtggaaaagtgactctaagggatggtggtggaaactaccggatgccctcaagaacatgggaatttttgg

SEQ ID NO: 287769 - DNA, 75 bp, Artificial Sequence
  Synthetic
gtagtgtcagcgccggtcgtgcactatatatccctccttatgacttgcttttgcatgagtggtacgaaaaatttt

SEQ ID NO: 287770 - DNA, 75 bp, Artificial Sequence
  Synthetic
taggatgattaccaatgagagtgacatatactcactcccgccagacccaaaatactttgatgggtacgacaacca

SEQ ID NO: 287771 - DNA, 75 bp, Artificial Sequence
  Synthetic
acactattattacggtaattttgtacgccagttttatgatcccctcccccttttgtaacttagaagttaaacaaa

SEQ ID NO: 287772 - DNA, 75 bp, Artificial Sequence
  Synthetic
atatactcactcccgccagacccaaaatactttgatgggtacgacaaccagagtgtggtaataatggatgacatc

SEQ ID NO: 287773 - DNA, 75 bp, Artificial Sequence
  Synthetic
atcccagaacatcagttggcatacataggatcagagaatgttagtgtaggatacaaacacacacaccctggggaa

SEQ ID NO: 287774 - DNA, 75 bp, Artificial Sequence
  Synthetic
gattgtcaaaggtcaagcacttctgtttccccggtcaaagctgatatgctccaacagggcaaaaacagctgagat

SEQ ID NO: 287775 - DNA, 75 bp, Artificial Sequence
  Synthetic
ctttcgattccaggtttgtgctatgtagtaccaaccactctctcctagctcctccaactatatcatcactaccag

SEQ ID NO: 287776 - DNA, 75 bp, Artificial Sequence
  Synthetic
tcttcccacatcagtttattaatttgaggagtaacaactcagccaccttaattctaccttatgtcaatgctgttc

SEQ ID NO: 287777 - DNA, 75 bp, Artificial Sequence
  Synthetic
tgacactaatttgaaaattgggaatgcaaaatgctgtccatttgtgtgcggtaaagcagtgatgttcaaagaccg

SEQ ID NO: 287778 - DNA, 75 bp, Artificial Sequence
  Synthetic
ctcactttgagtcctccggcccctgaatgtggctaaccttaaccctgcagctagtgcatgcaatccagtatgtat

SEQ ID NO: 287779 - DNA, 75 bp, Artificial Sequence
  Synthetic
atcaataagtcctatggcttcagagttttcaggtgctcgaaacacatccagacaaggtctaccagttatgctcac

SEQ ID NO: 287780 - DNA, 75 bp, Artificial Sequence
  Synthetic
caaggtcctatatcaatggacaaacccccaccaccggccataacagatctattacggtcagtgaggacacctgaa

SEQ ID NO: 287781 - DNA, 75 bp, Artificial Sequence
  Synthetic
atatattgacaccatgggcgcccaggtatctagacagaatgttggtacacactcaactcaaaatgtggtttctag

SEQ ID NO: 287782 - DNA, 75 bp, Artificial Sequence
  Synthetic
atatattgactccatgggcgcccaggtatctagacagaatgttggtacacactcaactcaaaatgtggtttctag

SEQ ID NO: 287783 - DNA, 75 bp, Artificial Sequence
  Synthetic
atatattgaccccatgggcgcccaggtatctagacagaatgttggtacacactcaactcaaaatgtggtttctag

SEQ ID NO: 287784 - DNA, 75 bp, Artificial Sequence
  Synthetic
atatattgacgccatgggcgcccaggtatctagacagaatgttggtacacactcaactcaaaatgtggtttctag

SEQ ID NO: 287785 - DNA, 75 bp, Artificial Sequence
  Synthetic
actaatctatcagaaatttgccaagtagattcaatgatcccaattaacaacacagtggcgagtcataaaagggta

SEQ ID NO: 287786 - DNA, 75 bp, Artificial Sequence
  Synthetic
ccccaccaccggccataacagatctattacggtcagtgaggacacctgaagtgatcaagtactgtcaagataaca

SEQ ID NO: 287787 - DNA, 75 bp, Artificial Sequence
  Synthetic
gatccagtcaaagatgtactagagaaaggcattcccactcttcaatccccaacggtcgaagcgtgtggatactct

SEQ ID NO: 287788 - DNA, 75 bp, Artificial Sequence
  Synthetic
atatataatttataaacttttctgtacactgcaaggaccatattcaggagaacctaaacctaaaacaaaagttcc

SEQ ID NO: 287789 - DNA, 75 bp, Artificial Sequence
  Synthetic
ttggagaaatagctagctattacacacactggacaggttctattagattctctttcatgttttgtggtacagcta

SEQ ID NO: 287790 - DNA, 75 bp, Artificial Sequence
  Synthetic
cacaggatgccaccgcaatagacaaaccatcacaacctgacacatcatctaatagattttatacattagagagta

SEQ ID NO: 287791 - DNA, 75 bp, Artificial Sequence
  Synthetic
ggacttggtatatatgataaaatcttaataataccaacacatgctgatccaggtagtgaaattcaagtgaatggt

SEQ ID NO: 287792 - DNA, 75 bp, Artificial Sequence
  Synthetic
tggcttacagtccactgtatcaatggtggttccctgggtttccgcaagtcactataggcttaccacacctgatac

SEQ ID NO: 287793 - DNA, 75 bp, Artificial Sequence
  Synthetic
aagaagtggttatacagtccatgtccaatgcaattctagcaaatttcaccagggcacattgatagtagcaatgat

SEQ ID NO: 287794 - DNA, 75 bp, Artificial Sequence
  Synthetic
atatacgcaagtatattccagaaacagaagatgattatccagagtgtaatttggcattggtagcaaatcaacctg

SEQ ID NO: 287795 - DNA, 75 bp, Artificial Sequence
  Synthetic
tgcaaggatttctgtttgaggatggctagagacacaaacctacattcccaaactgtcaatatcacacaaaatcca

SEQ ID NO: 287796 - DNA, 75 bp, Artificial Sequence
  Synthetic
cgtttgcatccaagtaaacaacctagtgatgacaattggttaaatttcgatggcacattgctaggaaatataacc

SEQ ID NO: 287797 - DNA, 75 bp, Artificial Sequence
  Synthetic
atctggatactgtggtggtgttttatacaaaattggtctggttttgggcatacacgtgggtggaaatggaaggga

SEQ ID NO: 287798 - DNA, 75 bp, Artificial Sequence
  Synthetic
ctgctgagactggtcacaccagccaaacacaaccagaagacacagtggaaaccaggtatgtcatcacagatcaaa

SEQ ID NO: 287799 - DNA, 75 bp, Artificial Sequence
  Synthetic
tacacgtgggtggaaatggaagggatgggttttcatctatgcttttgagatcttatttcactgagcaacagggcc

SEQ ID NO: 287800 - DNA, 75 bp, Artificial Sequence
  Synthetic
acaattggagtttggttataatccccatctgtcctttagaagttagtactactggaactaatggtatacctataa

SEQ ID NO: 287801 - DNA, 75 bp, Artificial Sequence
  Synthetic
ggataaaaatttcactaaatggaagattaccttaaaagagatggcacaaatcagaaggaaatgtgaattgttcac

SEQ ID NO: 287802 - DNA, 75 bp, Artificial Sequence
  Synthetic
aggtagtaaggaaccggctgtcctgacagataaagaccctagattaaaggtggattttgaaacagcattattttc

SEQ ID NO: 287803 - DNA, 75 bp, Artificial Sequence
  Synthetic
tacagatgatttccaatcaccttgtgcactaccatggttccaccccacaaaggagatttcaatacctggtgaagt

SEQ ID NO: 287804 - DNA, 75 bp, Artificial Sequence
  Synthetic
gctccaatatatgtttgttccaccaggggctccaatccctacaaaaagagatgattacacatggcagtctggcac

SEQ ID NO: 287805 - DNA, 75 bp, Artificial Sequence
  Synthetic
ccagtaacactagaagatagtgtatttggaatggatggtttggaggctctagacctcaatactagtgctggttat

SEQ ID NO: 287806 - DNA, 75 bp, Artificial Sequence
  Synthetic
agacaagatgaactaatgcaagaggtctttgctataagggttgatgtggcatcgcaaccgcttgcaacaacatta

SEQ ID NO: 287807 - DNA, 75 bp, Artificial Sequence
  Synthetic
gaggatgatacaccaaattcaaaatatggtgcagttgtaacaaatgacatgggaacattgtgtgtgcgtattgta

SEQ ID NO: 287808 - DNA, 75 bp, Artificial Sequence
  Synthetic
tacctatgattaccttcttgaaagatgagcttaggaaaaaagataaaatatctgcaggcaaaactagggttatag

SEQ ID NO: 287809 - DNA, 75 bp, Artificial Sequence
  Synthetic
acctccaatggctgacttacccgataagggaaaaccttttgactccagatttgttttttgtagtaccaaccactc

SEQ ID NO: 287810 - DNA, 75 bp, Artificial Sequence
  Synthetic
catacacacccccaggcatagcaaaacccaaaagtaggaaagaagcaatgttgggaacccatattgtatgggatg

SEQ ID NO: 287811 - DNA, 75 bp, Artificial Sequence
  Synthetic
atcagcgtgtacataataccaactttgttccagcaacaggacaagtagagatacagatacctacaagagcagatc

SEQ ID NO: 287812 - DNA, 75 bp, Artificial Sequence
  Synthetic
gggttgtgatccagaaactttttggtccaaaataccgctcatgttagatggagactgtatcatggcctttgatta

SEQ ID NO: 287813 - DNA, 75 bp, Artificial Sequence
  Synthetic
tacaaattatgatggaagtatacacccagtttggttcaaagctttgagaatggtacttgacaatttatcctttaa

SEQ ID NO: 287814 - DNA, 75 bp, Artificial Sequence
  Synthetic
atgctggtatcaaactaatcttgtgtttcctccagataccccaaccactgctagaatgctttgcttcgtatctgg

SEQ ID NO: 287815 - DNA, 75 bp, Artificial Sequence
  Synthetic
aatttgttactccagtgatttagtcatataccgaacaaatactaaaggtgatgattacattccagtgtgcaactg

SEQ ID NO: 287816 - DNA, 75 bp, Artificial Sequence
  Synthetic
atatttaattctatgattaataatataattattagaactctagttctggatgcatataaacatattgatcttgat

SEQ ID NO: 287817 - DNA, 75 bp, Artificial Sequence
  Synthetic
ttaaacgaagtccttgtggttccaaacattagggagagccaacccactacttctaattctgctccagcattggat

SEQ ID NO: 287818 - DNA, 75 bp, Artificial Sequence
  Synthetic
aaacacatacaatataatatattaattggagaagggccatgcactcctggagactgtggaggaaaattgctatgt

SEQ ID NO: 287819 - DNA, 75 bp, Artificial Sequence
  Synthetic
ccattacacctgcagacaaatctactgaatttaaagaactggattacaaaaatgtaacttttcttaagaggggat

SEQ ID NO: 287820 - DNA, 75 bp, Artificial Sequence
  Synthetic
gcttcctcggcagatctggatgtattcatatttccaaattagaaattgactatagtaactacaatgaggagaata

SEQ ID NO: 287821 - DNA, 75 bp, Artificial Sequence
  Synthetic
attatatacacacacttggagaggcatttggtgcaggctttgtagataacattaaagatcagatacaggctataa

SEQ ID NO: 287822 - DNA, 75 bp, Artificial Sequence
  Synthetic
ggaacatgtcttatcattgtgtcacttaatgtggcataatggccctgagatctatagggattttgaaacaaagat

SEQ ID NO: 287823 - DNA, 75 bp, Artificial Sequence
  Synthetic
ggtcccatgcatagcagcaaaaaatgatggcataggtcatgttgtcatgcaatacatgtatgtccccccaggagc

SEQ ID NO: 287824 - DNA, 75 bp, Artificial Sequence
  Synthetic
tgttgcaactttagccttgattggttgctctggttcaccatggagatttattaaagaaaaagtgtgtaattggtt

SEQ ID NO: 287825 - DNA, 75 bp, Artificial Sequence
  Synthetic
acgcagtgtcagcgctggtcgcgcactgtacatcccaccctatgatcttctgagacatgaatggtatgaaaaatt

SEQ ID NO: 287826 - DNA, 75 bp, Artificial Sequence
  Synthetic
tttctaagtattgcatctgcctactacatgttttatgatggttatgatggtcactcaactgaatcacattatggg

SEQ ID NO: 287827 - DNA, 75 bp, Artificial Sequence
  Synthetic
tcaaagtttattgactggctcaaatcaatgctaccacaagctaaactcaaagttgacttcattgggaaactcaag

SEQ ID NO: 287828 - DNA, 75 bp, Artificial Sequence
  Synthetic
agcatgttaaggcttggtgtccaagacctccaagggcagttgaatatagacacacacatgtaaacaactatagac

SEQ ID NO: 287829 - DNA, 75 bp, Artificial Sequence
  Synthetic
ccaataaatttctgcctctgtatgcacttgagaataaaagaatcaaagagttacttaaaagaagtgaaatgattc

SEQ ID NO: 287830 - DNA, 75 bp, Artificial Sequence
  Synthetic
aatatatagaaatttacatttgtttaactcagaaattagtgattctgttttagtttcttactcatcggatttagt

SEQ ID NO: 287831 - DNA, 75 bp, Artificial Sequence
  Synthetic
cacagaatctgacatatattcactaccaccatcaccaaaatactttgatggctatgaccagcaaagtgttgttat

SEQ ID NO: 287832 - DNA, 75 bp, Artificial Sequence
  Synthetic
aaagttaccagccatgattggtatgaaattcaggaaagtgagtattacccaaaacatatacaatacaacttatta

SEQ ID NO: 287833 - DNA, 75 bp, Artificial Sequence
  Synthetic
gacaaagggaaacctttctcctcagattatgtactagctagtacgaaccacaccttgctacatcctccaactata

SEQ ID NO: 287834 - DNA, 75 bp, Artificial Sequence
  Synthetic
cgtttatagatctacgccacttccattgtgcagaggagcaaggaatcactgattacatacatatgcttggagaag

SEQ ID NO: 287835 - DNA, 75 bp, Artificial Sequence
  Synthetic
cacttaaaccatgccaggatggtaaaattggaaatgcaaaatgttgccccctgatatgtggaaaagctgtagtgt

SEQ ID NO: 287836 - DNA, 75 bp, Artificial Sequence
  Synthetic
gacattgcaaatgcagttgttggttatggtgtatggccatcatacctaaccccagatgatgcaactgccattgat

SEQ ID NO: 287837 - DNA, 75 bp, Artificial Sequence
  Synthetic
ctcttaagaacatgggcatatttggtgagaatatgttttaccactttctaggaagatctggatatacaatacatg

SEQ ID NO: 287838 - DNA, 75 bp, Artificial Sequence
  Synthetic
aatttcagcaatggtgataataattagaaattcttcggaccctcaaacaattgtagccacactaacattaatagg

SEQ ID NO: 287839 - DNA, 75 bp, Artificial Sequence
  Synthetic
ggcaatttttcaaggcccaattgatgtagttaataaaccacccccacctgccatattggatcttctcaaatcagt

SEQ ID NO: 287840 - DNA, 75 bp, Artificial Sequence
  Synthetic
acagaaatgtgtaatgcagctagaggtcttgagtggattggtaataaaatatctaaatttattgattggatgaaa

SEQ ID NO: 287841 - DNA, 75 bp, Artificial Sequence
  Synthetic
tccatgattgctaatgttatcagtataatgggggttatatatattatatacaagttgttttgctcattacaggga

SEQ ID NO: 287842 - DNA, 75 bp, Artificial Sequence
  Synthetic
caaggtagagaagtggtgccatcacgaaattctgatgataacaaaaggcctagtgatgatagttggctaaatttt

SEQ ID NO: 287843 - DNA, 75 bp, Artificial Sequence
  Synthetic
ctaatacacaagaaaaaattaaattagaaattgacacactacatgatttgtcctgtaaatttctccctctatatg

SEQ ID NO: 287844 - DNA, 75 bp, Artificial Sequence
  Synthetic
acagctgtgtggtcactacatgtaatggaaagttcacagggttagggatatatgataatgtcatgattataccca

SEQ ID NO: 287845 - DNA, 75 bp, Artificial Sequence
  Synthetic
accaggaacaggcaaatctataacaaccagtttccttgcaaggatgataaccaatgagagtgatatttattcatt

SEQ ID NO: 287846 - DNA, 75 bp, Artificial Sequence
  Synthetic
aacagtccttaaacttaaaaggaatgaaaaatttagagacattagaaaatacataccagaaacagaagatgacta

SEQ ID NO: 287847 - DNA, 75 bp, Artificial Sequence
  Synthetic
tgtcagatggtatcaagtgtggcatttatacctccaatggctgatcttccagataaaggtaaaccatttgactct

SEQ ID NO: 287848 - DNA, 75 bp, Artificial Sequence
  Synthetic
caaactgcaaggatgatcaaatacaactacccaactaaatcagggtattgtgggggtattttatacaaaataggt

SEQ ID NO: 287849 - DNA, 75 bp, Artificial Sequence
  Synthetic
agaatgggatacgcagcgtcagcgctggacgtgcgttgtatatcccaccttatgagctcctgttgcatgaatggt

SEQ ID NO: 287850 - DNA, 75 bp, Artificial Sequence
  Synthetic
tggacgtgcgttgtatatcccaccttatgagctcctgttgcatgaatggtatgaaaaattttaaattctgtatat

SEQ ID NO: 287851 - DNA, 75 bp, Artificial Sequence
  Synthetic
actctactattccggtagttttgtacaccagttttatctcccttccccgtgtaacttagaagacaagcacttcag

SEQ ID NO: 287852 - DNA, 75 bp, Artificial Sequence
  Synthetic
acttttgcttaagattagctagggataccaatctacacatgcaagaaggggtgcttacacaaaacccagttgaaa

SEQ ID NO: 287853 - DNA, 75 bp, Artificial Sequence
  Synthetic
agaaggatgtcaaggaaatcaatttatatagtatacacacacctagtaagacaaaactacaacctagtgtttttc

SEQ ID NO: 287854 - DNA, 75 bp, Artificial Sequence
  Synthetic
cagttcatgataattataaggataatctgggtaaactggatgtgccaaaggcattcaaaccatgtgatgttgaca

SEQ ID NO: 287855 - DNA, 75 bp, Artificial Sequence
  Synthetic
ttatccgcaaagtgcctacgcaaagcttagtaacactttgaagaatgtgtggttggtcgttccgctattccccat

SEQ ID NO: 287856 - DNA, 75 bp, Artificial Sequence
  Synthetic
aactggacatactagctccgtccaaccagaggatatgattgaaaccaggtatgttataactgatcaaacaagaga

SEQ ID NO: 287857 - DNA, 75 bp, Artificial Sequence
  Synthetic
taataagaatgttgagctgactgataacatggtcacagctgctgctcactatgcagcacaattagctactctaga

SEQ ID NO: 287858 - DNA, 75 bp, Artificial Sequence
  Synthetic
taatttaattatagaagaggataagcgccgtagaaatgttgttgatgttatgtcggcaattttccagggccctat

SEQ ID NO: 287859 - DNA, 75 bp, Artificial Sequence
  Synthetic
ctcactttgagtcctccggcccctgaatgtggctaaccttaaccctgcagctagtgcatgcaatccagcatgtct

SEQ ID NO: 287860 - DNA, 75 bp, Artificial Sequence
  Synthetic
ccagcagattgcaaaatagaacgtgatttaaacttagcaaataatataacaacaatcatagcaaacattattagt

SEQ ID NO: 287861 - DNA, 75 bp, Artificial Sequence
  Synthetic
catggaattaagaagaaagatttgataccaaaggacaggaatcttgcaaaacttaaatgtgctatggaaaaatat

SEQ ID NO: 287862 - DNA, 75 bp, Artificial Sequence
  Synthetic
agatttgattcagaaatcacaatagtcaccgcagcagcagtacaaggagatgacagtgggcatgtagtattgcaa

SEQ ID NO: 287863 - DNA, 75 bp, Artificial Sequence
  Synthetic
atatatattgacaccatgggcgcacaagtttctagacagaatgttggcacacactccacacagaatgcagttaca

SEQ ID NO: 287864 - DNA, 75 bp, Artificial Sequence
  Synthetic
tagtagcacagggaccagaagaagaatttggtcggtcacttattaaacataactcatgtgtggtaaccacctcaa

SEQ ID NO: 287865 - DNA, 75 bp, Artificial Sequence
  Synthetic
atgacactgtacagttcagaatggtttttggaaatctcttttcaacctttcataagaatccaggaactattactg

SEQ ID NO: 287866 - DNA, 75 bp, Artificial Sequence
  Synthetic
ctgatccggttaaagatgttctaacaaagggtataccaactctacaatctccttcagttgaggcgtgtgggtact

SEQ ID NO: 287867 - DNA, 75 bp, Artificial Sequence
  Synthetic
agtacaagattcttatgatttatacaataaggatggggtaaagctagagatcacagttcttaaacttaagagaaa

SEQ ID NO: 287868 - DNA, 75 bp, Artificial Sequence
  Synthetic
cagtcttcacccgatctggtttgagttacttaaaaagattttggatgaactagggttcccaggggatatggttag

SEQ ID NO: 287869 - DNA, 75 bp, Artificial Sequence
  Synthetic
tagtgatgatgctagtgctatagataaaccaacccatccagacacttcatctaaccggttctacacactagaaag

SEQ ID NO: 287870 - DNA, 75 bp, Artificial Sequence
  Synthetic
attagtgttggagatgtcgtgtcatatggcaacatcttacttagtgggaatcagacagcaagaatgcttaaatac

SEQ ID NO: 287871 - DNA, 75 bp, Artificial Sequence
  Synthetic
ataaataatgtcataatcagaactctagttttagatacatacaagcacataaacctagataaattaaagatacta

SEQ ID NO: 287872 - DNA, 75 bp, Artificial Sequence
  Synthetic
ggtagggctgggtacaccatacatgtgcagtgtaatgctagtaaattccaccagggcactttgatagtagtggct

SEQ ID NO: 287873 - DNA, 75 bp, Artificial Sequence
  Synthetic
ctatgttactaagatcttacttcacagaagcacaaggccaaataaccaccaccaaaactactgctgagtgtaact

SEQ ID NO: 287874 - DNA, 75 bp, Artificial Sequence
  Synthetic
acaaatcagataagttccaaaaactcacttatgagaatgccacttttctcaaaaggggttttaaaccagatgaga

SEQ ID NO: 287875 - DNA, 75 bp, Artificial Sequence
  Synthetic
aaaacgtcccacgcaataggcagcccagtgatgaaaattggcttaactgcaatggtaccttgttaggtaatttaa

SEQ ID NO: 287876 - DNA, 75 bp, Artificial Sequence
  Synthetic
ccctagattaaagactaactttaaagaagctttgttctctaagtataaaggaaataaccagtgtgagattaatga

SEQ ID NO: 287877 - DNA, 75 bp, Artificial Sequence
  Synthetic
actgtgtcatttattatggcatagtggaagagacaaatatgaccagtttgtggccaagattaggagtgttagcgc

SEQ ID NO: 287878 - DNA, 75 bp, Artificial Sequence
  Synthetic
tggtcgtgcactctatataccaccatacgaactcttgtgccacgagtggtatgataagttctaatcagatataga

SEQ ID NO: 287879 - DNA, 75 bp, Artificial Sequence
  Synthetic
caataactggagcttagtgattattcctgtttgtccactggaagttgcagttgggtcagaacagtatgtaccaat

SEQ ID NO: 287880 - DNA, 75 bp, Artificial Sequence
  Synthetic
ggactagaagcacttgatctcaacactagtgctggatttccctatgtctccatgggtattaagaaaagggatctg

SEQ ID NO: 287881 - DNA, 75 bp, Artificial Sequence
  Synthetic
acactattattacggtaatcttgtacgccagttttataatccccttacccaagtaacttagaagataaacacaaa

SEQ ID NO: 287882 - DNA, 75 bp, Artificial Sequence
  Synthetic
tgataataatggtaagaaacagttctgaccctcaaactataattgctacccttaccctcttaggctgttcaggtt

SEQ ID NO: 287883 - DNA, 75 bp, Artificial Sequence
  Synthetic
gaccaataggagatgatcatccagatcatcataggtcaagcacttctgtttccccggtcaaggttgatatgctct

SEQ ID NO: 287884 - DNA, 75 bp, Artificial Sequence
  Synthetic
acaactgatgatactcagtcaccatcagcattaccatacttccaccctactaaagaaatattcataccaggtgag

SEQ ID NO: 287885 - DNA, 75 bp, Artificial Sequence
  Synthetic
aacaggaaaagatttctgctggaaaaacacgtgtcatagaagctagtagtgtaaatgatactgtactatttagaa

SEQ ID NO: 287886 - DNA, 75 bp, Artificial Sequence
  Synthetic
ggtagacctggcagatgaggctagaaattccccactggtgacagtgttctagcctgcgtggctgcctgcacaccc

SEQ ID NO: 287887 - DNA, 75 bp, Artificial Sequence
  Synthetic
ataaacaaacaacatcagcaggggaagtttttgcaatcccagttgacatagcttcacaacccttagctacaaccc

SEQ ID NO: 287888 - DNA, 75 bp, Artificial Sequence
  Synthetic
agctatgttaaatggtgaatgtttgatggcatttgattacacaaattatgatggtagtattcatccaatgtggtt

SEQ ID NO: 287889 - DNA, 75 bp, Artificial Sequence
  Synthetic
cagggtgtgaagagccccgtgtgctcgctttgagtcctccggcccctgaatgtggctaaccttaaccctgcagct

SEQ ID NO: 287890 - DNA, 75 bp, Artificial Sequence
  Synthetic
agggcacacaatccagtgtgtatctagtcgtaatgagcaattgcgggatgggaccaactactttgggtgtccgtg

SEQ ID NO: 287891 - DNA, 75 bp, Artificial Sequence
  Synthetic
agcatacacacctccaggtgtacccaaacctaccagtaggagggaagccatgcttggaacacatctggtgtggga

SEQ ID NO: 287892 - DNA, 75 bp, Artificial Sequence
  Synthetic
gttgaaggtggtgtaccatcaggctgttctgggaccagtatattcaacacaatgataaataatgtcataatcaga

SEQ ID NO: 287893 - DNA, 75 bp, Artificial Sequence
  Synthetic
ggaccaactactttgggtgtccgtgtttcttgtttttcttttatgtttgcttatggtgacaatatatagtaatat

SEQ ID NO: 287894 - DNA, 75 bp, Artificial Sequence
  Synthetic
acatgctggtatcagacaaacctcattgttgcaccaaatacaccatcaacagctaggatgatttgttttgtgtca

SEQ ID NO: 287895 - DNA, 75 bp, Artificial Sequence
  Synthetic
aaattactttaaggatgctgcatcaagcggtgcatcaaagcttgaattttcacaagaccctagtaagtttactga

SEQ ID NO: 287896 - DNA, 75 bp, Artificial Sequence
  Synthetic
tggaggcaattgccaaggaaggttcaaaatatggcctcacaataactcctgctgataaatctagtgaatttaaac

SEQ ID NO: 287897 - DNA, 75 bp, Artificial Sequence
  Synthetic
tcctcaatgaagttcttgttgtaccaaacatcagtgctagcaatggacatacatcaaactcagctccaacacttg

SEQ ID NO: 287898 - DNA, 75 bp, Artificial Sequence
  Synthetic
gattcaacaattacttcacaagatgttgccaatgcaatcgttggttatggagtttggcctcattaccttactcca

SEQ ID NO: 287899 - DNA, 75 bp, Artificial Sequence
  Synthetic
tgagtccatacgatggacaaagaaaccatctcagacacaagaacatatcctttcactgtgccatttaatgtggca

SEQ ID NO: 287900 - DNA, 75 bp, Artificial Sequence
  Synthetic
gcgctggtcgcgcactgtacattcccccttatgaattgcttcagcatgagtggtatgagaaattttaaattgttt

SEQ ID NO: 287901 - DNA, 75 bp, Artificial Sequence
  Synthetic
aagtttcttaggaagatctggttgtgttgctatcattgaaaccaaattaaaccatgaaacagacatgtacaatgc

SEQ ID NO: 287902 - DNA, 75 bp, Artificial Sequence
  Synthetic
ggtggtggaagttacctgatgcattgaaggacatgggaatttttgggcaaaatatgtactaccacttcctcggta

SEQ ID NO: 287903 - DNA, 75 bp, Artificial Sequence
  Synthetic
actctattattccggtaattttgtacgccagttttatctccccctacccccttacgtaacttagaagttttacac

SEQ ID NO: 287904 - DNA, 75 bp, Artificial Sequence
  Synthetic
ataacaatagtaactaccttagcaggacaaggggaggacattggtcatgtagttattcaatacatgtacgtacca

SEQ ID NO: 287905 - DNA, 75 bp, Artificial Sequence
  Synthetic
gagaggcaatgtcaccgccgggtataacttcacacaccctggtgaacctggtagagaggttggaaagcctaaccg

SEQ ID NO: 287906 - DNA, 75 bp, Artificial Sequence
  Synthetic
gatcgttatccgcaaagcaactacgcaaagcctagtaccatttttgatgatgtgtggttggtcgttccactatga

SEQ ID NO: 287907 - DNA, 75 bp, Artificial Sequence
  Synthetic
ctattccattcatgagtatagcctcagcttattacatgttctatgatgggtatgagagtgataaaggcaacattt

SEQ ID NO: 287908 - DNA, 75 bp, Artificial Sequence
  Synthetic
agaagcaacaattcagccacaataatagtaccatatgtgaatgcagtgcctatggactctatgctcagacacaat

SEQ ID NO: 287909 - DNA, 75 bp, Artificial Sequence
  Synthetic
tacatttgacaaggtgtgaagagccccgtgtgcttgctttgagtcctccggcccctgaatgtggctaaccttaac

SEQ ID NO: 287910 - DNA, 75 bp, Artificial Sequence
  Synthetic
ccgtgtgcttgctttgagtcctccggcccctgaatgtggctaaccttaaccctgcagctagtgtgtacaatccag

SEQ ID NO: 287911 - DNA, 75 bp, Artificial Sequence
  Synthetic
agctaaacacatcaaagcatggtgtccaagagcacctagagcagtcccataccaacatacctacagcccaaattt

SEQ ID NO: 287912 - DNA, 75 bp, Artificial Sequence
  Synthetic
aattttctggtgcacgtgcgaagagtcagggattacccgtgctaacaacaccaggatctggccaatttatgacta

SEQ ID NO: 287913 - DNA, 75 bp, Artificial Sequence
  Synthetic
gtgtccgtgtttcttgtttttctttcatatttgcttatggtgacaatatatataacacatatattggcaccatgg

SEQ ID NO: 287914 - DNA, 75 bp, Artificial Sequence
  Synthetic
ggtgaattaatatatagaaatctacacttatgtgaaccagaaaatctagatgattctgtcttaatatgttactca

SEQ ID NO: 287915 - DNA, 75 bp, Artificial Sequence
  Synthetic
agatactatcatacctataaacaatactggaactaacactacaagcattaacatgtatacagtacaagtagagag

SEQ ID NO: 287916 - DNA, 75 bp, Artificial Sequence
  Synthetic
tgctgcttctagcggtgcttctagattggatttttcacaagaccctagtaaatttacagatccagttaaagatgt

SEQ ID NO: 287917 - DNA, 75 bp, Artificial Sequence
  Synthetic
attaccctatagaagtgaagaaacaccaatggtatgaaattcaagaatcagaatactatccaaaacatatacaat

SEQ ID NO: 287918 - DNA, 75 bp, Artificial Sequence
  Synthetic
cactggacaggtagtttgcgttttagctttatgttctgtgggtcagctagttccactttgaaacttttattagca

SEQ ID NO: 287919 - DNA, 75 bp, Artificial Sequence
  Synthetic
tcacaggatatagccaacgctgtggttgcatatggcgtgtggccacagtatttgacccctgatcatgctagtgca

SEQ ID NO: 287920 - DNA, 75 bp, Artificial Sequence
  Synthetic
tactttggtgaaactcaaggcttaattactaaagagctacctgtatctgtcaagaatttaccatctatacatgtc

SEQ ID NO: 287921 - DNA, 75 bp, Artificial Sequence
  Synthetic
tgaccatgttgcattcatagatttgagggattttcattgtgcagagaaccagggcatatcagattacatacactc

SEQ ID NO: 287922 - DNA, 75 bp, Artificial Sequence
  Synthetic
tggtaccttgggttagtgctagtcactttagaaacacaactccagataagtactcattagcaggatttataactt

SEQ ID NO: 287923 - DNA, 75 bp, Artificial Sequence
  Synthetic
ctgatgcattaaagaacatggggatttttggtgagaatttgttctaccatttcttaggtagggcaggatatacgg

SEQ ID NO: 287924 - DNA, 75 bp, Artificial Sequence
  Synthetic
ttgattagaattatctcagctgtcacaattattattagaaataatgcagacccacacaccatcatcgcaaccttg

SEQ ID NO: 287925 - DNA, 75 bp, Artificial Sequence
  Synthetic
tcgggataccaatctacacaagcaaagtggcccaataacccaaaatccagtggagaattacatagatcaggtgct

SEQ ID NO: 287926 - DNA, 75 bp, Artificial Sequence
  Synthetic
agttggatacaatcacactcatccaggagagacaggcagagtgattggtggtttcactaataacaatagtagaca

SEQ ID NO: 287927 - DNA, 75 bp, Artificial Sequence
  Synthetic
taaagaaatttacagaaatgtgtaatgctgctagaggtttagagtggttaggcaataaaatatcaaagtttattg

SEQ ID NO: 287928 - DNA, 75 bp, Artificial Sequence
  Synthetic
gttcaacctgaagacatgattgaaacacgttatgtgcagacatcacaaaccagagatgaaatgagtcttgaaagc

SEQ ID NO: 287929 - DNA, 75 bp, Artificial Sequence
  Synthetic
actctaatactaccatacgtaaatgcagtacctatggattctatggttagacataataactggagcatagtgatc

SEQ ID NO: 287930 - DNA, 75 bp, Artificial Sequence
  Synthetic
actggccagccaaaaacaacaacaagaatatgtagaaaccctcaggataatggctgattcatctaggaaatttct

SEQ ID NO: 287931 - DNA, 75 bp, Artificial Sequence
  Synthetic
taaaggaaatggcccagatcaggaggaaatttgaattgtttacatatgcaagatttgactctgaaataacattgg

SEQ ID NO: 287932 - DNA, 75 bp, Artificial Sequence
  Synthetic
acaacacaacacaaggattacctgtaatgttaactccaggctcagcacaattcttaactacagatgatgctcaat

SEQ ID NO: 287933 - DNA, 75 bp, Artificial Sequence
  Synthetic
tttcatggagaaccaggtactggcaaatctattgcaacctcaatattgggtagaatgctaacaaatgaatcagat

SEQ ID NO: 287934 - DNA, 75 bp, Artificial Sequence
  Synthetic
tgcatggcaatcaggcacaaatgcttccatcttttggcaacatggacaatcatatcccagattttcacttccgtt

SEQ ID NO: 287935 - DNA, 75 bp, Artificial Sequence
  Synthetic
tctaagcatatatacaaatctaaatattatgaagtggaaggaggtatgccatctgggtgtgcaggtactagcatt

SEQ ID NO: 287936 - DNA, 75 bp, Artificial Sequence
  Synthetic
aattaacaacacaatagctgttaagaattcagctggtatgtatactgttcaagttagtcaacaaactcaaccagc

SEQ ID NO: 287937 - DNA, 75 bp, Artificial Sequence
  Synthetic
tgtctctcttttgccagatggtgtcttcagtccctttcatacctcctatggcagatttaccagacaagggcaaac

SEQ ID NO: 287938 - DNA, 75 bp, Artificial Sequence
  Synthetic
tgttcccgtgtagttactgaagagcatggaccccgtgtcaaaatttcaaccagaatatatcacaaagccaaacat

SEQ ID NO: 287939 - DNA, 75 bp, Artificial Sequence
  Synthetic
cttagatttagtttcatgttctgtgggacagctaataccagtctcaagctactgattgcatacacaccacctgga

SEQ ID NO: 287940 - DNA, 75 bp, Artificial Sequence
  Synthetic
tttagatataacagttaaagaggagtacaagatacaacaaggtaaattaaatttaagatgtgcattaaaaccatg

SEQ ID NO: 287941 - DNA, 75 bp, Artificial Sequence
  Synthetic
cagttagagacaatgttagggcagtaaagaatgtaggacccagtgatatgtatgttcatgtaggaaatttgatat

SEQ ID NO: 287942 - DNA, 75 bp, Artificial Sequence
  Synthetic
cagcaagtcattatagatacacaacaccagacacctattcacaggcaggatatatcacctgttggtatcagacaa

SEQ ID NO: 287943 - DNA, 75 bp, Artificial Sequence
  Synthetic
acaatctataatagaatagttgaagaaagtaagaataggaaggaattaactaattctctacaggccatatttcaa

SEQ ID NO: 287944 - DNA, 75 bp, Artificial Sequence
  Synthetic
ctatataccaacttgtgattgtactgatgccacttactactgtaaacataaaaatagatattaccccattaaggt

SEQ ID NO: 287945 - DNA, 75 bp, Artificial Sequence
  Synthetic
tgtatataccagcttacgaagtccttgagtatgagtggtatgaaaaattttagatataaaactattaaatgtagt

SEQ ID NO: 287946 - DNA, 75 bp, Artificial Sequence
  Synthetic
gcacacacaggtaggtgttatggaacaaaacccagtggaaaggtacacagaagctattttaaatgaagttcttgt

SEQ ID NO: 287947 - DNA, 75 bp, Artificial Sequence
  Synthetic
tgatacactcattcccgttaacaataaagaggaaaatgtaaaatctgtaaatatgtacactgttgatttacgccc

SEQ ID NO: 287948 - DNA, 75 bp, Artificial Sequence
  Synthetic
gggtagttcctactgagtgtaagttagagagagaccttaattatgctaatttagttatttctatgctagctaatg

SEQ ID NO: 287949 - DNA, 75 bp, Artificial Sequence
  Synthetic
tgtggtggaaaattattatgcaaacatggtgtgataggaataattacagctggtggtgagggtcatgttgcattt

SEQ ID NO: 287950 - DNA, 75 bp, Artificial Sequence
  Synthetic
acgccatgcttggtacacacctagtatgggatgtggggttacaatccactgcctctctggtagtaccatgggtta

SEQ ID NO: 287951 - DNA, 75 bp, Artificial Sequence
  Synthetic
atggtcgagacacggtatgtaattactgatcagacccgtgatgaaatgagtgtggaaagttttcttggtagatct

SEQ ID NO: 287952 - DNA, 75 bp, Artificial Sequence
  Synthetic
acactgttattacggtaactttgtacgccagttttatatccccccccccaacgtaacttagaagcaagcacaaac

SEQ ID NO: 287953 - DNA, 75 bp, Artificial Sequence
  Synthetic
aagaagagtagttacccagggaccacaagaagaatttggtcgtagcattattaaacacaatacatgtgtgctcac

SEQ ID NO: 287954 - DNA, 75 bp, Artificial Sequence
  Synthetic
gggatcaagtcaatgcaataaaccctataaataatataagtaagaaaatagtcaaatggatgcttagaataatat

SEQ ID NO: 287955 - DNA, 75 bp, Artificial Sequence
  Synthetic
tcacttacggacaagcacttctagtctccccggcaactgctgatatgctccaacagggcaaaaacagcgggagtc

SEQ ID NO: 287956 - DNA, 75 bp, Artificial Sequence
  Synthetic
tggctcaaatcagaagaaaatgtgagctctttacatacctcagatttgattctgagattacaatagtagcaacag

SEQ ID NO: 287957 - DNA, 75 bp, Artificial Sequence
  Synthetic
aaaaccaaagtattagactcatatgacctctacaataaacagggtgttaaattagagatcacagtcataaaatta

SEQ ID NO: 287958 - DNA, 75 bp, Artificial Sequence
  Synthetic
agaaaagttttgtaaatggacacaactgaattatgtacacaaggagtcagattcttggcttaagaaattcacaga

SEQ ID NO: 287959 - DNA, 75 bp, Artificial Sequence
  Synthetic
agaaataccccactggcgacagtgttctagcctgcgtggctgcctgcacaccctcacgggtgtgaagccattcat

SEQ ID NO: 287960 - DNA, 75 bp, Artificial Sequence
  Synthetic
atcagggacaaatgcatcagtattttggcagcagggccaaccttaccccagatttaccattccatttatgagtat

SEQ ID NO: 287961 - DNA, 75 bp, Artificial Sequence
  Synthetic
atttggtcgtaacgagcaattgcgggatgggaccaactactttgggtgtccgtgtttctttttattcttatcatt

SEQ ID NO: 287962 - DNA, 75 bp, Artificial Sequence
  Synthetic
aaatacttgagtgaattaaagaagttaaatttactagagaaacaaattgataacctacgttgtgctgacacaaaa

SEQ ID NO: 287963 - DNA, 75 bp, Artificial Sequence
  Synthetic
caacaattttgcaagttggtgattcagtctcatatgggaatatcctacttagtggtaatcaaactgctagaatga

SEQ ID NO: 287964 - DNA, 75 bp, Artificial Sequence
  Synthetic
attgtgactgagcagcagacacataaggttaagataaccagtaggatattccacaaggcaaagcatattagtgca

SEQ ID NO: 287965 - DNA, 75 bp, Artificial Sequence
  Synthetic
gtggatctagtcttaattactttaacatcaattactttaaggatgcagcatccagcggcgcatctaagctagagt

SEQ ID NO: 287966 - DNA, 75 bp, Artificial Sequence
  Synthetic
ataacaaatgttgtaatataattaaacaaaggaaaagaagtgagcctgtcgcaatcatgatacatggaccacctg

SEQ ID NO: 287967 - DNA, 75 bp, Artificial Sequence
  Synthetic
ataacaaatgttgtaatataattaaacaaaggaaaagaagtgagcctgtcgctatcatgatacatggaccacctg

SEQ ID NO: 287968 - DNA, 75 bp, Artificial Sequence
  Synthetic
ataacaaatgttgtaatataattaaacaaaggaaaagaagtgagcctgtcgccatcatgatacatggaccacctg

SEQ ID NO: 287969 - DNA, 75 bp, Artificial Sequence
  Synthetic
ataacaaatgttgtaatataattaaacaaaggaaaagaagtgagcctgtcgcgatcatgatacatggaccacctg

SEQ ID NO: 287970 - DNA, 75 bp, Artificial Sequence
  Synthetic
gttttctgcaatgttattacgctcatatttcaacaaccaccaaggacagattgtaaataagaccactacaaaaga

SEQ ID NO: 287971 - DNA, 75 bp, Artificial Sequence
  Synthetic
acactgtcaaagatctaacataccccacagaaatgacgaatgttggaccatctgatctttatgtacacgctggaa

SEQ ID NO: 287972 - DNA, 75 bp, Artificial Sequence
  Synthetic
agacagaataattcaaatcaccagaggtgactctactataacatcacaagatgtggccaatgccgtggtgggata

SEQ ID NO: 287973 - DNA, 75 bp, Artificial Sequence
  Synthetic
cgaccaacaaagtgtagtcattatggatgatatcatgcagaatcctggtggtgaagatatgtctttattttgtca

SEQ ID NO: 287974 - DNA, 75 bp, Artificial Sequence
  Synthetic
ccttatgacaacagattaaatgtggatctggaagactctatattttctaaatacaaaggtaacacaagcttagaa

SEQ ID NO: 287975 - DNA, 75 bp, Artificial Sequence
  Synthetic
aacaggtgatgacatgattcctacatgtgattgcacacaagcaacttattactgcaaacataaagacagatatta

SEQ ID NO: 287976 - DNA, 75 bp, Artificial Sequence
  Synthetic
aaggtatggaagagggactcaaagggatggtggtggaagttacctgatgcacttaaagacatgggaatatttggt

SEQ ID NO: 287977 - DNA, 75 bp, Artificial Sequence
  Synthetic
cttctagccccacccaccatcacttcactttctgcaatgaatagaagattttacctagatttggatattgtagtg

SEQ ID NO: 287978 - DNA, 75 bp, Artificial Sequence
  Synthetic
gaatagaaggattagaagcactagacttgcatacaagtgctggatacccatacacagcaaatggtataaagaaaa

SEQ ID NO: 287979 - DNA, 75 bp, Artificial Sequence
  Synthetic
gaaccaggtgactgtggtggaaaactcttgtgtaagcatggggttataggaatagtaacagcaggaggtgataac

SEQ ID NO: 287980 - DNA, 75 bp, Artificial Sequence
  Synthetic
ttcctgaacatcaacttgctagtgctaactatggtaatgttacagctggatataattatactcaccctggtgagg

SEQ ID NO: 287981 - DNA, 75 bp, Artificial Sequence
  Synthetic
tcatatgtggaaaagcagttgtgttcaaggacagaaacacatgccaaacatatacactgtgccagatttataaca

SEQ ID NO: 287982 - DNA, 75 bp, Artificial Sequence
  Synthetic
aagaaaaccagaaaagatccgtgagggcaagacgcgtatcattgaagctagtagtctaaatgatactgttcactt

SEQ ID NO: 287983 - DNA, 75 bp, Artificial Sequence
  Synthetic
tagataacattaaagaacagattcaggcaattaatccaatcaataagatcacaagcaaaataatcaaatggacaa

SEQ ID NO: 287984 - DNA, 75 bp, Artificial Sequence
  Synthetic
attcccacatcaattcataaatttacgcagtaacaactcagcaacaattatagtaccttatgttaatgcagttcc

SEQ ID NO: 287985 - DNA, 75 bp, Artificial Sequence
  Synthetic
agccgacttgttacaatcagtgagaactccagaagttgttaaatactgtgaatataataaatggataatcccagc

SEQ ID NO: 287986 - DNA, 75 bp, Artificial Sequence
  Synthetic
attcctgttatgttagatggtgactgtcttatggcttttgattactcaaactatgatggaagtcttaacccagta

SEQ ID NO: 287987 - DNA, 75 bp, Artificial Sequence
  Synthetic
gaggtttattaaggagaaggtgtgtaattggttacaactggtgtatgtacacaaagaatcagatggctggattaa

SEQ ID NO: 287988 - DNA, 75 bp, Artificial Sequence
  Synthetic
gtatcaatcagccccatgttttcagaattctcaggtgccagagctaggccagctgcggcaacacagggtctgcca

SEQ ID NO: 287989 - DNA, 75 bp, Artificial Sequence
  Synthetic
ttattctgttcattacagggaccatattcgggcgaacccaagccaaaaacaagaattcctgagaggagagtggtg

SEQ ID NO: 287990 - DNA, 75 bp, Artificial Sequence
  Synthetic
atgaggtagagggtgggatgccatcaggttgtgctgggactagtattttcaacactatgattaataatatcatta

SEQ ID NO: 287991 - DNA, 75 bp, Artificial Sequence
  Synthetic
aagttaaaagtagaattcattaaaaacttaaaacagttaccactcctggaaaagcaggttgatggattaagactt

SEQ ID NO: 287992 - DNA, 75 bp, Artificial Sequence
  Synthetic
cagggcaagttagaaatttaattgagatgtgccaggttgataccatgattccaataaacaacacaaatgaaagaa

SEQ ID NO: 287993 - DNA, 75 bp, Artificial Sequence
  Synthetic
atagatacatgattgttccaacacatgctgatccaggaaaaactgtgcaaattaatggcattgtcacaaatgttg

SEQ ID NO: 287994 - DNA, 75 bp, Artificial Sequence
  Synthetic
agatatgaaagaactagctagtgaaggggtcaagtatggattaacaataacacctgctgataaaacagaagaatt

SEQ ID NO: 287995 - DNA, 75 bp, Artificial Sequence
  Synthetic
tcaaagagttgctcaaacggagtcaaatgattcttcgtacatcaaaaagaacagaaccagttggggtaatatttc

SEQ ID NO: 287996 - DNA, 75 bp, Artificial Sequence
  Synthetic
tagcactttgataggtgaaattgcaagttactacacacattggacaggtagtctcaggtttagtttcatgttctg

SEQ ID NO: 287997 - DNA, 75 bp, Artificial Sequence
  Synthetic
acccgaaagggaggatgactaccctgaatgtaatttggcacttgtagcaaaccaggttgaaccaacaatcattag

SEQ ID NO: 287998 - DNA, 75 bp, Artificial Sequence
  Synthetic
gtgtgggagtccattagatggacaaagaatccacgcaatatgcaagaacatgttctttctctgtgtcatttaaag

SEQ ID NO: 287999 - DNA, 75 bp, Artificial Sequence
  Synthetic
gtgtgggagtccattagatggacaaagaatccacgcaatatgcaagaacatgttctttctctgtgtcatttaatg

SEQ ID NO: 288000 - DNA, 75 bp, Artificial Sequence
  Synthetic
gtgtgggagtccattagatggacaaagaatccacgcaatatgcaagaacatgttctttctctgtgtcatttaacg

SEQ ID NO: 288001 - DNA, 75 bp, Artificial Sequence
  Synthetic
gtgtgggagtccattagatggacaaagaatccacgcaatatgcaagaacatgttctttctctgtgtcatttaagg

SEQ ID NO: 288002 - DNA, 75 bp, Artificial Sequence
  Synthetic
gtgtgggagtccattagatggacaaagaatcctcgcaatatgcaagaacatgttctttctctgtgtcatttaaag

SEQ ID NO: 288003 - DNA, 75 bp, Artificial Sequence
  Synthetic
gtgtgggagtccattagatggacaaagaatcctcgcaatatgcaagaacatgttctttctctgtgtcatttaatg

SEQ ID NO: 288004 - DNA, 75 bp, Artificial Sequence
  Synthetic
gtgtgggagtccattagatggacaaagaatcctcgcaatatgcaagaacatgttctttctctgtgtcatttaacg

SEQ ID NO: 288005 - DNA, 75 bp, Artificial Sequence
  Synthetic
gtgtgggagtccattagatggacaaagaatcctcgcaatatgcaagaacatgttctttctctgtgtcatttaagg

SEQ ID NO: 288006 - DNA, 75 bp, Artificial Sequence
  Synthetic
gtgtgggagtccattagatggacaaagaatccccgcaatatgcaagaacatgttctttctctgtgtcatttaaag

SEQ ID NO: 288007 - DNA, 75 bp, Artificial Sequence
  Synthetic
gtgtgggagtccattagatggacaaagaatccccgcaatatgcaagaacatgttctttctctgtgtcatttaatg

SEQ ID NO: 288008 - DNA, 75 bp, Artificial Sequence
  Synthetic
gtgtgggagtccattagatggacaaagaatccccgcaatatgcaagaacatgttctttctctgtgtcatttaacg

SEQ ID NO: 288009 - DNA, 75 bp, Artificial Sequence
  Synthetic
gtgtgggagtccattagatggacaaagaatccccgcaatatgcaagaacatgttctttctctgtgtcatttaagg

SEQ ID NO: 288010 - DNA, 75 bp, Artificial Sequence
  Synthetic
gtgtgggagtccattagatggacaaagaatccgcgcaatatgcaagaacatgttctttctctgtgtcatttaaag

SEQ ID NO: 288011 - DNA, 75 bp, Artificial Sequence
  Synthetic
gtgtgggagtccattagatggacaaagaatccgcgcaatatgcaagaacatgttctttctctgtgtcatttaatg

SEQ ID NO: 288012 - DNA, 75 bp, Artificial Sequence
  Synthetic
gtgtgggagtccattagatggacaaagaatccgcgcaatatgcaagaacatgttctttctctgtgtcatttaacg

SEQ ID NO: 288013 - DNA, 75 bp, Artificial Sequence
  Synthetic
gtgtgggagtccattagatggacaaagaatccgcgcaatatgcaagaacatgttctttctctgtgtcatttaagg

SEQ ID NO: 288014 - DNA, 75 bp, Artificial Sequence
  Synthetic
ctttgatggatatgatcagcaaagtgtagttattatggatgacataatgcagaatcccagtggtgaagacatgtc

SEQ ID NO: 288015 - DNA, 75 bp, Artificial Sequence
  Synthetic
tgttagtgcaggtcgcgcactctatataccaccttatgaagttctttgtcacgagtggtatgacaaattttaagc

SEQ ID NO: 288016 - DNA, 75 bp, Artificial Sequence
  Synthetic
gtgtgggatgttgggttgcaatcaactgtctctttggttgtaccatgggtaagtgctagtcattttagatacaca

SEQ ID NO: 288017 - DNA, 75 bp, Artificial Sequence
  Synthetic
ggtgtcctgtataaaataggtagtataataggaattcatgtgggtggtaatggtagagatggattttcagcaatg

SEQ ID NO: 288018 - DNA, 75 bp, Artificial Sequence
  Synthetic
ttaaaactgggtctaggttgttcccacctaggcctcctacatggagttgtactctattattccggtaattttgta

SEQ ID NO: 288019 - DNA, 75 bp, Artificial Sequence
  Synthetic
acaaatcatactctacttcacccaccaaccatatcatgtacaacagccatgaacagaagattcttcttggatctg

SEQ ID NO: 288020 - DNA, 75 bp, Artificial Sequence
  Synthetic
ttgtgtctggttgcaaggacttttgcctccggatggctagagatactgacatgcatgttcagaatgtaccaatca

SEQ ID NO: 288021 - DNA, 75 bp, Artificial Sequence
  Synthetic
aactacatccaagtgtttttcatgatgtattcaaaggcacaaaagaacctgctgttttaacagaaaaagatccac

SEQ ID NO: 288022 - DNA, 75 bp, Artificial Sequence
  Synthetic
gctgtcctctaatttgtggaaaagccctacaattcagagacagaaatactggtgaacacttgtccctggccactg

SEQ ID NO: 288023 - DNA, 75 bp, Artificial Sequence
  Synthetic
agctttggatgctgctgaaactggacacacaagtagcatccaacctgaagacacaattgaaacaagatatgtgca

SEQ ID NO: 288024 - DNA, 75 bp, Artificial Sequence
  Synthetic
agcccaattaatgactcttgacataaatccagataacataactatggaagagagtgtttttggaacagatggtct

SEQ ID NO: 288025 - DNA, 75 bp, Artificial Sequence
  Synthetic
accaccagctataatagacctacttgaatcagttagaagcccagatgttattaaatattgtgaggaaaacaaatg

SEQ ID NO: 288026 - DNA, 75 bp, Artificial Sequence
  Synthetic
agtcgtaatgagcaattacgggatgggaccaactactttgggtgtccgtgtttcactttttccttttatatttgc

SEQ ID NO: 288027 - DNA, 75 bp, Artificial Sequence
  Synthetic
ctaagagcagcacttgataaatatggggtggatttgcctatggtcactttcctcaaagatgaacttagaaagaaa

SEQ ID NO: 288028 - DNA, 75 bp, Artificial Sequence
  Synthetic
gaacataattttgtggattggaaaattactttgcaggagatggcacaggttagaaggaaatttgaaatgttcacc

SEQ ID NO: 288029 - DNA, 75 bp, Artificial Sequence
  Synthetic
ataatatataaattattttgctcattacagggtccgtactcaggggaacccaagccaactacaagaaaaccagag

SEQ ID NO: 288030 - DNA, 75 bp, Artificial Sequence
  Synthetic
gtgcacctgtacctaagaagagagatgattacacatggcaatctggaacaaatgcctcagttttctggcaacacg

SEQ ID NO: 288031 - DNA, 75 bp, Artificial Sequence
  Synthetic
acaagaaccctggaattatcactggttcagcagtgggatgtgatcctgaaactttttggtcaaaaatacctgtga

SEQ ID NO: 288032 - DNA, 75 bp, Artificial Sequence
  Synthetic
atccagtttgaattactttaacataaattatttcaaggatgctgcttcaagcggcgcatcaaaattggagttctc

SEQ ID NO: 288033 - DNA, 75 bp, Artificial Sequence
  Synthetic
tagggatctatgacaatataatgattataccaacacatgctgatgctgggaaagaagtagaaatagatgggatca

SEQ ID NO: 288034 - DNA, 75 bp, Artificial Sequence
  Synthetic
tggtgtttctgtcactaatgatatgggtacactttgcactagaattgtaacaaaccaacagaaacacctagtgga

SEQ ID NO: 288035 - DNA, 75 bp, Artificial Sequence
  Synthetic
gaaatttgaacatagattgatagacaggttatgtaactctagacatatatttagggattcctattatgaggttga

SEQ ID NO: 288036 - DNA, 75 bp, Artificial Sequence
  Synthetic
aggattatacaaataactaggggagattcaacaataacatcacaagatgtggcaaatgctgttgtaggatacggt

SEQ ID NO: 288037 - DNA, 75 bp, Artificial Sequence
  Synthetic
tagaaaatacataccagagactgaagatgattatccagaatgccatttagcactggttgctaatcaacaggagcc

SEQ ID NO: 288038 - DNA, 75 bp, Artificial Sequence
  Synthetic
aaagtacgggacggtgaaccaacactctttataaaaccaagagagaatcttaccacagctggtccaagtgacatg

SEQ ID NO: 288039 - DNA, 75 bp, Artificial Sequence
  Synthetic
gatttagataaacttaaaataatagcttatggggatgatgttattttttcctataaatatcctctagacatggaa

SEQ ID NO: 288040 - DNA, 75 bp, Artificial Sequence
  Synthetic
tatggcatgaaacatcaaaaggttggtggtggaaattgcctgatgcacttaaagatatgggtatatttggtgaaa

SEQ ID NO: 288041 - DNA, 75 bp, Artificial Sequence
  Synthetic
ggattctgtggaggggtcttgtataaaataggattagtgctaggtatacatgttgggggaaatggtagggatggt

SEQ ID NO: 288042 - DNA, 75 bp, Artificial Sequence
  Synthetic
accgaacaaacacccaaggtgatgactatattcccacctgtgactgtactcaagctacctactactgtaaacata

SEQ ID NO: 288043 - DNA, 75 bp, Artificial Sequence
  Synthetic
aaagaggatttaaacaagactccaaatatcccttccttatacatcctactttcccagtgagtgaaattcatgaat

SEQ ID NO: 288044 - DNA, 75 bp, Artificial Sequence
  Synthetic
agaacatcaactagctagtgcaagccgtggtaatgtcactgcaggatataattatacacaccctggggagctcgg

SEQ ID NO: 288045 - DNA, 75 bp, Artificial Sequence
  Synthetic
catcaaataccaaattgcaacctagtgttttctatgatgttttccctggtagtaaggaacctgctgtcttatctg

SEQ ID NO: 288046 - DNA, 75 bp, Artificial Sequence
  Synthetic
agaaggaccttgtgaacctggtgattgtggaggaaaactactatgtaaacatggtgtaataggcattattacagc

SEQ ID NO: 288047 - DNA, 75 bp, Artificial Sequence
  Synthetic
gaacgggatacgcagcgtcagcgctggacgtgcgttgtatattccgccttatgagctcctgttgcatgagtggta

SEQ ID NO: 288048 - DNA, 75 bp, Artificial Sequence
  Synthetic
ttcccacaccaattcatcaacttgagaagtaataattcagcaacaatcattgttccttatgtaaatgctgtaccc

SEQ ID NO: 288049 - DNA, 75 bp, Artificial Sequence
  Synthetic
tgctcattatacagcccaattatccactctagacataaatcccaaaccattgagcctagaggaaagtgtatatgg

SEQ ID NO: 288050 - DNA, 75 bp, Artificial Sequence
  Synthetic
ggacgtgcgttgtatattccgccttatgagctcctgttgcatgagtggtatgaaaaattttaaactttatatata

SEQ ID NO: 288051 - DNA, 75 bp, Artificial Sequence
  Synthetic
acactattattacggtaattttgtacgccagttttatatcccttaccccaagtaacttagaagataaacacacag

SEQ ID NO: 288052 - DNA, 75 bp, Artificial Sequence
  Synthetic
ggcaatgggtttgttgatagtgtaaaagagcatgtgaaagcaattaatccagtaggtaatattagtaagaaaatt

SEQ ID NO: 288053 - DNA, 75 bp, Artificial Sequence
  Synthetic
caattagtccaatgtgtgctgaattttctggagccagagcaaaaccaactgctgcagcacaaggtctcccagttt

SEQ ID NO: 288054 - DNA, 75 bp, Artificial Sequence
  Synthetic
ttaacaaagctcaagcatgctattgaaaaatatggattagatttacctatgattaccttcttaaaagatgagctc

SEQ ID NO: 288055 - DNA, 75 bp, Artificial Sequence
  Synthetic
accaataggaggtggtcatccagatcactaagggtcaagcacttctgtttccccggtcaaggttgatatgctcca

SEQ ID NO: 288056 - DNA, 75 bp, Artificial Sequence
  Synthetic
caggatcaccatggagattcctaaaagagaaattctgtaaatggacacaactcacatatatacataaggaatcag

SEQ ID NO: 288057 - DNA, 75 bp, Artificial Sequence
  Synthetic
tgaggttaaaaaccttattgaaatgtgccaagttgacacactcattccagttaacaatacaattgcaaacctacg

SEQ ID NO: 288058 - DNA, 75 bp, Artificial Sequence
  Synthetic
caaaatttcaccagaatccgggaatcatcacgggatccgcagtaggatgtgatccagaggtgttttggtcaaaaa

SEQ ID NO: 288059 - DNA, 75 bp, Artificial Sequence
  Synthetic
gtagacctggcagatgaggctagaaatcccccactggtgacagtgttctagcctgcgtggctgcctgcacaccct

SEQ ID NO: 288060 - DNA, 75 bp, Artificial Sequence
  Synthetic
gctcccacaagcacaactaaaagttaaatatctaaatgaacttaaaagattgaacttatatgagaagcaagttga

SEQ ID NO: 288061 - DNA, 75 bp, Artificial Sequence
  Synthetic
acacttttaggtgaaatatgtagttactacacacactggacaggtagcctacgctttagttttatgttttgtggt

SEQ ID NO: 288062 - DNA, 75 bp, Artificial Sequence
  Synthetic
aaatgatctagggtttccaggtgaattagtgaataaactatgcaattctaaacacatatacaaaacaacttatta

SEQ ID NO: 288063 - DNA, 75 bp, Artificial Sequence
  Synthetic
gggcacacaatccagtgtgtatctagtcgtaatgagcaattgcgggatgggaccaactactttgggtgtccgtgt

SEQ ID NO: 288064 - DNA, 75 bp, Artificial Sequence
  Synthetic
gaggcaaaaagaataaaaattctacacaacaaatgtgacactataattaaacaaaagaagagaagtgaaccagtg

SEQ ID NO: 288065 - DNA, 75 bp, Artificial Sequence
  Synthetic
gggatgtgggattgcaatcaacagtttccttagtcgtcccttgggttagtgctagccattttagatacacaactc

SEQ ID NO: 288066 - DNA, 75 bp, Artificial Sequence
  Synthetic
ctacacagaattcagtcacaaatgggtctagtttaaattattttaacataaactacttcaaagatgctgcatcaa

SEQ ID NO: 288067 - DNA, 75 bp, Artificial Sequence
  Synthetic
aaatttataaatttagataaacttaaaatattagcatatggtgatgatgttattttttcatacccttttgatctt

SEQ ID NO: 288068 - DNA, 75 bp, Artificial Sequence
  Synthetic
ctgatcctaaatactttgatggttatgatcaacagagtgtagttataatggatgatattatgcaaaaccccactg

SEQ ID NO: 288069 - DNA, 75 bp, Artificial Sequence
  Synthetic
ttccgcatgtaaagatttttgcttgcgcatggctagagatactgacatgcacgttcaagaggtaccaatagaaca

SEQ ID NO: 288070 - DNA, 75 bp, Artificial Sequence
  Synthetic
tgttgaagcgtgtggatattctgatagaataatccaaatcacaagaggagattcaacaatcacttcacaagatgt

SEQ ID NO: 288071 - DNA, 75 bp, Artificial Sequence
  Synthetic
ctttcctaaaaaggggttttaaacaggatgaaaagtatggatttctcattcatcccatctatccagaaacagagg

SEQ ID NO: 288072 - DNA, 75 bp, Artificial Sequence
  Synthetic
tgtgttatgtagtactaaccattctttactagcacccccaacaatcacctctcttcctgccatgaataggcgatt

SEQ ID NO: 288073 - DNA, 75 bp, Artificial Sequence
  Synthetic
ctagatgcagcagaaactgggcacactagtggaatacaacctgaggatactatagaaacaagatatgtgcagaca

SEQ ID NO: 288074 - DNA, 75 bp, Artificial Sequence
  Synthetic
aggttttacactcttgaaagtaaaaattgggatagtgagtcaaaaggttggtggtggaaactgcctgatgcatta

SEQ ID NO: 288075 - DNA, 75 bp, Artificial Sequence
  Synthetic
acactttgtggacaagattaggagtgttagcgctggacgtgcactctatataccaccatatgaagtcttgctcca

SEQ ID NO: 288076 - DNA, 75 bp, Artificial Sequence
  Synthetic
attggtaatgcacgatgctgcccatttgtttgcggaaaagcagtctcattcaaggatcgaaattcatgtaacaag

SEQ ID NO: 288077 - DNA, 75 bp, Artificial Sequence
  Synthetic
atcatcattttagacaatgggatataacattacaagaaatggcacaaattcgaagaaaatttgaattctttactt

SEQ ID NO: 288078 - DNA, 75 bp, Artificial Sequence
  Synthetic
gaaccctaattgtggctatgatacctgaacaccaattggcagcggcagagaggggaaatgtcaccgctggataca

SEQ ID NO: 288079 - DNA, 75 bp, Artificial Sequence
  Synthetic
tacaaaatccacccccacctgcgattgctgatcttcttcaatcagttagaactccagaggtgattaagtattgtg

SEQ ID NO: 288080 - DNA, 75 bp, Artificial Sequence
  Synthetic
tgcacctaaacctaaaaagaggaatgattatacttgggaatcaagcacaaacccttctatattctggcagcatgg

SEQ ID NO: 288081 - DNA, 75 bp, Artificial Sequence
  Synthetic
aacactgttgggtaatattaccatctttccacaccagtttattaacttaagaagtaataactcagcaacaataat

SEQ ID NO: 288082 - DNA, 75 bp, Artificial Sequence
  Synthetic
tggtattatatatgtgatatataagttattttgcaccctgcagggtccatactcaggtgagcccaagcccaaaac

SEQ ID NO: 288083 - DNA, 75 bp, Artificial Sequence
  Synthetic
ggaacctcagtcactaatcacatgggcactttgtgttcaagagtagttactggcaaacaagaacacccagttgaa

SEQ ID NO: 288084 - DNA, 75 bp, Artificial Sequence
  Synthetic
gtatcaactactattccaattactatttctatcagtcctatgtttgctgagttctctggtgcacgtgcaaagagt

SEQ ID NO: 288085 - DNA, 75 bp, Artificial Sequence
  Synthetic
ctagacaaaatgttggtacacattctacacaaaattcagtaagcaatggatcaagtctaaattattttaacatta

SEQ ID NO: 288086 - DNA, 75 bp, Artificial Sequence
  Synthetic
aagtttactggcctaggaatttatgatagagtcatgattatccctacacatgctgatccagacaaagaggtccaa

SEQ ID NO: 288087 - DNA, 75 bp, Artificial Sequence
  Synthetic
tgcctcaagatggtgaaccaacaatctttcttaagcatagaaaagatcttgtaacagctgggcctagtgatatgt

SEQ ID NO: 288088 - DNA, 75 bp, Artificial Sequence
  Synthetic
agatatccatacctggacaggttagaaatttaatagaaatgtgtcaggtggataccatcataccaataaataaca

SEQ ID NO: 288089 - DNA, 75 bp, Artificial Sequence
  Synthetic
tatcccaacactccaatcaccaacagttgaagcttgtggttattcagataggttaatacaaataacccgtggaga

SEQ ID NO: 288090 - DNA, 75 bp, Artificial Sequence
  Synthetic
aatttagagatatcagaaagtatatcccagaaaatgaagatgactaccctgaatgtaatttggctctgtctgcaa

SEQ ID NO: 288091 - DNA, 75 bp, Artificial Sequence
  Synthetic
ccgcacaaacacaataggtgatgactacattccaacatgtgattgcacagaagctacatattactgtaaacacaa

SEQ ID NO: 288092 - DNA, 75 bp, Artificial Sequence
  Synthetic
tcatcctttagcaactacattattaggggaaattgctggttattatacccattggacaggcagtttacgttttag

SEQ ID NO: 288093 - DNA, 75 bp, Artificial Sequence
  Synthetic
gtgggaatgtatcagtagggtataatcacacccatccaggtgaacaaggtagagaagtggtgccatcacgaaatt

SEQ ID NO: 288094 - DNA, 75 bp, Artificial Sequence
  Synthetic
tcctaccaagtctgggtattgtggtggtatactttacaagattgggcaagttctggggattcatgtgggtggcaa

SEQ ID NO: 288095 - DNA, 75 bp, Artificial Sequence
  Synthetic
gagggaccatgtgagccaggcgattgtggagggaaattactgtgtaaacatggagtcattggaataatcactgct

SEQ ID NO: 288096 - DNA, 75 bp, Artificial Sequence
  Synthetic
ggtactcatgtggtttgggatgttggcttacaatcaactatttctatgatagtaccttgggttagcgctagccat

SEQ ID NO: 288097 - DNA, 75 bp, Artificial Sequence
  Synthetic
ttaccttatgtcaatgctgtgccaatggactctatgcttagacataataattggagtctagtcattattccaata

SEQ ID NO: 288098 - DNA, 75 bp, Artificial Sequence
  Synthetic
tggactctatgcttagacataataattggagtctagtcattattccaatatgccctttgcaagttcaggctgggg

SEQ ID NO: 288099 - DNA, 75 bp, Artificial Sequence
  Synthetic
agtatacataacccaagtaaaacaaaattgcaacctagtgtattttatgatattttccctggctccaaacaacca

SEQ ID NO: 288100 - DNA, 75 bp, Artificial Sequence
  Synthetic
gtacaggttttgttgacagtgtcaaggatcaaataaatgctatcaaccctattaacaacattagtaagaaaataa

SEQ ID NO: 288101 - DNA, 75 bp, Artificial Sequence
  Synthetic
acttactatgttttgtgtccgcttgcaaagacttttgcttgcgaatggctagagataccaacttgcacaaacaaa

SEQ ID NO: 288102 - DNA, 75 bp, Artificial Sequence
  Synthetic
agtcatgcttacacctggatctggacaatttttaacgactgatgacacacaatctccatcagcatttccatactt

SEQ ID NO: 288103 - DNA, 75 bp, Artificial Sequence
  Synthetic
taaaaattgcttcatcacactatgctgcacaattaatcacccttgacattaacccaaatcctattacgcttgaag

SEQ ID NO: 288104 - DNA, 75 bp, Artificial Sequence
  Synthetic
aggttcaccctggagattccttaaggaaaagttttgtaaatggactcaactaaattatattcataaggaatctga

SEQ ID NO: 288105 - DNA, 75 bp, Artificial Sequence
  Synthetic
taattcagccccagccttagatgctgccgaaacaggtcataccagtaatgttcaacctgaagacatgattgaaac

SEQ ID NO: 288106 - DNA, 75 bp, Artificial Sequence
  Synthetic
caataagacaaaagacataagtagacttaagcaagcaattgataaatatggtgttgatttgcccatggttacttt

SEQ ID NO: 288107 - DNA, 75 bp, Artificial Sequence
  Synthetic
ctaccacaagctcaacttaagataaaatacttaagtgaattaaagaagttaagcttccttgaaaaacaaatggaa

SEQ ID NO: 288108 - DNA, 75 bp, Artificial Sequence
  Synthetic
accaattacaataaaagtgttaagaatttcacaatttggaagataaatataaaagaaatggcccagattaggaga

SEQ ID NO: 288109 - DNA, 75 bp, Artificial Sequence
  Synthetic
tttggaaatctcttttcaaaatttcatttgaatcctggaatagttacaggttcagcagttggttgtgatccagaa

SEQ ID NO: 288110 - DNA, 75 bp, Artificial Sequence
  Synthetic
aggcaaaaagaataaaaattttacataatagatgtagtacaatcatcaggcaaaagaaaagatgtgaacctgttg

SEQ ID NO: 288111 - DNA, 75 bp, Artificial Sequence
  Synthetic
acatgtatgtaccaccaggggctcctctaccacaagcaagagatgactacacatggcaatctggcacgaatgcat

SEQ ID NO: 288112 - DNA, 75 bp, Artificial Sequence
  Synthetic
tatgtacctcctggagcacccgtccctgtaaaacgtgatgactacacatggcaatcaggaacaaatgcatctgtg

SEQ ID NO: 288113 - DNA, 75 bp, Artificial Sequence
  Synthetic
cactcaagcaagttctttcagatctttcgtttgatccatccttgatagacaggctatgcaagtctaaacacattt

SEQ ID NO: 288114 - DNA, 75 bp, Artificial Sequence
  Synthetic
agatcctaaatattttgatgggtatgaccaacaaagtgtggttattatggatgatgtgatgcaaaacccaagtgg

SEQ ID NO: 288115 - DNA, 75 bp, Artificial Sequence
  Synthetic
ctagatttacaattccctttatgagtattgcatcagcttattatatgttttatgatggttatgatggtgataatg

SEQ ID NO: 288116 - DNA, 75 bp, Artificial Sequence
  Synthetic
gccagattcacaatatggaacaattgtaacaaatgatatgggttccctgtgttctcgtatagtcaccgaagagca

SEQ ID NO: 288117 - DNA, 75 bp, Artificial Sequence
  Synthetic
agtattggatgcatacaaaaacattgatctggacaaacttaaaataatagcatatggtgatgatgtgatattctc

SEQ ID NO: 288118 - DNA, 75 bp, Artificial Sequence
  Synthetic
gtattgtgtagtactaatcataatttattagcacctcccacaataacctctttaccagctatgaataggagattt

SEQ ID NO: 288119 - DNA, 75 bp, Artificial Sequence
  Synthetic
catttatcacaaagccaaacacataaaggcctggtgtccacgtccaccaagagccgttccttaccaacacacaca

SEQ ID NO: 288120 - DNA, 75 bp, Artificial Sequence
  Synthetic
catgttacaaattacaaaccaagcacaggtgattacaccacagccatacaaaccagagagcatgttagagcagtc

SEQ ID NO: 288121 - DNA, 75 bp, Artificial Sequence
  Synthetic
aaggcctggtgtccacgtccaccaagagccgttccttaccaacacacacattccactaattatataccatccaaa

SEQ ID NO: 288122 - DNA, 75 bp, Artificial Sequence
  Synthetic
gattatagcaatgtgactttcttgaaaagaggattcagacaagatgaaaaatacaatttcctgattcaccccact

SEQ ID NO: 288123 - DNA, 75 bp, Artificial Sequence
  Synthetic
ttgggaatgccaaatgctgtccttttgtatgtggaaaggctgttgtctttagagatagaaacacgtgtcaaacat

SEQ ID NO: 288124 - DNA, 75 bp, Artificial Sequence
  Synthetic
atctttttaactctgctcttgatgattccatccttgtgtcttattccagtgatctagtcatataccgaacaaaca

SEQ ID NO: 288125 - DNA, 75 bp, Artificial Sequence
  Synthetic
cacattcatctgatttagtcatataccgcacaaacacaacaggtgatgactacataccaacttgtgactgtacag

SEQ ID NO: 288126 - DNA, 75 bp, Artificial Sequence
  Synthetic
ggcagagtgcttataagagttttgtagagaggattcgcagtgttagcgctggacgtgcactgtacattcctccct

SEQ ID NO: 288127 - DNA, 75 bp, Artificial Sequence
  Synthetic
tgaaggaccaccaccagcagcaataagtgatcttttacaatcagttagaactccagaagtaattaagtattgcga

SEQ ID NO: 288128 - DNA, 75 bp, Artificial Sequence
  Synthetic
ggacgtgcactgtacattcctccctatgatctgctcttgcatgaatggtatgagaaattttaactaattaattga

SEQ ID NO: 288129 - DNA, 75 bp, Artificial Sequence
  Synthetic
cattcaatataacttattaataggtgaaggaccttgtgagcctggtgattgtggtggaaaattattgtgcaagca

SEQ ID NO: 288130 - DNA, 75 bp, Artificial Sequence
  Synthetic
cagtttaggtaactttgtgtttgacgccagttttatcatccctttcccttttgtaacttagaagttataaacttg

SEQ ID NO: 288131 - DNA, 75 bp, Artificial Sequence
  Synthetic
tgaaccaggcgactgtgggggtaaactactatgtaaacatggggtcataggcatgattacagctggtggtgatgg

SEQ ID NO: 288132 - DNA, 75 bp, Artificial Sequence
  Synthetic
ggtattatttatgttatatataaactcttctgcacacttcagggtccatattcaggtgaacctaaacccaaaact

SEQ ID NO: 288133 - DNA, 75 bp, Artificial Sequence
  Synthetic
gtacatatgctaggtgaagcttttggaaatggttttgtagatagtgttagggatcaagttaatgcaataaatcct

SEQ ID NO: 288134 - DNA, 75 bp, Artificial Sequence
  Synthetic
gttatccgcaaagtgcctacgcaaagcctagtaatatcttgaatgatatatggttggtcgttcagctaaacccca

SEQ ID NO: 288135 - DNA, 75 bp, Artificial Sequence
  Synthetic
tggctcaaaagtaattaaatggctgctgaggatagtctcagctatgataataatggtaagaaacagttctgaccc

SEQ ID NO: 288136 - DNA, 75 bp, Artificial Sequence
  Synthetic
aatttacaggcttaggaatttatgatagaacactaatcataccaacacatgcagacccaggtaaagaggtgcaaa

SEQ ID NO: 288137 - DNA, 75 bp, Artificial Sequence
  Synthetic
ctacattaactctaataggatgttctggttcaccgtggcgattcttaaaagaaaaattctgcaaatggacacaac

SEQ ID NO: 288138 - DNA, 75 bp, Artificial Sequence
  Synthetic
atttaaagacattaggaaatatattccagagaatgaagatgattatccagattgcaatttggctctatctgccaa

SEQ ID NO: 288139 - DNA, 75 bp, Artificial Sequence
  Synthetic
atttattgattggatgaaatcaatgttgccacaagcacaacttaaagttaaatatttgagtgagctaaagaaact

SEQ ID NO: 288140 - DNA, 75 bp, Artificial Sequence
  Synthetic
aagctaaaacaacttaatctcttagagaaacaaatagagtcaatcaggcttgcacctgctaatgatcaggaaaaa

SEQ ID NO: 288141 - DNA, 75 bp, Artificial Sequence
  Synthetic
atatattgttaccatgggcgcacaagtctccagacagaatgttggcacacactccacacaaaacatggtctcaaa

SEQ ID NO: 288142 - DNA, 75 bp, Artificial Sequence
  Synthetic
ccaaccaaatcaggatattgtggtggaattttatacaaaattggtcaagtcttgggtattcatgttggtggtaac

SEQ ID NO: 288143 - DNA, 75 bp, Artificial Sequence
  Synthetic
actccacacaaaacatggtctcaaatgggtctagtttaaattattttaatataaattattttaaggacgcagcct

SEQ ID NO: 288144 - DNA, 75 bp, Artificial Sequence
  Synthetic
aagtttctgccattatatgcaagtgaagcaaagagaataaaaacattgcataacaaatgctgcaatataataaag

SEQ ID NO: 288145 - DNA, 75 bp, Artificial Sequence
  Synthetic
gtaatatcattaagggagggaagagaaatgaaccagttgcagtattaatacatggttctcctggtactggaaaat

SEQ ID NO: 288146 - DNA, 75 bp, Artificial Sequence
  Synthetic
catggttctcctggtactggaaaatctcttgctacttcagtccttgctcggatgctgactgttgaaactgacata

SEQ ID NO: 288147 - DNA, 75 bp, Artificial Sequence
  Synthetic
tacagtagaggcatgtggttattcagatagaataatgcaaatcacaaggggtgactctacaataacatcacagga

SEQ ID NO: 288148 - DNA, 75 bp, Artificial Sequence
  Synthetic
gcattcatacacctagcaaaactaaactgcaacccagtgtgttttatgatgttttccctggtagcaaagaaccag

SEQ ID NO: 288149 - DNA, 75 bp, Artificial Sequence
  Synthetic
aaagtgatatctactcacttccaccggatcctaaatattttgatggttatgatcaacagagtgttgtcataatgg

SEQ ID NO: 288150 - DNA, 75 bp, Artificial Sequence
  Synthetic
caaaagatgccactgctatcgataaacccacacaaccagacacttcatcaaatagattctacacactagacagta

SEQ ID NO: 288151 - DNA, 75 bp, Artificial Sequence
  Synthetic
ccctattctgccaaatggtatcaagtgttcctttcatacctcctatggcagatcttccagataaagggaaaccat

SEQ ID NO: 288152 - DNA, 75 bp, Artificial Sequence
  Synthetic
taaagtagcagtatctcactattcagcacaattgatgacactggatattgattcaaatccaatttcattagaaga

SEQ ID NO: 288153 - DNA, 75 bp, Artificial Sequence
  Synthetic
aggaaaaccctttgattcaagatttgttttttgcagcaccaatcattcacttcttgcccctcctaccattacctc

SEQ ID NO: 288154 - DNA, 75 bp, Artificial Sequence
  Synthetic
cagaagtggttacactgtacatgttcaatgcaatgccagtaaatttcatcaagggactttactaattttgatgat

SEQ ID NO: 288155 - DNA, 75 bp, Artificial Sequence
  Synthetic
agatattcaggttaagaaagattatctcttagatggtaagttagatatagcaaaaagttttagaccatgtgatgt

SEQ ID NO: 288156 - DNA, 75 bp, Artificial Sequence
  Synthetic
aaacaaacaaaagatatcacaaagcttaaaatagctttagacaaatatggtgttgatctacccatggttacattt

SEQ ID NO: 288157 - DNA, 75 bp, Artificial Sequence
  Synthetic
caaaaagttttagaccatgtgatgttaacaccaaaataggtaatgccaagtgctgcccattcatttgtggaaaag

SEQ ID NO: 288158 - DNA, 75 bp, Artificial Sequence
  Synthetic
caatgcaatgccagtaaatttcatcaagggactttactaattttgatgatacctgagcaccagttagcaaatgca

SEQ ID NO: 288159 - DNA, 75 bp, Artificial Sequence
  Synthetic
aaaccgtgtgacatagataataagattggaaatgcaaaatgttgcccctttatatgtggaaaagcagtcgtgttc

SEQ ID NO: 288160 - DNA, 75 bp, Artificial Sequence
  Synthetic
atgataactggcttaattttgatggtactttattgggtaatgctcttatatttccccaccaattcattaatttga

SEQ ID NO: 288161 - DNA, 75 bp, Artificial Sequence
  Synthetic
ttggaaatcttttctcaaaatttcatttaaatcctgggattgttactggttctgcagtaggatgtgatccagaga

SEQ ID NO: 288162 - DNA, 75 bp, Artificial Sequence
  Synthetic
agcaatggaggctatattccaaggtatagatctccagtctcccccacctccagctatagctgatcttctcagatc

SEQ ID NO: 288163 - DNA, 75 bp, Artificial Sequence
  Synthetic
atagatctccagtctcccccacctccagctatagctgatcttctcagatctgtgaagacaccagaaattattaaa

SEQ ID NO: 288164 - DNA, 75 bp, Artificial Sequence
  Synthetic
caattttccaaggtcccatatctatgaattccccacctccacctgccatagctgatttattacaatcagtaagaa

SEQ ID NO: 288165 - DNA, 75 bp, Artificial Sequence
  Synthetic
atggactcaatgcttagacataataactggagcttagtgataattccaatttgtgaattattggcagataccaaa

SEQ ID NO: 288166 - DNA, 75 bp, Artificial Sequence
  Synthetic
ccttaaggaagtgctatctaatttaggatttcaacccaatttgatagacagattatgtaaatcaaaacatatttt

SEQ ID NO: 288167 - DNA, 75 bp, Artificial Sequence
  Synthetic
gccagtgctgtagttccaatcactatatcaataagcccaatgtttgccgaattctctggggcacgtgcaaaacca

SEQ ID NO: 288168 - DNA, 75 bp, Artificial Sequence
  Synthetic
tattgcaaatatcattagtatagcaggtattatatttgttatttataaattattttgctcattgcaaggaccata

SEQ ID NO: 288169 - DNA, 75 bp, Artificial Sequence
  Synthetic
tttatatgacacctggctcaggtcaatttatgacaactgatgatttccaatcaccttcagccttaccatggtatc

SEQ ID NO: 288170 - DNA, 75 bp, Artificial Sequence
  Synthetic
ccaagagtaaagctccagaaagaagggtagtcacccagggcccagaagaggaatttggtcgttcactgcttaaac

SEQ ID NO: 288171 - DNA, 75 bp, Artificial Sequence
  Synthetic
taaaggcaaatttacaggtcttgggatatatgatcaggttatggtactcccaacacactctgatccaggttctga

SEQ ID NO: 288172 - DNA, 75 bp, Artificial Sequence
  Synthetic
gttttggatgcatataaaaacattgatttagataaactcaaaataatagcctatggagatgatgttatcttttct

SEQ ID NO: 288173 - DNA, 75 bp, Artificial Sequence
  Synthetic
atttatgacaactgatgatttccaatcaccttcagccttaccatggtatcacccaaccaaggaaatcctaatccc

SEQ ID NO: 288174 - DNA, 75 bp, Artificial Sequence
  Synthetic
tgtgtgattacaacagataatggaaaatttactggattgggtatttatgataaatacatgatcattccaacacat

SEQ ID NO: 288175 - DNA, 75 bp, Artificial Sequence
  Synthetic
cagttagaaaaccaaacagaaatggccaaagagatttttgctattaaagtagatattgcatcacaacctttagca

SEQ ID NO: 288176 - DNA, 75 bp, Artificial Sequence
  Synthetic
aatgagaaatttaaagacattaggaaatatttaccctcacgtgaggatgattatcctgcttgcaatcttgcttta

SEQ ID NO: 288177 - DNA, 75 bp, Artificial Sequence
  Synthetic
attatagtaatgtgacttttctgaaaagagggtttaagcaagataataaatactcatttctgatacatccaactt

SEQ ID NO: 288178 - DNA, 75 bp, Artificial Sequence
  Synthetic
agatattgcatcacaacctttagcaaacaccatgattggagaaatcgcaagctattttacacattggactggtag

SEQ ID NO: 288179 - DNA, 75 bp, Artificial Sequence
  Synthetic
tcattaagctagatagaaatgaaaaattcagagatatacgcaagtatataccagagagggaagatgattatcctg

SEQ ID NO: 288180 - DNA, 75 bp, Artificial Sequence
  Synthetic
accattacccaacaaaagctggatattgtgggggtgtcttatataaggttggctctatccttggtatacatgtgg

SEQ ID NO: 288181 - DNA, 75 bp, Artificial Sequence
  Synthetic
caagctatgcttgggacacacatagtttgggacgttgggttgcaatcaacagtatctttagttgttccatgggtt

SEQ ID NO: 288182 - DNA, 75 bp, Artificial Sequence
  Synthetic
tagagatgtgtataagcagtttgaacagaagatacgcagtgtgagcgctggtcgcgcactgtatatccctcccta

SEQ ID NO: 288183 - DNA, 75 bp, Artificial Sequence
  Synthetic
gtcgcgcactgtatatccctccctatgatctgcttctgcacgagtggtatgaaaaattttaagttgtttagatat

SEQ ID NO: 288184 - DNA, 75 bp, Artificial Sequence
  Synthetic
agctagaatgttaaagtaccattacccaactaaatctggatattgtggtggtgttttatacaagataggtagtat

SEQ ID NO: 288185 - DNA, 75 bp, Artificial Sequence
  Synthetic
ccaatagggctgacatgctgtgtttcgtatcagcgtgcaaggatttctgcttgcgtatggccagagacacggata

SEQ ID NO: 288186 - DNA, 75 bp, Artificial Sequence
  Synthetic
acactgttattacggtaaccttgtacgccagttttatcatccctttccctttgtaacttagaagttttaaacttg

SEQ ID NO: 288187 - DNA, 75 bp, Artificial Sequence
  Synthetic
ggaacctgcagttctaagcaataatgacccaagattagaaactgactttgacacggcacttttctcaaagtacaa

SEQ ID NO: 288188 - DNA, 75 bp, Artificial Sequence
  Synthetic
aatgttaaggatcttggatacccgactatacacacccctaacaagactaaactacacccaagtgtcttttatgat

SEQ ID NO: 288189 - DNA, 75 bp, Artificial Sequence
  Synthetic
cgtatcagcgtgcaaggatttctgcttgcgtatggccagagacacggatatgcacatacaaaatgatgccattga

SEQ ID NO: 288190 - DNA, 75 bp, Artificial Sequence
  Synthetic
aggtaaccctgcttgtgaagtgaccacacatatgaagattgctgtagcacattatgcagcacaattatccacact

SEQ ID NO: 288191 - DNA, 75 bp, Artificial Sequence
  Synthetic
attttagatgctgctgaaactgggcacactagtaatgtacaaccagaggatacaattgaaacccgatatgtacaa

SEQ ID NO: 288192 - DNA, 75 bp, Artificial Sequence
  Synthetic
ttaattgtgaattgaatgatcatatgagagttgctatagcgcactactcagctcaattaatgacccttgatattg

SEQ ID NO: 288193 - DNA, 75 bp, Artificial Sequence
  Synthetic
aatttagagtgtggcgcatcaatttacaagaaatggcccagattaggcgtaaatatgaaatgtttacatatgtga

SEQ ID NO: 288194 - DNA, 75 bp, Artificial Sequence
  Synthetic
gattaaaaagagagatcttatcaacaacagtacaaaggatatatctaaacttaaaatagcattagataaatatgg

SEQ ID NO: 288195 - DNA, 75 bp, Artificial Sequence
  Synthetic
tctccagacagaatgttggcacacactccacgcaaaacatggtctcaaatgggtctagtttaaattattttaata

SEQ ID NO: 288196 - DNA, 75 bp, Artificial Sequence
  Synthetic
ctccacgcaaaacatggtctcaaatgggtctagtttaaattattttaatataaattactttaaggatgcagcctc

SEQ ID NO: 288197 - DNA, 75 bp, Artificial Sequence
  Synthetic
agaaccaacaagtagagaacattttgcatggcaatcaggcactaatgcatctatcttctggcaacaaggacagcc

SEQ ID NO: 288198 - DNA, 75 bp, Artificial Sequence
  Synthetic
gacaccatagcatttagaatgacatatggaaatttgtttgcatgtttccacaaaaaccctggagttgtaactggt

SEQ ID NO: 288199 - DNA, 75 bp, Artificial Sequence
  Synthetic
ttgagtgttgcatctgcttattacatgttttatgatggttataatggtgacacacctggatccaaatatggcacc

SEQ ID NO: 288200 - DNA, 75 bp, Artificial Sequence
  Synthetic
aaaggacgccactgctattgataagcccacacaaccagacacttcatcaaacagattctacacactagatagcaa

SEQ ID NO: 288201 - DNA, 75 bp, Artificial Sequence
  Synthetic
gtatacaccctgtgtggtttgaagcactgaaggaaatcttaaaagacttacagtttgaacataggttaatagata

SEQ ID NO: 288202 - DNA, 75 bp, Artificial Sequence
  Synthetic
actaatatataccataaagctaagcatgtgaaagcatggtgtcccagaccacccagagctgttccatacaggtat

SEQ ID NO: 288203 - DNA, 75 bp, Artificial Sequence
  Synthetic
atgtgaaagcatggtgtcccagaccacccagagctgttccatacaggtatgttggatcaacaaattacaagaaac

SEQ ID NO: 288204 - DNA, 75 bp, Artificial Sequence
  Synthetic
taataatgtgattataagaaccttagtcctagatgcctataagcatatagatctagataaacttaagataatagc

SEQ ID NO: 288205 - DNA, 75 bp, Artificial Sequence
  Synthetic
atacagaaatttacatctatttaattcagaagtacatgactcagtattaatatcatattcctcagatttagtcat

SEQ ID NO: 288206 - DNA, 75 bp, Artificial Sequence
  Synthetic
taaccccggatgatgcaactgccattgataagcccacacaatcaaacacactataccaacactccaataaccaac

SEQ ID NO: 288207 - DNA, 75 bp, Artificial Sequence
  Synthetic
aaatctgatactttcaagaaattggattatgatagtgtcacattcttaaaaagaggattcaaacaagattccaaa

SEQ ID NO: 288208 - DNA, 75 bp, Artificial Sequence
  Synthetic
ccaaggagatattcatacctggacaagtcagaaacttgattgaaatgtgccaagttgatacactcatccccgtcc

SEQ ID NO: 288209 - DNA, 75 bp, Artificial Sequence
  Synthetic
gtgtttgaggtgcttgtagtgccaaatatccagcctagttcatctgtatcaagccattcagcccctgccctagat

SEQ ID NO: 288210 - DNA, 75 bp, Artificial Sequence
  Synthetic
ttcaagaaagtgaatactacccaaaacacattcaatataaccttttgattggtgaaggtccatgtgaaccaggag

SEQ ID NO: 288211 - DNA, 75 bp, Artificial Sequence
  Synthetic
taaagataggtattacccaattaatgtcaccagtcatgactggtatgagattcaagaaagtgaatactacccaaa

SEQ ID NO: 288212 - DNA, 75 bp, Artificial Sequence
  Synthetic
tgttgtattgtaacaactgataaaggcaaatttacaggtcttgggatatatgatcaggttatggtactcccaaca

SEQ ID NO: 288213 - DNA, 75 bp, Artificial Sequence
  Synthetic
atatgaagattgctgtagcacattatgcagcacaattatccacactagatataaacccccaacccctctcacttg

SEQ ID NO: 288214 - DNA, 75 bp, Artificial Sequence
  Synthetic
acatggagtgattggaataataacagcaggtggagagggtcatgtggcatttatcgatctcaggcaatttcattg

SEQ ID NO: 288215 - DNA, 75 bp, Artificial Sequence
  Synthetic
tgtgtcacttaatgtggcataatggacgtgatgtttacaaagagtttgaacgtgggattcgcagcgttagcgctg

SEQ ID NO: 288216 - DNA, 75 bp, Artificial Sequence
  Synthetic
tgtgttgacgagtgggaatgtatcagtagggtataatcacacccatccaggtgaacaaggtagagaagtggtgcc

SEQ ID NO: 288217 - DNA, 75 bp, Artificial Sequence
  Synthetic
cactgttattccggtaactttgtacgccagtttttccctcccttccctcattatgtaacttagaagcatgaacat

SEQ ID NO: 288218 - DNA, 75 bp, Artificial Sequence
  Synthetic
cgcggatgagcaaggaataactgattacattcacatgctgggtgaagcttttggatcaggatttgttgatagtgt

SEQ ID NO: 288219 - DNA, 75 bp, Artificial Sequence
  Synthetic
gacgtgcgttgtatatcccaccctatgaacttttactgcatgagtggtatgagaaattttaactttcatatatat

SEQ ID NO: 288220 - DNA, 75 bp, Artificial Sequence
  Synthetic
tttatgacaactgatgatttccaatcaccttcagccttaccatggtatcacccaaccaaagaaatcttaattcca

SEQ ID NO: 288221 - DNA, 75 bp, Artificial Sequence
  Synthetic
atggaccaataggcaataatcatccagattattgaaggtcaagcacttctgtttccccggtcaataaagatatgc

SEQ ID NO: 288222 - DNA, 75 bp, Artificial Sequence
  Synthetic
ttaaaactggatccaggttgttcccacctggatctcccaaagggagtggaactctgttattacggtaactttgta

SEQ ID NO: 288223 - DNA, 75 bp, Artificial Sequence
  Synthetic
agtttgagcttagaaagaaagaaaaaataagggacgggaaaactagagttatagaagccaatagtgtgaatgata

SEQ ID NO: 288224 - DNA, 75 bp, Artificial Sequence
  Synthetic
aattcctctgatccacaaacaatcatagccacattaacactaattggatgctcaggttccccctggcgatttctt

SEQ ID NO: 288225 - DNA, 75 bp, Artificial Sequence
  Synthetic
tagccacattaacactaattggatgctcaggttccccctggcgatttcttaaagaaaaattttgcaaatggaccc

SEQ ID NO: 288226 - DNA, 75 bp, Artificial Sequence
  Synthetic
ttacttaaggtcaagcacttctgtttccccggtcaacgttgatatgctctaacagggcaaaaacaactgcgatcg

SEQ ID NO: 288227 - DNA, 75 bp, Artificial Sequence
  Synthetic
ccagcagtagacctggcagatgaggctggacgtaccccactggcgacagtggtccagcctgcgtggctgcctgct

SEQ ID NO: 288228 - DNA, 75 bp, Artificial Sequence
  Synthetic
gatattgcatcacaacctttagcaaataccatgattggagaaattgcaagttattttacacattgggctggtagt

SEQ ID NO: 288229 - DNA, 75 bp, Artificial Sequence
  Synthetic
aaaattcattgaatggatgaaatccatgcttcctcaggctcagcttaaaatcaaatatttgagtgagctcaagaa

SEQ ID NO: 288230 - DNA, 75 bp, Artificial Sequence
  Synthetic
gcagccattgctcataatccaatgagttagtggtcgtaatgcgcaagtgcgggatgggaccaactactttgggtg

SEQ ID NO: 288231 - DNA, 75 bp, Artificial Sequence
  Synthetic
tgtgtgttatatggtgacaatttatagtatataagttgtcatcatgggcgcacaagtatctagacaaaatgttgg

SEQ ID NO: 288232 - DNA, 75 bp, Artificial Sequence
  Synthetic
actaacggttctagcctcaattatttcaacatcaactatttcaaagatgctgcctcaagtggagcatccagatta

SEQ ID NO: 288233 - DNA, 75 bp, Artificial Sequence
  Synthetic
aaacagaagaaaaggtgtgaaccagttgcagttgccatacatggtgaacctggtactggtaaatccatgactaca

SEQ ID NO: 288234 - DNA, 75 bp, Artificial Sequence
  Synthetic
tatattgacaccatgggcgcacaggtatctaggcaaaatgttggaactcattctacacaaaactccgtatcaaat

SEQ ID NO: 288235 - DNA, 75 bp, Artificial Sequence
  Synthetic
gtatcagcgtgcaaggatttctgcttgcgtatggccagagacacggatatgcacaaacaagatgatgccattgaa

SEQ ID NO: 288236 - DNA, 75 bp, Artificial Sequence
  Synthetic
ctcactccacccacgtggtgctgtacactgttattccggtaactttgtacgccagtttttccctcccttccctca

SEQ ID NO: 288237 - DNA, 75 bp, Artificial Sequence
  Synthetic
actcagacaggttgatgcaaatcacccgtggagattccaccataacatcccaggatatagctaatgcagtagttg

SEQ ID NO: 288238 - DNA, 75 bp, Artificial Sequence
  Synthetic
tggatgacattatgcaaaatccaagtggggaagatatgaccttattctgtcaaatggtatctagtgtcacattca

SEQ ID NO: 288239 - DNA, 75 bp, Artificial Sequence
  Synthetic
accctgttaaagatgtattagagaaaggaataccaacactacaatcacccacagtcgaggcttgtggatattcgg

SEQ ID NO: 288240 - DNA, 75 bp, Artificial Sequence
  Synthetic
tcaaatacttgctgaggacaaaagacgtaggcaagtagtagatgttatggcagcaatttttcagggacccattac

SEQ ID NO: 288241 - DNA, 75 bp, Artificial Sequence
  Synthetic
tagccgtacctggacatctgcctcattagggtggtggtggaaattacctgacgctcttaagaatatgggcatatt

SEQ ID NO: 288242 - DNA, 75 bp, Artificial Sequence
  Synthetic
caaagatgcttctgcaattgacaaaccttctcgtccggatacatcttctaatagattttatactttgaagagtgt

SEQ ID NO: 288243 - DNA, 75 bp, Artificial Sequence
  Synthetic
tcttgaaggacctccgcctgcagcaataaatgacttattgaaatcagttagaactccagaagtcattaagtattg

SEQ ID NO: 288244 - DNA, 75 bp, Artificial Sequence
  Synthetic
gctatacctgaacaccaactagcatcagcagtcaaaggaaatgtttcagtggggtataagcacactcatccaggt

SEQ ID NO: 288245 - DNA, 75 bp, Artificial Sequence
  Synthetic
tctggaataatttatgttatatataaacttttctgtacattacaaggaccatattcaggtgaacccaagcccaaa

SEQ ID NO: 288246 - DNA, 75 bp, Artificial Sequence
  Synthetic
aggagtggttacacaatacatgtacagtgcaatgctagcaaattccatcaaggcacgttaatcgttgcactaata

SEQ ID NO: 288247 - DNA, 75 bp, Artificial Sequence
  Synthetic
tacctatatatcctcaccaatatattaacctgagaactaacaattcagccactctcatccttccatacattaatg

SEQ ID NO: 288248 - DNA, 75 bp, Artificial Sequence
  Synthetic
gtaaattcacaggtctagggatatatgatagaacactaatcctaccaacacatgcagatccaggtagtgaaatac

SEQ ID NO: 288249 - DNA, 75 bp, Artificial Sequence
  Synthetic
gcatgaaccttaatttgcaacccactgaagagtattggcttaattttgatggaacactactcggaaatattacta

SEQ ID NO: 288250 - DNA, 75 bp, Artificial Sequence
  Synthetic
tgatagaacactaatcctaccaacacatgcagatccaggtagtgaaatacagatagatggcattacaactaaagt

SEQ ID NO: 288251 - DNA, 75 bp, Artificial Sequence
  Synthetic
tgtgaaagcatggtgtcccagaccacccagagctgttccatacaggtatgttggatcaacaaattataaaaaacc

SEQ ID NO: 288252 - DNA, 75 bp, Artificial Sequence
  Synthetic
tataacagtgtcaattagtccaatgttttctgaattctcagggcctaggaacaaagttgtctttacccaaggctt

SEQ ID NO: 288253 - DNA, 75 bp, Artificial Sequence
  Synthetic
caactggagtctggtgataatcccaatatgccctcttgaaacatcaagtaccgttaacacaatacctatcacaat

SEQ ID NO: 288254 - DNA, 75 bp, Artificial Sequence
  Synthetic
attccagaaaatgaagatgattacccagattgtaatttggccctatctgctaatcaaccagaaaccacaataatc

SEQ ID NO: 288255 - DNA, 75 bp, Artificial Sequence
  Synthetic
atacctgggcaagttagaaacttaatagaaatgtgtcaggttgatacactcatccccatcaataatacgggaaat

SEQ ID NO: 288256 - DNA, 75 bp, Artificial Sequence
  Synthetic
gatgactttcaatccccatgtgcactcccttggtatcacccaaccaaagaaatctctattccaggtgaggtaaaa

SEQ ID NO: 288257 - DNA, 75 bp, Artificial Sequence
  Synthetic
gtgggattctatacaaaattggacaagttttgggaattcatgttggtggtaatggaagagatgggtttgcagcta

SEQ ID NO: 288258 - DNA, 75 bp, Artificial Sequence
  Synthetic
tgttattaagatcatatttttcagaaacacaaggtcaaataactactactaaacctactattgaatgcaatctac

SEQ ID NO: 288259 - DNA, 75 bp, Artificial Sequence
  Synthetic
cattagcaaccacctatcttggggaaatgagtagttgctttacacactggactgggagtttacgatttagcttta

SEQ ID NO: 288260 - DNA, 75 bp, Artificial Sequence
  Synthetic
cagttggagaaccagataaaatcttttctatcaaaacagatgtagcctctcagccattagctactactctaattg

SEQ ID NO: 288261 - DNA, 75 bp, Artificial Sequence
  Synthetic
cagattagaggttgatttcaaacaagccttattttctaaatacaaaggtaacaaccaatgtgaaataaatgatca

SEQ ID NO: 288262 - DNA, 75 bp, Artificial Sequence
  Synthetic
acacctagtgtgggatgttggactccagtcaacagcctcacttgtagtgccatgggtcagtgcaagtcattttag

SEQ ID NO: 288263 - DNA, 75 bp, Artificial Sequence
  Synthetic
gcagatgagcaaggaataactgattacatccacatgctgggtgaagcctttggatcaggatttgttgacagtgtt

SEQ ID NO: 288264 - DNA, 75 bp, Artificial Sequence
  Synthetic
tacgccacctggcatcgcagaacctactacaagaaaggaagcaatgttaggtactcatgtaatatgggatgtagg

SEQ ID NO: 288265 - DNA, 75 bp, Artificial Sequence
  Synthetic
gtctgcatggtgtcagcttgcaaagacttttgcttgcgattggctagagatactaatttacacatgcaggagggt

SEQ ID NO: 288266 - DNA, 75 bp, Artificial Sequence
  Synthetic
gggcattaagaaaagagacttgattaataaacaaactagagatatcacaaaactcaaaatggcattggacaagta

SEQ ID NO: 288267 - DNA, 75 bp, Artificial Sequence
  Synthetic
tatcaaactaggctagtaattccacctcaaactccagccacagctaggttattatgttttgtatcaggctgtaaa

SEQ ID NO: 288268 - DNA, 75 bp, Artificial Sequence
  Synthetic
ctgtaccagcattggatgctgcagagactggacatactagttctgttcaacctgaagatatgatcgagacaaggt

SEQ ID NO: 288269 - DNA, 75 bp, Artificial Sequence
  Synthetic
ggtaatagaacaaaatcctgttgaacactacatagatgaggtccttaatgaggttttagttgttccaaatattaa

SEQ ID NO: 288270 - DNA, 75 bp, Artificial Sequence
  Synthetic
aatgacactgtgctgtttagaacaacttttggcaacctcttctccaaatttcatttaaaccctggtatcgttact

SEQ ID NO: 288271 - DNA, 75 bp, Artificial Sequence
  Synthetic
ctatgacacaggcaaaggtgttggtttcactacatggaaaatcagcttacaagaaatggcacaagtcagaagaaa

SEQ ID NO: 288272 - DNA, 75 bp, Artificial Sequence
  Synthetic
attgacactttacatgatctttcttgtaaatttttaccactctatgctagtgacgctaaaagaataaagatatta

SEQ ID NO: 288273 - DNA, 75 bp, Artificial Sequence
  Synthetic
gtagtatacacccaatttggtttgaagctcttaaagaagtgctctttaatctagggtttaagcctaatttaatag

SEQ ID NO: 288274 - DNA, 75 bp, Artificial Sequence
  Synthetic
tatgtacagacatcacaaacaagagatgaaatgagtttagagagttttcttggtaggtcagggtgtatacatgaa

SEQ ID NO: 288275 - DNA, 75 bp, Artificial Sequence
  Synthetic
aacagaagaaaaggtgtgaaccagttgcagttgccatacatggtgaacctggtactggtaagtctatgactacaa

SEQ ID NO: 288276 - DNA, 75 bp, Artificial Sequence
  Synthetic
gaaggaggggtcccatcaggttgctctggaacaagtatatttaatacaatgattaataatattattatcaggaca

SEQ ID NO: 288277 - DNA, 75 bp, Artificial Sequence
  Synthetic
atgtatgcacctccaggggccccagttccaataaaacgcgaagattatacatggcaatcaggaacaaatgcttct

SEQ ID NO: 288278 - DNA, 75 bp, Artificial Sequence
  Synthetic
tgtttacttacactagattcgattctgaaataaccttggttccatgcatttctgcacttagcaaggatattggac

SEQ ID NO: 288279 - DNA, 75 bp, Artificial Sequence
  Synthetic
ggatgacattatgcaaaatccaagtggggaagatatgaccttattctgtcaaatggtgtctagtgtcacattcat

SEQ ID NO: 288280 - DNA, 75 bp, Artificial Sequence
  Synthetic
aagcaattgctaaagaaggcattaagtatggtcttacaatcactccagctgacaaatcaagtgaattcaagaaat

SEQ ID NO: 288281 - DNA, 75 bp, Artificial Sequence
  Synthetic
atgcgtcatccaaatatggttccgtagtaaccaatgacatgggaaccatatgtgttagactagttacatctacac

SEQ ID NO: 288282 - DNA, 75 bp, Artificial Sequence
  Synthetic
gcaacatgggcaagcatacccaagattttctctaccctttttgagtgtagcttcagcttactacatgttttatga

SEQ ID NO: 288283 - DNA, 75 bp, Artificial Sequence
  Synthetic
gacaaatcaagtgaattcaagaaattggactataacagtgtgacctttctaaaaagaggatttaaacaagatgac

SEQ ID NO: 288284 - DNA, 75 bp, Artificial Sequence
  Synthetic
tcattgccagctatgaacagaagattctttctagatttagatattgtggcgtgtgataaatacaaggatccacag

SEQ ID NO: 288285 - DNA, 75 bp, Artificial Sequence
  Synthetic
gtgtgataaatacaaggatccacagggaaagctaaatgtggctgctgcctttcaaccttgtgatgtaaatacaaa

SEQ ID NO: 288286 - DNA, 75 bp, Artificial Sequence
  Synthetic
tcactccaccaactatgtgccacaaaatggagaggtcgcaactcaaatcaaaaccagagccaatcttttcaccct

SEQ ID NO: 288287 - DNA, 75 bp, Artificial Sequence
  Synthetic
cactgtgtcatttaatgtggcacaatggcagggacgtgtataagcagtttgagcaaaggatacgcagtgtgagcg

SEQ ID NO: 288288 - DNA, 75 bp, Artificial Sequence
  Synthetic
catatcatgacaagaatctatcataaagctaaacacgtcaaagcatggtgtccgcgcccacccagagcacttgaa

SEQ ID NO: 288289 - DNA, 75 bp, Artificial Sequence
  Synthetic
tcttattctagtgatttaatcatttaccgaacaaacactgaaggtgatgatgtaatccctaattgtaattgtact

SEQ ID NO: 288290 - DNA, 75 bp, Artificial Sequence
  Synthetic
tgtatgttcatgttggtaatcttatctatagaaatttacatctcttcaattctgaaatgcatgaatctatactgg

SEQ ID NO: 288291 - DNA, 75 bp, Artificial Sequence
  Synthetic
ttttgattccaggtttgtattgtgcagtactaatcataatttgttagcaccccctacaattacctcattgccagc

SEQ ID NO: 288292 - DNA, 75 bp, Artificial Sequence
  Synthetic
cttgaaggacctccacctgcagcaataaatgatttattgaaatcagttagaactccagaagtcattaagtactgt

SEQ ID NO: 288293 - DNA, 75 bp, Artificial Sequence
  Synthetic
atcctccagattatctaaggtcaagcacttctgtttccccggtctaaactgatatgctccaacagggcaaaaaca

SEQ ID NO: 288294 - DNA, 75 bp, Artificial Sequence
  Synthetic
cagacttacactctggcgcaagtgtataatcaaatacttgctgaggacaaaagacgtaggcaagtagtagatgtt

SEQ ID NO: 288295 - DNA, 75 bp, Artificial Sequence
  Synthetic
atatccaatacaacattttaattggagagggaccttgtgaaccaggagattgtggaggaaagctgttatgtaaac

SEQ ID NO: 288296 - DNA, 75 bp, Artificial Sequence
  Synthetic
taaaaatagatatttcccaatcacagtgacaagccatgactggtatgaaatacaggaaagtgaatactaccccaa

SEQ ID NO: 288297 - DNA, 75 bp, Artificial Sequence
  Synthetic
tgtagaacaccttggtcaagtttttggtgttggctttgtggacagtataaaacaacaagtaaattttattaatcc

SEQ ID NO: 288298 - DNA, 75 bp, Artificial Sequence
  Synthetic
gctggtggtgataatcatgtggcttttattgatcttagacactttcactgtgctgaggagcaaggaattacagat

SEQ ID NO: 288299 - DNA, 75 bp, Artificial Sequence
  Synthetic
agcatgtagctagtcgtaatgagcaattgcgggatgggaccaactactttgggtgtccgtgtttcactttttacc

SEQ ID NO: 288300 - DNA, 75 bp, Artificial Sequence
  Synthetic
gctactcttaccctactaggttgttcaggttcaccatggagatttttgaaagagaaattttgctcgtggcttcaa

SEQ ID NO: 288301 - DNA, 75 bp, Artificial Sequence
  Synthetic
tcatcaaatggatgctgaggataatatcagcaatggttataataataaggaattcctctgatccacaaactatat

SEQ ID NO: 288302 - DNA, 75 bp, Artificial Sequence
  Synthetic
agtatcaaatgggtcaagtttaaattatttcaatattaactatttcaaagatgctgcatcaagtggtgcttctaa

SEQ ID NO: 288303 - DNA, 75 bp, Artificial Sequence
  Synthetic
agtttatcgattggataaagagtatgttaccacaagcccaattaaaagtagaatatttaaataaacttaaacagc

SEQ ID NO: 288304 - DNA, 75 bp, Artificial Sequence
  Synthetic
agactcatggttgaaaaaatttactgaagcatgcaatgcagccagaggacttgagtggatagggaataaaatatc

SEQ ID NO: 288305 - DNA, 75 bp, Artificial Sequence
  Synthetic
ggttattcagataggattattcaaattactagaggagactcaacaattacctcacaagatgttgccaatgccgta

SEQ ID NO: 288306 - DNA, 75 bp, Artificial Sequence
  Synthetic
taaattcttgccactgtatgcatctgaagcacgtagaattaagaatctttataataaatgtaataatgttattaa

SEQ ID NO: 288307 - DNA, 75 bp, Artificial Sequence
  Synthetic
gaaagtcttagagtagcagatgtaagaacacaagaaaagattaaaatggaaattgataccctacatgacttatca

SEQ ID NO: 288308 - DNA, 75 bp, Artificial Sequence
  Synthetic
gaacacaagaaaagattaaaatggaaattgataccctacatgacttatcatgcaaatttttaccattgtatgcag

SEQ ID NO: 288309 - DNA, 75 bp, Artificial Sequence
  Synthetic
tagaaagcaaaatttggaatggcacatctaaaggttggtggtggaaattgcctgatgctcttaaaaatatgggaa

SEQ ID NO: 288310 - DNA, 75 bp, Artificial Sequence
  Synthetic
gagactgatatatactctctacctccagatccaaaatactttgatggttatgatcaacaaagtgttgtcattatg

SEQ ID NO: 288311 - DNA, 75 bp, Artificial Sequence
  Synthetic
tgccatgataccagaacaccaattagcaagtgcaacttctggaaatgttactgctggatacaatttaactcaccc

SEQ ID NO: 288312 - DNA, 75 bp, Artificial Sequence
  Synthetic
gatagtgtttttggtacagagggtctggaggcactcgatcttaccactagtgctggatttccttatgtgtctatg

SEQ ID NO: 288313 - DNA, 75 bp, Artificial Sequence
  Synthetic
aaggaaaaccatttacatcaaaatttgtgcttgcaagtactaatcatactcttctcacaccaccaactgtgtcat

SEQ ID NO: 288314 - DNA, 75 bp, Artificial Sequence
  Synthetic
caaatggtttccagtgtcacgttcataccaccaatggctgatttaccagataagggcaaggcctttgactctagg

SEQ ID NO: 288315 - DNA, 75 bp, Artificial Sequence
  Synthetic
tgctggatttccttatgtgtctatgggcattaagaaaagagacttaattaataaacaaacaagagatatcacaaa

SEQ ID NO: 288316 - DNA, 75 bp, Artificial Sequence
  Synthetic
aatataactatatacccccatcaacttattaatctaaggagcaataactcagcaaccattatagtcccttatgta

SEQ ID NO: 288317 - DNA, 75 bp, Artificial Sequence
  Synthetic
accatgtgatgttaataataaaataggtaatgcaaaatgttgtccatttatatgtggaaaagctgtggaattcaa

SEQ ID NO: 288318 - DNA, 75 bp, Artificial Sequence
  Synthetic
cgtgtcattgaagctagtagtgtaaatgacactgtgctgtttaggacaacttttggcaacctcttctccaaattt

SEQ ID NO: 288319 - DNA, 75 bp, Artificial Sequence
  Synthetic
tacatgataatttcaaggattcacagggtaaacttaatgtagcagcagccttccaaccatgtaatgtggacaata

SEQ ID NO: 288320 - DNA, 75 bp, Artificial Sequence
  Synthetic
ctattacagtatctattagtccaatgtgtgctgaattctctggagctcgggcaaaaagccagggattacctgtca

SEQ ID NO: 288321 - DNA, 75 bp, Artificial Sequence
  Synthetic
atatttcaaggtatagatcttcacacaccacctccaccagccataactgatcttcttagatctgttagaactcca

SEQ ID NO: 288322 - DNA, 75 bp, Artificial Sequence
  Synthetic
cataatgcttgaagaagacaaacggaggagacaagtggttgacgtcatgtcggccatattccaaggaccaattga

SEQ ID NO: 288323 - DNA, 75 bp, Artificial Sequence
  Synthetic
catttgattatacaaattatgatggtggtatacatccaatttggtttaaagctcttaaagaagtgctctttaatc

SEQ ID NO: 288324 - DNA, 75 bp, Artificial Sequence
  Synthetic
ccaagtcagaaacttgattgaactgtgtcaggtggataccctaattccagtgaataatgtagaagggaatgaaaa

SEQ ID NO: 288325 - DNA, 75 bp, Artificial Sequence
  Synthetic
aagggggggtcccatcaggttgctctggaacaagcatatttaatacaatgattaataatattattattaggacat

SEQ ID NO: 288326 - DNA, 75 bp, Artificial Sequence
  Synthetic
ctaacgtagtttcaatagtgggtatcatttatataatttataagttattttgcactctacaaggcccatactcag

SEQ ID NO: 288327 - DNA, 75 bp, Artificial Sequence
  Synthetic
gcagaatgtaaaatagagaaggaattaaatttagccaatacaatcataacaatcattgccaatgttattagtata

SEQ ID NO: 288328 - DNA, 75 bp, Artificial Sequence
  Synthetic
actatgattggtgaaatagctagttattttacccaatggacaggtagccttcgcttcagcttcttattttgtggt

SEQ ID NO: 288329 - DNA, 75 bp, Artificial Sequence
  Synthetic
tgtgacaactgataagggtaaattcactggtcttggtatttacaaccaaattatggttcttcctacacattctga

SEQ ID NO: 288330 - DNA, 75 bp, Artificial Sequence
  Synthetic
tggcacaggggccagaggaagaatttggaatgtctttgattaagcacaactcatgtgtgattacaacagagaatg

SEQ ID NO: 288331 - DNA, 75 bp, Artificial Sequence
  Synthetic
acaaatcaagtgaattcaagaaattggactatagtagtgtgacctttctaaaaagagggtttaaacaagatgaca

SEQ ID NO: 288332 - DNA, 75 bp, Artificial Sequence
  Synthetic
gggatgtaggattgcaatcaacagtgtcgatggtagtaccatgggtgagtgctagccatttcagaaacacaacac

SEQ ID NO: 288333 - DNA, 75 bp, Artificial Sequence
  Synthetic
aaattagaccgcaatgagaaatttagagatattagaaaatacttgcccacccgtgatgatgattacctcggatgc

SEQ ID NO: 288334 - DNA, 75 bp, Artificial Sequence
  Synthetic
tgctgactcatatgatttatataataaagatggaataaagttagaaataacagtcttaaaattagataggaatga

SEQ ID NO: 288335 - DNA, 75 bp, Artificial Sequence
  Synthetic
atccggctgcaaagacttctgtttgaggatggcacgtgacactaatttacatctacagagtgcgcccattacaca

SEQ ID NO: 288336 - DNA, 75 bp, Artificial Sequence
  Synthetic
tatgacctgcttttgcatgaatggtatgaaaaattttaagttgtttagatatagaaataataaacaattagtttt

SEQ ID NO: 288337 - DNA, 75 bp, Artificial Sequence
  Synthetic
gaatgattaaatatcactatccaacaaaagccggtttttgtggtggtgtcttgtacaaagttggttctattcttg

SEQ ID NO: 288338 - DNA, 75 bp, Artificial Sequence
  Synthetic
aatgttggagatgttatatcctatggcaacatactgcttagtggtaaccagacagctagaatgctcaaatacagc

SEQ ID NO: 288339 - DNA, 75 bp, Artificial Sequence
  Synthetic
ctctcatattccggtatgtttgcacgccagtttgcctctccttttcccacgtaacgttagaagcttatgcactaa

SEQ ID NO: 288340 - DNA, 75 bp, Artificial Sequence
  Synthetic
ctagatgcagcagaaactgggcatacaagcaatgtacaaccagaagatgtaattgagacaagatatgttcagaca

SEQ ID NO: 288341 - DNA, 75 bp, Artificial Sequence
  Synthetic
gtcaagtaaaaatttaccatctattcatgtttcatccaaaacacgcttacaacctagtgtattttatgatgtctt

SEQ ID NO: 288342 - DNA, 75 bp, Artificial Sequence
  Synthetic
tgttgcttagatcttactttactgatgtgcaaggccaaataatctcatcaaagaaaactagtgaatgtaatcttc

SEQ ID NO: 288343 - DNA, 75 bp, Artificial Sequence
  Synthetic
attatcgttatccgcacatttactacgcaaagcctattagcgttctggaagttcactggctggtcgttccgctag

SEQ ID NO: 288344 - DNA, 75 bp, Artificial Sequence
  Synthetic
agggaaaaaattttactaagtggcaagtaaacatccaagagatggctcagattagaagaaaatttgaaatgttca

SEQ ID NO: 288345 - DNA, 75 bp, Artificial Sequence
  Synthetic
tgtcaattgaccccacatatggagatagccgttgcgcattatgcagcacagttatcaacattggatataaatcct

SEQ ID NO: 288346 - DNA, 75 bp, Artificial Sequence
  Synthetic
acggcttcaggttgactttaatgaagcattattttctaaatacaaaggaaacacaaactgctttatgaatgatca

SEQ ID NO: 288347 - DNA, 75 bp, Artificial Sequence
  Synthetic
aagcccatgaatggacagggtgtgaagagccccgtgtgctaagtgtgagtcctccggcccctgaatgcggctaat

SEQ ID NO: 288348 - DNA, 75 bp, Artificial Sequence
  Synthetic
tggagcaccaattccaaagacaagagaagattatgcttggcaatcagggaccaatgcatctatcttttggcaaca

SEQ ID NO: 288349 - DNA, 75 bp, Artificial Sequence
  Synthetic
aaaagaaagatcttatagataagaaagcaagagatatttcaaaattaagaaaggcaattgataagtatggtattg

SEQ ID NO: 288350 - DNA, 75 bp, Artificial Sequence
  Synthetic
ttagaggctcttgacctaaatactagtgcaggatttccttacattacaatggggataaagaagagagatttaata

SEQ ID NO: 288351 - DNA, 75 bp, Artificial Sequence
  Synthetic
tccttttatattgcttatggtgacaggtatatagatatatatttgttaccatgggcgcacaggtttccagacaga

SEQ ID NO: 288352 - DNA, 75 bp, Artificial Sequence
  Synthetic
tatggcactgcagtcactaatgacatgggtactttatgttctagaataataactgataaccataagcacccaatt

SEQ ID NO: 288353 - DNA, 75 bp, Artificial Sequence
  Synthetic
aataacaaaaccaaagacataagtaaacttagggaagcaattgacaagtatggagttgacttgcctatggttact

SEQ ID NO: 288354 - DNA, 75 bp, Artificial Sequence
  Synthetic
tgtagtctttagaagtacatttggcaacctcttttccacgttccataaaaacccaggtatagtgactggatctgc

SEQ ID NO: 288355 - DNA, 75 bp, Artificial Sequence
  Synthetic
tcgattagatttctcacaggatccaagcaaattcactgatcctgttaaggatgttttgataaagggagtccctac

SEQ ID NO: 288356 - DNA, 75 bp, Artificial Sequence
  Synthetic
acaagaagactgatggcacagaaaagacagcaattaaatacagaagggacattaaaacagtgggccctagtgaca

SEQ ID NO: 288357 - DNA, 75 bp, Artificial Sequence
  Synthetic
cttttgggaatcttttttcaaaatttcatctaaatcctggaattatcactggatcagcagtcgggtgtgacccag

SEQ ID NO: 288358 - DNA, 75 bp, Artificial Sequence
  Synthetic
caccctatttggttcaagtgtttaaaaatgctcctggaagatataggattctcttcacaattgattgaccaaatt

SEQ ID NO: 288359 - DNA, 75 bp, Artificial Sequence
  Synthetic
gtagttgcatatggagtttggccacaatacttatcagatgctgatgcaaatgccatagataaaccatcacaccca

SEQ ID NO: 288360 - DNA, 75 bp, Artificial Sequence
  Synthetic
agcccttaaacaagtattgatggatttatcctttgatccaatgttaatagatagattatgcaaatccaaacacat

SEQ ID NO: 288361 - DNA, 75 bp, Artificial Sequence
  Synthetic
ataccgaacaaatactataggtgatgactatataccaacatgtgattgtactgaggcaacatattactgcaaaca

SEQ ID NO: 288362 - DNA, 75 bp, Artificial Sequence
  Synthetic
acatcataattagagttttagtgttagatgcatataagaacatagatttagataaattaaaaatcctggcatacg

SEQ ID NO: 288363 - DNA, 75 bp, Artificial Sequence
  Synthetic
gtatttttggagaaaatatgttttaccatttcttagggagagctggttatacagttcatgttcagtgtaacgcta

SEQ ID NO: 288364 - DNA, 75 bp, Artificial Sequence
  Synthetic
ttagtgttagatgcatataaaaatatagatttagacaaacttaagataattgcctatggtgatgatgttatattt

SEQ ID NO: 288365 - DNA, 75 bp, Artificial Sequence
  Synthetic
ggtgaaggaccatgtgaaccaggagattgtggagggaaactactttgtagacatggggttattggtatggttaca

SEQ ID NO: 288366 - DNA, 75 bp, Artificial Sequence
  Synthetic
cagtacttttcaggaattaacctacaaaaatgttacattccttaaacgtgggttcagagctgacgatcgtcactc

SEQ ID NO: 288367 - DNA, 75 bp, Artificial Sequence
  Synthetic
cccaggagaacagggccgtgtgataggcacacgtgagaatagaaacacaaatcaacccactgatgagagttggct

SEQ ID NO: 288368 - DNA, 75 bp, Artificial Sequence
  Synthetic
taaattacaataatgtcacctttttgaaaagaggattcaaacaagatgagaaatacaacttcttgatacacccca

SEQ ID NO: 288369 - DNA, 75 bp, Artificial Sequence
  Synthetic
ttggaagtgggtttgttgacagtgtgaaagatcagataaatgccattaacccaattaataacattagcaaaaaga

SEQ ID NO: 288370 - DNA, 75 bp, Artificial Sequence
  Synthetic
catctaatgtggcacaatggtagacatgagtatcagaattttgtcaaaggtatacgcagtgtgtccgctggtcgc

SEQ ID NO: 288371 - DNA, 75 bp, Artificial Sequence
  Synthetic
aatgcagtgcccatggattccatgataagacataacaattggagtattgttataataccaatttcccctctagaa

SEQ ID NO: 288372 - DNA, 75 bp, Artificial Sequence
  Synthetic
tatacgcagtgtgtccgctggtcgcgcattgtatataccagcctatgaagttcttgagcatgaatggtatgagaa

SEQ ID NO: 288373 - DNA, 75 bp, Artificial Sequence
  Synthetic
tgggcgtgatgcgtatgaaaagtttgtggagaagatacgcagtgtgagcgctggtcgcgcactgtacatccctcc

SEQ ID NO: 288374 - DNA, 75 bp, Artificial Sequence
  Synthetic
ctcaggttcgccctggaggttcttaaaagaaaaattctgtaaatggacacaattgaattatgtacataaggaatc

SEQ ID NO: 288375 - DNA, 75 bp, Artificial Sequence
  Synthetic
aaaccatcaacggtcaagcacttctgtttccccggttagattgatacgctccaacagggcgaaaacaactctaat

SEQ ID NO: 288376 - DNA, 75 bp, Artificial Sequence
  Synthetic
ctggtcgcgcactgtacatccctccatataacttgcttttgcatgagtggtatgaaaaattttaaactgatatag

SEQ ID NO: 288377 - DNA, 75 bp, Artificial Sequence
  Synthetic
cagttatgttgactccaggatcagcacaatttcttaccactgatgatgcacaatcaccctcagctttgccctact

SEQ ID NO: 288378 - DNA, 75 bp, Artificial Sequence
  Synthetic
actctattattgcggtaattttgtacgccagttttatctcccctccccgatatgtaacttagaagctgaacacaa

SEQ ID NO: 288379 - DNA, 75 bp, Artificial Sequence
  Synthetic
atgttgcctcaagcacaactcaaagtcaagtatttgagtgaactcaagaaactgaacctcctggaaaaacaaata

SEQ ID NO: 288380 - DNA, 75 bp, Artificial Sequence
  Synthetic
aaagaactctataagtatgtacacagtagaggttggtgtcaaaacaactctagcagaagaagttttcgctatacc

SEQ ID NO: 288381 - DNA, 75 bp, Artificial Sequence
  Synthetic
tgctcatcttgattcctccggcccctgaatgtggctaaccttaaacctgcagccaatgtacacgatccagtgtgc

SEQ ID NO: 288382 - DNA, 75 bp, Artificial Sequence
  Synthetic
cgttatccgcaaaacaactacgcaaagcctagtaccaccttctagagcatgtggctggtcgctccactataaacc

SEQ ID NO: 288383 - DNA, 75 bp, Artificial Sequence
  Synthetic
gtgaggctaaaagaattaaagttctccataacaagtgcaatgtggttatcaaacaaaggaaaagatgtgaacctg

SEQ ID NO: 288384 - DNA, 75 bp, Artificial Sequence
  Synthetic
tgtggaactgctaacaccagtcttaaactgctgattgcatacacaccaccaggggttggtaaaccacaaaataga

SEQ ID NO: 288385 - DNA, 75 bp, Artificial Sequence
  Synthetic
tatatattgtcactatgggcgctcaagtatctagacagaatgttggcacacacactacacaaaatgctgtatcaa

SEQ ID NO: 288386 - DNA, 75 bp, Artificial Sequence
  Synthetic
accagatcccaaatattttgatggatatgaccaacagagtgtggtcataatggatgatatcatgcagaatccaag

SEQ ID NO: 288387 - DNA, 75 bp, Artificial Sequence
  Synthetic
gtgcttgttttgagtcctccggcccctgaatgtggctaaccttaaccctgcagctagtgtgtacaatccagtgca

SEQ ID NO: 288388 - DNA, 75 bp, Artificial Sequence
  Synthetic
caactccagatgcttattcccaagctggttttataacttgctggtatcagacaaattttgtagttcctcctaata

SEQ ID NO: 288389 - DNA, 75 bp, Artificial Sequence
  Synthetic
tgatccagttaaagatgttctcacaaaaggcataccaaccctacaatcacccagtgttgaggcatgtggttattc

SEQ ID NO: 288390 - DNA, 75 bp, Artificial Sequence
  Synthetic
tttgtcctgtgtagtactaaccatagtatgcttgctccacccaccattacatcattacctgctatgaatagaaga

SEQ ID NO: 288391 - DNA, 75 bp, Artificial Sequence
  Synthetic
taacgtatatattggcatcatgggcgctcaggtatccagacagaatgttggtacacactccacacaaaatgctgt

SEQ ID NO: 288392 - DNA, 75 bp, Artificial Sequence
  Synthetic
tgaacaaaatcctgtagaaaaatatacagaagcaatactcaatgaggttctagttgtgccaaatatacaacctag

SEQ ID NO: 288393 - DNA, 75 bp, Artificial Sequence
  Synthetic
agccaagatgctagtgcaatagacaaaccaacacaccctgatacctcctctaacagattctatacattagaaagc

SEQ ID NO: 288394 - DNA, 75 bp, Artificial Sequence
  Synthetic
aaattggcagtgcccgatgctgtccttttatatgtggtaaagcagttatgtttaaagatagaaacacttgtcaca

SEQ ID NO: 288395 - DNA, 75 bp, Artificial Sequence
  Synthetic
ttcacagatccagttaaagatgtattggagaaaggcattcccacattacaatccccaactgtcgaggcatgtgga

SEQ ID NO: 288396 - DNA, 75 bp, Artificial Sequence
  Synthetic
atcactgatcaaactagggatgaaatgagcattgagagcttcttgggcagatctgcatgcatagctaccatacac

SEQ ID NO: 288397 - DNA, 75 bp, Artificial Sequence
  Synthetic
gtagagctgggtatactgtgcatgtacagtgtaatgccagcaagtttcatcaaggcaccctaatagttgctgcta

SEQ ID NO: 288398 - DNA, 75 bp, Artificial Sequence
  Synthetic
cttaaaaggccctcctccagctgctattagtgatcttcttcaatcagttaggactccagaggttatcaagtattg

SEQ ID NO: 288399 - DNA, 75 bp, Artificial Sequence
  Synthetic
tgacatcacaagatgctactgctatagataaaccctcccgcccagacacctcctctaatagattctatactctag

SEQ ID NO: 288400 - DNA, 75 bp, Artificial Sequence
  Synthetic
aatgtgaactcttcacatacctgcgctttgattcagagataacaattgtagctacactagcagggcaaggagatg

SEQ ID NO: 288401 - DNA, 75 bp, Artificial Sequence
  Synthetic
acctggcagcacattagacagacaacctagtgatgaaaattggctcaattgtgatggcacactcttaggaaatat

SEQ ID NO: 288402 - DNA, 75 bp, Artificial Sequence
  Synthetic
tctggtataatatatgtcatttataaactcttctgtacattgcaaggaccttattcaggagaaccaaagccaaaa

SEQ ID NO: 288403 - DNA, 75 bp, Artificial Sequence
  Synthetic
cctcggtagaagtggttacacagtacatgtccagtgcaatgcaagtaagtttcatcaaggcactttaattgttgc

SEQ ID NO: 288404 - DNA, 75 bp, Artificial Sequence
  Synthetic
agtcttttggcagcacggccaaccatacccaaggtttacaatccccttcatgagcattgcatcagcatattacat

SEQ ID NO: 288405 - DNA, 75 bp, Artificial Sequence
  Synthetic
cataataattggagtatagttattatacctatatctaaattagaaactgctggtggaactgcagttgtacccata

SEQ ID NO: 288406 - DNA, 75 bp, Artificial Sequence
  Synthetic
gtaaatttacaggtttgggcatttatgacagaacgttaatcgttccaacacatgcagatccaggtaaagagatcc

SEQ ID NO: 288407 - DNA, 75 bp, Artificial Sequence
  Synthetic
tcaaatcgagctgaccttagtaagcaacctagtgatgatgcctggcttaattttgatggtactttgttaggcaac

SEQ ID NO: 288408 - DNA, 75 bp, Artificial Sequence
  Synthetic
caaagcaacacagtcaacataacaagtaggatttatcacaaagccaaacatgtcagagcatggtgtcctagaccc

SEQ ID NO: 288409 - DNA, 75 bp, Artificial Sequence
  Synthetic
taacaactgatgatgctcaatctccatctgcacttccctattttcatcccaccaaggaaatattcatcccaggta

SEQ ID NO: 288410 - DNA, 75 bp, Artificial Sequence
  Synthetic
aaagtttaaagatatcaggaaatatataccagaaagtgaaagtgattatccagattgcaatttggccctctctgc

SEQ ID NO: 288411 - DNA, 75 bp, Artificial Sequence
  Synthetic
ggcataacaattggagtctagttataataccaatatgtccattagaatctttgccaagttcaactgtacccatta

SEQ ID NO: 288412 - DNA, 75 bp, Artificial Sequence
  Synthetic
aagaggtcagcaactatggtccttctgacttgcatgtacatatgggtaatctagtatacagaaatttacatctat

SEQ ID NO: 288413 - DNA, 75 bp, Artificial Sequence
  Synthetic
taggagccaggcatcattagcagctgaagtttttgcaatcccagtggatgttgcttcccagcccttagctactac

SEQ ID NO: 288414 - DNA, 75 bp, Artificial Sequence
  Synthetic
tacccaacaaaatcaggatactgtggtgggattttgtataaaattggacaagtccttgggatacacgttggtggt

SEQ ID NO: 288415 - DNA, 75 bp, Artificial Sequence
  Synthetic
catgacaacagatgatttccaatctcctagtgccctaccctggttccaccccactagggaaatttcaattcctgg

SEQ ID NO: 288416 - DNA, 75 bp, Artificial Sequence
  Synthetic
caactgcacgcaagccacatactattgtaaacataaaaacagatatttccctataaatgtcaagaaacatgaatg

SEQ ID NO: 288417 - DNA, 75 bp, Artificial Sequence
  Synthetic
agctaataccagtcttaaattactcatagcatacacaccacctggagttcctaaaccagattccagacagaaagc

SEQ ID NO: 288418 - DNA, 75 bp, Artificial Sequence
  Synthetic
ctagcatacacacaccaagtaaaacaaaattacaacctagtgttttttatgatgtattcccaggcaataaagagc

SEQ ID NO: 288419 - DNA, 75 bp, Artificial Sequence
  Synthetic
ttaactagagaaaccagtttagcacaagaaatatttgcaattaaggttgatattgcctcagatcctcttgcaact

SEQ ID NO: 288420 - DNA, 75 bp, Artificial Sequence
  Synthetic
gacacatactcaaaagctggctatatcacttgttggtatcaaacaaactttattgtaccacccagcacaccaaac

SEQ ID NO: 288421 - DNA, 75 bp, Artificial Sequence
  Synthetic
ctctgtagtcatggagtcatagggattgtcactgctggtggtgagggccacgttgccttcattgacctaagagac

SEQ ID NO: 288422 - DNA, 75 bp, Artificial Sequence
  Synthetic
tatcaaagtagctgtttctcattactcagctcaattagctaccctagatattaatccacaaccagtctctataga

SEQ ID NO: 288423 - DNA, 75 bp, Artificial Sequence
  Synthetic
ttatagcatacacaccccctggtatacgcaaaccaaagaacagaaaggaagcaatgttgggcactcatgtagtgt

SEQ ID NO: 288424 - DNA, 75 bp, Artificial Sequence
  Synthetic
acccagttgagaagtatactgaagcactacttaatgaagtgcttgttgtaccaaacatcaaccctagtaatgcac

SEQ ID NO: 288425 - DNA, 75 bp, Artificial Sequence
  Synthetic
ttattaatcctatcaacaaaatcactagtaaaatagttaaatggatcattagaatcatatcagctatgacaatca

SEQ ID NO: 288426 - DNA, 75 bp, Artificial Sequence
  Synthetic
aataaacagaccaaagatatatccaaacttaagatagctttagataaatatggtgttgatttacctatggttact

SEQ ID NO: 288427 - DNA, 75 bp, Artificial Sequence
  Synthetic
tgtgacctgttggtatcagaccaacctagtggtgccacccaacacaccaactactgccaaaatgctctgctttgt

SEQ ID NO: 288428 - DNA, 75 bp, Artificial Sequence
  Synthetic
ccaaactcgtgatgaaatgagtatagaaagctttctaggcaggtccagttgcattgcaataatccacactgatat

SEQ ID NO: 288429 - DNA, 75 bp, Artificial Sequence
  Synthetic
gtggttacagttgacttatgtacataaagaatcagatgggtggatcaagaaatttacagagatgtgtaatgctgc

SEQ ID NO: 288430 - DNA, 75 bp, Artificial Sequence
  Synthetic
cctttggaaatctcttttcaaaattccacctaaatcctggtgtcgttacaggttctgctgtggggtgtgatcctg

SEQ ID NO: 288431 - DNA, 75 bp, Artificial Sequence
  Synthetic
gagatattaaatgaggttcttgtagtaccaaacatcaaagagagtcaggctaccacatcaaatgcagcacctgct

SEQ ID NO: 288432 - DNA, 75 bp, Artificial Sequence
  Synthetic
tttacatatctcagatttgactctgaaatcacaatagtggtgtcagttgcaagtaagggtgatgacaatggacat

SEQ ID NO: 288433 - DNA, 75 bp, Artificial Sequence
  Synthetic
cttaagcagttgccactgttggaaaaacagattgatggcttaagactggccccccaaaagcaacagcaagaatat

SEQ ID NO: 288434 - DNA, 75 bp, Artificial Sequence
  Synthetic
agctcttaaagaagttctgaccaatttatcttttgaagctaatctgatagacagactatgtagatcaaaacatat

SEQ ID NO: 288435 - DNA, 75 bp, Artificial Sequence
  Synthetic
tggagagtttcttagggagatctggttgtattcatatttcaaagctagttgtagaatatgagggatatgatgata

SEQ ID NO: 288436 - DNA, 75 bp, Artificial Sequence
  Synthetic
aacaaggacaaccataccctagatttaccatacctttcatgagtattgcctcagcttattatatgttttatgatg

SEQ ID NO: 288437 - DNA, 75 bp, Artificial Sequence
  Synthetic
tgatattacgcacatcaaagagaacagagccagtcggtgtacttttccacggtgacccagggactggaaaatcga

SEQ ID NO: 288438 - DNA, 75 bp, Artificial Sequence
  Synthetic
ttggtccttgatgcttataaatacatagatttagataagttgaaaataatagcttatggtgatgatgttatcttc

SEQ ID NO: 288439 - DNA, 75 bp, Artificial Sequence
  Synthetic
tctagttccttctatagctgccaaaggggatgacattggtcatgtagtgatgcaatacatgtatgtcccaccagg

SEQ ID NO: 288440 - DNA, 75 bp, Artificial Sequence
  Synthetic
taaaataaccagcagagtgttccataaagctaagcatgttagtgcatggtgtcccagacctccacgtgctgtacc

SEQ ID NO: 288441 - DNA, 75 bp, Artificial Sequence
  Synthetic
agttatcatggatgatataatgcaaaacccaaatggggaagatatgtctctgttttgccaaatggtttcttcagt

SEQ ID NO: 288442 - DNA, 75 bp, Artificial Sequence
  Synthetic
ttgattataataatgtcactttcttgaaaagaggatttaagcaagatgagaaacaccagtttttaatacacccaa

SEQ ID NO: 288443 - DNA, 75 bp, Artificial Sequence
  Synthetic
ccctttctaagcatagcttcagcttattacatgttttatgatggatatgatggagaccaacctagttctaggtat

SEQ ID NO: 288444 - DNA, 75 bp, Artificial Sequence
  Synthetic
gctggtccgtctgatctttatgtacacactggagatctcatatacaggaacttacacttgtgtgaaccagaacat

SEQ ID NO: 288445 - DNA, 75 bp, Artificial Sequence
  Synthetic
actataacatgcacaccagctatgaataggagattctttttagatctggatatcatagttaaagatgattataaa

SEQ ID NO: 288446 - DNA, 75 bp, Artificial Sequence
  Synthetic
tggtagggatgtgtataaacagtttgaaaagcaaatacgcagtgttagcgctggtcgcgcactgtatattcctcc

SEQ ID NO: 288447 - DNA, 75 bp, Artificial Sequence
  Synthetic
caaagcatgttaaggtatggtgcccgagaccacctagagctgtagagtatacatacacccatgtaacaaactaca

SEQ ID NO: 288448 - DNA, 75 bp, Artificial Sequence
  Synthetic
ctggtcgcgcactgtatattcctccctatgatttgctcctgcacgagtggtatgaaaagttttaaattgtttaga

SEQ ID NO: 288449 - DNA, 75 bp, Artificial Sequence
  Synthetic
caacttattactgtaagcataaagacagatattacccaataaatgtcaagaaacaccagtggtatgagattcaag

SEQ ID NO: 288450 - DNA, 75 bp, Artificial Sequence
  Synthetic
ttctctttagagataggaatacaggagagcatttgtcactggcaactatatacaataaaattgtagaggaaagca

SEQ ID NO: 288451 - DNA, 75 bp, Artificial Sequence
  Synthetic
gttatccgcaagatgcctacgcaaagcctagtaatgcttttgaagatacttggttggtcgctcagctgtgcaccc

SEQ ID NO: 288452 - DNA, 75 bp, Artificial Sequence
  Synthetic
tagaaatctacacctctttaattcggatatccatgattccatattagtatcttactcatcagatttagtcatata

SEQ ID NO: 288453 - DNA, 75 bp, Artificial Sequence
  Synthetic
agttataggcatagtgactgcaggaggtgaaaatcatgttgcatttatagacttaagggattttctagttgctga

SEQ ID NO: 288454 - DNA, 75 bp, Artificial Sequence
  Synthetic
gtctgtcagaaatcctgaagtcattaggtattgtgaagataacagatggattgtacctgttgattgtagattgga

SEQ ID NO: 288455 - DNA, 75 bp, Artificial Sequence
  Synthetic
actagtcatgattggtatgagattcaagagagtgagtattacccaaaacacatacaatacaatctgttaataggt

SEQ ID NO: 288456 - DNA, 75 bp, Artificial Sequence
  Synthetic
aataagatcaccagtaaaatagttaaatggacaatcagaatcatctcagccattactattataatcagaaacaat

SEQ ID NO: 288457 - DNA, 75 bp, Artificial Sequence
  Synthetic
caaggtccatattcaggtgaacccaaaccgattactagaaaaccagagagaagagttgtcacccaagggcctcag

SEQ ID NO: 288458 - DNA, 75 bp, Artificial Sequence
  Synthetic
tagatttaagacatttccattgtgctgaagaacagggaattactgactacatacacatgctaggtgaagcatttg

SEQ ID NO: 288459 - DNA, 75 bp, Artificial Sequence
  Synthetic
tatatatccataaagaatcagatggttggattaaaaaatttacagaaatgtgtaatgcagctaggggtctagagt

SEQ ID NO: 288460 - DNA, 75 bp, Artificial Sequence
  Synthetic
taccaactcatgctgaagttggtaagagtgtagaaatagatggaatacaagttaaagtctctgattcatatgatc

SEQ ID NO: 288461 - DNA, 75 bp, Artificial Sequence
  Synthetic
agcaatggttgtaatcattagaaattcatctgaccctcaaacaataatagctacattaacactgattggttgctc

SEQ ID NO: 288462 - DNA, 75 bp, Artificial Sequence
  Synthetic
attactagaaaaacaagttgatgggttgcggttggctacacaaaagcaacaacaagattatatggacaccttaac

SEQ ID NO: 288463 - DNA, 75 bp, Artificial Sequence
  Synthetic
tgattattcagattgttgtctggctcttttagctaaccaaccagaacctacaattatagaagtgggtgatagctg

SEQ ID NO: 288464 - DNA, 75 bp, Artificial Sequence
  Synthetic
atgtgcaatgcagctagaggtttagagtggattggtaacaagatatcaaaatttattgagtggatgaaatcaatg

SEQ ID NO: 288465 - DNA, 75 bp, Artificial Sequence
  Synthetic
tcaaaaagaacagaaccagttggagtaatattccatggagaacctggtactggtaaatctataaccacttcaatt

SEQ ID NO: 288466 - DNA, 75 bp, Artificial Sequence
  Synthetic
ataggtttaatactgggtattcatgtagggggaaatgggaggaatgggttctctgctatgttgttgaggtcatat

SEQ ID NO: 288467 - DNA, 75 bp, Artificial Sequence
  Synthetic
ctcaagggaaaattaagtgtgagatagatactctacatgatttgtcatgtaaatttcttcccttatatgctagtg

SEQ ID NO: 288468 - DNA, 75 bp, Artificial Sequence
  Synthetic
atataatgcaaaaccctagtggtgaagacatgtcactattctgtcaaatggtctcatcagtaccattcataccac

SEQ ID NO: 288469 - DNA, 75 bp, Artificial Sequence
  Synthetic
tgttccatgatacctttcctggaaagaaggaacctgcggttctgtcaccaaaggatcccagattacaagttaact

SEQ ID NO: 288470 - DNA, 75 bp, Artificial Sequence
  Synthetic
agctggaaaatctatgaccacaaatttcctagcaagaatgataactaatgatagtgatatctattcactcccacc

SEQ ID NO: 288471 - DNA, 75 bp, Artificial Sequence
  Synthetic
aacagctatgaatagaagatttttccttgacttagacatagttgtcaaggatgaatataagctcaaccagggcaa

SEQ ID NO: 288472 - DNA, 75 bp, Artificial Sequence
  Synthetic
tcttgacatcaactcagaaccattaactctagaagaaagtgtatatggcatagaaggtcttgaagctttagactt

SEQ ID NO: 288473 - DNA, 75 bp, Artificial Sequence
  Synthetic
atggtatctagtgtcacgtttatcccccctatggctgatcttccagacaaaggtaaaccttttgactctagattt

SEQ ID NO: 288474 - DNA, 75 bp, Artificial Sequence
  Synthetic
aggaatagtggtgattatctatccttagccacagtgtacaataaaatcactcaagagagtaaaaacaggaaagat

SEQ ID NO: 288475 - DNA, 75 bp, Artificial Sequence
  Synthetic
aaatacggtctggatttgccaatgataacttttttaaaagatgaactcagaaaacctgaaaagataaacacaggg

SEQ ID NO: 288476 - DNA, 75 bp, Artificial Sequence
  Synthetic
gtgaaaaatataaagatcagcaagggaagcttaatgttgctgctgcattccaaccttgtgatgtcaatgttaaaa

SEQ ID NO: 288477 - DNA, 75 bp, Artificial Sequence
  Synthetic
cagatgttattagatactgtgaagaaaataagtggataataccctcagattgcaagcttgagcgtgatctaaact

SEQ ID NO: 288478 - DNA, 75 bp, Artificial Sequence
  Synthetic
tcactggctcagcagtagggtgtgatcctgaggtcttttggtcgaagataccagtaatgcttgatggtgaatgtc

SEQ ID NO: 288479 - DNA, 75 bp, Artificial Sequence
  Synthetic
catacttaatgaagataagaggcgtagacaagttgtagatgttatgtctgcaatcttccaagggccaatctcttt

SEQ ID NO: 288480 - DNA, 75 bp, Artificial Sequence
  Synthetic
atactgttattacggtaactttatacgccagttttatctccccttaccccaatgtaacttagaagtttgtacata

SEQ ID NO: 288481 - DNA, 75 bp, Artificial Sequence
  Synthetic
aggcgagcccaaaccaatcacaaagaaaccagaaaggagagtggtcacacaaggaccacaggaagaatttggaag

SEQ ID NO: 288482 - DNA, 75 bp, Artificial Sequence
  Synthetic
agtacaaaaattatgctactccaaacacatttttaaaactaaatattatgaagtggaaggaggaatgccatcagg

SEQ ID NO: 288483 - DNA, 75 bp, Artificial Sequence
  Synthetic
ccgaccaatagtgagcaatcatccagattgtttaaggtcaagcacttctgttaccccggtcagcgttgatatgct

SEQ ID NO: 288484 - DNA, 75 bp, Artificial Sequence
  Synthetic
gagtgtagaatagaaagagatttaaatatagccaacaccataattacaattatagcaaatgtaattagtatttct

SEQ ID NO: 288485 - DNA, 75 bp, Artificial Sequence
  Synthetic
gatgcaggcaaagaagtggagatagatggaatcaagacccaagttgatgatgcctatgatttatataattcccag

SEQ ID NO: 288486 - DNA, 75 bp, Artificial Sequence
  Synthetic
atattggcatatggtgatgatatactattttcctacccttatgagatggacatgaaagaattagcaagtgaggga

SEQ ID NO: 288487 - DNA, 75 bp, Artificial Sequence
  Synthetic
cagcaatagacctggcagatgaggctggacattccccactggcgacagtggtccagcctgcgtggctgcctgcac

SEQ ID NO: 288488 - DNA, 75 bp, Artificial Sequence
  Synthetic
cacaaggtcctgaggaggagtttgggagatcactgattaaacataactcatgtgtagtcaccacacaaaatggaa

SEQ ID NO: 288489 - DNA, 75 bp, Artificial Sequence
  Synthetic
gtcatttagcactagttgctaatcaacaagagcccactatattggaagttggtgattgctgctcatatggtaata

SEQ ID NO: 288490 - DNA, 75 bp, Artificial Sequence
  Synthetic
atgataaacacagttttctcatacatccggtgtatcctgagactgaagtctgggaatccattagatggacaaaga

SEQ ID NO: 288491 - DNA, 75 bp, Artificial Sequence
  Synthetic
gcagccattgtttgcaatccagcagatatatggtcgtaatgagcaattgcgggatgggaccgactactttgggtg

SEQ ID NO: 288492 - DNA, 75 bp, Artificial Sequence
  Synthetic
gcagccattgtttgcaatccagcagatttatggtcgtaatgagcaattgcgggatgggaccgactactttgggtg

SEQ ID NO: 288493 - DNA, 75 bp, Artificial Sequence
  Synthetic
gcagccattgtttgcaatccagcagatctatggtcgtaatgagcaattgcgggatgggaccgactactttgggtg

SEQ ID NO: 288494 - DNA, 75 bp, Artificial Sequence
  Synthetic
gcagccattgtttgcaatccagcagatgtatggtcgtaatgagcaattgcgggatgggaccgactactttgggtg

SEQ ID NO: 288495 - DNA, 75 bp, Artificial Sequence
  Synthetic
agattcttatgatttatataataaggatggtgttaagctagaaatcactgttctcaaacttcaaagaaatgaaaa

SEQ ID NO: 288496 - DNA, 75 bp, Artificial Sequence
  Synthetic
aggtatacatgttggaggaaatggtagagatggtttttctgcaatgctattaagatcatacttcactgaacaaca

SEQ ID NO: 288497 - DNA, 75 bp, Artificial Sequence
  Synthetic
tagcgctggtcgtgcactctatataccaccatacgaactcttgcgccatgaatggtatgagaaattttaaacaga

SEQ ID NO: 288498 - DNA, 75 bp, Artificial Sequence
  Synthetic
actcaacacagaatacggtctcaaatggatcaagcttgaattatttcaacatcaattattttaaagatgcggcat

SEQ ID NO: 288499 - DNA, 75 bp, Artificial Sequence
  Synthetic
gttggggatgttgtgtcatatggaaacattctacttagtggtaatcaaacagctaggatgcttaaatataattac

SEQ ID NO: 288500 - DNA, 75 bp, Artificial Sequence
  Synthetic
cagttttatatccccttccccctttgtaacttagaagttatgaacacagaccaataggtggtgatcatccagatc

SEQ ID NO: 288501 - DNA, 75 bp, Artificial Sequence
  Synthetic
ttccctggcagtaaagaacctgctgtcctatctggtagagaccccagattagaagtcaatctagatgaatctata

SEQ ID NO: 288502 - DNA, 75 bp, Artificial Sequence
  Synthetic
aactgtagaagcatgtggttattcagatagaattattcaaataactagaggagattcaacaatcacatcccaaga

SEQ ID NO: 288503 - DNA, 75 bp, Artificial Sequence
  Synthetic
tgctaagatcctatttttctgaaacacaggggcaaattactatctccaaaccaacagttgagcttggtttaccta

SEQ ID NO: 288504 - DNA, 75 bp, Artificial Sequence
  Synthetic
atccgcaaggtgcctacgcaaagcctagtaacatcttcgagggtacatggttggtcgctcagctattccccatag

SEQ ID NO: 288505 - DNA, 75 bp, Artificial Sequence
  Synthetic
ccacaccactgagcttggaagagagtgtgtatggtatagaaggtttagaagcattggacttgcacactagtgctg

SEQ ID NO: 288506 - DNA, 75 bp, Artificial Sequence
  Synthetic
gatagattttacactttggagagtaggtcatgggattctacatcaaagggttggtggtggaaattgcctgatgca

SEQ ID NO: 288507 - DNA, 75 bp, Artificial Sequence
  Synthetic
attggaggtagatttcaaacaagcattgttctccaagtataaaggtaacaatgaatgcacaatgaatgagcacat

SEQ ID NO: 288508 - DNA, 75 bp, Artificial Sequence
  Synthetic
cttacccatgataactttcttaaaagatgagctcaggaaaccagagaagattaaaactggaaaaaccagaataat

SEQ ID NO: 288509 - DNA, 75 bp, Artificial Sequence
  Synthetic
agggtactctgattgtggcaatgattccagagcatcagttggctagtgcaacacatggtaatgttacagctggat

SEQ ID NO: 288510 - DNA, 75 bp, Artificial Sequence
  Synthetic
gaagcccttgatcttaacacaagtgcagggtatccctatgtaaccatgggtattaagaagaaagatttaatagac

SEQ ID NO: 288511 - DNA, 75 bp, Artificial Sequence
  Synthetic
gtagggtgtgatcctgaggtattctggtcgaaagtgccagtaatgctagatggtgaatgtctcatggcttttgac

SEQ ID NO: 288512 - DNA, 75 bp, Artificial Sequence
  Synthetic
tggatcaagcctcaattattttaacatcaattatttcaaagatgcggcctccagtggagcatctaaattggagtt

SEQ ID NO: 288513 - DNA, 75 bp, Artificial Sequence
  Synthetic
tggcacgctgcttggcaacattactatctttcctcatcagtttatcaatttgagaagcaataattcagccactat

SEQ ID NO: 288514 - DNA, 75 bp, Artificial Sequence
  Synthetic
agaaaatctctgctgggaaaacccgtgtcattgaagctagcagtgttaatgatactgtattgttcaggtcagtct

SEQ ID NO: 288515 - DNA, 75 bp, Artificial Sequence
  Synthetic
gtaattccaaacacatatataaaactacttactatgaagttgagggtggtatgccatcaggatgtgctgggacta

SEQ ID NO: 288516 - DNA, 75 bp, Artificial Sequence
  Synthetic
gataggataatacaaattacaagaggcgactccacaattacatcgcaggatgttgccaatgcagtcgttggttat

SEQ ID NO: 288517 - DNA, 75 bp, Artificial Sequence
  Synthetic
ggtgttccacgcactgtgccaataactatatcaataagtccaatgtatgctgagttctcaggtgctagagcaaaa

SEQ ID NO: 288518 - DNA, 75 bp, Artificial Sequence
  Synthetic
gctagatggtgagtgtataatggcttttgattacacaaactatgatggtagtatacacccaatttggtttgatgc

SEQ ID NO: 288519 - DNA, 75 bp, Artificial Sequence
  Synthetic
tgatgatgtaatcttttcatacccttatgatcttgatatgaaggaacttgcaagtgggggcaccaagtatggttt

SEQ ID NO: 288520 - DNA, 75 bp, Artificial Sequence
  Synthetic
aagtgtggactccaacctcacaggggtggtggtggaaattaccagatgcacttaaggatatgggcatttttggag

SEQ ID NO: 288521 - DNA, 75 bp, Artificial Sequence
  Synthetic
aagaaatatccatcccaggtcaggttagaaacttgatagagatgtgcgaggttgataccctaatacctataaaca

SEQ ID NO: 288522 - DNA, 75 bp, Artificial Sequence
  Synthetic
ggtggggtcccatcagggtgctctggtacaagtatatttaatacaatgattaataatgtgattattagaacatta

SEQ ID NO: 288523 - DNA, 75 bp, Artificial Sequence
  Synthetic
tttcttgtccatcccatttacccagagacagaagtttgggaatctataaggtggactaaaaaccccagaaacatg

SEQ ID NO: 288524 - DNA, 75 bp, Artificial Sequence
  Synthetic
accagaacatcaattggcagctgcaaacactggcaatgttgcagcgggatacaatttcacacaccctggtgaaaa

SEQ ID NO: 288525 - DNA, 75 bp, Artificial Sequence
  Synthetic
ttctcaaccccttgctactacactgataggagaaattgccagttattacacacactggactggtagtcttcgatt

SEQ ID NO: 288526 - DNA, 75 bp, Artificial Sequence
  Synthetic
caattgcctcggagggtgtcaagtacggattaacaataacccctgcagacaaatccagtgtttttaagaggcttg

SEQ ID NO: 288527 - DNA, 75 bp, Artificial Sequence
  Synthetic
aaaatataaacactttgtagacaagatcaggagtgttagcgctggtcgtgcactctatataccaccatatgaggt

SEQ ID NO: 288528 - DNA, 75 bp, Artificial Sequence
  Synthetic
tttcctcatcaattcattaatctcagaagcaataattcggcaacaataatagtgccatatgtaaatgcagtgcca

SEQ ID NO: 288529 - DNA, 75 bp, Artificial Sequence
  Synthetic
ttaggcacgcatgtagtgtgggatgtgggtctacagtctacaatttctatgattgttccatggattagtgctagt

SEQ ID NO: 288530 - DNA, 75 bp, Artificial Sequence
  Synthetic
gatcagatggacaaagaaaccatctcagatgcaggagcatgtcttgtcactgtgtcatttaatgtggcataacgg

SEQ ID NO: 288531 - DNA, 75 bp, Artificial Sequence
  Synthetic
gtcgtgcactgtatatacctccttatgacttgcttttgcatgagtggtatgaaaaattttagtttaaatatagaa

SEQ ID NO: 288532 - DNA, 75 bp, Artificial Sequence
  Synthetic
ctaaaatgctttgctttgtatcgggttgcaaggatttttgtttaagaatggcaagggatacaaatctacataaac

SEQ ID NO: 288533 - DNA, 75 bp, Artificial Sequence
  Synthetic
tatccattagtcctatgtttgcagaattctctggagcaagagcccgacctgtagctcaagggctgcccgtatata

SEQ ID NO: 288534 - DNA, 75 bp, Artificial Sequence
  Synthetic
ctctcatattacggtatgcttgcacgccagtttgtttcccctttccccttttgtaactatagaagattgcactta

SEQ ID NO: 288535 - DNA, 75 bp, Artificial Sequence
  Synthetic
ggttaagaacttgatagaaatgtgtcaagtggacactttgatccccattaacaacacacaagcaaatttgaagaa

SEQ ID NO: 288536 - DNA, 75 bp, Artificial Sequence
  Synthetic
atccaatgcagcccctgcacttgatgcagctgaaactgggcatactagccaggtgcaacctgaagacatggtaga

SEQ ID NO: 288537 - DNA, 75 bp, Artificial Sequence
  Synthetic
attatcgtcatccgcgcaattactacgcaaagcttagtaacttcccaagaaattctttggttggccgttccgctg

SEQ ID NO: 288538 - DNA, 75 bp, Artificial Sequence
  Synthetic
ctacttggacaaattgctagttattttacacactggactggtagcttacgctttagtttcatgttttgtggcaca

SEQ ID NO: 288539 - DNA, 75 bp, Artificial Sequence
  Synthetic
tatgatgattataatgggacaggcaaaaattttacccaatggccaatcaacttgcaagaaatggcacaaattaga

SEQ ID NO: 288540 - DNA, 75 bp, Artificial Sequence
  Synthetic
gccatagaaaggacagggtgtgaagagccccgtgtgctaattgtgattcctccggcccctgaatgcggctaatct

SEQ ID NO: 288541 - DNA, 75 bp, Artificial Sequence
  Synthetic
atgtgggcttacaatcaactgtgtctctagttgttccatgggtcagtgctagccactttagatacacaacgccag

SEQ ID NO: 288542 - DNA, 75 bp, Artificial Sequence
  Synthetic
agtacatgtatgtaccaccaggtgcgccaattccaaaaactaggaaagattatgcatggcaatctggcacaaatg

SEQ ID NO: 288543 - DNA, 75 bp, Artificial Sequence
  Synthetic
cttataattagttcatggtgacaagtataagtgtttatatttgtcatcatgggcgctcaagtttcaaggcagaat

SEQ ID NO: 288544 - DNA, 75 bp, Artificial Sequence
  Synthetic
agcatgtaaggatttctgcctacgcatggccagagataccgacatgcatgttcagaatgatgccattacacaaaa

SEQ ID NO: 288545 - DNA, 75 bp, Artificial Sequence
  Synthetic
tgaccaaaaaacatcccgttatggcacaattgcaagcaaccacatgggaacattatgttctaggatagttacaga

SEQ ID NO: 288546 - DNA, 75 bp, Artificial Sequence
  Synthetic
gtctagatttttctcaagatcctagcaaatttactgacccagtcaaagatgttctgacaaaaggaataccaacac

SEQ ID NO: 288547 - DNA, 75 bp, Artificial Sequence
  Synthetic
gatgcagctgaaacaggacacactagtaaagtacagccagaggatactgttgaaacccgctatgtacagacatca

SEQ ID NO: 288548 - DNA, 75 bp, Artificial Sequence
  Synthetic
cacacacatgtcacaaattataaaagagaaggaaaggaggtagaaacagccatagtatctaggagggatatcaaa

SEQ ID NO: 288549 - DNA, 75 bp, Artificial Sequence
  Synthetic
agttggatatggtgtctggccacaatacttatctgatgccgatgctaatgctattgacaaaccaacgcacccaga

SEQ ID NO: 288550 - DNA, 75 bp, Artificial Sequence
  Synthetic
ctaaatttagaacatggcaaatcacattacaagaaatggctcaaataagacgcaaatttgagatgttcacatatg

SEQ ID NO: 288551 - DNA, 75 bp, Artificial Sequence
  Synthetic
tctcttactcctctgacttagtcatataccgaacaaacactgtaggtgatgactatattccaacatgtgattgca

SEQ ID NO: 288552 - DNA, 75 bp, Artificial Sequence
  Synthetic
atttttggagagaacatgttttatcactttttaggtagagctggatatactgtccatgtgcaatgcaatgctagc

SEQ ID NO: 288553 - DNA, 75 bp, Artificial Sequence
  Synthetic
tccaattccagataacagaacacactttgcctggcagtcaggaacaaatgcatctatattctggcaacttggaca

SEQ ID NO: 288554 - DNA, 75 bp, Artificial Sequence
  Synthetic
gcatatacagtacaatttattaataggtgagggcccatgtgaaccaggtgattgtggtggtaaattgttgtgtaa

SEQ ID NO: 288555 - DNA, 75 bp, Artificial Sequence
  Synthetic
caggagagaatgggcgtacaattgatgatacaagagtgaataccatgtccaatcaaccaactgatgagagttggt

SEQ ID NO: 288556 - DNA, 75 bp, Artificial Sequence
  Synthetic
aacacagtagtcaaccacatgggcacattatgtattagaatagttacaaatgagcaacaccataatgttgagatt

SEQ ID NO: 288557 - DNA, 75 bp, Artificial Sequence
  Synthetic
tacatccatttacttggggaagcttttggcaatggatttgttgaaagtgttaaggaacaggtaaatgcaataaat

SEQ ID NO: 288558 - DNA, 75 bp, Artificial Sequence
  Synthetic
taatgcagtaccaatggattcaatgcttaggcacaataactggagcatagtcatcatacccgtgtcacccctaga

SEQ ID NO: 288559 - DNA, 75 bp, Artificial Sequence
  Synthetic
ctcatactggtgacttgcaaattttcattaaacccagaacagatccaaaagtagttactgtaggacctagtgata

SEQ ID NO: 288560 - DNA, 75 bp, Artificial Sequence
  Synthetic
actctattattacggtaattttgtacgccagttttatatccccttccccttttgtaacttagaagtcgtgaacac

SEQ ID NO: 288561 - DNA, 75 bp, Artificial Sequence
  Synthetic
ttgctactttaacattaattggctgctctggatcaccatggcgcttcttaaaagaaaaattttgcaaatggactc

SEQ ID NO: 288562 - DNA, 75 bp, Artificial Sequence
  Synthetic
gtcatgctcactccaggttctgcccagtttcttactactgatgatacacaatcaccttcagctttaccatatttc

SEQ ID NO: 288563 - DNA, 75 bp, Artificial Sequence
  Synthetic
atcgcttaaggtcaagcacttctgtttccccggtcaacgttgatatgctccaccagggcaaaaacaacggagatc

SEQ ID NO: 288564 - DNA, 75 bp, Artificial Sequence
  Synthetic
ttaccgcacaaataccacaggtaatgactacatcccaacatgtgattgtacagatgccacatattattgtagaca

SEQ ID NO: 288565 - DNA, 75 bp, Artificial Sequence
  Synthetic
aaaatttatagagtggatgaagtccatgttaccccaagctcaacttaaagttaaataccttgctgagctcaagaa

SEQ ID NO: 288566 - DNA, 75 bp, Artificial Sequence
  Synthetic
acaataaaataggtatgtacacagtggaggttggtgttcaaacagaattgaaaactgaaatctttgctatccctg

SEQ ID NO: 288567 - DNA, 75 bp, Artificial Sequence
  Synthetic
ggtgagggaccatgtgaaccaggtgactgtggaggaaagctactttgcaaacatggtgtgattgggataattacc

SEQ ID NO: 288568 - DNA, 75 bp, Artificial Sequence
  Synthetic
tgtaaatttctacctctgtatgcaagtgaagcaaaaaggataaaagttttacataacaaatgtaacaatataatt

SEQ ID NO: 288569 - DNA, 75 bp, Artificial Sequence
  Synthetic
acatggtgtgattgggataattaccgctggtggagaaggacatgtagcattcattgatcttaggcatttccactg

SEQ ID NO: 288570 - DNA, 75 bp, Artificial Sequence
  Synthetic
tggtactgcaaacaccagtcttaaattattgattgcatatacaccaccaggagttgcgaaaccaaccacaagaac

SEQ ID NO: 288571 - DNA, 75 bp, Artificial Sequence
  Synthetic
tgggaccaactactttgggtgtccgtgtttcactttttccttttatatttgcttatggtgacaatatatatataa

SEQ ID NO: 288572 - DNA, 75 bp, Artificial Sequence
  Synthetic
atgaaagtgatgtatactctctaccccctgacccaaaatattttgatgggtatgatcaacagagtgtggtcataa

SEQ ID NO: 288573 - DNA, 75 bp, Artificial Sequence
  Synthetic
ccaatcaacaacattagtaagaagataatcaaatggttacttaggataatatcagcaatggttataattattaga

SEQ ID NO: 288574 - DNA, 75 bp, Artificial Sequence
  Synthetic
actccagacacatactcacaagctggttatatcacttgttggtatcaaaccaattttgtagttcccccaaataca

SEQ ID NO: 288575 - DNA, 75 bp, Artificial Sequence
  Synthetic
aatattaactattttaaagatgcggcttctagtggagcatcaaaattagaattctcacaagatcccagcaaattt

SEQ ID NO: 288576 - DNA, 75 bp, Artificial Sequence
  Synthetic
taaaggtaaaccctttgactcgaggtttgtattctgcagtacaaatcaaactctgttagcaccgcctactataac

SEQ ID NO: 288577 - DNA, 75 bp, Artificial Sequence
  Synthetic
aactaaattatgttcataaggaatcagattcatggctcaagaaattcactgaaatgtgcaatgcagccagggggc

SEQ ID NO: 288578 - DNA, 75 bp, Artificial Sequence
  Synthetic
cacaaaatccaattgagaagtatacagaagctctacttaatgaagtgttggtggtcccaaatatacaagctagta

SEQ ID NO: 288579 - DNA, 75 bp, Artificial Sequence
  Synthetic
ggggtgactccacaattacatcacaagatgttgccaatgcagtcgttggttatggtgtttggccacattacttaa

SEQ ID NO: 288580 - DNA, 75 bp, Artificial Sequence
  Synthetic
ttcaaaccatgtgatgtagacaataaaataggaaatgctaggtgctgcccattcatatgtggaaaagctgtctca

SEQ ID NO: 288581 - DNA, 75 bp, Artificial Sequence
  Synthetic
acttaatttcctggaaaaacaaatggaacatctgagagtagcagactcaaaaacacaggaaaaaatcaaacatga

SEQ ID NO: 288582 - DNA, 75 bp, Artificial Sequence
  Synthetic
cacagatcaaaccagagatgagatgagcgtagagagtttcctgggcagatctgcctgcatagcagtcattcacac

SEQ ID NO: 288583 - DNA, 75 bp, Artificial Sequence
  Synthetic
gggatggtggtggaaattaccggatgcacttaaggatatgggtatttttggagagaatatgttttatcactatct

SEQ ID NO: 288584 - DNA, 75 bp, Artificial Sequence
  Synthetic
ctgcgatatttcaaggacctatcacattggatgcaccaccccctcctgcaatcactgatttgttacgttctgtca

SEQ ID NO: 288585 - DNA, 75 bp, Artificial Sequence
  Synthetic
aaacaaaagaagaggtgtgaaccagttgcagttgtcatacatggtgaacctggtactggaaagtctatgactaca

SEQ ID NO: 288586 - DNA, 75 bp, Artificial Sequence
  Synthetic
agaaagtgtgaactcttcacctatttgcgctttgactcagaaattaccatagtggctactatagctggacaaggt

SEQ ID NO: 288587 - DNA, 75 bp, Artificial Sequence
  Synthetic
gcaagcactggcaatgttgcagcaggatacaatttcacacaccctggtgaaaaagggagggaagttggaagccca

SEQ ID NO: 288588 - DNA, 75 bp, Artificial Sequence
  Synthetic
cataatagctaatataataagtatagcaggcataatttttgtaatatacaaactcttttgttcactacaaggacc

SEQ ID NO: 288589 - DNA, 75 bp, Artificial Sequence
  Synthetic
tggatgacataatgcagaacccaagtggtgatgacatgactttattctgtcagatggtttcaagtgtaacattta

SEQ ID NO: 288590 - DNA, 75 bp, Artificial Sequence
  Synthetic
cttcagtcttttggcagcatggtcaaccataccccagatttacaattccttttgtgagtattgcctcagcatatt

SEQ ID NO: 288591 - DNA, 75 bp, Artificial Sequence
  Synthetic
ttagaagtaataattcagcaacaataatagtgccatatgtgaatgcagtgccaatggattcaatgctcagacata

SEQ ID NO: 288592 - DNA, 75 bp, Artificial Sequence
  Synthetic
acatgtgttgtcacaactgataatggaaagtttacaggtttaggtatatatgataaattaatgattttacctaca

SEQ ID NO: 288593 - DNA, 75 bp, Artificial Sequence
  Synthetic
ttcattaccagctatgaataggagattcttcttagatctagatattgtagtgtgtgataaatataaagattctca

SEQ ID NO: 288594 - DNA, 75 bp, Artificial Sequence
  Synthetic
aaggcaaaaacatgaagtcaacataaccagtagaatatatcataaagctaaacacatcagtgcttggtgtccacg

SEQ ID NO: 288595 - DNA, 75 bp, Artificial Sequence
  Synthetic
agaattctctggagcacgagcccgacctgtggctcaaggactgcccgtgtacattacacctggatctggacagtt

SEQ ID NO: 288596 - DNA, 75 bp, Artificial Sequence
  Synthetic
ctgtagtcaagttagatagaaatgagaaatttagggatattaggagatatattccagagaaagaagatgattacc

SEQ ID NO: 288597 - DNA, 75 bp, Artificial Sequence
  Synthetic
ttcagggatcgtaacacatgtcagacttacactctagctcaggtatataatttaatgcttgaggaagacaagaaa

SEQ ID NO: 288598 - DNA, 75 bp, Artificial Sequence
  Synthetic
attaaaattgtaaactttggaccttcagatatgtttgtacatatggatgatctaatatacagaaatttacacctg

SEQ ID NO: 288599 - DNA, 75 bp, Artificial Sequence
  Synthetic
tgtcaagtagatactttaattcccattaataacacacaagcaaatttaaagaaaatcaacatatatacaatacaa

SEQ ID NO: 288600 - DNA, 75 bp, Artificial Sequence
  Synthetic
aacagcaagaatgctcaagtataactacccaacaaaatcaggatattgtggtggtgttttatacaagataggaaa

SEQ ID NO: 288601 - DNA, 75 bp, Artificial Sequence
  Synthetic
gaactcctgaagtgatcaaatactgtgaagataacaaatggataatacctgctgaatgtaaagtagaaagagatc

SEQ ID NO: 288602 - DNA, 75 bp, Artificial Sequence
  Synthetic
gcaattgcacacaagctacatattattgcaaacacaaaaacagatattacccaataaatgttaagaagcatgatt

SEQ ID NO: 288603 - DNA, 75 bp, Artificial Sequence
  Synthetic
attttacacattggactggtagcttacgctttagttttatgttttgtggtacagctaacacaaccctgaaattac

SEQ ID NO: 288604 - DNA, 75 bp, Artificial Sequence
  Synthetic
aaaagtgtcagagagtatggatttcctaccatacataccccaagtaaaacaaagttgcaacccagtgtcttcttt

SEQ ID NO: 288605 - DNA, 75 bp, Artificial Sequence
  Synthetic
atactcaggtgaacctaaacccaagacaagagttccagaaaggagagtggtagcacagggaccagaggaagaatt

SEQ ID NO: 288606 - DNA, 75 bp, Artificial Sequence
  Synthetic
actttgcaagcatggagttattggtatactaactgctggtggagaagggcatgtggctttcatcgatctcaggga

SEQ ID NO: 288607 - DNA, 75 bp, Artificial Sequence
  Synthetic
gtccctggttgttccatgggttagtgccagccattttagatacaccacaccagatacatactcagcagctgggta

SEQ ID NO: 288608 - DNA, 75 bp, Artificial Sequence
  Synthetic
ataaagaatgtgaaatgaatgaccatataaaagttgctgttgctcactactcagctcaattaatgacattagata

SEQ ID NO: 288609 - DNA, 75 bp, Artificial Sequence
  Synthetic
catgctgatccaggtaaagaggtgcaaatagatggcattttaactaaagtggaagattcatatgacctatataac

SEQ ID NO: 288610 - DNA, 75 bp, Artificial Sequence
  Synthetic
gtaatcaatcccattaataaagttactagtaaaatagtaaaatggattattagaatcatatcagctattacaatt

SEQ ID NO: 288611 - DNA, 75 bp, Artificial Sequence
  Synthetic
cgcatggctagagatactgacatgcacgtccaaaatgatgccattacacaaaatccagttgaagattatgttgag

SEQ ID NO: 288612 - DNA, 75 bp, Artificial Sequence
  Synthetic
gggaattaaaaagagggatttgataaacaaaaacactagagacatttccaagcttaaagcagcattagataaata

SEQ ID NO: 288613 - DNA, 75 bp, Artificial Sequence
  Synthetic
cagattgcaacttggcactttctgctaaccaaccagagaccaccattatcaatgttggagatgtggtgtcatatg

SEQ ID NO: 288614 - DNA, 75 bp, Artificial Sequence
  Synthetic
attggttacacttaaattacatacacaaagaatcagatgggtggatcaagaaatttacagagatgtgtaatgccg

SEQ ID NO: 288615 - DNA, 75 bp, Artificial Sequence
  Synthetic
ctagtaaagtacaaccagaagatacagttgagactcgttacgtgcaaacatcacagactagagatgaaatgagca

SEQ ID NO: 288616 - DNA, 75 bp, Artificial Sequence
  Synthetic
aatgatacagtagcctttagaatgatttatggcaacttatttgctgcttttcataaaaaccctggaatagtgaca

SEQ ID NO: 288617 - DNA, 75 bp, Artificial Sequence
  Synthetic
aattattgggattcatgttggaggtaatggaagagatggattctcagctatgttattaagatcatacttctctga

SEQ ID NO: 288618 - DNA, 75 bp, Artificial Sequence
  Synthetic
tctcaaacagctccctttattggaaaaagaaattgatgggttgcgattggcttcccaaaaacaacaacaggatta

SEQ ID NO: 288619 - DNA, 75 bp, Artificial Sequence
  Synthetic
tacattgcaagaaatggctcaaatcagacgcaaatttgagatgttcacatatgttaggtttgattctgaaattac

SEQ ID NO: 288620 - DNA, 75 bp, Artificial Sequence
  Synthetic
gtagcatacatcctgtttggtttcaagcccttaaatctgtacttgagaatttacaatttgaacccaaactagtag

SEQ ID NO: 288621 - DNA, 75 bp, Artificial Sequence
  Synthetic
gatgtgtttccaggtaataaagaaccagctgtactctctgatcatgaccccagattagaagttgattttaaggaa

SEQ ID NO: 288622 - DNA, 75 bp, Artificial Sequence
  Synthetic
atgatcttacgtacttcaaaaagaacagaaccagttggtgtccttttccacggggaaccaggaactgggaaatca

SEQ ID NO: 288623 - DNA, 75 bp, Artificial Sequence
  Synthetic
cactttgcttggcaatcaggaacaaatgcatctatattctggcaacttggacaaccattcccaagattctcgcta

SEQ ID NO: 288624 - DNA, 75 bp, Artificial Sequence
  Synthetic
gattaataatgtaattattagaactttggttttggatgcctataaacacatagatctagataaattgaagataat

SEQ ID NO: 288625 - DNA, 75 bp, Artificial Sequence
  Synthetic
ttgattcaaaccccattacattagaagatagtgtttttggtgtggaaggattagaagcactcgatcttaacacca

SEQ ID NO: 288626 - DNA, 75 bp, Artificial Sequence
  Synthetic
tggtcataatggatgatataatgcaaaacccaaatggtgaagacatgtctttattctgtcagatggtttcttcag

SEQ ID NO: 288627 - DNA, 75 bp, Artificial Sequence
  Synthetic
gtacattatgtattaggattgttacaaatgaacagcaccataatgttgaaattactactagagtataccataagg

SEQ ID NO: 288628 - DNA, 75 bp, Artificial Sequence
  Synthetic
gataaatctgaaacatttaccaaacttgattataataacgtcacctttcttaagcggggtttcaaacaggatgta

SEQ ID NO: 288629 - DNA, 75 bp, Artificial Sequence
  Synthetic
tggtgtagatctacccatggtcacctttctaaaagatgaacttaggaaaaaggagaaaatctctgctggaaagac

SEQ ID NO: 288630 - DNA, 75 bp, Artificial Sequence
  Synthetic
tactataacatgtaccacagctatgaacaggagatttttcttagacttggatatagtagtcaaagaggtttttaa

SEQ ID NO: 288631 - DNA, 75 bp, Artificial Sequence
  Synthetic
tttcattaaacctagaacagatccaaaagtagtcaatgtaggacctagcgacatgtttgtacatgctggtaacct

SEQ ID NO: 288632 - DNA, 75 bp, Artificial Sequence
  Synthetic
cactgtgccacttaatgtggcacaatggacaagatgtctacaaggaatttgagcggagaattcgtagtgtaagcg

SEQ ID NO: 288633 - DNA, 75 bp, Artificial Sequence
  Synthetic
ggctccgcagttggatgcgacccagaaacattttggtcaaagatccctgtgatgctagatggagaatgcataatg

SEQ ID NO: 288634 - DNA, 75 bp, Artificial Sequence
  Synthetic
ctggtcgtgcactatatattcctccctatgaaatgcttctgcatgagtggtatgaaaaattttaaagatatagaa

SEQ ID NO: 288635 - DNA, 75 bp, Artificial Sequence
  Synthetic
gtagtctttaaagatagaaacacaggggattacttatcactagcaactgtgtacaataagatcacagaggagaac

SEQ ID NO: 288636 - DNA, 75 bp, Artificial Sequence
  Synthetic
aatgactacatcccaacgtgtgattgtactgatgccacatattattgtagacacaaagatagatattacccaatc

SEQ ID NO: 288637 - DNA, 75 bp, Artificial Sequence
  Synthetic
acactattattacggtaattttgtacgccagttttgcctccctccccaaatgtaacttagaagatgtacacaacg

SEQ ID NO: 288638 - DNA, 75 bp, Artificial Sequence
  Synthetic
atagattatgtagatcaaaacatattttcaaaaacatgtattatgaagttgagggtggagtcccatcaggatgct

SEQ ID NO: 288639 - DNA, 75 bp, Artificial Sequence
  Synthetic
aatctgtcagaaaccctgatgtcatcaaatactgtgaagataacaaatggattgtgccagctgattgtaagttag

SEQ ID NO: 288640 - DNA, 75 bp, Artificial Sequence
  Synthetic
gtgattgtggaggaaagttactctgtaaacatggtgtgattgggataattactgctggtggagaaggtcatgtag

SEQ ID NO: 288641 - DNA, 75 bp, Artificial Sequence
  Synthetic
gccaacaggcggtggttatccaaaccatcaaaggtcaagcacttctgtttccccggtcaatgttgatatgctcca

SEQ ID NO: 288642 - DNA, 75 bp, Artificial Sequence
  Synthetic
taaacatggtgtgattgggataattactgctggtggagaaggtcatgtagcatttattgatctcaggcattttca

SEQ ID NO: 288643 - DNA, 75 bp, Artificial Sequence
  Synthetic
agcatatggagatgatgtcattttctcatataaatatcaacttgatatggaagcaattgctaaagagggtacaaa

SEQ ID NO: 288644 - DNA, 75 bp, Artificial Sequence
  Synthetic
aagcaattgctaaagagggtacaaaatatggtcttaccatcacccctgctgataaatcaaatgaattcaagcaac

SEQ ID NO: 288645 - DNA, 75 bp, Artificial Sequence
  Synthetic
acagggaccatactcaggtgaacctaaaccagcaaccagaaaaccagagagaagggtggtaacacaaggcccaca

SEQ ID NO: 288646 - DNA, 75 bp, Artificial Sequence
  Synthetic
gtagacctggcagatgaggctagaaataccccactggtgacagtgttctagcctgcgtggctgcctgcgcaccct

SEQ ID NO: 288647 - DNA, 75 bp, Artificial Sequence
  Synthetic
aacccaatcaacaacattagtaagaaaataatcaaatggttacttaggataatatcagcaatggttataattatt

SEQ ID NO: 288648 - DNA, 75 bp, Artificial Sequence
  Synthetic
atgcacacaatccagtgtgtttttggtcgtaatgagtaattgtgggatgggaccaactactttgggtgtccgtgt

SEQ ID NO: 288649 - DNA, 75 bp, Artificial Sequence
  Synthetic
ttaccaactcatgctgatgctggtaaaactatagacatcaatggaatacagacaagggttgcagatgcatatgat

SEQ ID NO: 288650 - DNA, 75 bp, Artificial Sequence
  Synthetic
cacaattaaattatatccacaaagaatcagattcatggcttaaaaaattcactgaaatgtgtaacgcagctagag

SEQ ID NO: 288651 - DNA, 75 bp, Artificial Sequence
  Synthetic
gagcagaaaatacgcagtgtcagcgctggtcgtgcactgtatattcctccttatgacttgctcctccatgaatgg

SEQ ID NO: 288652 - DNA, 75 bp, Artificial Sequence
  Synthetic
ttgacaccatgggcgctcaagtttccaggcagaatgttggaacgcactctacgcaaaacgcagtttctggaggat

SEQ ID NO: 288653 - DNA, 75 bp, Artificial Sequence
  Synthetic
atgactaccctgaatgctgcctagctttattagccaaccaacctgaacccactataatagaagtgggtgatagtt

SEQ ID NO: 288654 - DNA, 75 bp, Artificial Sequence
  Synthetic
gaaactaaacttcctagaaaaacaaatagagcatttaagagtggcagattcaaaaacacaggagaaaattaaaca

SEQ ID NO: 288655 - DNA, 75 bp, Artificial Sequence
  Synthetic
aagaccctagcaaatttacagacccagtgaaagatgttcttaccaagggtattcccacactacaatcacccacag

SEQ ID NO: 288656 - DNA, 75 bp, Artificial Sequence
  Synthetic
aataggtttagtcttaggcatacatgttggaggcaatggtagaaatggtttctcagcaatgttattgaggtcata

SEQ ID NO: 288657 - DNA, 75 bp, Artificial Sequence
  Synthetic
tagacctggcagatgaggctggaagtaccccactggcgacagtgttccagcctgcgtggctgcctgcacacccta

SEQ ID NO: 288658 - DNA, 75 bp, Artificial Sequence
  Synthetic
attaaacagaagaagaggtgtgagccagttgcagttgttatacatggtgaacctggtactggaaagtctatgacc

SEQ ID NO: 288659 - DNA, 75 bp, Artificial Sequence
  Synthetic
atggcctacatacctcaactcaaaagatgcaacagccattgataaacctactcaacctgatacctcaaccaatag

SEQ ID NO: 288660 - DNA, 75 bp, Artificial Sequence
  Synthetic
gttttccatgacactttccctgggaaaaaggaacctgcagttctatcctcaaaagaccccagattgcaggtggat

SEQ ID NO: 288661 - DNA, 75 bp, Artificial Sequence
  Synthetic
agcacacaaaccagtgtgtatctagtcgtaatgagcaattgcgggatgggaccgactactttgggtgtccgtgtt

SEQ ID NO: 288662 - DNA, 75 bp, Artificial Sequence
  Synthetic
taatggatgacataatgcaaaatccaagtggtgatgacatgactttattctgtcagatggtatcaagtgtaacat

SEQ ID NO: 288663 - DNA, 75 bp, Artificial Sequence
  Synthetic
atgttttaccattcactaggtagagcaggttatttgattcatgttcagtgtaatgcaagtaaatttcactcaggg

SEQ ID NO: 288664 - DNA, 75 bp, Artificial Sequence
  Synthetic
cattagatataagcccagaaccactatccatggaagaaagtgtgtatggaatagaaggcctagaagctttagatc

SEQ ID NO: 288665 - DNA, 75 bp, Artificial Sequence
  Synthetic
acacaaaactctgtatctaatggatctagtttaaactacttcaacatcaactacttcaaagatgctgcttcaaat

SEQ ID NO: 288666 - DNA, 75 bp, Artificial Sequence
  Synthetic
aacctcgttgccagctatgaataggagatttttcttagatctagatattgtagtgtgtgataaatataaagattc

SEQ ID NO: 288667 - DNA, 75 bp, Artificial Sequence
  Synthetic
gagaaattgctgaagttgcaaataggaatgaaagacaaccatcatatgacagctggttgaactgtaatggcacat

SEQ ID NO: 288668 - DNA, 75 bp, Artificial Sequence
  Synthetic
gaagtacgggttggacttgcccatgattacatttttaaaagatgaactcagaaaaccagacaaaatttacacagg

SEQ ID NO: 288669 - DNA, 75 bp, Artificial Sequence
  Synthetic
ttgaggcttgtggatattcggatagaatcatacagattaccagaggagattcaacaataacatcacaggatgtgg

SEQ ID NO: 288670 - DNA, 75 bp, Artificial Sequence
  Synthetic
gtttttagggatcgtaacacatgccagacttacactttggcccaggtatacaatttaatgcttgaagaagatagg

SEQ ID NO: 288671 - DNA, 75 bp, Artificial Sequence
  Synthetic
ttccatgctcagacacaacaactggtcattgttgattgtacccatctctcaacttagaggtgatacaaactccat

SEQ ID NO: 288672 - DNA, 75 bp, Artificial Sequence
  Synthetic
attactggttcagcagtagggtgtgatccagagaccttttggtcgaagataccagtcatgcttgatggtgaatgt

SEQ ID NO: 288673 - DNA, 75 bp, Artificial Sequence
  Synthetic
taagaactcctgaagtgattaaatactgtgaaggcaacaagtggataatacctgctgaatgtaaggtggaaagag

SEQ ID NO: 288674 - DNA, 75 bp, Artificial Sequence
  Synthetic
tcagggcaatttctaacaactgatgatatgcaatccccttcagttttaccatacttccacccaactcaggaaatc

SEQ ID NO: 288675 - DNA, 75 bp, Artificial Sequence
  Synthetic
tggtacaaaaattgtgttactccaagcacatctttaaaacacaatattatgaggtagagggagggatgccatcag

SEQ ID NO: 288676 - DNA, 75 bp, Artificial Sequence
  Synthetic
accatactcaggtgaacctaaaccaaaaactaggattccagaaagaagggtagtagcacaaggaccagaggaaga

SEQ ID NO: 288677 - DNA, 75 bp, Artificial Sequence
  Synthetic
atgcactaccactcacgagacaaccccaatccgctgtaaaattgtttaccatcccaattgatattgcatcaccac

SEQ ID NO: 288678 - DNA, 75 bp, Artificial Sequence
  Synthetic
gatactagcatatggagatgatatcctgttttcctacccctatgatctagacatgaaagaattagcagatgaggg

SEQ ID NO: 288679 - DNA, 75 bp, Artificial Sequence
  Synthetic
acacatgctgatccaggtaaagaagtgcaaatagatggcatcacaaccaaagttgaagattcatatgacttatac

SEQ ID NO: 288680 - DNA, 75 bp, Artificial Sequence
  Synthetic
attaaagttactcattgcttatacccccccaggagcaccagaacccactaagagaaaggaagcaatgttaggtac

SEQ ID NO: 288681 - DNA, 75 bp, Artificial Sequence
  Synthetic
gatgaaaaacacagtttcttgatacaccctgtgtaccctgaagaggaagtgtgggagtccatcagatggactaaa

SEQ ID NO: 288682 - DNA, 75 bp, Artificial Sequence
  Synthetic
acccagattgtaatttggcactttctgctaatcaaccagaaactactattatcaatgttggagatgtggtgtcat

SEQ ID NO: 288683 - DNA, 75 bp, Artificial Sequence
  Synthetic
aaagctggttttgtaacatgttggtaccaaactaattttgttacagctccagatgcacctaccactgcggatatc

SEQ ID NO: 288684 - DNA, 75 bp, Artificial Sequence
  Synthetic
tcagtgctggtcgcgcgctttatataccaccatatgaactcttgcgccacgaatggtatgaaaaattttaaactg

SEQ ID NO: 288685 - DNA, 75 bp, Artificial Sequence
  Synthetic
acttttgtttaagaatggcaagagatacagatcaacatactcaggtgggtgctataacacaaaaccctattgaac

SEQ ID NO: 288686 - DNA, 75 bp, Artificial Sequence
  Synthetic
ccaaattattggaatccatgttggaggtaatggaagagatgggttctcagctatgttgttaagatcatatttttc

SEQ ID NO: 288687 - DNA, 75 bp, Artificial Sequence
  Synthetic
actctgttattacggtagctttgtacgccagttttatcacccctccccacaatgtaacttagaagttttacactt

SEQ ID NO: 288688 - DNA, 75 bp, Artificial Sequence
  Synthetic
gccagtaatggatctatagcaaattcagcaccagcattagatgcagcagagactggacacacaagttcagtgcaa

SEQ ID NO: 288689 - DNA, 75 bp, Artificial Sequence
  Synthetic
gactggacacacaagttcagtgcaacctgaagatcttatagagactaggtatgtaattacagatcaaactaggta

SEQ ID NO: 288690 - DNA, 75 bp, Artificial Sequence
  Synthetic
tatgatgtgtttccaggcaataaagagccagctgtactttctgatcatgatcccagactagaagttgactttaaa

SEQ ID NO: 288691 - DNA, 75 bp, Artificial Sequence
  Synthetic
tcgttatccgcaagatgcctacgcaaagcttagtagcgctctgaatgctttttggctggttgttccactacaaac

SEQ ID NO: 288692 - DNA, 75 bp, Artificial Sequence
  Synthetic
ggaataaacatacaagagatgtcacaaattagaaggaaatttgaaatgttcacttatgtaagatttgattcagag

SEQ ID NO: 288693 - DNA, 75 bp, Artificial Sequence
  Synthetic
atattgattcaaaccctattacgctagaagacagtgtctttggtgtggaaggattagaagcacttgaccttaaca

SEQ ID NO: 288694 - DNA, 75 bp, Artificial Sequence
  Synthetic
gttgacagggtgtgaagagccccgtgtgctcatcttgagtcctccggcccctgaatgtggctaaccttaaacccg

SEQ ID NO: 288695 - DNA, 75 bp, Artificial Sequence
  Synthetic
ggatgcacgatgcctggcaaaccagtacaaatgcctcagtcttctggcaagttggacagacttatcccagattca

SEQ ID NO: 288696 - DNA, 75 bp, Artificial Sequence
  Synthetic
atatggtgtagatttacccatggttactttcctcaaggatgagcttaggaaaaaggagaaaatttctgctgggaa

SEQ ID NO: 288697 - DNA, 75 bp, Artificial Sequence
  Synthetic
atgcctatggtgacaatatatagtatatattgtcattatgggcgctcaggtatccagacagaatgttggtacaca

SEQ ID NO: 288698 - DNA, 75 bp, Artificial Sequence
  Synthetic
catgggcacaatatgtgtgagaatggtgacagataaacagaaaattaaaactaaaattgattcaagaatatacct

SEQ ID NO: 288699 - DNA, 75 bp, Artificial Sequence
  Synthetic
acaggttctgctgttgggtgtgatccagaaacattctggtcgaaaatccctgtgatgctagacggagaatgcata

SEQ ID NO: 288700 - DNA, 75 bp, Artificial Sequence
  Synthetic
gaagatgtcattgaaaccagatatgtacagacatcacaaacaagagatgagatgagtttagagagttttcttggt

SEQ ID NO: 288701 - DNA, 75 bp, Artificial Sequence
  Synthetic
tcacaagacccaagtaaatttactgaccctgttaaagatgttcttacaaaaggtatcccgactttgcaatcccct

SEQ ID NO: 288702 - DNA, 75 bp, Artificial Sequence
  Synthetic
gaaactaaggtcaaatatagagctgaagtcacaaccattggaccttctgaaatgtttgtacatactaccaacctt

SEQ ID NO: 288703 - DNA, 75 bp, Artificial Sequence
  Synthetic
tagatagattgtgtaaatcaaaacatattttcaaaaacatgtattatgaggttgaaggtggagtcccgtcaggat

SEQ ID NO: 288704 - DNA, 75 bp, Artificial Sequence
  Synthetic
gtgtatggccagagtatttatctgctcaagatgctagtgccatagataaaccttcacaccctgatacatcatcaa

SEQ ID NO: 288705 - DNA, 75 bp, Artificial Sequence
  Synthetic
gtgatgactacatcccagattgtaattgtacagattgctgttattattgtgcccacaaaaacagatacataccag

SEQ ID NO: 288706 - DNA, 75 bp, Artificial Sequence
  Synthetic
aatagcatatggggatgatgttattttttcatataaatatcaacttgatatggaagcaattgctaaagagggcac

SEQ ID NO: 288707 - DNA, 75 bp, Artificial Sequence
  Synthetic
gggatgattatgcatggcagtctggcactaatgcatctattttctggcaacatgggcaagcatacccaagatttt

SEQ ID NO: 288708 - DNA, 75 bp, Artificial Sequence
  Synthetic
tggaagcaattgctaaagagggcacaaaatatggtcttacaatcactcctgctgataaatcaagtgaattcaaac

SEQ ID NO: 288709 - DNA, 75 bp, Artificial Sequence
  Synthetic
aaacctcttctaccacttccttggaagggctggatacacggttcatgttcaatgtaatgctagtaaatttcatca

SEQ ID NO: 288710 - DNA, 75 bp, Artificial Sequence
  Synthetic
aggagactgtggaggaaaattgttatgcaaacatggtgttattggaatggtaacagcaggtggggataatcatgt

SEQ ID NO: 288711 - DNA, 75 bp, Artificial Sequence
  Synthetic
tgcaaacatggtgttattggaatggtaacagcaggtggggataatcatgttgctttcatagatctcagaaaatac

SEQ ID NO: 288712 - DNA, 75 bp, Artificial Sequence
  Synthetic
agagtccatacgttggactaaaaaaccatctcaaatgcaggagcatgtcttgtcattgtgtcatttaatgtggca

SEQ ID NO: 288713 - DNA, 75 bp, Artificial Sequence
  Synthetic
ggcagagaaatagggacttttggggagaatagcgtattagacagacaacccagtgatgaaaattggttgaattgt

SEQ ID NO: 288714 - DNA, 75 bp, Artificial Sequence
  Synthetic
gcaacataaatccattaaacaaaattagtgctaaggttataaaatggttgattagagtaatatcagcattagtta

SEQ ID NO: 288715 - DNA, 75 bp, Artificial Sequence
  Synthetic
tagtgctaaggttataaaatggttgattagagtaatatcagcattagttattgcagttcgaagtcaaggggactt

SEQ ID NO: 288716 - DNA, 75 bp, Artificial Sequence
  Synthetic
gcgctggtcgtgcactgtatattcctccttacgacttgctcctccatgaatggtatgaaaaattttagattgttt

SEQ ID NO: 288717 - DNA, 75 bp, Artificial Sequence
  Synthetic
ttaaaactggatctgggttgttcccactcaggtctcccacgtggagtagtacactgttattacggtaactttgta

SEQ ID NO: 288718 - DNA, 75 bp, Artificial Sequence
  Synthetic
taccaatggactctatggttagacataacaattggagtatagtcataattccaatatctaaattggtgtcagtag

SEQ ID NO: 288719 - DNA, 75 bp, Artificial Sequence
  Synthetic
cacaaagaatcagatggttggattaagaaatttacagagatgtgcaatgcagcaagggggttggaatggattgga

SEQ ID NO: 288720 - DNA, 75 bp, Artificial Sequence
  Synthetic
tcattatgggccaagcacttctgtttccccggtcgaagttgatatgctccaacagggcaaaaacaactgagatcg

SEQ ID NO: 288721 - DNA, 75 bp, Artificial Sequence
  Synthetic
aacccctggttcagaacaatttctaacaactgatgatgcccagtcaccttctgctttgccctatttccatccaac

SEQ ID NO: 288722 - DNA, 75 bp, Artificial Sequence
  Synthetic
agaaacagattgatggattgccctatgcaaccattaaacagcaggaggaatatctacaggagatggaggaaatgt

SEQ ID NO: 288723 - DNA, 75 bp, Artificial Sequence
  Synthetic
gtaaacatgtatacggtacaagttcaagaacaaaccactccggcaaaagaggtatttgccataccagtggatgta

SEQ ID NO: 288724 - DNA, 75 bp, Artificial Sequence
  Synthetic
aattgaaccagtggctgttatgtttcatggagatccaggatcagggaaatccatctgcacaaacattcttgctcg

SEQ ID NO: 288725 - DNA, 75 bp, Artificial Sequence
  Synthetic
ctaatactagccttaaattactcattgcatacacaccccctggggtccccaagccaaccagtagaaaagatgcaa

SEQ ID NO: 288726 - DNA, 75 bp, Artificial Sequence
  Synthetic
tgggaccaactactttgggtgtccgtgtttcttgtttttcttttatatttgcttatggtgacaatatatagtgat

SEQ ID NO: 288727 - DNA, 75 bp, Artificial Sequence
  Synthetic
cagaacccaaacggagaagacatgagtacattctgtcaaatggtatcatcagttaactatgtagttcctatggct

SEQ ID NO: 288728 - DNA, 75 bp, Artificial Sequence
  Synthetic
ataaattactttaaggatgctgcttcaagtggcgcatcaaaattggaattttcacaagaccctagtaaatttact

SEQ ID NO: 288729 - DNA, 75 bp, Artificial Sequence
  Synthetic
tacatattcaaaggctggatatatcacatgctggtatcagacaaattttatagtccctcctagcacacccaactc

SEQ ID NO: 288730 - DNA, 75 bp, Artificial Sequence
  Synthetic
taaaccgtagactgttcttggatctgacaatcaaggtgaacccaaaatacttagaatcaggtaagcttaatttgg

SEQ ID NO: 288731 - DNA, 75 bp, Artificial Sequence
  Synthetic
gggattcaacaattacttcacaagatgttgctaacgcagttgttggctatggagtctggccccattaccttactc

SEQ ID NO: 288732 - DNA, 75 bp, Artificial Sequence
  Synthetic
ccggtagagaaatacacagaggctatcttaaatgaagtattagtagtcccaaacattaatgcaagcaatccacaa

SEQ ID NO: 288733 - DNA, 75 bp, Artificial Sequence
  Synthetic
tagtgatatatactctttacccccagatccaaaatattttgatggctacgatcaacaaagtgtcgtaataatgga

SEQ ID NO: 288734 - DNA, 75 bp, Artificial Sequence
  Synthetic
caatgaggaactatcactatcacgggtatacaatcagattgtacatgagcacaaccgccgcctaaatgtatcaaa

SEQ ID NO: 288735 - DNA, 75 bp, Artificial Sequence
  Synthetic
tggtttcaagtgtcacttttataccaccaatggctgatttaccagacaagggcaaggcctttgactctaggtttg

SEQ ID NO: 288736 - DNA, 75 bp, Artificial Sequence
  Synthetic
ctggtggtggaaattacctgatgctttaaaggacatgggaatatttggacaaaacatgtattaccactttcttgg

SEQ ID NO: 288737 - DNA, 75 bp, Artificial Sequence
  Synthetic
aaacccgggatgaaatgagcattgaaagtttcttaggcagatcaagttgcattgctgagatccataccaatttag

SEQ ID NO: 288738 - DNA, 75 bp, Artificial Sequence
  Synthetic
aattattgtaaaaaccagaactggatcattcctgctgatgttagtgtagagagagagttaaacttggtaaactta

SEQ ID NO: 288739 - DNA, 75 bp, Artificial Sequence
  Synthetic
tcttagatttgattcagaaataactatagtggtatcagtggctagtaaacaagggaataacgggcacgtggtgat

SEQ ID NO: 288740 - DNA, 75 bp, Artificial Sequence
  Synthetic
gaaaggggcaatgtcactgctggatacaatttcacacatcctggtgagcctggtagagaggttggaaaacctaat

SEQ ID NO: 288741 - DNA, 75 bp, Artificial Sequence
  Synthetic
caaagaaaaagactataccagaaaaaagaattgttgtacagggacccacaacagaatttggtcttagcctaatta

SEQ ID NO: 288742 - DNA, 75 bp, Artificial Sequence
  Synthetic
taagaagcaacaattcagccacaataatagtgccatatgtgaatgcagtacccatggattccatgctcagacata

SEQ ID NO: 288743 - DNA, 75 bp, Artificial Sequence
  Synthetic
caaccataccctagattcacaatccctttcatgagtattgcgtcagcatattatatgttctatgatgggtatgaa

SEQ ID NO: 288744 - DNA, 75 bp, Artificial Sequence
  Synthetic
aatagtgccatatgtgaatgcagtacccatggattccatgctcagacataacaattggagtttagtaatcatacc

SEQ ID NO: 288745 - DNA, 75 bp, Artificial Sequence
  Synthetic
aagtgttaatatagatggggttgaagtaaaagtggtagattcatatgatttgtttaataaagaaggagtgaaact

SEQ ID NO: 288746 - DNA, 75 bp, Artificial Sequence
  Synthetic
gacaataggtggataataccagcagaatgtaagatagagaaggagttaaatttagctaatacaatcataacaatc

SEQ ID NO: 288747 - DNA, 75 bp, Artificial Sequence
  Synthetic
ccagtaggatttatcacaaggctaaacatatcagtgcatggtgtccaagaccaccaagagcagttgcatatcaac

SEQ ID NO: 288748 - DNA, 75 bp, Artificial Sequence
  Synthetic
agtcaaggattacctgtgttaacaacaccagggtctggtcagttcatgaccacagatgattttcaatctcctagt

SEQ ID NO: 288749 - DNA, 75 bp, Artificial Sequence
  Synthetic
ctcgttgcaaaccaagaagtgccccagatcttggaggttggtgatgtggtatcatatggtaacatactactgagt

SEQ ID NO: 288750 - DNA, 75 bp, Artificial Sequence
  Synthetic
aagaaatttaatagaaatgtgtcaagtagataccatcatacctataaacaacactggaaccaacactacaagcat

SEQ ID NO: 288751 - DNA, 75 bp, Artificial Sequence
  Synthetic
tccatcagatttgtatgtgcactctagtaattttatttataaaaacttgcacttgtgtgaaccagaaaacctaaa

SEQ ID NO: 288752 - DNA, 75 bp, Artificial Sequence
  Synthetic
tgggtggtaatggaagacaaggattttcagccatgctactcaaaaggtactttaaccagcaacaaggtcaaatta

SEQ ID NO: 288753 - DNA, 75 bp, Artificial Sequence
  Synthetic
ctaggagaaattgcaagttattacacacactggacaggtagcttgcgtttcagttttatgttctgtggatcagcc

SEQ ID NO: 288754 - DNA, 75 bp, Artificial Sequence
  Synthetic
tactactgtaaacataaggatagatattaccccattagtgtgacaaaacatcagtggtatgaaatacaagaatca

SEQ ID NO: 288755 - DNA, 75 bp, Artificial Sequence
  Synthetic
cagttttatgttctgtggatcagccagcaccactttgaagcttctattggcatacactccaccagggattgcaaa

SEQ ID NO: 288756 - DNA, 75 bp, Artificial Sequence
  Synthetic
caaggaaccagcagtattatcagagaaagatccacgtctacaagtggatttaaacacatctcttttctcaaaata

SEQ ID NO: 288757 - DNA, 75 bp, Artificial Sequence
  Synthetic
ttggcttgcagtcaactatatccatggtagtgccctgggttagtgctagtcatttcagaaacacaaccccggata

SEQ ID NO: 288758 - DNA, 75 bp, Artificial Sequence
  Synthetic
ttggtataataaccgctggaggtgacaatcatgtagctttcatagatcttagagactttcaagttgctgaggagc

SEQ ID NO: 288759 - DNA, 75 bp, Artificial Sequence
  Synthetic
aatgagtatatgaaagtagcagcatcacactatgcatctcaactagaaactttagatatacctaatcaacaaatg

SEQ ID NO: 288760 - DNA, 75 bp, Artificial Sequence
  Synthetic
ttgcaaggatttctgcttgcgaatggctcgggacactaatctacacaaacagagtgggccaataacccagaatcc

SEQ ID NO: 288761 - DNA, 75 bp, Artificial Sequence
  Synthetic
gatatctagtaaaatagttaaatgggtaataagaatcatttcagctatcactataataatcagaaacaatgctga

SEQ ID NO: 288762 - DNA, 75 bp, Artificial Sequence
  Synthetic
gtggcattaggtattaagaagaaagacataatcaacaagagcaccagagacacatcaaaaatcaaaaactgttta

SEQ ID NO: 288763 - DNA, 75 bp, Artificial Sequence
  Synthetic
gctgctgaaacaggtcacaccagtaatgttcaacctgaagacatgattgagacacgttatgtacaaacatcacaa

SEQ ID NO: 288764 - DNA, 75 bp, Artificial Sequence
  Synthetic
atacataaggaatctgatgggtggataaagaaattcacagagatgtgtaatgctgctagaggtcttgagtggtta

SEQ ID NO: 288765 - DNA, 75 bp, Artificial Sequence
  Synthetic
gcagtctgaatgacactgtgcacatgcgcatgttatttggtaacttatttaaagctttccatgccaatccaggta

SEQ ID NO: 288766 - DNA, 75 bp, Artificial Sequence
  Synthetic
aaaatttcacaatttggaagataaacataaaagaaatggcccaaatcagaagaaagtttgaattgtttacatatg

SEQ ID NO: 288767 - DNA, 75 bp, Artificial Sequence
  Synthetic
tagaaaaacaggtagatgggttgagacttgcaacacaaaaacagcaacaggagtatattgatacccttaccctaa

SEQ ID NO: 288768 - DNA, 75 bp, Artificial Sequence
  Synthetic
ttatgatggcagtttgcatccagtctggtttaagatgttagaagtagtattagataggttaggattcccaggttg

SEQ ID NO: 288769 - DNA, 75 bp, Artificial Sequence
  Synthetic
ggttccatgtatagcagcagaaagtgaaagtgttggccatgtggttatgcagtacatgtatgtgccaccaggagc

SEQ ID NO: 288770 - DNA, 75 bp, Artificial Sequence
  Synthetic
gagaactgaaccagttggtgttatctttcatggtgagccagggacgggaaaatcaatcacaacatctatccttgc

SEQ ID NO: 288771 - DNA, 75 bp, Artificial Sequence
  Synthetic
aattcaatgattaacaatattataattagaacaataatattacatggatacaagaacattgatctggaccagttg

SEQ ID NO: 288772 - DNA, 75 bp, Artificial Sequence
  Synthetic
atcatatcccagattttcacttccatttttgagcattgcttctgcatattacatgttttatgatggctatgatgg

SEQ ID NO: 288773 - DNA, 75 bp, Artificial Sequence
  Synthetic
atgcaaaatcccagtggagaagacatgtccttattctgtcaaatggtatcatcagtaccatttataccacctatg

SEQ ID NO: 288774 - DNA, 75 bp, Artificial Sequence
  Synthetic
ccccagctgacaaatcagacacatttaaagatttagatttgagcactgctacctttttaaaaagaggtttcaaac

SEQ ID NO: 288775 - DNA, 75 bp, Artificial Sequence
  Synthetic
actagaatataccacaaagctaagcatgtcaaagcttggtgtccaaggcctcccagggcagttgaatatatacac

SEQ ID NO: 288776 - DNA, 75 bp, Artificial Sequence
  Synthetic
caatgaataggaggtttttcttggatttagatatcattgttaaagatgattataaattaggtcaaggcaaactaa

SEQ ID NO: 288777 - DNA, 75 bp, Artificial Sequence
  Synthetic
tgttcttagcctggctcatttgtgctggcacaatggaccagaacaatatgctgattttatcgggaaaatcagatc

SEQ ID NO: 288778 - DNA, 75 bp, Artificial Sequence
  Synthetic
tgtatgtccatgtaggaaacctaatatatagaaatctccacttgttcaattcagaagcaaatgattcagttttaa

SEQ ID NO: 288779 - DNA, 75 bp, Artificial Sequence
  Synthetic
tatcccgataggaagaagcctgtacctaccatcctacgacgttttgttgtacgaatggtacgaaaaattttgaaa

SEQ ID NO: 288780 - DNA, 75 bp, Artificial Sequence
  Synthetic
taatggagaacacttgtcccttgccacaatatataataggatcacacaggaaagcaaaaacagaaaggagttaac

SEQ ID NO: 288781 - DNA, 75 bp, Artificial Sequence
  Synthetic
taaaaatagatattaccctataaaagttactagccatgattggtatgagatacaggagagtgagtattatccaaa

SEQ ID NO: 288782 - DNA, 75 bp, Artificial Sequence
  Synthetic
gctctcatattccggtatgcttgcacgccagttttactcccctcccctcattgtaacttagaagcaaagcacacc

SEQ ID NO: 288783 - DNA, 75 bp, Artificial Sequence
  Synthetic
gtaattagatattgtgaagaaaataaatggataattccagcagattgtaaacttgaaagggatctcaactatgct

SEQ ID NO: 288784 - DNA, 75 bp, Artificial Sequence
  Synthetic
gtgtcacttaatgtggcataatgggcgtgatgcatacgaaaagtttgtggagaagatacgcagtgtgagcgctgg

SEQ ID NO: 288785 - DNA, 75 bp, Artificial Sequence
  Synthetic
gctggtggtgagggtcatgttgcatttatagatttaagacactttcactgtgctgaagagcaaggcattactgac

SEQ ID NO: 288786 - DNA, 75 bp, Artificial Sequence
  Synthetic
cgttatccgcaaggtgcctacgagaagcctagtaatgctcaagatgtggtttgactggtcgctccgctgttcccc

SEQ ID NO: 288787 - DNA, 75 bp, Artificial Sequence
  Synthetic
aaccaaaaccagtaacgaaaaaaccagagagaagggtggtcacacaagggcctcaggaggaatttggacgaagcc

SEQ ID NO: 288788 - DNA, 75 bp, Artificial Sequence
  Synthetic
cataatatgcatattatgacaagaatctatcataaagccaaacatgtcaaagcgtggtgcccgcgcccacccaga

SEQ ID NO: 288789 - DNA, 75 bp, Artificial Sequence
  Synthetic
taatcaaatggatgcttaggataatatcagccatggtcattatcattagaaatagttctgatccacaaacaataa

SEQ ID NO: 288790 - DNA, 75 bp, Artificial Sequence
  Synthetic
tgacagggtgtgaagagcctattgtgctcaccttgattcctccggcccctgaatgtggctaatcctaaccccgct

SEQ ID NO: 288791 - DNA, 75 bp, Artificial Sequence
  Synthetic
accaatagccagtaatcatccagattacttaaggtcaagcacttctgtttccccggtcaaagttgatatgctcca

SEQ ID NO: 288792 - DNA, 75 bp, Artificial Sequence
  Synthetic
cacctcttcaactctgaaatgcatgaatctatactggtatcctactcatcagatttaatcatctaccgaacaaac

SEQ ID NO: 288793 - DNA, 75 bp, Artificial Sequence
  Synthetic
aggtcaggaggtggaagtggatgggattaagaccaaagtcagtgatgcatatgatttatacaacacacaaggtgt

SEQ ID NO: 288794 - DNA, 75 bp, Artificial Sequence
  Synthetic
agactcttggcttaagaaatttacagagatgtgtaatgctgccagagggcttgagtggataggaaacaaaatatc

SEQ ID NO: 288795 - DNA, 75 bp, Artificial Sequence
  Synthetic
cttatggtcacaatatatatataacgtatattgtgatcatgggcgctcaggtatcaagacaaaatgttggtacac

SEQ ID NO: 288796 - DNA, 75 bp, Artificial Sequence
  Synthetic
ttggcactagttgcaaatcaggtagaacccacaattttagaagttggtgattgctgttcatatggaaacatctta

SEQ ID NO: 288797 - DNA, 75 bp, Artificial Sequence
  Synthetic
gacaacctacgttgtgctgacacaaaagtgcaggaaaagataaaatttgaaatagagacacttcatgatttatca

SEQ ID NO: 288798 - DNA, 75 bp, Artificial Sequence
  Synthetic
ttctcaagatccaagtaaatttactgatccagtgaaagatgtcttaactaaaggaatacctacattgcaatcacc

SEQ ID NO: 288799 - DNA, 75 bp, Artificial Sequence
  Synthetic
tacatgtgggaggcaatggaagagatggtttttctgcaatgttattaagatcttactttaatgaacaacaaggga

SEQ ID NO: 288800 - DNA, 75 bp, Artificial Sequence
  Synthetic
ttatggtgacaatatatacgtatatattgacaccatgggcgcacaagtatccaggcaaaatgttggaactcactc

SEQ ID NO: 288801 - DNA, 75 bp, Artificial Sequence
  Synthetic
ttgccatcatgatacatggaccgcctggtactggtaagtccattaccactagttttcttgccagaatgataacaa

SEQ ID NO: 288802 - DNA, 75 bp, Artificial Sequence
  Synthetic
ggtgtttggccacactacctctctgctgaagatgcaaatgcaatagacaaaccgactcgcccagacacgtcatct

SEQ ID NO: 288803 - DNA, 75 bp, Artificial Sequence
  Synthetic
aggtagcaaagagcctgctgtattatccacaagagatccaaggttagaggtagatttggacagctctattttctc

SEQ ID NO: 288804 - DNA, 75 bp, Artificial Sequence
  Synthetic
caagatcctagtaaatttactgatcctgttaaagatgttttggaaaaaggaataccaacactgcagtcgcctaca

SEQ ID NO: 288805 - DNA, 75 bp, Artificial Sequence
  Synthetic
tggtgaagacatgtctctattctgtcagatggtgtccagtgtgactttcatacctccaatggctgacttacctga

SEQ ID NO: 288806 - DNA, 75 bp, Artificial Sequence
  Synthetic
agaatatgttctaccatttcctaggaagagctggatatacaatacatgtgcaatgcaatgctagtaagttccatc

SEQ ID NO: 288807 - DNA, 75 bp, Artificial Sequence
  Synthetic
tacctccaatggctgacttacctgataaaggaaaaccttttgactccagatttgttttttgtagtaccaatcact

SEQ ID NO: 288808 - DNA, 75 bp, Artificial Sequence
  Synthetic
ccaattagtctagaggatagtgtatatggaattgagggtttagaagcattggatctccacaccagtgctggatac

SEQ ID NO: 288809 - DNA, 75 bp, Artificial Sequence
  Synthetic
tttggccgcactacttgtcatctgaagacgccactgcaattgacaaaccctcccgtcctgacacatcgtccaaca

SEQ ID NO: 288810 - DNA, 75 bp, Artificial Sequence
  Synthetic
aggtagaataatagcaaacaatgcagataataacaccagacaacctagtgatgacaattggcttaattgtgatgg

SEQ ID NO: 288811 - DNA, 75 bp, Artificial Sequence
  Synthetic
agggaaattagatgtgccaaaatctttcaaaccctgtgatatagataacaaaattggaaatgcaaaatgctgtcc

SEQ ID NO: 288812 - DNA, 75 bp, Artificial Sequence
  Synthetic
caatgataacatttctcaaggatgaacttagaaaaccagagaaaattagtgcaggaaaaactagaataatagaag

SEQ ID NO: 288813 - DNA, 75 bp, Artificial Sequence
  Synthetic
catgttctaccattatctgggtaggagtgggtatacagtgcatgtgcagtgtaatgctactaaatttcatcaagg

SEQ ID NO: 288814 - DNA, 75 bp, Artificial Sequence
  Synthetic
atggactcaatgttaagacacaacaactggtcactgttgataatccctgtttgcccattacaggttgatgcgcaa

SEQ ID NO: 288815 - DNA, 75 bp, Artificial Sequence
  Synthetic
cgcagaaatgttattgacgtcatgactgcaattttccagggtcctataaccatgaactcaccacctccccctgca

SEQ ID NO: 288816 - DNA, 75 bp, Artificial Sequence
  Synthetic
gtgtgatccagaggtgttttggtcaaaaattccagttatgctggacggggattgccttatggcatttgattattc

SEQ ID NO: 288817 - DNA, 75 bp, Artificial Sequence
  Synthetic
agagaggtcaaaaacactacacgtgaacatcttcagcagcagcctactgaagaacactggctcaattttgatggt

SEQ ID NO: 288818 - DNA, 75 bp, Artificial Sequence
  Synthetic
taacaccaggatctggtcaattcttgacaacagatgatgctcaatcaccctcagctttaccttactttcacccta

SEQ ID NO: 288819 - DNA, 75 bp, Artificial Sequence
  Synthetic
gctgaatgtaagatagaaagggatctcaatcttgcaaataatataataacaatcattgcaaatatcattagtata

SEQ ID NO: 288820 - DNA, 75 bp, Artificial Sequence
  Synthetic
aattgttttgctcattgcaagggccatattctggtgaacccaaaccaaaaacaagagttcctgaaagaagagtgg

SEQ ID NO: 288821 - DNA, 75 bp, Artificial Sequence
  Synthetic
tctaagcatatctataaaacaacatactatgaagtagagggtggaatgccatcaggttgtgctggaaccagtata

SEQ ID NO: 288822 - DNA, 75 bp, Artificial Sequence
  Synthetic
cataagtatgtacacagtccaattgactacacaaactgatgttgcaaaagaggtttttgctattccagtagatgt

SEQ ID NO: 288823 - DNA, 75 bp, Artificial Sequence
  Synthetic
tggattcaatgcgaagccacaataattggagtttagtgataatcccaatttgccctcttgagacaatgagcacca

SEQ ID NO: 288824 - DNA, 75 bp, Artificial Sequence
  Synthetic
tgatagatatatgattatcccaacacatgctgatccaggaaaaactgtgcaaattaatggtattgtcacaaatgt

SEQ ID NO: 288825 - DNA, 75 bp, Artificial Sequence
  Synthetic
atgtgttattctcttacccttatgatttggatatggcagaactagctaaagaaggtaacaaatatggtctgacaa

SEQ ID NO: 288826 - DNA, 75 bp, Artificial Sequence
  Synthetic
gcaaatactaccttgaaacttttgattgcatacacacctcctggtgttcctaaaccagacactaggaaaaaagcc

SEQ ID NO: 288827 - DNA, 75 bp, Artificial Sequence
  Synthetic
ctcaggtcaatttctaacaacagatgactttcaatctccatgtgcacttccatggtaccatccaactaaagaaat

SEQ ID NO: 288828 - DNA, 75 bp, Artificial Sequence
  Synthetic
ataccagaaagagaagatgactatcctgagtgtaatctagcacttgtagcaaatcaggatgaaccaacaatcatt

SEQ ID NO: 288829 - DNA, 75 bp, Artificial Sequence
  Synthetic
aatacatccaatttacccagaaagtgaggtttgggaatccattagatggacaaagaatcccagaaatatgcagga

SEQ ID NO: 288830 - DNA, 75 bp, Artificial Sequence
  Synthetic
acacttactcaaaagctggttacataacttgttggtatcaaacaaattttgttgtacctccaggaactccaaatt

SEQ ID NO: 288831 - DNA, 75 bp, Artificial Sequence
  Synthetic
tattcaatagaactgcagtcatcgactgaacaaagtaagatattttctattagaacagatattgcttcccaacct

SEQ ID NO: 288832 - DNA, 75 bp, Artificial Sequence
  Synthetic
gagtgttagtgctggtcgcgcactctatatcccaccgtatgaactcttgttgcatgaatggtatgaaaaatttta

SEQ ID NO: 288833 - DNA, 75 bp, Artificial Sequence
  Synthetic
ggggtgtcttatacaaaataggtagtataataggaattcatgtgggtggcaatggtagagatgggttctcagcaa

SEQ ID NO: 288834 - DNA, 75 bp, Artificial Sequence
  Synthetic
tcaaacttttattagcatacacaccacctggtattgcagaacctacaacaaggaaaaatgcaatgttgggtaccc

SEQ ID NO: 288835 - DNA, 75 bp, Artificial Sequence
  Synthetic
tccagtagagagatatgttgatgaggtgctaaatgaagttctagttgttccaaacataaacaaaagtaatgggca

SEQ ID NO: 288836 - DNA, 75 bp, Artificial Sequence
  Synthetic
aacacaaggacaaatagttagttcaagaaatgttaaagacattgggtatccaacaatccatacccctagtaaaac

SEQ ID NO: 288837 - DNA, 75 bp, Artificial Sequence
  Synthetic
actctattattccggtaatcttgtacgccagttttatattccctaccccttttgtaacttagaagttaagcacac

SEQ ID NO: 288838 - DNA, 75 bp, Artificial Sequence
  Synthetic
tggattcataacttgctggtatcaaactggattagttattccacctgacactccttccacagctagattattgtg

SEQ ID NO: 288839 - DNA, 75 bp, Artificial Sequence
  Synthetic
agaccaataggcggtgaccacccaagtcactaacggtcaagcacttatgtttccccggttaagattgatacgctc

SEQ ID NO: 288840 - DNA, 75 bp, Artificial Sequence
  Synthetic
agaccaataggcggtgaccacccaagtcactaacggtcaagcacttttgtttccccggttaagattgatacgctc

SEQ ID NO: 288841 - DNA, 75 bp, Artificial Sequence
  Synthetic
agaccaataggcggtgaccacccaagtcactaacggtcaagcacttctgtttccccggttaagattgatacgctc

SEQ ID NO: 288842 - DNA, 75 bp, Artificial Sequence
  Synthetic
agaccaataggcggtgaccacccaagtcactaacggtcaagcacttgtgtttccccggttaagattgatacgctc

SEQ ID NO: 288843 - DNA, 75 bp, Artificial Sequence
  Synthetic
cagactagagatgagatgtcaattgaatctttccttggtcggtccggatgcatttcaattatcgaattggattta

SEQ ID NO: 288844 - DNA, 75 bp, Artificial Sequence
  Synthetic
tctttattctccaaatacaaaggtaatgtagattgtacattaaatgaacacatgagagtagccatagcacattac

SEQ ID NO: 288845 - DNA, 75 bp, Artificial Sequence
  Synthetic
tagtagacctggcagatgaggctagaaataccccactggtaacagtgttctagcctgcgtggctgcctgcacacc

SEQ ID NO: 288846 - DNA, 75 bp, Artificial Sequence
  Synthetic
gtagatgaagttcttaatgaagtcttagttgttcccaatatcaatagtagtcatcccacaacatcaaactctgct

SEQ ID NO: 288847 - DNA, 75 bp, Artificial Sequence
  Synthetic
acttaaggtttgattctgaaatcaccattgttccaagcaatgcagcaatagaaggaagcaatggtcacgtggtgg

SEQ ID NO: 288848 - DNA, 75 bp, Artificial Sequence
  Synthetic
tcagctcaattaatgactcttgacataaacccaaacaacataactatggaagagagtgtatttggaacagatggt

SEQ ID NO: 288849 - DNA, 75 bp, Artificial Sequence
  Synthetic
tgacaaggtgtgaagagccccgtgtgctcactttgagtcctccggcccctgaatgtggctaaccttaaccctgca

SEQ ID NO: 288850 - DNA, 75 bp, Artificial Sequence
  Synthetic
aattaagagctgcacttgataagtatggggtggacttaccaatggtcactttccttaaagatgaacttagaaaga

SEQ ID NO: 288851 - DNA, 75 bp, Artificial Sequence
  Synthetic
gctagtcgtaatgagcaattgcgggatgggaccaactactttgggtgtccgtgtttcactttttccttttatttt

SEQ ID NO: 288852 - DNA, 75 bp, Artificial Sequence
  Synthetic
tcaaccttaccccagattcacaatcccttttattagtattgcctcagcatattacatgttttatgatggttatgc

SEQ ID NO: 288853 - DNA, 75 bp, Artificial Sequence
  Synthetic
tgagtttagaaagtttccttggtaggtcagggtgtatacatgaatctaaattaaaagttgagatcggaaactatg

SEQ ID NO: 288854 - DNA, 75 bp, Artificial Sequence
  Synthetic
tcacaagaaccctggaattgtcactggttcagcagtaggatgtgatcctgagactttttggtcaaagatacctgt

SEQ ID NO: 288855 - DNA, 75 bp, Artificial Sequence
  Synthetic
atgggtcaagtctgaattattttaatataaattattttaaggatgctgcatccagtggagcctcaaaacttgaat

SEQ ID NO: 288856 - DNA, 75 bp, Artificial Sequence
  Synthetic
attaccagtagaatataccataaagcaaaacatatcagtgcctggggccctagaccaccaagagctgtaccatac

SEQ ID NO: 288857 - DNA, 75 bp, Artificial Sequence
  Synthetic
tactttggttccatgcatttctgctcttagtcaagatattggtcacatcacaatgcagtatatgtatgtcccacc

SEQ ID NO: 288858 - DNA, 75 bp, Artificial Sequence
  Synthetic
ttaaaatttgagcataggttaatagataggttgtgtaattctagacatatatttagagacacttattatgaagtt

SEQ ID NO: 288859 - DNA, 75 bp, Artificial Sequence
  Synthetic
agatagaataatacagattacaagaggtgattctacaataacatcacaagatgtggctaatgcagttataggtta

SEQ ID NO: 288860 - DNA, 75 bp, Artificial Sequence
  Synthetic
atgtacactgtggagatcttatttacagaaatctgcatttgtgtgaaccggaacacctaaatgatagtgtgctca

SEQ ID NO: 288861 - DNA, 75 bp, Artificial Sequence
  Synthetic
ttaccctttttgagtgtggcatctgcttattacatgttttatgatggatacaatgagaaaggcacgcattatgga

SEQ ID NO: 288862 - DNA, 75 bp, Artificial Sequence
  Synthetic
ctggaactagcatatttaatactatgattaataatgtgatcattagaaccttggttttagatgcctataaaaata

SEQ ID NO: 288863 - DNA, 75 bp, Artificial Sequence
  Synthetic
aacatgtcaaagcatggtgtccgcggccacccagagcacttgaatacacacgcgctcaccgtactaatttcaaaa

SEQ ID NO: 288864 - DNA, 75 bp, Artificial Sequence
  Synthetic
aaaatatggcatactaattccaaaggatggtggtggaagttaccagacgcacttaaagatatgggtatatttgga

SEQ ID NO: 288865 - DNA, 75 bp, Artificial Sequence
  Synthetic
caaagatagatactttcctattacagttaagaaatataattggtttgagatacaagagagtgagtactacccaaa

SEQ ID NO: 288866 - DNA, 75 bp, Artificial Sequence
  Synthetic
atatgggttgaccatcactcctgcagacaagtctgacaccttcaagaaattggattatgacagtgtcacatttct

SEQ ID NO: 288867 - DNA, 75 bp, Artificial Sequence
  Synthetic
aaaccttcatctctttaattctgagatgcatgaatctatcttggtgtcttactcttcagatctaatcatttaccg

SEQ ID NO: 288868 - DNA, 75 bp, Artificial Sequence
  Synthetic
taccagagcaccagttggcaaatgcaaactctgctaaagcgggagctgggtataattacacacatcctggtgagc

SEQ ID NO: 288869 - DNA, 75 bp, Artificial Sequence
  Synthetic
gcaggtggcagtggcaaggtagctttcatcgatctacgtgattttcatgtggctgatgaacaaggaatttctgat

SEQ ID NO: 288870 - DNA, 75 bp, Artificial Sequence
  Synthetic
tctcaaatgcaagagcacgtgctttcattgtgtcatttaatgtggcataatggacgcgacgtgtataaggagttc

SEQ ID NO: 288871 - DNA, 75 bp, Artificial Sequence
  Synthetic
agccatgactggtatgaaatacaggagagtgaatattaccctaagcacatacaatacaacttgttaattggtgaa

SEQ ID NO: 288872 - DNA, 75 bp, Artificial Sequence
  Synthetic
tatatttccacaccaatttattaatcttaggagtaataactctgcaacaataatagtcccttatgtgaatgctgt

SEQ ID NO: 288873 - DNA, 75 bp, Artificial Sequence
  Synthetic
tactcaaatggacaatccgcataatttcagctctaacaatagttgttagaaatagttcagatcccctgaccattg

SEQ ID NO: 288874 - DNA, 75 bp, Artificial Sequence
  Synthetic
ctggacgtgcgttgtatatcccaccttatgagctcctgttgcatgagtggtatgaaaaattttaaattctatata

SEQ ID NO: 288875 - DNA, 75 bp, Artificial Sequence
  Synthetic
accttagacaatttcattgtgctgatgagcaaggaatcacagactacatacatatgttaggtgaggcatttggaa

SEQ ID NO: 288876 - DNA, 75 bp, Artificial Sequence
  Synthetic
actatatcaataagtccaatgttcgctgaattttccggagcacgagcgagacccgcaagagctactacagaaggc

SEQ ID NO: 288877 - DNA, 75 bp, Artificial Sequence
  Synthetic
agatggatggcttaagaaatttactgagatgtgcaacgcagccagaggacttgaatggattggaaacaaaatctc

SEQ ID NO: 288878 - DNA, 75 bp, Artificial Sequence
  Synthetic
aatggttataataattagaaactcttctgacccacaaaccatattggcaacactaacactgattggatgttcagg

SEQ ID NO: 288879 - DNA, 75 bp, Artificial Sequence
  Synthetic
taattccaggagaagttaaaaatctaatagaaatgtgccaagttgatacacttatccctataaacaatacagata

SEQ ID NO: 288880 - DNA, 75 bp, Artificial Sequence
  Synthetic
gatggtttgagagcagccacagaaaaacaaagggaagattacacagagacaatttccaggttagacgatttgtca

SEQ ID NO: 288881 - DNA, 75 bp, Artificial Sequence
  Synthetic
tgtaatgcagcaagaggtcttgaatggatagggaataaaatatccaaattcattgagtggatgaagtcaatgctt

SEQ ID NO: 288882 - DNA, 75 bp, Artificial Sequence
  Synthetic
cttagcaaacactatgcttggtcaaattgctagttattacacacactggactggtagtttacgctttagttttat

SEQ ID NO: 288883 - DNA, 75 bp, Artificial Sequence
  Synthetic
tgggtatattatttcatggagaaccaggtactggaaaatcaatcactacttctgtcttagcaaggatgttaacca

SEQ ID NO: 288884 - DNA, 75 bp, Artificial Sequence
  Synthetic
aggagaaaatcaaaatggagattgatactttgcatgacttgtcatgcaaattcttgccactgtatgcaagtgaag

SEQ ID NO: 288885 - DNA, 75 bp, Artificial Sequence
  Synthetic
cacatagtctgggatgttggactgcaatcaacagtatccttagttgtcccgtgggttagttctagtcactttaga

SEQ ID NO: 288886 - DNA, 75 bp, Artificial Sequence
  Synthetic
agaagatatgacactcttttgtcaaatggtatcttcagttccctttataccaccaatggcagatttgccagacaa

SEQ ID NO: 288887 - DNA, 75 bp, Artificial Sequence
  Synthetic
tggtaagtctataacaacaaatttcttagccaaaatgatcactaatgacagtgatatttattcccttcctccaga

SEQ ID NO: 288888 - DNA, 75 bp, Artificial Sequence
  Synthetic
tgtgttttgtgtcagcttgtaaagacttttgcttacgcatggctagggacacagatatgcacactcagagtgatg

SEQ ID NO: 288889 - DNA, 75 bp, Artificial Sequence
  Synthetic
taccttgatttagatattgtagtgcacccaaggtttcaaattaaccagggtaaactaaatcttgttgctgcactc

SEQ ID NO: 288890 - DNA, 75 bp, Artificial Sequence
  Synthetic
gtatctagtgttacctttataccaccaatggctgatctgccagacaagggtaaagcttttgattctagatttgtt

SEQ ID NO: 288891 - DNA, 75 bp, Artificial Sequence
  Synthetic
tgccccaattctagatgctgctgaaaccggacacactagtaatgtacaaccagaagacactattgaaacccgtta

SEQ ID NO: 288892 - DNA, 75 bp, Artificial Sequence
  Synthetic
cactttcaaccatatataacaagattgtggaagagaataagaacagaaagatgctttcaaaaagcttagaagcta

SEQ ID NO: 288893 - DNA, 75 bp, Artificial Sequence
  Synthetic
ataatttcaaagactcacagggaaaacttaatgtggcagcagctttcaaaccatgtgatgtagatatcaaaatag

SEQ ID NO: 288894 - DNA, 75 bp, Artificial Sequence
  Synthetic
aaagatagattcaaaacatggaatattaacttacaagagatggctcaaatcaggagaaagtttgaaatgtttaca

SEQ ID NO: 288895 - DNA, 75 bp, Artificial Sequence
  Synthetic
gaacaactggacagttccagcccaatgtacaattgagagagaattaaactattgtaatttagtgttgtccatgat

SEQ ID NO: 288896 - DNA, 75 bp, Artificial Sequence
  Synthetic
gcttgaagaggatcggcgcagaagacaaatggttgacgtcatgtcagctatattccaggggccaattgacatgaa

SEQ ID NO: 288897 - DNA, 75 bp, Artificial Sequence
  Synthetic
gggctccactaccaacagacagaaagcattttgcctggcaatcaagtactaatgcatcaatattttggcaacatg

SEQ ID NO: 288898 - DNA, 75 bp, Artificial Sequence
  Synthetic
caaccagagagaagggttgtcattcaaggcccagtggaagagtttggaagatcattaattaaacataataccaga

SEQ ID NO: 288899 - DNA, 75 bp, Artificial Sequence
  Synthetic
tgtaaaatagaaaaagagctaaacttggctaatacaattataacaattattgctaatgttattagtatagcaggt

SEQ ID NO: 288900 - DNA, 75 bp, Artificial Sequence
  Synthetic
cggtaccaccgtggttaatcgtatgggggcactgtgtatgaggattgtcacaaacaaacaagttcatgatgttga

SEQ ID NO: 288901 - DNA, 75 bp, Artificial Sequence
  Synthetic
atggcattaatgttaatgtaactgattcgtatgacttatgcaataaacaaggggttaaattggaaataacagtca

SEQ ID NO: 288902 - DNA, 75 bp, Artificial Sequence
  Synthetic
aaggaccagagggggagtttggaatgtctctgatcaaacataactcgtgtgttgtcacaacagaaaatggcaaat

SEQ ID NO: 288903 - DNA, 75 bp, Artificial Sequence
  Synthetic
gcagccagtgatagtgttgacatttttataaaatcaaggcaaaacttgcaaacagctgggccaagcgacatgtat

SEQ ID NO: 288904 - DNA, 75 bp, Artificial Sequence
  Synthetic
ggagcaaccaactattcttgaagttggggatgccgtttcctatggaaacattctgttgagtggtaatgaaactgc

SEQ ID NO: 288905 - DNA, 75 bp, Artificial Sequence
  Synthetic
ttcatatcacctatataacaaggatggtattaaacttgagataacagttttaaagttagataggaatgagaagtt

SEQ ID NO: 288906 - DNA, 75 bp, Artificial Sequence
  Synthetic
gaacaaatacaacaggtgatgactacatccctacttgtgattgtactgatgccacatattactgtaaacataaga

SEQ ID NO: 288907 - DNA, 75 bp, Artificial Sequence
  Synthetic
cgagacggcttttcagcaatgctgctcagaagttatttcacaaatttccaaggtgtcatcactatgcaggatgat

SEQ ID NO: 288908 - DNA, 75 bp, Artificial Sequence
  Synthetic
ggtgatgttgtatcctatggtaacattttgcttagtggaagccagactgccagaatgctcaagtacaattatcca

SEQ ID NO: 288909 - DNA, 75 bp, Artificial Sequence
  Synthetic
agggccatgtgaaccaggtgattgcgggggaaaattgttatgcaaacatggagtgattgggatagtgactgcagg

SEQ ID NO: 288910 - DNA, 75 bp, Artificial Sequence
  Synthetic
ttctctcaaaaagtgatagtcgtctggagacagattttgaaacagctttgttttcaaagtataaaggcaatgtgc

SEQ ID NO: 288911 - DNA, 75 bp, Artificial Sequence
  Synthetic
tcagatcttattttgctgacacccaaggccaaataaccttgtctaaaagaaccagtgagtgtaatcttcccagca

SEQ ID NO: 288912 - DNA, 75 bp, Artificial Sequence
  Synthetic
gcaggttttgttgacagtgttaaggagcaaataaatgctatcaacccaattaatagtattagtaagaaaataatt

SEQ ID NO: 288913 - DNA, 75 bp, Artificial Sequence
  Synthetic
tgtgtatggtgcagaaggtctggaggcccttgatctgaacaccagtgcaggatatccttacaccagtttaggtat

SEQ ID NO: 288914 - DNA, 75 bp, Artificial Sequence
  Synthetic
gcaggttgattttaatgaatcactattttcaaaatacaagggaaacacacattgtgtgatgaatgaacacataaa

SEQ ID NO: 288915 - DNA, 75 bp, Artificial Sequence
  Synthetic
gttccccctggagatttcttaaagagaaattctgtaaatggacccaattaaattacatacacaaagaatctgatt

SEQ ID NO: 288916 - DNA, 75 bp, Artificial Sequence
  Synthetic
gatgaattaaggaaaccagaaaagataaaagctggaaaaactcgtgttattgaagcatcaagcattaatgacact

SEQ ID NO: 288917 - DNA, 75 bp, Artificial Sequence
  Synthetic
gctcttgatttgaatactagtgcaggttttccatatattacaatgggaattaaaaagagagaccttataaacaac

SEQ ID NO: 288918 - DNA, 75 bp, Artificial Sequence
  Synthetic
tcctcaggctcaacttaaggtgaaatatttgagtgagcttaaaaaattaagctttcttgagaagcagatggaaca

SEQ ID NO: 288919 - DNA, 75 bp, Artificial Sequence
  Synthetic
ggtcaaagattcccttaatgttagatggagattgccttatggcttttgactacagcaattatgatgggagtttaa

SEQ ID NO: 288920 - DNA, 75 bp, Artificial Sequence
  Synthetic
gctttcttgagaagcagatggaacaccttagagttgctgactctcaaacccaggaaaaaattaagcatgagattg

SEQ ID NO: 288921 - DNA, 75 bp, Artificial Sequence
  Synthetic
aaataataaaaggaaaaactagagtcattgaagctagtagtgttaatgatactttgctgtttagaacgacctttg

SEQ ID NO: 288922 - DNA, 75 bp, Artificial Sequence
  Synthetic
caagtactatgaagttgatggtggaatgccatcaggctgtagtggtactagcatatttaattccatgatcaacaa

SEQ ID NO: 288923 - DNA, 75 bp, Artificial Sequence
  Synthetic
gagaaaaagatgtgaaccagttgcagttgtcatacatggagaacctggcactggcaaatccatgaccacaaattt

SEQ ID NO: 288924 - DNA, 75 bp, Artificial Sequence
  Synthetic
gttgtcatacatggagaacctggcactggcaaatccatgaccacaaatttccttgctagaatgataacaaatgat

SEQ ID NO: 288925 - DNA, 75 bp, Artificial Sequence
  Synthetic
agatgataaatgcattatggcctttgattacacaaattatgacggtagtatacatcctatttggtttgaagctct

SEQ ID NO: 288926 - DNA, 75 bp, Artificial Sequence
  Synthetic
tatgaattgtcaatggaggacattgccttggctggtcaaaaatatggattgaatattacacctgcagataaatct

SEQ ID NO: 288927 - DNA, 75 bp, Artificial Sequence
  Synthetic
gatatcatgcagaatccaagtggtgaggatatgactttattttgtcaaatggtatctagtgttacatttatacct

SEQ ID NO: 288928 - DNA, 75 bp, Artificial Sequence
  Synthetic
ggtgttccatctggatgctcgggcactagtatatttaacactatgataaataacatcattataagaactttagta

SEQ ID NO: 288929 - DNA, 75 bp, Artificial Sequence
  Synthetic
ttgaagaaatttgtgaatcaataagatggacaaagaacccacgatgcatgcaggagcatgtcttatccttgtgtt

SEQ ID NO: 288930 - DNA, 75 bp, Artificial Sequence
  Synthetic
tgcctgctatgaatagaagattcttttttgacttagatattgtagtgtgtgacaagtataaagactcacagggaa

SEQ ID NO: 288931 - DNA, 75 bp, Artificial Sequence
  Synthetic
tagcaatagaaggtgttaaatatggcctaaccataactcctgctgataaatctactactttcagaaaactagact

SEQ ID NO: 288932 - DNA, 75 bp, Artificial Sequence
  Synthetic
attcgcagtgttgctgctggacgggcactgtatatacctggatacgaagtactcgagcatgagtggtatgacaaa

SEQ ID NO: 288933 - DNA, 75 bp, Artificial Sequence
  Synthetic
ggatcgtaatacttgtcaaacctatactttagcacaggtctacaatcaaatacttgctgaagacaaaaggcgtag

SEQ ID NO: 288934 - DNA, 75 bp, Artificial Sequence
  Synthetic
tagatggacaaagaaaccttctcaaatgcacgagcatgttctgtctttgtgtcatttaatgtggcataatggacg

SEQ ID NO: 288935 - DNA, 75 bp, Artificial Sequence
  Synthetic
ccggaagtaatcagatactgtgaagaaaacaaatggatggtaccggctgagtgtaaagttgaaagagatcttaac

SEQ ID NO: 288936 - DNA, 75 bp, Artificial Sequence
  Synthetic
aagatacgcagcgttagcgctggtcgcatgctgtatatccctccatatgatctgctcttgcatgagtggtatgag

SEQ ID NO: 288937 - DNA, 75 bp, Artificial Sequence
  Synthetic
caggtgaacctaggccaaagactaaaataccagaaaggagggttgtagcccagggtccagaagaagaatttggta

SEQ ID NO: 288938 - DNA, 75 bp, Artificial Sequence
  Synthetic
agaccctggtaatgaaatacagattgatggaatcacaactaaagtagaaggctcctatgatttatacaataaaga

SEQ ID NO: 288939 - DNA, 75 bp, Artificial Sequence
  Synthetic
tgtaatctagccctgtctgctaatcaaccagagaccactataattaatgtaggagatgtggtatcttatggtaat

SEQ ID NO: 288940 - DNA, 75 bp, Artificial Sequence
  Synthetic
ttggaatccatgttggaggaaatgggagagatggattcgctgccatgctgttacgatcatacttttctgaaacac

SEQ ID NO: 288941 - DNA, 75 bp, Artificial Sequence
  Synthetic
gtttcctggtagtaaagaaccagctgtccttacaagtaatgatcctagattagaagtagacttcaaagaggcttt

SEQ ID NO: 288942 - DNA, 75 bp, Artificial Sequence
  Synthetic
tctaagcctatttccttggaggagagtgtttttggtatagaaggtttagaagcattagatcttaacactagtgca

SEQ ID NO: 288943 - DNA, 75 bp, Artificial Sequence
  Synthetic
ttgatttacctatggtaactttccttaaggatgaacttagaaagaaggaaaagatttgtgctggaaagacccgtg

SEQ ID NO: 288944 - DNA, 75 bp, Artificial Sequence
  Synthetic
tgctgtgggatgtgatccagaaacattttggtcaaaaataccagtgatgttagacggagagtgcataatggcttt

SEQ ID NO: 288945 - DNA, 75 bp, Artificial Sequence
  Synthetic
ttatgtagatccaaacatatttttaaaaatacatattatgaggttgaaggtggggttccatcgggctgttccggt

SEQ ID NO: 288946 - DNA, 75 bp, Artificial Sequence
  Synthetic
atggagatgatgtaattttttcctacaaatatcaacttgacatggaagcaattgctaaagaaggcatcaaatatg

SEQ ID NO: 288947 - DNA, 75 bp, Artificial Sequence
  Synthetic
tcaattcctgatacatccaacatttccagttgaggaaattcaagagtccattcgatggacaaagaaaccatctca

SEQ ID NO: 288948 - DNA, 75 bp, Artificial Sequence
  Synthetic
ttcgatggacaaagaaaccatctcaaatgcaggaacatgtactatcactgtgtcatttaatgtggcataatggca

SEQ ID NO: 288949 - DNA, 75 bp, Artificial Sequence
  Synthetic
tactgcatgagtggtatgaaaaattttaaattgtttagatatagaaatattaaacatttagttttttagttttat

SEQ ID NO: 288950 - DNA, 75 bp, Artificial Sequence
  Synthetic
ttaaaactggatctaggttgttcccacctagatctcctacatggagttgtactctattattccggtaattttgta

SEQ ID NO: 288951 - DNA, 75 bp, Artificial Sequence
  Synthetic
actctattattccggtaattttgtacgccagttttatcctcccctccccttaaagtaacttagaagttggacata

SEQ ID NO: 288952 - DNA, 75 bp, Artificial Sequence
  Synthetic
tcgaccaataggtaacatttatccaaaatgttaaaggtcaagcacttctgtttccccggtcaaggttgatgtgct

SEQ ID NO: 288953 - DNA, 75 bp, Artificial Sequence
  Synthetic
ccaatagtagacctggcagatgaggctagaaattccccactggtaacagtgttctagcctgcgtggctgcctgcg

SEQ ID NO: 288954 - DNA, 75 bp, Artificial Sequence
  Synthetic
gctctattattccggtaattttgcacgccagtttttcatcccttccccctttgtaacttagaagacttaaacaaa

SEQ ID NO: 288955 - DNA, 75 bp, Artificial Sequence
  Synthetic
cgggatgggaccaactactttgggtgtccgtgtttcctgtttttcttttatatttgcttatggtgacaatatata

SEQ ID NO: 288956 - DNA, 75 bp, Artificial Sequence
  Synthetic
ttatccgcaaggtgcctacgcaaagcctagtagcgctcttgaaattgtttggttggtcgctcaagtacaaaccca

SEQ ID NO: 288957 - DNA, 75 bp, Artificial Sequence
  Synthetic
actttaatataaactacttcaaggatgctgcctctagtggtgcttcaaaacttgagttttcacaggatccaagta

SEQ ID NO: 288958 - DNA, 75 bp, Artificial Sequence
  Synthetic
ggacagggtgtgaagagccacgtgtgctcatcttgattcctccggcccctgaatgcggctaaccttaaacctgca

SEQ ID NO: 288959 - DNA, 75 bp, Artificial Sequence
  Synthetic
aacacgaggagattccacaatcacatcacaggatgttgctaacgctgtggttgcctatggtgtgtggcctcacta

SEQ ID NO: 288960 - DNA, 75 bp, Artificial Sequence
  Synthetic
tgcttatggtgacaatatatagtagtatatattgacaccatgggcgctcaggtatctagacagaatgttggtaca

SEQ ID NO: 288961 - DNA, 75 bp, Artificial Sequence
  Synthetic
actctattattacggtaattttgtacgccagttttatatccccccccccctgtttgtaacttagaagttttgaac

SEQ ID NO: 288962 - DNA, 75 bp, Artificial Sequence
  Synthetic
tccaagggatggtggtggaaattaccagatgcactcaaggaaatgggaatctttggtgaaaacatgttttaccat

SEQ ID NO: 288963 - DNA, 75 bp, Artificial Sequence
  Synthetic
tttctcaagatcccagtaaatttacagacccagtgaaagatgttttggaaaaaggaatacccacactacaatcac

SEQ ID NO: 288964 - DNA, 75 bp, Artificial Sequence
  Synthetic
ccagatcatcaacggtcaagcacttctgtttcccccggttagattgatacgctccaacagggcgaaaacaactct

SEQ ID NO: 288965 - DNA, 75 bp, Artificial Sequence
  Synthetic
caagtgcaacaacaggaaatgttagagctggatacaatttaacacatcctggtgaaagtggcaggaatgttgacc

SEQ ID NO: 288966 - DNA, 75 bp, Artificial Sequence
  Synthetic
tggggtttggcctcattatttaacacctgaagatgcgacagccattgataagccttcacaaccagacacctctac

SEQ ID NO: 288967 - DNA, 75 bp, Artificial Sequence
  Synthetic
cgtgtgctcatcttgattcctccggcccctgaatgtggctaaccttaaacctgcagccaatgtacacaatccagt

SEQ ID NO: 288968 - DNA, 75 bp, Artificial Sequence
  Synthetic
tattaatttgaggagcaacaattctgctacaattattgtgccatatgtaaatgcagtcccaatggattctatgct

SEQ ID NO: 288969 - DNA, 75 bp, Artificial Sequence
  Synthetic
cccctgaatgtggctaaccttaaacctgcagccaatgtacacaatccagtgtattattggtcgtaatgagtaatt

SEQ ID NO: 288970 - DNA, 75 bp, Artificial Sequence
  Synthetic
cagaacatgtactaccacttccttggaaggagtgggtatacaatacatgttcaatgcaatgccagcaaatttcat

SEQ ID NO: 288971 - DNA, 75 bp, Artificial Sequence
  Synthetic
atgtgtgccgagttttctggcgcgcgtgcaagaagtcaaggattaccagttatgattacacctggctctggccaa

SEQ ID NO: 288972 - DNA, 75 bp, Artificial Sequence
  Synthetic
gcgctcaagtatctagacagaatgttggcacacacactacacaaaatgctgtatcaaatggttctagtttgaatt

SEQ ID NO: 288973 - DNA, 75 bp, Artificial Sequence
  Synthetic
tgggcagagatgtaggtaagattggtagagaaaacaatggaaaacaacctagtgatgataattggcttaactttg

SEQ ID NO: 288974 - DNA, 75 bp, Artificial Sequence
  Synthetic
tgtgtcaagtggacacactcattccaattgacagtgtggaagctaacattaaaagcacaaatatgtatactgtca

SEQ ID NO: 288975 - DNA, 75 bp, Artificial Sequence
  Synthetic
cctcacaaaaggtataccaacactgcaatcacccagtgttgaagcatgtggttattcagataggatcatgcaaat

SEQ ID NO: 288976 - DNA, 75 bp, Artificial Sequence
  Synthetic
ccctatggattctatgcttagacacaacaactggagtttagttataattcctatctgcccacttgaatcacaggg

SEQ ID NO: 288977 - DNA, 75 bp, Artificial Sequence
  Synthetic
ctattacacccattggacaggcagtcttcgttttagctttctcttttgcggtacagcgtgtactactttaaaact

SEQ ID NO: 288978 - DNA, 75 bp, Artificial Sequence
  Synthetic
atagacaaaccaacacaccctgacacttcttctaatagattttatacattagaaagtaaaaactggactgaaact

SEQ ID NO: 288979 - DNA, 75 bp, Artificial Sequence
  Synthetic
ccaggctctggtcaatttatgaccacagatgactatcaatcacctagtgccctaccatggttccattctactaaa

SEQ ID NO: 288980 - DNA, 75 bp, Artificial Sequence
  Synthetic
atttcaatggttgttccttgggttagcgctagccactttagaaatactaccccagacaaatattccctggcagga

SEQ ID NO: 288981 - DNA, 75 bp, Artificial Sequence
  Synthetic
tacatgtacagtgcaatgctagcaagtttcatcaaggtactttgatagtcgctgctatcccagaacaccaattgg

SEQ ID NO: 288982 - DNA, 75 bp, Artificial Sequence
  Synthetic
acatgtatactgtagtgttggacaagaaaacaagcttggcagaagaagtatttgctatcaaagttgacattgctt

SEQ ID NO: 288983 - DNA, 75 bp, Artificial Sequence
  Synthetic
taagaatggcacgagacaccaatttacacttacaaagtgctcctattacacaaaacccagtagaaaattatatag

SEQ ID NO: 288984 - DNA, 75 bp, Artificial Sequence
  Synthetic
cagacaacccagtgatgaaaattggcttaactgtgatggcacacttttaggaaatataacagtatatccacacca

SEQ ID NO: 288985 - DNA, 75 bp, Artificial Sequence
  Synthetic
tactactcttaaattattacttgcttacacccctccaggtattgcaaaaccacagaagagaaaagatgccatgtt

SEQ ID NO: 288986 - DNA, 75 bp, Artificial Sequence
  Synthetic
tacgagtagcgtgcagccagaagatatggttgaaactagatatgtccaaacatcacaaacattagatgagatgag

SEQ ID NO: 288987 - DNA, 75 bp, Artificial Sequence
  Synthetic
gtgattatacccatatccaaactagaaactcaaggagggacatcaattgtacccataaccatatccatcagcccg

SEQ ID NO: 288988 - DNA, 75 bp, Artificial Sequence
  Synthetic
ttctcactggcaggttatataacatgttggtatcagactaatcttgttactccacccaacacaccttccacagct

SEQ ID NO: 288989 - DNA, 75 bp, Artificial Sequence
  Synthetic
aatctacaagaaatggcccaagtcagaagaaaatttgaattattcacatatactagatttgactctgagattaca

SEQ ID NO: 288990 - DNA, 75 bp, Artificial Sequence
  Synthetic
aatccccatctgcactcccctatttccatcccaccaaggagatattcatcccgggtagagtaaacaatttatcag

SEQ ID NO: 288991 - DNA, 75 bp, Artificial Sequence
  Synthetic
tagagaaatatgtggacaccattctgaatgaggtgctagttgtcccaaatatcaatgaaagtcatccaagtacat

SEQ ID NO: 288992 - DNA, 75 bp, Artificial Sequence
  Synthetic
attatacatggcaatcaggaacaaatgcatctgtcttttggcaacatggacaaacctatcctagattttcccttc

SEQ ID NO: 288993 - DNA, 75 bp, Artificial Sequence
  Synthetic
ggctgctgaagtttttgcaatcccagcagacatagcctcccagcccttagctactacattgataggagagattgc

SEQ ID NO: 288994 - DNA, 75 bp, Artificial Sequence
  Synthetic
tagggatgaaatgagcatagaaagttttcttggcagatccggttgtgtacatgtttcagagctccaattagatta

SEQ ID NO: 288995 - DNA, 75 bp, Artificial Sequence
  Synthetic
attactcatagcatatacaccacctggagttcctaaaccagattctagacagaaagcaatgctctcgactcatgt

SEQ ID NO: 288996 - DNA, 75 bp, Artificial Sequence
  Synthetic
aactctatgctatagaatagtcactgacaagcataatcaccaaatagaaattacaacaagaatataccacaaagc

SEQ ID NO: 288997 - DNA, 75 bp, Artificial Sequence
  Synthetic
agatttgattcagaggtaacattagtcccttgcatagctgctaaaagtaaaaacattggacatgttgttatgcaa

SEQ ID NO: 288998 - DNA, 75 bp, Artificial Sequence
  Synthetic
ggctacatcacttgttggtatcaaacaaactttattgtaccacccagcacaccaaactcagcaaacattatatgc

SEQ ID NO: 288999 - DNA, 75 bp, Artificial Sequence
  Synthetic
gcaattgaacctagaagaggaattaaaacagttggtcctagtgacatgtatgtacatgttggtaatctcatatac

SEQ ID NO: 289000 - DNA, 75 bp, Artificial Sequence
  Synthetic
catacccaagattttcattaccttttctaagtatagcttctgcatattacatgttttatgatgggtatgatggag

SEQ ID NO: 289001 - DNA, 75 bp, Artificial Sequence
  Synthetic
ctgaagcactacttaatgaagtgcttgttgtgccaaacatcaatcctagcaacgcacaaactacaaatgcagctc

SEQ ID NO: 289002 - DNA, 75 bp, Artificial Sequence
  Synthetic
atataccaacatgcgattgcactgaggcaacttattactgtaaacacaaaaacagatactacccaattaaggtaa

SEQ ID NO: 289003 - DNA, 75 bp, Artificial Sequence
  Synthetic
aactagagtatatcataaagctaaacatataaaagcttggtgcccacgaccacccagagccgtggaatataccca

SEQ ID NO: 289004 - DNA, 75 bp, Artificial Sequence
  Synthetic
gagtatagagagtttcttaggtaggtctagttgcattgcaataatccatactgatgttgtgcatgaaacagacaa

SEQ ID NO: 289005 - DNA, 75 bp, Artificial Sequence
  Synthetic
tggtggcaaattgttatgcaaacatggagttataggaatagttactgctggtggtgaaggtcatgtagctttcat

SEQ ID NO: 289006 - DNA, 75 bp, Artificial Sequence
  Synthetic
atgtatgttcatgtgggaaatttgatttacagaaatttacatttatttaattcagatatgcatgattctatatta

SEQ ID NO: 289007 - DNA, 75 bp, Artificial Sequence
  Synthetic
gattctgaaattactatagtggtgtcagttgcaagtaaaggtgatgataatgggcatgtagttatgcaatatatg

SEQ ID NO: 289008 - DNA, 75 bp, Artificial Sequence
  Synthetic
gatcagataaatgcaataaatccaatcaacagtataagtaagaaaataattaaatggttacttagaataatatca

SEQ ID NO: 289009 - DNA, 75 bp, Artificial Sequence
  Synthetic
ataaaaacagatacttcccaattaaagttaccagtcatgattggtatgagattcaagagagtgaatattacccta

SEQ ID NO: 289010 - DNA, 75 bp, Artificial Sequence
  Synthetic
ccagattcactataccttttatgagtattgcctcagcttattacatgttttatgatggttatgaagatgacaatg

SEQ ID NO: 289011 - DNA, 75 bp, Artificial Sequence
  Synthetic
aaaaattttgtaaatggacacaactaaactacattcacaaggaatctgattcctggcttaagaaattcactgaga

SEQ ID NO: 289012 - DNA, 75 bp, Artificial Sequence
  Synthetic
agctggtggtgagggtcatgttgcatttatagatttaaggcatttccactgtgcagaagagcaaggaatcactga

SEQ ID NO: 289013 - DNA, 75 bp, Artificial Sequence
  Synthetic
attccacaaagctaaacatgtcagtgcatggtgccccagacctccacgcgctgtagcttatcaacatacatacag

SEQ ID NO: 289014 - DNA, 75 bp, Artificial Sequence
  Synthetic
atacctcagtgaacttaaaaaactcaatctcctagaaaaacagatagaacatcttagaattgcagattcaagtac

SEQ ID NO: 289015 - DNA, 75 bp, Artificial Sequence
  Synthetic
cttatcaaatggatgcttagaattatatctgcaatggtgatcattatcagaaattcttcagatcctcaaacaata

SEQ ID NO: 289016 - DNA, 75 bp, Artificial Sequence
  Synthetic
catactgggaatcttgtatatagaaacttacacttgtgtgaaccagaaaacctaaatgactcaacattaatatgc

SEQ ID NO: 289017 - DNA, 75 bp, Artificial Sequence
  Synthetic
aataaatgtaatgtgattattaaacaaaagaagagatgtgaaccagttgcagttgtaattcatggtgagcctggt

SEQ ID NO: 289018 - DNA, 75 bp, Artificial Sequence
  Synthetic
cagattcatggctcaagaaatttacagaaatgtgtaatgctgctagaggacttgagtggattggaaataaaatct

SEQ ID NO: 289019 - DNA, 75 bp, Artificial Sequence
  Synthetic
acaggtattacccaataaatgtaaagaaacatcaatggtatgagattcaagaatcagaatattacccaaaacaca

SEQ ID NO: 289020 - DNA, 75 bp, Artificial Sequence
  Synthetic
atcagcaaagtgtagttatcatggatgacattatgcaaaatccaagtggtgaagacatgacacttttctgtcaaa

SEQ ID NO: 289021 - DNA, 75 bp, Artificial Sequence
  Synthetic
agaaaatctgcgttgtgctgacacaaaaactcaggagaaaataaaattggagatagatacactacatgatctttc

SEQ ID NO: 289022 - DNA, 75 bp, Artificial Sequence
  Synthetic
aggtgagaatcatgttgcattcatagatttgagagatttcctagttgctgaagagcaaggtgtattagattatgt

SEQ ID NO: 289023 - DNA, 75 bp, Artificial Sequence
  Synthetic
gttagcaccaccaacaattacatcactaccagcaatgaatagaagattcttcctagatttagatattgtagtaaa

SEQ ID NO: 289024 - DNA, 75 bp, Artificial Sequence
  Synthetic
gttgccatcatgatacatgggcctccaggtaccggaaaatccataacaactagtttcttggctagaatgattaca

SEQ ID NO: 289025 - DNA, 75 bp, Artificial Sequence
  Synthetic
aaatggacaattagaattatctcagctattactattataatcaggaataatgctgacccacatactattatagct

SEQ ID NO: 289026 - DNA, 75 bp, Artificial Sequence
  Synthetic
atctgtggcaaagctgttatgtttaaggatagaaacacatgcacatcatacactctatcacaggtatataataat

SEQ ID NO: 289027 - DNA, 75 bp, Artificial Sequence
  Synthetic
acactattatcccggtaattttgtacgccagttttataacccctcccctttgtaacttagaagatgtaaacacag

SEQ ID NO: 289028 - DNA, 75 bp, Artificial Sequence
  Synthetic
atggagaagacatgtcattgttttgtcaaatggtttcaagtgtcacatttataccaccaatggctgatctcccag

SEQ ID NO: 289029 - DNA, 75 bp, Artificial Sequence
  Synthetic
accaataggtggtaactaaccaagttactaaaggtcaagcacttctgtttccccggctgatattgatatgctcca

SEQ ID NO: 289030 - DNA, 75 bp, Artificial Sequence
  Synthetic
gttggatcaaaaaatttacagagatgtgtaatgcagctaggggcctagaatggttaggcaataaaatatcaaaat

SEQ ID NO: 289031 - DNA, 75 bp, Artificial Sequence
  Synthetic
atgaccttctaaaatcagttagaactcctgaagtaattaaatattgtgaatataacaagtggacagttcctgctg

SEQ ID NO: 289032 - DNA, 75 bp, Artificial Sequence
  Synthetic
gttttatttagatctagacattatagttcatgacaattacaaggatggtcagggaaaattggatgttccaaagtc

SEQ ID NO: 289033 - DNA, 75 bp, Artificial Sequence
  Synthetic
gtagacctggcagatgaggctagaaataccccactggtaacagtgttctagcctgcgtggctgcctgcgcacccc

SEQ ID NO: 289034 - DNA, 75 bp, Artificial Sequence
  Synthetic
attgcggttggctacacaaaaacaacagcaagactacatagacattttaacactgatgctagattcatcaaacaa

SEQ ID NO: 289035 - DNA, 75 bp, Artificial Sequence
  Synthetic
gttctgcaccttacaagggccatattcaggtgaacctatcaagaaaactaaagtcccagaaagaagagttgttgc

SEQ ID NO: 289036 - DNA, 75 bp, Artificial Sequence
  Synthetic
gaatattcccttagccaaatttacaatgtgataatggaagaagacaaacgccgcagaaatgtggtagatgtgatg

SEQ ID NO: 289037 - DNA, 75 bp, Artificial Sequence
  Synthetic
agtgcacataagccaatgtgtatctggtcgtaatgagtaattgcgggatgggaccaactactttggatgtccgtg

SEQ ID NO: 289038 - DNA, 75 bp, Artificial Sequence
  Synthetic
gtgatattccatggagaacctggtactggcaaatccataactacttcaattcttgcccgcatgctcacaactgaa

SEQ ID NO: 289039 - DNA, 75 bp, Artificial Sequence
  Synthetic
agagtccttattatcccaactcatgctgaccctggtagagaagtacaaattgatggcattaatactacagtggag

SEQ ID NO: 289040 - DNA, 75 bp, Artificial Sequence
  Synthetic
gtgaagacaacaaatggataatcccagcagattgcaagattgagagagacctaaatattgcaaataacatcataa

SEQ ID NO: 289041 - DNA, 75 bp, Artificial Sequence
  Synthetic
gtgaagacaacaaatggttaatcccagcagattgcaagattgagagagacctaaatattgcaaataacatcataa

SEQ ID NO: 289042 - DNA, 75 bp, Artificial Sequence
  Synthetic
gtgaagacaacaaatggctaatcccagcagattgcaagattgagagagacctaaatattgcaaataacatcataa

SEQ ID NO: 289043 - DNA, 75 bp, Artificial Sequence
  Synthetic
gtgaagacaacaaatgggtaatcccagcagattgcaagattgagagagacctaaatattgcaaataacatcataa

SEQ ID NO: 289044 - DNA, 75 bp, Artificial Sequence
  Synthetic
tcaacacagaactctgtttcaaatggatctagtcttaattattttaacatcaattattttaaggatgctgcttca

SEQ ID NO: 289045 - DNA, 75 bp, Artificial Sequence
  Synthetic
aagatatgtcactgttttgtcaaatggtatcatcagtgccatttataccacccatggcagatctgccagataagg

SEQ ID NO: 289046 - DNA, 75 bp, Artificial Sequence
  Synthetic
cagaaaatgaagatgactacccagattgtagtctagccttgtcagccaatcaacctgaaaccactataattaatg

SEQ ID NO: 289047 - DNA, 75 bp, Artificial Sequence
  Synthetic
aacaaaagtgccagaaaggagggttgttgctcagggaccagaggaggagtttgggcgttccctcattaagcataa

SEQ ID NO: 289048 - DNA, 75 bp, Artificial Sequence
  Synthetic
cagtagaagcttgtggctactcagatagaatcatccaaataacccgaggtgactctacaataacatcccaagacg

SEQ ID NO: 289049 - DNA, 75 bp, Artificial Sequence
  Synthetic
ccttgacttagatatagttgttaaggatgaatataaacttagtcaaggcaaacttaatctacaatgtgctcttaa

SEQ ID NO: 289050 - DNA, 75 bp, Artificial Sequence
  Synthetic
tattttatacaagattggccaggttttaggtattcatgttgggggtaatggaagagatggttttgcggccatgtt

SEQ ID NO: 289051 - DNA, 75 bp, Artificial Sequence
  Synthetic
caaattaatggtatcaacacaagtgtcactgactcatatgatttgtataataaagatggaatcaaacttgagatc

SEQ ID NO: 289052 - DNA, 75 bp, Artificial Sequence
  Synthetic
cagattttacaccttagaaagtaaaacatgggttgaaacatcgaaaggatggtggtggaaactaccagatgcact

SEQ ID NO: 289053 - DNA, 75 bp, Artificial Sequence
  Synthetic
ctagccacagtgtacaatagaatcacccaagagagcaaaaataggaaggacttaacaaactccttacaagcaatc

SEQ ID NO: 289054 - DNA, 75 bp, Artificial Sequence
  Synthetic
ttgcaacctagtgtcttttatgatgtttttccaggcaataaggagccagctgttctctctgaacatgaccccaga

SEQ ID NO: 289055 - DNA, 75 bp, Artificial Sequence
  Synthetic
cgaatcagcctgaacctactatactaagtgttggtgatgttgtatcatatggtaacatactacttagtggaaatc

SEQ ID NO: 289056 - DNA, 75 bp, Artificial Sequence
  Synthetic
ggtacattattagtcgctatggtgcctgagcaccagttggctagtgcaaacattggcaatgttactgttggatat

SEQ ID NO: 289057 - DNA, 75 bp, Artificial Sequence
  Synthetic
aaaacaaatggataataccctcagattgcaagcttgagcgtgacttgaattacgcaaatctaataatatctatgt

SEQ ID NO: 289058 - DNA, 75 bp, Artificial Sequence
  Synthetic
cacaattgacaacactagacatatgtccagatcccatttctttggaagacagtgtttttggtgtagaaggtttag

SEQ ID NO: 289059 - DNA, 75 bp, Artificial Sequence
  Synthetic
aaatggtagggatggcttttcttctatgttgcttagatcatacttcagtgaaactcagggagaaataacaaagac

SEQ ID NO: 289060 - DNA, 75 bp, Artificial Sequence
  Synthetic
ctcttctgggaaatttattaatctttcctcatcaatttattaaccttaggagtaacaattctgcaacaattattg

SEQ ID NO: 289061 - DNA, 75 bp, Artificial Sequence
  Synthetic
gaaaccagagagaagagtggttacacagggaccccaggaagaatttgggagaagtttaattaaacataacacctg

SEQ ID NO: 289062 - DNA, 75 bp, Artificial Sequence
  Synthetic
gaaaatggcaatggacaagtatggtgttgatttacctatggtaacctttcttaaggatgagcttaggaagagaga

SEQ ID NO: 289063 - DNA, 75 bp, Artificial Sequence
  Synthetic
ccagctgtactatcagacagagatccacgcctacaaactgattttaaaactgccttgttttctaaatataaaggc

SEQ ID NO: 289064 - DNA, 75 bp, Artificial Sequence
  Synthetic
aacatcaaaagtcccaattactatctcaataagcccaatgttcgctgagttctctggagcaagagcgaaaccgat

SEQ ID NO: 289065 - DNA, 75 bp, Artificial Sequence
  Synthetic
gatgggattaaaactcagattgatgatgcctatgatttgcataactcccagggagttaaattggaaattactgtt

SEQ ID NO: 289066 - DNA, 75 bp, Artificial Sequence
  Synthetic
ttaaacccaggaattgtaacaggatcagctgttgggtgtgacccagaaacattttggtcaaagatacctgtaatg

SEQ ID NO: 289067 - DNA, 75 bp, Artificial Sequence
  Synthetic
aagatagtgtttttggtatagagggtcttgaggcattggatttaaacactagtgcaggctttccatatataagca

SEQ ID NO: 289068 - DNA, 75 bp, Artificial Sequence
  Synthetic
ccaacaaaggaaatctttatacctggtgaagtcaagaatttaattgagatgtgtcaagttgatactttgataccc

SEQ ID NO: 289069 - DNA, 75 bp, Artificial Sequence
  Synthetic
aacaggaacccaccatattagaagttggtgactgctgttcatatggaaatatactcctgagtggtaatcaaacag

SEQ ID NO: 289070 - DNA, 75 bp, Artificial Sequence
  Synthetic
gattcgaatctagtctgatagatagattgtgcaaatcaaaacatattttcaaaaacatgtattatgaggttgagg

SEQ ID NO: 289071 - DNA, 75 bp, Artificial Sequence
  Synthetic
tttcctaaaagatgaacttagaaagaaagaaaaaatttcagctggaaaaacccgtgtcatcgaggctagtagcat

SEQ ID NO: 289072 - DNA, 75 bp, Artificial Sequence
  Synthetic
atgttgcatcccaaccactgtcaagcactttgttaggtgaaatttgcagttattacacacactggactggcagct

SEQ ID NO: 289073 - DNA, 75 bp, Artificial Sequence
  Synthetic
tagagatggtttctctgcaatgttattaagatcatactttactgaacaccagggtaagatagtatcaaaagctaa

SEQ ID NO: 289074 - DNA, 75 bp, Artificial Sequence
  Synthetic
tttagacaaactcaaaataatagcatatggagatgatgttattttctcttataaatatcaacttgacatggaagc

SEQ ID NO: 289075 - DNA, 75 bp, Artificial Sequence
  Synthetic
gaagtcttttggtcaaaaatccctgttatgctggatggtgactgtattatggcctttgattatacaaattatgat

SEQ ID NO: 289076 - DNA, 75 bp, Artificial Sequence
  Synthetic
agccatgttaggaacacacattgtttgggatgtaggattacagtctacaatctcactagtggtaccatgggttag

SEQ ID NO: 289077 - DNA, 75 bp, Artificial Sequence
  Synthetic
gttctgtctagtaaggaccccagactagaagttaatttagatgaatctatattctcaaaatataagggtaatgaa

SEQ ID NO: 289078 - DNA, 75 bp, Artificial Sequence
  Synthetic
agaggatttagacaagatgaaaaacatcacttcttaatacacccaacttttccagtagaggaaatacaagagtcc

SEQ ID NO: 289079 - DNA, 75 bp, Artificial Sequence
  Synthetic
tatacagagattcttactatgaagtagaaggaggagttccatctggatgctctggaaccagcatatttaatacaa

SEQ ID NO: 289080 - DNA, 75 bp, Artificial Sequence
  Synthetic
tcttctgcagacatgctatgttttgtttctgcatgcaaagatttttgtctgcgtatggccagagacactgataca

SEQ ID NO: 289081 - DNA, 75 bp, Artificial Sequence
  Synthetic
gtgtgtatggcatagaaggtttagaggcgctggatttacacactagtgctggctacccatacacagcatgcggta

SEQ ID NO: 289082 - DNA, 75 bp, Artificial Sequence
  Synthetic
agaagatacgcagtgttagcgctggccgtgcactgtatgtccctccttatgacttgctccttcatgagtggtatg

SEQ ID NO: 289083 - DNA, 75 bp, Artificial Sequence
  Synthetic
ccgtgcactgtatgtccctccttatgacttgctccttcatgagtggtatgaaaaattttaaattgtttagatata

SEQ ID NO: 289084 - DNA, 75 bp, Artificial Sequence
  Synthetic
ttcttacaagtatgttttggacatggaagcaattgcgcaagagggtactaaatatggcttgacaattacacctgc

SEQ ID NO: 289085 - DNA, 75 bp, Artificial Sequence
  Synthetic
ttaaaactgggtctaggttgttcccacctagacctcctacatggagttgtactctattatttcggtaattttgta

SEQ ID NO: 289086 - DNA, 75 bp, Artificial Sequence
  Synthetic
caaccacctcaaatgctgctccagcattagatgcagcagagactggacatacaagcagtatacaacctgaggata

SEQ ID NO: 289087 - DNA, 75 bp, Artificial Sequence
  Synthetic
agatgaacttaggaaaccagagaaaatcaagactggaaaaaccagaataatagaagctagtagtttaaatgatac

SEQ ID NO: 289088 - DNA, 75 bp, Artificial Sequence
  Synthetic
acttttccaattaatgagattcatgaatcgattagatggactaagaaaccttctcaaatgcaggagcatgtactc

SEQ ID NO: 289089 - DNA, 75 bp, Artificial Sequence
  Synthetic
ttgctaaaggtcaagcacttctgtttccccggtcaagattgatacgctctaccagggcgaaaacaattgagatcg

SEQ ID NO: 289090 - DNA, 75 bp, Artificial Sequence
  Synthetic
tgtcaataaagacataaaatatgatgatggacactttcttaaatggcctataacattacaagaggtggcacaaat

SEQ ID NO: 289091 - DNA, 75 bp, Artificial Sequence
  Synthetic
tggtcaaaagtaccagtgatgctagatggtgaatgtctcatggcttttgattatacaaattatgatgggagtctt

SEQ ID NO: 289092 - DNA, 75 bp, Artificial Sequence
  Synthetic
gctggacgtgcgctgtacattcctccatacgaaatgctcttgcatgagtggtatgaaaaattttagataatatat

SEQ ID NO: 289093 - DNA, 75 bp, Artificial Sequence
  Synthetic
agtagacctggcagatgaggctagaaattccccactggcgacagtgttctagcctgcgtggctgcctgcacaccc

SEQ ID NO: 289094 - DNA, 75 bp, Artificial Sequence
  Synthetic
atgcaatatatgtatgttccaccaggtgctccactgcccacaaagagagatgattacacatggcaatctggtact

SEQ ID NO: 289095 - DNA, 75 bp, Artificial Sequence
  Synthetic
ccacttactatgaggctgagggtggtatgccatcaggatgtgctggaactagtattttcaataccattattaata

SEQ ID NO: 289096 - DNA, 75 bp, Artificial Sequence
  Synthetic
acaaggtgtgaagagcctagtgtgctcactttgagtcctccggcccctgaatgtggctaaccttaaacccgtagc

SEQ ID NO: 289097 - DNA, 75 bp, Artificial Sequence
  Synthetic
gggaccaactactttgggtgtccgtgtttcactttttccttttatatttgcttatggtgacaatatatagattat

SEQ ID NO: 289098 - DNA, 75 bp, Artificial Sequence
  Synthetic
atggagataaatctgaatctaggtatggtgtgtctgtaaccaaccacatgggcactttatgttctagaatagtta

SEQ ID NO: 289099 - DNA, 75 bp, Artificial Sequence
  Synthetic
ttatgaccttgacatgaaagaacttgcaagtgagggtaccaaatatggtttatctatcacaccagctgataaatc

SEQ ID NO: 289100 - DNA, 75 bp, Artificial Sequence
  Synthetic
aaattatttcaaggatgctgcttcaagtggagcatcaaaattagaattttcacaagatccaagtaaatttacaga

SEQ ID NO: 289101 - DNA, 75 bp, Artificial Sequence
  Synthetic
cacacacagctacgtaactaactacaagattgctggaaaagaacctgaaattttcttaaaaccaagaatgaatat

SEQ ID NO: 289102 - DNA, 75 bp, Artificial Sequence
  Synthetic
acactattattccggtaattttgtacgccagttttatctccccaccccccttttgtaatttagaagttatgaaca

SEQ ID NO: 289103 - DNA, 75 bp, Artificial Sequence
  Synthetic
gttttaagcaagatgaaaaatacagttttcttatccatcctatttatccagaaacagaagtttgggaatccataa

SEQ ID NO: 289104 - DNA, 75 bp, Artificial Sequence
  Synthetic
agttgttaaaggtcaagcacttctgtctccccggctgacgttgatatgctccaacagggcaaaaacaatgaaagt

SEQ ID NO: 289105 - DNA, 75 bp, Artificial Sequence
  Synthetic
gattcaacaatgacatcacaagatgtagcaaatgctgttgtgggatacggcgtctggccacattacttaacagca

SEQ ID NO: 289106 - DNA, 75 bp, Artificial Sequence
  Synthetic
tcttactcatctgatctagtcatataccgaacaaacacaaaaggtgatgactacatacctacatgtgattgcact

SEQ ID NO: 289107 - DNA, 75 bp, Artificial Sequence
  Synthetic
gatcaggagtgttagtgctggtcgcgcactctatataccaccatatgaggtcttgctccacgagtggtatgagaa

SEQ ID NO: 289108 - DNA, 75 bp, Artificial Sequence
  Synthetic
gaaataccccactggtaacagtgttctagcctgcgtggctgcctgcgcaccctccccgggtgcgaagccatatat

SEQ ID NO: 289109 - DNA, 75 bp, Artificial Sequence
  Synthetic
ggtggtggaaattacctgatgcacttaaagatatgggtatatttggtgagaatatgttctatcatttccttggga

SEQ ID NO: 289110 - DNA, 75 bp, Artificial Sequence
  Synthetic
acatccagtataatttgctgattggtgagggaccttgtgaaccaggggattgtggaggaaaactcttgtgcaaac

SEQ ID NO: 289111 - DNA, 75 bp, Artificial Sequence
  Synthetic
ggctggtcgtaatgagcaattgtgggatgggaccaactactttggatgtccgtgtttcctgtttttcttttattc

SEQ ID NO: 289112 - DNA, 75 bp, Artificial Sequence
  Synthetic
tcgtggtaatgtcactgcagggtataattacacacaccccggagaactcggtagagtagttgggcaagctagagt

SEQ ID NO: 289113 - DNA, 75 bp, Artificial Sequence
  Synthetic
cccagcagtagacctggcagatgaggctggacgtaccccactggcgacagtggtccagcctgcgtggctgcctgc

SEQ ID NO: 289114 - DNA, 75 bp, Artificial Sequence
  Synthetic
catacacatgctaggtgaggcctttggcactgggtttgtagacagtgtgaaagaacaaataagtgccataaaccc

SEQ ID NO: 289115 - DNA, 75 bp, Artificial Sequence
  Synthetic
tccaacgggtctagtctaaattattttaacatcaattactttaaagatgctgcatcaagtggcgcttccaaatta

SEQ ID NO: 289116 - DNA, 75 bp, Artificial Sequence
  Synthetic
agaactaacaactcagcaacaatcattgttccatatgtaaatgcagtacccatggactcaatgttgagacataac

SEQ ID NO: 289117 - DNA, 75 bp, Artificial Sequence
  Synthetic
gctacactcacactaattggatgctcagggtctccttggaggttcttaaaagagaaattctgtaagtggactcaa

SEQ ID NO: 289118 - DNA, 75 bp, Artificial Sequence
  Synthetic
actcagatagaattatccaaataactagaggtgattccacaataacatctcaagatgtggccaatgcagtggtag

SEQ ID NO: 289119 - DNA, 75 bp, Artificial Sequence
  Synthetic
tctctggcgccagagcaagaccagctgccgcagcacagggtttaccagtttatgttacaccaggatctggacaat

SEQ ID NO: 289120 - DNA, 75 bp, Artificial Sequence
  Synthetic
aatttatagagtggatgaaatccatgttgccacaggcacagttaaaagtcaaatatcttgaaggacttaagaagc

SEQ ID NO: 289121 - DNA, 75 bp, Artificial Sequence
  Synthetic
gagcaaagtgtggactcgaacatcaaaaggatggtggtggaagttgccagatgcactcaaagatatgggtgtctt

SEQ ID NO: 289122 - DNA, 75 bp, Artificial Sequence
  Synthetic
gtgtcaagttgatacactcattccaattaataacacatttgcaaatcttcgtaatgttaacaagtatgctgtctc

SEQ ID NO: 289123 - DNA, 75 bp, Artificial Sequence
  Synthetic
caaattcttaccattatatgcaagtgaggctaagagaatcaaggtattgcataacaaatgtaatgtaataattaa

SEQ ID NO: 289124 - DNA, 75 bp, Artificial Sequence
  Synthetic
atggttccagaacatcaattggctagtgctagcgctggaaatgtgactgctggatacaattacacccaccctggt

SEQ ID NO: 289125 - DNA, 75 bp, Artificial Sequence
  Synthetic
tattacacacactggacaggtagtttgcgttttagtttcatgttttgtggtacggctaacacaacactcaaggtg

SEQ ID NO: 289126 - DNA, 75 bp, Artificial Sequence
  Synthetic
gatagtgacatatactcattacctcctgaccccaaatattttgatggttatgaccagcagagtgttgtcataatg

SEQ ID NO: 289127 - DNA, 75 bp, Artificial Sequence
  Synthetic
ttaaaactggatccaggttgttcccacctggatttcctacatggagttgtactctgttattccggtaaccttgta

SEQ ID NO: 289128 - DNA, 75 bp, Artificial Sequence
  Synthetic
tgatttttcctcaccaatttatcaatcttagaagtaacaattctgcaacaatcatagtaccatatgtaaatgcag

SEQ ID NO: 289129 - DNA, 75 bp, Artificial Sequence
  Synthetic
tttctttagttgtcccttgggttagtgctagtcattttagatacacaactccagatacatactctgcagcagggt

SEQ ID NO: 289130 - DNA, 75 bp, Artificial Sequence
  Synthetic
aaggcaaaccttttgattctagatttgtgttatgtagtacaaaccataacatgttagccccacccactataactt

SEQ ID NO: 289131 - DNA, 75 bp, Artificial Sequence
  Synthetic
cccggtttgaattgatacgctccaacagggcgaaaacagtttaaatcgttatccgcaaagtgcctacgcaaagcc

SEQ ID NO: 289132 - DNA, 75 bp, Artificial Sequence
  Synthetic
taccatttcaattagtcctatgtgtgctgaattttctggagcacgagctaaaccagtggctgtgggccaaggatt

SEQ ID NO: 289133 - DNA, 75 bp, Artificial Sequence
  Synthetic
acgtatggctagggacactgacatgcatgtgcaaaatgtgccaatagaacaaaatcctgtagaaagatatgttga

SEQ ID NO: 289134 - DNA, 75 bp, Artificial Sequence
  Synthetic
tcaaccttgtgatgttgatgcaaaggttggaaatgctcgatgttgtccttttatctgtggcaaagcagtcacttt

SEQ ID NO: 289135 - DNA, 75 bp, Artificial Sequence
  Synthetic
atacctggtgaagttaaaaatttaattgagatgtgccaggttggtaccctaatacctgtgaataataccaacgct

SEQ ID NO: 289136 - DNA, 75 bp, Artificial Sequence
  Synthetic
actagtggaatacaacccgaggacaccatagaaacaagatttgtgcagacatcacaaactagagatgaaatgagc

SEQ ID NO: 289137 - DNA, 75 bp, Artificial Sequence
  Synthetic
gctatctttcagggtcctataacccttgaaggaccaccaccggccgccataaatgatcttcttcagtcagtacgc

SEQ ID NO: 289138 - DNA, 75 bp, Artificial Sequence
  Synthetic
actttgagtcctccggcccctgaatgtggctaaccttaaccctgcagctagtgcatgtaatccaacatgttgcta

SEQ ID NO: 289139 - DNA, 75 bp, Artificial Sequence
  Synthetic
gtcgtaatgagcaattgcgggatgggaccaactactttgggtgtccgtgtttcactttttccttttaatttgctt

SEQ ID NO: 289140 - DNA, 75 bp, Artificial Sequence
  Synthetic
tttcaagtactctcttgggtgaaatatgtagttactacacacactggactggtagtttgcgttttagtttcatgt

SEQ ID NO: 289141 - DNA, 75 bp, Artificial Sequence
  Synthetic
taacattacaagagatggcacaaatacgaaggaaatttgaattctttacttatgttaggtttgattcagaaatta

SEQ ID NO: 289142 - DNA, 75 bp, Artificial Sequence
  Synthetic
ttatagcaaacatcattagtatatctggtataatttatgtaatatataaattgttttgtacattgcaaggcccat

SEQ ID NO: 289143 - DNA, 75 bp, Artificial Sequence
  Synthetic
gggtctagtttaaactactttaacatcaattatttcaaagatgctgcatcaagtggggcatcaaagcttgaattc

SEQ ID NO: 289144 - DNA, 75 bp, Artificial Sequence
  Synthetic
tattgtctgggatgtgggattgcaatcaactatatcactagtagtcccatgggttagtgctagccatttccgata

SEQ ID NO: 289145 - DNA, 75 bp, Artificial Sequence
  Synthetic
tgattacacctgggagtcaagcacaaacccttctatattttggcaacatggccaagcttatccaagattctcttt

SEQ ID NO: 289146 - DNA, 75 bp, Artificial Sequence
  Synthetic
atgtgtagtaactacacaaaatggtaagtttacaggccttggaatttatgacaggacaataattataccaacaca

SEQ ID NO: 289147 - DNA, 75 bp, Artificial Sequence
  Synthetic
acaggattatacaaatcactagaggtgattcgaccataacatctcaagatgtggcaaatgctgtagttgggtatg

SEQ ID NO: 289148 - DNA, 75 bp, Artificial Sequence
  Synthetic
accatttttaagtattgcatctgcttactacatgttttatgatgggtatgatggtgacgcacctggatcaagata

SEQ ID NO: 289149 - DNA, 75 bp, Artificial Sequence
  Synthetic
tgctttgtttctgcttgtaaagacttttgcttacgcatggcaagagatacagacatgcatgtacagaatgtcccc

SEQ ID NO: 289150 - DNA, 75 bp, Artificial Sequence
  Synthetic
gttcttaaattaaagagaaatgaaaaatttagggacattaggaaatacataccagagagtgaagatgattaccca

SEQ ID NO: 289151 - DNA, 75 bp, Artificial Sequence
  Synthetic
gcaaaacacattagagcatggtgtccacgtgcacctagggctgtcccatacacacatactagatcaacaaattac

SEQ ID NO: 289152 - DNA, 75 bp, Artificial Sequence
  Synthetic
agaatggactaattcttcccagggatggtggtggaaattgcctgatgcattaaaagatatggggatatttggaga

SEQ ID NO: 289153 - DNA, 75 bp, Artificial Sequence
  Synthetic
ctcctgtacttgatgctgcggaaacaggacacacaagcagtatacaacctgaggatactgtagaaactagatatg

SEQ ID NO: 289154 - DNA, 75 bp, Artificial Sequence
  Synthetic
ctgctagaatgcttaaatacaattatcctactaaatcaggttactgtggtggtatactgtataaaataggacaag

SEQ ID NO: 289155 - DNA, 75 bp, Artificial Sequence
  Synthetic
acagaaacttacatcttttcaattctgaaatgcatgattctattctggtttcttactcttctgacttagtcatat

SEQ ID NO: 289156 - DNA, 75 bp, Artificial Sequence
  Synthetic
cctgaacaccagttagctagtgcaactacaggcaatgttacagcaggttataattacacacacccaggagaactt

SEQ ID NO: 289157 - DNA, 75 bp, Artificial Sequence
  Synthetic
ctatgacactggacattttaataaatggcaaataacattacaagagatggcacaaattagaaggaaatttgaatt

SEQ ID NO: 289158 - DNA, 75 bp, Artificial Sequence
  Synthetic
accaactagtctctgcgggctacctagtatacacactcctagcaaaacaaaattacagcctagtgtcttccatga

SEQ ID NO: 289159 - DNA, 75 bp, Artificial Sequence
  Synthetic
aactagccatgattggtatgaaatacaggaaagtgaatattatcccaaacatatacaatacaacctcttgattgg

SEQ ID NO: 289160 - DNA, 75 bp, Artificial Sequence
  Synthetic
tcttcccacaccaatttatcaacttgagaagcaataattcggcaacaatcattgttccgtatgtcaatgcagtac

SEQ ID NO: 289161 - DNA, 75 bp, Artificial Sequence
  Synthetic
ccacccggtgcccctctacccacccgaagagaagattacacatggcaatctggcactaatgcttcaatattctgg

SEQ ID NO: 289162 - DNA, 75 bp, Artificial Sequence
  Synthetic
gttgattgccctatgaatgatcatattagagtgtcagttgcacattactcagctcaattagccactctggatatt

SEQ ID NO: 289163 - DNA, 75 bp, Artificial Sequence
  Synthetic
attgatcttagacatttccactgtgctgaagaacaaggtataactgattatatccacatgcttggtgaggccttt

SEQ ID NO: 289164 - DNA, 75 bp, Artificial Sequence
  Synthetic
aatatcaataagtccaatgtgcgctgaattttctggtgcaagggcaagacccagcgcaaccacgcagggtttacc

SEQ ID NO: 289165 - DNA, 75 bp, Artificial Sequence
  Synthetic
ctaggtatggtgtttcagttactaaccacatggggactttatgttctagaattgtaacaaacagccaagaacatc

SEQ ID NO: 289166 - DNA, 75 bp, Artificial Sequence
  Synthetic
gtattaaaaagaaggatttgattgataatcgaacaaaagatatatccaaacttaaggtagctttagataaatatg

SEQ ID NO: 289167 - DNA, 75 bp, Artificial Sequence
  Synthetic
cagctatggtgataattattagaaactcatcagatccacagacaatcatagccacattgaccttaattggttgct

SEQ ID NO: 289168 - DNA, 75 bp, Artificial Sequence
  Synthetic
cctggagaggttaaaaatcttattgaaatgtgtcaagtggatactctaataccaataaacaacaccatgccaaat

SEQ ID NO: 289169 - DNA, 75 bp, Artificial Sequence
  Synthetic
taactataaaattacaggacaggagactgaaattttcttaaaacctagagcaactatcaagacagcaggacccag

SEQ ID NO: 289170 - DNA, 75 bp, Artificial Sequence
  Synthetic
tgacactctgttgtttaggactacctttggtaatttattctcaaaattccatctaaatccaggcatagttacagg

SEQ ID NO: 289171 - DNA, 75 bp, Artificial Sequence
  Synthetic
aatgtgtaatgcagcaaggggattagagtggattggcaataaaatatctaaatttattgattggatgaaatctat

SEQ ID NO: 289172 - DNA, 75 bp, Artificial Sequence
  Synthetic
ctagtacactcttgggagaaatatgttcatactacacacattggactggtagtttacgctttggttttatgttct

SEQ ID NO: 289173 - DNA, 75 bp, Artificial Sequence
  Synthetic
gtcatataccgcacaaacacaaaaggtgatgactatatacccacttgtgactgtactcaagctacctattactgt

SEQ ID NO: 289174 - DNA, 75 bp, Artificial Sequence
  Synthetic
agcatacaccctgtatggtttcaagctcttaagctagttttagaaaatctaggatttgaatctggcctaatagat

SEQ ID NO: 289175 - DNA, 75 bp, Artificial Sequence
  Synthetic
acacaagagaagattaaacatgaaattgatactcttcatgatctttcatgcaaatttcttccactgtatgcaagt

SEQ ID NO: 289176 - DNA, 75 bp, Artificial Sequence
  Synthetic
agtatgggatgtaggattgcaatcaacaatatctttagtagtaccttgggtgagtgctagtcattttagatatac

SEQ ID NO: 289177 - DNA, 75 bp, Artificial Sequence
  Synthetic
tgattggtgaaggtccttgtgagccaggtgactgtggtggtaagctcttatgtaaacatggtgtcataggtatca

SEQ ID NO: 289178 - DNA, 75 bp, Artificial Sequence
  Synthetic
tcaataatataataataaggactttagttttggatgcatacaaaaacattgatctagataaacttaaaatcatag

SEQ ID NO: 289179 - DNA, 75 bp, Artificial Sequence
  Synthetic
gtacgggtaaatctatgactacaaacttcctagctagaatgataaccaatgacagtgatatatattctttacctc

SEQ ID NO: 289180 - DNA, 75 bp, Artificial Sequence
  Synthetic
tttgtttctgcttgtaaagatttttgcctgcgcatggctagagacactgatatgcatgtgcaaaatgtgccaatc

SEQ ID NO: 289181 - DNA, 75 bp, Artificial Sequence
  Synthetic
agcttttggtacaggatttgtagatagtgtgaaagagcagataaatgccataaatccaattaacaatattagtaa

SEQ ID NO: 289182 - DNA, 75 bp, Artificial Sequence
  Synthetic
taaatcaaccactttcaagcaattggactatagtaatgtaacatttttgaaaagaggcttcaaacaggatgacaa

SEQ ID NO: 289183 - DNA, 75 bp, Artificial Sequence
  Synthetic
aatggtctctagtgtcacatttataccacctatggctgatctgccagataagggaaaaccttttgattctagatt

SEQ ID NO: 289184 - DNA, 75 bp, Artificial Sequence
  Synthetic
ctgccttggatgcagcagagactggacatacaagcaacatacaacctgaagatacaatagaaacaagatttgtgc

SEQ ID NO: 289185 - DNA, 75 bp, Artificial Sequence
  Synthetic
ggctgctcaggatcaccatggagattcttaaaggaaaaattttgtaagtggactcagttaaattatatacataaa

SEQ ID NO: 289186 - DNA, 75 bp, Artificial Sequence
  Synthetic
ctgtgtcatcttatgtggcacaatggaagagacacatacaagcagtttgaggacaagatacgcagtgttagcgct

SEQ ID NO: 289187 - DNA, 75 bp, Artificial Sequence
  Synthetic
tgtgacaaatacaaagattcacaagggaaactaaacgtgtctgctgccttcaaaccatgtgatgttaacacaaaa

SEQ ID NO: 289188 - DNA, 75 bp, Artificial Sequence
  Synthetic
tgatgaccaccactttgataagtggcagataaccatacaagagatgtcacaaattaggagaaaatttgaattctt

SEQ ID NO: 289189 - DNA, 75 bp, Artificial Sequence
  Synthetic
agtctatgttaccacaagcacaactcaaagttaagtatctcaaagaacttaaaaaactgaattttcttgaaaagc

SEQ ID NO: 289190 - DNA, 75 bp, Artificial Sequence
  Synthetic
ggtcgtgcactgtatatccccccatacgacctgctcttgcacgagtggtatgaaaaattttaaatgtttatatat

SEQ ID NO: 289191 - DNA, 75 bp, Artificial Sequence
  Synthetic
acactgttattccggtaaccttgtacgccagttttatatcccttcccccccttgtaacttagaagacatgcgaat

SEQ ID NO: 289192 - DNA, 75 bp, Artificial Sequence
  Synthetic
aaatacttgatgaagataaaaggcgtagacaggttgttgatgtgatggcagcaatatttcaaggtccaatttcac

SEQ ID NO: 289193 - DNA, 75 bp, Artificial Sequence
  Synthetic
cctggcgcacccataccaaagaaaagaaatgattacacatggcagtcaggcactaatgcttctgtattctggcaa

SEQ ID NO: 289194 - DNA, 75 bp, Artificial Sequence
  Synthetic
tgcaagtgaagccaaaaggattaaggtactgcacaataaatgtaacataataattaagcaaaagaaaagatgtga

SEQ ID NO: 289195 - DNA, 75 bp, Artificial Sequence
  Synthetic
attgtcaccggtcaagcacttctgtttccccggctctcgttgatatgctccaacagggcaaaaacaattggagtc

SEQ ID NO: 289196 - DNA, 75 bp, Artificial Sequence
  Synthetic
agagtgtaaaatagagagagacttgaacttagcaaataccattattacaatcattgcaaatattattagtatttc

SEQ ID NO: 289197 - DNA, 75 bp, Artificial Sequence
  Synthetic
gatatggcacatcagtcactaaccatatgggaacgctatgctcaagaatagtcaccaacaagcagcagcatgaag

SEQ ID NO: 289198 - DNA, 75 bp, Artificial Sequence
  Synthetic
ctacctcctgatcctaaatactttgatggttatgaccaacagagtgttgtcataatggatgatatcatgcaaaat

SEQ ID NO: 289199 - DNA, 75 bp, Artificial Sequence
  Synthetic
agaaataccccactggtgacagtgttctagcctgcgtggctgcctgcacacccacacgggtgtgaagccaaagat

SEQ ID NO: 289200 - DNA, 75 bp, Artificial Sequence
  Synthetic
gcacaaggtcctgaggaagaatttggcagatcacttattaaacataactcatgtgtggttactacttcaaatggt

SEQ ID NO: 289201 - DNA, 75 bp, Artificial Sequence
  Synthetic
ttataaacctcaagaaggtgaagtccagattttcctcaaagagagagccagcctaacaacagttggacctagtga

SEQ ID NO: 289202 - DNA, 75 bp, Artificial Sequence
  Synthetic
ctagatttgttttgtgtagtactaaccacaacatgttagccccacctactataacttcactaccagcaatgaata

SEQ ID NO: 289203 - DNA, 75 bp, Artificial Sequence
  Synthetic
atatggtcgtaatgagtaattacgggatgggaccgactactttgggtgtccgtgtttcactttttacttatcaat

SEQ ID NO: 289204 - DNA, 75 bp, Artificial Sequence
  Synthetic
aagactcttatgatctgtacaatagagatggtataaaattggaaattacagtccttaaacttaaaagaaatgaga

SEQ ID NO: 289205 - DNA, 75 bp, Artificial Sequence
  Synthetic
atataccgcacaaacacaataggtgatgactacattcccacatgtgattgcacagaggctacctactactgtaag

SEQ ID NO: 289206 - DNA, 75 bp, Artificial Sequence
  Synthetic
tgcaaaagttggcaatgctagatgttgtccttttatttgtggtaaagctgtcacttttagagaccgtaacacttg

SEQ ID NO: 289207 - DNA, 75 bp, Artificial Sequence
  Synthetic
aatggatcaagtttaaattacttcaacatcaactacttcaaggatgcggcatcaagtggagcttccaaattagaa

SEQ ID NO: 289208 - DNA, 75 bp, Artificial Sequence
  Synthetic
tgttggagatgtggtgtcatatggaaacattttgctcagtggaaatcaaacagcaagaatgctcaaatacaatta

SEQ ID NO: 289209 - DNA, 75 bp, Artificial Sequence
  Synthetic
ttggagaagggccatgtgaaccaggtgattgtggagggaaattgttatgtaaacatggcgtgattggcataatta

SEQ ID NO: 289210 - DNA, 75 bp, Artificial Sequence
  Synthetic
ataactctcgagggcccaccaccggctgccataagtgaccttcttcagtcagttcgaacaccagaagtcattaaa

SEQ ID NO: 289211 - DNA, 75 bp, Artificial Sequence
  Synthetic
cagacaggataatccaaatcactagaggtgattctacgattacttcacaggatgtagctaatgcagttgttgcat

SEQ ID NO: 289212 - DNA, 75 bp, Artificial Sequence
  Synthetic
ctattaagatcatactttacagaagcacaaggtcaaatagtcaccaccaaacctactatagagtgtaatctacct

SEQ ID NO: 289213 - DNA, 75 bp, Artificial Sequence
  Synthetic
ttttggcacaggttttgttgatagcgtcaaagaccagataagtgctattaatccaattaacaacattagtaagaa

SEQ ID NO: 289214 - DNA, 75 bp, Artificial Sequence
  Synthetic
gtatttctggtataatttatgtaatatacaaattgttttgtacactacaaggaccatattcaggagaacctaaac

SEQ ID NO: 289215 - DNA, 75 bp, Artificial Sequence
  Synthetic
ccagatgtggtcccctgaatccaaaggatggtggtggaagttacctgatgctttgaaggacatgggcatttttgg

SEQ ID NO: 289216 - DNA, 75 bp, Artificial Sequence
  Synthetic
gactagaggttgattttaaacaagctctattttcaaagtataaaggtaacaatcagtgtgaaatgaatgaacata

SEQ ID NO: 289217 - DNA, 75 bp, Artificial Sequence
  Synthetic
tgttcaggttccccttggagatttctcaaagaaaaattttgtaaatggactgaattaacatatatccataaagag

SEQ ID NO: 289218 - DNA, 75 bp, Artificial Sequence
  Synthetic
aaatggtaaattcacaggtttaggaatttatgatagagtattaatcttaccaacacatgcagaccccggtcatga

SEQ ID NO: 289219 - DNA, 75 bp, Artificial Sequence
  Synthetic
ataccagaacatcagttggctgccgccaagggtggcactgtcacagcaggatataaatacacgcatcctggtgaa

SEQ ID NO: 289220 - DNA, 75 bp, Artificial Sequence
  Synthetic
ggaagcacttgaccttaccaccagtgctgggtttccttatgtatctatgggtattaagaaaagggatttaatcaa

SEQ ID NO: 289221 - DNA, 75 bp, Artificial Sequence
  Synthetic
ctatgttacctcaagcccaacttaaggttaaatacctaagtgaattgaagaaattgagtttccttgagaagcaaa

SEQ ID NO: 289222 - DNA, 75 bp, Artificial Sequence
  Synthetic
aatgaaaaatttaaggatattagaaagtacataccagagagtgaggatgattacccagattgtaacttggccctt

SEQ ID NO: 289223 - DNA, 75 bp, Artificial Sequence
  Synthetic
ccatcttcccacaccaatttatcaatctcaggagtaataattcagctactattatagttccatatgttaatgcag

SEQ ID NO: 289224 - DNA, 75 bp, Artificial Sequence
  Synthetic
gtgttgatctacctatggtcacattccttaaagatgaactcaggaaaaaagagaaaatttctgctgggaagacac

SEQ ID NO: 289225 - DNA, 75 bp, Artificial Sequence
  Synthetic
aagtgaagcaaaaagaatcaaagttctacacaataaatgcagtgcaattattaaacaaaagaaaagatgtgaacc

SEQ ID NO: 289226 - DNA, 75 bp, Artificial Sequence
  Synthetic
acaattatccaacaaaatcaggatattgtggtggcattttatacaaaattggacaagtccttgggatccatgttg

SEQ ID NO: 289227 - DNA, 75 bp, Artificial Sequence
  Synthetic
aatatctataagccctatgtgtgctgagttttctggagctagagctagaaatgtcactcaaggactgccaacatt

SEQ ID NO: 289228 - DNA, 75 bp, Artificial Sequence
  Synthetic
ttctgcagtggggtgtgatccagagaccttttggtcaaaaataccagtgatgttagatggtgaatgcataatggc

SEQ ID NO: 289229 - DNA, 75 bp, Artificial Sequence
  Synthetic
cctccagatcctaagtattttgatggatatgatcagcaaagtgtagtcattatggatgatgttatgcagaatcca

SEQ ID NO: 289230 - DNA, 75 bp, Artificial Sequence
  Synthetic
gttacccagtattcacacaccaagcaaaactaaactccaacccagtgtattttatgatgtgtttccgggtaccaa

SEQ ID NO: 289231 - DNA, 75 bp, Artificial Sequence
  Synthetic
caagtccgaaacctagttgaactatgtcaagttgatactatgataccaatcaacaatattgcagcaaatgtcacc

SEQ ID NO: 289232 - DNA, 75 bp, Artificial Sequence
  Synthetic
agattgtgtaaatcaaaacatatcttcaaaaatgtgtactatgaagttgaggggggagtgccatcaggttgttct

SEQ ID NO: 289233 - DNA, 75 bp, Artificial Sequence
  Synthetic
gatttgtattatgtagtacaaaccacaacttactagcaccacccacaataacctctcttccagccatgaatagaa

SEQ ID NO: 289234 - DNA, 75 bp, Artificial Sequence
  Synthetic
aatcatgttaaagtggctatttcccattactcagcacaactcatgactttagatattaaccctgaacctatttct

SEQ ID NO: 289235 - DNA, 75 bp, Artificial Sequence
  Synthetic
cattaataggtgagatagctagttattacactcattggacagggagccttcgatttagtttcatgttttgtggtt

SEQ ID NO: 289236 - DNA, 75 bp, Artificial Sequence
  Synthetic
cttatggagatgatgtcatcttttcctataaatatcagctagacatggaggcaatagctaaagaaggtgttaagt

SEQ ID NO: 289237 - DNA, 75 bp, Artificial Sequence
  Synthetic
aaaaattggaaatgccaaatgttgtccattcatatgtggtaaagctgtcatttttagggatcgtaatacatgcca

SEQ ID NO: 289238 - DNA, 75 bp, Artificial Sequence
  Synthetic
tgattaataagcaaacaaaagatataaccaagctcaaagtagctttagataaatatggtgttgatttgccaatgg

SEQ ID NO: 289239 - DNA, 75 bp, Artificial Sequence
  Synthetic
ggatgttggtttgcaatcaacagtatcaatagtggtaccatgggtgagtgctagccattacagaaatacaacccc

SEQ ID NO: 289240 - DNA, 75 bp, Artificial Sequence
  Synthetic
atattcatttctaatacatccaacctttccagtcaatgaaattcaagagtccatacgatggacaaagaaaccatc

SEQ ID NO: 289241 - DNA, 75 bp, Artificial Sequence
  Synthetic
tctcttgaaggaccaccaccagcagcaataagtgatcttttgcaatcagtcagaactcctgaagtgattaaatac

SEQ ID NO: 289242 - DNA, 75 bp, Artificial Sequence
  Synthetic
aacaacttttggcaatctattttccaaatttcacttgaacccaggtattgttacaggatctgctgtgggttgtga

SEQ ID NO: 289243 - DNA, 75 bp, Artificial Sequence
  Synthetic
tcagggtgtaaggatttttgtttacgcatggcaagagatacaaatctacataaacaaagtggtgtgattgcacaa

SEQ ID NO: 289244 - DNA, 75 bp, Artificial Sequence
  Synthetic
ggtcgcgcactgtatattcctccctatgatctgcttctgcatgagtggtatgaaaagttttaaattgtttagata

SEQ ID NO: 289245 - DNA, 75 bp, Artificial Sequence
  Synthetic
tttctggaattatctatgttatatataaacttttttgcacacttcaaggcccatattcgggtgaacctaaaccaa

SEQ ID NO: 289246 - DNA, 75 bp, Artificial Sequence
  Synthetic
tttcaagctctaaaagaagttctatctaacttatcctttgaagctagtttaatagatagattgtgtaactctaaa

SEQ ID NO: 289247 - DNA, 75 bp, Artificial Sequence
  Synthetic
tggacgctgcagaaactggccataccagtggtgtacaaccagaagacatgattgagacccgttatgtccaaacat

SEQ ID NO: 289248 - DNA, 75 bp, Artificial Sequence
  Synthetic
tggtaaatttacaggattaggcatttatgatagaacattgattataccaacacatgctgacccaggtaaagaggt

SEQ ID NO: 289249 - DNA, 75 bp, Artificial Sequence
  Synthetic
gaacattagtactagatgcatataaaaacattgatttagataagttgaaaataatagcttatggagatgatgtga

SEQ ID NO: 289250 - DNA, 75 bp, Artificial Sequence
  Synthetic
tcctgaaaattttaccaaatggaaaataagtttacaagagatggctcaaatacgtaggaaatttgaattattcac

SEQ ID NO: 289251 - DNA, 75 bp, Artificial Sequence
  Synthetic
agtaggattctgaaagatctttggttggtcgttcagctgcatacccagcagtagaccttgcagatgaggctggac

SEQ ID NO: 289252 - DNA, 75 bp, Artificial Sequence
  Synthetic
gagaaatttaaggatattagaaagtatattccagaaaatgaagatgactacccagattgcaatttggctttatct

SEQ ID NO: 289253 - DNA, 75 bp, Artificial Sequence
  Synthetic
acagcttaattatgacaatgtcactttcttgaagagagggtttaaacaagatgaaaagcaccaattcctaataca

SEQ ID NO: 289254 - DNA, 75 bp, Artificial Sequence
  Synthetic
ggagcccctctacccacaaaaagaaatgactacacatggcagtccggcactaatgcatcagtattctggcaacat

SEQ ID NO: 289255 - DNA, 75 bp, Artificial Sequence
  Synthetic
caagaatccattcgctggacaaagaaaccatctcagatgcaagaacatgtcttgtcactgtgtcatttaatgtgg

SEQ ID NO: 289256 - DNA, 75 bp, Artificial Sequence
  Synthetic
attatccaacaaaatcggggtactgtggtggaattttatacaaaataggccaagtcctgggcattcatgtcggtg

SEQ ID NO: 289257 - DNA, 75 bp, Artificial Sequence
  Synthetic
atggcaccacagtagttaatgacatgggcacattatgctttaggatagtgactgaagaacacactagcagggtaa

SEQ ID NO: 289258 - DNA, 75 bp, Artificial Sequence
  Synthetic
gcctagtatccacacaccaagcaaaaccaaattacaacccagtgtcttctatgatgtctttcctggtaacaaaga

SEQ ID NO: 289259 - DNA, 75 bp, Artificial Sequence
  Synthetic
taaacccactgatggagaagttactactgccattaggcatagagataatgttagagccatccaaaattttggacc

SEQ ID NO: 289260 - DNA, 75 bp, Artificial Sequence
  Synthetic
ccccggtttaaactgatacgctccaacagggcgaaaacagtgcaaatcgttatccgcaaggtgcctacacaaagc

SEQ ID NO: 289261 - DNA, 75 bp, Artificial Sequence
  Synthetic
cacattaaagtagcaatctctcactactcagcacaattaatgacattggatattgattcaaatcctatttcatta

SEQ ID NO: 289262 - DNA, 75 bp, Artificial Sequence
  Synthetic
ctagtcatttaccgaacaaacactataggtgatgactttatcccatcttgtgattgcactgaagctacatattac

SEQ ID NO: 289263 - DNA, 75 bp, Artificial Sequence
  Synthetic
ttaataaacaaacaaaggatattacaaaattaaaagcagcactagataaatatggtgttgacttgcccatggtta

SEQ ID NO: 289264 - DNA, 75 bp, Artificial Sequence
  Synthetic
tgctaattggcgaaggtccctgtgaacctggagattgtggaggtaaactactatgtaaacatggggtgattggga

SEQ ID NO: 289265 - DNA, 75 bp, Artificial Sequence
  Synthetic
ttatggtgacaatatatatacaacatatatattggcatcatgggcgctcaggtatctagacagaatgttggaacg

SEQ ID NO: 289266 - DNA, 75 bp, Artificial Sequence
  Synthetic
aacttttggaaatctcttttcaaaatttcatctgaaccctggaattgtgactggatctgctgtgggttgtgatcc

SEQ ID NO: 289267 - DNA, 75 bp, Artificial Sequence
  Synthetic
tgaagcttttggcaatggttttgtagatagtgttaaagaacatgttaatgcaataaaccctattaatagtattag

SEQ ID NO: 289268 - DNA, 75 bp, Artificial Sequence
  Synthetic
tttcacaagatccaagtaaatttactgatccagtaaaagatgtcttagagaaaggaataccaactttgcaatctc

SEQ ID NO: 289269 - DNA, 75 bp, Artificial Sequence
  Synthetic
caagctcttaaagcagtgttatccaatctagggtttaattctaatctaatagatagactatgtagatctaagcat

SEQ ID NO: 289270 - DNA, 75 bp, Artificial Sequence
  Synthetic
attggttgttctgggtcgccatggaggttcttgaaagagaaattttgcaaatggacccagttaaattatatccat

SEQ ID NO: 289271 - DNA, 75 bp, Artificial Sequence
  Synthetic
tggagtgtggcctcactacctaacaccgcaagacgccacagctatagacaaacccagccaacctgacacatcatc

SEQ ID NO: 289272 - DNA, 75 bp, Artificial Sequence
  Synthetic
cattagttttagatgcatataagaatattgatttggataagcttaaaataatagcatatggagatgatgttatat

SEQ ID NO: 289273 - DNA, 75 bp, Artificial Sequence
  Synthetic
tgaaatcaatgttaccacaagcacaactcaaagttaagtatttgaatgagttaaagaaattgagcttacttgaaa

SEQ ID NO: 289274 - DNA, 75 bp, Artificial Sequence
  Synthetic
gaaaatatgtattatcattttcttggtagatcagggtatacagtgcatgtgcaatgtaatgcaagcagatttcac

SEQ ID NO: 289275 - DNA, 75 bp, Artificial Sequence
  Synthetic
gctgaattataacaatgtaactttcttgaaaagaggatttaagcaggatgacaagtaccagtttttaatacaccc

SEQ ID NO: 289276 - DNA, 75 bp, Artificial Sequence
  Synthetic
atatgccagtgaggctaaaagaatcaaagttatttataacaaatgcaataatatcatcaagcaaaagaaaagaag

SEQ ID NO: 289277 - DNA, 75 bp, Artificial Sequence
  Synthetic
taggtagaattgttggacaaacaagggctgaaataaacaacaagcaacctagtgatgacaattggttaaattttg

SEQ ID NO: 289278 - DNA, 75 bp, Artificial Sequence
  Synthetic
aatggtaaggatgtatacaaacagtttgagcagagaatacgcagtgttagcgctggtcgtgcactgtatattcct

SEQ ID NO: 289279 - DNA, 75 bp, Artificial Sequence
  Synthetic
cgctggtcgtgcactgtatattcctccatatgaactgctcctgcacgaatggtatgaaaaattttaaattgttta

SEQ ID NO: 289280 - DNA, 75 bp, Artificial Sequence
  Synthetic
tctttacctcctgacccaaagtactttgatggctatgatcagcaaagtgtcgttataatggatgacattatgcaa

SEQ ID NO: 289281 - DNA, 75 bp, Artificial Sequence
  Synthetic
ttaaaactgggagtgggttgttcccacccactccacccatgcggtgttgtactctgttattacggtaactttgta

SEQ ID NO: 289282 - DNA, 75 bp, Artificial Sequence
  Synthetic
accaatggactcaatgcttagacataataattggagtttggtaattattccaattagtccccttaaaagtgatac

SEQ ID NO: 289283 - DNA, 75 bp, Artificial Sequence
  Synthetic
actcaagatttgttctatgtagcactaaccactctctcttagctcctcccaccatcacctctcttcaggcaatga

SEQ ID NO: 289284 - DNA, 75 bp, Artificial Sequence
  Synthetic
gtttccccggtcaatgaggatatgctttacccaaggcaaaaaccttaaagatcgttatccccacactgcctacac

SEQ ID NO: 289285 - DNA, 75 bp, Artificial Sequence
  Synthetic
ccagtataccttacaccaggttcaaatcagttcatgaccacagatgactttcaatctccatgtgccttaccctgg

SEQ ID NO: 289286 - DNA, 75 bp, Artificial Sequence
  Synthetic
tgggacaaaaataggaaatgcccgctgttgcccatttatatgtggcaaagcagtaacctttaaagaccgcaatac

SEQ ID NO: 289287 - DNA, 75 bp, Artificial Sequence
  Synthetic
atctgcgtaacattaataagtacactgttcaattaactagtcaagtaaatttagctcaggaaatctttgcaataa

SEQ ID NO: 289288 - DNA, 75 bp, Artificial Sequence
  Synthetic
ccaatttcaatggaagtccccccccctcctgctataactgatctcttacgctctgtcagaacaccagaagttatt

SEQ ID NO: 289289 - DNA, 75 bp, Artificial Sequence
  Synthetic
ttgtggtactgctaatacaacacttaaacttctgcttgcctacacaccacctggaatagataagccaaagaacag

SEQ ID NO: 289290 - DNA, 75 bp, Artificial Sequence
  Synthetic
ttagtatagcaggcatcatatacattatatacaaactgttctgctcttttcaaggaccctattcaggtgaaccca

SEQ ID NO: 289291 - DNA, 75 bp, Artificial Sequence
  Synthetic
tcaacatcaattatttcaaggatgcagcctcaagtggtgcttccagattagatttctcccaagatcctagcaaat

SEQ ID NO: 289292 - DNA, 75 bp, Artificial Sequence
  Synthetic
acaacaccagatacatattctgccgctggctacataacatgctggtaccagactaattttgtgttcccaccaaat

SEQ ID NO: 289293 - DNA, 75 bp, Artificial Sequence
  Synthetic
tcaccaacagttgaggcttgtggttattcagacagactaatacaaataacccgaggagattccactataacgtct

SEQ ID NO: 289294 - DNA, 75 bp, Artificial Sequence
  Synthetic
tgataatggtaaatttactgggctgggaatctatgacaaacttatgatattacccacacatgctgatcctggtaa

SEQ ID NO: 289295 - DNA, 75 bp, Artificial Sequence
  Synthetic
ttactcaaaatcctgttgaaaaatacgttgatgaagtccttaatgaggttctagtggttccaaatatcaaagaga

SEQ ID NO: 289296 - DNA, 75 bp, Artificial Sequence
  Synthetic
catctaacagattctacactctggatagtcgctcttggacatctgcctcatctggctggtggtggaaattgcctg

SEQ ID NO: 289297 - DNA, 75 bp, Artificial Sequence
  Synthetic
agaaatgaaaagttcagggatatacgcaagtatataccggaaagggaggatgattaccctgattgcaacttagcc

SEQ ID NO: 289298 - DNA, 75 bp, Artificial Sequence
  Synthetic
tcaaacttcacagactagggatgaaatgagtttagaaagtttcttgggaagatctggatgtatccatatatctac

SEQ ID NO: 289299 - DNA, 75 bp, Artificial Sequence
  Synthetic
ccaccagggtttattgatagttgctgctatcccagaacatcaattggcatccgcgacaagtggaaatgtatcagt

SEQ ID NO: 289300 - DNA, 75 bp, Artificial Sequence
  Synthetic
aatataattatcccacaaaatcagggtattgtggtggtgttctatataaaataggccaaattataggaatccatg

SEQ ID NO: 289301 - DNA, 75 bp, Artificial Sequence
  Synthetic
ccgcgacaagtggaaatgtatcagttggatacaaccacacccacccaggtgaacaaggtagagaggtggtgccat

SEQ ID NO: 289302 - DNA, 75 bp, Artificial Sequence
  Synthetic
tttacttacactagatttgattcagaaatcactttagtcccttgtatagctggaaagggtgatgatattggacac

SEQ ID NO: 289303 - DNA, 75 bp, Artificial Sequence
  Synthetic
tggacttccaacgatacacactccgtccaaaactaagctacaacctagtgtcttctttgatgtttttgaaggatc

SEQ ID NO: 289304 - DNA, 75 bp, Artificial Sequence
  Synthetic
taatttaaggactaataattcagctacccttattttaccttatgttaatgctgtaccaatggattctatgcttag

SEQ ID NO: 289305 - DNA, 75 bp, Artificial Sequence
  Synthetic
aacatgggcaaactttccccagattttccttacctttcttgagtgttgcttcagcatattacatgttttatgatg

SEQ ID NO: 289306 - DNA, 75 bp, Artificial Sequence
  Synthetic
actgatcatatgagggttgctatctcacactattcagctcaattaatgaccctggacattgattcaacaaatatg

SEQ ID NO: 289307 - DNA, 75 bp, Artificial Sequence
  Synthetic
aaccaggggggacacaatccatacctataacagtatcgatcagccctatgttttcagaattttcagggccaagga

SEQ ID NO: 289308 - DNA, 75 bp, Artificial Sequence
  Synthetic
ggttgaaatcaccacgcgtgtgtatcataaggccaagcatgtaaaggcttggtgtccaagagcaccaagagcggt

SEQ ID NO: 289309 - DNA, 75 bp, Artificial Sequence
  Synthetic
tccatatttccatccaaccaaggaaatattcatacctggacaggtcaggaatttaattgaaatgtgccaagttga

SEQ ID NO: 289310 - DNA, 75 bp, Artificial Sequence
  Synthetic
atctaattaataacagtacaaaggacataactaaattgaagctagcacttgataaatatggggttgatttaccaa

SEQ ID NO: 289311 - DNA, 75 bp, Artificial Sequence
  Synthetic
gacatgtatgtgcatgttgggaacttaatttacagaaacctacacctctttaattctgaaatgcatgattcaatt

SEQ ID NO: 289312 - DNA, 75 bp, Artificial Sequence
  Synthetic
tccataccagtagatattgcctcacaacctttagccactaccctcataggtgaacttgcaagttattatacacac

SEQ ID NO: 289313 - DNA, 75 bp, Artificial Sequence
  Synthetic
tagggtagtgtatggaaatttgttttctacttttcacaagaaccctggtgtagtcacaggatctgcggtgggatg

SEQ ID NO: 289314 - DNA, 75 bp, Artificial Sequence
  Synthetic
aacataaaaataggtattatccaattagagtcacaagtcatgattggtatgaaattcaggagagtgaatactatc

SEQ ID NO: 289315 - DNA, 75 bp, Artificial Sequence
  Synthetic
gatccaggagagaagctatgcttggcacacacttagtatgggacgtgggattgcagtccaccgcctcactagttg

SEQ ID NO: 289316 - DNA, 75 bp, Artificial Sequence
  Synthetic
tggtttgaagctctaaaacaagttttaaacaatttatcatttgaagacaagcttatagatagattgtgtagatca

SEQ ID NO: 289317 - DNA, 75 bp, Artificial Sequence
  Synthetic
cactgctggtggagaaggacatgtagctttcattgacctcagacatttccactgtgctgaagaacagggcataac

SEQ ID NO: 289318 - DNA, 75 bp, Artificial Sequence
  Synthetic
tgatagtacaccagacaatgctaaaatggtgtgcatggtttccgcatgcaaagatttctgtttaagattagccag

SEQ ID NO: 289319 - DNA, 75 bp, Artificial Sequence
  Synthetic
ttaggactttagttcttgatgcttataagcatattgacttggacaaacttaaaataatagcttatggtgatgatg

SEQ ID NO: 289320 - DNA, 75 bp, Artificial Sequence
  Synthetic
aaaataattaagtggctccttaggattatatcagctatggttataatcataagaaattcatctgacccacagaca

SEQ ID NO: 289321 - DNA, 75 bp, Artificial Sequence
  Synthetic
caacctagtacatctgtatcaagtcatgcagcacctgcattggatgctgcagaaactggacacaccagctctgtt

SEQ ID NO: 289322 - DNA, 75 bp, Artificial Sequence
  Synthetic
taggaagcttgattatgacaatgtaactttcctgaaaagaggttttaggcaagatgctaaatatccattcctaat

SEQ ID NO: 289323 - DNA, 75 bp, Artificial Sequence
  Synthetic
aatctgactcatggcttaaaaaattcacagaaatgtgtaatgcagcaagaggcttggaatggattggaaataaaa

SEQ ID NO: 289324 - DNA, 75 bp, Artificial Sequence
  Synthetic
caacctgaagatatgattgaaactagatatgtcataactgaccagacaagggatgaaacaagtattgaaagtttc

SEQ ID NO: 289325 - DNA, 75 bp, Artificial Sequence
  Synthetic
tggcacaatggacgggatgtgtacaaggagtttgagaggaagatacgcagcgtgagcgctggacgcgcgctgtac

SEQ ID NO: 289326 - DNA, 75 bp, Artificial Sequence
  Synthetic
cgtgagcgctggacgcgcgctgtacatccccccttatgagctactcctgcatgagtggtatgaaaaattttgaat

SEQ ID NO: 289327 - DNA, 75 bp, Artificial Sequence
  Synthetic
gtctccaagaaatggcacaaattagaaggaagtttgaattattcacatatacaagatttgattcagaaataacaa

SEQ ID NO: 289328 - DNA, 75 bp, Artificial Sequence
  Synthetic
aatagagcatctcagggttgctgattctcatacacaagaaaaaataaaacatgaaattgacacccttcatgatct

SEQ ID NO: 289329 - DNA, 75 bp, Artificial Sequence
  Synthetic
acactgttattccggtaactttgtacgccagttttgaactcccctaccccttttgtaacttagaagctaaacaca

SEQ ID NO: 289330 - DNA, 75 bp, Artificial Sequence
  Synthetic
cagtttatgtatgtacccccaggagcacctgtccccgaaaaacgtgatgattacacatggcaatcaggaacaaat

SEQ ID NO: 289331 - DNA, 75 bp, Artificial Sequence
  Synthetic
cctgttgctgttgtaattcatggtgagcctggtactggcaaatctatgactacaaactttttagctaggatgata

SEQ ID NO: 289332 - DNA, 75 bp, Artificial Sequence
  Synthetic
tcgaccaatagcaggcaatcacccagattgcttatggtcaagtacttctgtttccccggtctcctctgatatgct

SEQ ID NO: 289333 - DNA, 75 bp, Artificial Sequence
  Synthetic
tatatgttttatgatggttatgatggtgataatgcggcatcaaaatatggctctgtagtcactaatgacatggga

SEQ ID NO: 289334 - DNA, 75 bp, Artificial Sequence
  Synthetic
cagtaatagacctggcagatgaggctagatatcccccactggcgacagtgatctagcctgcgtggctgcctgcac

SEQ ID NO: 289335 - DNA, 75 bp, Artificial Sequence
  Synthetic
ctagtggggatgacatgactttgttttgtcagatggtatctagtgtcacattcataccacctatggctgacttac

SEQ ID NO: 289336 - DNA, 75 bp, Artificial Sequence
  Synthetic
gcccaccaagggctgttgcctaccaacacacacactcaactaactacataccactcaatggtgaggccacaactc

SEQ ID NO: 289337 - DNA, 75 bp, Artificial Sequence
  Synthetic
ccactcaatggtgaggccacaactcagatcaaaactagacccgatgtttttaccattacaaacgttggaccatct

SEQ ID NO: 289338 - DNA, 75 bp, Artificial Sequence
  Synthetic
gcagccattgctcacaagccagtgggtatgtggtcgtaatgagaaattgcgggacgggaccgactactttgggtg

SEQ ID NO: 289339 - DNA, 75 bp, Artificial Sequence
  Synthetic
aagattcttccttgatttggatattattgtgtgtgataaatataaagatgcacaaggaaaattaaatgtgtgtgc

SEQ ID NO: 289340 - DNA, 75 bp, Artificial Sequence
  Synthetic
tcatataccgaacaaacactgaaggtaatgatgtaatcccaaattgtgattgtactgaatgtacatattactgcc

SEQ ID NO: 289341 - DNA, 75 bp, Artificial Sequence
  Synthetic
tactcattctactcagaattctgtttcaaatggttctagtttaaactattttaacattaattactttaaagatgc

SEQ ID NO: 289342 - DNA, 75 bp, Artificial Sequence
  Synthetic
caaacttacacactggcacaagtctacaacctaatacttgatgaagacaaaaggcgtaggcaagtcattgatgta

SEQ ID NO: 289343 - DNA, 75 bp, Artificial Sequence
  Synthetic
gatcggagagggtccatgtgaaccaggggattgtggaggaaaactactgtgtaagcatggtgttataggtatggt

SEQ ID NO: 289344 - DNA, 75 bp, Artificial Sequence
  Synthetic
tcaccaactgttgaagcatgtggttattcagatagaatcatccaaattacaagaggtgactccacaattacctca

SEQ ID NO: 289345 - DNA, 75 bp, Artificial Sequence
  Synthetic
actgtgaagtgaacaaatggataatacctgctgaatgtaaggtagagagggatttaaacattgcaaacaccatta

SEQ ID NO: 289346 - DNA, 75 bp, Artificial Sequence
  Synthetic
gtaagcatggtgttataggtatggttacagctggaggtgagggtcatgttgcttttattgacctaagaaaattcc

SEQ ID NO: 289347 - DNA, 75 bp, Artificial Sequence
  Synthetic
cttctaatagattttacacattagaaagccagacctggaccaatgaatccaagggctggtggtggaaattaccag

SEQ ID NO: 289348 - DNA, 75 bp, Artificial Sequence
  Synthetic
caaccccactagcaagattggctcaaaagtaattaaatggttgttgagaatagtttcagctatgataataatggt

SEQ ID NO: 289349 - DNA, 75 bp, Artificial Sequence
  Synthetic
taaaacaaaaataccagaaagaagagtagtagcccaaggaccagaagaggaatttggcagatcactcatcaaaca

SEQ ID NO: 289350 - DNA, 75 bp, Artificial Sequence
  Synthetic
gttattgccactctcacccttttaggttgttcaggttcaccatggagatttcttaaagaaaagctttgtgcgtgg

SEQ ID NO: 289351 - DNA, 75 bp, Artificial Sequence
  Synthetic
tcatcagggaactcttctggtagcaatgataccagagcaccagctagctaccgctgtaggcggcagtgtatctgc

SEQ ID NO: 289352 - DNA, 75 bp, Artificial Sequence
  Synthetic
gtgcaaatagatggcattacaacccaagtacaagactcttatgatttatacaataaggatgggataaagttagag

SEQ ID NO: 289353 - DNA, 75 bp, Artificial Sequence
  Synthetic
tactgaagcgtgtaatgcagcacgcggactagaatggattggacaaaagatatccaaatttatagattggataaa

SEQ ID NO: 289354 - DNA, 75 bp, Artificial Sequence
  Synthetic
tttgatggcacattattaggaaacttgacaatatttcctcaccaattcattaaccttagaagtaacaactcggct

SEQ ID NO: 289355 - DNA, 75 bp, Artificial Sequence
  Synthetic
ctgcaaaccaaccagaaaccaccataattaatgttggggatgtagtatcatatggtaatatcttactcagtggaa

SEQ ID NO: 289356 - DNA, 75 bp, Artificial Sequence
  Synthetic
aacaactcaatctcttagagaaacaaatagaaacaatcagacttgcacctgccagtgatcaagagaaaatctaca

SEQ ID NO: 289357 - DNA, 75 bp, Artificial Sequence
  Synthetic
gcggtgttgatctcaccatccctattacaatttccattagtcctatgtgtgctgaattctctggagcaagagcaa

SEQ ID NO: 289358 - DNA, 75 bp, Artificial Sequence
  Synthetic
tatcaaagggggaaagaggaatgaaccagttgcagttctaatacatggttctcctggtactggaaaatctcttgc

SEQ ID NO: 289359 - DNA, 75 bp, Artificial Sequence
  Synthetic
tggtaatgggagagatggatttgcagctatgttactgagatcctatttttcagagacccaaggacaaataatttc

SEQ ID NO: 289360 - DNA, 75 bp, Artificial Sequence
  Synthetic
ctcctggtactggaaaatctcttgccacctctgttcttgctcgaatgttaactgttgaaactgatatatattctt

SEQ ID NO: 289361 - DNA, 75 bp, Artificial Sequence
  Synthetic
caaggaaatttcaatacctggacaggttagaaatctagtggaattatgccaagtagataccttgataccaattaa

SEQ ID NO: 289362 - DNA, 75 bp, Artificial Sequence
  Synthetic
gaacctgctgtgctctcagaacatgatcctagattgaaagttgacttcaaggaggccttgttctccaagtacaag

SEQ ID NO: 289363 - DNA, 75 bp, Artificial Sequence
  Synthetic
ttgccaaatggtatcaagtgtccctttcatacctcctatggcagaccttccagataagggaaaaccatttacatc

SEQ ID NO: 289364 - DNA, 75 bp, Artificial Sequence
  Synthetic
taaatttgtgcttgcaagtactaatcacactctattgacaccaccaacagtgtcctcattgccagcaatggcaag

SEQ ID NO: 289365 - DNA, 75 bp, Artificial Sequence
  Synthetic
gcatcacaaccattagccactacacttataggtgaagtttccagctactacacacattggactgggagtgttaga

SEQ ID NO: 289366 - DNA, 75 bp, Artificial Sequence
  Synthetic
tggaagatagtgtttttggtatggaaggtctagaagctcttgacctcaataccagtgcagggtttccttatgttt

SEQ ID NO: 289367 - DNA, 75 bp, Artificial Sequence
  Synthetic
aaaataggcaatgctaagtgctgtccatttatctgtggaaaagctgtagagttcaaagatagaaattcatgtaca

SEQ ID NO: 289368 - DNA, 75 bp, Artificial Sequence
  Synthetic
tgcttggtacacatctaatatgggacgttggtctacagtccacagtgtcaatggtggttccctgggtcagtgcta

SEQ ID NO: 289369 - DNA, 75 bp, Artificial Sequence
  Synthetic
tacattccttaaagatgaacttagaaagaaggaaaaaatttctgctggcaagacaagggtcatagaggctagtag

SEQ ID NO: 289370 - DNA, 75 bp, Artificial Sequence
  Synthetic
tccaatcccctccaccaccagccatagccgatcttcttaggtctgtgaaaacaccagaaattattaagtactgtc

SEQ ID NO: 289371 - DNA, 75 bp, Artificial Sequence
  Synthetic
agctgatatgctgtgctttgtttcagggtgcaaagatttctgcctacgcatggcaagagatactaacttacacaa

SEQ ID NO: 289372 - DNA, 75 bp, Artificial Sequence
  Synthetic
ccagagacattttggtcaaagataccagtaatgctagatggtgagtgcataatggcatttgattacacaaattat

SEQ ID NO: 289373 - DNA, 75 bp, Artificial Sequence
  Synthetic
actctattattccggtaattttgtacgccagttttatctcccctacccctctatgtaacttagaagtttatgcac

SEQ ID NO: 289374 - DNA, 75 bp, Artificial Sequence
  Synthetic
aggtgttatttatataatttataaattgttttgcacactccaaggtccatactcaggggaacctaaacccaaaag

SEQ ID NO: 289375 - DNA, 75 bp, Artificial Sequence
  Synthetic
acatccaactcagcaccagtcttagacgctgctgaaacaggtcataccagcaatgttcaaccggaggacatgatt

SEQ ID NO: 289376 - DNA, 75 bp, Artificial Sequence
  Synthetic
acatttttaaaaacatgtattatgaagttgaaggaggggtaccatctggctgttctggaacaagtatattcaata

SEQ ID NO: 289377 - DNA, 75 bp, Artificial Sequence
  Synthetic
tcgttatccgcaaggcaactacgcaaagcctagtaccatttttgatgatgtgtggttggtcgctccactgtgaac

SEQ ID NO: 289378 - DNA, 75 bp, Artificial Sequence
  Synthetic
aaattcacaggtcttggtatatacgaccaagtcatggtacttccaactcattctgatccgggttctgagatctta

SEQ ID NO: 289379 - DNA, 75 bp, Artificial Sequence
  Synthetic
actatgataactatgatgattctattgaaaacttcaaggtgtggaaaataaacctgcaagagatggcacaaatac

SEQ ID NO: 289380 - DNA, 75 bp, Artificial Sequence
  Synthetic
attttcatataaatatcaattggatatggaagcaattgctaaagagggtgtcaaatatggtcttactataacccc

SEQ ID NO: 289381 - DNA, 75 bp, Artificial Sequence
  Synthetic
atagatggagtgaaagttaaagtttctgactcttatgatttgcacaaccatgagggagtcaagttagaaatcaca

SEQ ID NO: 289382 - DNA, 75 bp, Artificial Sequence
  Synthetic
gcaatacatgtatgttccacctggtgcacctacacctgagaaaagaaatgatttcacatggcaatcaggcacaaa

SEQ ID NO: 289383 - DNA, 75 bp, Artificial Sequence
  Synthetic
ccaacctttccaattgaagagattcaagagtccatacgatggactaagaaaccatctcagatgcaggaacacgtt

SEQ ID NO: 289384 - DNA, 75 bp, Artificial Sequence
  Synthetic
atcaggatgagccaacaataataagtgtaggtgatgcagaatcttatggtaacatcttgctaagtggtactaata

SEQ ID NO: 289385 - DNA, 75 bp, Artificial Sequence
  Synthetic
gcgggatgggaccaactactttgggtgtccgtgtttcttgtttttcttttatatttgcttatggtgacaatatat

SEQ ID NO: 289386 - DNA, 75 bp, Artificial Sequence
  Synthetic
agcgctggacgtgcactgtatattcctccctacgagctgcttttgcacgagtggtatgaaaaattttagattgtt

SEQ ID NO: 289387 - DNA, 75 bp, Artificial Sequence
  Synthetic
ggagattctgaaataacgcgctatggaacatcagtgacaaatgatatgggtgcattgtgctttagaatagtaact

SEQ ID NO: 289388 - DNA, 75 bp, Artificial Sequence
  Synthetic
atgtggctaaccttaaccctgcagctggtgtgtgcaatccagcacatggccagtcgtaatgagtaattgcgggat

SEQ ID NO: 289389 - DNA, 75 bp, Artificial Sequence
  Synthetic
tattttaacattaactattttaaggatgcagcttctagtggtgcttctagattggatttttcacaagatcctagt

SEQ ID NO: 289390 - DNA, 75 bp, Artificial Sequence
  Synthetic
ctaatgtgcatttgaccaattacaagcccaaagatagtgaaaaacaagttaccactttcatcaaacctagagcta

SEQ ID NO: 289391 - DNA, 75 bp, Artificial Sequence
  Synthetic
cttatggtgacaatatatatataacatatatattggcatcatgggcgctcaagtttcaagacagaatgttggtac

SEQ ID NO: 289392 - DNA, 75 bp, Artificial Sequence
  Synthetic
gcagtccttagtagtaatgatccaagattagaaactgattttgattcagcacttttctccaagtataaaggcaat

SEQ ID NO: 289393 - DNA, 75 bp, Artificial Sequence
  Synthetic
taacacgtggaaactcaaccatcacttcacaggacatagctaatgctgttgttgcctatggtgtttggccacaat

SEQ ID NO: 289394 - DNA, 75 bp, Artificial Sequence
  Synthetic
ttctgtattagtatcctactcatcagatttagtcatttaccgcacaaacaccgtaggtgatgactttataccaac

SEQ ID NO: 289395 - DNA, 75 bp, Artificial Sequence
  Synthetic
ttttcgcaggacccaagtaagttcacagacccagttaaggatgtattggaaaaaggaatccccactttgcaatct

SEQ ID NO: 289396 - DNA, 75 bp, Artificial Sequence
  Synthetic
agagtgtgtttggtattgagggattagaagccttagacctaaatactagtgcagggtttccttatgtctcattgg

SEQ ID NO: 289397 - DNA, 75 bp, Artificial Sequence
  Synthetic
atctaaaggttggtggtggaagttacctgatgctctaaagaacatgggcatatttggtgagaatctgttctatca

SEQ ID NO: 289398 - DNA, 75 bp, Artificial Sequence
  Synthetic
tattatccaaaacatattcaatataatctattaattggtgagggtccttgtgaaccaggtgattgtggagggaag

SEQ ID NO: 289399 - DNA, 75 bp, Artificial Sequence
  Synthetic
atggcgtgtggcctcattatctgacacctcaggatgctacagctatagacaagccctcccgaccagatacttctt

SEQ ID NO: 289400 - DNA, 75 bp, Artificial Sequence
  Synthetic
tttaaaagatgaactcagaaagaaagagaaaataaaagatggaaaaactagagtcatagaggccaatagtgtaaa

SEQ ID NO: 289401 - DNA, 75 bp, Artificial Sequence
  Synthetic
gagaaaataaaagatggaaaaactagagtcatagaggccaatagtgtaaatgatactgtgttattcagaagtgtg

SEQ ID NO: 289402 - DNA, 75 bp, Artificial Sequence
  Synthetic
gcttacataggtaaaggaaatgtcacagttggatacaatcacactcatccaggagagaagggtagaagaattggt

SEQ ID NO: 289403 - DNA, 75 bp, Artificial Sequence
  Synthetic
gagtaacagattatatccacatgttaggtgaggcttttggaaatggctttgtagatagtgttaaagaacatgtga

SEQ ID NO: 289404 - DNA, 75 bp, Artificial Sequence
  Synthetic
tgaaaacatgttttaccatttccttggtagaagtggttatacagtacatgtacaatgcaatgcaagcaaattcca

SEQ ID NO: 289405 - DNA, 75 bp, Artificial Sequence
  Synthetic
tgttagatggtgagtgtttgatggcctttgattactcaaattatgatggtagtttacatcctgtttggttcaaat

SEQ ID NO: 289406 - DNA, 75 bp, Artificial Sequence
  Synthetic
ttaatctcagaagtaacaactctgcaacactgattttaccatatgtgaatgcagtacccatggattccatggtta

SEQ ID NO: 289407 - DNA, 75 bp, Artificial Sequence
  Synthetic
ccaaaccgttgttgccactttaacattaattggatgttctgggtcaccatggagattcttaaaagaaaaattctg

SEQ ID NO: 289408 - DNA, 75 bp, Artificial Sequence
  Synthetic
acgggtagagatgttagcccgaaggtccgtgagaatcctgataaacaacccagtgatgatgcatggcttaatttt

SEQ ID NO: 289409 - DNA, 75 bp, Artificial Sequence
  Synthetic
caaatctgtaattctaaacacatatacaaatctaaatattatgaagtagaaggaggtatgccatctggatgtgct

SEQ ID NO: 289410 - DNA, 75 bp, Artificial Sequence
  Synthetic
gtgttcagaattttctggtgccagaaacaacaccacacaaggattacctgtaatgctaacaccaggttcagcaca

SEQ ID NO: 289411 - DNA, 75 bp, Artificial Sequence
  Synthetic
aataaaatatcaaaatttatagaatggatgaaatcaatgttgccacaagcacagcttaaagttaaatatttaaat

SEQ ID NO: 289412 - DNA, 75 bp, Artificial Sequence
  Synthetic
catatggagatgatgtcattttttcttacaactttaaacttgacatggcagttcttgctaaagaaggggaaaagt

SEQ ID NO: 289413 - DNA, 75 bp, Artificial Sequence
  Synthetic
ttcctatggattcaatgttaagacataataactggagtttggtcataataccaatttgtccattagaatctatgc

SEQ ID NO: 289414 - DNA, 75 bp, Artificial Sequence
  Synthetic
atttgccaagtagattccatgataccaattaacaatacacctactgcaaggaactcaaccaacatgtatactgtt

SEQ ID NO: 289415 - DNA, 75 bp, Artificial Sequence
  Synthetic
atgatttgtcctgtaaatttcttccactttatgctagtgaagccaagaggatcaaggtgatacacaataaatgta

SEQ ID NO: 289416 - DNA, 75 bp, Artificial Sequence
  Synthetic
aacaccaggatctggccaatttatgacaacagatgattttcaatcacctagtgctttgccctggttccaccctac

SEQ ID NO: 289417 - DNA, 75 bp, Artificial Sequence
  Synthetic
ccactcttttcttgtgcatcccacctttcctgtggctgaaatttatgactccattagatggactaagaacccttc

SEQ ID NO: 289418 - DNA, 75 bp, Artificial Sequence
  Synthetic
gttactacactcactggactggtagtctcagatttagttttatgttttgtggaacagccaatacaagtctcaaat

SEQ ID NO: 289419 - DNA, 75 bp, Artificial Sequence
  Synthetic
aatgataacaaatgagagtgacatatattcattaccacctgatcctaaatattttgatgggtacgatcagcagtc

SEQ ID NO: 289420 - DNA, 75 bp, Artificial Sequence
  Synthetic
ggtcgggcactgtatataccagcttatgaagttcttgagcatgaatggtatgaaaaattttagatataaaactgt

SEQ ID NO: 289421 - DNA, 75 bp, Artificial Sequence
  Synthetic
acaagtatatatactgtgactctagaaaaacaaactagcttagcacaagaaatatttgcaattaaagttgatatc

SEQ ID NO: 289422 - DNA, 75 bp, Artificial Sequence
  Synthetic
agtttccatggtagtaccgtgggtgtcagcaagtcattataggtatacaactccagatacctattctcaagctgg

SEQ ID NO: 289423 - DNA, 75 bp, Artificial Sequence
  Synthetic
gcactgttattccggtaactttacacgccagttttatctcccttcccaaaagtaacttagaagatgtacacagcg

SEQ ID NO: 289424 - DNA, 75 bp, Artificial Sequence
  Synthetic
gcactgttattccggtaactttacacgccagttttatctcccttcccaaatgtaacttagaagatgtacacagcg

SEQ ID NO: 289425 - DNA, 75 bp, Artificial Sequence
  Synthetic
gcactgttattccggtaactttacacgccagttttatctcccttcccaaacgtaacttagaagatgtacacagcg

SEQ ID NO: 289426 - DNA, 75 bp, Artificial Sequence
  Synthetic
gcactgttattccggtaactttacacgccagttttatctcccttcccaaaggtaacttagaagatgtacacagcg

SEQ ID NO: 289427 - DNA, 75 bp, Artificial Sequence
  Synthetic
gatttacctgataaaggaaaaccctttgactccagatttgttctttgcagtactaaccactccatgttggcccct

SEQ ID NO: 289428 - DNA, 75 bp, Artificial Sequence
  Synthetic
caaacactactctcaaattgttagtggcttatacaccccctggaatacgtaaacctactagtagaaaggaagcaa

SEQ ID NO: 289429 - DNA, 75 bp, Artificial Sequence
  Synthetic
accaataggtggcaactagccaagttgcttaaggtcaagcacttctgtctccccggtcaatgttgatacgctctc

SEQ ID NO: 289430 - DNA, 75 bp, Artificial Sequence
  Synthetic
ttaaggatggctagagacaccaacttgcatactcaagcaggtgtcatagaacaaaacccagttgaaaaatacaca

SEQ ID NO: 289431 - DNA, 75 bp, Artificial Sequence
  Synthetic
tgtctaaagcttttaaaccatgtgatgttggaacaaaaataggtaacgcacgttgttgtccattcatttgtggca

SEQ ID NO: 289432 - DNA, 75 bp, Artificial Sequence
  Synthetic
tacatattccttagctggatacgtgacttgctggtatcaaactaatctggtggtaccaagcaacacgccagtcac

SEQ ID NO: 289433 - DNA, 75 bp, Artificial Sequence
  Synthetic
gtagacctggcagatgaggctagaaattccccactggcgacagtgttctagcctgcgtggctgcctgcgtgtcct

SEQ ID NO: 289434 - DNA, 75 bp, Artificial Sequence
  Synthetic
atacaaaccaagtccaaccagaagatgtggttgaaacacgctatgtcataacagaccagacaagggatgaaatga

SEQ ID NO: 289435 - DNA, 75 bp, Artificial Sequence
  Synthetic
agatgttatgtctgctatatttcagggaccaatctctatggaagtacctcctcctcctgcaataactgatttgct

SEQ ID NO: 289436 - DNA, 75 bp, Artificial Sequence
  Synthetic
ccagtggaaaattacatagatgaggtattaaatgaggttctagtggtgcctaacatcagagagagcaagccaacc

SEQ ID NO: 289437 - DNA, 75 bp, Artificial Sequence
  Synthetic
agtgcgcacaaaccagtgtgtagctggtcgtaatgagtaattgcgggatgggaccaactactttgggtgtccgtg

SEQ ID NO: 289438 - DNA, 75 bp, Artificial Sequence
  Synthetic
ccaatggaaaattacaattaaggaaatggctcaaattagaagaaagtgtgaactattcacataccttaggtttga

SEQ ID NO: 289439 - DNA, 75 bp, Artificial Sequence
  Synthetic
aacattattacaattatagcaaacataattagcatagcaggtattatctacattatatataaactattttgctca

SEQ ID NO: 289440 - DNA, 75 bp, Artificial Sequence
  Synthetic
aaactcttgatgagatgagtgtagagagcttcttaggcagatctggttgtattcacatatcaaaattagtagtga

SEQ ID NO: 289441 - DNA, 75 bp, Artificial Sequence
  Synthetic
tcaactcagaacacagtttcaaatggttcaagtttaaattattttaacatcaattattttaaagatgctgcatca

SEQ ID NO: 289442 - DNA, 75 bp, Artificial Sequence
  Synthetic
aaaactagagatgattacacatggcagtcaggcactaatgcatcagtgttttggcaacaaggacaaccttacccc

SEQ ID NO: 289443 - DNA, 75 bp, Artificial Sequence
  Synthetic
tcaaacataacacttgtgtggtgaccactgataatggaaaatttactggattgggcatttatgacaaactcatga

SEQ ID NO: 289444 - DNA, 75 bp, Artificial Sequence
  Synthetic
tagatttgattcagagattaccttagttccttctatagctgctcaaggagatgatgttggtcatgttgtcatgca

SEQ ID NO: 289445 - DNA, 75 bp, Artificial Sequence
  Synthetic
ccgtagaagcatgtggttattcagataggattatacagataacaagaggggattccacaatcacttcccaagatg

SEQ ID NO: 289446 - DNA, 75 bp, Artificial Sequence
  Synthetic
atgatatgggcacattatgtgtccgtattgtgactgagcagcagacacatagggtcaaaataaccagcagaatat

SEQ ID NO: 289447 - DNA, 75 bp, Artificial Sequence
  Synthetic
actagagattacagctgtactattggataggaatgaaaaatttagagacattaggagatatataccagagaggga

SEQ ID NO: 289448 - DNA, 75 bp, Artificial Sequence
  Synthetic
acataccctagattctcactgcctttcctcagcatagcttcagcatattacatgttctatgatggatatgatgga

SEQ ID NO: 289449 - DNA, 75 bp, Artificial Sequence
  Synthetic
tagattttacactctggagagcaaaatgtgggacagttcatcaaagggatggtggtggaagttaccagatgccct

SEQ ID NO: 289450 - DNA, 75 bp, Artificial Sequence
  Synthetic
tattaaaactcatattaaatttaggaatactgttaaagatttggcatatcctccagaattagcaaaccttggacc

SEQ ID NO: 289451 - DNA, 75 bp, Artificial Sequence
  Synthetic
agtggcaaccaaacagcacgcatgcttaaatacaactatcccacaaaatctgggtactgtggtggagtcttgtac

SEQ ID NO: 289452 - DNA, 75 bp, Artificial Sequence
  Synthetic
cgacaagagtatatcataaagcaaagcatgttaaagtctggtgcccaagaccacccagagctgtagagtataccc

SEQ ID NO: 289453 - DNA, 75 bp, Artificial Sequence
  Synthetic
ggtacacttattgtagcaatgataccagaacaccaactggcaagtgcaacctatgggaatgttgccgccgggtat

SEQ ID NO: 289454 - DNA, 75 bp, Artificial Sequence
  Synthetic
gaccttgtcatctaccgaacaaatacaacaggtgatgacataattcctacatgtgattgcacacaggcaacctat

SEQ ID NO: 289455 - DNA, 75 bp, Artificial Sequence
  Synthetic
tcattacatcaaagaaagttcatgaatgtgggtatccaactatacacacccctgcaaaaacaaagttacagccta

SEQ ID NO: 289456 - DNA, 75 bp, Artificial Sequence
  Synthetic
acatgttggtaatctcatatatagaaatctgcaccttttcaactcagacgttcatgactccatattagtatcata

SEQ ID NO: 289457 - DNA, 75 bp, Artificial Sequence
  Synthetic
gtacattattaggtaatatcacaatttacccacatcaactcattaatttaagaagtaataattcagctacaatta

SEQ ID NO: 289458 - DNA, 75 bp, Artificial Sequence
  Synthetic
acattctgatgggtgaagggccttgtgaaccaggtgattgtggtgggaaactcctgtgtaaacatggggttatag

SEQ ID NO: 289459 - DNA, 75 bp, Artificial Sequence
  Synthetic
atacaaaggaaatgttgaatgcaacatgtctgaacacatgaaggttgccatatcacattattctgctcaattaat

SEQ ID NO: 289460 - DNA, 75 bp, Artificial Sequence
  Synthetic
agatattatccaataaaagtcactagtcatgattggtacgaaattcaggaaagtgaatactacccaaaacatata

SEQ ID NO: 289461 - DNA, 75 bp, Artificial Sequence
  Synthetic
cactgtgcctattaccatttccatcagcccgatgtgtgctgagttctcaggggctagagcaaaaaaccagggctt

SEQ ID NO: 289462 - DNA, 75 bp, Artificial Sequence
  Synthetic
tggtgaagcctttggagctggttttgtagataacattagagaacagattcagacaatcaatccaattaataaaat

SEQ ID NO: 289463 - DNA, 75 bp, Artificial Sequence
  Synthetic
cggaaagctgttgtgcaaacatggagttattggaataataactgcaggtggtgaggggcatgtggcattcataga

SEQ ID NO: 289464 - DNA, 75 bp, Artificial Sequence
  Synthetic
tacattagcatgggtatccgaaagagagatttaataaacaatagtacaaaagatatcaccaagttaaaagtggcc

SEQ ID NO: 289465 - DNA, 75 bp, Artificial Sequence
  Synthetic
atcccaggtcaagttaggaatttaattgaattatgtcaagtggatacactaatacccataaataatttacaacaa

SEQ ID NO: 289466 - DNA, 75 bp, Artificial Sequence
  Synthetic
ctattaggctgctcaggctcaccatggagatttattaaggaaaagatttgcaactggttacagctagtgtacata

SEQ ID NO: 289467 - DNA, 75 bp, Artificial Sequence
  Synthetic
caaataaatgctataaacccaattaacaatataagtaggaaaattgtaaaatggattctaagaataatatcagca

SEQ ID NO: 289468 - DNA, 75 bp, Artificial Sequence
  Synthetic
caagcagtatcaacgatacagttgctttcagaatgacatatggtaaactcttctctagtttccataaaaacccag

SEQ ID NO: 289469 - DNA, 75 bp, Artificial Sequence
  Synthetic
tggctaccaccctgcttggcgaaattgcaagttactacactcattggactggtagtcttagatttagttttatgt

SEQ ID NO: 289470 - DNA, 75 bp, Artificial Sequence
  Synthetic
ggcttaagtccatgttaccccaagcaaaactaaaagtggaattcattaaaaacttgaaacagttacctttgctag

SEQ ID NO: 289471 - DNA, 75 bp, Artificial Sequence
  Synthetic
agttctgcaaatggacacaattgaattacatccacaaagagtcagattcttggttgaagaaatttactgagatgt

SEQ ID NO: 289472 - DNA, 75 bp, Artificial Sequence
  Synthetic
taattatgatggtagtatacatcccatctggtttgaagcactcaaacaagttctcataaatttatcctttgagca

SEQ ID NO: 289473 - DNA, 75 bp, Artificial Sequence
  Synthetic
tgttgtctgggatgttggattacagtccactatgtcaatggtagtcccttgggtgagtgctagtcattttagaaa

SEQ ID NO: 289474 - DNA, 75 bp, Artificial Sequence
  Synthetic
tttgtatgccactgaaaacaaacgcatcaaagaattgcttaagcgaagccaaatgattcttcgcacatcaaagag

SEQ ID NO: 289475 - DNA, 75 bp, Artificial Sequence
  Synthetic
tctcaatgaactcaagaagttaaatcttttagagaagcaaattgagcacttgagaatagctgattctggtactca

SEQ ID NO: 289476 - DNA, 75 bp, Artificial Sequence
  Synthetic
tttaatacaatgattaacaatgtaataataagaactctagtccttgatgcatacaaatatatagatttagataag

SEQ ID NO: 289477 - DNA, 75 bp, Artificial Sequence
  Synthetic
tgctttgtttcggcatgtaaagatttttgcttaagaatggcaagagacacaaacttacataaacaatctggacct

SEQ ID NO: 289478 - DNA, 75 bp, Artificial Sequence
  Synthetic
tattccctacctccttccccaaaatactttgatggatacgatcagcagagtgtggtcatcatggatgatataatg

SEQ ID NO: 289479 - DNA, 75 bp, Artificial Sequence
  Synthetic
aagtgtaatgtaattatcaaacagaagaaaaggtgtgaaccagtggcagtggttatacatggggaacctggggca

SEQ ID NO: 289480 - DNA, 75 bp, Artificial Sequence
  Synthetic
tcacaccagctgacaagtctgataccttcaagaagcttgattacagcagtgttacattcttgaagagaggtttca

SEQ ID NO: 289481 - DNA, 75 bp, Artificial Sequence
  Synthetic
cccccgcactggatgcagctgagactggtcacactagcagtgtacaacctgaagatatgattgagaccaggtacg

SEQ ID NO: 289482 - DNA, 75 bp, Artificial Sequence
  Synthetic
tttcctcagattacgtgttagcaagcacaaatcacactctactccacccaccaaccataacatgtacaacagcta

SEQ ID NO: 289483 - DNA, 75 bp, Artificial Sequence
  Synthetic
aacaaagcgtggtcataatggatgacatcatgcaaaatccaagtggtgacgacatgactctcttttgtcaaatgg

SEQ ID NO: 289484 - DNA, 75 bp, Artificial Sequence
  Synthetic
acacgtactatccttgtgtcacttaatgtggcataatggccgggatgtgtataaagaattcgaaaggaaaatacg

SEQ ID NO: 289485 - DNA, 75 bp, Artificial Sequence
  Synthetic
caatgcaaaaacaaagaactttatgacatggcaaattaatttacaggaaatggcacagattagaaggaaatttga

SEQ ID NO: 289486 - DNA, 75 bp, Artificial Sequence
  Synthetic
cagtgttagcgctggacgtgcactgtatattcctccttacgatctcctgttgcatgagtggtatgaaaaatttta

SEQ ID NO: 289487 - DNA, 75 bp, Artificial Sequence
  Synthetic
tgaagggaaaattggaaatgccaaatgctgtcctttaatctgtggcaaggcattacaatttagagatagaaataa

SEQ ID NO: 289488 - DNA, 75 bp, Artificial Sequence
  Synthetic
tgaagggaaaattggaaatgccaattgctgtcctttaatctgtggcaaggcattacaatttagagatagaaataa

SEQ ID NO: 289489 - DNA, 75 bp, Artificial Sequence
  Synthetic
tgaagggaaaattggaaatgccaactgctgtcctttaatctgtggcaaggcattacaatttagagatagaaataa

SEQ ID NO: 289490 - DNA, 75 bp, Artificial Sequence
  Synthetic
tgaagggaaaattggaaatgccaagtgctgtcctttaatctgtggcaaggcattacaatttagagatagaaataa

SEQ ID NO: 289491 - DNA, 75 bp, Artificial Sequence
  Synthetic
ggcaccaccaactatcacatccttaccagcaatgaataggagattttatttagatttagatattgtagttagtga

SEQ ID NO: 289492 - DNA, 75 bp, Artificial Sequence
  Synthetic
gtaccaccaggtgcaccaatacctaaaactagagatgattttgcatggcaatctggaacaaatgcctcaatattt

SEQ ID NO: 289493 - DNA, 75 bp, Artificial Sequence
  Synthetic
cccatagatgtagtaaataaaccacctccaccagccataatagacttacttagatcagttagaaacccagatgtc

SEQ ID NO: 289494 - DNA, 75 bp, Artificial Sequence
  Synthetic
tgtgggaaggcagtaatgttcaaagataggaatacttgtcaatcatacacactagcacaggtatacaatcatata

SEQ ID NO: 289495 - DNA, 75 bp, Artificial Sequence
  Synthetic
attcaagatatggtacagtagtgactaatgacatgggtactttatgctccagaattgtaactgatgaacaccaaa

SEQ ID NO: 289496 - DNA, 75 bp, Artificial Sequence
  Synthetic
ttatcagtataatgggtgtaatatacattatatataaattgttttgctcactccaaggtccatattcaggcgagc

SEQ ID NO: 289497 - DNA, 75 bp, Artificial Sequence
  Synthetic
atctgttacaatcagttagaactccagaagtcatcaagtattgtgaagacaataaatggatagtccctgctgagt

SEQ ID NO: 289498 - DNA, 75 bp, Artificial Sequence
  Synthetic
tactaactacaaagttaggggtaaaactgagaagactgcaatcaaacacagagcaaagatcacaatggccggtcc

SEQ ID NO: 289499 - DNA, 75 bp, Artificial Sequence
  Synthetic
aacaagtaatgggaaattcactggattaggaatttatgataacattatgattattccaacacatgctgatgcagg

SEQ ID NO: 289500 - DNA, 75 bp, Artificial Sequence
  Synthetic
ttgcacattacagggaccttactctggtgagcctaagcaaaagacaaaaattcctgaaaggagagttgttgccca

SEQ ID NO: 289501 - DNA, 75 bp, Artificial Sequence
  Synthetic
ggtgagcctaagcaaaagacaaaaattcctgaaaggagagttgttgcccaaggacctgaggaagaatttgggcga

SEQ ID NO: 289502 - DNA, 75 bp, Artificial Sequence
  Synthetic
atccaggtaaggaggttcagattgatggcatctccacaaaagttgaagattcttatgacttatacaataaagatg

SEQ ID NO: 289503 - DNA, 75 bp, Artificial Sequence
  Synthetic
ttagtcatataccgcacaaacacaataggtgatgactatattccaacatgtgattgtactgaagccacatacttt

SEQ ID NO: 289504 - DNA, 75 bp, Artificial Sequence
  Synthetic
cacaggaatgaaaaattcagagatatcagaaagtatataccagaatctgaagatgattacccagaatgtcattta

SEQ ID NO: 289505 - DNA, 75 bp, Artificial Sequence
  Synthetic
taacttagctttatctgctaatcaacctgaaaccactataatcagtgttggagacgttgtctcatatggaaacat

SEQ ID NO: 289506 - DNA, 75 bp, Artificial Sequence
  Synthetic
tcttaattggagaagggccatgtgaaccaggtgattgtggagggaaactattatgtaaacatggtgttattggaa

SEQ ID NO: 289507 - DNA, 75 bp, Artificial Sequence
  Synthetic
ttaaaactgggagtgggttgttcccacccagaccacccacgtggtgttgtgctctgttattccggtaaccttgca

SEQ ID NO: 289508 - DNA, 75 bp, Artificial Sequence
  Synthetic
tcaaatacaattacccaacaaaatcagggttttgtggtggagtcttatacaaaatagggctagttctgggtatac

SEQ ID NO: 289509 - DNA, 75 bp, Artificial Sequence
  Synthetic
ggcattcatgttggtggcaatggtagggatggatttgcagcaatgctattaagatcttatttttctgagacacaa

SEQ ID NO: 289510 - DNA, 75 bp, Artificial Sequence
  Synthetic
tgaggcttttggcttgggttttgtggacagtgtcaaggaccaaataaatgcgattaacccgattaatggtattag

SEQ ID NO: 289511 - DNA, 75 bp, Artificial Sequence
  Synthetic
tccccggtcaatgttgatatgcttcaacaaggcaaaaacaacagcgatcgttatccgcaagatgcctacacaaag

SEQ ID NO: 289512 - DNA, 75 bp, Artificial Sequence
  Synthetic
atgtaatttgtatagcatacataccccatcaaacaccaaattacaacccagtgttttttatgatgttttccctgg

SEQ ID NO: 289513 - DNA, 75 bp, Artificial Sequence
  Synthetic
cttagtacctcctttgacggtatttgtctggtcgctcaggtgtttccccagcactagacctggcagatgaggcta

SEQ ID NO: 289514 - DNA, 75 bp, Artificial Sequence
  Synthetic
ttcctggaaacaaagagccagctgttcttactgacaatgatcccagattaacagtagacttcaaacaggcattat

SEQ ID NO: 289515 - DNA, 75 bp, Artificial Sequence
  Synthetic
attggttgttcaggatcaccatggagatttttaaaagagaaattctgtaaatggacccaacttaattatattcac

SEQ ID NO: 289516 - DNA, 75 bp, Artificial Sequence
  Synthetic
atcacgcaaaacatgctaacagcagctgcccattacacagcccaactttctactctagacatagacccaacacca

SEQ ID NO: 289517 - DNA, 75 bp, Artificial Sequence
  Synthetic
aagaagaaagacttgatagataaccgtactaaggacttaaccaaattgaaaatagcaatggataagtatggggtt

SEQ ID NO: 289518 - DNA, 75 bp, Artificial Sequence
  Synthetic
gttcatcttgagtcctccggcccctgaatgcggctaaccttaaacccgcagccattactcacaatccagtgagcg

SEQ ID NO: 289519 - DNA, 75 bp, Artificial Sequence
  Synthetic
tgaaatctatgttgccccaggcacaacttaaagtcaaataccttaatgaactaaagaaattaagcttccttgaaa

SEQ ID NO: 289520 - DNA, 75 bp, Artificial Sequence
  Synthetic
aagatttaataccaaaagacaggaatctaacaaggcttaagtgtgccattgagaaatatggtttggatttaccta

SEQ ID NO: 289521 - DNA, 75 bp, Artificial Sequence
  Synthetic
ccgttttgtttagatcagtctatggcaaccttttctcaaaatttcatttaaatcctggtatcatcactggttctg

SEQ ID NO: 289522 - DNA, 75 bp, Artificial Sequence
  Synthetic
tatatattggcatcatgggcgctcaagtgtctagacaaaatgttggtacgcactcaactcaaaacatggtttcaa

SEQ ID NO: 289523 - DNA, 75 bp, Artificial Sequence
  Synthetic
ttacgctagtgaggcaaaaagaataaagattttgcataatagatgtagtacaatcatcaaacaaagaaagagatg

SEQ ID NO: 289524 - DNA, 75 bp, Artificial Sequence
  Synthetic
cagaatggcctttggcaatttgttctccaagtttcaccaaaacccaggcattgtcacaggatctgcagtggggtg

SEQ ID NO: 289525 - DNA, 75 bp, Artificial Sequence
  Synthetic
acacccaatttggtttgatgcactcaaattagtcctagcaaacctttcatttagaactgacctgatagacagatt

SEQ ID NO: 289526 - DNA, 75 bp, Artificial Sequence
  Synthetic
agacccggttaaagatgttttagaaaagggaattccaactttgcaatcaccaacagttgaagcttgtggatattc

SEQ ID NO: 289527 - DNA, 75 bp, Artificial Sequence
  Synthetic
tccttaccacccgacccaaaatattttgatgggtatgatcaacaaagtgtggtcattatggatgatatcatgcag

SEQ ID NO: 289528 - DNA, 75 bp, Artificial Sequence
  Synthetic
tggtttaaattacttaatagagtactaactgaattgggctttccaggtgatttagtcaataaattgtgtaattct

SEQ ID NO: 289529 - DNA, 75 bp, Artificial Sequence
  Synthetic
aatgtgattattagaacattagtgttggatgcttacaaaaacattgatctggataaacttaaaattattgcctat

SEQ ID NO: 289530 - DNA, 75 bp, Artificial Sequence
  Synthetic
ccagaagatgccacagccatagataaaccaacacgccctgacacatcatccaatagattttacactttggagagc

SEQ ID NO: 289531 - DNA, 75 bp, Artificial Sequence
  Synthetic
attctagatttgtattgtgcagtactaatcataatttgttagcaccccccaccataacgtctttaccagcaatga

SEQ ID NO: 289532 - DNA, 75 bp, Artificial Sequence
  Synthetic
ttagaactctggtattagacacttacaaatttataaatctggataaacttaaaatattagcatatggtgatgatg

SEQ ID NO: 289533 - DNA, 75 bp, Artificial Sequence
  Synthetic
ctagcacttttaagaaacttgactacaacaacataacttttctaaagagaggctttaggcaagatgaaaagcata

SEQ ID NO: 289534 - DNA, 75 bp, Artificial Sequence
  Synthetic
gaagaagcggctatacaatccatgtgcaatgcaatgccagcaaattccaccagggcactttgatagtagctgcca

SEQ ID NO: 289535 - DNA, 75 bp, Artificial Sequence
  Synthetic
caatacaaaaattggcaatgcccgatgctgtccattcatctgtggtaaagcagtcaatttcagagaccgaaatac

SEQ ID NO: 289536 - DNA, 75 bp, Artificial Sequence
  Synthetic
caagaagctagattatagcaatgccactttccttaaaaggggtttcaagcaggatgaaaagtacagcttccttat

SEQ ID NO: 289537 - DNA, 75 bp, Artificial Sequence
  Synthetic
tcatttaatgtggcacaatggtagagatgtgtatactcaatttgaaaaggggatacgtagtgtcagcgctggtcg

SEQ ID NO: 289538 - DNA, 75 bp, Artificial Sequence
  Synthetic
ggaaagtactagatatcaacccagtgatgataattggctcaattttgatggtactttattgggtaatataaccat

SEQ ID NO: 289539 - DNA, 75 bp, Artificial Sequence
  Synthetic
actttccttaaaaggggtttcaagcaggatgaaaagtacagcttccttatccatcctatttacccagaaacagaa

SEQ ID NO: 289540 - DNA, 75 bp, Artificial Sequence
  Synthetic
gatgtgtatactcaatttgaaaaggggatacgtagtgtcagcgctggtcgtgcactatatatacctccttatgat

SEQ ID NO: 289541 - DNA, 75 bp, Artificial Sequence
  Synthetic
cctatctccatggagggccctccaccagcagcaataagtgacctgttgcaatcagttagaactcctgaagtaatt

SEQ ID NO: 289542 - DNA, 75 bp, Artificial Sequence
  Synthetic
aggcaataatgagtgtacaatgaatgaacacattaaagttgctgtttcccactattcagcacaattacacacact

SEQ ID NO: 289543 - DNA, 75 bp, Artificial Sequence
  Synthetic
atgatgggcatcaagaagaaagacttgatagataaccgtactaaggacttaaccaaattgaaaatagcaatggat

SEQ ID NO: 289544 - DNA, 75 bp, Artificial Sequence
  Synthetic
aacactttgtggacaagatcaggagtgttagtgctggtcgcgcactctatataccaccatatgaggtcttgctcc

SEQ ID NO: 289545 - DNA, 75 bp, Artificial Sequence
  Synthetic
aactggagtttagttataatcccaatttgtcctttagaaactaatggaggtgatgctactgtgcctataacaata

SEQ ID NO: 289546 - DNA, 75 bp, Artificial Sequence
  Synthetic
ttaaaactgggtccaggttgttcccacctggatctcctacatggagttgtactctattatcccggtaatcttgta

SEQ ID NO: 289547 - DNA, 75 bp, Artificial Sequence
  Synthetic
ataccaccatatgaggtcttgctccacgagtggtatgaaaaattttaatcagatatagaaattataaatgattag

SEQ ID NO: 289548 - DNA, 75 bp, Artificial Sequence
  Synthetic
ttagtatctctggaattatttatgttatatataaacttttttgtacattacaagggccttattctggagaaccta

SEQ ID NO: 289549 - DNA, 75 bp, Artificial Sequence
  Synthetic
cacttgtatcccggtacatttgtgcgccagttttatatcccctaccccaattgtaacttagaagttaagcaacac

SEQ ID NO: 289550 - DNA, 75 bp, Artificial Sequence
  Synthetic
atgactatcagtcacccagtgcattgccatggtttcgttcaacaaaggaaatatttatcccaggtcaagtgcata

SEQ ID NO: 289551 - DNA, 75 bp, Artificial Sequence
  Synthetic
tgaaaatggaaaattcacaggactgggcatctatgacagaacattgattgtgccaacacatgcagaccctggtaa

SEQ ID NO: 289552 - DNA, 75 bp, Artificial Sequence
  Synthetic
tcgttatccgcaaggtgcctacgggaagcctattaacactttgaaagaaatttggctggtcgctcagttgcgcaa

SEQ ID NO: 289553 - DNA, 75 bp, Artificial Sequence
  Synthetic
tgatcctggaagagaagtttttgccatgagagctgacatagcaactcaccctctagccacaacattaattggaga

SEQ ID NO: 289554 - DNA, 75 bp, Artificial Sequence
  Synthetic
agaaatgaaaagttcaaggacattaggaaatatataccagaacatgaagatgattacccagactgcaatctggct

SEQ ID NO: 289555 - DNA, 75 bp, Artificial Sequence
  Synthetic
cagaaattggacagggtgcgaagagcctactgtgctcaccttgagtcctccggcccctgaatgtggctaatccta

SEQ ID NO: 289556 - DNA, 75 bp, Artificial Sequence
  Synthetic
ccccctggaattgctaaaccaacaaacaggaaagatgcaatgcttggtacccatgttgtttgggatgttggcctg

SEQ ID NO: 289557 - DNA, 75 bp, Artificial Sequence
  Synthetic
agtataactacccaacaaaatcaggatactgtggtggcatattatataaaattggacaagtccttggaatccatg

SEQ ID NO: 289558 - DNA, 75 bp, Artificial Sequence
  Synthetic
tttatcattgcttatggtgacaagtatatatagatatatttgtcatcatgggcgctcaagtatcaaggcagaatg

SEQ ID NO: 289559 - DNA, 75 bp, Artificial Sequence
  Synthetic
atcagactgctcttgtcacacctcccagcacacctgctacagccagaatgctttgttttgtatcagggtgtaagg

SEQ ID NO: 289560 - DNA, 75 bp, Artificial Sequence
  Synthetic
tgactccacaataacatcacaagatgtggccaatgcagttataggttatggggtctggccacactatctgagtgc

SEQ ID NO: 289561 - DNA, 75 bp, Artificial Sequence
  Synthetic
taatttacctagcatccacacaccaagtaaaacaaaattacagcctagtgtcttctatgatgtgtttccaggtaa

SEQ ID NO: 289562 - DNA, 75 bp, Artificial Sequence
  Synthetic
acttgatttttcacaagacccaagcaaattcactgatccagtcaaagatgtactcaccaaaggagtaccaacact

SEQ ID NO: 289563 - DNA, 75 bp, Artificial Sequence
  Synthetic
ggtattagttgttcctaacattaatgaaagtcatcctagtacttcaaattcagctcctgccttggacgctgcaga

SEQ ID NO: 289564 - DNA, 75 bp, Artificial Sequence
  Synthetic
tggtggtggaaattgccagatgcacttaaagacatgggcatatttggagaaaacatgtattaccattaccttggc

SEQ ID NO: 289565 - DNA, 75 bp, Artificial Sequence
  Synthetic
aatgatcacattaaagtggccatctcccattactcggcacaattgaccacactagatatagatccaaatcctata

SEQ ID NO: 289566 - DNA, 75 bp, Artificial Sequence
  Synthetic
gtagcatatggagtatggcccagctatctcactgcaaaagatgcatctgcaattgacaagccaacacaaccggac

SEQ ID NO: 289567 - DNA, 75 bp, Artificial Sequence
  Synthetic
aatgcaatgctagtaagtttcatcaagggacattattggtagtgatgatacttgaacaccaactagcaagtgtag

SEQ ID NO: 289568 - DNA, 75 bp, Artificial Sequence
  Synthetic
gggagatctggctgcatacacatatcacacctaaatgtcagatacactgattataatgaaggtaataactttaga

SEQ ID NO: 289569 - DNA, 75 bp, Artificial Sequence
  Synthetic
atttaattaacaaacagaccaaggacatttctaaattgaaattggcattagataaatatggtgttgatttaccca

SEQ ID NO: 289570 - DNA, 75 bp, Artificial Sequence
  Synthetic
tttttggtgaaaatatgttttatcatttcctaggaagatcagggtatacagttcatgtccagtgtaatgccagca

SEQ ID NO: 289571 - DNA, 75 bp, Artificial Sequence
  Synthetic
tagcctctcaaagtaatgatattgggcatgtagtgatgcaatacatgtatgtcccaccaggtgctcctaaaccag

SEQ ID NO: 289572 - DNA, 75 bp, Artificial Sequence
  Synthetic
tagaacaacctttggcaacctcttctctaaatttcaccttaatcctgggattgttactggttctgctgtgggctg

SEQ ID NO: 289573 - DNA, 75 bp, Artificial Sequence
  Synthetic
tggagagtctggtagaataatagcaactaattcagttaataataacacaagacaacccagtgatgataactggct

SEQ ID NO: 289574 - DNA, 75 bp, Artificial Sequence
  Synthetic
agtgaattacaaacagagaatgccactaatctcacggtccctatcactgtatcaattagcccaatgtttgctgaa

SEQ ID NO: 289575 - DNA, 75 bp, Artificial Sequence
  Synthetic
agcctcagcttactatatgttctatgatggctatgatggtgatgctcccggatcgcgatacgggaccatagtgac

SEQ ID NO: 289576 - DNA, 75 bp, Artificial Sequence
  Synthetic
tggtttcaagcattaaaagaggtattaggcaatttgtcatttgaagctaatttaatagataggttatgtaattcc

SEQ ID NO: 289577 - DNA, 75 bp, Artificial Sequence
  Synthetic
aatgcagtaccaatggattccatgttaaggcataacaactggagcatagttattatcccagtttgttcattacaa

SEQ ID NO: 289578 - DNA, 75 bp, Artificial Sequence
  Synthetic
aatcaccttcagctttaccgtggtatcacccaacaaaagaaattttaattccaggagaagtaaaaaatttaatgg

SEQ ID NO: 289579 - DNA, 75 bp, Artificial Sequence
  Synthetic
gcgtggtgtccacgacccccgagggctgtgggttatacacacacacatgttaccaactacaagccatcacaggga

SEQ ID NO: 289580 - DNA, 75 bp, Artificial Sequence
  Synthetic
ttaggacactagttcttgatgcatacaaaaatattgatttggataaactgaaaataatagcttatggagatgatg

SEQ ID NO: 289581 - DNA, 75 bp, Artificial Sequence
  Synthetic
taccagttatgcttacaccaggatcagaacaatttctaaccacagatgacaatcagtctccctcagcactaccat

SEQ ID NO: 289582 - DNA, 75 bp, Artificial Sequence
  Synthetic
agctcagcaggtttttgccattaaagtagatattgcttcacaacctttagcaaatactatgcttggacaaattgc

SEQ ID NO: 289583 - DNA, 75 bp, Artificial Sequence
  Synthetic
atctacatctttttaactctgatgcccatgactctattttagtctcttattcatctgatttagtcatctaccgaa

SEQ ID NO: 289584 - DNA, 75 bp, Artificial Sequence
  Synthetic
taaacagcttgattatagcaatgtgacctttcttaaaagaggatttaagcaagatgaaaaacacaatttcctaat

SEQ ID NO: 289585 - DNA, 75 bp, Artificial Sequence
  Synthetic
ttctaaaaataatgttagtatgtatactgtcatgctgtcaacccaaacacaaactgctcaggaaatatttgccat

SEQ ID NO: 289586 - DNA, 75 bp, Artificial Sequence
  Synthetic
ggtattgggaagccagagaacagaaaacaggcgatgcttggtacacatatagtttgggatgttgggttgcaatca

SEQ ID NO: 289587 - DNA, 75 bp, Artificial Sequence
  Synthetic
acttactactgtagacataagaataggtactacccaataaaagtcactagccatgattggtatgagatacaagag

SEQ ID NO: 289588 - DNA, 75 bp, Artificial Sequence
  Synthetic
tggcataatggtagggatgtgtacaagcagtttgaggagcgaatacgtagtgtaagcgctggtcgtgcactatat

SEQ ID NO: 289589 - DNA, 75 bp, Artificial Sequence
  Synthetic
ttttgcggcacagcaaacacgacattaaaactacttatagcttacaccccaccaggagtcccaaaaccagatact

SEQ ID NO: 289590 - DNA, 75 bp, Artificial Sequence
  Synthetic
tgattggaattattacagcaggtggtgaggggcatgtggctttcatagatttgagacatttccattgtgcagaag

SEQ ID NO: 289591 - DNA, 75 bp, Artificial Sequence
  Synthetic
cacaacttgtcttccctccaaacactccaaatacagctgatatgttatgttttgtatcagcttgtaaggattttt

SEQ ID NO: 289592 - DNA, 75 bp, Artificial Sequence
  Synthetic
tgtaagcgctggtcgtgcactatatatccctccttatgatctgcttttgcatgagtggtatgaaaaattttagat

SEQ ID NO: 289593 - DNA, 75 bp, Artificial Sequence
  Synthetic
acactgttattccggtaactttgtacgccagttttataaccccttccccttatgtaacttagaagataagcacaa

SEQ ID NO: 289594 - DNA, 75 bp, Artificial Sequence
  Synthetic
tcaccacccctgacacgtactctaaagctgggtatataacatgctggtaccaaactaactttgtagtacccccag

SEQ ID NO: 289595 - DNA, 75 bp, Artificial Sequence
  Synthetic
caatatcagcaagaagctagttaagtggattcttagaataatatctgctatggtaataattattaggaatagttc

SEQ ID NO: 289596 - DNA, 75 bp, Artificial Sequence
  Synthetic
agttgtgcctaatatcagagagagccacccaagcacatctaactctgctccaattttggatgctgctgaaactgg

SEQ ID NO: 289597 - DNA, 75 bp, Artificial Sequence
  Synthetic
agaccaataggtggtggctatcccagtcactaaaggtcaagcacttctgtttccccggtcaacgttgatatgctc

SEQ ID NO: 289598 - DNA, 75 bp, Artificial Sequence
  Synthetic
cataacacaaaatccagtggaagaatatgttgatcaggttttaaatgaggttttagttgttccaaacataaaaga

SEQ ID NO: 289599 - DNA, 75 bp, Artificial Sequence
  Synthetic
tagtagacctggcagatgaggctagaaatcccccactggcgacagtgttctagcctgcgtggctgcctgcgtgtc

SEQ ID NO: 289600 - DNA, 75 bp, Artificial Sequence
  Synthetic
tatgtacacaaggaatcagattcatggcttaagaagttcacagaaatgtgcaatgcagcaagaggtcttgagtgg

SEQ ID NO: 289601 - DNA, 75 bp, Artificial Sequence
  Synthetic
tcagggtgtatacatgtttcaacaataaagacaaatcaggcacacaataccaagtttgataaatggaatatcaac

SEQ ID NO: 289602 - DNA, 75 bp, Artificial Sequence
  Synthetic
ctcactttgagtcctccggcccccgaatgtggctaaccttaaccctgcagctggggcatacaatccagtgtgaac

SEQ ID NO: 289603 - DNA, 75 bp, Artificial Sequence
  Synthetic
gttataactgaccaaacaagagatgaaatgagcattgaaagtttcctcggaagatcaggttgtgcaacaattatg

SEQ ID NO: 289604 - DNA, 75 bp, Artificial Sequence
  Synthetic
tattggagaaacaaattgagaacttgcgctgtgcagacacaaaaacccaggagaaaataaaagtagaagttgaca

SEQ ID NO: 289605 - DNA, 75 bp, Artificial Sequence
  Synthetic
atgatataggccacatagttatgcagtacatgtatgtactacctggagctccagtaccagatgacagaaaccact

SEQ ID NO: 289606 - DNA, 75 bp, Artificial Sequence
  Synthetic
atattggcaccatgggcgcacaagtatccagacagaacgttggtacacactctactcaaaattcagtttcgaatg

SEQ ID NO: 289607 - DNA, 75 bp, Artificial Sequence
  Synthetic
agatgttcacatatctcagatttgattcagaaatcactcttgtgtgtgcagtggcctcacaaggagacaataatg

SEQ ID NO: 289608 - DNA, 75 bp, Artificial Sequence
  Synthetic
aaagagaagtgaaccagttgctgtaatgatacatggtccacctgggactggtaaatctataactacaagctttct

SEQ ID NO: 289609 - DNA, 75 bp, Artificial Sequence
  Synthetic
catgttttatgacggttataatggaggtgatcatacagcaacttatggcaccacagtggttaaccggatggggac

SEQ ID NO: 289610 - DNA, 75 bp, Artificial Sequence
  Synthetic
cccagttaaggatgtgttagaaaagggtattcccacgcttcagtctccaactgttgaggcgtgtggatattctga

SEQ ID NO: 289611 - DNA, 75 bp, Artificial Sequence
  Synthetic
ttggcaacaaggtcaaacataccccaggttctctataccattttctagtattgcctcagcttattacatgtttta

SEQ ID NO: 289612 - DNA, 75 bp, Artificial Sequence
  Synthetic
ataatgcaaaatccggatggagaggatatgtccttattttgtcagatggtttcaagtgtcacattcattccacca

SEQ ID NO: 289613 - DNA, 75 bp, Artificial Sequence
  Synthetic
ccaccaagggttgtcccatacaagtatgttggcctaactaattacacacttaaagaaacagatacagttgtggaa

SEQ ID NO: 289614 - DNA, 75 bp, Artificial Sequence
  Synthetic
caagatgctacagcaattgataaaccatcaagacctgacacttcatccaatagattctatacactggagagtaaa

SEQ ID NO: 289615 - DNA, 75 bp, Artificial Sequence
  Synthetic
cataaggtcacaattacagctagagtctaccacaaggccaaacatattagtgcatggggcccaagacctcctaga

SEQ ID NO: 289616 - DNA, 75 bp, Artificial Sequence
  Synthetic
ctgctatgaatagaaggttttatttagatttagatataattgtgcatgagaattacaaaaacactcagggaaagt

SEQ ID NO: 289617 - DNA, 75 bp, Artificial Sequence
  Synthetic
actcaatcctaatatcatattcatcagatttagtcatttatcgaacaaacaccacaggtaatgactatatcccca

SEQ ID NO: 289618 - DNA, 75 bp, Artificial Sequence
  Synthetic
tatcctatcaaagtcactagtcatgattggtatgagatacaagaaagtgaatactatccaaaacacattcagtat

SEQ ID NO: 289619 - DNA, 75 bp, Artificial Sequence
  Synthetic
gaagtggttatacagtacatgtccaatgcaatgctagtaaatttcatcagggcacactgattgtagcaatgatac

SEQ ID NO: 289620 - DNA, 75 bp, Artificial Sequence
  Synthetic
cctcagatctttacgtgcatgtgggaaatttagtatatagaaacttacacttatgcaccaatgagaatcttagtg

SEQ ID NO: 289621 - DNA, 75 bp, Artificial Sequence
  Synthetic
ccggaacacatgtgaggtgtattctctctgccggatttataacatgattatgcaggaagacagacaccgtaggag

SEQ ID NO: 289622 - DNA, 75 bp, Artificial Sequence
  Synthetic
tggagacaatgaaaaacagcctagtgatgacaattggctcaactttgatggaacattattaggcaatatcacaat

SEQ ID NO: 289623 - DNA, 75 bp, Artificial Sequence
  Synthetic
ttattgcaagagtaaaggcagatactacccaataatagttagaaagcatgattggtatgagattcaagaatcaga

SEQ ID NO: 289624 - DNA, 75 bp, Artificial Sequence
  Synthetic
gaggtaatcaagtactgtgaggaaaacaaatggataattccagcagattgtaagattgagagggatctaaactta

SEQ ID NO: 289625 - DNA, 75 bp, Artificial Sequence
  Synthetic
aattggagtctggtgattatacccatatgtcaattagagggagatccaccaacaataccaataaccatctccatt

SEQ ID NO: 289626 - DNA, 75 bp, Artificial Sequence
  Synthetic
ggcattgtgacagctggtggagaaggacacgttgccttcatagacattagagatttccaatgtgctgaggaacag

SEQ ID NO: 289627 - DNA, 75 bp, Artificial Sequence
  Synthetic
gtgagcctaaacctaaacctaagattccagaaagaagagttgtagctcaaggacctgaagaggaatttggccgtt

SEQ ID NO: 289628 - DNA, 75 bp, Artificial Sequence
  Synthetic
tggagatttcttaaagagaaattttgtaaatggacccaattaaactatatacacaaggagtctgactcatggctt

SEQ ID NO: 289629 - DNA, 75 bp, Artificial Sequence
  Synthetic
tccaatccccttgtgctttaccttggttccatcctactaaagagatatctataccaggccaggttaggaacttaa

SEQ ID NO: 289630 - DNA, 75 bp, Artificial Sequence
  Synthetic
ttaattccaaaatggtcaagtggttactcagaatcatttcagcaatggttataattattagaaataatgctgatc

SEQ ID NO: 289631 - DNA, 75 bp, Artificial Sequence
  Synthetic
tccaggtaatacaatccaaatagatgggataaatgttaaaatttcagattcttacgacctatacaataaaaatgg

SEQ ID NO: 289632 - DNA, 75 bp, Artificial Sequence
  Synthetic
tggatgaaatctatgcttcctcaagctcagcttaaggtgaaatacttaagtgagcttaaaaaattaagtttcctt

SEQ ID NO: 289633 - DNA, 75 bp, Artificial Sequence
  Synthetic
cccagcaaaggaagtctttgcaataaaagttgacattgcctcccagccattagccactacattaattggagagat

SEQ ID NO: 289634 - DNA, 75 bp, Artificial Sequence
  Synthetic
acacaaagaatcagactcatggttgaagaaatttacagagatgtgtaatgctgcacgtggccttgaatggatagg

SEQ ID NO: 289635 - DNA, 75 bp, Artificial Sequence
  Synthetic
aatttggctttagtagctaatcagcctgaacccacaatattgaatgtgggagatgttgtgtcatatgggaatata

SEQ ID NO: 289636 - DNA, 75 bp, Artificial Sequence
  Synthetic
ccaggaattgccaaaccagcagataggaaggcagccatgctaggaactcatgttgtttgggatgttggattacaa

SEQ ID NO: 289637 - DNA, 75 bp, Artificial Sequence
  Synthetic
gagaagagtgttgatggactaagacttgccaatccagaaaaacaatatttatttttaaagcaaattgaagagatg

SEQ ID NO: 289638 - DNA, 75 bp, Artificial Sequence
  Synthetic
gtatacatgttgggggtaatggtaaagatggattctcagccacattgctcagatcttactttagtgaaactcaag

SEQ ID NO: 289639 - DNA, 75 bp, Artificial Sequence
  Synthetic
atactccttgccacctgaccccaaatattttgatggatatgaccagcaaagtgtggttataatggatgatgttat

SEQ ID NO: 289640 - DNA, 75 bp, Artificial Sequence
  Synthetic
aaacaaaccttattgctccaacaaatgccccacaaactgcaagaatgctgtgttttgtctcagcctgtaaggatt

SEQ ID NO: 289641 - DNA, 75 bp, Artificial Sequence
  Synthetic
gagttgagcctgttgcagttatgttccatgggaatccaggaacaggtaaatctttggcaacaaattttcttggca

SEQ ID NO: 289642 - DNA, 75 bp, Artificial Sequence
  Synthetic
caaaggaaccaaagagccagctgtactatctgagaaagatccacgcttggagacagatttcaagaaagccctatt

SEQ ID NO: 289643 - DNA, 75 bp, Artificial Sequence
  Synthetic
tttgactcacgatttgtactatgtagcactaatcataatatgctagcaccacctacaatcacttcattgccagct

SEQ ID NO: 289644 - DNA, 75 bp, Artificial Sequence
  Synthetic
gttagtggtcccaaatgtgaatgaaagtcacgcaattacatcaaattcagcccctgctttagatgccgctgaaac

SEQ ID NO: 289645 - DNA, 75 bp, Artificial Sequence
  Synthetic
gcagaatcctgatggagaggacatgtccttattctgtcaaatggtatcctcagtaccatttatcccacccatggc

SEQ ID NO: 289646 - DNA, 75 bp, Artificial Sequence
  Synthetic
agcaacatgagtctagaagatagtgtgtttggttcagaggggcttgaagctttagacttgaatactagtgcaggt

SEQ ID NO: 289647 - DNA, 75 bp, Artificial Sequence
  Synthetic
gtatcagctgccttccaaccctgtgatgtggatgtaaagattggaaatgcccgctgttgtccatttatctgtggc

SEQ ID NO: 289648 - DNA, 75 bp, Artificial Sequence
  Synthetic
agatcagggtgtatacatatctccaagttagttgtacattatgaagattataatgcagaaacaaggaactttgta

SEQ ID NO: 289649 - DNA, 75 bp, Artificial Sequence
  Synthetic
atgaatagaaggttctttttagacctggatattgaagttagtgagaattataaagatggaaatggtagaattcag

SEQ ID NO: 289650 - DNA, 75 bp, Artificial Sequence
  Synthetic
atttacccatggtcactttccctaaagatgagcttagaaagaaagaaaagatctcttctggaaaaactcgtgtca

SEQ ID NO: 289651 - DNA, 75 bp, Artificial Sequence
  Synthetic
tagctgctaagggtgatgacataggacatattgttatgcagtacatgtatgttcctccaggagcaccaataccaa

SEQ ID NO: 289652 - DNA, 75 bp, Artificial Sequence
  Synthetic
atagttgtgagaagtatactctagcccgaatttaccacaagatcttagaggaggataaaagaagacaatgccttt

SEQ ID NO: 289653 - DNA, 75 bp, Artificial Sequence
  Synthetic
agttggctgtgatccagaaactttctggtcaaagatccctgtcatgttagatggtgaatgcataatggcttttga

SEQ ID NO: 289654 - DNA, 75 bp, Artificial Sequence
  Synthetic
caccatcatcacaattattgctaatattattagtatttctggaatcatttatgtaatatataaacttttctgtac

SEQ ID NO: 289655 - DNA, 75 bp, Artificial Sequence
  Synthetic
agcatcagcttattacatgttctatgatggctacgacggtgaccagacctcatcgcggtatggcacagttgcaac

SEQ ID NO: 289656 - DNA, 75 bp, Artificial Sequence
  Synthetic
catcaagtattgtgaggataacaaatggattgtgccagctgagaataccattgaacgagacttaaatgtggcaaa

SEQ ID NO: 289657 - DNA, 75 bp, Artificial Sequence
  Synthetic
tgtaattccaagcacatatacaaagactcatactatgaggttgaaggtggagtaccttcaggatgttctggaaca

SEQ ID NO: 289658 - DNA, 75 bp, Artificial Sequence
  Synthetic
attaaacataattcatgcgttgtgtcgactcagaatggtaaatttacaggcttaggaatttatgatagaacacta

SEQ ID NO: 289659 - DNA, 75 bp, Artificial Sequence
  Synthetic
gcatggtgcccaaggccaccgagagctgtggagtacacacatacacatgtaactaactacaagcctaaggaagga

SEQ ID NO: 289660 - DNA, 75 bp, Artificial Sequence
  Synthetic
cccaaacctaaaacaaaaaccccagaacgtagagtagtaacgcagggaccagtagaagaatttggcagaagcttg

SEQ ID NO: 289661 - DNA, 75 bp, Artificial Sequence
  Synthetic
gtgatgatgtaattttctcatataaatacactcttgatatggaagcaattgctcaagagggcagtaaatatggac

SEQ ID NO: 289662 - DNA, 75 bp, Artificial Sequence
  Synthetic
agttggagatcacagtcttgaaactcaagaggaatgagaaattcaaagacattagaaaatacataccagaaaatg

SEQ ID NO: 289663 - DNA, 75 bp, Artificial Sequence
  Synthetic
tgtttaactcagaaatgcatgactcaattctaatctcatactcatcagatttagtcatataccgaacaaacacaa

SEQ ID NO: 289664 - DNA, 75 bp, Artificial Sequence
  Synthetic
gtagccaaattgaaattgatggagttaagacaaatgtggtggatagttatgatctgtataataaagatggtgtta

SEQ ID NO: 289665 - DNA, 75 bp, Artificial Sequence
  Synthetic
atttttaattcatccaaccttcccaattgatgagatacatgaatcaattagatggacaaagaaaccctcccaaat

SEQ ID NO: 289666 - DNA, 75 bp, Artificial Sequence
  Synthetic
gtatgaaatacaagagagtgagtactacccaaaacatatccaatacaatttactgattggagagggcccatgtga

SEQ ID NO: 289667 - DNA, 75 bp, Artificial Sequence
  Synthetic
tgctttggtggctaatcaggaacaaccaactattatagaagttggagatgtttgctcatatggcaacattctcct

SEQ ID NO: 289668 - DNA, 75 bp, Artificial Sequence
  Synthetic
ataattacttccaaatctacaagcgaatgtggtgtacctagcattcacacgccaagcaaaactaagttgcaaccc

SEQ ID NO: 289669 - DNA, 75 bp, Artificial Sequence
  Synthetic
gatacgcagtgtcagcgctggacgcgcactgtatatccctccatacgaaatgctcctgcatgagtggtatgaaaa

SEQ ID NO: 289670 - DNA, 75 bp, Artificial Sequence
  Synthetic
tttcaatgtgctgaagagcaaggcataacagattacatccatatgcttggtgaagcgtttggcacaggttttgtt

SEQ ID NO: 289671 - DNA, 75 bp, Artificial Sequence
  Synthetic
catgtaggagggaatggtagagatggattttccgctatgattttaagatcttacttcaatgaaaaccagggtctc

SEQ ID NO: 289672 - DNA, 75 bp, Artificial Sequence
  Synthetic
agtataaaggtaataaccagtgtattatgaatgatcatatcaaggtggccatctcacattattcagcacaactga

SEQ ID NO: 289673 - DNA, 75 bp, Artificial Sequence
  Synthetic
taattagaaattcatcagatccacagactataatagctactttaacattgattggctgctcaggttccccttgga

SEQ ID NO: 289674 - DNA, 75 bp, Artificial Sequence
  Synthetic
gtgataaagaaccagccgttcttagtaagcatgatccaagactagagactgatttccacactgcattattttcaa

SEQ ID NO: 289675 - DNA, 75 bp, Artificial Sequence
  Synthetic
ttatatatctatgggtatcaagaaaagagatttaatcaacaagcaaactaaggatgtgacaaaactcaaaatggc

SEQ ID NO: 289676 - DNA, 75 bp, Artificial Sequence
  Synthetic
ttaaaactgggtgtgggttgttcccacccacaccacccaatgggtgttgtactctgttattccggtaactttgta

SEQ ID NO: 289677 - DNA, 75 bp, Artificial Sequence
  Synthetic
tgatggaaagactcgtgtgattgaagccagtagcgtgaatgacactatactgttcaggacaacttttggcaatct

SEQ ID NO: 289678 - DNA, 75 bp, Artificial Sequence
  Synthetic
tagaggcctggagtggattggcaacaagatatcaaaatttattgaatggatgaaatctatgttaccccaagccca

SEQ ID NO: 289679 - DNA, 75 bp, Artificial Sequence
  Synthetic
actgtcattagaagaatgtgtgttcgggatagatggacttgaagccctggacttacataccagtgcaggataccc

SEQ ID NO: 289680 - DNA, 75 bp, Artificial Sequence
  Synthetic
aaacacgagattgacacattgcatgatttatcttgtaaatttctacccctctatgctagtgaggcaaaaagaatt

SEQ ID NO: 289681 - DNA, 75 bp, Artificial Sequence
  Synthetic
ccaatgataacatttctaaaagatgaacttaggaagaaagacaaaattgtggcagggaagactagagttatagag

SEQ ID NO: 289682 - DNA, 75 bp, Artificial Sequence
  Synthetic
tgactacaaacttcttagctagaatgataacaagtgatagtgatatctattccttaccacctgatcccaagtatt

SEQ ID NO: 289683 - DNA, 75 bp, Artificial Sequence
  Synthetic
gatgtgaccctgacactttttggtcaaaaattccacttatgcttgatggagaatgtcttatggcttttgattact

SEQ ID NO: 289684 - DNA, 75 bp, Artificial Sequence
  Synthetic
tacttttataccaccaatggcagatttgccagataagggaaaaccatttgactctagatttgtattatgtagcac

SEQ ID NO: 289685 - DNA, 75 bp, Artificial Sequence
  Synthetic
ttccaaacacatcttctcctctcaatattatgaggtggaaggtggaatgccatcaggttgtgcaggaaccagcat

SEQ ID NO: 289686 - DNA, 75 bp, Artificial Sequence
  Synthetic
tgtgacatttttgaaaagagggtttagacaggatgaaaaacataattttctaatacaccctacatttccagtaga

SEQ ID NO: 289687 - DNA, 75 bp, Artificial Sequence
  Synthetic
gactcacaagggaaactaaatgtgtctgcagctttccaactatgtgatgtgaatactaaagtaggaaatgcccgc

SEQ ID NO: 289688 - DNA, 75 bp, Artificial Sequence
  Synthetic
gatgtgcttttctgttatccatacaaattggatatgtctgaattagctagtgaaggaaggaagtatggtcttaaa

SEQ ID NO: 289689 - DNA, 75 bp, Artificial Sequence
  Synthetic
tacaagcagtttgtggaacggatacgtagtgtcagcgctggtcgtgcactatatattcctccttatgacttgctt

SEQ ID NO: 289690 - DNA, 75 bp, Artificial Sequence
  Synthetic
gtagtgtcagcgctggtcgtgcactatatattcctccttatgacttgcttttgcatgagtggtatgaaaaatttt

SEQ ID NO: 289691 - DNA, 75 bp, Artificial Sequence
  Synthetic
acagaaagcggacgcgggttgttgatgtcatggcagcaatatttcaaggtccaataacacttgagggtcccccac

SEQ ID NO: 289692 - DNA, 75 bp, Artificial Sequence
  Synthetic
ttatacatcctacttttccaatttctgaaatacacaactcaatcagatggaccagaagcccccgaaacatgcaag

SEQ ID NO: 289693 - DNA, 75 bp, Artificial Sequence
  Synthetic
gcagtgttagtgctggtcgcgcactgtatatccctccatttgaagtgctcagacatgagtggtatgataaatttt

SEQ ID NO: 289694 - DNA, 75 bp, Artificial Sequence
  Synthetic
aagagatttgaatatagctaacactataataacaatcattgctaacattgttagtatatctggtattatttatgt

SEQ ID NO: 289695 - DNA, 75 bp, Artificial Sequence
  Synthetic
acactgttattacggtaactttgtatgccagtttttgttcccctatccccctttaaagtaacttagaagcatgaa

SEQ ID NO: 289696 - DNA, 75 bp, Artificial Sequence
  Synthetic
gaggaatttggaagatctttaattaagcacaactcatgcattgtcactacacaaaatggaaaatttacaggccta

SEQ ID NO: 289697 - DNA, 75 bp, Artificial Sequence
  Synthetic
cccagatcattaaaggtcaagcacttctgtttccccggtcaatgaggatatgctttacccaaggcaaaaacctta

SEQ ID NO: 289698 - DNA, 75 bp, Artificial Sequence
  Synthetic
tatacaacaaagatggagtgaagctagaaattacagttcttaaattaaaaagaaatgagaaatttaaagacatca

SEQ ID NO: 289699 - DNA, 75 bp, Artificial Sequence
  Synthetic
aagctggacgttccccactggcgacagtggtccagcctgcgtggctgcctgctcacccatttgggtgagaagcct

SEQ ID NO: 289700 - DNA, 75 bp, Artificial Sequence
  Synthetic
atcatatggtaacattttacttagtggtaaccaaacagcaaggatgctcaaatacaattacccaacaaaatcagg

SEQ ID NO: 289701 - DNA, 75 bp, Artificial Sequence
  Synthetic
tgaaatgacggtcgtaacgcgaaagtgtgggatgggaccaactactttgggtgtccgtgtttcctattttttcct

SEQ ID NO: 289702 - DNA, 75 bp, Artificial Sequence
  Synthetic
ttctcagaaactcaaggccagatagtttcttccaaatccactgctgaatgcaattatcctagcatacacacacca

SEQ ID NO: 289703 - DNA, 75 bp, Artificial Sequence
  Synthetic
gtgactaatggatctagtctcaattattttaacatcaattactttaaggacgctgcttcaagtggtgcttctaga

SEQ ID NO: 289704 - DNA, 75 bp, Artificial Sequence
  Synthetic
ttaaagaggctttattctctaaatacaaaggaaataatccatgtgagataaatgaacatattaaggtagcagtct

SEQ ID NO: 289705 - DNA, 75 bp, Artificial Sequence
  Synthetic
ggtattcagacaggttaatgcagatcacccgtggggattctacaataacatcacaagatatagctaatgcagtgg

SEQ ID NO: 289706 - DNA, 75 bp, Artificial Sequence
  Synthetic
taataccagtgcaggatttccctatgtttccatgggcattagaaaaagagatctaatcaacaagcaaaccaaaga

SEQ ID NO: 289707 - DNA, 75 bp, Artificial Sequence
  Synthetic
ggagagtcgcacctggacaactgcttcgactggatggtggtggaaattacccgatgctctcaaaagtatgggtat

SEQ ID NO: 289708 - DNA, 75 bp, Artificial Sequence
  Synthetic
gggaagactcgagtcatagaagccagtagtgtgaatgacactgtattatttaggacaacttttgggaatcttttc

SEQ ID NO: 289709 - DNA, 75 bp, Artificial Sequence
  Synthetic
gctgctattccagaacaccaacttgcttctgcattgactggaaatgtttcagttgggtataaacacactcatcca

SEQ ID NO: 289710 - DNA, 75 bp, Artificial Sequence
  Synthetic
gtataatggcttttgattacacaaattatgatgggagcatacatccaatatggtttcaagcactcaaagaagtac

SEQ ID NO: 289711 - DNA, 75 bp, Artificial Sequence
  Synthetic
acctacccatttatccacatcaatatataaatttaaggactaataactcagccaccctcattctcccatacgtca

SEQ ID NO: 289712 - DNA, 75 bp, Artificial Sequence
  Synthetic
tggatgttctggaacaagcatattcaacacaatgattaacaacattatcattagaacactagttttggatgcata

SEQ ID NO: 289713 - DNA, 75 bp, Artificial Sequence
  Synthetic
acctataacagtgtcaattagcccaatgttttcggaattttcaggacctagaaataaggttgtatttaatcaagg

SEQ ID NO: 289714 - DNA, 75 bp, Artificial Sequence
  Synthetic
ggtaccaagtatggtcttaccataaccccagctgacaaatcaagtgaatttaagcaattagattatagcaatgtg

SEQ ID NO: 289715 - DNA, 75 bp, Artificial Sequence
  Synthetic
ttcatacctggagaagttaaaaatttagtagagatgtgccaggttgatacacttatcccagtcaacaacacagaa

SEQ ID NO: 289716 - DNA, 75 bp, Artificial Sequence
  Synthetic
agaaaccatctcaaatgcaggaacatgtgttgtcgttgtgtcatttaatgtggcataatggcaaaaacgtgtaca

SEQ ID NO: 289717 - DNA, 75 bp, Artificial Sequence
  Synthetic
cattagctactacttatcttggagaaatgagtagttactttacacactggaccggaagcttacgtttcagcttca

SEQ ID NO: 289718 - DNA, 75 bp, Artificial Sequence
  Synthetic
tgtcagcgctggacgtgcactgtatatccctccctacgaactgcttctgcatgaatggtacgaaaaattttgaat

SEQ ID NO: 289719 - DNA, 75 bp, Artificial Sequence
  Synthetic
acacttagtctgggacgtggggttgcaatcaactgcttcactggtggtaccatgggttagtgctagtcattttag

SEQ ID NO: 289720 - DNA, 75 bp, Artificial Sequence
  Synthetic
actctattattccggtaattttgtacgccagttttatattccctaccccgagtaacttagaagataagcacacaa

SEQ ID NO: 289721 - DNA, 75 bp, Artificial Sequence
  Synthetic
gtctgtatggtttcagcttgtaaggatttttgcttaagattggccagagatactaacttacacatgcaggaaggt

SEQ ID NO: 289722 - DNA, 75 bp, Artificial Sequence
  Synthetic
gttatccgcaaaatgcctacacaaagcctagtatcatcttggaaggcacagagttggtcgctccactattcccca

SEQ ID NO: 289723 - DNA, 75 bp, Artificial Sequence
  Synthetic
gcctagtatcatcttggaaggcacagagttggtcgctccactattccccatagtagacctggcagatgaggctag

SEQ ID NO: 289724 - DNA, 75 bp, Artificial Sequence
  Synthetic
ctgtgccagctctggatgctgcggaaacagggcatactagttctgttcaacctgaagatatgatagaaactagat

SEQ ID NO: 289725 - DNA, 75 bp, Artificial Sequence
  Synthetic
ctcattttgattcctccggcccctgaatgtggctaaccttaaccctgcagctagtgcacacaaaccagtgtgtat

SEQ ID NO: 289726 - DNA, 75 bp, Artificial Sequence
  Synthetic
ttacgacacaataggtgttggatttgtaacatggaagattagcttgcaagaaatggcacaaatcaggagaaaatt

SEQ ID NO: 289727 - DNA, 75 bp, Artificial Sequence
  Synthetic
tatattgacaccatgggcgcacaagtttctagacaaaatgttggtacacattccacacaaaatacagttgctaat

SEQ ID NO: 289728 - DNA, 75 bp, Artificial Sequence
  Synthetic
tatgtgcctccaggtgcaccaattcccaagaaacgtgatgattacacatggcagtcaggaacaaatgcatctgtg

SEQ ID NO: 289729 - DNA, 75 bp, Artificial Sequence
  Synthetic
atccagttaaggatgttttaacaaaaggcatccctacactacaatccccttcagttgaagcatgtggatactctg

SEQ ID NO: 289730 - DNA, 75 bp, Artificial Sequence
  Synthetic
catcatctaggtatggctcagtggtaactaatgatatgggaactatatgtattagattggtcacctccacccaaa

SEQ ID NO: 289731 - DNA, 75 bp, Artificial Sequence
  Synthetic
tgatgatgctagtgccatagataaaccaacacatccagatacatcatccaaccgattctataccttggaaagtaa

SEQ ID NO: 289732 - DNA, 75 bp, Artificial Sequence
  Synthetic
ctccaccaattatgtaccaaaagatggggaagtagcaactcaaatcaaaaccagacgagatgtttacactgttac

SEQ ID NO: 289733 - DNA, 75 bp, Artificial Sequence
  Synthetic
agagctggttacactatacatgtacaatgtaatgccagtaaattccatcagggtactttaatagtcgttgccata

SEQ ID NO: 289734 - DNA, 75 bp, Artificial Sequence
  Synthetic
tactctagtgatctaatcatttaccgaacaaacacaaaaggcgatgatgtgattccaaactgtgattgcactgat

SEQ ID NO: 289735 - DNA, 75 bp, Artificial Sequence
  Synthetic
gtactgagcgtaacagacaacctagtgatgaaaactggcttaattgtaatggaaccctattaggaaatttaacta

SEQ ID NO: 289736 - DNA, 75 bp, Artificial Sequence
  Synthetic
tccaatataatattttaattggagaagggccttgtgaaccaggtgattgcgggggtaaacttttatgcaaacatg

SEQ ID NO: 289737 - DNA, 75 bp, Artificial Sequence
  Synthetic
caattggagcctagtcattataccagtttgccctcttgaggtagcacaaggatcagagcaatatgtgccaataac

SEQ ID NO: 289738 - DNA, 75 bp, Artificial Sequence
  Synthetic
ggaacaccttggccaagtctttggcgttggctttgtagatagtattaaacagcaaataaactttatcaatccaac

SEQ ID NO: 289739 - DNA, 75 bp, Artificial Sequence
  Synthetic
cttaccactgatgatacacaatcaccatcagcattaccatatttccatcctactaaggaaatattcataccaggt

SEQ ID NO: 289740 - DNA, 75 bp, Artificial Sequence
  Synthetic
accttaactttacttggttgctcaggttcaccatggagatttctaaaagaaaaattctgttcatggctccaactt

SEQ ID NO: 289741 - DNA, 75 bp, Artificial Sequence
  Synthetic
tcactaaacaaacaaacccagcagaagagatctttgcaatcccagtagacgtagcttctcaaccattagctacaa

SEQ ID NO: 289742 - DNA, 75 bp, Artificial Sequence
  Synthetic
tcatagattggattaagagtatgttaccacaagctcaacttaaggttgattatttgactaaactcaaacaactaa

SEQ ID NO: 289743 - DNA, 75 bp, Artificial Sequence
  Synthetic
aatagcatatactcctccaggtgttcctaaacctactagtagaaaagaagcaatgcttggaacacacttggtctg

SEQ ID NO: 289744 - DNA, 75 bp, Artificial Sequence
  Synthetic
atttttaccactatatgcttctgaagcacgtagaattaagaatttgtatattaaatgcaacaacattatcaaagg

SEQ ID NO: 289745 - DNA, 75 bp, Artificial Sequence
  Synthetic
gtaacatgttggtaccaaacaaatcttgttgtggcgccaaatacaccaacaacagctagaatgatttgttttgta

SEQ ID NO: 289746 - DNA, 75 bp, Artificial Sequence
  Synthetic
actgatatctattctcttcccccagatccaaaatattttgatggctatgaccagcaaagtgttgttattatggat

SEQ ID NO: 289747 - DNA, 75 bp, Artificial Sequence
  Synthetic
ctgttcttaatgaggtccttgtagtacctaacatcaatgccagtagtggacatacatctaattcagctccagcac

SEQ ID NO: 289748 - DNA, 75 bp, Artificial Sequence
  Synthetic
gaaaaccatttacatcaaagtttgtgcttgcaagcactaatcacaccttgttgactccaccaactgtatcatcac

SEQ ID NO: 289749 - DNA, 75 bp, Artificial Sequence
  Synthetic
agaaagttttctaggaaggtcaggctgcattgccattattgagacagaattgaatcatgaagaagggaaatacaa

SEQ ID NO: 289750 - DNA, 75 bp, Artificial Sequence
  Synthetic
atgtgatgttgatattaaaataggtaatgctaaatgttgtccattcatatgtggtaaggctgttgaatttaagga

SEQ ID NO: 289751 - DNA, 75 bp, Artificial Sequence
  Synthetic
gaaataacaatagtcaccacattggcaggccaaggggatgatattggacatgtggtcatacaatatatgtatgtg

SEQ ID NO: 289752 - DNA, 75 bp, Artificial Sequence
  Synthetic
tttcaaggtatagaccttcaatcacctccacctccagctataactgatcttctcagatcagtcaggaccccagag

SEQ ID NO: 289753 - DNA, 75 bp, Artificial Sequence
  Synthetic
tcactatcccgttcatgagtatagcctcagcatattacatgttttatgatggctacgaaagtgataaaggcaaga

SEQ ID NO: 289754 - DNA, 75 bp, Artificial Sequence
  Synthetic
atgtagtgtctatagtaggtattatttacataatttacaaattattttgtactcttcagggtccttattcaggtg

SEQ ID NO: 289755 - DNA, 75 bp, Artificial Sequence
  Synthetic
caaggctaaacacattaaagcatggtgccccagggcacccagagcagtcccatatcaacatatttataatccaaa

SEQ ID NO: 289756 - DNA, 75 bp, Artificial Sequence
  Synthetic
gacaactgacaaaggtaaatttactggtcttggtatctatgatcagatcatggttctcccaacacattcagatcc

SEQ ID NO: 289757 - DNA, 75 bp, Artificial Sequence
  Synthetic
cacgcgggagacttaatatacagaaatctacatttatgtgaatcagaaaatctaaatgattcaattctaattagt

SEQ ID NO: 289758 - DNA, 75 bp, Artificial Sequence
  Synthetic
ttagcccgtaatgaaaagtttaaggatatcaggaaatatttacccacccgtgaggatgattaccctgcttgtaac

SEQ ID NO: 289759 - DNA, 75 bp, Artificial Sequence
  Synthetic
acagatattaccctgtgagtgtaacaaaacaccagtggtatgagatacaggaatcagattattatcctaaacaca

SEQ ID NO: 289760 - DNA, 75 bp, Artificial Sequence
  Synthetic
tgatcaaataccactacccaacaaaagctgggtactgcggtggtgtgctgtataaggtgggctctattcttggca

SEQ ID NO: 289761 - DNA, 75 bp, Artificial Sequence
  Synthetic
aggtgacaaccatgtagcttttatagatcttagggatttccagattgctgaggaacaaggaataccagaatatat

SEQ ID NO: 289762 - DNA, 75 bp, Artificial Sequence
  Synthetic
agccaaaaacttaccttctatccatgtgtcgtctaaaactcgcttacaacctagtgtgtttcatgatgttttccc

SEQ ID NO: 289763 - DNA, 75 bp, Artificial Sequence
  Synthetic
aagtgggtgataaggatcatttcagctgtcactataataatcagaaacagtgcagatccacatacaatagtagcc

SEQ ID NO: 289764 - DNA, 75 bp, Artificial Sequence
  Synthetic
ccattaacttcgcacatgaaggtggctgtagcgcactatgctgctcaactctcaactcttgacataaaccctcag

SEQ ID NO: 289765 - DNA, 75 bp, Artificial Sequence
  Synthetic
gatggatcaagaaattcacagagatgtgtaacgctgccagaggtttggaatggttaggtaataaaatatcaaagt

SEQ ID NO: 289766 - DNA, 75 bp, Artificial Sequence
  Synthetic
agaaagatcttatagacaagaaaacaaaagatattacaaagctgaaaaaagcaattgatgaatatggccttgatt

SEQ ID NO: 289767 - DNA, 75 bp, Artificial Sequence
  Synthetic
actgagacttgcaacacaaaaacaacaacaggaatacatagacaccctcaccctgatgctagactcatcaaacaa

SEQ ID NO: 289768 - DNA, 75 bp, Artificial Sequence
  Synthetic
aatatttaggagtgtgtttggtaatcttttctctgcttttcataaaaatccaggtgtggtcactggatcagcagt

SEQ ID NO: 289769 - DNA, 75 bp, Artificial Sequence
  Synthetic
gttattttccatggtgaaccaggtacaggaaaatcaatcacaacatctattcttgctagaatgctcacctcagaa

SEQ ID NO: 289770 - DNA, 75 bp, Artificial Sequence
  Synthetic
cccatatggtttaaatgtcttaaaatgcttttagaagatattgggtttccctctcaattaattgaccaaatttgt

SEQ ID NO: 289771 - DNA, 75 bp, Artificial Sequence
  Synthetic
aggatatgtcattattctgtcaaatggtatcgtctgttccatttataccacctatggctgacctaccagacaaag

SEQ ID NO: 289772 - DNA, 75 bp, Artificial Sequence
  Synthetic
ttaaaactggatctaggttgttcccacctagatctcccaagtggagtggtacactattatcacggtaattttgta

SEQ ID NO: 289773 - DNA, 75 bp, Artificial Sequence
  Synthetic
ttataattagaaccttggtactagatgcatacaaaaatatagatctagacaaacttaagattttagcatatggag

SEQ ID NO: 289774 - DNA, 75 bp, Artificial Sequence
  Synthetic
cctggatttagatatcattgtcaaagatgaatacaaattaaatcaaggtaaattaaatctacagtgtgcactcag

SEQ ID NO: 289775 - DNA, 75 bp, Artificial Sequence
  Synthetic
cgtttttcaagaattgacttacaataatgtaacatttctaaaacgagggtttagggctgatgaaaaacactcatt

SEQ ID NO: 289776 - DNA, 75 bp, Artificial Sequence
  Synthetic
ctggctactatatataacagaatcactcacgaaagcaagaacagaaaagagttaacaaactcattacaggcaatt

SEQ ID NO: 289777 - DNA, 75 bp, Artificial Sequence
  Synthetic
ttaatgtggcataatggtaggcatgagtatcagagctttgttgaccgtatacgcagtgtatccgctggccgtgca

SEQ ID NO: 289778 - DNA, 75 bp, Artificial Sequence
  Synthetic
aaaataaatggataatccctgcagattgtaggcttgaacgggatcttaattatgcaaatttaataatatctatga

SEQ ID NO: 289779 - DNA, 75 bp, Artificial Sequence
  Synthetic
agagcgcgcaaaccagcgtgtatctagtcgtaatgagcaattgcgggacgggaccaactactttgggtgtccgtg

SEQ ID NO: 289780 - DNA, 75 bp, Artificial Sequence
  Synthetic
acgcagtgtatccgctggccgtgcactgtatataccagcttatgaagttcttgagtatgaatggtatgaaaaatt

SEQ ID NO: 289781 - DNA, 75 bp, Artificial Sequence
  Synthetic
gttcttcccattgtacccttcctgaacttccaacccaagtaacgttagaagctcaactttcagtacaacaggaag

SEQ ID NO: 289782 - DNA, 75 bp, Artificial Sequence
  Synthetic
gaaaccagagagaagagtagtcacacaaggaccccaagaagagtttggacgtagtttgattaagcataacacatg

SEQ ID NO: 289783 - DNA, 75 bp, Artificial Sequence
  Synthetic
tctacacaaaattcagtttcaaatggatctagtttaaattattttaacataaattatttcaaggacgccgcctcg

SEQ ID NO: 289784 - DNA, 75 bp, Artificial Sequence
  Synthetic
aactacgtaaaagctagtaacatcatgtttctaaatcggcgttcgatcaggtggatttcccctccactagtttgg

SEQ ID NO: 289785 - DNA, 75 bp, Artificial Sequence
  Synthetic
gatggaattaaaaccaaagttagtgatgcatatgacctgcacaatatgcatggtgtcaagttagagattacagta

SEQ ID NO: 289786 - DNA, 75 bp, Artificial Sequence
  Synthetic
cagttgaagcatgtgggtattctgatagaataattcagattacaagaggggattcaacaattacctcccaggatg

SEQ ID NO: 289787 - DNA, 75 bp, Artificial Sequence
  Synthetic
actcgcatgtgcttggttgtgagtcctccggcccctgaatgcggctaaccttaaccctggagccttgcgtcacaa

SEQ ID NO: 289788 - DNA, 75 bp, Artificial Sequence
  Synthetic
agactgagcctacaattctagaagttggtgattgttgttcctatgggaatattttactgagtggtaatcaaactg

SEQ ID NO: 289789 - DNA, 75 bp, Artificial Sequence
  Synthetic
cagattctacactttggaaagtaagacatggagtgctgattctaaaggatggtggtggaagttgcctgatgcact

SEQ ID NO: 289790 - DNA, 75 bp, Artificial Sequence
  Synthetic
catatatattgtatatactgtgatcatgggcgctcaagtatcaacacagaagagtggatctcacgagaatcagaa

SEQ ID NO: 289791 - DNA, 75 bp, Artificial Sequence
  Synthetic
gagggatggcttttctgcaatgttactaagatcttacttcaatgagcaacaaggaaagattgtgtcaagagctga

SEQ ID NO: 289792 - DNA, 75 bp, Artificial Sequence
  Synthetic
ggaacactaatagttgccatgataccagaacatcagctagctgcagcggagagagggaatgttactgctggttac

SEQ ID NO: 289793 - DNA, 75 bp, Artificial Sequence
  Synthetic
tcaaaatttacagagccagtcaaagatttaatgttgaaaggagcaccagcactgaattcaccaaatgttgaagca

SEQ ID NO: 289794 - DNA, 75 bp, Artificial Sequence
  Synthetic
gtgttatctacaaaagatccaagattggaagtagaccttgatagttctattttttcaaaatataaaggaaatgag

SEQ ID NO: 289795 - DNA, 75 bp, Artificial Sequence
  Synthetic
gtactcttttaggaaacataaccatcttcccacaccaatttattaacttaagaagcaataactcagccacaataa

SEQ ID NO: 289796 - DNA, 75 bp, Artificial Sequence
  Synthetic
agtatttgtcagatagtgatgctagtgatgtgaacaaaacatcaaaaccagatacctctgtttgcagattttaca

SEQ ID NO: 289797 - DNA, 75 bp, Artificial Sequence
  Synthetic
gcgtgtatggaattgaaggtttggaagcgctagacctccacactagtgctggttatccatacacagctcatggaa

SEQ ID NO: 289798 - DNA, 75 bp, Artificial Sequence
  Synthetic
aggttcaaacataatacctattacagtttctattagtcccatgtttgctgagttttctggtgcacgagcacggaa

SEQ ID NO: 289799 - DNA, 75 bp, Artificial Sequence
  Synthetic
ccattcacttggtagaacaggctacacaatacatgtacagtgtaatgccaccaaatttcacagtggttgcctact

SEQ ID NO: 289800 - DNA, 75 bp, Artificial Sequence
  Synthetic
agatgagctcagaaaaccagagaaaataagtgctggaaaaactagaattatagaggctagtagtttaaatgatac

SEQ ID NO: 289801 - DNA, 75 bp, Artificial Sequence
  Synthetic
gaaatatccatacctggccaagttaggaatttaattgagatatgtcaagtagacacacttatacctataaacaat

SEQ ID NO: 289802 - DNA, 75 bp, Artificial Sequence
  Synthetic
gacaccgtcgaggtcgcaggtggccctaccagtgatgccatctacaacatggatggaacccttctagggaacctt

SEQ ID NO: 289803 - DNA, 75 bp, Artificial Sequence
  Synthetic
tggtcaaaaattccagtaatgttggatggagattgtctcatggcatttgactattccaattatgatgggagttta

SEQ ID NO: 289804 - DNA, 75 bp, Artificial Sequence
  Synthetic
cacatcctttagcaaccacattgttaggggaaattgcaagttactatacacactggacaggcagtttacgcttta

SEQ ID NO: 289805 - DNA, 75 bp, Artificial Sequence
  Synthetic
acaacaatgtgtcactaatggttgttccaattgccccgctcaatgcacctactggatcttctcctacattacctg

SEQ ID NO: 289806 - DNA, 75 bp, Artificial Sequence
  Synthetic
caacatactatgaagttgaaggtgggatgccttcaggttgtgctggaactagtatatttaattcaatgattaata

SEQ ID NO: 289807 - DNA, 75 bp, Artificial Sequence
  Synthetic
aggtacacatgtagtttgggatgtaggattacaatcaactatatccatgatagtaccatggattagcgctagcca

SEQ ID NO: 289808 - DNA, 75 bp, Artificial Sequence
  Synthetic
acaatttctaaccacagatgacaggcaatcaccaagtgctttaccgagttatgaacccacaccaagaatacacat

SEQ ID NO: 289809 - DNA, 75 bp, Artificial Sequence
  Synthetic
ttttgatttagatatggcagaactagccaaagaaggtgataaatatggtttaacaattacacctgcagataaatc

SEQ ID NO: 289810 - DNA, 75 bp, Artificial Sequence
  Synthetic
aatttgctttgttttgtatctgcatgcaaggatttctgtctgcgcatggctagggacacaaaccttcataaacaa

SEQ ID NO: 289811 - DNA, 75 bp, Artificial Sequence
  Synthetic
ccactacatgctgacaaacaaaatgaacagatatttggtacaaatctcttcattggtgatggtgttttcaaaaca

SEQ ID NO: 289812 - DNA, 75 bp, Artificial Sequence
  Synthetic
gaaagtgaagtttgggagtccattagatggacgaagaacccaagaaacatgcaagaacatgttctctccttgtgc

SEQ ID NO: 289813 - DNA, 75 bp, Artificial Sequence
  Synthetic
ccaattcagccccagctctagatgctgctgagacaggtcacactagcagtgtacaacctgaagatatgatcgaga

SEQ ID NO: 289814 - DNA, 75 bp, Artificial Sequence
  Synthetic
gattaggagtgttagcgctggtcgtgcactctatatcccaccatacgaagttctgttgcacgaatggtatgaaaa

SEQ ID NO: 289815 - DNA, 75 bp, Artificial Sequence
  Synthetic
ttttagcatacactcctcctggtacgcgtggcccagaagatagaaaggaagcaatgttaggaacacatgttgtgt

SEQ ID NO: 289816 - DNA, 75 bp, Artificial Sequence
  Synthetic
taatgcatatgatgaaagtagggacaatttcacaatttggaaaataaatataaaagaaatggcccagattaggag

SEQ ID NO: 289817 - DNA, 75 bp, Artificial Sequence
  Synthetic
acactgttatcacggtaactttgtatgccagttttgccacccttccccgtagcgtaacttagaagtttgtacact

SEQ ID NO: 289818 - DNA, 75 bp, Artificial Sequence
  Synthetic
tctatcatgctggtatcaaacatcgctcatacttccaccacaaaccagtggacaagtctatcttttatctttcat

SEQ ID NO: 289819 - DNA, 75 bp, Artificial Sequence
  Synthetic
tatatgtatgtacctccaggagcaccattaccaacaaaaagagatgactacacatggcaatcaggtacaaatgca

SEQ ID NO: 289820 - DNA, 75 bp, Artificial Sequence
  Synthetic
tagaccaataggcgataatcatccagattatcaaaggtcaagcacttctgtttccccggtcaatgaggatatgct

SEQ ID NO: 289821 - DNA, 75 bp, Artificial Sequence
  Synthetic
gtcattgtcgagaaaactaaacagacattggcttccgtctcttcgggacctaaacatacacagagtgttcctgcc

SEQ ID NO: 289822 - DNA, 75 bp, Artificial Sequence
  Synthetic
gaccagattcactatatggcaccatagtaactaatgatatgggttccttgtgttcgcgtatagttactgaagaac

SEQ ID NO: 289823 - DNA, 75 bp, Artificial Sequence
  Synthetic
cagcagtagacctggcagatgaggctggacgttccccactggcgacagtggtccagcctgcgtggctgcctgccc

SEQ ID NO: 289824 - DNA, 75 bp, Artificial Sequence
  Synthetic
tagagagtttcctcggtagagcggcttgtgtgcatgtgacagaaatcaagaacaaggatgcagctgacttggaca

SEQ ID NO: 289825 - DNA, 75 bp, Artificial Sequence
  Synthetic
cagccgctgcccatgatccagtgggtatacggtcgtaacgcgcaagtgtgggatgggaccaactactttgggtgt

SEQ ID NO: 289826 - DNA, 75 bp, Artificial Sequence
  Synthetic
acatgttacaaactatagaccagaaacaggtgaggctcaaacggttatacctgttagagcagatgttagaacaat

SEQ ID NO: 289827 - DNA, 75 bp, Artificial Sequence
  Synthetic
ctcagagtacactatcttagctacagcttcacaaccagaggcatctagttattctagtaacctaactgtccaggc

SEQ ID NO: 289828 - DNA, 75 bp, Artificial Sequence
  Synthetic
aacacactctacacaaaattcagtaagtaatggatcaagtctgaattattttaatattaactactttaaggatgc

SEQ ID NO: 289829 - DNA, 75 bp, Artificial Sequence
  Synthetic
tcatactcttcagacttagtcatataccgcacaaacactgtaggcgatgactatataccaacatgtgattgcaca

SEQ ID NO: 289830 - DNA, 75 bp, Artificial Sequence
  Synthetic
tccagattcagtgtcccttttgtaggcttagcatcagcatataattgtttttatgatggctattcacatgatgac

SEQ ID NO: 289831 - DNA, 75 bp, Artificial Sequence
  Synthetic
tcaccaacagttgaagcatgtggttattcagataggctaatacagataactcgtggagattctactataacatca

SEQ ID NO: 289832 - DNA, 75 bp, Artificial Sequence
  Synthetic
acatacaatacaatttactaattggagaaggaccttgtgaacccggtgattgtggtggaaagctgttatgcaaac

SEQ ID NO: 289833 - DNA, 75 bp, Artificial Sequence
  Synthetic
gggtttaccatagagccaaacatgtggaagcatggattccaagagcacccagagctttaccatacgtgtccattg

SEQ ID NO: 289834 - DNA, 75 bp, Artificial Sequence
  Synthetic
cctccaatagattctacaccttggaaagtcggaattggacaaactcttcgactggatggtggtggaaattgcctg

SEQ ID NO: 289835 - DNA, 75 bp, Artificial Sequence
  Synthetic
catacacatgttaggtgaagcatttggaaatggttttgtagatagtgtcaaagaacaagtcaatgccattaaccc

SEQ ID NO: 289836 - DNA, 75 bp, Artificial Sequence
  Synthetic
taacgtgaaaataataaattatcaccttatgactccagaagatcatctgaacttgatagccccttacccaagtag

SEQ ID NO: 289837 - DNA, 75 bp, Artificial Sequence
  Synthetic
ccaccaaggcttattgatagttgctgccataccagaacaccagttggcatctgcaacgagtggaaatgtgtgggt

SEQ ID NO: 289838 - DNA, 75 bp, Artificial Sequence
  Synthetic
gctactttaaccttaataggctgctctggttcaccttggagattcctaaaggaaaaattttgtaaatggacacaa

SEQ ID NO: 289839 - DNA, 75 bp, Artificial Sequence
  Synthetic
tatcctgtcatttgtgagagacctaccaacatctggattgagggcggcccgtactacccaagtagatatcaagct

SEQ ID NO: 289840 - DNA, 75 bp, Artificial Sequence
  Synthetic
tttgatggaacattacttggtaatttacctatttatcctcaccagtacattaatctaaggactaataattcagcc

SEQ ID NO: 289841 - DNA, 75 bp, Artificial Sequence
  Synthetic
agtttatagattggatgaagtctatgctaccacaagcacaacttaaagttaagtatttgagtgaattgaagaagc

SEQ ID NO: 289842 - DNA, 75 bp, Artificial Sequence
  Synthetic
gttatgtttgttttgcagacataagacaactagacttcattgcagatgaacagggcttgggtgattacattacta

SEQ ID NO: 289843 - DNA, 75 bp, Artificial Sequence
  Synthetic
aaggtggaggcacaccatctatacccataacagtatcaattagtccaatgttctcagaattttcaggaccaagaa

SEQ ID NO: 289844 - DNA, 75 bp, Artificial Sequence
  Synthetic
taaattcctcccattatatgctagtgaagctaagaggattaaaatattgcataataaatgctgcaatataattaa

SEQ ID NO: 289845 - DNA, 75 bp, Artificial Sequence
  Synthetic
atccaaggtagtaaaaatgatttcagccttagttatcatttgtagaaatcatgatgacttagttacagtcaccgc

SEQ ID NO: 289846 - DNA, 75 bp, Artificial Sequence
  Synthetic
tttccatccaaccaaggaaatattcatacctgggcaagtcaagaatttgattgaaatgtgtcaggttgatacact

SEQ ID NO: 289847 - DNA, 75 bp, Artificial Sequence
  Synthetic
gaaagtgatatttactcacttccaccagatcccaaatactttgatggttacgatcaacagagtgttgttataatg

SEQ ID NO: 289848 - DNA, 75 bp, Artificial Sequence
  Synthetic
gatggctggttcagaaaattcaatgatgcttgcaatgcagcaaaaggattagagtggattgctaacaagatctca

SEQ ID NO: 289849 - DNA, 75 bp, Artificial Sequence
  Synthetic
ccagttgacattgcttcgcaacccttagctaccacatatataggcgagattgctagttattacactcattggact

SEQ ID NO: 289850 - DNA, 75 bp, Artificial Sequence
  Synthetic
aaggaaaaccctttgattcaaggtttgtattttgtagcactaatcactcacttttagcccctcctacgatcacat

SEQ ID NO: 289851 - DNA, 75 bp, Artificial Sequence
  Synthetic
tagcatccatacacgactctaaccctacccaagagaaaagggagcagttattcaacaatgttttgtggttggagc

SEQ ID NO: 289852 - DNA, 75 bp, Artificial Sequence
  Synthetic
ggaaagaagccatgcttggcactcatttggtgtgggatgttggtctacagtctactgcttcactagttgtaccat

SEQ ID NO: 289853 - DNA, 75 bp, Artificial Sequence
  Synthetic
caagccatgtgacatagataacaaaattggaaatgcaaaatgttgccccttcatatgtggaaaagcagttgtgtt

SEQ ID NO: 289854 - DNA, 75 bp, Artificial Sequence
  Synthetic
gagaaccgaaccagtgtgtgttttaatacacggtacaccaggttctggcaaatcactaaccacgtccattgtggg

SEQ ID NO: 289855 - DNA, 75 bp, Artificial Sequence
  Synthetic
tacaccagccaatgcaaagatggcgtgtatggtgtcagcttgtaaagatttttgcctgaggttagccagagatac

SEQ ID NO: 289856 - DNA, 75 bp, Artificial Sequence
  Synthetic
gcaatattccaaggtcccatatcaatgaacttaccaccaccacctgccataactgatttattgcagtcagtaaga

SEQ ID NO: 289857 - DNA, 75 bp, Artificial Sequence
  Synthetic
gacttgaaccagaacccggatggacaagacatcagcatgttttgtcaaatggtttcttcagtagatttcttacca

SEQ ID NO: 289858 - DNA, 75 bp, Artificial Sequence
  Synthetic
agtacatctgtatcaagtcattctgtgcctgccttggatgctgcagaaacgggacacacaagttctgttcagcct

SEQ ID NO: 289859 - DNA, 75 bp, Artificial Sequence
  Synthetic
taattgcaaacatcattagtatcgcaggtatcatatttgtcatatacaagttgttttgttctttgcagggaccat

SEQ ID NO: 289860 - DNA, 75 bp, Artificial Sequence
  Synthetic
cagaagcactaaccagacggtttggatttgacttggatatctgcttacacagtacatacacaaagaatggtaaat

SEQ ID NO: 289861 - DNA, 75 bp, Artificial Sequence
  Synthetic
aatttaacacaaataagactaattatgatgacataggtgtaggatacaaaacatggaaaattagccttcaagaga

SEQ ID NO: 289862 - DNA, 75 bp, Artificial Sequence
  Synthetic
atgtgtggtcactacagacaatgggaaattcaccggtctgggtatatatgatagatacttaatcatacctacaca

SEQ ID NO: 289863 - DNA, 75 bp, Artificial Sequence
  Synthetic
agatagggtttccaatgttagatttagcatagatcaattagttactgctatcataaatgattataagaataaggt

SEQ ID NO: 289864 - DNA, 75 bp, Artificial Sequence
  Synthetic
acatattgtgttacaatttatgtatgtacccccaggagcacctgtacccaagaatcgtgatgactttacatggca

SEQ ID NO: 289865 - DNA, 75 bp, Artificial Sequence
  Synthetic
gttataaagctggacagaaatgagaaattcagggatatacgcaagtatatacctgaaagagaggatgattaccca

SEQ ID NO: 289866 - DNA, 75 bp, Artificial Sequence
  Synthetic
ctactaaaatcagtagattcagaagaagttagggaatattgcaagaaaaagaaatggattatcccacaaattcca

SEQ ID NO: 289867 - DNA, 75 bp, Artificial Sequence
  Synthetic
gatggctatgatggtgatgatgctaaatcaatatatggttctgtggtaacaaatgacatgggaactatatgtgtt

SEQ ID NO: 289868 - DNA, 75 bp, Artificial Sequence
  Synthetic
cagctaggatgcttaaatatcattatccaaccaagtcaggatattgtggaggagtgctttataaaataggtagtg

SEQ ID NO: 289869 - DNA, 75 bp, Artificial Sequence
  Synthetic
ttgctcaaacacaagggccctactctggaaatccagttcatagcaaactcaagccacccactttgaaaccagttg

SEQ ID NO: 289870 - DNA, 75 bp, Artificial Sequence
  Synthetic
ctgttccttatcaattcacacattctactaattacataccagatagtggtgaggtaacaacacaaatcaaaccca

SEQ ID NO: 289871 - DNA, 75 bp, Artificial Sequence
  Synthetic
aaatgttaaagatcttggatacccaaccatacacactccaaataaaacaaaattacaccccagtgttttccacga

SEQ ID NO: 289872 - DNA, 75 bp, Artificial Sequence
  Synthetic
tgaccgtatctgtgttctgccaacacatgctcagccaagtaatagtgtccttgtgaatggacaaaagattcaaat

SEQ ID NO: 289873 - DNA, 75 bp, Artificial Sequence
  Synthetic
agatgattctattcttgtctcatactctagtgatttaatcatacaccgaacaaacactgaaggtgatgatataat

SEQ ID NO: 289874 - DNA, 75 bp, Artificial Sequence
  Synthetic
gtagaatgtgaattgaacgaccatatgaaagtagctatagcacattattctgcccaattgatgacccttgatata

SEQ ID NO: 289875 - DNA, 75 bp, Artificial Sequence
  Synthetic
atatcagaggacttagaaggaatagatgcaactttagtagtacattccaatggattcactaacaccatgttagac

SEQ ID NO: 289876 - DNA, 75 bp, Artificial Sequence
  Synthetic
tcagaatactacccaaaacatattcaatacaacctgttgattggagaaggaccttgtgagcctggagattgtgga

SEQ ID NO: 289877 - DNA, 75 bp, Artificial Sequence
  Synthetic
gtattaagaaaagggacctcattaacaactctaccaaggatatttctaaacttaaaatagcattagataagtatg

SEQ ID NO: 289878 - DNA, 75 bp, Artificial Sequence
  Synthetic
gtgtgttgtgcacaactggaaagatatttggaatacacgttggtggtaatggtagacagggattttcagcacaac

SEQ ID NO: 289879 - DNA, 75 bp, Artificial Sequence
  Synthetic
aacagggactctcagattatgtggagcatttgggacaagtttttggtgtaggttttgtagatagcattaaagaac

SEQ ID NO: 289880 - DNA, 75 bp, Artificial Sequence
  Synthetic
tgacacaataacatttagaatgacctatggaaatttattttcatgctttcacaaaaatccaggggtcgttaccgg

SEQ ID NO: 289881 - DNA, 75 bp, Artificial Sequence
  Synthetic
acttcaccctagcgtattttacaatgtattccctggaagcaaacagcctgcagtacttagtgataatgaccctag

SEQ ID NO: 289882 - DNA, 75 bp, Artificial Sequence
  Synthetic
agatcctcaaactataattgccaccctcaccttgttgggctgctcagggtcgccatggaaattccttaaggagaa

SEQ ID NO: 289883 - DNA, 75 bp, Artificial Sequence
  Synthetic
agcatccaccctgtgtggttcgatgcactcaaagaagtgctaaaggatctacaatttgaacatagattaattgac

SEQ ID NO: 289884 - DNA, 75 bp, Artificial Sequence
  Synthetic
actctattatcccggtaattttgtacgccagttttatcctcccctccccatgtaacttagaagctgtacacaacg

SEQ ID NO: 289885 - DNA, 75 bp, Artificial Sequence
  Synthetic
gggcagttaatgtcattagacatacccaccaaagagttaacacttaaagaggcactgtatggagtagatggcttg

SEQ ID NO: 289886 - DNA, 75 bp, Artificial Sequence
  Synthetic
attggacaaaagatatccaaatttatagattggattaagggtatgttaccacaagcccagttaaaagttgattat

SEQ ID NO: 289887 - DNA, 75 bp, Artificial Sequence
  Synthetic
ttaataacataatcataaggactttggttttagatgcatacaagcatatagatttggataagttaaagataatag

SEQ ID NO: 289888 - DNA, 75 bp, Artificial Sequence
  Synthetic
accaacaggtaacattcatccagagtgttaaaggtcaagcacttctgtttccccggtcaaagttgatatgctcca

SEQ ID NO: 289889 - DNA, 75 bp, Artificial Sequence
  Synthetic
tgaagttttatttggataaatatggaatagatttaccattagtcacatatataaaagatgaactcaggagcacgg

SEQ ID NO: 289890 - DNA, 75 bp, Artificial Sequence
  Synthetic
ccctccatgatttatctttgaaatttttaccattatatgcgtctgaagcacgcaggattaaaaatttgtatatta

SEQ ID NO: 289891 - DNA, 75 bp, Artificial Sequence
  Synthetic
taaatcagatacctttaagaaattggattatgatagtgtcacatttctgaagagaggttttaaacaagattccaa

SEQ ID NO: 289892 - DNA, 75 bp, Artificial Sequence
  Synthetic
tcagaatccaggtataataacagggtctgcagtgggatgtgatccagatgtcttttggtctgttataccttgtct

SEQ ID NO: 289893 - DNA, 75 bp, Artificial Sequence
  Synthetic
tgctcgaatgttaactgttgaaactgacatatactcattacccccagatcccaaatattttgatggatatgatca

SEQ ID NO: 289894 - DNA, 75 bp, Artificial Sequence
  Synthetic
ctgtgtcacttaatgtggcacaatggacgtgatgtgtacaaagagtttgaacgtggaatacgcagtgtcagcgct

SEQ ID NO: 289895 - DNA, 75 bp, Artificial Sequence
  Synthetic
ggtcgtgcactgtacattccaccttatgagctcttgctgcatgagtggtatgaaaagttctaattctttatatat

SEQ ID NO: 289896 - DNA, 75 bp, Artificial Sequence
  Synthetic
tgggaccaactactttgggtgtccgtgtttcttgtttttcttttatatttgcttatggtgacaatatatatagaa

SEQ ID NO: 289897 - DNA, 75 bp, Artificial Sequence
  Synthetic
tttaaatatcccacattgatacagtcaatttgtaatacacatcacatcttcagagatgagatctataaagtggag

SEQ ID NO: 289898 - DNA, 75 bp, Artificial Sequence
  Synthetic
aagaccaatagtaggcaactctccaggttgtctaaggtcaagcacttctgtttccccggttgatgttgatatgct

SEQ ID NO: 289899 - DNA, 75 bp, Artificial Sequence
  Synthetic
atggcagatcttccagacaaaggaaaaccatttacatctaaatttgtgcttgcaagtactaaccatactctcctc

SEQ ID NO: 289900 - DNA, 75 bp, Artificial Sequence
  Synthetic
aatataaattattttaaggatgctgcttctagcggcgcctcaaaattggaattttctcaagatccaagtaaattt

SEQ ID NO: 289901 - DNA, 75 bp, Artificial Sequence
  Synthetic
atcttgacagtcttagaatattggcttatggtgatgacttaatagtctcatacccctttgaactagattctaaca

SEQ ID NO: 289902 - DNA, 75 bp, Artificial Sequence
  Synthetic
atatagcaaaaagcttccggctctgtgacatcaacaccaaaataggtaatgccaggtgctgcccatttatctgtg

SEQ ID NO: 289903 - DNA, 75 bp, Artificial Sequence
  Synthetic
ggggcgattccacaattacatcacaggatgttgccaatgctgtggtagcctatggtgtttggccacattacctga

SEQ ID NO: 289904 - DNA, 75 bp, Artificial Sequence
  Synthetic
aaggtatttcagacctgatccacaatttccctttttggtccatccagtgatgccaatgcaggatatctatgagtc

SEQ ID NO: 289905 - DNA, 75 bp, Artificial Sequence
  Synthetic
agcacaagcaatggaggctattttccaaggtatagatttgcaatctccaccacctccagctataactgatctact

SEQ ID NO: 289906 - DNA, 75 bp, Artificial Sequence
  Synthetic
agggtggtggtggaaattgccagatgcgctcaagggcatgggaatctttggtgagaatatgttttaccatttcct

SEQ ID NO: 289907 - DNA, 75 bp, Artificial Sequence
  Synthetic
tgagaaagattacaacgattttatagccaaaatcagaacaacagacattggcaagtgtcttaatctacctgaata

SEQ ID NO: 289908 - DNA, 75 bp, Artificial Sequence
  Synthetic
atggctataagtataatagccaatgtagtatctatagtaggtgttatttatataatatacaaactgttttgcaca

SEQ ID NO: 289909 - DNA, 75 bp, Artificial Sequence
  Synthetic
gctttggcaggaaatgtaacagctggatacaacttgacacatcctggtgaagggggcagaaccgttgatcaaaca

SEQ ID NO: 289910 - DNA, 75 bp, Artificial Sequence
  Synthetic
ttaaaactggatctgggttgttcccacttggatctcccaaagggagtggtactctgttattacggtaactttgta

SEQ ID NO: 289911 - DNA, 75 bp, Artificial Sequence
  Synthetic
cgccagttttatcctccccttaccccatgtaacttagaagtttttcataaagaccaatagttggtaatcatccag

SEQ ID NO: 289912 - DNA, 75 bp, Artificial Sequence
  Synthetic
agaccaatagttggtaatcatccagattacttaaggtcaagcacttctgtttccccggtcaatgttgatatgctc

SEQ ID NO: 289913 - DNA, 75 bp, Artificial Sequence
  Synthetic
ttaaacataactgctgtattgtaacaactgataaaggcaaatttacaggtcttggtatatatgatcaagtcatgg

SEQ ID NO: 289914 - DNA, 75 bp, Artificial Sequence
  Synthetic
accttagaagcaataattctgctacaatcatagtaccttatgtaaatgcagtacctatggactctatgctcagac

SEQ ID NO: 289915 - DNA, 75 bp, Artificial Sequence
  Synthetic
gttggaaattacagttgtaaagttagttagaaatgagaaattcaaggatattagaaaatatttaccctcgcgtga

SEQ ID NO: 289916 - DNA, 75 bp, Artificial Sequence
  Synthetic
tgaattctctggagctcgtgcaagaagtcagggactgccagtcatgataacacctgggtcagggcaatttttgac

SEQ ID NO: 289917 - DNA, 75 bp, Artificial Sequence
  Synthetic
agcggcaccaacaccgcacgaatgatcaagtaccattatccaacgaaagctggatattgtgggggtgtcttgtac

SEQ ID NO: 289918 - DNA, 75 bp, Artificial Sequence
  Synthetic
tagtcgtaatgagcaattgcgggatgggaccgactactttgggtgtccgtgtttcactttttttttacttataat

SEQ ID NO: 289919 - DNA, 75 bp, Artificial Sequence
  Synthetic
gtagacacattgattccaatagatagtgtagaggccaatgccaagaatacaagtatgtatacagttactttgagt

SEQ ID NO: 289920 - DNA, 75 bp, Artificial Sequence
  Synthetic
tcactaaagaactacctgtatctgttaagaatttgccatccatacatgtttcatccaagactcgcttacaaccca

SEQ ID NO: 289921 - DNA, 75 bp, Artificial Sequence
  Synthetic
cccattggacaggtagtatccgctttagtttcctcttctgcggtactgcaaatactactctaaaattattactgg

SEQ ID NO: 289922 - DNA, 75 bp, Artificial Sequence
  Synthetic
atataaaggcaatcctacttgtgaagtgaccccacacatgaaaattgctgtagcacactatgcagcacaattatc

SEQ ID NO: 289923 - DNA, 75 bp, Artificial Sequence
  Synthetic
ggttgtcccctgggttagtgctagtcattacaggaacactacaccggataaatattctttagcaggatttgtaac

SEQ ID NO: 289924 - DNA, 75 bp, Artificial Sequence
  Synthetic
tatgtttcattaggaataaaaaagaaagaccttatagataagaaaacaaaagatatcacaaaacttaagaaagca

SEQ ID NO: 289925 - DNA, 75 bp, Artificial Sequence
  Synthetic
gcacgggacacaaacctacatttgcaaagtggccctatcacacaaaatccagtggaaaattatatagatgaagtc

SEQ ID NO: 289926 - DNA, 75 bp, Artificial Sequence
  Synthetic
ctaatagtgtaaatgatactgtgctatttagaagtgtatatggaaatctcttttctacttttcacaagaacccag

SEQ ID NO: 289927 - DNA, 75 bp, Artificial Sequence
  Synthetic
atgtccagccagaagatgtggtagagaccagatacgtgcaaacatcacaaacaagagatgaaatgagtgttgaaa

SEQ ID NO: 289928 - DNA, 75 bp, Artificial Sequence
  Synthetic
cactccatggtgatgtgaatgttggttataaatatactcacccaggagaagcagggagagaagttaaaagtgaca

SEQ ID NO: 289929 - DNA, 75 bp, Artificial Sequence
  Synthetic
aaattatgatggtagtttacatccagtttggtttaagtgcttgagcatgcttttggaagatatagggttttcttc

SEQ ID NO: 289930 - DNA, 75 bp, Artificial Sequence
  Synthetic
agagatggcacagattagaagaaaatttgaattgtttacatatgctagatttgattctgaaattacaatagtacc

SEQ ID NO: 289931 - DNA, 75 bp, Artificial Sequence
  Synthetic
tttaacacaataatcaataatattattattagaactttagtactagatgcttataagaacatagatttagacaaa

SEQ ID NO: 289932 - DNA, 75 bp, Artificial Sequence
  Synthetic
tggcaatcaggcactaatgcatctatcttttggcaacatggacaaacataccctagattttcacttcctttctta

SEQ ID NO: 289933 - DNA, 75 bp, Artificial Sequence
  Synthetic
cactcccttggtaccacccaaccaaggaaatatctatcccaggtgaggtaaaaaacctagttgaaatatgtcaag

SEQ ID NO: 289934 - DNA, 75 bp, Artificial Sequence
  Synthetic
tcacccctgctgataagtctgatgtttttcaggagttgacttataagaatgtaacttttcttaaaagaggattta

SEQ ID NO: 289935 - DNA, 75 bp, Artificial Sequence
  Synthetic
gttatagaatagttacagatgaacatgcccacaaaatagagatcactacaagaatataccataaagcaaaacaca

SEQ ID NO: 289936 - DNA, 75 bp, Artificial Sequence
  Synthetic
tatacatcctacctttcctgttgtagaaattcatgactccatcaggtggaccaaaaacccttcatgtatgcaaga

SEQ ID NO: 289937 - DNA, 75 bp, Artificial Sequence
  Synthetic
gcccaggaaaacaatcacaacagcaggacccagtgacatgtatgtacatgttgggaaccttatatacagaaattt

SEQ ID NO: 289938 - DNA, 75 bp, Artificial Sequence
  Synthetic
acctggatctcctattgggagttgtactctattattccggtaattttgtacgccagttttatctccccttcccca

SEQ ID NO: 289939 - DNA, 75 bp, Artificial Sequence
  Synthetic
acatgtgattgtacagaagcaacttattactgcaaacataagaatagatattaccctattagagtgaccagtcat

SEQ ID NO: 289940 - DNA, 75 bp, Artificial Sequence
  Synthetic
atctacagctgggtatgtaacatgctggtatcaaaccagattagtaattccacctcaaaccccacccacagctag

SEQ ID NO: 289941 - DNA, 75 bp, Artificial Sequence
  Synthetic
aattgttatgtaagcatggagtcattggcataataacagctggtggtgagggacatgtggcttttattgacctta

SEQ ID NO: 289942 - DNA, 75 bp, Artificial Sequence
  Synthetic
tgggccaatagagcaaaaccctgttgaacaatatatagatgaggtccttaatgaggttttagttgttccaaatat

SEQ ID NO: 289943 - DNA, 75 bp, Artificial Sequence
  Synthetic
aaatgcaataaacccaataaacaacataagcaaaaagataatcaaatggttgcttagaataatatcagcaatggt

SEQ ID NO: 289944 - DNA, 75 bp, Artificial Sequence
  Synthetic
tatatattgacaccatgggcacccaggtatctagacagaatgttggaactcactccacacaaaattcagtatcca

SEQ ID NO: 289945 - DNA, 75 bp, Artificial Sequence
  Synthetic
tgtaaatggacccagttaaattatgttcacaaggagtcagattcttggcttaagaaatttaccgaaatgtgtaat

SEQ ID NO: 289946 - DNA, 75 bp, Artificial Sequence
  Synthetic
agacccagttaaagatgtacttgaaaaaggtatccccactctgcaatctccaaccgttgaggcatgcggttattc

SEQ ID NO: 289947 - DNA, 75 bp, Artificial Sequence
  Synthetic
cagaacttaaaaaattaaattttctggaaaaacaaattgaacacttgagagttgcagactcaaaaacacaagaaa

SEQ ID NO: 289948 - DNA, 75 bp, Artificial Sequence
  Synthetic
agtctggcactaatgcatctattttctggcaacatggacaagcatacccaagattttctctaccctttctgagcg

SEQ ID NO: 289949 - DNA, 75 bp, Artificial Sequence
  Synthetic
agtgacagagaaacacattcataatatgcacattatgacaagaatctatcacaaagctaaacatgtcaaagcgtg

SEQ ID NO: 289950 - DNA, 75 bp, Artificial Sequence
  Synthetic
ccacaagatgctactgcaattgacaaaccatctagaccagacacttcctcaaataggttttacacactagagagt

SEQ ID NO: 289951 - DNA, 75 bp, Artificial Sequence
  Synthetic
taatgtgatcattaaacaaaagaaaagatgtgagccagtagccgttgtaattcatggtgagcctggcactgggaa

SEQ ID NO: 289952 - DNA, 75 bp, Artificial Sequence
  Synthetic
attattacaacagctggccctagtgatatgtatgtccatgttggtaatcttatttatagaaatctacatctcttc

SEQ ID NO: 289953 - DNA, 75 bp, Artificial Sequence
  Synthetic
gtaggagtgggtacacagtgcatgttcagtgcaatgcaagtaaatttcatcaaggtactctgattgttgtaatga

SEQ ID NO: 289954 - DNA, 75 bp, Artificial Sequence
  Synthetic
agtgtagtcataatggatgacatcatgcaaaacccaagtggtgaagatatgacactcttttgccaaatggtctca

SEQ ID NO: 289955 - DNA, 75 bp, Artificial Sequence
  Synthetic
gatgattatattccctcttgtgattgcacccaggctacatattattgtaaacataaaagtagatatttcccaata

SEQ ID NO: 289956 - DNA, 75 bp, Artificial Sequence
  Synthetic
agtggaggatttgttgaagcaacctagtgatgatagctggcttaactttgatggtactctattggggaacataac

SEQ ID NO: 289957 - DNA, 75 bp, Artificial Sequence
  Synthetic
cacctacaatcacgtccttgccagcaatgaatagaagattctttctagacttagatattgtagtgaatgacaaat

SEQ ID NO: 289958 - DNA, 75 bp, Artificial Sequence
  Synthetic
gtgattgtggtgggaaattattatgtaaacatggtgttattggcatagtaacagctggtggtgacaatcatgtgg

SEQ ID NO: 289959 - DNA, 75 bp, Artificial Sequence
  Synthetic
aataactggagtttggttataatacccatatgccccttagaatctgatggtcagactccagtgcctattactatt

SEQ ID NO: 289960 - DNA, 75 bp, Artificial Sequence
  Synthetic
taaggcagtaatgtttaaagacaggaatacttgcaaatcatacacattagcacaagtgtacaatacaatacttga

SEQ ID NO: 289961 - DNA, 75 bp, Artificial Sequence
  Synthetic
taaggcagtaatgtttaaagacaggaatacttgcatatcatacacattagcacaagtgtacaatacaatacttga

SEQ ID NO: 289962 - DNA, 75 bp, Artificial Sequence
  Synthetic
taaggcagtaatgtttaaagacaggaatacttgcacatcatacacattagcacaagtgtacaatacaatacttga

SEQ ID NO: 289963 - DNA, 75 bp, Artificial Sequence
  Synthetic
taaggcagtaatgtttaaagacaggaatacttgcagatcatacacattagcacaagtgtacaatacaatacttga

SEQ ID NO: 289964 - DNA, 75 bp, Artificial Sequence
  Synthetic
atgattttcaatctccgagtgccttaccgtggtttcaccccaccaaagaaatctcaatcccagggcaagtcacaa

SEQ ID NO: 289965 - DNA, 75 bp, Artificial Sequence
  Synthetic
cttaaatctgttaggacacctgaagtcatcaaatattgtgaaggtaacaaatggatagttccagctgaatgtaaa

SEQ ID NO: 289966 - DNA, 75 bp, Artificial Sequence
  Synthetic
atgttctggttcaccatggagatttttaaaagagaaattttgtaaatggacacaacttaattatatacacaaaga

SEQ ID NO: 289967 - DNA, 75 bp, Artificial Sequence
  Synthetic
agaagtaaatattaccccagccaaagaaatttttgccattaaggttgatattgcttcgcaacctcttgcaaccac

SEQ ID NO: 289968 - DNA, 75 bp, Artificial Sequence
  Synthetic
cattacaaggaccttactcaggggaacctgtaaagaagaccaaaattcctgaaagaagagttgttgcccaaggtc

SEQ ID NO: 289969 - DNA, 75 bp, Artificial Sequence
  Synthetic
tcaatgcttccacaagcacaactcaaggttaagtacttaaatgaacttaaaaaattgagcctgtatgaaaagcaa

SEQ ID NO: 289970 - DNA, 75 bp, Artificial Sequence
  Synthetic
gtagcatacacaccccctggaattaaaaaacctgaaaataggaaagatgcaatgttaggaacccatgtcgtatgg

SEQ ID NO: 289971 - DNA, 75 bp, Artificial Sequence
  Synthetic
tattgtcccaacacatgctgatcctggtaaggaaatacagattgatggcattagtacaaaggttgaagactcata

SEQ ID NO: 289972 - DNA, 75 bp, Artificial Sequence
  Synthetic
caagtgaagcaaagagaataaagacactacacatcaagtgtgataacattatcaaacaaaagaaaagatgtgagc

SEQ ID NO: 289973 - DNA, 75 bp, Artificial Sequence
  Synthetic
taacatgttggtaccaaacaaatttggttgtcccacccaacactcctactagtgctaagatgttgtgttttgtgt

SEQ ID NO: 289974 - DNA, 75 bp, Artificial Sequence
  Synthetic
gaagatgattacccagattgtaaccttgctctatctgccaatcaacctgaaactaccataattaatgttggagac

SEQ ID NO: 289975 - DNA, 75 bp, Artificial Sequence
  Synthetic
agtcctaaatgaagtcttagtagtgccaaatatcagagagagtcatggaacaacatcaaactctgctcccgcact

SEQ ID NO: 289976 - DNA, 75 bp, Artificial Sequence
  Synthetic
acaaaattggccaagtccttggaatccacgtagggggcaatggtagagatggttttgcagcaatgttactgagat

SEQ ID NO: 289977 - DNA, 75 bp, Artificial Sequence
  Synthetic
gaaagttttctgggcagatcagggtgcattcacatgtcaaaattagtagttaactatgataattacaatactgga

SEQ ID NO: 289978 - DNA, 75 bp, Artificial Sequence
  Synthetic
cagtgtattctatgatgtgtttccaggtagtaaagaaccagcagtcctctctgatcatgatcccaggttagaagt

SEQ ID NO: 289979 - DNA, 75 bp, Artificial Sequence
  Synthetic
ctttggtgccgtcaattgcagctagagcgggtgacataggacatgttgtaatgcaatatatgtatgtcccaccag

SEQ ID NO: 289980 - DNA, 75 bp, Artificial Sequence
  Synthetic
caacataatgcttgaagaagacaaacgcaggagacaagtggttgacgttatgtcagccattttccagggaccaat

SEQ ID NO: 289981 - DNA, 75 bp, Artificial Sequence
  Synthetic
atgacattagatattgatccaaaacccatctctatagaggatagtgtctttggtatagagggccttgaggcatta

SEQ ID NO: 289982 - DNA, 75 bp, Artificial Sequence
  Synthetic
acccttccttagtatagcatcagcatactacatgttttatgatggttatgatggtgaccagactgactcacaata

SEQ ID NO: 289983 - DNA, 75 bp, Artificial Sequence
  Synthetic
caatggataagtatggtgttgatttgccaatggttacctttctgaaagatgaacttagaaagaaggaaaagatat

SEQ ID NO: 289984 - DNA, 75 bp, Artificial Sequence
  Synthetic
gcaaagcatgttaaagcttggtgccccagaccaccgagggccgttgaatacacacatacacacgtaaccaattac

SEQ ID NO: 289985 - DNA, 75 bp, Artificial Sequence
  Synthetic
aggagttgtaacaggttctgctgtagggtgtgatcctgagacattttggtcaaaaatacctgtgatgttagatgg

SEQ ID NO: 289986 - DNA, 75 bp, Artificial Sequence
  Synthetic
atttggaatgtctttgattaagcacaattcatgtgtgattacaacagataatggaaagtttacaggtcttggaat

SEQ ID NO: 289987 - DNA, 75 bp, Artificial Sequence
  Synthetic
atagaaatttgcacctcttcaattcagaaatgcatgactctatcctaatatcttattcatctgacttagtcatct

SEQ ID NO: 289988 - DNA, 75 bp, Artificial Sequence
  Synthetic
tcaaatttaatagatagattatgtagatccaaacatatctttaaaaacatgtattatgaagttgagggtggtgta

SEQ ID NO: 289989 - DNA, 75 bp, Artificial Sequence
  Synthetic
aataaagatggaataaagttggaaataacagtcttaaaattagataggaatgaaaaatttagagacatcagaaaa

SEQ ID NO: 289990 - DNA, 75 bp, Artificial Sequence
  Synthetic
taacagtcttaaaattagataggaatgaaaaatttagagacatcagaaaatacataccaaataatgaagatgact

SEQ ID NO: 289991 - DNA, 75 bp, Artificial Sequence
  Synthetic
caccagtcatgattggtacgagatccaagaaagtgagtattaccccaagcatattcaatacaacttattaatagg

SEQ ID NO: 289992 - DNA, 75 bp, Artificial Sequence
  Synthetic
aacttaagataatagcttatggtgatgatgtcattttctcatacaagtaccagcttgacatggaagcaattgcca

SEQ ID NO: 289993 - DNA, 75 bp, Artificial Sequence
  Synthetic
ccagacagctagaatgctcaagtacaactatccaacaaaatctgggtactgtgggggtgttctgtataaaattgg

SEQ ID NO: 289994 - DNA, 75 bp, Artificial Sequence
  Synthetic
atcgatcttagacacttccactgtgctgaagagcaaggaataactgattacattcatatgttaggtgaagcattt

SEQ ID NO: 289995 - DNA, 75 bp, Artificial Sequence
  Synthetic
taggcaagatgagaaacactccttcctaatacatccaatttttccaattgaagaaatacatgagtccatacgatg

SEQ ID NO: 289996 - DNA, 75 bp, Artificial Sequence
  Synthetic
tcaaagaagactagtgagtgtaatctccccagtatacatagcccatccaaaacaaaattgcagcccagtgttttc

SEQ ID NO: 289997 - DNA, 75 bp, Artificial Sequence
  Synthetic
aagaaatacatgagtccatacgatggacaaagaaaccatctcagatgcaagagcatgttttatcactatgtcact

SEQ ID NO: 289998 - DNA, 75 bp, Artificial Sequence
  Synthetic
cagcaatggtcataatcataagaaactcatctgatccccaaactataatagcaacactaactttaattggctgtt

SEQ ID NO: 289999 - DNA, 75 bp, Artificial Sequence
  Synthetic
ttaaaactggatccagattgttcccatctggatttcccacgtggagttgtacactattattccggtaattttgta

SEQ ID NO: 290000 - DNA, 75 bp, Artificial Sequence
  Synthetic
gatgtgtaatgcagctagggggttggagtggataggaaacaaaatttctaaattcattgactggatgaaatcaat

SEQ ID NO: 290001 - DNA, 75 bp, Artificial Sequence
  Synthetic
ctagtgcaggattcccttacatcacaatgggtataaagaagagagatctaataaataacaagaccaaggatataa

SEQ ID NO: 290002 - DNA, 75 bp, Artificial Sequence
  Synthetic
ctaaaggtcaagcacttctgtttccccggtcaaagttgatatgctccaacagggcaaaaacaactgagatcgtta

SEQ ID NO: 290003 - DNA, 75 bp, Artificial Sequence
  Synthetic
cccgcaaggtgcctacgcaaagcctagtaaccccttgaacgatgtgtggttggtcgttcggctgtaccccacagt

SEQ ID NO: 290004 - DNA, 75 bp, Artificial Sequence
  Synthetic
acacaagaaaaaattaaatgtgaaatagatacactacatgacctctcttgtaaattcttgccattgtatgctagt

SEQ ID NO: 290005 - DNA, 75 bp, Artificial Sequence
  Synthetic
ggtgtgaagagccccgtgtgctcaccttgagtcctccggcccctgaatgtggctaaccttaaccctgcagctagt

SEQ ID NO: 290006 - DNA, 75 bp, Artificial Sequence
  Synthetic
gaacaggaaaatcaatgacaactaatttccttgcaagaatgataaccaatgatagtgatatttactcattacctc

SEQ ID NO: 290007 - DNA, 75 bp, Artificial Sequence
  Synthetic
atggcctttgattacacaaattatgatggtagtatacaccccatttggtttgaagctcttaaacaagtattgatg

SEQ ID NO: 290008 - DNA, 75 bp, Artificial Sequence
  Synthetic
acccaaacctcccaagcggagtggtactctgttatttcggtaactttgtacgccagttttatattccctcccccc

SEQ ID NO: 290009 - DNA, 75 bp, Artificial Sequence
  Synthetic
tggtgacaatatatagatttatatattgtcaccatgggcgctcaagtatccagacagaatgttggtactcactca

SEQ ID NO: 290010 - DNA, 75 bp, Artificial Sequence
  Synthetic
aatggtttcaagtgttactttcatacccccaatggctgatttaccagataaaggaaaaccttttgattctagatt

SEQ ID NO: 290011 - DNA, 75 bp, Artificial Sequence
  Synthetic
gctcaggtactagtatttttaatacaatgattaataatattattataagaactttagtgttagatgcttataaaa

SEQ ID NO: 290012 - DNA, 75 bp, Artificial Sequence
  Synthetic
aattgcttatggtgatgatgttatattttcatatacatatgaattagacatggaagctatagcaatggagggtac

SEQ ID NO: 290013 - DNA, 75 bp, Artificial Sequence
  Synthetic
aagaccctagtaaatttacagaccctgttaaagatgtccttgagaaaggaattccaacattacaatctccaactg

SEQ ID NO: 290014 - DNA, 75 bp, Artificial Sequence
  Synthetic
tgtgataaatataaggatgcacaaggaaaactcaatgtatctgcagcctttaaaccctgtgatgttgacacaaaa

SEQ ID NO: 290015 - DNA, 75 bp, Artificial Sequence
  Synthetic
agtagacctggcagatgaggctagaaataccccactggtgacagtgttctagcctgcgtggctgcctgcacaccc

SEQ ID NO: 290016 - DNA, 75 bp, Artificial Sequence
  Synthetic
gtggcctcactatttaagtgcaacggatgccactgctattgacaaacctactcagcctgacacttcttcaaatag

SEQ ID NO: 290017 - DNA, 75 bp, Artificial Sequence
  Synthetic
aaattcttgaagaggacaaaagacgtagacaggtgattgatgtcatgtctgcaatcttccagggacctatttcct

SEQ ID NO: 290018 - DNA, 75 bp, Artificial Sequence
  Synthetic
gcgctggtcgtgcattgtatatccctccatataacttgcttttgcatgagtggtacgaaaaattttaaactgata

SEQ ID NO: 290019 - DNA, 75 bp, Artificial Sequence
  Synthetic
atgttttatcactatcttggcaggagtggatacacagtacatgtccaatgcaatgctagcaaatttcatcagggg

SEQ ID NO: 290020 - DNA, 75 bp, Artificial Sequence
  Synthetic
tgagtgtaaagtagaaagagatttgaatatagctaacacaattataacaattatagcaaacattatcagtatatc

SEQ ID NO: 290021 - DNA, 75 bp, Artificial Sequence
  Synthetic
tattggcaccatgggcgctcaggtatctagacagaatgttggtacacactcaacacagaactcagtatcaaatgg

SEQ ID NO: 290022 - DNA, 75 bp, Artificial Sequence
  Synthetic
actctgtcattccggtgactttgtacgccagtttttacaccccccccttcttgtaacttagaagaattaagttca

SEQ ID NO: 290023 - DNA, 75 bp, Artificial Sequence
  Synthetic
ttgtaacttagaagaattaagttcagaccaataggaaaacgacaaaccagtcgtttaaggtcaagcacttctgtt

SEQ ID NO: 290024 - DNA, 75 bp, Artificial Sequence
  Synthetic
ggactgttggagatcgtcgtgaccaccatgacaaacaacctagtgatgacaattggttgaattttgatggtactt

SEQ ID NO: 290025 - DNA, 75 bp, Artificial Sequence
  Synthetic
gctcaagggccagaggaagagtttggtagatcacttataaaacacaactcatgtgtagtgacaacacaaaatggc

SEQ ID NO: 290026 - DNA, 75 bp, Artificial Sequence
  Synthetic
ccagttaaagatgttctggaaaaaggcataccaactcttcaatcacccacggttgaagcatgcgggtattcagat

SEQ ID NO: 290027 - DNA, 75 bp, Artificial Sequence
  Synthetic
ttcaatgcttaggcacaataattggagtttagtaataattcctattagtcctttaaagtcagaccctagtgctag

SEQ ID NO: 290028 - DNA, 75 bp, Artificial Sequence
  Synthetic
ccagcctgcgtggctgcctgcacacccatacgggtgtgaagccaaatattggacaaggtgtgaagagccccgtgt

SEQ ID NO: 290029 - DNA, 75 bp, Artificial Sequence
  Synthetic
aagactcatatgatctatttaacaaagatggtgtaaaattagaaattactgtattgaaattaaagagaaatgaaa

SEQ ID NO: 290030 - DNA, 75 bp, Artificial Sequence
  Synthetic
aagatgcaactgctatagataagccctcacaccctgatacttcagctaacagattttacactttggaaagtaagt

SEQ ID NO: 290031 - DNA, 75 bp, Artificial Sequence
  Synthetic
gccattgcttgcattccagcaagtctatggtcgtaatgagcaattgtgggatgggaccgactactttgggtgtcc

SEQ ID NO: 290032 - DNA, 75 bp, Artificial Sequence
  Synthetic
gttacacctggttctggtcaatttatgacaactgatgatctgcaatcaccatccgcattaccgtggtatcatcca

SEQ ID NO: 290033 - DNA, 75 bp, Artificial Sequence
  Synthetic
tgtaggggatgtcatatcatatggtaatattttacttagtggaactcagacagctagaatgcttaagtataacta

SEQ ID NO: 290034 - DNA, 75 bp, Artificial Sequence
  Synthetic
aaacggatacacagtacatgtgcaatgtaattctagcaaattccatcaaggaacattaatagttgccatgatacc

SEQ ID NO: 290035 - DNA, 75 bp, Artificial Sequence
  Synthetic
cactcaacacaaaactcagtgtctaatggttcaagtctgaacttctttaacattaattattttaaggatgcagca

SEQ ID NO: 290036 - DNA, 75 bp, Artificial Sequence
  Synthetic
aagtaaatatgtatacaatacaattggcaaaccaaactaatatggctgaagaaatctttgcaattaaggtggaca

SEQ ID NO: 290037 - DNA, 75 bp, Artificial Sequence
  Synthetic
ttgttaagatcttacttctctgagacacaaggtcaaataatcaattcaaaacccacggataaatgtggcttacca

SEQ ID NO: 290038 - DNA, 75 bp, Artificial Sequence
  Synthetic
gaacacaccagtagacaacccagtgatgataattggttaaattttgatggtacattattaggaaacataacaatt

SEQ ID NO: 290039 - DNA, 75 bp, Artificial Sequence
  Synthetic
ctacagtggaagcttgtggatattctgataggattattcaaattacaagaggagattctacaattacctcacagg

SEQ ID NO: 290040 - DNA, 75 bp, Artificial Sequence
  Synthetic
tgcaaatactacccttaaattgttattagcatatacaccaccaggcataaagaaaccaacaaacaggaagcaggc

SEQ ID NO: 290041 - DNA, 75 bp, Artificial Sequence
  Synthetic
gattagaagttgattttgaaaaagctcttttctctaaatataaagggaatgaacactgtgttatgaatgatcata

SEQ ID NO: 290042 - DNA, 75 bp, Artificial Sequence
  Synthetic
actggagcttagttattatacctatttgtccattggaagtctcaggaaatgaggtaaacacagtgccaataacta

SEQ ID NO: 290043 - DNA, 75 bp, Artificial Sequence
  Synthetic
aaacagattctacacattagagagcaagacatgggcatcaaattcaaaaggctggtggtggaaattacctgatgc

SEQ ID NO: 290044 - DNA, 75 bp, Artificial Sequence
  Synthetic
gatacatattcagcagctggatacataacatgctggtatcaaaccaactttgtgttcccaccaaacacaccgagc

SEQ ID NO: 290045 - DNA, 75 bp, Artificial Sequence
  Synthetic
ggaagcacttgatttgaacactagcgcaggttttccttatgtcaccatgggtattaagaaaagggatttgattaa

SEQ ID NO: 290046 - DNA, 75 bp, Artificial Sequence
  Synthetic
tgatgattttcaatcgccaagtgcattaccatggtttcacccaacaaaagaaatatctattccaggacaggttag

SEQ ID NO: 290047 - DNA, 75 bp, Artificial Sequence
  Synthetic
cagggtacactaatagttgctgctataccagaacatcagttggctagtgctcataagggtaatgtcactacagga

SEQ ID NO: 290048 - DNA, 75 bp, Artificial Sequence
  Synthetic
atccagttgaaaattacattgataatgtacttaatgaagtcctagtggtacccaacatcagagaaagtcatccaa

SEQ ID NO: 290049 - DNA, 75 bp, Artificial Sequence
  Synthetic
gaaaaaatttctgctggaaagacccgtgttatcgaggctagcagtgtaaatgatactgttttgttcagaacaaca

SEQ ID NO: 290050 - DNA, 75 bp, Artificial Sequence
  Synthetic
aagcctgatttgatgcaggaagtatttgccataaaggtagatatagcttcacaaccacttgcaactacaatgatt

SEQ ID NO: 290051 - DNA, 75 bp, Artificial Sequence
  Synthetic
atggaactttattaggaaacataacaatatttccccaccaattcatcaatttaagaagcaacaactctgcaactt

SEQ ID NO: 290052 - DNA, 75 bp, Artificial Sequence
  Synthetic
ccagacgagagatgaaatgagtattgaaagttttcttggcaggtcaggttgtatacacacctcaacaataactgt

SEQ ID NO: 290053 - DNA, 75 bp, Artificial Sequence
  Synthetic
tgctagatggggattgcataatggcatttgattacacaaattatgatggtagtatacacccaatctggttccaag

SEQ ID NO: 290054 - DNA, 75 bp, Artificial Sequence
  Synthetic
acacccccccaggtattgataaaccaagaagtagaaaagatgctatgctggggactcatgttgtttgggatgttg

SEQ ID NO: 290055 - DNA, 75 bp, Artificial Sequence
  Synthetic
tgtggatactactgtacccataactatatccatcagtcccatgtatgccgagttttctggagctcgtgcaagaag

SEQ ID NO: 290056 - DNA, 75 bp, Artificial Sequence
  Synthetic
gttagatttgactcagaagtcactttagtaccttgcatcgcaggcaagggcgatgacataggtcacatagttatg

SEQ ID NO: 290057 - DNA, 75 bp, Artificial Sequence
  Synthetic
agggggtgtgccatcagggtgttctgggactagtatttttaatacaatgattaacaatgttataattagaacatt

SEQ ID NO: 290058 - DNA, 75 bp, Artificial Sequence
  Synthetic
ctggtaccaaaccaatttggttgtccctccaaacacacctgtgacagcaagaatgttgtgttttgtttctggatg

SEQ ID NO: 290059 - DNA, 75 bp, Artificial Sequence
  Synthetic
gagatctttatcccagggcaagtgcagaatttatcagaattatgtcaagttgacactataatcccaattaacaac

SEQ ID NO: 290060 - DNA, 75 bp, Artificial Sequence
  Synthetic
aacctttccctagattttctttacccttcttaagcattgcatctgcttactacatgttctatgatggttatgatg

SEQ ID NO: 290061 - DNA, 75 bp, Artificial Sequence
  Synthetic
gcaattgcaaatgaaggtactaaatatggattaacaataacgcctgcagacaaatccacatgttttaaacaactt

SEQ ID NO: 290062 - DNA, 75 bp, Artificial Sequence
  Synthetic
aatgaagtgttagttgttccaaatattagagaaagccattcaagtacttcaaactcagcaccagcactggatgca

SEQ ID NO: 290063 - DNA, 75 bp, Artificial Sequence
  Synthetic
aacctttggcaacaacaatgattggagaaatgtctagctatttcacacattggacaggcagtctacgctttagtt

SEQ ID NO: 290064 - DNA, 75 bp, Artificial Sequence
  Synthetic
taccaccagtgtttatcacaaagccaagcatgtcaaagcatggtgtccaagaccacccagagctgtaccatatac

SEQ ID NO: 290065 - DNA, 75 bp, Artificial Sequence
  Synthetic
ttcttggaagatcaggatgcatccatatctcacatctaaaaattgattatacaaactataatgttgaagggaaga

SEQ ID NO: 290066 - DNA, 75 bp, Artificial Sequence
  Synthetic
ccattcgatggactaaaaatccatctcagatgcaggagcatgttctgtcactgtgccatctaatgtggcataatg

SEQ ID NO: 290067 - DNA, 75 bp, Artificial Sequence
  Synthetic
aactcatgtagtgtgggatgttggccttcagtctactatttcaatgattgtaccatgggttagtgccagtcatta

SEQ ID NO: 290068 - DNA, 75 bp, Artificial Sequence
  Synthetic
atgtatgtccatgttggtaatttaatttatagaaacttacaccttttcaattcagaaatgcatgattcaattcta

SEQ ID NO: 290069 - DNA, 75 bp, Artificial Sequence
  Synthetic
tccatgcattgctgctaaaagtgacaacattggccatgttgttatgcaatacatgtatgtccccccaggagcacc

SEQ ID NO: 290070 - DNA, 75 bp, Artificial Sequence
  Synthetic
atgttgtgctttgtctcaggatgtaaggatttttgtttacgcatggccagagacacaaatttacataaacaaata

SEQ ID NO: 290071 - DNA, 75 bp, Artificial Sequence
  Synthetic
ataaagacaggtactaccccatcaaagttactagtcacgactggtatgagattcaggaaagtgaatattacccca

SEQ ID NO: 290072 - DNA, 75 bp, Artificial Sequence
  Synthetic
cttagcatagcatctgcttattacatgttttatgatggatatgatggagactctactgaatcacattatggtaca

SEQ ID NO: 290073 - DNA, 75 bp, Artificial Sequence
  Synthetic
agtcacctaagatcaagcacttctgtttccccggtgagtgtggatatgctttacccaaggcagaaactaatctca

SEQ ID NO: 290074 - DNA, 75 bp, Artificial Sequence
  Synthetic
atgcagcgccagctttagatgcagctgagaccggacacaccagtaatgtacagcctgaagatatgattgaaacgc

SEQ ID NO: 290075 - DNA, 75 bp, Artificial Sequence
  Synthetic
tgctggtggagaggggcatgtggcatttatagatctcaggcaatttcattgtgcggatgaacaaggaataactga

SEQ ID NO: 290076 - DNA, 75 bp, Artificial Sequence
  Synthetic
atgtgaaggcatggtgtcctagaccccctagagcagttgaatatactcacacacatgtcacaaattacaaaccac

SEQ ID NO: 290077 - DNA, 75 bp, Artificial Sequence
  Synthetic
tgggtataatgatgaaggtaacaattttaacaaatggcagatcaccttgaaagaaatggctcagataagaaggaa

SEQ ID NO: 290078 - DNA, 75 bp, Artificial Sequence
  Synthetic
ataataaaatggcttcttagaattatatctgcaatggtaataattattagaaattcatctgatccacagacaatt

SEQ ID NO: 290079 - DNA, 75 bp, Artificial Sequence
  Synthetic
tttgcatttattcaattcagaggccaatgattcagttttgatctcctactcatcagatttagtcatataccgaac

SEQ ID NO: 290080 - DNA, 75 bp, Artificial Sequence
  Synthetic
atgtatgtccctcctggagctccaataccaaccaaaagaaatgattacgtctggcagtcaggcaccaatgcatcc

SEQ ID NO: 290081 - DNA, 75 bp, Artificial Sequence
  Synthetic
ctgactcatggctcaaaaaattcacggaaatgtgtaatgcagctagaggtttggagtggatcgggaataaaatat

SEQ ID NO: 290082 - DNA, 75 bp, Artificial Sequence
  Synthetic
aatggctcaagtttaaattattttaacatcaattattttaaagatgcagcatcgagtggagcatcaagattagat

SEQ ID NO: 290083 - DNA, 75 bp, Artificial Sequence
  Synthetic
catgactggtatgaaatacaagaaagtgaatactacccaaaacatatacaatacaatctactaattggtgagggc

SEQ ID NO: 290084 - DNA, 75 bp, Artificial Sequence
  Synthetic
taccaaccaaaagaaatgattacgtctggcagtcaggcaccaatgcatccatcttttggcaacacggtcaaccat

SEQ ID NO: 290085 - DNA, 75 bp, Artificial Sequence
  Synthetic
gacaaatgatatgggcactttgtgttctagaattgtgactgaggaacacacaacacaggtcaacatcactactag

SEQ ID NO: 290086 - DNA, 75 bp, Artificial Sequence
  Synthetic
ggaacacctcagagttgctgattcaaaaacccaagagaagattaaacatgaggtggatactcttcatgacctttc

SEQ ID NO: 290087 - DNA, 75 bp, Artificial Sequence
  Synthetic
cagacagaataatacaaataacaagagggaactcaacaataacatcacaagatgtagcaaatgcagttgttgggt

SEQ ID NO: 290088 - DNA, 75 bp, Artificial Sequence
  Synthetic
ttagacactttcattgtgcagaagaacaaggcataacagactacatacatatgttgggggaagcatttggtaatg

SEQ ID NO: 290089 - DNA, 75 bp, Artificial Sequence
  Synthetic
ggagaatacacaccacccgttccgtcacgtaacagccccagagatattgtcacagtaggacctagtgatatgtat

SEQ ID NO: 290090 - DNA, 75 bp, Artificial Sequence
  Synthetic
gtagcagttgtgatacatggtgaacccgggactggtaaatcaatgaccacaaactttctagctaggatgataaca

SEQ ID NO: 290091 - DNA, 75 bp, Artificial Sequence
  Synthetic
taaagagtggaaaaatgattctaagggatggtggtggaaactaccagatgctctcaaaaatatgggaatttttgg

SEQ ID NO: 290092 - DNA, 75 bp, Artificial Sequence
  Synthetic
ggttataataataaggaactgttctgatcctcaaactataattgcaacactaacattgattgggtgctctggttc

SEQ ID NO: 290093 - DNA, 75 bp, Artificial Sequence
  Synthetic
cacgtaacagccccagagatattgtcacagtaggacctagtgatatgtatgtgcatgttggaaatttgatatata

SEQ ID NO: 290094 - DNA, 75 bp, Artificial Sequence
  Synthetic
gtggagaagacatgaccttgttttgccaaatggtatcaagtgttacattcataccacccatggcagatctgccag

SEQ ID NO: 290095 - DNA, 75 bp, Artificial Sequence
  Synthetic
tattccaatgtgtgattgtacagatgccacttactattgcaaacacaaaaacagatattacccaattaaagtaac

SEQ ID NO: 290096 - DNA, 75 bp, Artificial Sequence
  Synthetic
attccagaacaccagttggcatatatagggtcagaaaatgtcagtgtgggatataaacatacacaccctggggaa

SEQ ID NO: 290097 - DNA, 75 bp, Artificial Sequence
  Synthetic
aatgcagctagaggtctagaatggataggcaacaagatatctaaatttatagactggatgaaatccatgctacca

SEQ ID NO: 290098 - DNA, 75 bp, Artificial Sequence
  Synthetic
atttttctttgatctagatatcatagtgtgtgaaaagtacaaagacccacaaggcaaattaaatgtgactgctgc

SEQ ID NO: 290099 - DNA, 75 bp, Artificial Sequence
  Synthetic
ggtggaaaattactgtgcaagcatggagtaatagggattattacagctggaggtgagggacatgtggcatttata

SEQ ID NO: 290100 - DNA, 75 bp, Artificial Sequence
  Synthetic
tctacccacaccaatttatcaatctgaggagtaacaactcagctactttaattctaccttatgtaaatgctgttc

SEQ ID NO: 290101 - DNA, 75 bp, Artificial Sequence
  Synthetic
aaaagataaagcttgaaattgacactctacacgatttatcatgtaagttccttcctttgtatgctagtgaggcca

SEQ ID NO: 290102 - DNA, 75 bp, Artificial Sequence
  Synthetic
acttacacactagcacaagtgtacaatcgaatacttgatgaagataagcggcgtagacaggtgatcgatgtcatg

SEQ ID NO: 290103 - DNA, 75 bp, Artificial Sequence
  Synthetic
aacaagtcaatgctattaacccaataaacaacatcagcaaaaaattaattaaatggttacttagaatagtttctg

SEQ ID NO: 290104 - DNA, 75 bp, Artificial Sequence
  Synthetic
aataagccccatggcctcagaattttcaggtgctcggaacacagccagaccacaaggtctaccagttatgctcac

SEQ ID NO: 290105 - DNA, 75 bp, Artificial Sequence
  Synthetic
caaatcaattacaactagttttcttgctcgaatgataacaaatgaaagtgatatatactcactaccaccagatcc

SEQ ID NO: 290106 - DNA, 75 bp, Artificial Sequence
  Synthetic
gtgaaggtaacaaatggatcataccagcggaatgtaaggttgagagggatcttaatatagcaaacaccatcatca

SEQ ID NO: 290107 - DNA, 75 bp, Artificial Sequence
  Synthetic
gaaattttgcaagtggacgcaattaaattatgttcataaggaatcagattcatggctcaagaaatttacagaaat

SEQ ID NO: 290108 - DNA, 75 bp, Artificial Sequence
  Synthetic
actaacttatcagagatttgccaagtggactcaatgattccaattaacaacacagtggcaggccacaaaaaggtg

SEQ ID NO: 290109 - DNA, 75 bp, Artificial Sequence
  Synthetic
tccagtgttactttcatccctcctatggctgatttgcccgataaaggtaaaccatttgactctagatttgtgttt

SEQ ID NO: 290110 - DNA, 75 bp, Artificial Sequence
  Synthetic
aaccaagataccagaaagaagagtggtggctcagggtccagaagaggagtttggaagatcactcattaagcacaa

SEQ ID NO: 290111 - DNA, 75 bp, Artificial Sequence
  Synthetic
tatcttagtgaacttaagaaactaaacttgttagagaagcaaattgaaaatttacgcggtgcagatacaaagact

SEQ ID NO: 290112 - DNA, 75 bp, Artificial Sequence
  Synthetic
ttggagaaatagctagttattatacacactggacaggatctataagattctctttcatgttttgtggtacagcca

SEQ ID NO: 290113 - DNA, 75 bp, Artificial Sequence
  Synthetic
actatagagacaatcagggaaagttatatgtgccaaaatcttttaaaccatgtgacatagataacaaaattggca

SEQ ID NO: 290114 - DNA, 75 bp, Artificial Sequence
  Synthetic
caaatagatggtattacaaccaaggtggaagattcttttgacctgtacaacaaggatggggttaaactagagatt

SEQ ID NO: 290115 - DNA, 75 bp, Artificial Sequence
  Synthetic
ataagtgtaataatgttattaagcaaaagaaaaggagtgaaccagttgctgttatgatacacggcccacctggaa

SEQ ID NO: 290116 - DNA, 75 bp, Artificial Sequence
  Synthetic
tggattacagtccactgtgtcaatggtagtcccttgggtctctgcaagtcactatagacttaccacacctgatac

SEQ ID NO: 290117 - DNA, 75 bp, Artificial Sequence
  Synthetic
agaagaagacaagcgccgcagaaatgtaatagatgtgatgacagctatatttcaagggccaatctccatgaataa

SEQ ID NO: 290118 - DNA, 75 bp, Artificial Sequence
  Synthetic
aaagaaaaggagtgaaccagttgctgttatgatacacggcccacctggaactgggaagtcaataactactagttt

SEQ ID NO: 290119 - DNA, 75 bp, Artificial Sequence
  Synthetic
ctaatcaaccagaaactactataatcaatgtaggggatgtggtatcctatggaaatattctccttagtggcactc

SEQ ID NO: 290120 - DNA, 75 bp, Artificial Sequence
  Synthetic
tgcaaggatttctgtttgaggatggccagagacacaaacttacactctcaaactgttaatattacacaaaatcca

SEQ ID NO: 290121 - DNA, 75 bp, Artificial Sequence
  Synthetic
aaaatagagagagacttaaatctcgccaacaacataataacaatcatagcaaacattatcagtattgcaggtatt

SEQ ID NO: 290122 - DNA, 75 bp, Artificial Sequence
  Synthetic
ccaatggctgacttgccagataaaggtaaaccatttgattctagatttgttttctgtagcaccaatcactcacta

SEQ ID NO: 290123 - DNA, 75 bp, Artificial Sequence
  Synthetic
taatgggagggatggattcgctgccatgctattgagatcttacttttctgaaacacagggtgaaataataatttc

SEQ ID NO: 290124 - DNA, 75 bp, Artificial Sequence
  Synthetic
ctgctgagactggtcacaccaatcagacacaaccagaagacacagtagaaactaggtatgtcatcacagatcaaa

SEQ ID NO: 290125 - DNA, 75 bp, Artificial Sequence
  Synthetic
ggccggaagaagaatttggtaggtctttaattaaacacaatacttgtgtagttactactgaaaatggaaaattca

SEQ ID NO: 290126 - DNA, 75 bp, Artificial Sequence
  Synthetic
agctagatgtaccaaaatcattcaaaccatgtgatgtggataataaaattggaaatgctaaatgttgtccattta

SEQ ID NO: 290127 - DNA, 75 bp, Artificial Sequence
  Synthetic
ccagctgtcctctcaagtaacgatcctagattagaggttgattttaataaagctttgttttctaagtataaagga

SEQ ID NO: 290128 - DNA, 75 bp, Artificial Sequence
  Synthetic
gaataaaaattttactacatggaagattaccctaaaagagatggcacaaatcagaagaaagtgtgaattatttac

SEQ ID NO: 290129 - DNA, 75 bp, Artificial Sequence
  Synthetic
ctatgatttacataacaaagatggcattaaacttgaaattactgttattaaattggataggaatgagaagtttag

SEQ ID NO: 290130 - DNA, 75 bp, Artificial Sequence
  Synthetic
aaatgtggtggatgtcatgacagcaatatttcaaggtccaatatcaatgagtgcaccaccaccacctgctatcgc

SEQ ID NO: 290131 - DNA, 75 bp, Artificial Sequence
  Synthetic
aggacagtgtctttggaacagaaggcttggaagctcttgatcttaacactagtgcaggatttccatacgtgtcga

SEQ ID NO: 290132 - DNA, 75 bp, Artificial Sequence
  Synthetic
gatgtggtctcatatggaaacatactgctaagtggtaaccaaactgccagaatgctcaaatataactatccaact

SEQ ID NO: 290133 - DNA, 75 bp, Artificial Sequence
  Synthetic
gcttcaatacatgtttgtcccaccaggggctccagtccctaagaaaagagatgattatacatggcaatctggcac

SEQ ID NO: 290134 - DNA, 75 bp, Artificial Sequence
  Synthetic
ttggcaaataatataacaactataatagctaatgtgattagtatagcaggtattatatttgtcatctacaaattg

SEQ ID NO: 290135 - DNA, 75 bp, Artificial Sequence
  Synthetic
ctttcttaaagatgagcttaggaaaagagagaaaatcaccgccggaaagacccgcgtgattgaagctagtagtgt

SEQ ID NO: 290136 - DNA, 75 bp, Artificial Sequence
  Synthetic
gatcatactttagtgaaactcaaggacaattaacaacaacaaagaaagtccaggattgtggttatccaactatac

SEQ ID NO: 290137 - DNA, 75 bp, Artificial Sequence
  Synthetic
gctccctgattaaacacaatacatgtgtggtcactacagaaaatggtaagtttacaggtttgggaatttatgaca

SEQ ID NO: 290138 - DNA, 75 bp, Artificial Sequence
  Synthetic
gaaacattctggtcaaaaatacctgttatgctagatggagaatgtataatggcatttgattacacaaattatgat

SEQ ID NO: 290139 - DNA, 75 bp, Artificial Sequence
  Synthetic
atcagcgtgtacacaataccaactttgttccagaaacagggcaagtagaaatacaaatacctacaagaacagatc

SEQ ID NO: 290140 - DNA, 75 bp, Artificial Sequence
  Synthetic
aacagactttagaacagctttattctccaagtacaagggaaacaacacatgccagatgaatgatcacattagagt

SEQ ID NO: 290141 - DNA, 75 bp, Artificial Sequence
  Synthetic
tggtgttaaactagagataacagttgttaagttagataggaatgagaaatttagggatatacgcaaatacatccc

SEQ ID NO: 290142 - DNA, 75 bp, Artificial Sequence
  Synthetic
tcttcaagaatatgtattatgaagtggaaggtggagttccatcaggttgttctggaaccagtatatttaatacaa

SEQ ID NO: 290143 - DNA, 75 bp, Artificial Sequence
  Synthetic
aatttgttattccagtgatttagtcatataccgagcaaatactaaaggtgatgattatattccagtgtgtaactg

SEQ ID NO: 290144 - DNA, 75 bp, Artificial Sequence
  Synthetic
ttagatctaaacaccagcgctgggtttccatatattagcatgggaattaagaagagagatctaataaataacagc

SEQ ID NO: 290145 - DNA, 75 bp, Artificial Sequence
  Synthetic
atacttcttagtggcaaccaaacagctagaatgctcaaatataattatcctacaaaatcagggtattgtggtggg

SEQ ID NO: 290146 - DNA, 75 bp, Artificial Sequence
  Synthetic
ttcttacaaatatcaacttgacatggaagcaattgccaaggagggtaccaagtatggattaacaataacaccagc

SEQ ID NO: 290147 - DNA, 75 bp, Artificial Sequence
  Synthetic
aaacacatacaatacaatatattaattggagaaggaccatgcactcctggagactgtgaagggaaactactatgt

SEQ ID NO: 290148 - DNA, 75 bp, Artificial Sequence
  Synthetic
tctcagctgggaaaacaagagtgattgaagcaagcagtataaatgatactgtaacattcagaatggtatatggaa

SEQ ID NO: 290149 - DNA, 75 bp, Artificial Sequence
  Synthetic
aaggtcagattacaaaaagaacaaatgttaatgagtgtggcttaccaaccatacatacacctagcaaaactaaat

SEQ ID NO: 290150 - DNA, 75 bp, Artificial Sequence
  Synthetic
acatttccagttgaagaaattcaagagtctattcgatggacaaagaaaccatcccaaatgcaggaacatgtcctg

SEQ ID NO: 290151 - DNA, 75 bp, Artificial Sequence
  Synthetic
attacatacacacacttggagaggcgtttggtgcaggttttgtagataatattaaggatcagatacaggctataa

SEQ ID NO: 290152 - DNA, 75 bp, Artificial Sequence
  Synthetic
tggggactgcataatggcttttgattacacaaattatgatggaagcatacacccagtgtggtttgaagcacttaa

SEQ ID NO: 290153 - DNA, 75 bp, Artificial Sequence
  Synthetic
attctctaaatacaaaggaaacttaccatgtgagatgaatgatcatgttaaagttgctgttgcacactattctgc

SEQ ID NO: 290154 - DNA, 75 bp, Artificial Sequence
  Synthetic
gctggtcgtgcactgtacattcctccttacgatttgctgctgcatgagtggtatgaaaagttttaaattgtttag

SEQ ID NO: 290155 - DNA, 75 bp, Artificial Sequence
  Synthetic
tattgcaactctagctttaattggttgttctggctcaccgtggagattcattaaagagaaagtgtgtaattggtt

SEQ ID NO: 290156 - DNA, 75 bp, Artificial Sequence
  Synthetic
gtaccatcaggttgttctggaaccagcatatttaatacaatgattaataatgtaattataagaaccctagtttta

SEQ ID NO: 290157 - DNA, 75 bp, Artificial Sequence
  Synthetic
gggttcccttacataagcatgggaatcaaaaagagagaccttatcaataacagcaccaaagacatatccaaactt

SEQ ID NO: 290158 - DNA, 75 bp, Artificial Sequence
  Synthetic
tcaaaatttatcgactggctcaagtcaatgctaccacaagctaaactcaaagttgacttcattgggaaactcaaa

SEQ ID NO: 290159 - DNA, 75 bp, Artificial Sequence
  Synthetic
cagctgagggactcaaatatggacttacaatcacacctgcagataagtcagattgttttaagaaacttgactata

SEQ ID NO: 290160 - DNA, 75 bp, Artificial Sequence
  Synthetic
tcgttatccccacactgcctacacagagcctagtaccacttttgatgtaattaggttggtcgctccctgcaaacc

SEQ ID NO: 290161 - DNA, 75 bp, Artificial Sequence
  Synthetic
ttattgaagctagtagtgtcaatgatacagtagcatttaggatggtgtatggcaacttatttgcagctttccata

SEQ ID NO: 290162 - DNA, 75 bp, Artificial Sequence
  Synthetic
ctaataaatttctgcctctatacgcacttgagaacaaaagaatcaaagaacttcttaagagaagtgaaatgatcc

SEQ ID NO: 290163 - DNA, 75 bp, Artificial Sequence
  Synthetic
atggacgaagaaaccctcacaaatgcaagaacacgttttatcactgtgtcaccttatgtggcataatgggaaaga

SEQ ID NO: 290164 - DNA, 75 bp, Artificial Sequence
  Synthetic
atacgcagtgtaagcgctggacgtgcactgtatattcctccctacgagctccttcagcatgagtggtatgagaaa

SEQ ID NO: 290165 - DNA, 75 bp, Artificial Sequence
  Synthetic
tgattacacaaattatgatggaagtattcacccaatgtggtttgaagccctcaaaatgatactacacaatttaga

SEQ ID NO: 290166 - DNA, 75 bp, Artificial Sequence
  Synthetic
tgcattttatggtgacaatttatagtatatagattgtcgtcatgggtgcacaagtgtctagacaaaatgttggta

SEQ ID NO: 290167 - DNA, 75 bp, Artificial Sequence
  Synthetic
atactgttattacggtaactttatacgacggttttatctcccccccccccttatgtaacttagaagttttgcaca

SEQ ID NO: 290168 - DNA, 75 bp, Artificial Sequence
  Synthetic
accagcatatttaacacaatgattaataatataattataaggactttagtcttagatgcatataaacatatagac

SEQ ID NO: 290169 - DNA, 75 bp, Artificial Sequence
  Synthetic
gattgttttaggtcaagcactactgtttcccccggtcaacgttgatatgctccgacagggcaaaaacaacagcga

SEQ ID NO: 290170 - DNA, 75 bp, Artificial Sequence
  Synthetic
gacaaagggaaacctttctcttcagattatgtactagctagtacaaatcatactttactacatcccccaactata

SEQ ID NO: 290171 - DNA, 75 bp, Artificial Sequence
  Synthetic
tttctcccaagatcctagtaaatttactgatcctgtcaaagatgtactggaaaaaggtattccaacactccaatc

SEQ ID NO: 290172 - DNA, 75 bp, Artificial Sequence
  Synthetic
gcttaaccattacaccagcagacaaatctgagacttttagacaacttgattacagcaatgtcacatttttaaaaa

SEQ ID NO: 290173 - DNA, 75 bp, Artificial Sequence
  Synthetic
ctggacattccccactggtgacagtggtccagcctgcgtggctgcctgcacacctctatgaggtgtgaagccaga

SEQ ID NO: 290174 - DNA, 75 bp, Artificial Sequence
  Synthetic
cattgaaaccatgccaggatggtaaaatagggaatgcaaaatgttgtcctctgatatgtgggaaggctgtagtgt

SEQ ID NO: 290175 - DNA, 75 bp, Artificial Sequence
  Synthetic
aatgcaggatcatgtgctctcattgtgccatttaatgtggcataatggacaggatgtctacaaagaatttgaacg

SEQ ID NO: 290176 - DNA, 75 bp, Artificial Sequence
  Synthetic
gatgtatggtcgtaatgagtaattgtgggatgggaccgactactttgggtgtccgtgtttcctgttttttctttt

SEQ ID NO: 290177 - DNA, 75 bp, Artificial Sequence
  Synthetic
ggcaattttccaaggcccaattgatgtagttaataaaccacctccacctgccatattggatcttcttaaatcagt

SEQ ID NO: 290178 - DNA, 75 bp, Artificial Sequence
  Synthetic
gtgagaacatgttttatcactttctaggaagatctggatacacaatacatgtgcaatgtaattccagcaaatttc

SEQ ID NO: 290179 - DNA, 75 bp, Artificial Sequence
  Synthetic
cgcgcgctgtatattcctccgtacgagttactgctgcatgagtggtatgagaaattctaatctgtatatatagaa

SEQ ID NO: 290180 - DNA, 75 bp, Artificial Sequence
  Synthetic
caaatggatcaagtctaaattatttcaacatcaattattttaaagatgctgcctctagcggagcttccaagctag

SEQ ID NO: 290181 - DNA, 75 bp, Artificial Sequence
  Synthetic
actctattattccggtaattttgtatgccagttttatctccccttcccttttgtaacttagaagatgaactcacc

SEQ ID NO: 290182 - DNA, 75 bp, Artificial Sequence
  Synthetic
tctatgattgctaatgttatcagtataatgggggttatatatattatatataaactattttgctcattacaggga

SEQ ID NO: 290183 - DNA, 75 bp, Artificial Sequence
  Synthetic
acaaggtagagaagtggtgccatcacgaaactccgaagacaacaaaagacctagtgatgatagttggctaaattt

SEQ ID NO: 290184 - DNA, 75 bp, Artificial Sequence
  Synthetic
ctctgatagaattattcagataaccagaggagactcaactatcacatcccaagatgttgcaaatgcagtggtcgc

SEQ ID NO: 290185 - DNA, 75 bp, Artificial Sequence
  Synthetic
gttatccgcaaagcaactacgcaaagcctagtatcacttttgagagtatgtggttggtcgctccactataaaccc

SEQ ID NO: 290186 - DNA, 75 bp, Artificial Sequence
  Synthetic
atagctgtatagtcaccacatgtaatggaaaattcacagggctagggatatatgataatgtcatgattataccta

SEQ ID NO: 290187 - DNA, 75 bp, Artificial Sequence
  Synthetic
gtgccaatggactctatgcttagacataataattggagtttggtcataattccaatatgccctttgcaggtccag

SEQ ID NO: 290188 - DNA, 75 bp, Artificial Sequence
  Synthetic
agcaaaacctgggactcatcatcaaaaggttggtggtggaaactaccagatgcattgaaagacatgggcatattt

SEQ ID NO: 290189 - DNA, 75 bp, Artificial Sequence
  Synthetic
aacagttcttaaactcaaaagaaatgagaaattcagagacattaggaaatacattccagaaacagaagatgacta

SEQ ID NO: 290190 - DNA, 75 bp, Artificial Sequence
  Synthetic
gtgcttgctttgagtcctccggcccctgaatgtggctaaccttaaccctgcagctagtgtgcataatccaatgca

SEQ ID NO: 290191 - DNA, 75 bp, Artificial Sequence
  Synthetic
gtttaccagtcatgctgacacctggatctggacaatttttaacaactgatgacacacaatccccatcagcattcc

SEQ ID NO: 290192 - DNA, 75 bp, Artificial Sequence
  Synthetic
tgatcccagaacatcagttagctagtgcaagacatggaaatcttaccgctggttacaacttcacacacccaggtg

SEQ ID NO: 290193 - DNA, 75 bp, Artificial Sequence
  Synthetic
caaactgcaagaatgatcaaatacaattacccaactaaatcagggtattgtgggggtattttatacaaaataggt

SEQ ID NO: 290194 - DNA, 75 bp, Artificial Sequence
  Synthetic
tacatatatattggcatcatgggcgcccaggtatccagacagaacgttggcacacactccacacagaactcggtt

SEQ ID NO: 290195 - DNA, 75 bp, Artificial Sequence
  Synthetic
ggaaaatgtaaaatctgtgaatatgtacactgttgatttacgcacgcaaactgaattagcaaaagaagttttttc

SEQ ID NO: 290196 - DNA, 75 bp, Artificial Sequence
  Synthetic
tacaatattccctcatcaatttattaatctgagaagcaataattcagctacaataattgtcccctatgtgaatgc

SEQ ID NO: 290197 - DNA, 75 bp, Artificial Sequence
  Synthetic
agaaggatgttaaggaaatcaatttatatagcatacacacacctagtaagacaaaattacaacctagtgtttttc

SEQ ID NO: 290198 - DNA, 75 bp, Artificial Sequence
  Synthetic
ttacagatccagttaaagatgtactggaaaaaggcatccctactttgcaatctccaacagtcgaggcatgtggat

SEQ ID NO: 290199 - DNA, 75 bp, Artificial Sequence
  Synthetic
atgttctgtggttctgccagctccaccttaaagctgttgattgcatatactcctcctggtgttggaaaacccaaa

SEQ ID NO: 290200 - DNA, 75 bp, Artificial Sequence
  Synthetic
ataaccatatccataagcccaatgtttgcagaattttcaggagcaagagcaagaagccagggtattccaaccatg

SEQ ID NO: 290201 - DNA, 75 bp, Artificial Sequence
  Synthetic
taacaagaatgtagaactgactgacaacatgatcacagctgctgctcactacgcagcacaattagccaccttaga

SEQ ID NO: 290202 - DNA, 75 bp, Artificial Sequence
  Synthetic
aacatctcaagatgctacagccatagataaaccctcccgtccagacacctcctcaaatagattctatactttaga

SEQ ID NO: 290203 - DNA, 75 bp, Artificial Sequence
  Synthetic
gattcaccacacctgacacgtattcctcagctggttacattacatgctggtatcaaaccaacttcgtagttcctg

SEQ ID NO: 290204 - DNA, 75 bp, Artificial Sequence
  Synthetic
aagttagaaatctgattgaattgtgtgaggttgataccctcataccaataaacaacacttcagagaatctaaaaa

SEQ ID NO: 290205 - DNA, 75 bp, Artificial Sequence
  Synthetic
catgggattaggaagaaagatttaataccaaaagacaggaatcttacaaaacttaaatgtgctatggagcccttt

SEQ ID NO: 290206 - DNA, 75 bp, Artificial Sequence
  Synthetic
cttggtaggagtggctatacagtgcatgttcaatgtaatgctagcaagtttcaccaaggcaccttaatagttgca

SEQ ID NO: 290207 - DNA, 75 bp, Artificial Sequence
  Synthetic
ggtgcttacacaaaatccagttgaaaattacatagataatgtattaaatgaagtacttgtagtgccaaacatcca

SEQ ID NO: 290208 - DNA, 75 bp, Artificial Sequence
  Synthetic
attaataggagaaattgctagttactacacacactggaccggtagtcttcggtttagtttcatgttttgtggatc

SEQ ID NO: 290209 - DNA, 75 bp, Artificial Sequence
  Synthetic
atgatactgtgcagtttagaatggcttttgggaatcttttttcaacttttcataagaatccagggaccattaccg

SEQ ID NO: 290210 - DNA, 75 bp, Artificial Sequence
  Synthetic
cagaccgccaagatattacaaagcaacctagtgatgacagctggcttaattttgatggtacattattgggtaaca

SEQ ID NO: 290211 - DNA, 75 bp, Artificial Sequence
  Synthetic
tatgtcataactgatcaaacaagagatgagacaagtattgaaagcttcttaggtaggtcagggtgcatagctatg

SEQ ID NO: 290212 - DNA, 75 bp, Artificial Sequence
  Synthetic
gatgtgggattacagtcaactatttcaatgattgtgccatgggttagcgctagccattttagaaacacaacccca

SEQ ID NO: 290213 - DNA, 75 bp, Artificial Sequence
  Synthetic
cagtcttcatccgatttggtttgaattacttaaaaagattctagatgaactaggattcccagggagtatggttag

SEQ ID NO: 290214 - DNA, 75 bp, Artificial Sequence
  Synthetic
acataacaattggagtttagttatcataccaatatgcccattagaatcagatctaaacacacctgtgcctatcac

SEQ ID NO: 290215 - DNA, 75 bp, Artificial Sequence
  Synthetic
ggaaatatgaattgtttacatacacaagatttgactcagaaataacaatagtcaccgcagctgcagtgcagggag

SEQ ID NO: 290216 - DNA, 75 bp, Artificial Sequence
  Synthetic
gtcaccgcagctgcagtgcagggagatgatagtgggcatgtagtattacaattcatgtatgtacctccaggagcg

SEQ ID NO: 290217 - DNA, 75 bp, Artificial Sequence
  Synthetic
ctggctgtaaagatttttgcttaaggatggcgagggataccaacttacataaacaaagtggtgtcatagagcaaa

SEQ ID NO: 290218 - DNA, 75 bp, Artificial Sequence
  Synthetic
ataaacaatgttataatcagaactctagttttagacacatacaagcatataaatctagacaaattaaagatactg

SEQ ID NO: 290219 - DNA, 75 bp, Artificial Sequence
  Synthetic
acagatgattttcaatctcccagtgcactaccttggtttcaccctactaaagaaatctcaataccaggtcaagtg

SEQ ID NO: 290220 - DNA, 75 bp, Artificial Sequence
  Synthetic
ttatgagtattgcatcagcttattatatgttttatgatggttatgatggtgataatgccgcatcaaaatatggat

SEQ ID NO: 290221 - DNA, 75 bp, Artificial Sequence
  Synthetic
agatgcagctgaaactggccataccagccatgttcaaccagaagacatgttagaaacaaggcaagtacaaaattt

SEQ ID NO: 290222 - DNA, 75 bp, Artificial Sequence
  Synthetic
ataagtcagataagttccaaaaactcacctatgagaatgccacttttcttaagaggggttttaaaccagatgaaa

SEQ ID NO: 290223 - DNA, 75 bp, Artificial Sequence
  Synthetic
gagagaccaatttagcacaagagatatttgcaatcaaggttgacatagcatcacaccctcttgccaccactttga

SEQ ID NO: 290224 - DNA, 75 bp, Artificial Sequence
  Synthetic
acacataaaggcctggtgcccgcgtccaccaagggccgttccttaccaacacacacattccactaattatatacc

SEQ ID NO: 290225 - DNA, 75 bp, Artificial Sequence
  Synthetic
ggcaaaaacttcactcagtggccaatcaatctacaggaaatggctcaaattagaaggaaatatgaattatttaca

SEQ ID NO: 290226 - DNA, 75 bp, Artificial Sequence
  Synthetic
actgtgccatctattatggcatagtggaaaagataaatatgaccagttcgtggccaagattaggagtgttagcgc

SEQ ID NO: 290227 - DNA, 75 bp, Artificial Sequence
  Synthetic
ttacacaccacctggcataagcaaacccactagtaggaaagaagcaatgttgggtactcatgtggtttgggatgt

SEQ ID NO: 290228 - DNA, 75 bp, Artificial Sequence
  Synthetic
tggacgcgcactctatataccaccatatgaactcttgtgccacgagtggtatgataaattttaatcagatataga

SEQ ID NO: 290229 - DNA, 75 bp, Artificial Sequence
  Synthetic
aaccttcatctctttaactctgctcttgatgattccattcttgtgtcatactccagtgatctagtcatataccga

SEQ ID NO: 290230 - DNA, 75 bp, Artificial Sequence
  Synthetic
gagcaccaataccaacaactagaaaagattatgcatggcaatctggaacaaatgcatctgtattttggcaacatg

SEQ ID NO: 290231 - DNA, 75 bp, Artificial Sequence
  Synthetic
tgttggtatcaaaccaatttagtggtaccacctagcacgccaactactgccaagatgctgtgctttgtctcaggc

SEQ ID NO: 290232 - DNA, 75 bp, Artificial Sequence
  Synthetic
cacatgattggtatgaaattcaggagtcagagtattacccaaaacatatccagtataatctcttaattggagagg

SEQ ID NO: 290233 - DNA, 75 bp, Artificial Sequence
  Synthetic
tggcaccattgctagtaatcacatggggacactgtgttctagaatagttacagaagaacatcgaaataaagttga

SEQ ID NO: 290234 - DNA, 75 bp, Artificial Sequence
  Synthetic
taaatgaggttttagttgtacctaatataaaggagagccaagctaccacatcaaactcagcacctgctctagatg

SEQ ID NO: 290235 - DNA, 75 bp, Artificial Sequence
  Synthetic
cctcagaaaattccaatgtgctgaagaacaaggattgtctgattatgtggaacaccttggccaagtttttggtgt

SEQ ID NO: 290236 - DNA, 75 bp, Artificial Sequence
  Synthetic
aaaagagatggacaacaagttgagattgctattgagcccagaagagatgttaagtttgtaaatgcaggcccaact

SEQ ID NO: 290237 - DNA, 75 bp, Artificial Sequence
  Synthetic
actctattattccggtaatcttgtacgccagtttttacaccctccccccttgtaacttagaagaaagtacataac

SEQ ID NO: 290238 - DNA, 75 bp, Artificial Sequence
  Synthetic
cttcctaggtagatctggttgtattcacatgtccaagttaattgtgcagtatgaagactataatggaaagaaaaa

SEQ ID NO: 290239 - DNA, 75 bp, Artificial Sequence
  Synthetic
gaccaataggtggcaattaaccaaattgtcaacggtcaagcacttctgtttccccggtcaagattgatacgctcc

SEQ ID NO: 290240 - DNA, 75 bp, Artificial Sequence
  Synthetic
atgataataatggtgagaaacagttctgaccctcaaaccataattgctactcttaccctcctaggttgctcaggc

SEQ ID NO: 290241 - DNA, 75 bp, Artificial Sequence
  Synthetic
tcatttaccgaacaaacacaaaaggtgatgattatattccaacatgtgattgtacagaagccacatattattgca

SEQ ID NO: 290242 - DNA, 75 bp, Artificial Sequence
  Synthetic
ccttgtatagctgcaaaaggaaatgatattggtcatgttgtaatgcaatatatgtatgtcccaccaggtgctcca

SEQ ID NO: 290243 - DNA, 75 bp, Artificial Sequence
  Synthetic
gtaatgcagcacgtggattagaatggattggacagaaaatatctaaattcatagattggataaagagtatgttac

SEQ ID NO: 290244 - DNA, 75 bp, Artificial Sequence
  Synthetic
aataggggaaggtccatgtgagcctggtgactgtggtggaaaattgttgtgtaggcatggagtgataggtattgt

SEQ ID NO: 290245 - DNA, 75 bp, Artificial Sequence
  Synthetic
tgagtatagcctcagcatattacatgttttatgatggatatgatggagatcaaccaaactccagatatggtaata

SEQ ID NO: 290246 - DNA, 75 bp, Artificial Sequence
  Synthetic
ggaaaaaatatttactgagataaacactctccatgatctatccttgaaatttctaccactgtatgcatctgaagc

SEQ ID NO: 290247 - DNA, 75 bp, Artificial Sequence
  Synthetic
ttatggtgacaatatatatagtatatattgacaccatgggcgcgcaggtttctagacagaatgttgggacacact

SEQ ID NO: 290248 - DNA, 75 bp, Artificial Sequence
  Synthetic
gcttttggtaatggatttgtagaaagtgttaaagaacaagtcagtgcaataaatccaattaataacattagcaaa

SEQ ID NO: 290249 - DNA, 75 bp, Artificial Sequence
  Synthetic
tgtgaaggtgtggtgtccaagaccacctagagctgtagaatatactcacactcatgtaaccaattacaaaccaca

SEQ ID NO: 290250 - DNA, 75 bp, Artificial Sequence
  Synthetic
ggaaaatctcttgccacttcagttctcgctcggatgctaactgttgagactgatatatattctttacccccagat

SEQ ID NO: 290251 - DNA, 75 bp, Artificial Sequence
  Synthetic
acaagatccaagtaaatttactgatccagtcaaggatgtcctggaaaaaggaatccccacgctacaatcaccaac

SEQ ID NO: 290252 - DNA, 75 bp, Artificial Sequence
  Synthetic
gctgttcaggatcaccatggcgtttcctgaaggagaaattttgtaaatggacacaactcagttatatccataaag

SEQ ID NO: 290253 - DNA, 75 bp, Artificial Sequence
  Synthetic
ttacatcttttcaactcagacattcatgactctatactagtgtcatattcatcagatttagtcatataccgaaca

SEQ ID NO: 290254 - DNA, 75 bp, Artificial Sequence
  Synthetic
gtgtggccacattatctaacttcacgagatgccaccgctatagataagccttcacaaccagacacatcttccaat

SEQ ID NO: 290255 - DNA, 75 bp, Artificial Sequence
  Synthetic
gtccatgttacctcaagcccaacttaaagtgaaatacctttctgaacttcggaaactcaatcttctggaaaagca

SEQ ID NO: 290256 - DNA, 75 bp, Artificial Sequence
  Synthetic
atgattggtatgaaatccaagaaagtgagtactatccaaaacacatacaatacaacctattgataggtgagggac

SEQ ID NO: 290257 - DNA, 75 bp, Artificial Sequence
  Synthetic
aaaccattcacatccaaatttgtgcttgcaagtactaatcacaccatgttgacaccaccaacagtatcttcgcta

SEQ ID NO: 290258 - DNA, 75 bp, Artificial Sequence
  Synthetic
acatgtattaccatttccttggaaggagtggctatacagtccatgtgcagtgcaactctagtaaatttcatcagg

SEQ ID NO: 290259 - DNA, 75 bp, Artificial Sequence
  Synthetic
gtgatgttaacactaaaataggtaatgccaagtgctgcccattcatttgtggaaaagctgtggaatttaaagaca

SEQ ID NO: 290260 - DNA, 75 bp, Artificial Sequence
  Synthetic
gagacatttccattgtgctgaagaacaaggaatcaccgattatatacatatgcttggggaagcttttggtagtgg

SEQ ID NO: 290261 - DNA, 75 bp, Artificial Sequence
  Synthetic
gctagtgaagcaaagagaattaaagctttatacaataaatgtaataacataattaaacaaagaaagaggagtgag

SEQ ID NO: 290262 - DNA, 75 bp, Artificial Sequence
  Synthetic
gtcccaattatacaaccatattaaagaggaagataggagaagaagtagtgcagcacaagcaatggaggctatatt

SEQ ID NO: 290263 - DNA, 75 bp, Artificial Sequence
  Synthetic
cagggatgtcggtataactgttcgtgaacatccaaacaaacaacctagtgatgataactggcttaattttgatgg

SEQ ID NO: 290264 - DNA, 75 bp, Artificial Sequence
  Synthetic
tgccacctgaccctaagtattttgatgggtacgatcaacaaagtgtggttataatggatgatatcatgcaaaatc

SEQ ID NO: 290265 - DNA, 75 bp, Artificial Sequence
  Synthetic
gtggtaattattagaaattcatctgatcctcaaacaataatagccacactgaccttacttggttgttctggttca

SEQ ID NO: 290266 - DNA, 75 bp, Artificial Sequence
  Synthetic
tggattgtcccagcagagtgttctattgaaagagatttagggatagcaaatatgactataggtataatagctaat

SEQ ID NO: 290267 - DNA, 75 bp, Artificial Sequence
  Synthetic
atggattctatgcttagacacaataattggagtttagtgataatacccatttgtccattagaggttagtagtcct

SEQ ID NO: 290268 - DNA, 75 bp, Artificial Sequence
  Synthetic
taggtttgttttctgtagcacaaatcaaactctcttggcccctcctacaattacatctctgccagccatgaatag

SEQ ID NO: 290269 - DNA, 75 bp, Artificial Sequence
  Synthetic
atgcagctagaggtttagagtggattggcaataaaatatcaaagtttattgagtggatgaaatcgatgttaccac

SEQ ID NO: 290270 - DNA, 75 bp, Artificial Sequence
  Synthetic
aaagaagggtagtcactcagggcccagaagaagaatttggtcgttcactgctcaaacataactgttgtattgtga

SEQ ID NO: 290271 - DNA, 75 bp, Artificial Sequence
  Synthetic
ctgggtcaggacaatttatgaccacagatgatttccaatctccttgtgctttaccatggttccacccaactaaag

SEQ ID NO: 290272 - DNA, 75 bp, Artificial Sequence
  Synthetic
acaaaagtgggtaatgctcgttgttgcccatttatatgtggtaaagctgtaactttcaaagaccgcaacacatgt

SEQ ID NO: 290273 - DNA, 75 bp, Artificial Sequence
  Synthetic
gaaaattaaatgtgaaatagatactctacatgatctatcatgcaaatttcttccactgtatgccagtgaagccaa

SEQ ID NO: 290274 - DNA, 75 bp, Artificial Sequence
  Synthetic
aaaagttaaaatttctgactcttatgacttacataaccatgaaggtgtcaaactagagattacagttgtaaagct

SEQ ID NO: 290275 - DNA, 75 bp, Artificial Sequence
  Synthetic
tatgtatacagtagtattacaaagacaggatcaactaatgcaagaagtttttgctattagagttgatgtggcatc

SEQ ID NO: 290276 - DNA, 75 bp, Artificial Sequence
  Synthetic
taacactggatgcaccaccacctcctgctataacggatttattacggtctgttagaactccagaagtaattaaat

SEQ ID NO: 290277 - DNA, 75 bp, Artificial Sequence
  Synthetic
aaatccatgacaacaaactttttggcaagaatgataaccaatgatagtgatatttattcacttccacctgatccc

SEQ ID NO: 290278 - DNA, 75 bp, Artificial Sequence
  Synthetic
tgctttactagccaaccaggatgaaccaacaataataaatgttggagatgcagagtcttatggtaatatattatt

SEQ ID NO: 290279 - DNA, 75 bp, Artificial Sequence
  Synthetic
acaactctcaaacttttaatagcatacacaccaccaggtatagttaaacccagaaataggaaggaagcaatgcta

SEQ ID NO: 290280 - DNA, 75 bp, Artificial Sequence
  Synthetic
cattgcaggcatcatctgtgtgatatataaactgttttgttcattacagggcccatactctggggaacccaagcc

SEQ ID NO: 290281 - DNA, 75 bp, Artificial Sequence
  Synthetic
ctagtgttacatttattcctcccatggctgatcttccagataagggtaagccctttgattctaggtttgttttat

SEQ ID NO: 290282 - DNA, 75 bp, Artificial Sequence
  Synthetic
gattttctgcaatgcttcttaaatcttactttggtgaaactcaaggcttaattactaaagaactacctgtatctg

SEQ ID NO: 290283 - DNA, 75 bp, Artificial Sequence
  Synthetic
actcattagctgggtttataacatgttggtatcagaccaatcttgtagtccctccagacactccagccacagcca

SEQ ID NO: 290284 - DNA, 75 bp, Artificial Sequence
  Synthetic
aatggtaaatttacaggattgggcatatatgacaaagtaatgatcttgcccacacatgctgatcctggaaaacaa

SEQ ID NO: 290285 - DNA, 75 bp, Artificial Sequence
  Synthetic
atataaagatttacagggaaaacttaatgtgactgctgctttccaaccttgtgatgtcaatgtcaggattggtaa

SEQ ID NO: 290286 - DNA, 75 bp, Artificial Sequence
  Synthetic
gaacaaaggaacctgcagtcctaagtaataatgacccaagattagagactgactttgacacggcactcttctcaa

SEQ ID NO: 290287 - DNA, 75 bp, Artificial Sequence
  Synthetic
agaggaatacatagatggagtcttgaatgaggttcttgtggttccgaacattaaggaaagccactccagcacatc

SEQ ID NO: 290288 - DNA, 75 bp, Artificial Sequence
  Synthetic
atgaaaaatttagagatattagaaagtacataccagaaaaagaagatgattatccagaatgcaatctggcacttg

SEQ ID NO: 290289 - DNA, 75 bp, Artificial Sequence
  Synthetic
gatgaggacaaaaggcgcagacaagttgtggatgtcatgtctgcaatttttcaagggccaatctcactagaaaga

SEQ ID NO: 290290 - DNA, 75 bp, Artificial Sequence
  Synthetic
cctttcattagaggaaagtgtgtttggtattgaaggactagaggctttagacctgaatactagtgcagggtttcc

SEQ ID NO: 290291 - DNA, 75 bp, Artificial Sequence
  Synthetic
agagatgaaatgagtgtagaaagttttctaggaagatcaggttgtgtacatatatccaatcttgacatagattac

SEQ ID NO: 290292 - DNA, 75 bp, Artificial Sequence
  Synthetic
caattaccctactaaatcaggttattgtggtggtgttttatacaaaattggaaatatcctggggatccatgtggg

SEQ ID NO: 290293 - DNA, 75 bp, Artificial Sequence
  Synthetic
aaatagaaagagatttgaatatagctaacactataattacaattatagcaaatgtaattagcatttctggcatta

SEQ ID NO: 290294 - DNA, 75 bp, Artificial Sequence
  Synthetic
cccatggttaccttccttaaagatgagcttagaaagaaggagaaaataagggatggcaaaactagagtcatagaa

SEQ ID NO: 290295 - DNA, 75 bp, Artificial Sequence
  Synthetic
agcttagaaagaaggagaaaataagggatggcaaaactagagtcatagaagccaatagtgtgaatgacactgtac

SEQ ID NO: 290296 - DNA, 75 bp, Artificial Sequence
  Synthetic
gatttgattcagaagttacattagtcccatgtatagcagcacaaaatgaaggtgtggggcatgttgttatgcagt

SEQ ID NO: 290297 - DNA, 75 bp, Artificial Sequence
  Synthetic
tacccaaccattcacacacccagtaagacaaaattgcaaccaagtgttttctttgatgtctttgagggcacgaaa

SEQ ID NO: 290298 - DNA, 75 bp, Artificial Sequence
  Synthetic
gcctgaggaggaatttggaagatcattaatcaagcacaactcatgtgtggtgacaacacaaaatggaaaattcac

SEQ ID NO: 290299 - DNA, 75 bp, Artificial Sequence
  Synthetic
aaccatacctcttatgttagatggggaatgtctaatggcttttgattactcaaattatgatggtagtttacatcc

SEQ ID NO: 290300 - DNA, 75 bp, Artificial Sequence
  Synthetic
atatcctcgattttccttacctttcttaagcattgcatctgcctattatatgttttatgatggatatgatgggga

SEQ ID NO: 290301 - DNA, 75 bp, Artificial Sequence
  Synthetic
accacataaaagtggcaattgcccattattcagcccaactaatgactctagatatccaaacaagtagtgtctcac

SEQ ID NO: 290302 - DNA, 75 bp, Artificial Sequence
  Synthetic
tatgatttatataataaggatggtattaaattagagatcactgttctcaagctccagagaaatgaaaagttcaga

SEQ ID NO: 290303 - DNA, 75 bp, Artificial Sequence
  Synthetic
tattatgaagtggaaggaggcatgccatctggatgtgcaggtactagtattttcaacacaatgattaacaacatt

SEQ ID NO: 290304 - DNA, 75 bp, Artificial Sequence
  Synthetic
actagaatttatcataaggcaaaacatgtaaaagcctggtgtccaagacccccaagggcagttgaatatagacat

SEQ ID NO: 290305 - DNA, 75 bp, Artificial Sequence
  Synthetic
aattaacaacacaacaaaagatttaagtaaattaaaggctgcaatggataaatatggagttgatctacccatggt

SEQ ID NO: 290306 - DNA, 75 bp, Artificial Sequence
  Synthetic
atgttgtatcatatgggaatatcttgcttagtggcaatcaaacagctaggatgctcaaatacaattatccaacaa

SEQ ID NO: 290307 - DNA, 75 bp, Artificial Sequence
  Synthetic
aacttgatatgacagtccttgctaaggaaggagagaaatatggattgacaatcacccctgctgataaatctgata

SEQ ID NO: 290308 - DNA, 75 bp, Artificial Sequence
  Synthetic
tgtatgtgcatgtagggaatttaatctacagaaacttacatttatttaactcagaggttagtgattctgttttag

SEQ ID NO: 290309 - DNA, 75 bp, Artificial Sequence
  Synthetic
caaacctatggtaacctatttgcagcatttcacaaaaatcctggcattattactggttctgcagttgggtgtgac

SEQ ID NO: 290310 - DNA, 75 bp, Artificial Sequence
  Synthetic
atcctatttttctgaagcacaaggacaaatcaccacttctaaatcagtaactgaacttggtttacccagtatcca

SEQ ID NO: 290311 - DNA, 75 bp, Artificial Sequence
  Synthetic
agagatccatgactccatcagatggactaaaaacccttcatgcatgcaggaacacgtactatccttgtgccattt

SEQ ID NO: 290312 - DNA, 75 bp, Artificial Sequence
  Synthetic
taaaaatagatacttcccaataaaagttactagccatgattggtatgaaatacaagaaagtgaatattatccaaa

SEQ ID NO: 290313 - DNA, 75 bp, Artificial Sequence
  Synthetic
ttgaggctctaaagcaagtcttgaataatttatcctttgattccaaattaatagacagattatgtaattctaaac

SEQ ID NO: 290314 - DNA, 75 bp, Artificial Sequence
  Synthetic
gtgaattttaaggaagcactattttccaaatacaaggggaataatgattgtgtgatgaacgaccacattaaagtt

SEQ ID NO: 290315 - DNA, 75 bp, Artificial Sequence
  Synthetic
gcagtgtgtctgctggtcgggcactgtatataccagcttacgaagttcttgagcatgagtggtatgaaaaatttt

SEQ ID NO: 290316 - DNA, 75 bp, Artificial Sequence
  Synthetic
gctggtggtgagggtcatgtggcatttatagatctacgccacttccattgtgcagaagagcagggcatcacagac

SEQ ID NO: 290317 - DNA, 75 bp, Artificial Sequence
  Synthetic
aacattgatacttgatgcttacaaatacattgatctggacaaacttaaaataatagcatatggggatgatataat

SEQ ID NO: 290318 - DNA, 75 bp, Artificial Sequence
  Synthetic
ttgaccttaacactagtgcaggatacccttatgtaactatgggtattaagaagaaagatttgattgacaatcgta

SEQ ID NO: 290319 - DNA, 75 bp, Artificial Sequence
  Synthetic
tgctaaaggtcaagcacttctgtttccccggtcaagattgatacgctccaccagggcgaaaacaattgagatcgt

SEQ ID NO: 290320 - DNA, 75 bp, Artificial Sequence
  Synthetic
taatcaaatggatgctcagaattatatcagcaatggtaataataattagaaactcctctgatccacaaacgatca

SEQ ID NO: 290321 - DNA, 75 bp, Artificial Sequence
  Synthetic
aaattagattataataatgttactttccttaagagaggattcaaacaggatgcaaaatacccctttttagtgcac

SEQ ID NO: 290322 - DNA, 75 bp, Artificial Sequence
  Synthetic
ttctgctggaaaaacacgtgtcattgaggcaagtagtgtaaatgatactgtcctatttagatcaatctatggaaa

SEQ ID NO: 290323 - DNA, 75 bp, Artificial Sequence
  Synthetic
gctccccactggtgacagtgttctagcctgcgtggctgcctgcacacccttatgggtgtgaagccatatacttga

SEQ ID NO: 290324 - DNA, 75 bp, Artificial Sequence
  Synthetic
agattcatggctcaaaaaatttaccgaaatgtgcaatgcagctaggggtcttgaatggattggtaacaaaatttc

SEQ ID NO: 290325 - DNA, 75 bp, Artificial Sequence
  Synthetic
ataatggaccggaggtttataaggattttgagaataaaattcgcagtgtcagcgctggacgtgcactgtatatac

SEQ ID NO: 290326 - DNA, 75 bp, Artificial Sequence
  Synthetic
ggtgaatgtataatggcttttgattacactaattatgatggtagtatacacccaatttggtttgatgcacttaag

SEQ ID NO: 290327 - DNA, 75 bp, Artificial Sequence
  Synthetic
agcgctggacgtgcactgtatatacctccttatgacctccttttgcatgagtggtatgaaaaattttaaacatat

SEQ ID NO: 290328 - DNA, 75 bp, Artificial Sequence
  Synthetic
gacaatttacgctgtgcagattcaaaagttcaagagaagattaaattagagattgacacccttcatgatctatct

SEQ ID NO: 290329 - DNA, 75 bp, Artificial Sequence
  Synthetic
ttccatcagggtgttctggaacaagcatatttaacacaatgattaataatgtaataataagaacattagtattag

SEQ ID NO: 290330 - DNA, 75 bp, Artificial Sequence
  Synthetic
atccagcttgaattatttcaatataaattattttaaagatgctgcttcaagtggagcgtccaaattggaattctc

SEQ ID NO: 290331 - DNA, 75 bp, Artificial Sequence
  Synthetic
ttccccggtcaaagttgatatgctccacaagggcaaaaacaactgagatcgttatccgcaagatgcctacgcaaa

SEQ ID NO: 290332 - DNA, 75 bp, Artificial Sequence
  Synthetic
tcgccattatggtgcacggtccaccagggaccggtaagtccataacaactagtttccttgctagaatgataacta

SEQ ID NO: 290333 - DNA, 75 bp, Artificial Sequence
  Synthetic
gttatccgcaagatgcctacgcaaagcctagtaatacattgaaagatacttggttggtcgctcagctgttaaccc

SEQ ID NO: 290334 - DNA, 75 bp, Artificial Sequence
  Synthetic
taaagaaggtgtcaagtatggattgacaataacgcctgcagataagtccaatgttttcaagaaacttgattataa

SEQ ID NO: 290335 - DNA, 75 bp, Artificial Sequence
  Synthetic
aggattatacaaataactagaggagattcaacaataacatcacaagatgtggcaaatgccgttgtgggatatggt

SEQ ID NO: 290336 - DNA, 75 bp, Artificial Sequence
  Synthetic
cggtgaggacatgtcattgttttgtcaaatggtatccagtgttacattcataccgccaatggctgatctacctga

SEQ ID NO: 290337 - DNA, 75 bp, Artificial Sequence
  Synthetic
tggacaaagaaaccatcacaaatgcaggagcacgtcctatcactgtgtcatttaatgtggcataatggtagagat

SEQ ID NO: 290338 - DNA, 75 bp, Artificial Sequence
  Synthetic
tgtgggacgagacatcaaaaggctggtggtggaagttgcctgatgcactcaaagacatgggcatatttggtgaga

SEQ ID NO: 290339 - DNA, 75 bp, Artificial Sequence
  Synthetic
tacgcagcgtcagcgctggtcgtgcgctgtatatacctccttatgatttgctcctgcatgagtggtatgaaaaat

SEQ ID NO: 290340 - DNA, 75 bp, Artificial Sequence
  Synthetic
tttttcctggatctagacatcacagttcatgataactacaaggataatcaagggaaattgaatgttccaaaatca

SEQ ID NO: 290341 - DNA, 75 bp, Artificial Sequence
  Synthetic
tatatagcatatatatattgttatcatgggcgctcaagtatctagacagaatgttggtacgcactcaacacaaaa

SEQ ID NO: 290342 - DNA, 75 bp, Artificial Sequence
  Synthetic
agaacatcaattagccagcgcaagtcgtggcaatgtcactgcaggatataattatacacaccctggtgaacttgg

SEQ ID NO: 290343 - DNA, 75 bp, Artificial Sequence
  Synthetic
acactgttatcccggtaaccttgtacgccagttttatacacccttccctgtaacttagaagttataagcacgagg

SEQ ID NO: 290344 - DNA, 75 bp, Artificial Sequence
  Synthetic
cttactcactcagccagatttataacatgatcattgaagaggataaacggcggagaaatgtggtcgatgtcatgt

SEQ ID NO: 290345 - DNA, 75 bp, Artificial Sequence
  Synthetic
agtaaattcacagacccagttaaggatgtgttggagaaaggcatacccactctgcaatctccaagtgtagaagct

SEQ ID NO: 290346 - DNA, 75 bp, Artificial Sequence
  Synthetic
accaataggtagtgactttccaggtcactaaaggtcaagcacttctgtctccccggtcaaagttgatatgctctc

SEQ ID NO: 290347 - DNA, 75 bp, Artificial Sequence
  Synthetic
ttcccacaccaatttattaatttaagaagcaataattcagcaacaatcattgttccatatgtgaatgcagtgcca

SEQ ID NO: 290348 - DNA, 75 bp, Artificial Sequence
  Synthetic
ggtagacctggcagatgaggctagaaactccccactggcgacagtgttctagcctgcgtggctgcctgcgcactc

SEQ ID NO: 290349 - DNA, 75 bp, Artificial Sequence
  Synthetic
tgaggaaaataaatggataattccagcagattgcaaaattgagcgtgatttaaaccttgcaaataatataataac

SEQ ID NO: 290350 - DNA, 75 bp, Artificial Sequence
  Synthetic
actacctaactccgcaggatgcaacggctatagacaagccaacacaaccagatacatcatcaaataggttttaca

SEQ ID NO: 290351 - DNA, 75 bp, Artificial Sequence
  Synthetic
caattagtccaatgtgtgctgaattctctggtgccagagcaagaccagctgctgcagcacaaggtttgccggttt

SEQ ID NO: 290352 - DNA, 75 bp, Artificial Sequence
  Synthetic
actagaactccagaaagaagagtggtcgcacaaggaccagaggaagaatttggccgatcactcattaaacacaac

SEQ ID NO: 290353 - DNA, 75 bp, Artificial Sequence
  Synthetic
agtgcacacaaaccagtgtgtagctagtcgtaacgagcaattgcgggatgggaccaactactttgggtgtccgtg

SEQ ID NO: 290354 - DNA, 75 bp, Artificial Sequence
  Synthetic
tcatttcttgggtagaagtggttatacagtgcacgtacagtgcaatgcaagtaaattccaccagggtacactact

SEQ ID NO: 290355 - DNA, 75 bp, Artificial Sequence
  Synthetic
tgaggttagaaaccttattgagatgtgccaagtcgacacactcatcccaattaataacacacttccaaaccttcg

SEQ ID NO: 290356 - DNA, 75 bp, Artificial Sequence
  Synthetic
aaattgatggaatcaccactaaagtagaagactcttatgatttgtttaataaagatggagtcaaattggaaatca

SEQ ID NO: 290357 - DNA, 75 bp, Artificial Sequence
  Synthetic
actccactcaaaacacagtttcaaatggatctagtctaaattatttcaacatcaattattttaaggatgctgctt

SEQ ID NO: 290358 - DNA, 75 bp, Artificial Sequence
  Synthetic
ggtacacaagttgaaaatgagaaacaacctagtgatgataattggctaaattttgatggtacattattgggcaat

SEQ ID NO: 290359 - DNA, 75 bp, Artificial Sequence
  Synthetic
acacttttaggtgaaatatgtagttattacacacactggacaggtagtttacgttttagcttcatgttctgtggt

SEQ ID NO: 290360 - DNA, 75 bp, Artificial Sequence
  Synthetic
caatcaacctgaaactactataattaatgttggagatgttatatcatatggtaatattttactcagtggaaatca

SEQ ID NO: 290361 - DNA, 75 bp, Artificial Sequence
  Synthetic
aactgtagaagcttgtggttattcagacagaattatacaaatcactagaggagattcaaccatcacatcacaaga

SEQ ID NO: 290362 - DNA, 75 bp, Artificial Sequence
  Synthetic
gacataacaattggagtttggtaataataccagtttgtcaactacaaagcaacaatatatccaacattgttccca

SEQ ID NO: 290363 - DNA, 75 bp, Artificial Sequence
  Synthetic
gggatgtggggctacaatcgactgtttctctggttgtcccttgggttagtgctagccacttcagatacacaactc

SEQ ID NO: 290364 - DNA, 75 bp, Artificial Sequence
  Synthetic
aatgggagagatggatttgcagccatgttactcaggtcatacttcacagaagtgcaaggtcagataaccactacc

SEQ ID NO: 290365 - DNA, 75 bp, Artificial Sequence
  Synthetic
aacagattttatacattggaaagtaaagtttggacacaaacttcaaaaggatggtggtggaaattaccggatgct

SEQ ID NO: 290366 - DNA, 75 bp, Artificial Sequence
  Synthetic
attcatgacaacagatgatatgcaatctccatgtgcactgccttggtaccatccaacaaaagagatctttatacc

SEQ ID NO: 290367 - DNA, 75 bp, Artificial Sequence
  Synthetic
gtctgcttgtaaagacttttgcttacgcatggctagagacactgacatgcacgtgcaaaatgtgccaatagagca

SEQ ID NO: 290368 - DNA, 75 bp, Artificial Sequence
  Synthetic
cagctgtactctcagagcatgaccctagattaaaggttaatttcaaagaagctatattttctaagtacaaaggaa

SEQ ID NO: 290369 - DNA, 75 bp, Artificial Sequence
  Synthetic
aaggtaccttattggttgctatggttccagaacaccaactagcaagtgcaaataaaggtaatgtcacagcaggat

SEQ ID NO: 290370 - DNA, 75 bp, Artificial Sequence
  Synthetic
actctatcaccacaaacaaaattagctgaagaaatttttgcaattaaagtagatattgcctcacatcccttagcc

SEQ ID NO: 290371 - DNA, 75 bp, Artificial Sequence
  Synthetic
ttggatgcggcagaaactggacatactagtggaatacaacctgaggacactatagaaacaagatacgtacagact

SEQ ID NO: 290372 - DNA, 75 bp, Artificial Sequence
  Synthetic
agatagtgtctttggcatagaaggtctagaagcacttgaccttaacactagtgctggatttccttatgtttccat

SEQ ID NO: 290373 - DNA, 75 bp, Artificial Sequence
  Synthetic
tacttttatggggaatctgttgattttcccacatcaatttataaacttaaggagtaataattcagcaactataat

SEQ ID NO: 290374 - DNA, 75 bp, Artificial Sequence
  Synthetic
ttttgctagcatatacacccccagggattggtaagcctagaagtagaaaggaagcaatgttagggacacacgtgg

SEQ ID NO: 290375 - DNA, 75 bp, Artificial Sequence
  Synthetic
atcatcacttcaagaaatgggacataacattacaagaaatggcacaaatacggagaaaatttgaattctttactt

SEQ ID NO: 290376 - DNA, 75 bp, Artificial Sequence
  Synthetic
tttcttaaagatgagcttaggaaacaggagaagatttctgctggaaagacacgtgtcatagaggctagtagtgtg

SEQ ID NO: 290377 - DNA, 75 bp, Artificial Sequence
  Synthetic
gcaacatcccaggtacctatcactatatctatcagtcctatgtgtgctgagttctcaggtgccagagcaaagcca

SEQ ID NO: 290378 - DNA, 75 bp, Artificial Sequence
  Synthetic
ctacattacatgctggtatcaaactaattttgttgttccaccaaacacacctaacactgctgagatgttgtgttt

SEQ ID NO: 290379 - DNA, 75 bp, Artificial Sequence
  Synthetic
tgcaccaaaaccagagaaaaggaatgattacacctgggagtcaagtacaaacccttctatattttggcaacatgg

SEQ ID NO: 290380 - DNA, 75 bp, Artificial Sequence
  Synthetic
agacgttctggacaaagataccagtgatgttagatggtgaatgcataatggcattcgattacacaaattatgatg

SEQ ID NO: 290381 - DNA, 75 bp, Artificial Sequence
  Synthetic
acccaaccaaagaaatattcatcccaggagaggtaaaaaatttgattgaaatgtgtcaagtaggcacacttatac

SEQ ID NO: 290382 - DNA, 75 bp, Artificial Sequence
  Synthetic
gatgaagtcttaaatgaagtgttagtagtgcccaatattaatcagagccaccctaccacatcaaatgcagcccca

SEQ ID NO: 290383 - DNA, 75 bp, Artificial Sequence
  Synthetic
cccttcttaagcattgcatctgcttactacatgttctatgatggttatgatggtgatgcaccagggtcaaggtat

SEQ ID NO: 290384 - DNA, 75 bp, Artificial Sequence
  Synthetic
ctttaaaaatacatactatgaggttgagggaggagtaccatcaggctgctctgggacaagcatatttaatacaat

SEQ ID NO: 290385 - DNA, 75 bp, Artificial Sequence
  Synthetic
ggatgtggcctcacaaccgctctctagtacacttcttggagaaatatgtagttactacacacattggactggtag

SEQ ID NO: 290386 - DNA, 75 bp, Artificial Sequence
  Synthetic
gtgtggaaagcttcctaggcagatcggggtgcatccatgaatcagtgttggatattgtggacaattacaatgatc

SEQ ID NO: 290387 - DNA, 75 bp, Artificial Sequence
  Synthetic
caaaacacattagagcatggtgtccacgtgcacctagggctgtcccatacacacatactagatcaacaaattaca

SEQ ID NO: 290388 - DNA, 75 bp, Artificial Sequence
  Synthetic
tcatacaaatatcaattagatatggaagcaatagccaatgaaggtgtgaagtatggtcttacaataactcctgct

SEQ ID NO: 290389 - DNA, 75 bp, Artificial Sequence
  Synthetic
caggctatgttaggcacacatattgtatgggatgtgggcctacaatcaactgtatctctagtagtaccctgggtt

SEQ ID NO: 290390 - DNA, 75 bp, Artificial Sequence
  Synthetic
caggaatctacatcttttcaattctgaaatgcatgactctattctgatttcttactcttctgatttagtcatata

SEQ ID NO: 290391 - DNA, 75 bp, Artificial Sequence
  Synthetic
ggtaccaagtgtagcagccaaagatggtcacattggtcatatagtcatgcaatatatgtatgtaccaccaggagc

SEQ ID NO: 290392 - DNA, 75 bp, Artificial Sequence
  Synthetic
cttttccaattgatgagatacaagaatccataaggtggacaaagaaaccatctcaaatgcaggagcatgttctgt

SEQ ID NO: 290393 - DNA, 75 bp, Artificial Sequence
  Synthetic
caaacactgctgatatgttatgctttgtctctgcgtgtaaagacttttgtttgcgcatggcaagagatacggata

SEQ ID NO: 290394 - DNA, 75 bp, Artificial Sequence
  Synthetic
actagtcatgattggtatgaaatacaagaaagtgaatattaccctaaacacattcaatataaccttttgattgga

SEQ ID NO: 290395 - DNA, 75 bp, Artificial Sequence
  Synthetic
tttttgagtattgcatcagcatattacatgttttatgatggttatgatggagacacatataaatccagatatgga

SEQ ID NO: 290396 - DNA, 75 bp, Artificial Sequence
  Synthetic
ctggtcgcgcactgtatatccctccctatgaagtgcttctgcatgagtggtatgaaaaattttaaattgtttaga

SEQ ID NO: 290397 - DNA, 75 bp, Artificial Sequence
  Synthetic
tccatccacatcaaattctgcccctgcattagatgctgctgaaactggccatactagtgcaatccaaccagaaga

SEQ ID NO: 290398 - DNA, 75 bp, Artificial Sequence
  Synthetic
ttgatcttagacatttccattgtgccgaagagcaaggcataactgactacatccacatgcttggtgaagcctttg

SEQ ID NO: 290399 - DNA, 75 bp, Artificial Sequence
  Synthetic
aacacaccaaagcttggtgcccaagaccacccagagctgttcaatactcacatacacataccaccaactacaaat

SEQ ID NO: 290400 - DNA, 75 bp, Artificial Sequence
  Synthetic
actgtggataatgatgtagattataattcaaagcattataataaatggcaaataaccttacaagaaatggctcaa

SEQ ID NO: 290401 - DNA, 75 bp, Artificial Sequence
  Synthetic
agctatggtaataataatcagaaattcatcagatccacagacaattatagccactttaactttaattggttgttc

SEQ ID NO: 290402 - DNA, 75 bp, Artificial Sequence
  Synthetic
cagaaatctacatttatttaactctgacatacatgattccattttagtgtcttattcatcagatttaatcatata

SEQ ID NO: 290403 - DNA, 75 bp, Artificial Sequence
  Synthetic
taatgcaatacatgtatgtgcctcctggtgcaccacttccaaactcaagagatgattttacatggcaatctggca

SEQ ID NO: 290404 - DNA, 75 bp, Artificial Sequence
  Synthetic
atgtgcaatgcagcaagaggattagagtggattggcaataagatatctaaatttattgattggatgaaatctatg

SEQ ID NO: 290405 - DNA, 75 bp, Artificial Sequence
  Synthetic
acacctcatgactggtatgagatacaagagagtgaatattatccaaaacatatccagtacaatttactaataggt

SEQ ID NO: 290406 - DNA, 75 bp, Artificial Sequence
  Synthetic
tgatggagacacttcaagctccagatatggtacatcagttacaaaccacatggggacactctgttcaagaattgt

SEQ ID NO: 290407 - DNA, 75 bp, Artificial Sequence
  Synthetic
cacaggagaaaattaaacatgaaatcgacactcttcatgacctttcatgcaaatttcttccattatatgcaagtg

SEQ ID NO: 290408 - DNA, 75 bp, Artificial Sequence
  Synthetic
tagatcttagacactttcactgtgctgaagaacaaggaatcactgattacatacacatgctcggtgaagcttttg

SEQ ID NO: 290409 - DNA, 75 bp, Artificial Sequence
  Synthetic
tatacacatgctcacgtcaccaattataaaccacaagatggtgatgtacagatcttcttaaaacccagacccagc

SEQ ID NO: 290410 - DNA, 75 bp, Artificial Sequence
  Synthetic
tacaggaaaatctatgaccacaaacttcctagctagaatgataaccaatgatagtgatatatattctttacctcc

SEQ ID NO: 290411 - DNA, 75 bp, Artificial Sequence
  Synthetic
agctatggttataattattagaaactcttcagatccgcaaacaataattgccactttaacactgattggatgcaa

SEQ ID NO: 290412 - DNA, 75 bp, Artificial Sequence
  Synthetic
tttcttattcatctgatttagtcatttaccgcacaaacactacaggtgatgactatatcccaacatgtgactgca

SEQ ID NO: 290413 - DNA, 75 bp, Artificial Sequence
  Synthetic
atggtctctagtgtcacttttataccacctatggctgatttaccagataagggaaaaccttttgattctagattt

SEQ ID NO: 290414 - DNA, 75 bp, Artificial Sequence
  Synthetic
atgtgtaatgcagctagggggctagaatggattggaaacaaaatatccaaatttatcgattggatgaaatcaatg

SEQ ID NO: 290415 - DNA, 75 bp, Artificial Sequence
  Synthetic
acacatacaatacaacctgctaattggtgaagggccttgtgagccaggtgattgtggtggcaaattattatgtaa

SEQ ID NO: 290416 - DNA, 75 bp, Artificial Sequence
  Synthetic
gtgataaatataaagattcacaaggaaaattaaatgtgtctgctgcttttaaaccatgtgatgttaacacaaaaa

SEQ ID NO: 290417 - DNA, 75 bp, Artificial Sequence
  Synthetic
ctcaagaaaaaatcaagtgtgagatagatacattgcatgacttatcctgtaagtttttacctctgtatgccagtg

SEQ ID NO: 290418 - DNA, 75 bp, Artificial Sequence
  Synthetic
tacatacacatgttgggtgaagcttttggaacaggttttgttgacagtgttaaggatcaaataagtgctataaac

SEQ ID NO: 290419 - DNA, 75 bp, Artificial Sequence
  Synthetic
aatacttgatgaagataaaaggcgtagacaggttgttgacgtgatggcagcaatatttcaaggcccaatttcact

SEQ ID NO: 290420 - DNA, 75 bp, Artificial Sequence
  Synthetic
gaccggaaaatcaatcactacaagcttcctggctagaatgattactaatgagagtgacatatactcacttccacc

SEQ ID NO: 290421 - DNA, 75 bp, Artificial Sequence
  Synthetic
tagctactctaactttaatcgggtgttcaggttctccatggcgattcctcaaagaaaaattctgtaaatggaccc

SEQ ID NO: 290422 - DNA, 75 bp, Artificial Sequence
  Synthetic
gagtgcaagatagagagagatctgaatttggcaaacaccattatcacaatcattgcaaatattattagtatttca

SEQ ID NO: 290423 - DNA, 75 bp, Artificial Sequence
  Synthetic
atggtatctagtgtgacttttatacccccaatggctgatctaccagataagggaaaaccctttgattctagattt

SEQ ID NO: 290424 - DNA, 75 bp, Artificial Sequence
  Synthetic
aaagtttattgagtggatgaaatctatgttacctcaagctcaacttaaaatcaaatatttaagtgaacttaaaaa

SEQ ID NO: 290425 - DNA, 75 bp, Artificial Sequence
  Synthetic
cacaaggtcctgaagaagaatttggtagatcacttattaaacacaactcatgtgtggtcaccacttcaaatggta

SEQ ID NO: 290426 - DNA, 75 bp, Artificial Sequence
  Synthetic
atgataactacaaagataatcagggtaagttagatgtttctagagcatttcggctatgtgatgttgattcaaaga

SEQ ID NO: 290427 - DNA, 75 bp, Artificial Sequence
  Synthetic
tgtaaatttcttccactttatgctagtgaagcaaagagaattaaaattttatacaataagtgtaacacaattatc

SEQ ID NO: 290428 - DNA, 75 bp, Artificial Sequence
  Synthetic
agattcttatgatttgtataacaaagatggtataaaattggaaattacagttcttaaacttaaaagaaatgagaa

SEQ ID NO: 290429 - DNA, 75 bp, Artificial Sequence
  Synthetic
aattcttgaggaagacaagagaaggagacaggtggttgatgtcatgtctgcaattttccaagggcctatatccat

SEQ ID NO: 290430 - DNA, 75 bp, Artificial Sequence
  Synthetic
ctgagagtgacatttactctctaccacctgatcccaaatattttgatggatatgatcaacaaagtgtagttatca

SEQ ID NO: 290431 - DNA, 75 bp, Artificial Sequence
  Synthetic
gttggagatgtagtatcatatgggaacattttactcagtggaaatcaaacagcaagaatgctcaaatacaactac

SEQ ID NO: 290432 - DNA, 75 bp, Artificial Sequence
  Synthetic
gactgccaaattgaaagggatctgaatatagctaatagcataatcacaatcatagctaatatcatcagtatagca

SEQ ID NO: 290433 - DNA, 75 bp, Artificial Sequence
  Synthetic
taaaggcaaaccatttgattctagatttgtgttgtgtagtactaatcataatctattagctccaccaacaataac

SEQ ID NO: 290434 - DNA, 75 bp, Artificial Sequence
  Synthetic
tattaagatcatactttacagaggcacaaggtcaaatagttaccactaaatctaccatagagtgtaacctaccta

SEQ ID NO: 290435 - DNA, 75 bp, Artificial Sequence
  Synthetic
ctcaaggtccagaagaagaatttggaatgtctattattaaaaataatacctgtgttgtgaccacaacaaatggaa

SEQ ID NO: 290436 - DNA, 75 bp, Artificial Sequence
  Synthetic
ttccaaccgtgtgatgttgacacaaagattggcaatgcacgttgttgtccattcatttgcggtaaggcagtgatg

SEQ ID NO: 290437 - DNA, 75 bp, Artificial Sequence
  Synthetic
attagaagttgattttaaacaagctttgttttcaaagtataaaggcaataatcagtgtgaaataaatgagcacat

SEQ ID NO: 290438 - DNA, 75 bp, Artificial Sequence
  Synthetic
tgattcttatgacttatttaataaggaaggtgtcaagttggaaattactgtgctaaagttagatagaaatgagaa

SEQ ID NO: 290439 - DNA, 75 bp, Artificial Sequence
  Synthetic
ctgcaattttccaagggcctattacccttgagggaccaccaccagcagcaattagtgacctgctacagtcagtga

SEQ ID NO: 290440 - DNA, 75 bp, Artificial Sequence
  Synthetic
gaagcacttgatctcaccactagtgctggatttccttatgtgtctatgggtatcaagaaaagagatttgattaac

SEQ ID NO: 290441 - DNA, 75 bp, Artificial Sequence
  Synthetic
gtaggggatgttgtgtcttatggtaatatattacttagtggcacacagacagccagaatgcttaaatataactat

SEQ ID NO: 290442 - DNA, 75 bp, Artificial Sequence
  Synthetic
tgttgatctgcccatggtcacatttcttaaagatgaacttaggaaaaaagaaaagattcacactggaaagacacg

SEQ ID NO: 290443 - DNA, 75 bp, Artificial Sequence
  Synthetic
aatcattgctaatattattagtatttctgggataatttatgtaatatacaagttattttgcacactgcaaggacc

SEQ ID NO: 290444 - DNA, 75 bp, Artificial Sequence
  Synthetic
tattgagatcatacttcactgaacaacaaggccaaattcaaatctctaaacatgttaaagatgttggcttaccct

SEQ ID NO: 290445 - DNA, 75 bp, Artificial Sequence
  Synthetic
tccgcagtggggtgtgatccagagaccttttggtcaaaaataccagtgatgttagatggtgaatgcataatggca

SEQ ID NO: 290446 - DNA, 75 bp, Artificial Sequence
  Synthetic
tcatgtattgtaacaacacagaatggtaaatttacaggtcttggaatttatgatagagtgttaatcctaccaaca

SEQ ID NO: 290447 - DNA, 75 bp, Artificial Sequence
  Synthetic
attgaaagtggactttgactcagctcttttttcaaaatacaaaggtaacacagagtgcagtttgaatgaacatat

SEQ ID NO: 290448 - DNA, 75 bp, Artificial Sequence
  Synthetic
gattgtgcaaatctaaacatatttttaaaaatgtgtattatgaagttgaagggggggtaccatcaggttgttctg

SEQ ID NO: 290449 - DNA, 75 bp, Artificial Sequence
  Synthetic
ctgtactcaaattaaaaaggaatgaaaagtttaaagacattagaaaatacataccagaaaatgaggacgattacc

SEQ ID NO: 290450 - DNA, 75 bp, Artificial Sequence
  Synthetic
gaagctttggatctgaatactagtgcaggttatccctatgtaacactaggaattaaaaagaaagatcttattaat

SEQ ID NO: 290451 - DNA, 75 bp, Artificial Sequence
  Synthetic
ttatggggatgatgtcatcttttcctataaatatcaattagatatggaagcaattgctaaagaaggtgttaaata

SEQ ID NO: 290452 - DNA, 75 bp, Artificial Sequence
  Synthetic
aacagctagaatgcttaaatataattatccaacaaagtctggttattgtggtggtatcttatataaaataggaca

SEQ ID NO: 290453 - DNA, 75 bp, Artificial Sequence
  Synthetic
ataagatagcagcaggcaaaaccagagttatagaagctagtagtataaatgataccattttgtttagaacagttt

SEQ ID NO: 290454 - DNA, 75 bp, Artificial Sequence
  Synthetic
tattcatttttaatacatccaacttttccagtcaatgaaattcaagagtccatacgatggacaaagaaaccatct

SEQ ID NO: 290455 - DNA, 75 bp, Artificial Sequence
  Synthetic
aagtccactagtgaatgtggtttgcctagtatccatacaccaagcaagactaaactccaacctagtgtattcttt

SEQ ID NO: 290456 - DNA, 75 bp, Artificial Sequence
  Synthetic
gttagatggagattgcatcatggcttttgattatacaaattatgatggtagcattcatccaatttggtttaaagc

SEQ ID NO: 290457 - DNA, 75 bp, Artificial Sequence
  Synthetic
catacgatggacaaagaaaccatctcagatgcaggagcatgttctatcactgtgtcacttaatgtggcataatgg

SEQ ID NO: 290458 - DNA, 75 bp, Artificial Sequence
  Synthetic
ataaccagtgtgttatgaatgatcatgtcaaagtagccatttctcactactcagcacaactcatgactctggaca

SEQ ID NO: 290459 - DNA, 75 bp, Artificial Sequence
  Synthetic
ggtggtgtgccctctggttgttctggaactagtatatttaactcaatgattaataatataatcattagaacctta

SEQ ID NO: 290460 - DNA, 75 bp, Artificial Sequence
  Synthetic
acactattattacggtaattttgtacgccagttttatacccccttcccaaaatgtaacttagaagcaatacaaac

SEQ ID NO: 290461 - DNA, 75 bp, Artificial Sequence
  Synthetic
gggcattaagaagaaagatttaatcaataagcaaacaaaagatttgactaaacttaaaatagcattagataagta

SEQ ID NO: 290462 - DNA, 75 bp, Artificial Sequence
  Synthetic
ccatagccaaggaagggcagaaatatggacttactataacacctgcagataaatctagtgaattcaaagaacttg

SEQ ID NO: 290463 - DNA, 75 bp, Artificial Sequence
  Synthetic
aatgatactatactgtttaggacaacttttggtaaccttttctccaaatttcatttgaatccaggtattgttaca

SEQ ID NO: 290464 - DNA, 75 bp, Artificial Sequence
  Synthetic
cattagatggacaaagaaaccatctcaaatgcaggagcatgtcttatccttgtgtcacttaatgtggcacaatgg

SEQ ID NO: 290465 - DNA, 75 bp, Artificial Sequence
  Synthetic
tggacaaggtgtgaagagccccgtgtgctcatcttgagtcctccggcccctgaatgtggctaaccttaaacctgc

SEQ ID NO: 290466 - DNA, 75 bp, Artificial Sequence
  Synthetic
acaaagatacgcagtgtcagcgctggacgtgcactgtatatccctccttatgaactcctaagacatgaatggtat

SEQ ID NO: 290467 - DNA, 75 bp, Artificial Sequence
  Synthetic
gaagcatacaccccatgtggtttcaagctcttaaagaggttttgtccaacttatcctttgaagctagtttaattg

SEQ ID NO: 290468 - DNA, 75 bp, Artificial Sequence
  Synthetic
tgcttatggtgacaatatatatagtatatatatattgttatcatgggcgctcaagtatctagacagaatgttggt

SEQ ID NO: 290469 - DNA, 75 bp, Artificial Sequence
  Synthetic
gattaataatattattattaggacactagtgttagatgcctataaaaacattgatttggataaactcaagataat

SEQ ID NO: 290470 - DNA, 75 bp, Artificial Sequence
  Synthetic
atttttctcaggaccctagtaagtttactgacccggttaaggatgttttggaaaaaggtattcccactctacaat

SEQ ID NO: 290471 - DNA, 75 bp, Artificial Sequence
  Synthetic
gacaaatctagtacttttaaacaacttgattatagtaatgttacttttcttaaaaggggatttaaacaagatgag

SEQ ID NO: 290472 - DNA, 75 bp, Artificial Sequence
  Synthetic
gtatggagtgtggccacattatctgaattcacgagatgctgtggctatagacaagccaacccagccagatacatc

SEQ ID NO: 290473 - DNA, 75 bp, Artificial Sequence
  Synthetic
gtccattcgctggacaaagaaaccatctcaaatgcaggagcatgtcttgtcattgtgccacttaatgtggcataa

SEQ ID NO: 290474 - DNA, 75 bp, Artificial Sequence
  Synthetic
ggtgaaaacatgttttatcatttcttgggaagaagtggttacacagtgcacgtgcagtgtaatgctagtaaattt

SEQ ID NO: 290475 - DNA, 75 bp, Artificial Sequence
  Synthetic
tcttgcatgagtggtatgaaaaattttaaattgtttagatatagaagtattaaacaattagttttttagttttat

SEQ ID NO: 290476 - DNA, 75 bp, Artificial Sequence
  Synthetic
ttgtacgccagttttgcacccctccccttttgtaacttagaagaaataagttcagaccaataggaaggcgacaag

SEQ ID NO: 290477 - DNA, 75 bp, Artificial Sequence
  Synthetic
ccttttgtaacttagaagaaataagttcagaccaataggaaggcgacaagccagtcgtctaaggtcaagtacttc

SEQ ID NO: 290478 - DNA, 75 bp, Artificial Sequence
  Synthetic
aatcaggcagagtagttggtacacaagcagatgacacaaagcaacccagtgatgataactggttaaattttgatg

SEQ ID NO: 290479 - DNA, 75 bp, Artificial Sequence
  Synthetic
atttgtctggtcactcaggtacaaccccagtactagacctggcagatgaggctggaaaatccccactggcgacag

SEQ ID NO: 290480 - DNA, 75 bp, Artificial Sequence
  Synthetic
aatggactcaatggttagacataataattggagtttggtaataattccaatttgtcaactccaaagcaacaatac

SEQ ID NO: 290481 - DNA, 75 bp, Artificial Sequence
  Synthetic
acaccaggctcgggtcagtttatgacaactgatgacatgcagtccccttgtgcattaccctggtatcatccaaca

SEQ ID NO: 290482 - DNA, 75 bp, Artificial Sequence
  Synthetic
attatgcctatggtgacaatatatagtgttatatattggcatcatgggcgcccaggtatctagacagaatgttgg

SEQ ID NO: 290483 - DNA, 75 bp, Artificial Sequence
  Synthetic
ttaacatgtacacagttactctccaaccacagactgacatggcaactgaggtttttgcaatcaaggtggacattg

SEQ ID NO: 290484 - DNA, 75 bp, Artificial Sequence
  Synthetic
gagttttcccaagacccgagcaaattcacagaccctgttaaagatgtattagagaagggcatccccaccttacaa

SEQ ID NO: 290485 - DNA, 75 bp, Artificial Sequence
  Synthetic
aaacaccactttaaaactcttgttagcttatacacccccagggattagtaaacccaagaatcggaaggaagcaat

SEQ ID NO: 290486 - DNA, 75 bp, Artificial Sequence
  Synthetic
gatacggagtgtggccacattacctgactccacaagatgccacagcaattgacaaacctactcaaccagacacat

SEQ ID NO: 290487 - DNA, 75 bp, Artificial Sequence
  Synthetic
acatattccacagctggttatatcacatgttggtatcaaaccaattttgttgttccaccaaacacaccaaacact

SEQ ID NO: 290488 - DNA, 75 bp, Artificial Sequence
  Synthetic
acatattcctcagctggttatatcacatgttggtatcaaaccaattttgttgttccaccaaacacaccaaacact

SEQ ID NO: 290489 - DNA, 75 bp, Artificial Sequence
  Synthetic
acatattccccagctggttatatcacatgttggtatcaaaccaattttgttgttccaccaaacacaccaaacact

SEQ ID NO: 290490 - DNA, 75 bp, Artificial Sequence
  Synthetic
acatattccgcagctggttatatcacatgttggtatcaaaccaattttgttgttccaccaaacacaccaaacact

SEQ ID NO: 290491 - DNA, 75 bp, Artificial Sequence
  Synthetic
tggtcaaaacatgtattaccattttctgggtagagctggctatacaattcatgtgcagtgcaatgctagcaaatt

SEQ ID NO: 290492 - DNA, 75 bp, Artificial Sequence
  Synthetic
cagtggagcggtatgtggatgaagtcttaaatgaggtattggtagtccctaatattaatgaaagccaccctacaa

SEQ ID NO: 290493 - DNA, 75 bp, Artificial Sequence
  Synthetic
gaaggtggcagagatgttagtgtggaggtgcgtgacacagctaattaccagcctagtgatgatgcatggctcaat

SEQ ID NO: 290494 - DNA, 75 bp, Artificial Sequence
  Synthetic
gacactggatgaaatgagtgtagaaagttttttaggcagatcaggttgcattcatgaatccatattggacattaa

SEQ ID NO: 290495 - DNA, 75 bp, Artificial Sequence
  Synthetic
ctgttcccatggattctatgcttagacacaataattggagtttagtaatcattccaatttgtcccttggagactg

SEQ ID NO: 290496 - DNA, 75 bp, Artificial Sequence
  Synthetic
aactctgagattacactggtaccaagtattgcaaacaaggaaggtcatattggtcatatagtaatgcaatacatg

SEQ ID NO: 290497 - DNA, 75 bp, Artificial Sequence
  Synthetic
tacccctggatctggacaatttatgacaactgatgactaccaatctcccagtgctttaccttggttccacccaac

SEQ ID NO: 290498 - DNA, 75 bp, Artificial Sequence
  Synthetic
cccggttttcactcccttttctaagtgtagcatcagcatattacatgttctatgatggatatgatggtgatactt

SEQ ID NO: 290499 - DNA, 75 bp, Artificial Sequence
  Synthetic
gtaaacatgtatacacttcaattgactaagcagttaccaggatatgaagtttttgcaatgaaagttgacatagcg

SEQ ID NO: 290500 - DNA, 75 bp, Artificial Sequence
  Synthetic
aatatatcacaaagctaagcacaccaaagcttggtgtccaagaccacccagggctgttcagtacacacatacaca

SEQ ID NO: 290501 - DNA, 75 bp, Artificial Sequence
  Synthetic
gcacaacactcaagttgctcattgcttatactccccctggaattgaaaaaccaacaaagagaaaagatgcaatgc

SEQ ID NO: 290502 - DNA, 75 bp, Artificial Sequence
  Synthetic
gttggtaatcttatatatagaaacctacatctttttaactcagacatgcacgactctatcttggtttcatactca

SEQ ID NO: 290503 - DNA, 75 bp, Artificial Sequence
  Synthetic
attttctcaggcagggtatataacatgctggtatcaaacatcacttgtgacaccaccaagcacaccccaaacagc

SEQ ID NO: 290504 - DNA, 75 bp, Artificial Sequence
  Synthetic
attacccaattaaagtcacaccacatgattggtatgagattcaagagagtgaatattatccaaaacacattcagt

SEQ ID NO: 290505 - DNA, 75 bp, Artificial Sequence
  Synthetic
gttgaacaatatattgatggtgtattaaatgaagttttggttgttccaaacatcaatgagagtcatcccagcact

SEQ ID NO: 290506 - DNA, 75 bp, Artificial Sequence
  Synthetic
gggccacgtggcattcattgatctcagacatttccattgcgccgaagaacaaggaataactgattacatacacat

SEQ ID NO: 290507 - DNA, 75 bp, Artificial Sequence
  Synthetic
tgggtgttgtactctgttattccggtaactttgtacgccagttttccctccctccccatccttttacgtaactta

SEQ ID NO: 290508 - DNA, 75 bp, Artificial Sequence
  Synthetic
caagagatgagatgagtattgagagcttcttgggcagatctggttgcatacacatatcagatttaaaagtgaact

SEQ ID NO: 290509 - DNA, 75 bp, Artificial Sequence
  Synthetic
atgctcaggatcatatcagctatggttataataattagaaattcctcggatccacaaactataattgccactctc

SEQ ID NO: 290510 - DNA, 75 bp, Artificial Sequence
  Synthetic
tagatttgattctgaaataaccttagtgccctgtatatcttcccagagtgctagcattggtcatgttgttatgca

SEQ ID NO: 290511 - DNA, 75 bp, Artificial Sequence
  Synthetic
ttaagaaatttactgaaatgtgcaatgcagctaggggtttagaatggattggcaataaaatttctaaatttattg

SEQ ID NO: 290512 - DNA, 75 bp, Artificial Sequence
  Synthetic
ccatatcctcgattttctctccctttccttagtatagcctcagcatactacatgttttatgatgggtacgacggt

SEQ ID NO: 290513 - DNA, 75 bp, Artificial Sequence
  Synthetic
agcagctgatgcaaactctcaggagaagattaaatgtgaaattgatacactacatgatttatcttgcaaatttct

SEQ ID NO: 290514 - DNA, 75 bp, Artificial Sequence
  Synthetic
cgactactttgggtgtccgtgtttcactttttcctttatcaattgcttatggtgacaatatatacatagatatat

SEQ ID NO: 290515 - DNA, 75 bp, Artificial Sequence
  Synthetic
ctagggtttatcacaaagcaaaacacgtaaaggcatggtgtccacggcctccaagagctgttggatatacacaca

SEQ ID NO: 290516 - DNA, 75 bp, Artificial Sequence
  Synthetic
atacatggtccccctggaacaggtaagtctatcactactagttttttagccagaatgatcactaatgagagtgac

SEQ ID NO: 290517 - DNA, 75 bp, Artificial Sequence
  Synthetic
attactttaaggatgctgcttcgagtggtgcatccagattagacttctctcaagatccaagcaaattcactgatc

SEQ ID NO: 290518 - DNA, 75 bp, Artificial Sequence
  Synthetic
ttgtcacagtaggacctagtgatatgtatgtacatgttggaaatctggtatatagaaacctacatctctgtaatt

SEQ ID NO: 290519 - DNA, 75 bp, Artificial Sequence
  Synthetic
tgacactattctgtcaaatggtgtccagtgttacatttatacctcccatggcagacttaccagataaaggaaaac

SEQ ID NO: 290520 - DNA, 75 bp, Artificial Sequence
  Synthetic
ctcaacaatcacatcccaggacgtggcaaatgctgtggttggatatggggtttggccacactacttaaccccaca

SEQ ID NO: 290521 - DNA, 75 bp, Artificial Sequence
  Synthetic
agatgccacttactattgcaaacacaaaaacagatattacccaattaaagtaaccagtcatgattggtatgaaat

SEQ ID NO: 290522 - DNA, 75 bp, Artificial Sequence
  Synthetic
tttggatatcactgtgcatgacaactttaaagacaatcagggcaagttggatgtatcaagagcatttcaaccatg

SEQ ID NO: 290523 - DNA, 75 bp, Artificial Sequence
  Synthetic
tggtggaaattaccagatgctcttaaagaaatgggcatttttggagagaatatgtattatcacttcttgggtaga

SEQ ID NO: 290524 - DNA, 75 bp, Artificial Sequence
  Synthetic
catggagtgataggaattatcacagctggaggtgaggggcatgtggcattcatagacttgagacactttcactgt

SEQ ID NO: 290525 - DNA, 75 bp, Artificial Sequence
  Synthetic
tcacaggtatataatcaaattttagaagaggacaagagaagaagacaagtggttgatgtcatgtcagcaattttc

SEQ ID NO: 290526 - DNA, 75 bp, Artificial Sequence
  Synthetic
atggaagtgtaactgctggttatgatctcacacacccaggtgaggccggtagagttgtgggtcaacagcgtgatg

SEQ ID NO: 290527 - DNA, 75 bp, Artificial Sequence
  Synthetic
caataaacaacatcagcaaaaagttaatcaagtggttgcttagaatagtctctgccatggttataataataagaa

SEQ ID NO: 290528 - DNA, 75 bp, Artificial Sequence
  Synthetic
agtggatagtgcctgcagattgccaaattgaaagagaccttaatatagccaataatataattacaattatagcta

SEQ ID NO: 290529 - DNA, 75 bp, Artificial Sequence
  Synthetic
taataattctgcaactttgatagtaccatatgtgaatgctgtaccaatggattcaatgcttcgacacaataattg

SEQ ID NO: 290530 - DNA, 75 bp, Artificial Sequence
  Synthetic
gttaaattatgttcacaaggaatcagattcatggcttaaaaaattcacagaaatgtgcaatgctgctagaggtct

SEQ ID NO: 290531 - DNA, 75 bp, Artificial Sequence
  Synthetic
tgaaagaagagtagttgctcagggaccagaggaagaatttggtatgtcaataataaagaacaacacttgtgttgt

SEQ ID NO: 290532 - DNA, 75 bp, Artificial Sequence
  Synthetic
tctggtgcaagagcaaagaatgtcagacaaggtttacctgtatatataactccaggatctgggcaatttatgacg

SEQ ID NO: 290533 - DNA, 75 bp, Artificial Sequence
  Synthetic
cttaacttgttagagaaacaaattgaaaacttgcgtggtgcagacacaaagactcaagaaaaaataaaattggaa

SEQ ID NO: 290534 - DNA, 75 bp, Artificial Sequence
  Synthetic
atacatacaaaaatacttgattcatatgatttgtataataaagagggtgtcaaattggaaatcactgttttgaaa

SEQ ID NO: 290535 - DNA, 75 bp, Artificial Sequence
  Synthetic
tggataccttaatcccagtcaataatgtgggtaccaatgttggaaacattagtatgtacactgtgcaattaggaa

SEQ ID NO: 290536 - DNA, 75 bp, Artificial Sequence
  Synthetic
agcaaaagaaaagaagtgaaccagttgctgtcatgatacatggtccacctggtactgggaagtcaataaccacta

SEQ ID NO: 290537 - DNA, 75 bp, Artificial Sequence
  Synthetic
aaccaaccataattaaagtaggtgatgttatatcctatggtaatatattactcagtggaacacagacagctagaa

SEQ ID NO: 290538 - DNA, 75 bp, Artificial Sequence
  Synthetic
ccactggactggaagtttacgatttagtttcatgttttgtgggactgcaaacaccacacttaaattattacttgc

SEQ ID NO: 290539 - DNA, 75 bp, Artificial Sequence
  Synthetic
aaaggtaaaccatttgactctagatttgttttctgcagtaccaatcactcactattggctccgccaactattact

SEQ ID NO: 290540 - DNA, 75 bp, Artificial Sequence
  Synthetic
gttgtaccatgggtaagtgccagtcattttaggttaactgcaaatgacaaatattcgatggctggttatattaca

SEQ ID NO: 290541 - DNA, 75 bp, Artificial Sequence
  Synthetic
tgggttttcatctatgctcttaagatcctatttcactgagcaacagggtcaaattaaaatctcccaacacgtcaa

SEQ ID NO: 290542 - DNA, 75 bp, Artificial Sequence
  Synthetic
acagataaggaccctagattaaaagtggactttgaaacagcactgttttcaaaatataagggtaatgtgaaatgt

SEQ ID NO: 290543 - DNA, 75 bp, Artificial Sequence
  Synthetic
ctagggatacagatttacatatacaaagtggtccaatagagcaaaatccagtggaaaattacattgatgaagttt

SEQ ID NO: 290544 - DNA, 75 bp, Artificial Sequence
  Synthetic
gcagaaatgtggtggatgtcatgacagcaatatttcaaggtccaatatcaatgaatgcaccaccaccacctgcta

SEQ ID NO: 290545 - DNA, 75 bp, Artificial Sequence
  Synthetic
gcagaaatgtggtggatgtcatgacagcaatatttcaaggtccaatatcaatgattgcaccaccaccacctgcta

SEQ ID NO: 290546 - DNA, 75 bp, Artificial Sequence
  Synthetic
gcagaaatgtggtggatgtcatgacagcaatatttcaaggtccaatatcaatgactgcaccaccaccacctgcta

SEQ ID NO: 290547 - DNA, 75 bp, Artificial Sequence
  Synthetic
gcagaaatgtggtggatgtcatgacagcaatatttcaaggtccaatatcaatgagtgcaccaccaccacctgcta

SEQ ID NO: 290548 - DNA, 75 bp, Artificial Sequence
  Synthetic
ttggaatggatggtttggaagctttggacctcaacaccagtgctggttacccatatgtagcattagggattaaga

SEQ ID NO: 290549 - DNA, 75 bp, Artificial Sequence
  Synthetic
tgtacaaccagaggatgctatagaaacaagatatgttatgacatcacaaacaagagatgagatgagtatagaaag

SEQ ID NO: 290550 - DNA, 75 bp, Artificial Sequence
  Synthetic
gaatttggcaaataatataataactataatagctaatgtaattagtatagcaggtattatatttgttatctacaa

SEQ ID NO: 290551 - DNA, 75 bp, Artificial Sequence
  Synthetic
tgagcttaggaaaaaagataaaatacctgtaggcaaaactagggttatagaagctagtagcataaatgatactgt

SEQ ID NO: 290552 - DNA, 75 bp, Artificial Sequence
  Synthetic
ctgcaggagatggcacaaattagaagaaaattcgaactatttacttatgttaggtttgattcagaagtaacttta

SEQ ID NO: 290553 - DNA, 75 bp, Artificial Sequence
  Synthetic
ggacgctctttgattaaacacaacacatgtgtggtcaccacagagaatggtaaattcacaggtcttggaatttat

SEQ ID NO: 290554 - DNA, 75 bp, Artificial Sequence
  Synthetic
tctaaaatacccctgatgttagatggagattgtatcatggcttttgactatacaaattatgatggaagcatacac

SEQ ID NO: 290555 - DNA, 75 bp, Artificial Sequence
  Synthetic
tctcatggcaatcaggcactaatatgtcaatattctggcaacatggacaaccgttccctagattctctttaccat

SEQ ID NO: 290556 - DNA, 75 bp, Artificial Sequence
  Synthetic
tacaaattatgatggaagcatacacccagtttggttcaaagctttgagaatggtgcttgataacctatccttcaa

SEQ ID NO: 290557 - DNA, 75 bp, Artificial Sequence
  Synthetic
aaaatggtgtcaaactagaaataacagttgttaagttagatagaaatgagaaatttagggatatacgtaaataca

SEQ ID NO: 290558 - DNA, 75 bp, Artificial Sequence
  Synthetic
catatgttcaagaatagttacagagaagcaggaacaccctgtcgttattacaacacacatatatcacaaagctaa

SEQ ID NO: 290559 - DNA, 75 bp, Artificial Sequence
  Synthetic
caatatacttcttagtggcaaccaaacagctagaatgcttaaatataattatcctacaaaatcagggtattgtgg

SEQ ID NO: 290560 - DNA, 75 bp, Artificial Sequence
  Synthetic
atagttcctagagctagcatgaaaactgttggacccagtgatttgtatgtacatgtaggtaacttaatatatagg

SEQ ID NO: 290561 - DNA, 75 bp, Artificial Sequence
  Synthetic
ccataacacctgcagataagtccactaaattcaaggatctggattacaaaaatgtgacttttctcaagagaggat

SEQ ID NO: 290562 - DNA, 75 bp, Artificial Sequence
  Synthetic
gcacaaggccaaatcacaaagaggacaaatgttaatgagtgtggctttccaaccatacatacacctagcaaaact

SEQ ID NO: 290563 - DNA, 75 bp, Artificial Sequence
  Synthetic
caaatgttaatgagtgtggctttccaaccatacatacacctagcaaaactaaattgcaacctagtgtcttttatg

SEQ ID NO: 290564 - DNA, 75 bp, Artificial Sequence
  Synthetic
ttcctagttgtaactgcacagaggctacctattattgtaaacacaaaaatagatattacccaataaaggttactc

SEQ ID NO: 290565 - DNA, 75 bp, Artificial Sequence
  Synthetic
ggagcatgtcttatcgttgtgtcatctaatgtggcacaatggccctgagatttatagggattttgaaacaaagat

SEQ ID NO: 290566 - DNA, 75 bp, Artificial Sequence
  Synthetic
acgcagtgtcagcgctggtcgtgcactgtatattccaccctatgatcttttgagacatgaatggtatgaaaaatt

SEQ ID NO: 290567 - DNA, 75 bp, Artificial Sequence
  Synthetic
tttaccatgtgagatgaatgagcatgccaaagttgctgttgcacactattctgctcagttaatgacacttgaaat

SEQ ID NO: 290568 - DNA, 75 bp, Artificial Sequence
  Synthetic
tgggaaacttctttgtagacatggtgttattggcataattacagcaggtggtgaaggccatgtagcatttacaga

SEQ ID NO: 290569 - DNA, 75 bp, Artificial Sequence
  Synthetic
gccaaagttgctgttgcacactattctgctcagttaatgacacttgaaattgattcaagaaatatgagtatagag

SEQ ID NO: 290570 - DNA, 75 bp, Artificial Sequence
  Synthetic
gtgaaggccatgtagcatttacagatcttagacagtttcaatgtgctgaagaacagggtataactgattatatac

SEQ ID NO: 290571 - DNA, 75 bp, Artificial Sequence
  Synthetic
acactgttatttcggtaaccttgtacgccagttttataaccccctccccaaatgtaacttagaagctgtacacaa

SEQ ID NO: 290572 - DNA, 75 bp, Artificial Sequence
  Synthetic
cgaccaatagagggtaatcatccagattacttacggtcaagcacttctgtctccccggtttactttgatatgctc

SEQ ID NO: 290573 - DNA, 75 bp, Artificial Sequence
  Synthetic
ataatagcactaaagacatatccaagcttaaattggcattagacaagtatggagtagatctgcccatggtcacat

SEQ ID NO: 290574 - DNA, 75 bp, Artificial Sequence
  Synthetic
gtggctacttagaataatttcagctatggtcattataattagaaattcttctgaccctcaaacaatcatagcaac

SEQ ID NO: 290575 - DNA, 75 bp, Artificial Sequence
  Synthetic
atgatacagtagtatttaggatggtgtatggtaacctatttgcagccttccataaaaatcctggaattgtcacag

SEQ ID NO: 290576 - DNA, 75 bp, Artificial Sequence
  Synthetic
tggctcaagaaatttactgaaatgtgtaatgccgcgcgtggtcttgagtggattggcaataaaatttcaaagttc

SEQ ID NO: 290577 - DNA, 75 bp, Artificial Sequence
  Synthetic
aagtattcacccaatgtggtttgaagctctcaaaatgatactacacaatttagaatttgaacccaaattgattga

SEQ ID NO: 290578 - DNA, 75 bp, Artificial Sequence
  Synthetic
tacgcgcagcagataatgctacacaagaaaagatcaaatgtgaaattgacaccttgcatgacttatcatgtaaat

SEQ ID NO: 290579 - DNA, 75 bp, Artificial Sequence
  Synthetic
gtttatatattgacaccatgggcgcccaagtttctagacagaatgttggaactcactcaacacagaattctgttt

SEQ ID NO: 290580 - DNA, 75 bp, Artificial Sequence
  Synthetic
atcaacaatgtgataataaggactttagtcttggatgcatataaacatatagatttagataagcttaaaattata

SEQ ID NO: 290581 - DNA, 75 bp, Artificial Sequence
  Synthetic
aatgatacatggaccacctggtactggtaagtctataacaaccaatttcctagccagaatgataacaaatgaaag

SEQ ID NO: 290582 - DNA, 75 bp, Artificial Sequence
  Synthetic
cacagatccagtcaaagatgttctggagaagggaattccaaccttacaatcccctacagttgaagcatgtggtta

SEQ ID NO: 290583 - DNA, 75 bp, Artificial Sequence
  Synthetic
ataagtctgagacttttaaacaacttgattacagcaatgttacatttttgaaaagaggctttaagcaagatacaa

SEQ ID NO: 290584 - DNA, 75 bp, Artificial Sequence
  Synthetic
gacatgacactattttgtcaaatggtttcaagtgttacattcataccacctatggctgacctgcccgataagggt

SEQ ID NO: 290585 - DNA, 75 bp, Artificial Sequence
  Synthetic
acaccccaagatgccactgctatagacaaaccctccagacctgacacatcttccaatagattctacactctagag

SEQ ID NO: 290586 - DNA, 75 bp, Artificial Sequence
  Synthetic
aagccgtttgactcaagatttgttttgtgtagtactaatcactctcttctagctccacccaccatatcttcatta

SEQ ID NO: 290587 - DNA, 75 bp, Artificial Sequence
  Synthetic
attgtgtcatttaatgtggcacaatggtcaggatgtctataaggagtttgaacggaaaatacgcagtgttagcgc

SEQ ID NO: 290588 - DNA, 75 bp, Artificial Sequence
  Synthetic
aacggaaaatacgcagtgttagcgctggacgcgcgctgtatattcctccgtatgagctgctactgcatgagtggt

SEQ ID NO: 290589 - DNA, 75 bp, Artificial Sequence
  Synthetic
ttggtagaagcggatacacagttcatgtccaatgtaatgctagcaaattccatcagggcactctcttggtagtaa

SEQ ID NO: 290590 - DNA, 75 bp, Artificial Sequence
  Synthetic
cttgtaatgtcaatactaaaattggcaatgcaaaatgttgtccatttgtgtgtggtaaggcagtgtcatttaagg

SEQ ID NO: 290591 - DNA, 75 bp, Artificial Sequence
  Synthetic
acactgttatcccggtaactttgtacgccagttttatctccccacccccttttgtaacttagaagttatgcacaa

SEQ ID NO: 290592 - DNA, 75 bp, Artificial Sequence
  Synthetic
tgaccaatagtgggcaatcatccagattgtcatcggtcgagcactcctgtttccccggttcaagttgatatgctc

SEQ ID NO: 290593 - DNA, 75 bp, Artificial Sequence
  Synthetic
gggtcgggaggcaaatgtaagacaacctagtgatgataattggttaaattttgatggaacattattgggtaatct

SEQ ID NO: 290594 - DNA, 75 bp, Artificial Sequence
  Synthetic
tttccaagggccaatttctctaggtgctccgccgccaccagccatagcagatctgttacaatcagttagaacacc

SEQ ID NO: 290595 - DNA, 75 bp, Artificial Sequence
  Synthetic
cataacaactggagcttagtcattatacccatttgccggcttaatagcatgggtggtgaaccaactgtacccatc

SEQ ID NO: 290596 - DNA, 75 bp, Artificial Sequence
  Synthetic
gcaaatataataagtatagctggtattatatttgtaatttacaaattgttttgcacactacaaggaccatactca

SEQ ID NO: 290597 - DNA, 75 bp, Artificial Sequence
  Synthetic
ccacagatgatttccaatcccccagtgctttaccttggtaccatcctacaaaggaaatttcaatccccggccagg

SEQ ID NO: 290598 - DNA, 75 bp, Artificial Sequence
  Synthetic
tgattactacagacaatggaaaatttacaggtcttggtatctatgacagaactttgatcattccaacacatgctg

SEQ ID NO: 290599 - DNA, 75 bp, Artificial Sequence
  Synthetic
ccgtgtttcactttttacttattatttgcttatggtgacaatatatagatacatatattgacaccatgggcgccc

SEQ ID NO: 290600 - DNA, 75 bp, Artificial Sequence
  Synthetic
ttgcttatggtgacaatatatagatacatatattgacaccatgggcgcccaagtttctaggcagaatgttggaac

SEQ ID NO: 290601 - DNA, 75 bp, Artificial Sequence
  Synthetic
tggtgaacccaaccctaaaactccagttttcacaataagggtagatattgcatcacaacctttggcaactacatt

SEQ ID NO: 290602 - DNA, 75 bp, Artificial Sequence
  Synthetic
acagttagatagaaatgaaaaatttagggatattaggaagtacatacctgaaacagaagatgattatccagaatg

SEQ ID NO: 290603 - DNA, 75 bp, Artificial Sequence
  Synthetic
atcaagcggtgcttctaaattagagttttcacaagatccaagcaaattcacagatccagttaaggatgtactaga

SEQ ID NO: 290604 - DNA, 75 bp, Artificial Sequence
  Synthetic
gcatacactccacccggaattagagttccagaaaacaggaaagaggccatgctaggaacacatctcatatgggat

SEQ ID NO: 290605 - DNA, 75 bp, Artificial Sequence
  Synthetic
agaatgctaaaatataattaccctacaaaatcaggatattgtggaggtgtattatataaaattggtcagattcta

SEQ ID NO: 290606 - DNA, 75 bp, Artificial Sequence
  Synthetic
gatgttgccaatgcagtcgttggttacggtgtatggccacattatcttacaccacaagatgccactgccatagat

SEQ ID NO: 290607 - DNA, 75 bp, Artificial Sequence
  Synthetic
cctgctggtatcaaactaagttagtagcccccccaaatacacctacaactgcagacatgttgtgctttgtatcgg

SEQ ID NO: 290608 - DNA, 75 bp, Artificial Sequence
  Synthetic
ctaatgaatgtggtcttccaaccatacatacccctagtaaaactaaacttcaacctagtgtgttctacgatgtct

SEQ ID NO: 290609 - DNA, 75 bp, Artificial Sequence
  Synthetic
ccctaaaagatatgggaatttttggagagaatatgttttatcactttttaggtagatgtggttacactgtgcatg

SEQ ID NO: 290610 - DNA, 75 bp, Artificial Sequence
  Synthetic
acatacccctagtaaaactaaacttcaacctagtgtgttctacgatgtcttcccaggttctaaggaaccagctgt

SEQ ID NO: 290611 - DNA, 75 bp, Artificial Sequence
  Synthetic
cttgaatgaggttcttgtagtccctaatattaatgaaagttacccaacaacttccaattcagccccagtgctaga

SEQ ID NO: 290612 - DNA, 75 bp, Artificial Sequence
  Synthetic
gtataaatacacacatcctggtgagaaaggtagggatgttgggaagataaaccgagagagaaatgaccggcagcc

SEQ ID NO: 290613 - DNA, 75 bp, Artificial Sequence
  Synthetic
attgctatcgctcactattcagcacaattaataacattagatattgattctaaaccaatagcattagaggacagt

SEQ ID NO: 290614 - DNA, 75 bp, Artificial Sequence
  Synthetic
agctttttgggtagatcagggtgtatacacatgtcaacattaaacatagattatgacaattatgatgactcccct

SEQ ID NO: 290615 - DNA, 75 bp, Artificial Sequence
  Synthetic
atcatagtaccatatgttaatgcagtaccaatggattccatgcttaggcataataactggagcctggtaatcata

SEQ ID NO: 290616 - DNA, 75 bp, Artificial Sequence
  Synthetic
aaacaaaagacatatctagacttaaagaggctttagataaatatggtgttgacttgcctatgattactttcttaa

SEQ ID NO: 290617 - DNA, 75 bp, Artificial Sequence
  Synthetic
ttgttccatgtgttgctgtgcagagtggtgatattggtcatgtggtcatgcaatatatgtatgttccaccaggtg

SEQ ID NO: 290618 - DNA, 75 bp, Artificial Sequence
  Synthetic
atgttactcaaggtctgcccacactgttaacacctgggtcaggtcaattcttgacaacagatgatttccagtccc

SEQ ID NO: 290619 - DNA, 75 bp, Artificial Sequence
  Synthetic
taacttattctctaagtttcacttgaatccaggtgttgttactggttctgcagtagggtgtgatcctgagacttt

SEQ ID NO: 290620 - DNA, 75 bp, Artificial Sequence
  Synthetic
tttccttagtattgcctctgcatattacatgttttatgatggatatgatggtgactctgaatcaacacgctatgg

SEQ ID NO: 290621 - DNA, 75 bp, Artificial Sequence
  Synthetic
taacaacaccaatgataatattagagataaaagcatgtacacaattagacttggtggtgtaacaaatgctaagga

SEQ ID NO: 290622 - DNA, 75 bp, Artificial Sequence
  Synthetic
aagaaagttcttgaaaacttatcctttcaatctaatttgattgataggttgtgttactctaagcatttgtttaag

SEQ ID NO: 290623 - DNA, 75 bp, Artificial Sequence
  Synthetic
aaacatgttaaggtgtggtgcccgagaccccctagagcagttgaatacacaaatgtgcatctcacaaattataaa

SEQ ID NO: 290624 - DNA, 75 bp, Artificial Sequence
  Synthetic
cgattcagtttcatgttttgtggttctgcttttacaacacttaaattgttgattgcatacacaccaccaggaatc

SEQ ID NO: 290625 - DNA, 75 bp, Artificial Sequence
  Synthetic
tagatgcatataagaatattgatttggacaagttgaaaataatcgcatatggtgatgatgtgattttttcttaca

SEQ ID NO: 290626 - DNA, 75 bp, Artificial Sequence
  Synthetic
tatacagaaatttacatttatttaattcagagatatctgattctgtgctagtatcctactcatcagatttagtca

SEQ ID NO: 290627 - DNA, 75 bp, Artificial Sequence
  Synthetic
ctagtcattacagaaacactacaccagatacttattctgcagccggatacatcacttgctggtatcaaactgatt

SEQ ID NO: 290628 - DNA, 75 bp, Artificial Sequence
  Synthetic
caacaatgtgacttttcttaaacgtggttttaaacaagatgagaaacacacatttcttattcaccccacatttcc

SEQ ID NO: 290629 - DNA, 75 bp, Artificial Sequence
  Synthetic
agtcaaaagtcatgattggtatgagatacaggagagtgaatattacccaaaacacattcaatataatctattgat

SEQ ID NO: 290630 - DNA, 75 bp, Artificial Sequence
  Synthetic
taagcaaagtggggttatagcacaaaatcctgttgaaaggtatgtagatgaagtcttgaatgaagttcttgtagt

SEQ ID NO: 290631 - DNA, 75 bp, Artificial Sequence
  Synthetic
aaggtgtatgaggatttttccagtaagatacgcagtgtcagcgctggtcgtgcactgtatatcccaccttatgat

SEQ ID NO: 290632 - DNA, 75 bp, Artificial Sequence
  Synthetic
agatacgcagtgtcagcgctggtcgtgcactgtatatcccaccttatgatctattaaagcatgaatggtatgaaa

SEQ ID NO: 290633 - DNA, 75 bp, Artificial Sequence
  Synthetic
ttcatagatttaagacacttcttatgtgctgaggaacagggagtaacagactacatacacatgttaggtgaagcc

SEQ ID NO: 290634 - DNA, 75 bp, Artificial Sequence
  Synthetic
gttgaaacacgttatgtccaaacttcacaaactagggatgaaatgagtgttgagagctttttaggcagatctggt

SEQ ID NO: 290635 - DNA, 75 bp, Artificial Sequence
  Synthetic
actctgttattccggtaactttgtatgccagttttatctccctacccccaatgtaacttagaagatgtacacaac

SEQ ID NO: 290636 - DNA, 75 bp, Artificial Sequence
  Synthetic
tctctgctatggtaataataatcagaaattcttcagatccccagactgttgtcgccactcttacattgattgggt

SEQ ID NO: 290637 - DNA, 75 bp, Artificial Sequence
  Synthetic
tgcgcagaaaatttgagttgttcacctatgtaagatttgattcagaaataacaattgtgccatgtatagccgggc

SEQ ID NO: 290638 - DNA, 75 bp, Artificial Sequence
  Synthetic
ttatccgcaaagcgcctacgcaaagcctagtaacagcttcgaagatttatggttggtcgttccgctgttccccac

SEQ ID NO: 290639 - DNA, 75 bp, Artificial Sequence
  Synthetic
cctagtaacagcttcgaagatttatggttggtcgttccgctgttccccacagtagacctggcagatgaggctaga

SEQ ID NO: 290640 - DNA, 75 bp, Artificial Sequence
  Synthetic
tgaaatgtgcaatgcagcaagagggcttgagtggatagggaataaaatatcaaagtttatagaatggatgaaatc

SEQ ID NO: 290641 - DNA, 75 bp, Artificial Sequence
  Synthetic
caatgcatctgttttctggcaacatggtcaaatttacccccgattctctttaccatttcttagtattgcatctgc

SEQ ID NO: 290642 - DNA, 75 bp, Artificial Sequence
  Synthetic
aagactcaagaaagaataaagatagaaatagacacattgcatgatttatcatgcaagttccttccactttatgct

SEQ ID NO: 290643 - DNA, 75 bp, Artificial Sequence
  Synthetic
actgaagaacatactaacaaggtcaaggttacaactagaatctatcataaagctaaacatgtcaaagcatggtgt

SEQ ID NO: 290644 - DNA, 75 bp, Artificial Sequence
  Synthetic
tattggcaccatgggcgctcaggtatctagacagaatgttggcacacactcaacacaaaattcagtatcaaatgg

SEQ ID NO: 290645 - DNA, 75 bp, Artificial Sequence
  Synthetic
cgggtactggcaaatctataacaactagcttcttggcaagaatgattaccaatgagagtgatatatactcactac

SEQ ID NO: 290646 - DNA, 75 bp, Artificial Sequence
  Synthetic
ttagggaaattagaaactttggacccagtgacatgtatgtgcatgttggaaatttaatatatagaaatttgcatc

SEQ ID NO: 290647 - DNA, 75 bp, Artificial Sequence
  Synthetic
ccagtcaaagatgttttggagaagggtatccctactcttcaatcaccaactgtagaggcatgtgggtattcagat

SEQ ID NO: 290648 - DNA, 75 bp, Artificial Sequence
  Synthetic
tcaaatggtctccagtgtcactttcatccctccaatggctgacttaccagataagggaaaaccttttgattctag

SEQ ID NO: 290649 - DNA, 75 bp, Artificial Sequence
  Synthetic
tgattgcactcaagccacatactactgcaaacataaaaacagatattatccaattgaagttactagtcatgattg

SEQ ID NO: 290650 - DNA, 75 bp, Artificial Sequence
  Synthetic
aagatgccacagctattgataaaccatcacgtcctgacacttcatcaaacagattttacactttagagagtaaat

SEQ ID NO: 290651 - DNA, 75 bp, Artificial Sequence
  Synthetic
gtacatgacaattataaggatgcacaagggaaattggacgtttccaaagcatttaaaccatgtgatgtgaaagca

SEQ ID NO: 290652 - DNA, 75 bp, Artificial Sequence
  Synthetic
gtacatgacaattataaggatgcacaagggaaattggacgtttccaaagcatttaaaccatgtgatgtgaatgca

SEQ ID NO: 290653 - DNA, 75 bp, Artificial Sequence
  Synthetic
gtacatgacaattataaggatgcacaagggaaattggacgtttccaaagcatttaaaccatgtgatgtgaacgca

SEQ ID NO: 290654 - DNA, 75 bp, Artificial Sequence
  Synthetic
gtacatgacaattataaggatgcacaagggaaattggacgtttccaaagcatttaaaccatgtgatgtgaaggca

SEQ ID NO: 290655 - DNA, 75 bp, Artificial Sequence
  Synthetic
gtacatgacaattataaggatgcacaagggaaattggacgtttccaaagcatttaaaccatgtgatgtgtaagca

SEQ ID NO: 290656 - DNA, 75 bp, Artificial Sequence
  Synthetic
gtacatgacaattataaggatgcacaagggaaattggacgtttccaaagcatttaaaccatgtgatgtgtatgca

SEQ ID NO: 290657 - DNA, 75 bp, Artificial Sequence
  Synthetic
gtacatgacaattataaggatgcacaagggaaattggacgtttccaaagcatttaaaccatgtgatgtgtacgca

SEQ ID NO: 290658 - DNA, 75 bp, Artificial Sequence
  Synthetic
gtacatgacaattataaggatgcacaagggaaattggacgtttccaaagcatttaaaccatgtgatgtgtaggca

SEQ ID NO: 290659 - DNA, 75 bp, Artificial Sequence
  Synthetic
gtacatgacaattataaggatgcacaagggaaattggacgtttccaaagcatttaaaccatgtgatgtgcaagca

SEQ ID NO: 290660 - DNA, 75 bp, Artificial Sequence
  Synthetic
gtacatgacaattataaggatgcacaagggaaattggacgtttccaaagcatttaaaccatgtgatgtgcatgca

SEQ ID NO: 290661 - DNA, 75 bp, Artificial Sequence
  Synthetic
gtacatgacaattataaggatgcacaagggaaattggacgtttccaaagcatttaaaccatgtgatgtgcacgca

SEQ ID NO: 290662 - DNA, 75 bp, Artificial Sequence
  Synthetic
gtacatgacaattataaggatgcacaagggaaattggacgtttccaaagcatttaaaccatgtgatgtgcaggca

SEQ ID NO: 290663 - DNA, 75 bp, Artificial Sequence
  Synthetic
gtacatgacaattataaggatgcacaagggaaattggacgtttccaaagcatttaaaccatgtgatgtggaagca

SEQ ID NO: 290664 - DNA, 75 bp, Artificial Sequence
  Synthetic
gtacatgacaattataaggatgcacaagggaaattggacgtttccaaagcatttaaaccatgtgatgtggatgca

SEQ ID NO: 290665 - DNA, 75 bp, Artificial Sequence
  Synthetic
gtacatgacaattataaggatgcacaagggaaattggacgtttccaaagcatttaaaccatgtgatgtggacgca

SEQ ID NO: 290666 - DNA, 75 bp, Artificial Sequence
  Synthetic
gtacatgacaattataaggatgcacaagggaaattggacgtttccaaagcatttaaaccatgtgatgtggaggca

SEQ ID NO: 290667 - DNA, 75 bp, Artificial Sequence
  Synthetic
ctatgtaagcatggagtgattggaattatcacggctggtggcgagggtcatgtggctttcattgacttgagacac

SEQ ID NO: 290668 - DNA, 75 bp, Artificial Sequence
  Synthetic
gagtggttacactgtacatgtacagtgtaatgcaagtaaatttcatcaaggaacattaattgtggcaatgatacc

SEQ ID NO: 290669 - DNA, 75 bp, Artificial Sequence
  Synthetic
atctaatcctccaagaagataagagacgcacacatgttgttgatgtcatgtctgcaatatttcaaggaccaatat

SEQ ID NO: 290670 - DNA, 75 bp, Artificial Sequence
  Synthetic
caataaatcccataaacaatatcagtaaaaaagtcatcaaatggttattaagaattgtgtctgctatggtcataa

SEQ ID NO: 290671 - DNA, 75 bp, Artificial Sequence
  Synthetic
gatcaaaatgacaaacaacctagtgatgataattggctcaactttgacggaacactattaggtaatatcacaatc

SEQ ID NO: 290672 - DNA, 75 bp, Artificial Sequence
  Synthetic
caccgtcgttgctactctaacactaattggttgttctggctcaccatggagatttttgaaagagaaattttgtaa

SEQ ID NO: 290673 - DNA, 75 bp, Artificial Sequence
  Synthetic
agctgattgtaaaattgaaagggatctaaatcttgccaataatatcatcacaatcatagcaaatataatcagcat

SEQ ID NO: 290674 - DNA, 75 bp, Artificial Sequence
  Synthetic
attggagtttagtaattatacctatatgcccattagaaggaaccccaaccacagtacccattactatttccatta

SEQ ID NO: 290675 - DNA, 75 bp, Artificial Sequence
  Synthetic
aagatatctaaatttatagaatggatgaaatcaatgttaccacaagcacaactcaaagttaagtatttaaatgaa

SEQ ID NO: 290676 - DNA, 75 bp, Artificial Sequence
  Synthetic
gtggcacaaggccctgaggaggagtttggtcgttcccttattaaacataatacctgtgtagttactactgacaat

SEQ ID NO: 290677 - DNA, 75 bp, Artificial Sequence
  Synthetic
ccaatctccttgtgctttaccttggtaccacccaaccaaagagatatcaataccaggtcaggttaggaatttaat

SEQ ID NO: 290678 - DNA, 75 bp, Artificial Sequence
  Synthetic
atctatcctgcaaatttctcccactatatgctagtgaagccaaaagaattaaagtcatttacaataaatgcaata

SEQ ID NO: 290679 - DNA, 75 bp, Artificial Sequence
  Synthetic
ttagtgattcatatgatatgtacaacaaacaaggtattaagttagagattactgctgtagtgttagatagaaatg

SEQ ID NO: 290680 - DNA, 75 bp, Artificial Sequence
  Synthetic
atggcaaaggaaatttttgccatcaaagttgatattgcttcccaacccttagcaactaccttgattggagaggtt

SEQ ID NO: 290681 - DNA, 75 bp, Artificial Sequence
  Synthetic
gattactaatgaaagtgacatatactccttgccccctgacccaaagtactttgatggttacgatcagcaaagtgt

SEQ ID NO: 290682 - DNA, 75 bp, Artificial Sequence
  Synthetic
aaatgtgggtgatgtcatctcttatggcaatatattacttagtggtacccaaacagcacgtatgctcaaatacaa

SEQ ID NO: 290683 - DNA, 75 bp, Artificial Sequence
  Synthetic
caggtattggtaaaccaactaacaggaaagaagctatgttaggcactcatgttgtctgggatgtcggactacaat

SEQ ID NO: 290684 - DNA, 75 bp, Artificial Sequence
  Synthetic
ttaccagacaagggaaaaccctttgactcaagatttgttctgtgcagtactaatcattctcttttggcccctccc

SEQ ID NO: 290685 - DNA, 75 bp, Artificial Sequence
  Synthetic
atgttattgagatcctacttcagtgaaactcagggtgagattaaaacaacaaagaaagtcaatgaatgtggatac

SEQ ID NO: 290686 - DNA, 75 bp, Artificial Sequence
  Synthetic
aacaaatctcatagcaccaccaaacacaccgtcaacagctagaatgctctgttttgtttcaggatgcaaggattt

SEQ ID NO: 290687 - DNA, 75 bp, Artificial Sequence
  Synthetic
ccaaagcatttaggccatgtgatgttaagacaaaaattggaaatgctcgctgttgtccattcatatgtggtaaag

SEQ ID NO: 290688 - DNA, 75 bp, Artificial Sequence
  Synthetic
ctcgtttaaaaactgacttcaatcaggctttgttttcaaagtataaaggaaatgttaattgtgatatgtctgagc

SEQ ID NO: 290689 - DNA, 75 bp, Artificial Sequence
  Synthetic
ttagttgtcccaaatatcaaggagagtcaagccactacatcaaactctgcccctgctttagatgcagctgaaact

SEQ ID NO: 290690 - DNA, 75 bp, Artificial Sequence
  Synthetic
tgtcatgactgcaatattccaagggccaatttcaatggaagtcccccctcctcctgctataactgacctcttacg

SEQ ID NO: 290691 - DNA, 75 bp, Artificial Sequence
  Synthetic
tttggaagcacttgatttgaatacaagtgcgggctttccatacattagcatgggtattagaaagagggatttaat

SEQ ID NO: 290692 - DNA, 75 bp, Artificial Sequence
  Synthetic
gatctggttgtatacatatatctaaattagttgttgattatgatggttacaatgaggaaacaaagaacttcaaga

SEQ ID NO: 290693 - DNA, 75 bp, Artificial Sequence
  Synthetic
attatagcaattattgctaatataatcagcatagcaggtattatatacatcatatacaaattgttctgttctttc

SEQ ID NO: 290694 - DNA, 75 bp, Artificial Sequence
  Synthetic
aaggaaaagatttcagccggcaaaacaagggttattgaagctagcagtatcaatgatacagtagcttttagaatg

SEQ ID NO: 290695 - DNA, 75 bp, Artificial Sequence
  Synthetic
agctgccaagggtgttgatattggacatgttgtcatgcaatacatgtatgtcccaccaggtgcaccaatacccaa

SEQ ID NO: 290696 - DNA, 75 bp, Artificial Sequence
  Synthetic
aacacaacacatgtgtggttactactgataatggcaaattcactggattgggaatctatgataaactcatgatat

SEQ ID NO: 290697 - DNA, 75 bp, Artificial Sequence
  Synthetic
ttatgcttgatggagagtgcattatggcatttgattacactaattatgatggtagtatacaccctgtctggtttg

SEQ ID NO: 290698 - DNA, 75 bp, Artificial Sequence
  Synthetic
gcatctgcatattacatgttttatgatggttatgatggtgataaatctacatccaggtatggtacagtagttacc

SEQ ID NO: 290699 - DNA, 75 bp, Artificial Sequence
  Synthetic
agagatctcagctatagtattagatagaaatgagaaattcagggatatacgaaaatacataccagagagagagga

SEQ ID NO: 290700 - DNA, 75 bp, Artificial Sequence
  Synthetic
tgaagggggaataccatcagggtgttctggcactagtatattcaacacaatgataaataatgtgattataaggac

SEQ ID NO: 290701 - DNA, 75 bp, Artificial Sequence
  Synthetic
tctggtgtccaagaccaccaagagctgttgaatacacacacacccatgtcactaactacaagaaaagtgatgcta

SEQ ID NO: 290702 - DNA, 75 bp, Artificial Sequence
  Synthetic
ggcaatcaaacagcacggatgcttaaatataattaccccacaaaatcaggatactgtggtggtgttctatataaa

SEQ ID NO: 290703 - DNA, 75 bp, Artificial Sequence
  Synthetic
gaagcaattgctctagaaggaaataaatatggactgacaattacaccagctgataaatctgatacttttaagaag

SEQ ID NO: 290704 - DNA, 75 bp, Artificial Sequence
  Synthetic
attcaactcagagatgcatgattcaatcttagtctcctattcctcagacttagtcatataccgcacaaatacaat

SEQ ID NO: 290705 - DNA, 75 bp, Artificial Sequence
  Synthetic
cagtgacaaagaaagttactgaatgtgggcttccaacaatacacaccccatccaaaaccaagttgcaacctagtg

SEQ ID NO: 290706 - DNA, 75 bp, Artificial Sequence
  Synthetic
agtcgattaggtggaccaagaaaccttcacaaatgcaggagcatgtgctttccttgtgtcatttgatgtggcaca

SEQ ID NO: 290707 - DNA, 75 bp, Artificial Sequence
  Synthetic
tacgaaatccaggaaagtgaatattacccaaagcacatacaatataaccttttaattggggaaggaccatgtgaa

SEQ ID NO: 290708 - DNA, 75 bp, Artificial Sequence
  Synthetic
gctggacgtgcactgtatatccctccatatgaactcctcttgcatgagtggtatgaaaaattttaactaaatata

SEQ ID NO: 290709 - DNA, 75 bp, Artificial Sequence
  Synthetic
taagggtaatatagaatgtagcatgactgatcatatgagagttgctgtatcacattattcagctcaactaatgac

SEQ ID NO: 290710 - DNA, 75 bp, Artificial Sequence
  Synthetic
tccattgtgctgaagaacagggtataactgactatgtccacatgttaggtgaagcctttggtttggggtttgtag

SEQ ID NO: 290711 - DNA, 75 bp, Artificial Sequence
  Synthetic
ataagtatgggaataaagaaaagagatctaataaacaacagcacaaaagacataaccaaattaaagctagcactt

SEQ ID NO: 290712 - DNA, 75 bp, Artificial Sequence
  Synthetic
aataagaaattcatctgatccacaaacaataattgcaacattaactctaattggttgttctggttcaccatggag

SEQ ID NO: 290713 - DNA, 75 bp, Artificial Sequence
  Synthetic
gtagtgtaaatgatacaatagcctttagagtagtgtatggaaatttgttttctacttttcataaaaatcctggtg

SEQ ID NO: 290714 - DNA, 75 bp, Artificial Sequence
  Synthetic
agaggtctagaatggattggcaataaaatctcaaagtttattgagtggatgaaatctatgctgccccaagctcaa

SEQ ID NO: 290715 - DNA, 75 bp, Artificial Sequence
  Synthetic
ttatgatggtagcatacacccaatttggtttgaggctcttaaacaagttttgataaatttatcatttgaagacaa

SEQ ID NO: 290716 - DNA, 75 bp, Artificial Sequence
  Synthetic
gcttatagacagattgtgtaggtcaaaacatatattcagagacacatattatgaagttgaaggtggggtaccctc

SEQ ID NO: 290717 - DNA, 75 bp, Artificial Sequence
  Synthetic
aacatgaagttgacacactacatgatttatcctgcaaatttctcccactttatgccagtgaggcaaaaagaatta

SEQ ID NO: 290718 - DNA, 75 bp, Artificial Sequence
  Synthetic
aaaataatagcatatggtgatgatgttattttttcctacaaataccctttagacatggaggcaattgctatagaa

SEQ ID NO: 290719 - DNA, 75 bp, Artificial Sequence
  Synthetic
gactacaagctttctggcaaggatgataaccaatgaaagtgatatctactcgctaccaccagatcctaaatactt

SEQ ID NO: 290720 - DNA, 75 bp, Artificial Sequence
  Synthetic
aggatgctaaatacccattcctgattcacccaacatttccagtttctgaaatccatgagtccatcagatggacta

SEQ ID NO: 290721 - DNA, 75 bp, Artificial Sequence
  Synthetic
acttttataccaccaatggctgatttaccagataaagggaagccatttgattccagatttgtgttgtgtagtact

SEQ ID NO: 290722 - DNA, 75 bp, Artificial Sequence
  Synthetic
cgtgagcgctggacgtgcgctatatatccctccatatgaattactcctgcatgagtggtacgaaaaattctgaat

SEQ ID NO: 290723 - DNA, 75 bp, Artificial Sequence
  Synthetic
attcacaagggaaattaaatgtttctgctgctttccaaccatgtgatgtaaatacaaaaattggtaatgcccgct

SEQ ID NO: 290724 - DNA, 75 bp, Artificial Sequence
  Synthetic
taaaagacgcaggcaagtcattgatgttatgacagcaatattccaagggccaattagtctagagggacccccacc

SEQ ID NO: 290725 - DNA, 75 bp, Artificial Sequence
  Synthetic
taaaagacgcaggctagtcattgatgttatgacagcaatattccaagggccaattagtctagagggacccccacc

SEQ ID NO: 290726 - DNA, 75 bp, Artificial Sequence
  Synthetic
taaaagacgcaggccagtcattgatgttatgacagcaatattccaagggccaattagtctagagggacccccacc

SEQ ID NO: 290727 - DNA, 75 bp, Artificial Sequence
  Synthetic
taaaagacgcaggcgagtcattgatgttatgacagcaatattccaagggccaattagtctagagggacccccacc

SEQ ID NO: 290728 - DNA, 75 bp, Artificial Sequence
  Synthetic
agagaccttaatatagctaatacaatcattacaattatagctaatattattagtatttcaggaataatttatgta

SEQ ID NO: 290729 - DNA, 75 bp, Artificial Sequence
  Synthetic
acactgttatcacggtaattttgtacgccagttttataacccctttcccttttgtaacttagaagtttgaacttg

SEQ ID NO: 290730 - DNA, 75 bp, Artificial Sequence
  Synthetic
aagaatttggcagatctcttattaaacataattcatgtgttgtgactactgaaaatggaaaatttacaggtttag

SEQ ID NO: 290731 - DNA, 75 bp, Artificial Sequence
  Synthetic
agaccaataggcggtggtcaaccagatcactaaaggtcaagcacttctgtttccccggtcaacgttgatatgctc

SEQ ID NO: 290732 - DNA, 75 bp, Artificial Sequence
  Synthetic
agacctataggcggtggtcaaccagatcactaaaggtcaagcacttctgtttccccggtcaacgttgatatgctc

SEQ ID NO: 290733 - DNA, 75 bp, Artificial Sequence
  Synthetic
agacccataggcggtggtcaaccagatcactaaaggtcaagcacttctgtttccccggtcaacgttgatatgctc

SEQ ID NO: 290734 - DNA, 75 bp, Artificial Sequence
  Synthetic
agaccgataggcggtggtcaaccagatcactaaaggtcaagcacttctgtttccccggtcaacgttgatatgctc

SEQ ID NO: 290735 - DNA, 75 bp, Artificial Sequence
  Synthetic
tagtagacctggcagatgaggctggaaattccccactggcgacagtgttccagcctgcgtggctgcctgcgcact

SEQ ID NO: 290736 - DNA, 75 bp, Artificial Sequence
  Synthetic
gttcaataaagatggagtcaagctagagattactgtgcttaaacttaagaggaatgaaaaatttaaagatattag

SEQ ID NO: 290737 - DNA, 75 bp, Artificial Sequence
  Synthetic
ctcactttgagtcctccggcccctgaatgtggctaaccttaaccctgcagctagtgcatacaatccagtgtgtag

SEQ ID NO: 290738 - DNA, 75 bp, Artificial Sequence
  Synthetic
tcttatggaaacatcttattaagtgggaaccaaacagccagaatgctcaagtataactatccaacaaaatcagga

SEQ ID NO: 290739 - DNA, 75 bp, Artificial Sequence
  Synthetic
tatattgttgccatgggcgcacaagtttccagacagaatgttggtacacactccacacagaacatggtttcaaat

SEQ ID NO: 290740 - DNA, 75 bp, Artificial Sequence
  Synthetic
tttccgaaacacaaggtcagataattacctccaaatccactatagagtgcaacttacccagtatacacacaccaa

SEQ ID NO: 290741 - DNA, 75 bp, Artificial Sequence
  Synthetic
acccagtcaaagatgttcttgagaagggaatcccaacattacaatctcctacagtagaagcatgtggttactcag

SEQ ID NO: 290742 - DNA, 75 bp, Artificial Sequence
  Synthetic
taatgaagcactcttttccaaatataaaggaaataaccattgcacaatgaatgatcatattaaggtggctatctc

SEQ ID NO: 290743 - DNA, 75 bp, Artificial Sequence
  Synthetic
aaaagatgccactgccattgacaaacccacacaaccagacacttcatcaaatagattctacacactggaaagcaa

SEQ ID NO: 290744 - DNA, 75 bp, Artificial Sequence
  Synthetic
aataccagtgcaggattcccctatgtatccatgggaattaaaaagagagatttaataaacaaacaaactaaagac

SEQ ID NO: 290745 - DNA, 75 bp, Artificial Sequence
  Synthetic
agaagtggttacactgtgcatgttcaatgtaatgctagtaaatttcatcaaggaactttgctaattatgatgata

SEQ ID NO: 290746 - DNA, 75 bp, Artificial Sequence
  Synthetic
gcaagactcgtgtgatagaagcaagcagtgtgaatgatactgtattgtttaggacaacctttggtaatctttttt

SEQ ID NO: 290747 - DNA, 75 bp, Artificial Sequence
  Synthetic
tttctcatgctaaccttccaagtgatgataattggctcaactttgatggcactttattaggtaatgctcttatat

SEQ ID NO: 290748 - DNA, 75 bp, Artificial Sequence
  Synthetic
tataatggcatttgattatactaattatgatggtagcatacatccaatatggtttcaagcccttaaagaggtttt

SEQ ID NO: 290749 - DNA, 75 bp, Artificial Sequence
  Synthetic
ttggagtttagtgataatcccaatttgtgagttattagcagattccaaagctagtgctgtggttccaatcactat

SEQ ID NO: 290750 - DNA, 75 bp, Artificial Sequence
  Synthetic
ggatgctctggcacaagcatatttaatacaatgattaataatgtcattatcagaacattagttttagatgcatat

SEQ ID NO: 290751 - DNA, 75 bp, Artificial Sequence
  Synthetic
tttatgacgactgatgacttccaatcaccttcagccttaccatggtatcacccaaccaaggagatcttgattcca

SEQ ID NO: 290752 - DNA, 75 bp, Artificial Sequence
  Synthetic
gtgtgaaatatggtctaacaataaccccagctgacaaatctgagaattttaaacaacttgattacaataatgtga

SEQ ID NO: 290753 - DNA, 75 bp, Artificial Sequence
  Synthetic
aattatctaatcaaacagaaatggcccaagagatttttgctatcaaggtagatattgcctcacagcctttggcaa

SEQ ID NO: 290754 - DNA, 75 bp, Artificial Sequence
  Synthetic
gaaaccatcacaaatgcaggagcacgttctgtccttgtgtcatctaatgtggcacaatggtagagatgtgtacaa

SEQ ID NO: 290755 - DNA, 75 bp, Artificial Sequence
  Synthetic
gttggtgctggtcgcgcactgtacattcccccatacgatctgctcttgcatgaatggtatgaaaaattttagatt

SEQ ID NO: 290756 - DNA, 75 bp, Artificial Sequence
  Synthetic
gcttttggcatacacaccaccaggcattggtaaaccaagagacagaaagcaagctatgcttggaacacatatagt

SEQ ID NO: 290757 - DNA, 75 bp, Artificial Sequence
  Synthetic
ttaaaactgggagtgggttgttcccactcactccacccatgcggtgttgtactctgttattacggtaaccttgta

SEQ ID NO: 290758 - DNA, 75 bp, Artificial Sequence
  Synthetic
tatataacatgttggtatcaaacaaattttgtttttcccccaaacactcctaatagggctgacatgttgtgtttt

SEQ ID NO: 290759 - DNA, 75 bp, Artificial Sequence
  Synthetic
aagaggtacttaatgaggtcttagttgtaccaaatatcaaagaaagtcatccaagtacatccaactctgccccga

SEQ ID NO: 290760 - DNA, 75 bp, Artificial Sequence
  Synthetic
cattgagagcttccttggcaggtcaggatgtgtgcattcctcaacaatacaatcaaatgagcaacacattaataa

SEQ ID NO: 290761 - DNA, 75 bp, Artificial Sequence
  Synthetic
ccgtgtttcctgtttttcttttgattgcattttatggtgacaatttatagagtatagattgtcatcatgggtgca

SEQ ID NO: 290762 - DNA, 75 bp, Artificial Sequence
  Synthetic
ccatgtattgcagggtatggtgatgacataggtcacatagttatgcaatacatgtatgtgccgcctggggctcca

SEQ ID NO: 290763 - DNA, 75 bp, Artificial Sequence
  Synthetic
accaacagttgaggcttgtggttattcagacaggctaatacaaataacccgaggagattccactataacgtctca

SEQ ID NO: 290764 - DNA, 75 bp, Artificial Sequence
  Synthetic
tgagtgttgcatctgcttattacatgttttatgatggctataatggtgacagaagtggagccaagtatggcacca

SEQ ID NO: 290765 - DNA, 75 bp, Artificial Sequence
  Synthetic
tctaatagattctacactctggatagtcgttcctggacatctgcctcatctggttggtggtggaaattgcctgat

SEQ ID NO: 290766 - DNA, 75 bp, Artificial Sequence
  Synthetic
tgtgaaagcatggtgtcctagaccacctagagctgttccatatagatatgttggatcaacaaattacaaacctga

SEQ ID NO: 290767 - DNA, 75 bp, Artificial Sequence
  Synthetic
atcagggtttattgatagttgctgctatcccagaacatcaattggcatctgcgacaagtggaaatgtatcagttg

SEQ ID NO: 290768 - DNA, 75 bp, Artificial Sequence
  Synthetic
agaaatttacatttatttaattcagaagcacatgattcagtgttagtatcatattcctcagatttagtcatctac

SEQ ID NO: 290769 - DNA, 75 bp, Artificial Sequence
  Synthetic
gcgacaagtggaaatgtatcagttggatacaaccatacccacccaggtgagcaaggtagagaagtggtgccatca

SEQ ID NO: 290770 - DNA, 75 bp, Artificial Sequence
  Synthetic
ccagtcacgattggtatgaaattcaagagagtgaatactatccaaaacacattcaatacaatcttttaattggtg

SEQ ID NO: 290771 - DNA, 75 bp, Artificial Sequence
  Synthetic
cccaatatgccctcttcaagttcaaccaggggggacacaatccatacctataacagtatcaatcagccctatgtt

SEQ ID NO: 290772 - DNA, 75 bp, Artificial Sequence
  Synthetic
ccaggggggacacaatccatacctataacagtatcaatcagccctatgttttcagaattctcagggccgaggaat

SEQ ID NO: 290773 - DNA, 75 bp, Artificial Sequence
  Synthetic
tgatctcagacaatttcactgtgcagatgagcaaggaataactgactacatccacatgttgggtgaggcttttgg

SEQ ID NO: 290774 - DNA, 75 bp, Artificial Sequence
  Synthetic
gcaatggttataatcatcagaaattcctctgatccacaaacaatcatagctacattaacactaattggttgctca

SEQ ID NO: 290775 - DNA, 75 bp, Artificial Sequence
  Synthetic
cataccagtagatattgcctcacaacctttagccactaccctcataggtgaacttgcaagttattatacacactg

SEQ ID NO: 290776 - DNA, 75 bp, Artificial Sequence
  Synthetic
tgtgcaacgcagccaggggcctagagtggattggaaacaaaatatcaaaattcattgaatggatgaaatctatgc

SEQ ID NO: 290777 - DNA, 75 bp, Artificial Sequence
  Synthetic
tccaggagagaagccatgcttggtacacacttagtgtgggacgtgggattgcagtccactgcctcgctagttgta

SEQ ID NO: 290778 - DNA, 75 bp, Artificial Sequence
  Synthetic
acaggaaaagatcaaatgtgagattgataccttacatgatctctcttgcaaatttttgccactctatgccagtga

SEQ ID NO: 290779 - DNA, 75 bp, Artificial Sequence
  Synthetic
atagtacaccagacaatgctaaaatggtgtgcatggtttctgcatgtaaagatttttgtttaagattagccagag

SEQ ID NO: 290780 - DNA, 75 bp, Artificial Sequence
  Synthetic
actggcaaatctatgactacaaattttcttgctagaatgataactaatgatagtgacatttactccctaccacct

SEQ ID NO: 290781 - DNA, 75 bp, Artificial Sequence
  Synthetic
tggtatctagtgttacatttataccaccaatggctgacctacctgataagggcaaaccttttgattccagatttg

SEQ ID NO: 290782 - DNA, 75 bp, Artificial Sequence
  Synthetic
tgataaatataaggatccacagggaaaattaaatgtagctgctgcttttcaaccttgtgatgtaaatacaaaaat

SEQ ID NO: 290783 - DNA, 75 bp, Artificial Sequence
  Synthetic
atacttgttgaagacaaaaggcgtaggcaagttgtggatgttatggcagcaatctttcagggacctattactctt

SEQ ID NO: 290784 - DNA, 75 bp, Artificial Sequence
  Synthetic
ccataccctagattcacaatcccttttatgagcattgcatcagcttattatatgttttatgatggttatgatgga

SEQ ID NO: 290785 - DNA, 75 bp, Artificial Sequence
  Synthetic
tatgttttatgatggttatgatggagatagtgcggcatcaaaatatggttctgtagtcactaatgacatgggaac

SEQ ID NO: 290786 - DNA, 75 bp, Artificial Sequence
  Synthetic
agtgtaaggttgagagagatctcaatatagccaatacagttattacaattattgctaacattattagtatctctg

SEQ ID NO: 290787 - DNA, 75 bp, Artificial Sequence
  Synthetic
tcaagggccagaagaagaatttggtaggtcgcttattaaacacaactcatgtattgtaacaacacagaatggcaa

SEQ ID NO: 290788 - DNA, 75 bp, Artificial Sequence
  Synthetic
acacacactcaactaactacataccactcaatggtgaggctacaactcagatcaaaactagacccgatgttttta

SEQ ID NO: 290789 - DNA, 75 bp, Artificial Sequence
  Synthetic
actcaatggtgaggctacaactcagatcaaaactagacccgatgtttttaccatcacaaacgtcggaccatctag

SEQ ID NO: 290790 - DNA, 75 bp, Artificial Sequence
  Synthetic
gattcctatgatttgtttaataaagatgggatcaagctagaaattacagtgcttaaacttaagagaaatgaaaag

SEQ ID NO: 290791 - DNA, 75 bp, Artificial Sequence
  Synthetic
tttaaggatatcagaaagtacattccagaaaatgaagatgattatccagattgtaatttggccctatctgctaat

SEQ ID NO: 290792 - DNA, 75 bp, Artificial Sequence
  Synthetic
caacaaaatcaggttattgtggtgggattctatacaaaattggacaagttttggggattcatgttggtggtaatg

SEQ ID NO: 290793 - DNA, 75 bp, Artificial Sequence
  Synthetic
aagcatggtgttataggtatggttacagccggaggtgagggccatgttgcttttattgacctaagaaaattccaa

SEQ ID NO: 290794 - DNA, 75 bp, Artificial Sequence
  Synthetic
tattcacacacctagtaaaactaagttacaacctagtgtattttatgatgtctttcccggtagtaaggagccagc

SEQ ID NO: 290795 - DNA, 75 bp, Artificial Sequence
  Synthetic
ccgtgtgctcatcttgagtcctccggcccctgaatgcggctaaccttaaacccgcagccattactcacaatccag

SEQ ID NO: 290796 - DNA, 75 bp, Artificial Sequence
  Synthetic
agggtggcaatttctcattattcagcacagttaatgacattagatattgattcaaatccaatctcattagaagat

SEQ ID NO: 290797 - DNA, 75 bp, Artificial Sequence
  Synthetic
tgtgggatgggaccgactactttgggtgtccgtgtttcatgttttactttatgacttgcttatggtgacaatata

SEQ ID NO: 290798 - DNA, 75 bp, Artificial Sequence
  Synthetic
ctgaagcatgtaatgcagcacgcggactagaatggattggacaaaagatatccaaatttatagattggataaaga

SEQ ID NO: 290799 - DNA, 75 bp, Artificial Sequence
  Synthetic
aacaaacaagagacattacaaaactcaaaatggcattagataagtatggtgttgatttacctatggtcacatttc

SEQ ID NO: 290800 - DNA, 75 bp, Artificial Sequence
  Synthetic
tttcaacattaattactttaaggatgctgcttctagtggagcatctaaattggaattttcacaagatcccagtaa

SEQ ID NO: 290801 - DNA, 75 bp, Artificial Sequence
  Synthetic
tagtgatcaagagaaaatttacattgaaataaacaccctccatgatctatccttgaaattcttaccactgtatgc

SEQ ID NO: 290802 - DNA, 75 bp, Artificial Sequence
  Synthetic
tggtaacctcttttctaaatttcatctaaatcctggcatcgttactggttctgcagtgggatgtgatccagaaac

SEQ ID NO: 290803 - DNA, 75 bp, Artificial Sequence
  Synthetic
acaagaggagattccacaattacatcacaggatgtagcaaatgctgttgtggggtacgggatatggccacactac

SEQ ID NO: 290804 - DNA, 75 bp, Artificial Sequence
  Synthetic
cctggcactggaaaatctcttgccacctctgttcttgctcgaatgttaactgttgaaactgatatatattcttta

SEQ ID NO: 290805 - DNA, 75 bp, Artificial Sequence
  Synthetic
ctcaaagaagtactctctaatttggggttcaagcctaatttaatagatagattgtgtagatcaaaacatattttt

SEQ ID NO: 290806 - DNA, 75 bp, Artificial Sequence
  Synthetic
cgaaaggttggtggtggaaattgccagatgcactcaaggaaatgggagtttttggacagaacatgtattaccatt

SEQ ID NO: 290807 - DNA, 75 bp, Artificial Sequence
  Synthetic
gccaaatggtgtcaagtgtccctttcatacctcctatggcagatcttccagataagggaaaaccatttacatcta

SEQ ID NO: 290808 - DNA, 75 bp, Artificial Sequence
  Synthetic
aatttgtgcttgcaagtaccaatcacactctattaacaccaccaacagtgtcctcattaccagcaatggcaagga

SEQ ID NO: 290809 - DNA, 75 bp, Artificial Sequence
  Synthetic
ttctagatgcttacaaaaatattgatttagataagcttaagataatagcctatggagatgatgttatcttttctt

SEQ ID NO: 290810 - DNA, 75 bp, Artificial Sequence
  Synthetic
aagtgcagagaaaggaaatgttaatactggctataattacacacaccctggtgaaaggggtagggatgttgggca

SEQ ID NO: 290811 - DNA, 75 bp, Artificial Sequence
  Synthetic
aataggcaatgctaagtgctgtccatttatctgtggaaaagctgtagagtttaaagatagaaattcatgtacaac

SEQ ID NO: 290812 - DNA, 75 bp, Artificial Sequence
  Synthetic
ctacaacagtgtaacctttctaaagagaggattcaaacaggatgacaagtactcatttctaatacatccaacttt

SEQ ID NO: 290813 - DNA, 75 bp, Artificial Sequence
  Synthetic
aacttgagaagcaacaattctgcaacacttattctcccatatgtaaatgctgtacctatggactctatgcttaga

SEQ ID NO: 290814 - DNA, 75 bp, Artificial Sequence
  Synthetic
caatcccctccacctccagctatagctgatcttcttagatctgtaaaaacgccagagattatcaagtattgtcaa

SEQ ID NO: 290815 - DNA, 75 bp, Artificial Sequence
  Synthetic
agggatgtgtataagcagttcgagcaaaagatacgcagtgtgagcgctggtcgcgcactgtatatcccaccatac

SEQ ID NO: 290816 - DNA, 75 bp, Artificial Sequence
  Synthetic
ctgaattctctggagcgcgagcccgtagccagggattgccagtattaatgaccccaggatctggtcagttcatga

SEQ ID NO: 290817 - DNA, 75 bp, Artificial Sequence
  Synthetic
gtgttatttacataatttataaattgttttgtacacttcaaggtccatactcaggggaacctaaacccaaaagca

SEQ ID NO: 290818 - DNA, 75 bp, Artificial Sequence
  Synthetic
actctattattacggtaattttgtacgccagttttatctcccttaccccctttgtaacttagaagatttaaacac

SEQ ID NO: 290819 - DNA, 75 bp, Artificial Sequence
  Synthetic
ggttgatacaattataccaattaattatacaacagcaaatacaactagtgttaatatgtacactgtggtgctgca

SEQ ID NO: 290820 - DNA, 75 bp, Artificial Sequence
  Synthetic
atttacaggtcttggtatatatgaccaagtcatggtacttccaactcattctgatccaggctctgagatcttaat

SEQ ID NO: 290821 - DNA, 75 bp, Artificial Sequence
  Synthetic
gttatccgcaaggtgcctacacaaagcttagtaacattttgaagagcatttggttggtcgctcagctattacccc

SEQ ID NO: 290822 - DNA, 75 bp, Artificial Sequence
  Synthetic
cattggactggtagtttgagatttagcctcatgttttgcggaacggcaggcaccacacttaaattactagttgcc

SEQ ID NO: 290823 - DNA, 75 bp, Artificial Sequence
  Synthetic
agatggagtgaaagttaaagtctctgattcctatgatttgcacaaccatgagggagtcaagctagaaatcacagt

SEQ ID NO: 290824 - DNA, 75 bp, Artificial Sequence
  Synthetic
ttgtgccttgggtcagtgctagtcattttagaaacaccacaccagataaattctcacaagcaggatacataacat

SEQ ID NO: 290825 - DNA, 75 bp, Artificial Sequence
  Synthetic
atgggaccaactactttgggtgtccgtgtttcactttttccttttatatttgcttatggtgacaatatatatagc

SEQ ID NO: 290826 - DNA, 75 bp, Artificial Sequence
  Synthetic
cttggcatacatgttggtggtaatggtagagatggattttctgcaatgcttcttaaatcttactttggtgaaact

SEQ ID NO: 290827 - DNA, 75 bp, Artificial Sequence
  Synthetic
tagagacactaacttacataaacaagttggacccatcacacaaaatccagttgaaaaatatgttgacagtgttct

SEQ ID NO: 290828 - DNA, 75 bp, Artificial Sequence
  Synthetic
atcaattatttcaaggatgcagcctctagcggtgcttctaagttagagttttcacaagatcccagcaaatttaca

SEQ ID NO: 290829 - DNA, 75 bp, Artificial Sequence
  Synthetic
ctgtatctgtaaagaatttaccatccatacatgtttcatccaaaacccggctacagcccagtgtttttcatgatg

SEQ ID NO: 290830 - DNA, 75 bp, Artificial Sequence
  Synthetic
gtacaacctgaagacatgattgaaacacggtatgtccaaacatcacaaactagggatgagatgagtcttgagagt

SEQ ID NO: 290831 - DNA, 75 bp, Artificial Sequence
  Synthetic
tgcttgtcaagtgactccacacatgaaaattgctgtagcacattatgcagcacagttatctacactagacataaa

SEQ ID NO: 290832 - DNA, 75 bp, Artificial Sequence
  Synthetic
gtgattcaacaatcacatcacaagatgtagccaatgcagttgttggttatggtgtatggccacattacttaagtg

SEQ ID NO: 290833 - DNA, 75 bp, Artificial Sequence
  Synthetic
atggtggtggaaattgccagatgctctgaaagacatgggtatatttggggaaaatatgtattatcattatttggg

SEQ ID NO: 290834 - DNA, 75 bp, Artificial Sequence
  Synthetic
ataaagaagaaagatcttatagataaaaagactagagacattacaaaacttaagaaagcaattgatgaatacggt

SEQ ID NO: 290835 - DNA, 75 bp, Artificial Sequence
  Synthetic
cttgtatagcctctcaaagtaatgacattgggcatgtagtgatgcaatacatgtatgtcccacctggtgcaccca

SEQ ID NO: 290836 - DNA, 75 bp, Artificial Sequence
  Synthetic
gaaaataaaagatggaaaaactagagttatagaggccaatagtgtgaatgataccgtgttgttcagaagtgtgtt

SEQ ID NO: 290837 - DNA, 75 bp, Artificial Sequence
  Synthetic
agcagtggtaatgttacagcaggttacaactttacacatcctggtgagcagggaagggaagtgggcagtacacgt

SEQ ID NO: 290838 - DNA, 75 bp, Artificial Sequence
  Synthetic
aagcatagcctcagcttattacatgttttatgatggttatgatggtgatgttcccgggtcaagatatgggaccat

SEQ ID NO: 290839 - DNA, 75 bp, Artificial Sequence
  Synthetic
gaaccaataattcggcaacaataattgtgccatatgtaaatgcagtaccaatggattcaatgcttagacataata

SEQ ID NO: 290840 - DNA, 75 bp, Artificial Sequence
  Synthetic
gtgaaagcgtggtgcccacgacccccaagagctgtgggttacacacacacacatgttaccaactacaaaccatca

SEQ ID NO: 290841 - DNA, 75 bp, Artificial Sequence
  Synthetic
aatctgtaattctaaacatatatacaaatctaaatattatgaagtagaaggaggtatgccgtctggatgtgctgg

SEQ ID NO: 290842 - DNA, 75 bp, Artificial Sequence
  Synthetic
attttctggagcccgagctcatcccacggctcagggattacctgtgtatatcacacctggatctggacagttcat

SEQ ID NO: 290843 - DNA, 75 bp, Artificial Sequence
  Synthetic
acagaaatttacatctttttaattctgatgtccatgattctatcttagtctcttattcatctgatctagtcattt

SEQ ID NO: 290844 - DNA, 75 bp, Artificial Sequence
  Synthetic
agaatagatattacccaataaaagttactagccatgattggtatgaaatacaagaaagtgagtattatcccaaac

SEQ ID NO: 290845 - DNA, 75 bp, Artificial Sequence
  Synthetic
aatctgatgttttccaagagttaacttacaagaatgtgacttttctcaaaagaggattcagagctgatgaacgcc

SEQ ID NO: 290846 - DNA, 75 bp, Artificial Sequence
  Synthetic
caagtggatacattgattcctattaataacacacaggaaaatttaaagaaagttaatgtatatacaatacaatta

SEQ ID NO: 290847 - DNA, 75 bp, Artificial Sequence
  Synthetic
actcttttcttgtgcatcctacctttcctgtggctgaaatttatgattccattagatggactaagaacccttcat

SEQ ID NO: 290848 - DNA, 75 bp, Artificial Sequence
  Synthetic
aggtggtgagggacatgtggctttcatagatttgagacatttccattgtgcagaagaacaaggtatcacagacta

SEQ ID NO: 290849 - DNA, 75 bp, Artificial Sequence
  Synthetic
ttacacattggactggcagcttgcgctttagctttatgttttgtggcacagcaaatactactttgaagttacttt

SEQ ID NO: 290850 - DNA, 75 bp, Artificial Sequence
  Synthetic
gttaaatggatccttaggataatatctgctatggtgataatcataaggaatagctcagatccgcaaacagttata

SEQ ID NO: 290851 - DNA, 75 bp, Artificial Sequence
  Synthetic
cttggttgtcccatgggttagtgctagtcattttagatacaccacaccagatacatactctgcagctggatacat

SEQ ID NO: 290852 - DNA, 75 bp, Artificial Sequence
  Synthetic
cttggttgtcccatgggttagtgctagtcattttagttacaccacaccagatacatactctgcagctggatacat

SEQ ID NO: 290853 - DNA, 75 bp, Artificial Sequence
  Synthetic
cttggttgtcccatgggttagtgctagtcattttagctacaccacaccagatacatactctgcagctggatacat

SEQ ID NO: 290854 - DNA, 75 bp, Artificial Sequence
  Synthetic
cttggttgtcccatgggttagtgctagtcattttaggtacaccacaccagatacatactctgcagctggatacat

SEQ ID NO: 290855 - DNA, 75 bp, Artificial Sequence
  Synthetic
actctgttattccggtaactttgtacgccagttttatacccccttccccctttgtaacttagaagctgaacatac

SEQ ID NO: 290856 - DNA, 75 bp, Artificial Sequence
  Synthetic
actcatggcttaagaaattcacagaaatgtgcaatgcagcaagaggtcttgagtggattggaaataaaatatcca

SEQ ID NO: 290857 - DNA, 75 bp, Artificial Sequence
  Synthetic
atggctagagacactgacatgcatatccaaaatgatgctatcacacaaaatccagttgaggactatatcgataat

SEQ ID NO: 290858 - DNA, 75 bp, Artificial Sequence
  Synthetic
gttatccgcaagacaactacgcaaagcctagtatcatctttgaaagtatgtggttggtcgctccgctataaactc

SEQ ID NO: 290859 - DNA, 75 bp, Artificial Sequence
  Synthetic
gaacttgcgctgtgcagatgcaaaaacccaggagaaaataaaagtagaagttgataccctccatgatttatcatg

SEQ ID NO: 290860 - DNA, 75 bp, Artificial Sequence
  Synthetic
tttgacaaggtgtgaagagccccgtgtgcttgtcttgagtcctccggcccctgaatgtggctaaccttaaccctg

SEQ ID NO: 290861 - DNA, 75 bp, Artificial Sequence
  Synthetic
gtagtgtgcaaccagaagatacagttgagacccgctatgtacaaacttcccagacaagggatgagatgagtattg

SEQ ID NO: 290862 - DNA, 75 bp, Artificial Sequence
  Synthetic
gctgtgatgatacatggtccacctggaactggtaagtctataactacaagctttcttgctaggatgataacaaat

SEQ ID NO: 290863 - DNA, 75 bp, Artificial Sequence
  Synthetic
tttgcttatggtgacaatatatatataacatatatattggcatcatgggcgctcaagtttcaagacagaatgttg

SEQ ID NO: 290864 - DNA, 75 bp, Artificial Sequence
  Synthetic
actacaagaaatggctcaaattaggcgcaaatttgaaatgtttacatatgtaagatttgattcagaaattacatt

SEQ ID NO: 290865 - DNA, 75 bp, Artificial Sequence
  Synthetic
gagaggacatgtccctgttttgtcagatggtgtcaagtgtcacgtttattccaccaatggccgatttgccagata

SEQ ID NO: 290866 - DNA, 75 bp, Artificial Sequence
  Synthetic
tttgcatggcagtcagggactaatgcatcaatattctggcaacatggacaaccattcccaagattttcactacct

SEQ ID NO: 290867 - DNA, 75 bp, Artificial Sequence
  Synthetic
tgaattctcacaggatccaagtaaatttacagacccagtcaaggatgtattggaaaaaggaatccccactctaca

SEQ ID NO: 290868 - DNA, 75 bp, Artificial Sequence
  Synthetic
ttatttagatttggatataattgtgcatgaaaattacaaaaacgcccaagggaaattggacgtgtccagatcttt

SEQ ID NO: 290869 - DNA, 75 bp, Artificial Sequence
  Synthetic
cactgtgcattagaatagtcactaatcagcaaaatcatgaggttgaaatcaccactagagtataccacaaggcta

SEQ ID NO: 290870 - DNA, 75 bp, Artificial Sequence
  Synthetic
ggttatggcgtgtggcctcattatttgacacctcaagatgctacagctatagacaaaccttctcgaccagatact

SEQ ID NO: 290871 - DNA, 75 bp, Artificial Sequence
  Synthetic
tattctctctgccagatttacaacatgattatgcaggaggataggcaccgtaggagtgttgtggatgtgatgaca

SEQ ID NO: 290872 - DNA, 75 bp, Artificial Sequence
  Synthetic
tattaaagagagagcaagcccaaaagtagttacttttggaccaagtgatatgtttgtgcatgttggtaatcttgt

SEQ ID NO: 290873 - DNA, 75 bp, Artificial Sequence
  Synthetic
ttggtgaaaacatgttttaccatttccttggtagaagtggttatacagtacatgtgcagtgtaatgcaagcaagt

SEQ ID NO: 290874 - DNA, 75 bp, Artificial Sequence
  Synthetic
aagagaacaagtggataattccagcagattgtaaaattgagagggatttaaatttagcaaacaatattataacaa

SEQ ID NO: 290875 - DNA, 75 bp, Artificial Sequence
  Synthetic
gactacattcctacatgtgactgcacagaagctacttattactgcaaacacaaagacagatattatccaattaga

SEQ ID NO: 290876 - DNA, 75 bp, Artificial Sequence
  Synthetic
agaggcaggtagagatgtcagcccaaagactcgtgaaaatattgataaacagcccagtgatgatgcatggctcaa

SEQ ID NO: 290877 - DNA, 75 bp, Artificial Sequence
  Synthetic
caaaattccagaaagaagagttgtggctcaaggacctgaagaggaatttggtcgctccctaattaaacataatac

SEQ ID NO: 290878 - DNA, 75 bp, Artificial Sequence
  Synthetic
attgtgggggaaaattactttgtaagcacggggtgattggaatagtcactgctggtggtgagggtcatgtggctt

SEQ ID NO: 290879 - DNA, 75 bp, Artificial Sequence
  Synthetic
gcagttcctatggattcaatgctaagacacaacaactggagtttggttataataccaatttgtccactagaatct

SEQ ID NO: 290880 - DNA, 75 bp, Artificial Sequence
  Synthetic
atagatgggataaatgttaaaatttcagactcttatgatctatataataagaatggtgtgaagcttgagataaca

SEQ ID NO: 290881 - DNA, 75 bp, Artificial Sequence
  Synthetic
taaagatcagataaatgccattaatccaattaacaacattagtaaaaagataatcaaatggttactcagaataat

SEQ ID NO: 290882 - DNA, 75 bp, Artificial Sequence
  Synthetic
ttataacaccaggatctggtcaatttatgacaacagatgattttcaatcacccagtgctctgccctggtttcatc

SEQ ID NO: 290883 - DNA, 75 bp, Artificial Sequence
  Synthetic
accagcctgagcctacaatactaaatgtaggtgatgttgtatcatatggaaatatattacttagtggaaatcaaa

SEQ ID NO: 290884 - DNA, 75 bp, Artificial Sequence
  Synthetic
aaagaaaaattctgtaagtggacacaattaaattatgttcataaagaatcagattcatggcttaaaaaattcact

SEQ ID NO: 290885 - DNA, 75 bp, Artificial Sequence
  Synthetic
taacacaagtatatacactgtgactttggaaaaacagactaatttagcacaagaagtatttgcaattaaagttga

SEQ ID NO: 290886 - DNA, 75 bp, Artificial Sequence
  Synthetic
tggtaaggatggattctcagctacattactcagatcttactttagtgagactcaaggacagataacaaaaactgc

SEQ ID NO: 290887 - DNA, 75 bp, Artificial Sequence
  Synthetic
tgaaatatctgagtgaactcaaaaagttaaatttcttagaaaagcaaatagagtacctaagagttgctgattcaa

SEQ ID NO: 290888 - DNA, 75 bp, Artificial Sequence
  Synthetic
actgcaaacactactcttaaattgttgttagcctacacaccccctggaatacgtaaacctattagcagaaaggaa

SEQ ID NO: 290889 - DNA, 75 bp, Artificial Sequence
  Synthetic
gctgtactatctgagaaagatccacgcttagaaacagatttcaagaaagccttattttccaaatacaaggggaat

SEQ ID NO: 290890 - DNA, 75 bp, Artificial Sequence
  Synthetic
gcacaacagatgtaatacaatcattaagcagaagaaaagatgtgaaccggtggcagttgtcatacatggtgagcc

SEQ ID NO: 290891 - DNA, 75 bp, Artificial Sequence
  Synthetic
cagatacatattccttagctgggtatgtgacctgctggtaccagaccagcctggtggtaccaagcagtacaccaa

SEQ ID NO: 290892 - DNA, 75 bp, Artificial Sequence
  Synthetic
atagtgtgtttggctcagatggactagaggctttggatttgaatactagtgcaggttttccatacataagcatgg

SEQ ID NO: 290893 - DNA, 75 bp, Artificial Sequence
  Synthetic
tacgatcaacaaagtgtagtcataatggatgatataatgcagaatccaagtggtgatgacatgactttattttgt

SEQ ID NO: 290894 - DNA, 75 bp, Artificial Sequence
  Synthetic
aaatccagtagagaattatatagaagaggtgttgaatgaggttttagtagtgcctaatatcagagagagtcaagc

SEQ ID NO: 290895 - DNA, 75 bp, Artificial Sequence
  Synthetic
ccttaaagatgagcttagaaagaaagagaagatatcatctggaaaaactcgtgtcatagaggctagcagtgtgaa

SEQ ID NO: 290896 - DNA, 75 bp, Artificial Sequence
  Synthetic
atctactggcaccacctacgataacatcactaccagctatgaatagaagatttttccttgatttagatatagtag

SEQ ID NO: 290897 - DNA, 75 bp, Artificial Sequence
  Synthetic
tcacaaactcttgatgagatgagtgtggaaagcttcttaggaaggtctggttgcattcacatgtcaaaattagta

SEQ ID NO: 290898 - DNA, 75 bp, Artificial Sequence
  Synthetic
acattctggtcaaagatccctgtcatgttagatggtgaatgcataatggcttttgattatacaaactacgatggt

SEQ ID NO: 290899 - DNA, 75 bp, Artificial Sequence
  Synthetic
atttatttgtggaaaagcagtggttttcagagatcggaacacatgtcaaacatatactctatcccaggtatacaa

SEQ ID NO: 290900 - DNA, 75 bp, Artificial Sequence
  Synthetic
atgccagatttgattcagagatcaccctagtcccttctatagctgcccagggagatgatgttggtcatgttgtaa

SEQ ID NO: 290901 - DNA, 75 bp, Artificial Sequence
  Synthetic
acaaagattcatactatgaggttgaggggggggtgccttcaggatgttctggaacaagcatatttaatactatga

SEQ ID NO: 290902 - DNA, 75 bp, Artificial Sequence
  Synthetic
atcaatgatttgttacaatctgtgagaactcctgaagtaattaagtattgtgaagataataaatggattatacca

SEQ ID NO: 290903 - DNA, 75 bp, Artificial Sequence
  Synthetic
atcaatgatttgttacattctgtgagaactcctgaagtaattaagtattgtgaagataataaatggattatacca

SEQ ID NO: 290904 - DNA, 75 bp, Artificial Sequence
  Synthetic
atcaatgatttgttacactctgtgagaactcctgaagtaattaagtattgtgaagataataaatggattatacca

SEQ ID NO: 290905 - DNA, 75 bp, Artificial Sequence
  Synthetic
atcaatgatttgttacagtctgtgagaactcctgaagtaattaagtattgtgaagataataaatggattatacca

SEQ ID NO: 290906 - DNA, 75 bp, Artificial Sequence
  Synthetic
acaaacatatcctaggttctcattacctttccttagcatagcttcagcatattacatgttctatgatggatatga

SEQ ID NO: 290907 - DNA, 75 bp, Artificial Sequence
  Synthetic
atacaaatacactcttgatatggaagcgattgctcaagagggcagcaaatatggactaaccatcacacctgctga

SEQ ID NO: 290908 - DNA, 75 bp, Artificial Sequence
  Synthetic
aactcttttgcacactacaaggaccttattcaggtgagcccaaacccaagaccaaagtgccagagagaagagtgg

SEQ ID NO: 290909 - DNA, 75 bp, Artificial Sequence
  Synthetic
gttacaacaagagtataccataaagcaaaacatgtcaaagtctggtgcccaagaccacctagagctgtggaatac

SEQ ID NO: 290910 - DNA, 75 bp, Artificial Sequence
  Synthetic
tttccaattgatgagatacatgagtcaattagatggacaaagaaaccctcacaaatgcatgagcacattctctca

SEQ ID NO: 290911 - DNA, 75 bp, Artificial Sequence
  Synthetic
tgacaggactttaattttaccaacacatgcagacccaggtagggagatacaagtagatggaattacaactgaggt

SEQ ID NO: 290912 - DNA, 75 bp, Artificial Sequence
  Synthetic
atgtacatgttggtaatctcatatatagaaatttgcaccttttcaattcagacattcatgactccatatcagtat

SEQ ID NO: 290913 - DNA, 75 bp, Artificial Sequence
  Synthetic
ggacgtgcactgtatatccctccctatgaagtgctcttgcatgagtggtatgaaaaattttaatagaatatagaa

SEQ ID NO: 290914 - DNA, 75 bp, Artificial Sequence
  Synthetic
attccagagaatgaagatgactatccagattgcaacttggctctatctgctaatcaaccagaaactactatcatt

SEQ ID NO: 290915 - DNA, 75 bp, Artificial Sequence
  Synthetic
aaacagatattatccaataaaagtcactagtcatgattggtatgaaattcaggaaagtgagtattacccaaaaca

SEQ ID NO: 290916 - DNA, 75 bp, Artificial Sequence
  Synthetic
gtggtggtaaactgctgtgcaaacacggagttattggaataataactgcaggtggtgagggacatgtggcattca

SEQ ID NO: 290917 - DNA, 75 bp, Artificial Sequence
  Synthetic
gtggcatcttatacaagattggtcaagtcttaggaatacatgttggtggtaacgggagggatggctttgcagcta

SEQ ID NO: 290918 - DNA, 75 bp, Artificial Sequence
  Synthetic
agaccaaataaatgccataaacccaattaacaatataagtaggaaaattgtaaaatggattctaagaataatatc

SEQ ID NO: 290919 - DNA, 75 bp, Artificial Sequence
  Synthetic
caaattacaacctagtatcttttatgatattttccctggtaataaagagccagctgtgctttcagaaaatgatcc

SEQ ID NO: 290920 - DNA, 75 bp, Artificial Sequence
  Synthetic
ctctcatattacggtatgtttgcacgccagtttttaccccccccccaaatttgtaacattagaagtctgcactct

SEQ ID NO: 290921 - DNA, 75 bp, Artificial Sequence
  Synthetic
gaaaagttctgtaaatggacacaactaaattacatccacaaagagtcagattcctggctaaagaaatttactgaa

SEQ ID NO: 290922 - DNA, 75 bp, Artificial Sequence
  Synthetic
tcggcacagctaatgacattagatattgattcaaacccaatttccttagagagtagtgtctttggcatagaaggt

SEQ ID NO: 290923 - DNA, 75 bp, Artificial Sequence
  Synthetic
aatatcgttatccgcacaattactacacaaagcctagtaatatcttgataagctctttggttggtcgttcagctg

SEQ ID NO: 290924 - DNA, 75 bp, Artificial Sequence
  Synthetic
aataccttaatgaactcaagaagttgaaccttttagaaaagcaaattgagcacttgagaatagctgattctagta

SEQ ID NO: 290925 - DNA, 75 bp, Artificial Sequence
  Synthetic
aactcaaggtggcacttgataagtatggtgttgacttgcccatggttacatttcttaaagatgagcttagaaaga

SEQ ID NO: 290926 - DNA, 75 bp, Artificial Sequence
  Synthetic
caaaagtggacaaggtgtgaagagccccgtgtgctaattgtgattcctccggcccctgaatgcggctaatccaac

SEQ ID NO: 290927 - DNA, 75 bp, Artificial Sequence
  Synthetic
taataagtgtaatgtaattatcaaacagaagaagagatgtgaaccggtggcagtcgtcatacatggggaacctgg

SEQ ID NO: 290928 - DNA, 75 bp, Artificial Sequence
  Synthetic
tcatttaaaccctggaattataactggctctgctgtagggtgtgatccagaaactttctggtcaaaaataccagc

SEQ ID NO: 290929 - DNA, 75 bp, Artificial Sequence
  Synthetic
ttgcttatggtgacaagtattggtatatatttgtcatcatgggcgcccaggtttccagacagaatgtaggaactc

SEQ ID NO: 290930 - DNA, 75 bp, Artificial Sequence
  Synthetic
gatcagcagagtgtggttataatggatgatatcatgcaaaacccaagtggtgatgacatgactcttttctgccag

SEQ ID NO: 290931 - DNA, 75 bp, Artificial Sequence
  Synthetic
ttagggtttgaaccaggtctaatagatagattatgcaaatcaaaacatatctttaagaatacatactatgaagtt

SEQ ID NO: 290932 - DNA, 75 bp, Artificial Sequence
  Synthetic
ttctcaggatcctagcaaatttactgacccagttaaggatgttttaataaagggagtaccaacactacaatcgcc

SEQ ID NO: 290933 - DNA, 75 bp, Artificial Sequence
  Synthetic
tgttggcaccaccaactatcacatctttgccagcaatgaataggagattctatctagatttggatattgtagtta

SEQ ID NO: 290934 - DNA, 75 bp, Artificial Sequence
  Synthetic
ttgatttggataaacttaagataatagcatatggggatgatgtaattttttcctataaatatcaattagacatgg

SEQ ID NO: 290935 - DNA, 75 bp, Artificial Sequence
  Synthetic
ggtgtctggcctcattacttatctgatactgatgctaatgccattgacaaaccatcacatccggatacttcatca

SEQ ID NO: 290936 - DNA, 75 bp, Artificial Sequence
  Synthetic
catatgtggaaaggcagtaatgttcaaggatagaaacacttgtcaatcctacacattggcacaggtgtacaacca

SEQ ID NO: 290937 - DNA, 75 bp, Artificial Sequence
  Synthetic
aaagagagggtttaggcaagatgacaaatacaaattcttaatacatccaacttttccagttgatgaaatccatga

SEQ ID NO: 290938 - DNA, 75 bp, Artificial Sequence
  Synthetic
aaaacatgttctatcattttcttggtaggactgggtatacaattcatgtacaatgcaatgctagtaaatttcatc

SEQ ID NO: 290939 - DNA, 75 bp, Artificial Sequence
  Synthetic
agtgatctgctgcaatcagtaagaactccagaagtcatcaagtactgtgaggacaacaaatggataatccctgct

SEQ ID NO: 290940 - DNA, 75 bp, Artificial Sequence
  Synthetic
gagcaaaagatacgcagtgtgagcgctggtcgcgcactgtatatccccccttatgaactactcctgcatgaatgg

SEQ ID NO: 290941 - DNA, 75 bp, Artificial Sequence
  Synthetic
ctggtcgcgcactgtatatccccccttatgaactactcctgcatgaatggtatgaaaaattttaagttgtttaga

SEQ ID NO: 290942 - DNA, 75 bp, Artificial Sequence
  Synthetic
tggacgaacacttaatggctcaagggtagatggcaattcaaagcaacccaccgaagaaagttggctaaattgtga

SEQ ID NO: 290943 - DNA, 75 bp, Artificial Sequence
  Synthetic
tattttgtacattacaaggaccttactctggtgaacccaaacaaaggacaaaaattcctgagaggagagttgttg

SEQ ID NO: 290944 - DNA, 75 bp, Artificial Sequence
  Synthetic
acactgttattacggtaaccttgtacgccagttttgccacccttccctaatatgtaacttagaagtttgagcaat

SEQ ID NO: 290945 - DNA, 75 bp, Artificial Sequence
  Synthetic
cccatggattcaatgcttagacacaacaactggagtctagtaattatacctgtgtcacccctggcttctgaatct

SEQ ID NO: 290946 - DNA, 75 bp, Artificial Sequence
  Synthetic
tagaacaatcataattccaacacatgcagacccaggtaaagaagttcagattgatggcatttctacaaaagttga

SEQ ID NO: 290947 - DNA, 75 bp, Artificial Sequence
  Synthetic
ctccaggctctgcacaatttcttaccacagatgatacacaatccccttcagccctcccttattttcatccaacaa

SEQ ID NO: 290948 - DNA, 75 bp, Artificial Sequence
  Synthetic
cctgaaaaagaagatgactaccctgaatgcaacctggctttgtctgccaatcaacctgagaccaccataatcagt

SEQ ID NO: 290949 - DNA, 75 bp, Artificial Sequence
  Synthetic
attgacaaggtgtgaagagccgcgtgtgctcagtgtgcttcctccggcccctgaatgtggctaaccttaaccctg

SEQ ID NO: 290950 - DNA, 75 bp, Artificial Sequence
  Synthetic
tggtatgtatacagtacgggttgaggtacaaacagattttaaaaaagaaatttttgccatccctgttgatgtggc

SEQ ID NO: 290951 - DNA, 75 bp, Artificial Sequence
  Synthetic
gtatactatataaaattggtcaagttcttggcattcatgttggtggtaatggtagagatggatttgcagcaatgt

SEQ ID NO: 290952 - DNA, 75 bp, Artificial Sequence
  Synthetic
tgcattttatggtgacaatttatggtatatagattgtcatcatgggtgcacaagtatctagacaaaatgttggta

SEQ ID NO: 290953 - DNA, 75 bp, Artificial Sequence
  Synthetic
agcactagtttgaagttactcattgcatacacaccaccaggagttgataaacccaacacaaggactaaagctatg

SEQ ID NO: 290954 - DNA, 75 bp, Artificial Sequence
  Synthetic
cgcattctacacaaaattcagtgagcaatggatcaagtctgaactattttaacattaattattttaaagatgcag

SEQ ID NO: 290955 - DNA, 75 bp, Artificial Sequence
  Synthetic
attgcaacctagtgttttccatgatgtttttcctggaagtaaagagccagctgttctctctgataatgatcccag

SEQ ID NO: 290956 - DNA, 75 bp, Artificial Sequence
  Synthetic
catactcacaagcaggttacatcacttgttggtatcaaactaattttgtgacccccccaagcacccctaaatatg

SEQ ID NO: 290957 - DNA, 75 bp, Artificial Sequence
  Synthetic
gcacaattacacacactagatgttgaccctaggcccataaccgtagaagacagtgtctttggtgtagaaggctta

SEQ ID NO: 290958 - DNA, 75 bp, Artificial Sequence
  Synthetic
tatggtgtatggccatcatacctaaccccagatgatgcaactgctattgataaacctacacaaccagacacttca

SEQ ID NO: 290959 - DNA, 75 bp, Artificial Sequence
  Synthetic
tgttgaaaaatatacagaggctttactcaatgaagtgttggtggttcccaacatacaacctagcagtgggcacac

SEQ ID NO: 290960 - DNA, 75 bp, Artificial Sequence
  Synthetic
taaaaatagcaatggataaatatggagttgatttacccatggtcactttcctcaaggatgagcttagaaagaaag

SEQ ID NO: 290961 - DNA, 75 bp, Artificial Sequence
  Synthetic
gtgaaaatatgttttatcactttctaggaagatctggatacacaatacatgtacaatgtaattctagtaaatttc

SEQ ID NO: 290962 - DNA, 75 bp, Artificial Sequence
  Synthetic
actagagatgaaatgagtatagagagtttcttgggtagatctgcttgcgtagcaatcatccatacaaaccttgag

SEQ ID NO: 290963 - DNA, 75 bp, Artificial Sequence
  Synthetic
tctaaaccctggtatcatcaccggttctgcagtaggatgcgatccagagactttttggtcaaaaatacctgtaat

SEQ ID NO: 290964 - DNA, 75 bp, Artificial Sequence
  Synthetic
acaaggtagagaagtggtaccatcacgaaattctgatgacaacaaaagacctagtgatgatagctggttaaattt

SEQ ID NO: 290965 - DNA, 75 bp, Artificial Sequence
  Synthetic
aacttttcacatacttaagatttgattcagagatcactatagttgctaccattgctggacagggtgatgacatag

SEQ ID NO: 290966 - DNA, 75 bp, Artificial Sequence
  Synthetic
tcatttagaactgatttgatagacagattgtgtaagtcaaagcacatattcaaaggcacatattatgaggtagaa

SEQ ID NO: 290967 - DNA, 75 bp, Artificial Sequence
  Synthetic
ctggcaacatggacaaccataccctagatttacaatcccttttgtaagcatagcctcagcatactacatgtttta

SEQ ID NO: 290968 - DNA, 75 bp, Artificial Sequence
  Synthetic
atttggataaactcaaaattattgcttatggagatgatgtcattttctcttacaaatatcagcttgatatggagg

SEQ ID NO: 290969 - DNA, 75 bp, Artificial Sequence
  Synthetic
catgaggttaacataactagcaggatttaccacaaagccaaacatgtcagtgcatggtgccctcgtcctcctcgt

SEQ ID NO: 290970 - DNA, 75 bp, Artificial Sequence
  Synthetic
gagaggctttaggcaagatgagaagcataatttcctaattcacccaacttttccaattgatgaaattcatgagtc

SEQ ID NO: 290971 - DNA, 75 bp, Artificial Sequence
  Synthetic
gagaggctttaggcaagatgagaagcataatttccttattcacccaacttttccaattgatgaaattcatgagtc

SEQ ID NO: 290972 - DNA, 75 bp, Artificial Sequence
  Synthetic
gagaggctttaggcaagatgagaagcataatttcctcattcacccaacttttccaattgatgaaattcatgagtc

SEQ ID NO: 290973 - DNA, 75 bp, Artificial Sequence
  Synthetic
gagaggctttaggcaagatgagaagcataatttcctgattcacccaacttttccaattgatgaaattcatgagtc

SEQ ID NO: 290974 - DNA, 75 bp, Artificial Sequence
  Synthetic
tgaactttggaccctcagatctatttgtacacatggatgatctagtatatagaaacttacatttgtgtgaaccag

SEQ ID NO: 290975 - DNA, 75 bp, Artificial Sequence
  Synthetic
aacttgcaagttactacacacactggactggtagtttgcgttttagtttcatgttctgtggctctgccagctcca

SEQ ID NO: 290976 - DNA, 75 bp, Artificial Sequence
  Synthetic
aggaggatacgtagtgtcagcgctggtcgtgcactatatatacctccttatgacctgcttctgcatgagtggtat

SEQ ID NO: 290977 - DNA, 75 bp, Artificial Sequence
  Synthetic
gactggtagtttgcgttttagtttcatgttctgtggctctgccagctccactttaaagctgttgattgcttatac

SEQ ID NO: 290978 - DNA, 75 bp, Artificial Sequence
  Synthetic
gtcgtgcactatatatacctccttatgacctgcttctgcatgagtggtatgaaaaattttaaactgtttaaatat

SEQ ID NO: 290979 - DNA, 75 bp, Artificial Sequence
  Synthetic
ccaagctacatattactgtaaacataaaaatagatactatccaattaatgttaagaagcatgattggtatgaaat

SEQ ID NO: 290980 - DNA, 75 bp, Artificial Sequence
  Synthetic
ccatgggttagtgctagtcattttagattcaccacacctgatacatattcttcagctggttacattacatgctgg

SEQ ID NO: 290981 - DNA, 75 bp, Artificial Sequence
  Synthetic
catggtgttattggattattaactgctggtggaagtggacatgtagctttcattgatcttagggactttcatgtt

SEQ ID NO: 290982 - DNA, 75 bp, Artificial Sequence
  Synthetic
ataccaatctacacatgcaggaaggggtacttacacaaaacccagttgaaaattacatagataatgtgttaaatg

SEQ ID NO: 290983 - DNA, 75 bp, Artificial Sequence
  Synthetic
ccatcaacaagatcacaggaaaaatagtaaagtggattatcaggattatatcagctattacaattataattagaa

SEQ ID NO: 290984 - DNA, 75 bp, Artificial Sequence
  Synthetic
accagaggatatgattgaaaccagatatgttataactgatcaaacaagagatgaaacaagtattgagagcttctt

SEQ ID NO: 290985 - DNA, 75 bp, Artificial Sequence
  Synthetic
attgcattttatggtgacaatttatagtgtatagattgtcatcatgggtgcacaagtatctagacaaaatgttgg

SEQ ID NO: 290986 - DNA, 75 bp, Artificial Sequence
  Synthetic
actaagttatgttcacaaagaatcagatggttggattaagaagtttacagagatgtgcaacgcagctaggggttt

SEQ ID NO: 290987 - DNA, 75 bp, Artificial Sequence
  Synthetic
cttcaagaaatggcacaaatcagaagaaaatatgaattgtttacatacacaaggtttgattcagaaatcacaata

SEQ ID NO: 290988 - DNA, 75 bp, Artificial Sequence
  Synthetic
gatttttctcaagaccctagtaaatttactgatcctgttaaagatgtgttagaaaagggtattccaacacttcaa

SEQ ID NO: 290989 - DNA, 75 bp, Artificial Sequence
  Synthetic
cttcctctattagagaaagagattgatggattacgattggcctcccagaagcaacaacaagaatatattgataca

SEQ ID NO: 290990 - DNA, 75 bp, Artificial Sequence
  Synthetic
acacatggcaatcgggaacaaatgcatctgtgttttggcaagaaggacaaccatatcctagatttacaattccct

SEQ ID NO: 290991 - DNA, 75 bp, Artificial Sequence
  Synthetic
cttatggtgtgtggccatcatacttgactccagatgatgcgactgctattgacaaacccacacaacctgatacat

SEQ ID NO: 290992 - DNA, 75 bp, Artificial Sequence
  Synthetic
gcacctctaagagaacagaaccagttggggtgctcttccatggtgaaccaggaacaggtaaatcaattgctactt

SEQ ID NO: 290993 - DNA, 75 bp, Artificial Sequence
  Synthetic
ttatgagcattgcatcagcttattacatgttttatgatggttatgatggtgataatgctgcatcaaaatatgggt

SEQ ID NO: 290994 - DNA, 75 bp, Artificial Sequence
  Synthetic
acacataaaggcctggtgtccacgcccaccaagagccgttccttaccaacacacacattccactaattatatacc

SEQ ID NO: 290995 - DNA, 75 bp, Artificial Sequence
  Synthetic
tggtgaaaatatgttttaccattttctagggagatctggatacacaatacatgtacaatgtaattctagcaagtt

SEQ ID NO: 290996 - DNA, 75 bp, Artificial Sequence
  Synthetic
ggatgatataatgcaaaatccaaatggtgaggatatgtccttattttgccagatggtttcatcagtcccatttat

SEQ ID NO: 290997 - DNA, 75 bp, Artificial Sequence
  Synthetic
gagcaaggtagagaagtagtaccatcacggacatctagtgataataaaagacctagtgatgacagttggttaaat

SEQ ID NO: 290998 - DNA, 75 bp, Artificial Sequence
  Synthetic
aaccttcatctttttaactctactcttgatgattccatccttgtgtcatattccagtgatctagtcatataccga

SEQ ID NO: 290999 - DNA, 75 bp, Artificial Sequence
  Synthetic
tgcaccactgctatgaacaggaggtttttccttgatctggatatagtggttaaagatgtttttaaaataaatcag

SEQ ID NO: 291000 - DNA, 75 bp, Artificial Sequence
  Synthetic
ctgtaccaatggactctatgcttagacataataattggagcttggttataatcccaatatgccctcttcaggtcc

SEQ ID NO: 291001 - DNA, 75 bp, Artificial Sequence
  Synthetic
cacatgattggtacgaaattcaagaatcagagtattacccaaagcatatccagtacaatctcctaattggagagg

SEQ ID NO: 291002 - DNA, 75 bp, Artificial Sequence
  Synthetic
gagatagaaatacaggggattacctttccttatcaactatatataatagaataacagaagaaagtagaaatagaa

SEQ ID NO: 291003 - DNA, 75 bp, Artificial Sequence
  Synthetic
gaccttgtgaaccaggtgattgtggaggtaaattactgtgtaaacatggggttataggcatgattacagctggtg

SEQ ID NO: 291004 - DNA, 75 bp, Artificial Sequence
  Synthetic
gggtttaccagttatgttaacacctggatctgggcaattcttaacaactgatgatactcaatccccatcagcgtt

SEQ ID NO: 291005 - DNA, 75 bp, Artificial Sequence
  Synthetic
aaaccctgatgttatcaagtattgtgaagaaaataaatggatgataccagctgattgtaagttagaaagagattt

SEQ ID NO: 291006 - DNA, 75 bp, Artificial Sequence
  Synthetic
tggttttgtagatagtatcaaacaacaagtaaattttattaaccccactagcaaaattggctcaaaagtaattaa

SEQ ID NO: 291007 - DNA, 75 bp, Artificial Sequence
  Synthetic
caggaaaatgtaagatctgtgaatatgtacactgttgatttacgcacacaagttgatttagctaaagaagtcttt

SEQ ID NO: 291008 - DNA, 75 bp, Artificial Sequence
  Synthetic
tattctggtgagccaaaaccaatatctagaaaaccagaaagaagaatcgtaacacaaggtccacaagaagaattt

SEQ ID NO: 291009 - DNA, 75 bp, Artificial Sequence
  Synthetic
atgataataatggtaagaaacagttctgaccctcaaaccataattgctactcttaccctcttaggctgttcaggt

SEQ ID NO: 291010 - DNA, 75 bp, Artificial Sequence
  Synthetic
ttatgttttgtggttctgctagctctactttgaaactattaattgcatacactcctcctggtgttggaaaaccta

SEQ ID NO: 291011 - DNA, 75 bp, Artificial Sequence
  Synthetic
atgctgatgtagggagaactgtagacatagatggcatacaaacaaaagtagcagatgcctatgacctgcacaatt

SEQ ID NO: 291012 - DNA, 75 bp, Artificial Sequence
  Synthetic
tagattcactacacctgacacatattcctcagctggttatattacatgctggtaccagaccaactttgtagtacc

SEQ ID NO: 291013 - DNA, 75 bp, Artificial Sequence
  Synthetic
ggaaaaaatatttactgaaataaatactctccatgatctatccttaaaatttttaccactgtacgcatctgaagc

SEQ ID NO: 291014 - DNA, 75 bp, Artificial Sequence
  Synthetic
tgattgttgtttggctttattggctaatcaaccagagccaacaataatagagataggtgatagctgctcctatgg

SEQ ID NO: 291015 - DNA, 75 bp, Artificial Sequence
  Synthetic
ggagtactcacacaaaacccagttgaaaattatatagatagtgtattaaatgaagttcttgtggtgccaaatatc

SEQ ID NO: 291016 - DNA, 75 bp, Artificial Sequence
  Synthetic
atcctaggtatccatgttgggggcaatggtagaaatggtttctctgctatgttattaaggtcatatttcaatgaa

SEQ ID NO: 291017 - DNA, 75 bp, Artificial Sequence
  Synthetic
ggaaaatctcttgctacttcagttcttgctcggatgctgactgttgagactgacatatattctttgcccccagat

SEQ ID NO: 291018 - DNA, 75 bp, Artificial Sequence
  Synthetic
gatatgttataactgatcaaacaagggatgaaacaagtattgagagtttcttaggtaggtcagggtgtatcgcta

SEQ ID NO: 291019 - DNA, 75 bp, Artificial Sequence
  Synthetic
atgtttttcctggaaagaaggaacctgcagtcttatcttcaaaagatcctaggctgcaagtagacctggaagaag

SEQ ID NO: 291020 - DNA, 75 bp, Artificial Sequence
  Synthetic
tatcaagtgttcctttcatacctcctatggcagatcttccagataaggggaaaccatttacatctaaatttgtgc

SEQ ID NO: 291021 - DNA, 75 bp, Artificial Sequence
  Synthetic
taaaactgaacatgataaaattggtaaaggattcaaaacatggaaggttagtcttcaagaaatggcacaaatcag

SEQ ID NO: 291022 - DNA, 75 bp, Artificial Sequence
  Synthetic
agattatctcttagatggtaagttagatatagcaaaaagtttccgaccatgtgatgtaaacaccaaaataggtaa

SEQ ID NO: 291023 - DNA, 75 bp, Artificial Sequence
  Synthetic
aaacccagaaccgcttactatggaagaaagtgtatatggtatagaaggattggaagctttagatttacacactag

SEQ ID NO: 291024 - DNA, 75 bp, Artificial Sequence
  Synthetic
tgctaagtgctgcccatttatttgtggaaaagctgtggaatttaaagatagaaactcatgcaccaccttatcctt

SEQ ID NO: 291025 - DNA, 75 bp, Artificial Sequence
  Synthetic
ttagatttacccatgattaccttccttaaagatgagctcagaaaacctgaaaaaatcctagcaggaaaaactagg

SEQ ID NO: 291026 - DNA, 75 bp, Artificial Sequence
  Synthetic
ccacctccagccatagctgatcttctcagatctgtgaagacaccagaaattattaaatattgtcaagataataat

SEQ ID NO: 291027 - DNA, 75 bp, Artificial Sequence
  Synthetic
gtgatagtgcagcatcaaaatacggttctgtagtcactaatgatatgggaaccatatgtgttagaatagtgacat

SEQ ID NO: 291028 - DNA, 75 bp, Artificial Sequence
  Synthetic
tggattgtcccagcagagtgttctattgagagagatttagggatagcaaacatgaccataggtataatagctaat

SEQ ID NO: 291029 - DNA, 75 bp, Artificial Sequence
  Synthetic
cagccgtgggttgtgaccctgaagttttttggtcaaaaataccagtcatgcttgatggtgagtgccttatggctt

SEQ ID NO: 291030 - DNA, 75 bp, Artificial Sequence
  Synthetic
acacacacactcaaccaattacataccatccaatggtgaggccacaactcagattaaaaccagacctgatgtttt

SEQ ID NO: 291031 - DNA, 75 bp, Artificial Sequence
  Synthetic
aaagaagggtagtcacccagggcccagaagaggaatttggtcgctcactgcttaaacacaattgttgcattgtga

SEQ ID NO: 291032 - DNA, 75 bp, Artificial Sequence
  Synthetic
attatgttattccaaacacatcttcaagactcaataatatgaggtggaaggagggatgccatcagggtgtgctgg

SEQ ID NO: 291033 - DNA, 75 bp, Artificial Sequence
  Synthetic
attatgttattccaaacacatcttcaagactcaatattatgaggtggaaggagggatgccatcagggtgtgctgg

SEQ ID NO: 291034 - DNA, 75 bp, Artificial Sequence
  Synthetic
attatgttattccaaacacatcttcaagactcaatactatgaggtggaaggagggatgccatcagggtgtgctgg

SEQ ID NO: 291035 - DNA, 75 bp, Artificial Sequence
  Synthetic
attatgttattccaaacacatcttcaagactcaatagtatgaggtggaaggagggatgccatcagggtgtgctgg

SEQ ID NO: 291036 - DNA, 75 bp, Artificial Sequence
  Synthetic
cttgtatcatactccagtgatctaatcatatatcgaacaaacactgaaggtaatgatgtgatccctaattgtgat

SEQ ID NO: 291037 - DNA, 75 bp, Artificial Sequence
  Synthetic
gaaagttaaaatttctgactcttatgacctacataaccatgagggtgttaagttagaaataacagtagtaaagct

SEQ ID NO: 291038 - DNA, 75 bp, Artificial Sequence
  Synthetic
tatggtgatgacatattattttcttacccttatgacttggacatgaaagaattagcagatgaggggtctaaatat

SEQ ID NO: 291039 - DNA, 75 bp, Artificial Sequence
  Synthetic
caaaacatatccaatataatctcctgattggagagggtccttgtgaaccaggagattgtggaggaaaactattgt

SEQ ID NO: 291040 - DNA, 75 bp, Artificial Sequence
  Synthetic
ccaacaataataaatgttggagatgcagaatcttatggtaacatattgttaagtggtactaatactgcacgaatg

SEQ ID NO: 291041 - DNA, 75 bp, Artificial Sequence
  Synthetic
atagcttcctagtacaccctatctatcctgaggaagaggtgtgggagtctattagatggacaaagaatcccagaa

SEQ ID NO: 291042 - DNA, 75 bp, Artificial Sequence
  Synthetic
tgattatgtggaacatcttggtcaagtctttggtgtaggcttcgtagacagcatcaaacaacaggtaaactttat

SEQ ID NO: 291043 - DNA, 75 bp, Artificial Sequence
  Synthetic
gattttctgcaatgctccttaagtcttactttggtgaaactcaaggtttaattactaaagaactacctgtgtctg

SEQ ID NO: 291044 - DNA, 75 bp, Artificial Sequence
  Synthetic
tcgtgcgctctatataccaccatttgaactcttgagccacgaatggtatgaaaaattttaaacagatatagaatt

SEQ ID NO: 291045 - DNA, 75 bp, Artificial Sequence
  Synthetic
tcgtgcgctctatataccaccatttgaactcttgtgccacgaatggtatgaaaaattttaaacagatatagaatt

SEQ ID NO: 291046 - DNA, 75 bp, Artificial Sequence
  Synthetic
tcgtgcgctctatataccaccatttgaactcttgcgccacgaatggtatgaaaaattttaaacagatatagaatt

SEQ ID NO: 291047 - DNA, 75 bp, Artificial Sequence
  Synthetic
tcgtgcgctctatataccaccatttgaactcttgggccacgaatggtatgaaaaattttaaacagatatagaatt

SEQ ID NO: 291048 - DNA, 75 bp, Artificial Sequence
  Synthetic
tcaagaatttaccatctatacatgtttcatccaaaacccgcctgcaacctagtgtttttcatgatgtttttcccg

SEQ ID NO: 291049 - DNA, 75 bp, Artificial Sequence
  Synthetic
gtaattgccactctcacccttctaggttgttcaggctcaccatggaggtttcttaaagagaaactctgtgcgtgg

SEQ ID NO: 291050 - DNA, 75 bp, Artificial Sequence
  Synthetic
agtgaccacacatatgaagatcgctgtagcacattatgcagcacaattatccacactagacataaatccccaacc

SEQ ID NO: 291051 - DNA, 75 bp, Artificial Sequence
  Synthetic
tatctaaatttatagattggataaagagtatgttaccacaggctcaattgaaaattgattacctaaccaaattaa

SEQ ID NO: 291052 - DNA, 75 bp, Artificial Sequence
  Synthetic
aacaacttaatctcttagagaaacaaatagaaacaattagacttgcacctgctagtgttcaggagaaaattttca

SEQ ID NO: 291053 - DNA, 75 bp, Artificial Sequence
  Synthetic
aaagatctcatagataagaaaacaaaagacatcacaaaacttaagaaagcaattgataaatatggtattgatcta

SEQ ID NO: 291054 - DNA, 75 bp, Artificial Sequence
  Synthetic
ttttcagaagtgtgtatggaaaccttttctctgcttttcataaaaacccaggcatagttactggttctgcggtag

SEQ ID NO: 291055 - DNA, 75 bp, Artificial Sequence
  Synthetic
tgcgggatgggaccgactactttgggtgtccgtgtttcactttttcctttatcaattgcttatggtgacaatata

SEQ ID NO: 291056 - DNA, 75 bp, Artificial Sequence
  Synthetic
atcatggatgatatcatgcaaaatcctagtggtgaagacatgactttgttttgccaaatggtatcgagtgtccct

SEQ ID NO: 291057 - DNA, 75 bp, Artificial Sequence
  Synthetic
ggtctggttcaagtgcctaagcatgcttctagaagatataggattttcttctcaacttattaaccaaatttgcaa

SEQ ID NO: 291058 - DNA, 75 bp, Artificial Sequence
  Synthetic
caagtttgtacttgcaagcactaatcacactctactaacaccaccaacagtatcttcattaccagcaatggcaag

SEQ ID NO: 291059 - DNA, 75 bp, Artificial Sequence
  Synthetic
ttctaagcatatatacaaatctaaatattatgaagtggaaggaggtatgccatctggatgcgcaggtactagcat

SEQ ID NO: 291060 - DNA, 75 bp, Artificial Sequence
  Synthetic
gatgttatcttttcttataactttaaacttgatatggcagtccttgctaaagaaggagagaaatatggactgaca

SEQ ID NO: 291061 - DNA, 75 bp, Artificial Sequence
  Synthetic
gtcatataaaggaagaagataggagaagaagcagtgcagcacaagcaatggaggctatatttcaaggtatagacc

SEQ ID NO: 291062 - DNA, 75 bp, Artificial Sequence
  Synthetic
ttatacatcctacctttcctgtggcagagatccatgattccattagatggactaagaacccttcatgtatgcaag

SEQ ID NO: 291063 - DNA, 75 bp, Artificial Sequence
  Synthetic
agagtgttctattgaaagagatttagggatagcaaatatgactataggtataatagctaatgtggtctctatagt

SEQ ID NO: 291064 - DNA, 75 bp, Artificial Sequence
  Synthetic
actcagggcccagaggaagagtttggtcgctcactactcaaacataattgctgtgttgtgacaaccgacaaaggc

SEQ ID NO: 291065 - DNA, 75 bp, Artificial Sequence
  Synthetic
acactgttattccggtaactttgtacgccagttttatatccccaccccccttttgtaacttagaagttatgcaca

SEQ ID NO: 291066 - DNA, 75 bp, Artificial Sequence
  Synthetic
ctgaccaatagtgggcaatcatccagattgtcatcggtcgagcacttctgtttccccggtttgagttgatatgct

SEQ ID NO: 291067 - DNA, 75 bp, Artificial Sequence
  Synthetic
ctgattcctatgatttgcataaccatgagggtgttaagctagagatcacagttgtgaaattaattagaaatgaga

SEQ ID NO: 291068 - DNA, 75 bp, Artificial Sequence
  Synthetic
cagtaatagacctggcagatgaggctagaagttccccactggcgacagtgttctagcctgcgtggctgcctgcac

SEQ ID NO: 291069 - DNA, 75 bp, Artificial Sequence
  Synthetic
tgttggtgatgcagtatcttatggtaacatcttattgagtggtaccaatactgcacgaatgatcaagtaccatta

SEQ ID NO: 291070 - DNA, 75 bp, Artificial Sequence
  Synthetic
cttctcaaatcttattttggtgaaacccagggtttaatcactaaagaacttcctgtatctgtaaagaacttacca

SEQ ID NO: 291071 - DNA, 75 bp, Artificial Sequence
  Synthetic
tccgtacatgtttcatctaaaacccgactacaacctagtgtttttcatgatgttttccctggaacaaaagagcct

SEQ ID NO: 291072 - DNA, 75 bp, Artificial Sequence
  Synthetic
gttttcacaagatccaagtaaattcacagatccagttaaggatgtattagagaaaggaatccccactttacaatc

SEQ ID NO: 291073 - DNA, 75 bp, Artificial Sequence
  Synthetic
tgaaaattgctgtagcacattatgcagcacagttatctacactagacataaatcctcaacccctttcattggaag

SEQ ID NO: 291074 - DNA, 75 bp, Artificial Sequence
  Synthetic
tatggcgtatggccacattatcttacaccacaagatgctactgccatagacaaaccaactaggcctgacacttcc

SEQ ID NO: 291075 - DNA, 75 bp, Artificial Sequence
  Synthetic
taaaaagaccaaagacatcacaaaacttaggaaagcaattgatgaatatggtattgatttgcctatggttacttt

SEQ ID NO: 291076 - DNA, 75 bp, Artificial Sequence
  Synthetic
gtgagaacatgttttaccactttttgggtagaagtggctataccgtacatgttcaatgcaatgccagcaaatttc

SEQ ID NO: 291077 - DNA, 75 bp, Artificial Sequence
  Synthetic
tttggaaatcttttctctgctttccacaaaaacccaggtatagtcactggttcagcagtagggtgtgaccctgaa

SEQ ID NO: 291078 - DNA, 75 bp, Artificial Sequence
  Synthetic
gaaaggtagggatgttggcaagacaggccgagagagaaatgaccgacaacctagtgatgataattggttaaattt

SEQ ID NO: 291079 - DNA, 75 bp, Artificial Sequence
  Synthetic
gtcttagtatgctcttagaagacataggtttctcctctcaacttattaaccagatctgtaactctaaacatatat

SEQ ID NO: 291080 - DNA, 75 bp, Artificial Sequence
  Synthetic
gtaccaatggactccatgcttagacataataactggagcttagtaatcatacctatctgtgaactcaaatgcaat

SEQ ID NO: 291081 - DNA, 75 bp, Artificial Sequence
  Synthetic
ggtactagatgcttataagaacatagatctagataaactgaaaatcttagcatatggggatgatgtcatcttttc

SEQ ID NO: 291082 - DNA, 75 bp, Artificial Sequence
  Synthetic
tgctgacacctggatcaggccaattccttacaacagatgatttccaatcccctagtgctttgccatggtatcacc

SEQ ID NO: 291083 - DNA, 75 bp, Artificial Sequence
  Synthetic
acctataaaaatgtaacttttcttaaaagaggattcagagctgatgagcgccactctttccttatacaccctacc

SEQ ID NO: 291084 - DNA, 75 bp, Artificial Sequence
  Synthetic
ccactctttccttatacaccctacctttcctgtggctgagattcatgactccatcagatggaccaaaaacccttc

SEQ ID NO: 291085 - DNA, 75 bp, Artificial Sequence
  Synthetic
ggacaagagtatgtacacaattagacttggtggtgtgacaaatgctaaggaagccattttcgccatgagagttga

SEQ ID NO: 291086 - DNA, 75 bp, Artificial Sequence
  Synthetic
tctgcttttacaacacttaaattgcttattgcatacacaccaccaggaatcactgttccagagaataggaaaaaa

SEQ ID NO: 291087 - DNA, 75 bp, Artificial Sequence
  Synthetic
acactgttatctcggtaactttgtacgccagttttatctccccctcccccctttgtaacttagaagtcatgcaca

SEQ ID NO: 291088 - DNA, 75 bp, Artificial Sequence
  Synthetic
cagatacctattctgcagctggatacatcacttgctggtatcaaactgacttgattacacctccaaacacagccc

SEQ ID NO: 291089 - DNA, 75 bp, Artificial Sequence
  Synthetic
cgttatccgcaagatgcctacgcagaacctagtatcacactggaagattctcggttggtcgctcagttacaaccc

SEQ ID NO: 291090 - DNA, 75 bp, Artificial Sequence
  Synthetic
aacctagtatcacactggaagattctcggttggtcgctcagttacaaccccagtaacagacctggcagatgaggc

SEQ ID NO: 291091 - DNA, 75 bp, Artificial Sequence
  Synthetic
aaatcctgttgagaggtacgtagatgaagtcttgaatgaagttcttgtagtaccaaatattagtgaaagtaagcc

SEQ ID NO: 291092 - DNA, 75 bp, Artificial Sequence
  Synthetic
gtgctcatcttgagtcctccggcccctgaatgcggctaaccctaaccctgcagccattgcccacaaaccagtggg

SEQ ID NO: 291093 - DNA, 75 bp, Artificial Sequence
  Synthetic
tcacaaactagggatgaaatgagtgttgagagttttctaggaagatctggctgtatatacatgcataccatgaac

SEQ ID NO: 291094 - DNA, 75 bp, Artificial Sequence
  Synthetic
cctatgtaagatttgattcagaaataacaattgtaccatgcatagctgggcaaggtggtgatgtcggacatgttg

SEQ ID NO: 291095 - DNA, 75 bp, Artificial Sequence
  Synthetic
atcaagtggtgcttctaagctggaattttcgcaagacccaagtaaatttacagatccagtcaaagatgtcttaga

SEQ ID NO: 291096 - DNA, 75 bp, Artificial Sequence
  Synthetic
tggccaaatctatcctcgattctcgctaccatttcttagtatcgcttctgcatattacatgttttatgatgggta

SEQ ID NO: 291097 - DNA, 75 bp, Artificial Sequence
  Synthetic
gatgtggccaatgcagttgttggttatggcgtgtggcctcattatttaacatcacaggatgccactgctatagat

SEQ ID NO: 291098 - DNA, 75 bp, Artificial Sequence
  Synthetic
aaagtcacaactagaatctatcataaggctaagcatatcaaagcatggtgccctagacctcccagagctgttgaa

SEQ ID NO: 291099 - DNA, 75 bp, Artificial Sequence
  Synthetic
ctttaaaggacatggggatttttggtgaaaacatgttctatcattttttaggtaggagtggttacactgtacatg

SEQ ID NO: 291100 - DNA, 75 bp, Artificial Sequence
  Synthetic
ccagtgacatgtatgtacatgttggaaatttaatatatagaaatttgcatcttttcaactcagaaatgcatgatt

SEQ ID NO: 291101 - DNA, 75 bp, Artificial Sequence
  Synthetic
atataactacacacaccctggtgagaaaggtagagatgttggaaagatggatcgtgaaagaaacgaccgacaacc

SEQ ID NO: 291102 - DNA, 75 bp, Artificial Sequence
  Synthetic
ctgtaaacataagaacagatattatccaattaatgttactagtcatgattggtatgaaatacaagaaagtgaata

SEQ ID NO: 291103 - DNA, 75 bp, Artificial Sequence
  Synthetic
attatagtaccatatgtaaatgcagtcccaatggattctatgcttagacataacaactggagcctagttatcata

SEQ ID NO: 291104 - DNA, 75 bp, Artificial Sequence
  Synthetic
attattacagctggtggtgaaggccatgtggctttcattgacttaagacacttcttgtgtgctgaagaacaaggt

SEQ ID NO: 291105 - DNA, 75 bp, Artificial Sequence
  Synthetic
atgttacacaaggtcttccaacattattgacacctggatctggtcaattcttaacaacggacgattaccagtccc

SEQ ID NO: 291106 - DNA, 75 bp, Artificial Sequence
  Synthetic
gtaaaaaagtcattaaatggttactaagaattgtatctgccatggtcataatcattagaaactcttcagatccac

SEQ ID NO: 291107 - DNA, 75 bp, Artificial Sequence
  Synthetic
taataataccaatacaaatatcagggataaaagcatgtacacaatcagacttggtggagagactgatattaagga

SEQ ID NO: 291108 - DNA, 75 bp, Artificial Sequence
  Synthetic
aattggttgttctgggtcaccatggagatttctaaaggagaaattttgtaaatggactcagttgaactatatcca

SEQ ID NO: 291109 - DNA, 75 bp, Artificial Sequence
  Synthetic
cgcttcagcttcatgttctgtggctccgctttcacaacacttaaattgctgattgcatacacaccaccaggaatt

SEQ ID NO: 291110 - DNA, 75 bp, Artificial Sequence
  Synthetic
atgaaatcaatgttaccacaagcacaactcaaagttaagtacttaaatgaattaaagaagttaaacttacttgaa

SEQ ID NO: 291111 - DNA, 75 bp, Artificial Sequence
  Synthetic
ctagtcattatagaaacacaacaccagatacatactcttcggctggttacatcacttgctggtatcagacaaatt

SEQ ID NO: 291112 - DNA, 75 bp, Artificial Sequence
  Synthetic
tgtatgctagtgaagctaaaagaattaaagtcatttacaacaaatgcagcaacatcattaagcaaaggaaaagaa

SEQ ID NO: 291113 - DNA, 75 bp, Artificial Sequence
  Synthetic
caaacaaagtggtgtgatagaacaaaatcctgtagaaaggtatgtggatgaggtcctgaatgaggttcttgtggt

SEQ ID NO: 291114 - DNA, 75 bp, Artificial Sequence
  Synthetic
ttccttacctcctgatccaaaatactttgatggttatgaccagcaaagtgttgtcataatggatgatattatgca

SEQ ID NO: 291115 - DNA, 75 bp, Artificial Sequence
  Synthetic
attgaaacacgatatgtccaaacctcacaaactagagatgaaatgagcatagaaagctttttaggtagatcaggc

SEQ ID NO: 291116 - DNA, 75 bp, Artificial Sequence
  Synthetic
gactcaagatttgttttgtgcagtactaatcattctcttttggctcctcccacaatcacttcccttcaggcaatg

SEQ ID NO: 291117 - DNA, 75 bp, Artificial Sequence
  Synthetic
tacgtagaaagtttgagctttttacgtatgttagatttgactcagaaataacaattgtgccaagtatagctggac

SEQ ID NO: 291118 - DNA, 75 bp, Artificial Sequence
  Synthetic
tagacacaaaaattggaaatgctcgctgttgtccattcatatgtggtaaggcagtaaccttcaaagaccgcaaca

SEQ ID NO: 291119 - DNA, 75 bp, Artificial Sequence
  Synthetic
caatgcatctgtattctggcagtatggtcaagtttaccctaggttttctctaccatttcttagcattgcttccgc

SEQ ID NO: 291120 - DNA, 75 bp, Artificial Sequence
  Synthetic
accaatttcaatggaagcccctcctcctcctgctatagctgacctcttacgctctgtcaagacaccagaagttat

SEQ ID NO: 291121 - DNA, 75 bp, Artificial Sequence
  Synthetic
actgaagaacacaccaacaaagttaaggtcacaactagagtttaccacaaagctaaacatgttaaagcatggtgt

SEQ ID NO: 291122 - DNA, 75 bp, Artificial Sequence
  Synthetic
attagcatagcaggcattatatatatcatatataagttattttgttctttccaaggcccttactcaggtgagccc

SEQ ID NO: 291123 - DNA, 75 bp, Artificial Sequence
  Synthetic
atgttagacaagtaagaaattatggacccagtgacatgtatgtacatgttggaaatttaatctatagaaacttac

SEQ ID NO: 291124 - DNA, 75 bp, Artificial Sequence
  Synthetic
ctgacaatggcaaattcactggattgggaatctatgacaaacttatggtattacccacacatgctgatcctggca

SEQ ID NO: 291125 - DNA, 75 bp, Artificial Sequence
  Synthetic
ttgtgattgcactcaagctacatactactgtaaacataaaaatagatattacccaatcacagttactagtcatga

SEQ ID NO: 291126 - DNA, 75 bp, Artificial Sequence
  Synthetic
tagaaatgagaaattcagggatatacgaaagtatataccagagagagaggatgattaccctgattgcaatttagc

SEQ ID NO: 291127 - DNA, 75 bp, Artificial Sequence
  Synthetic
ttattgtgtaaacatggagtgatagggattataacagctggtggtgagggtcacgtggcctttattgacctgaga

SEQ ID NO: 291128 - DNA, 75 bp, Artificial Sequence
  Synthetic
aaatataactatcccacaaaatcaggctattgtggtggtgttctatacaaaataggtcagatcatagggattcat

SEQ ID NO: 291129 - DNA, 75 bp, Artificial Sequence
  Synthetic
atgcaataaatcctataaataacatcagtaaaaaagtcattaaatggttattgagaattgtatctgctatggtaa

SEQ ID NO: 291130 - DNA, 75 bp, Artificial Sequence
  Synthetic
gtgggcttccaacaatacacaccccatccaaaaccaaattacaacccagtgtcttctttgatgtctttgaggggt

SEQ ID NO: 291131 - DNA, 75 bp, Artificial Sequence
  Synthetic
gataagaccaataggtgataatcatccagattatcaaaggtcaagcacttctgtttccccggtcgatgaggatat

SEQ ID NO: 291132 - DNA, 75 bp, Artificial Sequence
  Synthetic
taaatggacccaacttaattacatccacaaagaatctgactcatggctcaagaaatttactgagatgtgcaatgc

SEQ ID NO: 291133 - DNA, 75 bp, Artificial Sequence
  Synthetic
gactgatcatatgagagttgctatatcacattattcagctcaattgatgactttagacattgactcagtaaatat

SEQ ID NO: 291134 - DNA, 75 bp, Artificial Sequence
  Synthetic
acccagcagtagacctggcagatgaggctggacgttccccactggcgacagtggtccagcctgcgtggctgcctg

SEQ ID NO: 291135 - DNA, 75 bp, Artificial Sequence
  Synthetic
gagctaaagaaattgaatcttttggagaaacaggttgaaaacctaagatgtgctgattcaaaaactcaggaaaag

SEQ ID NO: 291136 - DNA, 75 bp, Artificial Sequence
  Synthetic
ttaaaacagcggatgggtatcccaccatccggcccactgggtgtagtactctggtacattgtacctttgtacgcc

SEQ ID NO: 291137 - DNA, 75 bp, Artificial Sequence
  Synthetic
gcttctctgcacagttaaagaaacagtactttgtggaaaaacaaggagcaatcaccaccaaaagaaatgtaaggg

SEQ ID NO: 291138 - DNA, 75 bp, Artificial Sequence
  Synthetic
ctggtacattgtacctttgtacgcctgttttccccctcttgtacccgcccttcaagctccttgcccaagtaacgt

SEQ ID NO: 291139 - DNA, 75 bp, Artificial Sequence
  Synthetic
agtgtgttttatgaaatctttccagggtcaaaagaaccagctgtgttggatgaccatgaccccagattagaggtt

SEQ ID NO: 291140 - DNA, 75 bp, Artificial Sequence
  Synthetic
ggtcaaaagaaccagctgtgttggatgaccatgaccccagattagaggttaacttacatgattctttgttctcaa

SEQ ID NO: 291141 - DNA, 75 bp, Artificial Sequence
  Synthetic
tgtacaaacacttctgttgccccggagcgaggtatagatggtccccaccgtcaaaagcctttaaccgttatccgc

SEQ ID NO: 291142 - DNA, 75 bp, Artificial Sequence
  Synthetic
atagatcagtattcaggacaactattatcattggatataccaacagaggagttgacattgaaggatgcactgtat

SEQ ID NO: 291143 - DNA, 75 bp, Artificial Sequence
  Synthetic
atcaggtggtaacccccactagtttggtcgatgaggctaggaattccccacgggtgaccgtgtcctagcctgcgt

SEQ ID NO: 291144 - DNA, 75 bp, Artificial Sequence
  Synthetic
tatcattggatataccaacagaggagttgacattgaaggatgcactgtatggcacagatggactggagccaattg

SEQ ID NO: 291145 - DNA, 75 bp, Artificial Sequence
  Synthetic
agagacatattaaataaggagactcaggatacaatcaaaatggaacattacctagataaatatggtatagatttg

SEQ ID NO: 291146 - DNA, 75 bp, Artificial Sequence
  Synthetic
tcctccggcccctgaatgcggctaaccctaaccccggagccttgcagcacaatccagtgttgttaaggtcgtaat

SEQ ID NO: 291147 - DNA, 75 bp, Artificial Sequence
  Synthetic
aggatacaatcaaaatggaacattacctagataaatatggtatagatttgccactagttacatatataaaggatg

SEQ ID NO: 291148 - DNA, 75 bp, Artificial Sequence
  Synthetic
tttcttgaatttttcttatggtcacagcatatatacattatatactgtgatcatgggagctcaggtgtctacaca

SEQ ID NO: 291149 - DNA, 75 bp, Artificial Sequence
  Synthetic
gcatccagcttgaatgattcagtaaacatgagagtaaaactagggaacttgtataaggcatttcacctaaaccct

SEQ ID NO: 291150 - DNA, 75 bp, Artificial Sequence
  Synthetic
agcatatatacattatatactgtgatcatgggagctcaggtgtctacacagaagagtggttcacacgaaaaccaa

SEQ ID NO: 291151 - DNA, 75 bp, Artificial Sequence
  Synthetic
acatgagagtaaaactagggaacttgtataaggcatttcacctaaaccctggtgtcataaccgggtcagctgtag

SEQ ID NO: 291152 - DNA, 75 bp, Artificial Sequence
  Synthetic
taaagatgcagcaagttcatcatcagctggccaatctttgtcaatggatccatccaaatttactgaaccagtgaa

SEQ ID NO: 291153 - DNA, 75 bp, Artificial Sequence
  Synthetic
cagttgatggcttttgactactcaaattttgatgcctcattatctccagtgtggtttaactgtcttgaacaagtg

SEQ ID NO: 291154 - DNA, 75 bp, Artificial Sequence
  Synthetic
gctggccaatctttgtcaatggatccatccaaatttactgaaccagtgaaagatctaatgttaaaaggtgctcca

SEQ ID NO: 291155 - DNA, 75 bp, Artificial Sequence
  Synthetic
attttgatgcctcattatctccagtgtggtttaactgtcttgaacaagtgctcatcaaattagggttcaaacatg

SEQ ID NO: 291156 - DNA, 75 bp, Artificial Sequence
  Synthetic
gcagatcacgcttggaaattcaacaattacaacgcaggaagctgccaatgctgttgtctgctatgcagaatggcc

SEQ ID NO: 291157 - DNA, 75 bp, Artificial Sequence
  Synthetic
atttatgaggttgaaggcggtatgccatcaggatgctcaggtacaagcatctttaattcaatgataaataacata

SEQ ID NO: 291158 - DNA, 75 bp, Artificial Sequence
  Synthetic
attacaacgcaggaagctgccaatgctgttgtctgctatgcagaatggccggaatatttatcagataatgatgca

SEQ ID NO: 291159 - DNA, 75 bp, Artificial Sequence
  Synthetic
catcaggatgctcaggtacaagcatctttaattcaatgataaataacataatcattaggactctaatactggatg

SEQ ID NO: 291160 - DNA, 75 bp, Artificial Sequence
  Synthetic
cacactagatagtaaagattggagtccatcctcaaagggatggtgttggaaattacctgatgcactgaaagacat

SEQ ID NO: 291161 - DNA, 75 bp, Artificial Sequence
  Synthetic
gatttgattgtctcttacccttttgaactacaaccagatttattagctcttgctggtaaaaagtatggtttaacc

SEQ ID NO: 291162 - DNA, 75 bp, Artificial Sequence
  Synthetic
ccatcctcaaagggatggtgttggaaattacctgatgcactgaaagacatgggagtctttggtcaaaacatgttt

SEQ ID NO: 291163 - DNA, 75 bp, Artificial Sequence
  Synthetic
aactacaaccagatttattagctcttgctggtaaaaagtatggtttaaccataacccctccagacaaatcagaaa

SEQ ID NO: 291164 - DNA, 75 bp, Artificial Sequence
  Synthetic
tacaaaattccatagtggttgcctgttagtagtagtcatcccagagcatcaacttgcctctcatgacggtggaag

SEQ ID NO: 291165 - DNA, 75 bp, Artificial Sequence
  Synthetic
aaacctgactcccaatacccttttctcatacatccagtgatgccaatgcaggacatctacgagtctatacgatgg

SEQ ID NO: 291166 - DNA, 75 bp, Artificial Sequence
  Synthetic
ttagtagtagtcatcccagagcatcaacttgcctctcatgacggtggaagcgtctcagtgaaatacaaatataca

SEQ ID NO: 291167 - DNA, 75 bp, Artificial Sequence
  Synthetic
tcatacatccagtgatgccaatgcaggacatctacgagtctatacgatggactcgcgaccccaggagcacacaag

SEQ ID NO: 291168 - DNA, 75 bp, Artificial Sequence
  Synthetic
accagccaaagatgcagtgtatagtatggatggaactttgttaggaaatttgaccatcttcccacaccagttcat

SEQ ID NO: 291169 - DNA, 75 bp, Artificial Sequence
  Synthetic
tataaagattttgttgacaaaataagatcaaccagtatcggtaagtgcctgctgataccagaatatagtgtccta

SEQ ID NO: 291170 - DNA, 75 bp, Artificial Sequence
  Synthetic
gctgataccagaatatagtgtcctacgtcgacgctggttggatctcttttaaatatagatttgtaatttgattag

SEQ ID NO: 291171 - DNA, 75 bp, Artificial Sequence
  Synthetic
atggatggaactttgttaggaaatttgaccatcttcccacaccagttcatcaatctaaggacaaataacacagcg

SEQ ID NO: 291172 - DNA, 75 bp, Artificial Sequence
  Synthetic
cattcgacccattgggtgtagtactctggtactatgtacctttgtacgcctgtttctccccaaccacccttcctt

SEQ ID NO: 291173 - DNA, 75 bp, Artificial Sequence
  Synthetic
tcataacaacgtttcactcatggtcatccctattgttccccttatggcacctacaggaaatgcaacaacactccc

SEQ ID NO: 291174 - DNA, 75 bp, Artificial Sequence
  Synthetic
ctggtactatgtacctttgtacgcctgtttctccccaaccacccttccttaaaattcccacccatgaaacgttag

SEQ ID NO: 291175 - DNA, 75 bp, Artificial Sequence
  Synthetic
atccctattgttccccttatggcacctacaggaaatgcaacaacactccctattactgtgaccatagctcctatg

SEQ ID NO: 291176 - DNA, 75 bp, Artificial Sequence
  Synthetic
tccacaagggttacccaccacgacattacccgggtcagggcagtttctaaccactgatgataggcagtcacccag

SEQ ID NO: 291177 - DNA, 75 bp, Artificial Sequence
  Synthetic
ttacccgggtcagggcagtttctaaccactgatgataggcagtcacccagtgctttaccaaattatgaacccacc

SEQ ID NO: 291178 - DNA, 75 bp, Artificial Sequence
  Synthetic
ggttgataccttaatacccatgaataataccaaaaccaaagatgaagttgacagctacctcataccattgacaca

SEQ ID NO: 291179 - DNA, 75 bp, Artificial Sequence
  Synthetic
aataccaaaaccaaagatgaagttgacagctacctcataccattgacacagggtcttaaaaatgcccagatcttt

SEQ ID NO: 291180 - DNA, 75 bp, Artificial Sequence
  Synthetic
agtcctccggcccctgaatgcggctaaccttaaccctagagccttatgccacgatccagtggttgtaaggtcgta

SEQ ID NO: 291181 - DNA, 75 bp, Artificial Sequence
  Synthetic
tgagattgtgcaatattatgcacattggtctggatccctcagaatttccctcatgtacactggccccgcactatc

SEQ ID NO: 291182 - DNA, 75 bp, Artificial Sequence
  Synthetic
tggtctggatccctcagaatttccctcatgtacactggccccgcactatccagtgcaaaacttaccttagcttac

SEQ ID NO: 291183 - DNA, 75 bp, Artificial Sequence
  Synthetic
tttttcttcatattgtcttatggtcacagcatatatatacatatactgtgatcatgggcgctcaggtttctacac

SEQ ID NO: 291184 - DNA, 75 bp, Artificial Sequence
  Synthetic
acagcatatatatacatatactgtgatcatgggcgctcaggtttctacacagaaaagtggatctcacgaaaatca

SEQ ID NO: 291185 - DNA, 75 bp, Artificial Sequence
  Synthetic
tactcacgtagtgtgggatattggtttgcaatctacaatagtcatgacaatcccatggacctcaggtgtgcaatt

SEQ ID NO: 291186 - DNA, 75 bp, Artificial Sequence
  Synthetic
ttgcaatctacaatagtcatgacaatcccatggacctcaggtgtgcaatttagatatacagataaagatacctac

SEQ ID NO: 291187 - DNA, 75 bp, Artificial Sequence
  Synthetic
ataaggatgcagcaagtacatcatcagctggtcaatcactgtcaatggacccatctaagtttacagaaccagtta

SEQ ID NO: 291188 - DNA, 75 bp, Artificial Sequence
  Synthetic
agctggtcaatcactgtcaatggacccatctaagtttacagaaccagttaaagatctcatgcttaagggtgcacc

SEQ ID NO: 291189 - DNA, 75 bp, Artificial Sequence
  Synthetic
accacaaacagcaggtacagtgtatctgttatctttcattagtgcatgcccagattttaaactcagattgatgaa

SEQ ID NO: 291190 - DNA, 75 bp, Artificial Sequence
  Synthetic
ctgttatctttcattagtgcatgcccagattttaaactcagattgatgaaagatactcaaacaatatcacagact

SEQ ID NO: 291191 - DNA, 75 bp, Artificial Sequence
  Synthetic
aacaaatcacactcgggaattcaacaataacaacacaagaagcagccaacgctgttgtgtgttatgctgaatggc

SEQ ID NO: 291192 - DNA, 75 bp, Artificial Sequence
  Synthetic
aataacaacacaagaagcagccaacgctgttgtgtgttatgctgaatggccagagtaccttccagatgtggacgc

SEQ ID NO: 291193 - DNA, 75 bp, Artificial Sequence
  Synthetic
gaaaacgaaacagacattggcttctatcacttctggacccaaacatactcaaagtgtccccacgttaacagcaaa

SEQ ID NO: 291194 - DNA, 75 bp, Artificial Sequence
  Synthetic
atcacttctggacccaaacatactcaaagtgtccccacgttaacagcaaatgaaaccggtgccaccatgcctact

SEQ ID NO: 291195 - DNA, 75 bp, Artificial Sequence
  Synthetic
acacattggatagtaagacatggacaacaggttctaaaggctggtgctggaaattaccagatgcactcaaggata

SEQ ID NO: 291196 - DNA, 75 bp, Artificial Sequence
  Synthetic
aacaggttctaaaggctggtgctggaaattaccagatgcactcaaggatatgggtgtgttcgggcaaaacatgtt

SEQ ID NO: 291197 - DNA, 75 bp, Artificial Sequence
  Synthetic
ttcagaaacagatgttgaaaacttcctaggtagagcagcatgtgtacatatggtagaaatagttaataaaaaccc

SEQ ID NO: 291198 - DNA, 75 bp, Artificial Sequence
  Synthetic
ctaggtagagcagcatgtgtacatatggtagaaatagttaataaaaaccctgaaggtcttgaaaaccagaaagag

SEQ ID NO: 291199 - DNA, 75 bp, Artificial Sequence
  Synthetic
ccacaaaattccatagcggttgtctacttgtagttgtaataccagaacaccaactggcttcacatgagggtggca

SEQ ID NO: 291200 - DNA, 75 bp, Artificial Sequence
  Synthetic
acttgtagttgtaataccagaacaccaactggcttcacatgagggtggcaatgtttcagttaaatacacattcac

SEQ ID NO: 291201 - DNA, 75 bp, Artificial Sequence
  Synthetic
tagaaagaaattagagttattcacctatgtcagatttgattcagaatacacaattttagccactgcttcacagcc

SEQ ID NO: 291202 - DNA, 75 bp, Artificial Sequence
  Synthetic
tatgtcagatttgattcagaatacacaattttagccactgcttcacagccaaccagttctaaatattctagcagt

SEQ ID NO: 291203 - DNA, 75 bp, Artificial Sequence
  Synthetic
ggcctgtcaaggatgtcatatacaatatgaatggtactttattaggaaatctgctcattttccctcaccagttca

SEQ ID NO: 291204 - DNA, 75 bp, Artificial Sequence
  Synthetic
tatgaatggtactttattaggaaatctgctcattttccctcaccagttcattaatctaagaaccaataatacagc

SEQ ID NO: 291205 - DNA, 75 bp, Artificial Sequence
  Synthetic
atgggatgattacacatggcaaagtgcttcaaaccccagtgttttcttcaaggttggtgatacagctaggtttag

SEQ ID NO: 291206 - DNA, 75 bp, Artificial Sequence
  Synthetic
gcttcaaaccccagtgttttcttcaaggttggtgatacagctaggtttagtgtgccctttgttggccttgcatcc

SEQ ID NO: 291207 - DNA, 75 bp, Artificial Sequence
  Synthetic
gtcacaacaatgtctcactgatggtcatccctattgcccctcttacagtaccaactggagcaactccctcactcc

SEQ ID NO: 291208 - DNA, 75 bp, Artificial Sequence
  Synthetic
catccctattgcccctcttacagtaccaactggagcaactccctcactccctataacagtcacaatagcacctat

SEQ ID NO: 291209 - DNA, 75 bp, Artificial Sequence
  Synthetic
ttatggtatcacagtgctaaaccacatgggtagcatggctttcagaatagttaatgaacatgatgcacacactac

SEQ ID NO: 291210 - DNA, 75 bp, Artificial Sequence
  Synthetic
atgggtagcatggctttcagaatagttaatgaacatgatgcacacactactgaagtcaaaatcagggtttatcac

SEQ ID NO: 291211 - DNA, 75 bp, Artificial Sequence
  Synthetic
tgccaactacaactttgccggggtcaggacaattcttgaccacagatgacaggcaatcccccagtgcactgccaa

SEQ ID NO: 291212 - DNA, 75 bp, Artificial Sequence
  Synthetic
aggacaattcttgaccacagatgacaggcaatcccccagtgcactgccaaattatgagccaactccaagaataca

SEQ ID NO: 291213 - DNA, 75 bp, Artificial Sequence
  Synthetic
atatgtgtcaataggacgcactaattataataaacaagcaatagttccagttattaaaaagagatcattgattac

SEQ ID NO: 291214 - DNA, 75 bp, Artificial Sequence
  Synthetic
tataataaacaagcaatagttccagttattaaaaagagatcattgattacaaattatggaataggacccagattt

SEQ ID NO: 291215 - DNA, 75 bp, Artificial Sequence
  Synthetic
tcattcctatgaacaacacgcatacaaaagatgaggttaacagttacctcataccactaaatgcaaacaggcaaa

SEQ ID NO: 291216 - DNA, 75 bp, Artificial Sequence
  Synthetic
aaaagatgaggttaacagttacctcataccactaaatgcaaacaggcaaaatgagcaggtttttgggacaaacct

SEQ ID NO: 291217 - DNA, 75 bp, Artificial Sequence
  Synthetic
cccagaagatcacttgaatctagtagccccccatccaaacagagatctagcagtagtatcaactggtgctcatgg

SEQ ID NO: 291218 - DNA, 75 bp, Artificial Sequence
  Synthetic
gccccccatccaaacagagatctagcagtagtatcaactggtgctcatggagcagagactatacctcattgtaat

SEQ ID NO: 291219 - DNA, 75 bp, Artificial Sequence
  Synthetic
agtactatacacattggtctggatcacttagattctcttcgatgtatactggtcctgccttgtccagtgctaaac

SEQ ID NO: 291220 - DNA, 75 bp, Artificial Sequence
  Synthetic
ggtcctgccttgtccagtgctaaactcactctagcatacaccccgcctggtgctcgtggtccacaggacaggaga

SEQ ID NO: 291221 - DNA, 75 bp, Artificial Sequence
  Synthetic
tatttgtgggaagcccacaactatttggattgagggtggcccttattacccaagtagatatcaggttggggttat

SEQ ID NO: 291222 - DNA, 75 bp, Artificial Sequence
  Synthetic
tggattgagggtggcccttattacccaagtagatatcaggttggggttatgaaaggtgtcggaccagcagagcct

SEQ ID NO: 291223 - DNA, 75 bp, Artificial Sequence
  Synthetic
tctgggatattggtctgcaatccaccatagtaatgacaataccatggacatcaggggtgcagtttagatatactg

SEQ ID NO: 291224 - DNA, 75 bp, Artificial Sequence
  Synthetic
catagtaatgacaataccatggacatcaggggtgcagtttagatatactgatccagatacatacaccagtgctgg

SEQ ID NO: 291225 - DNA, 75 bp, Artificial Sequence
  Synthetic
gacagctggaggtagtggctatgtatgttttgcagacattagacaattagattgcattgctgaagaacaaggcct

SEQ ID NO: 291226 - DNA, 75 bp, Artificial Sequence
  Synthetic
tgttttgcagacattagacaattagattgcattgctgaagaacaaggcctgggagattacatcactagcttagga

SEQ ID NO: 291227 - DNA, 75 bp, Artificial Sequence
  Synthetic
ccggccaggtctacttattatcattcataagtgcatgtccagattttaagcttaggctgatgaaagatactcaaa

SEQ ID NO: 291228 - DNA, 75 bp, Artificial Sequence
  Synthetic
cataagtgcatgtccagattttaagcttaggctgatgaaagatactcaaactatctcacagactgttgcactcac

SEQ ID NO: 291229 - DNA, 75 bp, Artificial Sequence
  Synthetic
attacaagatgtagcaaaagatttcctcacaacaaaggtattatctaaggttgttaaaatgatatcagctcttgt

SEQ ID NO: 291230 - DNA, 75 bp, Artificial Sequence
  Synthetic
ctcacaacaaaggtattatctaaggttgttaaaatgatatcagctcttgttattatctgtagaaatcatgatgat

SEQ ID NO: 291231 - DNA, 75 bp, Artificial Sequence
  Synthetic
agacggtggcctcaatctcatctggtccaaaacacacacaaaaagtccccatactaactgcaaacgaaacagggg

SEQ ID NO: 291232 - DNA, 75 bp, Artificial Sequence
  Synthetic
tccaaaacacacacaaaaagtccccatactaactgcaaacgaaacaggggccacaatgcctgttcttccatcaga

SEQ ID NO: 291233 - DNA, 75 bp, Artificial Sequence
  Synthetic
atggaggtttcttaaaatgtatatctctaaacactttcaagttccttatattgaaagacaagcaaatgatggatg

SEQ ID NO: 291234 - DNA, 75 bp, Artificial Sequence
  Synthetic
tctaaacactttcaagttccttatattgaaagacaagcaaatgatggatggttcagaaagttcaatgatgcatgc

SEQ ID NO: 291235 - DNA, 75 bp, Artificial Sequence
  Synthetic
atgtagaatgctttttgggtcgtgcagcttgtgtgcatgtaactgaaatacaaaacaaagatgctactggaatag

SEQ ID NO: 291236 - DNA, 75 bp, Artificial Sequence
  Synthetic
agcttgtgtgcatgtaactgaaatacaaaacaaagatgctactggaatagataatcacagagaagcaaaattgtt

SEQ ID NO: 291237 - DNA, 75 bp, Artificial Sequence
  Synthetic
agagtggattaaaaataaagtattgccacaggccaaggaaaaactagatttctgtagcaaattaaaacagcttga

SEQ ID NO: 291238 - DNA, 75 bp, Artificial Sequence
  Synthetic
ccacaggccaaggaaaaactagatttctgtagcaaattaaaacagcttgatatgttggaacgacaaataaccaca

SEQ ID NO: 291239 - DNA, 75 bp, Artificial Sequence
  Synthetic
tggaactcttcacttatgttaggtttgattctgagtataccatactggccactgcatctcaacctgattcagcaa

SEQ ID NO: 291240 - DNA, 75 bp, Artificial Sequence
  Synthetic
tgattctgagtataccatactggccactgcatctcaacctgattcagcaaactattcaagcaatttggtggtcca

SEQ ID NO: 291241 - DNA, 75 bp, Artificial Sequence
  Synthetic
tgtcatgtggttagagcagatgtctcaaaagtttgcccccctttatgctgcagaagctaagagaatcagagaact

SEQ ID NO: 291242 - DNA, 75 bp, Artificial Sequence
  Synthetic
caaaagtttgcccccctttatgctgcagaagctaagagaatcagagaactcaagaacaaaatacttaattatatg

SEQ ID NO: 291243 - DNA, 75 bp, Artificial Sequence
  Synthetic
acacatggcaaagtgcttcaaaccccagtgtattcttcaaggtgggggatacatcaaggtttagtgtgccttatg

SEQ ID NO: 291244 - DNA, 75 bp, Artificial Sequence
  Synthetic
cagtgtattcttcaaggtgggggatacatcaaggtttagtgtgccttatgtaggattggcatcagcatataattg

SEQ ID NO: 291245 - DNA, 75 bp, Artificial Sequence
  Synthetic
aacacctgggtcaggtaagtctttgacaacctcaattgtaggccgtgcactagctgaacaccttaactctgcagt

SEQ ID NO: 291246 - DNA, 75 bp, Artificial Sequence
  Synthetic
acaacctcaattgtaggccgtgcactagctgaacaccttaactctgcagtttactcacttcccccagacccaaaa

SEQ ID NO: 291247 - DNA, 75 bp, Artificial Sequence
  Synthetic
ctgttctaaaccatatgggtagtatggcattcagaatagtaaatgaacatgatgaacacaaaactcttgtcaaga

SEQ ID NO: 291248 - DNA, 75 bp, Artificial Sequence
  Synthetic
tcaaaatccagatggtcaagatattagtatgttttgtcaaatggtttcctctgttgattttataccaccaatggc

SEQ ID NO: 291249 - DNA, 75 bp, Artificial Sequence
  Synthetic
tcagagtttatcacagggcaaagctcgttgaagcatggattccaagagcacccagagcactaccctacacatcaa

SEQ ID NO: 291250 - DNA, 75 bp, Artificial Sequence
  Synthetic
agtatgttttgtcaaatggtttcctctgttgattttataccaccaatggccagtttagataacaaaggaatgctg

SEQ ID NO: 291251 - DNA, 75 bp, Artificial Sequence
  Synthetic
tagggcgcacaaattatcctaagaatacagaaccagtaattaagaagaggaaaggtgacattaaatcctatggtt

SEQ ID NO: 291252 - DNA, 75 bp, Artificial Sequence
  Synthetic
tacagaaccagtaattaagaagaggaaaggtgacattaaatcctatggtttaggacctaggtacggtgggattta

SEQ ID NO: 291253 - DNA, 75 bp, Artificial Sequence
  Synthetic
tccaaccattttgaaccctgaagcactagccaggagatttggttttgacttagatatttgcctacatagtacata

SEQ ID NO: 291254 - DNA, 75 bp, Artificial Sequence
  Synthetic
ctagccaggagatttggttttgacttagatatttgcctacatagtacatacactaaaaatggaaagctaaatgca

SEQ ID NO: 291255 - DNA, 75 bp, Artificial Sequence
  Synthetic
accataatctgatagcaccctatccaaatagagatttagcaatagtctcaacaggaggacatggtgcagaaacaa

SEQ ID NO: 291256 - DNA, 75 bp, Artificial Sequence
  Synthetic
gaaatgttgtccactagtgtgtggtaaagcaattagtctagtggatagagcaacaaatatcagatatagtgtaga

SEQ ID NO: 291257 - DNA, 75 bp, Artificial Sequence
  Synthetic
tgtttactattccacatattacagaaagtattaccccataatttgcgaaaagcccaccaacatctggattgaagg

SEQ ID NO: 291258 - DNA, 75 bp, Artificial Sequence
  Synthetic
aaagcaattagtctagtggatagagcaacaaatatcagatatagtgtagaccagttagtttcagctataatcaat

SEQ ID NO: 291259 - DNA, 75 bp, Artificial Sequence
  Synthetic
aagtattaccccataatttgcgaaaagcccaccaacatctggattgaaggaagcccttattacccaagtagattt

SEQ ID NO: 291260 - DNA, 75 bp, Artificial Sequence
  Synthetic
aggaccagtctataaggatctagaaatagatgtgtgtaacacaccagccccagagtgcattaatgatttactcaa

SEQ ID NO: 291261 - DNA, 75 bp, Artificial Sequence
  Synthetic
tgggattttgagatgcatacatggtcccattggattgttaacagctgaaggtagtggatatgtttgttttgctga

SEQ ID NO: 291262 - DNA, 75 bp, Artificial Sequence
  Synthetic
cccattggattgttaacagctgaaggtagtggatatgtttgttttgctgacatacgacagttggagtgtatcgca

SEQ ID NO: 291263 - DNA, 75 bp, Artificial Sequence
  Synthetic
atagatgtgtgtaacacaccagccccagagtgcattaatgatttactcaaatcagtagattctgaagaagttagg

SEQ ID NO: 291264 - DNA, 75 bp, Artificial Sequence
  Synthetic
agaaagggcagtaaaccaggctagtatgattatcaacacaatcttgatgtttgttagtacactaggcatagtgta

SEQ ID NO: 291265 - DNA, 75 bp, Artificial Sequence
  Synthetic
tgtcgggttcactgaccaaatctcaacaaaagtcacagaactacaagaagtggcgaaagatttcctcaccacaaa

SEQ ID NO: 291266 - DNA, 75 bp, Artificial Sequence
  Synthetic
acaaaagtcacagaactacaagaagtggcgaaagatttcctcaccacaaaagttttgtccaaagtggtcaaaatg

SEQ ID NO: 291267 - DNA, 75 bp, Artificial Sequence
  Synthetic
atgattatcaacacaatcttgatgtttgttagtacactaggcatagtgtatgttatatataaactctttgcacag

SEQ ID NO: 291268 - DNA, 75 bp, Artificial Sequence
  Synthetic
tacattaagaccaattgtagtacaaggtcccaatactgagtttgctttgtctttacttaggaaaaatatagtcac

SEQ ID NO: 291269 - DNA, 75 bp, Artificial Sequence
  Synthetic
tacggccactctagcactacttggatgtgatggatctccttggagatttctgaagatgtacatttccaaacactt

SEQ ID NO: 291270 - DNA, 75 bp, Artificial Sequence
  Synthetic
tgtgatggatctccttggagatttctgaagatgtacatttccaaacactttcaggtgccttacattgaaagacaa

SEQ ID NO: 291271 - DNA, 75 bp, Artificial Sequence
  Synthetic
ggtcccaatactgagtttgctttgtctttacttaggaaaaatatagtcaccatcaccacagagaagggagagttt

SEQ ID NO: 291272 - DNA, 75 bp, Artificial Sequence
  Synthetic
acccagcgagagtgttcttttgaacggacagaaagtgcatcttaaagacaaatacaaattggttgatcctgaaaa

SEQ ID NO: 291273 - DNA, 75 bp, Artificial Sequence
  Synthetic
gggattggaatggattgctaataagatttccaaactgattgaatggataaaaaacaaagtacttccccaagccaa

SEQ ID NO: 291274 - DNA, 75 bp, Artificial Sequence
  Synthetic
atttccaaactgattgaatggataaaaaacaaagtacttccccaagccaaagaaaaactagaattttgtagtaaa

SEQ ID NO: 291275 - DNA, 75 bp, Artificial Sequence
  Synthetic
ggacagaaagtgcatcttaaagacaaatacaaattggttgatcctgaaaatgttaacctggaactcaccataata

SEQ ID NO: 291276 - DNA, 75 bp, Artificial Sequence
  Synthetic
ggatgcagaagggcttgatgcatcattagtgatacactccaataactatactaacaccattctagatgtaggtcc

SEQ ID NO: 291277 - DNA, 75 bp, Artificial Sequence
  Synthetic
gaatccaacacaggaaaaacgagagcagttgttcaataacgtattgtggttggaacaaatgtcgcaaaagtttgc

SEQ ID NO: 291278 - DNA, 75 bp, Artificial Sequence
  Synthetic
ttagtgatacactccaataactatactaacaccattctagatgtaggtcccataactatggcaggtttaattaat

SEQ ID NO: 291279 - DNA, 75 bp, Artificial Sequence
  Synthetic
agaatcagggaactcaagaacaaaatggtaaattatatgcaatttaaaagtaaacaaagaactgaaccagtgtgt

SEQ ID NO: 291280 - DNA, 75 bp, Artificial Sequence
  Synthetic
aacagggcaatgtggaggagtactgtgtaccactgggaagatctttggaatacatgttggaggtaatggaagaca

SEQ ID NO: 291281 - DNA, 75 bp, Artificial Sequence
  Synthetic
taaacaaagaactgaaccagtgtgtgtattaatccatggtacacccggttctggtaaatcattaacaacatccat

SEQ ID NO: 291282 - DNA, 75 bp, Artificial Sequence
  Synthetic
gtattaatccatggtacacccggttctggtaaatcattaacaacatccattgtgggacgtgcaattgcagaacac

SEQ ID NO: 291283 - DNA, 75 bp, Artificial Sequence
  Synthetic
tgtaccactgggaagatctttggaatacatgttggaggtaatggaagacaagggttttcagcacagttgagaaag

SEQ ID NO: 291284 - DNA, 75 bp, Artificial Sequence
  Synthetic
ggaattgaacttagctccagtgaacactccaacaaagacaaagctacaccctagtgtattctatgatgttttccc

SEQ ID NO: 291285 - DNA, 75 bp, Artificial Sequence
  Synthetic
ttatcagcaacaggaagttgtgattatggatgatctgaaccaaaatccagatggacaggatataagcatgttttg

SEQ ID NO: 291286 - DNA, 75 bp, Artificial Sequence
  Synthetic
atggatgatctgaaccaaaatccagatggacaggatataagcatgttttgtcaaatggtttcttcagtggatttc

SEQ ID NO: 291287 - DNA, 75 bp, Artificial Sequence
  Synthetic
actccaacaaagacaaagctacaccctagtgtattctatgatgttttccctggaaacaaacaaccagctgttctt

SEQ ID NO: 291288 - DNA, 75 bp, Artificial Sequence
  Synthetic
aaagtacaaagggaatgtagaaatgaagcccactgaaaacatgctagtagctgtagatcattatgcaggtcagtt

SEQ ID NO: 291289 - DNA, 75 bp, Artificial Sequence
  Synthetic
ttttgttctagcctccacaaattctaacacactaagccccccaacaatcttgaatcctgaagctttagtcaggag

SEQ ID NO: 291290 - DNA, 75 bp, Artificial Sequence
  Synthetic
aacacactaagccccccaacaatcttgaatcctgaagctttagtcaggagatttggttttgacctagatatatgt

SEQ ID NO: 291291 - DNA, 75 bp, Artificial Sequence
  Synthetic
aagcccactgaaaacatgctagtagctgtagatcattatgcaggtcagttattatcattagatatacctactgat

SEQ ID NO: 291292 - DNA, 75 bp, Artificial Sequence
  Synthetic
agacataacaacaagtgctggttacccttatgttagtcttggtattaagaaaagagacattttaaacaaggaaac

SEQ ID NO: 291293 - DNA, 75 bp, Artificial Sequence
  Synthetic
caagacatgcaaagattgccatcaaccatctaatttcaagaaatgttgccccctagtctgtggaaaagctattag

SEQ ID NO: 291294 - DNA, 75 bp, Artificial Sequence
  Synthetic
ccatctaatttcaagaaatgttgccccctagtctgtggaaaagctattagcttggtagacagaactaccaacgtt

SEQ ID NO: 291295 - DNA, 75 bp, Artificial Sequence
  Synthetic
ccttatgttagtcttggtattaagaaaagagacattttaaacaaggaaacccaggaaactgaaaagatgaaattt

SEQ ID NO: 291296 - DNA, 75 bp, Artificial Sequence
  Synthetic
tgagctgagaagtgctgacaaagttagattgggcaagagtagattgattgaagcctctagtttgaatgattcagt

SEQ ID NO: 291297 - DNA, 75 bp, Artificial Sequence
  Synthetic
caaaatgcaaattacagattccctagaaacactgtttcaaggaccagtgtataaagatttagagattgatgtttg

SEQ ID NO: 291298 - DNA, 75 bp, Artificial Sequence
  Synthetic
gaaacactgtttcaaggaccagtgtataaagatttagagattgatgtttgcaacacaccaccttcagaatgtatc

SEQ ID NO: 291299 - DNA, 75 bp, Artificial Sequence
  Synthetic
agattgggcaagagtagattgattgaagcctctagtttgaatgattcagtaaacatgaggatgaaattaggacac

SEQ ID NO: 291300 - DNA, 75 bp, Artificial Sequence
  Synthetic
cggttgtgatcctgatgtgttctggtcagtcataccgtgtttaatggatggacatcttatggcttttgattattc

SEQ ID NO: 291301 - DNA, 75 bp, Artificial Sequence
  Synthetic
gaagaagaaatggattatacctgaaattcctaccaacatagaaagggctatgaatcaagccagcatgattattaa

SEQ ID NO: 291302 - DNA, 75 bp, Artificial Sequence
  Synthetic
attcctaccaacatagaaagggctatgaatcaagccagcatgattattaatactattctgatgtttgtcagtaca

SEQ ID NO: 291303 - DNA, 75 bp, Artificial Sequence
  Synthetic
tcagtcataccgtgtttaatggatggacatcttatggcttttgattattcaaattttgatgcttccctatctcca

SEQ ID NO: 291304 - DNA, 75 bp, Artificial Sequence
  Synthetic
tgcttcactgattcagacaatttgcaatactcaccatattttcagagatgagatttacacagtcaaaggaggaat

SEQ ID NO: 291305 - DNA, 75 bp, Artificial Sequence
  Synthetic
atattctggtaacccgcctcacaataaactaaaagccccaactttacgcccagttgttgtgcaaggaccaaacac

SEQ ID NO: 291306 - DNA, 75 bp, Artificial Sequence
  Synthetic
aaactaaaagccccaactttacgcccagttgttgtgcaaggaccaaacacagaatttgcactatccctgttaagg

SEQ ID NO: 291307 - DNA, 75 bp, Artificial Sequence
  Synthetic
aatactcaccatattttcagagatgagatttacacagtcaaaggaggaatgccatctggttgctctggaactagt

SEQ ID NO: 291308 - DNA, 75 bp, Artificial Sequence
  Synthetic
tgcatacaaaggcatagatctagataaacttaaggtaattgcatatggtgatgatttgattgtatcctatccctt

SEQ ID NO: 291309 - DNA, 75 bp, Artificial Sequence
  Synthetic
catacatgatcgtgtctgtgtgatacccacacacgcacagcctggtgatgatgtactagtgaatggtcagaaaat

SEQ ID NO: 291310 - DNA, 75 bp, Artificial Sequence
  Synthetic
cccacacacgcacagcctggtgatgatgtactagtgaatggtcagaaaattagagttaaggataagtacaaatta

SEQ ID NO: 291311 - DNA, 75 bp, Artificial Sequence
  Synthetic
aaacttaaggtaattgcatatggtgatgatttgattgtatcctatccctttgagttagatcctggagtattggct

SEQ ID NO: 291312 - DNA, 75 bp, Artificial Sequence
  Synthetic
gaaatttgtgaaaatgacttgggaaaatttaacattcttaaagagatacttcagaccagatgaacagtttccttt

SEQ ID NO: 291313 - DNA, 75 bp, Artificial Sequence
  Synthetic
aaatgaaaaattcagagatatcaggggatttatatcagaagatctagaaggtgtggatgccactttggtagtaca

SEQ ID NO: 291314 - DNA, 75 bp, Artificial Sequence
  Synthetic
ggatttatatcagaagatctagaaggtgtggatgccactttggtagtacattcaaataactttaccaacactatc

SEQ ID NO: 291315 - DNA, 75 bp, Artificial Sequence
  Synthetic
aatttaacattcttaaagagatacttcagaccagatgaacagtttcctttcttaatccacccagtgatgcctatg

SEQ ID NO: 291316 - DNA, 75 bp, Artificial Sequence
  Synthetic
agaccatgtcaggtcactatgcatgttagcatggcactcaggtcaaaaagaatatgatgagttcttgagtaaaat

SEQ ID NO: 291317 - DNA, 75 bp, Artificial Sequence
  Synthetic
ccccactaacagaatgattcgttatgattatgcaacaaaaactgggcagtgtggaggtgtgctgtgtgctactgg

SEQ ID NO: 291318 - DNA, 75 bp, Artificial Sequence
  Synthetic
tcagaaagcgctggctggatatgttttaaatcaattagataagtacatatagacatttaatttgattagaattag

SEQ ID NO: 291319 - DNA, 75 bp, Artificial Sequence
  Synthetic
ctcaacttaaaaaacaatattttgtagagaaacaaggccaagtaatagctagacataaggttagggagtttaaca

SEQ ID NO: 291320 - DNA, 75 bp, Artificial Sequence
  Synthetic
catccgacccactgggtgtagtactctggtacttcgtacctttgtacgcctgttcttcccattgtacccttcctg

SEQ ID NO: 291321 - DNA, 75 bp, Artificial Sequence
  Synthetic
tatgatgtttttccaggtgacaaggaacctgctgtattgagtgacaatgatcccagactggaagttaaattgact

SEQ ID NO: 291322 - DNA, 75 bp, Artificial Sequence
  Synthetic
aacctgctgtattgagtgacaatgatcccagactggaagttaaattgactgaatcattattctctaagtacaagg

SEQ ID NO: 291323 - DNA, 75 bp, Artificial Sequence
  Synthetic
gcaccacatccagtggtgtttagtacaagcacttctgtttccccggagcgaggtataggctgtacccactgccaa

SEQ ID NO: 291324 - DNA, 75 bp, Artificial Sequence
  Synthetic
tatgcagggcaactattatcactagatatccccacttctgaacttacactaaaagaagcattatatggagtagat

SEQ ID NO: 291325 - DNA, 75 bp, Artificial Sequence
  Synthetic
atatccccacttctgaacttacactaaaagaagcattatatggagtagatggactagaacctatagatattacaa

SEQ ID NO: 291326 - DNA, 75 bp, Artificial Sequence
  Synthetic
ggtggatttcccctccactagtttggtcgatgaggctaggaattccccacgggtgaccgtgtcctagcctgcgtg

SEQ ID NO: 291327 - DNA, 75 bp, Artificial Sequence
  Synthetic
gtcgatgaggctaggaattccccacgggtgaccgtgtcctagcctgcgtggcggccaacccagcttatgctggga

SEQ ID NO: 291328 - DNA, 75 bp, Artificial Sequence
  Synthetic
ctgaataaagagacccaggacacagaaaagatgaagttttatctagacaagtatggcattgacttgcctctagtt

SEQ ID NO: 291329 - DNA, 75 bp, Artificial Sequence
  Synthetic
aaaagatgaagttttatctagacaagtatggcattgacttgcctctagttacatatattaaggatgaattaagaa

SEQ ID NO: 291330 - DNA, 75 bp, Artificial Sequence
  Synthetic
ttgaatgattctgttaacatgagaatgaaactaggcaacctttacaaagcattccatcaaaatcccggtgttctg

SEQ ID NO: 291331 - DNA, 75 bp, Artificial Sequence
  Synthetic
ctttgggtgtccgtgtttcttatttttcttattattgtcttatggtcacagcatatatataacatatactgtgat

SEQ ID NO: 291332 - DNA, 75 bp, Artificial Sequence
  Synthetic
tgaaactaggcaacctttacaaagcattccatcaaaatcccggtgttctgactggatcagcagtgggttgtgatc

SEQ ID NO: 291333 - DNA, 75 bp, Artificial Sequence
  Synthetic
atatattaactaatggatctaatcaaaccttcacagttattaattattacaaagatgcagctagttcatcttcag

SEQ ID NO: 291334 - DNA, 75 bp, Artificial Sequence
  Synthetic
gcatttgattactctaattttgatgcctctttgtcaccagtttggtttgtctgtctagagaaggttttgaccaag

SEQ ID NO: 291335 - DNA, 75 bp, Artificial Sequence
  Synthetic
aaccttcacagttattaattattacaaagatgcagctagttcatcttcagctggacaatctttttcaatggatcc

SEQ ID NO: 291336 - DNA, 75 bp, Artificial Sequence
  Synthetic
cctctttgtcaccagtttggtttgtctgtctagagaaggttttgaccaagttaggctttgcaggctcttcattaa

SEQ ID NO: 291337 - DNA, 75 bp, Artificial Sequence
  Synthetic
cactgaattcaccgaatgttgaagcatgtggttacagtgatagggttcaacaaatcaccctgggcaattccacca

SEQ ID NO: 291338 - DNA, 75 bp, Artificial Sequence
  Synthetic
gttgaaggtggcatgccctcagggtgttcaggaaccagcatattcaattccatgatcaacaacataatcattagg

SEQ ID NO: 291339 - DNA, 75 bp, Artificial Sequence
  Synthetic
atgtggttacagtgatagggttcaacaaatcaccctgggcaattccaccataactactcaggaagcagctaacgc

SEQ ID NO: 291340 - DNA, 75 bp, Artificial Sequence
  Synthetic
gttcaggaaccagcatattcaattccatgatcaacaacataatcattaggactttgatattagatgcatataaag

SEQ ID NO: 291341 - DNA, 75 bp, Artificial Sequence
  Synthetic
gtgatgtaaataaaacatcaaaaccagacatttctgtatgtagattttacacattagatagcaaaacatggaaag

SEQ ID NO: 291342 - DNA, 75 bp, Artificial Sequence
  Synthetic
gtttcttatccttatgaactggatccacaagtgttggcaactcttggtaaaaattatggactaaccatcacaccc

SEQ ID NO: 291343 - DNA, 75 bp, Artificial Sequence
  Synthetic
agacatttctgtatgtagattttacacattagatagcaaaacatggaaagctacttccaaaggctggtgttggaa

SEQ ID NO: 291344 - DNA, 75 bp, Artificial Sequence
  Synthetic
cacaagtgttggcaactcttggtaaaaattatggactaaccatcacacccccagacaaatctgaaacttttacaa

SEQ ID NO: 291345 - DNA, 75 bp, Artificial Sequence
  Synthetic
accattcacttggtagaacaggttacacaatacatgtacagtgcaatgctaccaaatttcatagtggctgcctat

SEQ ID NO: 291346 - DNA, 75 bp, Artificial Sequence
  Synthetic
caacaatttccctttttggttcacccagttatgcccatgaaagatatacatgagtcaatcagatggacaaaggat

SEQ ID NO: 291347 - DNA, 75 bp, Artificial Sequence
  Synthetic
cacaatacatgtacagtgcaatgctaccaaatttcatagtggctgcctattggttgtggttatcccagaacacca

SEQ ID NO: 291348 - DNA, 75 bp, Artificial Sequence
  Synthetic
cagttatgcccatgaaagatatacatgagtcaatcagatggacaaaggatcctaaaaacacacaggatcacgtcc

SEQ ID NO: 291349 - DNA, 75 bp, Artificial Sequence
  Synthetic
atccaggagatcgaggtattgatctagacactgttgaagttgcaggtggccctaccagcgacgccatctacaaca

SEQ ID NO: 291350 - DNA, 75 bp, Artificial Sequence
  Synthetic
ttcattcagaagatcagaactactgacattggaaaatgtctaattctcccagaatacagcgtacttaggaggcgc

SEQ ID NO: 291351 - DNA, 75 bp, Artificial Sequence
  Synthetic
agacactgttgaagttgcaggtggccctaccagcgacgccatctacaacatggacggaactcttctaggcaatct

SEQ ID NO: 291352 - DNA, 75 bp, Artificial Sequence
  Synthetic
agaatacagcgtacttaggaggcgctggttggacctcttttaggttaacaatatagacacttaatttgagtagaa

SEQ ID NO: 291353 - DNA, 75 bp, Artificial Sequence
  Synthetic
caatagttgttccttatatcaattcagtacctattgactcaatgaccagacacaacaatgtatcactgatggttg

SEQ ID NO: 291354 - DNA, 75 bp, Artificial Sequence
  Synthetic
agtacctattgactcaatgaccagacacaacaatgtatcactgatggttgttccaatagctccacttaatgcacc

SEQ ID NO: 291355 - DNA, 75 bp, Artificial Sequence
  Synthetic
cacccgacccactgggtgttgtacactggtattttgtacctttgtatgcctgtttgcacctccccaccccttcca

SEQ ID NO: 291356 - DNA, 75 bp, Artificial Sequence
  Synthetic
cagtgcaataggacgtatcacatccagtgatataaagcacaagcaattcttgttccccggagctggatatagact

SEQ ID NO: 291357 - DNA, 75 bp, Artificial Sequence
  Synthetic
gcacagaatttactggtattagatctagatccattgtaccacaagggttacccactactacccttccaggatctg

SEQ ID NO: 291358 - DNA, 75 bp, Artificial Sequence
  Synthetic
tagatccattgtaccacaagggttacccactactacccttccaggatctggtcaatttctcactacagatgacag

SEQ ID NO: 291359 - DNA, 75 bp, Artificial Sequence
  Synthetic
agtgatataaagcacaagcaattcttgttccccggagctggatatagactgctaacgtggttgaaggtccttaac

SEQ ID NO: 291360 - DNA, 75 bp, Artificial Sequence
  Synthetic
tgagcgttcgatcaggtgaattccccattcactagtttggtcgatgaggctgagaactccccacaggtgactgtg

SEQ ID NO: 291361 - DNA, 75 bp, Artificial Sequence
  Synthetic
ttccagggaaagtgagaaatttattagagataatacaagtgggtacattgattccaatgaacaacacaggaacaa

SEQ ID NO: 291362 - DNA, 75 bp, Artificial Sequence
  Synthetic
agagataatacaagtgggtacattgattccaatgaacaacacaggaacaaatgataatgtcacaaattacctcat

SEQ ID NO: 291363 - DNA, 75 bp, Artificial Sequence
  Synthetic
cattcactagtttggtcgatgaggctgagaactccccacaggtgactgtgtctcagcctgcgtggcggccaaccc

SEQ ID NO: 291364 - DNA, 75 bp, Artificial Sequence
  Synthetic
gcttggttgtgactcctccggcccctgaatgcggctaacctcaaccccggagccttgtagtgtaagccaacacat

SEQ ID NO: 291365 - DNA, 75 bp, Artificial Sequence
  Synthetic
acattggtgatggtgttttcaagactactttattgggtgaaatagctcagtactacacacactggtctggatctc

SEQ ID NO: 291366 - DNA, 75 bp, Artificial Sequence
  Synthetic
tactttattgggtgaaatagctcagtactacacacactggtctggatctcttagaatttcactcatgtacacagg

SEQ ID NO: 291367 - DNA, 75 bp, Artificial Sequence
  Synthetic
tgaatgcggctaacctcaaccccggagccttgtagtgtaagccaacacatacaaggtcgtaatgggcaactctgg

SEQ ID NO: 291368 - DNA, 75 bp, Artificial Sequence
  Synthetic
gtgtcttatggttacaagtattgattgtaaccatgggtgcacaggtctctacacagaaaagtggttcacatgaaa

SEQ ID NO: 291369 - DNA, 75 bp, Artificial Sequence
  Synthetic
cgcgtggtccagaagatagaaaggaagcaatgttgggaacacatgttgtatgggatattggcttacaatccacca

SEQ ID NO: 291370 - DNA, 75 bp, Artificial Sequence
  Synthetic
agcaatgttgggaacacatgttgtatgggatattggcttacaatccaccatagttatgaccattccatggacatc

SEQ ID NO: 291371 - DNA, 75 bp, Artificial Sequence
  Synthetic
tgtaaccatgggtgcacaggtctctacacagaaaagtggttcacatgaaaatcaaaatttcttgtccaatggatc

SEQ ID NO: 291372 - DNA, 75 bp, Artificial Sequence
  Synthetic
catctgccggtcaatcgttatcaatggaccccagcaaatttacagaaccagttaaggatttaatgttgaaaggag

SEQ ID NO: 291373 - DNA, 75 bp, Artificial Sequence
  Synthetic
atctatcatgctggtatcagacatcactcatacttccaccacaaaccagtggtcaagtctaccttttatctttta

SEQ ID NO: 291374 - DNA, 75 bp, Artificial Sequence
  Synthetic
actcatacttccaccacaaaccagtggtcaagtctaccttttatcttttatcagtgcttgtcctgatttcaaact

SEQ ID NO: 291375 - DNA, 75 bp, Artificial Sequence
  Synthetic
ggaccccagcaaatttacagaaccagttaaggatttaatgttgaaaggagcccctgctttaaactcaccaaatat

SEQ ID NO: 291376 - DNA, 75 bp, Artificial Sequence
  Synthetic
caacaattactacacaggaagcagcaaacactgttgttgcttatggtgaatggccttcatttttgtctgacgttg

SEQ ID NO: 291377 - DNA, 75 bp, Artificial Sequence
  Synthetic
agggtcttagtgacgagttggaggaagtcattgtcgagaaaactaaacagacattggcctcagtctcctcaggac

SEQ ID NO: 291378 - DNA, 75 bp, Artificial Sequence
  Synthetic
agtcattgtcgagaaaactaaacagacattggcctcagtctcctcaggacctaagcacactcagagtgttcctgc

SEQ ID NO: 291379 - DNA, 75 bp, Artificial Sequence
  Synthetic
aaacactgttgttgcttatggtgaatggccttcatttttgtctgacgttgatgccagcgacgttaacaagacaac

SEQ ID NO: 291380 - DNA, 75 bp, Artificial Sequence
  Synthetic
ggaacccagattctaagggatggtgttggaaattacctgatgctttaaaagagatgggaatatttggacaaaata

SEQ ID NO: 291381 - DNA, 75 bp, Artificial Sequence
  Synthetic
acgtggaaactagaactacttacatgcatttcaatggttcagaaacagatgtagagagcttcctcggcagagcag

SEQ ID NO: 291382 - DNA, 75 bp, Artificial Sequence
  Synthetic
gcatttcaatggttcagaaacagatgtagagagcttcctcggcagagcagcttgtgtgcatgtgacagaaatcaa

SEQ ID NO: 291383 - DNA, 75 bp, Artificial Sequence
  Synthetic
ttggaaattacctgatgctttaaaagagatgggaatatttggacaaaatatgtttttccatgcccagggaagaac

SEQ ID NO: 291384 - DNA, 75 bp, Artificial Sequence
  Synthetic
gcttgttggttgtggttatacctgagcatcaacttgcttccattaaaggagccaatgtatcagttttgtatgata

SEQ ID NO: 291385 - DNA, 75 bp, Artificial Sequence
  Synthetic
atgattggaaaattaacctttcaagtcttgtccagcttagaaagaagttagaactctttacttatgtcagatttg

SEQ ID NO: 291386 - DNA, 75 bp, Artificial Sequence
  Synthetic
tcttgtccagcttagaaagaagttagaactctttacttatgtcagatttgactcagaatacactattctggccac

SEQ ID NO: 291387 - DNA, 75 bp, Artificial Sequence
  Synthetic
gcatcaacttgcttccattaaaggagccaatgtatcagttttgtatgataaaactcaccctggggaatcaggaat

SEQ ID NO: 291388 - DNA, 75 bp, Artificial Sequence
  Synthetic
tgatgaatggaacattgattggcaatagtttaatttttcctcatcagttcattaacctcagaaccaacaacacag

SEQ ID NO: 291389 - DNA, 75 bp, Artificial Sequence
  Synthetic
caatgtatgtgcctcccggtgcacctaaccctaaggaatgggatgattacacatggcaaagtgcttctaacccca

SEQ ID NO: 291390 - DNA, 75 bp, Artificial Sequence
  Synthetic
taaccctaaggaatgggatgattacacatggcaaagtgcttctaaccccagtgtgtttttcaaagttggtgagac

SEQ ID NO: 291391 - DNA, 75 bp, Artificial Sequence
  Synthetic
tagtttaatttttcctcatcagttcattaacctcagaaccaacaacacagctacaattgttgtcccatatatcaa

SEQ ID NO: 291392 - DNA, 75 bp, Artificial Sequence
  Synthetic
tgatcccgatagtgggtataacagcaactagcggatctgcaccctcaataccagttacagttaccattgcaccta

SEQ ID NO: 291393 - DNA, 75 bp, Artificial Sequence
  Synthetic
tttatgatgggtactcacatgatgatccagacactccttatggcataacagtactaaatcacatgggtagcatgg

SEQ ID NO: 291394 - DNA, 75 bp, Artificial Sequence
  Synthetic
tccagacactccttatggcataacagtactaaatcacatgggtagcatggcattcagagtggttaatgaacatga

SEQ ID NO: 291395 - DNA, 75 bp, Artificial Sequence
  Synthetic
aactagcggatctgcaccctcaataccagttacagttaccattgcacctatgtttttggaattatcaggcataag

SEQ ID NO: 291396 - DNA, 75 bp, Artificial Sequence
  Synthetic
aacaatttctcacaacagatgatagacaatcacccagtgcaatgcccaattatgaaccaacaccacttatacaca

SEQ ID NO: 291397 - DNA, 75 bp, Artificial Sequence
  Synthetic
tggaagcatggattccaagagcacctagagccttgccatacgtgtctattggacgcactaactaccccagagatt

SEQ ID NO: 291398 - DNA, 75 bp, Artificial Sequence
  Synthetic
tagagccttgccatacgtgtctattggacgcactaactaccccagagattcaaaaacaataataaagaagaggac

SEQ ID NO: 291399 - DNA, 75 bp, Artificial Sequence
  Synthetic
acaatcacccagtgcaatgcccaattatgaaccaacaccacttatacacattcctggtgaagtcaataacctgct

SEQ ID NO: 291400 - DNA, 75 bp, Artificial Sequence
  Synthetic
tagttggcttggatatgtacagaataccattgcatcagaacagacaagagacacaagtttttggtttcagactgt

SEQ ID NO: 291401 - DNA, 75 bp, Artificial Sequence
  Synthetic
gcaatgtgaaaataataaattaccaccttatgactccagatgatcacctaaacttagtagccccttacccaaata

SEQ ID NO: 291402 - DNA, 75 bp, Artificial Sequence
  Synthetic
ccttatgactccagatgatcacctaaacttagtagccccttacccaaatagagatttagcagtagttgctactgg

SEQ ID NO: 291403 - DNA, 75 bp, Artificial Sequence
  Synthetic
accattgcatcagaacagacaagagacacaagtttttggtttcagactgtttttaggtgatggtgttttgaaaac

SEQ ID NO: 291404 - DNA, 75 bp, Artificial Sequence
  Synthetic
tgcgtttatccttcatgtacaccggaccagcattgtccagtgccaagttgttaatagcatacactcccccaggtg

SEQ ID NO: 291405 - DNA, 75 bp, Artificial Sequence
  Synthetic
actactccagatattacaggaagttctatcccatcatttgtgagagacccactaacatctggattgagggtagct

SEQ ID NO: 291406 - DNA, 75 bp, Artificial Sequence
  Synthetic
ctatcccatcatttgtgagagacccactaacatctggattgagggtagctcgtactacccaagtagataccaagc

SEQ ID NO: 291407 - DNA, 75 bp, Artificial Sequence
  Synthetic
accagcattgtccagtgccaagttgttaatagcatacactcccccaggtgcagaaggaccaacaaaacgtaaaga

SEQ ID NO: 291408 - DNA, 75 bp, Artificial Sequence
  Synthetic
tggtattgaacatcccatggacatctggagtgcagtatagatacacagatccggacacatacaccagtgctggat

SEQ ID NO: 291409 - DNA, 75 bp, Artificial Sequence
  Synthetic
tacttagatgtatacatggccccatcggattgttaacagctggtggaggcggttatgtctgttttgcagacataa

SEQ ID NO: 291410 - DNA, 75 bp, Artificial Sequence
  Synthetic
tggagtgcagtatagatacacagatccggacacatacaccagtgctggatatgtttcgtgttggtatcaaacatc

SEQ ID NO: 291411 - DNA, 75 bp, Artificial Sequence
  Synthetic
ggttatgtctgttttgcagacataagacaattggatttcattgctgatgagcagggcctaggtgattacattacc

SEQ ID NO: 291412 - DNA, 75 bp, Artificial Sequence
  Synthetic
taagtgcttgtccagacttcaaactcagacttatgaaagacacccaatcaatataccaagactcagcattaactg

SEQ ID NO: 291413 - DNA, 75 bp, Artificial Sequence
  Synthetic
cagacttatgaaagacacccaatcaatataccaagactcagcattaactgaaggtttggaggatgacttggtaga

SEQ ID NO: 291414 - DNA, 75 bp, Artificial Sequence
  Synthetic
ggtttgtgaacttcaggatgttgcaaaagattttctaacaacaaaggtattatccaaggtagtaaaaatgatttc

SEQ ID NO: 291415 - DNA, 75 bp, Artificial Sequence
  Synthetic
tatccaaggtagtaaaaatgatttcagccctagtcatcatctgtagaaaccatgatgatctagttactgttactg

SEQ ID NO: 291416 - DNA, 75 bp, Artificial Sequence
  Synthetic
ccaaacatacccaaaaggctccagcactgactgcaaatgaaactggagcaacaatgcccactaccccatcagata

SEQ ID NO: 291417 - DNA, 75 bp, Artificial Sequence
  Synthetic
actgactgcaaatgaaactggagcaacaatgcccactaccccatcagatagtgtagaaaccagaacaacactgat

SEQ ID NO: 291418 - DNA, 75 bp, Artificial Sequence
  Synthetic
atgtacatatcaaaacattttcaagtaccttacattgaaagacaagcaaatgatggctggttcagaaaatttaat

SEQ ID NO: 291419 - DNA, 75 bp, Artificial Sequence
  Synthetic
taccttacattgaaagacaagcaaatgatggctggttcagaaaatttaatgatgcttgcaacgctgcaaagggat

SEQ ID NO: 291420 - DNA, 75 bp, Artificial Sequence
  Synthetic
catgtgttcatgtagttgaaataaaaaacaaagaaccccaggatgtaaatcataaaagtgaacttttgttcaacg

SEQ ID NO: 291421 - DNA, 75 bp, Artificial Sequence
  Synthetic
aaacaaagaaccccaggatgtaaatcataaaagtgaacttttgttcaacgattggaaaataaatttatcaagttt

SEQ ID NO: 291422 - DNA, 75 bp, Artificial Sequence
  Synthetic
aaggttctgccccaagccagggaaaagcttgagttttgtagcaaactaaagcaactagacatattagagagacaa

SEQ ID NO: 291423 - DNA, 75 bp, Artificial Sequence
  Synthetic
agcttgagttttgtagcaaactaaagcaactagacatattagagagacaaatagcatccatacatgactcgaatc

SEQ ID NO: 291424 - DNA, 75 bp, Artificial Sequence
  Synthetic
cagaatacactataattgcaaccagttcccagccaaataatgccaaatattcaagtaatctcactgttcaagcaa

SEQ ID NO: 291425 - DNA, 75 bp, Artificial Sequence
  Synthetic
ttcccagccaaataatgccaaatattcaagtaatctcactgttcaagcaatgtatataccaccaggagcaccaaa

SEQ ID NO: 291426 - DNA, 75 bp, Artificial Sequence
  Synthetic
caaatgtcacaaaaattctcacccttatatgcctcagaagcaaagagaatcagggacctcaaaaacaagatcact

SEQ ID NO: 291427 - DNA, 75 bp, Artificial Sequence
  Synthetic
tatatgcctcagaagcaaagagaatcagggacctcaaaaacaagatcactaattacatgcagtttaagagtaagc

SEQ ID NO: 291428 - DNA, 75 bp, Artificial Sequence
  Synthetic
tatttttcaatgtgggaaaatctgctaggtttagtgtaccttatttgggaatagcttcagcttacaattgtttct

SEQ ID NO: 291429 - DNA, 75 bp, Artificial Sequence
  Synthetic
taggtttagtgtaccttatttgggaatagcttcagcttacaattgtttctatgatggatattcccatgatgatac

SEQ ID NO: 291430 - DNA, 75 bp, Artificial Sequence
  Synthetic
aaatcactaactacatccattgtgggccgcgcattggcagaacattttaattcatctgtttattctttacctcct

SEQ ID NO: 291431 - DNA, 75 bp, Artificial Sequence
  Synthetic
gccgcgcattggcagaacattttaattcatctgtttattctttacctcctgatccaaaacattttgatggttacc

SEQ ID NO: 291432 - DNA, 75 bp, Artificial Sequence
  Synthetic
ttagagtggttaatgaacatgacagtcacactacccatgttaaaatcagagtgtatcatagagcaaaacatgtga

SEQ ID NO: 291433 - DNA, 75 bp, Artificial Sequence
  Synthetic
tcacactacccatgttaaaatcagagtgtatcatagagcaaaacatgtgagagcatgggttcctagagcccctag

SEQ ID NO: 291434 - DNA, 75 bp, Artificial Sequence
  Synthetic
caggatattagtatgttttgtcaaatggtctcatcagtagatttcttaccacccatggctagtttagacaataaa

SEQ ID NO: 291435 - DNA, 75 bp, Artificial Sequence
  Synthetic
aaaaccctattaaaaccagaaaaaccatatcaacatatgggttaggacctagatttggtggtatacacacaggca

SEQ ID NO: 291436 - DNA, 75 bp, Artificial Sequence
  Synthetic
aaaaccctattaaaaccagataaaccatatcaacatatgggttaggacctagatttggtggtatacacacaggca

SEQ ID NO: 291437 - DNA, 75 bp, Artificial Sequence
  Synthetic
aaaaccctattaaaaccagacaaaccatatcaacatatgggttaggacctagatttggtggtatacacacaggca

SEQ ID NO: 291438 - DNA, 75 bp, Artificial Sequence
  Synthetic
aaaaccctattaaaaccagagaaaccatatcaacatatgggttaggacctagatttggtggtatacacacaggca

SEQ ID NO: 291439 - DNA, 75 bp, Artificial Sequence
  Synthetic
ggaatgttgtttactagtaactttgtgttggcctcaaccaattcaaacactctaagtccccccactatcttgaac

SEQ ID NO: 291440 - DNA, 75 bp, Artificial Sequence
  Synthetic
catatcaacatatgggttaggacctagatttggtggtatacacacaggcaatgttaaaatcatgaattaccacct

SEQ ID NO: 291441 - DNA, 75 bp, Artificial Sequence
  Synthetic
cagcacatacacaaagaatggtaagttgaatgcagcaatggcaaccagtttgtgtaaagattgtcaccagccttc

SEQ ID NO: 291442 - DNA, 75 bp, Artificial Sequence
  Synthetic
atttggctgtagttggggtgggtgcccatggttcagaaaccgtaccacattgtaactgcacatccggtgtgtatt

SEQ ID NO: 291443 - DNA, 75 bp, Artificial Sequence
  Synthetic
ttgaatgcagcaatggcaaccagtttgtgtaaagattgtcaccagccttcaaattttaaaaaatgttgcccatta

SEQ ID NO: 291444 - DNA, 75 bp, Artificial Sequence
  Synthetic
ccatggttcagaaaccgtaccacattgtaactgcacatccggtgtgtattactctagatattacaacaaattcta

SEQ ID NO: 291445 - DNA, 75 bp, Artificial Sequence
  Synthetic
tagtattgatcaattagttactgccatcataaatgattacaaaaataaggtgaaaattacagattcacttgaagt

SEQ ID NO: 291446 - DNA, 75 bp, Artificial Sequence
  Synthetic
actaccctagtagataccagcagggtgttatgagaggtgtgggtcccgctgaaccaggtgattgtggtggtatct

SEQ ID NO: 291447 - DNA, 75 bp, Artificial Sequence
  Synthetic
atcataaatgattacaaaaataaggtgaaaattacagattcacttgaagtgttatttcaagggcctgtgtacaag

SEQ ID NO: 291448 - DNA, 75 bp, Artificial Sequence
  Synthetic
tgttatgagaggtgtgggtcccgctgaaccaggtgattgtggtggtatcttaagatgcattcatggaccaattgg

SEQ ID NO: 291449 - DNA, 75 bp, Artificial Sequence
  Synthetic
cttattgaaatcagtagattcagaggaagtcagagaatattgcaagaaaaagaaatggattattccacaaatttc

SEQ ID NO: 291450 - DNA, 75 bp, Artificial Sequence
  Synthetic
cattagacatgtttaatgctgagtatcagggaatttcagactacattctaaatttggggaaggcatttggaacag

SEQ ID NO: 291451 - DNA, 75 bp, Artificial Sequence
  Synthetic
gaagtcagagaatattgcaagaaaaagaaatggattattccacaaatttccactaacatagaaagggcagttaac

SEQ ID NO: 291452 - DNA, 75 bp, Artificial Sequence
  Synthetic
tcagggaatttcagactacattctaaatttggggaaggcatttggaacaggattcacagaacatattagtgaaaa

SEQ ID NO: 291453 - DNA, 75 bp, Artificial Sequence
  Synthetic
tatagtttatgtcatatacaaactttttgctcagacacaaggaccttactctgggaatccagttcataacaaact

SEQ ID NO: 291454 - DNA, 75 bp, Artificial Sequence
  Synthetic
tgtcaaaaatagttaaaattatctcagcactagttataatttgtagaaatcatgatgatttaattactgtcactg

SEQ ID NO: 291455 - DNA, 75 bp, Artificial Sequence
  Synthetic
tttgctcagacacaaggaccttactctgggaatccagttcataacaaactcaaaccacccactttaaaaccagtt

SEQ ID NO: 291456 - DNA, 75 bp, Artificial Sequence
  Synthetic
agcactagttataatttgtagaaatcatgatgatttaattactgtcactgcaactctggcattgttagggtgtga

SEQ ID NO: 291457 - DNA, 75 bp, Artificial Sequence
  Synthetic
tatactcacaatcaccacagagaaaggggaattcactagtttgggtattcatgatcgtatctgtgtcttaccaac

SEQ ID NO: 291458 - DNA, 75 bp, Artificial Sequence
  Synthetic
taccttacatagaaagacaatcaaatgacttatggtttaaaaaatttaatgacatgtgcaatgcagcaaaaggat

SEQ ID NO: 291459 - DNA, 75 bp, Artificial Sequence
  Synthetic
ggggaattcactagtttgggtattcatgatcgtatctgtgtcttaccaacacatgcccaaccaggtgataatgtc

SEQ ID NO: 291460 - DNA, 75 bp, Artificial Sequence
  Synthetic
tgacttatggtttaaaaaatttaatgacatgtgcaatgcagcaaaaggattggagtggattgcaaacaaaatatc

SEQ ID NO: 291461 - DNA, 75 bp, Artificial Sequence
  Synthetic
tccagataatactaatttagaactcaccataatagagttagacaggaatgaaaaattcagggatattaggggttt

SEQ ID NO: 291462 - DNA, 75 bp, Artificial Sequence
  Synthetic
agttagacttctgtaagagattaaaacagttagatatattagaaagacaaataaacacccttcatatgaatcaaa

SEQ ID NO: 291463 - DNA, 75 bp, Artificial Sequence
  Synthetic
accataatagagttagacaggaatgaaaaattcagggatattaggggtttcatatcagaggatttggaaggatta

SEQ ID NO: 291464 - DNA, 75 bp, Artificial Sequence
  Synthetic
acagttagatatattagaaagacaaataaacacccttcatatgaatcaaataagtgataatgacagagaggtgtt

SEQ ID NO: 291465 - DNA, 75 bp, Artificial Sequence
  Synthetic
tgtaggaccaataaccatggctggacttataaatttaagtaatacaccaacaaccaggatgatccgctatgacta

SEQ ID NO: 291466 - DNA, 75 bp, Artificial Sequence
  Synthetic
tgtacgctgtagagtccaagagaattagaacactcaaaaacaagatgacaaacttcatacaatttagatccaaac

SEQ ID NO: 291467 - DNA, 75 bp, Artificial Sequence
  Synthetic
cttataaatttaagtaatacaccaacaaccaggatgatccgctatgactacccaacaaaaacagggcagtgcggg

SEQ ID NO: 291468 - DNA, 75 bp, Artificial Sequence
  Synthetic
tagaacactcaaaaacaagatgacaaacttcatacaatttagatccaaacatcgcacagagccagtatgtgttct

SEQ ID NO: 291469 - DNA, 75 bp, Artificial Sequence
  Synthetic
tggtagacgaggattttcagcacaactcaaaaagcaatactttgtggagaaacagggattaattgtatctaaaca

SEQ ID NO: 291470 - DNA, 75 bp, Artificial Sequence
  Synthetic
gaagagcaattgcagataattatgggtcatcagtgtactcactaccaccagatccaaagcactttgatggatatc

SEQ ID NO: 291471 - DNA, 75 bp, Artificial Sequence
  Synthetic
ctcaaaaagcaatactttgtggagaaacagggattaattgtatctaaacaaaaggtgagagatattggtctaaac

SEQ ID NO: 291472 - DNA, 75 bp, Artificial Sequence
  Synthetic
gtcatcagtgtactcactaccaccagatccaaagcactttgatggatatcagcaacaagcagttgtaatccttga

SEQ ID NO: 291473 - DNA, 75 bp, Artificial Sequence
  Synthetic
tgtgttccctggaagcaaacaacccgctgtgctcaatgacaatgaccctagacttgaagtgaaattagctgaatc

SEQ ID NO: 291474 - DNA, 75 bp, Artificial Sequence
  Synthetic
tggtatcatcagttgattttattcctccaatggctaatctagataacaaaggaatgttattcaccagtaattttg

SEQ ID NO: 291475 - DNA, 75 bp, Artificial Sequence
  Synthetic
gctgtgctcaatgacaatgaccctagacttgaagtgaaattagctgaatctttgttttcaaagtataaaggtaat

SEQ ID NO: 291476 - DNA, 75 bp, Artificial Sequence
  Synthetic
tccaatggctaatctagataacaaaggaatgttattcaccagtaattttgtattagcctctaccaactcccagac

SEQ ID NO: 291477 - DNA, 75 bp, Artificial Sequence
  Synthetic
agggcagttgatgtcattagatatctctactaaagagctaacactaaaagaagcactgtatggagtagatggctt

SEQ ID NO: 291478 - DNA, 75 bp, Artificial Sequence
  Synthetic
gtttcgatttagacatgtgcttacattccactttcacaaaatcaggtaaattgaatgcagctttagcatcagaac

SEQ ID NO: 291479 - DNA, 75 bp, Artificial Sequence
  Synthetic
tctactaaagagctaacactaaaagaagcactgtatggagtagatggcttagaaccaatagatgtaacaaccagt

SEQ ID NO: 291480 - DNA, 75 bp, Artificial Sequence
  Synthetic
ttccactttcacaaaatcaggtaaattgaatgcagctttagcatcagaactgtgtaaggattgccataaaccaac

SEQ ID NO: 291481 - DNA, 75 bp, Artificial Sequence
  Synthetic
caaagaaactcaagatgtagagaaaatgaagttttacttagataaatatggaatagacttgccattagttacata

SEQ ID NO: 291482 - DNA, 75 bp, Artificial Sequence
  Synthetic
tggatagacgtacaaatgttagatatagtatagatcagttagtaacagcaatcataactgagcatgttaataaaa

SEQ ID NO: 291483 - DNA, 75 bp, Artificial Sequence
  Synthetic
atgaagttttacttagataaatatggaatagacttgccattagttacatacataaaagatgagctcaggagcgta

SEQ ID NO: 291484 - DNA, 75 bp, Artificial Sequence
  Synthetic
tagtatagatcagttagtaacagcaatcataactgagcatgttaataaaaccaaaatatccagttcattagaggt

SEQ ID NO: 291485 - DNA, 75 bp, Artificial Sequence
  Synthetic
tgattctgtcaacatgagaatgaaactaggtaacctgtacaaagcttttcaccaaaatccaggtataataacaga

SEQ ID NO: 291486 - DNA, 75 bp, Artificial Sequence
  Synthetic
ccccaccaccagagtgcattgtggatttactcaaatcagtagacaatgaggaagttcgccagtattgtcaagaga

SEQ ID NO: 291487 - DNA, 75 bp, Artificial Sequence
  Synthetic
ctaggtaacctgtacaaagcttttcaccaaaatccaggtataataacagaatctgcagtgggatgtgatccagat

SEQ ID NO: 291488 - DNA, 75 bp, Artificial Sequence
  Synthetic
tttactcaaatcagtagacaatgaggaagttcgccagtattgtcaagagaaaagatggctcatccctgagttacc

SEQ ID NO: 291489 - DNA, 75 bp, Artificial Sequence
  Synthetic
tgattattcaaactttgatgcgtctctttcaccagtctggtttgaatgtttagagaaagttttaaataagttagg

SEQ ID NO: 291490 - DNA, 75 bp, Artificial Sequence
  Synthetic
ttctcatgttcatcactacacttggtatagtgtacatgatctacaaactttttgcacaaacacaaggaccctatt

SEQ ID NO: 291491 - DNA, 75 bp, Artificial Sequence
  Synthetic
ctttcaccagtctggtttgaatgtttagagaaagttttaaataagttaggctttaaacaaccctcattaatacag

SEQ ID NO: 291492 - DNA, 75 bp, Artificial Sequence
  Synthetic
tatagtgtacatgatctacaaactttttgcacaaacacaaggaccctattcaggacttgatagtaaatctaaact

SEQ ID NO: 291493 - DNA, 75 bp, Artificial Sequence
  Synthetic
gggaggtatgccatcaggttgttcaggaaccagtatattcaattccatgataaacaacataattatcagaacatt

SEQ ID NO: 291494 - DNA, 75 bp, Artificial Sequence
  Synthetic
ttgcactctccttactcaggaaaaatatagtaactgtgaccactgataagggggagtttacaggactgggagtat

SEQ ID NO: 291495 - DNA, 75 bp, Artificial Sequence
  Synthetic
ggaaccagtatattcaattccatgataaacaacataattatcagaacattaattttggatgcttataaaggcata

SEQ ID NO: 291496 - DNA, 75 bp, Artificial Sequence
  Synthetic
tatagtaactgtgaccactgataagggggagtttacaggactgggagtatacgacagactgctggtcattccaac

SEQ ID NO: 291497 - DNA, 75 bp, Artificial Sequence
  Synthetic
atacccctttgaactagattctaacattttggcagcaatagggaaaaattatggtttaactattactccacctga

SEQ ID NO: 291498 - DNA, 75 bp, Artificial Sequence
  Synthetic
tcaaggacaaatggaagttagtagatccagatgatataaatttggaaattactgtgcttgaattagatagaaatg

SEQ ID NO: 291499 - DNA, 75 bp, Artificial Sequence
  Synthetic
attttggcagcaatagggaaaaattatggtttaactattactccacctgataagtcagatgcatttacaaaaata

SEQ ID NO: 291500 - DNA, 75 bp, Artificial Sequence
  Synthetic
tccagatgatataaatttggaaattactgtgcttgaattagatagaaatgagaaattcagagacattagaatgtt

SEQ ID NO: 291501 - DNA, 75 bp, Artificial Sequence
  Synthetic
gtttccctttttgatccatccagtaatgccaatgcaagatatctatgagtcaatcagatggacaagggatccaag

SEQ ID NO: 291502 - DNA, 75 bp, Artificial Sequence
  Synthetic
acaatttcaaagacaccatattatcagttgggtcaaccacacttgcaggtattataaacttgagtaacactccca

SEQ ID NO: 291503 - DNA, 75 bp, Artificial Sequence
  Synthetic
atgccaatgcaagatatctatgagtcaatcagatggacaagggatccaaggaatactcaagatcatgttagatca

SEQ ID NO: 291504 - DNA, 75 bp, Artificial Sequence
  Synthetic
agttgggtcaaccacacttgcaggtattataaacttgagtaacactcccacagccaggatgattcgttacgagtt

SEQ ID NO: 291505 - DNA, 75 bp, Artificial Sequence
  Synthetic
aaccaagatcagaacaacagacattggcaaatgtcttaatctacctgaatacagtgtcctgcgtagacgctggtt

SEQ ID NO: 291506 - DNA, 75 bp, Artificial Sequence
  Synthetic
tatatggtatacatgtaggtggcaatgggagacaaggtttctcagcacaattaaagaaacagtattttgttcaaa

SEQ ID NO: 291507 - DNA, 75 bp, Artificial Sequence
  Synthetic
acagtgtcctgcgtagacgctggttggatttattttaaataaatagataatatagacatttagtttgaatagaaa

SEQ ID NO: 291508 - DNA, 75 bp, Artificial Sequence
  Synthetic
tgggagacaaggtttctcagcacaattaaagaaacagtattttgttcaaaaacagggtcaaattgttagtaaaag

SEQ ID NO: 291509 - DNA, 75 bp, Artificial Sequence
  Synthetic
tttccccggagcgaggtataagtggtacccactgctgaaagcctttaaccgttatccgccaatcaactacgtaat

SEQ ID NO: 291510 - DNA, 75 bp, Artificial Sequence
  Synthetic
aattacaccctagtgttttttacaatgtctttccaggaagcaaagaaccagcagtcctacatccagctgatcaga

SEQ ID NO: 291511 - DNA, 75 bp, Artificial Sequence
  Synthetic
tgtctttccaggaagcaaagaaccagcagtcctacatccagctgatcagagattggaagttaattttgaggattc

SEQ ID NO: 291512 - DNA, 75 bp, Artificial Sequence
  Synthetic
cactagtttggtcgatgaggctaggaactccccacgggcgaccgtgtcctagcctgcgtggcggccaacccagct

SEQ ID NO: 291513 - DNA, 75 bp, Artificial Sequence
  Synthetic
tgaaagtagccattgatcattatgctgggcagcttttgtcactagacatcccaactcaggaactcagccttaagg

SEQ ID NO: 291514 - DNA, 75 bp, Artificial Sequence
  Synthetic
atggtgtgaagacctgcatgtgcttgattgtgagtcctccggcccctgaatgcggctaaccttaaccccggagcc

SEQ ID NO: 291515 - DNA, 75 bp, Artificial Sequence
  Synthetic
tgggcagcttttgtcactagacatcccaactcaggaactcagccttaaggaagccttatatggtacagatggttt

SEQ ID NO: 291516 - DNA, 75 bp, Artificial Sequence
  Synthetic
ggtcgtaatgagtaattctgggatgggaccgactactttgggtgtccgtgtttccttttattctttatattgtct

SEQ ID NO: 291517 - DNA, 75 bp, Artificial Sequence
  Synthetic
ggatcaagaaaagagcaatactaaacaaagacaccaaggatacatcaaaaatggaagagtgcctaagtaaatatg

SEQ ID NO: 291518 - DNA, 75 bp, Artificial Sequence
  Synthetic
tttccttttattctttatattgtcttatggtcacagcatatatagtatatatactgtgatcatgggcgcacaagt

SEQ ID NO: 291519 - DNA, 75 bp, Artificial Sequence
  Synthetic
tatggtcacagcatatatagtatatatactgtgatcatgggcgcacaagtgtcaacacagaagagcggttcacac

SEQ ID NO: 291520 - DNA, 75 bp, Artificial Sequence
  Synthetic
caaagacaccaaggatacatcaaaaatggaagagtgcctaagtaaatatggaattgacttgccattagtgacata

SEQ ID NO: 291521 - DNA, 75 bp, Artificial Sequence
  Synthetic
gattgattgaagcttctagtctcaatgattcagtaaatatgagagtaaaattaggtaacttgtacaaagctttcc

SEQ ID NO: 291522 - DNA, 75 bp, Artificial Sequence
  Synthetic
aaattactacaaagatgcggccagttcgtcatcagctggtcaatcattctcaatggatccgtcaaaattcactga

SEQ ID NO: 291523 - DNA, 75 bp, Artificial Sequence
  Synthetic
tcgtcatcagctggtcaatcattctcaatggatccgtcaaaattcactgaaccggtcaaggacataatgcttaag

SEQ ID NO: 291524 - DNA, 75 bp, Artificial Sequence
  Synthetic
tgattcagtaaatatgagagtaaaattaggtaacttgtacaaagctttccacaaaaatccaggtatattaacagg

SEQ ID NO: 291525 - DNA, 75 bp, Artificial Sequence
  Synthetic
tattagatggagaattgattgcttttgattattcaaattttgatgccagcctttcaccagtgtggtttaaatgcc

SEQ ID NO: 291526 - DNA, 75 bp, Artificial Sequence
  Synthetic
cagagttgaacaaataaccattggtaattcaacaatcacaactcaagaagcagccaatgcagtggtggcctatgc

SEQ ID NO: 291527 - DNA, 75 bp, Artificial Sequence
  Synthetic
tgattattcaaattttgatgccagcctttcaccagtgtggtttaaatgccttgaaaatgttcttagaaaaatagg

SEQ ID NO: 291528 - DNA, 75 bp, Artificial Sequence
  Synthetic
tgaatggcccagctttttaagagatgatgatgctagtgatgtgaacaaacctactagacctgatacatctgcttg

SEQ ID NO: 291529 - DNA, 75 bp, Artificial Sequence
  Synthetic
ttaaagatcaaatttatgttgtagaaggtggcatgccctctggctgctctggaaccagcatctttaattcaatga

SEQ ID NO: 291530 - DNA, 75 bp, Artificial Sequence
  Synthetic
aggtggcatgccctctggctgctctggaaccagcatctttaattcaatgattaacaatattattattagaaccct

SEQ ID NO: 291531 - DNA, 75 bp, Artificial Sequence
  Synthetic
ggtgttggaaattgccggatgctctcaaagacatgggaatatttggacaaaacatgttttatcattctcaaggca

SEQ ID NO: 291532 - DNA, 75 bp, Artificial Sequence
  Synthetic
caaagacatgggaatatttggacaaaacatgttttatcattctcaaggcagaactggatatactatccatgtgca

SEQ ID NO: 291533 - DNA, 75 bp, Artificial Sequence
  Synthetic
catatggagatgatgtaattatctcatatccattcactttggatgctgaaaaaatatcagaacagggactcaaat

SEQ ID NO: 291534 - DNA, 75 bp, Artificial Sequence
  Synthetic
atatccattcactttggatgctgaaaaaatatcagaacagggactcaaatatggtttaactataacaccaccaga

SEQ ID NO: 291535 - DNA, 75 bp, Artificial Sequence
  Synthetic
cagaacatcaattggcatcagcagagggtggaaatgtctcagtcttctatgatcaaacacacccaggggagaggg

SEQ ID NO: 291536 - DNA, 75 bp, Artificial Sequence
  Synthetic
gggtggaaatgtctcagtcttctatgatcaaacacacccaggggagaggggaattgatttgggaacagttattga

SEQ ID NO: 291537 - DNA, 75 bp, Artificial Sequence
  Synthetic
agcgacactttaaaccagatcatgaatttccctttcttgtacatccagtgatgccaatgtctgaaattcaggaat

SEQ ID NO: 291538 - DNA, 75 bp, Artificial Sequence
  Synthetic
atttccctttcttgtacatccagtgatgccaatgtctgaaattcaggaatcaattagatggaccaaagaccctaa

SEQ ID NO: 291539 - DNA, 75 bp, Artificial Sequence
  Synthetic
gtaatgctctcatctttcctcatcagttcattaacctgagaaccaataatacagctacaatagtaatcccataca

SEQ ID NO: 291540 - DNA, 75 bp, Artificial Sequence
  Synthetic
gttcattaacctgagaaccaataatacagctacaatagtaatcccatacataaactcagtcccaatggattcaat

SEQ ID NO: 291541 - DNA, 75 bp, Artificial Sequence
  Synthetic
gtgaggaagaatataacaaatttgttgaaggaatcagaagtacagacataggtaaagtcctcttaataccctctt

SEQ ID NO: 291542 - DNA, 75 bp, Artificial Sequence
  Synthetic
ctgccaacactggatcaccacctagtatacctgtcactgtgacaatagcaccaatgaatcttgaattatcaggaa

SEQ ID NO: 291543 - DNA, 75 bp, Artificial Sequence
  Synthetic
attctgttctgagacgcagatggcttgatctgttctaaatttaaatatatagagtattaatttagtgtagtgaat

SEQ ID NO: 291544 - DNA, 75 bp, Artificial Sequence
  Synthetic
ttaaaacagcggatgggttctcccaccatccgacccactgggtgtagtactctggtatgatgtacctttgtacgc

SEQ ID NO: 291545 - DNA, 75 bp, Artificial Sequence
  Synthetic
tatacctgtcactgtgacaatagcaccaatgaatcttgaattatcaggaattaggtccaaaacagtggtgaggga

SEQ ID NO: 291546 - DNA, 75 bp, Artificial Sequence
  Synthetic
ccatccgacccactgggtgtagtactctggtatgatgtacctttgtacgcctgtttattcccaaacccccacccg

SEQ ID NO: 291547 - DNA, 75 bp, Artificial Sequence
  Synthetic
cagatgatagacaatctccttcagctctaccaaattatgaaccaactccactcatacacatccctggtagggtca

SEQ ID NO: 291548 - DNA, 75 bp, Artificial Sequence
  Synthetic
tctaccaaattatgaaccaactccactcatacacatccctggtagggtcaccaatttattagagttggtacaggt

SEQ ID NO: 291549 - DNA, 75 bp, Artificial Sequence
  Synthetic
tagggagcaccatatccaatggtgtaacgtacaagcacttctgtttccccggagcgaggtataggtggtacccac

SEQ ID NO: 291550 - DNA, 75 bp, Artificial Sequence
  Synthetic
aatatagaataccattgatgcagaaccaacaagaacagcaagtctttggtttctccctgtttttgggaggagatg

SEQ ID NO: 291551 - DNA, 75 bp, Artificial Sequence
  Synthetic
gccaatcaactacgtaacagctagtaacatcttgttgttgattggacgttcgatcaggtggttcaccccccacta

SEQ ID NO: 291552 - DNA, 75 bp, Artificial Sequence
  Synthetic
ccaacaagaacagcaagtctttggtttctccctgtttttgggaggagatgttctaaagacaacattactaggtga

SEQ ID NO: 291553 - DNA, 75 bp, Artificial Sequence
  Synthetic
tgtacacaggtccggctttatccagtgcaaaactgttacttgcatatacaccaccaggagcaccagggcctacaa

SEQ ID NO: 291554 - DNA, 75 bp, Artificial Sequence
  Synthetic
tgcaaaactgttacttgcatatacaccaccaggagcaccagggcctacaaataggagagatgcaatgttaggtac

SEQ ID NO: 291555 - DNA, 75 bp, Artificial Sequence
  Synthetic
tgggacgccctttcaatgacatggtgtgaagactcgcatgtgcttgattgtgagtccgccggcccctgaatgcgg

SEQ ID NO: 291556 - DNA, 75 bp, Artificial Sequence
  Synthetic
taatgagtaattctgggatgggaccgactactttgggtgtccgtgtttctcatttttcttttaattgtcttatgg

SEQ ID NO: 291557 - DNA, 75 bp, Artificial Sequence
  Synthetic
cctggactgccggatcccaatttagatatacagacccagacacctacacacacccgggttttatatcatgctggt

SEQ ID NO: 291558 - DNA, 75 bp, Artificial Sequence
  Synthetic
atatacagacccagacacctacacacacccgggttttatatcatgctggtatcaaacctcactagtactaccacc

SEQ ID NO: 291559 - DNA, 75 bp, Artificial Sequence
  Synthetic
gactactttgggtgtccgtgtttctcatttttcttttaattgtcttatggtcacagcatatagtattatatactg

SEQ ID NO: 291560 - DNA, 75 bp, Artificial Sequence
  Synthetic
caaaatattttgacaaacgggtcaaatcaaaccttcacagtcataaattactacaaagatgctgcaagtagttca

SEQ ID NO: 291561 - DNA, 75 bp, Artificial Sequence
  Synthetic
acttcaaacttagattactgaaggacacaccatcaatttcacaaactgaagcactaacagagggactaggagagg

SEQ ID NO: 291562 - DNA, 75 bp, Artificial Sequence
  Synthetic
cacaccatcaatttcacaaactgaagcactaacagagggactaggagaggaacttgaggaagtgatagtcgacaa

SEQ ID NO: 291563 - DNA, 75 bp, Artificial Sequence
  Synthetic
atcaaaccttcacagtcataaattactacaaagatgctgcaagtagttcatcagctggtcaatctctgtcaatgg

SEQ ID NO: 291564 - DNA, 75 bp, Artificial Sequence
  Synthetic
ccagcactaaattcaccaaatgttgaagcgtgcggatatagtgacagggtgcaacaaatcactcttggcaactct

SEQ ID NO: 291565 - DNA, 75 bp, Artificial Sequence
  Synthetic
aagttccgacactatcagcaagtgagacaggggcaactcttcctacagttccatctgacaatgttgagaccagaa

SEQ ID NO: 291566 - DNA, 75 bp, Artificial Sequence
  Synthetic
aagcgtgcggatatagtgacagggtgcaacaaatcactcttggcaactctaccataacaacacaagaagctgcaa

SEQ ID NO: 291567 - DNA, 75 bp, Artificial Sequence
  Synthetic
agagacaagtttagaaagcttcctgggtagggctgcatgtgtacatgttacaaccatagaaaacaaactccccac

SEQ ID NO: 291568 - DNA, 75 bp, Artificial Sequence
  Synthetic
gcaagtgatgtaaacaaaacttcaaaaccggacacgtctgtttgtaggttttacacattagacagcaaaatgtgg

SEQ ID NO: 291569 - DNA, 75 bp, Artificial Sequence
  Synthetic
aaccggacacgtctgtttgtaggttttacacattagacagcaaaatgtggcagaaaaactcaaagggatggtgtt

SEQ ID NO: 291570 - DNA, 75 bp, Artificial Sequence
  Synthetic
acttgtcaagcctagtgcaattaaggagaaagttggacatgttcacctacgttaggtttgattcagagtatacca

SEQ ID NO: 291571 - DNA, 75 bp, Artificial Sequence
  Synthetic
gagaaagttggacatgttcacctacgttaggtttgattcagagtataccatcattgccacatcctcacagcctca

SEQ ID NO: 291572 - DNA, 75 bp, Artificial Sequence
  Synthetic
tttttccattcattgggtagatcagggtacactatacatgtacagtgcaatgcaacaaaattccacagtgggtgt

SEQ ID NO: 291573 - DNA, 75 bp, Artificial Sequence
  Synthetic
ggtacactatacatgtacagtgcaatgcaacaaaattccacagtgggtgtttactcgtagttgtgataccagaac

SEQ ID NO: 291574 - DNA, 75 bp, Artificial Sequence
  Synthetic
caggagcaccaaacccaatagaatgggatgattacacctggcagagtgcttcaaaccccagtgtcttctttaatg

SEQ ID NO: 291575 - DNA, 75 bp, Artificial Sequence
  Synthetic
ggatgattacacctggcagagtgcttcaaaccccagtgtcttctttaatgttggtaagtcagcacgtttcagtgt

SEQ ID NO: 291576 - DNA, 75 bp, Artificial Sequence
  Synthetic
acacacccaggtgaaggtggcatcgatttgtcaacaaatatagaagcagatggacctgttaaggacccagtttat

SEQ ID NO: 291577 - DNA, 75 bp, Artificial Sequence
  Synthetic
atttgtcaacaaatatagaagcagatggacctgttaaggacccagtttataatatgaatggtacactactgggta

SEQ ID NO: 291578 - DNA, 75 bp, Artificial Sequence
  Synthetic
cacatgacagcaagaccactgtttatggtataaatgtattaaatcatatgggtagtatagcatttagaatagtca

SEQ ID NO: 291579 - DNA, 75 bp, Artificial Sequence
  Synthetic
tggtataaatgtattaaatcatatgggtagtatagcatttagaatagtcaatgaaaatgatgttcacctcaccaa

SEQ ID NO: 291580 - DNA, 75 bp, Artificial Sequence
  Synthetic
gccacactggttgtgccatacattaattcagtaccaattgattcaatgacaagacacaataatgtatcactaatg

SEQ ID NO: 291581 - DNA, 75 bp, Artificial Sequence
  Synthetic
attcagtaccaattgattcaatgacaagacacaataatgtatcactaatgattattccaattgccccactcattg

SEQ ID NO: 291582 - DNA, 75 bp, Artificial Sequence
  Synthetic
ccagaccccccagagcaaaaccatatctttcaataggtagaaccaactatgacaaaacaggaagcataatcccaa

SEQ ID NO: 291583 - DNA, 75 bp, Artificial Sequence
  Synthetic
tctttcaataggtagaaccaactatgacaaaacaggaagcataatcccaaaaagaaataacatctcaaattatgg

SEQ ID NO: 291584 - DNA, 75 bp, Artificial Sequence
  Synthetic
atgtgtaccgaattcacaggcataagatccaaaactgtagttccacaagggttaccgacaacaactctaccagga

SEQ ID NO: 291585 - DNA, 75 bp, Artificial Sequence
  Synthetic
gatccaaaactgtagttccacaagggttaccgacaacaactctaccaggatctggccagtttcttaccacagatg

SEQ ID NO: 291586 - DNA, 75 bp, Artificial Sequence
  Synthetic
actatcatctaatgactcatgaagacacactaaatttgcaaactccactcccagagagggatttagcagtaatca

SEQ ID NO: 291587 - DNA, 75 bp, Artificial Sequence
  Synthetic
cacactaaatttgcaaactccactcccagagagggatttagcagtaatcaatataaatgctcatggttcagaaac

SEQ ID NO: 291588 - DNA, 75 bp, Artificial Sequence
  Synthetic
catataccaggtcaagtcaaaaacttactagaaatcatccaagtagatactttaatcccaatgaacaatacccac

SEQ ID NO: 291589 - DNA, 75 bp, Artificial Sequence
  Synthetic
tactagaaatcatccaagtagatactttaatcccaatgaacaatacccacaacaaggatgcagtgaaaagctacc

SEQ ID NO: 291590 - DNA, 75 bp, Artificial Sequence
  Synthetic
acaaatactacccagtggtctgtgagaaaccgacatgtgtgtggattgaaggtaataactattaccctagtagat

SEQ ID NO: 291591 - DNA, 75 bp, Artificial Sequence
  Synthetic
gaaaccgacatgtgtgtggattgaaggtaataactattaccctagtagataccaacaaggagtcatgaaaggagt

SEQ ID NO: 291592 - DNA, 75 bp, Artificial Sequence
  Synthetic
cttttcataggagatggtgtgtttaaaaccactcttcttggtgaaatagttcaatattacacccactgggcagga

SEQ ID NO: 291593 - DNA, 75 bp, Artificial Sequence
  Synthetic
aaaccactcttcttggtgaaatagttcaatattacacccactgggcaggatcattgagattttctttgatgtata

SEQ ID NO: 291594 - DNA, 75 bp, Artificial Sequence
  Synthetic
gaccaattggcattttgacagctggtggtggtggttatgtctgctttgctgacattaggggcttggacatgtttc

SEQ ID NO: 291595 - DNA, 75 bp, Artificial Sequence
  Synthetic
tggtggtggttatgtctgctttgctgacattaggggcttggacatgtttcgggcagaataccagggaatatcaga

SEQ ID NO: 291596 - DNA, 75 bp, Artificial Sequence
  Synthetic
ggagccaacggaccaacaaccagaaaagaggcaatgcttggaacacatgtagtgtgggatattgggctacaatcc

SEQ ID NO: 291597 - DNA, 75 bp, Artificial Sequence
  Synthetic
aagaggcaatgcttggaacacatgtagtgtgggatattgggctacaatccacaatagttatgacaattccttgga

SEQ ID NO: 291598 - DNA, 75 bp, Artificial Sequence
  Synthetic
ttagtgagaaggttagtgaactccaaaatatcaccatggggtacttaaatacaaaggttctctctaaagtaatca

SEQ ID NO: 291599 - DNA, 75 bp, Artificial Sequence
  Synthetic
aaatatcaccatggggtacttaaatacaaaggttctctctaaagtaatcaaaattgtctctgctttagtgattat

SEQ ID NO: 291600 - DNA, 75 bp, Artificial Sequence
  Synthetic
ggatttttatcatgttggtatcaaacatctctgatacttccccctgacacacccactgaggtgtacatgctctcc

SEQ ID NO: 291601 - DNA, 75 bp, Artificial Sequence
  Synthetic
catctctgatacttccccctgacacacccactgaggtgtacatgctctcctttatcagtgcatgcccagacttca

SEQ ID NO: 291602 - DNA, 75 bp, Artificial Sequence
  Synthetic
tagggtgtgatggctcaccttggagattcctaaaaatgtatatcagtaaacacttccacctaccctacattgaaa

SEQ ID NO: 291603 - DNA, 75 bp, Artificial Sequence
  Synthetic
attcctaaaaatgtatatcagtaaacacttccacctaccctacattgaaagacaatcaaatgatttatggtttaa

SEQ ID NO: 291604 - DNA, 75 bp, Artificial Sequence
  Synthetic
acggaaggtttgaatgacgagttagaggaagtcatcgtcgagaaaacgaaacagacgttggcttcaatttcatcc

SEQ ID NO: 291605 - DNA, 75 bp, Artificial Sequence
  Synthetic
aggaagtcatcgtcgagaaaacgaaacagacgttggcttcaatttcatccgggccaaaatacactcaaagtgttc

SEQ ID NO: 291606 - DNA, 75 bp, Artificial Sequence
  Synthetic
acaaaatatcaaaattaatagattggataaaaaacaaaatcctaccacaagccagagataagttggacttctgta

SEQ ID NO: 291607 - DNA, 75 bp, Artificial Sequence
  Synthetic
gataaaaaacaaaatcctaccacaagccagagataagttggacttctgtaaaagactcaaacagttagatatttt

SEQ ID NO: 291608 - DNA, 75 bp, Artificial Sequence
  Synthetic
gacaatgttgaaaccagaacaacatatatgcatttcaacgggtctgagacagatattgagtgcttcctgggtcgt

SEQ ID NO: 291609 - DNA, 75 bp, Artificial Sequence
  Synthetic
atatgcatttcaacgggtctgagacagatattgagtgcttcctgggtcgtgctgcttgtgtgcatgtaacagaaa

SEQ ID NO: 291610 - DNA, 75 bp, Artificial Sequence
  Synthetic
gggaaacattattcaataatgtgttgtggttggaacaaatgtctcagaagtttgcaccgctatacgccttagagg

SEQ ID NO: 291611 - DNA, 75 bp, Artificial Sequence
  Synthetic
gtggttggaacaaatgtctcagaagtttgcaccgctatacgccttagaggcaaaaagaattaaatcattgaagaa

SEQ ID NO: 291612 - DNA, 75 bp, Artificial Sequence
  Synthetic
tttaatgattggaaaattagcctctctagtcttgtgcaactcaggaaaaagttagaactcttcacttatgtcaga

SEQ ID NO: 291613 - DNA, 75 bp, Artificial Sequence
  Synthetic
ctagtcttgtgcaactcaggaaaaagttagaactcttcacttatgtcagatttgattcagaatacaccatattag

SEQ ID NO: 291614 - DNA, 75 bp, Artificial Sequence
  Synthetic
tgtgtgtgttgatccatggtacaccagggtcaggtaagtctctaaccacttctttgattggtagatctattgctg

SEQ ID NO: 291615 - DNA, 75 bp, Artificial Sequence
  Synthetic
agggtcaggtaagtctctaaccacttctttgattggtagatctattgctgacatacataaatcttcagtttattc

SEQ ID NO: 291616 - DNA, 75 bp, Artificial Sequence
  Synthetic
caagccatgtatgtgcctcctggtgcacccaacccagtagaatgggatgattacacatggcagagtgcatctaat

SEQ ID NO: 291617 - DNA, 75 bp, Artificial Sequence
  Synthetic
cacccaacccagtagaatgggatgattacacatggcagagtgcatctaatcctagtgtcttcttcaaggtcggtg

SEQ ID NO: 291618 - DNA, 75 bp, Artificial Sequence
  Synthetic
ttattttggatgatctaaaccagaatcccaatggtgaggatataagtactttctgtcaaatggtgtcatcagttg

SEQ ID NO: 291619 - DNA, 75 bp, Artificial Sequence
  Synthetic
tcccaatggtgaggatataagtactttctgtcaaatggtgtcatcagttgatttcatcccaccaatggcaaacct

SEQ ID NO: 291620 - DNA, 75 bp, Artificial Sequence
  Synthetic
tgcttttatgatggttactcacatgatgatgcagaaactcaatatggaatatctgttctgaatcatatgggtagc

SEQ ID NO: 291621 - DNA, 75 bp, Artificial Sequence
  Synthetic
atgatgcagaaactcaatatggaatatctgttctgaatcatatgggtagcatggcttttagaatagttaatgaac

SEQ ID NO: 291622 - DNA, 75 bp, Artificial Sequence
  Synthetic
attcacagactcttaaccctccaactgtattaaacccagaggcattggcacgtaggttcgggtttgacttggaca

SEQ ID NO: 291623 - DNA, 75 bp, Artificial Sequence
  Synthetic
tgtattaaacccagaggcattggcacgtaggttcgggtttgacttggacatgtgtttacattcatcatttacaaa

SEQ ID NO: 291624 - DNA, 75 bp, Artificial Sequence
  Synthetic
cacattgaagcgtgggtcccacgtgctcccagggctttaccatacacatcaattggacgtactaattatcccaaa

SEQ ID NO: 291625 - DNA, 75 bp, Artificial Sequence
  Synthetic
ctcccagggctttaccatacacatcaattggacgtactaattatcccaaaaatccaaaaccagtaattaagaaaa

SEQ ID NO: 291626 - DNA, 75 bp, Artificial Sequence
  Synthetic
ataaaccaacaaattttaaaaagtgctgtccgttaatttgtggaaaagccctcagtttagtagatagacacacca

SEQ ID NO: 291627 - DNA, 75 bp, Artificial Sequence
  Synthetic
ctgtccgttaatttgtggaaaagccctcagtttagtagatagacacaccaatgttaggtatagtatagatcagct

SEQ ID NO: 291628 - DNA, 75 bp, Artificial Sequence
  Synthetic
tacacatctaatgcgaaaataatgaactttcatttgatgacaccagaagatcatttgaacttggtgacctcatat

SEQ ID NO: 291629 - DNA, 75 bp, Artificial Sequence
  Synthetic
actttcatttgatgacaccagaagatcatttgaacttggtgacctcatatcctagtagggacctagcaattgttt

SEQ ID NO: 291630 - DNA, 75 bp, Artificial Sequence
  Synthetic
cccttgaggtcctgtttcaaggtccagtgtacaaggacatgaccattgatgtctatgacaaacctccacctgaat

SEQ ID NO: 291631 - DNA, 75 bp, Artificial Sequence
  Synthetic
agtgtacaaggacatgaccattgatgtctatgacaaacctccacctgaatgtatagtggacctactcaaatcagt

SEQ ID NO: 291632 - DNA, 75 bp, Artificial Sequence
  Synthetic
ggtgtctattactctagttactacagaaaattttacccagtaatatgtgaaaaacccaccacaatatggattgaa

SEQ ID NO: 291633 - DNA, 75 bp, Artificial Sequence
  Synthetic
gaaaattttacccagtaatatgtgaaaaacccaccacaatatggattgaaggcggaccatattaccccagcagat

SEQ ID NO: 291634 - DNA, 75 bp, Artificial Sequence
  Synthetic
ctgaaataccaacaaatattgacagagcagtcaatcaagcaacatctttaatcaacaccatactaatgttcatta

SEQ ID NO: 291635 - DNA, 75 bp, Artificial Sequence
  Synthetic
ggtggcatactcaggtgtgttcatggaccaattggactgttgacagcaggtggtagtggttatgtctgttttgct

SEQ ID NO: 291636 - DNA, 75 bp, Artificial Sequence
  Synthetic
gaccaattggactgttgacagcaggtggtagtggttatgtctgttttgctgacataagacaactagagtgcattg

SEQ ID NO: 291637 - DNA, 75 bp, Artificial Sequence
  Synthetic
ctacaagatgtttgctcaaactcagggtccatattctggattagataataaaactaaactgaaagcaccagtact

SEQ ID NO: 291638 - DNA, 75 bp, Artificial Sequence
  Synthetic
ggtgttgggttcactgatcaaatttcggccaaggtgacagaattacaggatgttgctaaggatttcttgacaaca

SEQ ID NO: 291639 - DNA, 75 bp, Artificial Sequence
  Synthetic
ttaggaaaaacattgtcacaataacaacagccaaaggagaattcacagctttagggatttatgatagaatctgtg

SEQ ID NO: 291640 - DNA, 75 bp, Artificial Sequence
  Synthetic
aacagccaaaggagaattcacagctttagggatttatgatagaatctgtgttgtccccacacattcacaaccaga

SEQ ID NO: 291641 - DNA, 75 bp, Artificial Sequence
  Synthetic
cggccaaggtgacagaattacaggatgttgctaaggatttcttgacaacaaaagttttatcaaaagtagtgaaaa

SEQ ID NO: 291642 - DNA, 75 bp, Artificial Sequence
  Synthetic
gtcactgctactttagctttgctgggttgtgatggctccccctggagatttctaaaaatgtacatttccaagcat

SEQ ID NO: 291643 - DNA, 75 bp, Artificial Sequence
  Synthetic
ggttagtggatccagataacttgaatctagagattacagttttagaattagataggaatgaaaaatttagagaca

SEQ ID NO: 291644 - DNA, 75 bp, Artificial Sequence
  Synthetic
tctagagattacagttttagaattagataggaatgaaaaatttagagacatcagaatgtttattgctgatgaatc

SEQ ID NO: 291645 - DNA, 75 bp, Artificial Sequence
  Synthetic
gttgtgatggctccccctggagatttctaaaaatgtacatttccaagcattttcaggtaccttacattgaaagac

SEQ ID NO: 291646 - DNA, 75 bp, Artificial Sequence
  Synthetic
aaaggtttggaatggattgcaaacaagatctcaaagttaattgaatgggttaaaaacaaagtgctcccacaggcc

SEQ ID NO: 291647 - DNA, 75 bp, Artificial Sequence
  Synthetic
ccataatgtcggtgggtcacattacaatggctggcataattaatttgagtaacacacccacagccagaatgatta

SEQ ID NO: 291648 - DNA, 75 bp, Artificial Sequence
  Synthetic
aatggctggcataattaatttgagtaacacacccacagccagaatgattagatatgattaccccaccaagacagg

SEQ ID NO: 291649 - DNA, 75 bp, Artificial Sequence
  Synthetic
agatctcaaagttaattgaatgggttaaaaacaaagtgctcccacaggccaaagagaaattagaattctgcagca

SEQ ID NO: 291650 - DNA, 75 bp, Artificial Sequence
  Synthetic
tcaaaccccacacaagaaaagagagaacaattgtttaacaatgtcttatggttggaacaaatgtctcaaaagttt

SEQ ID NO: 291651 - DNA, 75 bp, Artificial Sequence
  Synthetic
tgggtggtaatggaagacagggtttttcagctcagctcaaaaaacagtattttgttcaaaaacaaggtgaaatag

SEQ ID NO: 291652 - DNA, 75 bp, Artificial Sequence
  Synthetic
ttcagctcagctcaaaaaacagtattttgttcaaaaacaaggtgaaatagttagtaagaaaaaggtacatgatct

SEQ ID NO: 291653 - DNA, 75 bp, Artificial Sequence
  Synthetic
aacaattgtttaacaatgtcttatggttggaacaaatgtctcaaaagtttgcaccactttatgccaccgaagcaa

SEQ ID NO: 291654 - DNA, 75 bp, Artificial Sequence
  Synthetic
aataagcaaaggactgaaccagtatgtgtattgattcatggcaccccgggttcagggaaatcactaaccacttca

SEQ ID NO: 291655 - DNA, 75 bp, Artificial Sequence
  Synthetic
ttttctataatgtattcccagggacaaaagaaccagcagttttacatccagcagatgaaagattggaggtggatt

SEQ ID NO: 291656 - DNA, 75 bp, Artificial Sequence
  Synthetic
aaaagaaccagcagttttacatccagcagatgaaagattggaggtggattttgaagagtcactgttttcaaaata

SEQ ID NO: 291657 - DNA, 75 bp, Artificial Sequence
  Synthetic
gtgtattgattcatggcaccccgggttcagggaaatcactaaccacttcaataatcggaagagcaatagcagaac

SEQ ID NO: 291658 - DNA, 75 bp, Artificial Sequence
  Synthetic
ggttaccaacagcaagaagttgtcatcatggatgacctaaaccaaaatccagatggacaagacataagtatgttc

SEQ ID NO: 291659 - DNA, 75 bp, Artificial Sequence
  Synthetic
atcattatgcgggtcaattactgtccttggatatccccaccaaagaactctcattaaaagaggctttgtatggta

SEQ ID NO: 291660 - DNA, 75 bp, Artificial Sequence
  Synthetic
cttggatatccccaccaaagaactctcattaaaagaggctttgtatggtacagatggcctagagcctattgacct

SEQ ID NO: 291661 - DNA, 75 bp, Artificial Sequence
  Synthetic
tcatggatgacctaaaccaaaatccagatggacaagacataagtatgttctgtcaaatggtatcatcagtggact

SEQ ID NO: 291662 - DNA, 75 bp, Artificial Sequence
  Synthetic
aattttgttttagcttcaactaattccaacacgttgagtcctccaaccattttaaatccagatgccctggctaga

SEQ ID NO: 291663 - DNA, 75 bp, Artificial Sequence
  Synthetic
caatattaaataaagagacccaggacacaactaagatggaagaatgcttaagcaaatatggcatagatttaccac

SEQ ID NO: 291664 - DNA, 75 bp, Artificial Sequence
  Synthetic
cacaactaagatggaagaatgcttaagcaaatatggcatagatttaccactagttacatacattaaagatgaact

SEQ ID NO: 291665 - DNA, 75 bp, Artificial Sequence
  Synthetic
ccaacacgttgagtcctccaaccattttaaatccagatgccctggctagaagatttggttttgatctcgacatct

SEQ ID NO: 291666 - DNA, 75 bp, Artificial Sequence
  Synthetic
accagagtgtgcaaggattgccatcaaccaacaaattttaaaaagtgctgtccacttgtttgtggaaaagctact

SEQ ID NO: 291667 - DNA, 75 bp, Artificial Sequence
  Synthetic
ccagtttgaatgactctgtgaacatgagagttaagttaggtgaattgtacaaagcatttcacaaaaatcctggga

SEQ ID NO: 291668 - DNA, 75 bp, Artificial Sequence
  Synthetic
gagagttaagttaggtgaattgtacaaagcatttcacaaaaatcctgggatattaactgggtctgcagtagggtg

SEQ ID NO: 291669 - DNA, 75 bp, Artificial Sequence
  Synthetic
aaccaacaaattttaaaaagtgctgtccacttgtttgtggaaaagctactagtttggtagatagagccactaatg

SEQ ID NO: 291670 - DNA, 75 bp, Artificial Sequence
  Synthetic
aataaaatgcaaatcactgattcacttgaaacactattccagggccctgtctacaaagacctagaaatagatgtg

SEQ ID NO: 291671 - DNA, 75 bp, Artificial Sequence
  Synthetic
tactagcctttgattattcaaactttgatgctagtctgtccccagtgtggtttgactgtttagagctagtactta

SEQ ID NO: 291672 - DNA, 75 bp, Artificial Sequence
  Synthetic
tgatgctagtctgtccccagtgtggtttgactgtttagagctagtacttagaaaattgggatttgagtcagctga

SEQ ID NO: 291673 - DNA, 75 bp, Artificial Sequence
  Synthetic
ttgaaacactattccagggccctgtctacaaagacctagaaatagatgtgaatagtacaccaccccctgaatgca

SEQ ID NO: 291674 - DNA, 75 bp, Artificial Sequence
  Synthetic
aaaaagaaaaactggacaataccagaaattcctaccaacattgagagggctgttaaccaagctagcatgataatc

SEQ ID NO: 291675 - DNA, 75 bp, Artificial Sequence
  Synthetic
atgtagttgaaggaggaatgccatcaggctgttcaggtactagcatttttaattcaatgattaacaacataatta

SEQ ID NO: 291676 - DNA, 75 bp, Artificial Sequence
  Synthetic
aggctgttcaggtactagcatttttaattcaatgattaacaacataattattaggaccttgattcttgatacata

SEQ ID NO: 291677 - DNA, 75 bp, Artificial Sequence
  Synthetic
aaattcctaccaacattgagagggctgttaaccaagctagcatgataatcaacacaatattaatgtttgttagta

SEQ ID NO: 291678 - DNA, 75 bp, Artificial Sequence
  Synthetic
ccatactctggtaatccagcacactccaagcttaaagccccgaccctacgtccagtaattgtgcaagggcctaac

SEQ ID NO: 291679 - DNA, 75 bp, Artificial Sequence
  Synthetic
tcatagcttcatacccctttgaattagattcagagaaaattgctcaacaaggtgttaagtatggtctgactatta

SEQ ID NO: 291680 - DNA, 75 bp, Artificial Sequence
  Synthetic
agattcagagaaaattgctcaacaaggtgttaagtatggtctgactattacaccacctgacaaatctacacagtt

SEQ ID NO: 291681 - DNA, 75 bp, Artificial Sequence
  Synthetic
ccaagcttaaagccccgaccctacgtccagtaattgtgcaagggcctaacacagagtttgcattgtctttgctca

SEQ ID NO: 291682 - DNA, 75 bp, Artificial Sequence
  Synthetic
ggtatatatgatcatatctgtgttattcccacacacgcacaaccaaatgatagtgtgcttatcaatggtcaaaaa

SEQ ID NO: 291683 - DNA, 75 bp, Artificial Sequence
  Synthetic
cagacaaacagtttcctttccttgttcatcctgtcatgccaatgtcagacatatatgaatcaattagatggacaa

SEQ ID NO: 291684 - DNA, 75 bp, Artificial Sequence
  Synthetic
tcatcctgtcatgccaatgtcagacatatatgaatcaattagatggacaaaagaccctaagaatactcaagacca

SEQ ID NO: 291685 - DNA, 75 bp, Artificial Sequence
  Synthetic
ttcccacacacgcacaaccaaatgatagtgtgcttatcaatggtcaaaaagttcaaattaaggacaagttcaaat

SEQ ID NO: 291686 - DNA, 75 bp, Artificial Sequence
  Synthetic
aggaatgagaaatttagggatattagagcattcatatcagaagactttgaaggggtagaagcaacattggttgtc

SEQ ID NO: 291687 - DNA, 75 bp, Artificial Sequence
  Synthetic
atgagtttgtacgcggtatccgcagtacagacatagggaaggttcttgttataccaccttactcagttcttaggc

SEQ ID NO: 291688 - DNA, 75 bp, Artificial Sequence
  Synthetic
tacagacatagggaaggttcttgttataccaccttactcagttcttaggcacagatggcttgagttattctgaac

SEQ ID NO: 291689 - DNA, 75 bp, Artificial Sequence
  Synthetic
gagcattcatatcagaagactttgaaggggtagaagcaacattggttgtccactcaaacaactacaccaatacaa

SEQ ID NO: 291690 - DNA, 75 bp, Artificial Sequence
  Synthetic
actccaaccaacagaatgattcgttatgaatatgcaacaaagacaggtcagtgtggaggggtattatgtgccact

SEQ ID NO: 291691 - DNA, 75 bp, Artificial Sequence
  Synthetic
ctggtattttgtacctttgtacgcctgttgttcctaatgtacccaccctaaaacttcctacccaagtaacgttag

SEQ ID NO: 291692 - DNA, 75 bp, Artificial Sequence
  Synthetic
atgaatatgcaacaaagacaggtcagtgtggaggggtattatgtgccactgggaaaatttttgggattcatgtag

SEQ ID NO: 291693 - DNA, 75 bp, Artificial Sequence
  Synthetic
gttgagaaacaaggtcaagtgatagccaggcaaaaagtcagggaactaaacatgaaccctattaacaccccaaca

SEQ ID NO: 291694 - DNA, 75 bp, Artificial Sequence
  Synthetic
ccaggcaaaaagtcagggaactaaacatgaaccctattaacaccccaacaaaatcaaaactacaccccagtgtat

SEQ ID NO: 291695 - DNA, 75 bp, Artificial Sequence
  Synthetic
cgaggtataggctgtacccactgccgaaagcctttaaccgttatccgccaaccaactacgtaaaagctagtatca

SEQ ID NO: 291696 - DNA, 75 bp, Artificial Sequence
  Synthetic
gatcctagattggaagtaaaattaactgaatcactgttttcaaaatataagggtaatgtggaaatggaacccaca

SEQ ID NO: 291697 - DNA, 75 bp, Artificial Sequence
  Synthetic
ctgaatcactgttttcaaaatataagggtaatgtggaaatggaacccacagaaaacatgctagtggctgtggatc

SEQ ID NO: 291698 - DNA, 75 bp, Artificial Sequence
  Synthetic
gacgcctttttatggacatggtgtgaagactcgcatgtgcttggttgtgactcctccggcccctgaatgcggcta

SEQ ID NO: 291699 - DNA, 75 bp, Artificial Sequence
  Synthetic
aagactcgcatgtgcttggttgtgactcctccggcccctgaatgcggctaaccttaaccccggagccctgtgttg

SEQ ID NO: 291700 - DNA, 75 bp, Artificial Sequence
  Synthetic
atcaaggaagccttgtatggggtagatgggttagaacctattgatgtgacaactagtgctgggtacccttatgtc

SEQ ID NO: 291701 - DNA, 75 bp, Artificial Sequence
  Synthetic
atgggttagaacctattgatgtgacaactagtgctgggtacccttatgtcagcttaggaattaaaaagagagata

SEQ ID NO: 291702 - DNA, 75 bp, Artificial Sequence
  Synthetic
tactttgggtgtccgtgtttctcatttttcttattattgtcttatggtcacagcatatatataacgtatatactg

SEQ ID NO: 291703 - DNA, 75 bp, Artificial Sequence
  Synthetic
aaatatggtatagacttaccattagttacttacataaaagatgaattgagaagtactgataaagtacgattaggg

SEQ ID NO: 291704 - DNA, 75 bp, Artificial Sequence
  Synthetic
caaaacatactcaccaatggatcaaaccagacctttacggtcataaattactacaaagatgcagctagttcatcc

SEQ ID NO: 291705 - DNA, 75 bp, Artificial Sequence
  Synthetic
accagacctttacggtcataaattactacaaagatgcagctagttcatcctcggctagccaatctttctcaatgg

SEQ ID NO: 291706 - DNA, 75 bp, Artificial Sequence
  Synthetic
aagagcaggttaattgaagcatccagtttaaatgattcagtaaatatgagaatgaaattaggaaacttatataaa

SEQ ID NO: 291707 - DNA, 75 bp, Artificial Sequence
  Synthetic
cccgcattgaactcaccaaatgttgaggcttgtggttatagtgatagagtccagcagattaccctaggtaattca

SEQ ID NO: 291708 - DNA, 75 bp, Artificial Sequence
  Synthetic
aggcttgtggttatagtgatagagtccagcagattaccctaggtaattcaaccataacaacccaggaagcagcca

SEQ ID NO: 291709 - DNA, 75 bp, Artificial Sequence
  Synthetic
ccttgtttaatggatggtcatttaatggcctttgattactcaaattttgatgcctccctatcaccagtatggttt

SEQ ID NO: 291710 - DNA, 75 bp, Artificial Sequence
  Synthetic
gcaagtgatgttaataaaacttcaaaaccagacacttctgtatgtagattctacacattagaaagtaagacatgg

SEQ ID NO: 291711 - DNA, 75 bp, Artificial Sequence
  Synthetic
gatacaatcaatatgtaatacacaccacatcttcagagatgaaatttatgtagttgagggtggcatgccatcagg

SEQ ID NO: 291712 - DNA, 75 bp, Artificial Sequence
  Synthetic
aaccagacacttctgtatgtagattctacacattagaaagtaagacatggaaaaacagttcaaaagggtggtgtt

SEQ ID NO: 291713 - DNA, 75 bp, Artificial Sequence
  Synthetic
cacatcttcagagatgaaatttatgtagttgagggtggcatgccatcaggatgttcaggcactagtatatttaat

SEQ ID NO: 291714 - DNA, 75 bp, Artificial Sequence
  Synthetic
ttcttccactcccttggcagatctggttacaccatacatgttcaatgcaatgcaaccaaatttcacagtggctgt

SEQ ID NO: 291715 - DNA, 75 bp, Artificial Sequence
  Synthetic
gggaatagatctggataagcttaagatcatagcatatggtgatgacctaattgtgtcctatccttatgagctgaa

SEQ ID NO: 291716 - DNA, 75 bp, Artificial Sequence
  Synthetic
gttacaccatacatgttcaatgcaatgcaaccaaatttcacagtggctgtctccttgtagttgttattccagaac

SEQ ID NO: 291717 - DNA, 75 bp, Artificial Sequence
  Synthetic
atcatagcatatggtgatgacctaattgtgtcctatccttatgagctgaaccctgaagtgctggccaccttgggt

SEQ ID NO: 291718 - DNA, 75 bp, Artificial Sequence
  Synthetic
acacacccaggggaaaatggtattgatttggaattaccaccagagaaagatggtccagttaaaaaccccgtttat

SEQ ID NO: 291719 - DNA, 75 bp, Artificial Sequence
  Synthetic
taaagtaacatgggaaaatctcacctttctaaagagatatttcaggccagacaaacaatttcctttcctagttca

SEQ ID NO: 291720 - DNA, 75 bp, Artificial Sequence
  Synthetic
atttggaattaccaccagagaaagatggtccagttaaaaaccccgtttatggtatgaatggtaccttgttaggca

SEQ ID NO: 291721 - DNA, 75 bp, Artificial Sequence
  Synthetic
tttctaaagagatatttcaggccagacaaacaatttcctttcctagttcacccagtgatgcctatgaaggatatt

SEQ ID NO: 291722 - DNA, 75 bp, Artificial Sequence
  Synthetic
gctacaatagttgtgccttacattaactcagtaccaatagattcaatgacacgtcataacaacgtgtctcttatg

SEQ ID NO: 291723 - DNA, 75 bp, Artificial Sequence
  Synthetic
cagatccttatgcatgttagcatggcattcaggtgaggaagaatacaatgagttcattaggaaaatcagaactac

SEQ ID NO: 291724 - DNA, 75 bp, Artificial Sequence
  Synthetic
actcagtaccaatagattcaatgacacgtcataacaacgtgtctcttatggtgatccccatagcacctcttgtgg

SEQ ID NO: 291725 - DNA, 75 bp, Artificial Sequence
  Synthetic
cctgaatacagtgttcttaggaaacgctggttggacctcttttaaacagttcaaatatagacatctagtttaatt

SEQ ID NO: 291726 - DNA, 75 bp, Artificial Sequence
  Synthetic
atgtgtactgagtttactggtattaggtctaaaaccattgttccacagggcttaccaactaccaccctaccaggc

SEQ ID NO: 291727 - DNA, 75 bp, Artificial Sequence
  Synthetic
ggtctaaaaccattgttccacagggcttaccaactaccaccctaccaggctcaggacaattccttactacggatg

SEQ ID NO: 291728 - DNA, 75 bp, Artificial Sequence
  Synthetic
catatcccaggtaaagttgaaaatctgttggaaatcatacaagtggataccttgattcctatgaataacttgcaa

SEQ ID NO: 291729 - DNA, 75 bp, Artificial Sequence
  Synthetic
tgttggaaatcatacaagtggataccttgattcctatgaataacttgcaaggtagtgacgaggtaagtaactact

SEQ ID NO: 291730 - DNA, 75 bp, Artificial Sequence
  Synthetic
ctgttcattggagatggtgtgtttaaaaccactttgctcggtgaaatagcacaatactacacacattggtctgga

SEQ ID NO: 291731 - DNA, 75 bp, Artificial Sequence
  Synthetic
aaaccactttgctcggtgaaatagcacaatactacacacattggtctggatcccttagaatctccctaatgtaca

SEQ ID NO: 291732 - DNA, 75 bp, Artificial Sequence
  Synthetic
ggtgcacaagggccaacaaacagaaaggatgccatgcttgggacacatgttgtctgggatattggattgcaatcc

SEQ ID NO: 291733 - DNA, 75 bp, Artificial Sequence
  Synthetic
ttaaaacagcggatgggtaccctaccatccgacccactgggtgtagtacactggtacattgtacctttgtacgcc

SEQ ID NO: 291734 - DNA, 75 bp, Artificial Sequence
  Synthetic
aggatgccatgcttgggacacatgttgtctgggatattggattgcaatccaccattgtaatgaccataccctgga

SEQ ID NO: 291735 - DNA, 75 bp, Artificial Sequence
  Synthetic
ctggtacattgtacctttgtacgcctgtttctccctattgtaccttccctcacaatcctaacccctgtaacgtta

SEQ ID NO: 291736 - DNA, 75 bp, Artificial Sequence
  Synthetic
tgtttctccctattgtaccttccctcacaatcctaacccctgtaacgttagaagatgtgcaactcgtgcaatagg

SEQ ID NO: 291737 - DNA, 75 bp, Artificial Sequence
  Synthetic
ggttatctatcctgttggtatcaaacatcactcatactcccacccaacactgctggacaggtttacctattgtca

SEQ ID NO: 291738 - DNA, 75 bp, Artificial Sequence
  Synthetic
catcactcatactcccacccaacactgctggacaggtttacctattgtcatttattagtgcatgttctgatttca

SEQ ID NO: 291739 - DNA, 75 bp, Artificial Sequence
  Synthetic
cggagtatagatggtccccaccgtcaaaagctcttaaccgttatccgccaatcaactacgtgacgactggtagca

SEQ ID NO: 291740 - DNA, 75 bp, Artificial Sequence
  Synthetic
aaaagctcttaaccgttatccgccaatcaactacgtgacgactggtagcaacattttgacactttgacgttcgat

SEQ ID NO: 291741 - DNA, 75 bp, Artificial Sequence
  Synthetic
aaaagctcttaaccgttatccgccaatcaactacgtgacgactggtagcatcattttgacactttgacgttcgat

SEQ ID NO: 291742 - DNA, 75 bp, Artificial Sequence
  Synthetic
aaaagctcttaaccgttatccgccaatcaactacgtgacgactggtagcaccattttgacactttgacgttcgat

SEQ ID NO: 291743 - DNA, 75 bp, Artificial Sequence
  Synthetic
aaaagctcttaaccgttatccgccaatcaactacgtgacgactggtagcagcattttgacactttgacgttcgat

SEQ ID NO: 291744 - DNA, 75 bp, Artificial Sequence
  Synthetic
actgaaggtctgggtgatgaactggaagaagttattgttgagaaaacgaaacagacactagcttcaatatcatca

SEQ ID NO: 291745 - DNA, 75 bp, Artificial Sequence
  Synthetic
aagaagttattgttgagaaaacgaaacagacactagcttcaatatcatcaggacctaagcatacccagagtgttc

SEQ ID NO: 291746 - DNA, 75 bp, Artificial Sequence
  Synthetic
tcacaggtaactgtgtcccagcctgcgtggcggccaacccagcaattgctgggacgccaatttgttgacatggtg

SEQ ID NO: 291747 - DNA, 75 bp, Artificial Sequence
  Synthetic
cgtggcggccaacccagcaattgctgggacgccaatttgttgacatggtgtgaagatcttaatgtgcttggttgt

SEQ ID NO: 291748 - DNA, 75 bp, Artificial Sequence
  Synthetic
gataatgtagaaactagaacaacatacatgcacttcaatggttctgaaacggacattgaaagtttcttgggacgt

SEQ ID NO: 291749 - DNA, 75 bp, Artificial Sequence
  Synthetic
acatgcacttcaatggttctgaaacggacattgaaagtttcttgggacgtgctgcctgtgtacatataactgaaa

SEQ ID NO: 291750 - DNA, 75 bp, Artificial Sequence
  Synthetic
cacaagccagtgacattaaggtcgtaatgagtaatttcgggatgggaccgactactttgggtgtccgtgtttcct

SEQ ID NO: 291751 - DNA, 75 bp, Artificial Sequence
  Synthetic
aatgagtaatttcgggatgggaccgactactttgggtgtccgtgtttcctgtttttctttatgattgtcttatgg

SEQ ID NO: 291752 - DNA, 75 bp, Artificial Sequence
  Synthetic
tttaatgattggaaaatcaatttatcaagtttggttcaacttaggaaaaaactggagcttttcacatatgttaga

SEQ ID NO: 291753 - DNA, 75 bp, Artificial Sequence
  Synthetic
caagtttggttcaacttaggaaaaaactggagcttttcacatatgttagatttgactctgagtataccattctag

SEQ ID NO: 291754 - DNA, 75 bp, Artificial Sequence
  Synthetic
ctcaaaggagtggttctcacgaaaaccaaaatattcttacaaatggatcacatcaaaccttcactgttattaatt

SEQ ID NO: 291755 - DNA, 75 bp, Artificial Sequence
  Synthetic
ccaaaatattcttacaaatggatcacatcaaaccttcactgttattaattactataaggatgcagccagtgcatc

SEQ ID NO: 291756 - DNA, 75 bp, Artificial Sequence
  Synthetic
caagcaatgtatgtccctccaggagcaccaaatccaaaggaatggaatgattttacatggcagagtgcttctaat

SEQ ID NO: 291757 - DNA, 75 bp, Artificial Sequence
  Synthetic
caccaaatccaaaggaatggaatgattttacatggcagagtgcttctaatccaagtgtattctttaaggtaggtg

SEQ ID NO: 291758 - DNA, 75 bp, Artificial Sequence
  Synthetic
tcaaagatctaatgcttaaaggagccccagcactaaattccccaaatgttgaggcatgtggttacagtgacagag

SEQ ID NO: 291759 - DNA, 75 bp, Artificial Sequence
  Synthetic
cccagcactaaattccccaaatgttgaggcatgtggttacagtgacagagtgcaacaaatcaccctcggaaactc

SEQ ID NO: 291760 - DNA, 75 bp, Artificial Sequence
  Synthetic
tgtttttatgatggatattcacatgatgatgagaacacaccctatggaataacagtcttgaatcacatgggtagt

SEQ ID NO: 291761 - DNA, 75 bp, Artificial Sequence
  Synthetic
atgatgagaacacaccctatggaataacagtcttgaatcacatgggtagtatggctttcagagtggttgatgagc

SEQ ID NO: 291762 - DNA, 75 bp, Artificial Sequence
  Synthetic
ggcctgagtatttaccagataaagatgctagtgatgtgaacaaaacctcaaaacctgacacatcagtgtgtagat

SEQ ID NO: 291763 - DNA, 75 bp, Artificial Sequence
  Synthetic
tgctagtgatgtgaacaaaacctcaaaacctgacacatcagtgtgtagattttacaccttagatagtaaaacttg

SEQ ID NO: 291764 - DNA, 75 bp, Artificial Sequence
  Synthetic
catgttgaagcatggatacccagagcccctagagcactaccatatgaagcaataggaaagacaaattatcctaag

SEQ ID NO: 291765 - DNA, 75 bp, Artificial Sequence
  Synthetic
cccctagagcactaccatatgaagcaataggaaagacaaattatcctaagatgattactccagtaattaagaaaa

SEQ ID NO: 291766 - DNA, 75 bp, Artificial Sequence
  Synthetic
atatgggtgtatttggtcaaaacatgttctttcattcacttggcagatctgggtacaccatacatgtccagtgta

SEQ ID NO: 291767 - DNA, 75 bp, Artificial Sequence
  Synthetic
gttctttcattcacttggcagatctgggtacaccatacatgtccagtgtaatgccaccaaatttcacagtggctg

SEQ ID NO: 291768 - DNA, 75 bp, Artificial Sequence
  Synthetic
actagcaacgttaagatcatgaactaccacttgatgactccagaagatcacttaaacttaatcacaccttatgta

SEQ ID NO: 291769 - DNA, 75 bp, Artificial Sequence
  Synthetic
accacttgatgactccagaagatcacttaaacttaatcacaccttatgtaaatagagatctagcaattgtataca

SEQ ID NO: 291770 - DNA, 75 bp, Artificial Sequence
  Synthetic
gaaatgtatcagtcaaatacactctcacacatcctggtgaagctggtattgacttgagcaaagcagaagtagata

SEQ ID NO: 291771 - DNA, 75 bp, Artificial Sequence
  Synthetic
cacacatcctggtgaagctggtattgacttgagcaaagcagaagtagataaaggaccttccaacaatccagttta

SEQ ID NO: 291772 - DNA, 75 bp, Artificial Sequence
  Synthetic
gtgtattattccagatattacaggaaattttacccaataatgtgtgaaaaaccaacaaccatatggattgaaggc

SEQ ID NO: 291773 - DNA, 75 bp, Artificial Sequence
  Synthetic
aattttacccaataatgtgtgaaaaaccaacaaccatatggattgaaggcagctcttattatcctagtagatatc

SEQ ID NO: 291774 - DNA, 75 bp, Artificial Sequence
  Synthetic
tcatcaacctacgaacaaataacacagcaactattgtagtaccatacatcaactcagtgccaattgactcaatga

SEQ ID NO: 291775 - DNA, 75 bp, Artificial Sequence
  Synthetic
agcaactattgtagtaccatacatcaactcagtgccaattgactcaatgacacgccataacaacgtgtctttatt

SEQ ID NO: 291776 - DNA, 75 bp, Artificial Sequence
  Synthetic
ggtattctgaggtgtgtccatggcccaataggcttactaacagcaggagggagtggatatgtttgttttgcagac

SEQ ID NO: 291777 - DNA, 75 bp, Artificial Sequence
  Synthetic
caataggcttactaacagcaggagggagtggatatgtttgttttgcagacataagacaattagactgtattgctg

SEQ ID NO: 291778 - DNA, 75 bp, Artificial Sequence
  Synthetic
taccagtgactgtgactatagcaccaatgtgtgcagaatttagtggaattagatctagatcaattgtaccacagg

SEQ ID NO: 291779 - DNA, 75 bp, Artificial Sequence
  Synthetic
aatgtgtgcagaatttagtggaattagatctagatcaattgtaccacaggggttgccgactacaactctgccagg

SEQ ID NO: 291780 - DNA, 75 bp, Artificial Sequence
  Synthetic
gttggctttactgaccaaatatcagcaaaagtaacagagttgcaagatgtggccaaagactttttaacaaccaaa

SEQ ID NO: 291781 - DNA, 75 bp, Artificial Sequence
  Synthetic
caaaagtaacagagttgcaagatgtggccaaagactttttaacaaccaaagtgttatctaaggttgttaagatga

SEQ ID NO: 291782 - DNA, 75 bp, Artificial Sequence
  Synthetic
catgttatgagcctacacctaagatacacattccaggggaggttaaaaacttactggaaatgattcaggtagata

SEQ ID NO: 291783 - DNA, 75 bp, Artificial Sequence
  Synthetic
acacattccaggggaggttaaaaacttactggaaatgattcaggtagatacattaataccgatgaataacaccac

SEQ ID NO: 291784 - DNA, 75 bp, Artificial Sequence
  Synthetic
actgcaactctagcccttttgggttgtgatggttctccatggagattcttgaaaatgtatatatccaagcacttt

SEQ ID NO: 291785 - DNA, 75 bp, Artificial Sequence
  Synthetic
gtgatggttctccatggagattcttgaaaatgtatatatccaagcactttcaggtaccatatattgaaagacaag

SEQ ID NO: 291786 - DNA, 75 bp, Artificial Sequence
  Synthetic
agaatgaacagatatttggaacaaatcttttcattggtgatggagttttcaaaactacattattgggggaaatag

SEQ ID NO: 291787 - DNA, 75 bp, Artificial Sequence
  Synthetic
tcttttcattggtgatggagttttcaaaactacattattgggggaaatagctcagtactacacacactgggctgg

SEQ ID NO: 291788 - DNA, 75 bp, Artificial Sequence
  Synthetic
ggtttagaatggattgccaacaagatatcaaagctgattgagtggatcaaaaacaaagtcctaccacaagccaag

SEQ ID NO: 291789 - DNA, 75 bp, Artificial Sequence
  Synthetic
tatcaaagctgattgagtggatcaaaaacaaagtcctaccacaagccaaggaaaaacttgagtactgcagtaaat

SEQ ID NO: 291790 - DNA, 75 bp, Artificial Sequence
  Synthetic
aacttatattggcatacacaccccctggtgttgctggacctaaaaacagaaaagaagcaatgcttggaacacatg

SEQ ID NO: 291791 - DNA, 75 bp, Artificial Sequence
  Synthetic
tggtgttgctggacctaaaaacagaaaagaagcaatgcttggaacacatgtggtatgggatataggtttacaatc

SEQ ID NO: 291792 - DNA, 75 bp, Artificial Sequence
  Synthetic
aatcccacccaggagaagagagaacagttgttcaacaacgtattatggctggaacaaatgtcacaaaaatttgcc

SEQ ID NO: 291793 - DNA, 75 bp, Artificial Sequence
  Synthetic
agttgttcaacaacgtattatggctggaacaaatgtcacaaaaatttgccccgctatacgctgctgaatcaaaaa

SEQ ID NO: 291794 - DNA, 75 bp, Artificial Sequence
  Synthetic
ctgatccagacacatatacaagtgctggtcacttgtcatgttggtatcaaacatccttgatattgccacctcaaa

SEQ ID NO: 291795 - DNA, 75 bp, Artificial Sequence
  Synthetic
tggtcacttgtcatgttggtatcaaacatccttgatattgccacctcaaaccagtggcactgcatatttactatc

SEQ ID NO: 291796 - DNA, 75 bp, Artificial Sequence
  Synthetic
aaacagaggactgaaccagtgtgcgtgttaatacacggaacaccaggctctggcaagtccctgaccacatcaatt

SEQ ID NO: 291797 - DNA, 75 bp, Artificial Sequence
  Synthetic
tgttaatacacggaacaccaggctctggcaagtccctgaccacatcaattgttggtcgtgcactagcagaacact

SEQ ID NO: 291798 - DNA, 75 bp, Artificial Sequence
  Synthetic
aaactatctcacaaactgatgcactagaagaagggttgggagatgaactagaggaagtcatagtcgaaaaaacga

SEQ ID NO: 291799 - DNA, 75 bp, Artificial Sequence
  Synthetic
agaagaagggttgggagatgaactagaggaagtcatagtcgaaaaaacgaaacagacattggcttcagttgcaac

SEQ ID NO: 291800 - DNA, 75 bp, Artificial Sequence
  Synthetic
taccaacaacaagaagttgttataatggatgatttaaatcagaacccagatggccaagacattagtatgttttgc

SEQ ID NO: 291801 - DNA, 75 bp, Artificial Sequence
  Synthetic
tggatgatttaaatcagaacccagatggccaagacattagtatgttttgccaaatggtctcttcagttgatttca

SEQ ID NO: 291802 - DNA, 75 bp, Artificial Sequence
  Synthetic
gagcaaccatgcccacagtaccatcagataatatagaaaccagaactacatatatgaattttacaggatctgaaa

SEQ ID NO: 291803 - DNA, 75 bp, Artificial Sequence
  Synthetic
agataatatagaaaccagaactacatatatgaattttacaggatctgaaacagatgtggagtgctttttgggtag

SEQ ID NO: 291804 - DNA, 75 bp, Artificial Sequence
  Synthetic
tttgtcttggcctctacaaactccaacactctaagtccccctacaattcttaatccagaggctttagctagaaga

SEQ ID NO: 291805 - DNA, 75 bp, Artificial Sequence
  Synthetic
acactctaagtccccctacaattcttaatccagaggctttagctagaagatttggatttgatttggatatttgct

SEQ ID NO: 291806 - DNA, 75 bp, Artificial Sequence
  Synthetic
ttgaaaaccagaaagaggctaagttgttcaatgattggaaaattaatttgtccagtttagttcaattaagaaaga

SEQ ID NO: 291807 - DNA, 75 bp, Artificial Sequence
  Synthetic
gttcaatgattggaaaattaatttgtccagtttagttcaattaagaaagaagttagaactctttacatatgtcag

SEQ ID NO: 291808 - DNA, 75 bp, Artificial Sequence
  Synthetic
agtatatgtaaagattgtcatcaaccatcaaattttaaaaagtgttgcccactggtgtgtggcaaagccattagt

SEQ ID NO: 291809 - DNA, 75 bp, Artificial Sequence
  Synthetic
catcaaattttaaaaagtgttgcccactggtgtgtggcaaagccattagtttggtggatagggctaccaacatta

SEQ ID NO: 291810 - DNA, 75 bp, Artificial Sequence
  Synthetic
ctagttattctagtaatcttactgtccaggctatgtatgtgccaccaggagcacccaatcctaaaacttggaatg

SEQ ID NO: 291811 - DNA, 75 bp, Artificial Sequence
  Synthetic
ccaggctatgtatgtgccaccaggagcacccaatcctaaaacttggaatgattacacatggcaaagtgcatcaaa

SEQ ID NO: 291812 - DNA, 75 bp, Artificial Sequence
  Synthetic
aagataaaaataacagattcacttgaggcgttatttcaaggaccagtgtatagagatttagagatagatgtttgc

SEQ ID NO: 291813 - DNA, 75 bp, Artificial Sequence
  Synthetic
aggcgttatttcaaggaccagtgtatagagatttagagatagatgtttgcaacaaatcaccccctgaatgcataa

SEQ ID NO: 291814 - DNA, 75 bp, Artificial Sequence
  Synthetic
tcgtgggactcgcttcagcatatagctgtttctatgatggctattcacatgataatgaagatactccttatggca

SEQ ID NO: 291815 - DNA, 75 bp, Artificial Sequence
  Synthetic
ctgtttctatgatggctattcacatgataatgaagatactccttatggcataacagtcttgaaccacatgggtag

SEQ ID NO: 291816 - DNA, 75 bp, Artificial Sequence
  Synthetic
aaaaagaactggattataccacaagtacctaccaatatagaaagggctatgaaccaagccagtatgatcattaat

SEQ ID NO: 291817 - DNA, 75 bp, Artificial Sequence
  Synthetic
tacctaccaatatagaaagggctatgaaccaagccagtatgatcattaatacaatattgatgtttgttagcacat

SEQ ID NO: 291818 - DNA, 75 bp, Artificial Sequence
  Synthetic
aaatcagagtgtatcatagagcaaaacacattcaaacttggatccccagagctcctagggcgttgccttatgaga

SEQ ID NO: 291819 - DNA, 75 bp, Artificial Sequence
  Synthetic
acacattcaaacttggatccccagagctcctagggcgttgccttatgagacaattggccgcacaaatttcccaag

SEQ ID NO: 291820 - DNA, 75 bp, Artificial Sequence
  Synthetic
tactcaggcaatccttctcacaacaagttgaaaccccccagcttacgaccagttatggtacagggccccaacaca

SEQ ID NO: 291821 - DNA, 75 bp, Artificial Sequence
  Synthetic
agttgaaaccccccagcttacgaccagttatggtacagggccccaacacagaatttgcactgtccctattgagaa

SEQ ID NO: 291822 - DNA, 75 bp, Artificial Sequence
  Synthetic
taggacccaggtttgggggaatatttactggaaatgtcaagattatgaattaccatctaatgaccccagaggatc

SEQ ID NO: 291823 - DNA, 75 bp, Artificial Sequence
  Synthetic
tactggaaatgtcaagattatgaattaccatctaatgaccccagaggatcatttaaacttagtgacaccttaccc

SEQ ID NO: 291824 - DNA, 75 bp, Artificial Sequence
  Synthetic
atctatgaccgcgtgtgtgtcatacccacacatgcacaaccaggcaacagtgttttacttaatggacaaaagata

SEQ ID NO: 291825 - DNA, 75 bp, Artificial Sequence
  Synthetic
ccacacatgcacaaccaggcaacagtgttttacttaatggacaaaagatacagattaaggataaatacaaattga

SEQ ID NO: 291826 - DNA, 75 bp, Artificial Sequence
  Synthetic
ttcctcattgcagttgtacgtcaggtgtatactactccagatattataacaaattttatccaataatatgtgaaa

SEQ ID NO: 291827 - DNA, 75 bp, Artificial Sequence
  Synthetic
tgtatactactccagatattataacaaattttatccaataatatgtgaaaagcctaccaacatttggatagaggg

SEQ ID NO: 291828 - DNA, 75 bp, Artificial Sequence
  Synthetic
aatgaaaagttcagggatattagaaatttcatatcagaagacattgaaggcatggaagccaccctagtagtgcat

SEQ ID NO: 291829 - DNA, 75 bp, Artificial Sequence
  Synthetic
atttcatatcagaagacattgaaggcatggaagccaccctagtagtgcattccaacaatttcaccaataccatac

SEQ ID NO: 291830 - DNA, 75 bp, Artificial Sequence
  Synthetic
gtcccgccgaaccaggagactgtggaggcatcttacgatgcatccatggaccaattggtttgttgacagcaggtg

SEQ ID NO: 291831 - DNA, 75 bp, Artificial Sequence
  Synthetic
aggcatcttacgatgcatccatggaccaattggtttgttgacagcaggtgggagtggatttgtttgttttgctga

SEQ ID NO: 291832 - DNA, 75 bp, Artificial Sequence
  Synthetic
cccacaagcagaatgattcgatacgattacccaactaaaactggacaatgtggaggcgtgctctgcacaactgga

SEQ ID NO: 291833 - DNA, 75 bp, Artificial Sequence
  Synthetic
attacccaactaaaactggacaatgtggaggcgtgctctgcacaactggaaaaatttttggaattcatgttggag

SEQ ID NO: 291834 - DNA, 75 bp, Artificial Sequence
  Synthetic
tatcaaacttaggaaaagctttcggtgctggtttcaccgaccaaattacaagcaaaattggggaattgcaagata

SEQ ID NO: 291835 - DNA, 75 bp, Artificial Sequence
  Synthetic
tgctggtttcaccgaccaaattacaagcaaaattggggaattgcaagatacagttaaagattatctcacaactaa

SEQ ID NO: 291836 - DNA, 75 bp, Artificial Sequence
  Synthetic
gaaaaacaggggcaaatagtttccaggcaaaaagttagggaactaaacattgcaccagtaaacaccccaaacaaa

SEQ ID NO: 291837 - DNA, 75 bp, Artificial Sequence
  Synthetic
ggcaaaaagttagggaactaaacattgcaccagtaaacaccccaaacaaaaccaaactacaccccagtgtttttt

SEQ ID NO: 291838 - DNA, 75 bp, Artificial Sequence
  Synthetic
gaaatcatgaagatttagtaacagtaacagctaccttggcattactggggtgtgatggttctccctggagatttt

SEQ ID NO: 291839 - DNA, 75 bp, Artificial Sequence
  Synthetic
aacagctaccttggcattactggggtgtgatggttctccctggagatttttaaaaatgtatgtgtcaaaacattt

SEQ ID NO: 291840 - DNA, 75 bp, Artificial Sequence
  Synthetic
cctagacttgaagtcaagctttcagactctctgttttcaaaatacaaaggtaatgttgaaatgaaacctacagaa

SEQ ID NO: 291841 - DNA, 75 bp, Artificial Sequence
  Synthetic
actctctgttttcaaaatacaaaggtaatgttgaaatgaaacctacagaaaacatgttagtggctgtagatcatt

SEQ ID NO: 291842 - DNA, 75 bp, Artificial Sequence
  Synthetic
tcaatgatgcttgcaatgcagctaaagggcttgaatggatagctaataaaatctcaaaatttatagattgggtta

SEQ ID NO: 291843 - DNA, 75 bp, Artificial Sequence
  Synthetic
agggcttgaatggatagctaataaaatctcaaaatttatagattgggttaaaaccaaaattctcccacaagctag

SEQ ID NO: 291844 - DNA, 75 bp, Artificial Sequence
  Synthetic
aaagaggcactctacggagtggatgggttagaaccaatagatgtgacaacaagtgctggttacccttatgttagt

SEQ ID NO: 291845 - DNA, 75 bp, Artificial Sequence
  Synthetic
ggttagaaccaatagatgtgacaacaagtgctggttacccttatgttagtttaggaatcaaaaagagagacatct

SEQ ID NO: 291846 - DNA, 75 bp, Artificial Sequence
  Synthetic
ggcagattaccacaatgcacatctcaaatcccactcaggaaaaaagggaacaactctttaacaacatattgtggt

SEQ ID NO: 291847 - DNA, 75 bp, Artificial Sequence
  Synthetic
aaatcccactcaggaaaaaagggaacaactctttaacaacatattgtggttagaacaaatgtcccagaaatttgc

SEQ ID NO: 291848 - DNA, 75 bp, Artificial Sequence
  Synthetic
tatggaatagatttacctttagttacctatataaaagatgaattgagaagcactgacaaggtgcgattgggcaag

SEQ ID NO: 291849 - DNA, 75 bp, Artificial Sequence
  Synthetic
cctatataaaagatgaattgagaagcactgacaaggtgcgattgggcaagagtagacttattgaagcctcaagct

SEQ ID NO: 291850 - DNA, 75 bp, Artificial Sequence
  Synthetic
tgttaaattacatacaattcaaatcaaaacaaagaactgaaccagtttgtgtactaatccatggcacacctgggt

SEQ ID NO: 291851 - DNA, 75 bp, Artificial Sequence
  Synthetic
aaaacaaagaactgaaccagtttgtgtactaatccatggcacacctgggtctggaaaatccttgactacatcaat

SEQ ID NO: 291852 - DNA, 75 bp, Artificial Sequence
  Synthetic
ttccaccagaacccaggggtaatcactggatctgcagtgggatgtgatccagacacattctggtctatcatccca

SEQ ID NO: 291853 - DNA, 75 bp, Artificial Sequence
  Synthetic
ctggatctgcagtgggatgtgatccagacacattctggtctatcatcccatgtcttatggatggacatttaatgg

SEQ ID NO: 291854 - DNA, 75 bp, Artificial Sequence
  Synthetic
caccagatcctaaacactttgatggataccagcaacaagaagttgtcatcatggatgacttaaaccagaacccag

SEQ ID NO: 291855 - DNA, 75 bp, Artificial Sequence
  Synthetic
ataccagcaacaagaagttgtcatcatggatgacttaaaccagaacccagatggtcaggatatcagtatgttttg

SEQ ID NO: 291856 - DNA, 75 bp, Artificial Sequence
  Synthetic
tgtttagaaaaagttttaattaagttaggttttaaacactcctccttaatacaatcaatctgtcacacccatcac

SEQ ID NO: 291857 - DNA, 75 bp, Artificial Sequence
  Synthetic
taggttttaaacactcctccttaatacaatcaatctgtcacacccatcacatatttaaagatgaaatttacattg

SEQ ID NO: 291858 - DNA, 75 bp, Artificial Sequence
  Synthetic
ataaaggtatgttgtttactagtaattttgttttagcctctacaaattcaaacactttgagccctcctactatcc

SEQ ID NO: 291859 - DNA, 75 bp, Artificial Sequence
  Synthetic
ttttgttttagcctctacaaattcaaacactttgagccctcctactatcctcaatccagaagctctaacaagaag

SEQ ID NO: 291860 - DNA, 75 bp, Artificial Sequence
  Synthetic
atgattaataatataattatcagaacactcattctggatgcatacaaaggaatagaccttgacaaactcaaaatt

SEQ ID NO: 291861 - DNA, 75 bp, Artificial Sequence
  Synthetic
cactcattctggatgcatacaaaggaatagaccttgacaaactcaaaattttagcttatggagatgatttgattg

SEQ ID NO: 291862 - DNA, 75 bp, Artificial Sequence
  Synthetic
gcaaattgaatgcctcgatggcaactagtctgtgcaaggattgtcacaaaccctccaatttcaagaaatgttgtc

SEQ ID NO: 291863 - DNA, 75 bp, Artificial Sequence
  Synthetic
tagtctgtgcaaggattgtcacaaaccctccaatttcaagaaatgttgtcccttggtttgtggtaaagctatcag

SEQ ID NO: 291864 - DNA, 75 bp, Artificial Sequence
  Synthetic
aactatggtttaacaataactcctccagataaaacagagaaattttccaagataacatgggacaatttaacattt

SEQ ID NO: 291865 - DNA, 75 bp, Artificial Sequence
  Synthetic
cagataaaacagagaaattttccaagataacatgggacaatttaacatttctaaaaagatactttagatctgatg

SEQ ID NO: 291866 - DNA, 75 bp, Artificial Sequence
  Synthetic
ctgcaattataaatgattataacaacaagattaaaataacagattctcttgaaactcttttccagggacccgtat

SEQ ID NO: 291867 - DNA, 75 bp, Artificial Sequence
  Synthetic
caagattaaaataacagattctcttgaaactcttttccagggacccgtatacaaagacattgagattgatgtttg

SEQ ID NO: 291868 - DNA, 75 bp, Artificial Sequence
  Synthetic
gaatcaatcagatggaccaaagatcccaggaatacacaggatcatgtcaggtctttatgcatgttggcatggcac

SEQ ID NO: 291869 - DNA, 75 bp, Artificial Sequence
  Synthetic
ctgaggaagttagagaatattgtaaaaagaaaaagtggactattccagaaatacccacagacattgagagagcag

SEQ ID NO: 291870 - DNA, 75 bp, Artificial Sequence
  Synthetic
aaagaaaaagtggactattccagaaatacccacagacattgagagagcagtgaatcaggcaagtatgattataaa

SEQ ID NO: 291871 - DNA, 75 bp, Artificial Sequence
  Synthetic
catcggcaaatgtttaaacttacctgagtacagtgttcttagaaaacgctggttggacttgttctaaattactta

SEQ ID NO: 291872 - DNA, 75 bp, Artificial Sequence
  Synthetic
gagtacagtgttcttagaaaacgctggttggacttgttctaaattacttacaaatatagacatctagttttattt

SEQ ID NO: 291873 - DNA, 75 bp, Artificial Sequence
  Synthetic
aattgtttgcacaaacccagggtccttattctggcaatgtagctcataataaactaaaaccccctacacttagac

SEQ ID NO: 291874 - DNA, 75 bp, Artificial Sequence
  Synthetic
catccgacccactgggtgtagtactctggtattttgtacctttgtacgcctgtttctcccctacctcccaaccta

SEQ ID NO: 291875 - DNA, 75 bp, Artificial Sequence
  Synthetic
ctggtattttgtacctttgtacgcctgtttctcccctacctcccaacctaaacaatcctggtaacttagaagact

SEQ ID NO: 291876 - DNA, 75 bp, Artificial Sequence
  Synthetic
ttattctggcaatgtagctcataataaactaaaaccccctacacttagaccagtggtagttcagggacctaatac

SEQ ID NO: 291877 - DNA, 75 bp, Artificial Sequence
  Synthetic
cacttctgtttccccggagcggagtataaatggccaccgctgtcaaaagctcttaaccgttatccgccaattaac

SEQ ID NO: 291878 - DNA, 75 bp, Artificial Sequence
  Synthetic
aaaaaggggagttcactggtttaggcatttatgatcgtgtgtgtgttgtacctacacattcacatccaggtcaag

SEQ ID NO: 291879 - DNA, 75 bp, Artificial Sequence
  Synthetic
catttatgatcgtgtgtgtgttgtacctacacattcacatccaggtcaagaagtgctattaaatggacagaaaat

SEQ ID NO: 291880 - DNA, 75 bp, Artificial Sequence
  Synthetic
agtaaacccctcactagtctggtcgatgaggctgagaattccccacgggcgaccgtgtctcagcctgcgtggcgg

SEQ ID NO: 291881 - DNA, 75 bp, Artificial Sequence
  Synthetic
agcttacagtgttaacactagatagaaatgagaagtttagggatattagacctttcatctgtgaagatccagaag

SEQ ID NO: 291882 - DNA, 75 bp, Artificial Sequence
  Synthetic
aaatgagaagtttagggatattagacctttcatctgtgaagatccagaaggcatggaagccacattagtaataca

SEQ ID NO: 291883 - DNA, 75 bp, Artificial Sequence
  Synthetic
caggtctaataaacttaagtagcacacccacaggaagaatgatacggtatgaatatccaaccaaaacaggacaat

SEQ ID NO: 291884 - DNA, 75 bp, Artificial Sequence
  Synthetic
agtgttggcaaggtcgtaatgagtaattccgggacgggaccgactactttgggtgtccgtgtttccttttatttt

SEQ ID NO: 291885 - DNA, 75 bp, Artificial Sequence
  Synthetic
attccgggacgggaccgactactttgggtgtccgtgtttccttttattttcaaattgttcttatggtcacaatat

SEQ ID NO: 291886 - DNA, 75 bp, Artificial Sequence
  Synthetic
acccacaggaagaatgatacggtatgaatatccaaccaaaacaggacaatgtggaggagtcttatgctccacagg

SEQ ID NO: 291887 - DNA, 75 bp, Artificial Sequence
  Synthetic
cccagcttagaaagcaatattttgtagaaaaacagggtgaaattgtgtcaaaacagaaagtgaaggaattagggt

SEQ ID NO: 291888 - DNA, 75 bp, Artificial Sequence
  Synthetic
ttcgcatgaaaatcaaaacatcttgacaaatggctcgacacaacactttacggttattaattactataaagatgc

SEQ ID NO: 291889 - DNA, 75 bp, Artificial Sequence
  Synthetic
acaaatggctcgacacaacactttacggttattaattactataaagatgctgcaagctcatcgtctgccggccag

SEQ ID NO: 291890 - DNA, 75 bp, Artificial Sequence
  Synthetic
agaaaaacagggtgaaattgtgtcaaaacagaaagtgaaggaattagggttacatcctataaacaccccatccaa

SEQ ID NO: 291891 - DNA, 75 bp, Artificial Sequence
  Synthetic
aacctgctgtgttgaaagacaatgatcccagattggaagtcaatttctctgaatctttgttttcaaagtataaag

SEQ ID NO: 291892 - DNA, 75 bp, Artificial Sequence
  Synthetic
gttgaaaggagcacctgctttgaactctcccaacgtggaagcatgtggatacagtgatagagtacaacaaatcac

SEQ ID NO: 291893 - DNA, 75 bp, Artificial Sequence
  Synthetic
tctcccaacgtggaagcatgtggatacagtgatagagtacaacaaatcacacttggaaattcaacaatcacaacc

SEQ ID NO: 291894 - DNA, 75 bp, Artificial Sequence
  Synthetic
tcccagattggaagtcaatttctctgaatctttgttttcaaagtataaaggcaatgttgaaatgaaaccaactcc

SEQ ID NO: 291895 - DNA, 75 bp, Artificial Sequence
  Synthetic
atataccagtaaaggagttaagtttaaaagaggccttatatggagttgatggacttgaacccctagacataacaa

SEQ ID NO: 291896 - DNA, 75 bp, Artificial Sequence
  Synthetic
ggcagatattgatgcaagtgatgtgaacaagacttcgcaacctgacacgtcagtgtgtaggttttataccttaga

SEQ ID NO: 291897 - DNA, 75 bp, Artificial Sequence
  Synthetic
aacaagacttcgcaacctgacacgtcagtgtgtaggttttataccttagaaagcaaaacatggaccagagattct

SEQ ID NO: 291898 - DNA, 75 bp, Artificial Sequence
  Synthetic
aaaagaggccttatatggagttgatggacttgaacccctagacataacaaccagtgcaggttatccatatgttag

SEQ ID NO: 291899 - DNA, 75 bp, Artificial Sequence
  Synthetic
caaaaatgcaggcttatttagataaatatggaatagacttgccacttgttacctatattaaagatgaactaagaa

SEQ ID NO: 291900 - DNA, 75 bp, Artificial Sequence
  Synthetic
tggacagaacatgttcttccatgcactggggagaacaggatacaccatccatgtgcagtgtaatgccactaagtt

SEQ ID NO: 291901 - DNA, 75 bp, Artificial Sequence
  Synthetic
ctggggagaacaggatacaccatccatgtgcagtgtaatgccactaagttccatagtgggtgtcttttggtggtc

SEQ ID NO: 291902 - DNA, 75 bp, Artificial Sequence
  Synthetic
atatggaatagacttgccacttgttacctatattaaagatgaactaagaagtgttgataaagtaagattaggcaa

SEQ ID NO: 291903 - DNA, 75 bp, Artificial Sequence
  Synthetic
tgaagttagggagtctctataaaacttttcaccaaaatcctggcattataactggttcagcagttgggtgtgatc

SEQ ID NO: 291904 - DNA, 75 bp, Artificial Sequence
  Synthetic
caagtacaagtacacccatccaggtgaacaaggtatagagttagatagtgcagctgaggaaggaggagcatcaca

SEQ ID NO: 291905 - DNA, 75 bp, Artificial Sequence
  Synthetic
gaacaaggtatagagttagatagtgcagctgaggaaggaggagcatcacatgacccggtatattctatgaatgga

SEQ ID NO: 291906 - DNA, 75 bp, Artificial Sequence
  Synthetic
ttttcaccaaaatcctggcattataactggttcagcagttgggtgtgatccagatgtcttctggtcagttatacc

SEQ ID NO: 291907 - DNA, 75 bp, Artificial Sequence
  Synthetic
cttccctatcaccagtgtggtttgattgcttggaaaaagttcttgaaaaacttgggtttaaagattccaacttaa

SEQ ID NO: 291908 - DNA, 75 bp, Artificial Sequence
  Synthetic
aacaaacaatactgctacaatcattgtgccctacattaattcagtaccaatggattctatgaccagacacaataa

SEQ ID NO: 291909 - DNA, 75 bp, Artificial Sequence
  Synthetic
gtgccctacattaattcagtaccaatggattctatgaccagacacaataatgcatccttgttggttatcccagtt

SEQ ID NO: 291910 - DNA, 75 bp, Artificial Sequence
  Synthetic
ttgcttggaaaaagttcttgaaaaacttgggtttaaagattccaacttaattagatccatatgcaacacacatca

SEQ ID NO: 291911 - DNA, 75 bp, Artificial Sequence
  Synthetic
gctctggaactagcattttcaattctatgattaataatataataataagaactttgattctagatgcttataagg

SEQ ID NO: 291912 - DNA, 75 bp, Artificial Sequence
  Synthetic
gaccattgctcccatgtacacagaattttcaggcatcagatctaaagctgtagtaccacagggcttgcctacttt

SEQ ID NO: 291913 - DNA, 75 bp, Artificial Sequence
  Synthetic
ttttcaggcatcagatctaaagctgtagtaccacagggcttgcctactttaaccactcctgggtctggccagttc

SEQ ID NO: 291914 - DNA, 75 bp, Artificial Sequence
  Synthetic
tatgattaataatataataataagaactttgattctagatgcttataagggtatagatcttgacaaattgagggt

SEQ ID NO: 291915 - DNA, 75 bp, Artificial Sequence
  Synthetic
catcagttctagcatcaatggggaagaaatatggattgactatcactcctccagacaaatctgaaaatttcacaa

SEQ ID NO: 291916 - DNA, 75 bp, Artificial Sequence
  Synthetic
aaccccgttaatacacattccaggggaagttcacaatctcctagaaattatacaggtggacactttaatccccat

SEQ ID NO: 291917 - DNA, 75 bp, Artificial Sequence
  Synthetic
gaagttcacaatctcctagaaattatacaggtggacactttaatccccatgaacaacaaaggtgccactgacagc

SEQ ID NO: 291918 - DNA, 75 bp, Artificial Sequence
  Synthetic
gaaatatggattgactatcactcctccagacaaatctgaaaatttcacaaaaatgacatgggaaaacatcacttt

SEQ ID NO: 291919 - DNA, 75 bp, Artificial Sequence
  Synthetic
cagtcatgccaatgcaagacattcatgagtctattaggtggacaaaagacccaaagaatacccaggatcatgtaa

SEQ ID NO: 291920 - DNA, 75 bp, Artificial Sequence
  Synthetic
attcggcactagactgtttataggagatggggtgtttaaaactacactgtttggagaaattgctcagtactacac

SEQ ID NO: 291921 - DNA, 75 bp, Artificial Sequence
  Synthetic
gatggggtgtttaaaactacactgtttggagaaattgctcagtactacacacactggtcaggttccatcaggatc

SEQ ID NO: 291922 - DNA, 75 bp, Artificial Sequence
  Synthetic
tgagtctattaggtggacaaaagacccaaagaatacccaggatcatgtaagatctttatgcatgttagcatggca

SEQ ID NO: 291923 - DNA, 75 bp, Artificial Sequence
  Synthetic
acataggaaagtgcttgaacttgcctgagtatagtgtacttagaagaagatggttagacatgttttaaataatga

SEQ ID NO: 291924 - DNA, 75 bp, Artificial Sequence
  Synthetic
atacaccccaccaggaaccaaaggacctaaagacaggaaagaagcaatgcttggtacgcatgtggtgtgggatgt

SEQ ID NO: 291925 - DNA, 75 bp, Artificial Sequence
  Synthetic
cctaaagacaggaaagaagcaatgcttggtacgcatgtggtgtgggatgtcggtctgcaatcaacagttgttatg

SEQ ID NO: 291926 - DNA, 75 bp, Artificial Sequence
  Synthetic
tgagtatagtgtacttagaagaagatggttagacatgttttaaataatgatatagaaacttaatttgtgtgcaga

SEQ ID NO: 291927 - DNA, 75 bp, Artificial Sequence
  Synthetic
cactagtctggtcgatgaggctaggaattccccacgggcgaccgtgtcctagcctgcgtggcggccagcccagct

SEQ ID NO: 291928 - DNA, 75 bp, Artificial Sequence
  Synthetic
atacaccagtgctggttatctttcctgttggtatcagacatccctcattctaccaccagacacaactggtaccgt

SEQ ID NO: 291929 - DNA, 75 bp, Artificial Sequence
  Synthetic
atggtgtgaagacctgcatgtgcttggttgtgagtcctccggcccctgaatgcggctaaccctaaccctggagcc

SEQ ID NO: 291930 - DNA, 75 bp, Artificial Sequence
  Synthetic
tgttggtatcagacatccctcattctaccaccagacacaactggtaccgtgtatcttctggcatttattagtgca

SEQ ID NO: 291931 - DNA, 75 bp, Artificial Sequence
  Synthetic
aacagaagctctcatggaaggatttgaagatgagctggaagaagttgttattgacaaaatgaaacaggtaacagc

SEQ ID NO: 291932 - DNA, 75 bp, Artificial Sequence
  Synthetic
gaagatgagctggaagaagttgttattgacaaaatgaaacaggtaacagcttcaagtcagagtggacccaaacac

SEQ ID NO: 291933 - DNA, 75 bp, Artificial Sequence
  Synthetic
tatggtcacagcatatatagtatatatactgtgatcatgggcgcacaagtgtcaacacaaaagagcggttcacat

SEQ ID NO: 291934 - DNA, 75 bp, Artificial Sequence
  Synthetic
aaactattacaaggatgcagccagttcatcatccgctggccaatccttgtcaatggacccaagcaaatttaccga

SEQ ID NO: 291935 - DNA, 75 bp, Artificial Sequence
  Synthetic
aacaaacccatctgacaatgtagagaccagaaccacatacatgcacttcactggatcagaaacttccctagagaa

SEQ ID NO: 291936 - DNA, 75 bp, Artificial Sequence
  Synthetic
accagaaccacatacatgcacttcactggatcagaaacttccctagagaacttcttgggaagatcagcttgtgtc

SEQ ID NO: 291937 - DNA, 75 bp, Artificial Sequence
  Synthetic
tcatcatccgctggccaatccttgtcaatggacccaagcaaatttaccgaaccagtcaaagatctgatgctgaag

SEQ ID NO: 291938 - DNA, 75 bp, Artificial Sequence
  Synthetic
tagagtggagcaaatcaccttaggaaactctacaataacaactcaagaggcagcaaattcaattgtagcatacgg

SEQ ID NO: 291939 - DNA, 75 bp, Artificial Sequence
  Synthetic
ggatagaatgataaatacacacaaggaacaagggttgttcaatgattggaagataagtttatccagtttagtaca

SEQ ID NO: 291940 - DNA, 75 bp, Artificial Sequence
  Synthetic
gaacaagggttgttcaatgattggaagataagtttatccagtttagtacaatttaggaaaaaactagaacttttc

SEQ ID NO: 291941 - DNA, 75 bp, Artificial Sequence
  Synthetic
aactctacaataacaactcaagaggcagcaaattcaattgtagcatacggggaatggccatcatttctcgatgat

SEQ ID NO: 291942 - DNA, 75 bp, Artificial Sequence
  Synthetic
tagattttatacactagatagtaaaacttggaccaatcagtcaaaagggtggtgttggaaacttccagatgcttt

SEQ ID NO: 291943 - DNA, 75 bp, Artificial Sequence
  Synthetic
acccaacacagctaaatatgccagtaacttaacagtacaggcaatgtatgtccctccaggtgcaccaaatcctgt

SEQ ID NO: 291944 - DNA, 75 bp, Artificial Sequence
  Synthetic
aacttaacagtacaggcaatgtatgtccctccaggtgcaccaaatcctgttaaatggaatgattatacgtggcaa

SEQ ID NO: 291945 - DNA, 75 bp, Artificial Sequence
  Synthetic
acttggaccaatcagtcaaaagggtggtgttggaaacttccagatgctttaaaagatatgggaatatttgggcag

SEQ ID NO: 291946 - DNA, 75 bp, Artificial Sequence
  Synthetic
gtgtaatgcaacaaaattccacagtggttgtttattagttgtggtgataccagagcatcaattggcatctataca

SEQ ID NO: 291947 - DNA, 75 bp, Artificial Sequence
  Synthetic
cagtgtaccattcataggcattgcatcagcctatagctgcttttatgatggatactcacatgatgatgaaaatac

SEQ ID NO: 291948 - DNA, 75 bp, Artificial Sequence
  Synthetic
tcagcctatagctgcttttatgatggatactcacatgatgatgaaaatactccatatggtataaatgtcttaaat

SEQ ID NO: 291949 - DNA, 75 bp, Artificial Sequence
  Synthetic
ggttgtttattagttgtggtgataccagagcatcaattggcatctatacagggaggaagtgtatcagtgtattat

SEQ ID NO: 291950 - DNA, 75 bp, Artificial Sequence
  Synthetic
tgatggtccaatgttagatccattatacatgatggatggaacactgattggaaatagcttgatttttcctcatca

SEQ ID NO: 291951 - DNA, 75 bp, Artificial Sequence
  Synthetic
aactctcgtcaagataagagttttccacagagcaaaacacattagagcttgggtaccaagaccgcctagggcttt

SEQ ID NO: 291952 - DNA, 75 bp, Artificial Sequence
  Synthetic
cacagagcaaaacacattagagcttgggtaccaagaccgcctagggctttaccatacacctctataggaagaacc

SEQ ID NO: 291953 - DNA, 75 bp, Artificial Sequence
  Synthetic
tacatgatggatggaacactgattggaaatagcttgatttttcctcatcaatttataaatttgagaacaaacaac

SEQ ID NO: 291954 - DNA, 75 bp, Artificial Sequence
  Synthetic
gaccaggcacaataacctgtctcttatggtaattccaattgtaaacatcactgcaacaagtggtgcagctccatc

SEQ ID NO: 291955 - DNA, 75 bp, Artificial Sequence
  Synthetic
cacttatggaggaaacctcaaattcggggcagtttacacctgtaattacaaaataatgaattaccacctgatgac

SEQ ID NO: 291956 - DNA, 75 bp, Artificial Sequence
  Synthetic
ggggcagtttacacctgtaattacaaaataatgaattaccacctgatgacacatgaagaccacttaaatctccta

SEQ ID NO: 291957 - DNA, 75 bp, Artificial Sequence
  Synthetic
atggtaattccaattgtaaacatcactgcaacaagtggtgcagctccatcaatacccattacagtaacaattgca

SEQ ID NO: 291958 - DNA, 75 bp, Artificial Sequence
  Synthetic
gctccccactgttttaacacctggttcagaacaatttcttaccacagatgacagacaatcccctagtgcaatgcc

SEQ ID NO: 291959 - DNA, 75 bp, Artificial Sequence
  Synthetic
ttcagaaacaatccctcactgtaattgtacttcaggagtctactactctcagtactacaataaatattatccaat

SEQ ID NO: 291960 - DNA, 75 bp, Artificial Sequence
  Synthetic
tgtacttcaggagtctactactctcagtactacaataaatattatccaataatatgtgacaaacctacaaacata

SEQ ID NO: 291961 - DNA, 75 bp, Artificial Sequence
  Synthetic
tcagaacaatttcttaccacagatgacagacaatcccctagtgcaatgcccaattatgaaccaacccctctaatc

SEQ ID NO: 291962 - DNA, 75 bp, Artificial Sequence
  Synthetic
gctgataccaataaacaatgcccaaggagttacgggattggaaacatacaggatccctctctatcaaagcagaca

SEQ ID NO: 291963 - DNA, 75 bp, Artificial Sequence
  Synthetic
gaaaggtgttggtccagctgaacctggagattgtggtggagtcttgcgatgtgtgcatggtccgatcggcttgtt

SEQ ID NO: 291964 - DNA, 75 bp, Artificial Sequence
  Synthetic
ggagattgtggtggagtcttgcgatgtgtgcatggtccgatcggcttgttaacagcaggtggaagcggatatgtg

SEQ ID NO: 291965 - DNA, 75 bp, Artificial Sequence
  Synthetic
ggagttacgggattggaaacatacaggatccctctctatcaaagcagacaaggtcagcaagtctttggtttcagg

SEQ ID NO: 291966 - DNA, 75 bp, Artificial Sequence
  Synthetic
tcagtacttcacccactgggctggttcattacgtttgtcattcatgtacacgggaccagccctttccagtgcaaa

SEQ ID NO: 291967 - DNA, 75 bp, Artificial Sequence
  Synthetic
tactgattacataacaagcttaggaaaggcatttggtgtaggtttcacagaccaaatatcagcaaagatcacgga

SEQ ID NO: 291968 - DNA, 75 bp, Artificial Sequence
  Synthetic
aaggcatttggtgtaggtttcacagaccaaatatcagcaaagatcacggaacttcaagacagtgctaaggattac

SEQ ID NO: 291969 - DNA, 75 bp, Artificial Sequence
  Synthetic
tcattacgtttgtcattcatgtacacgggaccagccctttccagtgcaaaattactcattgcctacacgccacct

SEQ ID NO: 291970 - DNA, 75 bp, Artificial Sequence
  Synthetic
ggtttgggatattgggttacaatcaacagtagttctcaatattccctggacttcaggagttcaattcagatacac

SEQ ID NO: 291971 - DNA, 75 bp, Artificial Sequence
  Synthetic
gattatatgcaggaatcatgaggatctggttacagtcactgctacattggcactacttgggtgtgatggatcacc

SEQ ID NO: 291972 - DNA, 75 bp, Artificial Sequence
  Synthetic
ctggttacagtcactgctacattggcactacttgggtgtgatggatcaccttggaggtttctcaaaatgtatata

SEQ ID NO: 291973 - DNA, 75 bp, Artificial Sequence
  Synthetic
acagtagttctcaatattccctggacttcaggagttcaattcagatacacagacccagatacatataccagcgca

SEQ ID NO: 291974 - DNA, 75 bp, Artificial Sequence
  Synthetic
ggaacagacagtgtatatgcttggctttgttagtgcatgtccagattttaaattaagactcatgaaagacacaca

SEQ ID NO: 291975 - DNA, 75 bp, Artificial Sequence
  Synthetic
gttcagaaaatttaatgatgcttgcaatgcagctaaaggtctagagtggatagcaaacaagatttccaaactgat

SEQ ID NO: 291976 - DNA, 75 bp, Artificial Sequence
  Synthetic
aatgcagctaaaggtctagagtggatagcaaacaagatttccaaactgatagaatgggtaaagacaaagataatc

SEQ ID NO: 291977 - DNA, 75 bp, Artificial Sequence
  Synthetic
tttgttagtgcatgtccagattttaaattaagactcatgaaagacacacaatctatacaacaagaaacagcattg

SEQ ID NO: 291978 - DNA, 75 bp, Artificial Sequence
  Synthetic
ccagacattggcttctgtgaaaagtgattcaaaacacactcagaaagtacctgcgctcacagcaaatgagactgg

SEQ ID NO: 291979 - DNA, 75 bp, Artificial Sequence
  Synthetic
catcctagaaaggcaaattgcaacaatgcacgtttccaatccgacacaggagaaaagagaacaacttttcaacaa

SEQ ID NO: 291980 - DNA, 75 bp, Artificial Sequence
  Synthetic
atgcacgtttccaatccgacacaggagaaaagagaacaacttttcaacaatgtcctgtggttagagcaaatgtct

SEQ ID NO: 291981 - DNA, 75 bp, Artificial Sequence
  Synthetic
gattcaaaacacactcagaaagtacctgcgctcacagcaaatgagactggagccacactaccaacaacaccctca

SEQ ID NO: 291982 - DNA, 75 bp, Artificial Sequence
  Synthetic
aactctggaaaacttcctaggaagggctgcatgcgtgcatgtggtggaaattaagaataaacaagccactgatga

SEQ ID NO: 291983 - DNA, 75 bp, Artificial Sequence
  Synthetic
gaaaacaaagatagtgaactacatgcagttcaaatctaaacaaagaactgagccagtctgtgttttaatacacgg

SEQ ID NO: 291984 - DNA, 75 bp, Artificial Sequence
  Synthetic
cagttcaaatctaaacaaagaactgagccagtctgtgttttaatacacggctctccagggtcagggaaatcacta

SEQ ID NO: 291985 - DNA, 75 bp, Artificial Sequence
  Synthetic
gctgcatgcgtgcatgtggtggaaattaagaataaacaagccactgatgacactaatcataaaaagcagttgttg

SEQ ID NO: 291986 - DNA, 75 bp, Artificial Sequence
  Synthetic
attagaactgtttacttatgtcagatttgattcagagtataccataatagctaccagttctcaaccagaggatgc

SEQ ID NO: 291987 - DNA, 75 bp, Artificial Sequence
  Synthetic
ttactcacttcctccagacccaaaacattttgatgggtaccaacaacaagaagtagtgattatggatgatttaaa

SEQ ID NO: 291988 - DNA, 75 bp, Artificial Sequence
  Synthetic
cattttgatgggtaccaacaacaagaagtagtgattatggatgatttaaatcagaatcctgatggtcaagacatt

SEQ ID NO: 291989 - DNA, 75 bp, Artificial Sequence
  Synthetic
tttgattcagagtataccataatagctaccagttctcaaccagaggatgcaaactactcaagtaatcttactgtc

SEQ ID NO: 291990 - DNA, 75 bp, Artificial Sequence
  Synthetic
ttacacatggcaaagtgcaactaatcccagtgtgttctttaatgtaggaaagtctgccagattcagtgttcccta

SEQ ID NO: 291991 - DNA, 75 bp, Artificial Sequence
  Synthetic
cagtttagacaacaaagggatttcattcaccagtaactttgttcttgcatcaactaactcaaatacactcagccc

SEQ ID NO: 291992 - DNA, 75 bp, Artificial Sequence
  Synthetic
ttcaccagtaactttgttcttgcatcaactaactcaaatacactcagccctccaacaattttaaatccagaagca

SEQ ID NO: 291993 - DNA, 75 bp, Artificial Sequence
  Synthetic
cccagtgtgttctttaatgtaggaaagtctgccagattcagtgttccctatttaggaattgcttcagcatacaat

SEQ ID NO: 291994 - DNA, 75 bp, Artificial Sequence
  Synthetic
caatgtgttaaatcatatgggttctatagcattcagagtagttaatgagcatgacaagcacacaacacatgttaa

SEQ ID NO: 291995 - DNA, 75 bp, Artificial Sequence
  Synthetic
cactaaatctggaaagttaaatgtagcaatggcaacagagctctgcaaggactgttataagcccagcaacttcaa

SEQ ID NO: 291996 - DNA, 75 bp, Artificial Sequence
  Synthetic
gcaatggcaacagagctctgcaaggactgttataagcccagcaacttcaataaatgttgcccattgatatgtggc

SEQ ID NO: 291997 - DNA, 75 bp, Artificial Sequence
  Synthetic
atagcattcagagtagttaatgagcatgacaagcacacaacacatgttaagattcgggtttaccacagagcaaaa

SEQ ID NO: 291998 - DNA, 75 bp, Artificial Sequence
  Synthetic
tattggaagaacaaactatagtccaaaccctgatagtcctatcaaacccagagaaacaattaacacctacgggtt

SEQ ID NO: 291999 - DNA, 75 bp, Artificial Sequence
  Synthetic
ccagttagtcacagcaatcataactgacttcaacaacaagctgaaaattacagattctctggaagtcttgtttca

SEQ ID NO: 292000 - DNA, 75 bp, Artificial Sequence
  Synthetic
gacttcaacaacaagctgaaaattacagattctctggaagtcttgtttcagggtcctgtttacaaagatttagaa

SEQ ID NO: 292001 - DNA, 75 bp, Artificial Sequence
  Synthetic
aaccctgatagtcctatcaaacccagagaaacaattaacacctacgggttagggcccagatttgggggggttcac

SEQ ID NO: 292002 - DNA, 75 bp, Artificial Sequence
  Synthetic
cttgaggcttttaacacccatgcctgagagagatctagcaatagttgatgcaagggcccatggttctgagacagt

SEQ ID NO: 292003 - DNA, 75 bp, Artificial Sequence
  Synthetic
gtctgttgattctgaggaattgagagagtattgcaaacagaaaaattggcttattccagaaattccaaccaatat

SEQ ID NO: 292004 - DNA, 75 bp, Artificial Sequence
  Synthetic
gagtattgcaaacagaaaaattggcttattccagaaattccaaccaatatagaaagggcagtaaaccaggctagt

SEQ ID NO: 292005 - DNA, 75 bp, Artificial Sequence
  Synthetic
gagagagatctagcaatagttgatgcaagggcccatggttctgagacagtgccacaatgtaactgcacatctggt

SEQ ID NO: 292006 - DNA, 75 bp, Artificial Sequence
  Synthetic
accaacctgtgtatggatagaaggtaacaactattacccaagtagatatcagcagggagtcatgaagggtgttgg

SEQ ID NO: 292007 - DNA, 75 bp, Artificial Sequence
  Synthetic
tgtaatatacaaattatttgcacaaacacagggtccatactcaggcaatccctcacataccaagttaaaaccacc

SEQ ID NO: 292008 - DNA, 75 bp, Artificial Sequence
  Synthetic
acacagggtccatactcaggcaatccctcacataccaagttaaaaccacccactttgcggcaagtggtagttcaa

SEQ ID NO: 292009 - DNA, 75 bp, Artificial Sequence
  Synthetic
aacaactattacccaagtagatatcagcagggagtcatgaagggtgttggcccagcagaaccaggtgattgtggc

SEQ ID NO: 292010 - DNA, 75 bp, Artificial Sequence
  Synthetic
tagtgggtttgtgtgctttgctgacattagaatgctggaattattcaaagctgagtatcagggtatatcagatta

SEQ ID NO: 292011 - DNA, 75 bp, Artificial Sequence
  Synthetic
tattaccactaccaagggagaatttacagcactaggagtccatgacagggtttgtgtagtacccacacactcaca

SEQ ID NO: 292012 - DNA, 75 bp, Artificial Sequence
  Synthetic
acagcactaggagtccatgacagggtttgtgtagtacccacacactcacaacctgatgatgaagtcttagttaat

SEQ ID NO: 292013 - DNA, 75 bp, Artificial Sequence
  Synthetic
attagaatgctggaattattcaaagctgagtatcagggtatatcagattacattgttaatcttggcaaagccttt

SEQ ID NO: 292014 - DNA, 75 bp, Artificial Sequence
  Synthetic
tatctcaatgggctaccttaacactaaagtcttgtctaaaataatcaaaatagtttctgctttggtcatcatttg

SEQ ID NO: 292015 - DNA, 75 bp, Artificial Sequence
  Synthetic
taccaacttggaattgactatattgattttagatagaaatgaaaagtttagagatataagagcattcatagcaga

SEQ ID NO: 292016 - DNA, 75 bp, Artificial Sequence
  Synthetic
attttagatagaaatgaaaagtttagagatataagagcattcatagcagatgacccagagggaatggagggaact

SEQ ID NO: 292017 - DNA, 75 bp, Artificial Sequence
  Synthetic
aaagtcttgtctaaaataatcaaaatagtttctgctttggtcatcatttgcaggaatcatgatgacctaattaca

SEQ ID NO: 292018 - DNA, 75 bp, Artificial Sequence
  Synthetic
cctcaaaatgtacatcagtaaacatttttgcctaccctacatagaaagacaatcaaatgatttgtggttcaagaa

SEQ ID NO: 292019 - DNA, 75 bp, Artificial Sequence
  Synthetic
attaacttttgctggtctaataaacctcagtagcgttccaacaaatcgcatgatacgctacgaatacccaacaag

SEQ ID NO: 292020 - DNA, 75 bp, Artificial Sequence
  Synthetic
ctcagtagcgttccaacaaatcgcatgatacgctacgaatacccaacaagaacgggacaatgtggtggtgttcta

SEQ ID NO: 292021 - DNA, 75 bp, Artificial Sequence
  Synthetic
ttttgcctaccctacatagaaagacaatcaaatgatttgtggttcaagaaattcaatgacatgtgtaatgctgct

SEQ ID NO: 292022 - DNA, 75 bp, Artificial Sequence
  Synthetic
caaacaaaagattctacctcaagcaagagataagctggatttttgcaaaagacttaaacagttggatattctaga

SEQ ID NO: 292023 - DNA, 75 bp, Artificial Sequence
  Synthetic
gggtttttccgcgcagttgagaaagcaatactttgttgaaaaacaaggggcaattattaataaaagaaatgtaaa

SEQ ID NO: 292024 - DNA, 75 bp, Artificial Sequence
  Synthetic
caatactttgttgaaaaacaaggggcaattattaataaaagaaatgtaaaggaattaggtttgaaacccatcaac

SEQ ID NO: 292025 - DNA, 75 bp, Artificial Sequence
  Synthetic
aaggcagattgacacgctgcatgtgaatcaggttaatgataatgacagggaaacactatttaacaatgttttgtg

SEQ ID NO: 292026 - DNA, 75 bp, Artificial Sequence
  Synthetic
aggaacaaaggaaccagctgctttgaacgactccgaccccagactggaggttaacttgcgtgattctctgttctc

SEQ ID NO: 292027 - DNA, 75 bp, Artificial Sequence
  Synthetic
aacgactccgaccccagactggaggttaacttgcgtgattctctgttctcaaagtacaaagggaatgtggaaatt

SEQ ID NO: 292028 - DNA, 75 bp, Artificial Sequence
  Synthetic
actgtcgctggacatacctacaaatgaattatcacttaaggaagctttgtatggaacagatggcttggaaccaat

SEQ ID NO: 292029 - DNA, 75 bp, Artificial Sequence
  Synthetic
ttaattggcagggctattgctgataattacaactcatctgtctactcattaccaccagaccctaaacattttgat

SEQ ID NO: 292030 - DNA, 75 bp, Artificial Sequence
  Synthetic
gaattatcacttaaggaagctttgtatggaacagatggcttggaaccaatcgatatcaacaccagtgctggttat

SEQ ID NO: 292031 - DNA, 75 bp, Artificial Sequence
  Synthetic
attacaactcatctgtctactcattaccaccagaccctaaacattttgatggatatcagcaacaagcagtcgtca

SEQ ID NO: 292032 - DNA, 75 bp, Artificial Sequence
  Synthetic
tcaagatattgctaaaatggaacattatctggacaagtatggtattgatctgccactagttacatacataaaaga

SEQ ID NO: 292033 - DNA, 75 bp, Artificial Sequence
  Synthetic
tgtcaaatggtttcatcagttgacttcatcccacctatggcaaacttagacaataaaggaatgctattcacaagc

SEQ ID NO: 292034 - DNA, 75 bp, Artificial Sequence
  Synthetic
tatctggacaagtatggtattgatctgccactagttacatacataaaagatgaactcagaagtaaagataaggtt

SEQ ID NO: 292035 - DNA, 75 bp, Artificial Sequence
  Synthetic
tcatcccacctatggcaaacttagacaataaaggaatgctattcacaagcagctttgttctggcttccacaaact

SEQ ID NO: 292036 - DNA, 75 bp, Artificial Sequence
  Synthetic
gaacatgagagtgaaattaggtaacctatataaggcttttcacacaaatcctggagtgataactggttcagcagt

SEQ ID NO: 292037 - DNA, 75 bp, Artificial Sequence
  Synthetic
agatttggttttgatttagatatgtgtctccacaccacattcaccagatctggaaaattgaacgctgcattagca

SEQ ID NO: 292038 - DNA, 75 bp, Artificial Sequence
  Synthetic
ctatataaggcttttcacacaaatcctggagtgataactggttcagcagtggggtgcgatccagacacattttgg

SEQ ID NO: 292039 - DNA, 75 bp, Artificial Sequence
  Synthetic
gtctccacaccacattcaccagatctggaaaattgaacgctgcattagcatcagaattgtgtaaggactgtcaca

SEQ ID NO: 292040 - DNA, 75 bp, Artificial Sequence
  Synthetic
aaactttgatgcctctctatctccagtgtggtttaagtgtcttgaacaagtgctttccaaacttgggttcaagca

SEQ ID NO: 292041 - DNA, 75 bp, Artificial Sequence
  Synthetic
agtttagttgatagacacacaaatgttaggtacagtatagaccaattagttacagcaataatcactgagcatgta

SEQ ID NO: 292042 - DNA, 75 bp, Artificial Sequence
  Synthetic
gtgtggtttaagtgtcttgaacaagtgctttccaaacttgggttcaagcactccaatttgatccagacaatatgt

SEQ ID NO: 292043 - DNA, 75 bp, Artificial Sequence
  Synthetic
ttaggtacagtatagaccaattagttacagcaataatcactgagcatgtaaacaagaccaaaatatcaaattcat

SEQ ID NO: 292044 - DNA, 75 bp, Artificial Sequence
  Synthetic
gccatcagggtgttcgggcactagtgtttttaattcaatgataaacaatataatcattagaacattaatattaga

SEQ ID NO: 292045 - DNA, 75 bp, Artificial Sequence
  Synthetic
acaacaacaccaccaccagaatgtattgtagatttactcaaatcagtagataatgaagaggttaggcaatactgt

SEQ ID NO: 292046 - DNA, 75 bp, Artificial Sequence
  Synthetic
gtttttaattcaatgataaacaatataatcattagaacattaatattagatgtctacaaaggaattgaccttgac

SEQ ID NO: 292047 - DNA, 75 bp, Artificial Sequence
  Synthetic
ttgtagatttactcaaatcagtagataatgaagaggttaggcaatactgtcaagaaaagaaatggctcattccag

SEQ ID NO: 292048 - DNA, 75 bp, Artificial Sequence
  Synthetic
tgaactgcaaccagaattactagcactcgctggtaaaaaatatggtctgacaatcacacccccagataaatcaga

SEQ ID NO: 292049 - DNA, 75 bp, Artificial Sequence
  Synthetic
aatactatactgatgttcatcactactcttggcataatctatatgatttataagctctttgcacaaactcaaggc

SEQ ID NO: 292050 - DNA, 75 bp, Artificial Sequence
  Synthetic
ctcgctggtaaaaaatatggtctgacaatcacacccccagataaatcagagaaatttgtgaaaacaacatgggag

SEQ ID NO: 292051 - DNA, 75 bp, Artificial Sequence
  Synthetic
ctcttggcataatctatatgatttataagctctttgcacaaactcaaggcccatattctggtttggatgggaaat

SEQ ID NO: 292052 - DNA, 75 bp, Artificial Sequence
  Synthetic
tctcatccatccagtgatgccaatgcaagacattcatgaatccatccgatggacgcgcgatccaaaaaacacaca

SEQ ID NO: 292053 - DNA, 75 bp, Artificial Sequence
  Synthetic
acagaatttgctttatccctactcaggaagaatatagtaaccgttactactagtaaaggtgaattcactggcctt

SEQ ID NO: 292054 - DNA, 75 bp, Artificial Sequence
  Synthetic
caagacattcatgaatccatccgatggacgcgcgatccaaaaaacacacaggatcatgtgcgttctctgtgtatg

SEQ ID NO: 292055 - DNA, 75 bp, Artificial Sequence
  Synthetic
ggaagaatatagtaaccgttactactagtaaaggtgaattcactggccttggtatttatgacaggattttagtta

SEQ ID NO: 292056 - DNA, 75 bp, Artificial Sequence
  Synthetic
aagatcaaccaacatcggtaaatgcctgctgataccggaatatagtgtcctgcgccggcggtggttggatctgtt

SEQ ID NO: 292057 - DNA, 75 bp, Artificial Sequence
  Synthetic
actaatgtcaaagataaatggaagttagttgatccagacaacctaaatttggaaataactgtcattgagctggac

SEQ ID NO: 292058 - DNA, 75 bp, Artificial Sequence
  Synthetic
tagttgatccagacaacctaaatttggaaataactgtcattgagctggacagaaatgagaaatttagagatatca

SEQ ID NO: 292059 - DNA, 75 bp, Artificial Sequence
  Synthetic
ttaaaacagcgggtgggtatcccaccacccgacccactgggtgtagtacactggtattttgtacctttgtatgcc

SEQ ID NO: 292060 - DNA, 75 bp, Artificial Sequence
  Synthetic
cacccgacccactgggtgtagtacactggtattttgtacctttgtatgcctgtttgccatccctccctctcctct

SEQ ID NO: 292061 - DNA, 75 bp, Artificial Sequence
  Synthetic
ctgctgataccggaatatagtgtcctgcgccggcggtggttggatctgttctaaataatatagatttatgatttg

SEQ ID NO: 292062 - DNA, 75 bp, Artificial Sequence
  Synthetic
aactcaaataattttaaagatactatactcacagttggaacaactactttagcaggtattatcaatcttagtaat

SEQ ID NO: 292063 - DNA, 75 bp, Artificial Sequence
  Synthetic
tactcacagttggaacaactactttagcaggtattatcaatcttagtaatacaccaactgctagaatgatcagat

SEQ ID NO: 292064 - DNA, 75 bp, Artificial Sequence
  Synthetic
aatagggtataccacatccagtggtatgaagcacaagcaattcttgttccccggagctggatataaactgctaac

SEQ ID NO: 292065 - DNA, 75 bp, Artificial Sequence
  Synthetic
atgaagcacaagcaattcttgttccccggagctggatataaactgctaacgtggttgaaagtccttaaccgttat

SEQ ID NO: 292066 - DNA, 75 bp, Artificial Sequence
  Synthetic
ggtaagatctatggtatacatgtggggggaaatggaagacagggtttttcagcacaactgaagaagcagtatttt

SEQ ID NO: 292067 - DNA, 75 bp, Artificial Sequence
  Synthetic
ggggaaatggaagacagggtttttcagcacaactgaagaagcagtattttgtgcaaaaacaaggtgaaattattc

SEQ ID NO: 292068 - DNA, 75 bp, Artificial Sequence
  Synthetic
ttcgatcaggtggataccccattcactagtttggtcgatgaggctgggaatcccccacaggtaactgtgtctcag

SEQ ID NO: 292069 - DNA, 75 bp, Artificial Sequence
  Synthetic
ctagtttggtcgatgaggctgggaatcccccacaggtaactgtgtctcagcctgcgtggcggccaacccagcttt

SEQ ID NO: 292070 - DNA, 75 bp, Artificial Sequence
  Synthetic
aaaaccaaattgcacccgagtgttttctacaatgtttttccaggcaccaaggaaccagcaattttacaccctagt

SEQ ID NO: 292071 - DNA, 75 bp, Artificial Sequence
  Synthetic
tctacaatgtttttccaggcaccaaggaaccagcaattttacaccctagtgatagtagattggaagtagactttg

SEQ ID NO: 292072 - DNA, 75 bp, Artificial Sequence
  Synthetic
ctgtgagtcctccggcccctgaatgcggctaacctcaaccccggagccttgtggtgtaaaccaacactcgcaagg

SEQ ID NO: 292073 - DNA, 75 bp, Artificial Sequence
  Synthetic
cggctaacctcaaccccggagccttgtggtgtaaaccaacactcgcaaggtcgtaacgagtaattctgggacggg

SEQ ID NO: 292074 - DNA, 75 bp, Artificial Sequence
  Synthetic
gataacatgagagtcgcaattgaccattactctggtcaattgttgtcactggatatccccactcaggagcttacc

SEQ ID NO: 292075 - DNA, 75 bp, Artificial Sequence
  Synthetic
attactctggtcaattgttgtcactggatatccccactcaggagcttacccttaaggaagcactttatggaacag

SEQ ID NO: 292076 - DNA, 75 bp, Artificial Sequence
  Synthetic
ctatggttacaaatttactgtaatcatgggtgcacaggtttcaactcagaaaagcggttctcatgaaaatcagaa

SEQ ID NO: 292077 - DNA, 75 bp, Artificial Sequence
  Synthetic
atgggtgcacaggtttcaactcagaaaagcggttctcatgaaaatcagaacattcttaccaacggctcaaatcaa

SEQ ID NO: 292078 - DNA, 75 bp, Artificial Sequence
  Synthetic
agtctaggaatcaataaaaagtccatcttgaacagagaaacaaaggaagttgccaagatgcaagagtgcttaagc

SEQ ID NO: 292079 - DNA, 75 bp, Artificial Sequence
  Synthetic
tcttgaacagagaaacaaaggaagttgccaagatgcaagagtgcttaagcaaatatggaattgacctccccctaa

SEQ ID NO: 292080 - DNA, 75 bp, Artificial Sequence
  Synthetic
tggacaatcattatcaatggatccaagcaagtttactgaaccagtaaaggacatcatgttaaaaggtgcaccagc

SEQ ID NO: 292081 - DNA, 75 bp, Artificial Sequence
  Synthetic
agcaagtttactgaaccagtaaaggacatcatgttaaaaggtgcaccagcactaaattcacctaatatagaagct

SEQ ID NO: 292082 - DNA, 75 bp, Artificial Sequence
  Synthetic
aaaagcagattaatcgaggcatccagtttgaatgattcagtaaatatgagagtgaagttgggtaacttgtacaaa

SEQ ID NO: 292083 - DNA, 75 bp, Artificial Sequence
  Synthetic
gtttgaatgattcagtaaatatgagagtgaagttgggtaacttgtacaaagcatttcataaaaatccaggtgtgt

SEQ ID NO: 292084 - DNA, 75 bp, Artificial Sequence
  Synthetic
taccactcaagaagcagcaaacacagttgttgcttatggagaatggccttcttttctatcagacaatgatgctag

SEQ ID NO: 292085 - DNA, 75 bp, Artificial Sequence
  Synthetic
gttgttgcttatggagaatggccttcttttctatcagacaatgatgctagtgatgttaataaaactaccaaacca

SEQ ID NO: 292086 - DNA, 75 bp, Artificial Sequence
  Synthetic
ccttgcctgttagacggagaattaatagcttttgattattcaaattttgatgcaagcttatctccagtgtggttt

SEQ ID NO: 292087 - DNA, 75 bp, Artificial Sequence
  Synthetic
tagcttttgattattcaaattttgatgcaagcttatctccagtgtggtttaattgtttagaaattgtgttagaaa

SEQ ID NO: 292088 - DNA, 75 bp, Artificial Sequence
  Synthetic
ggattcaaaaggctggtgttggaaattaccagatgcacttaaagacatgggcattttcggtcaaaacatgtttta

SEQ ID NO: 292089 - DNA, 75 bp, Artificial Sequence
  Synthetic
ttaccagatgcacttaaagacatgggcattttcggtcaaaacatgttttaccactcacaaggtaggaccggatac

SEQ ID NO: 292090 - DNA, 75 bp, Artificial Sequence
  Synthetic
cacattttcagggaccaaatttatgtagtagagggcggcatgccatcagggtgttcaggaacatctatcttcaac

SEQ ID NO: 292091 - DNA, 75 bp, Artificial Sequence
  Synthetic
tagtagagggcggcatgccatcagggtgttcaggaacatctatcttcaactctatgattaacaatataattatta

SEQ ID NO: 292092 - DNA, 75 bp, Artificial Sequence
  Synthetic
agttgtggtcatacccgaacaccaacttgcatctatagagggagcaaacgtgtcagttctatatgacaaaactca

SEQ ID NO: 292093 - DNA, 75 bp, Artificial Sequence
  Synthetic
cttgcatctatagagggagcaaacgtgtcagttctatatgacaaaactcaccctggtgaacagggtatagacctc

SEQ ID NO: 292094 - DNA, 75 bp, Artificial Sequence
  Synthetic
atcatagcatatggtgatgatgttattatctcataccccttcactttggactcagaagccattgccaaacaggga

SEQ ID NO: 292095 - DNA, 75 bp, Artificial Sequence
  Synthetic
ttatctcataccccttcactttggactcagaagccattgccaaacagggaagcaaatatggtttgacaatcacac

SEQ ID NO: 292096 - DNA, 75 bp, Artificial Sequence
  Synthetic
tggcacattaattggcaatagtctcatattcccacaccagttcataaatctgagaactaataacacagcaacaat

SEQ ID NO: 292097 - DNA, 75 bp, Artificial Sequence
  Synthetic
atattcccacaccagttcataaatctgagaactaataacacagcaacaatagtaataccctatattaactcagtg

SEQ ID NO: 292098 - DNA, 75 bp, Artificial Sequence
  Synthetic
tttttgaaaaggtatttcaaaccagatccagatttcccatttttaatacatccagtaatgccaatggctgatata

SEQ ID NO: 292099 - DNA, 75 bp, Artificial Sequence
  Synthetic
atccagatttcccatttttaatacatccagtaatgccaatggctgatatacatgaatccattaggtggactaaag

SEQ ID NO: 292100 - DNA, 75 bp, Artificial Sequence
  Synthetic
agttgtcaatattactgcaactagtggaacttctccttcaataccagtaacagtaaccattgcccctatgttctt

SEQ ID NO: 292101 - DNA, 75 bp, Artificial Sequence
  Synthetic
ggaacttctccttcaataccagtaacagtaaccattgcccctatgttcttagaattgtctggcatacgctcaaaa

SEQ ID NO: 292102 - DNA, 75 bp, Artificial Sequence
  Synthetic
cactcgggtgaacaagagtataacaagtttgtagaaggaattagaagtacagaaattggcaaagtcttagtgata

SEQ ID NO: 292103 - DNA, 75 bp, Artificial Sequence
  Synthetic
tttaacaacagatgacaggcaatcacctagtgctatgcctaactatgagccaacacccttaatccacattccagg

SEQ ID NO: 292104 - DNA, 75 bp, Artificial Sequence
  Synthetic
ccatcttactcagtcttaaggcgcaggtggctagacttgttttaatcctttcttgtatatatatagagtactaat

SEQ ID NO: 292105 - DNA, 75 bp, Artificial Sequence
  Synthetic
cctagtgctatgcctaactatgagccaacacccttaatccacattccaggtgaggtcaagaacttgcttgaaatt

SEQ ID NO: 292106 - DNA, 75 bp, Artificial Sequence
  Synthetic
ccatccgacccactgggtgtagtactctggtattatgtacctttgtacgcctgtttattcccaaaccccctcccg

SEQ ID NO: 292107 - DNA, 75 bp, Artificial Sequence
  Synthetic
tttagacatgtatagaattccactcatgcaaaataaacaaggtgaacaagtttttggattcagactttacctggg

SEQ ID NO: 292108 - DNA, 75 bp, Artificial Sequence
  Synthetic
atgcaaaataaacaaggtgaacaagtttttggattcagactttacctgggagatggtgtcctgaaaacaacattg

SEQ ID NO: 292109 - DNA, 75 bp, Artificial Sequence
  Synthetic
taggaggcaccatatccaatggtgtaatgtacgagcacttctgtttccccggagcgaggtataggtggtacccac

SEQ ID NO: 292110 - DNA, 75 bp, Artificial Sequence
  Synthetic
aatgtacgagcacttctgtttccccggagcgaggtataggtggtacccaccgctgaaagcctttaaccgttatcc

SEQ ID NO: 292111 - DNA, 75 bp, Artificial Sequence
  Synthetic
atcctttatgtatactgggcctgcattatcaagtgctagattactcatagcttacacacccccaggtgcacaggg

SEQ ID NO: 292112 - DNA, 75 bp, Artificial Sequence
  Synthetic
ttatcaagtgctagattactcatagcttacacacccccaggtgcacagggaccaacaaaacgcaaagacgcaatg

SEQ ID NO: 292113 - DNA, 75 bp, Artificial Sequence
  Synthetic
tgcgtggcggccaacccagctcatgctgggacgccctttcaatgacatggtgtgaagactcgcatgtgcttgatt

SEQ ID NO: 292114 - DNA, 75 bp, Artificial Sequence
  Synthetic
aaatataccttggacatcaggtgtgcagttcagatatacagatccagatacctacaccagtgctggatttgtgtc

SEQ ID NO: 292115 - DNA, 75 bp, Artificial Sequence
  Synthetic
cagttcagatatacagatccagatacctacaccagtgctggatttgtgtcatgctggtatcaaacctcattagtg

SEQ ID NO: 292116 - DNA, 75 bp, Artificial Sequence
  Synthetic
ttgtcctgactttaaacttagattaatgaaagacacacaatcaatttatcaggacacagcattaactgagggttt

SEQ ID NO: 292117 - DNA, 75 bp, Artificial Sequence
  Synthetic
atgaaagacacacaatcaatttatcaggacacagcattaactgagggtttggaagaagatttggtagaagtcatt

SEQ ID NO: 292118 - DNA, 75 bp, Artificial Sequence
  Synthetic
tacacagaaggtgcctgcattaactgccaacgaaacaggtgcaacattgccaacaaaaccatcagacagcgtgga

SEQ ID NO: 292119 - DNA, 75 bp, Artificial Sequence
  Synthetic
gccaacgaaacaggtgcaacattgccaacaaaaccatcagacagcgtggaaacaaggacaacacttatgcattac

SEQ ID NO: 292120 - DNA, 75 bp, Artificial Sequence
  Synthetic
tcatgtggtagaaatcagaaacaagcgaccaactgatgagatagaacataagaaggaccttttgttcaatgattg

SEQ ID NO: 292121 - DNA, 75 bp, Artificial Sequence
  Synthetic
cgaccaactgatgagatagaacataagaaggaccttttgttcaatgattggaaaataaatttatctagtttagta

SEQ ID NO: 292122 - DNA, 75 bp, Artificial Sequence
  Synthetic
atataccataatagccaccagttcacagcccgatggtgcaaaatactccagtaatcttaccattcaagcaatgtt

SEQ ID NO: 292123 - DNA, 75 bp, Artificial Sequence
  Synthetic
cagcccgatggtgcaaaatactccagtaatcttaccattcaagcaatgttcatcccacctggcgcacccaacccc

SEQ ID NO: 292124 - DNA, 75 bp, Artificial Sequence
  Synthetic
ctttaatgtagggaaaacagctaggtttagtgtgccctatttaggaatagcctcagcatataactgcttctatga

SEQ ID NO: 292125 - DNA, 75 bp, Artificial Sequence
  Synthetic
ctttaatgtagggaaaacagctaggtttagtgtgccctatttaggaatagcctcagcatatatctgcttctatga

SEQ ID NO: 292126 - DNA, 75 bp, Artificial Sequence
  Synthetic
ctttaatgtagggaaaacagctaggtttagtgtgccctatttaggaatagcctcagcatatacctgcttctatga

SEQ ID NO: 292127 - DNA, 75 bp, Artificial Sequence
  Synthetic
ctttaatgtagggaaaacagctaggtttagtgtgccctatttaggaatagcctcagcatatagctgcttctatga

SEQ ID NO: 292128 - DNA, 75 bp, Artificial Sequence
  Synthetic
tttagtgtgccctatttaggaatagcctcagcatataactgcttctatgatgggtattcccatgatgatccaaac

SEQ ID NO: 292129 - DNA, 75 bp, Artificial Sequence
  Synthetic
tttagtgtgccctatttaggaatagcctcagcatatatctgcttctatgatgggtattcccatgatgatccaaac

SEQ ID NO: 292130 - DNA, 75 bp, Artificial Sequence
  Synthetic
tttagtgtgccctatttaggaatagcctcagcatatacctgcttctatgatgggtattcccatgatgatccaaac

SEQ ID NO: 292131 - DNA, 75 bp, Artificial Sequence
  Synthetic
tttagtgtgccctatttaggaatagcctcagcatatagctgcttctatgatgggtattcccatgatgatccaaac

SEQ ID NO: 292132 - DNA, 75 bp, Artificial Sequence
  Synthetic
agtagttaatgaacatgacacacacaccacatatgttaaaataagagtctatcacagagctaaacatataagagc

SEQ ID NO: 292133 - DNA, 75 bp, Artificial Sequence
  Synthetic
accacatatgttaaaataagagtctatcacagagctaaacatataagagcatggattcctagagcacccagagct

SEQ ID NO: 292134 - DNA, 75 bp, Artificial Sequence
  Synthetic
ccccattaaaaccagagactccataagtacttatggcttgggacctagatttggtggtgtgtgtactggaaatgt

SEQ ID NO: 292135 - DNA, 75 bp, Artificial Sequence
  Synthetic
agtacttatggcttgggacctagatttggtggtgtgtgtactggaaatgttaaaataatgaattaccatctaatg

SEQ ID NO: 292136 - DNA, 75 bp, Artificial Sequence
  Synthetic
agcagtggtgagtctacaaggacatggttcagaaacagtaccacaatgcaaatgcacttctggagtttattattc

SEQ ID NO: 292137 - DNA, 75 bp, Artificial Sequence
  Synthetic
ggttcagaaacagtaccacaatgcaaatgcacttctggagtttattattctaggtattataacaagttttaccca

SEQ ID NO: 292138 - DNA, 75 bp, Artificial Sequence
  Synthetic
tcctagtagatatcaacagggagtaatgaaaggtatgggtccagctgagccaggtgattgtggtggtatattgag

SEQ ID NO: 292139 - DNA, 75 bp, Artificial Sequence
  Synthetic
atgaaaggtatgggtccagctgagccaggtgattgtggtggtatattgagatgcacacatggcccaattggactc

SEQ ID NO: 292140 - DNA, 75 bp, Artificial Sequence
  Synthetic
tgacatgtttgaagcagaatatcaaggtatttcagattatatattaaatttaggtaaagcttttggaactgggtt

SEQ ID NO: 292141 - DNA, 75 bp, Artificial Sequence
  Synthetic
ggtatttcagattatatattaaatttaggtaaagcttttggaactgggttcacagaacacatcagtgaaaaagtc

SEQ ID NO: 292142 - DNA, 75 bp, Artificial Sequence
  Synthetic
taaaatagtgaagattgtttcagcactagtcatcatatgcagaaatcatgatgatttaataactgtcacagccac

SEQ ID NO: 292143 - DNA, 75 bp, Artificial Sequence
  Synthetic
ctagtcatcatatgcagaaatcatgatgatttaataactgtcacagccacattagcactattggggtgtgatgga

SEQ ID NO: 292144 - DNA, 75 bp, Artificial Sequence
  Synthetic
atacatagaaagacaatcaaatgatttatggttcaaaaaattcaatgacatgtgtaacgcagcaaaaggtttgga

SEQ ID NO: 292145 - DNA, 75 bp, Artificial Sequence
  Synthetic
ttatggttcaaaaaattcaatgacatgtgtaacgcagcaaaaggtttggagtggattgcaaataaaatatccaaa

SEQ ID NO: 292146 - DNA, 75 bp, Artificial Sequence
  Synthetic
tgacttctgtaaaagattaaaacaactggacgtactggaaagacagatagatacactgcacatgaatcaggttag

SEQ ID NO: 292147 - DNA, 75 bp, Artificial Sequence
  Synthetic
ctggacgtactggaaagacagatagatacactgcacatgaatcaggttagtgataatgatagagaaacactattc

SEQ ID NO: 292148 - DNA, 75 bp, Artificial Sequence
  Synthetic
tgcagttgaagccaaaagaatcagagtgcttaaaaataaaatgacaaattttatccagttcagatcaaaacatcg

SEQ ID NO: 292149 - DNA, 75 bp, Artificial Sequence
  Synthetic
gtgcttaaaaataaaatgacaaattttatccagttcagatcaaaacatcgcactgagccagtatgtgttttgata

SEQ ID NO: 292150 - DNA, 75 bp, Artificial Sequence
  Synthetic
agcaattgcagatagttgtggttcttctgtatactcactccctccagatccaaaacattttgatggctatcaaca

SEQ ID NO: 292151 - DNA, 75 bp, Artificial Sequence
  Synthetic
tctgtatactcactccctccagatccaaaacattttgatggctatcaacaacaagctgtagttattttagatgac

SEQ ID NO: 292152 - DNA, 75 bp, Artificial Sequence
  Synthetic
atcatcagttgacttcattccaccaatggctaacttggataataagggcatgttattcaccagtaattatgtatt

SEQ ID NO: 292153 - DNA, 75 bp, Artificial Sequence
  Synthetic
atggctaacttggataataagggcatgttattcaccagtaattatgtattagcatccacaaactctcaaacacta

SEQ ID NO: 292154 - DNA, 75 bp, Artificial Sequence
  Synthetic
tgatttagacatgtgtttgcacaccacatacacaagatcagggaaattgaatgctgctttagcatcagaattatg

SEQ ID NO: 292155 - DNA, 75 bp, Artificial Sequence
  Synthetic
acatacacaagatcagggaaattgaatgctgctttagcatcagaattatgcaaagattgccataaaccaacaaat

SEQ ID NO: 292156 - DNA, 75 bp, Artificial Sequence
  Synthetic
taggcgcacaaatgttaggtatagtatagatcaattagtcacagcaatcataactgaacatgcaaacaaaacaaa

SEQ ID NO: 292157 - DNA, 75 bp, Artificial Sequence
  Synthetic
atagatcaattagtcacagcaatcataactgaacatgcaaacaaaacaaaaatttctagctcattagaggtgctg

SEQ ID NO: 292158 - DNA, 75 bp, Artificial Sequence
  Synthetic
acctccagaatgtattgtagatttgctcaaatctgtagacaatgaagaagttaggcagtattgtcaggaaaagaa

SEQ ID NO: 292159 - DNA, 75 bp, Artificial Sequence
  Synthetic
ctcaaatctgtagacaatgaagaagttaggcagtattgtcaggaaaagaaatggctcatcccagagattcccacc

SEQ ID NO: 292160 - DNA, 75 bp, Artificial Sequence
  Synthetic
tatgtttattaccacacttggcatagtttacatgatttacaaactctttgcacagacccaagggccatactcagg

SEQ ID NO: 292161 - DNA, 75 bp, Artificial Sequence
  Synthetic
gtttacatgatttacaaactctttgcacagacccaagggccatactcaggtcttgatagtaagtcaaaattgaaa

SEQ ID NO: 292162 - DNA, 75 bp, Artificial Sequence
  Synthetic
actttccttacttaggaagaatatagtaacagtaactactaacaaaggagaattcacaggattgggtatatatga

SEQ ID NO: 292163 - DNA, 75 bp, Artificial Sequence
  Synthetic
gtaacagtaactactaacaaaggagaattcacaggattgggtatatatgacaaaattttagtcgtgccaactcat

SEQ ID NO: 292164 - DNA, 75 bp, Artificial Sequence
  Synthetic
agataagtggaagctagtagatcctgacaatttaaatctggaaataactgttcttgaattggataggaatgaaaa

SEQ ID NO: 292165 - DNA, 75 bp, Artificial Sequence
  Synthetic
gacaatttaaatctggaaataactgttcttgaattggataggaatgaaaaattcagagacattagaatgttcatt

SEQ ID NO: 292166 - DNA, 75 bp, Artificial Sequence
  Synthetic
tttcaaggataccatactgtcagttggatcaacaacattagctggaattataaatctaagtagcacacccactgc

SEQ ID NO: 292167 - DNA, 75 bp, Artificial Sequence
  Synthetic
ggatcaacaacattagctggaattataaatctaagtagcacacccactgcacgaatgatacgctatgatttccca

SEQ ID NO: 292168 - DNA, 75 bp, Artificial Sequence
  Synthetic
tggtatacatgtgggtggtaatgggagacaaggcttttcagcacaactcaagaaacaatattttgtgcaaaaaca

SEQ ID NO: 292169 - DNA, 75 bp, Artificial Sequence
  Synthetic
agacaaggcttttcagcacaactcaagaaacaatattttgtgcaaaaacaaggagaaattgtaacaaaaaggaat

SEQ ID NO: 292170 - DNA, 75 bp, Artificial Sequence
  Synthetic
acaccccagtgttttttttaatgtttttccaggcagcaaagaaccagcagttctacatccttctgatgaacgact

SEQ ID NO: 292171 - DNA, 75 bp, Artificial Sequence
  Synthetic
tttccaggcagcaaagaaccagcagttctacatccttctgatgaacgactggaagtgatctttgaggattcatta

SEQ ID NO: 292172 - DNA, 75 bp, Artificial Sequence
  Synthetic
agttgctgttgatcattatgctggacaactcttatcccttgatattccaacacaagaactcacgctcaaagaagc

SEQ ID NO: 292173 - DNA, 75 bp, Artificial Sequence
  Synthetic
caactcttatcccttgatattccaacacaagaactcacgctcaaagaagccctttatggtacagatggcttggag

SEQ ID NO: 292174 - DNA, 75 bp, Artificial Sequence
  Synthetic
taagaagagatcaatcctcaacaaagaaaccaaggatacaacaaaaatggaggaatgtttaagcaaatatggaat

SEQ ID NO: 292175 - DNA, 75 bp, Artificial Sequence
  Synthetic
gaaaccaaggatacaacaaaaatggaggaatgtttaagcaaatatggaattgatcttcctttggtgacatacatt

SEQ ID NO: 292176 - DNA, 75 bp, Artificial Sequence
  Synthetic
gatagaagcatcaagtttaaatgattcagtaaatatgagggtgaaactaggtaacttgtacaaggcctttcattt

SEQ ID NO: 292177 - DNA, 75 bp, Artificial Sequence
  Synthetic
tcagtaaatatgagggtgaaactaggtaacttgtacaaggcctttcatttaaatcctggaatattaactggctct

SEQ ID NO: 292178 - DNA, 75 bp, Artificial Sequence
  Synthetic
ggatggagagttaattgcctttgattactcaaattttgatgccagtctttccccagtatggtttgaatgtttgga

SEQ ID NO: 292179 - DNA, 75 bp, Artificial Sequence
  Synthetic
tactcaaattttgatgccagtctttccccagtatggtttgaatgtttggaaaaagtcttaagtaaaataggattt

SEQ ID NO: 292180 - DNA, 75 bp, Artificial Sequence
  Synthetic
agaccaaatctacacagtagaaggtggaatgccttcaggttgctcagggacaagcatttttaactcaatgatcaa

SEQ ID NO: 292181 - DNA, 75 bp, Artificial Sequence
  Synthetic
ggaatgccttcaggttgctcagggacaagcatttttaactcaatgatcaacaatattataattaggaccctaata

SEQ ID NO: 292182 - DNA, 75 bp, Artificial Sequence
  Synthetic
tggtgatgatgtcattgtgtcatatcctttctctttagatccagaaagaattgcaaggcaaggaagtacctatgg

SEQ ID NO: 292183 - DNA, 75 bp, Artificial Sequence
  Synthetic
cctttctctttagatccagaaagaattgcaaggcaaggaagtacctatggtctgaccattacaccaccagataaa

SEQ ID NO: 292184 - DNA, 75 bp, Artificial Sequence
  Synthetic
acatttcaaaccagatagtgaatttccatttcttatacatccagtaatgccaatgtcagacatttatgagtccat

SEQ ID NO: 292185 - DNA, 75 bp, Artificial Sequence
  Synthetic
ccatttcttatacatccagtaatgccaatgtcagacatttatgagtccatcagatggacaaaagatcccaagaat

SEQ ID NO: 292186 - DNA, 75 bp, Artificial Sequence
  Synthetic
gagtgaatacaataagtttgtcgatggcatcagaagcacagacatcggcagagtattgctaataccctcttattc

SEQ ID NO: 292187 - DNA, 75 bp, Artificial Sequence
  Synthetic
tgtccttagacgtagatggcttgatttgttttaaataaactatatatagagtataaatttagtgtagtgaatttt

SEQ ID NO: 292188 - DNA, 75 bp, Artificial Sequence
  Synthetic
catccgacccactgggtgtagtactctggtactttgtacctttgtacgcctgtttctccctcccttcccaaccta

SEQ ID NO: 292189 - DNA, 75 bp, Artificial Sequence
  Synthetic
tgcaaccagcaatagtcagtgcaagcacttctgtttccccggagcggagtgtagatggccaccgctgtcaaaagc

SEQ ID NO: 292190 - DNA, 75 bp, Artificial Sequence
  Synthetic
cacttctgtttccccggagcggagtgtagatggccaccgctgtcaaaagctcttaaccgttatccgccagttaac

SEQ ID NO: 292191 - DNA, 75 bp, Artificial Sequence
  Synthetic
agatttaccccctcgctagtctggtcgatgaggctgagaattccccacgggcgaccgtgtctcagcctgcgtggc

SEQ ID NO: 292192 - DNA, 75 bp, Artificial Sequence
  Synthetic
cgatgaggctgagaattccccacgggcgaccgtgtctcagcctgcgtggcggccagcccagcctttgctgggacg

SEQ ID NO: 292193 - DNA, 75 bp, Artificial Sequence
  Synthetic
tccggcccctgaatgcggctaacctaaaccctggagccttgaaacacaacccagtgttcgcaaggtcgtaacgag

SEQ ID NO: 292194 - DNA, 75 bp, Artificial Sequence
  Synthetic
aaaccctggagccttgaaacacaacccagtgttcgcaaggtcgtaacgagcaattccgggacgggaccgactact

SEQ ID NO: 292195 - DNA, 75 bp, Artificial Sequence
  Synthetic
ataagtgttatattgtgatcatgggtgcacaagtgtctacacaaaagagcggttcacatgagaatcaaaacatcc

SEQ ID NO: 292196 - DNA, 75 bp, Artificial Sequence
  Synthetic
tgcacaagtgtctacacaaaagagcggttcacatgagaatcaaaacatcctgacaaacggttcaacacaacactt

SEQ ID NO: 292197 - DNA, 75 bp, Artificial Sequence
  Synthetic
agtctttttcaatggatccatcaaagtttactgagcctgtaaaggatatcatgttgaagggtgcacctgctctga

SEQ ID NO: 292198 - DNA, 75 bp, Artificial Sequence
  Synthetic
gtttactgagcctgtaaaggatatcatgttgaagggtgcacctgctctgaactccccaaatgttgaagcgtgcgg

SEQ ID NO: 292199 - DNA, 75 bp, Artificial Sequence
  Synthetic
cccaggaggcagctaatgcagtagtggcatatgcagaatggcctagttacttaacagatactgatgcaagtgatg

SEQ ID NO: 292200 - DNA, 75 bp, Artificial Sequence
  Synthetic
ggcatatgcagaatggcctagttacttaacagatactgatgcaagtgatgtaaacaaaacctctcagcctgatac

SEQ ID NO: 292201 - DNA, 75 bp, Artificial Sequence
  Synthetic
caaagggatggtgctggaagcttccagatgcactcaaagaaatgggtgtatttgggcaaaacatgtttttccacg

SEQ ID NO: 292202 - DNA, 75 bp, Artificial Sequence
  Synthetic
agatgcactcaaagaaatgggtgtatttgggcaaaacatgtttttccacgcactagggagaacaggttatactat

SEQ ID NO: 292203 - DNA, 75 bp, Artificial Sequence
  Synthetic
tggtcataccagagcaccaattggcatcgcatacagaaggaaatgtttctgttaagtacaaatatacccacccag

SEQ ID NO: 292204 - DNA, 75 bp, Artificial Sequence
  Synthetic
atcgcatacagaaggaaatgtttctgttaagtacaaatatacccacccaggtgagacaggaataaacttgagtga

SEQ ID NO: 292205 - DNA, 75 bp, Artificial Sequence
  Synthetic
gaaccttggtaggaaaccttttgatcttcccacatcagtttattaatctcagaaccaataatactgctacactta

SEQ ID NO: 292206 - DNA, 75 bp, Artificial Sequence
  Synthetic
cttcccacatcagtttattaatctcagaaccaataatactgctacacttattgtaccctatataaattcagtgcc

SEQ ID NO: 292207 - DNA, 75 bp, Artificial Sequence
  Synthetic
ttgttccattgactaatcccacaggaatgtccacaacaatacctataacagtgaccattgcacccatgaacacag

SEQ ID NO: 292208 - DNA, 75 bp, Artificial Sequence
  Synthetic
aatgtccacaacaatacctataacagtgaccattgcacccatgaacacagaattctcaggcattagatctagagc

SEQ ID NO: 292209 - DNA, 75 bp, Artificial Sequence
  Synthetic
ttttaaccacagatgacaggcagtcacctagtgcaatgccaaattatgaacccactcctccaattcacattccag

SEQ ID NO: 292210 - DNA, 75 bp, Artificial Sequence
  Synthetic
ttaggaagcgctggttggacctcttttaaacagttttaatatagacatctagtttaattagaaatagaagtttat

SEQ ID NO: 292211 - DNA, 75 bp, Artificial Sequence
  Synthetic
acctagtgcaatgccaaattatgaacccactcctccaattcacattccaggagaggttcataaccttctagaaat

SEQ ID NO: 292212 - DNA, 75 bp, Artificial Sequence
  Synthetic
ctatggatgagtatcgaatcccacttgaagttaacaaagtgaatgagcaaatattcggcaccagactgttcatag

SEQ ID NO: 292213 - DNA, 75 bp, Artificial Sequence
  Synthetic
tgaagttaacaaagtgaatgagcaaatattcggcaccagactgttcataggagatggggtgttcaaaaccacgtt

SEQ ID NO: 292214 - DNA, 75 bp, Artificial Sequence
  Synthetic
tatccttgatgtacacaggcccagcattatcaagtgctaaattgattctagcatataccccaccaggaactaagg

SEQ ID NO: 292215 - DNA, 75 bp, Artificial Sequence
  Synthetic
attatcaagtgctaaattgattctagcatataccccaccaggaactaaggggcctaaaaccagaagagaggcaat

SEQ ID NO: 292216 - DNA, 75 bp, Artificial Sequence
  Synthetic
gtgtctacacaaaagagtggttcacatgagaatcaaaactttttgtctaatggatctaatcaaacatttacagtc

SEQ ID NO: 292217 - DNA, 75 bp, Artificial Sequence
  Synthetic
tgaacataccctggacatctggtgtacaattcaggtacacagatccggatacttacaccagtgcaggccaccttt

SEQ ID NO: 292218 - DNA, 75 bp, Artificial Sequence
  Synthetic
acaattcaggtacacagatccggatacttacaccagtgcaggccacctttcttgttggtatcagacatcccttat

SEQ ID NO: 292219 - DNA, 75 bp, Artificial Sequence
  Synthetic
gtcaatggatccatctaaattcactgagccagttaaagatctcatgctaaaaggagccccagcactaaactcccc

SEQ ID NO: 292220 - DNA, 75 bp, Artificial Sequence
  Synthetic
gagccagttaaagatctcatgctaaaaggagccccagcactaaactcccctaatattgaagcttgtggatacagt

SEQ ID NO: 292221 - DNA, 75 bp, Artificial Sequence
  Synthetic
catgtccagattttaaactaaggcttatgaaagatacacaaacaatatcacaaacagaagccctcacagaggggt

SEQ ID NO: 292222 - DNA, 75 bp, Artificial Sequence
  Synthetic
tatgaaagatacacaaacaatatcacaaacagaagccctcacagaggggttgggggaagagctggaagaagttgt

SEQ ID NO: 292223 - DNA, 75 bp, Artificial Sequence
  Synthetic
agcggctaacgccatcgttgggtatggtgaatggcccagctttctagatgataaagatgccagtgatgtcaacaa

SEQ ID NO: 292224 - DNA, 75 bp, Artificial Sequence
  Synthetic
ggtgaatggcccagctttctagatgataaagatgccagtgatgtcaacaaacccaccagacctgacacttcggca

SEQ ID NO: 292225 - DNA, 75 bp, Artificial Sequence
  Synthetic
atacacaaaaggtaccagcacttagtgctagcgaaactggggccacacttcccaccaatccctctgatagtgttg

SEQ ID NO: 292226 - DNA, 75 bp, Artificial Sequence
  Synthetic
tgctagcgaaactggggccacacttcccaccaatccctctgatagtgttgaaacaaggaccacttacatgcattt

SEQ ID NO: 292227 - DNA, 75 bp, Artificial Sequence
  Synthetic
atggtgttggaaactgcctgatgctttaaaggatatgggcatttttggacaaaatatgttctatcactcacaagg

SEQ ID NO: 292228 - DNA, 75 bp, Artificial Sequence
  Synthetic
ttaaaggatatgggcatttttggacaaaatatgttctatcactcacaaggaagaactggatatactatacatgtt

SEQ ID NO: 292229 - DNA, 75 bp, Artificial Sequence
  Synthetic
tacacataacagaaatccagaataaaaagcccatagagtccttagaagaagggaaaaacacccacaagggacaga

SEQ ID NO: 292230 - DNA, 75 bp, Artificial Sequence
  Synthetic
aaagcccatagagtccttagaagaagggaaaaacacccacaagggacagatgctatttaatgattggaaaataag

SEQ ID NO: 292231 - DNA, 75 bp, Artificial Sequence
  Synthetic
tccagaacatcaattagcatcagcaaaaggaggcaatgtgtcagtatattatgataaaacccacccaggtgagaa

SEQ ID NO: 292232 - DNA, 75 bp, Artificial Sequence
  Synthetic
aaaggaggcaatgtgtcagtatattatgataaaacccacccaggtgagaacggaatagacttatctgtggtagat

SEQ ID NO: 292233 - DNA, 75 bp, Artificial Sequence
  Synthetic
tgaggtttgattctgagtacaccatactagccactgcgtcacaaccgaacgcatctgagtatgctagtaacttaa

SEQ ID NO: 292234 - DNA, 75 bp, Artificial Sequence
  Synthetic
actagccactgcgtcacaaccgaacgcatctgagtatgctagtaacttaacagtacaggcaatgtatgttcctcc

SEQ ID NO: 292235 - DNA, 75 bp, Artificial Sequence
  Synthetic
gggtaatgctttaatttttcctcatcagtttattaatttgagaacaaacaatactgctactctggtaatgccata

SEQ ID NO: 292236 - DNA, 75 bp, Artificial Sequence
  Synthetic
cagtttattaatttgagaacaaacaatactgctactctggtaatgccatatataaactcagtacccatggattca

SEQ ID NO: 292237 - DNA, 75 bp, Artificial Sequence
  Synthetic
caaaccctagtgtcttctttgaggttggcaagacagccaggttcagtgtaccattcactggcattgcatcagcct

SEQ ID NO: 292238 - DNA, 75 bp, Artificial Sequence
  Synthetic
tggcaagacagccaggttcagtgtaccattcactggcattgcatcagcctataattgcttttatgatggttactc

SEQ ID NO: 292239 - DNA, 75 bp, Artificial Sequence
  Synthetic
tacagcaactagtggggctgcacacagtgttccaattactgtaacaattgccccaatgttccttgagctctcagg

SEQ ID NO: 292240 - DNA, 75 bp, Artificial Sequence
  Synthetic
agtgttccaattactgtaacaattgccccaatgttccttgagctctcaggtattagatctatggctgttgtcaca

SEQ ID NO: 292241 - DNA, 75 bp, Artificial Sequence
  Synthetic
gaagcattgccttcagagttgtgaatgatcatgatgaacacacaaccatagttaaaattagggtcttccatagag

SEQ ID NO: 292242 - DNA, 75 bp, Artificial Sequence
  Synthetic
tgatcatgatgaacacacaaccatagttaaaattagggtcttccatagagccaagcatatcagagcatggatacc

SEQ ID NO: 292243 - DNA, 75 bp, Artificial Sequence
  Synthetic
cgacgatagacaatcaccatcagcactaccaaattatgaagttaccccactcatacacattcctggtagagtagt

SEQ ID NO: 292244 - DNA, 75 bp, Artificial Sequence
  Synthetic
ctaccaaattatgaagttaccccactcatacacattcctggtagagtagtgaatctattagaaattgcacaggtt

SEQ ID NO: 292245 - DNA, 75 bp, Artificial Sequence
  Synthetic
caaatacacatggtaaagtcatcactagaagaaacaagatcaccacatatggaggtagccctagatttggcgcag

SEQ ID NO: 292246 - DNA, 75 bp, Artificial Sequence
  Synthetic
tagaagaaacaagatcaccacatatggaggtagccctagatttggcgcagtctacacctgtaactataaaataat

SEQ ID NO: 292247 - DNA, 75 bp, Artificial Sequence
  Synthetic
gtaccgcatcccactaactcctaatgtacaggaaaaacaagtctttggtttctcattattcttgggtggcactgt

SEQ ID NO: 292248 - DNA, 75 bp, Artificial Sequence
  Synthetic
gtacaggaaaaacaagtctttggtttctcattattcttgggtggcactgttctgaagacgacgcttttaggtgaa

SEQ ID NO: 292249 - DNA, 75 bp, Artificial Sequence
  Synthetic
actatgacagagacctggcagtggtagcaacgggggcacaagggtcagagatagttccccattgcaattgtactt

SEQ ID NO: 292250 - DNA, 75 bp, Artificial Sequence
  Synthetic
agcaacgggggcacaagggtcagagatagttccccattgcaattgtacttctggagtttattactcccaatatta

SEQ ID NO: 292251 - DNA, 75 bp, Artificial Sequence
  Synthetic
gtacacaggaccagcattgtccagtgcaaaactcttactcgcatacactcccccaggtgccccaggaccaaaaac

SEQ ID NO: 292252 - DNA, 75 bp, Artificial Sequence
  Synthetic
gcaaaactcttactcgcatacactcccccaggtgccccaggaccaaaaactagaaaagacgccatgttaggtaca

SEQ ID NO: 292253 - DNA, 75 bp, Artificial Sequence
  Synthetic
aaggaggaaactattaccccagtagatttcaatcgggagtcatgaaaggaattggaccagctgaacctggagact

SEQ ID NO: 292254 - DNA, 75 bp, Artificial Sequence
  Synthetic
atttcaatcgggagtcatgaaaggaattggaccagctgaacctggagactgtggcgggattttgcggtgcataca

SEQ ID NO: 292255 - DNA, 75 bp, Artificial Sequence
  Synthetic
atggacatcagggtcacaattcagatatactgacccagatacatacacacatccaggttacatatcctgttggta

SEQ ID NO: 292256 - DNA, 75 bp, Artificial Sequence
  Synthetic
gggcattgactgaagggcttgaagacgtgttggaagaagttatagttgataaagcaaaacagactatagcttcca

SEQ ID NO: 292257 - DNA, 75 bp, Artificial Sequence
  Synthetic
cgtgttggaagaagttatagttgataaagcaaaacagactatagcttccataaacagcaattccaaacacacaca

SEQ ID NO: 292258 - DNA, 75 bp, Artificial Sequence
  Synthetic
cagacattaggcagttagattttattgctgagacacaaggtattactgactacataacaaacttgggaaaagcat

SEQ ID NO: 292259 - DNA, 75 bp, Artificial Sequence
  Synthetic
tgctgagacacaaggtattactgactacataacaaacttgggaaaagcatttggtgtgggctttacagaccagat

SEQ ID NO: 292260 - DNA, 75 bp, Artificial Sequence
  Synthetic
tgccttctgacaatgtggaaaccagaaaaacttatatgcattatgatggcacagaaaccagtgttgaaagctttt

SEQ ID NO: 292261 - DNA, 75 bp, Artificial Sequence
  Synthetic
aaaaacttatatgcattatgatggcacagaaaccagtgttgaaagctttttaggcaggtccgcttgtgtgcatgt

SEQ ID NO: 292262 - DNA, 75 bp, Artificial Sequence
  Synthetic
ttaagattctttccaaggttgttaaaatgatttcagcattagtaattatatgtagaaaccatgatgatttgatca

SEQ ID NO: 292263 - DNA, 75 bp, Artificial Sequence
  Synthetic
aatgatttcagcattagtaattatatgtagaaaccatgatgatttgatcacagttactgctactttggctttgct

SEQ ID NO: 292264 - DNA, 75 bp, Artificial Sequence
  Synthetic
agaaattgtttgatgattggaaaattaatttgtctagcttagttcaactcagaagaaaattggaatttttcactt

SEQ ID NO: 292265 - DNA, 75 bp, Artificial Sequence
  Synthetic
atttccaggtgccctatatagagaggcaagcaaatgatggctggttcagaaagtttaatgatgcttgcaatgctg

SEQ ID NO: 292266 - DNA, 75 bp, Artificial Sequence
  Synthetic
tgggagttatggctttcagagttgtcaatgaaaatgatcagcatgtcactaaagttaaaattagagtttatcata

SEQ ID NO: 292267 - DNA, 75 bp, Artificial Sequence
  Synthetic
gcaagcaaatgatggctggttcagaaagtttaatgatgcttgcaatgctgcaaaaggcttggagtggatagctaa

SEQ ID NO: 292268 - DNA, 75 bp, Artificial Sequence
  Synthetic
caatgaaaatgatcagcatgtcactaaagttaaaattagagtttatcatagagctaagcatgtaatggcttgggt

SEQ ID NO: 292269 - DNA, 75 bp, Artificial Sequence
  Synthetic
caaaggagaaattggacttttgtaaaaggcttaaacagctggacattttggaaagacaagtcacaacaatgcatg

SEQ ID NO: 292270 - DNA, 75 bp, Artificial Sequence
  Synthetic
atgacggatcacagtcaattattcccaagagagataccatctcaacatatggtttagggcccaggtttgggggtg

SEQ ID NO: 292271 - DNA, 75 bp, Artificial Sequence
  Synthetic
aaggcttaaacagctggacattttggaaagacaagtcacaacaatgcatgtttccaatccaacacaggagaaaag

SEQ ID NO: 292272 - DNA, 75 bp, Artificial Sequence
  Synthetic
ggtttagggcccaggtttgggggtgtatgcactggtagtgtcaaagtaatgaattaccacctcatgacacaagaa

SEQ ID NO: 292273 - DNA, 75 bp, Artificial Sequence
  Synthetic
ttgcaccattatatgcagtagaagccagaagaatcaaggaaatgaaaatgaagatgatgaactatatacaattta

SEQ ID NO: 292274 - DNA, 75 bp, Artificial Sequence
  Synthetic
ttgcaccattatatgcagtagaagccagaagattcaaggaaatgaaaatgaagatgatgaactatatacaattta

SEQ ID NO: 292275 - DNA, 75 bp, Artificial Sequence
  Synthetic
ttgcaccattatatgcagtagaagccagaagactcaaggaaatgaaaatgaagatgatgaactatatacaattta

SEQ ID NO: 292276 - DNA, 75 bp, Artificial Sequence
  Synthetic
ttgcaccattatatgcagtagaagccagaagagtcaaggaaatgaaaatgaagatgatgaactatatacaattta

SEQ ID NO: 292277 - DNA, 75 bp, Artificial Sequence
  Synthetic
cagaagaatcaaggaaatgaaaatgaagatgatgaactatatacaatttaagtcaaaacatagaactgaaccagt

SEQ ID NO: 292278 - DNA, 75 bp, Artificial Sequence
  Synthetic
cagaagattcaaggaaatgaaaatgaagatgatgaactatatacaatttaagtcaaaacatagaactgaaccagt

SEQ ID NO: 292279 - DNA, 75 bp, Artificial Sequence
  Synthetic
cagaagactcaaggaaatgaaaatgaagatgatgaactatatacaatttaagtcaaaacatagaactgaaccagt

SEQ ID NO: 292280 - DNA, 75 bp, Artificial Sequence
  Synthetic
cagaagagtcaaggaaatgaaaatgaagatgatgaactatatacaatttaagtcaaaacatagaactgaaccagt

SEQ ID NO: 292281 - DNA, 75 bp, Artificial Sequence
  Synthetic
caggagtttactattcaagatactacaacaaattttatccagtaatctgtgagaaaccaacatgcatatggattg

SEQ ID NO: 292282 - DNA, 75 bp, Artificial Sequence
  Synthetic
caattattggtagggctatagcagaaagatttaagtccacagtttattcactccctccagacccaaagcattttg

SEQ ID NO: 292283 - DNA, 75 bp, Artificial Sequence
  Synthetic
gtaggtcctgctgaacctggggattgtggaggcatcttaagatgtgtgcatggtccgataggacttctaactgct

SEQ ID NO: 292284 - DNA, 75 bp, Artificial Sequence
  Synthetic
aagatttaagtccacagtttattcactccctccagacccaaagcattttgatggataccaacagcaggaggttgt

SEQ ID NO: 292285 - DNA, 75 bp, Artificial Sequence
  Synthetic
gtggaggcatcttaagatgtgtgcatggtccgataggacttctaactgctggtgggggtggatttgtgtgttttg

SEQ ID NO: 292286 - DNA, 75 bp, Artificial Sequence
  Synthetic
tttgccaaatggtttcatcagttgatttcataccacccatggctagcttagataacaaaggaatcctgtttacta

SEQ ID NO: 292287 - DNA, 75 bp, Artificial Sequence
  Synthetic
gactacataaccaatctaggcagagcatttggcacaggctttacagatcatattaatgataaaatagcagagctg

SEQ ID NO: 292288 - DNA, 75 bp, Artificial Sequence
  Synthetic
tttcataccacccatggctagcttagataacaaaggaatcctgtttactagcaattttgttcttgcgtcaactaa

SEQ ID NO: 292289 - DNA, 75 bp, Artificial Sequence
  Synthetic
catttggcacaggctttacagatcatattaatgataaaatagcagagctgcagaatacagccacaaattatctga

SEQ ID NO: 292290 - DNA, 75 bp, Artificial Sequence
  Synthetic
gaagatttggatttgatttggatatatgcttgcatacttcatttacaaaatcaggaaagttgaacgtagcaatgg

SEQ ID NO: 292291 - DNA, 75 bp, Artificial Sequence
  Synthetic
atttgtagaaatcatgatgatttagttacagtaacagccacattagcattgttaggttgtgatggttctccttgg

SEQ ID NO: 292292 - DNA, 75 bp, Artificial Sequence
  Synthetic
atgcttgcatacttcatttacaaaatcaggaaagttgaacgtagcaatggctacagagctttgtaaggactgcca

SEQ ID NO: 292293 - DNA, 75 bp, Artificial Sequence
  Synthetic
ttacagtaacagccacattagcattgttaggttgtgatggttctccttggagatttctaaaaatgtatatcagta

SEQ ID NO: 292294 - DNA, 75 bp, Artificial Sequence
  Synthetic
tcagtcttgtagatcgttctactaatgttagatacagtttagatcaattggtcacagcaatcataactgatttta

SEQ ID NO: 292295 - DNA, 75 bp, Artificial Sequence
  Synthetic
aaaaagttcaatgacatgtgcaatgcagctaaaggactggaatggatagcaaacaaaatttcaaaattgattgac

SEQ ID NO: 292296 - DNA, 75 bp, Artificial Sequence
  Synthetic
tgttagatacagtttagatcaattggtcacagcaatcataactgattttaataacaagttgaagatcacagattc

SEQ ID NO: 292297 - DNA, 75 bp, Artificial Sequence
  Synthetic
cagctaaaggactggaatggatagcaaacaaaatttcaaaattgattgactggatcaaaaacaagttactacccc

SEQ ID NO: 292298 - DNA, 75 bp, Artificial Sequence
  Synthetic
tgcacactacaccaccacctgaatgcattaatgacttgctcaagtcagttgattctgaagaactcagggagtatt

SEQ ID NO: 292299 - DNA, 75 bp, Artificial Sequence
  Synthetic
atagaaagacaggttgaaacattacacatgaaccacacaaatgaaaatgatagggaagtattatttaacaacatc

SEQ ID NO: 292300 - DNA, 75 bp, Artificial Sequence
  Synthetic
cattaatgacttgctcaagtcagttgattctgaagaactcagggagtattgcaaacagaaaaactggctcatacc

SEQ ID NO: 292301 - DNA, 75 bp, Artificial Sequence
  Synthetic
acatgaaccacacaaatgaaaatgatagggaagtattatttaacaacatcctatggttagaacagatgtcccaga

SEQ ID NO: 292302 - DNA, 75 bp, Artificial Sequence
  Synthetic
taaacacaatactgatgtttgtgagtaccctcgggattctttatgtaatatacaaattatttgcacaaacacaag

SEQ ID NO: 292303 - DNA, 75 bp, Artificial Sequence
  Synthetic
aacaaaatgacaaactttatccaattcagatccaaacatagaactgaaccagtgtgtgtactaattcatggcagc

SEQ ID NO: 292304 - DNA, 75 bp, Artificial Sequence
  Synthetic
taccctcgggattctttatgtaatatacaaattatttgcacaaacacaaggcccatactcgggtaacccctcaca

SEQ ID NO: 292305 - DNA, 75 bp, Artificial Sequence
  Synthetic
agataaccataagtcatctgtatactccttaccaccagatccgaaacattttgatggataccagcaacaagcagt

SEQ ID NO: 292306 - DNA, 75 bp, Artificial Sequence
  Synthetic
acactgaatttgccatgtccctacttaggaaaaatatagttacaatcactacttccaagggagagttcacagcat

SEQ ID NO: 292307 - DNA, 75 bp, Artificial Sequence
  Synthetic
taggaaaaatatagttacaatcactacttccaagggagagttcacagcattaggggttcatgatagggtttgtgt

SEQ ID NO: 292308 - DNA, 75 bp, Artificial Sequence
  Synthetic
ctttttgtcaaatggtgtcttcagtagattttgtaccaccaatggcaaatttggacaacaaagggatgcttttta

SEQ ID NO: 292309 - DNA, 75 bp, Artificial Sequence
  Synthetic
agattttgtaccaccaatggcaaatttggacaacaaagggatgctttttaccagtagttttgttttagcttccac

SEQ ID NO: 292310 - DNA, 75 bp, Artificial Sequence
  Synthetic
caattaagttaaaagataaatacaaactactagacccagaaaacacaaacttggagttgaccatagtagttctag

SEQ ID NO: 292311 - DNA, 75 bp, Artificial Sequence
  Synthetic
actactagacccagaaaacacaaacttggagttgaccatagtagttctagacaggaatgaaaaattcagagatat

SEQ ID NO: 292312 - DNA, 75 bp, Artificial Sequence
  Synthetic
cacgtagattcggctttgatttagatatgtgtttacattcatcatacaccaagtcaggcaaattgaatgctgcca

SEQ ID NO: 292313 - DNA, 75 bp, Artificial Sequence
  Synthetic
tatgtgtttacattcatcatacaccaagtcaggcaaattgaatgctgccatggcttgtgaattatgcaaagactg

SEQ ID NO: 292314 - DNA, 75 bp, Artificial Sequence
  Synthetic
taaattccaataattttagagataccatactggaggtaggacaattgacctttgctggcctcataaacctcagta

SEQ ID NO: 292315 - DNA, 75 bp, Artificial Sequence
  Synthetic
catactggaggtaggacaattgacctttgctggcctcataaacctcagtagcgtgcccaccaatcgcatgatacg

SEQ ID NO: 292316 - DNA, 75 bp, Artificial Sequence
  Synthetic
ctctcagtttagttgatagacatactaatgtaagatatactattgatcaactggttactgctatactccaggaac

SEQ ID NO: 292317 - DNA, 75 bp, Artificial Sequence
  Synthetic
taatgtaagatatactattgatcaactggttactgctatactccaggaacataacaacaaaacaaaaatcacaaa

SEQ ID NO: 292318 - DNA, 75 bp, Artificial Sequence
  Synthetic
ctggcaaaatttacggaatccatgttggtggtaacgggcggcaaggcttttctgcacagttaaagaaacagtatt

SEQ ID NO: 292319 - DNA, 75 bp, Artificial Sequence
  Synthetic
tggtggtaacgggcggcaaggcttttctgcacagttaaagaaacagtattttgtggaaaaacaaggagcgattac

SEQ ID NO: 292320 - DNA, 75 bp, Artificial Sequence
  Synthetic
atgtacatgataaaccccctccagaatgtattgtagatttgttgaaatctgtagattgtgaagaggttaggcaat

SEQ ID NO: 292321 - DNA, 75 bp, Artificial Sequence
  Synthetic
atgtattgtagatttgttgaaatctgtagattgtgaagaggttaggcaatattgtaaggaaaagaagtggttaat

SEQ ID NO: 292322 - DNA, 75 bp, Artificial Sequence
  Synthetic
ctaaaacaaaactccaccccagtgtgttttatgaagttttcccagggtcaaaggaacctgctgtgttagatgatt

SEQ ID NO: 292323 - DNA, 75 bp, Artificial Sequence
  Synthetic
gttttatgaagttttcccagggtcaaaggaacctgctgtgttagatgattctgatcccagactggaagtcaatct

SEQ ID NO: 292324 - DNA, 75 bp, Artificial Sequence
  Synthetic
tcataaatacaatattaatgtttattactacaatgggaattatttacatgatttataaaatgtttgcccagatgc

SEQ ID NO: 292325 - DNA, 75 bp, Artificial Sequence
  Synthetic
tactacaatgggaattatttacatgatttataaaatgtttgcccagatgcaaggaccttattcagggttggagag

SEQ ID NO: 292326 - DNA, 75 bp, Artificial Sequence
  Synthetic
ctgaaaacatgcaagtagccatagaccactactcaggccagttactgtcactggatatcccaacagatgagatgt

SEQ ID NO: 292327 - DNA, 75 bp, Artificial Sequence
  Synthetic
ccactactcaggccagttactgtcactggatatcccaacagatgagatgtcactcaaagaagccttatacggcac

SEQ ID NO: 292328 - DNA, 75 bp, Artificial Sequence
  Synthetic
ctaacactgaattcgccttgtcactcctaaggaaaaatataattactgtaacaacatctaagggggagtttacca

SEQ ID NO: 292329 - DNA, 75 bp, Artificial Sequence
  Synthetic
cctaaggaaaaatataattactgtaacaacatctaagggggagtttaccagtctggggatttatgacagaatatg

SEQ ID NO: 292330 - DNA, 75 bp, Artificial Sequence
  Synthetic
tgagcttgggaataaagaaaaaagacatactaaacagagaaactcaggacacctctaaaatggaacattatttgg

SEQ ID NO: 292331 - DNA, 75 bp, Artificial Sequence
  Synthetic
catactaaacagagaaactcaggacacctctaaaatggaacattatttggacaaatatggcatagatttaccact

SEQ ID NO: 292332 - DNA, 75 bp, Artificial Sequence
  Synthetic
ttaaaactagagttagtgacaagtggaagctagttgacccagacaatatgaacttggaaatcactgttctccaat

SEQ ID NO: 292333 - DNA, 75 bp, Artificial Sequence
  Synthetic
gaagctagttgacccagacaatatgaacttggaaatcactgttctccaattggatagaaatgagaaattcaggga

SEQ ID NO: 292334 - DNA, 75 bp, Artificial Sequence
  Synthetic
gtaagagtagactaattgaggcatccagcttgaatgattctgttaacatgagggttaaattaggaaatttgtaca

SEQ ID NO: 292335 - DNA, 75 bp, Artificial Sequence
  Synthetic
cagcttgaatgattctgttaacatgagggttaaattaggaaatttgtacaaagctttccacttgaacccaggggt

SEQ ID NO: 292336 - DNA, 75 bp, Artificial Sequence
  Synthetic
taattaattcaaacaattttaaagatacaattattacagtaggtcaagctgctttagttggaatgattaatttaa

SEQ ID NO: 292337 - DNA, 75 bp, Artificial Sequence
  Synthetic
tacaattattacagtaggtcaagctgctttagttggaatgattaatttaagtaatacacccactactagaatgat

SEQ ID NO: 292338 - DNA, 75 bp, Artificial Sequence
  Synthetic
taccatgtcttatggatggtcaactcatggcatttgattactcaaatttcgacgcctcactatcaccagtgtggt

SEQ ID NO: 292339 - DNA, 75 bp, Artificial Sequence
  Synthetic
catggcatttgattactcaaatttcgacgcctcactatcaccagtgtggttcaagtgcctcgagcaagtgctcac

SEQ ID NO: 292340 - DNA, 75 bp, Artificial Sequence
  Synthetic
caacaggtaaaatttatggtatacatgtgggtggaaatggtagacaaggcttctccgctcaactaagaaaacagt

SEQ ID NO: 292341 - DNA, 75 bp, Artificial Sequence
  Synthetic
tgtgggtggaaatggtagacaaggcttctccgctcaactaagaaaacagtattttgttcagcaacaagggcagat

SEQ ID NO: 292342 - DNA, 75 bp, Artificial Sequence
  Synthetic
accacatatttagggatgaaatttatgaagttgagggaggcatgccatcaggttgttcaggtactagtgtcttca

SEQ ID NO: 292343 - DNA, 75 bp, Artificial Sequence
  Synthetic
tgaagttgagggaggcatgccatcaggttgttcaggtactagtgtcttcaattcaatgataaacaacataatcat

SEQ ID NO: 292344 - DNA, 75 bp, Artificial Sequence
  Synthetic
ccacaaaaacaaagctcctccccagtgtgttttacaatgtttttcctggatcaaaagagccagcagtcctacatc

SEQ ID NO: 292345 - DNA, 75 bp, Artificial Sequence
  Synthetic
tgtgttttacaatgtttttcctggatcaaaagagccagcagtcctacatccagcagacaaaaggttagaagtaga

SEQ ID NO: 292346 - DNA, 75 bp, Artificial Sequence
  Synthetic
aagtaatagcttatggggatgaccttattgtttcttatccatttgagttacaaccagaactactagctcaggctg

SEQ ID NO: 292347 - DNA, 75 bp, Artificial Sequence
  Synthetic
tattgtttcttatccatttgagttacaaccagaactactagctcaggctggaaagggatatggcttgacaatcac

SEQ ID NO: 292348 - DNA, 75 bp, Artificial Sequence
  Synthetic
tgactgaaaatatgaaagtggcagtggatcactatgctggtcaattaatgtcactagaaataccaacagaggaat

SEQ ID NO: 292349 - DNA, 75 bp, Artificial Sequence
  Synthetic
ggatcactatgctggtcaattaatgtcactagaaataccaacagaggaattgtcacttaaagaagcactctatgg

SEQ ID NO: 292350 - DNA, 75 bp, Artificial Sequence
  Synthetic
ccttcttaaaaaggtatttcagacctgattcacaatatcccttccttatacatccagtgatgccaatgcaagata

SEQ ID NO: 292351 - DNA, 75 bp, Artificial Sequence
  Synthetic
tgattcacaatatcccttccttatacatccagtgatgccaatgcaagatattcatgagtccattcgctggacacg

SEQ ID NO: 292352 - DNA, 75 bp, Artificial Sequence
  Synthetic
atgtgagcttgggtataaagaaaagatccattttgaataaagaaacacaagatacaacaaaaatgcaagagtgtt

SEQ ID NO: 292353 - DNA, 75 bp, Artificial Sequence
  Synthetic
atccattttgaataaagaaacacaagatacaacaaaaatgcaagagtgtttaagtaaatatggaatagatttacc

SEQ ID NO: 292354 - DNA, 75 bp, Artificial Sequence
  Synthetic
ggcattcaggggaagaggagtataaagtcttcactgacaaaataaggtcaactagcattggcaaatgcttactaa

SEQ ID NO: 292355 - DNA, 75 bp, Artificial Sequence
  Synthetic
tcccagagtacagcgttttgcgtcgacgctggcttgacctgttttaataatatagatttataatttgtttagaat

SEQ ID NO: 292356 - DNA, 75 bp, Artificial Sequence
  Synthetic
taggtaaaagtagattaatagaagcatcaagcctaaatgattcagttaacatgagagtcaaattggggcacttat

SEQ ID NO: 292357 - DNA, 75 bp, Artificial Sequence
  Synthetic
atcaagcctaaatgattcagttaacatgagagtcaaattggggcacttatacaaagcatttcacaaaaacccagg

SEQ ID NO: 292358 - DNA, 75 bp, Artificial Sequence
  Synthetic
catccgacccactgggtgtagtacactggtattatgtacctttgtacgcctgtttctccctccctactaccccgc

SEQ ID NO: 292359 - DNA, 75 bp, Artificial Sequence
  Synthetic
catccgacccactgggtgtagtactctggtattatgtacctttgtacgcctgtttctccctccctactaccccgc

SEQ ID NO: 292360 - DNA, 75 bp, Artificial Sequence
  Synthetic
catccgacccactgggtgtagtaccctggtattatgtacctttgtacgcctgtttctccctccctactaccccgc

SEQ ID NO: 292361 - DNA, 75 bp, Artificial Sequence
  Synthetic
catccgacccactgggtgtagtacgctggtattatgtacctttgtacgcctgtttctccctccctactaccccgc

SEQ ID NO: 292362 - DNA, 75 bp, Artificial Sequence
  Synthetic
tgataccatgcttgttagatggggagttactggcatttgattactcaaacttcgatgccagcttatcacccattt

SEQ ID NO: 292363 - DNA, 75 bp, Artificial Sequence
  Synthetic
attacaaccagtaatagttagtgcaagcacttctgtttccccggagcggagtatagacggccaccgctgtcaaaa

SEQ ID NO: 292364 - DNA, 75 bp, Artificial Sequence
  Synthetic
gttactggcatttgattactcaaacttcgatgccagcttatcacccatttggtttgattgtctagagcttgtatt

SEQ ID NO: 292365 - DNA, 75 bp, Artificial Sequence
  Synthetic
gtatagacggccaccgctgtcaaaagctcttaaccgttatccgccagttaactacgtaacggctagtaacatctt

SEQ ID NO: 292366 - DNA, 75 bp, Artificial Sequence
  Synthetic
cacaccacatattcagagatcaaatttatatagtggagggtggaatgccatctggttgttctggaaccagtatat

SEQ ID NO: 292367 - DNA, 75 bp, Artificial Sequence
  Synthetic
gttgtgcttagggtgttcgatcaggtgaagaaaaacccccttcactagtctggtcgatgaggctgagaagtcccc

SEQ ID NO: 292368 - DNA, 75 bp, Artificial Sequence
  Synthetic
ttatatagtggagggtggaatgccatctggttgttctggaaccagtatattcaactcaatgatcaacaacataat

SEQ ID NO: 292369 - DNA, 75 bp, Artificial Sequence
  Synthetic
gacgccttaagtatgacatggtgtgaagacccgcatgtgcttaactgtgagtcctccggcccctgaatgcggcta

SEQ ID NO: 292370 - DNA, 75 bp, Artificial Sequence
  Synthetic
taaaaattattgcttatggtgatgatgtaattatctcttacccttatgagttaaacccagaaagaattgcagagc

SEQ ID NO: 292371 - DNA, 75 bp, Artificial Sequence
  Synthetic
aagacccgcatgtgcttaactgtgagtcctccggcccctgaatgcggctaacctaaaccctggagccttggagca

SEQ ID NO: 292372 - DNA, 75 bp, Artificial Sequence
  Synthetic
tgtaattatctcttacccttatgagttaaacccagaaagaattgcagagcaaggcaaaacatatggattaacaat

SEQ ID NO: 292373 - DNA, 75 bp, Artificial Sequence
  Synthetic
tactttgggtgtccgtgtttccttttatctcattattgttcttatggttacaatatatagagtatattgtaatca

SEQ ID NO: 292374 - DNA, 75 bp, Artificial Sequence
  Synthetic
ttacttttttaaaaagaagtttcagaccagacccagaatttccattccttgttcatccagtcatgccaatgactg

SEQ ID NO: 292375 - DNA, 75 bp, Artificial Sequence
  Synthetic
accagacccagaatttccattccttgttcatccagtcatgccaatgactgacatctatgaatctatcagatggac

SEQ ID NO: 292376 - DNA, 75 bp, Artificial Sequence
  Synthetic
gagtggttcgcatgaaaaccaaaatattcttacaaatggttctacacaaaactttactgtcatcaattattacaa

SEQ ID NO: 292377 - DNA, 75 bp, Artificial Sequence
  Synthetic
cttggcattcaggagaacaagaatatgagaaatttgttgagggcatacgcagtaccagtgttggtaaggctctta

SEQ ID NO: 292378 - DNA, 75 bp, Artificial Sequence
  Synthetic
tgagaaatttgttgagggcatacgcagtaccagtgttggtaaggctcttatcattccatcatactcagttctcag

SEQ ID NO: 292379 - DNA, 75 bp, Artificial Sequence
  Synthetic
ccaagtttactgaacccgttaaggatataatgctcaagggagcaccagctttaaactcccctaatgttgaggcat

SEQ ID NO: 292380 - DNA, 75 bp, Artificial Sequence
  Synthetic
tataatgctcaagggagcaccagctttaaactcccctaatgttgaggcatgtggatacagtgacagggtacaaca

SEQ ID NO: 292381 - DNA, 75 bp, Artificial Sequence
  Synthetic
acacatccaggttacatatcctgttggtatcaaacatctcttatcctgcctccagaaaccaactcaaacacaaag

SEQ ID NO: 292382 - DNA, 75 bp, Artificial Sequence
  Synthetic
gagaacgggcattgactgaagggcttgaagacgtgttggaagaagttatagttgataaagcaaaacagactatag

SEQ ID NO: 292383 - DNA, 75 bp, Artificial Sequence
  Synthetic
aatttttcacttatgtcagatttgattcagagtatacaatcatagcaacatcttcacaacttaatgatgcccagc

SEQ ID NO: 292384 - DNA, 75 bp, Artificial Sequence
  Synthetic
aagtcacatgggagttatggctttcagagttgtcaatgaaaatgatcagcatgtcactaaagttaaaattagagt

SEQ ID NO: 292385 - DNA, 75 bp, Artificial Sequence
  Synthetic
ttgtggcatacgctgaatggcccagttatttgtcagattctgatgcaagtgatgtcaacaaaacctcacagcctg

SEQ ID NO: 292386 - DNA, 75 bp, Artificial Sequence
  Synthetic
ttatttgtcagattctgatgcaagtgatgtcaacaaaacctcacagcctgacacttctgtttgtaggttttacac

SEQ ID NO: 292387 - DNA, 75 bp, Artificial Sequence
  Synthetic
ttccagatgcacttaaagatatgggagtgtttggacaaaacatgtttttccatgcactagggagaacaggctaca

SEQ ID NO: 292388 - DNA, 75 bp, Artificial Sequence
  Synthetic
ccgtacatgttcaatgtaatgcaaccaaattccacagtggctgtttactggtagtagccattccagaacaccagc

SEQ ID NO: 292389 - DNA, 75 bp, Artificial Sequence
  Synthetic
ccaggtgaatcagggataaatttggatgacacaccagaagcagggggggcgtcacatgatccagtgtactccatg

SEQ ID NO: 292390 - DNA, 75 bp, Artificial Sequence
  Synthetic
atgacacaccagaagcagggggggcgtcacatgatccagtgtactccatgaatggaaccttagtgggtaatcttc

SEQ ID NO: 292391 - DNA, 75 bp, Artificial Sequence
  Synthetic
cttatcttaccctacataaattcagtgcccatggattccatgactagacataacaatatatctttattagttatc

SEQ ID NO: 292392 - DNA, 75 bp, Artificial Sequence
  Synthetic
caggaatgaccactacaattccagtcacagtcactattgcccctatgtacactgaattctcaggtattaggtcaa

SEQ ID NO: 292393 - DNA, 75 bp, Artificial Sequence
  Synthetic
caatttctcactacagatgataggcaatcacctagtgcaatgccaaactatgaaccaaccccacaaatccacata

SEQ ID NO: 292394 - DNA, 75 bp, Artificial Sequence
  Synthetic
aatcacctagtgcaatgccaaactatgaaccaaccccacaaatccacataccaggagaagtccacaatctgttgg

SEQ ID NO: 292395 - DNA, 75 bp, Artificial Sequence
  Synthetic
gacaccatgagtgagtaccgaattccactcactgcaggtagagtgaatgaacaaatattcggtactagattgtac

SEQ ID NO: 292396 - DNA, 75 bp, Artificial Sequence
  Synthetic
cactcactgcaggtagagtgaatgaacaaatattcggtactagattgtacataggagatggtgttttcaagacca

SEQ ID NO: 292397 - DNA, 75 bp, Artificial Sequence
  Synthetic
cgaatctccctaatgtatacaggtcctgcactatccagtgccaaattgattttagcgtacaccccaccaggagcc

SEQ ID NO: 292398 - DNA, 75 bp, Artificial Sequence
  Synthetic
ctgcactatccagtgccaaattgattttagcgtacaccccaccaggagccggaggcccaaaagacaggaaagaag

SEQ ID NO: 292399 - DNA, 75 bp, Artificial Sequence
  Synthetic
gtcatgaacataccatggacaagtggtgtacaattcaggtatacagatccagacacatacacaagtgccgggttt

SEQ ID NO: 292400 - DNA, 75 bp, Artificial Sequence
  Synthetic
gtgtacaattcaggtatacagatccagacacatacacaagtgccgggtttctctcatgttggtatcaaacatctt

SEQ ID NO: 292401 - DNA, 75 bp, Artificial Sequence
  Synthetic
aagtattaccccataatttgtgaaaagcccaccaacatctggattgaaggaaacccttattacccaagtaggttt

SEQ ID NO: 292402 - DNA, 75 bp, Artificial Sequence
  Synthetic
agtgcatgtccagactttaaattgagactaatgaaagatacccagacaatatcacagacagaagcactcacagaa

SEQ ID NO: 292403 - DNA, 75 bp, Artificial Sequence
  Synthetic
atcacagacagaagcactcacagaaggtcttggggaagagctagaggaagttgttgtcgacaaaatgagacagat

SEQ ID NO: 292404 - DNA, 75 bp, Artificial Sequence
  Synthetic
taagtgcaagtgagacaggtgccacattgcccacaaatccatctgataatgttgaaactagaaccacatacatgc

SEQ ID NO: 292405 - DNA, 75 bp, Artificial Sequence
  Synthetic
attgcccacaaatccatctgataatgttgaaactagaaccacatacatgcatttcaatggctcagaaactacatt

SEQ ID NO: 292406 - DNA, 75 bp, Artificial Sequence
  Synthetic
acaaagtaccccaagaccctacgccagaaggaggaaatacccacaaagaacaaaaactattcaatgactggaaaa

SEQ ID NO: 292407 - DNA, 75 bp, Artificial Sequence
  Synthetic
agaaggaggaaatacccacaaagaacaaaaactattcaatgactggaaaataagcttgtccagtttggtacaact

SEQ ID NO: 292408 - DNA, 75 bp, Artificial Sequence
  Synthetic
ccatactagccactgcttctcaacctgaggctgctgaatatgctagcaatctgacagtacaggcaatgtatgttc

SEQ ID NO: 292409 - DNA, 75 bp, Artificial Sequence
  Synthetic
tgaggctgctgaatatgctagcaatctgacagtacaggcaatgtatgttcctccaggcgcaccaaaccctgttaa

SEQ ID NO: 292410 - DNA, 75 bp, Artificial Sequence
  Synthetic
aagttggcaaaacagccaggttcagtgtgccattcattggtatcgcctcagcttataactgcttttatgatggct

SEQ ID NO: 292411 - DNA, 75 bp, Artificial Sequence
  Synthetic
tgtgccattcattggtatcgcctcagcttataactgcttttatgatggctactcacatgatgacccagaaacaca

SEQ ID NO: 292412 - DNA, 75 bp, Artificial Sequence
  Synthetic
taaatgatcatgactttcacaaaacattggtgaagataagggtattccacagagctaagcacattagagcttggg

SEQ ID NO: 292413 - DNA, 75 bp, Artificial Sequence
  Synthetic
attggtgaagataagggtattccacagagctaagcacattagagcttgggtaccaagaccacccagagcactacc

SEQ ID NO: 292414 - DNA, 75 bp, Artificial Sequence
  Synthetic
catccgacccactgggtgtagtactctggtacattgtacctttgtacgcctgtttctcccctccctcccaaccta

SEQ ID NO: 292415 - DNA, 75 bp, Artificial Sequence
  Synthetic
ttgccaaaagagaaaagatcaccacctatggtggtagtcccagatttggagctatttacacatgtaattataaaa

SEQ ID NO: 292416 - DNA, 75 bp, Artificial Sequence
  Synthetic
ctatggtggtagtcccagatttggagctatttacacatgtaattataaaataatgaactaccatttgatgactca

SEQ ID NO: 292417 - DNA, 75 bp, Artificial Sequence
  Synthetic
ctggtacattgtacctttgtacgcctgtttctcccctccctcccaacctatacaatcccggcaacttagaagatt

SEQ ID NO: 292418 - DNA, 75 bp, Artificial Sequence
  Synthetic
ttgttgcaactggagctcagggctcagaaatcattccacattgcaattgtacctcaggtgtttattattctcagt

SEQ ID NO: 292419 - DNA, 75 bp, Artificial Sequence
  Synthetic
agaaatcattccacattgcaattgtacctcaggtgtttattattctcagtactacagaaaatactatcccataat

SEQ ID NO: 292420 - DNA, 75 bp, Artificial Sequence
  Synthetic
atagatggccaccgctgtcaaaagctcttaaccgttatccgccaattaactacgcaacggctagtaatatcatgt

SEQ ID NO: 292421 - DNA, 75 bp, Artificial Sequence
  Synthetic
gtagatttcaatcaggggtaatgaagggtgttggaccagctgaacctggggactgtggtggcatcttacgatgcg

SEQ ID NO: 292422 - DNA, 75 bp, Artificial Sequence
  Synthetic
ccagcccagcttatgctgggacgccttaattgtgacatggtgtgaagacccacgtgtgcttaattgtgagtcctc

SEQ ID NO: 292423 - DNA, 75 bp, Artificial Sequence
  Synthetic
tttgcagatattagacaactagacttcatcgcagaaacacagggcattactgattacataacaaatctgggaaag

SEQ ID NO: 292424 - DNA, 75 bp, Artificial Sequence
  Synthetic
tcatcgcagaaacacagggcattactgattacataacaaatctgggaaaggcatttggtgtaggctttacagatc

SEQ ID NO: 292425 - DNA, 75 bp, Artificial Sequence
  Synthetic
attccgggacgggaccgactactttgggtgtccgtgtttccttttatttttaagttgttcttatggtcacaatat

SEQ ID NO: 292426 - DNA, 75 bp, Artificial Sequence
  Synthetic
aatgtcaaaattttatccaaagttgtcaaaatggtatcagcattagttattatttgtagaaatcatgatgatttg

SEQ ID NO: 292427 - DNA, 75 bp, Artificial Sequence
  Synthetic
ggttcgcatgagaatcaaaacatcttgacaaatggctcaacacaacacttcacagtcattaactattacaaagat

SEQ ID NO: 292428 - DNA, 75 bp, Artificial Sequence
  Synthetic
tgacaaatggctcaacacaacacttcacagtcattaactattacaaagatgctgcaagctcatcgtctgccagtc

SEQ ID NO: 292429 - DNA, 75 bp, Artificial Sequence
  Synthetic
tactcgggtgtgatggatcaccctggagatttctcaaaatgtacatatcaaagcatttccaggtgccctacatag

SEQ ID NO: 292430 - DNA, 75 bp, Artificial Sequence
  Synthetic
atgctaaaaggagcacctgctttgaactctcccaacgtggaagcatgtggatacagtgacagggtacaacaaatc

SEQ ID NO: 292431 - DNA, 75 bp, Artificial Sequence
  Synthetic
actctcccaacgtggaagcatgtggatacagtgacagggtacaacaaatcacgcttggaaactcaacaattacaa

SEQ ID NO: 292432 - DNA, 75 bp, Artificial Sequence
  Synthetic
gcagcaaaaggtctggaatggatagcaaacaaaatttccaaacttatagaatgggtaaagacaaagataattcct

SEQ ID NO: 292433 - DNA, 75 bp, Artificial Sequence
  Synthetic
caaacaaaatttccaaacttatagaatgggtaaagacaaagataattcctcaagcaaaagaaaaactagattttt

SEQ ID NO: 292434 - DNA, 75 bp, Artificial Sequence
  Synthetic
ttggcagacagtgatgcaagtgatgtaaataagacttcaaagcctgacacgtcagtatgtagattttatacttta

SEQ ID NO: 292435 - DNA, 75 bp, Artificial Sequence
  Synthetic
taaataagacttcaaagcctgacacgtcagtatgtagattttatactttagacagcaaaacatggaccagagaat

SEQ ID NO: 292436 - DNA, 75 bp, Artificial Sequence
  Synthetic
catgtttctaatccaacacaggagaaaagagagcagctttttaacaatgttttgtggctagaacaaatgtcccag

SEQ ID NO: 292437 - DNA, 75 bp, Artificial Sequence
  Synthetic
aaagagagcagctttttaacaatgttttgtggctagaacaaatgtcccagaaatttgccccgttgtatgcagtag

SEQ ID NO: 292438 - DNA, 75 bp, Artificial Sequence
  Synthetic
tttggacagaacatgttctttcatgctttggggagaacaggatataccattcatgtgcaatgtaatgccaccaag

SEQ ID NO: 292439 - DNA, 75 bp, Artificial Sequence
  Synthetic
ctttggggagaacaggatataccattcatgtgcaatgtaatgccaccaagttccacagcggatgtcttttggtag

SEQ ID NO: 292440 - DNA, 75 bp, Artificial Sequence
  Synthetic
ttcaaatcaaaacagagaaccgaaccagtttgtgttttgattcatggttcacctggatcaggtaagtcactaacc

SEQ ID NO: 292441 - DNA, 75 bp, Artificial Sequence
  Synthetic
cagtttgtgttttgattcatggttcacctggatcaggtaagtcactaaccacatccattattggcagggctatag

SEQ ID NO: 292442 - DNA, 75 bp, Artificial Sequence
  Synthetic
gttaagtacaagtacacgcatccaggtgaacaaggcatagaactaagcaatttggctgaagaagggggagcatca

SEQ ID NO: 292443 - DNA, 75 bp, Artificial Sequence
  Synthetic
gtgaacaaggcatagaactaagcaatttggctgaagaagggggagcatcacatgacccagtatattctatgaatg

SEQ ID NO: 292444 - DNA, 75 bp, Artificial Sequence
  Synthetic
tttgatggttaccaacagcaggaagtggtgatcatggatgatctaaatcaaaatccagatggccaggatatcagt

SEQ ID NO: 292445 - DNA, 75 bp, Artificial Sequence
  Synthetic
tggtgatcatggatgatctaaatcaaaatccagatggccaggatatcagtatgttctgtcagatggtttcatcag

SEQ ID NO: 292446 - DNA, 75 bp, Artificial Sequence
  Synthetic
agaacaaataacactgctacgatcattgtgccttacataaattcagtaccaatggactccatgaccagacacaat

SEQ ID NO: 292447 - DNA, 75 bp, Artificial Sequence
  Synthetic
ttgtgccttacataaattcagtaccaatggactccatgaccagacacaataatctatccctattagttattccag

SEQ ID NO: 292448 - DNA, 75 bp, Artificial Sequence
  Synthetic
actagcaattttgttcttgcatcaaccaactcaaacacactaagccctccaacaatcctaaacccagaagcactg

SEQ ID NO: 292449 - DNA, 75 bp, Artificial Sequence
  Synthetic
ccaactcaaacacactaagccctccaacaatcctaaacccagaagcactggctaggaggtttggatttgatctgg

SEQ ID NO: 292450 - DNA, 75 bp, Artificial Sequence
  Synthetic
gtaaccattgcccccatgtgtacagaattttcaggcattagatcacaagccgtgaagatacagggcttacctacc

SEQ ID NO: 292451 - DNA, 75 bp, Artificial Sequence
  Synthetic
aattttcaggcattagatcacaagccgtgaagatacagggcttacctaccttaaccacccccggatctggccagt

SEQ ID NO: 292452 - DNA, 75 bp, Artificial Sequence
  Synthetic
atggcaactgaactttgtaaagactgtcataaacccagtaacttcagcaggtgttgcccattgatatgtggaaaa

SEQ ID NO: 292453 - DNA, 75 bp, Artificial Sequence
  Synthetic
gtcataaacccagtaacttcagcaggtgttgcccattgatatgtggaaaagctatcagtcttgtagaccgatcca

SEQ ID NO: 292454 - DNA, 75 bp, Artificial Sequence
  Synthetic
ccaaccccaccaatacacattcctggtgaagttcacaatctattagaaattatacaagtagacactcttattcct

SEQ ID NO: 292455 - DNA, 75 bp, Artificial Sequence
  Synthetic
gtgaagttcacaatctattagaaattatacaagtagacactcttattcctatgaacaacaaaggtaccactgata

SEQ ID NO: 292456 - DNA, 75 bp, Artificial Sequence
  Synthetic
tataataataaactaaaaatcactgactccctagaggttctgtttcaaggacctgtttacaaagacctggaaata

SEQ ID NO: 292457 - DNA, 75 bp, Artificial Sequence
  Synthetic
atatttggcaccagattgtttataggggatggggtgttcaaaaccacactgtttggagaaattgcacagtactat

SEQ ID NO: 292458 - DNA, 75 bp, Artificial Sequence
  Synthetic
gggatggggtgttcaaaaccacactgtttggagaaattgcacagtactatacccactggtcaggttccatcagaa

SEQ ID NO: 292459 - DNA, 75 bp, Artificial Sequence
  Synthetic
tgttgattctgaggagcttagggaatactgcaaacagaaaaattggcttatcccagaaattccaacaaacataga

SEQ ID NO: 292460 - DNA, 75 bp, Artificial Sequence
  Synthetic
tactgcaaacagaaaaattggcttatcccagaaattccaacaaacatagaaagagcagtgaaccaggctagcacc

SEQ ID NO: 292461 - DNA, 75 bp, Artificial Sequence
  Synthetic
gcatacactccacctggaactgaaggacctaaatccagaagagaagcaatgcttggcacgcatgttgtctgggat

SEQ ID NO: 292462 - DNA, 75 bp, Artificial Sequence
  Synthetic
gacctaaatccagaagagaagcaatgcttggcacgcatgttgtctgggatgtcggtcttcaatcaacggttgtca

SEQ ID NO: 292463 - DNA, 75 bp, Artificial Sequence
  Synthetic
aatatacaagctatttgcacaaacccaaggtccgtattctggtaacccctcacacacaaaactaaagccaccaac

SEQ ID NO: 292464 - DNA, 75 bp, Artificial Sequence
  Synthetic
caaggtccgtattctggtaacccctcacacacaaaactaaagccaccaacactacgacaagtggtagtgcaaggt

SEQ ID NO: 292465 - DNA, 75 bp, Artificial Sequence
  Synthetic
acatacactagtgctggtcacctttcatgttggtatcaaacatccctcattctaccaccagatacaacaggtgct

SEQ ID NO: 292466 - DNA, 75 bp, Artificial Sequence
  Synthetic
catgttggtatcaaacatccctcattctaccaccagatacaacaggtgctgtgcaccttttggcattcattagtg

SEQ ID NO: 292467 - DNA, 75 bp, Artificial Sequence
  Synthetic
tactaccactaagggagagttcacagcattgggaattcatgatagagtctgtgtggtacccacgcactcccagcc

SEQ ID NO: 292468 - DNA, 75 bp, Artificial Sequence
  Synthetic
gcattgggaattcatgatagagtctgtgtggtacccacgcactcccagcccgatgatgaagtgttggttaatgga

SEQ ID NO: 292469 - DNA, 75 bp, Artificial Sequence
  Synthetic
caaacagaagctctcacggaagggtttgaaggtgagttggaagaagttgttattgacaaaatgaaacaggtaaca

SEQ ID NO: 292470 - DNA, 75 bp, Artificial Sequence
  Synthetic
ttgaaggtgagttggaagaagttgttattgacaaaatgaaacaggtaacagcttcaagccagagtgggtcaaaat

SEQ ID NO: 292471 - DNA, 75 bp, Artificial Sequence
  Synthetic
taacctagaattaaccataatagttttggatagaaatgaaaaatttagggacataagagcatttatagcagaaga

SEQ ID NO: 292472 - DNA, 75 bp, Artificial Sequence
  Synthetic
ccaacagacccgtctgacaatgtggaaaccagaaccacgtacatgcattatactggatcagagaccaccttagag

SEQ ID NO: 292473 - DNA, 75 bp, Artificial Sequence
  Synthetic
gtaataaactccaacaatttcaaagacaccatcctagaagtgggccagttgacttttgctggtctaataaatttg

SEQ ID NO: 292474 - DNA, 75 bp, Artificial Sequence
  Synthetic
aaaccagaaccacgtacatgcattatactggatcagagaccaccttagagaatttcttaggtaggtcagcttgtg

SEQ ID NO: 292475 - DNA, 75 bp, Artificial Sequence
  Synthetic
aggtcagtgcggtggtgtgttgtgctcgactggcaagatatatggaattcatgttggcgggaatgggcggcaagg

SEQ ID NO: 292476 - DNA, 75 bp, Artificial Sequence
  Synthetic
ggcggcaacatgaaaaacactcacaaggaacaaaaattatttaatgactggaaaataaatttatccagtttggtg

SEQ ID NO: 292477 - DNA, 75 bp, Artificial Sequence
  Synthetic
aggaacaaaaattatttaatgactggaaaataaatttatccagtttggtgcaatttaggaaaaagctagaacttt

SEQ ID NO: 292478 - DNA, 75 bp, Artificial Sequence
  Synthetic
tattttgtggaaaaacaaggagcaatcaccactaggaaaaatgtcagggaaatgggactaaaacctattaacacc

SEQ ID NO: 292479 - DNA, 75 bp, Artificial Sequence
  Synthetic
tcaccactaggaaaaatgtcagggaaatgggactaaaacctattaacacccctaccaaaacaaagctccacccca

SEQ ID NO: 292480 - DNA, 75 bp, Artificial Sequence
  Synthetic
caacctgaaacagcccaatacgccagtaatttaacagtacaagcaatgtacgtccctccaggtgcaccaaatccc

SEQ ID NO: 292481 - DNA, 75 bp, Artificial Sequence
  Synthetic
gtaatttaacagtacaagcaatgtacgtccctccaggtgcaccaaatcccattaaatgggatgattacacgtggc

SEQ ID NO: 292482 - DNA, 75 bp, Artificial Sequence
  Synthetic
gacgcagaccccaggttggaggttaacctgcgtgactccctgttttcaaaatacagggggaatgttgaaactgac

SEQ ID NO: 292483 - DNA, 75 bp, Artificial Sequence
  Synthetic
acctgcgtgactccctgttttcaaaatacagggggaatgttgaaactgacatcacagagaacatgcaggtggcca

SEQ ID NO: 292484 - DNA, 75 bp, Artificial Sequence
  Synthetic
ttcagtgtaccctttataggtattgcatcagcttacaactgtttttatgatggatactcacatgataatgaagac

SEQ ID NO: 292485 - DNA, 75 bp, Artificial Sequence
  Synthetic
catcagcttacaactgtttttatgatggatactcacatgataatgaagacacaccatatggtataaatgtcctga

SEQ ID NO: 292486 - DNA, 75 bp, Artificial Sequence
  Synthetic
ttgtcacttaaagaagccttgtatggtacagatggactagaaccaattgacataaacaccagtgctggctacccg

SEQ ID NO: 292487 - DNA, 75 bp, Artificial Sequence
  Synthetic
gtacagatggactagaaccaattgacataaacaccagtgctggctacccgtatgtgagtctagggattaaaaaga

SEQ ID NO: 292488 - DNA, 75 bp, Artificial Sequence
  Synthetic
acaacccttgtcaagataagggttttccacagacctaagcacattagagcttggataccaagaccacccagagca

SEQ ID NO: 292489 - DNA, 75 bp, Artificial Sequence
  Synthetic
tccacagacctaagcacattagagcttggataccaagaccacccagagcattaccttacacctctataggaagaa

SEQ ID NO: 292490 - DNA, 75 bp, Artificial Sequence
  Synthetic
ttagataaatatggcatagatttaccacttgtcacatacatcaaggatgaactcagaggcaaggataaagttaga

SEQ ID NO: 292491 - DNA, 75 bp, Artificial Sequence
  Synthetic
cacttgtcacatacatcaaggatgaactcagaggcaaggataaagttagattaggtaagagtagattgatagaag

SEQ ID NO: 292492 - DNA, 75 bp, Artificial Sequence
  Synthetic
accacctacgggggaaactccaggtttggagcagtctacacttgcaattataaaataatgaattaccacctgatg

SEQ ID NO: 292493 - DNA, 75 bp, Artificial Sequence
  Synthetic
ttggagcagtctacacttgcaattataaaataatgaattaccacctgatgacgcatgaagatcatttaaaccttt

SEQ ID NO: 292494 - DNA, 75 bp, Artificial Sequence
  Synthetic
tacaaggcttttcatttaaaccctggtgtaataactggatcagctgtgggatgtgacccggacacattctggtct

SEQ ID NO: 292495 - DNA, 75 bp, Artificial Sequence
  Synthetic
ggctcagaaataatcccacattgcaattgtacttcaggggtctattactcccagtactacaataaatactaccca

SEQ ID NO: 292496 - DNA, 75 bp, Artificial Sequence
  Synthetic
attgtacttcaggggtctattactcccagtactacaataaatactacccaataatatgtgataaacccacaaata

SEQ ID NO: 292497 - DNA, 75 bp, Artificial Sequence
  Synthetic
cttcgacgcctcactatccccagtatggttcaaatgtcttgagcaggtgcttgctaaacttggatttaaacattc

SEQ ID NO: 292498 - DNA, 75 bp, Artificial Sequence
  Synthetic
tggttcaaatgtcttgagcaggtgcttgctaaacttggatttaaacattctaatcttataagaacaatttgcaac

SEQ ID NO: 292499 - DNA, 75 bp, Artificial Sequence
  Synthetic
atgaaaggtgttggtccagctgaacccggggattgtggtggaatcttgcgatgtgtacatggcccaatcggcctg

SEQ ID NO: 292500 - DNA, 75 bp, Artificial Sequence
  Synthetic
ccggggattgtggtggaatcttgcgatgtgtacatggcccaatcggcctgttaacagcaggcgggagcgggtatg

SEQ ID NO: 292501 - DNA, 75 bp, Artificial Sequence
  Synthetic
atctgggtgttcaggcacaagtgtcttcaattcaatgataaacaacataatcattagaacattaatattagatgt

SEQ ID NO: 292502 - DNA, 75 bp, Artificial Sequence
  Synthetic
tcattagaacattaatattagatgtttacaaaggtattgatcttgacaagctgaaagtgattgcttatggtgatg

SEQ ID NO: 292503 - DNA, 75 bp, Artificial Sequence
  Synthetic
attactgattacataacaagcttgggaaaggcatttggtgtgggtttcacagaccaaatatcagcaaaagtttca

SEQ ID NO: 292504 - DNA, 75 bp, Artificial Sequence
  Synthetic
gaaaggcatttggtgtgggtttcacagaccaaatatcagcaaaagtttcagaacttcaggacagtgtcaaggatt

SEQ ID NO: 292505 - DNA, 75 bp, Artificial Sequence
  Synthetic
gctggcaagaaatatggcctgacaatcacacccccagataagtcagaaaaatttacaaaaacaacatgggaaaat

SEQ ID NO: 292506 - DNA, 75 bp, Artificial Sequence
  Synthetic
gtgatcatatgcagaaatcatgaagatttggtcacagtcaccgccacattggcattgcttggatgtgacgggtcg

SEQ ID NO: 292507 - DNA, 75 bp, Artificial Sequence
  Synthetic
ggcctgacccacaatatccttttctcatacacccagtgatgccaatgcaagacattcatgagtccattcgttgga

SEQ ID NO: 292508 - DNA, 75 bp, Artificial Sequence
  Synthetic
atttggtcacagtcaccgccacattggcattgcttggatgtgacgggtcgccttggagatttctcaagatgtaca

SEQ ID NO: 292509 - DNA, 75 bp, Artificial Sequence
  Synthetic
gcttggcattctggagaagaagaatacaagaactttactgagaaaatcagatcaaccagcattggcaaatgcttg

SEQ ID NO: 292510 - DNA, 75 bp, Artificial Sequence
  Synthetic
tggttcaggaaattcaatgatgcttgcaatgcagccaaaggtctggaatggatagcaaacaaaatctccaagcta

SEQ ID NO: 292511 - DNA, 75 bp, Artificial Sequence
  Synthetic
gcaatgcagccaaaggtctggaatggatagcaaacaaaatctccaagctaatagaatggataaagacaaagataa

SEQ ID NO: 292512 - DNA, 75 bp, Artificial Sequence
  Synthetic
ttaatcccagagtacagtgtcttacgccgacgctggttagatctgttctaaataatatagatttataatttgatt

SEQ ID NO: 292513 - DNA, 75 bp, Artificial Sequence
  Synthetic
ttaaaacagtggatgggtttcctaccatccgacccactgggtgtagtgctctggtatattgtacctttgcacgcc

SEQ ID NO: 292514 - DNA, 75 bp, Artificial Sequence
  Synthetic
gacatcatggagaggcaaattgcaacaatgcatgtttctaatccaacacaggagaaaagagaacagctttttaac

SEQ ID NO: 292515 - DNA, 75 bp, Artificial Sequence
  Synthetic
ctggtatattgtacctttgcacgcctgttttcccattgtacccttccttaaattcctccccatgtaacgttagaa

SEQ ID NO: 292516 - DNA, 75 bp, Artificial Sequence
  Synthetic
tgttttcccattgtacccttccttaaattcctccccatgtaacgttagaagtttaagaacataaatgtacaatag

SEQ ID NO: 292517 - DNA, 75 bp, Artificial Sequence
  Synthetic
caatgcatgtttctaatccaacacaggagaaaagagaacagctttttaacaacgttttgtggttggagcaaatgt

SEQ ID NO: 292518 - DNA, 75 bp, Artificial Sequence
  Synthetic
ttaaaaacaaagatggtaaactacatgcaattcaaatctaagcaaagaactgaaccggtctgcgtcttgatacac

SEQ ID NO: 292519 - DNA, 75 bp, Artificial Sequence
  Synthetic
gcgaggtataagcggtacccactgctgaaagcctttaaccgttaaccgccaatcaactacgtaacggctagtatt

SEQ ID NO: 292520 - DNA, 75 bp, Artificial Sequence
  Synthetic
tgcaattcaaatctaagcaaagaactgaaccggtctgcgtcttgatacacggctctcccggatcagggaaatcat

SEQ ID NO: 292521 - DNA, 75 bp, Artificial Sequence
  Synthetic
tcaggtggttccccccactagtttggtcgatgaggctaggagttccccacgggcgaccgtgtcctagcctgcgtg

SEQ ID NO: 292522 - DNA, 75 bp, Artificial Sequence
  Synthetic
gtttactcacttcccccagatccaaaacattttgatggttaccaacaacaagaagtggtaattatggatgattta

SEQ ID NO: 292523 - DNA, 75 bp, Artificial Sequence
  Synthetic
aacattttgatggttaccaacaacaagaagtggtaattatggatgatttaaaccaaaacccggatggtcaagaca

SEQ ID NO: 292524 - DNA, 75 bp, Artificial Sequence
  Synthetic
gctagtctagacaacaaagggattttattcaccagcaatttcgttcttgcatcaactaattcaaatacacttagt

SEQ ID NO: 292525 - DNA, 75 bp, Artificial Sequence
  Synthetic
tattcaccagcaatttcgttcttgcatcaactaattcaaatacacttagtcctccaacaattttaaacccagaag

SEQ ID NO: 292526 - DNA, 75 bp, Artificial Sequence
  Synthetic
ctttgggtgtccgtgtttctctttattctttacattgtcttatggtcacagcatatataatacatatatactgtg

SEQ ID NO: 292527 - DNA, 75 bp, Artificial Sequence
  Synthetic
ttctttacattgtcttatggtcacagcatatataatacatatatactgtgatcatgggcgcacagatttcaactc

SEQ ID NO: 292528 - DNA, 75 bp, Artificial Sequence
  Synthetic
tatactaaatctggaaaattgaatgcagcaatggcaacagaactctgtaaagactgtcacaagcccagcaacttt

SEQ ID NO: 292529 - DNA, 75 bp, Artificial Sequence
  Synthetic
cagcaatggcaacagaactctgtaaagactgtcacaagcccagcaactttaataaatgctgcccactgatatgcg

SEQ ID NO: 292530 - DNA, 75 bp, Artificial Sequence
  Synthetic
cagactttcacagttataaattattacaaagatgcagctagctcatcatcagctggccaatcactatcaatggat

SEQ ID NO: 292531 - DNA, 75 bp, Artificial Sequence
  Synthetic
acaaagatgcagctagctcatcatcagctggccaatcactatcaatggatccatcaaaatttactgaaccagtta

SEQ ID NO: 292532 - DNA, 75 bp, Artificial Sequence
  Synthetic
gaccagttagtcacagcaatcataactgactttaataataaattgaaaattacagattcactggaagttttgttc

SEQ ID NO: 292533 - DNA, 75 bp, Artificial Sequence
  Synthetic
ctgactttaataataaattgaaaattacagattcactggaagttttgttccagggccctgtttacaaagatttgg

SEQ ID NO: 292534 - DNA, 75 bp, Artificial Sequence
  Synthetic
gcgtgtggctacagtgacagagttgagcaaatcactattggcaattcaaccataacaacccaagaggcagctaat

SEQ ID NO: 292535 - DNA, 75 bp, Artificial Sequence
  Synthetic
agcaaatcactattggcaattcaaccataacaacccaagaggcagctaatgcaatagtggcttatgcagaatggc

SEQ ID NO: 292536 - DNA, 75 bp, Artificial Sequence
  Synthetic
aagtctgttgattctgaggaactcagagagtattgtaaacagaagaattggcttatcccagagatcccaaccaat

SEQ ID NO: 292537 - DNA, 75 bp, Artificial Sequence
  Synthetic
gagagtattgtaaacagaagaattggcttatcccagagatcccaaccaatatagaaagagcagtaaaccaagcta

SEQ ID NO: 292538 - DNA, 75 bp, Artificial Sequence
  Synthetic
ccagacacatctgcatgtagattctatacacttgctagtaaaacatggagtcctgcgtccagaggatggtgttgg

SEQ ID NO: 292539 - DNA, 75 bp, Artificial Sequence
  Synthetic
atacacttgctagtaaaacatggagtcctgcgtccagaggatggtgttggaagttgcctgatgctcttaaggaca

SEQ ID NO: 292540 - DNA, 75 bp, Artificial Sequence
  Synthetic
tatgtaatatacaagttatttgcacaaacacaaggtccatactcaggtaatccctcacacaccaaactaaaaccg

SEQ ID NO: 292541 - DNA, 75 bp, Artificial Sequence
  Synthetic
aaacacaaggtccatactcaggtaatccctcacacaccaaactaaaaccgcctactttacgacaagtggtggttc

SEQ ID NO: 292542 - DNA, 75 bp, Artificial Sequence
  Synthetic
tataccatccatgtacaatgcaatgctacaaaattccacagtggaactttactagtagtaatcattccagaacac

SEQ ID NO: 292543 - DNA, 75 bp, Artificial Sequence
  Synthetic
ctacaaaattccacagtggaactttactagtagtaatcattccagaacaccagttggcatcagcaaatggtggca

SEQ ID NO: 292544 - DNA, 75 bp, Artificial Sequence
  Synthetic
accatcactactgctaagggagaattcacagcactaggaatctatgatagggtttgcgtagtgcccacgcactcg

SEQ ID NO: 292545 - DNA, 75 bp, Artificial Sequence
  Synthetic
tcacagcactaggaatctatgatagggtttgcgtagtgcccacgcactcgcaacctgatgatgaagtattagtta

SEQ ID NO: 292546 - DNA, 75 bp, Artificial Sequence
  Synthetic
ttaggaagtgaagtcaaagatggaccaatgactgaccctatatataacatggatgggacgttactcggtaatgtt

SEQ ID NO: 292547 - DNA, 75 bp, Artificial Sequence
  Synthetic
caatgactgaccctatatataacatggatgggacgttactcggtaatgttctcatcttcccacatcaatttatca

SEQ ID NO: 292548 - DNA, 75 bp, Artificial Sequence
  Synthetic
aatactaacttagaattaactatattagttttagacagaaatgaaaagtttagagatataagagcattcatagca

SEQ ID NO: 292549 - DNA, 75 bp, Artificial Sequence
  Synthetic
tagttttagacagaaatgaaaagtttagagatataagagcattcatagcagatgatccagagggaatggaaggaa

SEQ ID NO: 292550 - DNA, 75 bp, Artificial Sequence
  Synthetic
gccccaatggattcaatgactagacacaataacctgtcacttttggtgatcccggttgtaccaataacagctagt

SEQ ID NO: 292551 - DNA, 75 bp, Artificial Sequence
  Synthetic
acaataacctgtcacttttggtgatcccggttgtaccaataacagctagtaccgggtcagcacctagtatacctg

SEQ ID NO: 292552 - DNA, 75 bp, Artificial Sequence
  Synthetic
cagttaacttttgctggcttaataaaccttagtagcgttccaacaaaccgaatgatacgctacgaatatcccaca

SEQ ID NO: 292553 - DNA, 75 bp, Artificial Sequence
  Synthetic
accttagtagcgttccaacaaaccgaatgatacgctacgaatatcccacaagaacaggtcagtgtggtggtgtcc

SEQ ID NO: 292554 - DNA, 75 bp, Artificial Sequence
  Synthetic
aaaacagtaataacaccacagggcttgccaacaacactgacacctggctctgaacaatttctgactactgatgat

SEQ ID NO: 292555 - DNA, 75 bp, Artificial Sequence
  Synthetic
tgccaacaacactgacacctggctctgaacaatttctgactactgatgatagacagtcaccatcagccttaccaa

SEQ ID NO: 292556 - DNA, 75 bp, Artificial Sequence
  Synthetic
caaggcttctcagcacaactgaagaaacaatattttgttgaaaaacaaggagcaatcatcaataaaagaagtgta

SEQ ID NO: 292557 - DNA, 75 bp, Artificial Sequence
  Synthetic
aacaatattttgttgaaaaacaaggagcaatcatcaataaaagaagtgtaagagaattaggtttgaaacccatta

SEQ ID NO: 292558 - DNA, 75 bp, Artificial Sequence
  Synthetic
ttggaactaatacaagtagacacaatgattccaataaataatgttacagaattagatactatagataaatacaga

SEQ ID NO: 292559 - DNA, 75 bp, Artificial Sequence
  Synthetic
tgattccaataaataatgttacagaattagatactatagataaatacagagtgccattaattcaaggccaacagg

SEQ ID NO: 292560 - DNA, 75 bp, Artificial Sequence
  Synthetic
ccagggtcaaaagaaccagcagctctgaatggctctgatcccagactggaggtcaatctgcgtgattctctattc

SEQ ID NO: 292561 - DNA, 75 bp, Artificial Sequence
  Synthetic
tgaatggctctgatcccagactggaggtcaatctgcgtgattctctattctcaaaatataaagggaacatagaaa

SEQ ID NO: 292562 - DNA, 75 bp, Artificial Sequence
  Synthetic
acaacactactaggtgaaattgcacagtattatacacattgggcaggctcaattaggatatcgttcatgtataca

SEQ ID NO: 292563 - DNA, 75 bp, Artificial Sequence
  Synthetic
agtattatacacattgggcaggctcaattaggatatcgttcatgtatacaggaccagctctatctagtgcaaaat

SEQ ID NO: 292564 - DNA, 75 bp, Artificial Sequence
  Synthetic
ttgctatcactagacatacctaccaatgaactatcactcaaggaagctctatacgggacggatgggttggaacca

SEQ ID NO: 292565 - DNA, 75 bp, Artificial Sequence
  Synthetic
atgaactatcactcaaggaagctctatacgggacggatgggttggaaccaatcgacattaacaccagtgccggtt

SEQ ID NO: 292566 - DNA, 75 bp, Artificial Sequence
  Synthetic
gatgcaatgttgggtactcatgtaatctgggatattggtttgcaatcaacagtagtaatgaacataccttggact

SEQ ID NO: 292567 - DNA, 75 bp, Artificial Sequence
  Synthetic
tctgggatattggtttgcaatcaacagtagtaatgaacataccttggactgctggagctcaattcagatatactg

SEQ ID NO: 292568 - DNA, 75 bp, Artificial Sequence
  Synthetic
actcaagatgttgctaagatggaacactacctagacaaatatggtattgacctgccactagtcacatatataaag

SEQ ID NO: 292569 - DNA, 75 bp, Artificial Sequence
  Synthetic
actacctagacaaatatggtattgacctgccactagtcacatatataaaggatgaactcagaagtaaagacaaaa

SEQ ID NO: 292570 - DNA, 75 bp, Artificial Sequence
  Synthetic
tcattagtcctgccacctggcacgaatcagaatgtgtacatacttgggtttgttagtgcatgtccagacttcaaa

SEQ ID NO: 292571 - DNA, 75 bp, Artificial Sequence
  Synthetic
atcagaatgtgtacatacttgggtttgttagtgcatgtccagacttcaaattgagactattaaaggatacatcat

SEQ ID NO: 292572 - DNA, 75 bp, Artificial Sequence
  Synthetic
gtgaacatgagagtgaagttgggcaacttgtataaggctttccacacaaaccctggggtgataactggttcagca

SEQ ID NO: 292573 - DNA, 75 bp, Artificial Sequence
  Synthetic
acttgtataaggctttccacacaaaccctggggtgataactggttcagcagtggggtgtgacccagacacatttt

SEQ ID NO: 292574 - DNA, 75 bp, Artificial Sequence
  Synthetic
gaagtaatagtcgacaaagcgaaacagactattgcttcagttgtaagtaattccaaacacacacaaaaggttcca

SEQ ID NO: 292575 - DNA, 75 bp, Artificial Sequence
  Synthetic
agactattgcttcagttgtaagtaattccaaacacacacaaaaggttccaacactatcagctagtgaaacaggag

SEQ ID NO: 292576 - DNA, 75 bp, Artificial Sequence
  Synthetic
tcaaattttgatgcttctctgtccccagtgtggttcaagtgccttgaacaggttctctccaagctcggattcaaa

SEQ ID NO: 292577 - DNA, 75 bp, Artificial Sequence
  Synthetic
cagtgtggttcaagtgccttgaacaggttctctccaagctcggattcaaacactctaacctgatccagacaatat

SEQ ID NO: 292578 - DNA, 75 bp, Artificial Sequence
  Synthetic
atgcactatgatggtacagaaacaagtttagaaagttttctgggcagagctgcttgtgtacatgtaactgacata

SEQ ID NO: 292579 - DNA, 75 bp, Artificial Sequence
  Synthetic
gtttagaaagttttctgggcagagctgcttgtgtacatgtaactgacatagaaaataaactccccactagagagt

SEQ ID NO: 292580 - DNA, 75 bp, Artificial Sequence
  Synthetic
atgccatcagggtgttcaggtaccagtatttttaattcaatgataaacaacataatcattagaacattaatattg

SEQ ID NO: 292581 - DNA, 75 bp, Artificial Sequence
  Synthetic
gtatttttaattcaatgataaacaacataatcattagaacattaatattggatgtttacaaaggaattgatcttg

SEQ ID NO: 292582 - DNA, 75 bp, Artificial Sequence
  Synthetic
agcttagtacaattaaggagaaaattagatatgttcacttatgtaagatttgattcagagtatactataattgct

SEQ ID NO: 292583 - DNA, 75 bp, Artificial Sequence
  Synthetic
tagatatgttcacttatgtaagatttgattcagagtatactataattgctacatcatcacaaccacaagatgcac

SEQ ID NO: 292584 - DNA, 75 bp, Artificial Sequence
  Synthetic
tttgaactgcaaccagaattactagcacttgctggtaagaagtatggtctcacaatcacacctccagacaagtca

SEQ ID NO: 292585 - DNA, 75 bp, Artificial Sequence
  Synthetic
cacttgctggtaagaagtatggtctcacaatcacacctccagacaagtcagaaaagtttgtgaaaacaacatggg

SEQ ID NO: 292586 - DNA, 75 bp, Artificial Sequence
  Synthetic
ccaaatccacaagaatgggatgattatacttggcaaagtgcttcaaaccccagtgttttcttcaatgttggcaaa

SEQ ID NO: 292587 - DNA, 75 bp, Artificial Sequence
  Synthetic
atacttggcaaagtgcttcaaaccccagtgttttcttcaatgttggcaaatcagcgcgattcagtgttccttatt

SEQ ID NO: 292588 - DNA, 75 bp, Artificial Sequence
  Synthetic
ttcctcattcacccagtaatgccaatgcaagatatacacgaatccatccgatggacgcgtgatcccaaaaacaca

SEQ ID NO: 292589 - DNA, 75 bp, Artificial Sequence
  Synthetic
tgcaagatatacacgaatccatccgatggacgcgtgatcccaaaaacacacaggatcatgtgcgctctctgtgta

SEQ ID NO: 292590 - DNA, 75 bp, Artificial Sequence
  Synthetic
gacaagaccacagtctatgggataaatgtactcaatcatatgggcagtatagcattcagggttgtcaatgagaat

SEQ ID NO: 292591 - DNA, 75 bp, Artificial Sequence
  Synthetic
atgtactcaatcatatgggcagtatagcattcagggttgtcaatgagaatgatgcacaccttaccaaagtaaaaa

SEQ ID NO: 292592 - DNA, 75 bp, Artificial Sequence
  Synthetic
attagatccaccaacattggtaaatgtctgttaataccagaatatagtgtcctacgccgaagatggctggatctg

SEQ ID NO: 292593 - DNA, 75 bp, Artificial Sequence
  Synthetic
gtctgttaataccagaatatagtgtcctacgccgaagatggctggatctgttttaaataatatagatttgtgatt

SEQ ID NO: 292594 - DNA, 75 bp, Artificial Sequence
  Synthetic
cccagagccaagccatatcttaagatcgggagaactaactatgataaatcaggacatgtgatccctaaaagagat

SEQ ID NO: 292595 - DNA, 75 bp, Artificial Sequence
  Synthetic
catccgacccaatgggtgtagtactctggtattctgtacctttgtacgcctgtttctccccacccccccgtccta

SEQ ID NO: 292596 - DNA, 75 bp, Artificial Sequence
  Synthetic
tcgggagaactaactatgataaatcaggacatgtgatccctaaaagagatggcatatcaacttacggatttggcc

SEQ ID NO: 292597 - DNA, 75 bp, Artificial Sequence
  Synthetic
ctggtattctgtacctttgtacgcctgtttctccccacccccccgtcctaaataatcccagtaacttagaagatt

SEQ ID NO: 292598 - DNA, 75 bp, Artificial Sequence
  Synthetic
ttaatgactcatgaggacatgctaaacttgcaaactccactcccagaaagggacttagcagtggttaacattaat

SEQ ID NO: 292599 - DNA, 75 bp, Artificial Sequence
  Synthetic
acttgcaaactccactcccagaaagggacttagcagtggttaacattaatgcccatggatcagagactgttcccc

SEQ ID NO: 292600 - DNA, 75 bp, Artificial Sequence
  Synthetic
tatcccataatttgtgaaaaacccacttgtatctggatcgaaggcagtaattactacccaagtagatatcaacaa

SEQ ID NO: 292601 - DNA, 75 bp, Artificial Sequence
  Synthetic
cttgtatctggatcgaaggcagtaattactacccaagtagatatcaacaaggagttatgaaaggggtgggaccag

SEQ ID NO: 292602 - DNA, 75 bp, Artificial Sequence
  Synthetic
ttaattgtgacatggtgcgaagacccacgtgtgcttaattgtgagtcctccggcccccgaatgcggctaacctaa

SEQ ID NO: 292603 - DNA, 75 bp, Artificial Sequence
  Synthetic
gggatactaactgctgggggtggtggttatgtctgctttgcagatatcagaggcttggatatgttccatgcagaa

SEQ ID NO: 292604 - DNA, 75 bp, Artificial Sequence
  Synthetic
attctgggacgggaccgactactttgggtgtccgtgtttcctgttattctcaaattgttcttatggtcacaatat

SEQ ID NO: 292605 - DNA, 75 bp, Artificial Sequence
  Synthetic
gttatgtctgctttgcagatatcagaggcttggatatgttccatgcagaataccagggaatatctgattacatct

SEQ ID NO: 292606 - DNA, 75 bp, Artificial Sequence
  Synthetic
gggtgtccgtgtttcctgttattctcaaattgttcttatggtcacaatataagtaatatatatattgtgatcatg

SEQ ID NO: 292607 - DNA, 75 bp, Artificial Sequence
  Synthetic
aaagtcagtgagttacaaaatataacaatgggatacttgaatacaaaagtcttgtccaaggtaatcaaaattgtt

SEQ ID NO: 292608 - DNA, 75 bp, Artificial Sequence
  Synthetic
tttgacaaatggctcaacacaacactttacagttataaattattacaaagatgctgcaagttcatcgtctgccgg

SEQ ID NO: 292609 - DNA, 75 bp, Artificial Sequence
  Synthetic
caatgggatacttgaatacaaaagtcttgtccaaggtaatcaaaattgtttcagctttagtaatcatatgtagaa

SEQ ID NO: 292610 - DNA, 75 bp, Artificial Sequence
  Synthetic
tttacagttataaattattacaaagatgctgcaagttcatcgtctgccggtcagtccttctcaatggatccttcc

SEQ ID NO: 292611 - DNA, 75 bp, Artificial Sequence
  Synthetic
gatggctccccctggagatttctaaagatgtatattagtaagcatttccacttaccctacatagaaagacaatct

SEQ ID NO: 292612 - DNA, 75 bp, Artificial Sequence
  Synthetic
gaactctcctaatgtagaagcgtgtggatacagtgatagggttcaacaaatcacgcttggaaactcaacaataac

SEQ ID NO: 292613 - DNA, 75 bp, Artificial Sequence
  Synthetic
agatgtatattagtaagcatttccacttaccctacatagaaagacaatctaatgatttgtggtttaagaagttta

SEQ ID NO: 292614 - DNA, 75 bp, Artificial Sequence
  Synthetic
ggatacagtgatagggttcaacaaatcacgcttggaaactcaacaataacaacccaagaggcagccaacgcagtt

SEQ ID NO: 292615 - DNA, 75 bp, Artificial Sequence
  Synthetic
tctaagttgatagaatgggttaaaaacaaaattctaccacaagccagggataaactggatttctgtaagaggctc

SEQ ID NO: 292616 - DNA, 75 bp, Artificial Sequence
  Synthetic
tgtaaacaagacttcacaacctgacacatcagtgtgtagattttatactttggaaagcaaaacatggaccaacag

SEQ ID NO: 292617 - DNA, 75 bp, Artificial Sequence
  Synthetic
acaaaattctaccacaagccagggataaactggatttctgtaagaggctcaaacaattggacatcttggaaagac

SEQ ID NO: 292618 - DNA, 75 bp, Artificial Sequence
  Synthetic
acatcagtgtgtagattttatactttggaaagcaaaacatggaccaacagttctaaaggatggtgttggaaactt

SEQ ID NO: 292619 - DNA, 75 bp, Artificial Sequence
  Synthetic
ttgttcaacaatgtgctatggttagagcagatgtcacagaaatttgccccactatacgcactggaagcaaaaaga

SEQ ID NO: 292620 - DNA, 75 bp, Artificial Sequence
  Synthetic
tgcgttggggagaacggggtacaccatccatgtgcaatgtaacgccaccaagttccatagcggctgtcttttggt

SEQ ID NO: 292621 - DNA, 75 bp, Artificial Sequence
  Synthetic
agcagatgtcacagaaatttgccccactatacgcactggaagcaaaaagaataagaacattaaaaaacaaaatga

SEQ ID NO: 292622 - DNA, 75 bp, Artificial Sequence
  Synthetic
atccatgtgcaatgtaacgccaccaagttccatagcggctgtcttttggtagttgtcgttcctgaacatcagctg

SEQ ID NO: 292623 - DNA, 75 bp, Artificial Sequence
  Synthetic
ttgattcatggcaccccagggtcagggaaatctcttgccacctccttaattggtagatctattgctgatatacat

SEQ ID NO: 292624 - DNA, 75 bp, Artificial Sequence
  Synthetic
aggtgaacaaggtatagacttagatagtgtagctgaaacagggggagcatcacacgatccagtatactccatgaa

SEQ ID NO: 292625 - DNA, 75 bp, Artificial Sequence
  Synthetic
ggaaatctcttgccacctccttaattggtagatctattgctgatatacataaatcttcagtttactccctcccac

SEQ ID NO: 292626 - DNA, 75 bp, Artificial Sequence
  Synthetic
agtgtagctgaaacagggggagcatcacacgatccagtatactccatgaatggaactttaataggaaacctttta

SEQ ID NO: 292627 - DNA, 75 bp, Artificial Sequence
  Synthetic
gatgatctaaaccagaatccaaatggtgaagatataagtacattctgccaaatggtatcgtcagttgatttcata

SEQ ID NO: 292628 - DNA, 75 bp, Artificial Sequence
  Synthetic
tattgtgccttacataaactcagtgccaatggattctatgaccagacataacaatgtatccctgttagtcatccc

SEQ ID NO: 292629 - DNA, 75 bp, Artificial Sequence
  Synthetic
gtgaagatataagtacattctgccaaatggtatcgtcagttgatttcataccaccaatggcaaacttagacaaca

SEQ ID NO: 292630 - DNA, 75 bp, Artificial Sequence
  Synthetic
ccaatggattctatgaccagacataacaatgtatccctgttagtcatcccagttgtgccgttggtaaatccagta

SEQ ID NO: 292631 - DNA, 75 bp, Artificial Sequence
  Synthetic
acactcaaccctccaactgtgttaaacccagaagctttagctcgtaggtttggttttgatttagacatgtgctta

SEQ ID NO: 292632 - DNA, 75 bp, Artificial Sequence
  Synthetic
agaattctcaggtatcagatcaaaagctgtggtgccacagggcttacccaccctaactacccccgggtctggcca

SEQ ID NO: 292633 - DNA, 75 bp, Artificial Sequence
  Synthetic
acccagaagctttagctcgtaggtttggttttgatttagacatgtgcttacattcttcttttacaaagtcaggta

SEQ ID NO: 292634 - DNA, 75 bp, Artificial Sequence
  Synthetic
gctgtggtgccacagggcttacccaccctaactacccccgggtctggccagtttctaacaacagatgatagacaa

SEQ ID NO: 292635 - DNA, 75 bp, Artificial Sequence
  Synthetic
acaaacttcaagaaatgttgcccattaatttgtggaaaagctctcagtttagtggacagacatacaaatgttaga

SEQ ID NO: 292636 - DNA, 75 bp, Artificial Sequence
  Synthetic
aggggaagttcataatctcctagaaattatacaagtagatactctaattcccatgaacaataagggtgctacaga

SEQ ID NO: 292637 - DNA, 75 bp, Artificial Sequence
  Synthetic
taatttgtggaaaagctctcagtttagtggacagacatacaaatgttagatatagtatagaccagctggttacag

SEQ ID NO: 292638 - DNA, 75 bp, Artificial Sequence
  Synthetic
attatacaagtagatactctaattcccatgaacaataagggtgctacagacactttggatgaatatcgcatccca

SEQ ID NO: 292639 - DNA, 75 bp, Artificial Sequence
  Synthetic
gtcctgtttcagggtcctgtgtataaagatttaactatagatgttaatgataaaccaccaccagattgcatagta

SEQ ID NO: 292640 - DNA, 75 bp, Artificial Sequence
  Synthetic
aggagatggggtgttcaagaccacactgtttggagagatagcacagtattatactcactggtcaggttctatcag

SEQ ID NO: 292641 - DNA, 75 bp, Artificial Sequence
  Synthetic
aagatttaactatagatgttaatgataaaccaccaccagattgcatagtagatctacttaagtcagttgatagtg

SEQ ID NO: 292642 - DNA, 75 bp, Artificial Sequence
  Synthetic
ctgtttggagagatagcacagtattatactcactggtcaggttctatcaggatctccctaatgtacacaggtcct

SEQ ID NO: 292643 - DNA, 75 bp, Artificial Sequence
  Synthetic
ccaacaaatatagatagggcagttaaccaggcaacatctttgataaacactatactcatgttcataaccacaatg

SEQ ID NO: 292644 - DNA, 75 bp, Artificial Sequence
  Synthetic
aggacctaaatccaggaaagaagcaatgctaggtacacatgtggtttgggatgtcggactgcagtcaacagttgt

SEQ ID NO: 292645 - DNA, 75 bp, Artificial Sequence
  Synthetic
accaggcaacatctttgataaacactatactcatgttcataaccacaatgggtattgtatatatgatttataaga

SEQ ID NO: 292646 - DNA, 75 bp, Artificial Sequence
  Synthetic
atgctaggtacacatgtggtttgggatgtcggactgcagtcaacagttgtcatgaatataccgtggacatctggt

SEQ ID NO: 292647 - DNA, 75 bp, Artificial Sequence
  Synthetic
ctaaaagcaccagtgttgcgcgcagtggttacacaagggcccaacaccgaatttgcattatcattgctcaggaag

SEQ ID NO: 292648 - DNA, 75 bp, Artificial Sequence
  Synthetic
ttcctgttggtaccagacatctctcattctaccaccagatacaacaggcaccgtgtatctattggcattcattag

SEQ ID NO: 292649 - DNA, 75 bp, Artificial Sequence
  Synthetic
tggttacacaagggcccaacaccgaatttgcattatcattgctcaggaagaacataattacaataacaacatcaa

SEQ ID NO: 292650 - DNA, 75 bp, Artificial Sequence
  Synthetic
attctaccaccagatacaacaggcaccgtgtatctattggcattcattagtgcatgtccagatttcaagctaagg

SEQ ID NO: 292651 - DNA, 75 bp, Artificial Sequence
  Synthetic
acacactcacaaccagaaaatgaagtccttctcaatggttacaataccaaaattaaagataaatggagactggta

SEQ ID NO: 292652 - DNA, 75 bp, Artificial Sequence
  Synthetic
gtttgaaggtgagttagaagaagttgttatcgataaaatgaaacaggtaacagcttcaagtcagagtggacctaa

SEQ ID NO: 292653 - DNA, 75 bp, Artificial Sequence
  Synthetic
tccttctcaatggttacaataccaaaattaaagataaatggagactggtagacccagacaacttaaatttggaga

SEQ ID NO: 292654 - DNA, 75 bp, Artificial Sequence
  Synthetic
gttatcgataaaatgaaacaggtaacagcttcaagtcagagtggacctaagtatactcaaaaggttccagcatta

SEQ ID NO: 292655 - DNA, 75 bp, Artificial Sequence
  Synthetic
ttcattgcagatgaagtagagtgccctgatgcaagtctagtaattcactccaacaattacaaaaacaccataatg

SEQ ID NO: 292656 - DNA, 75 bp, Artificial Sequence
  Synthetic
ggagactagaaccacatacatgcattttactggatcagaaacctccttggagaactttttaggaagatcagcttg

SEQ ID NO: 292657 - DNA, 75 bp, Artificial Sequence
  Synthetic
ctgatgcaagtctagtaattcactccaacaattacaaaaacaccataatgtcagtaggacacaccactatggctg

SEQ ID NO: 292658 - DNA, 75 bp, Artificial Sequence
  Synthetic
tttactggatcagaaacctccttggagaactttttaggaagatcagcttgtgttcacataacagaaatcaaaaat

SEQ ID NO: 292659 - DNA, 75 bp, Artificial Sequence
  Synthetic
tacccaactaaaactggacagtgtggtggagttttatgttcaacaggcaaaatttatggaatacatgttggtggt

SEQ ID NO: 292660 - DNA, 75 bp, Artificial Sequence
  Synthetic
caaagaacaagggttgtttaatgactggaaaataaatttgtccagtttggtgcaatttaggaaaaaactagaact

SEQ ID NO: 292661 - DNA, 75 bp, Artificial Sequence
  Synthetic
gtggagttttatgttcaacaggcaaaatttatggaatacatgttggtggtaatggaaaacagggtttttcagcac

SEQ ID NO: 292662 - DNA, 75 bp, Artificial Sequence
  Synthetic
tggaaaataaatttgtccagtttggtgcaatttaggaaaaaactagaactctttacttatgtaaggtttgactct

SEQ ID NO: 292663 - DNA, 75 bp, Artificial Sequence
  Synthetic
agaaaagtacaagaattgggaatgaaaccaataaatacacccaacaaaacaaaattgcttccgagtgttttctac

SEQ ID NO: 292664 - DNA, 75 bp, Artificial Sequence
  Synthetic
cagtaacctaacagttcaagcaatgtatgtccctccaggtgcaccaaatcccattaaatgggatgactacacgtg

SEQ ID NO: 292665 - DNA, 75 bp, Artificial Sequence
  Synthetic
aaccaataaatacacccaacaaaacaaaattgcttccgagtgttttctacaatgtgtttccagggacaaaggagc

SEQ ID NO: 292666 - DNA, 75 bp, Artificial Sequence
  Synthetic
tatgtccctccaggtgcaccaaatcccattaaatgggatgactacacgtggcagagtgcctcaaaccccagtgtc

SEQ ID NO: 292667 - DNA, 75 bp, Artificial Sequence
  Synthetic
tccttattctcaaagtacaaaggtaatgtgaaaatggaaatcagtgataacatgatcattgcagttgaccactat

SEQ ID NO: 292668 - DNA, 75 bp, Artificial Sequence
  Synthetic
tgcatcagcctacaactgtttctatgatggatactcacatgataatgaagatacaccatatggcataagtgtctt

SEQ ID NO: 292669 - DNA, 75 bp, Artificial Sequence
  Synthetic
atgtgaaaatggaaatcagtgataacatgatcattgcagttgaccactatgcaggacaactgctctcactagata

SEQ ID NO: 292670 - DNA, 75 bp, Artificial Sequence
  Synthetic
gatggatactcacatgataatgaagatacaccatatggcataagtgtcttaaatcacatgggtagtatagctttc

SEQ ID NO: 292671 - DNA, 75 bp, Artificial Sequence
  Synthetic
ttagaacccatagaccttaatactagtgcaggatacccatacgttagcctaggaattaagaaaagatcaatatta

SEQ ID NO: 292672 - DNA, 75 bp, Artificial Sequence
  Synthetic
cttccatagagctaaacacattagagcttgggtaccaagaccacccagagcactaccatacacttccataggaaa

SEQ ID NO: 292673 - DNA, 75 bp, Artificial Sequence
  Synthetic
gtgcaggatacccatacgttagcctaggaattaagaaaagatcaatattaaataaagagactcaggacacaacca

SEQ ID NO: 292674 - DNA, 75 bp, Artificial Sequence
  Synthetic
gcttgggtaccaagaccacccagagcactaccatacacttccataggaaaaaccaacttcccgaacacgcacagc

SEQ ID NO: 292675 - DNA, 75 bp, Artificial Sequence
  Synthetic
tacattaaagatgaacttaggggtaaagataaggttaggttaggcaaaagtagattaatagaagcatctagccta

SEQ ID NO: 292676 - DNA, 75 bp, Artificial Sequence
  Synthetic
gtttggggcaatttacacatgtaattacaagataatgaattaccacttgatgacacatgaagattacctaaacct

SEQ ID NO: 292677 - DNA, 75 bp, Artificial Sequence
  Synthetic
aagataaggttaggttaggcaaaagtagattaatagaagcatctagcctaaatgattcagtaaatatgagagtca

SEQ ID NO: 292678 - DNA, 75 bp, Artificial Sequence
  Synthetic
tacaagataatgaattaccacttgatgacacatgaagattacctaaaccttttgactccttactacaacagagat

SEQ ID NO: 292679 - DNA, 75 bp, Artificial Sequence
  Synthetic
ggatccgcagtgggatgtgaccctgataccttctggtctatcataccaagtctcctggatggtgaactgttagca

SEQ ID NO: 292680 - DNA, 75 bp, Artificial Sequence
  Synthetic
taactgcacctcaggagtctattactctcagtactacaataagtattatccaataatatgtgacaaacccacaaa

SEQ ID NO: 292681 - DNA, 75 bp, Artificial Sequence
  Synthetic
ataccttctggtctatcataccaagtctcctggatggtgaactgttagcatttgattattcaaattttgatgcaa

SEQ ID NO: 292682 - DNA, 75 bp, Artificial Sequence
  Synthetic
tctcagtactacaataagtattatccaataatatgtgacaaacccacaaacatatggattgaaggaggaaactac

SEQ ID NO: 292683 - DNA, 75 bp, Artificial Sequence
  Synthetic
ggctttgaatcagctgacttaatcagaaagatatcaaccacacaccacatattcaaagaccaaatttatgttgta

SEQ ID NO: 292684 - DNA, 75 bp, Artificial Sequence
  Synthetic
acccggagattgtggtggaattttgcggtgtgtgcatggtccgatcggtctgctaacagcgggtgggagtggata

SEQ ID NO: 292685 - DNA, 75 bp, Artificial Sequence
  Synthetic
gaaagatatcaaccacacaccacatattcaaagaccaaatttatgttgtagaagggggaatgccttcaggttgtt

SEQ ID NO: 292686 - DNA, 75 bp, Artificial Sequence
  Synthetic
cggtgtgtgcatggtccgatcggtctgctaacagcgggtgggagtggatatgtatgcttcgcagatatcagacag

SEQ ID NO: 292687 - DNA, 75 bp, Artificial Sequence
  Synthetic
ttgattcttgatacatataaaggcattgatttggataagttgagaataattgcatatggtgatgatattatagca

SEQ ID NO: 292688 - DNA, 75 bp, Artificial Sequence
  Synthetic
gggaaaggcatttggtgtgggtttcacagaccaaatatcagcaaaggttacagagctccaagacagtgtcaagga

SEQ ID NO: 292689 - DNA, 75 bp, Artificial Sequence
  Synthetic
ttgatttggataagttgagaataattgcatatggtgatgatattatagcatcatacccatttgaattggattcag

SEQ ID NO: 292690 - DNA, 75 bp, Artificial Sequence
  Synthetic
acagaccaaatatcagcaaaggttacagagctccaagacagtgtcaaggattacataaatgtcaaaatactctcc

SEQ ID NO: 292691 - DNA, 75 bp, Artificial Sequence
  Synthetic
gacaagtccacacaattccacaaggtgacatgggagaatgtgacattccttaaaagacacttcagaccagataag

SEQ ID NO: 292692 - DNA, 75 bp, Artificial Sequence
  Synthetic
ggacctggttacagtcactgctacattagcactgcttgggtgtgatgggtcaccatggaggtttctcaagatgta

SEQ ID NO: 292693 - DNA, 75 bp, Artificial Sequence
  Synthetic
tgacatgggagaatgtgacattccttaaaagacacttcagaccagataagcaatttcctttccttgtccacccag

SEQ ID NO: 292694 - DNA, 75 bp, Artificial Sequence
  Synthetic
ttagcactgcttgggtgtgatgggtcaccatggaggtttctcaagatgtatatatcaaaacacttccaagtgccc

SEQ ID NO: 292695 - DNA, 75 bp, Artificial Sequence
  Synthetic
aaaaacacacaggatcacgtgagatctctgtgtatgttagcatggcattctggagagaaagaatacgataagttt

SEQ ID NO: 292696 - DNA, 75 bp, Artificial Sequence
  Synthetic
ttgtaatgcagccaaaggtctagaatggatagcaaataaaatttccaaactaatagaatggataaaggtaaagat

SEQ ID NO: 292697 - DNA, 75 bp, Artificial Sequence
  Synthetic
tggatagcaaataaaatttccaaactaatagaatggataaaggtaaagataatcccacaagcaaaagagaaacta

SEQ ID NO: 292698 - DNA, 75 bp, Artificial Sequence
  Synthetic
atactcagttctcagacacagatggcttgaattattttaaaatttgaatagatatttagagatttaatttgaata

SEQ ID NO: 292699 - DNA, 75 bp, Artificial Sequence
  Synthetic
aacaatgcatgtttctaacccaacacaggagaaaagagaacaacttttcaacaacgtcttgtggttagaacaaat

SEQ ID NO: 292700 - DNA, 75 bp, Artificial Sequence
  Synthetic
tggtactctgtacctttgtacgcctgttcttcccattgtacccttcctgaacttccaacccaagtaacgttagaa

SEQ ID NO: 292701 - DNA, 75 bp, Artificial Sequence
  Synthetic
caggagaaaagagaacaacttttcaacaacgtcttgtggttagaacaaatgtctcagaaatttgccccactgtat

SEQ ID NO: 292702 - DNA, 75 bp, Artificial Sequence
  Synthetic
aagcacttctgtttccccggagcgaggtataggctgtacccactgccaaaagcctttaaccgttatccgccaacc

SEQ ID NO: 292703 - DNA, 75 bp, Artificial Sequence
  Synthetic
tatgcagttcaaatccaagcaaagaactgaaccagtctgtgttttgatacatggctcccccgggtcagggaaatc

SEQ ID NO: 292704 - DNA, 75 bp, Artificial Sequence
  Synthetic
actgaaccagtctgtgttttgatacatggctcccccgggtcagggaaatcactaactacatctattgttggcaga

SEQ ID NO: 292705 - DNA, 75 bp, Artificial Sequence
  Synthetic
aaaacactttgatgggtatcaacaacaagaagtggtgatcatggatgatttaaatcagaatcctgatggtcagga

SEQ ID NO: 292706 - DNA, 75 bp, Artificial Sequence
  Synthetic
caagaagtggtgatcatggatgatttaaatcagaatcctgatggtcaggacgttagtatgttctgccagatggtc

SEQ ID NO: 292707 - DNA, 75 bp, Artificial Sequence
  Synthetic
gcctttttacagacatggtgcgaagactcgcatgtgcttggttgtgagtcctccggcccctgaatgcggctaacc

SEQ ID NO: 292708 - DNA, 75 bp, Artificial Sequence
  Synthetic
cttgtttaccagtaactttgttcttgcatcaaccaattcaaatacactcagtcctccaacaattttaaatccaga

SEQ ID NO: 292709 - DNA, 75 bp, Artificial Sequence
  Synthetic
gcatcaaccaattcaaatacactcagtcctccaacaattttaaatccagaagcactagccagaagatttgggttt

SEQ ID NO: 292710 - DNA, 75 bp, Artificial Sequence
  Synthetic
tttgggtgtccgtgtttctcatttttcttattattgtcttatggtcacagcatatatattgtatatactgtgatc

SEQ ID NO: 292711 - DNA, 75 bp, Artificial Sequence
  Synthetic
tgcagcaatggcaacagaactttgtaaagactgtcacaagcctagtaactttaacaaatgttgcccattgatatg

SEQ ID NO: 292712 - DNA, 75 bp, Artificial Sequence
  Synthetic
aaagactgtcacaagcctagtaactttaacaaatgttgcccattgatatgtggtaaagcaattagtcttgtggac

SEQ ID NO: 292713 - DNA, 75 bp, Artificial Sequence
  Synthetic
catattaactaatggatccaatcaaacctttacggttattaattattacaaggatgcagcaagttcatcttcagc

SEQ ID NO: 292714 - DNA, 75 bp, Artificial Sequence
  Synthetic
acctttacggttattaattattacaaggatgcagcaagttcatcttcagccgggcaatctttttcaatggatcca

SEQ ID NO: 292715 - DNA, 75 bp, Artificial Sequence
  Synthetic
aactgacttcaataataaattgaaaatcacagattctctggaaatcttgtttcagggccctgtttacaaagattt

SEQ ID NO: 292716 - DNA, 75 bp, Artificial Sequence
  Synthetic
atcacagattctctggaaatcttgtttcagggccctgtttacaaagatttagaaatagatgtccataacacacct

SEQ ID NO: 292717 - DNA, 75 bp, Artificial Sequence
  Synthetic
actgaattcaccaaatgttgaagcatgcggttacagtgatagggttcaacaaattactctaggtaattccaccat

SEQ ID NO: 292718 - DNA, 75 bp, Artificial Sequence
  Synthetic
tgcggttacagtgatagggttcaacaaattactctaggtaattccaccataaccacccaagaggcagctaatgca

SEQ ID NO: 292719 - DNA, 75 bp, Artificial Sequence
  Synthetic
gagagagtattgtaagcagaaaaactggcttattccagaaattccaaccaatatagaaagagcagttaatcaggc

SEQ ID NO: 292720 - DNA, 75 bp, Artificial Sequence
  Synthetic
tggcttattccagaaattccaaccaatatagaaagagcagttaatcaggctagtaccataattaacaccattctg

SEQ ID NO: 292721 - DNA, 75 bp, Artificial Sequence
  Synthetic
tgatgtgaacaaaacatcaaaaccagatacctctgtttgcagattttacacactggatagtaaaacatggaaagc

SEQ ID NO: 292722 - DNA, 75 bp, Artificial Sequence
  Synthetic
gatacctctgtttgcagattttacacactggatagtaaaacatggaaagctacttctaaaggctggtgctggaaa

SEQ ID NO: 292723 - DNA, 75 bp, Artificial Sequence
  Synthetic
acaaacacagggtccatactcaggcaatccctcacatgttaaactaaaaccacctaccctacggcaagtggtggt

SEQ ID NO: 292724 - DNA, 75 bp, Artificial Sequence
  Synthetic
aatccctcacatgttaaactaaaaccacctaccctacggcaagtggtggttcaaggcccaaatactgaatttgct

SEQ ID NO: 292725 - DNA, 75 bp, Artificial Sequence; identical to SEQ ID NO: 289799
  Synthetic

SEQ ID NO: 292726 - DNA, 75 bp, Artificial Sequence
  Synthetic
acaatacatgtacagtgtaatgccaccaaatttcacagtggttgcctactggttgtggtcatcccagaacatcaa

SEQ ID NO: 292727 - DNA, 75 bp, Artificial Sequence
  Synthetic
attcacagcactgggaattcatgatagggtttgtgtagtacctacgcactcacagcctgatgatgaagtgttagt

SEQ ID NO: 292728 - DNA, 75 bp, Artificial Sequence
  Synthetic
agggtttgtgtagtacctacgcactcacagcctgatgatgaagtgttagttaatggacaaccagtaaagttaaaa

SEQ ID NO: 292729 - DNA, 75 bp, Artificial Sequence
  Synthetic
tccaggggatcgaggtattgacctagacaccgtcgaggtcgcaggtggccctaccagtgatgccatctacaacat

SEQ ID NO: 292730 - DNA, 75 bp, Artificial Sequence; identical to SEQ ID NO: 289802
  Synthetic

SEQ ID NO: 292731 - DNA, 75 bp, Artificial Sequence
  Synthetic
attagttttagatagaaatgaaaagtttagggatataagagcattcatagcagatgatccagagggaatggaagg

SEQ ID NO: 292732 - DNA, 75 bp, Artificial Sequence
  Synthetic
tttagggatataagagcattcatagcagatgatccagagggaatggaaggaactttagtgataaactccaataat

SEQ ID NO: 292733 - DNA, 75 bp, Artificial Sequence
  Synthetic
aatagttgtcccctacataaactcagtgcccattgactcaatgaccagacacaacaatgtgtcactaatggttgt

SEQ ID NO: 292734 - DNA, 75 bp, Artificial Sequence
  Synthetic
gtgcccattgactcaatgaccagacacaacaatgtgtcactaatggttgttccaattgccccgctcaatgcacct

SEQ ID NO: 292735 - DNA, 75 bp, Artificial Sequence
  Synthetic
aaacctcagtagcgttccaacaaaccgcatgatacgctatgaataccctacaagaacaggacaatgtggtggtgt

SEQ ID NO: 292736 - DNA, 75 bp, Artificial Sequence
  Synthetic
cgcatgatacgctatgaataccctacaagaacaggacaatgtggtggtgttttatgctcaactggcaagatctac

SEQ ID NO: 292737 - DNA, 75 bp, Artificial Sequence
  Synthetic
cacagagttcactggtattagatctagatctattgtaccacaaggattacccactaccaccctgccaggatctgg

SEQ ID NO: 292738 - DNA, 75 bp, Artificial Sequence
  Synthetic
agatctattgtaccacaaggattacccactaccaccctgccaggatctggacaatttctaaccacagatgacagg

SEQ ID NO: 292739 - DNA, 75 bp, Artificial Sequence
  Synthetic
aaaacaatactttgttgaaaaacagggagcaatcattaacaaaagaaatgttaaagaattgggtttgaaacccat

SEQ ID NO: 292740 - DNA, 75 bp, Artificial Sequence
  Synthetic
ggagcaatcattaacaaaagaaatgttaaagaattgggtttgaaacccattaacaccccaactaaaacaaagctt

SEQ ID NO: 292741 - DNA, 75 bp, Artificial Sequence
  Synthetic
tccagggaaagtaagaaatttgttggagataatacaagtagatacattaattccaatgaacaacacagggacaaa

SEQ ID NO: 292742 - DNA, 75 bp, Artificial Sequence
  Synthetic
gagataatacaagtagatacattaattccaatgaacaacacagggacaaatgacaatgtcacaaactatctcatt

SEQ ID NO: 292743 - DNA, 75 bp, Artificial Sequence
  Synthetic
cttgaatgactctgaccccagactggaggtcaatttgcgtgattctctattctcaaagtacaaagggaatgtaga

SEQ ID NO: 292744 - DNA, 75 bp, Artificial Sequence
  Synthetic
gaggtcaatttgcgtgattctctattctcaaagtacaaagggaatgtagaaattgatatcacagagaatatgcaa

SEQ ID NO: 292745 - DNA, 75 bp, Artificial Sequence
  Synthetic
cattggtgatggtgttttcaaaacaactttgttaggtgagatagcccagtactatacacactggtctggatccct

SEQ ID NO: 292746 - DNA, 75 bp, Artificial Sequence
  Synthetic
actttgttaggtgagatagcccagtactatacacactggtctggatccctcagaatttcacttatgtacacagga

SEQ ID NO: 292747 - DNA, 75 bp, Artificial Sequence
  Synthetic
agatgaactatcactaaaagaagctctatacgggacagatggcttggaaccaattgacattaataccagtgccgg

SEQ ID NO: 292748 - DNA, 75 bp, Artificial Sequence
  Synthetic
ctatacgggacagatggcttggaaccaattgacattaataccagtgccggttatccatatgtgagcttaggaata

SEQ ID NO: 292749 - DNA, 75 bp, Artificial Sequence
  Synthetic
gcgtggcccagaagatagaaaggaagcaatgttaggaacacatgttgtgtgggatattggtctacagtccaccat

SEQ ID NO: 292750 - DNA, 75 bp, Artificial Sequence
  Synthetic
gcaatgttaggaacacatgttgtgtgggatattggtctacagtccaccatagtcatgaccatcccatggacatcg

SEQ ID NO: 292751 - DNA, 75 bp, Artificial Sequence
  Synthetic
acattatctggataaatatggtattgatctgccactggttacatatataaaagatgaactcagaagcaaagataa

SEQ ID NO: 292752 - DNA, 75 bp, Artificial Sequence
  Synthetic
gatctgccactggttacatatataaaagatgaactcagaagcaaagataaggttaggctagggaaaagtagacta

SEQ ID NO: 292753 - DNA, 75 bp, Artificial Sequence; identical to SEQ ID NO: 289818
  Synthetic

SEQ ID NO: 292754 - DNA, 75 bp, Artificial Sequence
  Synthetic
ctcatacttccaccacaaaccagtggacaagtctatcttttatctttcatcagcgcttgtcctgatttcaaactt

SEQ ID NO: 292755 - DNA, 75 bp, Artificial Sequence
  Synthetic
taacctgtataaggcttttcacacaaatccaggagtaataactggctcagcagtggggtgtgatccagacacatt

SEQ ID NO: 292756 - DNA, 75 bp, Artificial Sequence
  Synthetic
aatccaggagtaataactggctcagcagtggggtgtgatccagacacattttggtcaattataccatgccttatg

SEQ ID NO: 292757 - DNA, 75 bp, Artificial Sequence
  Synthetic
aggtcttggtgatgagttggaggaagtcattgtcgagaaaactaaacagacattggcttccgtctcttcgggacc

SEQ ID NO: 292758 - DNA, 75 bp, Artificial Sequence; identical to SEQ ID NO: 289821
  Synthetic

SEQ ID NO: 292759 - DNA, 75 bp, Artificial Sequence
  Synthetic
tccagtgtggtttaaatgtcttgagcaagtactttccaggctcgggtttagacattccaatctgatccagacaat

SEQ ID NO: 292760 - DNA, 75 bp, Artificial Sequence
  Synthetic
caagtactttccaggctcgggtttagacattccaatctgatccagacaatatgcaacacacaccacatattcaga

SEQ ID NO: 292761 - DNA, 75 bp, Artificial Sequence
  Synthetic
tgtggaaaccagaaccacttacatgcacttcaatggttcggaaacagatgtagagagtttcctcggtagagcggc

SEQ ID NO: 292762 - DNA, 75 bp, Artificial Sequence
  Synthetic
cacttcaatggttcggaaacagatgtagagagtttcctcggtagagcggcttgtgtgcatgtgacagaaatcaag

SEQ ID NO: 292763 - DNA, 75 bp, Artificial Sequence
  Synthetic
tagtgtttttaattcaatgataaacaacataatcattagaacattaatactggatgtctacaaaggaattgacct

SEQ ID NO: 292764 - DNA, 75 bp, Artificial Sequence
  Synthetic
aacataatcattagaacattaatactggatgtctacaaaggaattgaccttgataaattgaaagtaattgcctat

SEQ ID NO: 292765 - DNA, 75 bp, Artificial Sequence
  Synthetic
tgattggaaaattaacctttcaagtcttgttcaacttagaaagaagttggaactcttcacttatgttagatttga

SEQ ID NO: 292766 - DNA, 75 bp, Artificial Sequence
  Synthetic
cttgttcaacttagaaagaagttggaactcttcacttatgttagatttgactcagagtacactatcttagctaca

SEQ ID NO: 292767 - DNA, 75 bp, Artificial Sequence
  Synthetic
agcactcgctggtaaaaaatatggtctgacaattacacccccagacaaatcagaaaaatttgtgaaaacaacatg

SEQ ID NO: 292768 - DNA, 75 bp, Artificial Sequence
  Synthetic
ctgacaattacacccccagacaaatcagaaaaatttgtgaaaacaacatgggagaatgtaacatttctgaaaaga

SEQ ID NO: 292769 - DNA, 75 bp, Artificial Sequence
  Synthetic
aatgtatgtacctcctggtgcacctaaccctaagaaatgggatgactacacatggcaaagtgcttctaaccccag

SEQ ID NO: 292770 - DNA, 75 bp, Artificial Sequence
  Synthetic
aaccctaagaaatgggatgactacacatggcaaagtgcttctaaccccagcgtgtttttcaaagttggtgagact

SEQ ID NO: 292771 - DNA, 75 bp, Artificial Sequence
  Synthetic
aatgcaagatatacacgaatccatacgatggacacgcgatccaaaaaacacacaggatcacgtgcgctctctgtg

SEQ ID NO: 292772 - DNA, 75 bp, Artificial Sequence
  Synthetic
cgatggacacgcgatccaaaaaacacacaggatcacgtgcgctctctgtgcatgttggcttggcattcaggagag

SEQ ID NO: 292773 - DNA, 75 bp, Artificial Sequence
  Synthetic
ttatgatggctattcacatgatgaccaggacactccttatggcataacagtattaaatcatatgggtagtatggc

SEQ ID NO: 292774 - DNA, 75 bp, Artificial Sequence
  Synthetic
caggacactccttatggcataacagtattaaatcatatgggtagtatggcatttagagtagtcaatgaacatgat

SEQ ID NO: 292775 - DNA, 75 bp, Artificial Sequence
  Synthetic
atgtctgttaataccagaatacagtgtcctacgccgacgatggttagatctgttttgaataatatagatttttga

SEQ ID NO: 292776 - DNA, 75 bp, Artificial Sequence
  Synthetic
ggaagcatggattccaagagcacccagagctttaccatacgtgtccattggacgtactaactaccctagagattc

SEQ ID NO: 292777 - DNA, 75 bp, Artificial Sequence
  Synthetic
agagctttaccatacgtgtccattggacgtactaactaccctagagattcaaaaacaataataaagaaaaggcca

SEQ ID NO: 292778 - DNA, 75 bp, Artificial Sequence; identical to SEQ ID NO: 289836
  Synthetic

SEQ ID NO: 292779 - DNA, 75 bp, Artificial Sequence
  Synthetic
cttatgactccagaagatcatctgaacttgatagccccttacccaagtagagatttagcagtagttgctactgga

SEQ ID NO: 292780 - DNA, 75 bp, Artificial Sequence
  Synthetic
ttattccagatactacagaaaattctatcctgtcatttgtgagagacctaccaacatctggattgagggcggccc

SEQ ID NO: 292781 - DNA, 75 bp, Artificial Sequence
  Synthetic
tatcctgtcatttgtgagagacctaccaacatctggattgagggcggcccgtactacccaagtagatatcaagat

SEQ ID NO: 292782 - DNA, 75 bp, Artificial Sequence
  Synthetic
tatcctgtcatttgtgagagacctaccaacatctggattgagggcggcccgtactacccaagtagatatcaagtt

SEQ ID NO: 292783 - DNA, 75 bp, Artificial Sequence; identical to SEQ ID NO: 289839
  Synthetic

SEQ ID NO: 292784 - DNA, 75 bp, Artificial Sequence
  Synthetic
tatcctgtcatttgtgagagacctaccaacatctggattgagggcggcccgtactacccaagtagatatcaaggt

SEQ ID NO: 292785 - DNA, 75 bp, Artificial Sequence
  Synthetic
tctcagatgtgtacatggtcctattggaatactaacagctggtggtagtggttatgtttgttttgcagacataag

SEQ ID NO: 292786 - DNA, 75 bp, Artificial Sequence; identical to SEQ ID NO: 289842
  Synthetic

SEQ ID NO: 292787 - DNA, 75 bp, Artificial Sequence; identical to SEQ ID NO: 289845
  Synthetic

SEQ ID NO: 292788 - DNA, 75 bp, Artificial Sequence
  Synthetic
accttacattgaaagacaagcaaatgatggctggttcagaaaattcaatgatgcttgcaatgcagcaaaaggatt

SEQ ID NO: 292789 - DNA, 75 bp, Artificial Sequence
  Synthetic
aggttctaccccaagccagagaaaaactcgagttttgcagtaagttaaaacagttagatgtattagagagacaaa

SEQ ID NO: 292790 - DNA, 75 bp, Artificial Sequence
  Synthetic
actcgagttttgcagtaagttaaaacagttagatgtattagagagacaaatagcatccatacacgactctaaccc

SEQ ID NO: 292791 - DNA, 75 bp, Artificial Sequence
  Synthetic
agatgtcacaaaaattctcacccttgtatgccgcagaagcaaagaggatcagggatcttaaaaacaagattacta

SEQ ID NO: 292792 - DNA, 75 bp, Artificial Sequence
  Synthetic
gtatgccgcagaagcaaagaggatcagggatcttaaaaacaagattactaattacatgcaatttaaaagtaagca

SEQ ID NO: 292793 - DNA, 75 bp, Artificial Sequence
  Synthetic
aatcactaaccacgtccattgtgggccgtgcactagcagagcacttcaattcatctgtttattctttgccccctg

SEQ ID NO: 292794 - DNA, 75 bp, Artificial Sequence
  Synthetic
ccgtgcactagcagagcacttcaattcatctgtttattctttgccccctgatccaaaacattttgatggttacca

SEQ ID NO: 292795 - DNA, 75 bp, Artificial Sequence
  Synthetic
aagacatcagcatgttttgtcaaatggtttcttcagtagatttcttaccacccatggctagtctagacaataaag

SEQ ID NO: 292796 - DNA, 75 bp, Artificial Sequence
  Synthetic
ggtttcttcagtagatttcttaccacccatggctagtctagacaataaagggatgttgttcaccagcaattttgt

SEQ ID NO: 292797 - DNA, 75 bp, Artificial Sequence; identical to SEQ ID NO: 289860
  Synthetic

SEQ ID NO: 292798 - DNA, 75 bp, Artificial Sequence
  Synthetic
atttgacttggatatctgcttacacagtacatacacaaagaatggtaaattaaatgcagcaatggcaaccagttt

SEQ ID NO: 292799 - DNA, 75 bp, Artificial Sequence
  Synthetic
tttgtggtaaagctatcagcttagtagatagggtttccaatgttagatttagcatagatcaattagttactgcta

SEQ ID NO: 292800 - DNA, 75 bp, Artificial Sequence; identical to SEQ ID NO: 289863
  Synthetic

SEQ ID NO: 292801 - DNA, 75 bp, Artificial Sequence
  Synthetic
acttagaaattgatgtatgcaacacacctccacctgagtgtatcagtgatctactaaaatcagtagattcagaag

SEQ ID NO: 292802 - DNA, 75 bp, Artificial Sequence
  Synthetic
acctccacctgagtgtatcagtgatctactaaaatcagtagattcagaagaagttagggaatattgcaagaaaaa

SEQ ID NO: 292803 - DNA, 75 bp, Artificial Sequence
  Synthetic
aagcaagtatgataattaatacaattttaatgtttgttagtacactaggcatagtttatgttatatacaaactgt

SEQ ID NO: 292804 - DNA, 75 bp, Artificial Sequence
  Synthetic
tttaatgtttgttagtacactaggcatagtttatgttatatacaaactgtttgctcaaacacaagggccctactc

SEQ ID NO: 292805 - DNA, 75 bp, Artificial Sequence
  Synthetic
tggtacaaggacctaatacagagtttgccttgtccttgcttagaaaaaacatactcacaatcaccacagagaaag

SEQ ID NO: 292806 - DNA, 75 bp, Artificial Sequence
  Synthetic
tgccttgtccttgcttagaaaaaacatactcacaatcaccacagagaaaggagaatttactagtttaggcattca

SEQ ID NO: 292807 - DNA, 75 bp, Artificial Sequence
  Synthetic
ttgtgaatggacaaaagattcaaattaaagacaaatataaactagtagatccagataatactaatttggaactca

SEQ ID NO: 292808 - DNA, 75 bp, Artificial Sequence
  Synthetic
taaagacaaatataaactagtagatccagataatactaatttggaactcaccataatagaattggacagaaatga

SEQ ID NO: 292809 - DNA, 75 bp, Artificial Sequence
  Synthetic
atgcaactttagtagtacattccaatggattcactaacaccatgttagacgtgggaccaataaccatggctgggc

SEQ ID NO: 292810 - DNA, 75 bp, Artificial Sequence
  Synthetic
tggattcactaacaccatgttagacgtgggaccaataaccatggctgggcttatcaatttaagtaatacaccaac

SEQ ID NO: 292811 - DNA, 75 bp, Artificial Sequence; identical to SEQ ID NO: 289878
  Synthetic

SEQ ID NO: 292812 - DNA, 75 bp, Artificial Sequence
  Synthetic
atttggaatacacgttggtggtaatggtagacagggattttcagcacaactcaaaaagcagtactttgtggaaaa

SEQ ID NO: 292813 - DNA, 75 bp, Artificial Sequence
  Synthetic
caataaatacgcccactaaaaccaaacttcaccctagcgtattttacaatgtattccctggaagcaaacagcctg

SEQ ID NO: 292814 - DNA, 75 bp, Artificial Sequence; identical to SEQ ID NO: 289881
  Synthetic

SEQ ID NO: 292815 - DNA, 75 bp, Artificial Sequence
  Synthetic
tccagatggaaccaactgaaaatatgctagtagctgtagatcattatgcagggcagttaatgtcattagacatac

SEQ ID NO: 292816 - DNA, 75 bp, Artificial Sequence
  Synthetic
gctagtagctgtagatcattatgcagggcagttaatgtcattagacatacccaccaaagagttaacacttaaaga

SEQ ID NO: 292817 - DNA, 75 bp, Artificial Sequence
  Synthetic
caggatacccatatgttagcttagggataaagaagagagatatactaaataaggaaactcaagatgtagagaaaa

SEQ ID NO: 292818 - DNA, 75 bp, Artificial Sequence
  Synthetic
gataaagaagagagatatactaaataaggaaactcaagatgtagagaaaatgaagttttatttggataaatatgg

SEQ ID NO: 292819 - DNA, 75 bp, Artificial Sequence
  Synthetic
ataaagtgcgcttgggaaagagtagattgattgaagcatcaagtttaaatgattccgttaacatgagaatgaaat

SEQ ID NO: 292820 - DNA, 75 bp, Artificial Sequence
  Synthetic
attgattgaagcatcaagtttaaatgattccgttaacatgagaatgaaattaggcaacttgtacaaagcttttca

SEQ ID NO: 292821 - DNA, 75 bp, Artificial Sequence
  Synthetic
tcttttggtctgttataccttgtctaatggatggacacttgatggcatttgattattcaaattttgatgcgtccc

SEQ ID NO: 292822 - DNA, 75 bp, Artificial Sequence
  Synthetic
aatggatggacacttgatggcatttgattattcaaattttgatgcgtccctttcaccagtttggtttgaatgttt

SEQ ID NO: 292823 - DNA, 75 bp, Artificial Sequence
  Synthetic
caatttgtaatacacatcacatcttcagagatgagatctataaagtggagggaggtatgccatcaggttgctcag

SEQ ID NO: 292824 - DNA, 75 bp, Artificial Sequence
  Synthetic
cagagatgagatctataaagtggagggaggtatgccatcaggttgctcaggaactagtatattcaattccatgat

SEQ ID NO: 292825 - DNA, 75 bp, Artificial Sequence; identical to SEQ ID NO: 289901
  Synthetic

SEQ ID NO: 292826 - DNA, 75 bp, Artificial Sequence
  Synthetic
ttatggtgatgacttaatagtctcatacccctttgaactagattctaacatcttagcagcaatagggaaaaatta

SEQ ID NO: 292827 - DNA, 75 bp, Artificial Sequence
  Synthetic
catgggaaaatattacattccttaaaaggtatttcagacctgatccacaatttccctttttggtccatccagtga

SEQ ID NO: 292828 - DNA, 75 bp, Artificial Sequence; identical to SEQ ID NO: 289904
  Synthetic

SEQ ID NO: 292829 - DNA, 75 bp, Artificial Sequence
  Synthetic
tgtgcatgctagcctggcactcaggtgagaaagattacaacgattttatagccaaaatcagaacaacagacattg

SEQ ID NO: 292830 - DNA, 75 bp, Artificial Sequence
  Synthetic
gccaaaatcagaacaacagacattggcaagtgtcttaatctacctgaatacagtgtcctgcgaaggcgctggctg

SEQ ID NO: 292831 - DNA, 75 bp, Artificial Sequence
  Synthetic
ggacgttcgatcaggtggtttacccccccactagtttggtcgatgaggctggaaattccccacgggtgaccgtgt

SEQ ID NO: 292832 - DNA, 75 bp, Artificial Sequence
  Synthetic
gctcatgctgggacgccctttcgatgacatggtgtgaagactcgcatgtgcttgattgtgaatcctccggcccct

SEQ ID NO: 292833 - DNA, 75 bp, Artificial Sequence
  Synthetic
gtctcaacacaaaaaagtggatcccacgagaatcaaaatatcctaacaaatgggtcaaatcaaactttcacagtc

SEQ ID NO: 292834 - DNA, 75 bp, Artificial Sequence
  Synthetic
acgagaatcaaaatatcctaacaaatgggtcaaatcaaactttcacagtcataaactactacaaggatgctgcaa

SEQ ID NO: 292835 - DNA, 75 bp, Artificial Sequence
  Synthetic
tgggtcaaatcaaactttcacagtcataaactactacaaggatgctgcaagtagctcatcagctggtcaatctct

SEQ ID NO: 292836 - DNA, 75 bp, Artificial Sequence
  Synthetic
agggtgcaccagcactaaattcacccaacgttgaagcgtgtgggtatagtgacagggtgcaacaaatcactcttg

SEQ ID NO: 292837 - DNA, 75 bp, Artificial Sequence
  Synthetic
agctgcaaacgcagtggtttgttatgctgagtggcctgaatatctcccagataaagatgcaagtgatgtaaacaa

SEQ ID NO: 292838 - DNA, 75 bp, Artificial Sequence
  Synthetic
ataaagatgcaagtgatgtaaacaaaacttcaaaaccagacacatctgtttgtagattttacacactggatagca

SEQ ID NO: 292839 - DNA, 75 bp, Artificial Sequence
  Synthetic
aacttcaaaaccagacacatctgtttgtagattttacacactggatagcaaaatgtggcagaaaaattcaaaagg

SEQ ID NO: 292840 - DNA, 75 bp, Artificial Sequence
  Synthetic
aaaacatgtttttccactcactgggtagatcaggatacaccatacatgtacagtgcaatgcaacaaagtttcaca

SEQ ID NO: 292841 - DNA, 75 bp, Artificial Sequence
  Synthetic
tagatcaggatacaccatacatgtacagtgcaatgcaacaaagtttcacagtgggtgtttgcttgtagttgtgat

SEQ ID NO: 292842 - DNA, 75 bp, Artificial Sequence
  Synthetic
ataaactcacacacccgggtgaaggtggtattgatttgtcaacaaatgtagaggcagatggacctgttaaggacc

SEQ ID NO: 292843 - DNA, 75 bp, Artificial Sequence
  Synthetic
tggtattgatttgtcaacaaatgtagaggcagatggacctgttaaggacccagtttataacatgaatggtacatt

SEQ ID NO: 292844 - DNA, 75 bp, Artificial Sequence
  Synthetic
ataacactgctacattggtagtaccatacattaattcagtgccaattgattcaatgacaagacacaacaatgtat

SEQ ID NO: 292845 - DNA, 75 bp, Artificial Sequence
  Synthetic
atacattaattcagtgccaattgattcaatgacaagacacaacaatgtatcactaatgatcattccaattgcccc

SEQ ID NO: 292846 - DNA, 75 bp, Artificial Sequence
  Synthetic
tagctccaatgtgtactgagttcacgggcataaggtctaaaactgtagttccacaagggttaccaacaacaactc

SEQ ID NO: 292847 - DNA, 75 bp, Artificial Sequence
  Synthetic
taccgggatctggtcagtttctgactactgatgatagacagtcacccagtgcattaccaaattatgagccaacac

SEQ ID NO: 292848 - DNA, 75 bp, Artificial Sequence
  Synthetic
gtagatactctaatcccaatgaacaatacccacaatagggatgaagtgaaaagctaccttatacccctgcagcca

SEQ ID NO: 292849 - DNA, 75 bp, Artificial Sequence
  Synthetic
atacccacaatagggatgaagtgaaaagctaccttatacccctgcagccaaacagacaaggagagatggtgtttg

SEQ ID NO: 292850 - DNA, 75 bp, Artificial Sequence
  Synthetic
gaaatagttcagtactacacccattgggcaggatcactgagattttctttaatgtatacaggtcccgccttgtct

SEQ ID NO: 292851 - DNA, 75 bp, Artificial Sequence
  Synthetic
gggcaggatcactgagattttctttaatgtatacaggtcccgccttgtctagtgcaaagttaatactgtcttaca

SEQ ID NO: 292852 - DNA, 75 bp, Artificial Sequence
  Synthetic
acacatgtggtgtgggatattggattacagtccacaatagttatgacaataccctggacttcaggggtgcaattc

SEQ ID NO: 292853 - DNA, 75 bp, Artificial Sequence
  Synthetic
tacagtccacaatagttatgacaataccctggacttcaggggtgcaattcaggtacacagatccagatacttaca

SEQ ID NO: 292854 - DNA, 75 bp, Artificial Sequence
  Synthetic
ccagacacacccaatgaagtgtacatgctctcctttatcagcgcatgcccagactttaaacttagacttatgaaa

SEQ ID NO: 292855 - DNA, 75 bp, Artificial Sequence
  Synthetic
tgctctcctttatcagcgcatgcccagactttaaacttagacttatgaaagatacccagactatatcacagactg

SEQ ID NO: 292856 - DNA, 75 bp, Artificial Sequence
  Synthetic
aaaacgaaacagacgctggcttcggtttcatctgggccaaaacacacacaaagtgtccccactctaactgcaaat

SEQ ID NO: 292857 - DNA, 75 bp, Artificial Sequence
  Synthetic
tttcatctgggccaaaacacacacaaagtgtccccactctaactgcaaatgaaacaggtgctactatgccaactt

SEQ ID NO: 292858 - DNA, 75 bp, Artificial Sequence
  Synthetic
tctgagacagacattgaatgcttcctgggtcgtgctgcttgtgtacatgtgacagagatagaaaacaaaaaccca

SEQ ID NO: 292859 - DNA, 75 bp, Artificial Sequence
  Synthetic
gaaaattgttcaatgattggaaaattagtctctctagtcttgtgcaactcaggaagaagttagaactctttacct

SEQ ID NO: 292860 - DNA, 75 bp, Artificial Sequence
  Synthetic
aggaagaagttagaactctttacctatgtcagatttgattcagaatacacaatattagcaactgcttcacagccc

SEQ ID NO: 292861 - DNA, 75 bp, Artificial Sequence
  Synthetic
gtgccatatgtaggcttagcatcagcatataattgtttctatgatggttactcacatgatgacgcaaatactccg

SEQ ID NO: 292862 - DNA, 75 bp, Artificial Sequence
  Synthetic
catataattgtttctatgatggttactcacatgatgacgcaaatactccgtatggaatatctgttctgaatcata

SEQ ID NO: 292863 - DNA, 75 bp, Artificial Sequence
  Synthetic
atcccaaaaatccacaaccagtaatcaagaagagagaaggggacataaaaacttatggactgggaccaaggtttg

SEQ ID NO: 292864 - DNA, 75 bp, Artificial Sequence
  Synthetic
caagaagagagaaggggacataaaaacttatggactgggaccaaggtttggaggggtgtatacatccaatgtgaa

SEQ ID NO: 292865 - DNA, 75 bp, Artificial Sequence
  Synthetic
ccccataccctagcagggacctagcagttgtctcaacaggagcacatggtgcagaaactataccacattgtaact

SEQ ID NO: 292866 - DNA, 75 bp, Artificial Sequence
  Synthetic
gtacatcaggtgtctattactctagttactacaggaaattttacccagtgatatgtgaaaaacccactaccatat

SEQ ID NO: 292867 - DNA, 75 bp, Artificial Sequence
  Synthetic
aaaggtgttggtcccgcagaaccaggtgattgtggtggcatactcaggtgcattcatggaccaattgggttactg

SEQ ID NO: 292868 - DNA, 75 bp, Artificial Sequence
  Synthetic
gtgattgtggtggcatactcaggtgcattcatggaccaattgggttactgacagcaggtggcagtggttatgtct

SEQ ID NO: 292869 - DNA, 75 bp, Artificial Sequence
  Synthetic
agtgattacatcaccagcctggggagagctttcggtgttgggttcaccgatcaaatttcagccaaggtaacagag

SEQ ID NO: 292870 - DNA, 75 bp, Artificial Sequence
  Synthetic
tgacaacaaaagttttatcaaaagtagtgaaaatggtgtcagcattagtgatcatctgcagaaactatgaagatc

SEQ ID NO: 292871 - DNA, 75 bp, Artificial Sequence
  Synthetic
tggaggtttctaaaaatgtatatttctaagcattttcaagtaccctacattgaaagacaggcaaacgatggctgg

SEQ ID NO: 292872 - DNA, 75 bp, Artificial Sequence
  Synthetic
atgcagcaaaaggtttggagtggatcgcaaacaagatttcaaaactaattgaatgggtcaaaaacaaggtacttc

SEQ ID NO: 292873 - DNA, 75 bp, Artificial Sequence
  Synthetic
ttgttggaaagacagatcaacaccatgcatgtttcaaaccccacgcaagagaaaagagagcaactgttcaacaac

SEQ ID NO: 292874 - DNA, 75 bp, Artificial Sequence
  Synthetic
tgcatgtttcaaaccccacgcaagagaaaagagagcaactgttcaacaacgtattatggttggaacaaatgtctc

SEQ ID NO: 292875 - DNA, 75 bp, Artificial Sequence
  Synthetic
aaaaacaaaatagtgaattacatgcagtttagaaacaaacaaaggactgaaccagtatgtgtgttgattcatggt

SEQ ID NO: 292876 - DNA, 75 bp, Artificial Sequence
  Synthetic
agtttagaaacaaacaaaggactgaaccagtatgtgtgttgattcatggtaccccaggttcaggaaaatcattga

SEQ ID NO: 292877 - DNA, 75 bp, Artificial Sequence
  Synthetic
tactcccttcccccagatccaaaacactttgatggttaccaacagcaagaggttgttatcatggatgacttgaat

SEQ ID NO: 292878 - DNA, 75 bp, Artificial Sequence
  Synthetic
actttgatggttaccaacagcaagaggttgttatcatggatgacttgaatcaaaatccagatggacaagatataa

SEQ ID NO: 292879 - DNA, 75 bp, Artificial Sequence
  Synthetic
agtttagataacaaagggatgttgttcactagcaactttgttttagcttcaactaattccaacacattaagtcct

SEQ ID NO: 292880 - DNA, 75 bp, Artificial Sequence
  Synthetic
tcactagcaactttgttttagcttcaactaattccaacacattaagtcctccaaccatcttaaacccagatgccc

SEQ ID NO: 292881 - DNA, 75 bp, Artificial Sequence
  Synthetic
actaagaatggtaaactcaatgctgcaatggcaaccagagtgtgcaaggattgtcaccaaccaacaaatttcaaa

SEQ ID NO: 292882 - DNA, 75 bp, Artificial Sequence
  Synthetic
caatggcaaccagagtgtgcaaggattgtcaccaaccaacaaatttcaaaaagtgctgtccacttgtttgtggaa

SEQ ID NO: 292883 - DNA, 75 bp, Artificial Sequence
  Synthetic
caattagttacagctgttgttaatgattacaagaataaaatgcaaatcactgattcccttgagatactattccag

SEQ ID NO: 292884 - DNA, 75 bp, Artificial Sequence
  Synthetic
attacaagaataaaatgcaaatcactgattcccttgagatactattccagggccctgtatacaaagacctagaaa

SEQ ID NO: 292885 - DNA, 75 bp, Artificial Sequence
  Synthetic
tctgtagattctgaagaggtcagagaatactgtaaaaagaaaaactggataataccagagatccctactaacatt

SEQ ID NO: 292886 - DNA, 75 bp, Artificial Sequence
  Synthetic
aatactgtaaaaagaaaaactggataataccagagatccctactaacattgagagggctgtcaaccaagctagta

SEQ ID NO: 292887 - DNA, 75 bp, Artificial Sequence
  Synthetic
gtaatttacaagttgtttgcccaaactcaaggtccatactctggtaatccagcacactccaagcttaaagcccca

SEQ ID NO: 292888 - DNA, 75 bp, Artificial Sequence
  Synthetic
ctcaaggtccatactctggtaatccagcacactccaagcttaaagccccaactctacgcccagtagttgtgcaag

SEQ ID NO: 292889 - DNA, 75 bp, Artificial Sequence
  Synthetic
atcactacagataaaggggaatttactggtcttggcatatatgatcacatctgtgttgttcccacacatgcacaa

SEQ ID NO: 292890 - DNA, 75 bp, Artificial Sequence
  Synthetic
ctggtcttggcatatatgatcacatctgtgttgttcccacacatgcacaaccaaatgacaacgtgctcatcaatg

SEQ ID NO: 292891 - DNA, 75 bp, Artificial Sequence
  Synthetic
attaacttggaactgactatcctggaccttaataggaatgaaaaatttagagatatcagagcattcatatcagaa

SEQ ID NO: 292892 - DNA, 75 bp, Artificial Sequence
  Synthetic
accttaataggaatgaaaaatttagagatatcagagcattcatatcagaagactttgaaggggtggaagcaacac

SEQ ID NO: 292893 - DNA, 75 bp, Artificial Sequence
  Synthetic
gtaacaatggcaggcctcatcaatttaagtagcactccaaccaacagaatgattcgttatgagtatgcaacaaaa

SEQ ID NO: 292894 - DNA, 75 bp, Artificial Sequence
  Synthetic
cagtgtattctataatgtttttccaggagataaagaaccagcagtgcttagtgataatgatcctagattagaagt

SEQ ID NO: 292895 - DNA, 75 bp, Artificial Sequence
  Synthetic
aaatacaagggtaacgtggaaatggaacccacagaaaacatgctagtggctgtggatcattatgctggacaacta

SEQ ID NO: 292896 - DNA, 75 bp, Artificial Sequence
  Synthetic
tggggtagatggattagaacccattgatgttacaactagtgctgggtacccttatgttagcctgggaattaaaaa

SEQ ID NO: 292897 - DNA, 75 bp, Artificial Sequence
  Synthetic
gatgttacaactagtgctgggtacccttatgttagcctgggaattaaaaagagagatataataaacaaagaaaca

SEQ ID NO: 292898 - DNA, 75 bp, Artificial Sequence
  Synthetic
gccattagtcacttatataaaggatgaactaagaagcactgacaaagtgcgattagggaaaagcaggttaattga

SEQ ID NO: 292899 - DNA, 75 bp, Artificial Sequence
  Synthetic
agcatctagtttaaatgattcagtaaacatgagaatgaagttaggaaatttgtacaaagcattccatcagaatcc

SEQ ID NO: 292900 - DNA, 75 bp, Artificial Sequence
  Synthetic
ctgttattccttgtttaatggatggtcatttaatggcttttgattactcaaattttgatgcctccttatcaccag

SEQ ID NO: 292901 - DNA, 75 bp, Artificial Sequence
  Synthetic
tcctcattgatacaatcaatatgcaatacacaccacattttcagagatgaaatttatgtagttgagggtggtatg

SEQ ID NO: 292902 - DNA, 75 bp, Artificial Sequence
  Synthetic
atacacaccacattttcagagatgaaatttatgtagttgagggtggtatgccatcaggatgttcaggcactagca

SEQ ID NO: 292903 - DNA, 75 bp, Artificial Sequence
  Synthetic
gcttataaaggaatagatctagacaaactcaaaatcatagcatatggtgatgacctgattgtgtcttatccttat

SEQ ID NO: 292904 - DNA, 75 bp, Artificial Sequence
  Synthetic
aactcaaaatcatagcatatggtgatgacctgattgtgtcttatccttatgagcttaatcctgaagtgctggcca

SEQ ID NO: 292905 - DNA, 75 bp, Artificial Sequence
  Synthetic
accttctctaaaataacatgggaaaatctcaccttcttgaagaggtatttcagaccagataagcaatttcctttc

SEQ ID NO: 292906 - DNA, 75 bp, Artificial Sequence
  Synthetic
atctcaccttcttgaagaggtatttcagaccagataagcaatttcctttcctggttcacccagtgatgcctatga

SEQ ID NO: 292907 - DNA, 75 bp, Artificial Sequence
  Synthetic
gatcatgtcagatccctatgcatgttagcatggcattcaggtgaagaagaatacaatgagttcattgggaaaatt

SEQ ID NO: 292908 - DNA, 75 bp, Artificial Sequence
  Synthetic
atacaatgagttcattgggaaaattagaaccacagacattggtaagtgtttaattctgcctgaatacagtgttct

SEQ ID NO: 292909 - DNA, 75 bp, Artificial Sequence
  Synthetic
ggtcagtgtggaggggtgttatgtgccacagggaagatttttgggattcatgtgggaggtaatggaagacaaggc

SEQ ID NO: 292910 - DNA, 75 bp, Artificial Sequence
  Synthetic
ggtcaagtaataactaggcaaaaggtcagggaactaaacatgaaccctgttaataccccaacaaaatcaaagttg

SEQ ID NO: 292911 - DNA, 75 bp, Artificial Sequence
  Synthetic
ttaaaacagcggatgggtatcccaccatccggcccactgggcgtagtacactggtattctgtacctttgtacgcc

SEQ ID NO: 292912 - DNA, 75 bp, Artificial Sequence
  Synthetic
ctggtattctgtacctttgtacgcctgtttgccgcccctcccccttttattaccacatttgtggtcgctgcaacg

SEQ ID NO: 292913 - DNA, 75 bp, Artificial Sequence
  Synthetic
tgtttgccgcccctcccccttttattaccacatttgtggtcgctgcaacgttagaagattttaaagtagtgcaat

SEQ ID NO: 292914 - DNA, 75 bp, Artificial Sequence
  Synthetic
gagcgaggtatagacggtccccactgtcaaaagcctttaaccgttatccgccaaccaactacgagacagctagta

SEQ ID NO: 292915 - DNA, 75 bp, Artificial Sequence
  Synthetic
agtctggtcgatgaggctagaagtaccccacaggtaactgtgttctagcctgcgtggcggccagcccagcttctg

SEQ ID NO: 292916 - DNA, 75 bp, Artificial Sequence
  Synthetic
ccccacaggtaactgtgttctagcctgcgtggcggccagcccagcttctgctgggacgcctttcaagagacatgg

SEQ ID NO: 292917 - DNA, 75 bp, Artificial Sequence
  Synthetic
tgcgtggcggccagcccagcttctgctgggacgcctttcaagagacatggtgtgaagactcaattgtgcttggtt

SEQ ID NO: 292918 - DNA, 75 bp, Artificial Sequence
  Synthetic
tatgcaaaccagcatagttatggtcgtaatgggcaactctgggatgggaccgactactttgggtgtccgtgtttc

SEQ ID NO: 292919 - DNA, 75 bp, Artificial Sequence
  Synthetic
ggttacaattaagttgtaaccatgggtgcacaggtgtctacacaaaagagtggttcacatgagaatcaaaacttt

SEQ ID NO: 292920 - DNA, 75 bp, Artificial Sequence
  Synthetic
gtgcacaggtgtctacacaaaagagtggttcacatgagaatcaaaactttttgactaatggatccaaccaaacat

SEQ ID NO: 292921 - DNA, 75 bp, Artificial Sequence
  Synthetic
caatcactgtcaatggatccgtctaagtttactgaaccagttaaagaccttatgttaaaaggagccccagcacta

SEQ ID NO: 292922 - DNA, 75 bp, Artificial Sequence
  Synthetic
agtttactgaaccagttaaagaccttatgttaaaaggagccccagcactaaactcccccaacattgaggcttgtg

SEQ ID NO: 292923 - DNA, 75 bp, Artificial Sequence
  Synthetic
actcaggaagcagccaatgccattgttgggtatggtgaatggcccagctttctggatgataaagatgccagtgat

SEQ ID NO: 292924 - DNA, 75 bp, Artificial Sequence
  Synthetic
ttgggtatggtgaatggcccagctttctggatgataaagatgccagtgatgttaacaaacctaccagacctgaca

SEQ ID NO: 292925 - DNA, 75 bp, Artificial Sequence
  Synthetic
tctaaaggatggtgttggaaactgcctgatgctttaaaggatatgggtatttttggacaaaacatgttttatcac

SEQ ID NO: 292926 - DNA, 75 bp, Artificial Sequence
  Synthetic
ctgatgctttaaaggatatgggtatttttggacaaaacatgttttatcactcacagggaagaaccggatatacca

SEQ ID NO: 292927 - DNA, 75 bp, Artificial Sequence
  Synthetic
gtggtaataccagaacaccaattagcatcggcaaagggaggcaatgtgtcagtatactatgataaaacccaccca

SEQ ID NO: 292928 - DNA, 75 bp, Artificial Sequence
  Synthetic
catcggcaaagggaggcaatgtgtcagtatactatgataaaacccacccaggtgaaaatgggatagacctatctg

SEQ ID NO: 292929 - DNA, 75 bp, Artificial Sequence
  Synthetic
accctcttgggtaatgccttaatctttcctcatcaatttattaatctgagaacaaacaatactgctaccttggtg

SEQ ID NO: 292930 - DNA, 75 bp, Artificial Sequence
  Synthetic
ttcctcatcaatttattaatctgagaacaaacaatactgctaccttggtgatgccatatataaattcagtaccca

SEQ ID NO: 292931 - DNA, 75 bp, Artificial Sequence
  Synthetic
ataccaatcacagcaactagtggagctgcacacagtgttccaattactgtcacaattgccccaatgtttcttgag

SEQ ID NO: 292932 - DNA, 75 bp, Artificial Sequence
  Synthetic
ctgcacacagtgttccaattactgtcacaattgccccaatgtttcttgagctttcgggtatcagatctatggctg

SEQ ID NO: 292933 - DNA, 75 bp, Artificial Sequence
  Synthetic
ttgactacagatgataggcaatcaccatcagcattaccaaattatgaagtcaccccactcattcatattcctggt

SEQ ID NO: 292934 - DNA, 75 bp, Artificial Sequence
  Synthetic
catcagcattaccaaattatgaagtcaccccactcattcatattcctggtagagtagtgaacctattagaaattg

SEQ ID NO: 292935 - DNA, 75 bp, Artificial Sequence
  Synthetic
ttggagaggtaccgcatcccactaacccccaatgtacaagaaacacaagtctttggcttctcattattcttgggt

SEQ ID NO: 292936 - DNA, 75 bp, Artificial Sequence
  Synthetic
cccccaatgtacaagaaacacaagtctttggcttctcattattcttgggtggcaccgtcctgaaaacaacactct

SEQ ID NO: 292937 - DNA, 75 bp, Artificial Sequence
  Synthetic
tcattcatgtacacaggaccagcattatccagtgcaaaactcttaattgcatacactcccccaggtgccccaggg

SEQ ID NO: 292938 - DNA, 75 bp, Artificial Sequence
  Synthetic
tatccagtgcaaaactcttaattgcatacactcccccaggtgccccagggccaaaaaccagaaaggacgccatgt

SEQ ID NO: 292939 - DNA, 75 bp, Artificial Sequence
  Synthetic
aacataccatggacatcaggatcacaatttagatacactgacccagatacatacacacatccaggttacatatcc

SEQ ID NO: 292940 - DNA, 75 bp, Artificial Sequence
  Synthetic
aatttagatacactgacccagatacatacacacatccaggttacatatcctgctggtatcaaacatctctcattt

SEQ ID NO: 292941 - DNA, 75 bp, Artificial Sequence
  Synthetic
tgtccagatttcaaattgaggttaatgaaagatacatcttcaatttctcaagagagagcattaactgaagggctt

SEQ ID NO: 292942 - DNA, 75 bp, Artificial Sequence
  Synthetic
tgaaagatacatcttcaatttctcaagagagagcattaactgaagggcttgaggatgtgttagaagaagttatag

SEQ ID NO: 292943 - DNA, 75 bp, Artificial Sequence
  Synthetic
acacagcaagtcccaaccctatcagcaagtgaaacaggtgcaaccctgcaaacagtaccttctgacaatgtggaa

SEQ ID NO: 292944 - DNA, 75 bp, Artificial Sequence
  Synthetic
caagtgaaacaggtgcaaccctgcaaacagtaccttctgacaatgtggaaactagaaagacctatatgcattatg

SEQ ID NO: 292945 - DNA, 75 bp, Artificial Sequence
  Synthetic
catgttactgaaattgaaaacaaaagtcctgcaacagatatgaaccacaagaatcaaaagttatttgatgattgg

SEQ ID NO: 292946 - DNA, 75 bp, Artificial Sequence
  Synthetic
gtcctgcaacagatatgaaccacaagaatcaaaagttatttgatgattggaagattaatttatccagcttagttc

SEQ ID NO: 292947 - DNA, 75 bp, Artificial Sequence
  Synthetic
tacacaatcatagcaacttcttcacaacctaatgatgcccagtattcaaacacactcacaatacaggcaatgttt

SEQ ID NO: 292948 - DNA, 75 bp, Artificial Sequence
  Synthetic
aacctaatgatgcccagtattcaaacacactcacaatacaggcaatgtttatcccaccaggtgcacccaatccaa

SEQ ID NO: 292949 - DNA, 75 bp, Artificial Sequence
  Synthetic
ttcaatgtaggtaattcagcaagattcagtgttccatacttaggaatagcttcagcttataacaatttctatgac

SEQ ID NO: 292950 - DNA, 75 bp, Artificial Sequence
  Synthetic
tcagtgttccatacttaggaatagcttcagcttataacaatttctatgacggctattcccatgacagcagaacca

SEQ ID NO: 292951 - DNA, 75 bp, Artificial Sequence
  Synthetic
gttgtcaatgaaaatgatcaacatactactaaagttaaaattagaatttatcatagagccaaacatgtaatggct

SEQ ID NO: 292952 - DNA, 75 bp, Artificial Sequence
  Synthetic
gttgtcaatgaaaatgatcaacattctactaaagttaaaattagaatttatcatagagccaaacatgtaatggct

SEQ ID NO: 292953 - DNA, 75 bp, Artificial Sequence
  Synthetic
gttgtcaatgaaaatgatcaacatcctactaaagttaaaattagaatttatcatagagccaaacatgtaatggct

SEQ ID NO: 292954 - DNA, 75 bp, Artificial Sequence
  Synthetic
gttgtcaatgaaaatgatcaacatgctactaaagttaaaattagaatttatcatagagccaaacatgtaatggct

SEQ ID NO: 292955 - DNA, 75 bp, Artificial Sequence
  Synthetic
ctactaaagttaaaattagaatttatcatagagccaaacatgtaatggcttggattcccagaccaccaagggcca

SEQ ID NO: 292956 - DNA, 75 bp, Artificial Sequence
  Synthetic
attcccaagagagataccatctcaacatatggtttaggacccaggtttgggggtgtatgtactggtagtgtcaaa

SEQ ID NO: 292957 - DNA, 75 bp, Artificial Sequence
  Synthetic
catatggtttaggacccaggtttgggggtgtatgtactggtagtgtcaaagtgatgaactaccacttaatgacac

SEQ ID NO: 292958 - DNA, 75 bp, Artificial Sequence
  Synthetic
ataatcaacctaaatgggcatggttcagaaacaattccacattgtaactgcacatcaggagtttactattcaaga

SEQ ID NO: 292959 - DNA, 75 bp, Artificial Sequence
  Synthetic
cagaaacaattccacattgtaactgcacatcaggagtttactattcaagacattacaacaaattctatccagtaa

SEQ ID NO: 292960 - DNA, 75 bp, Artificial Sequence
  Synthetic
agcaggtaccagcaaggagtaatgaaaggagtaggccctgctgaacctggggattgtggaggcatcttgagatgt

SEQ ID NO: 292961 - DNA, 75 bp, Artificial Sequence
  Synthetic
aaggagtaggccctgctgaacctggggattgtggaggcatcttgagatgtgtacacggtccaataggactcctga

SEQ ID NO: 292962 - DNA, 75 bp, Artificial Sequence
  Synthetic
atgctccatgcacactaccagggtatcccagactacataaccaatctgggcagagcatttggcacaggctttaca

SEQ ID NO: 292963 - DNA, 75 bp, Artificial Sequence
  Synthetic
tcccagactacataaccaatctgggcagagcatttggcacaggctttacagatcacattaatgataaaatagcag

SEQ ID NO: 292964 - DNA, 75 bp, Artificial Sequence
  Synthetic
gtagttaaaattgtatcagctctagttatcatttgtagaaaccatgatgatttagtcacagtaacagccacatta

SEQ ID NO: 292965 - DNA, 75 bp, Artificial Sequence
  Synthetic
ttatcatttgtagaaaccatgatgatttagtcacagtaacagccacattagcattactagggtgtgatggttctc

SEQ ID NO: 292966 - DNA, 75 bp, Artificial Sequence
  Synthetic
atagagagacaatcaaatgatttgtggtttaaaaagtttaatgacatgtgcaatgctgccaagggactggaatgg

SEQ ID NO: 292967 - DNA, 75 bp, Artificial Sequence
  Synthetic
ggtttaaaaagtttaatgacatgtgcaatgctgccaagggactggaatggatagcaaacaaaatttcaaaattaa

SEQ ID NO: 292968 - DNA, 75 bp, Artificial Sequence
  Synthetic
ttttgcaaaaggctaaaacagcttgatataatagaaagacaggttgaaacactgcacatgaaccacacaaatgaa

SEQ ID NO: 292969 - DNA, 75 bp, Artificial Sequence
  Synthetic
atataatagaaagacaggttgaaacactgcacatgaaccacacaaatgaaaatgacagggaagtattatttaaca

SEQ ID NO: 292970 - DNA, 75 bp, Artificial Sequence
  Synthetic
gctgaagcaaagagaataaaaacactcaaaaacaaaatgacaaactttatccagttcagatccaaacatagaact

SEQ ID NO: 292971 - DNA, 75 bp, Artificial Sequence
  Synthetic
tcaaaaacaaaatgacaaactttatccagttcagatccaaacatagaactgaacctgtgtgtgtattaattcacg

SEQ ID NO: 292972 - DNA, 75 bp, Artificial Sequence
  Synthetic
attgcagacaatcataagtcatctgtatattctttaccaccagatccaaaacattttgatggataccagcaacag

SEQ ID NO: 292973 - DNA, 75 bp, Artificial Sequence
  Synthetic
tctagcacgcagatttggctttgatttagacatgtgtctacactcttcatacactaaatcaggcaaattaaatgt

SEQ ID NO: 292974 - DNA, 75 bp, Artificial Sequence
  Synthetic
ttagacatgtgtctacactcttcatacactaaatcaggcaaattaaatgtagcaatggcttgtgaactatgtaag

SEQ ID NO: 292975 - DNA, 75 bp, Artificial Sequence
  Synthetic
taaagctctcagcttagttgataaacacactaatgtaagatatactattgaccaactggtcactgctatactcca

SEQ ID NO: 292976 - DNA, 75 bp, Artificial Sequence
  Synthetic
cacactaatgtaagatatactattgaccaactggtcactgctatactccaggagcacaacaacaaaacaaaaatc

SEQ ID NO: 292977 - DNA, 75 bp, Artificial Sequence
  Synthetic
tatagatgtacatgataaaccccctccagaatgtattgtagatttattgaaatctgtggactgtgatgaagttag

SEQ ID NO: 292978 - DNA, 75 bp, Artificial Sequence
  Synthetic
ccagaatgtattgtagatttattgaaatctgtggactgtgatgaagttagacagtattgtaaagaaaagaaatgg

SEQ ID NO: 292979 - DNA, 75 bp, Artificial Sequence
  Synthetic
ttcacttataaatacaatattaatgtttatcacaacaatgggtattatctacatgatttacaagatgtttgccca

SEQ ID NO: 292980 - DNA, 75 bp, Artificial Sequence
  Synthetic
tttatcacaacaatgggtattatctacatgatttacaagatgtttgcccagatgcaaggaccttactcaggattg

SEQ ID NO: 292981 - DNA, 75 bp, Artificial Sequence
  Synthetic
agggcctaacaccgagttcgccttgtcactcctaaggaaaaatataattactgtaacaacatctaaaggagagtt

SEQ ID NO: 292982 - DNA, 75 bp, Artificial Sequence
  Synthetic
tcactcctaaggaaaaatataattactgtaacaacatctaaaggagagtttactagtctgggaatttatgacaga

SEQ ID NO: 292983 - DNA, 75 bp, Artificial Sequence
  Synthetic
tggattcaaaactagagttagtgacaaatggaaactagtagatccagataacatgaatttggaaattaccgttct

SEQ ID NO: 292984 - DNA, 75 bp, Artificial Sequence
  Synthetic
aaatggaaactagtagatccagataacatgaatttggaaattaccgttctccagttggacagaaatgaaaagttc

SEQ ID NO: 292985 - DNA, 75 bp, Artificial Sequence
  Synthetic
actagtgattaattcaaataattttaaagatacaatcattacagtaggtcaagcaaccttagttgggatgattaa

SEQ ID NO: 292986 - DNA, 75 bp, Artificial Sequence
  Synthetic
aaagatacaatcattacagtaggtcaagcaaccttagttgggatgattaatctaagtaatacacccaccactaga

SEQ ID NO: 292987 - DNA, 75 bp, Artificial Sequence
  Synthetic
gtgttcaacaggcaaaatttatggtatacatgtaggtggaaatggtagacagggcttttccgctcaattaagaaa

SEQ ID NO: 292988 - DNA, 75 bp, Artificial Sequence
  Synthetic
atacatgtaggtggaaatggtagacagggcttttccgctcaattaagaaaacaatactttgtccagcaacaaggg

SEQ ID NO: 292989 - DNA, 75 bp, Artificial Sequence
  Synthetic
tacacccacaaagacaaaactacttcccagtgtattttacaatgttttccccgggtctaaggaaccagcagtctt

SEQ ID NO: 292990 - DNA, 75 bp, Artificial Sequence
  Synthetic
cccagtgtattttacaatgttttccccgggtctaaggaaccagcagtcttgcatccagcagacaagagattagaa

SEQ ID NO: 292991 - DNA, 75 bp, Artificial Sequence
  Synthetic
gaagatgactgagaacatgaaagtggcagtagatcattatgctggccaactaatgtcactagagataccaacaga

SEQ ID NO: 292992 - DNA, 75 bp, Artificial Sequence
  Synthetic
gcagtagatcattatgctggccaactaatgtcactagagataccaacagaagaattgtcacttaaagaagcactc

SEQ ID NO: 292993 - DNA, 75 bp, Artificial Sequence
  Synthetic
cccttatgtgggcttgggtataaagaagaggtccattctaaataaggaaacacaagacacaacaaaaatgcaaga

SEQ ID NO: 292994 - DNA, 75 bp, Artificial Sequence
  Synthetic
aagaggtccattctaaataaggaaacacaagacacaacaaaaatgcaagagtgtttaagtaaatatggaatagat

SEQ ID NO: 292995 - DNA, 75 bp, Artificial Sequence
  Synthetic
taggttaggtaaaagtagattaatagaagcatcaagcctgaatgactcagttaatatgagagtcaaattaggtca

SEQ ID NO: 292996 - DNA, 75 bp, Artificial Sequence
  Synthetic
gaagcatcaagcctgaatgactcagttaatatgagagtcaaattaggtcacttatacaaagcattccacaaaaac

SEQ ID NO: 292997 - DNA, 75 bp, Artificial Sequence
  Synthetic
gtcagtgataccttgcttgttagatggggagttgctagcatttgattattcaaactttgatgccagcttatctcc

SEQ ID NO: 292998 - DNA, 75 bp, Artificial Sequence
  Synthetic
ggggagttgctagcatttgattattcaaactttgatgccagcttatctcctatctggtttgattgtctagaacta

SEQ ID NO: 292999 - DNA, 75 bp, Artificial Sequence
  Synthetic
taccactcaccacatatttagagatcaagtttatgtggtggagggtggaatgccatctggttgttctggaactag

SEQ ID NO: 293000 - DNA, 75 bp, Artificial Sequence
  Synthetic
caagtttatgtggtggagggtggaatgccatctggttgttctggaactagcatattcaattcaatgattaataac

SEQ ID NO: 293001 - DNA, 75 bp, Artificial Sequence
  Synthetic
caaattaaaaataattgcttatggtgatgatgtaattatttcttatccttatgagttagacccagagagaatagc

SEQ ID NO: 293002 - DNA, 75 bp, Artificial Sequence
  Synthetic
gatgatgtaattatttcttatccttatgagttagacccagagagaatagcagagcaaggaaaaacctatggatta

SEQ ID NO: 293003 - DNA, 75 bp, Artificial Sequence
  Synthetic
taatgttactttcttaaaaagaaattttagaccagatccagaatttccattcctcattcatccagtcatgccaat

SEQ ID NO: 293004 - DNA, 75 bp, Artificial Sequence
  Synthetic
tttagaccagatccagaatttccattcctcattcatccagtcatgccaatggctgatattcatgagtctatcaga

SEQ ID NO: 293005 - DNA, 75 bp, Artificial Sequence
  Synthetic
gttagcttggcattcaggagaagaagaatatgagaaatttgtcaagggtatacgtagtaccagtgtaggtaaagc

SEQ ID NO: 293006 - DNA, 75 bp, Artificial Sequence
  Synthetic
tcttgttatcccatcatactcagttctcagacgtaggtggctggatttgttttgaatgatttatatatagagaat

SEQ ID NO: 293007 - DNA, 75 bp, Artificial Sequence
  Synthetic
ttaaaacagcggatgggtatcccaccatccgacccactgggtgtagtactctggtattttgtacctttgtacgcc

SEQ ID NO: 293008 - DNA, 75 bp, Artificial Sequence
  Synthetic
catccgacccactgggtgtagtactctggtattttgtacctttgtacgcctgtttcttccctttgtacccgcccc

SEQ ID NO: 293009 - DNA, 75 bp, Artificial Sequence
  Synthetic
ggttgcaccataaccagtggtgtttcgtacaagcacttctgtttccccggagcggggtatagacggtacccactg

SEQ ID NO: 293010 - DNA, 75 bp, Artificial Sequence
  Synthetic
cgtacaagcacttctgtttccccggagcggggtatagacggtacccactgtcaaaagcccttaaccgttatccgc

SEQ ID NO: 293011 - DNA, 75 bp, Artificial Sequence
  Synthetic
ggtcgatgaggctaggaattccccacgggtaaccgtgtcctagcctgcgtggcggccaacccagcatttgctggg

SEQ ID NO: 293012 - DNA, 75 bp, Artificial Sequence
  Synthetic
tcctccggcccctgaatgcggctaaccttaaccccggagccttgcagcataatccaatgttgtggaggtcgtaat

SEQ ID NO: 293013 - DNA, 75 bp, Artificial Sequence
  Synthetic
ccttaaccccggagccttgcagcataatccaatgttgtggaggtcgtaatgagcaattctgggatgggaccgact

SEQ ID NO: 293014 - DNA, 75 bp, Artificial Sequence
  Synthetic
gcatatatactatatatactgtgatcatgggagctcaagtgtctacacagaagagtggctcacacgaaaatcaaa

SEQ ID NO: 293015 - DNA, 75 bp, Artificial Sequence
  Synthetic
catgggagctcaagtgtctacacagaagagtggctcacacgaaaatcaaaacattctgactaatggatcacatca

SEQ ID NO: 293016 - DNA, 75 bp, Artificial Sequence
  Synthetic
caggccaatcactatcaatggatccatcaagatttactgaaccagttaaagatctgatgttaaaaggcgctccag

SEQ ID NO: 293017 - DNA, 75 bp, Artificial Sequence
  Synthetic
atcaagatttactgaaccagttaaagatctgatgttaaaaggcgctccagcattaaattcaccaaatgttgaagc

SEQ ID NO: 293018 - DNA, 75 bp, Artificial Sequence
  Synthetic
taactactcaagaagcagcaaatgctgtagtatgttatgctgaatggccagagtatttaccagataaggatgcaa

SEQ ID NO: 293019 - DNA, 75 bp, Artificial Sequence
  Synthetic
tgtagtatgttatgctgaatggccagagtatttaccagataaggatgcaagtgatgtaaataaaacatccaaacc

SEQ ID NO: 293020 - DNA, 75 bp, Artificial Sequence
  Synthetic
caaactcaaaaggatggtgttggaagttacctgatgcactcaaggatatgggagtttttggccagaatatgtttt

SEQ ID NO: 293021 - DNA, 75 bp, Artificial Sequence
  Synthetic
gttacctgatgcactcaaggatatgggagtttttggccagaatatgtttttccactcactagggagaactggtta

SEQ ID NO: 293022 - DNA, 75 bp, Artificial Sequence
  Synthetic
tagttgttgttattccagaacatcaattagcctcccatgatgggggaactgtatctgtaaaatacaaattcacac

SEQ ID NO: 293023 - DNA, 75 bp, Artificial Sequence
  Synthetic
attagcctcccatgatgggggaactgtatctgtaaaatacaaattcacacatccgggtgaacagggcattgatct

SEQ ID NO: 293024 - DNA, 75 bp, Artificial Sequence
  Synthetic
tggatggaactttaattggaaacttaacaattttcccacaccaattcatcaacctcagaacaaataatacagcaa

SEQ ID NO: 293025 - DNA, 75 bp, Artificial Sequence
  Synthetic
aacaattttcccacaccaattcatcaacctcagaacaaataatacagcaactataatagtaccttacatcaattc

SEQ ID NO: 293026 - DNA, 75 bp, Artificial Sequence
  Synthetic
ttcccattgtcccactatcagtccctaacggaaaccaacccacactccctatcacagtgacaattgcaccaatgt

SEQ ID NO: 293027 - DNA, 75 bp, Artificial Sequence
  Synthetic
taacggaaaccaacccacactccctatcacagtgacaattgcaccaatgtgtacagagttttcaggtataagatc

SEQ ID NO: 293028 - DNA, 75 bp, Artificial Sequence
  Synthetic
taccaggatcgggacaatttctaactactgatgacaggcaatcacccagtgctttaccaaactatgaacctacac

SEQ ID NO: 293029 - DNA, 75 bp, Artificial Sequence
  Synthetic
tactgatgacaggcaatcacccagtgctttaccaaactatgaacctacacccagaatccatattccagggcaagt

SEQ ID NO: 293030 - DNA, 75 bp, Artificial Sequence
  Synthetic
agaccaaggtgaatgatgaagtgggaaattaccttataccactcatacagggtcagaagaatgaacagatctttg

SEQ ID NO: 293031 - DNA, 75 bp, Artificial Sequence
  Synthetic
aaattaccttataccactcatacagggtcagaagaatgaacagatctttggaacaaatttgtatataggggatgg

SEQ ID NO: 293032 - DNA, 75 bp, Artificial Sequence
  Synthetic
ggtcaggttcactcagaatttctctaatgtataccggccctgcactatctagtgctaagcttatattagcctaca

SEQ ID NO: 293033 - DNA, 75 bp, Artificial Sequence
  Synthetic
aatgtataccggccctgcactatctagtgctaagcttatattagcctacacaccacctggagcacaaggtccaac

SEQ ID NO: 293034 - DNA, 75 bp, Artificial Sequence
  Synthetic
tgcaatcaaccatagtgatgacaataccatggacatcaggtgttcaattcagatacacggacaaagatacataca

SEQ ID NO: 293035 - DNA, 75 bp, Artificial Sequence
  Synthetic
accatggacatcaggtgttcaattcagatacacggacaaagatacatacaccagtgctggttttctatcttgttg

SEQ ID NO: 293036 - DNA, 75 bp, Artificial Sequence
  Synthetic
tattgtcttttgtaagtgcatgtccagatttcaaattgagattgatgaaagatacacaaacaatatcacaaactt

SEQ ID NO: 293037 - DNA, 75 bp, Artificial Sequence
  Synthetic
agatttcaaattgagattgatgaaagatacacaaacaatatcacaaacttcagcattaacagagggcctcaatga

SEQ ID NO: 293038 - DNA, 75 bp, Artificial Sequence
  Synthetic
ttgcatcaggaccaaaacacacccagagcgtgcctattttaacagcaaatgaaactggtgccaccatgccaactc

SEQ ID NO: 293039 - DNA, 75 bp, Artificial Sequence
  Synthetic
gagcgtgcctattttaacagcaaatgaaactggtgccaccatgccaactcaaccatcagacaatgttgagactag

SEQ ID NO: 293040 - DNA, 75 bp, Artificial Sequence
  Synthetic
tgggtagagctgcatgtgtacatatggttgaaatagttaataaaaacccactaaatattaaaaaccagaagagag

SEQ ID NO: 293041 - DNA, 75 bp, Artificial Sequence
  Synthetic
ggttgaaatagttaataaaaacccactaaatattaaaaaccagaagagagagaagctatttaatgagtggagaat

SEQ ID NO: 293042 - DNA, 75 bp, Artificial Sequence
  Synthetic
atgccagatttgattcagaatacaccatcctggccactgcttcacaaccaaccaactccagttactctagtgact

SEQ ID NO: 293043 - DNA, 75 bp, Artificial Sequence
  Synthetic
catcctggccactgcttcacaaccaaccaactccagttactctagtgacttaactgtgcaagcaatgtatgtacc

SEQ ID NO: 293044 - DNA, 75 bp, Artificial Sequence
  Synthetic
cttcaaatcctagtgtcttcttcaaagttggtgacacagctagattcagtgttccctttgttggtctcgcatcag

SEQ ID NO: 293045 - DNA, 75 bp, Artificial Sequence
  Synthetic
agttggtgacacagctagattcagtgttccctttgttggtctcgcatcagcatacaactgtttctatgatggcta

SEQ ID NO: 293046 - DNA, 75 bp, Artificial Sequence
  Synthetic
tgggtagcatggcttttagagtagtaaatgaacatgatgcacacactacagaagtaaaaatcagagtctatcaca

SEQ ID NO: 293047 - DNA, 75 bp, Artificial Sequence
  Synthetic
aaatgaacatgatgcacacactacagaagtaaaaatcagagtctatcacagagccaaacatgttcaggtatgggt

SEQ ID NO: 293048 - DNA, 75 bp, Artificial Sequence
  Synthetic
atgaaaggcaaaacataaaaccagtcattgaaaagagaaccagtatcaaacaatatggattgggtccaagatttg

SEQ ID NO: 293049 - DNA, 75 bp, Artificial Sequence
  Synthetic
cattgaaaagagaaccagtatcaaacaatatggattgggtccaagatttggaggggtgtatactggtaatgtaaa

SEQ ID NO: 293050 - DNA, 75 bp, Artificial Sequence
  Synthetic
cttcccatccaaacagagatttggccgtggtgtcaacaggtgctcatggtgctgaaactataccccactgtagtt

SEQ ID NO: 293051 - DNA, 75 bp, Artificial Sequence
  Synthetic
cgtggtgtcaacaggtgctcatggtgctgaaactataccccactgtagttgcacatccggtgtgtattattcaac

SEQ ID NO: 293052 - DNA, 75 bp, Artificial Sequence
  Synthetic
ggatagaaggtggtccctattacccaagcagataccaggctggtgtaatgaaaggagttggaccagcagaacctg

SEQ ID NO: 293053 - DNA, 75 bp, Artificial Sequence
  Synthetic
aagcagataccaggctggtgtaatgaaaggagttggaccagcagaacctggggattgtgggggcattttgagatg

SEQ ID NO: 293054 - DNA, 75 bp, Artificial Sequence
  Synthetic
gctttgcagatattagacagctggaatgcattgctgaagaacagggcttaggggattacattaccagtttaggaa

SEQ ID NO: 293055 - DNA, 75 bp, Artificial Sequence
  Synthetic
atgcattgctgaagaacagggcttaggggattacattaccagtttaggaagggctttcggtgtggggtttacaga

SEQ ID NO: 293056 - DNA, 75 bp, Artificial Sequence
  Synthetic
ttacaacaaaagtattatctaaagtggtgaaaatgatatctgctcttgtcatcatatgtagaaatcatgatgatt

SEQ ID NO: 293057 - DNA, 75 bp, Artificial Sequence
  Synthetic
ggtgaaaatgatatctgctcttgtcatcatatgtagaaatcatgatgatttggtcactgttactgctaccttagc

SEQ ID NO: 293058 - DNA, 75 bp, Artificial Sequence
  Synthetic
ccaaacattttcaggtaccatacattgagaggcaagcaaatgatggttggttcagaaaattcaatgacgcatgta

SEQ ID NO: 293059 - DNA, 75 bp, Artificial Sequence
  Synthetic
tgagaggcaagcaaatgatggttggttcagaaaattcaatgacgcatgtaatgcagcaaagggtttggaatggat

SEQ ID NO: 293060 - DNA, 75 bp, Artificial Sequence
  Synthetic
cacaggctaaggaaaaattggaattttgtagtaaactaaaacagcttgacatattggagcgccaaataaccacaa

SEQ ID NO: 293061 - DNA, 75 bp, Artificial Sequence
  Synthetic
ttgtagtaaactaaaacagcttgacatattggagcgccaaataaccacaatgcatgtgtccaatcccacacagga

SEQ ID NO: 293062 - DNA, 75 bp, Artificial Sequence
  Synthetic
agaagtttgcccctctttatgctgcagaagctaggagaattaaggatctgaagaataagatactcaattacatgc

SEQ ID NO: 293063 - DNA, 75 bp, Artificial Sequence
  Synthetic
agaagctaggagaattaaggatctgaagaataagatactcaattacatgcagtttaaaaacaaacaaagaactga

SEQ ID NO: 293064 - DNA, 75 bp, Artificial Sequence
  Synthetic
caacatcaatagtgggacgtgcactagccgagcacttcaattcagcagtttactcacttcccccagatccaaagc

SEQ ID NO: 293065 - DNA, 75 bp, Artificial Sequence
  Synthetic
agccgagcacttcaattcagcagtttactcacttcccccagatccaaagcattttgatggttaccaacaacaaga

SEQ ID NO: 293066 - DNA, 75 bp, Artificial Sequence
  Synthetic
gtatgttttgtcaaatggtctcctctgtagactttctaccccctatggccagcttggataacaagggaatgttgt

SEQ ID NO: 293067 - DNA, 75 bp, Artificial Sequence
  Synthetic
tgtagactttctaccccctatggccagcttggataacaagggaatgttgttcaccagtaacttcgtactggcttc

SEQ ID NO: 293068 - DNA, 75 bp, Artificial Sequence
  Synthetic
tagttaggaggtttggttttgatttggatatttgtttacacagtacttacacaaagaatggaaagttaaatgctg

SEQ ID NO: 293069 - DNA, 75 bp, Artificial Sequence
  Synthetic
ggatatttgtttacacagtacttacacaaagaatggaaagttaaatgctgcaatggcaacaagtatatgcaagga

SEQ ID NO: 293070 - DNA, 75 bp, Artificial Sequence
  Synthetic
aggcaactagtttagtagatagagcaactaatatcagatacagtgtagatcagctggtcacagccataattagtg

SEQ ID NO: 293071 - DNA, 75 bp, Artificial Sequence
  Synthetic
aactaatatcagatacagtgtagatcagctggtcacagccataattagtgattacaaaaacaaggttaaaattac

SEQ ID NO: 293072 - DNA, 75 bp, Artificial Sequence
  Synthetic
tagatgtgtgcaatacacctcctccagaatgtattagtgacttacttagatcagttgattcagaagaagttaggg

SEQ ID NO: 293073 - DNA, 75 bp, Artificial Sequence
  Synthetic
agaatgtattagtgacttacttagatcagttgattcagaagaagttagggaatattgcaagaagaaaaactggat

SEQ ID NO: 293074 - DNA, 75 bp, Artificial Sequence
  Synthetic
tgatcataaacacaatactaatgtttgttagcacactaggaatagtttatgttatatataaactgtttgcacaga

SEQ ID NO: 293075 - DNA, 75 bp, Artificial Sequence
  Synthetic
tgttagcacactaggaatagtttatgttatatataaactgtttgcacagacacagggaccctattccggtaatcc

SEQ ID NO: 293076 - DNA, 75 bp, Artificial Sequence
  Synthetic
gtccaaacacagaatttgcgttatctctgctcaggaaaaatatagtcactattacaacagaaaaaggtgaattca

SEQ ID NO: 293077 - DNA, 75 bp, Artificial Sequence
  Synthetic
tctgctcaggaaaaatatagtcactattacaacagaaaaaggtgaattcaccggtttgggagtgtacgatcagat

SEQ ID NO: 293078 - DNA, 75 bp, Artificial Sequence
  Synthetic
gacagaaggttcaaatcaaagataaatacaaactagttgacccagagaatgtcaatttggagctcactataataa

SEQ ID NO: 293079 - DNA, 75 bp, Artificial Sequence
  Synthetic
atacaaactagttgacccagagaatgtcaatttggagctcactataataactcttgatagaaatgaaaaatttag

SEQ ID NO: 293080 - DNA, 75 bp, Artificial Sequence
  Synthetic
tagttattcattccaataatttcactaacaccattctggacgtgggaccaataactatggcaggtttaattaact

SEQ ID NO: 293081 - DNA, 75 bp, Artificial Sequence
  Synthetic
taacaccattctggacgtgggaccaataactatggcaggtttaattaacttgagcagtacaccaacaaaccgaat

SEQ ID NO: 293082 - DNA, 75 bp, Artificial Sequence
  Synthetic
gcacaacggggaaaatattcggaatacatgttggaggcaacggaagacaaggcttttcagcacaactcagaaaac

SEQ ID NO: 293083 - DNA, 75 bp, Artificial Sequence
  Synthetic
acatgttggaggcaacggaagacaaggcttttcagcacaactcagaaaacaatactttgtttctaaacagggaca

SEQ ID NO: 293084 - DNA, 75 bp, Artificial Sequence
  Synthetic
ctcctacaaaaacaaagttacaccccagtgtattccatgatgtttttcctggtagcaaacaaccagcagtcttga

SEQ ID NO: 293085 - DNA, 75 bp, Artificial Sequence
  Synthetic
cagtgtattccatgatgtttttcctggtagcaaacaaccagcagtcttgagtgataatgatcccagacttgaggt

SEQ ID NO: 293086 - DNA, 75 bp, Artificial Sequence
  Synthetic
agcctactgaaaacatgttaattgctgtggatcattatgcaggacaactcatgtcattagacattcccactggag

SEQ ID NO: 293087 - DNA, 75 bp, Artificial Sequence
  Synthetic
tgtggatcattatgcaggacaactcatgtcattagacattcccactggagaactaagtctcaaagaggcactata

SEQ ID NO: 293088 - DNA, 75 bp, Artificial Sequence
  Synthetic
cttatgttagtctaggtattaaaaagagagatattttaaacaaagaaacccaggaggtagagaaaatgaaatttt

SEQ ID NO: 293089 - DNA, 75 bp, Artificial Sequence
  Synthetic
gagagatattttaaacaaagaaacccaggaggtagagaaaatgaaattttatcttgacaagtatggcatagattt

SEQ ID NO: 293090 - DNA, 75 bp, Artificial Sequence
  Synthetic
ggttgggcaaaagtagattgatagaagcatctagtttgaatgattcagtcaatatgagaatgaaattggggcatt

SEQ ID NO: 293091 - DNA, 75 bp, Artificial Sequence
  Synthetic
agcatctagtttgaatgattcagtcaatatgagaatgaaattggggcatttatataaaactttccatcagaaccc

SEQ ID NO: 293092 - DNA, 75 bp, Artificial Sequence
  Synthetic
cagtgataccatgcttaatggatggacatttgatggcttttgattactcaaattttgatgcttctttatccccag

SEQ ID NO: 293093 - DNA, 75 bp, Artificial Sequence
  Synthetic
acatttgatggcttttgattactcaaattttgatgcttctttatccccagtctggtttgagtgtttggaaagagt

SEQ ID NO: 293094 - DNA, 75 bp, Artificial Sequence
  Synthetic
acactcatcatatctttaaagatgaaatctacacagttaaaggggggatgccatctggttgttctgggactagta

SEQ ID NO: 293095 - DNA, 75 bp, Artificial Sequence
  Synthetic
aatctacacagttaaaggggggatgccatctggttgttctgggactagtatctttaattctatgattaataacat

SEQ ID NO: 293096 - DNA, 75 bp, Artificial Sequence
  Synthetic
agcttaaaattattgcttatggtgatgatttaattgcttcttatccttttgaactggatccagaggtgttagcta

SEQ ID NO: 293097 - DNA, 75 bp, Artificial Sequence
  Synthetic
tgatttaattgcttcttatccttttgaactggatccagaggtgttagctaaattagggaaaaattatggcttaac

SEQ ID NO: 293098 - DNA, 75 bp, Artificial Sequence
  Synthetic
atttaacatttctaaaaaggtactttagaccagatgaacaattcccatttctgattcacccagtcatgcccatgc

SEQ ID NO: 293099 - DNA, 75 bp, Artificial Sequence
  Synthetic
tagaccagatgaacaattcccatttctgattcacccagtcatgcccatgcaagacatacacgaatccattcgctg

SEQ ID NO: 293100 - DNA, 75 bp, Artificial Sequence
  Synthetic
tagcttggcattcagggcaaaaagaatacaatgaatttataactaaaatcagaactacggaaattggaaagtgtt

SEQ ID NO: 293101 - DNA, 75 bp, Artificial Sequence
  Synthetic
tgaacttacctgaatacagtgttcttagaagacgctggttagatatgttttaaatgataaggaaacagatataga

SEQ ID NO: 293102 - DNA, 75 bp, Artificial Sequence
  Synthetic
ttaaaacagcgggtgggtatcccaccacccgacccactgggtgtggtacactggtactttgtacctttgtatgcc

SEQ ID NO: 293103 - DNA, 75 bp, Artificial Sequence
  Synthetic
cacccgacccactgggtgtggtacactggtactttgtacctttgtatgcctgtttgcatcccttttcccttcacc

SEQ ID NO: 293104 - DNA, 75 bp, Artificial Sequence
  Synthetic
ttgttccccggagctggatatagactgctaacgtggtcaaaagtccttaaccgttatccgccagctaactgcgag

SEQ ID NO: 293105 - DNA, 75 bp, Artificial Sequence
  Synthetic
ccgttatccgccagctaactgcgagaagactagtaacatcatgcacatttctagacgttcgatcaggtgaatacc

SEQ ID NO: 293106 - DNA, 75 bp, Artificial Sequence
  Synthetic
gtctcagcctgcgtggcggccaacccgacttatgtcgggacgcctattaatggacatggtgtgaagatcctattg

SEQ ID NO: 293107 - DNA, 75 bp, Artificial Sequence
  Synthetic
cgacttatgtcgggacgcctattaatggacatggtgtgaagatcctattgcgcttagctgtgagtcctccggccc

SEQ ID NO: 293108 - DNA, 75 bp, Artificial Sequence
  Synthetic
tgcaaggtcgtaatgagcaattctgggatgggaccgactactttgggtgtccgtgtttcctttattcttattatt

SEQ ID NO: 293109 - DNA, 75 bp, Artificial Sequence
  Synthetic
ggatgggaccgactactttgggtgtccgtgtttcctttattcttattatttgtgtttcatggttacaagcatagt

SEQ ID NO: 293110 - DNA, 75 bp, Artificial Sequence
  Synthetic
aatcaaaacatactcacaaatggatcaaaccagacatttacagttataaattattacaaggatgcagctagttca

SEQ ID NO: 293111 - DNA, 75 bp, Artificial Sequence
  Synthetic
caaaccagacatttacagttataaattattacaaggatgcagctagttcatcttctgcagggcaatcattttcaa

SEQ ID NO: 293112 - DNA, 75 bp, Artificial Sequence
  Synthetic
gcaccagcattaaattcaccaaacatagaagcatgtggatatagtgacagagttgaacaaataacactagggaat

SEQ ID NO: 293113 - DNA, 75 bp, Artificial Sequence
  Synthetic
tagaagcatgtggatatagtgacagagttgaacaaataacactagggaattctacaatcaccacacaggaggcag

SEQ ID NO: 293114 - DNA, 75 bp, Artificial Sequence
  Synthetic
gatgctagtgatgttaacaaaaccaccaaaccagacacttcagcttgtaggttttacactttggatagcaaaaca

SEQ ID NO: 293115 - DNA, 75 bp, Artificial Sequence
  Synthetic
ccaaaccagacacttcagcttgtaggttttacactttggatagcaaaacatggagtcagaattcaaagggttggt

SEQ ID NO: 293116 - DNA, 75 bp, Artificial Sequence
  Synthetic
atgttctttcactctcaaggcagaactgggtacaccattcatgttcaatgtaacgcaaccaaatttcacagtggc

SEQ ID NO: 293117 - DNA, 75 bp, Artificial Sequence
  Synthetic
ctgggtacaccattcatgttcaatgtaacgcaaccaaatttcacagtggctgcctactggtcgtagtgatacctg

SEQ ID NO: 293118 - DNA, 75 bp, Artificial Sequence
  Synthetic
aaaacgcaccctggagagaaaggcatagaccttaacaaagaagattcaaaaggtccaatgaaagatcccctttac

SEQ ID NO: 293119 - DNA, 75 bp, Artificial Sequence
  Synthetic
tagaccttaacaaagaagattcaaaaggtccaatgaaagatcccctttacatgatggatggtacattaattggaa

SEQ ID NO: 293120 - DNA, 75 bp, Artificial Sequence
  Synthetic
gcaacaattgtggttccttacattaattcagtgcccatggactccatgactagacataacaatctttctttattg

SEQ ID NO: 293121 - DNA, 75 bp, Artificial Sequence
  Synthetic
attcagtgcccatggactccatgactagacataacaatctttctttattggtcattcccattgtacaaatcacag

SEQ ID NO: 293122 - DNA, 75 bp, Artificial Sequence
  Synthetic
atgtttttagagttgtctggcatacgatcaaaagctgttatacaaggattgcctacagttctgacaccaggctca

SEQ ID NO: 293123 - DNA, 75 bp, Artificial Sequence
  Synthetic
gatcaaaagctgttatacaaggattgcctacagttctgacaccaggctcagagcagtttttgactacagatgata

SEQ ID NO: 293124 - DNA, 75 bp, Artificial Sequence
  Synthetic
attcctggagaagtcaaaaacctattagaaattgcacaggttgatactttgattccaataaataatgcaaagaat

SEQ ID NO: 293125 - DNA, 75 bp, Artificial Sequence
  Synthetic
tagaaattgcacaggttgatactttgattccaataaataatgcaaagaatgtcaatggtctggacatgtacaggg

SEQ ID NO: 293126 - DNA, 75 bp, Artificial Sequence
  Synthetic
tgcttgggtgatggtgttctaaaaacaacactaataggtgagttgtgtcagtattttacacattgggcaggttca

SEQ ID NO: 293127 - DNA, 75 bp, Artificial Sequence
  Synthetic
caacactaataggtgagttgtgtcagtattttacacattgggcaggttcattgcgcctatcctttatgtatactg

SEQ ID NO: 293128 - DNA, 75 bp, Artificial Sequence
  Synthetic
gcccaaggtccaaccaaacgtaaagaagcaatgttaggtacacatgtaatttgggatattgggctacaatcaacg

SEQ ID NO: 293129 - DNA, 75 bp, Artificial Sequence
  Synthetic
aagcaatgttaggtacacatgtaatttgggatattgggctacaatcaacggtagtgttgaacataccttggacct

SEQ ID NO: 293130 - DNA, 75 bp, Artificial Sequence
  Synthetic
tttatttcttgctggtatcaaacatccttggtgttacccccacaaacacaacaaacagtgtatatactaggtttt

SEQ ID NO: 293131 - DNA, 75 bp, Artificial Sequence
  Synthetic
ccttggtgttacccccacaaacacaacaaacagtgtatatactaggttttatcagtgcctgccctgacttcaagc

SEQ ID NO: 293132 - DNA, 75 bp, Artificial Sequence
  Synthetic
gagggattggaggatgaattgatggaagtcattgttgacaaaacgcagcaaacattggcttcagttaaaagtgga

SEQ ID NO: 293133 - DNA, 75 bp, Artificial Sequence
  Synthetic
aagtcattgttgacaaaacgcagcaaacattggcttcagttaaaagtggatccaaacacacccaaaaagtgcctt

SEQ ID NO: 293134 - DNA, 75 bp, Artificial Sequence
  Synthetic
agtgtggaaacccggacaaccatgatgcattatacagggtcagaaacaacattggaaaatttcctgggtagggca

SEQ ID NO: 293135 - DNA, 75 bp, Artificial Sequence
  Synthetic
tgcattatacagggtcagaaacaacattggaaaatttcctgggtagggcagcttgtgtgcatgtggtggagatca

SEQ ID NO: 293136 - DNA, 75 bp, Artificial Sequence
  Synthetic
aatgattggaagataaatctgtctagcttagtacaacttagaagaaaacttgaaatgttcacatatgtcagattt

SEQ ID NO: 293137 - DNA, 75 bp, Artificial Sequence
  Synthetic
tgaaatgttcacatatgtcagatttgattcagagtacactataatagctaccagttcacaacctaatgatgctaa

SEQ ID NO: 293138 - DNA, 75 bp, Artificial Sequence
  Synthetic
ccaaccccagtaaatgggatgattatacatggcaaagtgcaactaatcccagtgtattctttaatgtaggaaaat

SEQ ID NO: 293139 - DNA, 75 bp, Artificial Sequence
  Synthetic
tacatggcaaagtgcaactaatcccagtgtattctttaatgtaggaaaatcagccagatttagtgtaccttattt

SEQ ID NO: 293140 - DNA, 75 bp, Artificial Sequence
  Synthetic
atccaaccacgccatatggaataaatgtgctaaaccacatgggctcaatggcttttagagtagttaatgagcatg

SEQ ID NO: 293141 - DNA, 75 bp, Artificial Sequence
  Synthetic
tgtgctaaaccacatgggctcaatggcttttagagtagttaatgagcatgataatcataccacccatgttaaaat

SEQ ID NO: 293142 - DNA, 75 bp, Artificial Sequence
  Synthetic
ctagagctttagagtacttacatattggtagaacaaattacaaacaaaatccagaaaatcccattaagactagag

SEQ ID NO: 293143 - DNA, 75 bp, Artificial Sequence
  Synthetic
tggtagaacaaattacaaacaaaatccagaaaatcccattaagactagagaaaccatcagcacatacgggttggg

SEQ ID NO: 293144 - DNA, 75 bp, Artificial Sequence
  Synthetic
atctaatgtctcatgaggacactctcaaccttgtcacacctctacctgaaagggatcttgctatcgtgagtacag

SEQ ID NO: 293145 - DNA, 75 bp, Artificial Sequence
  Synthetic
caaccttgtcacacctctacctgaaagggatcttgctatcgtgagtacaggtgctcacggttcagaaactgttcc

SEQ ID NO: 293146 - DNA, 75 bp, Artificial Sequence
  Synthetic
tttaccctgtagtttgtgaaaaaccaacatgtttatggattgaaggtaacaactactacccaagtagataccaac

SEQ ID NO: 293147 - DNA, 75 bp, Artificial Sequence
  Synthetic
aacatgtttatggattgaaggtaacaactactacccaagtagataccaacagggtgtaatgagaggtgttggtcc

SEQ ID NO: 293148 - DNA, 75 bp, Artificial Sequence
  Synthetic
ttggacttttgactgcaggtggaagtggctatgtctgttttgctgacatcagagcattagatatgtttaaagctg

SEQ ID NO: 293149 - DNA, 75 bp, Artificial Sequence
  Synthetic
tggctatgtctgttttgctgacatcagagcattagatatgtttaaagctgaataccaagggatttcagattacat

SEQ ID NO: 293150 - DNA, 75 bp, Artificial Sequence
  Synthetic
aaaaggtaacagaactgcagaacatgtcactaggttacttaaatactaaggttttatctaaaatagtaaaaatag

SEQ ID NO: 293151 - DNA, 75 bp, Artificial Sequence
  Synthetic
aaatcatgatgacttgattactgttacagccacattagcattattaggatgtgatggatcaccatggaggtattt

SEQ ID NO: 293152 - DNA, 75 bp, Artificial Sequence
  Synthetic
ccaatgatttatggttcaagaagtttaatgacatgtgtaatgcagcaaaagggctagaatggattgcaaacaaaa

SEQ ID NO: 293153 - DNA, 75 bp, Artificial Sequence
  Synthetic
taatgacatgtgtaatgcagcaaaagggctagaatggattgcaaacaaaatttccaaacttatagattgggttaa

SEQ ID NO: 293154 - DNA, 75 bp, Artificial Sequence
  Synthetic
ttaaacaattagatatcttggaaaggcaaatagatacattacacatgaaccaggttaatgataatgacagagagg

SEQ ID NO: 293155 - DNA, 75 bp, Artificial Sequence
  Synthetic
gcaaatagatacattacacatgaaccaggttaatgataatgacagagaggtattattcaataacatattgtggct

SEQ ID NO: 293156 - DNA, 75 bp, Artificial Sequence
  Synthetic
gaatcaaaacactcaagaataaaatgaccaattttatacagtttagatcaaaacatcgcacagaaccagtgtgtg

SEQ ID NO: 293157 - DNA, 75 bp, Artificial Sequence
  Synthetic
gaccaattttatacagtttagatcaaaacatcgcacagaaccagtgtgtgtgctaatacatggttcacctggctc

SEQ ID NO: 293158 - DNA, 75 bp, Artificial Sequence
  Synthetic
gtggctcctctgtgtactcactacccccagatccaaaacactttgatggctatcagcagcaagccgttgtcatac

SEQ ID NO: 293159 - DNA, 75 bp, Artificial Sequence
  Synthetic
cccagatccaaaacactttgatggctatcagcagcaagccgttgtcatacttgatgatctaaatcaaaacccaaa

SEQ ID NO: 293160 - DNA, 75 bp, Artificial Sequence
  Synthetic
ttcccccaatggcaaacctagataacaaaggtatgttattcactagcaactttgtgttggcttccacaaattctc

SEQ ID NO: 293161 - DNA, 75 bp, Artificial Sequence
  Synthetic
caaaggtatgttattcactagcaactttgtgttggcttccacaaattctcaaactctgaacccaccaacggttct

SEQ ID NO: 293162 - DNA, 75 bp, Artificial Sequence
  Synthetic
tgcacaccacatacacaaaatcagggaaattgaatgccgcattagcatcagaattgtgtaaagactgtcacaaac

SEQ ID NO: 293163 - DNA, 75 bp, Artificial Sequence
  Synthetic
gaaattgaatgccgcattagcatcagaattgtgtaaagactgtcacaaaccaacaaatttcaagagatgctgtcc

SEQ ID NO: 293164 - DNA, 75 bp, Artificial Sequence
  Synthetic
gatacagcatagatcagttggttactgcaattataaatgagcatgcaaacaagaccaaaatctccagctcattgg

SEQ ID NO: 293165 - DNA, 75 bp, Artificial Sequence
  Synthetic
tgcaattataaatgagcatgcaaacaagaccaaaatctccagctcattggaggtgctatttcaaggaccaacata

SEQ ID NO: 293166 - DNA, 75 bp, Artificial Sequence
  Synthetic
tggacctactaaaatctgtggacaatgaggaggttagacaatactgtcaagaaaaaagatggctcattcctgaaa

SEQ ID NO: 293167 - DNA, 75 bp, Artificial Sequence
  Synthetic
tgaggaggttagacaatactgtcaagaaaaaagatggctcattcctgaaattccaaccaatgtagagagagcagt

SEQ ID NO: 293168 - DNA, 75 bp, Artificial Sequence
  Synthetic
ttggcataatttacatgatatataaactctttgctcagacacagggaccttattcaggacttgataataaatcca

SEQ ID NO: 293169 - DNA, 75 bp, Artificial Sequence
  Synthetic
actctttgctcagacacagggaccttattcaggacttgataataaatccaagctcaagccccccacacttagagc

SEQ ID NO: 293170 - DNA, 75 bp, Artificial Sequence
  Synthetic
agaacatagtaacagtcaccactgataaaggagagtttacaggactgggaatacatgaaagaatactggttatac

SEQ ID NO: 293171 - DNA, 75 bp, Artificial Sequence
  Synthetic
taaaggagagtttacaggactgggaatacatgaaagaatactggttataccaacccatgcacaaccctcagaaaa

SEQ ID NO: 293172 - DNA, 75 bp, Artificial Sequence
  Synthetic
tggatccagacaatttaaatttggaaattactgtcttagaattggataggaatgaaaaatttagggatatcagaa

SEQ ID NO: 293173 - DNA, 75 bp, Artificial Sequence
  Synthetic
aattactgtcttagaattggataggaatgaaaaatttagggatatcagaatgtttattgcagatgatccagagtg

SEQ ID NO: 293174 - DNA, 75 bp, Artificial Sequence
  Synthetic
taacggttggtgccaccacactagccggcataataaatttgagtaatacacccactgcacgaatgattcgctacg

SEQ ID NO: 293175 - DNA, 75 bp, Artificial Sequence
  Synthetic
cggcataataaatttgagtaatacacccactgcacgaatgattcgctacgacttccctaccagaacagggcagtg

SEQ ID NO: 293176 - DNA, 75 bp, Artificial Sequence
  Synthetic
gcaatggaaaacaaggattctcagcccaacttaaaaaacagtactttgtgcaaaaacagggccaaattgttacaa

SEQ ID NO: 293177 - DNA, 75 bp, Artificial Sequence
  Synthetic
ccaacttaaaaaacagtactttgtgcaaaaacagggccaaattgttacaaaaagaaatgttagggaactaaacat

SEQ ID NO: 293178 - DNA, 75 bp, Artificial Sequence
  Synthetic
acaatgtgttccctggaaacaaagaaccagcggtcttacaccctgcagatgaacgacttgaggtcaattttgagg

SEQ ID NO: 293179 - DNA, 75 bp, Artificial Sequence
  Synthetic
accagcggtcttacaccctgcagatgaacgacttgaggtcaattttgaggaatccctattctcaaaatacaaagg

SEQ ID NO: 293180 - DNA, 75 bp, Artificial Sequence
  Synthetic
atgctggccaactcctatcacttgacatacccacacaagagcttaccctaaaagaggccctctatggtacagatg

SEQ ID NO: 293181 - DNA, 75 bp, Artificial Sequence
  Synthetic
catacccacacaagagcttaccctaaaagaggccctctatggtacagatggattggagcccattgatttgaatac

SEQ ID NO: 293182 - DNA, 75 bp, Artificial Sequence
  Synthetic
taaacaaggagaccaaagacacaacaaaaatggaagagtgcttgagtaaatatggcattgacctgccattggtta

SEQ ID NO: 293183 - DNA, 75 bp, Artificial Sequence
  Synthetic
aaaaatggaagagtgcttgagtaaatatggcattgacctgccattggttacttacataaaagatgagctcagagg

SEQ ID NO: 293184 - DNA, 75 bp, Artificial Sequence
  Synthetic
taaatgattcagttaacatgagagttaaattgggcaatttatacaaagcttttcacaagaatcctggaatactaa

SEQ ID NO: 293185 - DNA, 75 bp, Artificial Sequence
  Synthetic
taaattgggcaatttatacaaagcttttcacaagaatcctggaatactaactggttctgctgttggttgtgatcc

SEQ ID NO: 293186 - DNA, 75 bp, Artificial Sequence
  Synthetic
cttttgactattcaaattttgatgctagtctttcaccagtttggtttgagtgtttggaacaagtattaaagaaga

SEQ ID NO: 293187 - DNA, 75 bp, Artificial Sequence
  Synthetic
taggattccaatgttcagagttaattcaacaaatatgcaccacccaccatatctttagagaccagatttatgtgg

SEQ ID NO: 293188 - DNA, 75 bp, Artificial Sequence
  Synthetic
atgattaacaacataataatcaggactctaatattggatgtttataaaggtatagaactggattccttgagaata

SEQ ID NO: 293189 - DNA, 75 bp, Artificial Sequence
  Synthetic
atagcatatggtgatgatgttatcatttcatatccctttcctttaaatccagagaaaattgcacagcagggagtc

SEQ ID NO: 293190 - DNA, 75 bp, Artificial Sequence
  Synthetic
aatggactggaatactgtaactttcttaaaaagacactttaaaccagataaggaatttccatttctcatacaccc

SEQ ID NO: 293191 - DNA, 75 bp, Artificial Sequence
  Synthetic
ctaaaaacactcaagaccacatcagatcattgtgtatgatggcctggcattcaggagaggatgaatacaacaagt

SEQ ID NO: 293192 - DNA, 75 bp, Artificial Sequence
  Synthetic
atcattgtgtatgatggcctggcattcaggagaggatgaatacaacaagtttgtggatggaattaggagtactga

SEQ ID NO: 293193 - DNA, 75 bp, Artificial Sequence
  Synthetic
tggcttgatttgttttaaaatttccttctttagatatatagagtataaatttagtgtagtgaatttttcctctat

SEQ ID NO: 293194 - DNA, 75 bp, Artificial Sequence
  Synthetic
tgtttgcttccactcccctttacctaatattcttccccaagtatattttgcggtaacgttagaagaagcaaagtt

SEQ ID NO: 293195 - DNA, 75 bp, Artificial Sequence
  Synthetic
ctaacgtggtcaaaagtccttaaccgttatccgccagctaactgcgagaagactagtaacaccatgtttgttttt

SEQ ID NO: 293196 - DNA, 75 bp, Artificial Sequence
  Synthetic
gagaataccccacaggtaactgtgtctcagcctgcgtggcggccaacccgactcatgtcgggacgcctactaata

SEQ ID NO: 293197 - DNA, 75 bp, Artificial Sequence
  Synthetic
ctcagcctgcgtggcggccaacccgactcatgtcgggacgcctactaatagacatggtgtgaagatcctattgcg

SEQ ID NO: 293198 - DNA, 75 bp, Artificial Sequence
  Synthetic
gccttgtggtgtaaaccaacatttgcaaggtcgtaatgagtaattctgggatgggaccgactactttgggtgtcc

SEQ ID NO: 293199 - DNA, 75 bp, Artificial Sequence
  Synthetic
caaggtcgtaatgagtaattctgggatgggaccgactactttgggtgtccgtgtttcctttatttttattgtgtg

SEQ ID NO: 293200 - DNA, 75 bp, Artificial Sequence
  Synthetic
cacagaagagcggctctcatgaaaaccaaaacatactcaccaatgggtcaaatcaaacattcacagtcataaatt

SEQ ID NO: 293201 - DNA, 75 bp, Artificial Sequence
  Synthetic
ccaaaacatactcaccaatgggtcaaatcaaacattcacagtcataaattattacaaggatgcagctagttcatc

SEQ ID NO: 293202 - DNA, 75 bp, Artificial Sequence
  Synthetic
ttaaagacataatgttaaagggtgcacctgcactaaattcaccaaatatagaagcctgtggttacagtgatagag

SEQ ID NO: 293203 - DNA, 75 bp, Artificial Sequence
  Synthetic
acctgcactaaattcaccaaatatagaagcctgtggttacagtgatagagtagaacaaataacactaggaaactc

SEQ ID NO: 293204 - DNA, 75 bp, Artificial Sequence
  Synthetic
ggccatccttcttatcggatgttgatgcaagtgatgtcaataaaacgacaaaaccagatacttcagcatgcagat

SEQ ID NO: 293205 - DNA, 75 bp, Artificial Sequence
  Synthetic
tgcaagtgatgtcaataaaacgacaaaaccagatacttcagcatgcagattttacaccttggatagtaagatgtg

SEQ ID NO: 293206 - DNA, 75 bp, Artificial Sequence
  Synthetic
atatgggcatatttggtcaaaatatgtttttccactctcagggtagaactgggtataccattcatgtgcagtgta

SEQ ID NO: 293207 - DNA, 75 bp, Artificial Sequence
  Synthetic
gtttttccactctcagggtagaactgggtataccattcatgtgcagtgtaatgcaaccaaattccatagcgggtg

SEQ ID NO: 293208 - DNA, 75 bp, Artificial Sequence
  Synthetic
gtaacgtgtcagttctttatgacaaaacacatccgggagagaagggtatagatcttagtgaagcagattcaacag

SEQ ID NO: 293209 - DNA, 75 bp, Artificial Sequence
  Synthetic
aacacatccgggagagaagggtatagatcttagtgaagcagattcaacaggcccaatgaaagaccccctctacat

SEQ ID NO: 293210 - DNA, 75 bp, Artificial Sequence
  Synthetic
taaacttgaggacaaataatacagccacaatagtagtcccttacatcaactcagtacccatggattccatgaccc

SEQ ID NO: 293211 - DNA, 75 bp, Artificial Sequence
  Synthetic
cacaatagtagtcccttacatcaactcagtacccatggattccatgacccgacataataacctgtctttgatggt

SEQ ID NO: 293212 - DNA, 75 bp, Artificial Sequence
  Synthetic
cagtaaccataaccattgccccaatgtttctagaattgtctggcatacgatcaaaggctgtgatccaaggtcttc

SEQ ID NO: 293213 - DNA, 75 bp, Artificial Sequence
  Synthetic
gtttctagaattgtctggcatacgatcaaaggctgtgatccaaggtcttcccgcagttttaacaccaggctcaga

SEQ ID NO: 293214 - DNA, 75 bp, Artificial Sequence
  Synthetic
atgaaccaacaccattaatacacattcctggagaggtaaaaaatctactggaaattgcacaagttgatacactaa

SEQ ID NO: 293215 - DNA, 75 bp, Artificial Sequence
  Synthetic
tcctggagaggtaaaaaatctactggaaattgcacaagttgatacactaatacctttaaataatacaaccaacac

SEQ ID NO: 293216 - DNA, 75 bp, Artificial Sequence
  Synthetic
aacaagtgtttggcttcagattgtacctgggggatggtgttttaaagacaacactattaggtgaactatgtcagt

SEQ ID NO: 293217 - DNA, 75 bp, Artificial Sequence
  Synthetic
cctgggggatggtgttttaaagacaacactattaggtgaactatgtcagtattttactcattgggcaggctctct

SEQ ID NO: 293218 - DNA, 75 bp, Artificial Sequence
  Synthetic
tcattgcttatacacctccaggagcacaaggcccaacaaagcgtaaagaagcaatgttgggaacacatgtagttt

SEQ ID NO: 293219 - DNA, 75 bp, Artificial Sequence
  Synthetic
acaaggcccaacaaagcgtaaagaagcaatgttgggaacacatgtagtttgggatattgggttacaatcaacagt

SEQ ID NO: 293220 - DNA, 75 bp, Artificial Sequence
  Synthetic
cagacacatatactagtgcaggttttgtttcatgttggtaccagacttcactagtattacccccacagacacaac

SEQ ID NO: 293221 - DNA, 75 bp, Artificial Sequence
  Synthetic
tgtttcatgttggtaccagacttcactagtattacccccacagacacaacagactgtgtatatgctaggctttat

SEQ ID NO: 293222 - DNA, 75 bp, Artificial Sequence
  Synthetic
tacatcaggaaacagcgttaactgagggcttggaggatgacttggtagaagtcattgttgacaaagcgcaacaaa

SEQ ID NO: 293223 - DNA, 75 bp, Artificial Sequence
  Synthetic
gggcttggaggatgacttggtagaagtcattgttgacaaagcgcaacaaacattggcttcaattaagagtgattc

SEQ ID NO: 293224 - DNA, 75 bp, Artificial Sequence
  Synthetic
cattaccaacaacaccatctgatagtgttgagaccagaacaaccttgatgcactacacaggatcagaaacaacat

SEQ ID NO: 293225 - DNA, 75 bp, Artificial Sequence
  Synthetic
tgttgagaccagaacaaccttgatgcactacacaggatcagaaacaacattagagaactttttgggcagggctgc

SEQ ID NO: 293226 - DNA, 75 bp, Artificial Sequence
  Synthetic
aacacagaatgcaactcttgtttaataattggaaaataaatttgtccagtctggtgcaacttagaagaaagttag

SEQ ID NO: 293227 - DNA, 75 bp, Artificial Sequence
  Synthetic
taattggaaaataaatttgtccagtctggtgcaacttagaagaaagttagaaatgtttacatatgttagatttga

SEQ ID NO: 293228 - DNA, 75 bp, Artificial Sequence
  Synthetic
tctctagcaatctaaccattcaggcaatgttcatcccaccaggtgcaccaaatcccaaaaagtgggatgattaca

SEQ ID NO: 293229 - DNA, 75 bp, Artificial Sequence
  Synthetic
aatgttcatcccaccaggtgcaccaaatcccaaaaagtgggatgattacacatggcaaagtgcaaccaaccccag

SEQ ID NO: 293230 - DNA, 75 bp, Artificial Sequence
  Synthetic
gaattgcttctgcttacaactgtttctatgatggatactctcatgataattctacaacaccatatggaattaatg

SEQ ID NO: 293231 - DNA, 75 bp, Artificial Sequence
  Synthetic
ctatgatggatactctcatgataattctacaacaccatatggaattaatgttcttaaccacatgggttcaatggc

SEQ ID NO: 293232 - DNA, 75 bp, Artificial Sequence
  Synthetic
gagtttatcacagggccaaacatattagagcatgggtacccagagcccctagagcactagaatacttgcatattg

SEQ ID NO: 293233 - DNA, 75 bp, Artificial Sequence
  Synthetic
tagagcatgggtacccagagcccctagagcactagaatacttgcatattggcaggacaaactacaaacaaagccc

SEQ ID NO: 293234 - DNA, 75 bp, Artificial Sequence
  Synthetic
ccagatttggtggagtatgtactggtaatattaaaataatgaactatcaccttatgacacatgaggataatctta

SEQ ID NO: 293235 - DNA, 75 bp, Artificial Sequence
  Synthetic
taatattaaaataatgaactatcaccttatgacacatgaggataatcttaacctcgtgacacccatgcctgaaag

SEQ ID NO: 293236 - DNA, 75 bp, Artificial Sequence
  Synthetic
actgcaattgcacatcaggagtttacttttccaggtactacaacaacttttaccctgtaatttgtgaaaaaccaa

SEQ ID NO: 293237 - DNA, 75 bp, Artificial Sequence
  Synthetic
cttttccaggtactacaacaacttttaccctgtaatttgtgaaaaaccaacatgtttgtggatcgagggaaacaa

SEQ ID NO: 293238 - DNA, 75 bp, Artificial Sequence
  Synthetic
cggaaccaggtgattgtggaggtatcttaagatgcgtccatggtcctattggactcctgactgcaggtggtagtg

SEQ ID NO: 293239 - DNA, 75 bp, Artificial Sequence
  Synthetic
cttaagatgcgtccatggtcctattggactcctgactgcaggtggtagtggctatgtttgctttgctgacatcag

SEQ ID NO: 293240 - DNA, 75 bp, Artificial Sequence
  Synthetic
tgaatttaggaaaagcttttggatctggatttacagagcacattagtgaaaaggtgacagaattgcaaaatattt

SEQ ID NO: 293241 - DNA, 75 bp, Artificial Sequence
  Synthetic
tggatttacagagcacattagtgaaaaggtgacagaattgcaaaatatttcaatgggttacttaaacacaaaagt

SEQ ID NO: 293242 - DNA, 75 bp, Artificial Sequence
  Synthetic
accatgatgacctaattactgttacagctacattagcactattgggatgtgatgggtcaccatggagatatttaa

SEQ ID NO: 293243 - DNA, 75 bp, Artificial Sequence
  Synthetic
agctacattagcactattgggatgtgatgggtcaccatggagatatttaaaaatgtacataagtaaacatttctg

SEQ ID NO: 293244 - DNA, 75 bp, Artificial Sequence
  Synthetic
atgacatgtgtaatgcagcaaagggtcttgaatggattgcaaacaaaatttctaaacttattgaatgggtcaaac

SEQ ID NO: 293245 - DNA, 75 bp, Artificial Sequence
  Synthetic
tcttgaatggattgcaaacaaaatttctaaacttattgaatgggtcaaacagaaaattttaccacaggcaagaga

SEQ ID NO: 293246 - DNA, 75 bp, Artificial Sequence
  Synthetic
aaatagacacattgcatatgaaccaggttaatgataatgacagagaagtgttgtttaacaacatattgtggttgg

SEQ ID NO: 293247 - DNA, 75 bp, Artificial Sequence
  Synthetic
ggttaatgataatgacagagaagtgttgtttaacaacatattgtggttggaacaaatgtctcagaaatttgcacc

SEQ ID NO: 293248 - DNA, 75 bp, Artificial Sequence
  Synthetic
ctaatttcatacagtttagatcaaaacaccgcacagaacctgtgtgtgtgttggtgcatggctcgcctggctcag

SEQ ID NO: 293249 - DNA, 75 bp, Artificial Sequence
  Synthetic
acaccgcacagaacctgtgtgtgtgttggtgcatggctcgcctggctcaggcaagtcactaaccacctccttaat

SEQ ID NO: 293250 - DNA, 75 bp, Artificial Sequence
  Synthetic
cagacccaaaacattttgatggatatcagcaacaggctgtagtgatactagatgatttaaatcaaaatccaaatg

SEQ ID NO: 293251 - DNA, 75 bp, Artificial Sequence
  Synthetic
tcagcaacaggctgtagtgatactagatgatttaaatcaaaatccaaatggagaagatattagtactttttgcca

SEQ ID NO: 293252 - DNA, 75 bp, Artificial Sequence
  Synthetic
agggtatgttatttactagtaattttgtgttagcatccacaaactctcaaaccttgaacccaccaacagtactta

SEQ ID NO: 293253 - DNA, 75 bp, Artificial Sequence
  Synthetic
tgtgttagcatccacaaactctcaaaccttgaacccaccaacagtacttaatcctgaagcactagcacgtagatt

SEQ ID NO: 293254 - DNA, 75 bp, Artificial Sequence
  Synthetic
aactaaatactgctctggcttcagaattatgtaaggattgtcataaaccaacaaattttaagagatgctgccctc

SEQ ID NO: 293255 - DNA, 75 bp, Artificial Sequence
  Synthetic
attatgtaaggattgtcataaaccaacaaattttaagagatgctgccctctaatttgtggcaaagccttaagctt

SEQ ID NO: 293256 - DNA, 75 bp, Artificial Sequence
  Synthetic
ccattataactgagcatgcaaataaaacaaaaatttccagttcattagaggcattgttccaagggccagtgtata

SEQ ID NO: 293257 - DNA, 75 bp, Artificial Sequence
  Synthetic
aacaaaaatttccagttcattagaggcattgttccaagggccagtgtataaagacctatctatagatataacaac

SEQ ID NO: 293258 - DNA, 75 bp, Artificial Sequence
  Synthetic
aagaggttagacaatattgtcaagaaaagaggtggcttattcctgagattccaaccaatattgatagagcagtaa

SEQ ID NO: 293259 - DNA, 75 bp, Artificial Sequence
  Synthetic
aaagaggtggcttattcctgagattccaaccaatattgatagagcagtaaaccaggcaactagtttaattaacac

SEQ ID NO: 293260 - DNA, 75 bp, Artificial Sequence
  Synthetic
tttttgcacaaactcaagggccatattcaggtctagacaacaaatctaagttgaagcctccaacactcagggcag

SEQ ID NO: 293261 - DNA, 75 bp, Artificial Sequence
  Synthetic
ttcaggtctagacaacaaatctaagttgaagcctccaacactcagggcagtagtaacacaaggacctaacacaga

SEQ ID NO: 293262 - DNA, 75 bp, Artificial Sequence
  Synthetic
agggagagtttacaggattggggatatatgaaagagtattagtgataccaacccatgcacaaccctcagatcaag

SEQ ID NO: 293263 - DNA, 75 bp, Artificial Sequence
  Synthetic
atatgaaagagtattagtgataccaacccatgcacaaccctcagatcaagtgttgatcaatggctttgctactaa

SEQ ID NO: 293264 - DNA, 75 bp, Artificial Sequence
  Synthetic
ttactgttttggaattggacagaaatgaaaaattcagagatattagaatgtttattgcagatgatccagagtgta

SEQ ID NO: 293265 - DNA, 75 bp, Artificial Sequence
  Synthetic
tgaaaaattcagagatattagaatgtttattgcagatgatccagagtgtaacgaagcctcactcgtcatacattc

SEQ ID NO: 293266 - DNA, 75 bp, Artificial Sequence
  Synthetic
gtattataaatttaagtaacacacccactgcacgaatgattcgctatgagttccctaccaaaacaggacaatgtg

SEQ ID NO: 293267 - DNA, 75 bp, Artificial Sequence
  Synthetic
cactgcacgaatgattcgctatgagttccctaccaaaacaggacaatgtggtggtgtcttgtgctcaacaggaaa

SEQ ID NO: 293268 - DNA, 75 bp, Artificial Sequence
  Synthetic
agcttaagaaacagtattttgtacaaaaacagggtcaaattatcacaaaaagaaatgttagagaattggatatta

SEQ ID NO: 293269 - DNA, 75 bp, Artificial Sequence
  Synthetic
aaaacagggtcaaattatcacaaaaagaaatgttagagaattggatattaaacctatcaacaccccaagcaaaac

SEQ ID NO: 293270 - DNA, 75 bp, Artificial Sequence
  Synthetic
cagctgtcctgcatcctgcagatgagcgattggaggttaattttgaggagtccttattttccaaatacaagggta

SEQ ID NO: 293271 - DNA, 75 bp, Artificial Sequence
  Synthetic
gcgattggaggttaattttgaggagtccttattttccaaatacaagggtaatatagaaagtgaaattactgaaaa

SEQ ID NO: 293272 - DNA, 75 bp, Artificial Sequence
  Synthetic
ttccaacacaagaacttactcttaaagaagccctctatggcacagatggactggaaccaatagatctaaacacta

SEQ ID NO: 293273 - DNA, 75 bp, Artificial Sequence
  Synthetic
agaagccctctatggcacagatggactggaaccaatagatctaaacactagtgcaggatacccatatgttagttt

SEQ ID NO: 293274 - DNA, 75 bp, Artificial Sequence
  Synthetic
aaatggaggaatgcctaagcaaatatggtattgatttgccattagttacatacataaaggatgaacttagaggta

SEQ ID NO: 293275 - DNA, 75 bp, Artificial Sequence
  Synthetic
tggtattgatttgccattagttacatacataaaggatgaacttagaggtaaagacaaaatcaggctggggaaaag

SEQ ID NO: 293276 - DNA, 75 bp, Artificial Sequence
  Synthetic
agttaggtaatttgtataaggctttccacaaaaatccaggaatattaaccggttctgctgtcggttgtgatccag

SEQ ID NO: 293277 - DNA, 75 bp, Artificial Sequence
  Synthetic
ccacaaaaatccaggaatattaaccggttctgctgtcggttgtgatccagatactttctggtctgttataccatg

SEQ ID NO: 293278 - DNA, 75 bp, Artificial Sequence
  Synthetic
gtctttcaccagtttggtttaagtgtctggaacaagtcttaaagaaaatagggtttcaatgttcagaactaatcc

SEQ ID NO: 293279 - DNA, 75 bp, Artificial Sequence
  Synthetic
tctggaacaagtcttaaagaaaatagggtttcaatgttcagaactaatccagcaaatatgcactacccatcatat

SEQ ID NO: 293280 - DNA, 75 bp, Artificial Sequence
  Synthetic
ctggaaccagtatctttaattcaatgattaataatataataattaggactctaatattagatgtttacaaaggta

SEQ ID NO: 293281 - DNA, 75 bp, Artificial Sequence
  Synthetic
gattaataatataataattaggactctaatattagatgtttacaaaggtatagatttagactcattaagaataat

SEQ ID NO: 293282 - DNA, 75 bp, Artificial Sequence
  Synthetic
agaaaattgcagaacaaggagccatttatggcttgactatcacaccaccagacaaatctcctaaattcacaaaaa

SEQ ID NO: 293283 - DNA, 75 bp, Artificial Sequence
  Synthetic
ttatggcttgactatcacaccaccagacaaatctcctaaattcacaaaaatggattggaatacagtaaccttttt

SEQ ID NO: 293284 - DNA, 75 bp, Artificial Sequence
  Synthetic
taatgccaatgacagatattcatgaatctatcagatggacaaaagatcccaaaaatactcaagatcatgtcagat

SEQ ID NO: 293285 - DNA, 75 bp, Artificial Sequence
  Synthetic
atctatcagatggacaaaagatcccaaaaatactcaagatcatgtcagatcattgtgcatgatggcatggcattc

SEQ ID NO: 293286 - DNA, 75 bp, Artificial Sequence
  Synthetic
ttggaaaggcattgctaattccttcttattctgttcttaggcacagatggcttgatttgttttaattttaatata

SEQ ID NO: 293287 - DNA, 75 bp, Artificial Sequence
  Synthetic
ttattctgttcttaggcacagatggcttgatttgttttaattttaatatatagagtattaatttagtgtagtgaa

SEQ ID NO: 293288 - DNA, 75 bp, Artificial Sequence
  Synthetic
atgctgtgaccataagacaataataagtaaaataagaaacacggacacccaaagtagtcggtcccgtcccggaat

SEQ ID NO: 293289 - DNA, 75 bp, Artificial Sequence
  Synthetic
tggtgtgaagactcgcatgtgcttggttgtgattcctccggcccctgaatgcggctaaccttaaccctggagcct

SEQ ID NO: 293290 - DNA, 75 bp, Artificial Sequence
  Synthetic
gttgtgattcctccggcccctgaatgcggctaaccttaaccctggagccttgtattacaaaccagtaatattaag

SEQ ID NO: 293291 - DNA, 75 bp, Artificial Sequence
  Synthetic
ttcttattttacttattattgtcttatggtcacagcatatttgttaaatatactgtgatcatgggcgctcaggtc

SEQ ID NO: 293292 - DNA, 75 bp, Artificial Sequence
  Synthetic
atggtcacagcatatttgttaaatatactgtgatcatgggcgctcaggtctcaacgcaaaagagtggatctcatg

SEQ ID NO: 293293 - DNA, 75 bp, Artificial Sequence
  Synthetic
aactattataaagatgcagctagctcgtcatcagctggccagtctttctcaatggacccatcaaaatttacagaa

SEQ ID NO: 293294 - DNA, 75 bp, Artificial Sequence
  Synthetic
tgttgaggcgtgtggttatagtgatagagtccagcaaattaccctaggcaactccaccataacaactcaagaggc

SEQ ID NO: 293295 - DNA, 75 bp, Artificial Sequence
  Synthetic
atgatgcaagtgatgttaataaaacttccaaaccagacacatctgtgtgtagattttacacgctggaaagtaaaa

SEQ ID NO: 293296 - DNA, 75 bp, Artificial Sequence
  Synthetic
aaagacatgggtgtgtttggacaaaatatgttttttcactcacttggtagatctggctacaccatacatgtgcaa

SEQ ID NO: 293297 - DNA, 75 bp, Artificial Sequence
  Synthetic
atctggctacaccatacatgtgcaatgtaatgcaaccaagtttcatagtggctgtctccttgttgttgttattcc

SEQ ID NO: 293298 - DNA, 75 bp, Artificial Sequence
  Synthetic
aatacacacatccaggagagggtggtatagacttaagtacaccacaagatgaggaaggtccagtaaaagatcctg

SEQ ID NO: 293299 - DNA, 75 bp, Artificial Sequence
  Synthetic
atgacacgtcataataacgtgtcactcctggtgattcccattgcacccttggtggctccaactggatcgctacag

SEQ ID NO: 293300 - DNA, 75 bp, Artificial Sequence
  Synthetic
tatcaggtcaaagaccattgttccacaagggttaccaactacaactttaccaggttcaggacagtttctcactac

SEQ ID NO: 293301 - DNA, 75 bp, Artificial Sequence
  Synthetic
gaatctgctagaaatcatacaggtggatacattaattccaatgaataatatacatgctaaagatgaagtaagtag

SEQ ID NO: 293302 - DNA, 75 bp, Artificial Sequence
  Synthetic
ttatctcatacctctaacagccaacagacagaatgaacagatatttggtacaaaattattcattggtgatggagt

SEQ ID NO: 293303 - DNA, 75 bp, Artificial Sequence
  Synthetic
ctggatctcttagaatctctctgatgtacactggcccagctttgtctagtgccaaactcatcttggcatatacac

SEQ ID NO: 293304 - DNA, 75 bp, Artificial Sequence
  Synthetic
ctccaggtgcacaaggtccaaccaacagaaaagatgcaatgcttggaacacatgttgtttgggatattggattac

SEQ ID NO: 293305 - DNA, 75 bp, Artificial Sequence
  Synthetic
tacactgacccagacacatacactagtgccggttacttatcttgttggtaccagacatcacttatactaccaccc

SEQ ID NO: 293306 - DNA, 75 bp, Artificial Sequence
  Synthetic
gtgccggttacttatcttgttggtaccagacatcacttatactaccacccaatactaccggtcaagttcatttat

SEQ ID NO: 293307 - DNA, 75 bp, Artificial Sequence
  Synthetic
acccaaactatttctcagactgatgctctaacagaagggttaggagatgaattagaagaagttattgttgagaaa

SEQ ID NO: 293308 - DNA, 75 bp, Artificial Sequence
  Synthetic
attagaagaagttattgttgagaaaacgaaacagacactagcttcaatatcatcaggaccaaagcatacccaaag

SEQ ID NO: 293309 - DNA, 75 bp, Artificial Sequence
  Synthetic
cttcagacaatgtggaaactagaacgacatatatgcactttaatggttctgagacagacatagaaagctttttgg

SEQ ID NO: 293310 - DNA, 75 bp, Artificial Sequence
  Synthetic
gacatatatgcactttaatggttctgagacagacatagaaagctttttggggcgtgcagcttgtgtgcatataac

SEQ ID NO: 293311 - DNA, 75 bp, Artificial Sequence
  Synthetic
aactgtttaatgattggaagatcaatttatccagcttggttcagctcaggaagaaattggaacttttcacatatg

SEQ ID NO: 293312 - DNA, 75 bp, Artificial Sequence
  Synthetic
tttatccagcttggttcagctcaggaagaaattggaacttttcacatatgtcagatttgattcagagtacaccat

SEQ ID NO: 293313 - DNA, 75 bp, Artificial Sequence
  Synthetic
tggttcaagcaatgtatgtaccccctggagctccaaatccagacaagtggaatgacttcacgtggcaaagtgctt

SEQ ID NO: 293314 - DNA, 75 bp, Artificial Sequence
  Synthetic
tggagctccaaatccagacaagtggaatgacttcacgtggcaaagtgcttctaatccaagtgtattcttcaaagt

SEQ ID NO: 293315 - DNA, 75 bp, Artificial Sequence
  Synthetic
acaactgtttttatgatggttattcacatgatgataaagacacaccatacggaataacagttcttaatcatatgg

SEQ ID NO: 293316 - DNA, 75 bp, Artificial Sequence
  Synthetic
acatgatgataaagacacaccatacggaataacagttcttaatcatatgggtagcatagctttcagagtggttaa

SEQ ID NO: 293317 - DNA, 75 bp, Artificial Sequence
  Synthetic
caaaacatgttgaggcctggatacccagagcccctagagcattaccatatgagacaataggacgcacaaattatc

SEQ ID NO: 293318 - DNA, 75 bp, Artificial Sequence
  Synthetic
aagaagagataacataacaacctatggacttggacccaggtttggtggtgtttttacaagtaatgtcaaaattat

SEQ ID NO: 293319 - DNA, 75 bp, Artificial Sequence
  Synthetic
atgtcaatagagacttagcagttgtatttactggagcacatggtgcagaaactataccacactgtgactgcacct

SEQ ID NO: 293320 - DNA, 75 bp, Artificial Sequence
  Synthetic
ataccaaacgggtgtgctaaagggtgtcggacctgctgagccaggtgattgtggtggcatcctaaggtgtgtgca

SEQ ID NO: 293321 - DNA, 75 bp, Artificial Sequence
  Synthetic
cagatataagacaattagattgcattgcagaggagcagggtttgaatgattacatcacaaatttaggcagagcat

SEQ ID NO: 293322 - DNA, 75 bp, Artificial Sequence
  Synthetic
tcggagttggtttcactgatcagatatcagcaaaagtaacagaactacaagatgtagcaaaagattttctaacta

SEQ ID NO: 293323 - DNA, 75 bp, Artificial Sequence
  Synthetic
aatgatatcagcccttgtaattatctgcagaaatcatgatgatttagttactgttacagcaacactggcactctt

SEQ ID NO: 293324 - DNA, 75 bp, Artificial Sequence
  Synthetic
tgcagaaatcatgatgatttagttactgttacagcaacactggcactcttaggttgtgatggttctccttggagg

SEQ ID NO: 293325 - DNA, 75 bp, Artificial Sequence
  Synthetic
acaggccaatgatgggtggtttagaaaatttaatgatgcttgcaatgcggcaaagggtcttgaatggattgctaa

SEQ ID NO: 293326 - DNA, 75 bp, Artificial Sequence
  Synthetic
ccaaagaaaaacttgagtattgtagtaaactgaaacagctggatattctagaaagacaaataactacaatgcatg

SEQ ID NO: 293327 - DNA, 75 bp, Artificial Sequence
  Synthetic
atggttggaacagatgtcacaaaagttcgccccactgtatcagctgagtcaaagagaatcagagacctcaaaaac

SEQ ID NO: 293328 - DNA, 75 bp, Artificial Sequence
  Synthetic
ttgtgtgttaatacatggtacacctggttccggaaagtccctaacaacatcaattgtaggacgagcacttgcaga

SEQ ID NO: 293329 - DNA, 75 bp, Artificial Sequence
  Synthetic
ggttccggaaagtccctaacaacatcaattgtaggacgagcacttgcagagtactttaattcatcagtttactcc

SEQ ID NO: 293330 - DNA, 75 bp, Artificial Sequence
  Synthetic
cataatggatgacttaaatcaaaacccagatggccaagatatcagtatgttttgtcaaatggtctcatcagttga

SEQ ID NO: 293331 - DNA, 75 bp, Artificial Sequence
  Synthetic
ccagatggccaagatatcagtatgttttgtcaaatggtctcatcagttgatttcataccaccaatggctaattta

SEQ ID NO: 293332 - DNA, 75 bp, Artificial Sequence
  Synthetic
ttctaacactctgagccctccgacaatcctcaacccagaggctttagctagaagatttggatttgatctagatat

SEQ ID NO: 293333 - DNA, 75 bp, Artificial Sequence
  Synthetic
atcctcaacccagaggctttagctagaagatttggatttgatctagatatttgcttgcatagtacctacactaag

SEQ ID NO: 293334 - DNA, 75 bp, Artificial Sequence
  Synthetic
gttacagctataatcaatgattataagaataaaatgaagattacagattcacttgaagtgctgttccaaggccca

SEQ ID NO: 293335 - DNA, 75 bp, Artificial Sequence
  Synthetic
agaataaaatgaagattacagattcacttgaagtgctgttccaaggcccagtgtataaagatttggaaatagatg

SEQ ID NO: 293336 - DNA, 75 bp, Artificial Sequence
  Synthetic
gattcagaagaagttagagaatactgtaagaagaagaaatggatcataccacagatacctactaacatagaaaga

SEQ ID NO: 293337 - DNA, 75 bp, Artificial Sequence
  Synthetic
gtaagaagaagaaatggatcataccacagatacctactaacatagaaagagtcatgaatcaagctagtatgatca

SEQ ID NO: 293338 - DNA, 75 bp, Artificial Sequence
  Synthetic
tacaagttatttgcacaaacccaaggcccttattcaggtaatccatcccacaataaactcaagcctcccagcttg

SEQ ID NO: 293339 - DNA, 75 bp, Artificial Sequence
  Synthetic
gcccttattcaggtaatccatcccacaataaactcaagcctcccagcttgcgaccagttgtggtgcaaggtccta

SEQ ID NO: 293340 - DNA, 75 bp, Artificial Sequence
  Synthetic
actgaaaagggagagtttacaggtttaggtgtctatgatcgtgtgtgtgttataccaactcatgcacagccagac

SEQ ID NO: 293341 - DNA, 75 bp, Artificial Sequence
  Synthetic
ctgtacagataaaggataaatacaaattagtggacccagacaacaccaacttagaactcacagtattaatacttg

SEQ ID NO: 293342 - DNA, 75 bp, Artificial Sequence
  Synthetic
ttagaactcacagtattaatacttgacaggaatgaaaagtttagggacattaggagttttatatcagaggaccta

SEQ ID NO: 293343 - DNA, 75 bp, Artificial Sequence
  Synthetic
acaggaatgaaaagtttagggacattaggagttttatatcagaggacctagagggtatggaagccactttagtag

SEQ ID NO: 293344 - DNA, 75 bp, Artificial Sequence
  Synthetic
atggcaggtcttattaatttgagtagcactcccacaagtagaatgattcggtatgattacccaactaagactggt

SEQ ID NO: 293345 - DNA, 75 bp, Artificial Sequence
  Synthetic
cagtgtggaggtgtgttgtgtacaactggaaaaatctttggcatccatgtcggaggcaatggtagacagggcttt

SEQ ID NO: 293346 - DNA, 75 bp, Artificial Sequence
  Synthetic
tcagcacaattaaggaagcagtacttcatagagaaacaggggcaaataatttccagacaaaaagttagggatttg

SEQ ID NO: 293347 - DNA, 75 bp, Artificial Sequence
  Synthetic
tcatagagaaacaggggcaaataatttccagacaaaaagttagggatttgaatatggcatcaatcaatacaccaa

SEQ ID NO: 293348 - DNA, 75 bp, Artificial Sequence
  Synthetic
aaagaacctgctgttcttagtgacaatgattctagacttgaagttaaactctcagactccttgttttcaaaatac

SEQ ID NO: 293349 - DNA, 75 bp, Artificial Sequence
  Synthetic
atgattctagacttgaagttaaactctcagactccttgttttcaaaatacaagggtaacattgacatgaaaccca

SEQ ID NO: 293350 - DNA, 75 bp, Artificial Sequence
  Synthetic
ttagatattcctactgaagaattaacactcaaagaagctctttatggggtagatgggttagaacccatagacata

SEQ ID NO: 293351 - DNA, 75 bp, Artificial Sequence
  Synthetic
acaaccagtgcaggttatccctatgttagcctgggtattaagaagagggacattctaaatcgagaaactcaggag

SEQ ID NO: 293352 - DNA, 75 bp, Artificial Sequence
  Synthetic
agttacctacataaaagatgagttgagaagcactgataaagtgcgattaggcaagagcaggctcattgaagcatc

SEQ ID NO: 293353 - DNA, 75 bp, Artificial Sequence
  Synthetic
aggatgaaattaggaaatctatacaaagcatttcatcaaaatccaggtgtaataactggctcagcagttgggtgt

SEQ ID NO: 293354 - DNA, 75 bp, Artificial Sequence
  Synthetic
gatggcgtttgattactcaaattttgacgcctctctctctccagtctggtttgaatgtttagagaaagtcttggc

SEQ ID NO: 293355 - DNA, 75 bp, Artificial Sequence
  Synthetic
gacgcctctctctctccagtctggtttgaatgtttagagaaagtcttggctaaattgggttttaaacactcatct

SEQ ID NO: 293356 - DNA, 75 bp, Artificial Sequence
  Synthetic
accacatatttaaggatgaaatttacactgttaagggagggatgccatctggttgctctggcaccagtatattca

SEQ ID NO: 293357 - DNA, 75 bp, Artificial Sequence
  Synthetic
aaaggaatagatctagacaaacttaagattctagcatatggagatgatctaatagtgtcttatccttatgagctt

SEQ ID NO: 293358 - DNA, 75 bp, Artificial Sequence
  Synthetic
gacccagaagttttggcaacactcgggagaaaatatgggttaacaataacccctcctgataaaacagaaaagttt

SEQ ID NO: 293359 - DNA, 75 bp, Artificial Sequence
  Synthetic
tgatgaacagtttccctttttggtccacccagtcatgccaatgcaagacatctatgaatcaatcagatggactaa

SEQ ID NO: 293360 - DNA, 75 bp, Artificial Sequence
  Synthetic
cacccagtcatgccaatgcaagacatctatgaatcaatcagatggactaaggatcctagaaacacacaggatcac

SEQ ID NO: 293361 - DNA, 75 bp, Artificial Sequence
  Synthetic
tgactttattcagaaaattagaacaacagatattggcaagtgtttgaatttacctgaatacagcgtcctcaggag

SEQ ID NO: 293362 - DNA, 75 bp, Artificial Sequence
  Synthetic
acagatattggcaagtgtttgaatttacctgaatacagcgtcctcaggagacgctggttggacttgttttaaatc

SEQ ID NO: 293363 - DNA, 75 bp, Artificial Sequence
  Synthetic
cagtcacccagtgcattaccaaattatgagccaacaccaagaatacacataccaggccaagtcaaaaacctatta

SEQ ID NO: 293364 - DNA, 75 bp, Artificial Sequence
  Synthetic
tatgtatgtacctcctggtgcacccaacccagtagaatgggatgattacacatggcagagtgcatccaaccccag

SEQ ID NO: 293365 - DNA, 75 bp, Artificial Sequence
  Synthetic
acacataggactctagtcaagatcagagtctaccatcgggcaaaacacattgaagcgtggattccacgtgctccc

SEQ ID NO: 293366 - DNA, 75 bp, Artificial Sequence
  Synthetic
aatggaagacaaggcttttccgcacaacttaaaaaacaatactttgttgagaaacaaggtcaagtaataactagg

SEQ ID NO: 293367 - DNA, 75 bp, Artificial Sequence
  Synthetic
tagattagaagtaaaattgactgaatcactgttttcaaaatacaagggtaacgtggaaatggaacccacagaaaa

SEQ ID NO: 293368 - DNA, 75 bp, Artificial Sequence
  Synthetic
ttcctacagaggaactcacaatcaaggaagccttgtacggggtagatggattagaacccattgatgttacaacta

SEQ ID NO: 293369 - DNA, 75 bp, Artificial Sequence
  Synthetic
atgtgttttggtctgttattccttgtttaatggatggtcatttaatggcttttgattactcaaattttgatgcct

SEQ ID NO: 293370 - DNA, 75 bp, Artificial Sequence
  Synthetic
caggtggatttcccctccactagtttggtcgatgaggctaggaatccctcacgggcgaccgtgtcctagcctgcg

SEQ ID NO: 293371 - DNA, 75 bp, Artificial Sequence
  Synthetic
agctttaaactcaccaaatgttgaggcatgtggttatagtgatagagtccagcaaattactttaggtaactccac

SEQ ID NO: 293372 - DNA, 75 bp, Artificial Sequence
  Synthetic
gcatgtggttatagtgatagagtccagcaaattactttaggtaactccaccataacaactcaagaggcagctaat

SEQ ID NO: 293373 - DNA, 75 bp, Artificial Sequence
  Synthetic
tacaccatacatgtgcaatgtaacgcaaccaagtttcatagtggctgtcttcttgttgttgttattccggaacac

SEQ ID NO: 293374 - DNA, 75 bp, Artificial Sequence
  Synthetic
gtccagtaaaagatcctgtctatagcatgaatggcaccctgttaggtaacttgcttatcttccctcatcagttta

SEQ ID NO: 293375 - DNA, 75 bp, Artificial Sequence
  Synthetic
tctgtaccaatagactcaatgacacgtcacaataacgtgtcactcctggtgattcccattgcacccttggtggct

SEQ ID NO: 293376 - DNA, 75 bp, Artificial Sequence
  Synthetic
gtgtacggagtttacaggtatcaggtcaaagaccattgttccacaagggttaccaaccacaactttaccaggttc

SEQ ID NO: 293377 - DNA, 75 bp, Artificial Sequence
  Synthetic
tcaaagaccattgttccacaagggttaccaaccacaactttaccaggttcaggacagtttctcaccacagatgac

SEQ ID NO: 293378 - DNA, 75 bp, Artificial Sequence
  Synthetic
catcccaggcaaggttaagaatctgctagaaatcatacaggtggatacattaattccaatgaataacatacatgc

SEQ ID NO: 293379 - DNA, 75 bp, Artificial Sequence
  Synthetic
aaattttatccagtgatatgtgaaaaaccaaccaccatatggatagaaggcagctcttactacccaagcagatac

SEQ ID NO: 293380 - DNA, 75 bp, Artificial Sequence
  Synthetic
caaacgggtgtgttaaagggtgtcggacctgctgagccaggtgattgtggtggtatcctaaggtgtgtgcatggt

SEQ ID NO: 293381 - DNA, 75 bp, Artificial Sequence
  Synthetic
aaaacaaggtcctgccgcaagccaaagaaaaacttgagtattgtagtaaactgaaacaactggatattctagaaa

SEQ ID NO: 293382 - DNA, 75 bp, Artificial Sequence
  Synthetic
cagttgttcaataatgtattatggttggaacagatgtcacaaaagttcgccccactgtatgcagctgagtcaaag

SEQ ID NO: 293383 - DNA, 75 bp, Artificial Sequence
  Synthetic
tggaacagatgtcacaaaagttcgccccactgtatgcagctgagtcaaagagaatcagagatctcaaaaacaaaa

SEQ ID NO: 293384 - DNA, 75 bp, Artificial Sequence
  Synthetic
ccagccaacttcaaaaagtgttgcccactggtttgtggcaaagcaatcagcttggtagacagaaccaccaacatt

SEQ ID NO: 293385 - DNA, 75 bp, Artificial Sequence
  Synthetic
gtgtttctctttttactcattattgtcttatggtcacagcatatttgttaaatatactgtgatcatgggtgctca

SEQ ID NO: 293386 - DNA, 75 bp, Artificial Sequence
  Synthetic
cccagctttaaactcaccaaatgttgaggcatgtggttatagtgatagagtccagcaaattactttaggtaactc

SEQ ID NO: 293387 - DNA, 75 bp, Artificial Sequence
  Synthetic
tcagatttgattcagagtacaccattttggcaactgcctcacaacccactcaaacacaaggcacaagacacaact

SEQ ID NO: 293388 - DNA, 75 bp, Artificial Sequence
  Synthetic
atgaccccagaagatcaactaaatttaatcactccccatgtcaatagagacttagcagttgtatttactggagca

SEQ ID NO: 293389 - DNA, 75 bp, Artificial Sequence
  Synthetic
ctggttgagggagggatgccatctggttgctctggcaccagtatatttaattctatgattaacaatataattatt

SEQ ID NO: 293390 - DNA, 75 bp, Artificial Sequence
  Synthetic
gtgcttggttgtgactcctccggcccctgaatgcggctaaccttaaccccggagccttgtgttgcaaaccagcaa

SEQ ID NO: 293391 - DNA, 75 bp, Artificial Sequence
  Synthetic
tccgtgtttccaatttttcttattattgtcttatggtcacagcatatttgataaatatactgtgatcatgggcgc

SEQ ID NO: 293392 - DNA, 75 bp, Artificial Sequence
  Synthetic
ttgtcttatggtcacagcatatttgataaatatactgtgatcatgggcgcacaagtttcaacacagaagagcggt

SEQ ID NO: 293393 - DNA, 75 bp, Artificial Sequence
  Synthetic
agtcataaattactacaaagacgcagccagctcatcatcagcaggacagtctttctcaatggacccatcaaagtt

SEQ ID NO: 293394 - DNA, 75 bp, Artificial Sequence
  Synthetic
gccagctcatcatcagcaggacagtctttctcaatggacccatcaaagttcacagaaccagtcaaagacctaatg

SEQ ID NO: 293395 - DNA, 75 bp, Artificial Sequence
  Synthetic
tagtgatagagtccaacaaattactttaggcaattccaccataacaacccaggaagcagctaacgcagttgtgtg

SEQ ID NO: 293396 - DNA, 75 bp, Artificial Sequence
  Synthetic
ttaggcaattccaccataacaacccaggaagcagctaacgcagttgtgtgctatgccgagtggcctgaatatttg

SEQ ID NO: 293397 - DNA, 75 bp, Artificial Sequence
  Synthetic
tgtatgtagattttatacattggaaagcaaagtatggcaaaacagctcaaaaggctggtgttggaaactaccaga

SEQ ID NO: 293398 - DNA, 75 bp, Artificial Sequence
  Synthetic
agcaaagtatggcaaaacagctcaaaaggctggtgttggaaactaccagacgctctcaaagacatgggagtgttt

SEQ ID NO: 293399 - DNA, 75 bp, Artificial Sequence
  Synthetic
tgtgcagtgtaacgcaactaaattccatagtggctgtcttcttgttgttgtcattccagaacatcaattagcatc

SEQ ID NO: 293400 - DNA, 75 bp, Artificial Sequence
  Synthetic
catagtggctgtcttcttgttgttgtcattccagaacatcaattagcatctcataaagggggaaacgtatcagta

SEQ ID NO: 293401 - DNA, 75 bp, Artificial Sequence
  Synthetic
gttagacgaggacggtccagtaaaagaccccgtctatagtatgaatggtactctactaggtaacttactcatctt

SEQ ID NO: 293402 - DNA, 75 bp, Artificial Sequence
  Synthetic
gaccccgtctatagtatgaatggtactctactaggtaacttactcatcttccctcaccaattcattaatctcaga

SEQ ID NO: 293403 - DNA, 75 bp, Artificial Sequence
  Synthetic
agactcaatgacacgtcataataacgtgtcacttctagtgattcccatagcacctctggtggctccaactggatc

SEQ ID NO: 293404 - DNA, 75 bp, Artificial Sequence
  Synthetic
gtgtcacttctagtgattcccatagcacctctggtggctccaactggatcaccacaaacacttccagtaacagtg

SEQ ID NO: 293405 - DNA, 75 bp, Artificial Sequence
  Synthetic
tgttccacagggattaccaactacaactttaccaggttcaggacaatttcttactactgatgataggcaatcacc

SEQ ID NO: 293406 - DNA, 75 bp, Artificial Sequence
  Synthetic
actttaccaggttcaggacaatttcttactactgatgataggcaatcacccagtgcattacccaattatgagcca

SEQ ID NO: 293407 - DNA, 75 bp, Artificial Sequence
  Synthetic
acaggtggacacattaattccaatgaataatgtacacactagtgatgaggtaaacagttatcttatacctctgac

SEQ ID NO: 293408 - DNA, 75 bp, Artificial Sequence
  Synthetic
aataatgtacacactagtgatgaggtaaacagttatcttatacctctgacagccaatagacagaatgatcagata

SEQ ID NO: 293409 - DNA, 75 bp, Artificial Sequence
  Synthetic
tggtgaaattgcacagtactacacacactggtctggctccctcagaatctctttaatgtacactggtccggcttt

SEQ ID NO: 293410 - DNA, 75 bp, Artificial Sequence
  Synthetic
cactggtctggctccctcagaatctctttaatgtacactggtccggctttgtccagtgctaaactcattttggca

SEQ ID NO: 293411 - DNA, 75 bp, Artificial Sequence
  Synthetic
cggaacacatgttgtctgggatattggattacagtccactattgtcatgacaataccatggacatcaggggtgca

SEQ ID NO: 293412 - DNA, 75 bp, Artificial Sequence
  Synthetic
ggattacagtccactattgtcatgacaataccatggacatcaggggtgcaatttagatacactgacccagacact

SEQ ID NO: 293413 - DNA, 75 bp, Artificial Sequence
  Synthetic
accacccaataccactggacaagttcatctattgtcttttatcagtgcatgtccagattttaaattaaggttaat

SEQ ID NO: 293414 - DNA, 75 bp, Artificial Sequence
  Synthetic
catctattgtcttttatcagtgcatgtccagattttaaattaaggttaatgaaagatacccagaccatttcacaa

SEQ ID NO: 293415 - DNA, 75 bp, Artificial Sequence
  Synthetic
cgagaaaacgaaacagacattagcttcagtatcatcaggaccaaaacacacccagagcgtccctacattaacagc

SEQ ID NO: 293416 - DNA, 75 bp, Artificial Sequence
  Synthetic
tcagtatcatcaggaccaaaacacacccagagcgtccctacattaacagccaatgaaacaggtgccactatgcca

SEQ ID NO: 293417 - DNA, 75 bp, Artificial Sequence
  Synthetic
tggatctgaaacagatgttgaaagtttcttaggacgtgccgcttgtgttcacatagttgagatagagaacaaaaa

SEQ ID NO: 293418 - DNA, 75 bp, Artificial Sequence
  Synthetic
ttcttaggacgtgccgcttgtgttcacatagttgagatagagaacaaaaacccagcaggtattgaaaatcaaaaa

SEQ ID NO: 293419 - DNA, 75 bp, Artificial Sequence
  Synthetic
actcaggaagaaactagaacttttcacatatgtcaggtttgattctgaatacaccattttggccactgcctcaca

SEQ ID NO: 293420 - DNA, 75 bp, Artificial Sequence
  Synthetic
acatatgtcaggtttgattctgaatacaccattttggccactgcctcacaacccactgaatccagttatgcaagt

SEQ ID NO: 293421 - DNA, 75 bp, Artificial Sequence
  Synthetic
aaaatgggatgatttcacatggcagagtgcctctaatccaagtgtatttttcaaagtgggtgacacatccaggtt

SEQ ID NO: 293422 - DNA, 75 bp, Artificial Sequence
  Synthetic
agtgcctctaatccaagtgtatttttcaaagtgggtgacacatccaggtttagtgtaccttttgtaggcattgct

SEQ ID NO: 293423 - DNA, 75 bp, Artificial Sequence
  Synthetic
accatatggaatatcagttctcaatcatatgggtagcatagcctttagagtagtcaatgaacatgacgtacacaa

SEQ ID NO: 293424 - DNA, 75 bp, Artificial Sequence
  Synthetic
catatgggtagcatagcctttagagtagtcaatgaacatgacgtacacaaaacactagtaaaaatcagagtatat

SEQ ID NO: 293425 - DNA, 75 bp, Artificial Sequence
  Synthetic
accatatgagacaataggacgtacaaactaccctaaaaagagtgaaattgtcccagtgattaagaagagaaatac

SEQ ID NO: 293426 - DNA, 75 bp, Artificial Sequence
  Synthetic
aactaccctaaaaagagtgaaattgtcccagtgattaagaagagaaataccataacaacttatggacttggatcc

SEQ ID NO: 293427 - DNA, 75 bp, Artificial Sequence
  Synthetic
gatgaccccagaagaccacttaaatttaattacaccttatgttaatagagatttagcagttgtgtttactggagc

SEQ ID NO: 293428 - DNA, 75 bp, Artificial Sequence
  Synthetic
ttaattacaccttatgttaatagagatttagcagttgtgtttactggagcacacggtgcagaaacaataccacac

SEQ ID NO: 293429 - DNA, 75 bp, Artificial Sequence
  Synthetic
cccaataatatgtgaaaagcccaccaccatatggatagaaggcagttcttattatccaagtagataccaaacagg

SEQ ID NO: 293430 - DNA, 75 bp, Artificial Sequence
  Synthetic
accatatggatagaaggcagttcttattatccaagtagataccaaacaggcgtcatgaaaggtgttggacctgct

SEQ ID NO: 293431 - DNA, 75 bp, Artificial Sequence
  Synthetic
tttattaacagcaggagggagtgggtatgtttgttttgcagatattagacaattagattgcattgcagaagaaca

SEQ ID NO: 293432 - DNA, 75 bp, Artificial Sequence
  Synthetic
tatgtttgttttgcagatattagacaattagattgcattgcagaagaacagggtttaaatgactatatcaccaat

SEQ ID NO: 293433 - DNA, 75 bp, Artificial Sequence
  Synthetic
aacagaactgcaggatgtggccaaagattttctaactaccaaagtgttgtccaaagtagttaagatgatttcagc

SEQ ID NO: 293434 - DNA, 75 bp, Artificial Sequence
  Synthetic
gattttctaactaccaaagtgttgtccaaagtagttaagatgatttcagctcttgtgattatttgtagaaaccat

SEQ ID NO: 293435 - DNA, 75 bp, Artificial Sequence
  Synthetic
ttccccgtggaggtttttaaagatgtacatatccaaacacttccaggtaccatacattgaaagacaagccaacga

SEQ ID NO: 293436 - DNA, 75 bp, Artificial Sequence
  Synthetic
tacatatccaaacacttccaggtaccatacattgaaagacaagccaacgatggttggtttaggaagtttaatgat

SEQ ID NO: 293437 - DNA, 75 bp, Artificial Sequence
  Synthetic
attaattgaatggattaaaaacaaaattctgccacaagcaaaagagaaacttgaatattgcagtaaattaaaaca

SEQ ID NO: 293438 - DNA, 75 bp, Artificial Sequence
  Synthetic
attctgccacaagcaaaagagaaacttgaatattgcagtaaattaaaacaattggacattctagaaagacaaata

SEQ ID NO: 293439 - DNA, 75 bp, Artificial Sequence
  Synthetic
taacaatgtgctgtggttggaacaaatgtcacaaaaattcgccccactgtacgcagctgaatcaaaaagaatcaa

SEQ ID NO: 293440 - DNA, 75 bp, Artificial Sequence
  Synthetic
atgtcacaaaaattcgccccactgtacgcagctgaatcaaaaagaatcaaagaccttaagaacaaaattgtgaat

SEQ ID NO: 293441 - DNA, 75 bp, Artificial Sequence
  Synthetic
acacggtacacctggctctgggaaatccctaacaacctcaatcgtaggccgcgcactagcagaatacttcaactc

SEQ ID NO: 293442 - DNA, 75 bp, Artificial Sequence
  Synthetic
tccctaacaacctcaatcgtaggccgcgcactagcagaatacttcaactcatcagtctactctttaccacctgac

SEQ ID NO: 293443 - DNA, 75 bp, Artificial Sequence
  Synthetic
cttaaaccaaaacccagatggtcaagatatcagtatgttttgtcaaatggtttcatcagttgattttatacctcc

SEQ ID NO: 293444 - DNA, 75 bp, Artificial Sequence
  Synthetic
gatatcagtatgttttgtcaaatggtttcatcagttgattttatacctccaatggccaatctagacaataaagga

SEQ ID NO: 293445 - DNA, 75 bp, Artificial Sequence
  Synthetic
gagtcccccaacaattcttaacccagaggctctagccagaagatttggatttgatttagacatctgtttgcacag

SEQ ID NO: 293446 - DNA, 75 bp, Artificial Sequence
  Synthetic
gaggctctagccagaagatttggatttgatttagacatctgtttgcacagtacttacactaaaaatggaaagctc

SEQ ID NO: 293447 - DNA, 75 bp, Artificial Sequence
  Synthetic
cttcaaaaagtgctgcccactggtttgtggtaaagcaatcagtttagtagatagaaccactaacattagatacag

SEQ ID NO: 293448 - DNA, 75 bp, Artificial Sequence
  Synthetic
tgtggtaaagcaatcagtttagtagatagaaccactaacattagatacagtgtagatcaacttgttacagctata

SEQ ID NO: 293449 - DNA, 75 bp, Artificial Sequence
  Synthetic
gtttcagggtccagtatataaagatttagagattgatgtttgtaatacaccacctccagaatgcataaatgacct

SEQ ID NO: 293450 - DNA, 75 bp, Artificial Sequence
  Synthetic
ttagagattgatgtttgtaatacaccacctccagaatgcataaatgacctactaaaatcagttgattcagaagaa

SEQ ID NO: 293451 - DNA, 75 bp, Artificial Sequence
  Synthetic
caacattgagagggctatgaaccaggctagtatgattattaacacaatattaatgtttgttagtacattaggtat

SEQ ID NO: 293452 - DNA, 75 bp, Artificial Sequence
  Synthetic
gctagtatgattattaacacaatattaatgtttgttagtacattaggtatagtatatgtcatatataaattgttt

SEQ ID NO: 293453 - DNA, 75 bp, Artificial Sequence
  Synthetic
acctcccagcttgcgaccagttgtagtgcaaggtcctaacactgaatttgcactgtccctgttgaggaaaaatat

SEQ ID NO: 293454 - DNA, 75 bp, Artificial Sequence
  Synthetic
gtgcaaggtcctaacactgaatttgcactgtccctgttgaggaaaaatatagttactgttacaacagaaaaaggg

SEQ ID NO: 293455 - DNA, 75 bp, Artificial Sequence
  Synthetic
cgcacagccagacaaaaaggttttaatcaatggtcaagctgttcaattaaaagacaaatacaaattggttgaccc

SEQ ID NO: 293456 - DNA, 75 bp, Artificial Sequence
  Synthetic
atcaatggtcaagctgttcaattaaaagacaaatacaaattggttgacccagataacaccaatctagagcttaca

SEQ ID NO: 293457 - DNA, 75 bp, Artificial Sequence
  Synthetic
atcagaagacctggagggcatggaagccaccctggtagtccactccaacaactttaccaacaccatactggatgt

SEQ ID NO: 293458 - DNA, 75 bp, Artificial Sequence
  Synthetic
gccaccctggtagtccactccaacaactttaccaacaccatactggatgtggggccaattactatggcaggcctt

SEQ ID NO: 293459 - DNA, 75 bp, Artificial Sequence
  Synthetic
aacaaagactgggcagtgcgggggtgtactgtgcacaaccggtaaaatctttggtatccatgtaggaggcaatgg

SEQ ID NO: 293460 - DNA, 75 bp, Artificial Sequence
  Synthetic
gtactgtgcacaaccggtaaaatctttggtatccatgtaggaggcaatggtaggcaaggtttctcagcacaacta

SEQ ID NO: 293461 - DNA, 75 bp, Artificial Sequence
  Synthetic
ggttagggaattgaacatggcatcaattaatacaccaaccaagagcaaattacaccccagtgtcttttataatgt

SEQ ID NO: 293462 - DNA, 75 bp, Artificial Sequence
  Synthetic
attaatacaccaaccaagagcaaattacaccccagtgtcttttataatgtcttcccaggtagcaaagagccagct

SEQ ID NO: 293463 - DNA, 75 bp, Artificial Sequence
  Synthetic
attctcaaagtataagggtaacattgaaatgaagcccactgaaaacatgctgatagcagtagatcattatgctgg

SEQ ID NO: 293464 - DNA, 75 bp, Artificial Sequence
  Synthetic
gaaatgaagcccactgaaaacatgctgatagcagtagatcattatgctggacagttaatgtcattagatattccc

SEQ ID NO: 293465 - DNA, 75 bp, Artificial Sequence
  Synthetic
acccatagacataacaactagtgcaggttacccctatgtaagcttgggtatcaaaaagagggacattctaaatcg

SEQ ID NO: 293466 - DNA, 75 bp, Artificial Sequence
  Synthetic
ggttacccctatgtaagcttgggtatcaaaaagagggacattctaaatcgagagactcaagatgtggaaaagatg

SEQ ID NO: 293467 - DNA, 75 bp, Artificial Sequence
  Synthetic
aaaagatgaattgagaagcactgataaggtgcgtttaggcaaaagcagactcattgaagcttcaagtttaaatga

SEQ ID NO: 293468 - DNA, 75 bp, Artificial Sequence
  Synthetic
aaggtgcgtttaggcaaaagcagactcattgaagcttcaagtttaaatgattcagtaaacatgaggatgaagttg

SEQ ID NO: 293469 - DNA, 75 bp, Artificial Sequence
  Synthetic
agctgtagggtgtgatccagatgtcttttggtctgtaattccttgtcttatggatggacacttaatggcatttga

SEQ ID NO: 293470 - DNA, 75 bp, Artificial Sequence
  Synthetic
ttttggtctgtaattccttgtcttatggatggacacttaatggcatttgattattcaaattttgatgcttccctc

SEQ ID NO: 293471 - DNA, 75 bp, Artificial Sequence
  Synthetic
taaacattcttccttgatccagacaatctgtcatacccatcatatatttaaggatgagatttatgtggttgaagg

SEQ ID NO: 293472 - DNA, 75 bp, Artificial Sequence
  Synthetic
atctgtcatacccatcatatatttaaggatgagatttatgtggttgaaggaggaatgccatctggctgttctggc

SEQ ID NO: 293473 - DNA, 75 bp, Artificial Sequence
  Synthetic
tttggatgcttacaaaggaatagatctggacaaactcaaaattctagcatatggggatgatttaatagtttctta

SEQ ID NO: 293474 - DNA, 75 bp, Artificial Sequence
  Synthetic
ctggacaaactcaaaattctagcatatggggatgatttaatagtttcttacccttatgaacttgacccagaagtt

SEQ ID NO: 293475 - DNA, 75 bp, Artificial Sequence
  Synthetic
aacagaaaaattttcaaagataacatgggacaacttgacatttctgaagagatattttagatctgatgaacagtt

SEQ ID NO: 293476 - DNA, 75 bp, Artificial Sequence
  Synthetic
tgggacaacttgacatttctgaagagatattttagatctgatgaacagtttccctttttagtccacccagtcatg

SEQ ID NO: 293477 - DNA, 75 bp, Artificial Sequence
  Synthetic
cacacaggaccacgttaggtctttgtgcatgttagcatggcattcaggagagaaagactacaatgatttcactca

SEQ ID NO: 293478 - DNA, 75 bp, Artificial Sequence
  Synthetic
aaatgtttaaatctacctgaatacagtgttcttaggagacgctggttggacttattttaaattacatatatatat

SEQ ID NO: 293479 - DNA, 75 bp, Artificial Sequence
  Synthetic
ttaaaacagcggacgggtatcccaccatccggctcactgagcgtagtactctggtattgtgtacctttgtacgcc

SEQ ID NO: 293480 - DNA, 75 bp, Artificial Sequence
  Synthetic
ctggtattgtgtacctttgtacgcctgttttccccaaatcccctaccctttatatctcctaccccgtaacgtaag

SEQ ID NO: 293481 - DNA, 75 bp, Artificial Sequence
  Synthetic
tgttttccccaaatcccctaccctttatatctcctaccccgtaacgtaagaagttttcaaacagtacaataggaa

SEQ ID NO: 293482 - DNA, 75 bp, Artificial Sequence
  Synthetic
aggtataggtggtcaccaccgccaaaagcctttaaccgttacccgccaaccaactacgtaatggctagtaacatc

SEQ ID NO: 293483 - DNA, 75 bp, Artificial Sequence
  Synthetic
aagcctttaaccgttacccgccaaccaactacgtaatggctagtaacatcattgatttagattggcgttcgatca

SEQ ID NO: 293484 - DNA, 75 bp, Artificial Sequence
  Synthetic
gtgaccgtgtcctagcctgcgtggcggccaacccagcatacgctgggacgccagtttactgacatggtgcgaaga

SEQ ID NO: 293485 - DNA, 75 bp, Artificial Sequence
  Synthetic
ggccaacccagcatacgctgggacgccagtttactgacatggtgcgaagacttgcatgtgcttggttgagagtcc

SEQ ID NO: 293486 - DNA, 75 bp, Artificial Sequence
  Synthetic
ccaatgttgtagaggtcgtaacgagtaattctgggatgggaccgactactttgggtgtccgtgtttcctgttttt

SEQ ID NO: 293487 - DNA, 75 bp, Artificial Sequence
  Synthetic
taattctgggatgggaccgactactttgggtgtccgtgtttcctgtttttctttaaaatgtcttatggtcacagc

SEQ ID NO: 293488 - DNA, 75 bp, Artificial Sequence
  Synthetic
gagtggctcacacgaaaaccagaacattttgaccaatggatcccatcagacttttacggttatcaactactacaa

SEQ ID NO: 293489 - DNA, 75 bp, Artificial Sequence
  Synthetic
attttgaccaatggatcccatcagacttttacggttatcaactactacaaagatgcagctagttcatcgtctgca

SEQ ID NO: 293490 - DNA, 75 bp, Artificial Sequence
  Synthetic
tttaatgttgaaaggtgccccagctttaaattcaccaaatgtagaggcatgtggatatagtgatagggtgcaaca

SEQ ID NO: 293491 - DNA, 75 bp, Artificial Sequence
  Synthetic
ttaaattcaccaaatgtagaggcatgtggatatagtgatagggtgcaacaaattacactgggcaattccacgatt

SEQ ID NO: 293492 - DNA, 75 bp, Artificial Sequence
  Synthetic
gtacttaccagatagtgatgctagtgatgtcaataaaacttccaaaccagacacatctgtgtgtagatttttcac

SEQ ID NO: 293493 - DNA, 75 bp, Artificial Sequence
  Synthetic
gatgtcaataaaacttccaaaccagacacatctgtgtgtagatttttcaccttagacagcaaggaatggacacaa

SEQ ID NO: 293494 - DNA, 75 bp, Artificial Sequence
  Synthetic
tgtttttggacagaatatgttcttccactcgctagggagaactggttacaccatccatgtgcaatgcaatgctac

SEQ ID NO: 293495 - DNA, 75 bp, Artificial Sequence
  Synthetic
cactcgctagggagaactggttacaccatccatgtgcaatgcaatgctaccaaatttcacagtggttgtttgtta

SEQ ID NO: 293496 - DNA, 75 bp, Artificial Sequence
  Synthetic
ttcagtgaaatatgaattcacacacccaggcgatcagggcattgacttgagtacagctgaggtgcaatttggacc

SEQ ID NO: 293497 - DNA, 75 bp, Artificial Sequence
  Synthetic
ccaggcgatcagggcattgacttgagtacagctgaggtgcaatttggacctgctaaagacgctatttatagcatg

SEQ ID NO: 293498 - DNA, 75 bp, Artificial Sequence
  Synthetic
cctcagaacaaataacacagccacaataatagtgccttacatgaactcagtaccaattgattcaatgacacgcca

SEQ ID NO: 293499 - DNA, 75 bp, Artificial Sequence
  Synthetic
ataatagtgccttacatgaactcagtaccaattgattcaatgacacgccataataatatttcattaatggttatt

SEQ ID NO: 293500 - DNA, 75 bp, Artificial Sequence
  Synthetic
cacagtaacaatagctcctatgtgcactgaatttacagggataagatccaaaactattgtgccaaatgttagccc

SEQ ID NO: 293501 - DNA, 75 bp, Artificial Sequence
  Synthetic
actgaatttacagggataagatccaaaactattgtgccaaatgttagcccccaaggattgccagtgaccacatta

SEQ ID NO: 293502 - DNA, 75 bp, Artificial Sequence
  Synthetic
attgccaaactatgaacctacccccagaatacatatcccaggcaaagtcaggaatttgttagaaataatacaagt

SEQ ID NO: 293503 - DNA, 75 bp, Artificial Sequence
  Synthetic
agaatacatatcccaggcaaagtcaggaatttgttagaaataatacaagttgataccctgattcctatgaataat

SEQ ID NO: 293504 - DNA, 75 bp, Artificial Sequence
  Synthetic
ccagcaaaacacccagatttttgggactaacttatttattggggatggtgtattcaaaacaacactcttgggtga

SEQ ID NO: 293505 - DNA, 75 bp, Artificial Sequence
  Synthetic
actaacttatttattggggatggtgtattcaaaacaacactcttgggtgaaatagttcagtactatacacattgg

SEQ ID NO: 293506 - DNA, 75 bp, Artificial Sequence
  Synthetic
tgcaaaactcatattggcttataccccccctggagctcaaggaccaacatctaggaaggaagcaatgcttggtac

SEQ ID NO: 293507 - DNA, 75 bp, Artificial Sequence
  Synthetic
ccccctggagctcaaggaccaacatctaggaaggaagcaatgcttggtactcacgttgtttgggatattggtttg

SEQ ID NO: 293508 - DNA, 75 bp, Artificial Sequence
  Synthetic
atacacagacaaagatacctacaccagtgcaggatttctatcgtgttggtatcaaacatcacttatacttccacc

SEQ ID NO: 293509 - DNA, 75 bp, Artificial Sequence
  Synthetic
agtgcaggatttctatcgtgttggtatcaaacatcacttatacttccaccacagactgctggtaaggtctattta

SEQ ID NO: 293510 - DNA, 75 bp, Artificial Sequence
  Synthetic
cacacaaacaatatcacagaccacagcactcacagaaggtcttaatgatgaattagaagaggtcattgtcgagaa

SEQ ID NO: 293511 - DNA, 75 bp, Artificial Sequence
  Synthetic
gcactcacagaaggtcttaatgatgaattagaagaggtcattgtcgagaaaacgagacagacattggcctctgtt

SEQ ID NO: 293512 - DNA, 75 bp, Artificial Sequence
  Synthetic
aactggagccaccatgccaactcaaccttctgacaatgtagagaccaggactacttatatgcattttaatggttc

SEQ ID NO: 293513 - DNA, 75 bp, Artificial Sequence
  Synthetic
ccttctgacaatgtagagaccaggactacttatatgcattttaatggttcagaaacagatgtagagagcttctta

SEQ ID NO: 293514 - DNA, 75 bp, Artificial Sequence
  Synthetic
agatattgtgaatcaaaaagagcatcttttgttcaatgactggagaatcaatctatccagcttagtgcaactcag

SEQ ID NO: 293515 - DNA, 75 bp, Artificial Sequence
  Synthetic
cttttgttcaatgactggagaatcaatctatccagcttagtgcaactcagaaagaaacttgaactttttacctat

SEQ ID NO: 293516 - DNA, 75 bp, Artificial Sequence
  Synthetic
tgattcacaatattccagtaatctgacagtacaagcaatgtatgtacctccaggagcacccaatcccacaaaatg

SEQ ID NO: 293517 - DNA, 75 bp, Artificial Sequence
  Synthetic
acagtacaagcaatgtatgtacctccaggagcacccaatcccacaaaatgggatgactacacatggcagagtgct

SEQ ID NO: 293518 - DNA, 75 bp, Artificial Sequence
  Synthetic
tccttttgtgggccttgcttcagcatataattgtttctatgatggatactcacatgatgatgaaaatactccata

SEQ ID NO: 293519 - DNA, 75 bp, Artificial Sequence
  Synthetic
tataattgtttctatgatggatactcacatgatgatgaaaatactccatatgggatcacagtacttaatcatatg

SEQ ID NO: 293520 - DNA, 75 bp, Artificial Sequence
  Synthetic
agtaaagattagagtttatcatagagcaaaacatgttgaagcctggatccctagagcacccagagcattacctta

SEQ ID NO: 293521 - DNA, 75 bp, Artificial Sequence
  Synthetic
gcaaaacatgttgaagcctggatccctagagcacccagagcattaccttatatgtcaattggtcgaaccaattac

SEQ ID NO: 293522 - DNA, 75 bp, Artificial Sequence
  Synthetic
tggtctaggaccaaggtttgggggtgttttcaccagcaatgttaaaataatgaactaccacctcatgactccaga

SEQ ID NO: 293523 - DNA, 75 bp, Artificial Sequence
  Synthetic
gttttcaccagcaatgttaaaataatgaactaccacctcatgactccagaagatcatttgaatttagtgacatcc

SEQ ID NO: 293524 - DNA, 75 bp, Artificial Sequence
  Synthetic
gactgtaccacactgcaattgcacctctggtgtgtattactccacatattacaggaaatcttacccaatcatatg

SEQ ID NO: 293525 - DNA, 75 bp, Artificial Sequence
  Synthetic
tctggtgtgtattactccacatattacaggaaatcttacccaatcatatgtgacaaacccacaaccatctggata

SEQ ID NO: 293526 - DNA, 75 bp, Artificial Sequence
  Synthetic
tgtaggaccagcagaaccaggcgattgtggaggcattttaagatgtgtacatggaccaataggtttgttaacagc

SEQ ID NO: 293527 - DNA, 75 bp, Artificial Sequence
  Synthetic
tgtggaggcattttaagatgtgtacatggaccaataggtttgttaacagcaggaggtagtggatatgtttgtttt

SEQ ID NO: 293528 - DNA, 75 bp, Artificial Sequence
  Synthetic
ttacatcaccagtttgggaagagcattcggagtaggattcacagatcaaatatcagcaaaagtcacagaattgca

SEQ ID NO: 293529 - DNA, 75 bp, Artificial Sequence
  Synthetic
ttcggagtaggattcacagatcaaatatcagcaaaagtcacagaattgcaagatgtggccaaagattttttaaca

SEQ ID NO: 293530 - DNA, 75 bp, Artificial Sequence
  Synthetic
atgtaggaatcatgatgacttagttaccgtcacagcaaccttagctctattgggttgtgacggttcaccatggag

SEQ ID NO: 293531 - DNA, 75 bp, Artificial Sequence
  Synthetic
accgtcacagcaaccttagctctattgggttgtgacggttcaccatggaggttcttgaagatgtacatctcaaaa

SEQ ID NO: 293532 - DNA, 75 bp, Artificial Sequence
  Synthetic
aaaatttaatgatgcatgcaacgcagccaaaggtttggaatggattgcaaacaaaatttcaaagctcatagaatg

SEQ ID NO: 293533 - DNA, 75 bp, Artificial Sequence
  Synthetic
gccaaaggtttggaatggattgcaaacaaaatttcaaagctcatagaatggattaaaaataaagttttacctcaa

SEQ ID NO: 293534 - DNA, 75 bp, Artificial Sequence
  Synthetic
agagaggcaaataacaactatgcatgtttccaaccctacacaagaaaaaagggagcagctgtttaataatgttat

SEQ ID NO: 293535 - DNA, 75 bp, Artificial Sequence
  Synthetic
gtttccaaccctacacaagaaaaaagggagcagctgtttaataatgttatgtggttggaacagatgtctcaaaag

SEQ ID NO: 293536 - DNA, 75 bp, Artificial Sequence
  Synthetic
caaaatactaaactacatgcagtttagaagcaaacagaggactgagcctgtgtgtgtcctgatccatggtacacc

SEQ ID NO: 293537 - DNA, 75 bp, Artificial Sequence
  Synthetic
agaagcaaacagaggactgagcctgtgtgtgtcctgatccatggtacacctggttcaggtaaatctctaacaaca

SEQ ID NO: 293538 - DNA, 75 bp, Artificial Sequence
  Synthetic
actaccaccagaccctaaacattttgatggttaccaacaacaagaggttgtgattatggatgacttaaaccaaaa

SEQ ID NO: 293539 - DNA, 75 bp, Artificial Sequence
  Synthetic
gatggttaccaacaacaagaggttgtgattatggatgacttaaaccaaaatccagatggtcaagatattagcatg

SEQ ID NO: 293540 - DNA, 75 bp, Artificial Sequence
  Synthetic
agataataaaggaatgctttttactagcaatttcgtcctggcttccacaaactcaaacaccctaagtcctccaac

SEQ ID NO: 293541 - DNA, 75 bp, Artificial Sequence
  Synthetic
agcaatttcgtcctggcttccacaaactcaaacaccctaagtcctccaactatactaaacccagaagctctggtt

SEQ ID NO: 293542 - DNA, 75 bp, Artificial Sequence
  Synthetic
aaatggtaaattgaatgcagcaatggcaactagcatatgtaaagattgtcatcaaccttcaaacttcaaaaagtg

SEQ ID NO: 293543 - DNA, 75 bp, Artificial Sequence
  Synthetic
gcaactagcatatgtaaagattgtcatcaaccttcaaacttcaaaaagtgctgcccgttagtctgtgggaaggct

SEQ ID NO: 293544 - DNA, 75 bp, Artificial Sequence
  Synthetic
agtcacagctatcatcaatgattacaaaaacaaaatgaaaatcacagactcacttgaagcactcttccaggggcc

SEQ ID NO: 293545 - DNA, 75 bp, Artificial Sequence
  Synthetic
aaaaacaaaatgaaaatcacagactcacttgaagcactcttccaggggcctgtgtataaggacttagagatagac

SEQ ID NO: 293546 - DNA, 75 bp, Artificial Sequence
  Synthetic
ggactcagaggagattagggaatattgtaaaaagaaaaattggactataccacaaatccccaccaatatagatag

SEQ ID NO: 293547 - DNA, 75 bp, Artificial Sequence
  Synthetic
tgtaaaaagaaaaattggactataccacaaatccccaccaatatagatagagcaatgaatcaagccagcatgatc

SEQ ID NO: 293548 - DNA, 75 bp, Artificial Sequence
  Synthetic
ttacaagctctttgcccaaacccaaggaccttattcaggtaatccctctcataataaacttaaaccaccaactct

SEQ ID NO: 293549 - DNA, 75 bp, Artificial Sequence
  Synthetic
ggaccttattcaggtaatccctctcataataaacttaaaccaccaactctaagacctgttatagttcaaggtccc

SEQ ID NO: 293550 - DNA, 75 bp, Artificial Sequence
  Synthetic
tacagaaaaaggggaatttacaggtttgggggtgtatgatcatgtctgtgtcattcccactcatgcacaacctag

SEQ ID NO: 293551 - DNA, 75 bp, Artificial Sequence
  Synthetic
ttgggggtgtatgatcatgtctgtgtcattcccactcatgcacaacctagtgatagtgttttagttaatggccag

SEQ ID NO: 293552 - DNA, 75 bp, Artificial Sequence
  Synthetic
cttggagttaactatattagtccttgatagaaacgaaaaatttagggatataagaggatttatatcagaagattt

SEQ ID NO: 293553 - DNA, 75 bp, Artificial Sequence
  Synthetic
gatagaaacgaaaaatttagggatataagaggatttatatcagaagatttagaaggattggatgccaccttagta

SEQ ID NO: 293554 - DNA, 75 bp, Artificial Sequence
  Synthetic
catggcaggtcttattaatctcagtagcacaccaacaaatcgcatgatcagatatgattacccaaccagaacagg

SEQ ID NO: 293555 - DNA, 75 bp, Artificial Sequence
  Synthetic
agcacaccaacaaatcgcatgatcagatatgattacccaaccagaacagggcaatgtggtggagtgctatgcaca

SEQ ID NO: 293556 - DNA, 75 bp, Artificial Sequence
  Synthetic
ttccgcacaactcagaaggcaatattttgtgagcaagcaaggtcaaataacctctagacaaaagctaaaagattt

SEQ ID NO: 293557 - DNA, 75 bp, Artificial Sequence
  Synthetic
tttgtgagcaagcaaggtcaaataacctctagacaaaagctaaaagatttgaatctaaatccaataaacactcca

SEQ ID NO: 293558 - DNA, 75 bp, Artificial Sequence
  Synthetic
caaacaacctgcagtcctcagtgacaatgatcccagacttgaggtaaagttagcagactctctgttttcaaaata

SEQ ID NO: 293559 - DNA, 75 bp, Artificial Sequence
  Synthetic
aatgatcccagacttgaggtaaagttagcagactctctgttttcaaaatataaaggaaatgttgaaatgaaaccc

SEQ ID NO: 293560 - DNA, 75 bp, Artificial Sequence
  Synthetic
attagatatacctactaatgaattaaccttaaaggaagctttgtatggtgttgatggattagaacccatagatgt

SEQ ID NO: 293561 - DNA, 75 bp, Artificial Sequence
  Synthetic
accttaaaggaagctttgtatggtgttgatggattagaacccatagatgtaacaactagtgctggatacccatat

SEQ ID NO: 293562 - DNA, 75 bp, Artificial Sequence
  Synthetic
tacagaaaagatgaaattttatttagataaatatgggatagatctacctttagtaacctatatcaaagatgagct

SEQ ID NO: 293563 - DNA, 75 bp, Artificial Sequence
  Synthetic
gataaatatgggatagatctacctttagtaacctatatcaaagatgagcttaggagttcagataaagttagatta

SEQ ID NO: 293564 - DNA, 75 bp, Artificial Sequence
  Synthetic
gagaatgaaattaggacatttgtataaggcttttcatcaaaatccaggtgtaataacaggatctgctgtaggatg

SEQ ID NO: 293565 - DNA, 75 bp, Artificial Sequence
  Synthetic
aaggcttttcatcaaaatccaggtgtaataacaggatctgctgtaggatgtgatccagatgtgttctggtcagtt

SEQ ID NO: 293566 - DNA, 75 bp, Artificial Sequence
  Synthetic
tgatgcttctttatctccagtttggtttgaatgcttagagaaagttttagaaaaattaggatttaagtgtgcttc

SEQ ID NO: 293567 - DNA, 75 bp, Artificial Sequence
  Synthetic
tttgaatgcttagagaaagttttagaaaaattaggatttaagtgtgcttcactaattcaaacaatatgcaatact

SEQ ID NO: 293568 - DNA, 75 bp, Artificial Sequence
  Synthetic
aggttgttcagggaccagcattttcaattccatgattaataatataatcatcagaacactcatcctagatgcata

SEQ ID NO: 293569 - DNA, 75 bp, Artificial Sequence
  Synthetic
aattccatgattaataatataatcatcagaacactcatcctagatgcatataaaggaatagatttagataaactt

SEQ ID NO: 293570 - DNA, 75 bp, Artificial Sequence
  Synthetic
ggacccagaggttttagcaacacttgggaaaaactatggacttgtgattaccccaccagataaatcagagaagtt

SEQ ID NO: 293571 - DNA, 75 bp, Artificial Sequence
  Synthetic
gggaaaaactatggacttgtgattaccccaccagataaatcagagaagttcacaaagatgacatgggaaaatctg

SEQ ID NO: 293572 - DNA, 75 bp, Artificial Sequence
  Synthetic
ccacccagtcatgcctatgcaggacatatatgagtccattcgatggactaaggatccaaggaacacacaggatca

SEQ ID NO: 293573 - DNA, 75 bp, Artificial Sequence
  Synthetic
atatatgagtccattcgatggactaaggatccaaggaacacacaggatcatgtcagatctttgtgtatgttagca

SEQ ID NO: 293574 - DNA, 75 bp, Artificial Sequence
  Synthetic
aacagacattggaaaatgtttgaatttacccgagtatagtgtccttaggagacgttggttggacatgttttaaat

SEQ ID NO: 293575 - DNA, 75 bp, Artificial Sequence
  Synthetic
ttacccgagtatagtgtccttaggagacgttggttggacatgttttaaatttaatcagatatatatagacattta

SEQ ID NO: 293576 - DNA, 75 bp, Artificial Sequence
  Synthetic
catccgacccactgggtgtagtactctggtattatgtacctttgtacgcctgttcttcccattgtacccttccca

SEQ ID NO: 293577 - DNA, 75 bp, Artificial Sequence
  Synthetic
gaggtataggctgtacccactgccaaaaacctttaaccgttacccgccagccaactacgtaaaagctagtaacat

SEQ ID NO: 293578 - DNA, 75 bp, Artificial Sequence
  Synthetic
gagcaattccgggacgggaccgactactttgggtgtccgtgtttctcatttttcttattattgtcttatggtcac

SEQ ID NO: 293579 - DNA, 75 bp, Artificial Sequence
  Synthetic
actttgggtgtccgtgtttctcatttttcttattattgtcttatggtcacagcatatttgttaaatatactgtga

SEQ ID NO: 293580 - DNA, 75 bp, Artificial Sequence
  Synthetic
aacatcttaactaatggctcaaatcagacgttcacagttataaattattataaagatgcagctagctcatcatca

SEQ ID NO: 293581 - DNA, 75 bp, Artificial Sequence
  Synthetic
agacgttcacagttataaattattataaagatgcagctagctcatcatcagcaggtcagtctttctcaacggacc

SEQ ID NO: 293582 - DNA, 75 bp, Artificial Sequence
  Synthetic
gcattgaactcaccaaatgttgaagcatgtggttatagtgacagagtccaacaaattactctaggtaattccact

SEQ ID NO: 293583 - DNA, 75 bp, Artificial Sequence
  Synthetic
catgtggttatagtgacagagtccaacaaattactctaggtaattccactataacaacccaggaagcagccaatg

SEQ ID NO: 293584 - DNA, 75 bp, Artificial Sequence
  Synthetic
agtgatgttaataagacttccaaaccagacacatctgtatgtagattctacacattggagagtaaaacatggcaa

SEQ ID NO: 293585 - DNA, 75 bp, Artificial Sequence
  Synthetic
cagacacatctgtatgtagattctacacattggagagtaaaacatggcaaaacagctcaaagggatggtgttgga

SEQ ID NO: 293586 - DNA, 75 bp, Artificial Sequence
  Synthetic
ttccactcgcttggtagatctggctatactatacatgtgcaatgtaatgcaactaaattccatagtggctgtctt

SEQ ID NO: 293587 - DNA, 75 bp, Artificial Sequence
  Synthetic
atactatacatgtgcaatgtaatgcaactaaattccatagtggctgtcttcttgttgttgttatcccagaacacc

SEQ ID NO: 293588 - DNA, 75 bp, Artificial Sequence
  Synthetic
catccaggagagagtggtatagacttgagtacacagttagatgaggatggtccagtgaaagatcctgtctatagc

SEQ ID NO: 293589 - DNA, 75 bp, Artificial Sequence
  Synthetic
tgagtacacagttagatgaggatggtccagtgaaagatcctgtctatagcatgaatggcactctattaggtaact

SEQ ID NO: 293590 - DNA, 75 bp, Artificial Sequence
  Synthetic
acaatagttgtgccatatattaattcagtgccaatagactcaatgacacgccataataacgtgtcactcttagtg

SEQ ID NO: 293591 - DNA, 75 bp, Artificial Sequence
  Synthetic
cagtgccaatagactcaatgacacgccataataacgtgtcactcttagtgattcccatagcacctctagtggctc

SEQ ID NO: 293592 - DNA, 75 bp, Artificial Sequence
  Synthetic
tgtacagagttcacgggtattagatcaaaaaccattgttccacaggggttaccaaccacaactttaccaggttca

SEQ ID NO: 293593 - DNA, 75 bp, Artificial Sequence
  Synthetic
caaaaaccattgttccacaggggttaccaaccacaactttaccaggttcaggacaatttctcactactgatgaca

SEQ ID NO: 293594 - DNA, 75 bp, Artificial Sequence
  Synthetic
attccgggtaaggttaggaatttactagaaattatacaggtagacacattaattccaatgaacaacgtgcatact

SEQ ID NO: 293595 - DNA, 75 bp, Artificial Sequence
  Synthetic
tagaaattatacaggtagacacattaattccaatgaacaacgtgcatactagtgatgaggtaaacagttatctta

SEQ ID NO: 293596 - DNA, 75 bp, Artificial Sequence
  Synthetic
ttcattggtgatggtgtgttcaaaactactttacttggtgagattgcacagtactacacacactggtctggctcc

SEQ ID NO: 293597 - DNA, 75 bp, Artificial Sequence
  Synthetic
ctactttacttggtgagattgcacagtactacacacactggtctggctcccttagaatctctctaatgtacactg

SEQ ID NO: 293598 - DNA, 75 bp, Artificial Sequence
  Synthetic
gcacaaggaccaactaacagaagggatgcaatgcttggaacacatgttgtctgggatattggattacaatccact

SEQ ID NO: 293599 - DNA, 75 bp, Artificial Sequence
  Synthetic
atgcaatgcttggaacacatgttgtctgggatattggattacaatccactattgttatgaccataccatggacat

SEQ ID NO: 293600 - DNA, 75 bp, Artificial Sequence
  Synthetic
tatttatcttgttggtatcaaacatcacttatactaccacctaacaccaccggacaagtccacttactgtctttc

SEQ ID NO: 293601 - DNA, 75 bp, Artificial Sequence
  Synthetic
cacttatactaccacctaacaccaccggacaagtccacttactgtctttcatcagcgcatgtccagattttaaat

SEQ ID NO: 293602 - DNA, 75 bp, Artificial Sequence
  Synthetic
gaaggattgggtgatgaattagaagaagttattgtcgagaaaacgaaacagacactagcttcagtatcatcagga

SEQ ID NO: 293603 - DNA, 75 bp, Artificial Sequence
  Synthetic
aagttattgtcgagaaaacgaaacagacactagcttcagtatcatcaggaccaaaacacacccagagtgtcccca

SEQ ID NO: 293604 - DNA, 75 bp, Artificial Sequence
  Synthetic
aatgtggaaaccagaacaacatacatgcattttaatggatctgaaacagatgttgaaagcttcttaggacgtgca

SEQ ID NO: 293605 - DNA, 75 bp, Artificial Sequence
  Synthetic
tgcattttaatggatctgaaacagatgttgaaagcttcttaggacgtgcagcttgtgtgcacataactgaaatag

SEQ ID NO: 293606 - DNA, 75 bp, Artificial Sequence
  Synthetic
aatgattggaagattaatttttccagtctagttcaacttaggaagaaactagaacttttcacatatatcaggttt

SEQ ID NO: 293607 - DNA, 75 bp, Artificial Sequence
  Synthetic
gtctagttcaacttaggaagaaactagaacttttcacatatatcaggtttgattctgaatacactatcttggcca

SEQ ID NO: 293608 - DNA, 75 bp, Artificial Sequence
  Synthetic
atgtatgtacctcctggagcaccaaacccagaaaaatgggatgattttacatggcagagtgcttctaatccaagt

SEQ ID NO: 293609 - DNA, 75 bp, Artificial Sequence
  Synthetic
acccagaaaaatgggatgattttacatggcagagtgcttctaatccaagtgtgtttttcaaagtaggtgacacat

SEQ ID NO: 293610 - DNA, 75 bp, Artificial Sequence
  Synthetic
tatgatggttactcacatgataacaaggacacaccatatggaataacagttcttaatcatatgggtagcatagcc

SEQ ID NO: 293611 - DNA, 75 bp, Artificial Sequence
  Synthetic
aggacacaccatatggaataacagttcttaatcatatgggtagcatagcctttagagtagttaatgagcatgatg

SEQ ID NO: 293612 - DNA, 75 bp, Artificial Sequence
  Synthetic
gaggcttggatacccagagctcctagagcgctaccatatgagacaataggacgcacaaattaccccaagaaaaat

SEQ ID NO: 293613 - DNA, 75 bp, Artificial Sequence
  Synthetic
gagcgctaccatatgagacaataggacgcacaaattaccccaagaaaaataaaattgttccagtaattaagaaga

SEQ ID NO: 293614 - DNA, 75 bp, Artificial Sequence
  Synthetic
acaagcaatgttaaaatcatgaattaccacttgatgaccccagaagaccatttgaatttaattacaccttatgtt

SEQ ID NO: 293615 - DNA, 75 bp, Artificial Sequence
  Synthetic
accacttgatgaccccagaagaccatttgaatttaattacaccttatgttaatagagacttggcagttgtgttta

SEQ ID NO: 293616 - DNA, 75 bp, Artificial Sequence
  Synthetic
gtatactattcaagatactatagaaaattctacccagtgatatgtgaaaagcccactactatatggatagaaggt

SEQ ID NO: 293617 - DNA, 75 bp, Artificial Sequence
  Synthetic
aattctacccagtgatatgtgaaaagcccactactatatggatagaaggtagttcttactatccaagtagatacc

SEQ ID NO: 293618 - DNA, 75 bp, Artificial Sequence
  Synthetic
ggtattttaagatgtgtgcatggcccaataggtttgttaacagcaggagggagtgggtatgtctgttttgcagat

SEQ ID NO: 293619 - DNA, 75 bp, Artificial Sequence
  Synthetic
caataggtttgttaacagcaggagggagtgggtatgtctgttttgcagatattagacaattagattgcattgcag

SEQ ID NO: 293620 - DNA, 75 bp, Artificial Sequence
  Synthetic
gttggcttcactgatcagatatcagcaaaggtaacagaactgcaggatgtagctaaagattttctaactactaaa

SEQ ID NO: 293621 - DNA, 75 bp, Artificial Sequence
  Synthetic
caaaggtaacagaactgcaggatgtagctaaagattttctaactactaaagtgctgtccaaagtagttaagatga

SEQ ID NO: 293622 - DNA, 75 bp, Artificial Sequence
  Synthetic
acggcaacactagcactcttaggctgtgatggttccccatggagatttctaaaaatgtacatatctaaacatttc

SEQ ID NO: 293623 - DNA, 75 bp, Artificial Sequence
  Synthetic
gtgatggttccccatggagatttctaaaaatgtacatatctaaacatttccaggtaccatacattgaaaggcaag

SEQ ID NO: 293624 - DNA, 75 bp, Artificial Sequence
  Synthetic
ggtctagaatggattgccaacaagatctcaaaattaattgggtggatcaaaaacaaagttctgccacaagcaaaa

SEQ ID NO: 293625 - DNA, 75 bp, Artificial Sequence
  Synthetic
tctcaaaattaattgggtggatcaaaaacaaagttctgccacaagcaaaagagaaacttgagtattgcagcaaat

SEQ ID NO: 293626 - DNA, 75 bp, Artificial Sequence
  Synthetic
aacccctctcaggaaaagagagaacagttgttcaacaatgtgttgtggttggaacaaatgtcacaaaagtttgcc

SEQ ID NO: 293627 - DNA, 75 bp, Artificial Sequence
  Synthetic
agttgttcaacaatgtgttgtggttggaacaaatgtcacaaaagtttgccccattgtatgcagctgagtcaaaga

SEQ ID NO: 293628 - DNA, 75 bp, Artificial Sequence
  Synthetic
aagcagagaactgaaccagtttgtgtgctaatacacggtacacccggttctgggaagtccctaacaacttcaatc

SEQ ID NO: 293629 - DNA, 75 bp, Artificial Sequence
  Synthetic
tgctaatacacggtacacccggttctgggaagtccctaacaacttcaatcgtaggtcgtgcactagcagagcatt

SEQ ID NO: 293630 - DNA, 75 bp, Artificial Sequence
  Synthetic
taccaacaacaggaagttgtcataatggacgacttgaaccaaaatccagatggtcaggatatcagtatgttttgt

SEQ ID NO: 293631 - DNA, 75 bp, Artificial Sequence
  Synthetic
tggacgacttgaaccaaaatccagatggtcaggatatcagtatgttttgtcaaatggtttcaacagttgatttca

SEQ ID NO: 293632 - DNA, 75 bp, Artificial Sequence
  Synthetic
tttgtcctggcctcaacaaattctaacaccttgagtcccccaacaatccttaacccagaggcactagctagaaga

SEQ ID NO: 293633 - DNA, 75 bp, Artificial Sequence
  Synthetic
acaccttgagtcccccaacaatccttaacccagaggcactagctagaagatttggatttgatttagatatctgtt

SEQ ID NO: 293634 - DNA, 75 bp, Artificial Sequence
  Synthetic
agtttgtgcaaagattgccatcagccggcaaacttcaaaaagtgctgtccactggtttgtggcaaggcaatcagt

SEQ ID NO: 293635 - DNA, 75 bp, Artificial Sequence
  Synthetic
cggcaaacttcaaaaagtgctgtccactggtttgtggcaaggcaatcagtttagtagacagaaccaccaacatta

SEQ ID NO: 293636 - DNA, 75 bp, Artificial Sequence
  Synthetic
aaaatgaaaataacagattcactagaagtgttgtttcagggtccagtatataaagacttagaaatagatgtttgc

SEQ ID NO: 293637 - DNA, 75 bp, Artificial Sequence
  Synthetic
aagtgttgtttcagggtccagtatataaagacttagaaatagatgtttgcaatacaccacctccagaatgcataa

SEQ ID NO: 293638 - DNA, 75 bp, Artificial Sequence
  Synthetic
aagaagaagtggatcataccacagataccaactaacatagaaagggccatgaatcaagctagtatgattatcaac

SEQ ID NO: 293639 - DNA, 75 bp, Artificial Sequence
  Synthetic
taccaactaacatagaaagggccatgaatcaagctagtatgattatcaacacaatattgatgtttgttagtacat

SEQ ID NO: 293640 - DNA, 75 bp, Artificial Sequence
  Synthetic
tactcaggtaatccatctcacaacaaactaaaacctcccagcttacgaccagttgtggtacagggtcctaacact

SEQ ID NO: 293641 - DNA, 75 bp, Artificial Sequence
  Synthetic
aactaaaacctcccagcttacgaccagttgtggtacagggtcctaacactgagtttgcactgtccctgttgagaa

SEQ ID NO: 293642 - DNA, 75 bp, Artificial Sequence
  Synthetic
atctatgaccgtgtgtgtgtcataccaactcacgcacaaccagataacaaagttttagttaatggtcaagctgtc

SEQ ID NO: 293643 - DNA, 75 bp, Artificial Sequence
  Synthetic
caactcacgcacaaccagataacaaagttttagttaatggtcaagctgtccaaataaaagacaaatacaaattgg

SEQ ID NO: 293644 - DNA, 75 bp, Artificial Sequence
  Synthetic
aatgaaaaattcagggacattaggagttttatatcagaagacatggagggtatggaagccaccctagtagtccac

SEQ ID NO: 293645 - DNA, 75 bp, Artificial Sequence
  Synthetic
gttttatatcagaagacatggagggtatggaagccaccctagtagtccactccaataattttaccaacaccatac

SEQ ID NO: 293646 - DNA, 75 bp, Artificial Sequence
  Synthetic
cctacaagtagaatgattcgatatgattatccaacaaagaccggccaatgtggaggcgtgttgtgcacaactggt

SEQ ID NO: 293647 - DNA, 75 bp, Artificial Sequence
  Synthetic
attatccaacaaagaccggccaatgtggaggcgtgttgtgcacaactggtaaaatctttggtatccatgttggag

SEQ ID NO: 293648 - DNA, 75 bp, Artificial Sequence
  Synthetic
gaaaaacaaggacaaataatctccagacaaaaggttagggaattaaacatggcatcaattaatacaccaactaaa

SEQ ID NO: 293649 - DNA, 75 bp, Artificial Sequence
  Synthetic
gacaaaaggttagggaattaaacatggcatcaattaatacaccaactaaaagtaagttgcaccccagtgtttttt

SEQ ID NO: 293650 - DNA, 75 bp, Artificial Sequence
  Synthetic
cctaggcttgaagttaaactttcagattctctattctcaaagtacaaaggcaatattgaaatgaagcctacagaa

SEQ ID NO: 293651 - DNA, 75 bp, Artificial Sequence
  Synthetic
attctctattctcaaagtacaaaggcaatattgaaatgaagcctacagaaaatatgctgatagcagtggaccact

SEQ ID NO: 293652 - DNA, 75 bp, Artificial Sequence
  Synthetic
aaagaagccctctatggagtagatgggttagagcccatagatataacaaccagtgcaggttatccctatgttagt

SEQ ID NO: 293653 - DNA, 75 bp, Artificial Sequence
  Synthetic
ggttagagcccatagatataacaaccagtgcaggttatccctatgttagtttaggcatcaaaaagagggacattc

SEQ ID NO: 293654 - DNA, 75 bp, Artificial Sequence
  Synthetic
tacggaatagacttacccttggttacctacataaaagatgagttgagaagcactgataaagtgcgtttgggcaaa

SEQ ID NO: 293655 - DNA, 75 bp, Artificial Sequence
  Synthetic
cctacataaaagatgagttgagaagcactgataaagtgcgtttgggcaaaagcagacttattgaggcttcaagcc

SEQ ID NO: 293656 - DNA, 75 bp, Artificial Sequence
  Synthetic
tttcatcagaacccggggataataactggctcagcagtggggtgtgatccagatgttttttggtccataattcct

SEQ ID NO: 293657 - DNA, 75 bp, Artificial Sequence
  Synthetic
ctggctcagcagtggggtgtgatccagatgttttttggtccataattccttgtcttatggatgggcacttaatgg

SEQ ID NO: 293658 - DNA, 75 bp, Artificial Sequence
  Synthetic
tgcctagagagggttttggctaagttgggtttcaaacactcttccttgattcaaacaatttgtcatactcaccat

SEQ ID NO: 293659 - DNA, 75 bp, Artificial Sequence
  Synthetic
tgggtttcaaacactcttccttgattcaaacaatttgtcatactcaccatatatccaaagatgaaatttacattg

SEQ ID NO: 293660 - DNA, 75 bp, Artificial Sequence
  Synthetic
atgattaacaatataattattagaactttagttttggatgcttacaaaggaatagatctggataaactcaaaatt

SEQ ID NO: 293661 - DNA, 75 bp, Artificial Sequence
  Synthetic
ctttagttttggatgcttacaaaggaatagatctggataaactcaaaattttagcatatggggatgatctaatag

SEQ ID NO: 293662 - DNA, 75 bp, Artificial Sequence
  Synthetic
aagtacggattaacaataacccctcctgacaaaacagaaaaattttcaaaaataacatgggataacttaacattt

SEQ ID NO: 293663 - DNA, 75 bp, Artificial Sequence
  Synthetic
ctgacaaaacagaaaaattttcaaaaataacatgggataacttaacatttctaaagagatattttagatctgatg

SEQ ID NO: 293664 - DNA, 75 bp, Artificial Sequence
  Synthetic
gaatcaattagatggactaaagatccaagaaatacacaggatcacgttagatctctgtgtatgttagcatggcat

SEQ ID NO: 293665 - DNA, 75 bp, Artificial Sequence
  Synthetic
cattggcaaatgtctaaatttacctgaatacagtgttcttaggagacgctggctggacttgttttaaattacaca

SEQ ID NO: 293666 - DNA, 75 bp, Artificial Sequence
  Synthetic
gaatacagtgttcttaggagacgctggctggacttgttttaaattacacatatatatagacctctagtttagatt

SEQ ID NO: 293667 - DNA, 75 bp, Artificial Sequence
  Synthetic
ttaaaacagcggatgggtatcccaccatccgacccactgggtgtagtactctggtattatgtacctttgtacgcc

SEQ ID NO: 293668 - DNA, 75 bp, Artificial Sequence
  Synthetic
catccgacccactgggtgtagtactctggtattatgtacctttgtacgcctgtttctccctccctaccaccccgc

SEQ ID NO: 293669 - DNA, 75 bp, Artificial Sequence
  Synthetic
agcacttctgtttccccggagcggagtatagacggccaccgctgtcaaaagctcttaaccgttacccgccagtta

SEQ ID NO: 293670 - DNA, 75 bp, Artificial Sequence
  Synthetic
gagtggctcgcatgaaaaccaaaatattcttacaaatggttctacacaaaacttcactgtcattaattattacaa

SEQ ID NO: 293671 - DNA, 75 bp, Artificial Sequence
  Synthetic
ttgtggcatatgctgaatggcccagctatttgtcagattctgatgcaagtgatgtcaataaaacctcgcaacccg

SEQ ID NO: 293672 - DNA, 75 bp, Artificial Sequence
  Synthetic
ctatttgtcagattctgatgcaagtgatgtcaataaaacctcgcaacccgacacttctgtttgcaggttttatac

SEQ ID NO: 293673 - DNA, 75 bp, Artificial Sequence
  Synthetic
ttccagatgcacttaaagatatgggagtgtttggacaaaacatgtttttccacgcactagggagaacaggttaca

SEQ ID NO: 293674 - DNA, 75 bp, Artificial Sequence
  Synthetic
ctgtgcatgttcaatgtaatgcaaccaaattccacagtggctgtctactggtggtagctattccagaacaccaac

SEQ ID NO: 293675 - DNA, 75 bp, Artificial Sequence
  Synthetic
atgacacaccagaagcagggggggcgtcacacgatccagtgtactccatgaacggaaccttagcgggtaatcttc

SEQ ID NO: 293676 - DNA, 75 bp, Artificial Sequence
  Synthetic
cttatcttaccctatataaattcagtgcccatggattccatgactagacacaacaatatatctttgttagtcatc

SEQ ID NO: 293677 - DNA, 75 bp, Artificial Sequence
  Synthetic
caggaatgaccactacaattccagttacagtgactattgcccctatgtacactgaattctcaggcattaggtcaa

SEQ ID NO: 293678 - DNA, 75 bp, Artificial Sequence
  Synthetic
aatcacctagtgcaatgccaaattatgaaccaaccccacaaatccacataccaggagaagtccacaatctgctag

SEQ ID NO: 293679 - DNA, 75 bp, Artificial Sequence
  Synthetic
gacaccatgagtgagtatcgagttccacttactgcaggcagagtgaatgaacaaatattcggtactagattatac

SEQ ID NO: 293680 - DNA, 75 bp, Artificial Sequence
  Synthetic
cacttactgcaggcagagtgaatgaacaaatattcggtactagattatacataggagatggtgtcttcaaaacca

SEQ ID NO: 293681 - DNA, 75 bp, Artificial Sequence
  Synthetic
cgaatctccctaatgtatacaggtcctgcactatccagtgctaaattgatcttagcgtacaccccaccaggagct

SEQ ID NO: 293682 - DNA, 75 bp, Artificial Sequence
  Synthetic
ctgcactatccagtgctaaattgatcttagcgtacaccccaccaggagctgggggccccaaaaatagaaaagaag

SEQ ID NO: 293683 - DNA, 75 bp, Artificial Sequence
  Synthetic
gtcatgaacataccatggacaagtggtgtgcaattcagatatacagatcctgacacatacacaagtgccgggttt

SEQ ID NO: 293684 - DNA, 75 bp, Artificial Sequence
  Synthetic
gtgtgcaattcagatatacagatcctgacacatacacaagtgccgggtttctctcatgctggtatcaaacatcct

SEQ ID NO: 293685 - DNA, 75 bp, Artificial Sequence
  Synthetic
atcacagacagaagcactcacagaaggttttggggaagaactagaggaagttgttgtcgacaaaatgagacagat

SEQ ID NO: 293686 - DNA, 75 bp, Artificial Sequence
  Synthetic
attgcccacaaatccatctgataatgttgaaacaagaaccacatacatgcatttcaacggctcagaaactacact

SEQ ID NO: 293687 - DNA, 75 bp, Artificial Sequence
  Synthetic
ataaagtgccccaagatcccacactagaaggaggaaaaacccacaaagaacaaaaactgttcaatgactggaaaa

SEQ ID NO: 293688 - DNA, 75 bp, Artificial Sequence
  Synthetic
agaaggaggaaaaacccacaaagaacaaaaactgttcaatgactggaaaataagcttgtccagtctagtacaact

SEQ ID NO: 293689 - DNA, 75 bp, Artificial Sequence
  Synthetic
ccatactagctactgcttctcaacctgaaactgctcaatatgctagcaatctgacagtgcaggcaatgtatgttc

SEQ ID NO: 293690 - DNA, 75 bp, Artificial Sequence
  Synthetic
tgaaactgctcaatatgctagcaatctgacagtgcaggcaatgtatgttccaccaggtgcaccaaaccctgttga

SEQ ID NO: 293691 - DNA, 75 bp, Artificial Sequence
  Synthetic
aagttggcaaaacagctaggttcagtgtaccatttattggtatcgcttcagcttacaactgcttctatgatggct

SEQ ID NO: 293692 - DNA, 75 bp, Artificial Sequence
  Synthetic
tgtaccatttattggtatcgcttcagcttacaactgcttctatgatggctactcacatgatgacccagaaacaca

SEQ ID NO: 293693 - DNA, 75 bp, Artificial Sequence
  Synthetic
taaatgatcatgaccttcacaagacattagtgaagataagggtgtttcacagagctaagcatattagagcttggg

SEQ ID NO: 293694 - DNA, 75 bp, Artificial Sequence
  Synthetic
attagtgaagataagggtgtttcacagagctaagcatattagagcttgggtaccaagaccacccagggcactacc

SEQ ID NO: 293695 - DNA, 75 bp, Artificial Sequence
  Synthetic
ttgccaaaagagacaagatcatcacctatggtggtagtcccagatttggagctatttacacatgtaattataaga

SEQ ID NO: 293696 - DNA, 75 bp, Artificial Sequence
  Synthetic
ctatggtggtagtcccagatttggagctatttacacatgtaattataagataatgaactaccatttgatgactcc

SEQ ID NO: 293697 - DNA, 75 bp, Artificial Sequence
  Synthetic
ttgttgcaactggggctcagggctcagagatcattccacattgtaattgtacttcaggtgtttattactctcagt

SEQ ID NO: 293698 - DNA, 75 bp, Artificial Sequence
  Synthetic
agagatcattccacattgtaattgtacttcaggtgtttattactctcagtactacagaaaatactatcccataat

SEQ ID NO: 293699 - DNA, 75 bp, Artificial Sequence
  Synthetic
gtagatttcaatcaggagtgatgaagggtgtcggaccagctgaacctggggactgtggtggcattttaagatgca

SEQ ID NO: 293700 - DNA, 75 bp, Artificial Sequence
  Synthetic
tttgcagatattagacaattggacttcattgcagaaacacagggcattactgactacataacaaacctgggaaag

SEQ ID NO: 293701 - DNA, 75 bp, Artificial Sequence
  Synthetic
tcattgcagaaacacagggcattactgactacataacaaacctgggaaaggcatttggtgtaggtttcacagatc

SEQ ID NO: 293702 - DNA, 75 bp, Artificial Sequence
  Synthetic
tactagggtgtgatggatcaccctggagatttctcaaaatgtacatatcaaagcactttcaagtaccctatatag

SEQ ID NO: 293703 - DNA, 75 bp, Artificial Sequence
  Synthetic
caaacaaaatttccaagcttatagaatgggtaaagacaaagataattcctcaagcaaaagaaaaattagatttct

SEQ ID NO: 293704 - DNA, 75 bp, Artificial Sequence
  Synthetic
catgtttctaatccaacacaggaaaaaagagagcagctttttaacaatgttttatggttagaacaaatgtctcag

SEQ ID NO: 293705 - DNA, 75 bp, Artificial Sequence
  Synthetic
aaagagagcagctttttaacaatgttttatggttagaacaaatgtctcagaaatttgctccactgtatgcagtgg

SEQ ID NO: 293706 - DNA, 75 bp, Artificial Sequence
  Synthetic
ttcaagtccaaacagagaaccgaaccagtctgtgttttgattcatggttcacctggatcaggcaagtcactaacc

SEQ ID NO: 293707 - DNA, 75 bp, Artificial Sequence
  Synthetic
cagtctgtgttttgattcatggttcacctggatcaggcaagtcactaaccacatccattattggtagggctgtag

SEQ ID NO: 293708 - DNA, 75 bp, Artificial Sequence
  Synthetic
tttgatggctatcaacagcaggaggtggtaatcatggatgatttaaatcaaaatccagatggtcaggatatcagt

SEQ ID NO: 293709 - DNA, 75 bp, Artificial Sequence
  Synthetic
tggtaatcatggatgatttaaatcaaaatccagatggtcaggatatcagtatgttctgtcagatggtttcatcag

SEQ ID NO: 293710 - DNA, 75 bp, Artificial Sequence
  Synthetic
actagcaattttgttcttgcatcaaccaactcaaacacactgagccccccaacaatcttaaacccagaagcactg

SEQ ID NO: 293711 - DNA, 75 bp, Artificial Sequence
  Synthetic
ccaactcaaacacactgagccccccaacaatcttaaacccagaagcactggccaggaggtttggatttgatctgg

SEQ ID NO: 293712 - DNA, 75 bp, Artificial Sequence
  Synthetic
atggcaactgaactttgcaaggactgtcacaaacccagcaacttcagcaaatgttgtccattgatatgtggaaaa

SEQ ID NO: 293713 - DNA, 75 bp, Artificial Sequence
  Synthetic
gtcacaaacccagcaacttcagcaaatgttgtccattgatatgtggaaaagctattagtcttgtagaccggtcta

SEQ ID NO: 293714 - DNA, 75 bp, Artificial Sequence
  Synthetic
tataacaataaactaaaaatcactgactccttggaggttctgtttcaaggacctgtttacaaagacctggaaata

SEQ ID NO: 293715 - DNA, 75 bp, Artificial Sequence
  Synthetic
agttgattctgaagagcttagggaatactgcaaacagaaaaattggcttatcccagaaattccaacaaatataga

SEQ ID NO: 293716 - DNA, 75 bp, Artificial Sequence
  Synthetic
tactgcaaacagaaaaattggcttatcccagaaattccaacaaatatagagagagcagtaaaccaggctagcact

SEQ ID NO: 293717 - DNA, 75 bp, Artificial Sequence
  Synthetic
caaggtccgtattcaggtaacccctcacacacaaaactaaagccaccaacactacgacaagtagtagtgcaaggt

SEQ ID NO: 293718 - DNA, 75 bp, Artificial Sequence
  Synthetic
tactaccactaagggagagtttacagcattggggatccatgatagggtctgtgtggtacccacgcactcccagcc

SEQ ID NO: 293719 - DNA, 75 bp, Artificial Sequence
  Synthetic
gcattggggatccatgatagggtctgtgtggtacccacgcactcccagcctgatgatgaagtgttagttaatggg

SEQ ID NO: 293720 - DNA, 75 bp, Artificial Sequence
  Synthetic
aaacctagaattaactataatagttttggatagaaatgaaaaatttagggacataagagcattcatagcagaaga

SEQ ID NO: 293721 - DNA, 75 bp, Artificial Sequence
  Synthetic
gtaataaattccaacaattttaaagacaccattctagaagtgggccagttgacgtttgctggtctaataaacttg

SEQ ID NO: 293722 - DNA, 75 bp, Artificial Sequence
  Synthetic
tcaccactaggaaaaatgtcagggaaatgggactaaaacctatcaacacccccactaaaacaaagcttcacccca

SEQ ID NO: 293723 - DNA, 75 bp, Artificial Sequence
  Synthetic
gatacagaccccaggttagaggttaacctgcgtgattccctgttttcaaaatacaagggaaatgttgaaactgat

SEQ ID NO: 293724 - DNA, 75 bp, Artificial Sequence
  Synthetic
acctgcgtgattccctgttttcaaaatacaagggaaatgttgaaactgatatcacggagaacatgcaggtggcca

SEQ ID NO: 293725 - DNA, 75 bp, Artificial Sequence
  Synthetic
ttgtcactcaaggaagctttatatggtacagatggattagaaccaattgacataaacaccagtgctggttacccg

SEQ ID NO: 293726 - DNA, 75 bp, Artificial Sequence
  Synthetic
gtacagatggattagaaccaattgacataaacaccagtgctggttacccgtatgtgagtttagggataaaaaaga

SEQ ID NO: 293727 - DNA, 75 bp, Artificial Sequence
  Synthetic
ttagataaatatggcatagatttaccacttgttacatacattaaggatgaactcagaggcaaggataaggttaga

SEQ ID NO: 293728 - DNA, 75 bp, Artificial Sequence
  Synthetic
cacttgttacatacattaaggatgaactcagaggcaaggataaggttagactaggtaaaagtagattgatagaag

SEQ ID NO: 293729 - DNA, 75 bp, Artificial Sequence
  Synthetic
tacaaagcttttcatttaaaccctggagtaataactggatcagctgtgggatgtgacccagacacattctggtct

SEQ ID NO: 293730 - DNA, 75 bp, Artificial Sequence
  Synthetic
gagtaataactggatcagctgtgggatgtgacccagacacattctggtctgtcataccgtgcctcatggatggac

SEQ ID NO: 293731 - DNA, 75 bp, Artificial Sequence
  Synthetic
tggttcaaatgccttgagcaggtgcttgctaaacttggatttaaacactctaatcttataaaaacaatttgcaac

SEQ ID NO: 293732 - DNA, 75 bp, Artificial Sequence
  Synthetic
ttgctaaacttggatttaaacactctaatcttataaaaacaatttgcaacactcatcacatcttcagagatgaaa

SEQ ID NO: 293733 - DNA, 75 bp, Artificial Sequence
  Synthetic
ttcaattcaatgataaacaatataattattaggacattaatattagatgtttataaaggtattgatcttgacaag

SEQ ID NO: 293734 - DNA, 75 bp, Artificial Sequence
  Synthetic
ttattaggacattaatattagatgtttataaaggtattgatcttgacaagttaaaagtgattgcttatggtgatg

SEQ ID NO: 293735 - DNA, 75 bp, Artificial Sequence
  Synthetic
gacctgacccacaatatccttttcttatacacccagtgatgccgatgcaagacattcatgaatccattcgttgga

SEQ ID NO: 293736 - DNA, 75 bp, Artificial Sequence
  Synthetic
ttaaaacagcggatgggtatcccaccatccgacccacagggtgtagtgctctggtattttgtacctttgcacgcc

SEQ ID NO: 293737 - DNA, 75 bp, Artificial Sequence
  Synthetic
ctggtattttgtacctttgcacgcctgtttccccattgtacccctccttaaatttcctccccaagtaacgttaga

SEQ ID NO: 293738 - DNA, 75 bp, Artificial Sequence
  Synthetic
tgtacaagcacttctgtttccccggagcgaggtataagtggtacccaccgccgaaagcctttaaccgttatccgc

SEQ ID NO: 293739 - DNA, 75 bp, Artificial Sequence
  Synthetic
agcgaggtataagtggtacccaccgccgaaagcctttaaccgttatccgccaatcaactacgtaatggctagtat

SEQ ID NO: 293740 - DNA, 75 bp, Artificial Sequence
  Synthetic
agcatatatagcatatatactgtgatcatgggcgcacaagtgtcaacacagaagagcggttcacatgaaaaccaa

SEQ ID NO: 293741 - DNA, 75 bp, Artificial Sequence
  Synthetic
caaagatgcagccagttcatcatcagctggccaatcgttctcaatggacccgtcaaaatttactgaaccggtcaa

SEQ ID NO: 293742 - DNA, 75 bp, Artificial Sequence
  Synthetic
gctggccaatcgttctcaatggacccgtcaaaatttactgaaccggtcaaggacataatgcttaaaggtgcacca

SEQ ID NO: 293743 - DNA, 75 bp, Artificial Sequence
  Synthetic
acaaataaccattggcaattcaacaattacaacccaagaagcagctaatgcaatagtggcttatgctgaatggcc

SEQ ID NO: 293744 - DNA, 75 bp, Artificial Sequence
  Synthetic
cagctttttaaaagatgatgatgctagtgatgtgaataagcccactagacctgacacatctgcttgcagatttta

SEQ ID NO: 293745 - DNA, 75 bp, Artificial Sequence
  Synthetic
gggaatatttggacaaaacatgttttatcattctcaaggcagaactgggtataccatccatgtacaatgtaacgc

SEQ ID NO: 293746 - DNA, 75 bp, Artificial Sequence
  Synthetic
agttggcatcagcagagggtggtaatgtttcagttttctatgaccagacacatccaggagagagaggaattgatt

SEQ ID NO: 293747 - DNA, 75 bp, Artificial Sequence
  Synthetic
tgtttcagttttctatgaccagacacatccaggagagagaggaattgatttgggaacagttattgaaaagggacc

SEQ ID NO: 293748 - DNA, 75 bp, Artificial Sequence
  Synthetic
ttatctttccccatcagttcatcaatctgagaaccaataatacggctacaatagtaaccccatacataaactcag

SEQ ID NO: 293749 - DNA, 75 bp, Artificial Sequence
  Synthetic
tctgagaaccaataatacggctacaatagtaaccccatacataaactcagtcccaatggattcaatgaccagaca

SEQ ID NO: 293750 - DNA, 75 bp, Artificial Sequence
  Synthetic
ctggatcaccacccagtatacctgttactgtgacaatagcaccaatgaatcttgaattatcagggattagatcca

SEQ ID NO: 293751 - DNA, 75 bp, Artificial Sequence
  Synthetic
tactgtgacaatagcaccaatgaatcttgaattatcagggattagatccaaaacagtggtgaaagaacagggcct

SEQ ID NO: 293752 - DNA, 75 bp, Artificial Sequence
  Synthetic
gacaatctccttcagctctaccaaattatgaaccaactccactcatacatatccctggcagggttaccaacttgc

SEQ ID NO: 293753 - DNA, 75 bp, Artificial Sequence
  Synthetic
ttatgaaccaactccactcatacatatccctggcagggttaccaacttgctagagttggtgcaggttgacacaat

SEQ ID NO: 293754 - DNA, 75 bp, Artificial Sequence
  Synthetic
taccattgatgcagaatcagcaagaacaacaagtctttggtttttccctatttttgggaggaggtgtcttaaaaa

SEQ ID NO: 293755 - DNA, 75 bp, Artificial Sequence
  Synthetic
acaacaagtctttggtttttccctatttttgggaggaggtgtcttaaaaacaacactactaggtgaaatagcaca

SEQ ID NO: 293756 - DNA, 75 bp, Artificial Sequence
  Synthetic
gtccagccttatctagtgcaaagctgttacttgcatacacaccaccaggagcaccaggacctacaaataggaaag

SEQ ID NO: 293757 - DNA, 75 bp, Artificial Sequence
  Synthetic
gttacttgcatacacaccaccaggagcaccaggacctacaaataggaaagatgcaatgttaggtactcatataat

SEQ ID NO: 293758 - DNA, 75 bp, Artificial Sequence
  Synthetic
ccgggtctcaatttagatatacagacccagacacttacacacacccaggctttatatcatgctggtatcaaacct

SEQ ID NO: 293759 - DNA, 75 bp, Artificial Sequence
  Synthetic
cccagacacttacacacacccaggctttatatcatgctggtatcaaacctcattagtactaccaccagatacaaa

SEQ ID NO: 293760 - DNA, 75 bp, Artificial Sequence
  Synthetic
ttagattgctgaaggacacatcatcaatttcacagactgaggcactaacagaagggttgggagaagaacttgagg

SEQ ID NO: 293761 - DNA, 75 bp, Artificial Sequence
  Synthetic
aatttcacagactgaggcactaacagaagggttgggagaagaacttgaggaagtgatagtcgacaaagcgaaaca

SEQ ID NO: 293762 - DNA, 75 bp, Artificial Sequence
  Synthetic
cactatcagcaagtgagacagggacaactcttcctacagttccatctgacaatattgagactagaaccacttaca

SEQ ID NO: 293763 - DNA, 75 bp, Artificial Sequence
  Synthetic
aactcttcctacagttccatctgacaatattgagactagaaccacttacatgcattatgatggtacagaaacaag

SEQ ID NO: 293764 - DNA, 75 bp, Artificial Sequence
  Synthetic
aaaacaaacttcccacaacaggccaaactcacaaagaacaaaaattatacaatgattggaaaataaacctgtcga

SEQ ID NO: 293765 - DNA, 75 bp, Artificial Sequence
  Synthetic
aactcacaaagaacaaaaattatacaatgattggaaaataaacctgtcgagcctagtgcagttgagaagaaagct

SEQ ID NO: 293766 - DNA, 75 bp, Artificial Sequence
  Synthetic
catcctcgcaaccgcaggcagcacgattttcaaacacactgacagtgcaagcaatgtttatacctccaggagcac

SEQ ID NO: 293767 - DNA, 75 bp, Artificial Sequence
  Synthetic
attttcaaacacactgacagtgcaagcaatgtttatacctccaggagcaccaaacccagtagaatgggatgatta

SEQ ID NO: 293768 - DNA, 75 bp, Artificial Sequence
  Synthetic
cagcacgttttagtgtcccctatctaggtattgcctcagcctataataatttctatgatggctattcacatgata

SEQ ID NO: 293769 - DNA, 75 bp, Artificial Sequence
  Synthetic
aggtattgcctcagcctataataatttctatgatggctattcacatgatagtaagaccactgtttatggcataaa

SEQ ID NO: 293770 - DNA, 75 bp, Artificial Sequence
  Synthetic
atgttcacctcaccaaggttaaaatcagagtttaccaccgtgctaagcacgtcttggcatggattcccagacccc

SEQ ID NO: 293771 - DNA, 75 bp, Artificial Sequence
  Synthetic
cagagtttaccaccgtgctaagcacgtcttggcatggattcccagaccccccagagcaaaaccatatctttcaat

SEQ ID NO: 293772 - DNA, 75 bp, Artificial Sequence
  Synthetic
atatctcaacttatggacttggtccaagatttggtggtgtatgcacagggaatataaaaataatgaactatcatt

SEQ ID NO: 293773 - DNA, 75 bp, Artificial Sequence
  Synthetic
aagatttggtggtgtatgcacagggaatataaaaataatgaactatcatttaatgactcatgaggatacattaaa

SEQ ID NO: 293774 - DNA, 75 bp, Artificial Sequence
  Synthetic
ctcatggttcagaaactgtccctcaatgcagctgtacaggtggtgtttactactccagatactataacaaatatt

SEQ ID NO: 293775 - DNA, 75 bp, Artificial Sequence
  Synthetic
atgcagctgtacaggtggtgtttactactccagatactataacaaatattacccagtggtttgtgagaaaccaac

SEQ ID NO: 293776 - DNA, 75 bp, Artificial Sequence
  Synthetic
gagtcatgaaaggagtgggaccagctgagccaggggattgtggtggcatactcaggtgtatacatggaccaattg

SEQ ID NO: 293777 - DNA, 75 bp, Artificial Sequence
  Synthetic
tgagccaggggattgtggtggcatactcaggtgtatacatggaccaattggtattttaacagctgggggtggtgg

SEQ ID NO: 293778 - DNA, 75 bp, Artificial Sequence
  Synthetic
accagggaatatcagattacatactaaacttgggaaaggcatttggcactggtttcacagatcacattagtgaga

SEQ ID NO: 293779 - DNA, 75 bp, Artificial Sequence
  Synthetic
aaacttgggaaaggcatttggcactggtttcacagatcacattagtgagaaggttagtgaacttcaaaacattac

SEQ ID NO: 293780 - DNA, 75 bp, Artificial Sequence
  Synthetic
ctgccttagtgattatatgtagaaatcatgaagacttggttacagttactgcaactttagcactactagggtgtg

SEQ ID NO: 293781 - DNA, 75 bp, Artificial Sequence
  Synthetic
tcatgaagacttggttacagttactgcaactttagcactactagggtgtgatggctcaccttggagattcctgaa

SEQ ID NO: 293782 - DNA, 75 bp, Artificial Sequence
  Synthetic
atgacttatggtttaagaaattcaatgacatgtgcaatgcagctaagggattagaatggatagcaaacaagatat

SEQ ID NO: 293783 - DNA, 75 bp, Artificial Sequence
  Synthetic
tgacatgtgcaatgcagctaagggattagaatggatagcaaacaagatatcaaaattaatagattggataaagaa

SEQ ID NO: 293784 - DNA, 75 bp, Artificial Sequence
  Synthetic
aacagttagatattttagaaaggcagattgataccttacacatgaattacactaacgaaaatgatagggaaacat

SEQ ID NO: 293785 - DNA, 75 bp, Artificial Sequence
  Synthetic
gattgataccttacacatgaattacactaacgaaaatgatagggaaacattattcaacaatgtattatggttgga

SEQ ID NO: 293786 - DNA, 75 bp, Artificial Sequence
  Synthetic
ttaaatcattgaagaacaaattaaccaattttatacagtttcgttcaaaacataggacggaaccagtatgtgtgt

SEQ ID NO: 293787 - DNA, 75 bp, Artificial Sequence
  Synthetic
caattttatacagtttcgttcaaaacataggacggaaccagtatgtgtgttgattcatggcacgccagggtcagg

SEQ ID NO: 293788 - DNA, 75 bp, Artificial Sequence
  Synthetic
gatcttcagtttattcccttccacctgatcccaaacattttgatggttatcaacagcaagcagtagttattttgg

SEQ ID NO: 293789 - DNA, 75 bp, Artificial Sequence
  Synthetic
tgatcccaaacattttgatggttatcaacagcaagcagtagttattttggatgatctaaaccagaaccccaatgg

SEQ ID NO: 293790 - DNA, 75 bp, Artificial Sequence
  Synthetic
caccgatggcaaacttagataataaaggcatgttgttcacaagtagctttgtcttagcctctacaaattctcaga

SEQ ID NO: 293791 - DNA, 75 bp, Artificial Sequence
  Synthetic
aggcatgttgttcacaagtagctttgtcttagcctctacaaattctcagacactcaaccctccaactgtgttgaa

SEQ ID NO: 293792 - DNA, 75 bp, Artificial Sequence
  Synthetic
actcatcatttacaaaatcgggcaaattgaatactgccatggcatgtgaactgtgtaaagattgtcataaaccaa

SEQ ID NO: 293793 - DNA, 75 bp, Artificial Sequence
  Synthetic
attgaatactgccatggcatgtgaactgtgtaaagattgtcataaaccaacaaactttaaaaagtgctgtccgtt

SEQ ID NO: 293794 - DNA, 75 bp, Artificial Sequence
  Synthetic
atagtatagatcagctggttacagctatactgcaggagcacaataataagacaaaaattactaactcccttgaaa

SEQ ID NO: 293795 - DNA, 75 bp, Artificial Sequence
  Synthetic
tatactgcaggagcacaataataagacaaaaattactaactcccttgaaattctgttccaaggtccagtgtacaa

SEQ ID NO: 293796 - DNA, 75 bp, Artificial Sequence
  Synthetic
acctactcaaatcagttgatagtgtagaagtgagacaatactgtagagagaagaaatggcttatccctgaaatac

SEQ ID NO: 293797 - DNA, 75 bp, Artificial Sequence
  Synthetic
agaagtgagacaatactgtagagagaagaaatggcttatccctgaaataccaacaaatattgacagggcagttaa

SEQ ID NO: 293798 - DNA, 75 bp, Artificial Sequence
  Synthetic
gtatagtatacatgatctacaagatgtttgctcaaactcagggtccatattctggattagacagtaaagccaaac

SEQ ID NO: 293799 - DNA, 75 bp, Artificial Sequence
  Synthetic
gtttgctcaaactcagggtccatattctggattagacagtaaagccaaactgaaagcaccggtactacgtgcagt

SEQ ID NO: 293800 - DNA, 75 bp, Artificial Sequence
  Synthetic
aggagaattcacagctttagggatttatgatagaatctgtgttatccctacacattcacaaccagaaaatgaggt

SEQ ID NO: 293801 - DNA, 75 bp, Artificial Sequence
  Synthetic
atccagataacttgaatctagaaattacagttttagaactagacagaaatgaaaaatttagagatattagaatgt

SEQ ID NO: 293802 - DNA, 75 bp, Artificial Sequence
  Synthetic
tacagttttagaactagacagaaatgaaaaatttagagatattagaatgtttattgctgatgaatcagaatgtcc

SEQ ID NO: 293803 - DNA, 75 bp, Artificial Sequence
  Synthetic
ctgtgggtcacattacgatggctggcataatcaatttgagtaacacacccacagccagaatgattagatatgatt

SEQ ID NO: 293804 - DNA, 75 bp, Artificial Sequence
  Synthetic
cataatcaatttgagtaacacacccacagccagaatgattagatatgattaccctaccaagacagggcagtgtgg

SEQ ID NO: 293805 - DNA, 75 bp, Artificial Sequence
  Synthetic
atggaagacaaggtttttcagctcagcttaaaaaacagtattttgtccaaaaacaaggtgaaataattagtaaga

SEQ ID NO: 293806 - DNA, 75 bp, Artificial Sequence
  Synthetic
gcttaaaaaacagtattttgtccaaaaacaaggtgaaataattagtaagaagaaggtacatgatttgggcctaaa

SEQ ID NO: 293807 - DNA, 75 bp, Artificial Sequence
  Synthetic
atgtgtttccagggacgaaagagccagcagttttacatccagcagatgaaagattagaagtggattttgaggaat

SEQ ID NO: 293808 - DNA, 75 bp, Artificial Sequence
  Synthetic
agcagttttacatccagcagatgaaagattagaagtggattttgaggaatcactgttctcaaaatacaaaggtaa

SEQ ID NO: 293809 - DNA, 75 bp, Artificial Sequence
  Synthetic
caggtcagttgctttctttggatattcccaccaaagaactttcattaaaagaagctttgtatggcacagatggct

SEQ ID NO: 293810 - DNA, 75 bp, Artificial Sequence
  Synthetic
tcccaccaaagaactttcattaaaagaagctttgtatggcacagatggcttggaacccattgaccttaataccag

SEQ ID NO: 293811 - DNA, 75 bp, Artificial Sequence
  Synthetic
acaaagaaacccaagacacaaccaaaatggaagaatgtttgagcaaatatggcattgatttaccattagttacat

SEQ ID NO: 293812 - DNA, 75 bp, Artificial Sequence
  Synthetic
aatggaagaatgtttgagcaaatatggcattgatttaccattagttacatacattaaagatgaacttaggggaag

SEQ ID NO: 293813 - DNA, 75 bp, Artificial Sequence
  Synthetic
atgattctgtgaacatgagggtcaagttaggtgagttgtataaggcattccacaagaatcctgggatattaaccg

SEQ ID NO: 293814 - DNA, 75 bp, Artificial Sequence
  Synthetic
gttaggtgagttgtataaggcattccacaagaatcctgggatattaaccgggtctgcagtagggtgtgatccaga

SEQ ID NO: 293815 - DNA, 75 bp, Artificial Sequence
  Synthetic
ttgactattcaaattttgatgctagtttatccccagtgtggtttgactgcttagagctagtgcttagaaaattgg

SEQ ID NO: 293816 - DNA, 75 bp, Artificial Sequence
  Synthetic
tttatccccagtgtggtttgactgcttagagctagtgcttagaaaattgggttttgagtcggctgatctagtaaa

SEQ ID NO: 293817 - DNA, 75 bp, Artificial Sequence
  Synthetic
agggaggaatgccatcaggttgctcaggcactagtatttttaattcaatgattaataatataattattagaacct

SEQ ID NO: 293818 - DNA, 75 bp, Artificial Sequence
  Synthetic
aggcactagtatttttaattcaatgattaataatataattattagaaccttaattcttgatacatataagggcat

SEQ ID NO: 293819 - DNA, 75 bp, Artificial Sequence
  Synthetic
catatccttttgaattggattcagaaaaaattgctcagcaaggtgctaagtatggtctgactatcacaccaccag

SEQ ID NO: 293820 - DNA, 75 bp, Artificial Sequence
  Synthetic
aaaaattgctcagcaaggtgctaagtatggtctgactatcacaccaccagacaagtctacacagtttcataaaat

SEQ ID NO: 293821 - DNA, 75 bp, Artificial Sequence
  Synthetic
agtttcctttccttgttcatcctgttatgccaatgtcagacatacatgaatcaattagatggacaaaggatccca

SEQ ID NO: 293822 - DNA, 75 bp, Artificial Sequence
  Synthetic
tatgccaatgtcagacatacatgaatcaattagatggacaaaggatcccaagaacactcaagaccacgtgaggtc

SEQ ID NO: 293823 - DNA, 75 bp, Artificial Sequence
  Synthetic
tacgtggcatccgcagtacggacatagggaaggttcttgtgataccaccttactcagttcttagacatagatggc

SEQ ID NO: 293824 - DNA, 75 bp, Artificial Sequence
  Synthetic
tactcagttcttagacatagatggcttgagctattctgaattaaactaaatacatatatagagatttaatttgag

SEQ ID NO: 293825 - DNA, 75 bp, Artificial Sequence
  Synthetic
cacccgacccactgggtgtggtacactggtactttgtacctttgtatgcctgtttgcatccccttccctttacct

SEQ ID NO: 293826 - DNA, 75 bp, Artificial Sequence
  Synthetic
tagtgcaacaggaagtatcaccaccagtgatataacgcacaagcaattcttgttccccggagctggatatagact

SEQ ID NO: 293827 - DNA, 75 bp, Artificial Sequence
  Synthetic
cgttatccgccagttaactgcgaaaagactagtaacatcatgcacatttctaggtgttcgatcaggtgaaaaccc

SEQ ID NO: 293828 - DNA, 75 bp, Artificial Sequence
  Synthetic
gcaaggtcgtaatgagtaattctgggatgggaccgactactttgggtgtccgtgtttcctttattcttatcattt

SEQ ID NO: 293829 - DNA, 75 bp, Artificial Sequence
  Synthetic
gatgggaccgactactttgggtgtccgtgtttcctttattcttatcatttgtgtttcatggttacaagcattgtt

SEQ ID NO: 293830 - DNA, 75 bp, Artificial Sequence
  Synthetic
atcaaaacatacttacaaatggatcaaatcagacatttacagttataaattattacaaggatgcagctagttcat

SEQ ID NO: 293831 - DNA, 75 bp, Artificial Sequence
  Synthetic
aaatcagacatttacagttataaattattacaaggatgcagctagttcatcctctgcaggacaatcactttcaat

SEQ ID NO: 293832 - DNA, 75 bp, Artificial Sequence
  Synthetic
caccagcactaaattcaccaaacatagaggcatgtggatatagtgacagagttgaacaaataacattagggaatt

SEQ ID NO: 293833 - DNA, 75 bp, Artificial Sequence
  Synthetic
agaggcatgtggatatagtgacagagttgaacaaataacattagggaattctacgattactacacaggaggcagc

SEQ ID NO: 293834 - DNA, 75 bp, Artificial Sequence
  Synthetic
atgctagtgatgttaacaaaactactaaaccagacacttcagcatgtaggttttacactttggatagtaaaacat

SEQ ID NO: 293835 - DNA, 75 bp, Artificial Sequence
  Synthetic
taaaccagacacttcagcatgtaggttttacactttggatagtaaaacatggagtcagagttcaaagggttggtg

SEQ ID NO: 293836 - DNA, 75 bp, Artificial Sequence
  Synthetic
tgtttttccactctcaaggcagaaccgggtatactattcatgttcaatgtaatgcaaccaaatttcacagtggtt

SEQ ID NO: 293837 - DNA, 75 bp, Artificial Sequence
  Synthetic
cgggtatactattcatgttcaatgtaatgcaaccaaatttcacagtggttgtctattagttgtagtgatacctga

SEQ ID NO: 293838 - DNA, 75 bp, Artificial Sequence
  Synthetic
agacacatccaggagagaaaggcatagaccttaatgatgaagatccaaaaggcccaatgaaagatcctctctaca

SEQ ID NO: 293839 - DNA, 75 bp, Artificial Sequence
  Synthetic
agaccttaatgatgaagatccaaaaggcccaatgaaagatcctctctacatgatggatggcacactaattggaaa

SEQ ID NO: 293840 - DNA, 75 bp, Artificial Sequence
  Synthetic
caacaattgtggttccttacattaactcagtacctatggactccatgactagacataacaacctctctctgttag

SEQ ID NO: 293841 - DNA, 75 bp, Artificial Sequence
  Synthetic
ctcagtacctatggactccatgactagacataacaacctctctctgttagtcatccccattgtgcaaatcgcagc

SEQ ID NO: 293842 - DNA, 75 bp, Artificial Sequence
  Synthetic
tgtttttagagttatctggcatacgatcaaaagctgttatacaaggactgcccacagttttaacaccaggttcag

SEQ ID NO: 293843 - DNA, 75 bp, Artificial Sequence
  Synthetic
atcaaaagctgttatacaaggactgcccacagttttaacaccaggttcagagcagtttttgactacagatgatag

SEQ ID NO: 293844 - DNA, 75 bp, Artificial Sequence
  Synthetic
ttcctggagaagttaaaaacctattggaaattgcacaagttgatactttgattccaataaataacacagagactg

SEQ ID NO: 293845 - DNA, 75 bp, Artificial Sequence
  Synthetic
ggaaattgcacaagttgatactttgattccaataaataacacagagactgccagtggattggatatgtacagagt

SEQ ID NO: 293846 - DNA, 75 bp, Artificial Sequence
  Synthetic
acttaggtgatggtgttttaaaaacaacactaataggtgagttgtgtcagtattttacacattgggcaggttcac

SEQ ID NO: 293847 - DNA, 75 bp, Artificial Sequence
  Synthetic
aacactaataggtgagttgtgtcagtattttacacattgggcaggttcactgcgcctatcctttatgtacactgg

SEQ ID NO: 293848 - DNA, 75 bp, Artificial Sequence
  Synthetic
cccaaggtccaatcaaacgcaaagaagcaatgctaggtacacatgtaatttgggacattggactgcaatcaacag

SEQ ID NO: 293849 - DNA, 75 bp, Artificial Sequence
  Synthetic
agcaatgctaggtacacatgtaatttgggacattggactgcaatcaacagtagtcttgaatataccttggacttc

SEQ ID NO: 293850 - DNA, 75 bp, Artificial Sequence
  Synthetic
tcatttcttgttggtatcaaacttccttagtgttacccccacaaacacaacaaactgtatatatactaggtttca

SEQ ID NO: 293851 - DNA, 75 bp, Artificial Sequence
  Synthetic
cttagtgttacccccacaaacacaacaaactgtatatatactaggtttcattagtgcatgtcctgatttcaaact

SEQ ID NO: 293852 - DNA, 75 bp, Artificial Sequence
  Synthetic
aggggttggaagatgaattgatggaagtcattgttgacaaaacgcagcaaacactggcttcagtcaagagtggat

SEQ ID NO: 293853 - DNA, 75 bp, Artificial Sequence
  Synthetic
agtcattgttgacaaaacgcagcaaacactggcttcagtcaagagtggatctaagcatacccaaaaagtaccttc

SEQ ID NO: 293854 - DNA, 75 bp, Artificial Sequence
  Synthetic
gcgtggaaacccggacaactatgatgcactatacagggtcagaaacaacactggaaaattttctgggtagagcag

SEQ ID NO: 293855 - DNA, 75 bp, Artificial Sequence
  Synthetic
gcactatacagggtcagaaacaacactggaaaattttctgggtagagcagcatgtgtacatgttgttgaaatcag

SEQ ID NO: 293856 - DNA, 75 bp, Artificial Sequence
  Synthetic
atgattggaaaataaatttgtccagcttagtacaacttagaagaaaacttgaaatgtttacgtatgttagatttg

SEQ ID NO: 293857 - DNA, 75 bp, Artificial Sequence
  Synthetic
gaaatgtttacgtatgttagatttgattcagaatatactataatagctaccagttcacaacctaatgatgctaaa

SEQ ID NO: 293858 - DNA, 75 bp, Artificial Sequence
  Synthetic
cctaactacaccatatggaataaatgtgctaaaccacatgggttcaatggcttttagagtagttaatgagcatga

SEQ ID NO: 293859 - DNA, 75 bp, Artificial Sequence
  Synthetic
gtgctaaaccacatgggttcaatggcttttagagtagttaatgagcatgatattcacaccacccatgtcaaaatc

SEQ ID NO: 293860 - DNA, 75 bp, Artificial Sequence
  Synthetic
tagagttttagagtacctacacattggtagaacaaactacaaacaaaatcccaaaaatcccattaagactaggga

SEQ ID NO: 293861 - DNA, 75 bp, Artificial Sequence
  Synthetic
ggtagaacaaactacaaacaaaatcccaaaaatcccattaagactagggattctatcagtacatatgggttggga

SEQ ID NO: 293862 - DNA, 75 bp, Artificial Sequence
  Synthetic
cctgatgtctcatgaggacactcttaaccttgtcacacctctacctgaaagggaccttgccatcgtgagcacggg

SEQ ID NO: 293863 - DNA, 75 bp, Artificial Sequence
  Synthetic
aaccttgtcacacctctacctgaaagggaccttgccatcgtgagcacgggtgctcacggttcagagaccgtccca

SEQ ID NO: 293864 - DNA, 75 bp, Artificial Sequence
  Synthetic
ttaccccgtaatttgtgaaaaaccaacatgtttatggattgaaggtaacaattactatccaagcagataccaaca

SEQ ID NO: 293865 - DNA, 75 bp, Artificial Sequence
  Synthetic
acatgtttatggattgaaggtaacaattactatccaagcagataccaacagggggtaatgagaggtgtcggccca

SEQ ID NO: 293866 - DNA, 75 bp, Artificial Sequence
  Synthetic
tggacttttaactgcaggtggaagtggctatgtttgctttgctgatatcagagcattggacatgttcaaagctga

SEQ ID NO: 293867 - DNA, 75 bp, Artificial Sequence
  Synthetic
ggctatgtttgctttgctgatatcagagcattggacatgttcaaagctgaataccaaggaatttcagactacatc

SEQ ID NO: 293868 - DNA, 75 bp, Artificial Sequence
  Synthetic
aaaagtaacagaattgcaaaatatgtcactgggttacttaaatactaaggttttatctaaaatagtaaaaattgt

SEQ ID NO: 293869 - DNA, 75 bp, Artificial Sequence
  Synthetic
aatcatgatgatttgatcactgttacagccacactagcattattaggatgtgatggatcaccatggagatactta

SEQ ID NO: 293870 - DNA, 75 bp, Artificial Sequence
  Synthetic
aatgacatgtgtaatgcagcaaaagggctagaatggattgcaaacaaaatctccaaacttatagattgggtcaaa

SEQ ID NO: 293871 - DNA, 75 bp, Artificial Sequence
  Synthetic
taaacagctagatattttagaaagacaaatagattcattgcacatgaaccaggttaatgataatgatagagaggt

SEQ ID NO: 293872 - DNA, 75 bp, Artificial Sequence
  Synthetic
caaatagattcattgcacatgaaccaggttaatgataatgatagagaggtcttatttaataatatattatggctg

SEQ ID NO: 293873 - DNA, 75 bp, Artificial Sequence
  Synthetic
aatcaaaatgcttaagaataaaatgactaattttatacagttcaggtcaaaacatcgcacagaaccagtgtgtgt

SEQ ID NO: 293874 - DNA, 75 bp, Artificial Sequence
  Synthetic
actaattttatacagttcaggtcaaaacatcgcacagaaccagtgtgtgtgctaatacatggttcacctggctca

SEQ ID NO: 293875 - DNA, 75 bp, Artificial Sequence
  Synthetic
tggttcctctgtgtactcactacccccagacccaaaacactttgatggttatcagcagcaagctgtagtcatact

SEQ ID NO: 293876 - DNA, 75 bp, Artificial Sequence
  Synthetic
ccagacccaaaacactttgatggttatcagcagcaagctgtagtcatacttgatgacctaaatcaaaatccaaat

SEQ ID NO: 293877 - DNA, 75 bp, Artificial Sequence
  Synthetic
tcccccaatggcaaacctggacaataaaggtatgttgttcaccagcaactttgtattggcatccacaaattccca

SEQ ID NO: 293878 - DNA, 75 bp, Artificial Sequence
  Synthetic
aaaggtatgttgttcaccagcaactttgtattggcatccacaaattcccaaacactaaacccaccaacagttctt

SEQ ID NO: 293879 - DNA, 75 bp, Artificial Sequence
  Synthetic
gcataccacatacacaaaatcaggaaaattgaatgccgcattagcatcagaattgtgtaaagattgtcacaaacc

SEQ ID NO: 293880 - DNA, 75 bp, Artificial Sequence
  Synthetic
aaattgaatgccgcattagcatcagaattgtgtaaagattgtcacaaaccaacaaacttcaagagatgctgccct

SEQ ID NO: 293881 - DNA, 75 bp, Artificial Sequence
  Synthetic
gttcagcatagaccagttagtcactgcaattataactgaacatgcaaataaaaccaaaatttccagttcgctgga

SEQ ID NO: 293882 - DNA, 75 bp, Artificial Sequence
  Synthetic
gcaattataactgaacatgcaaataaaaccaaaatttccagttcgctggaggtgttattccaaggaccaacatac

SEQ ID NO: 293883 - DNA, 75 bp, Artificial Sequence
  Synthetic
agacctacttaaatctgtggataatgaggaggtcagacaatactgtcaagaaaaaagatggcttatacctgaaat

SEQ ID NO: 293884 - DNA, 75 bp, Artificial Sequence
  Synthetic
gaggaggtcagacaatactgtcaagaaaaaagatggcttatacctgaaattccaactaatgtagagagagcagtg

SEQ ID NO: 293885 - DNA, 75 bp, Artificial Sequence
  Synthetic
tggtataatttacatgatatacaagctttttgctcagacacaaggaccctattcaggacttgataataaatccaa

SEQ ID NO: 293886 - DNA, 75 bp, Artificial Sequence
  Synthetic
ctttttgctcagacacaaggaccctattcaggacttgataataaatccaagctcaagccccctacacttagagca

SEQ ID NO: 293887 - DNA, 75 bp, Artificial Sequence
  Synthetic
gaatatagtaacagtcactactgacaaaggagagtttacaggattgggaatacatgaaaggatattagtaatacc

SEQ ID NO: 293888 - DNA, 75 bp, Artificial Sequence
  Synthetic
aaaggagagtttacaggattgggaatacatgaaaggatattagtaataccaacccatgcacagccctcagaaaaa

SEQ ID NO: 293889 - DNA, 75 bp, Artificial Sequence
  Synthetic
ggatccagacaatttaaatttggaaatcactgtcctagaattagacaggaatgaaaaatttagggacattagaat

SEQ ID NO: 293890 - DNA, 75 bp, Artificial Sequence
  Synthetic
atcactgtcctagaattagacaggaatgaaaaatttagggacattagaatgttcattgcagatgacccagagtgc

SEQ ID NO: 293891 - DNA, 75 bp, Artificial Sequence
  Synthetic
gacggttggtgcgaccacactagccggtataataaatttaagcaacacacccactgcgcgaatgattcgctatga

SEQ ID NO: 293892 - DNA, 75 bp, Artificial Sequence
  Synthetic
ggtataataaatttaagcaacacacccactgcgcgaatgattcgctatgatttccctaccagaacaggacagtgt

SEQ ID NO: 293893 - DNA, 75 bp, Artificial Sequence
  Synthetic
caatggaaaacaaggattctcagctcaacttaaaaaacagtactttgtacaaaaacagggtcaaatcattacaaa

SEQ ID NO: 293894 - DNA, 75 bp, Artificial Sequence
  Synthetic
caacttaaaaaacagtactttgtacaaaaacagggtcaaatcattacaaaaagaaatgttagggaactaagtatc

SEQ ID NO: 293895 - DNA, 75 bp, Artificial Sequence
  Synthetic
taatgtgttccctggaagtaaagaaccagcagttctacatcctgcagatgaacgacttgaagtcaattttgagga

SEQ ID NO: 293896 - DNA, 75 bp, Artificial Sequence
  Synthetic
ccagcagttctacatcctgcagatgaacgacttgaagtcaattttgaggaatccctattctcaaaatataaaggc

SEQ ID NO: 293897 - DNA, 75 bp, Artificial Sequence
  Synthetic
tgctggccaactcctatcacttgatatacccacacaagaacttaccctgaaagaggccctctatggtacagatgg

SEQ ID NO: 293898 - DNA, 75 bp, Artificial Sequence
  Synthetic
atacccacacaagaacttaccctgaaagaggccctctatggtacagatggattagaacccatagacttgaacact

SEQ ID NO: 293899 - DNA, 75 bp, Artificial Sequence
  Synthetic
aaataaggagaccaaagacacaacaaaaatggaagagtgcctaagtaaatatggtattgacctgccactggttac

SEQ ID NO: 293900 - DNA, 75 bp, Artificial Sequence
  Synthetic
aaaatggaagagtgcctaagtaaatatggtattgacctgccactggttacctatataaaagatgaactcagaggc

SEQ ID NO: 293901 - DNA, 75 bp, Artificial Sequence
  Synthetic
aaatgattcagttaacatgagaatcaaattgggtaacttatataaagcttttcacaaaaatcctggaatactaac

SEQ ID NO: 293902 - DNA, 75 bp, Artificial Sequence
  Synthetic
aaattgggtaacttatataaagcttttcacaaaaatcctggaatactaaccggttctgccgttggttgtgatcca

SEQ ID NO: 293903 - DNA, 75 bp, Artificial Sequence
  Synthetic
ttttgattattcaaactttgatgctagtctttcaccagtttggtttgagtgtttagagcaagtgttaaagaagat

SEQ ID NO: 293904 - DNA, 75 bp, Artificial Sequence
  Synthetic
aggatttcaatgttcagaattaattcaacaaatatgtaccacccatcatatctttaaagatcagatttatgtggt

SEQ ID NO: 293905 - DNA, 75 bp, Artificial Sequence
  Synthetic
tagcatatggtgatgatgttattgtttcatatccctttcctttggacccggaaaagattgcacagcaaggagtca

SEQ ID NO: 293906 - DNA, 75 bp, Artificial Sequence
  Synthetic
taaaaacactcaagaccacattagatcattgtgcatgatggcctggcactcaggagaggatgaatacaacaagtt

SEQ ID NO: 293907 - DNA, 75 bp, Artificial Sequence
  Synthetic
tcattgtgcatgatggcctggcactcaggagaggatgaatacaacaagtttgtggatggaatcaggagtactgat

SEQ ID NO: 293908 - DNA, 75 bp, Artificial Sequence
  Synthetic
ttaaaacagcggatgggttccctaccatccgacccactgggtgtagtactctggtactctgtacctttgtacgcc

SEQ ID NO: 293909 - DNA, 75 bp, Artificial Sequence
  Synthetic
ctggtactctgtacctttgtacgcctgtttatccactacccttttcctaaattttccacccgtgtaaccttagaa

SEQ ID NO: 293910 - DNA, 75 bp, Artificial Sequence
  Synthetic
tgtttatccactacccttttcctaaattttccacccgtgtaaccttagaagcaaacaaattgtacaatagggtgc

SEQ ID NO: 293911 - DNA, 75 bp, Artificial Sequence
  Synthetic
gtatagacggtcaccactgtcaaaagcccttaaccgttacccgccaaccaactacgtaacggctagtaacaccat

SEQ ID NO: 293912 - DNA, 75 bp, Artificial Sequence
  Synthetic
gcccttaaccgttacccgccaaccaactacgtaacggctagtaacaccatgaatttgtcttgacgttcgatcagg

SEQ ID NO: 293913 - DNA, 75 bp, Artificial Sequence
  Synthetic
aaccgtgtctcagcctgcgtggcggccaacccagcttctgctgggacgccaattcattgacatggtgtgaagacc

SEQ ID NO: 293914 - DNA, 75 bp, Artificial Sequence
  Synthetic
ccaacccagcttctgctgggacgccaattcattgacatggtgtgaagacctgcatgtgcttggttgtgattcctc

SEQ ID NO: 293915 - DNA, 75 bp, Artificial Sequence
  Synthetic
aatgtcgtatgggtcgtaatgagtaattctgggatgggaccgactactttgggtgtccgtgtttcctgtttttcc

SEQ ID NO: 293916 - DNA, 75 bp, Artificial Sequence
  Synthetic
attctgggatgggaccgactactttgggtgtccgtgtttcctgtttttccaaattattcttatggtcacagcata

SEQ ID NO: 293917 - DNA, 75 bp, Artificial Sequence
  Synthetic
gtgggtcgcatgagaatcaaaacattcttaccaatgggtctcaccaaactttcactgttattaattactataagg

SEQ ID NO: 293918 - DNA, 75 bp, Artificial Sequence
  Synthetic
tcttaccaatgggtctcaccaaactttcactgttattaattactataaggatgcagcaagttcttcatcagctag

SEQ ID NO: 293919 - DNA, 75 bp, Artificial Sequence
  Synthetic
tgatgttgaaaggtgctccggcattgaactcacctaatgtcgaggcgtgtggatacagtgatagggtacaacaaa

SEQ ID NO: 293920 - DNA, 75 bp, Artificial Sequence
  Synthetic
gaactcacctaatgtcgaggcgtgtggatacagtgatagggtacaacaaataactttgggcaattcaacaataac

SEQ ID NO: 293921 - DNA, 75 bp, Artificial Sequence
  Synthetic
atttatcagatgatgatgctagtgatgtcaataaaacttctaaaccagacacttcagtatgtaggttttacactt

SEQ ID NO: 293922 - DNA, 75 bp, Artificial Sequence
  Synthetic
tgtcaataaaacttctaaaccagacacttcagtatgtaggttttacactttagatagtaaaacgtggcaacaaga

SEQ ID NO: 293923 - DNA, 75 bp, Artificial Sequence
  Synthetic
tatttggacaaaatatgttttaccacacacttggcagaactggctacactattcatgtgcaatgtaatgcaacaa

SEQ ID NO: 293924 - DNA, 75 bp, Artificial Sequence
  Synthetic
cacacttggcagaactggctacactattcatgtgcaatgtaatgcaacaaaattccacagtgggtgtttattgat

SEQ ID NO: 293925 - DNA, 75 bp, Artificial Sequence
  Synthetic
cagtcaaatataaatttacccacccaggtgatcaaggtatagacctcagtacagcagaagagacaaacggccctg

SEQ ID NO: 293926 - DNA, 75 bp, Artificial Sequence
  Synthetic
aggtgatcaaggtatagacctcagtacagcagaagagacaaacggccctgtaaagaacccggtatacaatatgga

SEQ ID NO: 293927 - DNA, 75 bp, Artificial Sequence
  Synthetic
ttagaacaaataatacagctacaataatagtcccatatatgaactcagtgccaatggattcaatgacacgtcaca

SEQ ID NO: 293928 - DNA, 75 bp, Artificial Sequence
  Synthetic
aatagtcccatatatgaactcagtgccaatggattcaatgacacgtcacaataatgtgtcattaatggttattcc

SEQ ID NO: 293929 - DNA, 75 bp, Artificial Sequence
  Synthetic
cagtgaccatagccccaatgtttactgaatttactggaattagatccaagactatcgttccaaatgctacccctc

SEQ ID NO: 293930 - DNA, 75 bp, Artificial Sequence
  Synthetic
tgaatttactggaattagatccaagactatcgttccaaatgctacccctcagggattgccaacgacaaccctgcc

SEQ ID NO: 293931 - DNA, 75 bp, Artificial Sequence
  Synthetic
taccaaattatgaacccacacccaaaatacacattccaggagaagtcaaaaacttattagaaataattcaggttg

SEQ ID NO: 293932 - DNA, 75 bp, Artificial Sequence
  Synthetic
aatacacattccaggagaagtcaaaaacttattagaaataattcaggttgacaccttaattccaatgaataatac

SEQ ID NO: 293933 - DNA, 75 bp, Artificial Sequence
  Synthetic
aacaaaatcagaaaatctttggaacagacttgtatattggagatggcgttttcaagactacacttttaggagaga

SEQ ID NO: 293934 - DNA, 75 bp, Artificial Sequence
  Synthetic
agacttgtatattggagatggcgttttcaagactacacttttaggagagattgctcagtactacacacactggtc

SEQ ID NO: 293935 - DNA, 75 bp, Artificial Sequence
  Synthetic
caaaattgattctagcttacactccacctggagcacctggaccggaaaccagaaaggatgctatgcttggcacac

SEQ ID NO: 293936 - DNA, 75 bp, Artificial Sequence
  Synthetic
acctggagcacctggaccggaaaccagaaaggatgctatgcttggcacacatgttgtgtgggatataggcctaca

SEQ ID NO: 293937 - DNA, 75 bp, Artificial Sequence
  Synthetic
acacggacaaggacacttacactagtgcaggctttctgtcgtgttggtatcaaacatctctaatactcccaccac

SEQ ID NO: 293938 - DNA, 75 bp, Artificial Sequence
  Synthetic
tgcaggctttctgtcgtgttggtatcaaacatctctaatactcccaccacaaacacaaggtcaggtgtatttatt

SEQ ID NO: 293939 - DNA, 75 bp, Artificial Sequence
  Synthetic
cacaaaccatatcacaaacagatgcattaccagagggcttgggagaagagcttgaggaagtcattgtcgagaaaa

SEQ ID NO: 293940 - DNA, 75 bp, Artificial Sequence
  Synthetic
attaccagagggcttgggagaagagcttgaggaagtcattgtcgagaaaacgaaacagacagtggcttcaattgc

SEQ ID NO: 293941 - DNA, 75 bp, Artificial Sequence
  Synthetic
caggagctagcatgcccgtggagccatcagatagtgttgagactagattaacctatatgcatttcaaaggttcag

SEQ ID NO: 293942 - DNA, 75 bp, Artificial Sequence
  Synthetic
atcagatagtgttgagactagattaacctatatgcatttcaaaggttcagaaacagatgtggaaagtttcttggg

SEQ ID NO: 293943 - DNA, 75 bp, Artificial Sequence
  Synthetic
gtagtacaaatcaaaaacaagacaaactatttaatgattggagaataaacttgtctagtcttgtacagtttagga

SEQ ID NO: 293944 - DNA, 75 bp, Artificial Sequence
  Synthetic
actatttaatgattggagaataaacttgtctagtcttgtacagtttaggaaaaaacttgaactttttacttatgt

SEQ ID NO: 293945 - DNA, 75 bp, Artificial Sequence
  Synthetic
actcaaagtattccagcaacttgactgtacaggctatgtatgtccctcctggtgctcctaaccctgaagcatgga

SEQ ID NO: 293946 - DNA, 75 bp, Artificial Sequence
  Synthetic
tgtacaggctatgtatgtccctcctggtgctcctaaccctgaagcatggaatgattacacctggcaaagtgcctc

SEQ ID NO: 293947 - DNA, 75 bp, Artificial Sequence
  Synthetic
cctttgtaggtttggcatcagcatataattgcttctatgatggttattctcatgatgatgagaataccccttatg

SEQ ID NO: 293948 - DNA, 75 bp, Artificial Sequence
  Synthetic
taattgcttctatgatggttattctcatgatgatgagaataccccttatggcattacagtattaaatcacatggg

SEQ ID NO: 293949 - DNA, 75 bp, Artificial Sequence
  Synthetic
taaagattagggtttaccacagagcaaaacatgtccaggcatggatcccaagggcaccaagagcactaccatatg

SEQ ID NO: 293950 - DNA, 75 bp, Artificial Sequence
  Synthetic
aaaacatgtccaggcatggatcccaagggcaccaagagcactaccatatgtgtcaattggacgttcaaattatga

SEQ ID NO: 293951 - DNA, 75 bp, Artificial Sequence
  Synthetic
gcttgggtccaagatttggaggtgtatttaccagtaatttcaaaataatgaattatcacttgatgactccagaag

SEQ ID NO: 293952 - DNA, 75 bp, Artificial Sequence
  Synthetic
atttaccagtaatttcaaaataatgaattatcacttgatgactccagaagatcacttgaatttaatagcaccata

SEQ ID NO: 293953 - DNA, 75 bp, Artificial Sequence
  Synthetic
ccataccacattgcaactgtacctccggagtttactactccacctattacagaaaattttatcctgttatatgtg

SEQ ID NO: 293954 - DNA, 75 bp, Artificial Sequence
  Synthetic
cggagtttactactccacctattacagaaaattttatcctgttatatgtgagaaacccacaacaatctggattga

SEQ ID NO: 293955 - DNA, 75 bp, Artificial Sequence
  Synthetic
taggaccagcagaaccaggtgactgtggtggtattttaagatgtattcatggtccaataggtttacttacagcag

SEQ ID NO: 293956 - DNA, 75 bp, Artificial Sequence
  Synthetic
tggtggtattttaagatgtattcatggtccaataggtttacttacagcaggtggtggaggctatgtctgctttgc

SEQ ID NO: 293957 - DNA, 75 bp, Artificial Sequence
  Synthetic
acataaccagtctaggcagggcttttggtgtgggattcacagaccaaatatcagctaaagtagtagaattacagg

SEQ ID NO: 293958 - DNA, 75 bp, Artificial Sequence
  Synthetic
tggtgtgggattcacagaccaaatatcagctaaagtagtagaattacaggatgttgcaaaagatttcctcacaac

SEQ ID NO: 293959 - DNA, 75 bp, Artificial Sequence
  Synthetic
gtagaaatcatgatgatttagtcacggtcactgccactttggctctgttgggctgtgatggttccccttggagat

SEQ ID NO: 293960 - DNA, 75 bp, Artificial Sequence
  Synthetic
ggtcactgccactttggctctgttgggctgtgatggttccccttggagattcttgaagatgtatatttctaagca

SEQ ID NO: 293961 - DNA, 75 bp, Artificial Sequence
  Synthetic
aattcaatgatgcatgcaatgcggcaaaaggtctagaatggattgcaaacaaaatttcaaaattgattgaatgga

SEQ ID NO: 293962 - DNA, 75 bp, Artificial Sequence
  Synthetic
tagagaaaaattagagttctgcagtaagctgaagcagttagatatactagaaagacagataaccacaatgcacat

SEQ ID NO: 293963 - DNA, 75 bp, Artificial Sequence
  Synthetic
ggttggagcagatgtcacaaaaatttgcccctctctatgctacagaggcaaaaagaatcagagacttaaagaaca

SEQ ID NO: 293964 - DNA, 75 bp, Artificial Sequence
  Synthetic
tgcccctctctatgctacagaggcaaaaagaatcagagacttaaagaacaaaatagttaattacatgcaattcag

SEQ ID NO: 293965 - DNA, 75 bp, Artificial Sequence
  Synthetic
gttctggaaaatctctgactacatcaattgtagggcgcgcattggctgaacatttcaactcagcagtatattcac

SEQ ID NO: 293966 - DNA, 75 bp, Artificial Sequence
  Synthetic
aattgtagggcgcgcattggctgaacatttcaactcagcagtatattcactgcctccagatccaaaacactttga

SEQ ID NO: 293967 - DNA, 75 bp, Artificial Sequence
  Synthetic
cagatggtcaagacatcagtatgttttgtcaaatggtttcctcagttgactttctccctccaatggctagtttag

SEQ ID NO: 293968 - DNA, 75 bp, Artificial Sequence
  Synthetic
ttgtcaaatggtttcctcagttgactttctccctccaatggctagtttagataacaagggaatgttatttaccag

SEQ ID NO: 293969 - DNA, 75 bp, Artificial Sequence
  Synthetic
tcttgaatccagaagcactagccagaagatttgggtttgatctagatatctgcttgcatagtacatatacaaaga

SEQ ID NO: 293970 - DNA, 75 bp, Artificial Sequence
  Synthetic
aagatttgggtttgatctagatatctgcttgcatagtacatatacaaagaatgggaaacttaatgtaacaatggc

SEQ ID NO: 293971 - DNA, 75 bp, Artificial Sequence
  Synthetic
gcccgttagtttgtggtaaagctataagcttggtggatagaacatcaaatgttagatatagtgtagaccaattag

SEQ ID NO: 293972 - DNA, 75 bp, Artificial Sequence
  Synthetic
aagcttggtggatagaacatcaaatgttagatatagtgtagaccaattagttacagccattatcaatgactacag

SEQ ID NO: 293973 - DNA, 75 bp, Artificial Sequence
  Synthetic
tgtacaaggacctggaaatagatgtgtgtaacacaccaccaccagagtgtattaatgatttactcaaatcagttg

SEQ ID NO: 293974 - DNA, 75 bp, Artificial Sequence
  Synthetic
gtgtaacacaccaccaccagagtgtattaatgatttactcaaatcagttgattctgaagaggttagggattactg

SEQ ID NO: 293975 - DNA, 75 bp, Artificial Sequence
  Synthetic
ctgtgaaccaggctagcatgataattaatacaatactgatgtttgttagtactttaggtatagtgtatgtcattt

SEQ ID NO: 293976 - DNA, 75 bp, Artificial Sequence
  Synthetic
taatacaatactgatgtttgttagtactttaggtatagtgtatgtcatttacaaattatttgcacaaacccaagg

SEQ ID NO: 293977 - DNA, 75 bp, Artificial Sequence
  Synthetic
gaccagtagtggcacaaggtcccaacacagagtttgcactgtccttactcaggaagaatattgtaaccatcacaa

SEQ ID NO: 293978 - DNA, 75 bp, Artificial Sequence
  Synthetic
cacagagtttgcactgtccttactcaggaagaatattgtaaccatcacaacagagaaaggagagttcactggatt

SEQ ID NO: 293979 - DNA, 75 bp, Artificial Sequence
  Synthetic
atagtgtgttagttaatggacagaaaatacaggtcagagacaaatataagcttgtagatccagagaatgtaaatt

SEQ ID NO: 293980 - DNA, 75 bp, Artificial Sequence
  Synthetic
aatacaggtcagagacaaatataagcttgtagatccagagaatgtaaatttagaactcaccattctgatccttga

SEQ ID NO: 293981 - DNA, 75 bp, Artificial Sequence
  Synthetic
aggggttagaagctacactggtaattcattcaaaccacttcaccaatacaatcttagatgtagggccaataacca

SEQ ID NO: 293982 - DNA, 75 bp, Artificial Sequence
  Synthetic
tcattcaaaccacttcaccaatacaatcttagatgtagggccaataaccatggcaggtttaattaacttgagtag

SEQ ID NO: 293983 - DNA, 75 bp, Artificial Sequence
  Synthetic
agtgtggtggtgtgttgtgtacaactggtaagatctttggaatacatgtgggtggcaatggaagacagggtttct

SEQ ID NO: 293984 - DNA, 75 bp, Artificial Sequence
  Synthetic
tggtaagatctttggaatacatgtgggtggcaatggaagacagggtttctctgcacaactcagaaggcagtactt

SEQ ID NO: 293985 - DNA, 75 bp, Artificial Sequence
  Synthetic
atttaatgccagtcaacactcctaccaaaacaaagatacacccaagtgtattctatgacgtgtttccaggcagta

SEQ ID NO: 293986 - DNA, 75 bp, Artificial Sequence
  Synthetic
caaaacaaagatacacccaagtgtattctatgacgtgtttccaggcagtaaagaacctgcagtcctcagtgataa

SEQ ID NO: 293987 - DNA, 75 bp, Artificial Sequence
  Synthetic
agggaaatgttgaaatgaaacctacagataatatgttggtggctgtggatcactatgctggacaattaatgtcat

SEQ ID NO: 293988 - DNA, 75 bp, Artificial Sequence
  Synthetic
agataatatgttggtggctgtggatcactatgctggacaattaatgtcattagacattccaactactgagttgac

SEQ ID NO: 293989 - DNA, 75 bp, Artificial Sequence
  Synthetic
caactagtgcaggttacccctatgttagtttaggcataaagaagagagacattttgaacagagaaacccaggaag

SEQ ID NO: 293990 - DNA, 75 bp, Artificial Sequence
  Synthetic
tagtttaggcataaagaagagagacattttgaacagagaaacccaggaagttgaaaagatgaaattttacttgga

SEQ ID NO: 293991 - DNA, 75 bp, Artificial Sequence
  Synthetic
gaagtgtggacaaggtacgattgggaaagagcaggttaattgaagcctccagtttgaatgattcagttaacatga

SEQ ID NO: 293992 - DNA, 75 bp, Artificial Sequence
  Synthetic
aaagagcaggttaattgaagcctccagtttgaatgattcagttaacatgagaatgaaattaggtaacttatataa

SEQ ID NO: 293993 - DNA, 75 bp, Artificial Sequence
  Synthetic
atcctgacactttctggtccgttataccatgtttgatggatggacacctgatggctttcgattattcaaattttg

SEQ ID NO: 293994 - DNA, 75 bp, Artificial Sequence
  Synthetic
accatgtttgatggatggacacctgatggctttcgattattcaaattttgatgcttcattatccccagtatggtt

SEQ ID NO: 293995 - DNA, 75 bp, Artificial Sequence
  Synthetic
tgattcagaccatatgcaatacccatcacatattcaaagatgaaatttacacagttaaaggtggaatgccttctg

SEQ ID NO: 293996 - DNA, 75 bp, Artificial Sequence
  Synthetic
tcacatattcaaagatgaaatttacacagttaaaggtggaatgccttctggttgttctgggaccagcattttcaa

SEQ ID NO: 293997 - DNA, 75 bp, Artificial Sequence
  Synthetic
aaggcatagatttggacaaactcaaagtcattgcgtatggtgatgacttaatagtatcttacccctttgaattag

SEQ ID NO: 293998 - DNA, 75 bp, Artificial Sequence
  Synthetic
agtcattgcgtatggtgatgacttaatagtatcttacccctttgaattagatccaggggtgttggcatcacatgg

SEQ ID NO: 293999 - DNA, 75 bp, Artificial Sequence
  Synthetic
agaaaatgacttgggaaaatctaacatttttgaagagatattttaaaccagatgagcaatttccattccttgtcc

SEQ ID NO: 294000 - DNA, 75 bp, Artificial Sequence
  Synthetic
atttttgaagagatattttaaaccagatgagcaatttccattccttgtccatccagtaatgccaatgcaagacat

SEQ ID NO: 294001 - DNA, 75 bp, Artificial Sequence
  Synthetic
tgagatccctatgtatgttagcatggcattcaggacagaaggaatatgaacacttcattgaaaggataagatcag

SEQ ID NO: 294002 - DNA, 75 bp, Artificial Sequence
  Synthetic
gcctgaatacagcgtgctgagaaagcgctggttagacatgttctaatctggttaaaacaatgatatagacattta

SEQ ID NO: 294003 - DNA, 75 bp, Artificial Sequence
  Synthetic
ttaaaacagcggatgggtttcccaccatccgacccactgggtgtagtgctctggtattttgtacctttgcacgcc

SEQ ID NO: 294004 - DNA, 75 bp, Artificial Sequence
  Synthetic
catccgacccactgggtgtagtgctctggtattttgtacctttgcacgcctgtttcccatttgtacccttcctta

SEQ ID NO: 294005 - DNA, 75 bp, Artificial Sequence
  Synthetic
gaagcgccacatccagtggtgttgcgtacaaatacttctgtttacccggagcgaggtataggttgtacccacggc

SEQ ID NO: 294006 - DNA, 75 bp, Artificial Sequence
  Synthetic
gcgaggtataggttgtacccacggccaaaagcctttaaccgttatccgccaatcaactacgtaacggctagtatc

SEQ ID NO: 294007 - DNA, 75 bp, Artificial Sequence
  Synthetic
ctttgggtgtccgtgtttccttttattcttacattgtcttatggtcacagcatatatattatatatactgtgatc

SEQ ID NO: 294008 - DNA, 75 bp, Artificial Sequence
  Synthetic
ttcttacattgtcttatggtcacagcatatatattatatatactgtgatcatgggtgcacaagtgtcaacacaga

SEQ ID NO: 294009 - DNA, 75 bp, Artificial Sequence
  Synthetic
actttcactgtcataaactattataaggatgcagctagctcatcatccgctggacaatccttatcaatggatcca

SEQ ID NO: 294010 - DNA, 75 bp, Artificial Sequence
  Synthetic
aggatgcagctagctcatcatccgctggacaatccttatcaatggatccaagcaaattcactgaaccagtcaaag

SEQ ID NO: 294011 - DNA, 75 bp, Artificial Sequence
  Synthetic
tgtggttatagtgatagagtggagcaaattactttaggaaattctacaataacaacacaagaagcagcaaattca

SEQ ID NO: 294012 - DNA, 75 bp, Artificial Sequence
  Synthetic
aaattactttaggaaattctacaataacaacacaagaagcagcaaattcaattgtagcatatggggagtggccat

SEQ ID NO: 294013 - DNA, 75 bp, Artificial Sequence
  Synthetic
gacatctcagcatgtagattttatacattagatagcaaaacatggactaatctgtcaaaagggtggtgttggaag

SEQ ID NO: 294014 - DNA, 75 bp, Artificial Sequence
  Synthetic
cattagatagcaaaacatggactaatctgtcaaaagggtggtgttggaagcttcctgatgctttgaaagacatgg

SEQ ID NO: 294015 - DNA, 75 bp, Artificial Sequence
  Synthetic
actatacatgtacagtgtaatgcaacaaaattccatagtggttgtttattggttgtggttataccagagcaccaa

SEQ ID NO: 294016 - DNA, 75 bp, Artificial Sequence
  Synthetic
caaaattccatagtggttgtttattggttgtggttataccagagcaccaattggcatctatacagggaggaagtg

SEQ ID NO: 294017 - DNA, 75 bp, Artificial Sequence
  Synthetic
aatgaatcagatggtgatggtccaatgttagatccattgtacatgatggatggaacactgattggaaatagttta

SEQ ID NO: 294018 - DNA, 75 bp, Artificial Sequence
  Synthetic
tgttagatccattgtacatgatggatggaacactgattggaaatagtttaatttttccccatcagtttataaatt

SEQ ID NO: 294019 - DNA, 75 bp, Artificial Sequence
  Synthetic
cctatggactcaatgactagacacaacaatctgtctttaatggtgattccaattgtaaatattactgcaacaagt

SEQ ID NO: 294020 - DNA, 75 bp, Artificial Sequence
  Synthetic
acaatctgtctttaatggtgattccaattgtaaatattactgcaacaagtggtgctgctccatcaatatctatca

SEQ ID NO: 294021 - DNA, 75 bp, Artificial Sequence
  Synthetic
acagtaatacaaggactccccactgtcttaactcctggttcagaacagttccttaccacggatgacaggcaatcc

SEQ ID NO: 294022 - DNA, 75 bp, Artificial Sequence
  Synthetic
tcttaactcctggttcagaacagttccttaccacggatgacaggcaatcccctagtgcaatgcccaattatgaac

SEQ ID NO: 294023 - DNA, 75 bp, Artificial Sequence
  Synthetic
gcccaagtggacacactgatacctataaacaatgctgaaggaatcacaggattagaaacatacaggatcccactt

SEQ ID NO: 294024 - DNA, 75 bp, Artificial Sequence
  Synthetic
taaacaatgctgaaggaatcacaggattagaaacatacaggatcccactttatcaaaacaggcaaggtcaacaag

SEQ ID NO: 294025 - DNA, 75 bp, Artificial Sequence
  Synthetic
ctaggagaaatctgtcagtacttcactcattgggctggctctttacgtctgtcattcatgtacacaggaccagcc

SEQ ID NO: 294026 - DNA, 75 bp, Artificial Sequence
  Synthetic
ctcattgggctggctctttacgtctgtcattcatgtacacaggaccagccctttccagtgcaaaactacttattg

SEQ ID NO: 294027 - DNA, 75 bp, Artificial Sequence
  Synthetic
ctgggtacacatgtagtttgggacattgggctacaatcaacagttgtcctcaatattccctggacttcaggagtt

SEQ ID NO: 294028 - DNA, 75 bp, Artificial Sequence
  Synthetic
ttgggctacaatcaacagttgtcctcaatattccctggacttcaggagttcaattcagatacacagacccagaca

SEQ ID NO: 294029 - DNA, 75 bp, Artificial Sequence
  Synthetic
ttaccccctcaagtggagcaaacagtgtacatgcttggctttgttagtgcatgcccagattttaagttaagactc

SEQ ID NO: 294030 - DNA, 75 bp, Artificial Sequence
  Synthetic
tgtacatgcttggctttgttagtgcatgcccagattttaagttaagactcatgaaagatacacaatctatacaac

SEQ ID NO: 294031 - DNA, 75 bp, Artificial Sequence
  Synthetic
gtcgacaaaactcatcagacattggcttctgtgaagagtgattcaaagcacactcagaaagtccctgcactcaca

SEQ ID NO: 294032 - DNA, 75 bp, Artificial Sequence
  Synthetic
cttctgtgaagagtgattcaaagcacactcagaaagtccctgcactcacagcaaatgaaactggagctacactac

SEQ ID NO: 294033 - DNA, 75 bp, Artificial Sequence
  Synthetic
agagggtcagagacaactttggaaaacttcttaggaagagctgcatgtgtacatgtggtagagatcaaaaacaaa

SEQ ID NO: 294034 - DNA, 75 bp, Artificial Sequence
  Synthetic
acttcttaggaagagctgcatgtgtacatgtggtagagatcaaaaacaaacgggttactgatgataccaagcaca

SEQ ID NO: 294035 - DNA, 75 bp, Artificial Sequence
  Synthetic
cagcttagaagaaagttagagctatttacttatgtcaggtttgattcagagtataccataatagctaccagttct

SEQ ID NO: 294036 - DNA, 75 bp, Artificial Sequence
  Synthetic
ttacttatgtcaggtttgattcagagtataccataatagctaccagttctcaacctgaggatgcaagttactcaa

SEQ ID NO: 294037 - DNA, 75 bp, Artificial Sequence
  Synthetic
atcaaatgggatgactacacatggcaaagtgcaactaatcccagtgtgttcttcaatgtaggaaaatctgccagg

SEQ ID NO: 294038 - DNA, 75 bp, Artificial Sequence
  Synthetic
aaagtgcaactaatcccagtgtgttcttcaatgtaggaaaatctgccaggttcagtgttccctatttaggaattg

SEQ ID NO: 294039 - DNA, 75 bp, Artificial Sequence
  Synthetic
acaccttatggaattaatgtactaaatcacatgggctctatagcattcagagtagttaatgagcatgataaacac

SEQ ID NO: 294040 - DNA, 75 bp, Artificial Sequence
  Synthetic
atcacatgggctctatagcattcagagtagttaatgagcatgataaacacacaacacacgttaagattcgagttt

SEQ ID NO: 294041 - DNA, 75 bp, Artificial Sequence
  Synthetic
ttacagtatttatatattggcagaacaaattacagtccaaaccctgttagtcccattaaaaccagagaatcaatc

SEQ ID NO: 294042 - DNA, 75 bp, Artificial Sequence
  Synthetic
caaattacagtccaaaccctgttagtcccattaaaaccagagaatcaatcaacacctacgggttagggcccagat

SEQ ID NO: 294043 - DNA, 75 bp, Artificial Sequence
  Synthetic
actcatgaggataacttgagacttttaacacccatgcctgagagagatttggcaatagttgatgcaagggctcac

SEQ ID NO: 294044 - DNA, 75 bp, Artificial Sequence
  Synthetic
taacacccatgcctgagagagatttggcaatagttgatgcaagggctcacggttctgaaacagtaccacagtgta

SEQ ID NO: 294045 - DNA, 75 bp, Artificial Sequence
  Synthetic
gtagtatgtgaaaaaccaacctgtgtgtggatagaaggaaacaactactacccaagtagataccaacaaggagtc

SEQ ID NO: 294046 - DNA, 75 bp, Artificial Sequence
  Synthetic
tgtggatagaaggaaacaactactacccaagtagataccaacaaggagtcatgaagggtgttggccctgcagaac

SEQ ID NO: 294047 - DNA, 75 bp, Artificial Sequence
  Synthetic
ctcactgcaggaggcagcgggtttgtgtgctttgctgacattagaatgttagaattattcaaagctgagtatcag

SEQ ID NO: 294048 - DNA, 75 bp, Artificial Sequence
  Synthetic
tgtgctttgctgacattagaatgttagaattattcaaagctgagtatcagggcatatcagattacattgttaacc

SEQ ID NO: 294049 - DNA, 75 bp, Artificial Sequence
  Synthetic
gctgaactccagaatatttcaatgggttacctaaataccaaagtcttgtccaagataattaaaatagtttctgct

SEQ ID NO: 294050 - DNA, 75 bp, Artificial Sequence
  Synthetic
gttacctaaataccaaagtcttgtccaagataattaaaatagtttctgctttagttatcatttgcaggaaccatg

SEQ ID NO: 294051 - DNA, 75 bp, Artificial Sequence
  Synthetic
tctccatggaggtaccttaaaatgtatatcagtaaacatttttgtctgccctacatagaaaggcaatcaaatgat

SEQ ID NO: 294052 - DNA, 75 bp, Artificial Sequence
  Synthetic
atatcagtaaacatttttgtctgccctacatagaaaggcaatcaaatgatttgtggttcaagaaattcaatgaca

SEQ ID NO: 294053 - DNA, 75 bp, Artificial Sequence
  Synthetic
ttgattgattgggtcaaacagaagattttaccccaggcaagagacaagctggatttttgcaagaggctaaaacag

SEQ ID NO: 294054 - DNA, 75 bp, Artificial Sequence
  Synthetic
ttggatattctagaaagacaaattgacaccctacatgtaaatcaggtcaatgataatgacagggaaacactattt

SEQ ID NO: 294055 - DNA, 75 bp, Artificial Sequence
  Synthetic
tgcagttgaagcaaagagaataaaaagtttaaaaaacaaaatcacaaactttatacaatttagatcaaaacaccg

SEQ ID NO: 294056 - DNA, 75 bp, Artificial Sequence
  Synthetic
agtttaaaaaacaaaatcacaaactttatacaatttagatcaaaacaccgcacagaaccagtatgtgtcctcata

SEQ ID NO: 294057 - DNA, 75 bp, Artificial Sequence
  Synthetic
ggctattgctgacaactacaactcatctgtctattcattaccaccagaccctaaacattttgatggatatcagca

SEQ ID NO: 294058 - DNA, 75 bp, Artificial Sequence
  Synthetic
tctgtctattcattaccaccagaccctaaacattttgatggatatcagcaacaagcagttgtcatacttgatgat

SEQ ID NO: 294059 - DNA, 75 bp, Artificial Sequence
  Synthetic
atcatcagttgatttcatcccacctatggcaaatttggacaataaaggaatgctattcacaagcagctttgttct

SEQ ID NO: 294060 - DNA, 75 bp, Artificial Sequence
  Synthetic
atggcaaatttggacaataaaggaatgctattcacaagcagctttgttctggcttctacaaactcccagacatta

SEQ ID NO: 294061 - DNA, 75 bp, Artificial Sequence
  Synthetic
tgatttagatatgtgccttcatactacatttactagatctggaaaattgaacgctgcattagcgtcagaattgtg

SEQ ID NO: 294062 - DNA, 75 bp, Artificial Sequence
  Synthetic
acatttactagatctggaaaattgaacgctgcattagcgtcagaattgtgtaaagactgtcacaagccagctaac

SEQ ID NO: 294063 - DNA, 75 bp, Artificial Sequence
  Synthetic
caggcacactaatgtcagatacagcatagatcaattggttacagcaataatcactgaacatgtaaacaagaccaa

SEQ ID NO: 294064 - DNA, 75 bp, Artificial Sequence
  Synthetic
atagatcaattggttacagcaataatcactgaacatgtaaacaagaccaaaatatcaaattcactagaagttctt

SEQ ID NO: 294065 - DNA, 75 bp, Artificial Sequence
  Synthetic
accaccagaatgtattgtagatttgcttaaatcagtagacaatgaagaagttagacaatattgccaaggaaagaa

SEQ ID NO: 294066 - DNA, 75 bp, Artificial Sequence
  Synthetic
cttaaatcagtagacaatgaagaagttagacaatattgccaaggaaagaaatggctcattccagaaattccaact

SEQ ID NO: 294067 - DNA, 75 bp, Artificial Sequence
  Synthetic
gatgttcattaccacccttggcataatctatatgatctacaagctttttgcccaaacccaaggtccatattctgg

SEQ ID NO: 294068 - DNA, 75 bp, Artificial Sequence
  Synthetic
atctatatgatctacaagctttttgcccaaacccaaggtccatattctggtttagatggaaaatctaagctaaaa

SEQ ID NO: 294069 - DNA, 75 bp, Artificial Sequence
  Synthetic
attgtccctacttaggaaaaatatagtgactgtcaccactagtaaaggtgagtttactggccttggtatttatga

SEQ ID NO: 294070 - DNA, 75 bp, Artificial Sequence
  Synthetic
gtgactgtcaccactagtaaaggtgagtttactggccttggtatttatgataggattttagttattcccacccat

SEQ ID NO: 294071 - DNA, 75 bp, Artificial Sequence
  Synthetic
ggacaaatggaagttagttgacccagacaacctaaatttggaaataactgtcattgaattagacagaaatgaaaa

SEQ ID NO: 294072 - DNA, 75 bp, Artificial Sequence
  Synthetic
gacaacctaaatttggaaataactgtcattgaattagacagaaatgaaaaatttagagatattagaatgtttata

SEQ ID NO: 294073 - DNA, 75 bp, Artificial Sequence
  Synthetic
ctttaaagatactatacttacagttggaacaaccactttggcaggtattattaatctcagtaatacacctacagc

SEQ ID NO: 294074 - DNA, 75 bp, Artificial Sequence
  Synthetic
ggaacaaccactttggcaggtattattaatctcagtaatacacctacagctagaatgattagatatgagttcccc

SEQ ID NO: 294075 - DNA, 75 bp, Artificial Sequence
  Synthetic
cggcatacatgtgggaggaaatggaagacaaggtttttcagcacaattaaagaagcagtattttgtgcaaaaaca

SEQ ID NO: 294076 - DNA, 75 bp, Artificial Sequence
  Synthetic
agacaaggtttttcagcacaattaaagaagcagtattttgtgcaaaaacaaggtgaaattgttcaaagaaagaat

SEQ ID NO: 294077 - DNA, 75 bp, Artificial Sequence
  Synthetic
gcacccaagtgtcttttataatgttttcccaggaaccaaagaaccagcagtgttacatcccagtgatagtagatt

SEQ ID NO: 294078 - DNA, 75 bp, Artificial Sequence
  Synthetic
ttcccaggaaccaaagaaccagcagtgttacatcccagtgatagtagattagaggtagattttgaagagtctttg

SEQ ID NO: 294079 - DNA, 75 bp, Artificial Sequence
  Synthetic
agtcgcgatcgaccactactctggtcaattgttatcattagatatccccacccaagagcttactcttaaagaagc

SEQ ID NO: 294080 - DNA, 75 bp, Artificial Sequence
  Synthetic
caattgttatcattagatatccccacccaagagcttactcttaaagaagcactctatggaacagatggattagaa

SEQ ID NO: 294081 - DNA, 75 bp, Artificial Sequence
  Synthetic
caataaaaagtccatattaaacagagagacaaaagaagttgccaaaatgcaagagtgcctgagcaagtatggaat

SEQ ID NO: 294082 - DNA, 75 bp, Artificial Sequence
  Synthetic
gagacaaaagaagttgccaaaatgcaagagtgcctgagcaagtatggaattgatctccccctaatcacatatatc

SEQ ID NO: 294083 - DNA, 75 bp, Artificial Sequence
  Synthetic
gattgaggcatccagtttgaatgattcagtcaatatgagagtaaagttgggcaatttgtacaaagcatttcataa

SEQ ID NO: 294084 - DNA, 75 bp, Artificial Sequence
  Synthetic
tcagtcaatatgagagtaaagttgggcaatttgtacaaagcatttcataaaaacccaggtgtattgacaggttca

SEQ ID NO: 294085 - DNA, 75 bp, Artificial Sequence
  Synthetic
agatggagagttaatagcctttgattattcaaactttgatgcaagtttatctccagtgtggtttaattgtttaga

SEQ ID NO: 294086 - DNA, 75 bp, Artificial Sequence
  Synthetic
tattcaaactttgatgcaagtttatctccagtgtggtttaattgtttagaaattgtattagaaaaattaggtttt

SEQ ID NO: 294087 - DNA, 75 bp, Artificial Sequence
  Synthetic
ggaccaaatctatgtagtagagggcggtatgccatcagggtgttcaggaacatctatctttaattccatgattaa

SEQ ID NO: 294088 - DNA, 75 bp, Artificial Sequence
  Synthetic
ggtatgccatcagggtgttcaggaacatctatctttaattccatgattaacaacataattatcagaactttggta

SEQ ID NO: 294089 - DNA, 75 bp, Artificial Sequence
  Synthetic
tggtgatgatgttattatttcatatccctttactttggactcagaggttattgctaaacagggaagcaagtatgg

SEQ ID NO: 294090 - DNA, 75 bp, Artificial Sequence
  Synthetic
ccctttactttggactcagaggttattgctaaacagggaagcaagtatggtttgacaatcacgccaccagataaa

SEQ ID NO: 294091 - DNA, 75 bp, Artificial Sequence
  Synthetic
gtattttaaaccagatccagatttcccgttcttaatacatccagtgatgccaatggctgacatacatgaatccat

SEQ ID NO: 294092 - DNA, 75 bp, Artificial Sequence
  Synthetic
ccgttcttaatacatccagtgatgccaatggctgacatacatgaatccattagatggaccaaagatccgaaaaac

SEQ ID NO: 294093 - DNA, 75 bp, Artificial Sequence
  Synthetic
gcaagaatataacaaatttgtggaaggaattagaagcacagatattggtaaggttttagtgataccatcttactc

SEQ ID NO: 294094 - DNA, 75 bp, Artificial Sequence
  Synthetic
tgtcttaaggcgtaggtggcttgacttgttctaatctgtcttttgcttatatatatagagtattaatttagtgta

SEQ ID NO: 294095 - DNA, 75 bp, Artificial Sequence
  Synthetic
catccgacccactgggtgtagtgctctggtattttgtacctttgcacgcctgtttcccctttgtacccatcctga

SEQ ID NO: 294096 - DNA, 75 bp, Artificial Sequence
  Synthetic
gaagcatcacatccagtggtgttcagtacaagcactcctgtttccccggagcgaggtataggttgtacccacgac

SEQ ID NO: 294097 - DNA, 75 bp, Artificial Sequence
  Synthetic
gcgaggtataggttgtacccacgaccgaaagcctttaaccgttatccgccaatcaactacataacggctagtatc

SEQ ID NO: 294098 - DNA, 75 bp, Artificial Sequence
  Synthetic
ctttgggtgtccgtgtttctttttattcttatattgtcttatggtcacagcatatatagtatatatactgtgatc

SEQ ID NO: 294099 - DNA, 75 bp, Artificial Sequence
  Synthetic
ttcttatattgtcttatggtcacagcatatatagtatatatactgtgatcatgggtgcgcaagtgtcaacacaga

SEQ ID NO: 294100 - DNA, 75 bp, Artificial Sequence
  Synthetic
accttcactgttattaattattacaaagatgctgcaagttcatcatcagcaggtcaatcattgtcaatggatcca

SEQ ID NO: 294101 - DNA, 75 bp, Artificial Sequence
  Synthetic
aagatgctgcaagttcatcatcagcaggtcaatcattgtcaatggatccatcaaagtttactgaaccagttaaag

SEQ ID NO: 294102 - DNA, 75 bp, Artificial Sequence
  Synthetic
tgtggctatagtgatagagtagaacagataactataggaaattcaaccattacaactcaggaagctgccaatgca

SEQ ID NO: 294103 - DNA, 75 bp, Artificial Sequence
  Synthetic
agataactataggaaattcaaccattacaactcaggaagctgccaatgcagttgtggcatatgctgaatggccca

SEQ ID NO: 294104 - DNA, 75 bp, Artificial Sequence
  Synthetic
gatacatctgcttgtaggttttacacattggccagtaaaacctggaaccctacatcaaaaggatggtgttggaag

SEQ ID NO: 294105 - DNA, 75 bp, Artificial Sequence
  Synthetic
cattggccagtaaaacctggaaccctacatcaaaaggatggtgttggaagttgccggatgccctgaaggacatgg

SEQ ID NO: 294106 - DNA, 75 bp, Artificial Sequence
  Synthetic
actattcatgtgcagtgtaatgccacaaaattccacagtggcactctattggttgtcatcatcccagaacatcaa

SEQ ID NO: 294107 - DNA, 75 bp, Artificial Sequence
  Synthetic
caaaattccacagtggcactctattggttgtcatcatcccagaacatcaattggcttcagcagaagggggaaatg

SEQ ID NO: 294108 - DNA, 75 bp, Artificial Sequence
  Synthetic
aataccaatgatgcaaagggcccaaaaactgacccaatatacaacatggatggtacattattgggcaatgtactc

SEQ ID NO: 294109 - DNA, 75 bp, Artificial Sequence
  Synthetic
aaactgacccaatatacaacatggatggtacattattgggcaatgtactcattttcccacaccagttcataaatc

SEQ ID NO: 294110 - DNA, 75 bp, Artificial Sequence
  Synthetic
ccaatggattcaatgactagacacaacaatttgtcacttttggtgatcccaatagtaccaatcacagcgagcaca

SEQ ID NO: 294111 - DNA, 75 bp, Artificial Sequence
  Synthetic
acaatttgtcacttttggtgatcccaatagtaccaatcacagcgagcacaggatcatctcatagtatacctatta

SEQ ID NO: 294112 - DNA, 75 bp, Artificial Sequence
  Synthetic
acagtcataacacaaggtctccctacaacattaacacctggatctgaacaatttctgactacagacgataggcaa

SEQ ID NO: 294113 - DNA, 75 bp, Artificial Sequence
  Synthetic
caacattaacacctggatctgaacaatttctgactacagacgataggcaatctccatcagccttaccaaactatg

SEQ ID NO: 294114 - DNA, 75 bp, Artificial Sequence
  Synthetic
ataatacaagtggattcaatgatcccaataaacaacataactttaccagatggggttgaaaagtacagagtacca

SEQ ID NO: 294115 - DNA, 75 bp, Artificial Sequence
  Synthetic
caataaacaacataactttaccagatggggttgaaaagtacagagtaccattaatgcaaaaccagcaagaaagtc

SEQ ID NO: 294116 - DNA, 75 bp, Artificial Sequence
  Synthetic
ttgttaggtgaaatagcacagtattacacacattgggcaggttccatcagaatatcttttatgtacacaggtcca

SEQ ID NO: 294117 - DNA, 75 bp, Artificial Sequence
  Synthetic
acacacattgggcaggttccatcagaatatcttttatgtacacaggtccagcattgtctagtgctaaactcttag

SEQ ID NO: 294118 - DNA, 75 bp, Artificial Sequence
  Synthetic
atgttgggcacccatgtagtatgggatattggtttgcaatcaactgtagtaatgaatataccttggactgctggt

SEQ ID NO: 294119 - DNA, 75 bp, Artificial Sequence
  Synthetic
atattggtttgcaatcaactgtagtaatgaatataccttggactgctggtgcgcaattcagatatacagacccag

SEQ ID NO: 294120 - DNA, 75 bp, Artificial Sequence
  Synthetic
gtattaccaccagaaaccaatcagagtgtatacatacttggcttcatcagtgcatgtccagacttcaaactccgc

SEQ ID NO: 294121 - DNA, 75 bp, Artificial Sequence
  Synthetic
gtgtatacatacttggcttcatcagtgcatgtccagacttcaaactccgcctcatgaaggatacctcatcaatct

SEQ ID NO: 294122 - DNA, 75 bp, Artificial Sequence
  Synthetic
atagtcgacaaagcaaaacagactattgcttcagcatccagtatctcaaaacacacacaaaaggtcccaactcta

SEQ ID NO: 294123 - DNA, 75 bp, Artificial Sequence
  Synthetic
ttgcttcagcatccagtatctcaaaacacacacaaaaggtcccaactctatcagctagcgaaactggtgcaaccc

SEQ ID NO: 294124 - DNA, 75 bp, Artificial Sequence
  Synthetic
tatgatggcactgaaacaagcatagaaagttttcttggtagagcagcatgtgtgcatgttactgatatagagaac

SEQ ID NO: 294125 - DNA, 75 bp, Artificial Sequence
  Synthetic
aaagttttcttggtagagcagcatgtgtgcatgttactgatatagagaacaagttaccaaatacaactgataatc

SEQ ID NO: 294126 - DNA, 75 bp, Artificial Sequence
  Synthetic
gtgcaactaagaaggaaactagatatgtttacatatgttaggtttgactcagaatacactattattgcaacttca

SEQ ID NO: 294127 - DNA, 75 bp, Artificial Sequence
  Synthetic
tgtttacatatgttaggtttgactcagaatacactattattgcaacttcatcacaaccagaacgtgcacagttct

SEQ ID NO: 294128 - DNA, 75 bp, Artificial Sequence
  Synthetic
ccaattcaatgggacgattacacatggcaaagtgcttcaaaccccagtgtattcttcaatgttggtagatcagca

SEQ ID NO: 294129 - DNA, 75 bp, Artificial Sequence
  Synthetic
ggcaaagtgcttcaaaccccagtgtattcttcaatgttggtagatcagcacgctttagtgttccatatttgggta

SEQ ID NO: 294130 - DNA, 75 bp, Artificial Sequence
  Synthetic
gacacagtctatggaataaatgtactaaatcacatgggtagtatagcttttagagtagtcaatgaaaatgatgtt

SEQ ID NO: 294131 - DNA, 75 bp, Artificial Sequence
  Synthetic
taaatcacatgggtagtatagcttttagagtagtcaatgaaaatgatgttcacttaaccaaagttaaaatcagag

SEQ ID NO: 294132 - DNA, 75 bp, Artificial Sequence
  Synthetic
gcaaaaccttatctcaaaataggtaggactaactatactggatcagataacataattcctaaaagaaaaggtatt

SEQ ID NO: 294133 - DNA, 75 bp, Artificial Sequence
  Synthetic
ggactaactatactggatcagataacataattcctaaaagaaaaggtatttcaacttatggatttggaccaagat

SEQ ID NO: 294134 - DNA, 75 bp, Artificial Sequence
  Synthetic
acacatgaggacaccttgaacctacaaaccccactcccagaaagagatttggcagtagtcaacataaatgctcat

SEQ ID NO: 294135 - DNA, 75 bp, Artificial Sequence
  Synthetic
aaaccccactcccagaaagagatttggcagtagtcaacataaatgctcatggttcggagaccgtcccgcaatgta

SEQ ID NO: 294136 - DNA, 75 bp, Artificial Sequence
  Synthetic
gtaatttgtgaaaaacctacttgtatctggattgagggtaacagttactacccaagtagatatcaacagggagtt

SEQ ID NO: 294137 - DNA, 75 bp, Artificial Sequence
  Synthetic
tctggattgagggtaacagttactacccaagtagatatcaacagggagttatgaaaggtgtgggaccagccgaac

SEQ ID NO: 294138 - DNA, 75 bp, Artificial Sequence
  Synthetic
ttaactgcagggggtggtggtttcgtctgctttgcagatatcagaggtctggatatgttccgagcagagtatcaa

SEQ ID NO: 294139 - DNA, 75 bp, Artificial Sequence
  Synthetic
tctgctttgcagatatcagaggtctggatatgttccgagcagagtatcaaggaatatctgattacattttaaatc

SEQ ID NO: 294140 - DNA, 75 bp, Artificial Sequence
  Synthetic
agtgaacttcaaaacattacaatggggtatttgaatacaaaagttctttccaaagtgattaaaatagtctcagct

SEQ ID NO: 294141 - DNA, 75 bp, Artificial Sequence
  Synthetic
ggtatttgaatacaaaagttctttccaaagtgattaaaatagtctcagctttagtcattatatgcagaaatcatg

SEQ ID NO: 294142 - DNA, 75 bp, Artificial Sequence
  Synthetic
tcaccatggaggttcctgaagatgtacattagtaaacactttcacttaccctatatcgagagacaatcaaatgat

SEQ ID NO: 294143 - DNA, 75 bp, Artificial Sequence
  Synthetic
acattagtaaacactttcacttaccctatatcgagagacaatcaaatgatttgtggttcaaaaagtttaatgaca

SEQ ID NO: 294144 - DNA, 75 bp, Artificial Sequence
  Synthetic
ttgattgattggataaagaacaaaatcctaccgcaagctagagataaattggatttttgcaaaagacttaagcaa

SEQ ID NO: 294145 - DNA, 75 bp, Artificial Sequence
  Synthetic
tcctaccgcaagctagagataaattggatttttgcaaaagacttaagcaattagatatactagaaagacaaattg

SEQ ID NO: 294146 - DNA, 75 bp, Artificial Sequence
  Synthetic
aacaatgtgttgtggttggaacaaatgtcacaaaaatttgccccattatacgctttagaggcaaagaggatcaga

SEQ ID NO: 294147 - DNA, 75 bp, Artificial Sequence
  Synthetic
tgtcacaaaaatttgccccattatacgctttagaggcaaagaggatcagatcacttaaaaataaaataaccaatt

SEQ ID NO: 294148 - DNA, 75 bp, Artificial Sequence
  Synthetic
catggtacaccaggatcgggaaaatcccttactacctccttaattggtagatctatagcagaaatatataaatct

SEQ ID NO: 294149 - DNA, 75 bp, Artificial Sequence
  Synthetic
catggtacaccaggatcgggaaaatcccttactacctccttaattggtagatctatagcagatatatataaatct

SEQ ID NO: 294150 - DNA, 75 bp, Artificial Sequence
  Synthetic
catggtacaccaggatcgggaaaatcccttactacctccttaattggtagatctatagcagacatatataaatct

SEQ ID NO: 294151 - DNA, 75 bp, Artificial Sequence
  Synthetic
catggtacaccaggatcgggaaaatcccttactacctccttaattggtagatctatagcagagatatataaatct

SEQ ID NO: 294152 - DNA, 75 bp, Artificial Sequence
  Synthetic
cccttactacctccttaattggtagatctatagcagaaatatataaatcttcagtatattccctcccaccagatc

SEQ ID NO: 294153 - DNA, 75 bp, Artificial Sequence
  Synthetic
cccttactacctccttaattggtagatctatagcagatatatataaatcttcagtatattccctcccaccagatc

SEQ ID NO: 294154 - DNA, 75 bp, Artificial Sequence
  Synthetic
cccttactacctccttaattggtagatctatagcagacatatataaatcttcagtatattccctcccaccagatc

SEQ ID NO: 294155 - DNA, 75 bp, Artificial Sequence
  Synthetic
cccttactacctccttaattggtagatctatagcagagatatataaatcttcagtatattccctcccaccagatc

SEQ ID NO: 294156 - DNA, 75 bp, Artificial Sequence
  Synthetic
ttgaatcagaacccaaatggtgaagacgtaagcacattttgccaaatggtgtcttcagttgattttattccacca

SEQ ID NO: 294157 - DNA, 75 bp, Artificial Sequence
  Synthetic
acgtaagcacattttgccaaatggtgtcttcagttgattttattccaccaatggcaaatttagataacaaaggca

SEQ ID NO: 294158 - DNA, 75 bp, Artificial Sequence
  Synthetic
aaccctccaacagtcttaaatccagaggcattggcccgtagatttgggtttgatctggacatgtgcttacactcc

SEQ ID NO: 294159 - DNA, 75 bp, Artificial Sequence
  Synthetic
aggcattggcccgtagatttgggtttgatctggacatgtgcttacactcctcattcacaaagtcgggcaagttga

SEQ ID NO: 294160 - DNA, 75 bp, Artificial Sequence
  Synthetic
ttcaagaaatgctgtccactaatttgtggaaaagcccttagcttagtggataggcacaccaatgtcagatatagt

SEQ ID NO: 294161 - DNA, 75 bp, Artificial Sequence
  Synthetic
gtggaaaagcccttagcttagtggataggcacaccaatgtcagatatagtatagatcaactagtcacagctatcc

SEQ ID NO: 294162 - DNA, 75 bp, Artificial Sequence
  Synthetic
tttcaaggccctgtgtacaaagacataaccatagatgtccatgacaaacctccaccagactgtatagtggacttg

SEQ ID NO: 294163 - DNA, 75 bp, Artificial Sequence
  Synthetic
taaccatagatgtccatgacaaacctccaccagactgtatagtggacttgcttaaatcagtggatagtgaagaag

SEQ ID NO: 294164 - DNA, 75 bp, Artificial Sequence
  Synthetic
aacattgacagggcagtcaatcaggcaacatctttaataaatacaatacttatgttcattactacaatgggcatt

SEQ ID NO: 294165 - DNA, 75 bp, Artificial Sequence
  Synthetic
caacatctttaataaatacaatacttatgttcattactacaatgggcattgtgtatatgatatacaaaatgtttg

SEQ ID NO: 294166 - DNA, 75 bp, Artificial Sequence
  Synthetic
gcaccagtgttgcgtgcagttgtcacgcaaggtcccaacactgaatttgcattatcattactcagaaagaacatt

SEQ ID NO: 294167 - DNA, 75 bp, Artificial Sequence
  Synthetic
cgcaaggtcccaacactgaatttgcattatcattactcagaaagaacattgtcacaataacaacagccaaaggag

SEQ ID NO: 294168 - DNA, 75 bp, Artificial Sequence
  Synthetic
tcccaaccagaaaatgaagtactcctcaatggttataatattaagataaaagataaatggaaactaatagatcca

SEQ ID NO: 294169 - DNA, 75 bp, Artificial Sequence
  Synthetic
tcaatggttataatattaagataaaagataaatggaaactaatagatccagacaatttgaacttagaaattacag

SEQ ID NO: 294170 - DNA, 75 bp, Artificial Sequence
  Synthetic
gcagatgacttggaatgttctgaagctagcttagtgatacactctaataactacaaaaacaccataatgtctgtt

SEQ ID NO: 294171 - DNA, 75 bp, Artificial Sequence
  Synthetic
ctagcttagtgatacactctaataactacaaaaacaccataatgtctgttggacacattaccatggctggcataa

SEQ ID NO: 294172 - DNA, 75 bp, Artificial Sequence
  Synthetic
accaaaactggacaatgtggtggagttctatgttcaacaggtaaaatctatggaatacatgttggtggtaatggt

SEQ ID NO: 294173 - DNA, 75 bp, Artificial Sequence
  Synthetic
ttctatgttcaacaggtaaaatctatggaatacatgttggtggtaatggtaaacaaggtttttcagcacaactaa

SEQ ID NO: 294174 - DNA, 75 bp, Artificial Sequence
  Synthetic
gtacatgatttaggattaaaaccaataaacacacctagcaaaacaaagttacttcccagtgttttttacaatgtg

SEQ ID NO: 294175 - DNA, 75 bp, Artificial Sequence
  Synthetic
taaacacacctagcaaaacaaagttacttcccagtgttttttacaatgtgtttccaggaacaaaagaaccagcag

SEQ ID NO: 294176 - DNA, 75 bp, Artificial Sequence
  Synthetic
ttttcaaagtacaagggaaatgtgaaaatagaaatcaccgagaacatgtgtattgcaattgatcactatgcagga

SEQ ID NO: 294177 - DNA, 75 bp, Artificial Sequence
  Synthetic
aaatagaaatcaccgagaacatgtgtattgcaattgatcactatgcaggacaattgctctcattggacataccta

SEQ ID NO: 294178 - DNA, 75 bp, Artificial Sequence
  Synthetic
cctattgacctcaataccagtgcaggatacccatatgtcagtttaggaattaagaaaagatcaatattgaataaa

SEQ ID NO: 294179 - DNA, 75 bp, Artificial Sequence
  Synthetic
gatacccatatgtcagtttaggaattaagaaaagatcaatattgaataaagaaaccaaggatactgctaaaatgg

SEQ ID NO: 294180 - DNA, 75 bp, Artificial Sequence
  Synthetic
aaggatgagcttagagggaaggacaaggtcagactagggaaaagtagattaatagaagcatctagtttgaatgat

SEQ ID NO: 294181 - DNA, 75 bp, Artificial Sequence
  Synthetic
aggtcagactagggaaaagtagattaatagaagcatctagtttgaatgattctgtaaatatgagagtcaaactag

SEQ ID NO: 294182 - DNA, 75 bp, Artificial Sequence
  Synthetic
gctgtagggtgcgatcctgataccttttggtctgtcataccaagtcttctagatggtgagcttttagcttttgat

SEQ ID NO: 294183 - DNA, 75 bp, Artificial Sequence
  Synthetic
tttggtctgtcataccaagtcttctagatggtgagcttttagcttttgattattctaattttgatgcaagcttat

SEQ ID NO: 294184 - DNA, 75 bp, Artificial Sequence
  Synthetic
gaatcagctgacctaataaagagaatatctactactcatcacatattcaaggatcagatctatgttgtggagggt

SEQ ID NO: 294185 - DNA, 75 bp, Artificial Sequence
  Synthetic
tatctactactcatcacatattcaaggatcagatctatgttgtggagggtggaatgccatcaggttgttcaggca

SEQ ID NO: 294186 - DNA, 75 bp, Artificial Sequence
  Synthetic
cttgacacatataaaggcattgatttggacaaattgagaataatagcatatggtgatgatattatagcatcatac

SEQ ID NO: 294187 - DNA, 75 bp, Artificial Sequence
  Synthetic
tggacaaattgagaataatagcatatggtgatgatattatagcatcatacccatttgaattagactcagagaaaa

SEQ ID NO: 294188 - DNA, 75 bp, Artificial Sequence
  Synthetic
tcagcacaatttcataaaataacatgggaaaatgtgacttttctaaaaagatatttcagaccagataaacagttc

SEQ ID NO: 294189 - DNA, 75 bp, Artificial Sequence
  Synthetic
gggaaaatgtgacttttctaaaaagatatttcagaccagataaacagttccctttcctagtacacccagttatgc

SEQ ID NO: 294190 - DNA, 75 bp, Artificial Sequence
  Synthetic
acacaagaccatgttagatcattgtgtatgttggcatggcattcaggtgaaaaggaatatgacgaatttgtgcgt

SEQ ID NO: 294191 - DNA, 75 bp, Artificial Sequence
  Synthetic
agttcttaggcatagatggcttgaaatgttttaaacaatttagatatatagagatttaatttgagtagaattttt

SEQ ID NO: 294192 - DNA, 75 bp, Artificial Sequence
  Synthetic
tgtttctcccccccattacccctccccacatatcccagtaacttagaagaattaaattatcgcacaataggagct

SEQ ID NO: 294193 - DNA, 75 bp, Artificial Sequence
  Synthetic
tggtcgatgaggctgagaaatccccacgggcgaccgtgtctcagcctgcgtggcggccagcccagcttatgctgg

SEQ ID NO: 294194 - DNA, 75 bp, Artificial Sequence
  Synthetic
acgggcgaccgtgtctcagcctgcgtggcggccagcccagcttatgctgggacgccttaagtatgacatggtgtg

SEQ ID NO: 294195 - DNA, 75 bp, Artificial Sequence
  Synthetic
aagacccgcatgtgcttaactgtgagtcctccggcccctgaatgcggctaaccttaaccctggagccttggggta

SEQ ID NO: 294196 - DNA, 75 bp, Artificial Sequence
  Synthetic
tatttcattattgttcttatggttacaatatatagagtatattgtaatcatgggtgcacaagtgtctacacaaaa

SEQ ID NO: 294197 - DNA, 75 bp, Artificial Sequence
  Synthetic
actttactgttatcaattattataaggatgcagcaagctcatcatctgctggtcaatctttttcaatggaccctt

SEQ ID NO: 294198 - DNA, 75 bp, Artificial Sequence
  Synthetic
ggatgcagcaagctcatcatctgctggtcaatctttttcaatggacccttctaagtttactgaacctgttaaaga

SEQ ID NO: 294199 - DNA, 75 bp, Artificial Sequence
  Synthetic
gtggatatagtgatagggtgcaacaaattacacttggaaactcaacaatcacaacccaagaggcagctaatgcag

SEQ ID NO: 294200 - DNA, 75 bp, Artificial Sequence
  Synthetic
aattacacttggaaactcaacaatcacaacccaagaggcagctaatgcagttgttgcatatgctgaatggcccag

SEQ ID NO: 294201 - DNA, 75 bp, Artificial Sequence
  Synthetic
acacatctgtttgtaggttttatacattggacagcaagacatggtcagctaactcaaaagggtggtgttggaagc

SEQ ID NO: 294202 - DNA, 75 bp, Artificial Sequence
  Synthetic
attggacagcaagacatggtcagctaactcaaaagggtggtgttggaagcttccagatgcacttaaggatatggg

SEQ ID NO: 294203 - DNA, 75 bp, Artificial Sequence
  Synthetic
ccgtgcatgttcagtgtaacgcaactaaattccatagtggttgcctactagtagtagccatcccggaacaccaat

SEQ ID NO: 294204 - DNA, 75 bp, Artificial Sequence
  Synthetic
taaattccatagtggttgcctactagtagtagccatcccggaacaccaattagcatcacatacacaggggaatgt

SEQ ID NO: 294205 - DNA, 75 bp, Artificial Sequence
  Synthetic
atgatataccagaagaaggaggagcatcacatgacccagtatattctatgaatggaaccctagtgggtaaccttc

SEQ ID NO: 294206 - DNA, 75 bp, Artificial Sequence
  Synthetic
atcacatgacccagtatattctatgaatggaaccctagtgggtaaccttctcatcttcccacaccagttcattaa

SEQ ID NO: 294207 - DNA, 75 bp, Artificial Sequence
  Synthetic
tacctatggattctatgaccagacataacaatatatccttgttagtcattccaattgtaccactgtcaaatccaa

SEQ ID NO: 294208 - DNA, 75 bp, Artificial Sequence
  Synthetic
taacaatatatccttgttagtcattccaattgtaccactgtcaaatccaacaggaatgactactacaatcccagt

SEQ ID NO: 294209 - DNA, 75 bp, Artificial Sequence
  Synthetic
aagctgtggtgccacaaggtctacccaccttgactacccctggatcaggtcaatttttaactacagatgatagac

SEQ ID NO: 294210 - DNA, 75 bp, Artificial Sequence
  Synthetic
caccttgactacccctggatcaggtcaatttttaactacagatgatagacaatcacctagtgcaatgccaaatta

SEQ ID NO: 294211 - DNA, 75 bp, Artificial Sequence
  Synthetic
agcttatacaagtagatacattgattcctttgaacaatttgggtactacagactctatgagtgagtatcggattc

SEQ ID NO: 294212 - DNA, 75 bp, Artificial Sequence
  Synthetic
tcctttgaacaatttgggtactacagactctatgagtgagtatcggattccacttacggcaggtaaagtgaacga

SEQ ID NO: 294213 - DNA, 75 bp, Artificial Sequence
  Synthetic
ctttgtttggggaaatcgcccagtacttcactcattggtcaggttccatcagaatttcattaatgtatacaggcc

SEQ ID NO: 294214 - DNA, 75 bp, Artificial Sequence
  Synthetic
cttcactcattggtcaggttccatcagaatttcattaatgtatacaggccccgcattgtccagtgccaagttgat

SEQ ID NO: 294215 - DNA, 75 bp, Artificial Sequence
  Synthetic
caatgttgggcactcatgtagtgtgggatgtaggtttacagtcaacagttgtcatgaatataccatggacaagtg

SEQ ID NO: 294216 - DNA, 75 bp, Artificial Sequence
  Synthetic
ggatgtaggtttacagtcaacagttgtcatgaatataccatggacaagtggtgtacaatttaggtttacagatcc

SEQ ID NO: 294217 - DNA, 75 bp, Artificial Sequence
  Synthetic
tgattcttccaccagaaacatcaggaactgtctacctgttagcttttgttagtgcatgtccagattttaaattga

SEQ ID NO: 294218 - DNA, 75 bp, Artificial Sequence
  Synthetic
aactgtctacctgttagcttttgttagtgcatgtccagattttaaattgagattaatgaaagacacccaaacaat

SEQ ID NO: 294219 - DNA, 75 bp, Artificial Sequence
  Synthetic
ttgttgtcgacaaaatgagacagataacagcttcaagtcagagcggtccaaaacatactcaaaaagtaccagcat

SEQ ID NO: 294220 - DNA, 75 bp, Artificial Sequence
  Synthetic
aacagcttcaagtcagagcggtccaaaacatactcaaaaagtaccagcattaagtgcaagtgaaacaggtgctac

SEQ ID NO: 294221 - DNA, 75 bp, Artificial Sequence
  Synthetic
acttcactggctcagaaactacattggagaattttctaggaaggtccgcctgtgtacatataacagagattgaga

SEQ ID NO: 294222 - DNA, 75 bp, Artificial Sequence
  Synthetic
ggagaattttctaggaaggtccgcctgtgtacatataacagagattgagaacgaaatacctcaaaatcccacacc

SEQ ID NO: 294223 - DNA, 75 bp, Artificial Sequence
  Synthetic
tgaacttatccagtctagtgcagcttagaaagaaactggaactttttacctatgtgagatttgactctgagtaca

SEQ ID NO: 294224 - DNA, 75 bp, Artificial Sequence
  Synthetic
tagaaagaaactggaactttttacctatgtgagatttgactctgagtacactatactggccactgcttcccaacc

SEQ ID NO: 294225 - DNA, 75 bp, Artificial Sequence
  Synthetic
ctccaggtgcaccaaaccctgttgaatggaatgattacacatggcagagtgcttcaaatcctagtgttttctttg

SEQ ID NO: 294226 - DNA, 75 bp, Artificial Sequence
  Synthetic
atggaatgattacacatggcagagtgcttcaaatcctagtgttttctttgaagttggtaaaacagctagatttag

SEQ ID NO: 294227 - DNA, 75 bp, Artificial Sequence
  Synthetic
attcacatgatgatgcaaacacacaatatggcataaatgtgctaaatcacatgggtagtattgcctttagggtag

SEQ ID NO: 294228 - DNA, 75 bp, Artificial Sequence
  Synthetic
atatggcataaatgtgctaaatcacatgggtagtattgcctttagggtagtaaatgaccatgacctccacaaaac

SEQ ID NO: 294229 - DNA, 75 bp, Artificial Sequence
  Synthetic
taccgcgaccacccagagcactaccgtatacatctatcggtagaaccaactttccactaaatcatggcaaaatta

SEQ ID NO: 294230 - DNA, 75 bp, Artificial Sequence
  Synthetic
gtatacatctatcggtagaaccaactttccactaaatcatggcaaaattattgccaaaagagacaagatcacaac

SEQ ID NO: 294231 - DNA, 75 bp, Artificial Sequence
  Synthetic
taatgaattaccatttgatgacacaggaagatcacttaaacctcctaactccttattacaacagagatttagcag

SEQ ID NO: 294232 - DNA, 75 bp, Artificial Sequence
  Synthetic
ggaagatcacttaaacctcctaactccttattacaacagagatttagcagttgtagcaaccggagcacagggctc

SEQ ID NO: 294233 - DNA, 75 bp, Artificial Sequence
  Synthetic
actacaggaaatattatccaataatatgtgagaaacccacaaacatttggattgaaggtggtagttattatccca

SEQ ID NO: 294234 - DNA, 75 bp, Artificial Sequence
  Synthetic
atgtgagaaacccacaaacatttggattgaaggtggtagttattatcccagtagatttcaatcaggagtgatgaa

SEQ ID NO: 294235 - DNA, 75 bp, Artificial Sequence
  Synthetic
tgcatggtccaattggcctgttaacagcaggcgggagtggttatgtgtgctttgcagacattagacaattagact

SEQ ID NO: 294236 - DNA, 75 bp, Artificial Sequence
  Synthetic
agcaggcgggagtggttatgtgtgctttgcagacattagacaattagacttcattgctgaaacacagggtatcac

SEQ ID NO: 294237 - DNA, 75 bp, Artificial Sequence
  Synthetic
aaatatcagcaaaggttactgagcttcaagatagtgttaaagattacataaatgtcaaaattctatccaaagttg

SEQ ID NO: 294238 - DNA, 75 bp, Artificial Sequence
  Synthetic
tcaagatagtgttaaagattacataaatgtcaaaattctatccaaagttgtcaaaatggtatcagcattagttat

SEQ ID NO: 294239 - DNA, 75 bp, Artificial Sequence
  Synthetic
tacttgggtgtgacggatcaccctggagattcctcaaaatgtacatatcaaaacacttccaagtgccttacatag

SEQ ID NO: 294240 - DNA, 75 bp, Artificial Sequence
  Synthetic
gagattcctcaaaatgtacatatcaaaacacttccaagtgccttacatagagagacaagcaaatgacggctggtt

SEQ ID NO: 294241 - DNA, 75 bp, Artificial Sequence
  Synthetic
caaacaaaatttccaagcttatagaatgggtgaagacaaagataattcctcaggcaagagaaaagctggattttt

SEQ ID NO: 294242 - DNA, 75 bp, Artificial Sequence
  Synthetic
atgggtgaagacaaagataattcctcaggcaagagaaaagctggatttttgcaagagactcaaacaactggacat

SEQ ID NO: 294243 - DNA, 75 bp, Artificial Sequence
  Synthetic
aaagagagcaactctttaataatgttctgtggttggaacaaatgtcccagaagttcgcaccactgtacgcagtgg

SEQ ID NO: 294244 - DNA, 75 bp, Artificial Sequence
  Synthetic
tctgtggttggaacaaatgtcccagaagttcgcaccactgtacgcagtggaagccaggagaatcaaggagatgaa

SEQ ID NO: 294245 - DNA, 75 bp, Artificial Sequence
  Synthetic
cggtctgtgttctaattcatggctcccctggatcaggaaagtcactaactacatccatcattggcagagctatag

SEQ ID NO: 294246 - DNA, 75 bp, Artificial Sequence
  Synthetic
ccctggatcaggaaagtcactaactacatccatcattggcagagctatagctgaaaggtttaaatccacggttta

SEQ ID NO: 294247 - DNA, 75 bp, Artificial Sequence
  Synthetic
tggtgataatggatgacctgaaccaaaacccagatggccaagatatcagtatgttttgccagatggtttcatcag

SEQ ID NO: 294248 - DNA, 75 bp, Artificial Sequence
  Synthetic
aaacccagatggccaagatatcagtatgttttgccagatggtttcatcagttgactttataccaccgatggccag

SEQ ID NO: 294249 - DNA, 75 bp, Artificial Sequence
  Synthetic
ccaactcaaacacactaagtcccccaacaattttgaacccggaagcattggccaggagatttgggtttgatctag

SEQ ID NO: 294250 - DNA, 75 bp, Artificial Sequence
  Synthetic
aacaattttgaacccggaagcattggccaggagatttgggtttgatctagacatttgcttgcacaccacttacac

SEQ ID NO: 294251 - DNA, 75 bp, Artificial Sequence
  Synthetic
gtcacaaacccagcaatttcagtaagtgttgtccactaatatgtggaaaagccgttagtcttgtggatcgatcca

SEQ ID NO: 294252 - DNA, 75 bp, Artificial Sequence
  Synthetic
gtcacaaacccagcaatttcagtaagtgttgtccactaatatgtggtaaagccgttagtcttgtggatcgatcca

SEQ ID NO: 294253 - DNA, 75 bp, Artificial Sequence
  Synthetic
gtcacaaacccagcaatttcagtaagtgttgtccactaatatgtggcaaagccgttagtcttgtggatcgatcca

SEQ ID NO: 294254 - DNA, 75 bp, Artificial Sequence
  Synthetic
gtcacaaacccagcaatttcagtaagtgttgtccactaatatgtgggaaagccgttagtcttgtggatcgatcca

SEQ ID NO: 294255 - DNA, 75 bp, Artificial Sequence
  Synthetic
gccgttagtcttgtggatcgatccaccaatgttagatatagtttaaatcaattagtcacagcaattataactgac

SEQ ID NO: 294256 - DNA, 75 bp, Artificial Sequence
  Synthetic
gccgttagtcttgtggatcgatccaccaatgttagatatagtttatatcaattagtcacagcaattataactgac

SEQ ID NO: 294257 - DNA, 75 bp, Artificial Sequence
  Synthetic
gccgttagtcttgtggatcgatccaccaatgttagatatagtttacatcaattagtcacagcaattataactgac

SEQ ID NO: 294258 - DNA, 75 bp, Artificial Sequence
  Synthetic
gccgttagtcttgtggatcgatccaccaatgttagatatagtttagatcaattagtcacagcaattataactgac

SEQ ID NO: 294259 - DNA, 75 bp, Artificial Sequence
  Synthetic
actccttggaagttctgtttcagggacctgtttataaagacttagaaatagatgtccacagcacacccccacctg

SEQ ID NO: 294260 - DNA, 75 bp, Artificial Sequence
  Synthetic
acctgtttataaagacttagaaatagatgtccacagcacacccccacctgagtgtattaatgacctacttaaatc

SEQ ID NO: 294261 - DNA, 75 bp, Artificial Sequence
  Synthetic
tcccagaaattccaacaaatatagagagagcagtaaaccaggctagtactatcatcaacacaattttgatgtttg

SEQ ID NO: 294262 - DNA, 75 bp, Artificial Sequence
  Synthetic
gagagcagtaaaccaggctagtactatcatcaacacaattttgatgtttgtgagtacccttgggatcctttatgt

SEQ ID NO: 294263 - DNA, 75 bp, Artificial Sequence
  Synthetic
cacacacaaaactaaaaccaccaacattacgacaggtggtggtgcaaggtccaaatactgagtttgctatgtctc

SEQ ID NO: 294264 - DNA, 75 bp, Artificial Sequence
  Synthetic
attacgacaggtggtggtgcaaggtccaaatactgagtttgctatgtctctccttagaaagaacatagtcacagt

SEQ ID NO: 294265 - DNA, 75 bp, Artificial Sequence
  Synthetic
gtgtggtacccacgcactcccaacctgatgatgaagtgttagttaatgggcaaccagttaagttgaaggacaagt

SEQ ID NO: 294266 - DNA, 75 bp, Artificial Sequence
  Synthetic
tgatgatgaagtgttagttaatgggcaaccagttaagttgaaggacaagtataaattgatggatccagaaaacac

SEQ ID NO: 294267 - DNA, 75 bp, Artificial Sequence
  Synthetic
acataagagcatttatagcagaagacccagagggaatggaaggaactcttgtaataaattccaacaattttaaag

SEQ ID NO: 294268 - DNA, 75 bp, Artificial Sequence
  Synthetic
cccagagggaatggaaggaactcttgtaataaattccaacaattttaaagacaccattctggaggtggggcagtt

SEQ ID NO: 294269 - DNA, 75 bp, Artificial Sequence
  Synthetic
tacgctacgagtaccctaccaggacaggacaatgtggtggcgtgctgtgctcaactggcaagatatacggaattc

SEQ ID NO: 294270 - DNA, 75 bp, Artificial Sequence
  Synthetic
aggacaatgtggtggcgtgctgtgctcaactggcaagatatacggaattcatgtcggtggaaatggacgacaggg

SEQ ID NO: 294271 - DNA, 75 bp, Artificial Sequence
  Synthetic
tcaccaccaggaaaaatgttagggaagtgggattgaaacctatcaacactcccactaagacaaagcttcacccta

SEQ ID NO: 294272 - DNA, 75 bp, Artificial Sequence
  Synthetic
agtgggattgaaacctatcaacactcccactaagacaaagcttcaccctagtgtgtttcatgaaatattccctgg

SEQ ID NO: 294273 - DNA, 75 bp, Artificial Sequence
  Synthetic
acctgtgtgactccctattttcaaaatacaagggaaatgttgaaattgatatcacagaaaacatgcaggtggcca

SEQ ID NO: 294274 - DNA, 75 bp, Artificial Sequence
  Synthetic
atacaagggaaatgttgaaattgatatcacagaaaacatgcaggtggccatagatcaatactcaggtcagttgtt

SEQ ID NO: 294275 - DNA, 75 bp, Artificial Sequence
  Synthetic
gcacagatgggttagaaccaattgatataaacactagtgctggttacccgtatgtaagtttaggaataaagaaga

SEQ ID NO: 294276 - DNA, 75 bp, Artificial Sequence
  Synthetic
gcacagatgggttagaaccaattgatataaactctagtgctggttacccgtatgtaagtttaggaataaagaaga

SEQ ID NO: 294277 - DNA, 75 bp, Artificial Sequence
  Synthetic
gcacagatgggttagaaccaattgatataaaccctagtgctggttacccgtatgtaagtttaggaataaagaaga

SEQ ID NO: 294278 - DNA, 75 bp, Artificial Sequence
  Synthetic
gcacagatgggttagaaccaattgatataaacgctagtgctggttacccgtatgtaagtttaggaataaagaaga

SEQ ID NO: 294279 - DNA, 75 bp, Artificial Sequence
  Synthetic
tataaacactagtgctggttacccgtatgtaagtttaggaataaagaagaaagacatactcaatagggaaaccca

SEQ ID NO: 294280 - DNA, 75 bp, Artificial Sequence
  Synthetic
tataaactctagtgctggttacccgtatgtaagtttaggaataaagaagaaagacatactcaatagggaaaccca

SEQ ID NO: 294281 - DNA, 75 bp, Artificial Sequence
  Synthetic
tataaaccctagtgctggttacccgtatgtaagtttaggaataaagaagaaagacatactcaatagggaaaccca

SEQ ID NO: 294282 - DNA, 75 bp, Artificial Sequence
  Synthetic
tataaacgctagtgctggttacccgtatgtaagtttaggaataaagaagaaagacatactcaatagggaaaccca

SEQ ID NO: 294283 - DNA, 75 bp, Artificial Sequence
  Synthetic
cacttgtcacatacatcaaagatgaacttagaggtagggataaggttagattaggcaaaagcagactgattgaag

SEQ ID NO: 294284 - DNA, 75 bp, Artificial Sequence
  Synthetic
acttagaggtagggataaggttagattaggcaaaagcagactgattgaagcatccagcttgaatgactctgtaaa

SEQ ID NO: 294285 - DNA, 75 bp, Artificial Sequence
  Synthetic
gagtgataactggatcagctgtgggatgtgacccagatacgttctggtctgtcataccgtgtctcatggacgggc

SEQ ID NO: 294286 - DNA, 75 bp, Artificial Sequence
  Synthetic
tggttcaggtgtcttgagcaggtacttgccaagcttggattcagacactctaacctcataaaaacaatttgcaac

SEQ ID NO: 294287 - DNA, 75 bp, Artificial Sequence
  Synthetic
ttcaattcaatgataaacaatataatcattagaacattaatattagatgtttataaaggcattgatcttgacaaa

SEQ ID NO: 294288 - DNA, 75 bp, Artificial Sequence
  Synthetic
gctgcaaccagaactactagcttctgctggtaagaaatacggcttgacaattacacctccagacaaatcagaaaa

SEQ ID NO: 294289 - DNA, 75 bp, Artificial Sequence
  Synthetic
gctggtaagaaatacggcttgacaattacacctccagacaaatcagaaaagtttacaaaaacaacatgggaaaat

SEQ ID NO: 294290 - DNA, 75 bp, Artificial Sequence
  Synthetic
catacacccagtgatgccaatgcaggatatttatgagtccattcgctggactcgcgatcctaaaaatacacagga

SEQ ID NO: 294291 - DNA, 75 bp, Artificial Sequence
  Synthetic
gatatttatgagtccattcgctggactcgcgatcctaaaaatacacaggatcatatacgatccttgtgtatgttg

SEQ ID NO: 294292 - DNA, 75 bp, Artificial Sequence
  Synthetic
atcaaccagcattggtaaatgcttgttaattccagaatacagtgtcttgcgccgacgctggttagatctgtttta

SEQ ID NO: 294293 - DNA, 75 bp, Artificial Sequence
  Synthetic
ttaattccagaatacagtgtcttgcgccgacgctggttagatctgttttaaataatatagatttgcaatttgatt

SEQ ID NO: 294294 - DNA, 75 bp, Artificial Sequence
  Synthetic
catccgacccactgggtgtagtactctggtactctgtacctttgtacgcctgtttctcctcaaccctcccctacc

SEQ ID NO: 294295 - DNA, 75 bp, Artificial Sequence
  Synthetic
ctggtactctgtacctttgtacgcctgtttctcctcaaccctcccctacccgttatatatctcagtaacttagaa

SEQ ID NO: 294296 - DNA, 75 bp, Artificial Sequence
  Synthetic
agtatagacggccactgctgtcaaaagctcttaaccgttacccgccagttaactacacaacagctagtaacatct

SEQ ID NO: 294297 - DNA, 75 bp, Artificial Sequence
  Synthetic
ctaaaccccggagccttgaggcacaatccagtgcccgcgaggtcgtaacgagaaattctgggacgggaccgacta

SEQ ID NO: 294298 - DNA, 75 bp, Artificial Sequence
  Synthetic
atccagtgcccgcgaggtcgtaacgagaaattctgggacgggaccgactactttgggtgtccgtgtttcctttta

SEQ ID NO: 294299 - DNA, 75 bp, Artificial Sequence
  Synthetic
ggtgcacaagtgtctacacaaaagactggttcgcatgagaatcagaatatccttaccaatggttctacacaacat

SEQ ID NO: 294300 - DNA, 75 bp, Artificial Sequence
  Synthetic
ctggttcgcatgagaatcagaatatccttaccaatggttctacacaacatttcaccgtaatcaactactataagg

SEQ ID NO: 294301 - DNA, 75 bp, Artificial Sequence
  Synthetic
aaatttactgaaccagtcaaagatattatgattaagggagcgccggccttaaattctccaaatgttgaggcctgt

SEQ ID NO: 294302 - DNA, 75 bp, Artificial Sequence
  Synthetic
ttatgattaagggagcgccggccttaaattctccaaatgttgaggcctgtggctatagtgatagggtgcaacaga

SEQ ID NO: 294303 - DNA, 75 bp, Artificial Sequence
  Synthetic
gtggcatatgcagagtggcctagttacttgtcggacatggatgctagtgacgtaaataaaacctcacagtccgac

SEQ ID NO: 294304 - DNA, 75 bp, Artificial Sequence
  Synthetic
acttgtcggacatggatgctagtgacgtaaataaaacctcacagtccgacacatctgtatgcagattctacactt

SEQ ID NO: 294305 - DNA, 75 bp, Artificial Sequence
  Synthetic
ccagatgcacttaaggatatgggagtgtttggacaaaacatgtttttccactcgttagggagaacaggttatacc

SEQ ID NO: 294306 - DNA, 75 bp, Artificial Sequence
  Synthetic
tgtttggacaaaacatgtttttccactcgttagggagaacaggttataccatccatgtccagtgcaatgccacta

SEQ ID NO: 294307 - DNA, 75 bp, Artificial Sequence
  Synthetic
gcatcacgcactgaaggaaatgtatctgtaaattataaatacacccacccaggtgagagaggaatagacctggat

SEQ ID NO: 294308 - DNA, 75 bp, Artificial Sequence
  Synthetic
ctgtaaattataaatacacccacccaggtgagagaggaatagacctggatgaggcggaaaaagaaggaggagcaa

SEQ ID NO: 294309 - DNA, 75 bp, Artificial Sequence
  Synthetic
attttcccacatcagttcatcaatcttaggaccaacaacactgcaacacttgttataccttacataaattcagtc

SEQ ID NO: 294310 - DNA, 75 bp, Artificial Sequence
  Synthetic
ttaggaccaacaacactgcaacacttgttataccttacataaattcagtcccaatggattctatgactagacata

SEQ ID NO: 294311 - DNA, 75 bp, Artificial Sequence
  Synthetic
ggaatgactacaacaataccaatcacagtaactatagcacccatgtgtactgagttttcaggcattcggtcaaaa

SEQ ID NO: 294312 - DNA, 75 bp, Artificial Sequence
  Synthetic
cagtaactatagcacccatgtgtactgagttttcaggcattcggtcaaaagcagtggcaatacagggtttaccta

SEQ ID NO: 294313 - DNA, 75 bp, Artificial Sequence
  Synthetic
tcacccagtgcaatgccaaactatgaaccaactccaccaatccatatcccaggggaagtccacaacttgttagag

SEQ ID NO: 294314 - DNA, 75 bp, Artificial Sequence
  Synthetic
aaccaactccaccaatccatatcccaggggaagtccacaacttgttagagattatacaagttgacacgttgattc

SEQ ID NO: 294315 - DNA, 75 bp, Artificial Sequence
  Synthetic
ctcacagtaggcagagtaaatgatcaagtgtttggtactagaatgtttataggagatggtgtctttaaaactaca

SEQ ID NO: 294316 - DNA, 75 bp, Artificial Sequence
  Synthetic
aagtgtttggtactagaatgtttataggagatggtgtctttaaaactacactatttggagaaatagcacaatatt

SEQ ID NO: 294317 - DNA, 75 bp, Artificial Sequence
  Synthetic
gcattatcaagtgctaagttaatcctggtatacacaccaccaggaacagagggaccaaagaacagaaaggaagca

SEQ ID NO: 294318 - DNA, 75 bp, Artificial Sequence
  Synthetic
tggtatacacaccaccaggaacagagggaccaaagaacagaaaggaagcaatgttaggaacacacgtggtgtggg

SEQ ID NO: 294319 - DNA, 75 bp, Artificial Sequence
  Synthetic
gtccaatttagatacacagatcctgatacctataccagtgctgggttcctttcttgctggtatcaaacatccttg

SEQ ID NO: 294320 - DNA, 75 bp, Artificial Sequence
  Synthetic
atacctataccagtgctgggttcctttcttgctggtatcaaacatccttgattttaccaccagatacatcaggtg

SEQ ID NO: 294321 - DNA, 75 bp, Artificial Sequence
  Synthetic
cttatgaaagacacacaaacaatatcccaaacagaagctctcacagaagggtttgaagaagaattggaggaagtt

SEQ ID NO: 294322 - DNA, 75 bp, Artificial Sequence
  Synthetic
cccaaacagaagctctcacagaagggtttgaagaagaattggaggaagttgttgttgacaaaatgaaacagataa

SEQ ID NO: 294323 - DNA, 75 bp, Artificial Sequence
  Synthetic
agtgctaatgaaactggtgctacattacctacaaacccatctgataatgtggaaaccaggactacatacatgcat

SEQ ID NO: 294324 - DNA, 75 bp, Artificial Sequence
  Synthetic
tacctacaaacccatctgataatgtggaaaccaggactacatacatgcatttcagtggttcagaaactaccttgg

SEQ ID NO: 294325 - DNA, 75 bp, Artificial Sequence
  Synthetic
aaaagacctgaagagtttacttcagaagaaacagctaagactcacaaagaacaaaagttatttaatgattggaag

SEQ ID NO: 294326 - DNA, 75 bp, Artificial Sequence
  Synthetic
aagaaacagctaagactcacaaagaacaaaagttatttaatgattggaagataagcctatctagtttagtccaac

SEQ ID NO: 294327 - DNA, 75 bp, Artificial Sequence
  Synthetic
actattctagctactgcttcacaaccagaccaggcccaatatgccagtaatctgatagtacaagcaatgtatgtt

SEQ ID NO: 294328 - DNA, 75 bp, Artificial Sequence
  Synthetic
cagaccaggcccaatatgccagtaatctgatagtacaagcaatgtatgttcccccaggtgcaccaaatcctattg

SEQ ID NO: 294329 - DNA, 75 bp, Artificial Sequence
  Synthetic
gaagttggcaaaacagcacggtttagtgtaccgttcactggcattgcatcagcttacaattgtttctatgatggt

SEQ ID NO: 294330 - DNA, 75 bp, Artificial Sequence
  Synthetic
gtgtaccgttcactggcattgcatcagcttacaattgtttctatgatggttattcacatgatgatgaaaataccc

SEQ ID NO: 294331 - DNA, 75 bp, Artificial Sequence
  Synthetic
gtgaatgaccatgacagccatacaacccttgtcaagataagggtttttcatagagctaaacacattagagcttgg

SEQ ID NO: 294332 - DNA, 75 bp, Artificial Sequence
  Synthetic
cccttgtcaagataagggtttttcatagagctaaacacattagagcttggttgccaagaccacccagagcattgc

SEQ ID NO: 294333 - DNA, 75 bp, Artificial Sequence
  Synthetic
attgccaaaagagaatcacttcacacatatggtagtaaccccaggtttggggccatatacacttgcaactacaag

SEQ ID NO: 294334 - DNA, 75 bp, Artificial Sequence
  Synthetic
catatggtagtaaccccaggtttggggccatatacacttgcaactacaagatcatgaattaccacctaatgacac

SEQ ID NO: 294335 - DNA, 75 bp, Artificial Sequence
  Synthetic
gttgtggcaacaggagcgcaaggctcagaaattattccccattgtaattgcacttcaggtgtttattattcccag

SEQ ID NO: 294336 - DNA, 75 bp, Artificial Sequence
  Synthetic
cagaaattattccccattgtaattgcacttcaggtgtttattattcccagtactatggaaaatattacccaataa

SEQ ID NO: 294337 - DNA, 75 bp, Artificial Sequence
  Synthetic
agcagataccaagcaggagttatgaaaggtgttggcccagctgaacctggggattgtggtggaatcttacgatgc

SEQ ID NO: 294338 - DNA, 75 bp, Artificial Sequence
  Synthetic
aaggtgttggcccagctgaacctggggattgtggtggaatcttacgatgcatacatggaccaattggattgttga

SEQ ID NO: 294339 - DNA, 75 bp, Artificial Sequence
  Synthetic
ttcattgcagaaacacaaggtatcactgattacattacaagcctgggaaaagcttttggagtgggtttcactgac

SEQ ID NO: 294340 - DNA, 75 bp, Artificial Sequence
  Synthetic
ctgattacattacaagcctgggaaaagcttttggagtgggtttcactgaccagatttcagcaaaaatcacagaac

SEQ ID NO: 294341 - DNA, 75 bp, Artificial Sequence
  Synthetic
gttaaaatggtatcagcattggtgattatttgcagaaatcatgaggacctaataaccgttactgccactttggcc

SEQ ID NO: 294342 - DNA, 75 bp, Artificial Sequence
  Synthetic
ttatttgcagaaatcatgaggacctaataaccgttactgccactttggccttattgggatgtgatggttcaccat

SEQ ID NO: 294343 - DNA, 75 bp, Artificial Sequence
  Synthetic
gaaaggcaagcaaatgatggttggttcagaaagtttaatgatgcttgcaatgcagctaaaggcttggaatggata

SEQ ID NO: 294344 - DNA, 75 bp, Artificial Sequence
  Synthetic
tcagaaagtttaatgatgcttgcaatgcagctaaaggcttggaatggatagccaataaaatctccaaactcatag

SEQ ID NO: 294345 - DNA, 75 bp, Artificial Sequence
  Synthetic
tgcagaaggttgaaacaattagatatcttggagaggcaaattgcaacaatgcacgtttctaatcccacacaagaa

SEQ ID NO: 294346 - DNA, 75 bp, Artificial Sequence
  Synthetic
tcttggagaggcaaattgcaacaatgcacgtttctaatcccacacaagaaaaaagagagcagctcttaaacaatg

SEQ ID NO: 294347 - DNA, 75 bp, Artificial Sequence
  Synthetic
gaagctagaagaatcaaagaaatgaaaacaaagatgatgaattacattcagtttaaatcaaagcaaagaaccgaa

SEQ ID NO: 294348 - DNA, 75 bp, Artificial Sequence
  Synthetic
aaacaaagatgatgaattacattcagtttaaatcaaagcaaagaaccgaaccagtctgtgtgttaatacatggtt

SEQ ID NO: 294349 - DNA, 75 bp, Artificial Sequence
  Synthetic
gcagaaagatacaaatccacagtatattcacttcctccagatccaaagcactttgatgggtaccaacagcaagaa

SEQ ID NO: 294350 - DNA, 75 bp, Artificial Sequence
  Synthetic
attcacttcctccagatccaaagcactttgatgggtaccaacagcaagaagtggtaataatggatgacctgaacc

SEQ ID NO: 294351 - DNA, 75 bp, Artificial Sequence
  Synthetic
gtcgattttattccacctatggctagcttggacaacaagggtattttgtttaccagcaattttgttcttgcatca

SEQ ID NO: 294352 - DNA, 75 bp, Artificial Sequence
  Synthetic
gcttggacaacaagggtattttgtttaccagcaattttgttcttgcatcaactaactcaaatacactcaatcctc

SEQ ID NO: 294353 - DNA, 75 bp, Artificial Sequence
  Synthetic
gatatctgtctacatactacatacactaaatcaggaaaattaaatgctgcaatggcaacagaactctgtaaggat

SEQ ID NO: 294354 - DNA, 75 bp, Artificial Sequence
  Synthetic
ctaaatcaggaaaattaaatgctgcaatggcaacagaactctgtaaggattgtcacaaacccagtaatttcaata

SEQ ID NO: 294355 - DNA, 75 bp, Artificial Sequence
  Synthetic
actaatgtcagatacagcatagatcaattagttaccgcaattatatctgacttcaacaataagcttaagataaca

SEQ ID NO: 294356 - DNA, 75 bp, Artificial Sequence
  Synthetic
aattagttaccgcaattatatctgacttcaacaataagcttaagataacagactctttagaaattttgtttcaag

SEQ ID NO: 294357 - DNA, 75 bp, Artificial Sequence
  Synthetic
gaatgtatcagtgacctgcttaaatcagttgattctgaagaactcagagagtattgcaaacagaaaaattggctt

SEQ ID NO: 294358 - DNA, 75 bp, Artificial Sequence
  Synthetic
cagttgattctgaagaactcagagagtattgcaaacagaaaaattggcttattccagagattccaacaaacattg

SEQ ID NO: 294359 - DNA, 75 bp, Artificial Sequence
  Synthetic
gtaagtactcttggaatcctttatgtaatatacaaattatttgcacagacacaaggtccatattcaggtaaccct

SEQ ID NO: 294360 - DNA, 75 bp, Artificial Sequence
  Synthetic
taatatacaaattatttgcacagacacaaggtccatattcaggtaacccttcacataccaaattgaaaccaccaa

SEQ ID NO: 294361 - DNA, 75 bp, Artificial Sequence
  Synthetic
cttcttaggaaaaacatagttacaatcactacttccaaaggtgaattcacagctctggggattcacgatagagtt

SEQ ID NO: 294362 - DNA, 75 bp, Artificial Sequence
  Synthetic
tcactacttccaaaggtgaattcacagctctggggattcacgatagagtttgtgtagtacctacccattcacaac

SEQ ID NO: 294363 - DNA, 75 bp, Artificial Sequence
  Synthetic
tacaagctacttgatccagagaataccaatttagagctaactatactagtgttagatagaaatgagaaattcaga

SEQ ID NO: 294364 - DNA, 75 bp, Artificial Sequence
  Synthetic
ccaatttagagctaactatactagtgttagatagaaatgagaaattcagagacataagagcttttatagcagaag

SEQ ID NO: 294365 - DNA, 75 bp, Artificial Sequence
  Synthetic
gataccatattggaagtgggtcagttaacctttgcaggcttaataaatcttagcagtgttccaacaaatcgcatg

SEQ ID NO: 294366 - DNA, 75 bp, Artificial Sequence
  Synthetic
taacctttgcaggcttaataaatcttagcagtgttccaacaaatcgcatgatacgctacgaataccccactaaaa

SEQ ID NO: 294367 - DNA, 75 bp, Artificial Sequence
  Synthetic
catgttggtggtaatggaagacaaggcttctctgcacagttaaagaaacagtactttgtggaaaaacaaggagca

SEQ ID NO: 294368 - DNA, 75 bp, Artificial Sequence
  Synthetic
acacaaagaccccctagtgcttatcaagtatatcatggattactttcctgtgatatctgttgatttgcagagtgg

SEQ ID NO: 294369 - DNA, 75 bp, Artificial Sequence
  Synthetic
catttgtcgccaatgtcatggcgcaaattttcctccgatatctgtcagaaggctgatgctggaagacatcgcatc

SEQ ID NO: 294370 - DNA, 75 bp, Artificial Sequence
  Synthetic
tgtctacatagctgctttaggagttaatggaaagaagcataaagcagacactttagtgcaacaaatgagagacag

SEQ ID NO: 294371 - DNA, 75 bp, Artificial Sequence
  Synthetic
agtcgcacgaaggctgatcattgtcgcatcgttcggtagctaaaactgaccgctagcaaatcctagcctagttca

SEQ ID NO: 294372 - DNA, 75 bp, Artificial Sequence
  Synthetic
taccttattctatggttgggccctgttgtgtctttctcatgcaccatcgtcctagtcacgaggttcgcttgcgat

SEQ ID NO: 294373 - DNA, 75 bp, Artificial Sequence
  Synthetic
gagtaaacagcctttctccccagatcatgatgtggatcacatatctgaatttctctctgcatgctctagtgactt

SEQ ID NO: 294374 - DNA, 75 bp, Artificial Sequence
  Synthetic
cctagtcacgaggttcgcttgcgattctctgatttctacaatgtcggagaattcccataccgagtcggacttgga

SEQ ID NO: 294375 - DNA, 75 bp, Artificial Sequence
  Synthetic
aacatcgagccatattctctttgccaatcgactgatctcgaccttttacgacttccgcgacatcttgttctgcgc

SEQ ID NO: 294376 - DNA, 75 bp, Artificial Sequence
  Synthetic
gcctggcatgtccagccagccagggcggcagcaactcgtgatagagtcaactcatcccgggagggattcccctcc

SEQ ID NO: 294377 - DNA, 75 bp, Artificial Sequence
  Synthetic
gactttgcatcaaacgttgcacctccaccagcaaagccttttcagagacttattgatctaataggccatatgact

SEQ ID NO: 294378 - DNA, 75 bp, Artificial Sequence
  Synthetic
ctgatctcgaccttttacgacttccgcgacatcttgttctgcgccatatagatccatgattgggcgcctttgtgt

SEQ ID NO: 294379 - DNA, 75 bp, Artificial Sequence
  Synthetic
ttgtgtctttctcatgcaccatcgtcctagtcacgaggttcgcttgcgattctctgatttctacaatgtcggaga

SEQ ID NO: 294380 - DNA, 75 bp, Artificial Sequence
  Synthetic
ctcgtggcaacaagccccggaggatgatgatgaaaatgtcaaaagagggcaaggcaactgtggaggccctcatca

SEQ ID NO: 294381 - DNA, 75 bp, Artificial Sequence
  Synthetic
ttttgtgattaaacgactactaggttctgggattttcttgctaatcaagcccacttccagcaaaagccatatatt

SEQ ID NO: 294382 - DNA, 75 bp, Artificial Sequence
  Synthetic
atctaaaagaagccatatcctggcctcttggagaaccctcactggctttctttgacctaagctctactagagtgc

SEQ ID NO: 294383 - DNA, 75 bp, Artificial Sequence
  Synthetic
tttgacctaagctctactagagtgcacaggaatgacgacattaggagggatcagattgctactctagcaatgagg

SEQ ID NO: 294384 - DNA, 75 bp, Artificial Sequence
  Synthetic
cgtatctttcgcaattaagcgctcttgctgggcctttgacctctccacttccagggttttcaagccttatataga

SEQ ID NO: 294385 - DNA, 75 bp, Artificial Sequence
  Synthetic
tgctcacgtgcagtgtgttcggctcctgcaggcagcaaaagaggacatttctaatgctgtagttccaaattcagc

SEQ ID NO: 294386 - DNA, 75 bp, Artificial Sequence
  Synthetic
cctcattgctcttatggaggagagcctgatgctgcgctcatcacttcctagcatgatggggagaaacaactggat

SEQ ID NO: 294387 - DNA, 75 bp, Artificial Sequence
  Synthetic
ctgatgctgcgctcatcacttcctagcatgatggggagaaacaactggatcccagttgttcctccaatcccagat

SEQ ID NO: 294388 - DNA, 75 bp, Artificial Sequence
  Synthetic
ccgtcagcagctgtcatggcagctgctcaggcgtacaagacagcagcctaaatggctgcccaggggtttggggga

SEQ ID NO: 294389 - DNA, 75 bp, Artificial Sequence
  Synthetic
ccttcgtccctttctgggatgtataagaaaattatagaacttgagcaccttagaccacagtcagatgccttcttg

SEQ ID NO: 294390 - DNA, 75 bp, Artificial Sequence
  Synthetic
cttgaaggaggcttgcaatcatgctaagctagtcttaaggagcctctatggacagaatttcatggagcaaataga

SEQ ID NO: 294391 - DNA, 75 bp, Artificial Sequence
  Synthetic
aagctagtcttaaggagcctctatggacagaatttcatggagcaaatagacaaccagattattcgagagctcagt

SEQ ID NO: 294392 - DNA, 75 bp, Artificial Sequence
  Synthetic
aaggggtggttggggttacggtcgggattggggggtggggggtggggcagccttaacctctagtcaacctcaaca

SEQ ID NO: 294393 - DNA, 75 bp, Artificial Sequence
  Synthetic
aatccatcatcatcactctcctcctctgattccatctcaacatctgggattggaggaacaactggaatccagttg

SEQ ID NO: 294394 - DNA, 75 bp, Artificial Sequence
  Synthetic
tgattagaggttaaggctgccccaccccccaccccccaatcccgaccgtaaccccaaccccattttcccaacccc

SEQ ID NO: 294395 - DNA, 75 bp, Artificial Sequence
  Synthetic
tttctccccatcatgctaggaagtgatgagcgcagcatcaggctctcctccataagagcaatgagggctgagttt

SEQ ID NO: 294396 - DNA, 75 bp, Artificial Sequence
  Synthetic
ggaactacagcattagaaatgtcctcttttgctgcctgcagaagccgaacacactggacgtgagcaacctcatac

SEQ ID NO: 294397 - DNA, 75 bp, Artificial Sequence
  Synthetic
atgaggtcaaagcctggcaacaggcacagatcaatccctctgagaatagcctcggtcactatcatcctgtgtagg

SEQ ID NO: 294398 - DNA, 75 bp, Artificial Sequence
  Synthetic
atagccaggtccatagggaagttctttgcttctgataccctctgtaacccccccaataaagtgaaaattcctgag

SEQ ID NO: 294399 - DNA, 75 bp, Artificial Sequence
  Synthetic
atcattaggggatgttcaatgtttaccaggaaaaggatgatgatgaatttgaattatcttaagatcctggatggt

SEQ ID NO: 294400 - DNA, 75 bp, Artificial Sequence
  Synthetic
ccaacaaaggagtcttccagatcattggtgatcttgcagctcctcattgctagagtggcaatctgatcccttcta

SEQ ID NO: 294401 - DNA, 75 bp, Artificial Sequence
  Synthetic
gatactatgctagtattggaatccatgtgggttctgatactagcatagtgctacatgattgggcgcctttgtgta

SEQ ID NO: 294402 - DNA, 75 bp, Artificial Sequence
  Synthetic
aggtttgggttgatgacccgggagaactgcagcagatacagagagtgagcatctaatattgcccttagatagtct

SEQ ID NO: 294403 - DNA, 75 bp, Artificial Sequence
  Synthetic
atgtcatcatttctgtgcactctagtagagcttaggtcaaagaaagccagagagggttctccaagaggccaggat

SEQ ID NO: 294404 - DNA, 75 bp, Artificial Sequence
  Synthetic
atggcttctttcagattggggaaccttgtgaaatcactaagagtcatatggcctattagatcaataagtctctga

SEQ ID NO: 294405 - DNA, 75 bp, Artificial Sequence
  Synthetic
aaaggctttgctggtggaggtgcaacgtttgatgcaaagtctccaagtccgactcggtacgggaattctccgaca

SEQ ID NO: 294406 - DNA, 75 bp, Artificial Sequence
  Synthetic
ttgtagaaatcagagaatcgcaagcgaacctcgtgactaggacgatggtgcatgagaaagacacaacagggccca

SEQ ID NO: 294407 - DNA, 75 bp, Artificial Sequence
  Synthetic
cttgttgccacgagtcagagccagaacaatcattttcttggcatccttctcccagtcagccccaccatactgctt

SEQ ID NO: 294408 - DNA, 75 bp, Artificial Sequence
  Synthetic
acaatcattttcttggcatccttctcccagtcagccccaccatactgctttaagagttcgataaccctacgggca

SEQ ID NO: 294409 - DNA, 75 bp, Artificial Sequence
  Synthetic
ccccaacccccattttccccaacccccctgggcagccacttaggctgctgtcttgtaggcctgagcagctgccat

SEQ ID NO: 294410 - DNA, 75 bp, Artificial Sequence
  Synthetic
ccctgggcagccacttaggctgctgtcttgtaggcctgagcagctgccatgacagcagctgacggcttcccatta

SEQ ID NO: 294411 - DNA, 75 bp, Artificial Sequence
  Synthetic
accatagaataaggtatcctgggaggaccatcacctctaatatactccactgacacaacacgacgaccactctgc

SEQ ID NO: 294412 - DNA, 75 bp, Artificial Sequence
  Synthetic
ccactctgcaaatcaacagatatcacaggaaagtaatccatgatatacttgataagcactagggggtctttgtgt

SEQ ID NO: 294413 - DNA, 75 bp, Artificial Sequence
  Synthetic
cagcaaactggatcgcaagctcttgatagttgtccattattgtaatagtgtttgtatctctagggagctttgtgt

SEQ ID NO: 294414 - DNA, 75 bp, Artificial Sequence
  Synthetic
tgattagaggttaaggctgccccacccccccaccccccaatcccgaccgtaaccccaaccacccccttcccccaa

SEQ ID NO: 294415 - DNA, 75 bp, Artificial Sequence
  Synthetic
gggattcactcagagaggaggagatgccagaggagctctcctgctctatatcaggcataagggaggttaagacct

SEQ ID NO: 294416 - DNA, 75 bp, Artificial Sequence
  Synthetic
tacaaaagatggctgcatattctggctttcatggtttcaatgatatggagccagaagatatattattcctattcc

SEQ ID NO: 294417 - DNA, 75 bp, Artificial Sequence
  Synthetic
cgaatattgaggaattagaatcactggattctatagtttacaacaagggagaaatagacatcatcccaagagtca

SEQ ID NO: 294418 - DNA, 75 bp, Artificial Sequence
  Synthetic
cgggtggggatagttcggtgtgagagacgaagagacgctaagcaaatagggagagaaaccatggcagggattgca

SEQ ID NO: 294419 - DNA, 75 bp, Artificial Sequence
  Synthetic
accttcctggctgaatgggaaaagctaaagaaaattgtgaagtggttggaagacactccagaagcaactctagct

SEQ ID NO: 294420 - DNA, 75 bp, Artificial Sequence
  Synthetic
ggggcatgtagcagttttgatgtcttgctcgaaaagggaaaattccccctcttccagtcgtatgctcatcataga

SEQ ID NO: 294421 - DNA, 75 bp, Artificial Sequence
  Synthetic
gtcagctgaaattctcaagcactttctgttctgtatactacagggtccatacagtgagagctataagctacagct

SEQ ID NO: 294422 - DNA, 75 bp, Artificial Sequence
  Synthetic
cttccagtcgtatgctcatcatagaaccctactagaggcagttcatgacaccatcattgcaaaggctgatccacc

SEQ ID NO: 294423 - DNA, 75 bp, Artificial Sequence
  Synthetic
caagccaggaattatacagggcattaaaagccatcattgctgctgatggcttgaacaacatcacctgccatggta

SEQ ID NO: 294424 - DNA, 75 bp, Artificial Sequence
  Synthetic
tcaaacgttgagataaaggaatcagatggtaagacaaaaaccaatttgattgggatccttcagagatttctagat

SEQ ID NO: 294425 - DNA, 75 bp, Artificial Sequence
  Synthetic
tagttgtgatcttcagagtgctcatgggaatccttgcatgaaagagaaactcgtgatgaagacacactgtccaaa

SEQ ID NO: 294426 - DNA, 75 bp, Artificial Sequence
  Synthetic
gggaatccttgcatgaaagagaaactcgtgatgaagacacactgtccaaatgactaccagtcagcccactacctc

SEQ ID NO: 294427 - DNA, 75 bp, Artificial Sequence
  Synthetic
cagatgacaggtgctagcctgaagaaggggtcttatcctctccaggacttattttgtcagtcaagtgaggatgat

SEQ ID NO: 294428 - DNA, 75 bp, Artificial Sequence
  Synthetic
gacctgagtgttccaataaggcagtgggcagaagacatgggggtcacaaacaaccaggattattcctctaaatct

SEQ ID NO: 294429 - DNA, 75 bp, Artificial Sequence
  Synthetic
attttgtcagtcaagtgaggatgatggatcaaaattaaaaacaaaaatgaaaggggtctgcgaagtgggggttca

SEQ ID NO: 294430 - DNA, 75 bp, Artificial Sequence
  Synthetic
ggatcaaaattaaaaacaaaaatgaaaggggtctgcgaagtgggggttcaggcactcaagaagtgtgatggccag

SEQ ID NO: 294431 - DNA, 75 bp, Artificial Sequence
  Synthetic
cgggtgggggtagttcggtgtgagagacaaagagacgctaagcaaatagggagaggaaccatggcagggattgca

SEQ ID NO: 294432 - DNA, 75 bp, Artificial Sequence
  Synthetic
cagactcatttgtctgcttcgagcataagggacagtataaaggaacaatggactctggtcagactaagagggagc

SEQ ID NO: 294433 - DNA, 75 bp, Artificial Sequence
  Synthetic
gactctggtcaaactaagagggagctcaaaagctttgatatctctcagtgccccaagattggaggacatggtagc

SEQ ID NO: 294434 - DNA, 75 bp, Artificial Sequence
  Synthetic
ccccaagattggaggacatggtagcaagaagtgcactggggacgcagcattttgctctgcttatgagtgcactgc

SEQ ID NO: 294435 - DNA, 75 bp, Artificial Sequence
  Synthetic
aagaagtgcactggggacgcagcattttgctctgcttatgagtgcactgctcaatacgccaatgcctattgttca

SEQ ID NO: 294436 - DNA, 75 bp, Artificial Sequence
  Synthetic
gaagaaagcattaggatagatgatctggagttatatgaggagacagatgtggcggatgacatgctaggctaagac

SEQ ID NO: 294437 - DNA, 75 bp, Artificial Sequence
  Synthetic
tggagttatatgaggagacagatgtggcggatgacatgctaggctaagaccaacaagcaaagtcaggcttagatt

SEQ ID NO: 294438 - DNA, 75 bp, Artificial Sequence
  Synthetic
gatcaacagggttcaagatatcatctgcagttgcttgtgctagcggagtttgcgtcacaggatcgcagagccctt

SEQ ID NO: 294439 - DNA, 75 bp, Artificial Sequence
  Synthetic
tgcagttgcttgtgctagcggagtttgcgtcacaggatcgcagagcccttctacagagattacactcaagtaccc

SEQ ID NO: 294440 - DNA, 75 bp, Artificial Sequence
  Synthetic
tgcagttgcatgtgctagcggagtttgtgtcacaggatcgcagagtccttctaccgagatcacactcaagtatcc

SEQ ID NO: 294441 - DNA, 75 bp, Artificial Sequence
  Synthetic
atgatcagtcagttagctccaaaatagtagctcactgccccccccaggacccgtgcctagtgcatggctgcatag

SEQ ID NO: 294442 - DNA, 75 bp, Artificial Sequence
  Synthetic
tttgttgttgtgttcgtattcagctctgttgcaataatttgtttggccattctttataaggtgctcaagtgccta

SEQ ID NO: 294443 - DNA, 75 bp, Artificial Sequence
  Synthetic
ctgttgcaataatttgtttggccattctttataaggtgctcaagtgcctaaagattgccccaaggaaagttctaa

SEQ ID NO: 294444 - DNA, 75 bp, Artificial Sequence
  Synthetic
cattaatcagggcagggtcagttggggcagaggcttgtttgatgttgaagggggtcaaggaagaccaaaccaagt

SEQ ID NO: 294445 - DNA, 75 bp, Artificial Sequence
  Synthetic
tcttgaagataaaaactgtctcaagtgagctatcgtgcagggagggccagagctattggactgggtcctttagcc

SEQ ID NO: 294446 - DNA, 75 bp, Artificial Sequence
  Synthetic
tgattcaggcaagctctagaataaccacttgctccacagaaggtgtcaacaccaagtgtaggctgtctggcacag

SEQ ID NO: 294447 - DNA, 75 bp, Artificial Sequence
  Synthetic
accaagtgtaggctgtctggcacagcattaatcagggcagggtcagttggggcagaggcttgcttgatgttaaag

SEQ ID NO: 294448 - DNA, 75 bp, Artificial Sequence
  Synthetic
ggagtcaaggaggaccaaacaaagttcttgaagataaaaactgtctcaagtgagctatcgtgcagggaaggccag

SEQ ID NO: 294449 - DNA, 75 bp, Artificial Sequence
  Synthetic
tcttgaagataaaaactgtctcaagtgagctatcgtgcagggaaggccagagctattggactggatcctttagtc

SEQ ID NO: 294450 - DNA, 75 bp, Artificial Sequence
  Synthetic
atgtacaacatcgttgagttcaccacctttaggggagatgaaagaggtgcattccaggctgccatgactaaactc

SEQ ID NO: 294451 - DNA, 75 bp, Artificial Sequence
  Synthetic
tgagctatcgtgcagggaaggccagagctattggactggatcctttagtcccaaatgtctgagctcaaggagatg

SEQ ID NO: 294452 - DNA, 75 bp, Artificial Sequence
  Synthetic
agaagacaaccttagggacctcaatgaccacaagtcaactattcagctgcctccctggctgtcctatcacgatgt

SEQ ID NO: 294453 - DNA, 75 bp, Artificial Sequence
  Synthetic
ttgacaggttgctattcctgcaatgcaggggccagagtctgcctgtctatcacatccacaggaactggaactctt

SEQ ID NO: 294454 - DNA, 75 bp, Artificial Sequence
  Synthetic
aataggtgtctgtcttggagggacaatgaaacttcagcagagttttcatttgttggggaaagcacgactatgcga

SEQ ID NO: 294455 - DNA, 75 bp, Artificial Sequence
  Synthetic
ccttatctcatacaagcccatgatagatcagttggagtgcacaacaaatctgattgatccctttgttgtctttga

SEQ ID NO: 294456 - DNA, 75 bp, Artificial Sequence
  Synthetic
gagaataaatgttttgagcagtgtgggggatggggatgtgggtgcttcaatgtgaacccatcttgcttgtttgtg

SEQ ID NO: 294457 - DNA, 75 bp, Artificial Sequence
  Synthetic
cacacgtatctgcagtcagttagaaaagaggcccttagagtttttaactgtatcgattgggtgcataaactcact

SEQ ID NO: 294458 - DNA, 75 bp, Artificial Sequence
  Synthetic
attcagcaagctcagtgcactctccattacatgctgatgggcatgggagtgtctgagctattcttagaatataag

SEQ ID NO: 294459 - DNA, 75 bp, Artificial Sequence
  Synthetic
gacataagcaaacctgattatgtaaatattgtacagataggctaaactattgagatatccaagtttagaaacttt

SEQ ID NO: 294460 - DNA, 75 bp, Artificial Sequence
  Synthetic
aatgataaaacttttgcagcttcaaaaggaaataggggtgttcaagctttctctaagggctctgtacaagctgat

SEQ ID NO: 294461 - DNA, 75 bp, Artificial Sequence
  Synthetic
atattgtacagataggtcaaattattgggatatccaagcttagaaacttatgcaataatacattagatgtaagct

SEQ ID NO: 294462 - DNA, 75 bp, Artificial Sequence
  Synthetic
aaggaaataggggtgttcaagctttctctaagggctctgtacaagctgatttaactctgatgtttgacaattttg

SEQ ID NO: 294463 - DNA, 75 bp, Artificial Sequence
  Synthetic
aggtggactttgtgggagcagccgtgtcttgtgatgccgctttcttaaatctgacaggttgttattcttgtaatg

SEQ ID NO: 294464 - DNA, 75 bp, Artificial Sequence
  Synthetic
ttaactctgatgtttgacaattttgaggtggactttgtgggagcagccgtgtcttgtgatgccgctttcttaaat

SEQ ID NO: 294465 - DNA, 75 bp, Artificial Sequence
  Synthetic
caggggccagagtctgcctgtctatcacatccacaggaactggaactctctctgcccacaataaggatgggtctc

SEQ ID NO: 294466 - DNA, 75 bp, Artificial Sequence
  Synthetic
tagttggcgtgattgtcttttgccagattagctgaaaattaaactaactctttgaggttgcaccggtctttgtgt

SEQ ID NO: 294467 - DNA, 75 bp, Artificial Sequence
  Synthetic
tctgcccacaataaggatgggtctctgcatatagttcttccatcagagaatggaacaaaagatcagtgtcagata

SEQ ID NO: 294468 - DNA, 75 bp, Artificial Sequence
  Synthetic
ctacacttcactgtacctgaggtagaggaggagtttatgtactcttgtgatggagatgagcggcctctgttggtg

SEQ ID NO: 294469 - DNA, 75 bp, Artificial Sequence
  Synthetic
agctgcaagattaccaatgatctagaagactcctttgttggcttacacaggatgatagtgaccgaggctatcctc

SEQ ID NO: 294470 - DNA, 75 bp, Artificial Sequence
  Synthetic
ataggtctgatgatattagaagggaccagattgctactctagcaatgaggagctgcaagattaccaatgatctgg

SEQ ID NO: 294471 - DNA, 75 bp, Artificial Sequence
  Synthetic
gtttggagggcctcttaagactatactcctcatttgcctgtatgttgcattatcaattgggctctttttccttct

SEQ ID NO: 294472 - DNA, 75 bp, Artificial Sequence
  Synthetic
ctgcaggcagcaagagaggatatttctaatgctgtagttccaaactcagctctcattgctcttatggaggagagc

SEQ ID NO: 294473 - DNA, 75 bp, Artificial Sequence
  Synthetic
agaaggcctcataaatcagcacgtgtagaagcagtatgtagaaataaatagacacaagcaaacccaattatgtaa

SEQ ID NO: 294474 - DNA, 75 bp, Artificial Sequence
  Synthetic
ctaatgctgtagttccaaactcagctctcattgctcttatggaggagagcttgatgctgcgctcatcactcccta

SEQ ID NO: 294475 - DNA, 75 bp, Artificial Sequence
  Synthetic
tttgtttcttacaaactaagtaaacttactaacctctgcaagtgcgtttcgttgatggagtcctctttctcattc

SEQ ID NO: 294476 - DNA, 75 bp, Artificial Sequence
  Synthetic
aaattgtacagataagccagactattgggatatccaggtttagaaacttatacaatgatactttagatgtaagct

SEQ ID NO: 294477 - DNA, 75 bp, Artificial Sequence
  Synthetic
cgatggcaaagatctgtgccctcttcagggattagatgtgagaggggaccatcccatgtgcaacctgtggagaga

SEQ ID NO: 294478 - DNA, 75 bp, Artificial Sequence
  Synthetic
tacaatgatactttagatgtaagcttaatcacaatttggggtggtggggtgaggcagcagcagtctcaggttcat

SEQ ID NO: 294479 - DNA, 75 bp, Artificial Sequence
  Synthetic
tgattagagattaaggctgccccaccccccacccccaatcccgaccgtaaccccaaccaccccttttccccaaac

SEQ ID NO: 294480 - DNA, 75 bp, Artificial Sequence
  Synthetic
tagttggcgtgattgtcttttgccagattagctgggaattaaactaactctttgaagttgcaccggtctttgtgt

SEQ ID NO: 294481 - DNA, 75 bp, Artificial Sequence
  Synthetic
tgatatctgttgatttgcagagtggtcgtcgtgttgtgtcagtggagtacattagaggtgatggtcctcccagga

SEQ ID NO: 294482 - DNA, 75 bp, Artificial Sequence
  Synthetic
ttagattggcagcccagagaattcatcagccatccttatcagaaaggggcttcaatgagatcataacagagcact

SEQ ID NO: 294483 - DNA, 75 bp, Artificial Sequence
  Synthetic
atctgaaagaagccatatcctggcctcttggagaaccctccctggctttctttgacctgagctccactagagtgc

SEQ ID NO: 294484 - DNA, 75 bp, Artificial Sequence
  Synthetic
acaggaatgatgacattaggagggaccagattgccactctagcaatgaggagttgcaagatcaccaatgatcttg

SEQ ID NO: 294485 - DNA, 75 bp, Artificial Sequence
  Synthetic
tgtgtctttcgcaattaagcgctcttgctgggcctttgatctctccacttccagggttttcaaaccctacataga

SEQ ID NO: 294486 - DNA, 75 bp, Artificial Sequence
  Synthetic
gatgatagtgaccgaggctatcctcagagggattgacctgtgcctgttgccaggctttgacctcatgtatgaggt

SEQ ID NO: 294487 - DNA, 75 bp, Artificial Sequence
  Synthetic
tgctcatgttcagtgtgttcggctcctgcaggcagcaaaagaggacatttctaatgctgtagttccaaactcagc

SEQ ID NO: 294488 - DNA, 75 bp, Artificial Sequence
  Synthetic
atcaaatccttgataagcaaactctcggacccactgttcaatctcattgcggtccactgcttgagcagcaaactg

SEQ ID NO: 294489 - DNA, 75 bp, Artificial Sequence
  Synthetic
ctgcaggcagcaaaagaggacatttctaatgctgtagttccaaactcagccctcattgctcttatggaggagagc

SEQ ID NO: 294490 - DNA, 75 bp, Artificial Sequence
  Synthetic
aaagcagtgctaaagtggaatgaccctggcctaggtttcttcctgcttgataacccttatgcgtgcgggttggga

SEQ ID NO: 294491 - DNA, 75 bp, Artificial Sequence
  Synthetic
tgattagaggttaaggctgccccaccccccaccccccaatcccgaccgtaaccccaaccaccccttcccccaaac

SEQ ID NO: 294492 - DNA, 75 bp, Artificial Sequence
  Synthetic
cttaaaggaggcttgcaatcatgctaagctagtcttaaggagcctctacggacagaatttcatggagcagataga

SEQ ID NO: 294493 - DNA, 75 bp, Artificial Sequence
  Synthetic
acaggaatgatgacattagaagggatcagattgctactctagcaatgaggagctgcaagattaccaatgatctag

SEQ ID NO: 294494 - DNA, 75 bp, Artificial Sequence
  Synthetic
gaatccacaagcccaaaagctttcaagaattctctcctcttctcatggcttataaagttgctattcactgctgca

SEQ ID NO: 294495 - DNA, 75 bp, Artificial Sequence
  Synthetic
tataaagttgctattcactgctgcattcattggctgcgtgaacgttgcagcaacctcctcctttgttctacctcg

SEQ ID NO: 294496 - DNA, 75 bp, Artificial Sequence
  Synthetic
caacctcctcctttgttctacctcggaggtttgggttgatgacccgggagaactgcagcagatacagagagtgag

SEQ ID NO: 294497 - DNA, 75 bp, Artificial Sequence
  Synthetic
atagtgagagctataagctacagctaatctacagagtcctaagctcagtgtcaaacgttgagataaaggaatcag

SEQ ID NO: 294498 - DNA, 75 bp, Artificial Sequence
  Synthetic
atccatggtagtcccagtgacaggaagccactcactcaagacgaccaaagcctggcatgtccagccagccagggc

SEQ ID NO: 294499 - DNA, 75 bp, Artificial Sequence
  Synthetic
tcccagtcagccccaccatactgctttaagagttcgataaccctacgggcatcaaatccttgataagcaaactct

SEQ ID NO: 294500 - DNA, 75 bp, Artificial Sequence
  Synthetic
acacaaaggcgcccaatcatggattctatattatcaaaacagctggttgacaagactggctttgttagagtgcca

SEQ ID NO: 294501 - DNA, 75 bp, Artificial Sequence
  Synthetic
gagtgtctctaagctccacaagagaagaaacctgttttggtgactccaccaacccagagatgattgaaggagctt

SEQ ID NO: 294502 - DNA, 75 bp, Artificial Sequence
  Synthetic
gggattcactcagagaggaggagatgccagaagagctctcctgttccatatcaggcataagagaggttaagacct

SEQ ID NO: 294503 - DNA, 75 bp, Artificial Sequence
  Synthetic
cataaagggtcctcctcacaaaaagcgggtggggatagttcggtgtgagagacgaagagatgctaagcaaatagg

SEQ ID NO: 294504 - DNA, 75 bp, Artificial Sequence
  Synthetic
atgacagtccttccagccttagcagtttttgctttggcacctgttgtttttgctgaagaccctcatctcagaaac

SEQ ID NO: 294505 - DNA, 75 bp, Artificial Sequence
  Synthetic
tttttgctttggcacctgttgtttttgctgaagaccctcatctcagaaacagaccagggaaggggcacaactaca

SEQ ID NO: 294506 - DNA, 75 bp, Artificial Sequence
  Synthetic
cacatgtaaacctgtgacatatgctggggcatgtagcagttttgatgtcttgctcgaaaagggaaaattccccct

SEQ ID NO: 294507 - DNA, 75 bp, Artificial Sequence
  Synthetic
cacactccactgaataaccatattcaagttaggaatttctttgctagaatggaaagcaagcctagaacggtcaga

SEQ ID NO: 294508 - DNA, 75 bp, Artificial Sequence
  Synthetic
acagatctcagggcaggactgttgttctttatgttgttagcgcctaccggcatggtgtttggtctaacttggaac

SEQ ID NO: 294509 - DNA, 75 bp, Artificial Sequence
  Synthetic
agtgtgatggatgagctaaggaccttgttcccagaactgtcatccacagatgaggaactagggaagactgagaga

SEQ ID NO: 294510 - DNA, 75 bp, Artificial Sequence
  Synthetic
tgttcccagaactgtcatccacagatgaggaactagggaagactgagagagagttgctagccatggtctcctcca

SEQ ID NO: 294511 - DNA, 75 bp, Artificial Sequence
  Synthetic
tgaggaactagggaagactgagagagagttgctagccatggtctcctccatccaaataaattggtcagtcacaga

SEQ ID NO: 294512 - DNA, 75 bp, Artificial Sequence
  Synthetic
tccaaataaattggtcagtcacagaatctgtgtttcctccctttagcagagaaatgtttgacagatttagatctt

SEQ ID NO: 294513 - DNA, 75 bp, Artificial Sequence
  Synthetic
ggtgatcacgttgtccccataattgaagagatgggagccggaacagtgggtggatttatcaagagacaacagtct

SEQ ID NO: 294514 - DNA, 75 bp, Artificial Sequence
  Synthetic
gttctgtcaatcaagtgaggatgatggatcaaaattaaaaacaaaaatgaaaggggtctgcgaagtgggggttca

SEQ ID NO: 294515 - DNA, 75 bp, Artificial Sequence
  Synthetic
gaggatagtgagcagatgcctcataaattctcaagagaaactcatcaataattctttctttgctgaagggaatga

SEQ ID NO: 294516 - DNA, 75 bp, Artificial Sequence
  Synthetic
gaaggtttatcttgacaagcttgacctcaagactgaggaaaatctgctaccagactcatttgtctgcttcgagca

SEQ ID NO: 294517 - DNA, 75 bp, Artificial Sequence
  Synthetic
gctgaggagtgctccttggcaatagagagagctttaaatcagtatagggcagaagacaaccttagggatcttaat

SEQ ID NO: 294518 - DNA, 75 bp, Artificial Sequence
  Synthetic
gggcagaagacatgggggtcacaaacaaccaggattattcctctaaatctagcagaggagccagatattggatgc

SEQ ID NO: 294519 - DNA, 75 bp, Artificial Sequence
  Synthetic
agaagacaaccttagggatcttaatgaccacaagtcaactatacagctgcctccctggttgtcctaccacgatgc

SEQ ID NO: 294520 - DNA, 75 bp, Artificial Sequence
  Synthetic
gcctccacagttgctttgccttcttttgacattttcatcatcatcctccggggcttgttgccacgagttagagcc

SEQ ID NO: 294521 - DNA, 75 bp, Artificial Sequence
  Synthetic
cgatggcaaagatctgtgcccccttcagggattagatgtgagaggggatcatcccatgtgcaacctatggagaga

SEQ ID NO: 294522 - DNA, 75 bp, Artificial Sequence
  Synthetic
tcaatacgccaatgcctattgttcacatgctaatgggtcaggaattgtacagatacaagtatccggggtctggaa

SEQ ID NO: 294523 - DNA, 75 bp, Artificial Sequence
  Synthetic
gagattgagaggatgcacgatgatgcagcagcagaacttgagtttgccctttcaggggtgaaggacaggccagat

SEQ ID NO: 294524 - DNA, 75 bp, Artificial Sequence
  Synthetic
cagcagcagaacttgagtttgccctttcaggggtgaaggacaggccagatgagagaaacagataccatagagttc

SEQ ID NO: 294525 - DNA, 75 bp, Artificial Sequence
  Synthetic
atctgaatatggacccagatgatagtgtctatatagctgccttaggggttaatggaaagaagcacaaagcagata

SEQ ID NO: 294526 - DNA, 75 bp, Artificial Sequence
  Synthetic
cgttagtgcaacaaatgagagacaggagtaaacagcccttctctccagatcatgatgtggatcacatatctgaat

SEQ ID NO: 294527 - DNA, 75 bp, Artificial Sequence
  Synthetic
gagtaaacagcccttctctccagatcatgatgtggatcacatatctgaatttctctctgcatgctctagtgactt

SEQ ID NO: 294528 - DNA, 75 bp, Artificial Sequence
  Synthetic
agaaagcttcatagatcagtacgtgtagaagcaatatatagaaaaaatatatagaaaaataagtaaatataagaa

SEQ ID NO: 294529 - DNA, 75 bp, Artificial Sequence
  Synthetic
gtgggcaacagatgaggacctgtacaaccctctttcttgtgataaagagcttagattagcagcccagagaatcca

SEQ ID NO: 294530 - DNA, 75 bp, Artificial Sequence
  Synthetic
ccgtgcctagtgcatggctgcatagtgtgtgctcatggcttgataaattaccagtgtcacactgctctcagtgcc

SEQ ID NO: 294531 - DNA, 75 bp, Artificial Sequence
  Synthetic
aatctaattatgtaaatattgtacagataggtcaaactattaggatacccaagtttagaatcttatacaatagta

SEQ ID NO: 294532 - DNA, 75 bp, Artificial Sequence
  Synthetic
ttcaatgagatcataacagagcactacaaatttatgggaagtaggataggttcatggtgccaaatggtcagtttg

SEQ ID NO: 294533 - DNA, 75 bp, Artificial Sequence
  Synthetic
aagtttagaatcttatacaatagtactttagatgtgagcttagttgtaatttggggtggtggggtgaggcagcag

SEQ ID NO: 294534 - DNA, 75 bp, Artificial Sequence
  Synthetic
atcaagtgaacagggaaataggatggatggaaggaggccagttggctctagggaaccctgcccctattcctcgtc

SEQ ID NO: 294535 - DNA, 75 bp, Artificial Sequence
  Synthetic
agagggattgacctgtgcctgttgccaggctttgacctcatgtatgaggttgctcacgttcagtgtgttcggctc

SEQ ID NO: 294536 - DNA, 75 bp, Artificial Sequence
  Synthetic
tagaggactctgaagcagaggagatggtttacaggtataggcttgctcttagtgtaatggatgagctgaggacct

SEQ ID NO: 294537 - DNA, 75 bp, Artificial Sequence
  Synthetic
tgattagaggttaaggctgccccaccccccaccccccaatcccgaccgtaaccccaactcccccttccccccaac

SEQ ID NO: 294538 - DNA, 75 bp, Artificial Sequence
  Synthetic
tttgtttcttacaagctaagtaagcttactaacctctgcaagtgtgtttcattaatggagtcctctttctcattt

SEQ ID NO: 294539 - DNA, 75 bp, Artificial Sequence
  Synthetic
atgcagaactatccagagaatagcaggtgagcccttcattcttaagaagaaggatgggtctatatcctggggtgg

SEQ ID NO: 294540 - DNA, 75 bp, Artificial Sequence
  Synthetic
cacacgtatctgcagtcggttagaaaagaggcccttagagttttcaactgtattgattgggtgcataaactcact

SEQ ID NO: 294541 - DNA, 75 bp, Artificial Sequence
  Synthetic
ggtgagcccttcattcttaagaagaaggatgggtctatatcctggggtggcatgtttaatcctttttcagggcgt

SEQ ID NO: 294542 - DNA, 75 bp, Artificial Sequence
  Synthetic
tagaccacagtcagatgccttcttgggttataaagatccagaactgcctagaatgcatgagttcagtgtttccta

SEQ ID NO: 294543 - DNA, 75 bp, Artificial Sequence
  Synthetic
gatcagttggagtgcacaacaaatctgattgatccctttgttgtctttgagaggggttctctgccacagacaagg

SEQ ID NO: 294544 - DNA, 75 bp, Artificial Sequence
  Synthetic
gttcttgggagagatcaggtgcaattcagaatcttcagtcctgagtgctcatgaatcatgccttagggcaccaaa

SEQ ID NO: 294545 - DNA, 75 bp, Artificial Sequence
  Synthetic
cccccaccccccaatcccgaccgtaaccccaaccaccccccttcccccaaacccctgggcagccgcttaggctgc

SEQ ID NO: 294546 - DNA, 75 bp, Artificial Sequence
  Synthetic
aagctagtcttaaggagtctctatggacagaatttcatggagcaaatagacaaccagattattcgagagctcagt

SEQ ID NO: 294547 - DNA, 75 bp, Artificial Sequence
  Synthetic
gggttgactctagaaagactagccacactcaaggccacgagcaacttcaacgagaattggtatgtctataaggat

SEQ ID NO: 294548 - DNA, 75 bp, Artificial Sequence
  Synthetic
atatgcctctgagggaaagagcctagctattcagaaatttgaggattgcatgaggcagatagaatcacaaggatg

SEQ ID NO: 294549 - DNA, 75 bp, Artificial Sequence
  Synthetic
agattcaagtatcaggggtctggaagaaacctttatgtgtggggtatgagagagtggttgtgaagagagaactct

SEQ ID NO: 294550 - DNA, 75 bp, Artificial Sequence
  Synthetic
aattgttcaatcggtggtggagacaatagccaggtctatagggaagttctttgcttctgataccctctgtaaccc

SEQ ID NO: 294551 - DNA, 75 bp, Artificial Sequence
  Synthetic
atagccaggtctatagggaagttctttgcttctgataccctctgtaacccccccaataaggtgaaaattcctgag

SEQ ID NO: 294552 - DNA, 75 bp, Artificial Sequence
  Synthetic
tctatgtgatgggtgcagaggaaagaattgttcaatcggtggtggagacaatagccaggtctatagggaagttct

SEQ ID NO: 294553 - DNA, 75 bp, Artificial Sequence
  Synthetic
acacatggcattagggctcggaagcaatgtaaggggcctgtgtggacttgtgcaacatcagatgatgcaaggaag

SEQ ID NO: 294554 - DNA, 75 bp, Artificial Sequence
  Synthetic
actggttttctggacttatgagttggtttggagggcctcttaagaccatactcctaatttgcctgtatgtggcat

SEQ ID NO: 294555 - DNA, 75 bp, Artificial Sequence
  Synthetic
catcgggagcttgatattagagatgactttgtgatggatctcttcaaagcttatcatggtgaggcagaagttcca

SEQ ID NO: 294556 - DNA, 75 bp, Artificial Sequence
  Synthetic
ttatcatggtgaggcagaagttccatgggcctttaagggcaaaacatatttggaaaccacaacagggatgatgca

SEQ ID NO: 294557 - DNA, 75 bp, Artificial Sequence
  Synthetic
tacaatagtactttagatgtaagcttagttgtaatttggggtggtggggtgaggcagcagcagtctcaagtactt

SEQ ID NO: 294558 - DNA, 75 bp, Artificial Sequence
  Synthetic
ctattacacaccattcatcaagaatacatccggtctttgtcctttaagatatttaatctgaaggttgctcctgag

SEQ ID NO: 294559 - DNA, 75 bp, Artificial Sequence
  Synthetic
ttgacaggttgctattcttgcaatgcaggggccagagtctgcctgtctatcacatccacaggaactgggactctc

SEQ ID NO: 294560 - DNA, 75 bp, Artificial Sequence
  Synthetic
catgctaatcagcttcccagctgatgacgagaaggttctcaccagatgcaaagtggccgcagccatatgcttccg

SEQ ID NO: 294561 - DNA, 75 bp, Artificial Sequence
  Synthetic
catgaagaaggagctgggagtgtaccttgccatttacccctcagagaagtccacagcaaacacagattttgtgat

SEQ ID NO: 294562 - DNA, 75 bp, Artificial Sequence
  Synthetic
tctaaaatgtggcttgctgctactaagaaggcctcatagatcagtacgtgtaggagcaatatgtagaaataagta

SEQ ID NO: 294563 - DNA, 75 bp, Artificial Sequence
  Synthetic
cacacccagcatgttaggccgacaattagatggattgcagcatgttgcagcctgccagaagtggaaacactagta

SEQ ID NO: 294564 - DNA, 75 bp, Artificial Sequence
  Synthetic
ttggaggattccaagtacagcttgctacagaagatggccgcatattctggctttcatggtttcaatgacatggag

SEQ ID NO: 294565 - DNA, 75 bp, Artificial Sequence
  Synthetic
atattgtacagacaggtcaaatcattgggatttccaagcttagaaacttatgcaataatacattaggtgtaagct

SEQ ID NO: 294566 - DNA, 75 bp, Artificial Sequence
  Synthetic
atccagcaagctcagtgcactctccattacatgctaatgggcatgggagtgtctgagctatttctagagtataag

SEQ ID NO: 294567 - DNA, 75 bp, Artificial Sequence
  Synthetic
agctgacaagactgacagactgttaatgcgtgagtttcccatgatgaatgacgggtttgatcatttaagccctga

SEQ ID NO: 294568 - DNA, 75 bp, Artificial Sequence
  Synthetic
tgattagaggttaaggctgccccaccccccaccccccaatcccgaccgtaaccccaaccacccctttcccccaaa

SEQ ID NO: 294569 - DNA, 75 bp, Artificial Sequence
  Synthetic
accccaaccacccctttcccccaaacccctgggcagccacttaggctgctgtcttgtacgcctgagcagctgcca

SEQ ID NO: 294570 - DNA, 75 bp, Artificial Sequence
  Synthetic
cccctgggcagccacttaggctgctgtcttgtacgcctgagcagctgccatgacagccgctgacggcttcccatt

SEQ ID NO: 294571 - DNA, 75 bp, Artificial Sequence
  Synthetic
ctggcctgggtttcttcctgcttgacaatccttatgcgtgcgggctgggaggttttaggtttaatctctttaagg

SEQ ID NO: 294572 - DNA, 75 bp, Artificial Sequence
  Synthetic
gctatatgctttcttcatgaagaaggtcaagggctcagctgcaagggattgggcagatgaggatgtcactatccc

SEQ ID NO: 294573 - DNA, 75 bp, Artificial Sequence
  Synthetic
ggcgctctaattcttagctcctctctaaagtggggatctaggaagaagtttcagaaactgagagaccgtttgaac

SEQ ID NO: 294574 - DNA, 75 bp, Artificial Sequence
  Synthetic
ctccctggctgtcttatcacgatgttgatggcaaagacctatgccctcttcagggattagatataagaggggacc

SEQ ID NO: 294575 - DNA, 75 bp, Artificial Sequence
  Synthetic
taaagtggggatctaggaagaagtttcagaaactgagagaccgtttgaacataccagagaactggattgaactaa

SEQ ID NO: 294576 - DNA, 75 bp, Artificial Sequence
  Synthetic
tcttatcagcaacaatttttgaagacactggacgtcctgagttcaacttcttagaggattccaagtacagcttgc

SEQ ID NO: 294577 - DNA, 75 bp, Artificial Sequence
  Synthetic
ttagaggattccaagtacagcttgctgcaaaagatggccgcatattctggctttcatggtttcaatgatatggag

SEQ ID NO: 294578 - DNA, 75 bp, Artificial Sequence
  Synthetic
ctatattatcaaaacagctggttgacaagactggttttgttagagtgccaatcaagcattatgactgtacaatgc

SEQ ID NO: 294579 - DNA, 75 bp, Artificial Sequence
  Synthetic
atatcagggatgcaacccaaaccagggtcactatctttaatgagcaaaagaccctccgtacatctccagagaagt

SEQ ID NO: 294580 - DNA, 75 bp, Artificial Sequence
  Synthetic
tctaaaatgtggcttgctgctactaagaaggcctcatagactagtacgtgtggaagcaatatgtagagataagta

SEQ ID NO: 294581 - DNA, 75 bp, Artificial Sequence
  Synthetic
atgcgtgagtttcccatgatgaatgacgggtttgatcatttgagccctgacatgatcatcaaaactacatctggc

SEQ ID NO: 294582 - DNA, 75 bp, Artificial Sequence
  Synthetic
ataacaggagctcctgtaaagaagaggtcaggggttagtaagatagctatggttatccgtgacaatttctcccgg

SEQ ID NO: 294583 - DNA, 75 bp, Artificial Sequence
  Synthetic
acagatctcagggcaggactgttgttctttatgttgttagcgcctatcggcatggtgtttggtctaatttggagc

SEQ ID NO: 294584 - DNA, 75 bp, Artificial Sequence
  Synthetic
tctttatgttgttagcgcctatcggcatggtgtttggtctaatttggagctagaggactctgaagcagaggagat

SEQ ID NO: 294585 - DNA, 75 bp, Artificial Sequence
  Synthetic
gtcagctgaaatcctcaagcactttctgttctgtatactacagggtccatatagtgagagctataagctacagct

SEQ ID NO: 294586 - DNA, 75 bp, Artificial Sequence
  Synthetic
tagaggactctgaagcagaggagatggtttataggtatagacttgctctcagtgtaatggatgagctaaggacct

SEQ ID NO: 294587 - DNA, 75 bp, Artificial Sequence
  Synthetic
ggtgatcacgttgttcccataattgaggagatgggagccggaacagtgggtggtttcatcaagagacaacagtct

SEQ ID NO: 294588 - DNA, 75 bp, Artificial Sequence
  Synthetic
gaaatgtttgacaggtttagatcttctcctcccgactcagagtatatcacgaggatagtgagcagatgcctcata

SEQ ID NO: 294589 - DNA, 75 bp, Artificial Sequence
  Synthetic
cttgagatagagaatgacataggacagcccccaaggcttaggaatgtcacaaccaactgtcagagcagcccttgg

SEQ ID NO: 294590 - DNA, 75 bp, Artificial Sequence
  Synthetic
taaagttctgagattttcaaaaaacgctgaggagtgttccttggcaatagagagagctttaaatcagtatagggc

SEQ ID NO: 294591 - DNA, 75 bp, Artificial Sequence
  Synthetic
gctgaggagtgttccttggcaatagagagagctttaaatcagtatagggcagaagacaaccttagggacctcaat

SEQ ID NO: 294592 - DNA, 75 bp, Artificial Sequence
  Synthetic
ctccctggctgtcctatcacgatgttgatggcaaagatctatgccctcttcaaggactagatgtgagaggggacc

SEQ ID NO: 294593 - DNA, 75 bp, Artificial Sequence
  Synthetic
atgatagaagatgccaagaacaatgcatttagtcatgtcgttaattgcatagagttggatgttagtggtccttac

SEQ ID NO: 294594 - DNA, 75 bp, Artificial Sequence
  Synthetic
tcatcagactaagaaaagaggaggtggagatgaaagtacggggctctactctcaacttgtacactaagcaccatt

SEQ ID NO: 294595 - DNA, 75 bp, Artificial Sequence
  Synthetic
acctgaatgtggacttagatgatagtgtctacatagctgctttgggagttaatgggaaaaagcataaagcagata

SEQ ID NO: 294596 - DNA, 75 bp, Artificial Sequence
  Synthetic
ttctctctgcatgctctagtgacttatgggcaacagatgaagacctgtacaaccctctttcttgtgacaaggagc

SEQ ID NO: 294597 - DNA, 75 bp, Artificial Sequence
  Synthetic
cagataaaaggaattaatagaaccagactctcagagattgtgagaatttgttctgaatcttccctaagatcaaag

SEQ ID NO: 294598 - DNA, 75 bp, Artificial Sequence
  Synthetic
ttttgtgattaaacgactactaggttctgggattttcttactgattaagcccacttccagcaaaagccatatatt

SEQ ID NO: 294599 - DNA, 75 bp, Artificial Sequence
  Synthetic
gacataagcaaaccaaattatgtaaatattgtacagataggtcaaattattgggatatccaagcttagaaactta

SEQ ID NO: 294600 - DNA, 75 bp, Artificial Sequence
  Synthetic
tgctggggatctgttagttactgactttgtttcttacaaactaagtaagcttactaacctctgcaagtgcgtttc

SEQ ID NO: 294601 - DNA, 75 bp, Artificial Sequence
  Synthetic
gagatggagtcttttgatacatctgatgtcaacctctttgggccagcccattacaaggacatcagttcattatcc

SEQ ID NO: 294602 - DNA, 75 bp, Artificial Sequence
  Synthetic
ttacaaggacatcagttcattatccatgattgctcaccccttaatggacaagtttgttgattatgctatttctaa

SEQ ID NO: 294603 - DNA, 75 bp, Artificial Sequence
  Synthetic
gatggggagagcctcagttaggaaagttctagagacaggtcggtgctccagcaaagattatgatttatcaaaggt

SEQ ID NO: 294604 - DNA, 75 bp, Artificial Sequence
  Synthetic
tttcccaaagttctcaggtcagagctgcaggtttacttattaaactgcttatgcagaactatccagagaatagca

SEQ ID NO: 294605 - DNA, 75 bp, Artificial Sequence
  Synthetic
gatactatgctagcattggaatccatgtgggttctgatactagcatagtgctacaatattgggcggtctttgtgt

SEQ ID NO: 294606 - DNA, 75 bp, Artificial Sequence
  Synthetic
acacaaagacggtgcattaaatgtatgttttattaacaattctaatctcggttctggtgtgtgaagcggttatta

SEQ ID NO: 294607 - DNA, 75 bp, Artificial Sequence
  Synthetic
tgttttattaacaattctaatctcggttctggtgtgtgaagcggttattagagtgtctctaagctccacaagaga

SEQ ID NO: 294608 - DNA, 75 bp, Artificial Sequence
  Synthetic
aacccagagatgattgaaggagcttgggattcactcagagaggaggagatgccagaggagctctcctgttctata

SEQ ID NO: 294609 - DNA, 75 bp, Artificial Sequence
  Synthetic
ggttataaagatccagaacttcctagaatgcatgagttcagtgtttcctacttgaaggaggcttgcaatcatgct

SEQ ID NO: 294610 - DNA, 75 bp, Artificial Sequence
  Synthetic
ttgaacaacatcacctgccatggtaaggatcctgaggacaagatttctctcataaagggtcctcctcacaaaaag

SEQ ID NO: 294611 - DNA, 75 bp, Artificial Sequence
  Synthetic
ccttcatccctttctgggatgtataagaaaattatagaacttgagcaccttagaccacagtcagatgccttcttg

SEQ ID NO: 294612 - DNA, 75 bp, Artificial Sequence
  Synthetic
tagaccacagtcagatgccttcttgggttataaagatccagaactgcctagaatgcatgagttcagtgtttctta

SEQ ID NO: 294613 - DNA, 75 bp, Artificial Sequence
  Synthetic
gtggcagacaagaactacacaagggataaattgttagtaaagatgtcaaaatatgcctctgagggaaagagccta

SEQ ID NO: 294614 - DNA, 75 bp, Artificial Sequence
  Synthetic
ttgacgggatgactcaggaggatgccacatgcaaacctgtgacatatgctggggcatgtagcagttttgatgtct

SEQ ID NO: 294615 - DNA, 75 bp, Artificial Sequence
  Synthetic
caacagcatggaggtctgagagagatctatgtgatgggtgcagaggaaagaattgttcaatcagtggtggagaca

SEQ ID NO: 294616 - DNA, 75 bp, Artificial Sequence
  Synthetic
cttccagtcgtatgctcatcatagaactctactagaggcagttcacgacaccatcattgcaaaggctgatccacc

SEQ ID NO: 294617 - DNA, 75 bp, Artificial Sequence
  Synthetic
ctcagcaccgcacatgaggttgtgccctttgcagtgttcaagaactcaaagaaggtttacctcgataagcttgac

SEQ ID NO: 294618 - DNA, 75 bp, Artificial Sequence
  Synthetic
ccatcattgcaaaggctgatccacctagctgtgaccttcagagtgctcatgggaatccctgcatgaaagagaaac

SEQ ID NO: 294619 - DNA, 75 bp, Artificial Sequence
  Synthetic
aaagttgtgcaaaacaaagtggtttattatggagttgggatctggagaggcttcatggatggatatcaggtccat

SEQ ID NO: 294620 - DNA, 75 bp, Artificial Sequence
  Synthetic
tagctgtgaccttcagagtgctcatgggaatccctgcatgaaagagaaactcgtgatgaagacacactgtccaaa

SEQ ID NO: 294621 - DNA, 75 bp, Artificial Sequence
  Synthetic
tcgtgatgaagacacactgtccaaatgactaccagtcagctcattacctcaacaatgacgggaaaatggcttcag

SEQ ID NO: 294622 - DNA, 75 bp, Artificial Sequence
  Synthetic
tgactaccagtcagctcattacctcaacaatgacgggaaaatggcttcagtcaagtgccctcctaagtatgagct

SEQ ID NO: 294623 - DNA, 75 bp, Artificial Sequence
  Synthetic
taagggacagtataaaggaacaatggactctggtcagactaagagggagctcaaaagctttgatatctctcagtg

SEQ ID NO: 294624 - DNA, 75 bp, Artificial Sequence
  Synthetic
tgggcctttaagggcaaaacatatttggaaaccacaacagggatgatgcaggggatattgcattatacttcctca

SEQ ID NO: 294625 - DNA, 75 bp, Artificial Sequence
  Synthetic
atggacaactatcaagagcttgcgatccagtttgctgctcaagcagtggaccgcaatgagattgaacagtgggtc

SEQ ID NO: 294626 - DNA, 75 bp, Artificial Sequence
  Synthetic
agcactcaaaaagtgtgatggccaactcagcactgcacatgaggttgtgccctttgcagtgtttaagaactcaaa

SEQ ID NO: 294627 - DNA, 75 bp, Artificial Sequence
  Synthetic
ctcagcactgcacatgaggttgtgccctttgcagtgtttaagaactcaaagaaggtttatcttgataagcttgac

SEQ ID NO: 294628 - DNA, 75 bp, Artificial Sequence
  Synthetic
cgagagtttgcttatcaaggatttgatgcccgtagggttatcgaactcttaaagcagtatggtggggctgactgg

SEQ ID NO: 294629 - DNA, 75 bp, Artificial Sequence
  Synthetic
cctttgcagtgtttaagaactcaaagaaggtttatcttgataagcttgacctcaagactgaggagaatctgctac

SEQ ID NO: 294630 - DNA, 75 bp, Artificial Sequence
  Synthetic
gagaaggatgccaagaaaatgattgttctggctctgactcgtggcaacaagccccggaggatgatgatgaaaatg

SEQ ID NO: 294631 - DNA, 75 bp, Artificial Sequence
  Synthetic
ttctggctctgactcgtggcaacaagccccggaggatgatgatgaaaatgtcgaaagaaggcaaagcaactgtgg

SEQ ID NO: 294632 - DNA, 75 bp, Artificial Sequence
  Synthetic
aagattgccccaaggaaagttctgaatccactaatgtggatcacagccttcatcagatgggtgtataagaagatg

SEQ ID NO: 294633 - DNA, 75 bp, Artificial Sequence
  Synthetic
tcaaaagctttgatatctctcagtgccccaagattggaggacatggtagtaagaagtgcactggggacgcagcat

SEQ ID NO: 294634 - DNA, 75 bp, Artificial Sequence
  Synthetic
aggctctcatcaacaagtataagctaaaggaggggaatccttcccgggatgagttgactctatcacgagttgctg

SEQ ID NO: 294635 - DNA, 75 bp, Artificial Sequence
  Synthetic
gcccgccaagaagaggcctctaatctaatgacatcagttactgaggggggtgggtcattctctttagctgcaatg

SEQ ID NO: 294636 - DNA, 75 bp, Artificial Sequence
  Synthetic
aaaggaggggaatccttcccgggatgagttgactctatcacgagttgctgctgccctggctggctggacttgcca

SEQ ID NO: 294637 - DNA, 75 bp, Artificial Sequence
  Synthetic
ggctttggtcgtcttgagtgagtggcttcctgtcactgggaccaccatggatggcctatcccctgcatacccaag

SEQ ID NO: 294638 - DNA, 75 bp, Artificial Sequence
  Synthetic
cttcctgtcactgggaccaccatggatggcctatcccctgcatacccaaggcatatgatgcaccccagctttgct

SEQ ID NO: 294639 - DNA, 75 bp, Artificial Sequence
  Synthetic
ctggcctgggtttcttcctgcttgacaatccttatgcgtgtgggttgggaggttttagatttaatctcttcaagg

SEQ ID NO: 294640 - DNA, 75 bp, Artificial Sequence
  Synthetic
ggcatggtggacccttctctaccagaagactatctaagggcaatattggatgctcactctctgtatctgctgcag

SEQ ID NO: 294641 - DNA, 75 bp, Artificial Sequence
  Synthetic
gctatatgccttcttcatgaagaaggtcaagggctcagctgctagggactgggcagatgaagatatcaccattcc

SEQ ID NO: 294642 - DNA, 75 bp, Artificial Sequence
  Synthetic
ttctcccgggtcatcaacccaaacctccgaggtagaacaaaggaggaggttgccgcaacgttcacgcagccaatg

SEQ ID NO: 294643 - DNA, 75 bp, Artificial Sequence
  Synthetic
aatgcagcagtgaatagcaactttataagccatgagaagaggagagaattcttgaaagcttttgggcttgtggat

SEQ ID NO: 294644 - DNA, 75 bp, Artificial Sequence
  Synthetic
gggcttgtggattccaatgggaagccgtcagcagctgtcatggcagctgctcaggcgtacaagacagcagcctaa

SEQ ID NO: 294645 - DNA, 75 bp, Artificial Sequence
  Synthetic
ccagaagatatattattcctattcccgaacattgaggaattagaatcactggattctatagtttacaacaagggt

SEQ ID NO: 294646 - DNA, 75 bp, Artificial Sequence
  Synthetic
tttgttgttgtgtttgtgttcagttctattgcaataatttgtttagctattcttcatagggtgctcaagtgctta

SEQ ID NO: 294647 - DNA, 75 bp, Artificial Sequence
  Synthetic
atccactaatgtggattacagccttcatcagatgggtgtataagaagatggttgccagagtggcagacaatatta

SEQ ID NO: 294648 - DNA, 75 bp, Artificial Sequence
  Synthetic
catcagatgggtgtataagaagatggttgccagagtggcagacaatattaatcaagtgaacagggaaataggatg

SEQ ID NO: 294649 - DNA, 75 bp, Artificial Sequence
  Synthetic
gttgccagagtggcagacaatattaatcaagtgaacagggaaataggatggatggaaggaggtcagttggttcta

SEQ ID NO: 294650 - DNA, 75 bp, Artificial Sequence
  Synthetic
gatggaaggaggtcagttggttctagggaaccctgcccctattcctcgccatgccccaattccacgttatagcac

SEQ ID NO: 294651 - DNA, 75 bp, Artificial Sequence
  Synthetic
atgccccaattccacgttatagcacatacctaatgctactattgattgtctcatatgcatcagcatgttcagaac

SEQ ID NO: 294652 - DNA, 75 bp, Artificial Sequence
  Synthetic
atacctaatgctactattgattgtctcatatgcatcagcatgttcagaactgattcaggcaagctccagaatcac

SEQ ID NO: 294653 - DNA, 75 bp, Artificial Sequence
  Synthetic
tcatatgcatcagcatgttcagaactgattcaggcaagctccagaatcaccacttgctccacagagggtgtcaac

SEQ ID NO: 294654 - DNA, 75 bp, Artificial Sequence
  Synthetic
gacatgagcaaacctaattatgtaaatattgtacagataggtcaaattattgggatatctaagcttagaaacttc

SEQ ID NO: 294655 - DNA, 75 bp, Artificial Sequence
  Synthetic
cggcagcaactcgtgatagagtcaactcatcccgggaaggattcccctcctttagcttatacttgttgatgagag

SEQ ID NO: 294656 - DNA, 75 bp, Artificial Sequence
  Synthetic
gtgatgatgatggatttgttgaggttgattagaggttaaggctgccccaccccccacccccaatcccgaccgtaa

SEQ ID NO: 294657 - DNA, 75 bp, Artificial Sequence
  Synthetic
tcttaaagataaaaactgtctcaagtgagctatcgtgcagggagggccagagctattggactgggtcctttagcc

SEQ ID NO: 294658 - DNA, 75 bp, Artificial Sequence
  Synthetic
tgagctatcgtgcagggagggccagagctattggactgggtcctttagccctaaatgtctgagctcaaggagatg

SEQ ID NO: 294659 - DNA, 75 bp, Artificial Sequence
  Synthetic
acagatctcagggcaggactgttgttctttatgttgtcagcgcctatcggcatggtgtatggtccaatttggagc

SEQ ID NO: 294660 - DNA, 75 bp, Artificial Sequence
  Synthetic
tgtgaacccatcttgcttatttgtgcacacgtatctgcagtcagttagaaaagaggcccttagagtttttaactg

SEQ ID NO: 294661 - DNA, 75 bp, Artificial Sequence
  Synthetic
atgatcagtcagttagctccaaaatagtagctcactgccctccccaggacccgtgcctagtgcatggctgcatag

SEQ ID NO: 294662 - DNA, 75 bp, Artificial Sequence
  Synthetic
cacacgtatctgcagtcagttagaaaagaggcccttagagtttttaactgtatcgactgggtgcataaactcaca

SEQ ID NO: 294663 - DNA, 75 bp, Artificial Sequence
  Synthetic
agagagccttaaatcagtatagagcagaagacaaccttagggacctcaatgaccacaagtcaaccattcagctgc

SEQ ID NO: 294664 - DNA, 75 bp, Artificial Sequence
  Synthetic
agaagacaaccttagggacctcaatgaccacaagtcaaccattcagctgcctccctggttgtcctaccacgatgt

SEQ ID NO: 294665 - DNA, 75 bp, Artificial Sequence
  Synthetic
ctcaccaggacctacacattttatcttacactgcatcagacaatgatctcagtccaggcattttcaagtcaatat

SEQ ID NO: 294666 - DNA, 75 bp, Artificial Sequence
  Synthetic
aaaggatatgcaattgttgatgagccattctcagaaattcctcgacaagggttcctgggggagatcaggtgcaat

SEQ ID NO: 294667 - DNA, 75 bp, Artificial Sequence
  Synthetic
tcagagtcctcagtcctgagtgctcatgaatcatgccttagggcaccaaaccttatctcatacaagcccatgata

SEQ ID NO: 294668 - DNA, 75 bp, Artificial Sequence
  Synthetic
gtcggatctatgttctcatttgtcgccaatgtcgaggaggctcatgatgttgattatgatgcgttaatggatcta

SEQ ID NO: 294669 - DNA, 75 bp, Artificial Sequence
  Synthetic
ctctaagggctctgtacaagctgatctaactctgatgtttgacaattttgaggtggactttgtgggagcagccgt

SEQ ID NO: 294670 - DNA, 75 bp, Artificial Sequence
  Synthetic
ggcggatgacatgctaggctaagaccagtaagcaaagtcaggcttagatttagggatactatgctagtattggaa

SEQ ID NO: 294671 - DNA, 75 bp, Artificial Sequence
  Synthetic
aaggggaccctgatagctattgatccatttgatgataggcgggaagcagggggggaatcaacagttgtgaatcca

SEQ ID NO: 294672 - DNA, 75 bp, Artificial Sequence
  Synthetic
catttgatgataggcgggaagcagggggggaatcaacagttgtgaatccaaaatctggatcttggaatttctttg

SEQ ID NO: 294673 - DNA, 75 bp, Artificial Sequence
  Synthetic
acacaaagacggtgcattaaatgtatgttttactaacaattctgatcacggttctggtgtgtgaggcggttatta

SEQ ID NO: 294674 - DNA, 75 bp, Artificial Sequence
  Synthetic
tgttttactaacaattctgatcacggttctggtgtgtgaggcggttattagagtgtctctaagttccacaagaga

SEQ ID NO: 294675 - DNA, 75 bp, Artificial Sequence
  Synthetic
actggttttctggactcatgagttggtttggagggcctcttaaaactatactcctcatttgcctgtatgttgcat

SEQ ID NO: 294676 - DNA, 75 bp, Artificial Sequence
  Synthetic
caccagcaaagccttttcagagacttattgatctaataggccatatgactctcagtgatttcacaaggttcccca

SEQ ID NO: 294677 - DNA, 75 bp, Artificial Sequence
  Synthetic
ctcctcatttgcctgtatgttgcattatcaattgggctctttttcctcctcatatatcttggaagaacaggcctc

SEQ ID NO: 294678 - DNA, 75 bp, Artificial Sequence
  Synthetic
gccagaagagctctcctgttccatatcaggcataagggaggtcaaaacctcaagccaggaattgtatagggcatt

SEQ ID NO: 294679 - DNA, 75 bp, Artificial Sequence
  Synthetic
gatgcctcatacatgggcaaactttccctgttaacccttttggaggacaaagcaacaactgaagagttacagact

SEQ ID NO: 294680 - DNA, 75 bp, Artificial Sequence
  Synthetic
tctaaaatgtggcttgccgctactaagaaggcctcatagatcagtacgtgtagaagcaacatgtaaaaataagta

SEQ ID NO: 294681 - DNA, 75 bp, Artificial Sequence
  Synthetic
tagttggcgtaattgtcttttgccagattagctgggaattaaactaactctttgaagttgcaccggtctttgtgt

SEQ ID NO: 294682 - DNA, 75 bp, Artificial Sequence
  Synthetic
tgctcgaaaagggaaaattccccctcttccagtcgtatgcccatcacagaaccctactagaagcagttcacgaca

SEQ ID NO: 294683 - DNA, 75 bp, Artificial Sequence
  Synthetic
tattgatctaataggccatatgactcttagtgatttcacaaggttccccaatctgaaagaagccatatcctggcc

SEQ ID NO: 294684 - DNA, 75 bp, Artificial Sequence
  Synthetic
gatcaacagggttcaagatatcatctgcagttgcttgtgctagcggggtttgcgtcacaggatcgcagagtcctt

SEQ ID NO: 294685 - DNA, 75 bp, Artificial Sequence
  Synthetic
atctgaaagaagccatatcctggcctcttggagaaccctcactggctttctttgacctaagctctactagagtgc

SEQ ID NO: 294686 - DNA, 75 bp, Artificial Sequence
  Synthetic
tttgacctaagctctactagagtgcacaggaatgatgacattagaagggatcagattgccactctagcaatgagg

SEQ ID NO: 294687 - DNA, 75 bp, Artificial Sequence
  Synthetic
tcagattgccactctagcaatgaggagctgcaagattaccaatgatctagaggactcctttgttggcttacacag

SEQ ID NO: 294688 - DNA, 75 bp, Artificial Sequence
  Synthetic
cactgaggactgcaatttttgcaggcagatgacaggtgctagcttgaagaaggggtcttatcctcttcaggactt

SEQ ID NO: 294689 - DNA, 75 bp, Artificial Sequence
  Synthetic
ctgatgctgcgctcatcacttcctagcatgatggggagaaacaactggattccagttgttcctccaatcccagat

SEQ ID NO: 294690 - DNA, 75 bp, Artificial Sequence
  Synthetic
gcatgatggggagaaacaactggattccagttgttcctccaatcccagatgttgagatggaatcagaggaagaga

SEQ ID NO: 294691 - DNA, 75 bp, Artificial Sequence
  Synthetic
cctttgcagtatttaagaactcaaagaaggtttatcttgataagcttgacctcaagactgaggaaaatctgttgc

SEQ ID NO: 294692 - DNA, 75 bp, Artificial Sequence
  Synthetic
accccaacccccttttcccccaaccccctgggcagccacttaggctgctgtcttgtaagcctgagcagctgccat

SEQ ID NO: 294693 - DNA, 75 bp, Artificial Sequence
  Synthetic
agatacaagtatccggggtctggaagaagcctttgtgtgtcgggtatgagagggtggttgtgaagagagaactct

SEQ ID NO: 294694 - DNA, 75 bp, Artificial Sequence
  Synthetic
ttcattggctgcgtgaacgttgcagcaacctcctcctttgttctgcctcggaggtttgggttgatgacccgggag

SEQ ID NO: 294695 - DNA, 75 bp, Artificial Sequence
  Synthetic
ttctggtagagaagggtccaccatgccagcaaagctggggtgcatcatatgccttgggtatgcaggggataggcc

SEQ ID NO: 294696 - DNA, 75 bp, Artificial Sequence
  Synthetic
ccagcaaagctggggtgcatcatatgccttgggtatgcaggggataggccatccatggtagtcccagtgacagga

SEQ ID NO: 294697 - DNA, 75 bp, Artificial Sequence
  Synthetic
gccttgggtatgcaggggataggccatccatggtagtcccagtgacaggaagccactcactcaagacgaccagag

SEQ ID NO: 294698 - DNA, 75 bp, Artificial Sequence
  Synthetic
agggatatcccagtcctctgggggggacataggggttcacatggcacatgatgatcagtcagttagctccaaaat

SEQ ID NO: 294699 - DNA, 75 bp, Artificial Sequence
  Synthetic
tctgcccacaataaggatgggtctctgcatatagttctcccatcagagaatgggacaaaagatcagtgtcagata

SEQ ID NO: 294700 - DNA, 75 bp, Artificial Sequence
  Synthetic
agccactcactcaagacgaccagagcctggcatgtccagccagccagggcggcagcaactcgtgatagagtcaac

SEQ ID NO: 294701 - DNA, 75 bp, Artificial Sequence
  Synthetic
tttgttgttgtgttcgtatttagctctgtcgcaataatttgtttggccattctttataaagttctcaagtgccta

SEQ ID NO: 294702 - DNA, 75 bp, Artificial Sequence
  Synthetic
ctgtcgcaataatttgtttggccattctttataaagttctcaagtgcctaaagattgccccaaggaaagttctgg

SEQ ID NO: 294703 - DNA, 75 bp, Artificial Sequence
  Synthetic
gacataagcaaacctaattatgtaaatattgtacagataggtcaaattattgggatatccaagcttagaaactta

SEQ ID NO: 294704 - DNA, 75 bp, Artificial Sequence
  Synthetic
tgggatatccaagcttagaaacttatgcaataatactttagatgtaagcttagttgtaatttggggtggtggggt

SEQ ID NO: 294705 - DNA, 75 bp, Artificial Sequence
  Synthetic
tgcaataatactttagatgtaagcttagttgtaatttggggtggtggggtgaggcagcagcagtctcaagtgctc

SEQ ID NO: 294706 - DNA, 75 bp, Artificial Sequence
  Synthetic
atcaggtgaacagggaaataggatggatggaaggaggccagctggctctagggaaccctgcccctattcctcgtc

SEQ ID NO: 294707 - DNA, 75 bp, Artificial Sequence
  Synthetic
taactctggcacttccaacatttgatgtttctaagatggtagatagaattaccatagacttcaatctggatgata

SEQ ID NO: 294708 - DNA, 75 bp, Artificial Sequence
  Synthetic
tgattcaggcaagctccagaatcaccacttgctccacagaaggtgtcaacaccaagtgtaggctgtctggcacag

SEQ ID NO: 294709 - DNA, 75 bp, Artificial Sequence
  Synthetic
accatagacttcaatctggatgatatacaaggagcatctgaaataggctcaactttgctaccctccatgtcgata

SEQ ID NO: 294710 - DNA, 75 bp, Artificial Sequence
  Synthetic
tacaaggagcatctgaaataggctcaactttgctaccctccatgtcgatagatgtggaagatatggctaattttg

SEQ ID NO: 294711 - DNA, 75 bp, Artificial Sequence
  Synthetic
aataggtgtctgtcttggagagacaatgaaacctcagcagaattttcatttgttggggaaagcacgaccatgcgg

SEQ ID NO: 294712 - DNA, 75 bp, Artificial Sequence
  Synthetic
catgatcattaaaactacatctggcatgtacaacatcgttgagttcaccacctttaggggagatgaaagaggtgc

SEQ ID NO: 294713 - DNA, 75 bp, Artificial Sequence
  Synthetic
gatgatagtgactgaggccatcctcagagggattgacctgtgcctgttgccaggctttgacctcatgtatgaggt

SEQ ID NO: 294714 - DNA, 75 bp, Artificial Sequence
  Synthetic
tgtctacatagctgctttaggagttaatggaaagaagcacaaagcagacactttagtgcaacaaatgagagacag

SEQ ID NO: 294715 - DNA, 75 bp, Artificial Sequence
  Synthetic
ctagagattactgactttgatggctctgtttcaacaatagacctgggagcatcatctagccgtttcacaaactgg

SEQ ID NO: 294716 - DNA, 75 bp, Artificial Sequence
  Synthetic
tattcccagaactgtcatccacagatgaggaactagggaagactgagagagagttgctagccatggtctcctcca

SEQ ID NO: 294717 - DNA, 75 bp, Artificial Sequence
  Synthetic
tccaaataaattggtcagtcacagaatctgtgtttccaccctttagcagagaaatgtttgacaggtttagatcct

SEQ ID NO: 294718 - DNA, 75 bp, Artificial Sequence
  Synthetic
gttcttgggggagatcaggtgcaattcagaatcttcagtcctgagtgctcatgaatcatgccttagggcaccaaa

SEQ ID NO: 294719 - DNA, 75 bp, Artificial Sequence
  Synthetic
cattctcagaaattcctcggcaagggttcttgggggagatcaggtgcaattcagaatcttcagtcctgagtgctc

SEQ ID NO: 294720 - DNA, 75 bp, Artificial Sequence
  Synthetic
tcagaatcttcagtcctgagtgctcatgaatcatgccttagggcaccaaatcttatttcatacaagcccatgata

SEQ ID NO: 294721 - DNA, 75 bp, Artificial Sequence
  Synthetic
gaggatagtgagcagatgcctcataaattctcaagagaaactcatcaataattccttctttgctgaagggaatga

SEQ ID NO: 294722 - DNA, 75 bp, Artificial Sequence
  Synthetic
ggtgagcccttcattcttaagaagaaggatggatctatatcctggggtggcatgttcaatcctttttcagggcgt

SEQ ID NO: 294723 - DNA, 75 bp, Artificial Sequence
  Synthetic
caggctttgatctcatgtatgaggttgctcacgtacagtgcgttcggcttctgcaagcagcaaagaggacatttc

SEQ ID NO: 294724 - DNA, 75 bp, Artificial Sequence
  Synthetic
gaccacaagtcaactattcagctgcctccctggctgtcctaccacgatgtcgatggcaaagatctgtgccctctt

SEQ ID NO: 294725 - DNA, 75 bp, Artificial Sequence
  Synthetic
tgatgatgatggatttgttgaggttgattagaggttaaggctgccccaccccccaccccccaatcccgaccgtaa

SEQ ID NO: 294726 - DNA, 75 bp, Artificial Sequence
  Synthetic
cgatggcaaagatctgtgccctcttcagggattagatgtgagaggggaccatcccatgtgcaacctgtggaggga

SEQ ID NO: 294727 - DNA, 75 bp, Artificial Sequence
  Synthetic
ggcagcaactcgtgatagagtcaactcatctcgggaaggattcccttcctttagtttatatctgttgatgagagc

SEQ ID NO: 294728 - DNA, 75 bp, Artificial Sequence
  Synthetic
gaattctctcctcttctcatggcttataaagttgctattcactgctgcattcattggctgcgtgaacgttgcagc

SEQ ID NO: 294729 - DNA, 75 bp, Artificial Sequence
  Synthetic
aatggaaagaagcataaagcagacactttagtgcaacaaatgagagacagaagtaaacagcctttctccccagat

SEQ ID NO: 294730 - DNA, 75 bp, Artificial Sequence
  Synthetic
ctcctcatttgcctgtatgtagcattatcaattgggctctttttccttcttatatatcttggaagaacaggcctc

SEQ ID NO: 294731 - DNA, 75 bp, Artificial Sequence
  Synthetic
ttctctctgcatgctctagtgacttgtgggcaacagatgaggacctgtacaaccctctctcttgtgataaagagc

SEQ ID NO: 294732 - DNA, 75 bp, Artificial Sequence
  Synthetic
cccccaccccccaatcccgaccgtaaccccaacccccattttcccaacccccctgggcagtcacttaggctgctg

SEQ ID NO: 294733 - DNA, 75 bp, Artificial Sequence
  Synthetic
aaccctctctcttgtgataaagagcttagattggcagcccagaggattcatcagccatccttatcagaaaggggc

SEQ ID NO: 294734 - DNA, 75 bp, Artificial Sequence
  Synthetic
agaaagcctcatagatcagtacgtgtagaagcaatatatagaaataagtaaacataagcaaatctaattatgtaa

SEQ ID NO: 294735 - DNA, 75 bp, Artificial Sequence
  Synthetic
ttcatggtgccaaatggtcagtttgataggagctgagctatcagcttctgttaagcaacatgtcaagcctaacta

SEQ ID NO: 294736 - DNA, 75 bp, Artificial Sequence
  Synthetic
ataggagctgagctatcagcttctgttaagcaacatgtcaagcctaactattttgtgattaaacgactactaggt

SEQ ID NO: 294737 - DNA, 75 bp, Artificial Sequence
  Synthetic
tacaatagtactttagatgtaagcttagttgtaatttggggtggtggggtgaggcagcagtagtctcaagtacat

SEQ ID NO: 294738 - DNA, 75 bp, Artificial Sequence
  Synthetic
gtggatattctagttaatgtgaatgtcttttgccagattagctgggaattaaactaactctttgaagttgcaccg

SEQ ID NO: 294739 - DNA, 75 bp, Artificial Sequence
  Synthetic
tagttaatgtgaatgtcttttgccagattagctgggaattaaactaactctttgaagttgcaccggtctttgtgt

SEQ ID NO: 294740 - DNA, 75 bp, Artificial Sequence
  Synthetic
atcaagcattatgactgtacaatgctaactctggcactcccaacatttgatgtctccaagatggtagatagaatt

SEQ ID NO: 294741 - DNA, 75 bp, Artificial Sequence
  Synthetic
caggtcttcagactctgcagcaatggatgcctcatacatgggcaaactttctttattaacccttttggaagacaa

SEQ ID NO: 294742 - DNA, 75 bp, Artificial Sequence
  Synthetic
gatgcctcatacatgggcaaactttctttattaacccttttggaagacaaagcaacaactgaagagttacagact

SEQ ID NO: 294743 - DNA, 75 bp, Artificial Sequence
  Synthetic
attgcaagatatataatcatggagggctttgtctcgcccccagaaatcccaaaacctcacaagatgacctctaag

SEQ ID NO: 294744 - DNA, 75 bp, Artificial Sequence
  Synthetic
tttcccaaggttctcaggtcagagctgcaggtttacttattaaactgcttatgcagaactatccagagaatagca

SEQ ID NO: 294745 - DNA, 75 bp, Artificial Sequence
  Synthetic
ggtatataggtacagacttgcccttagtgtgatggatgagctaaggaccttgttcccagaactgtcatccacaga

SEQ ID NO: 294746 - DNA, 75 bp, Artificial Sequence
  Synthetic
cagcaaactggactcgaagctcttgatagttgtccattattgtaatagtgtttgtatctctagggagctttgtgt

SEQ ID NO: 294747 - DNA, 75 bp, Artificial Sequence
  Synthetic
gggttgactctagaaaggctagccacacttaaggccacaagcaactttaatgagaattggtatgtctataaggat

SEQ ID NO: 294748 - DNA, 75 bp, Artificial Sequence
  Synthetic
tgagaattggtatgtctataaggatgtggcagacaagaactacacaagggataaattgttagtgaagatgtcaaa

SEQ ID NO: 294749 - DNA, 75 bp, Artificial Sequence
  Synthetic
agaagacaaccttagggacctaaatgaccacaagtctactattcagctgcctccctggctgtcctatcacgatgc

SEQ ID NO: 294750 - DNA, 75 bp, Artificial Sequence
  Synthetic
ataaattgttagtgaagatgtcaaaatatgcctctgagggaaagagcctagctatccagaagtttgaggattgta

SEQ ID NO: 294751 - DNA, 75 bp, Artificial Sequence
  Synthetic
gctatccagaagtttgaggattgtatgaggcagatagagtcacaaggatgtatgcatatttgtttgtttaagaaa

SEQ ID NO: 294752 - DNA, 75 bp, Artificial Sequence
  Synthetic
aaatctggatcttggaatttctttgactggttttctggactcatgagttggtttggagggcctcttaaactatac

SEQ ID NO: 294753 - DNA, 75 bp, Artificial Sequence
  Synthetic
atatatcttggaagaacaggcctctctaaaatgtggcttgctgccactaagaaggcctcatagatcagtacgtgt

SEQ ID NO: 294754 - DNA, 75 bp, Artificial Sequence
  Synthetic
tggaaccaaggccattttgttacaaagtttgccctcatgctatgtgagttcacctctcctaaatggtggccactg

SEQ ID NO: 294755 - DNA, 75 bp, Artificial Sequence
  Synthetic
ccaggaaaaggatgatgatgaatttgaattatctcaagatcctggatggtcatcgggagcttgatattagagatg

SEQ ID NO: 294756 - DNA, 75 bp, Artificial Sequence
  Synthetic
actttgtgatggatctcttcaaagcttatcatggtgaggcagaagttccatgggcctttaaaggcaaaacatatt

SEQ ID NO: 294757 - DNA, 75 bp, Artificial Sequence
  Synthetic
gatggaaggaggccagttggttctagggaaccctgcccctattcctcgtcatgctccaattccacgttatagcac

SEQ ID NO: 294758 - DNA, 75 bp, Artificial Sequence
  Synthetic
tggaaaccacaacagggatgatgcagggaatattgcattatacttcctcactattacacaccattcatcaagaat

SEQ ID NO: 294759 - DNA, 75 bp, Artificial Sequence
  Synthetic
ttcaatgagattataacagagcactacagatttatgggaagtaggataggatcatggtgccaaatggtcagttta

SEQ ID NO: 294760 - DNA, 75 bp, Artificial Sequence
  Synthetic
acatccggtccttgtcctttaaaatattcaacctgaaggttgctcctgagatgagcaagagcctggtttgtgaca

SEQ ID NO: 294761 - DNA, 75 bp, Artificial Sequence
  Synthetic
attcaacctgaaggttgctcctgagatgagcaagagcctggtttgtgacatgatgcaaggatcagatgatagtag

SEQ ID NO: 294762 - DNA, 75 bp, Artificial Sequence
  Synthetic
cttgccatttacccctcagagaagtccacagcaaacacagattttgtgatggagtacaattctgaattttatttc

SEQ ID NO: 294763 - DNA, 75 bp, Artificial Sequence
  Synthetic
ggagtacaattctgaattttatttccacacccagcatgttagaccaacgatcaggtggattgcagcatgttgcag

SEQ ID NO: 294764 - DNA, 75 bp, Artificial Sequence
  Synthetic
gttaatggaatcctccttctcattttgggcagaggcatttgggattccaagctggaactttgttagtgacttgtt

SEQ ID NO: 294765 - DNA, 75 bp, Artificial Sequence
  Synthetic
gcccgccaggaagaggcctctaacctaatgacttcagttactgaggggggtgggtcattctccttagctgcaatg

SEQ ID NO: 294766 - DNA, 75 bp, Artificial Sequence
  Synthetic
taatgacttcagttactgaggggggtgggtcattctccttagctgcaatgattcagcaagctcagtgcactctcc

SEQ ID NO: 294767 - DNA, 75 bp, Artificial Sequence
  Synthetic
tattgattgggtgcataaactcactctagagatcacagactttgatggctctgtttcaacagtagacttgggagc

SEQ ID NO: 294768 - DNA, 75 bp, Artificial Sequence
  Synthetic
catgtttaatcctttttcagggcgtccactgcttgatatgcaaccactcatcagctgttgttacaatggttactt

SEQ ID NO: 294769 - DNA, 75 bp, Artificial Sequence
  Synthetic
aaggcagtgctgaagtggaatgaccctggcctgggtttcttcctgcttgacaatccttatgcgtgcgggttagga

SEQ ID NO: 294770 - DNA, 75 bp, Artificial Sequence
  Synthetic
ggttttagatttaatctcttcaaagctatcaccagaactgatttgcagaagctatatgctttcttcatgaagaag

SEQ ID NO: 294771 - DNA, 75 bp, Artificial Sequence
  Synthetic
gctatatgctttcttcatgaagaaggtcaagggctcagctgctagagactgggcagatgaagatatcaccatccc

SEQ ID NO: 294772 - DNA, 75 bp, Artificial Sequence
  Synthetic
gggcagatgaagatatcaccatcccagaaacgtgtagcgtgagcccaggtggcgctctaattcttagctcctctc

SEQ ID NO: 294773 - DNA, 75 bp, Artificial Sequence
  Synthetic
agaaacgtgtagcgtgagcccaggtggcgctctaattcttagctcctctctaaagtggggatctaggaagaagtt

SEQ ID NO: 294774 - DNA, 75 bp, Artificial Sequence
  Synthetic
ataccagagaactggattgaactaataaatgagaatccagaggtgctctatcgggctcccagaacaggcccagaa

SEQ ID NO: 294775 - DNA, 75 bp, Artificial Sequence
  Synthetic
tcttatcagcaacaatttttgaggacactggacgtcctgagttcaacttcttggaggattctaagtacagcttgc

SEQ ID NO: 294776 - DNA, 75 bp, Artificial Sequence
  Synthetic
cactggacgtcctgagttcaacttcttggaggattctaagtacagcttgctacaaaagatggctgcatattctgg

SEQ ID NO: 294777 - DNA, 75 bp, Artificial Sequence
  Synthetic
ttggaggattctaagtacagcttgctacaaaagatggctgcatattctggctttcacggtttcaatgatatggag

SEQ ID NO: 294778 - DNA, 75 bp, Artificial Sequence
  Synthetic
aaggggaccctgatagctattgatccatttgatgataggcgagaagcagggggggaatcaacagttgtgaatcca

SEQ ID NO: 294779 - DNA, 75 bp, Artificial Sequence
  Synthetic
actttgtgatggatctcttcaaagcttatcatggtgaggcagaagttccatgggcttttaagggtaaaacatatc

SEQ ID NO: 294780 - DNA, 75 bp, Artificial Sequence
  Synthetic
gtttggagggcctcttaagactatactcctaatttgcctgtatgtagcattatcaattgggctctttttccttct

SEQ ID NO: 294781 - DNA, 75 bp, Artificial Sequence
  Synthetic
tatatatcttggaagaacaggtctctccaaaatgtggcttgctgccactaagaaagcttcatagatcagtacgtg

SEQ ID NO: 294782 - DNA, 75 bp, Artificial Sequence
  Synthetic
agaaagcttcatagatcagtacgtgtagaagcaatatatagaaataagtaaatataaaaaaatctaattatgtaa

SEQ ID NO: 294783 - DNA, 75 bp, Artificial Sequence
  Synthetic
cacactccactgaataaccatattcaagttaggaatttctttgctagaatggaaagcaagcctagaacagtcaga

SEQ ID NO: 294784 - DNA, 75 bp, Artificial Sequence
  Synthetic
tagttgtaatttggggtggtggggtgaggcagcagcagtctcaagcacttgtggatattctagtcggcgtgattg

SEQ ID NO: 294785 - DNA, 75 bp, Artificial Sequence
  Synthetic
ggttatccgtgacaatttctcccggatgggccatcttcgaggtgtagaagaccttgctggcttcactcgtagtgt

SEQ ID NO: 294786 - DNA, 75 bp, Artificial Sequence
  Synthetic
tagtcggcgtgattgtcttttgccagattagctgggaattaaactaactctttgaagttgcaccggtctttgtgt

SEQ ID NO: 294787 - DNA, 75 bp, Artificial Sequence
  Synthetic
tcttggagaaccctccctggctttctttgacctaagctctactagagtgcacaggaatgatgacattagaaggga

SEQ ID NO: 294788 - DNA, 75 bp, Artificial Sequence
  Synthetic
tcagattgccactctagcaatgaggagctgcaagattaccaatgatctagaagactcctttgttggcttacacag

SEQ ID NO: 294789 - DNA, 75 bp, Artificial Sequence
  Synthetic
aagactcctttgttggcttacacaggatgatagtgaccgaggctattctcagagggattgacctgtgcctgttac

SEQ ID NO: 294790 - DNA, 75 bp, Artificial Sequence
  Synthetic
gctatatgctttcttcatgaagaaggttaagggctcagctgctagggactgggcagatgaggatgttaccatccc

SEQ ID NO: 294791 - DNA, 75 bp, Artificial Sequence
  Synthetic
attatggagttgggatctggagaggcttcatggatggatatcaggtccatcttgagatagaaaatgacataggac

SEQ ID NO: 294792 - DNA, 75 bp, Artificial Sequence
  Synthetic
cttcatggatggatatcaggtccatcttgagatagaaaatgacataggacagcccccaaggcttaggaatgtcac

SEQ ID NO: 294793 - DNA, 75 bp, Artificial Sequence
  Synthetic
cttgagatagaaaatgacataggacagcccccaaggcttaggaatgtcacaactaactgtcagagcagcccatgg

SEQ ID NO: 294794 - DNA, 75 bp, Artificial Sequence
  Synthetic
agcccccaaggcttaggaatgtcacaactaactgtcagagcagcccatgggacctgagtattccaataaggcagt

SEQ ID NO: 294795 - DNA, 75 bp, Artificial Sequence
  Synthetic
tgattagaggttaaggctgccccaccccccaccccccaaccccaaccgtaaccccaacccccccttccccccaaa

SEQ ID NO: 294796 - DNA, 75 bp, Artificial Sequence
  Synthetic
tcatcagactgagaaaagaggaggtggagatgaaagtacggggctctactctcaacttgtacaccaagcaccatt

SEQ ID NO: 294797 - DNA, 75 bp, Artificial Sequence
  Synthetic
ggagatgaaagtacggggctctactctcaacttgtacaccaagcaccattctcatcaggacctacacattttatc

SEQ ID NO: 294798 - DNA, 75 bp, Artificial Sequence
  Synthetic
ctcatcaggacctacacattttatcttacactgcatcagacaatgatctcagtccaggcattttcaagtcaatat

SEQ ID NO: 294799 - DNA, 75 bp, Artificial Sequence
  Synthetic
tcagaagagtaggataggcaaaacaactttcctggctgaatgggagaagctaaagaaaattgtgaagtggttgga

SEQ ID NO: 294800 - DNA, 75 bp, Artificial Sequence
  Synthetic
aactgctgggtgagatgtgagtctgtagctccaaaatttatatcagccatccttgagatatgtgaggggaagaga

SEQ ID NO: 294801 - DNA, 75 bp, Artificial Sequence
  Synthetic
tagctccaaaatttatatcagccatccttgagatatgtgaggggaagagacagataaaaggaattaacagaacca

SEQ ID NO: 294802 - DNA, 75 bp, Artificial Sequence
  Synthetic
gactctcagagattgtgagaatttgttctgaatcttccctaagatcaaaagtcggatctatgttctcatttgtcg

SEQ ID NO: 294803 - DNA, 75 bp, Artificial Sequence
  Synthetic
tggaggactctgaagcagaggagatggtttataggtatagacttgctcttagtgtaatggatgagctaaggacct

SEQ ID NO: 294804 - DNA, 75 bp, Artificial Sequence
  Synthetic
atgatagaagatgccaagaacaatgcattcagtcatgttgttaattgcatagagttggatgttagtggtccttac

SEQ ID NO: 294805 - DNA, 75 bp, Artificial Sequence
  Synthetic
ctgttctgcatactacagggtccatacagtgagagctataagctacagctaatctacagagtcctaagctcagtg

SEQ ID NO: 294806 - DNA, 75 bp, Artificial Sequence
  Synthetic
gagttgctagccatggtctcctccatccaaataaattggtcagtcacagaatccgtgtttccaccctttagcaga

SEQ ID NO: 294807 - DNA, 75 bp, Artificial Sequence
  Synthetic
gagatggagtcttttgatacatctgatgtcaatctctttgggccagcccattacaaggacatcagttcattatct

SEQ ID NO: 294808 - DNA, 75 bp, Artificial Sequence
  Synthetic
agtgtaatggatgagctaaggaccttgtttccagaactgtcatccacagatgaggaactagggaagactgagaga

SEQ ID NO: 294809 - DNA, 75 bp, Artificial Sequence
  Synthetic
ttacaaggacatcagttcattatctatgattgctcatcccttaatggataagtttgttgattatgctatttctaa

SEQ ID NO: 294810 - DNA, 75 bp, Artificial Sequence
  Synthetic
atgattgctcatcccttaatggataagtttgttgattatgctatttctaagatggggagagcctcagttaggaaa

SEQ ID NO: 294811 - DNA, 75 bp, Artificial Sequence
  Synthetic
gttctagaaacaggtcggtgctccagcaaagactatgatttatcaaaggttctcttcagaactctacagagacca

SEQ ID NO: 294812 - DNA, 75 bp, Artificial Sequence
  Synthetic
gaagaaagcattagaatagatgatctggagttatatgaggagacagatgtagcggatgacatgctaggctaagac

SEQ ID NO: 294813 - DNA, 75 bp, Artificial Sequence
  Synthetic
tggagttatatgaggagacagatgtagcggatgacatgctaggctaagacctataagcaaagtcaggcttagatt

SEQ ID NO: 294814 - DNA, 75 bp, Artificial Sequence
  Synthetic
gcagcaaactggatcgcaagctcttgatagttgtccattattgtaatagtgtttgtatctcagggagctttgtgt

SEQ ID NO: 294815 - DNA, 75 bp, Artificial Sequence
  Synthetic
ttcatggtgccaaatggttagtctgataggagctgagttatcagcttctgtaaagcaacatgtcaagcctaacta

SEQ ID NO: 294816 - DNA, 75 bp, Artificial Sequence
  Synthetic
gagagaaaccatggcagggattgcaatgacagtccttccagccttagcagtttttgctttggcacctgttgtttt

SEQ ID NO: 294817 - DNA, 75 bp, Artificial Sequence
  Synthetic
tgctgaagacccccatctcagaaacagaccagggaaggggcacaactacattgacgggatgactcaggaggatgc

SEQ ID NO: 294818 - DNA, 75 bp, Artificial Sequence
  Synthetic
gatgcctcatatatgggtaaactttctttattgacccttttggaagacaaagcaacaactgaagagttgcagact

SEQ ID NO: 294819 - DNA, 75 bp, Artificial Sequence
  Synthetic
atgattgctcatcccttaatggataagtttgttgattatgccatttccaagatggggagagcctcagttagaaaa

SEQ ID NO: 294820 - DNA, 75 bp, Artificial Sequence
  Synthetic
attttgtcagtcaagtgaggatgatgggtcaaaattaaaaacaaaaatgaaaggggtctgcgaagtgggagttca

SEQ ID NO: 294821 - DNA, 75 bp, Artificial Sequence
  Synthetic
caaccagattattcgagagctcagtgggctgactctagaaaggctagccacacttaaggccacaagcaactttaa

SEQ ID NO: 294822 - DNA, 75 bp, Artificial Sequence
  Synthetic
ctagttggcgtgattgtcttttgccagattagttgggaattaaactaactctttgaagttgcaccggtctttgtg

SEQ ID NO: 294823 - DNA, 75 bp, Artificial Sequence
  Synthetic
ccccaaccacccccttttccccaaacccctgggcagccacttaggctgctgtcttgtacgcctgagcagctgcca

SEQ ID NO: 294824 - DNA, 75 bp, Artificial Sequence
  Synthetic
cttaagactgaggaaaatctgctaccagactcatttgtctgcttcgagcataaaggacaacataaaggaacaatg

SEQ ID NO: 294825 - DNA, 75 bp, Artificial Sequence
  Synthetic
tatgcatatttgtttgtttaagaaacaacagcatgggggtctgagagagatctatgtgatgggtgcagaggaaag

SEQ ID NO: 294826 - DNA, 75 bp, Artificial Sequence
  Synthetic
ggaatccacaagcccaaaagctttcaagaattctctcctcttctcatggcttataaagttgctattcactgctgc

SEQ ID NO: 294827 - DNA, 75 bp, Artificial Sequence
  Synthetic
aaaggcgcccaatcatggattctatattatcaaaacagctggttgacaagactggttttgttagagtgccaatca

SEQ ID NO: 294828 - DNA, 75 bp, Artificial Sequence
  Synthetic
gccagcaaagctggggtgcatcatatgccttgggtatgcaggggataggccatccatggtggtcccagtgacagg

SEQ ID NO: 294829 - DNA, 75 bp, Artificial Sequence
  Synthetic
gatcaacagggttcaagatatcatctgcagttgcttgtgctagcggagtttgcgtcacaggatcgcagagtcctt

SEQ ID NO: 294830 - DNA, 75 bp, Artificial Sequence
  Synthetic
tgcagttgcttgtgctagcggagtttgcgtcacaggatcgcagagtccttctaccgagattacactcaagtatcc

SEQ ID NO: 294831 - DNA, 75 bp, Artificial Sequence
  Synthetic
ggagtacaattctgagttttatttccacacccagcatgttagacctacgatcaggtggattgcagcatgttgcag

SEQ ID NO: 294832 - DNA, 75 bp, Artificial Sequence
  Synthetic
gcccgccaagaagaggcctctaatctaatgacttcagttactgagggaggtgggtcattctctttggctgcaatg

SEQ ID NO: 294833 - DNA, 75 bp, Artificial Sequence
  Synthetic
agtatgaggttccttgtgagaacagatctcagggcaggactgttgttctttatgttgttagcgcctatcggcatg

SEQ ID NO: 294834 - DNA, 75 bp, Artificial Sequence
  Synthetic
cacatgcaaacctgtgacatatgctggggcatgtagcagttttgatgtcttgcttgaaaaggggaaatttcccct

SEQ ID NO: 294835 - DNA, 75 bp, Artificial Sequence
  Synthetic
aagattgccccaaagaaagttctgaatccgctaatgtggattactgccttcatcagatgggtatataagaagatg

SEQ ID NO: 294836 - DNA, 75 bp, Artificial Sequence
  Synthetic
tgcttgaaaaggggaaatttccccttttccagtcatatgctcatcatagaactctactagaggcagttcacgaca

SEQ ID NO: 294837 - DNA, 75 bp, Artificial Sequence
  Synthetic
atccgctaatgtggattactgccttcatcagatgggtatataagaagatggttgccagagtggcagataatataa

SEQ ID NO: 294838 - DNA, 75 bp, Artificial Sequence
  Synthetic
cactgaggactgcaacttttgtaggcagatgacaggtgctagcctgaagaaggggtcttatcctctccaagactt

SEQ ID NO: 294839 - DNA, 75 bp, Artificial Sequence
  Synthetic
tttgctctgcttatgaatgcactgctcagtatgccaatgcctattgttcacatgctaatgggtcagggattgtgc

SEQ ID NO: 294840 - DNA, 75 bp, Artificial Sequence
  Synthetic
acgctccaatcccacgctatagcacatacctaatgctactactgattgtctcatatgcgtcagcatgttcagaac

SEQ ID NO: 294841 - DNA, 75 bp, Artificial Sequence
  Synthetic
tcagaaactgagagaccgtttgaacataccagagaactggatcgaactaataaatgagaatccagaggtgctcta

SEQ ID NO: 294842 - DNA, 75 bp, Artificial Sequence
  Synthetic
atagtgagcagatgcctcataaattctcaagagaaactcatcaataattctttctttgctgaagggaatgacaaa

SEQ ID NO: 294843 - DNA, 75 bp, Artificial Sequence
  Synthetic
ggcagaggcttgtttgatgttaaagggggtcaaggaagaccaaaccaagttcttgaagataaaaactgtctcaag

SEQ ID NO: 294844 - DNA, 75 bp, Artificial Sequence
  Synthetic
gttctgagattttcaaaaaacgctgaagagtgttccttggcaatagagagagccttaaatcagtatagagcagaa

SEQ ID NO: 294845 - DNA, 75 bp, Artificial Sequence
  Synthetic
aagattgccccaaggaaagttctgaatccactaatgtggattacagccttcatcagatgggtgtataagaagatg

SEQ ID NO: 294846 - DNA, 75 bp, Artificial Sequence
  Synthetic
atgaaacttcagcagagttttcatttgttggggaaagcacgaccatgcgagagaataagtgttttgagcagtgtg

SEQ ID NO: 294847 - DNA, 75 bp, Artificial Sequence
  Synthetic
ggtcaggggttagcaagatagccatggttatccgtgacaatttctcccggataggccatcttcgaggtgtagaag

SEQ ID NO: 294848 - DNA, 75 bp, Artificial Sequence
  Synthetic
ggttatccgtgacaatttctcccggataggccatcttcgaggtgtagaagacctcgctggcttcactcgtagtgt

SEQ ID NO: 294849 - DNA, 75 bp, Artificial Sequence
  Synthetic
ctagagatcacagactttgatggctctgtttcaacaatagacttgggagcatcatctagccgtttcacaaactgg

SEQ ID NO: 294850 - DNA, 75 bp, Artificial Sequence
  Synthetic
tacatagctgctttaggagttaatggaaagaagcacaaagcagacactttagtgcagcaaatgagagacaggagt

SEQ ID NO: 294851 - DNA, 75 bp, Artificial Sequence
  Synthetic
tcagagtcctcagtcctgagtgctcatgaatcatgccttagggcaccaaaccttatctcgtacaagcccatgata

SEQ ID NO: 294852 - DNA, 75 bp, Artificial Sequence
  Synthetic
ctacatttcactgtacctgaagtagaagaggagtttatgtactcttgtgatggagatgagcggcctctgttagtg

SEQ ID NO: 294853 - DNA, 75 bp, Artificial Sequence
  Synthetic
aagaggagtttatgtactcttgtgatggagatgagcggcctctgttagtgaaagggaccctgatagctattgacc

SEQ ID NO: 294854 - DNA, 75 bp, Artificial Sequence
  Synthetic
agcagaggagccagatattggatgcattcattcaggatgcaaggacctagcaagccatttggatgcccagtttat

SEQ ID NO: 294855 - DNA, 75 bp, Artificial Sequence
  Synthetic
caagccatttggatgcccagtttatatcattaagggtgacatgtcagatgtcatcagattgagaaaagaggaggt

SEQ ID NO: 294856 - DNA, 75 bp, Artificial Sequence
  Synthetic
aggtggactttgtgggagcagccgtgtcttgtgatgccgccttcttaaatttgacaggttgctattcttgcaatg

SEQ ID NO: 294857 - DNA, 75 bp, Artificial Sequence
  Synthetic
ttccagcaaaagccacatatttgtgtctttcgcaattaagcgctcttgctgggcctttgatctctccacttccag

SEQ ID NO: 294858 - DNA, 75 bp, Artificial Sequence
  Synthetic
agagttggatgttagtggtccttacgagatggagtcttttgatacatctgatgtcaacctctttgggccagccca

SEQ ID NO: 294859 - DNA, 75 bp, Artificial Sequence
  Synthetic
tgggatatccaagcttagaaacttatgcaataatacattagatgtaagcttagttgtaatttggggtggtggggt

SEQ ID NO: 294860 - DNA, 75 bp, Artificial Sequence
  Synthetic
ttgacaggttgctattcttgcaatgcaggggccagggtctgcctgtctatcacatccacaggaactggaactctc

SEQ ID NO: 294861 - DNA, 75 bp, Artificial Sequence
  Synthetic
tgcatatagttctcccatcagaaaatggaacaaaagatcagtgtcagatactacacttcactgtgcctgaggtag

SEQ ID NO: 294862 - DNA, 75 bp, Artificial Sequence
  Synthetic
tatcaattgggctctttttccttcttatatatcttggaagaacaggtctctctaaaatgtggcttgctgctacta

SEQ ID NO: 294863 - DNA, 75 bp, Artificial Sequence
  Synthetic
agaaggcttcatagatcagtgcgtgtagaagcaatatatagaaataagtagacataaacaaacccaatcatgtaa

SEQ ID NO: 294864 - DNA, 75 bp, Artificial Sequence
  Synthetic
tagaagcaatatatagaaataagtagacataaacaaacccaatcatgtaaatattgtacagatagatcaaactat

SEQ ID NO: 294865 - DNA, 75 bp, Artificial Sequence
  Synthetic
aaccctctctcttgtgataaagagcttagattggcagcccagaggattcatcagccatccttgtcagaaaggggc

SEQ ID NO: 294866 - DNA, 75 bp, Artificial Sequence
  Synthetic
tcagccatccttgtcagaaaggggcttcaatgaaatcataacagagcattacaaatttatgggaagtaggatagg

SEQ ID NO: 294867 - DNA, 75 bp, Artificial Sequence
  Synthetic
ttttgtgattaaacgactactaggttctgggattttcttgctaatcaagcccacttccagcaaaagccacatatt

SEQ ID NO: 294868 - DNA, 75 bp, Artificial Sequence
  Synthetic
tagttgtaatttggggtggtggggtgaggcagcagcagtctaaagtacttgtgaatattctagttggcatgattg

SEQ ID NO: 294869 - DNA, 75 bp, Artificial Sequence
  Synthetic
tagttggcatgattgtctcttgccagattggctgggaattaaactaactctttgaagttgcaccggtctttgtgt

SEQ ID NO: 294870 - DNA, 75 bp, Artificial Sequence
  Synthetic
tcagctgttgttacaatggttactttaaaaacaaagaagaagagactgagccttcatccctttctgggatgtata

SEQ ID NO: 294871 - DNA, 75 bp, Artificial Sequence
  Synthetic
tgactctagaaaggttagccacacttaaggccacaagcaacttcaatgagaattggtatgtctataaggatgtgg

SEQ ID NO: 294872 - DNA, 75 bp, Artificial Sequence
  Synthetic
tttgatctaagctctactagagtgcacaggaatgatgacattagaagggatcagattgccactctagcaatgagg

SEQ ID NO: 294873 - DNA, 75 bp, Artificial Sequence
  Synthetic
gttgagatggaatcagaggaagagagtgatgatgatggatttgttgaggttgattagaggttaaggctgccccac

SEQ ID NO: 294874 - DNA, 75 bp, Artificial Sequence
  Synthetic
tgcaataatactttagatgcaagcttagttgtaatttggggtggtggggtgaggcagcagcagtctcaagtgctt

SEQ ID NO: 294875 - DNA, 75 bp, Artificial Sequence
  Synthetic
acatcagggatgcaacccaaaccagggtcaccatctttaatgagcagaagaccctccgaacatctccagagaagt

SEQ ID NO: 294876 - DNA, 75 bp, Artificial Sequence
  Synthetic
gcaacctcctcctttgttctacctcggaggtttgggttgatgacccgagagaactgcagcagatacagagagtga

SEQ ID NO: 294877 - DNA, 75 bp, Artificial Sequence
  Synthetic
atgggccacctccgaggtgtagaagaccttgctggcttcactcgtagtgtgtcagctgaaattctcaagcacttt

SEQ ID NO: 294878 - DNA, 75 bp, Artificial Sequence
  Synthetic
attcatttaggatgcaaggacctagcaagccatttggatgcccagtttatattattaagggtgatatgtcagatg

SEQ ID NO: 294879 - DNA, 75 bp, Artificial Sequence
  Synthetic
tcattctccttagctgcaatgattcagcaagctcagtgcactctccattacatgctgatgggcatgggagtgtct

SEQ ID NO: 294880 - DNA, 75 bp, Artificial Sequence
  Synthetic
cagatgagggggtagctcaagccctgcaattatttgagagggagccaagcaactgctgggtgagatgtgagtctg

SEQ ID NO: 294881 - DNA, 75 bp, Artificial Sequence
  Synthetic
tcagccatccttgtcagaaaggggcttcaatgagatcataacagagcactacaaatttatgggaagtaggatagg

SEQ ID NO: 294882 - DNA, 75 bp, Artificial Sequence
  Synthetic
ccttatgcgtgcgggttgggaggtttcagatttaatctcttcaaagctatcaccagaactgatttgcagaagcta

SEQ ID NO: 294883 - DNA, 75 bp, Artificial Sequence
  Synthetic
caataagcaaagtcaggcttagatttagggatactatgctagtattggaatccatgtgggttctgatactagcat

SEQ ID NO: 294884 - DNA, 75 bp, Artificial Sequence
  Synthetic
ttcacgatttcacctttggccacttagctgacaagactgacagactgttaatgcgtgagtttcccatgatgaatg

SEQ ID NO: 294885 - DNA, 75 bp, Artificial Sequence
  Synthetic
tgattagaggttaaggctgccccaccccccaccccccaatcccgaccgtaaccccaacccccattttccccaacc

SEQ ID NO: 294886 - DNA, 75 bp, Artificial Sequence
  Synthetic
attccaggctgccatgactaaactcgctaagtatgaggttccttgtgagaacagatctcagggcaggactgttgt

SEQ ID NO: 294887 - DNA, 75 bp, Artificial Sequence
  Synthetic
cttctggtagagaagggtccaccatgccagcaaagctgggatgcatcatatgccttgggtatgcaggggataggc

SEQ ID NO: 294888 - DNA, 75 bp, Artificial Sequence
  Synthetic
aaggcagtgctgaagtggaatgaccctggcctgggtttcttcctgcttgacaatccttatgcgtgcgggttggga

SEQ ID NO: 294889 - DNA, 75 bp, Artificial Sequence
  Synthetic
catggtttcaatgatatggagccggaagatatattattcctatttccgaatattgaggaattagaatcactggat

SEQ ID NO: 294890 - DNA, 75 bp, Artificial Sequence
  Synthetic
aagttaggaatttctttgctagaatggaaagcaagcctagaacagtcagaataacaggagctcctgtaaagaaga

SEQ ID NO: 294891 - DNA, 75 bp, Artificial Sequence
  Synthetic
tccgaacatctccagagaagttggtgtcagacaagtggtttgggactcagaagagtaggataggcaaaacaacct

SEQ ID NO: 294892 - DNA, 75 bp, Artificial Sequence
  Synthetic
attccttctttgctgaagggaatgataaagctctgagattttcaaaaaacgctgaagagtgttccttggcaatag

SEQ ID NO: 294893 - DNA, 75 bp, Artificial Sequence
  Synthetic
ctccctggctgtcctatcatgatgtcgatggcaaagatctgtgccctcttcaagggttagatgtgaaaggggacc

SEQ ID NO: 294894 - DNA, 75 bp, Artificial Sequence
  Synthetic
agtggtcacctctgcaaatctagaggagattgagaggatgcacgatgatgcagcagcagaacttgagtttgccct

SEQ ID NO: 294895 - DNA, 75 bp, Artificial Sequence
  Synthetic
gagagaaacagataccatagagtccatctgaatatggactcagatgatagtgtctacatagctgctttaggagtt

SEQ ID NO: 294896 - DNA, 75 bp, Artificial Sequence
  Synthetic
atctgaatatggactcagatgatagtgtctacatagctgctttaggagttaatggaaagaagcataaagcagata

SEQ ID NO: 294897 - DNA, 75 bp, Artificial Sequence
  Synthetic
gaaggtttatcttgataagcttgaccttaagactgaggagaatctgctaccagactcatttgtctgtttcgagca

SEQ ID NO: 294898 - DNA, 75 bp, Artificial Sequence
  Synthetic
agatacaagtatcaggggtctggaagaagcctttatgtgtagggtatgagagagtggttgtgaagagagaactct

SEQ ID NO: 294899 - DNA, 75 bp, Artificial Sequence
  Synthetic
atcacgttgtccccattattgaagagatgggagccggaacagtgggtggatttatcaagagacaacaatctaaag

SEQ ID NO: 294900 - DNA, 75 bp, Artificial Sequence
  Synthetic
agagtggttgtgaagagagaactctctgccaagcccatccagagagttgagccttgcacaacttgtataaccaaa

SEQ ID NO: 294901 - DNA, 75 bp, Artificial Sequence
  Synthetic
ctttagtgcaacaaatgagagacaggagcaaacagcctttctctccagatcatgatgtggatcacatatctgaat

SEQ ID NO: 294902 - DNA, 75 bp, Artificial Sequence
  Synthetic
aaccctctctcttgtgataaagagcttaggttggcagcccagagaattcatcagccatccttatcagaaaggggc

SEQ ID NO: 294903 - DNA, 75 bp, Artificial Sequence
  Synthetic
ataggagcagagctatcagcttctgtaaagcaacatgtcaagcctaattattttgtgattaaacgactactaggt

SEQ ID NO: 294904 - DNA, 75 bp, Artificial Sequence
  Synthetic
tttgttgttgtgtttgtattcagttctattgcaataatttgtttagctgttctttatagggtgcttaagtgcctg

SEQ ID NO: 294905 - DNA, 75 bp, Artificial Sequence
  Synthetic
ttttgtgattaaacgactactaggttctgggatatacttactgatcaaacccacttccagcaaaagccatatatt

SEQ ID NO: 294906 - DNA, 75 bp, Artificial Sequence
  Synthetic
aagattgccccaaggaaagttctgaatccactaatgtggatcacagccttcatcagatggatatataagaagatg

SEQ ID NO: 294907 - DNA, 75 bp, Artificial Sequence
  Synthetic
attaatggagtcctccttctcattctgggcagaagcatttggaattccaagctggaactttgttggtgacttgtt

SEQ ID NO: 294908 - DNA, 75 bp, Artificial Sequence
  Synthetic
tgggcagaagcatttggaattccaagctggaactttgttggtgacttgttcaggtcttcagactctgcagcaatg

SEQ ID NO: 294909 - DNA, 75 bp, Artificial Sequence
  Synthetic
acttgtacaccaagcaccattctcatcaggacctacacattttatcttacactgcatcagacaatgatctcagtc

SEQ ID NO: 294910 - DNA, 75 bp, Artificial Sequence
  Synthetic
tcatatgcatcagcatgttcagaactgattcaggcaagctccagaatcaccacttgctctacagagggtgttaac

SEQ ID NO: 294911 - DNA, 75 bp, Artificial Sequence
  Synthetic
gtgcattaaatgtatgttttattgacaattctaatctcggttctggtgtgtgaagcggttattagagtgtctcta

SEQ ID NO: 294912 - DNA, 75 bp, Artificial Sequence
  Synthetic
gctgggtgagatgtgagtctgtggctccaaaatttatatcagccatccttgagatatgtgaggggaagagacaga

SEQ ID NO: 294913 - DNA, 75 bp, Artificial Sequence
  Synthetic
gagatatgtgaggggaagagacagataaaaggaattaacagaaccagactctcagagattgtgagaatttgttct

SEQ ID NO: 294914 - DNA, 75 bp, Artificial Sequence
  Synthetic
tttcctaaggttctcaggtcagagctgcaggtttacctattaaactgcttatgcagaacaatccagagaatagca

SEQ ID NO: 294915 - DNA, 75 bp, Artificial Sequence
  Synthetic
tgagctatcatgcagggagggccagagttattggactgggtcctttagccctaaatgtttgagctcaaggagatg

SEQ ID NO: 294916 - DNA, 75 bp, Artificial Sequence
  Synthetic
atgaatcatgccttagggcaccaaaccttatctcatacaagcccatgatagatcaattggagtgcacaacaaatc

SEQ ID NO: 294917 - DNA, 75 bp, Artificial Sequence
  Synthetic
tgattgatccctttgttgtctttgagaggggttctctgccacagacaaggaatgataaaacctttgcagcttcaa

SEQ ID NO: 294918 - DNA, 75 bp, Artificial Sequence
  Synthetic
gggttgactctagaaagattagccacacttaaggccacaagcaacttcaatgaaaattggtatgtttacaaggat

SEQ ID NO: 294919 - DNA, 75 bp, Artificial Sequence
  Synthetic
aaggaaatagaggtgttcaagctttctctaagggctctgtacaagctgatctaactctgatgtttgacaattttg

SEQ ID NO: 294920 - DNA, 75 bp, Artificial Sequence
  Synthetic
aggaggagtttatgtactcttgtgatggagatgagcggcctctgttggtgaaggggaccctgatagccattgatc

SEQ ID NO: 294921 - DNA, 75 bp, Artificial Sequence
  Synthetic
atagccaggtctatagggaagttctttgcttctgacaccctctgtaacccccccaacaaggtgagaattcctgag

SEQ ID NO: 294922 - DNA, 75 bp, Artificial Sequence
  Synthetic
tctaaaatgtggcttgctgccactaagaaggcctcatagatcagtacgtgtaaaagcaatatgttgaaataagta

SEQ ID NO: 294923 - DNA, 75 bp, Artificial Sequence
  Synthetic
atcattaggggatgttcaatgtttaccaggaaaaggatgatgatgaatctgaattatcttaagatcctggatggt

SEQ ID NO: 294924 - DNA, 75 bp, Artificial Sequence
  Synthetic
ttgataagcttgacctcaagactgaggagaatctgctaccagactcatttgtctgcttcgagcataagggacagt

SEQ ID NO: 294925 - DNA, 75 bp, Artificial Sequence
  Synthetic
tagttgtaatttggggtggtggggtgaggcagcagcagtctcaagtgcttgtgaatattctagttggcgtaatcg

SEQ ID NO: 294926 - DNA, 75 bp, Artificial Sequence
  Synthetic
tggaaaccacaacagggatgatgcaggggatattgcattatacttcctcactattacacaccattcatcaagaat

SEQ ID NO: 294927 - DNA, 75 bp, Artificial Sequence
  Synthetic
ggggatattgcattatacttcctcactattacacaccattcatcaagaatacatccggtccttgtcctttaaaat

SEQ ID NO: 294928 - DNA, 75 bp, Artificial Sequence
  Synthetic
cacacccagcatgttagaccaacgatcaggtggattgcagcatgttgcagcctgccagaagtggaaacactagta

SEQ ID NO: 294929 - DNA, 75 bp, Artificial Sequence
  Synthetic
cctgccagaagtggaaacactagtagcccgccaggaagaggcctctaatctaatgacttcagttactgagggggg

SEQ ID NO: 294930 - DNA, 75 bp, Artificial Sequence
  Synthetic
agagggattgacctgtgcctgttgccaggctttgatctcatgtatgaggttgctcacgtacagtgcgttcggctt

SEQ ID NO: 294931 - DNA, 75 bp, Artificial Sequence
  Synthetic
gcatggctgcatagtgtgtgctcatggcctgataaattaccagtgtcacactgctctcagtgcctttgttgttgt

SEQ ID NO: 294932 - DNA, 75 bp, Artificial Sequence
  Synthetic
cctcattgttcttatggaggagagcctgatgctgcgctcatcacttcccagcatgatggggagaaacaactggat

SEQ ID NO: 294933 - DNA, 75 bp, Artificial Sequence
  Synthetic
tccagttattcctccaatcccagatgttgagatggaatcagaggaggagagtgatgatgatggatttgttgaggt

SEQ ID NO: 294934 - DNA, 75 bp, Artificial Sequence
  Synthetic
atttgtattcagttctattgcaataatttgcttagctattctttatagggtgctcaagtgcctaaagattgcccc

SEQ ID NO: 294935 - DNA, 75 bp, Artificial Sequence
  Synthetic
agaaacgtgtagtgtgagcccaggtggcgctctaattcttagctcctctctaaagtggggatctagaaaaaagtt

SEQ ID NO: 294936 - DNA, 75 bp, Artificial Sequence
  Synthetic
taaatgagaatccagaggtgctctatcgggctcccagaacaggcccagaaatattgttgcgcattgcagagaaag

SEQ ID NO: 294937 - DNA, 75 bp, Artificial Sequence
  Synthetic
atattgttgcgcattgcagagaaagtccatagcccaggtgttgtgtcatcattgtcttctggcaatgcagtctgt

SEQ ID NO: 294938 - DNA, 75 bp, Artificial Sequence
  Synthetic
aaagtcatggcctcagctgtgtacttcttatcagcaacaatttttgaagacactggacgtcctgagttcaacttc

SEQ ID NO: 294939 - DNA, 75 bp, Artificial Sequence
  Synthetic
ttggaggattctaagtacagcttgctacagaagatggccgcatattctggctttcatggtttcaatgatatggaa

SEQ ID NO: 294940 - DNA, 75 bp, Artificial Sequence
  Synthetic
acagatctcagggcaggactgttgttctttatgttgttagtgcttatcggcatggtgtatggtctaatctggagc

SEQ ID NO: 294941 - DNA, 75 bp, Artificial Sequence
  Synthetic
agctcaaggagatgccatcttgtcggggaatgtcatgtgaataggtgtctgtcttggagggacaatgaaacttca

SEQ ID NO: 294942 - DNA, 75 bp, Artificial Sequence
  Synthetic
gggaatgtcatgtgaataggtgtctgtcttggagggacaatgaaacttcagcagagttttcatttgttggggaaa

SEQ ID NO: 294943 - DNA, 75 bp, Artificial Sequence
  Synthetic
ggtcacaatctttaatgagcagaagacccttcgaacatctccagagaagttagtgtcagacaagtggtttggcac

SEQ ID NO: 294944 - DNA, 75 bp, Artificial Sequence
  Synthetic
gaaatagacatcatcccaagagtcaatatcagggatgcaacccaaaccagggtcacaatctttaatgagcagaag

SEQ ID NO: 294945 - DNA, 75 bp, Artificial Sequence
  Synthetic
cccctcccgattcagagtatatcacgaggatagtgagcagatgcctcataaattctcaagagaaactcatcaata

SEQ ID NO: 294946 - DNA, 75 bp, Artificial Sequence
  Synthetic
accttcctagctgaatgggaaaagctaaagaaaattgtgaagtggctggaagacactccggaagcaactctagct

SEQ ID NO: 294947 - DNA, 75 bp, Artificial Sequence
  Synthetic
atacctaatgctactactaattgtctcatatgcatcagcatgttcagaactgattcaggcaagctccagaatcac

SEQ ID NO: 294948 - DNA, 75 bp, Artificial Sequence
  Synthetic
ggttatccgtgacaatttctcccggatgggccatcttcgaggtgtagaagacctcgctggcttcactcgtagtgt

SEQ ID NO: 294949 - DNA, 75 bp, Artificial Sequence
  Synthetic
acctcgctggcttcactcgtagtgtgtcagctgaaatcctcaagcactttctgttctgtatactacagggtccat

SEQ ID NO: 294950 - DNA, 75 bp, Artificial Sequence
  Synthetic
agtggtcacctctgcaaacctagaggagattgagaggatgcacgatgatgcagcagcagaacttgagtttgctct

SEQ ID NO: 294951 - DNA, 75 bp, Artificial Sequence
  Synthetic
atggtaagacaaaaaccaatttgattgggatccttcagagatttctagatggtgatcacgttgtccccataattg

SEQ ID NO: 294952 - DNA, 75 bp, Artificial Sequence
  Synthetic
gacataagcaaacctgattatgtaaatattgtacagataggtcaaattattgggatatccaagctcagaaacttc

SEQ ID NO: 294953 - DNA, 75 bp, Artificial Sequence
  Synthetic
aaagttgtgcaaaacaaagtggtctattatggagttgggatctggagaggcttcatggatggatatcaggtccat

SEQ ID NO: 294954 - DNA, 75 bp, Artificial Sequence
  Synthetic
gtgggagcagccgtgtcttgtgatgccgccttcttgaatttgacaggttgctattcttgcaatgcaggggccaga

SEQ ID NO: 294955 - DNA, 75 bp, Artificial Sequence
  Synthetic
ttcaatgagatcataacagagcactacaaattcatgggaagtaggataggttcatggtgccaaatggtcagcttg

SEQ ID NO: 294956 - DNA, 75 bp, Artificial Sequence
  Synthetic
ataggagctgagctatcagcttctgttaaacaacatgtcaagcctaactactttgtgattaaacgactactaggt

SEQ ID NO: 294957 - DNA, 75 bp, Artificial Sequence
  Synthetic
attcatttaggatgcaaggacctagcaagccatttggatgcccagtttatattattaagggtgacatgtcagatg

SEQ ID NO: 294958 - DNA, 75 bp, Artificial Sequence
  Synthetic
ctcatcaggacctacacattttatcttacactgcatcagacaatgatctcagcccaggcatcttcaaatcaatat

SEQ ID NO: 294959 - DNA, 75 bp, Artificial Sequence
  Synthetic
cagttgtgaatccaaaatctggatcttggaatttctttgactggttttctggactcatgagttggtttggagggc

SEQ ID NO: 294960 - DNA, 75 bp, Artificial Sequence
  Synthetic
ctaatgtcgaggaggcccatgatgttgattatgatgcgttaatggatctaatgatagaagatgccaagaacaatg

SEQ ID NO: 294961 - DNA, 75 bp, Artificial Sequence
  Synthetic
tgattatgatgcgttaatggatctaatgatagaagatgccaagaacaatgcattcagtcatgttgtcaattgcat

SEQ ID NO: 294962 - DNA, 75 bp, Artificial Sequence
  Synthetic
ccactgcttgatatgcaaccactcatcagctgttgttacaatggttactttaaaaataaagaagaagagactgag

SEQ ID NO: 294963 - DNA, 75 bp, Artificial Sequence
  Synthetic
tagatcagtacgtgtaggagcaatatgtagaaataagtagacataagcaaactaaattatgtaaatattgtacag

SEQ ID NO: 294964 - DNA, 75 bp, Artificial Sequence
  Synthetic
tggggtggtggggtgaggcagcagcagtctcaagtgctcgtgaatatactagttggcgtgattgtcttttgccag

SEQ ID NO: 294965 - DNA, 75 bp, Artificial Sequence
  Synthetic
tactagttggcgtgattgtcttttgccagattagttgggaattaaactaactctttgaagttgcaccggtctttg

SEQ ID NO: 294966 - DNA, 75 bp, Artificial Sequence
  Synthetic
caaccagattattcgagagctcagtgggttgactctagaaaggttggccacacttaaggccacaagcaactttaa

SEQ ID NO: 294967 - DNA, 75 bp, Artificial Sequence
  Synthetic
tgttttattgacaattctaatctcggttctggtgtgtgaagcggttattagagtgtctctaagctccacaagaga

SEQ ID NO: 294968 - DNA, 75 bp, Artificial Sequence
  Synthetic
aaaagccatcattgctgctgatggcttgaacaacatcacctgccatggtaagaatcctgaggacaagatttctct

SEQ ID NO: 294969 - DNA, 75 bp, Artificial Sequence
  Synthetic
cgggtggggatagtccggtgtgagagacgaagagatgctaagcaaatagggagagaaaccatggcagggattgcg

SEQ ID NO: 294970 - DNA, 75 bp, Artificial Sequence
  Synthetic
gacgaagagatgctaagcaaatagggagagaaaccatggcagggattgcgatgacagtccttccagccttagcag

SEQ ID NO: 294971 - DNA, 75 bp, Artificial Sequence
  Synthetic
tgatggcaaagacctgtgccctcttcagggattagatataagaggggaccatcccatgtgcaacctgtggaggga

SEQ ID NO: 294972 - DNA, 75 bp, Artificial Sequence
  Synthetic
gggaatccctgtatgaaagagaaacttgtgatgaagacacattgtccaaatgactaccagtcagctcattacctc

SEQ ID NO: 294973 - DNA, 75 bp, Artificial Sequence
  Synthetic
tgactaccagtcagctcattacctcaacaatgacgggaaaatggcttcagtcaagtgcccacctaagtatgagct

SEQ ID NO: 294974 - DNA, 75 bp, Artificial Sequence
  Synthetic
agaaaattatagaacttgagcaccttagaccacagtcagatgatttcttaggttataaagatccagaattgccta

SEQ ID NO: 294975 - DNA, 75 bp, Artificial Sequence
  Synthetic
catgcatatttgtttgtttaagaaacaacagcatggaggtctgagagaaatctatgtgatgggtgcagaggagag

SEQ ID NO: 294976 - DNA, 75 bp, Artificial Sequence
  Synthetic
gtcaagggctcagctgctagggactgggcagatgaagatgtcaccatcccagaaacgtgtagcgtgagcccaggt

SEQ ID NO: 294977 - DNA, 75 bp, Artificial Sequence
  Synthetic
tcaaaagctttgatatctctcagtgccccaagattggagggcatggtagtaagaagtgcactggggacgcagcat

SEQ ID NO: 294978 - DNA, 75 bp, Artificial Sequence
  Synthetic
ctgccaaacccatccagagagttgagccttgcacaacttgtataaccaaatgtgagcctcatggattggttgtcc

SEQ ID NO: 294979 - DNA, 75 bp, Artificial Sequence
  Synthetic
gccttgcacaacttgtataaccaaatgtgagcctcatggattggttgtccgatcaacagggttcaagatatcatc

SEQ ID NO: 294980 - DNA, 75 bp, Artificial Sequence
  Synthetic
agacactccagaagcaactctagctcacaccccactgaataaccatattcaagttaggaatttctttgctagaat

SEQ ID NO: 294981 - DNA, 75 bp, Artificial Sequence
  Synthetic
tgcagttgcttgtgctagcggggtttgcgtcacagggtcgcagagtccttctactgagattacactcaagtatcc

SEQ ID NO: 294982 - DNA, 75 bp, Artificial Sequence
  Synthetic
gacataggggttcacatggcacacgatgatcagtcagttagctccaaaatagtagctcactgccctccccaggac

SEQ ID NO: 294983 - DNA, 75 bp, Artificial Sequence
  Synthetic
tttgttgtcatatttgtattcagttctactgcaataatttgcttagctgttctttatagggtgctcaagtgctta

SEQ ID NO: 294984 - DNA, 75 bp, Artificial Sequence
  Synthetic
tggattcatcaagagacaacaatctaaagttgtgcagaacaaagtggtctattatggagttgggatttggagagg

SEQ ID NO: 294985 - DNA, 75 bp, Artificial Sequence
  Synthetic
atttagggatactatgctagtattggaatccatgtgggttctgatactagcatagtgctacaatattgggcggtc

SEQ ID NO: 294986 - DNA, 75 bp, Artificial Sequence
  Synthetic
accaagtgtagactgtctggcacagcattgatcagggcagggtcagttggggcagaggcttgtttgatgttgaag

SEQ ID NO: 294987 - DNA, 75 bp, Artificial Sequence
  Synthetic
cattgatcagggcagggtcagttggggcagaggcttgtttgatgttgaagggggtcaaggaagatcaaaccaagt

SEQ ID NO: 294988 - DNA, 75 bp, Artificial Sequence
  Synthetic
ggggtcaaggaagatcaaaccaagttcttaaagataaaaactgtctcaagtgagctatcgtgcagggagggccag

SEQ ID NO: 294989 - DNA, 75 bp, Artificial Sequence
  Synthetic
attattaagggtgatatgtcagatgtcatcagactgagaaaggaggaggtggagatgaaagtacggggctctact

SEQ ID NO: 294990 - DNA, 75 bp, Artificial Sequence
  Synthetic
tgttggagaaagcacaaccatgcgagagaataagtgttttgagcagtgtggaggatgggggtgtggatgtttcaa

SEQ ID NO: 294991 - DNA, 75 bp, Artificial Sequence
  Synthetic
gtcggatctatgttctcatttgtcgccaatgtcgaggaggcccatgatgttgattatgatgcgttaatggatcta

SEQ ID NO: 294992 - DNA, 75 bp, Artificial Sequence
  Synthetic
atgatagaggatgccaagaacaatgcattcagtcatgttgttgactgcatagagttggatgttagtggcccttac

SEQ ID NO: 294993 - DNA, 75 bp, Artificial Sequence
  Synthetic
aaagggtatgcaattgttgatgagccattctcagagatccctcggcaagggttcttgggggagatcaggtgcaat

SEQ ID NO: 294994 - DNA, 75 bp, Artificial Sequence
  Synthetic
ctctaagggctctgtacaagctgatctgactctgatgtttgataattttgaggtggactttgtgggagcagccgt

SEQ ID NO: 294995 - DNA, 75 bp, Artificial Sequence
  Synthetic
tgcatatagttctcccatcagagaacgggacaaaagatcagtgtcagatactacattttactgtacctgaagtag

SEQ ID NO: 294996 - DNA, 75 bp, Artificial Sequence
  Synthetic
tgcgtcacaggatcgcagagtccttctaccgagattacactcaagtatccagggatatcccagtcctctgggggg

SEQ ID NO: 294997 - DNA, 75 bp, Artificial Sequence
  Synthetic
ctaccgagattacactcaagtatccagggatatcccagtcctctgggggggacataggggttcacatggcacacg

SEQ ID NO: 294998 - DNA, 75 bp, Artificial Sequence
  Synthetic
tatatatcttggaagaacaggcctctctaaaatgtggcttgccgctactaagaaggcctcatagatcagtacgtg

SEQ ID NO: 294999 - DNA, 75 bp, Artificial Sequence
  Synthetic
atccactaatgtggattactgctttcatcagatgggtgtataagaagatggttgccagagtggcagacaatatca

SEQ ID NO: 295000 - DNA, 75 bp, Artificial Sequence
  Synthetic
ccaaatgtctgagctcaaggagatgccatcttgttggagagtgtcatgtgaataggtgtctgtcttggagggaca

SEQ ID NO: 295001 - DNA, 75 bp, Artificial Sequence
  Synthetic
tagttggcgtgattgtcttttgccagattagttgggaattaaactaactctttgaagttgcaccggtctttgtgt

SEQ ID NO: 295002 - DNA, 75 bp, Artificial Sequence
  Synthetic
gagaataagtgttttgagcagtgtggaggatgggggtgtgggtgtttcaatgtgaacccatcttgcttatttgtg

SEQ ID NO: 295003 - DNA, 75 bp, Artificial Sequence
  Synthetic
gaggggttctctgccacagacaaggaatgacaaaacctttgcagcttcaaaaggaaatagaggtgttcaagcttt

SEQ ID NO: 295004 - DNA, 75 bp, Artificial Sequence
  Synthetic
aacataagcaaatctaattatgtaaatattgtacagatgggtcaaactattgggatatccaagtttagaatctta

SEQ ID NO: 295005 - DNA, 75 bp, Artificial Sequence
  Synthetic
ctacacttcactgtacctgaagtagaggaggagtttatgtactcttgtgatggagatgagcggcctctgttggtg

SEQ ID NO: 295006 - DNA, 75 bp, Artificial Sequence
  Synthetic
aaagggaccctgatagctattgatccatttgatgataggcgggaagcagggggggaatcaacagttgtgaatcca

SEQ ID NO: 295007 - DNA, 75 bp, Artificial Sequence
  Synthetic
tgtctccaagatggtagatagaattaccatagacttcaatctagacgacatacaaggagcatctgaaataggctc

SEQ ID NO: 295008 - DNA, 75 bp, Artificial Sequence
  Synthetic
tatcaattgggctctttttcctccttatatatcttggaagaacaggcctctctaaaatgtggcttgctgctacta

SEQ ID NO: 295009 - DNA, 75 bp, Artificial Sequence
  Synthetic
agaatccacaagcccaaaagctttcaagaattctctcctcttctcatggcttataaagttgctattcactgctgc

SEQ ID NO: 295010 - DNA, 75 bp, Artificial Sequence
  Synthetic
ggaggtttgggttgatgacccgggagaactgcagcagatacagagagtgagcatctaatattgcccttagatagt

SEQ ID NO: 295011 - DNA, 75 bp, Artificial Sequence
  Synthetic
tgcctcgggtatgcaggggatagaccgtccatggttgtcccagtgacaggaagccactcactcaagacgaccaaa

SEQ ID NO: 295012 - DNA, 75 bp, Artificial Sequence
  Synthetic
gcctggcatgtccagccagccagggcagcagcaactcgtgatagagtcagctcatcccgggaaggattcccctcc

SEQ ID NO: 295013 - DNA, 75 bp, Artificial Sequence
  Synthetic
tttagcttatacttgttgatgagagcctccacagttgctttgccttctttcgacattttcatcatcatcctccgg

SEQ ID NO: 295014 - DNA, 75 bp, Artificial Sequence
  Synthetic
atctgtgtttccaccctttagcagagaaatgtttgacaggtttagatcctcccctcccgattcagagtatatcac

SEQ ID NO: 295015 - DNA, 75 bp, Artificial Sequence
  Synthetic
attccttctttgctgaagggaatgataaggctctgagattttcaaaaaacgctgaagagtgttccttggcaatag

SEQ ID NO: 295016 - DNA, 75 bp, Artificial Sequence
  Synthetic
gagattgagaggatgcacgatgatgcagcagcagagcttgagtttgccctttcgggagtaaaggacaggccagat

SEQ ID NO: 295017 - DNA, 75 bp, Artificial Sequence
  Synthetic
tacaaggagcatctgaaataggttcaactttactaccctccatgtcgatagatgtggaagatatggccaattttg

SEQ ID NO: 295018 - DNA, 75 bp, Artificial Sequence
  Synthetic
aactttactaccctccatgtcgatagatgtggaagatatggccaattttgttcacgatttcacctttggccactt

SEQ ID NO: 295019 - DNA, 75 bp, Artificial Sequence
  Synthetic
tagaggactctgaagcagaggagatggtttataggtacagacttgctcttagtgtgatggatgagctaaggacct

SEQ ID NO: 295020 - DNA, 75 bp, Artificial Sequence
  Synthetic
ggtttataggtacagacttgctcttagtgtgatggatgagctaaggaccttatttccagaactgtcatccacaga

SEQ ID NO: 295021 - DNA, 75 bp, Artificial Sequence
  Synthetic
tccaaataaattggtcagtcacagaatctgtgtttccaccctttagcagagagatgtttgacaagtttagatcct

SEQ ID NO: 295022 - DNA, 75 bp, Artificial Sequence
  Synthetic
gagatgtttgacaagtttagatcctcccctcccgattcagagtatatcacaaggatagtgagcagatgcctcata

SEQ ID NO: 295023 - DNA, 75 bp, Artificial Sequence
  Synthetic
atcaagtgaacagagaaataggatggatggaaggaggtcagttggttctagggaaccctgcccctattcctcgtc

SEQ ID NO: 295024 - DNA, 75 bp, Artificial Sequence
  Synthetic
atcccatgtgcaacctgtggagggaagtggtcacctctgcaaatctagaggagattgagaggatgcacgatgatg

SEQ ID NO: 295025 - DNA, 75 bp, Artificial Sequence
  Synthetic
ttcgggagtaaaggacaggccagatgagagaaacagataccatagagtccatctaaatatgggctcagatgatag

SEQ ID NO: 295026 - DNA, 75 bp, Artificial Sequence
  Synthetic
gagagaaacagataccatagagtccatctaaatatgggctcagatgatagtgtctacatagctgctttaggagtt

SEQ ID NO: 295027 - DNA, 75 bp, Artificial Sequence
  Synthetic
ccaagtgcctgagctcaaggagatgccatcttgtcggggaatgtcatgtgaataggtgtctgtcctggagggaca

SEQ ID NO: 295028 - DNA, 75 bp, Artificial Sequence
  Synthetic
ttttgtgattaaacgactactgggttctggaattttcttgctaatcaagcccacttccagcaaaagccacatatt

SEQ ID NO: 295029 - DNA, 75 bp, Artificial Sequence
  Synthetic
tgctgggcctttgatctctccacttccagggttttcaagccctacatagatgctggggatctgttagttactgac

SEQ ID NO: 295030 - DNA, 75 bp, Artificial Sequence
  Synthetic
tgctggggatctgttagttactgactttgtttcttataagctaagcaagcttactaacctctgcaagtgcgtttc

SEQ ID NO: 295031 - DNA, 75 bp, Artificial Sequence
  Synthetic
tttgtttcttataagctaagcaagcttactaacctctgcaagtgcgtttcattaatggagtcctccttctcattc

SEQ ID NO: 295032 - DNA, 75 bp, Artificial Sequence
  Synthetic
actagttagcgtgattgtcttttgccagattagttgggaattaaactaactctttgaagttgcaccggtctttgt

SEQ ID NO: 295033 - DNA, 75 bp, Artificial Sequence
  Synthetic
acatcagggatgcaacccaaaccagggtcactatctttaatgagcagaagaccctccgaacatctccagagaagt

SEQ ID NO: 295034 - DNA, 75 bp, Artificial Sequence
  Synthetic
ggttataaagatccagaactgcctagaatgcatgagtttagtgtttcttacttgaaggaggcttgcaatcatgcc

SEQ ID NO: 295035 - DNA, 75 bp, Artificial Sequence
  Synthetic
cttgaaggaggcttgcaatcatgccaagctagtcttaaggagcctctatggacagaatttcatggagcaaataga

SEQ ID NO: 295036 - DNA, 75 bp, Artificial Sequence
  Synthetic
gacagaatttcatggagcaaatagacaatcagattatacgagagcttagtgggttgactctagaaaggttagcta

SEQ ID NO: 295037 - DNA, 75 bp, Artificial Sequence
  Synthetic
gacagaatttcatggagcaaatagacaatcagattatacgagagctcagtgggttgactctagaaaggttagcca

SEQ ID NO: 295038 - DNA, 75 bp, Artificial Sequence
  Synthetic
tgagaattggtatgtctataaggatgtggcagacaagaactacacaagggataaattattagtgaagatgtcaaa

SEQ ID NO: 295039 - DNA, 75 bp, Artificial Sequence
  Synthetic
gtggcagacaagaactacacaagggataaattattagtgaagatgtcaaaatatgcctctgagggaaagagccta

SEQ ID NO: 295040 - DNA, 75 bp, Artificial Sequence
  Synthetic
gctatccagaagtttgaggattgtatgaggcagatagagtcacaaggatgcatgcatatttgtttgtttaagaaa

SEQ ID NO: 295041 - DNA, 75 bp, Artificial Sequence
  Synthetic
tgattatgatgcgttaatggatctaatgatagaagatgccaagaacaatgcattcagtcatgttgttaactgcat

SEQ ID NO: 295042 - DNA, 75 bp, Artificial Sequence
  Synthetic
agaaggcctcataaatcagcacgtgtagaagcaatatatagaagtaaatagacacaagcaaacctaattatgtaa

SEQ ID NO: 295043 - DNA, 75 bp, Artificial Sequence
  Synthetic
acattgtacagataagccaaactattgggatatctaagtttagaaacttatgcaataatactttagatgtaagct

SEQ ID NO: 295044 - DNA, 75 bp, Artificial Sequence
  Synthetic
taatcataatttggggtggtggggtgaggcagcagcagtcttaggttcttgtgaatattctagttggcgtgattg

SEQ ID NO: 295045 - DNA, 75 bp, Artificial Sequence
  Synthetic
tagttggcgtgattgtcttctgccaaattagctgggaattaaactaactctttaaagttgcaccggtctttgtgt

SEQ ID NO: 295046 - DNA, 75 bp, Artificial Sequence
  Synthetic
gggatactatgctagtattggaatccatgtgggttctgatactagcatagtgctacaatattgggcggtctttgt

SEQ ID NO: 295047 - DNA, 75 bp, Artificial Sequence
  Synthetic
gggaatattgcattacacttcctcactattacacaccattcatcaagaatatatccggtccttgtcctttaaaat

SEQ ID NO: 295048 - DNA, 75 bp, Artificial Sequence
  Synthetic
atgagcaagagcctggtttgtgacatgatgcaaggatcagatgatagtagcatgctaatcagcttcccagctgat

SEQ ID NO: 295049 - DNA, 75 bp, Artificial Sequence
  Synthetic
atctgagagaagccatatcctggcctcttggtgaaccctctctggctttctttgacctgagctccactagagtgc

SEQ ID NO: 295050 - DNA, 75 bp, Artificial Sequence
  Synthetic
gatgagaaggttctcaccagatgcaaagtggccgcagccatatgcttccgcatgaagaaggagctgggagtgtac

SEQ ID NO: 295051 - DNA, 75 bp, Artificial Sequence
  Synthetic
acaggaatgatgacattagaagggaccagattgccactctagcaatgaggagttgcaagatcaccaatgatctag

SEQ ID NO: 295052 - DNA, 75 bp, Artificial Sequence
  Synthetic
gcccgtcaggaagaggcctctaacctaatgacttcagtcactgaggggggtgggtcattctccttagctgcaatg

SEQ ID NO: 295053 - DNA, 75 bp, Artificial Sequence
  Synthetic
cccccaccccccaatcccgaccgtaaccccaacccccctttcccccaaccccctgggcagccacttaggctgctg

SEQ ID NO: 295054 - DNA, 75 bp, Artificial Sequence
  Synthetic
aaggcagtgttgaagtggaatgaccctggcctgggtttcttcctgcttgacaacccttatgcgtgcgggttggga

SEQ ID NO: 295055 - DNA, 75 bp, Artificial Sequence
  Synthetic
ctatcaccagaactgatttgcagaagctatatgctttcttcatgaagaaggtcaagggctcagctgctagggact

SEQ ID NO: 295056 - DNA, 75 bp, Artificial Sequence
  Synthetic
agaaacgtgtagcgtgagcccaggtggcgctctaattcttagctcttctctaaagtggggatctaggaagaagtt

SEQ ID NO: 295057 - DNA, 75 bp, Artificial Sequence
  Synthetic
aagtatatcatggattactttcctgtgatatctgttgatttgcagagtggtcgtcaggcagcaaaagaggacatt

SEQ ID NO: 295058 - DNA, 75 bp, Artificial Sequence
  Synthetic
cttagtgatttcacaaggttccccaatctgaaagaagccatatcctggcctcttggagaaccctcactagctttc

SEQ ID NO: 295059 - DNA, 75 bp, Artificial Sequence
  Synthetic
tctaatgctgtagttccaaactcagccctcattgctcttatggaggagagcctgatgctgcgctcatcacttcct

SEQ ID NO: 295060 - DNA, 75 bp, Artificial Sequence
  Synthetic
tcagaaactaagagaccgtttgaacataccagagaactggattgaactaataaatgagaatccagaggtgctcta

SEQ ID NO: 295061 - DNA, 75 bp, Artificial Sequence
  Synthetic
tccatagcccaggtgttgtgtcatcattgtcttctggcaatgcagtctgtaaagtcatggcctcagctgtatact

SEQ ID NO: 295062 - DNA, 75 bp, Artificial Sequence
  Synthetic
cccctgggcagccacttaggctgctgtcttgtaagcctgagcagctgccatgacagcagctgacggcttcccatt

SEQ ID NO: 295063 - DNA, 75 bp, Artificial Sequence
  Synthetic
taactctggcactcccaacatttgatgtctccaagatggtagatagaattaccatagacttcaatctggatgaca

SEQ ID NO: 295064 - DNA, 75 bp, Artificial Sequence
  Synthetic
cccctgggcagccacttaggctgctgtcttgtacgcctgagcagctgccatgacagccgctgatggcttcccatt

SEQ ID NO: 295065 - DNA, 75 bp, Artificial Sequence
  Synthetic
tcagaagagtaggataggcaaaacaaccttcctggctgaatgggaaaagctaaagaaaattgtgaagtggttgga

SEQ ID NO: 295066 - DNA, 75 bp, Artificial Sequence
  Synthetic
accttcctggctgaatgggaaaagctaaagaaaattgtgaagtggttggaagatactccagaagcaactctagct

SEQ ID NO: 295067 - DNA, 75 bp, Artificial Sequence
  Synthetic
catgatcatcaaaactacatctggcatgtacaacatcgttgagttcaccacctttaggggagatgaaagaggtgc

SEQ ID NO: 295068 - DNA, 75 bp, Artificial Sequence
  Synthetic
ggtcaggagtcagtaagatagccatggttatccgtgacaatttctcccggatgggccacctccgaggtgtagaag

SEQ ID NO: 295069 - DNA, 75 bp, Artificial Sequence
  Synthetic
cgatggcaaggatctgtgccctcttcagggattggatgtgagagggggccatcctatgtgcaacctgtggagaga

SEQ ID NO: 295070 - DNA, 75 bp, Artificial Sequence
  Synthetic
acagtgagagctataagctacagctaatctacagagtcctaagctcagtgtcaaacgttgagataaaggaatcag

SEQ ID NO: 295071 - DNA, 75 bp, Artificial Sequence
  Synthetic
atggtaagactaaaacaaatttgattgggatccttcagagatttctagatggtgatcacgttgtccccattattg

SEQ ID NO: 295072 - DNA, 75 bp, Artificial Sequence
  Synthetic
tcatcaggctgagaaaggaagaggtggagatgaaagtgcggggctctactcttaacttgtacaccaagcaccatt

SEQ ID NO: 295073 - DNA, 75 bp, Artificial Sequence
  Synthetic
ctcaagactgaagaaaatctgctaccagactcatttgtctgctttgagcataaaggacagtataaaggaacaata

SEQ ID NO: 295074 - DNA, 75 bp, Artificial Sequence
  Synthetic
ttctgaatcttccctaagatcaaaagtcggatctatgttctcatttgtcgccaatgtcgaggaggcccatgatgt

SEQ ID NO: 295075 - DNA, 75 bp, Artificial Sequence
  Synthetic
tcagtatgccaatgcctattgttcacatgctaatgggtctgggattgtacagatacaagtgtccggggtctggaa

SEQ ID NO: 295076 - DNA, 75 bp, Artificial Sequence
  Synthetic
tgcagttgcttgtgctagcggggtttgcgtcacaggatcgcagagcccttctactgagatcactcttaagtatcc

SEQ ID NO: 295077 - DNA, 75 bp, Artificial Sequence
  Synthetic
agtttgccctcatgctatgtgagttcacctctcctaagtggtggccactgatcattaggggatgttcaatgttta

SEQ ID NO: 295078 - DNA, 75 bp, Artificial Sequence
  Synthetic
atgtcaatctctttgggccagcccactacaaggacatcagttcattatctatgattgctcatcccttgatggata

SEQ ID NO: 295079 - DNA, 75 bp, Artificial Sequence
  Synthetic
acacaaagatggtgcattaaatgtatgttttattaacaattctaacctcggttctggtgtgtgaagcgattatta

SEQ ID NO: 295080 - DNA, 75 bp, Artificial Sequence
  Synthetic
tttgttgttgtattcgtattcagctctgttgcaataatttgtctggccatcctttataaggtgctcaggtgccta

SEQ ID NO: 295081 - DNA, 75 bp, Artificial Sequence
  Synthetic
tgatatctgttgatttgcagagtggtcgtcgtgttgtgtcagtggagtacattagaggagatggtcctcccagga

SEQ ID NO: 295082 - DNA, 75 bp, Artificial Sequence
  Synthetic
gggaaccctgctcctattcctcgtcatgctccaattccacgttatagcacgtatctaatgctactattgattatc

SEQ ID NO: 295083 - DNA, 75 bp, Artificial Sequence
  Synthetic
agctgcaagatcaccaatgatctagaggactcctttgttggcttacacaggatgatagtgaccgaggccatcctc

SEQ ID NO: 295084 - DNA, 75 bp, Artificial Sequence
  Synthetic
aggactcctttgttggcttacacaggatgatagtgaccgaggccatcctcagagggattgacctgtgcctgttgc

SEQ ID NO: 295085 - DNA, 75 bp, Artificial Sequence
  Synthetic
agagggattgacctgtgcctgttgccaggctttgatctcatgtatgaggttgctcatgtacagtgtgttaggctc

SEQ ID NO: 295086 - DNA, 75 bp, Artificial Sequence
  Synthetic
tgattagaggttaaggctgccccaccccccaccccccaatcccgaccgtaaccccaactcccctttcccccaacc

SEQ ID NO: 295087 - DNA, 75 bp, Artificial Sequence
  Synthetic
gaaatagatatcatcccaagagtcaatatcagggatgcaacccaaaccagggtcactatctttaatgagcagaag

SEQ ID NO: 295088 - DNA, 75 bp, Artificial Sequence
  Synthetic
atctcgctggattcactcgtagtgtgtcagctgaaatcctcaagcacttcctattctgtatactacagggccctt

SEQ ID NO: 295089 - DNA, 75 bp, Artificial Sequence
  Synthetic
tagttgtaatttggggtggtggggtgaggcagcagcagtctcaattacttgtggatatcctaatcggcgtggttg

SEQ ID NO: 295090 - DNA, 75 bp, Artificial Sequence
  Synthetic
tttaagagttcgataaccctacgagcatcaaacccttgataagcaaactctcggacccactgttcaatctcattg

SEQ ID NO: 295091 - DNA, 75 bp, Artificial Sequence
  Synthetic
tagagttatatgaggagacagatgtggcggatgacatgctaggctgagaccagtaagcaaagtctggcttagatt

SEQ ID NO: 295092 - DNA, 75 bp, Artificial Sequence
  Synthetic
gacataagcaaacctaattatgtaagtattgtacagataggtcaaattattggaatatccaagcttagaaactta

SEQ ID NO: 295093 - DNA, 75 bp, Artificial Sequence
  Synthetic
attcccataccgagtcggacttggagactttgcatcaaatgttgcacctccaccagcaaagccttttcagagact

SEQ ID NO: 295094 - DNA, 75 bp, Artificial Sequence
  Synthetic
tcagattgccactctagcaatgaggagttgcaagatcaccaatgatctagaggactcctttgttggcttacacag

SEQ ID NO: 295095 - DNA, 75 bp, Artificial Sequence
  Synthetic
caggctttgacctcatgtatgaggttgctcacgtacagtgtgttcggctcctgcaggcagcaaaagaggacattt

SEQ ID NO: 295096 - DNA, 75 bp, Artificial Sequence
  Synthetic
atgacagctgctgacggctttccattagaatccacaagcccaaaagctttcaagaatcctctcctcttctcatgg

SEQ ID NO: 295097 - DNA, 75 bp, Artificial Sequence
  Synthetic
agaattctctcctcttctcatggcttatgaagttgctattcactgctgcattcattggctgcgtgaacgttgcag

SEQ ID NO: 295098 - DNA, 75 bp, Artificial Sequence
  Synthetic
catctaatattgcccttagatagtcttctggtagagaagggtccaccatgccagcaaagctggggtgcatcatat

SEQ ID NO: 295099 - DNA, 75 bp, Artificial Sequence
  Synthetic
cctggcatgtccagccagccagggcggcagcaactcgtgatagagttaactcatcccgggaaggattcccttcct

SEQ ID NO: 295100 - DNA, 75 bp, Artificial Sequence
  Synthetic
ggggagccctttattcttaagaagaaggatgggtccatatcctggggtggcatgtttaatcctttctcagggcgc

SEQ ID NO: 295101 - DNA, 75 bp, Artificial Sequence
  Synthetic
gggcttgttgccacgagttagagccagaacaatcattttcttggcatccttctcccagtcagccccaccatactg

SEQ ID NO: 295102 - DNA, 75 bp, Artificial Sequence
  Synthetic
agagacctgttttggtgactccaccaacccagagatgattgaaggagcttgggattcactcagagaggaggagat

SEQ ID NO: 295103 - DNA, 75 bp, Artificial Sequence
  Synthetic
taaaaataaagaagaagagactgagccttcgtccctttctggaatgtataagaagattatagaactcgagcacct

SEQ ID NO: 295104 - DNA, 75 bp, Artificial Sequence
  Synthetic
tcaggcataagggaggttaagacctcaagccaggagttatacagggcattaaaagccatcattgctgctgatggc

SEQ ID NO: 295105 - DNA, 75 bp, Artificial Sequence
  Synthetic
gaagcctttatgtgtaggatatgagagagtggttgtgaagagagaactctctgccaagcccatccagagagttga

SEQ ID NO: 295106 - DNA, 75 bp, Artificial Sequence
  Synthetic
gggctgactctagaaaggctagccacactcaaggccacaagcaacttcaatgagaattggtatgtttataaagat

SEQ ID NO: 295107 - DNA, 75 bp, Artificial Sequence
  Synthetic
gggaaccctgcccctattcctcgtcatgccccaatcccacgttatagcacatacctgatgttactattgattgtc

SEQ ID NO: 295108 - DNA, 75 bp, Artificial Sequence
  Synthetic
aacaatgacgggaaaatggcttcagtcaagtgccctcctaagtatgagctcactgaggactgcaacttttgtagg

SEQ ID NO: 295109 - DNA, 75 bp, Artificial Sequence
  Synthetic
tatgatcattaaaactacatctggcgtatacaacatcgttgagttcaccaactttaggggagatgaaagaggtgc

SEQ ID NO: 295110 - DNA, 75 bp, Artificial Sequence
  Synthetic
atagctaggtctatagggaagttctttgcatctgataccctctgtaatccccccaataaggtaaaaattcctgag

SEQ ID NO: 295111 - DNA, 75 bp, Artificial Sequence
  Synthetic
tctttacgttgttagtgcttatcgggcatggtgcatggtctatctggagctagagcggactctgaagcagaggga

SEQ ID NO: 295112 - DNA, 75 bp, Artificial Sequence
  Synthetic
tttgctctgcttatgagtgcactgctcagtacgccaatgcctattgttcacatgctaatgggtcagggattgtgc

SEQ ID NO: 295113 - DNA, 75 bp, Artificial Sequence
  Synthetic
gcatggtgcatggtctatctggagctagagcggactctgaagcagagggagatggtttataggtacagacttgct

SEQ ID NO: 295114 - DNA, 75 bp, Artificial Sequence
  Synthetic
ctgccaagcccatccagagagttgagccttgcacaacttgtataaccaaatgtgagcctcatgggttggttgtcc

SEQ ID NO: 295115 - DNA, 75 bp, Artificial Sequence
  Synthetic
agggatatcccagtcctctggaggggacataggggttcacatggcacacgatgatcagtcagttagctccaaaat

SEQ ID NO: 295116 - DNA, 75 bp, Artificial Sequence
  Synthetic
ccgtgcttagtgcacggctgcatagtgtgtgctcatggcctgataaattaccagtgtcacactgctctcagtgcc

SEQ ID NO: 295117 - DNA, 75 bp, Artificial Sequence
  Synthetic
tttgttgttgtgtttgtattcagttctattgcaataatttgtttagctattctttatagggtgctcaagtgccta

SEQ ID NO: 295118 - DNA, 75 bp, Artificial Sequence
  Synthetic
atcaagtgaacagggagataggatggatggaaggaggtcagttggttctagggaaccctgcccctattcctcgtc

SEQ ID NO: 295119 - DNA, 75 bp, Artificial Sequence
  Synthetic
tttcgggagtaaaggacaggccagagagagaaacagataccatagagtccacctaaatatgggctcagatgtatt

SEQ ID NO: 295120 - DNA, 75 bp, Artificial Sequence
  Synthetic
tcatatgcatcagcatgttcagaactgattcaggcaagctccagaatcactacttgctccacagagggtgtcaac

SEQ ID NO: 295121 - DNA, 75 bp, Artificial Sequence
  Synthetic
cacgatgtgatcacatatctgaatttctctctgcatgctctagtgacttgtgggcaacagatgaggacctgtaca

SEQ ID NO: 295122 - DNA, 75 bp, Artificial Sequence
  Synthetic
gccctctctcttgtgataagagattcagttggcagcccagaggattcatcagccatccttgtcagaaaggggttt

SEQ ID NO: 295123 - DNA, 75 bp, Artificial Sequence
  Synthetic
agctattggactgggtcctttagccccaaatgtctgagctcaaggagatgccatcttgtcggggaatgtcatgtg

SEQ ID NO: 295124 - DNA, 75 bp, Artificial Sequence
  Synthetic
catgagatcataacagagcactacaaattcatgggaagtaggataggtcatggttgccaaatggtcagcttgata

SEQ ID NO: 295125 - DNA, 75 bp, Artificial Sequence
  Synthetic
ctggagatcacagactttgatggctctgtttcaacaatagacttgggagcatcatctagccgtttcacaaactgg

SEQ ID NO: 295126 - DNA, 75 bp, Artificial Sequence
  Synthetic
ggttcagttagcctctcactggacgcagagggcatttcaggctcaaatagcttttctttcattgagagcccaggc

SEQ ID NO: 295127 - DNA, 75 bp, Artificial Sequence
  Synthetic
tgtgattaaacgactactaggttctgggattttcttgctaatcaagcccacttccagcaaaagccatatatttgt

SEQ ID NO: 295128 - DNA, 75 bp, Artificial Sequence
  Synthetic
aaagggtatgcaattgttgatgagccattctcagaaattcctcggcaagggttcttgggggagatcaggtgcaat

SEQ ID NO: 295129 - DNA, 75 bp, Artificial Sequence
  Synthetic
gtcttttgcattaagcgctcttgctgggcctttgatctctccacttccagggttttcaagccctactaagatgct

SEQ ID NO: 295130 - DNA, 75 bp, Artificial Sequence
  Synthetic
gggcctttgatctctccacttccagggttttcaagccctactaagatgctggggattctgttagttactgacttt

SEQ ID NO: 295131 - DNA, 75 bp, Artificial Sequence
  Synthetic
cgaacattgaggaattagagtcactggattctatagtttacaacaagggtgaaatagatatcattccaagagtca

SEQ ID NO: 295132 - DNA, 75 bp, Artificial Sequence
  Synthetic
ccttatctcatacaagcccatgatagatcaattggagtgctcaacaaatctgattgacccctttgttgtatttaa

SEQ ID NO: 295133 - DNA, 75 bp, Artificial Sequence
  Synthetic
aatggagtcctccttctcattctgggcagaagcatttggaattcaagctggaactttggttggtgactttgttcc

SEQ ID NO: 295134 - DNA, 75 bp, Artificial Sequence
  Synthetic
accctccgaacatccccagagaagttggtgtcagacaagtggtttgggactcagaaaagtagaataggcaaaaca

SEQ ID NO: 295135 - DNA, 75 bp, Artificial Sequence
  Synthetic
ggaaagcaagcctagaacggtcagaataacaggagcccctgtaaagaagaggtcaggggttagcaagatagctat

SEQ ID NO: 295136 - DNA, 75 bp, Artificial Sequence
  Synthetic
aagagatgggagcagggacagtgggtggattcatcaagagacaacagtctaaagttgtacaaaacaaagtggtct

SEQ ID NO: 295137 - DNA, 75 bp, Artificial Sequence
  Synthetic
tagaagcaatatgtagaaataagtagacataagcaaacctaattatgtaaatattgtacagataggtcaaattat

SEQ ID NO: 295138 - DNA, 75 bp, Artificial Sequence
  Synthetic
gacataagcaaacctaattatgtaaatattgtacagataggtcaaattattgggacatccaagcttagaaacttc

SEQ ID NO: 295139 - DNA, 75 bp, Artificial Sequence
  Synthetic
tagttgtaatttggggtggtggggtgaggcagcagcagtctcaagtgcttgtgaatattctagttggcgtgattg

SEQ ID NO: 295140 - DNA, 75 bp, Artificial Sequence
  Synthetic
gtgaatattctagttggcgtgattgtcttttgccagattagctgggaattaaactaactctttgaagttgcaccg

SEQ ID NO: 295141 - DNA, 75 bp, Artificial Sequence
  Synthetic
tacaaggagcatctgaaataggctcaactttgctaccctccatgtcgatagatgtggaagatatggccaattttg

SEQ ID NO: 295142 - DNA, 75 bp, Artificial Sequence
  Synthetic
atctgaaagaagccgtatcatggcctcttggagaaccttctctggctttctttgacctaagttctactagagtgc

SEQ ID NO: 295143 - DNA, 75 bp, Artificial Sequence
  Synthetic
ttatcagattgagaaaagaggaggtggagatgaaagtacggggttctactctcaacttgtacactaagcaccact

SEQ ID NO: 295144 - DNA, 75 bp, Artificial Sequence
  Synthetic
aagattcctttgttggcttacacaggatgatagtaaccgaggccattctcagaggaattgacctgtgcctgttac

SEQ ID NO: 295145 - DNA, 75 bp, Artificial Sequence
  Synthetic
agagttggatgttagtggcccttacgagatggagtcttttcatggtaggtctactctaacttgtacaccaagcac

SEQ ID NO: 295146 - DNA, 75 bp, Artificial Sequence
  Synthetic
tctcagtccaggcatttcaagtcatattagatgagggggtgctcttaatagccctagttaacaattatttgagag

SEQ ID NO: 295147 - DNA, 75 bp, Artificial Sequence
  Synthetic
attagatgagggggtgctcttaatagccctagttaacaattatttgagagggagcaaagcaaactgctgggtgag

SEQ ID NO: 295148 - DNA, 75 bp, Artificial Sequence
  Synthetic
tctcttcagaactctacagagaccagaagagagcattaggatagatgatctggagttgtatgaggagacagatgt

SEQ ID NO: 295149 - DNA, 75 bp, Artificial Sequence
  Synthetic
taacagaaccagactctcagagattgtagaatttgttctgaatcttcctaagatcaaaagtcggatctatgttct

SEQ ID NO: 295150 - DNA, 75 bp, Artificial Sequence
  Synthetic
acacaaagctccctagagatacaaacactattacaataatggacaactatcaagagcttgcgatccagtttgctg

SEQ ID NO: 295151 - DNA, 75 bp, Artificial Sequence
  Synthetic
accagacaaagctgggtaaggatcgttatattaataattatgacttagtacacttaggattcaagatcctatcga

SEQ ID NO: 295152 - DNA, 75 bp, Artificial Sequence
  Synthetic
ctggagtaggctcaaggcaaaggttttttgaaatggcttctctcttgaagagcttagccctgttcaagaggaaca

SEQ ID NO: 295153 - DNA, 75 bp, Artificial Sequence
  Synthetic
aagacaagccaccccttgctgcaggctctggtggtgctatccgaggaatcaagcatgtcattattgttccgatcc

SEQ ID NO: 295154 - DNA, 75 bp, Artificial Sequence
  Synthetic
caggggactcctcaatcaccacaagatcacgccttctagaccgtcttgttaaaatggtgggggacccagacatca

SEQ ID NO: 295155 - DNA, 75 bp, Artificial Sequence
  Synthetic
gtggtcccaaattaactggggctctcatcagtatcctgtcgctgtttgttgaatcacccggccaactgattcaaa

SEQ ID NO: 295156 - DNA, 75 bp, Artificial Sequence
  Synthetic
ggatcactgatgaccccgatatcagcattaaattggtggaggtaattcaaagtgacaaaactcagtcgggattga

SEQ ID NO: 295157 - DNA, 75 bp, Artificial Sequence
  Synthetic
agcttggccctattcaaaaagaataaagacaagccaccccttgctgcaggctcaggtggtgctattcggggaatc

SEQ ID NO: 295158 - DNA, 75 bp, Artificial Sequence
  Synthetic
cctttgcctctaggggtacgagcatggatgacgaggctgatagatattttacttatgatgaacctaatggcggag

SEQ ID NO: 295159 - DNA, 75 bp, Artificial Sequence
  Synthetic
aaaatggtgggggacccagacatcagtggtcctaaattgactggggctctcatcagcatcctgtcgctgttcgtt

SEQ ID NO: 295160 - DNA, 75 bp, Artificial Sequence
  Synthetic
aagagaggcagtcttattggtttgagaacagggagattcaggacattgaagtccaggatccagaagggttcaata

SEQ ID NO: 295161 - DNA, 75 bp, Artificial Sequence
  Synthetic
tgatactagcaactatcttagcccagatctggatcttattggctaaagcagtcacagcccctgatactgcagccg

SEQ ID NO: 295162 - DNA, 75 bp, Artificial Sequence
  Synthetic
gtcacagcccctgatactgcagccgactcagagttacggaggtgggtgaaatacacccaacaaaggagggtcatt

SEQ ID NO: 295163 - DNA, 75 bp, Artificial Sequence
  Synthetic
ggagaattcaggcttgacaaaggatggcttgacacagtacgtaacaggatcgcagaagatctctccttacgcaga

SEQ ID NO: 295164 - DNA, 75 bp, Artificial Sequence
  Synthetic
ttcatggtggcattgatcttggacatcaagagaactccagggaacaaaccgaggattgctgagatgatctgtgac

SEQ ID NO: 295165 - DNA, 75 bp, Artificial Sequence
  Synthetic
attgacacctacatagtggaggcagggttggctagttttatactcactatcaagttcggtatagaaaccatgtac

SEQ ID NO: 295166 - DNA, 75 bp, Artificial Sequence
  Synthetic
ccagcactgggcttgcatgaatttgccggagaactctccacaatagagtctctcatgaatctgtaccaacaaatg

SEQ ID NO: 295167 - DNA, 75 bp, Artificial Sequence
  Synthetic
ggtgaactggctccgtacatggtgattttggagaactcgattcagaacaaattcagtgcaggggcgtaccccctg

SEQ ID NO: 295168 - DNA, 75 bp, Artificial Sequence
  Synthetic
ttatggagctatgccatgggggtaggcgttgaactagagaactccatgggaggactcaattttggcagatcttat

SEQ ID NO: 295169 - DNA, 75 bp, Artificial Sequence
  Synthetic
gcaagtaagaaagatgaagcgagagtaccccaagttaggaaagaaacctgggctagcagcaggttagacaggtac

SEQ ID NO: 295170 - DNA, 75 bp, Artificial Sequence
  Synthetic
tttgaccccgcatatttcaggctgggacaagaaatggtaaggaggtcagctgggaaggtcagctctaatttggcg

SEQ ID NO: 295171 - DNA, 75 bp, Artificial Sequence
  Synthetic
tctgagctcggcatcaccgaggaagaagcgagacttgtctcagagattgcagcatacacaggtgatgatcggaac

SEQ ID NO: 295172 - DNA, 75 bp, Artificial Sequence
  Synthetic
gacaccgatcctctggggagcaagaagtcggcagaggctatacttaaactgcaggctatggccagcatcctgggg

SEQ ID NO: 295173 - DNA, 75 bp, Artificial Sequence
  Synthetic
agtagaacctccggacccaaacaggcccaggtttcattcctgcgtaccgatcaagggagtgagacccagcacaat

SEQ ID NO: 295174 - DNA, 75 bp, Artificial Sequence
  Synthetic
gcaagtaagaaagatgaagcgagagcaccccaatttaggaaggacacctgggccagcagcaggtcagacaggtac

SEQ ID NO: 295175 - DNA, 75 bp, Artificial Sequence
  Synthetic
cccttgcagcatgggtcgagaccccagagggggacacgcccgatcgaatgtcctccgacaaggccgaggcagacc

SEQ ID NO: 295176 - DNA, 75 bp, Artificial Sequence
  Synthetic
aagggagatacaagtaaagaacctgtaagcccctcagtcaagactctgattgatgtggacacaaccccggaggta

SEQ ID NO: 295177 - DNA, 75 bp, Artificial Sequence
  Synthetic
agagggggacacgcccgatcgaatgtcctccgacaaggccgaggcagaccatcagagcaccagcaggccatgccg

SEQ ID NO: 295178 - DNA, 75 bp, Artificial Sequence
  Synthetic
gacaccgatcccttagggagcaagaagtcagcagaggcccttattagactgcaggctatggccagcatcctggag

SEQ ID NO: 295179 - DNA, 75 bp, Artificial Sequence
  Synthetic
tacagtgttatcatgtttctgatcacagcggtgaaaaggttgagggagtcgaagatgctgactctatcctggttc

SEQ ID NO: 295180 - DNA, 75 bp, Artificial Sequence
  Synthetic
cagcggtgaaaaggttgagggagtcgaagatgctgactctatcctggttcaaccaggcgctgatgatggtatcaa

SEQ ID NO: 295181 - DNA, 75 bp, Artificial Sequence
  Synthetic
gactcaacacttggcaatgacagtccgagagcatacaacgacaaggatctcctcagttaagtggatgctccacac

SEQ ID NO: 295182 - DNA, 75 bp, Artificial Sequence
  Synthetic
gctccggcccgcaatctccccatgcaagtcattattataaaaaacttaggacccaggtctacaagtccgcccatc

SEQ ID NO: 295183 - DNA, 75 bp, Artificial Sequence
  Synthetic
actgcagcaacaagagcctctgatgttgaaacaatagaaggagacaagatccagaagctgctggaggatcaatca

SEQ ID NO: 295184 - DNA, 75 bp, Artificial Sequence
  Synthetic
aagtcattattataaaaaacttaggacccaggtctacaagtccgcccatcccgagacaaccccctccggcaactg

SEQ ID NO: 295185 - DNA, 75 bp, Artificial Sequence
  Synthetic
atccagatggcagaggagcaagcctaccatgtcaacaaaggtctggagtgcatcaaagcccttagggctcgacct

SEQ ID NO: 295186 - DNA, 75 bp, Artificial Sequence
  Synthetic
ctcgaccccctggttgttgaagaagcccttgcagcatgggtcgagacctcagagggggagacgcttgatcggatg

SEQ ID NO: 295187 - DNA, 75 bp, Artificial Sequence
  Synthetic
agtcaccgtgggggccgtcagggccaaatgtacctgcggggaatgccctcttgtctgtgagcaatgctccaccga

SEQ ID NO: 295188 - DNA, 75 bp, Artificial Sequence
  Synthetic
tcctccgacgagaccgaagcagaccatcagggtgtcagcaagccatgctgcccagcaactggaccaggcaaaagc

SEQ ID NO: 295189 - DNA, 75 bp, Artificial Sequence
  Synthetic
agtaacacaggagctgaggatgattacgaagatgagctgttctcggatatccaagacatcaaagcaacactagcc

SEQ ID NO: 295190 - DNA, 75 bp, Artificial Sequence
  Synthetic
agcaagtctcgcagtcacgatcagggatctggagaaagcaacagctgtgatgaggggctgggagcactcatggat

SEQ ID NO: 295191 - DNA, 75 bp, Artificial Sequence
  Synthetic
gactccccaatacataacaccgaggtacagcgttatcatgtttatgatcacggcggtgaaaaggttgagggagtc

SEQ ID NO: 295192 - DNA, 75 bp, Artificial Sequence
  Synthetic
gaagatgctgactctatcctggttcaatcagtcgctgatgatggtgtcgagttctggggaggagatgaggaatct

SEQ ID NO: 295193 - DNA, 75 bp, Artificial Sequence
  Synthetic
ctccaaggatcttgctcagttccatcagatgctggaaaaaattctaaagaactaggctcgacacaacacggctga

SEQ ID NO: 295194 - DNA, 75 bp, Artificial Sequence
  Synthetic
gagaacagcgatgtggatcctggcgaacttgatcccgagggaagtgctcccgctgactggggatcttctcccatt

SEQ ID NO: 295195 - DNA, 75 bp, Artificial Sequence
  Synthetic
tccttgcgcttctcctcaacttagcaatagcctgcatgctcattacaaaaaacttaggagcaaggagtaatgctc

SEQ ID NO: 295196 - DNA, 75 bp, Artificial Sequence
  Synthetic
tctgcagcaacaagagcctccgatgttgaaacaatagaaggagacgagatccagaagctgctggaggatcagtca

SEQ ID NO: 295197 - DNA, 75 bp, Artificial Sequence
  Synthetic
cgcactctcggcatggcagaaatttatgatttcgacaagtcctcgtgggatgtcaaagggtcgatcgcgcccatc

SEQ ID NO: 295198 - DNA, 75 bp, Artificial Sequence
  Synthetic
cggattcggagaatggccaaagcagggaagactcttgtggtgccgccaatcccctctcatgagaggccaaccgca

SEQ ID NO: 295199 - DNA, 75 bp, Artificial Sequence
  Synthetic
aggccaacaacatacaatgacggccggttgatccctcaagtaagagtaattgacccaggactcggggatcgaaaa

SEQ ID NO: 295200 - DNA, 75 bp, Artificial Sequence
  Synthetic
tgttggggattgttgaagacagtgatccgctaagtctcccgcgaggccgaacttttggttccctacctttaggag

SEQ ID NO: 295201 - DNA, 75 bp, Artificial Sequence
  Synthetic
ttagataaacccattaaaaagggcacaggcgcgaaatcagcctcatctggaacgatgaccgagtcttcatcgaca

SEQ ID NO: 295202 - DNA, 75 bp, Artificial Sequence
  Synthetic
ggtggtgcaacccgacctgctcaaaagtcaccgtggggaccgtcagggccaaatgtatctgtggggaatgccctc

SEQ ID NO: 295203 - DNA, 75 bp, Artificial Sequence
  Synthetic
gtgtctgtgagcaatgcttcactgacccagggatcgaaaacagggtctggtaccgcagtctcgcagatatcccag

SEQ ID NO: 295204 - DNA, 75 bp, Artificial Sequence
  Synthetic
atcccgttagatactccacagaggttccgcgtggtgtacatgagtatcacgcggctatctgacagcggttgttac

SEQ ID NO: 295205 - DNA, 75 bp, Artificial Sequence
  Synthetic
agtaacacaggaactgaggatgattacgatgatgaactgttctctgatatccaagacatcaaagcagctctagct

SEQ ID NO: 295206 - DNA, 75 bp, Artificial Sequence
  Synthetic
aaattgcatgaggatcaacaagttataattaccagattagagtcactgctttcgctcaagggggagattgattcg

SEQ ID NO: 295207 - DNA, 75 bp, Artificial Sequence
  Synthetic
gatacgggcaccgaacctggaagaccagaggtgggggcagtgggcctttccgaggcaacatttatggtccatatt

SEQ ID NO: 295208 - DNA, 75 bp, Artificial Sequence
  Synthetic
atcaagaagcaaatcaataagcagaacattggcatatctaccatagaaggccatctctctagcatcatgatcgcg

SEQ ID NO: 295209 - DNA, 75 bp, Artificial Sequence
  Synthetic
cagaggtgggggcagtgggcctttccgaggcaacatttatggtccatattgggaacttcagaaggaagaagaacg

SEQ ID NO: 295210 - DNA, 75 bp, Artificial Sequence
  Synthetic
atcccgggatttggcaaggatcccaatgatcccactgcagatgtcgatataaaccctgacctgagacctataatt

SEQ ID NO: 295211 - DNA, 75 bp, Artificial Sequence
  Synthetic
ggtcgggactcagggagggctctcgctgaggtgcttaaaaagccggcgtcagacagacaatccaaggacactggt

SEQ ID NO: 295212 - DNA, 75 bp, Artificial Sequence
  Synthetic
aaatcaggaatcgaatccaaaggcctgttgaagagggagttccaactgaagccaatcgaaaagaactcaagttcg

SEQ ID NO: 295213 - DNA, 75 bp, Artificial Sequence
  Synthetic
cccagagcaggagccacacaccacccacaccacaaccccacccgacccggacccctccacagccccgcccacccc

SEQ ID NO: 295214 - DNA, 75 bp, Artificial Sequence
  Synthetic
gctatcagatttgtcccggacagcagtgtcgcatctcgtagtgtgatccgttcaattatcaaggcaagtcatctt

SEQ ID NO: 295215 - DNA, 75 bp, Artificial Sequence
  Synthetic
cgcaaccaaccaaatcccaaacaacgcgcgaccgccgcacacccagacgacacccccgacaacgaccccaacagc

SEQ ID NO: 295216 - DNA, 75 bp, Artificial Sequence
  Synthetic
ggagaggatcgcaagaattacctgatgggcctcttgaatgatattcagggctccaaggatcttgctcagttccat

SEQ ID NO: 295217 - DNA, 75 bp, Artificial Sequence
  Synthetic
cagatgctggccaaaattataaagaactaggctcggcacaacacagtcgatccttgcgcttttccccagcttagc

SEQ ID NO: 295218 - DNA, 75 bp, Artificial Sequence
  Synthetic
tgtagcctgcatgctcattataaaaaacttaggagcaaagcgtaatgctccgcactcccagcatggcagagattt

SEQ ID NO: 295219 - DNA, 75 bp, Artificial Sequence
  Synthetic
cccaccccacagagcagggcggaaccaaggggcaggcccgccccatgcacagcaacagaacacctccagatcccc

SEQ ID NO: 295220 - DNA, 75 bp, Artificial Sequence
  Synthetic
aaaagggacaacaccatcgccacccaaccaaactggaaaccagggagcagccacccgcagggcccaaagcccggg

SEQ ID NO: 295221 - DNA, 75 bp, Artificial Sequence
  Synthetic
atgatttcgacaagtctgcgtgggatgtcaaagggtcgattgcgcctatcaggccaacaacatacagtgacggcc

SEQ ID NO: 295222 - DNA, 75 bp, Artificial Sequence
  Synthetic
tgtcaaagggtcgattgcgcctatcaggccaacaacatacagtgacggccggttgattccccaagtaagagtaat

SEQ ID NO: 295223 - DNA, 75 bp, Artificial Sequence
  Synthetic
tcccccgaccccagacccccaacagcagcatcccccacccacccctcccgccactctccccggaactccgctccc

SEQ ID NO: 295224 - DNA, 75 bp, Artificial Sequence
  Synthetic
tgacccaggactcggggatcgaaaagatgagtgcttcatgtacatctttctgttggggattgttgaagacagtga

SEQ ID NO: 295225 - DNA, 75 bp, Artificial Sequence
  Synthetic
tgttggggattgttgaagacagtgacccgctaagtcccccgcgaggccgaacttttggttccctaccactaggag

SEQ ID NO: 295226 - DNA, 75 bp, Artificial Sequence
  Synthetic
ccgcaccccaacacggaaggcctcggccgcccagcgccgccgaagacccagccagaaggagcaccaaaagcagac

SEQ ID NO: 295227 - DNA, 75 bp, Artificial Sequence
  Synthetic
gccgcccagcgccgccgaagacccagccagaaggagcaccaaaagcagaccaccgggccttgcggtggaccccgc

SEQ ID NO: 295228 - DNA, 75 bp, Artificial Sequence
  Synthetic
ggagttgctcaaagaggcgacagatctagatatagtcgtcagacgcacagcagggttgaacgaaaaactggtgtt

SEQ ID NO: 295229 - DNA, 75 bp, Artificial Sequence
  Synthetic
tcaggtgtgcagttcggtcaacctgatccccctagataccccacagagattccgagtggtgtacatgagtatcac

SEQ ID NO: 295230 - DNA, 75 bp, Artificial Sequence
  Synthetic
gcgtctatccgacaacggttattacactgtaccaagaaagatgctagagtttagatccgccaatgcaatggcatt

SEQ ID NO: 295231 - DNA, 75 bp, Artificial Sequence
  Synthetic
caatttgttggtcaccctcaaaattgatagggacaccgaacctggaagaccagcaatggggggagtgggcctttc

SEQ ID NO: 295232 - DNA, 75 bp, Artificial Sequence
  Synthetic
gaggctgttggggacagtgcttaagcctatcagggacgctcttaacgctattactaagaacataaaaccaatcag

SEQ ID NO: 295233 - DNA, 75 bp, Artificial Sequence
  Synthetic
cgaggcgacatttatggtccatattgggaacttcagaaggaagaagaatgaggcctattcagcagattactgtaa

SEQ ID NO: 295234 - DNA, 75 bp, Artificial Sequence
  Synthetic
actgaaatcttgtcattatttggacccagcctcagggacccggtctcggctgagctttctattcaggccttgagt

SEQ ID NO: 295235 - DNA, 75 bp, Artificial Sequence
  Synthetic
gatgaaaattgagaagatgggtttagtttttgcactcggggggatagggggaacaagccttcatataagaagtac

SEQ ID NO: 295236 - DNA, 75 bp, Artificial Sequence
  Synthetic
cgaagacctcaaccgtttgttgtggagatccaaatgcaggatcatcaggattcaggcggtcctacaaccatcagt

SEQ ID NO: 295237 - DNA, 75 bp, Artificial Sequence
  Synthetic
aataataagtcaagaccctgacaagatcctaacatatatagctgcagaccaatgccctgtcgtagaagtaggcga

SEQ ID NO: 295238 - DNA, 75 bp, Artificial Sequence
  Synthetic
cccccaagagttccgcatttatgatgatgtaatcataaatgacgatcaagggcttttcaaggtcctgtgacactc

SEQ ID NO: 295239 - DNA, 75 bp, Artificial Sequence
  Synthetic
gaccagcaccactccacccccgccacaccggcccgcagagacccacagcaaggcaggacgcccgacaccaacatc

SEQ ID NO: 295240 - DNA, 75 bp, Artificial Sequence
  Synthetic
agattcatctgatctgatcctgaaaaacatcaggggtgtttcagtcacaaacgcgggttatattctagtcggagt

SEQ ID NO: 295241 - DNA, 75 bp, Artificial Sequence
  Synthetic
aacccctcccagcagcagggcccaaacccccacaatgcagcaccccaccccgagctcaacccacgaaacacccaa

SEQ ID NO: 295242 - DNA, 75 bp, Artificial Sequence
  Synthetic
cccagggcagcatccacaccccacctgcaccacacccccacctgacccggaccaccccacagccccgcccacccc

SEQ ID NO: 295243 - DNA, 75 bp, Artificial Sequence
  Synthetic
cactgtggtcttgaacccgggtcttagaccagatcttactggtacatctaaatcctacgtacggtcgttgtagca

SEQ ID NO: 295244 - DNA, 75 bp, Artificial Sequence
  Synthetic
cgcaaccaaccaaagcccaaacaacacgcggccgccacacacccaggggacacacccgacaatggccccaacagt

SEQ ID NO: 295245 - DNA, 75 bp, Artificial Sequence
  Synthetic
cgccacccaaaaccgcaatcccagacacaagaccagagccaacagaggaaagggatcacaggaaccaaacaaccc

SEQ ID NO: 295246 - DNA, 75 bp, Artificial Sequence
  Synthetic
cgaggcgagacaacccacccaccatgaataccaaacaaaacttagggtcaaagaaccacaccgacccaagccgcc

SEQ ID NO: 295247 - DNA, 75 bp, Artificial Sequence
  Synthetic
ggaaaggaggacaccatcgccacccaaccaaaccgggaaccagggggcagccacccgcagggcccaaagcccggg

SEQ ID NO: 295248 - DNA, 75 bp, Artificial Sequence
  Synthetic
ttaattatgatcagtattgtgctcacacagctgctgaggagctgataactatgctggtcaattcgtccctagcag

SEQ ID NO: 295249 - DNA, 75 bp, Artificial Sequence
  Synthetic
cccaccacactgagcagagcagaaccaaagggcacgtccgctccgcgcacagcaacaggacaccgcaagatcccc

SEQ ID NO: 295250 - DNA, 75 bp, Artificial Sequence
  Synthetic
cacccaaagccgcctcgacaccgggccgaacccaagggcactcaggtgaacccccagaccccaggcccccaacag

SEQ ID NO: 295251 - DNA, 75 bp, Artificial Sequence
  Synthetic
tctctaagatgtcattggctctttcagggatatactcaggtcgtggctacaatatttcatccatgataacaatca

SEQ ID NO: 295252 - DNA, 75 bp, Artificial Sequence
  Synthetic
caaactacctggagctcccaagacagccggaattggagacctgcatgctagctctaggagagttcaaattagctg

SEQ ID NO: 295253 - DNA, 75 bp, Artificial Sequence
  Synthetic
cagcattccccatgcacccctctcaccactgctcccggaactccgatcccacacctctcccgacggggacagagg

SEQ ID NO: 295254 - DNA, 75 bp, Artificial Sequence
  Synthetic
ccctctgcttagctgataactctgtcgcactgcattacggagggttaagggacgacaaaaagatcaagtttgtca

SEQ ID NO: 295255 - DNA, 75 bp, Artificial Sequence
  Synthetic
gccccctcctctcacctctcaccgccctggtctcaaccccgagaccacccccgcaccccaacacggaaggctccg

SEQ ID NO: 295256 - DNA, 75 bp, Artificial Sequence
  Synthetic
gccacttggcgccgccggagagccagccagacggagcaccaaggacaagccaccgggctccgcgacggacccccc

SEQ ID NO: 295257 - DNA, 75 bp, Artificial Sequence
  Synthetic
ggctctatatcacaaatcataggggaatcatagctgcagggaaggccgtatgggctgtccctgtgacgagagcag

SEQ ID NO: 295258 - DNA, 75 bp, Artificial Sequence
  Synthetic
caactaggcagccccagatccccaaatccaccaaggcatcaatccacggcagagcgaccaaggcactgttcaaca

SEQ ID NO: 295259 - DNA, 75 bp, Artificial Sequence
  Synthetic
gacatacccagaccacccacaaagtacccagaatggagatcttatttgctgccctactagcaatggctaacccac

SEQ ID NO: 295260 - DNA, 75 bp, Artificial Sequence
  Synthetic
acatagccactggccagatccactggggcaatctttcaaaaattggagtcgtgggaacaggtagtgcaagttaca

SEQ ID NO: 295261 - DNA, 75 bp, Artificial Sequence
  Synthetic
aggtgatgacccaatcgagccaccagtcactagttataaagctgatgcccaatatcactgctatagataactgca

SEQ ID NO: 295262 - DNA, 75 bp, Artificial Sequence
  Synthetic
catccttactctccccatcaggtcggggggaggtgactgttacacccccacttacctgtcagacctggccgatga

SEQ ID NO: 295263 - DNA, 75 bp, Artificial Sequence
  Synthetic
ttactaagaatataaaaccaatccagagttccactaccagtaggaggcacacgaggttcgcaggagtcgttttgg

SEQ ID NO: 295264 - DNA, 75 bp, Artificial Sequence
  Synthetic
cttacctgtcagacctggccgatgatgatgttaaattgagctccaatcttgtaatcctcccgagtagaaacctcc

SEQ ID NO: 295265 - DNA, 75 bp, Artificial Sequence
  Synthetic
ctggtgccgctctcggagttgcaactgcagcccagattacagcagggattgctcttcatcagtcaatgatgaatt

SEQ ID NO: 295266 - DNA, 75 bp, Artificial Sequence
  Synthetic
aatatgtgtcagcaacctacgacacctctagagttgagcatgccattgtatactatatctatagcaacgggggac

SEQ ID NO: 295267 - DNA, 75 bp, Artificial Sequence
  Synthetic
cccaggctatcgaaagtcttaaggcaagtttggaaacaaccaatcaagcaattgaggaaatacgacaagcaggtc

SEQ ID NO: 295268 - DNA, 75 bp, Artificial Sequence
  Synthetic
ggggcctcaagctatggtgccatcatttctgctctgttatagattcagggactggcaagcaggtcacccatacag

SEQ ID NO: 295269 - DNA, 75 bp, Artificial Sequence
  Synthetic
aagaaatgatcctggcggtccagggtgtccaagattacatcaacaatgaattggtgcctgcgatgggccagctat

SEQ ID NO: 295270 - DNA, 75 bp, Artificial Sequence
  Synthetic
caatagcagatagcagtgtcttggccctacaagatctctgagaccgggacccccaacagctgtgggaccaggcac

SEQ ID NO: 295271 - DNA, 75 bp, Artificial Sequence
  Synthetic
cctacaagatctctgagaccgggacccccaacagctgtgggaccaggcaccacggtgcaccatgcagacagctat

SEQ ID NO: 295272 - DNA, 75 bp, Artificial Sequence
  Synthetic
cgtgtgacatggtgggtcaaaagctagggctgaagctgctcagatattacactgaaatactgtcattatttggac

SEQ ID NO: 295273 - DNA, 75 bp, Artificial Sequence
  Synthetic
ccagcctcagggacccggtctcggctgagctatctattcaagccttgagttacgccttgggtggggacatcaaca

SEQ ID NO: 295274 - DNA, 75 bp, Artificial Sequence
  Synthetic
tgagctatctattcaagccttgagttacgccttgggtggggacatcaacaaaatactagaaaagcttgggtatag

SEQ ID NO: 295275 - DNA, 75 bp, Artificial Sequence
  Synthetic
cgggagtgatctccttgctatactggaaagtaagggtatcaaggctaagataacctatgtggatatcgaaagtta

SEQ ID NO: 295276 - DNA, 75 bp, Artificial Sequence
  Synthetic
cttcattgtgctcagcatcgcttatccatcgctctccgaaattaagggggtgatagtgcaccgtctagagggtgt

SEQ ID NO: 295277 - DNA, 75 bp, Artificial Sequence
  Synthetic
aaagttatccgaatcatgaacatatcccatatccagaatgcaaccaggagttgttcagtgctcaggataaggagg

SEQ ID NO: 295278 - DNA, 75 bp, Artificial Sequence
  Synthetic
ctcctacaatatagggtcacaagagtggtacaccacagtaccgcgatatgtagcaactcagggttacctcatttc

SEQ ID NO: 295279 - DNA, 75 bp, Artificial Sequence
  Synthetic
aaatttcgatgacacaccctgtgccttcactccggggggcactatctgcagtcaaaatgcattatacccgatgag

SEQ ID NO: 295280 - DNA, 75 bp, Artificial Sequence
  Synthetic
gtgcattcctaaaccattgcttcacagaaatccatgaaatacttaatcaaaatggagtaacaaatgaaaacacat

SEQ ID NO: 295281 - DNA, 75 bp, Artificial Sequence
  Synthetic
cccattgctccaggaatgtttccgtgggtcaaccagatcatgcgctcgtacgttggtctccggatccatagggaa

SEQ ID NO: 295282 - DNA, 75 bp, Artificial Sequence
  Synthetic
caggtttatactatctaaggggaacctcattgccaactgtgcctctatcttgtgcaagtgttacactactggctc

SEQ ID NO: 295283 - DNA, 75 bp, Artificial Sequence
  Synthetic
aataataagtcaagaccctgacaagatcctaacatatatagctgcagaccaatgccctgtcgtagaagtagacgg

SEQ ID NO: 295284 - DNA, 75 bp, Artificial Sequence
  Synthetic
tgtaaccatccaggttgggagcagggagtaccccgacacagtgtacctgcataaaatagatcttggcccaccaat

SEQ ID NO: 295285 - DNA, 75 bp, Artificial Sequence
  Synthetic
cctacacctccctgtgcatgccgccacctctataagaaatgctcaggcttcgggtgaaggattgacttatgagca

SEQ ID NO: 295286 - DNA, 75 bp, Artificial Sequence
  Synthetic
acctctataagaaatgctcaggcttcgggtgaaggattgacttatgagcagtgcgtcgtcaactggaagtcattt

SEQ ID NO: 295287 - DNA, 75 bp, Artificial Sequence
  Synthetic
atcgctagagaagctggatgtggggactaacctcgggaatgcagtgacaaaactagagaaagccaaagatctact

SEQ ID NO: 295288 - DNA, 75 bp, Artificial Sequence
  Synthetic
gccggtgtaaggtttggctgcttcatgcctctgagtttagacagtgaccttacgatgtacctaaaggacaaggct

SEQ ID NO: 295289 - DNA, 75 bp, Artificial Sequence
  Synthetic
agattcatctgacctgattctgaaaaatatcaaaggtgtttcagtcacgaacacaagttatattctagtcggtac

SEQ ID NO: 295290 - DNA, 75 bp, Artificial Sequence
  Synthetic
tgggttgattgcagtagtgggtatcctcattattacgtgttgttgtaaaaagcgcagtagtgacaacaaagtatc

SEQ ID NO: 295291 - DNA, 75 bp, Artificial Sequence
  Synthetic
aactgtggtgttgaacccgggtcttaaaccagaccttactggtacatccaaatcctacgtacgctcgttgtagca

SEQ ID NO: 295292 - DNA, 75 bp, Artificial Sequence
  Synthetic
ggtgtgtctcccatgtgaccactgtccccaaacacctcactaaaccctgcaatgccccgtcctcctcgcagccag

SEQ ID NO: 295293 - DNA, 75 bp, Artificial Sequence
  Synthetic
gtaattaccgcggtgggccaagagctaagaccttctctctcaagaagacacacactgggactgggatctcaaggg

SEQ ID NO: 295294 - DNA, 75 bp, Artificial Sequence
  Synthetic
ccagtcgccatccccagcggacacctcgcctgatcgctcatcaattgttataaagaaaaacttaggatgcaaggt

SEQ ID NO: 295295 - DNA, 75 bp, Artificial Sequence
  Synthetic
catccaccatgtcctccccaagagacagggtcaatgctttctacaaagacaacctccaatttaagaacacccgag

SEQ ID NO: 295296 - DNA, 75 bp, Artificial Sequence
  Synthetic
tgagagcggagtcaggattgcttctcttgtacagggagacaatcagacaattgcagttaccaagcgggtaccaag

SEQ ID NO: 295297 - DNA, 75 bp, Artificial Sequence
  Synthetic
tggttcttaataaagagcagctcctgatagagagaccttacatgttgctggcggtgttgtttgttatgttcctga

SEQ ID NO: 295298 - DNA, 75 bp, Artificial Sequence
  Synthetic
gtctagttgggctgttagcaattgcaggtatcagactccaccgtgctgctgtcaacacagcagagatcaacaatg

SEQ ID NO: 295299 - DNA, 75 bp, Artificial Sequence
  Synthetic
gcctgacgacaagcattgatattaccaagtctattgagtaccaggtcaaggatgtcttaactcctctcttcaaaa

SEQ ID NO: 295300 - DNA, 75 bp, Artificial Sequence
  Synthetic
ggtgcgtcactgatgcctgaagagacacttcatcaggtgatgacacagcagcccggtgactcatcatttcttgac

SEQ ID NO: 295301 - DNA, 75 bp, Artificial Sequence
  Synthetic
taattggggatgaggttgggttgaggacacctcagagattcacagatctgactaagttcatatcagacaagatta

SEQ ID NO: 295302 - DNA, 75 bp, Artificial Sequence
  Synthetic
agttcctcaaccctgataaagagtacgactttcgggatatcaactggtgcatcaaccctccagagagaatcaaga

SEQ ID NO: 295303 - DNA, 75 bp, Artificial Sequence
  Synthetic
acaggctcaaagagaaattatctaattgatagagattcatgctcggtccagctagctagagctctgagaagccac

SEQ ID NO: 295304 - DNA, 75 bp, Artificial Sequence
  Synthetic
ttaattatgatcagtattgtgctcatacagctgctgaggatctgataacaatgctggtcaattcgtccctggcag

SEQ ID NO: 295305 - DNA, 75 bp, Artificial Sequence
  Synthetic
ggactacagtactccgcacatcatcagtcaacttggggaggaactgtactgggcccacaacgactaaaggccaat

SEQ ID NO: 295306 - DNA, 75 bp, Artificial Sequence
  Synthetic
agtcaacttggggaggaactgtactgggcccacaacgactaaaggccaattctctaatatgtcattggctctttc

SEQ ID NO: 295307 - DNA, 75 bp, Artificial Sequence
  Synthetic
gagaggactgatatgaagctcgcatttgttaagtcacccagtcgatccctacggtcagccgtgcggatagccacc

SEQ ID NO: 295308 - DNA, 75 bp, Artificial Sequence
  Synthetic
ctgagaaaggcatgtacgggagcacttacctagtcgggaaatacaatcaaagagccagaaggccaagaacagcgt

SEQ ID NO: 295309 - DNA, 75 bp, Artificial Sequence
  Synthetic
caaactacctggaactcccaagacagccggaattggagacatgcatgctagctctaggagagtccaagttagctg

SEQ ID NO: 295310 - DNA, 75 bp, Artificial Sequence
  Synthetic
aattgggcatttgacatccattaccatcgaccttcagggaaataccaaatgggagaactcctgacctcattcctt

SEQ ID NO: 295311 - DNA, 75 bp, Artificial Sequence
  Synthetic
ccctctgcttggctgatggccctgtcgcactgcattacggggggttaagggacgacaacaagatcaaatttgtca

SEQ ID NO: 295312 - DNA, 75 bp, Artificial Sequence
  Synthetic
aactgggagtatggccatcaccagccgacttagacaccccggccactctttcaggggtagatccgactttggacg

SEQ ID NO: 295313 - DNA, 75 bp, Artificial Sequence
  Synthetic
ccccaagatttacaggaagttctggcatagtgggattatagagccaattcatggtccctcattagatactcaaaa

SEQ ID NO: 295314 - DNA, 75 bp, Artificial Sequence
  Synthetic
gtctctatatcacagctcataggggagtcatagctacagggaaggctatatgggctgttcctgtgacgagaacag

SEQ ID NO: 295315 - DNA, 75 bp, Artificial Sequence
  Synthetic
acgaccaaatgaaaatgggacagtgccgtctagaggcttgtcgagacagaccaccacctttctgtaacagtacag

SEQ ID NO: 295316 - DNA, 75 bp, Artificial Sequence
  Synthetic
attgggagccactagaggccggccgaatactggcatacggagtactaactatcaagctggggctggctgataagc

SEQ ID NO: 295317 - DNA, 75 bp, Artificial Sequence
  Synthetic
acaggtgtttgtaattacgaggtccatgcgttccgcaggataggactaaactcatctgcttgttacaaagcagta

SEQ ID NO: 295318 - DNA, 75 bp, Artificial Sequence
  Synthetic
ctgaaattgacataatttcaggatttggtcccctaatcacacatgactcagggatggacttatacaccccacttg

SEQ ID NO: 295319 - DNA, 75 bp, Artificial Sequence
  Synthetic
acggtaacgggtactggctgactattcctccattgcagaatttagctctaggaacggtgaacactctagttttag

SEQ ID NO: 295320 - DNA, 75 bp, Artificial Sequence
  Synthetic
ctatagatcccggagaggatagcttgttcttaggggaaggatcagggtcaatgttggttatatataagaacgtcc

SEQ ID NO: 295321 - DNA, 75 bp, Artificial Sequence
  Synthetic
ttaagttgaagcaatgcttttataatagcggggtatcagcagagtctagatcaggccagcgagagttagcccctt

SEQ ID NO: 295322 - DNA, 75 bp, Artificial Sequence
  Synthetic
agcccagtctcaaaattagtcctaacatccttactctccccatcagatcgggagggggtgactgttacactccca

SEQ ID NO: 295323 - DNA, 75 bp, Artificial Sequence
  Synthetic
tcaggccagcgagagttagccccttacccgtctgaagtgagcctggttgaacatcagcttggtgtggagaaaact

SEQ ID NO: 295324 - DNA, 75 bp, Artificial Sequence
  Synthetic
cttacctgtcagatcgggctgacgatgctgttaaattgagctccaatcttgtaatcctcccgagtaggaacctcc

SEQ ID NO: 295325 - DNA, 75 bp, Artificial Sequence
  Synthetic
gtaatcctcccgagtaggaacctccaatatgtgtcagcaacctacgacatctctagagtcgagcatgccattgta

SEQ ID NO: 295326 - DNA, 75 bp, Artificial Sequence
  Synthetic
gggactcaaggctaatagactgatagaccctgaaagaatcaaacaacaggtagtagattctggggtcagaaccat

SEQ ID NO: 295327 - DNA, 75 bp, Artificial Sequence
  Synthetic
agcctgcagatcggatgcttcccgtggggccgcaagctatggtgccatcatttctgctctgttatagattcagga

SEQ ID NO: 295328 - DNA, 75 bp, Artificial Sequence
  Synthetic
ccctggtttaatcggacatatcctctccgttaagcaactcaactgcatacagagtcaagtgggaccagctatcac

SEQ ID NO: 295329 - DNA, 75 bp, Artificial Sequence
  Synthetic
actggcgagcaggtcacccatacaggggcagtaggaattgagatcacttgcaataggagttagtggtgtcttggc

SEQ ID NO: 295330 - DNA, 75 bp, Artificial Sequence
  Synthetic
cctgcaaaaactcagaaaccagggctccccacagctgtgaggccaagcaccacaatgcaccatacaaacagctat

SEQ ID NO: 295331 - DNA, 75 bp, Artificial Sequence
  Synthetic
caacattaccattataaaaaacgtagggtccaggcgatattccaccatggactctctctcagtcaaccagattct

SEQ ID NO: 295332 - DNA, 75 bp, Artificial Sequence
  Synthetic
actctctctcagtcaaccagattctgtacccggaggtgcacctcgatagcccaatagtgaccaacaagttggtag

SEQ ID NO: 295333 - DNA, 75 bp, Artificial Sequence
  Synthetic
tatcattctgcttaaagaattagctagattcagggataatcaaaggagtcagcaagggctgtttcatgcctaccc

SEQ ID NO: 295334 - DNA, 75 bp, Artificial Sequence
  Synthetic
ccatactagagtatgcccggatcccacataagtacattctcgaggatccaactctttgcaaaaatataaagcatc

SEQ ID NO: 295335 - DNA, 75 bp, Artificial Sequence
  Synthetic
gatatcttttgtttgatcttcaccagaacgtattcctgaaaagcctgtcaaaatcagagaagcagctgatcagga

SEQ ID NO: 295336 - DNA, 75 bp, Artificial Sequence
  Synthetic
gcctagatagcggtttttccaaccagatgatcatcaataatattgagatagggaatgttgtccgatccaaactca

SEQ ID NO: 295337 - DNA, 75 bp, Artificial Sequence
  Synthetic
aaagttatccgaattacgagcacatcccatatccagaatgcaaccaggagttgttcaatgctcgggataagaagg

SEQ ID NO: 295338 - DNA, 75 bp, Artificial Sequence
  Synthetic
atagtgcattaattcaagagtgattctataattgcctgcctcctgaccccgatcttatcaataaaactgcagaaa

SEQ ID NO: 295339 - DNA, 75 bp, Artificial Sequence
  Synthetic
ctacggtgaaaatccgatccttgcttaaaaaggggaccactctgtattccaagatcagtgatagagtgtgcacat

SEQ ID NO: 295340 - DNA, 75 bp, Artificial Sequence
  Synthetic
gcttagagactgccaacttaagacttggattgggtgctgatttaggagttggggtcaaggagaaggtcttgaacc

SEQ ID NO: 295341 - DNA, 75 bp, Artificial Sequence
  Synthetic
ctttgaaatggcttctctcttgaagagcttggccctattcaaaaagaacaaagacaagccaccccttgctgcagg

SEQ ID NO: 295342 - DNA, 75 bp, Artificial Sequence
  Synthetic
taagcttgtacatgcagagttcccagtggtttgagccattcttgttctggttcactattaagacagaaatgagat

SEQ ID NO: 295343 - DNA, 75 bp, Artificial Sequence
  Synthetic
caacaatcaagtcatcatcccacactagtcaccgacgaaggtacattccctctttttttaccggtgactcatttg

SEQ ID NO: 295344 - DNA, 75 bp, Artificial Sequence
  Synthetic
tctttttttaccggtgactcatttgaaatcttgatttcccgtgatttagtagcaatagtacacagaaagctccac

SEQ ID NO: 295345 - DNA, 75 bp, Artificial Sequence
  Synthetic
gctatggtcatagactccaggtacatagagctcctggagagagtccagtatctgtggaaactcatagacggtttt

SEQ ID NO: 295346 - DNA, 75 bp, Artificial Sequence
  Synthetic
ttcccaactcttggaaatcctacctatcaattggtggctctgttggagccactttcccttgcctacctccaactg

SEQ ID NO: 295347 - DNA, 75 bp, Artificial Sequence
  Synthetic
agagatgtgacaattgagctaagaggtgcattcctaaaccattgctttactgagatccatgacattctcaatcaa

SEQ ID NO: 295348 - DNA, 75 bp, Artificial Sequence
  Synthetic
ccggagaactctccacaatagagtctctcatgaatctatatcaacagatgggtgaactggctccttacatggtga

SEQ ID NO: 295349 - DNA, 75 bp, Artificial Sequence
  Synthetic
aatggagttacaaatgacaacacataccaagagatcatcgaggccttagattatattttcataactgatgatatt

SEQ ID NO: 295350 - DNA, 75 bp, Artificial Sequence
  Synthetic
catctcacgggcgagatcttctcattctttaggagttttggccaccccaggcttgaggcaatcacagccgcagat

SEQ ID NO: 295351 - DNA, 75 bp, Artificial Sequence
  Synthetic
gcttgaggcaatcacagccgcagataacgtaagaaaacatatgaaccagccgaaggtaatagtctatgagacctt

SEQ ID NO: 295352 - DNA, 75 bp, Artificial Sequence
  Synthetic
taccccaagttaggaaagaaacctgggctagcagcaggtcagacaggtacaaggaagacacagacaacgaatctg

SEQ ID NO: 295353 - DNA, 75 bp, Artificial Sequence
  Synthetic
cctacacctccctgcacatgccgccacccctataagaaatgctcaggcctcgggtgaaggattgacttatgagca

SEQ ID NO: 295354 - DNA, 75 bp, Artificial Sequence
  Synthetic
agtcagcagaggctctacttaaactgcagactatggccagcatcctggagggttcaacccttggcaatgacagcc

SEQ ID NO: 295355 - DNA, 75 bp, Artificial Sequence
  Synthetic
cgggtgaaggattgacttatgagcagtgcgtcgataactggaagtcatttgccggcgtaaggtttggctgcttca

SEQ ID NO: 295356 - DNA, 75 bp, Artificial Sequence
  Synthetic
gcagactatggccagcatcctggagggttcaacccttggcaatgacagcctgagaacatacaacgacaaggatct

SEQ ID NO: 295357 - DNA, 75 bp, Artificial Sequence
  Synthetic
tgcctctgagtttagacagtgaccttacgatgtacctaaaggacaaggccctggcagctcttaaaagggaatggg

SEQ ID NO: 295358 - DNA, 75 bp, Artificial Sequence
  Synthetic
attccgcctacccgaaagaattcctccgctataaccctcctaagagcactagttcacggaggctggtcgatgtat

SEQ ID NO: 295359 - DNA, 75 bp, Artificial Sequence
  Synthetic
acccaagcctacgagtccgccaaccccgagacaacccgccccagcagccgacccagatggcagaggagcaagctt

SEQ ID NO: 295360 - DNA, 75 bp, Artificial Sequence
  Synthetic
ttctcaatgattcaacattcgacccttataacatgatcatgtatgtggtgagcggtgattacctccgggactctg

SEQ ID NO: 295361 - DNA, 75 bp, Artificial Sequence
  Synthetic
acttcaatttatcctacagcctaaaggaaaaggaaattaaggagactgggagactctttgctaaaatgacttaca

SEQ ID NO: 295362 - DNA, 75 bp, Artificial Sequence
  Synthetic
agactctttgctaaaatgacttacaagatgagagcatgccaagtcatagccgaaaacctaatctcaaatggtatc

SEQ ID NO: 295363 - DNA, 75 bp, Artificial Sequence
  Synthetic
gggaagtattttagagacaatgggatggcaaaggatgagcatgacctcactaaagctctccatacattggcagtc

SEQ ID NO: 295364 - DNA, 75 bp, Artificial Sequence
  Synthetic
taaagctctccatacattggcagtctcaggagttccaaaggatttcaaagataattaccgcggtggacccagggc

SEQ ID NO: 295365 - DNA, 75 bp, Artificial Sequence
  Synthetic
cagctgtgaaaaggttgagggagtcgaagatgctgactctatcctggttcagccaggcgctgatgatggtgtcgg

SEQ ID NO: 295366 - DNA, 75 bp, Artificial Sequence
  Synthetic
taagaccctctctttcaagaagacacacactgggactgggatctcgaggatgtcaagaaatgagacacattcccg

SEQ ID NO: 295367 - DNA, 75 bp, Artificial Sequence
  Synthetic
aacctgatcccgagggaagtgctcccgctgactggggatcttctcccacttctgcagcaacaagagcctctgatg

SEQ ID NO: 295368 - DNA, 75 bp, Artificial Sequence
  Synthetic
gtcatctgagcaacgagactgcaacacagatagtccagatcagatagagaactatgaaacagtcagtgctttcat

SEQ ID NO: 295369 - DNA, 75 bp, Artificial Sequence
  Synthetic
caccgccgatctcaagaaatattgcctaaattggaggtatgaaacaataagcttatttgcccagagattaaatga

SEQ ID NO: 295370 - DNA, 75 bp, Artificial Sequence
  Synthetic
gatatacgggctgccatccttcttccagtggttgcataggcgccttgaaagagcagtgttgtatgttagtgaccc

SEQ ID NO: 295371 - DNA, 75 bp, Artificial Sequence
  Synthetic
gtgtctgtgagcaatgcttcaccgattcagggatcgaaaacagagtctggtaccacagtcccgcagataccccag

SEQ ID NO: 295372 - DNA, 75 bp, Artificial Sequence
  Synthetic
tcattgtccccccgatttagacaaccatgtgcacttggataatgtcccgaatgatcagattttcattaaataccc

SEQ ID NO: 295373 - DNA, 75 bp, Artificial Sequence
  Synthetic
tatgggggggatagaaggctattgtcaaaaactatggacaatcagtactattccctatctttacttggctgcaca

SEQ ID NO: 295374 - DNA, 75 bp, Artificial Sequence
  Synthetic
tgagagcggggtcaggattgcttctcttgtccagggagacaatcagacaattgcagttaccaagcgggtaccaag

SEQ ID NO: 295375 - DNA, 75 bp, Artificial Sequence
  Synthetic
agacaggcaatccagggacactggtaaatcaggaatcgaatccagaggcctgttgaagaaggaattccaactgaa

SEQ ID NO: 295376 - DNA, 75 bp, Artificial Sequence
  Synthetic
ttcatggccttaccaccttaagaaaagagaagctgcacgcgtgacaagagaatatttctgtctcctgagacaaag

SEQ ID NO: 295377 - DNA, 75 bp, Artificial Sequence
  Synthetic
tgttgaagaaggaattccaactgaacccaatcgataagaaatcaagttcagctatcaggtttgtcccggacgaca

SEQ ID NO: 295378 - DNA, 75 bp, Artificial Sequence
  Synthetic
actccacgatatcggccatcatcttaaggcaaacgaaacaattgtgtcatcacacttctttgtctactccaaggg

SEQ ID NO: 295379 - DNA, 75 bp, Artificial Sequence
  Synthetic
gatatattatgacggactactgatctcacagtctctcaaaagcattgcacggtgtgtcttctggtcagagactat

SEQ ID NO: 295380 - DNA, 75 bp, Artificial Sequence
  Synthetic
cagatgctggcaaaaattataaataactaggatcggcacaatacggctgatctttgcgcttctcctcagtttagc

SEQ ID NO: 295381 - DNA, 75 bp, Artificial Sequence
  Synthetic
agttgatgaaacaagggcagcttgtagcaacatcgcaacaactatagccaagagcatagagagaggatttgacag

SEQ ID NO: 295382 - DNA, 75 bp, Artificial Sequence
  Synthetic
gtacctcgcttattctctgaatatcctgaaggtcatacaacagatactaatatcactgggtttcacaataaattc

SEQ ID NO: 295383 - DNA, 75 bp, Artificial Sequence
  Synthetic
tacaatgacacaagatgtagtggtccctcttctatcaaacaatgaccttctgataaggatggccctcttacctgc

SEQ ID NO: 295384 - DNA, 75 bp, Artificial Sequence
  Synthetic
tccgatcggaggtatgaattacttaaacatgagcaggttgttcgtcaggaacatcggggatccagtgacatcatc

SEQ ID NO: 295385 - DNA, 75 bp, Artificial Sequence
  Synthetic
gatagctgaccttaagagaatgattggtgcgtcactgatgcctgaagagacacttcaccaggtgatgacgcaaca

SEQ ID NO: 295386 - DNA, 75 bp, Artificial Sequence
  Synthetic
ctgacaccctggaaaaaggtcctgacaaaagggagtattttcaacgccaatcgggtgtgcagtgcgatcaacctg

SEQ ID NO: 295387 - DNA, 75 bp, Artificial Sequence
  Synthetic
gcctggtgactcatcatttctcgactgggctagtgacccctactctgctaacctggtctgcgtccagagcataac

SEQ ID NO: 295388 - DNA, 75 bp, Artificial Sequence
  Synthetic
aaggcttctcaagaatatcaccgcaagatatgttctaataaacagccccaacccaatgcttagaggtttattcca

SEQ ID NO: 295389 - DNA, 75 bp, Artificial Sequence
  Synthetic
caacttattggtcaccctcaagattgataggggcaccgaacctggaagaccagcggtgggggaagtgggcctttc

SEQ ID NO: 295390 - DNA, 75 bp, Artificial Sequence
  Synthetic
tgatgacagcaaggaagaggatgagcaattggccaccttcctaatggacagaagtgtaatagtcccgagagctgc

SEQ ID NO: 295391 - DNA, 75 bp, Artificial Sequence
  Synthetic
ccacgaaatattagaccatagtttaactggggcccgggaagcaatcgcaggaatgctagatacaactaaaggact

SEQ ID NO: 295392 - DNA, 75 bp, Artificial Sequence
  Synthetic
catcaggactagcatgagaagagggggcctgaccaccagggtaatagcaagactatccacatatgattatgagca

SEQ ID NO: 295393 - DNA, 75 bp, Artificial Sequence
  Synthetic
gaccagcaccactccacccctgccacaccggcccgcagagacccacagcagagcaaaacgtccgccgccagcacc

SEQ ID NO: 295394 - DNA, 75 bp, Artificial Sequence
  Synthetic
gtttaagtctgggatggtgcttctaacaggctcaaagagaaattatctcattgacagagattcatgctcagtcca

SEQ ID NO: 295395 - DNA, 75 bp, Artificial Sequence
  Synthetic
gagcaaaacgtccgccgccagcaccaacccagcccaacaacagggcccaaacccccctaacgcagcaccccaccc

SEQ ID NO: 295396 - DNA, 75 bp, Artificial Sequence
  Synthetic
actagctagggctctgagaaaccacatgtgggctaggctagcccgaggaaggcccatatatggcttggaggtacc

SEQ ID NO: 295397 - DNA, 75 bp, Artificial Sequence
  Synthetic
aacccagcccaacaacagggcccaaacccccctaacgcagcaccccaccccgaacccaacccacagagcacccag

SEQ ID NO: 295398 - DNA, 75 bp, Artificial Sequence
  Synthetic
cccagagcagcacccacaccctacccgcaccacaaccccacccgacccggacccccccacagccccgcccacccc

SEQ ID NO: 295399 - DNA, 75 bp, Artificial Sequence
  Synthetic
ggacgtgcttgagtcaatgagaggccacctgatccaacgccatgcaacctgcatcctatgtgacttcggttcatc

SEQ ID NO: 295400 - DNA, 75 bp, Artificial Sequence
  Synthetic
cgcaaccaaccagaccccaaacaacgcgcaaccgctgcacacccagacgacacccccgataacgaccccaacagc

SEQ ID NO: 295401 - DNA, 75 bp, Artificial Sequence
  Synthetic
caattacggttggttttttgtaccatcgaactgtcagttagatgacatagatagggagacatcggcactcagagt

SEQ ID NO: 295402 - DNA, 75 bp, Artificial Sequence
  Synthetic
cccctacatcggatcgacaacagatgagaggactgatatgaagctcgcatttgttaagtcacccagtcgatccct

SEQ ID NO: 295403 - DNA, 75 bp, Artificial Sequence
  Synthetic
cgccacccaaaaccacaatcccaagcaccaaaccagagccaacagaggatggaaaccacaggaacccaacaacct

SEQ ID NO: 295404 - DNA, 75 bp, Artificial Sequence
  Synthetic
cgaggcgaagcaacccacccaccatgaatactaaacaaaacttaggatcaaagaatcacattgacccaagccgcc

SEQ ID NO: 295405 - DNA, 75 bp, Artificial Sequence
  Synthetic
gtgtactcatgggcatacggggatgacgataaatcatgggctgaagccttaaaactagcgcagcagagggcaaaa

SEQ ID NO: 295406 - DNA, 75 bp, Artificial Sequence
  Synthetic
agaaaggacaacaccatcgccatccaaccaaaccggaaaccagggagcagccacccgcagggcccaaagcccagg

SEQ ID NO: 295407 - DNA, 75 bp, Artificial Sequence
  Synthetic
gtgagcctggaggagttaaaaatgataaccccaatttcaacatccaccaacctcgcacatagacttagggatcgg

SEQ ID NO: 295408 - DNA, 75 bp, Artificial Sequence
  Synthetic
cccaccccacagagcagggcggaaccaaggggcaggcccacccaatgcacagcaacagaacacccccagatcccc

SEQ ID NO: 295409 - DNA, 75 bp, Artificial Sequence
  Synthetic
agtacccaagttaagtactcagggacatctttagtcagagtggctcggtatacaacaatatcaaatgataaccta

SEQ ID NO: 295410 - DNA, 75 bp, Artificial Sequence
  Synthetic
tcatttgtcatctcggataagaaggtagatacaaacttcatctaccagcaaggaatgttattaggtttgggtgtg

SEQ ID NO: 295411 - DNA, 75 bp, Artificial Sequence
  Synthetic
tcccccgaccccagacccccaacagcagcatcccccacccacccctcccgccacttctcccagaactccgctccc

SEQ ID NO: 295412 - DNA, 75 bp, Artificial Sequence
  Synthetic
tgctgcgtgattcctatggtagatcacccgaggatcccaagcctgcatgaattgacgttcaaaagagagctatgt

SEQ ID NO: 295413 - DNA, 75 bp, Artificial Sequence
  Synthetic
ccgcaccccaacacggaaggtcccggccgctcagcgccgccgaagatccagccagaaagagcaccaaaggcagac

SEQ ID NO: 295414 - DNA, 75 bp, Artificial Sequence
  Synthetic
accaacccactgatttatgacagtgctcccatcatcgatagggacgcaacaaaactctatacccaaagtcatcga

SEQ ID NO: 295415 - DNA, 75 bp, Artificial Sequence
  Synthetic
caccgggccctgcggaggacccccccaaccgggcagccccagatccccaaatccatccgggcatcaaatcacagc

SEQ ID NO: 295416 - DNA, 75 bp, Artificial Sequence
  Synthetic
aaaactctatacccaaagtcatcgaaggcatctcgtggaatttgtaacatggtctacatctcagttgtaccacat

SEQ ID NO: 295417 - DNA, 75 bp, Artificial Sequence
  Synthetic
agagcaaccaaggcactgctcaacaaacatggccagatcacctacaaaggacctagcatggggatcttatttgct

SEQ ID NO: 295418 - DNA, 75 bp, Artificial Sequence
  Synthetic
tgccctaataggggatgacgacatcaacagtttcataacagagttcctccttgtagagcccagattgtttactgt

SEQ ID NO: 295419 - DNA, 75 bp, Artificial Sequence
  Synthetic
ctaaaacagagattatggagtacaagaggctgttggggacagtgcttaagcctatcagggaagctcttaacgcta

SEQ ID NO: 295420 - DNA, 75 bp, Artificial Sequence
  Synthetic
gaggctgttggggacagtgcttaagcctatcagggaagctcttaacgctattactaagaacataaaaccaatcca

SEQ ID NO: 295421 - DNA, 75 bp, Artificial Sequence
  Synthetic
aacagtttcataacagagttcctccttgtagagcccagattgtttactgtctacttgggtcagtgcacagctata

SEQ ID NO: 295422 - DNA, 75 bp, Artificial Sequence
  Synthetic
gcaaggatgagtaagagcgtattcaaggtctttgtgaatgcgctgagccaccccaagatttacaggaagttctgg

SEQ ID NO: 295423 - DNA, 75 bp, Artificial Sequence
  Synthetic
cccaagctatcgaaagtcttaaggcaagtctggaaacaaccaatcaagcaattgaggaaatacgacaagcaggtc

SEQ ID NO: 295424 - DNA, 75 bp, Artificial Sequence
  Synthetic
aagtctggaaacaaccaatcaagcaattgaggaaatacgacaagcaggtcaagaaatggtcctagcggttcaggg

SEQ ID NO: 295425 - DNA, 75 bp, Artificial Sequence
  Synthetic
ctggtgcctgcgatgggccagctatcgtgtgaaattgtgggtcaaaagctagggctgaaactgctcagatattac

SEQ ID NO: 295426 - DNA, 75 bp, Artificial Sequence
  Synthetic
tctccatattaccgtgtgcaatatgatctatagctgctatatgacttatcttgatctactgctaaatgatgaact

SEQ ID NO: 295427 - DNA, 75 bp, Artificial Sequence
  Synthetic
ggacgagttcacatacctcctctgcgagagtgatgaggacatagtggctgaccgctttgataatatacaggctag

SEQ ID NO: 295428 - DNA, 75 bp, Artificial Sequence
  Synthetic
acatctgtgtgtcttatcagatttatactgcaatcccagagggtgtccgaccatcaggggcctacagccagtgga

SEQ ID NO: 295429 - DNA, 75 bp, Artificial Sequence
  Synthetic
gaaatgtgccattatgaccaaacacatcgaggccgaggcaaaattgtcccctgccggcccttcatggaacataga

SEQ ID NO: 295430 - DNA, 75 bp, Artificial Sequence
  Synthetic
ctcttacaatataggatcgcaggagtggtccaccacagtaccgcggtatgtggcaacccagggttacctcatctc

SEQ ID NO: 295431 - DNA, 75 bp, Artificial Sequence
  Synthetic
ccctattgtaattgatcacttttcttgttccctgacttacttaagacggggttcgatcaagcaaattcggttgag

SEQ ID NO: 295432 - DNA, 75 bp, Artificial Sequence
  Synthetic
ggttgatccagggttcatttttgaagccttaactgagacagatccgcagagacccaacttaaagcatgaacaagt

SEQ ID NO: 295433 - DNA, 75 bp, Artificial Sequence
  Synthetic
ttcactccagagggcactatctgcagtcaaaatgcattatacccgatgagcccattgctccaggaatgtttccgt

SEQ ID NO: 295434 - DNA, 75 bp, Artificial Sequence
  Synthetic
tgctgatatgcacataagcaactttagaccgccctatgataatgtggcagaactattagggaccataaactcaag

SEQ ID NO: 295435 - DNA, 75 bp, Artificial Sequence
  Synthetic
agaccgccctatgataatgtggcagaactattagggaccataaactcaagtaagcacaaccttcctatacttggc

SEQ ID NO: 295436 - DNA, 75 bp, Artificial Sequence
  Synthetic
aacatcaagggtgtttcagtcatgaacacaggttatattctagtcggagtcgggttgattgcagtggtggggatc

SEQ ID NO: 295437 - DNA, 75 bp, Artificial Sequence
  Synthetic
gagatatccactctagtcaagagctctatagatccaggagaggatagcttgttcttaggggaaggatcaggatca

SEQ ID NO: 295438 - DNA, 75 bp, Artificial Sequence
  Synthetic
cgggttgattgcagtggtggggatcctcattattacctgctgttgtaagaagcgcaggagtgacaacaaagactc

SEQ ID NO: 295439 - DNA, 75 bp, Artificial Sequence
  Synthetic
atgttggtaacatataaggacgtccttaaattgaagaagtgcttttacaacagtggggtatcagcagaatctaga

SEQ ID NO: 295440 - DNA, 75 bp, Artificial Sequence
  Synthetic
agaccagatcttactggcacatctaaatcctacgtacggtcgttgtagcaggtgtgtctcccatgtgaccactgt

SEQ ID NO: 295441 - DNA, 75 bp, Artificial Sequence
  Synthetic
tcaggccagcgagagctagccccttacccgtctgaggtaagcttggtcgaacatcagcttggtgtagagaaaact

SEQ ID NO: 295442 - DNA, 75 bp, Artificial Sequence
  Synthetic
gtcagagtactattcaacgggagacctgaggttacctgggtaggtagtgtagactgcttcaattatatcatcagt

SEQ ID NO: 295443 - DNA, 75 bp, Artificial Sequence
  Synthetic
agactgcttcaattatatcatcagtaatatacagacgtctagtcttggcctaatacactccgacatcgaaaccct

SEQ ID NO: 295444 - DNA, 75 bp, Artificial Sequence
  Synthetic
caagtctattgagcaccaggtcaaggacgtcttaactcccctcttcaaaataattggagatgaggtcgggttgag

SEQ ID NO: 295445 - DNA, 75 bp, Artificial Sequence
  Synthetic
aggttcagtattggtgatcaaagtaatgcctataagtggagactatgtccaagggttcattagttatgcagtgcc

SEQ ID NO: 295446 - DNA, 75 bp, Artificial Sequence
  Synthetic
ttattacagagagacactgatcatctacccgagatatagtaacttaatatcaactgaggcatacctagtcctgtt

SEQ ID NO: 295447 - DNA, 75 bp, Artificial Sequence
  Synthetic
gggcctcaagaccaatagactgatagaccctgaaagaatcaaacaacaggtagtagaatccaggatcagaactat

SEQ ID NO: 295448 - DNA, 75 bp, Artificial Sequence
  Synthetic
agtcaacttggggaggagctgtaccgggtccacaacgactaaaggtcaattctctaaaatgtcattggctctctc

SEQ ID NO: 295449 - DNA, 75 bp, Artificial Sequence
  Synthetic
ccctggtttagtcggacatatcctatctgttaagcaactcaattgcatacagagtcaagtggggccagctatcac

SEQ ID NO: 295450 - DNA, 75 bp, Artificial Sequence
  Synthetic
ctgagaaaggcatgtacgggagcacttatctagtcgggaaacataatcgaagagtcaggaggccaagcactgctt

SEQ ID NO: 295451 - DNA, 75 bp, Artificial Sequence
  Synthetic
caaaggtgagataaaccctgtattaagaaagctcacacctattgagcggattctgatcaactgcgggcttactat

SEQ ID NO: 295452 - DNA, 75 bp, Artificial Sequence
  Synthetic
caatggcacaaagatttgcagcgatatagtccaccatgatatatcctcagggtcggacggtctgcttaattcttc

SEQ ID NO: 295453 - DNA, 75 bp, Artificial Sequence
  Synthetic
ccctctgcttagctgataactctgtcgcattgcattacggggggttaagggacgacaacaagatcaagtttgtca

SEQ ID NO: 295454 - DNA, 75 bp, Artificial Sequence
  Synthetic
tatcattctgcttaaagaattagctagattcagggataatcagaggagccagcaaggaatgttccatgcttaccc

SEQ ID NO: 295455 - DNA, 75 bp, Artificial Sequence
  Synthetic
aactgggagtatggccgtcaccagccgactcagacaccctggccactctttcatcagtagatccgaccttggatg

SEQ ID NO: 295456 - DNA, 75 bp, Artificial Sequence
  Synthetic
tgttttgctgagcagcaggcagcgtgaattgatctccagagttgctcgaaagttttggggttacatcctcttata

SEQ ID NO: 295457 - DNA, 75 bp, Artificial Sequence
  Synthetic
aatcatagctgcagggaaggccgtatgggctgtccctgtgacaagaacagatgaacaaaggaaaatgggacagtg

SEQ ID NO: 295458 - DNA, 75 bp, Artificial Sequence
  Synthetic
gatatcttttgtttgatcttcaccagaacttattcatgaaaaacctgtcaaagtcagagaagcagctgatcagaa

SEQ ID NO: 295459 - DNA, 75 bp, Artificial Sequence
  Synthetic
caggagggctcaagcgtgagtggctttttaagctcactacgaaagagatcaaagagtggttcaagctaataggtt

SEQ ID NO: 295460 - DNA, 75 bp, Artificial Sequence
  Synthetic
gggatggacttatacaccccacttgacggtaatgagtactggctgactgttcctccattgcaaaattcatcttta

SEQ ID NO: 295461 - DNA, 75 bp, Artificial Sequence
  Synthetic
atagtgcattaattcgggagtgattctataattgtctgccccctgaccccgatctgatcaataaaactgcagaaa

SEQ ID NO: 295462 - DNA, 75 bp, Artificial Sequence
  Synthetic
tcaataaaactgcagaaataagatactaaagaaaacttcaaagaagtgaagtacctatccccaactttgtctggt

SEQ ID NO: 295463 - DNA, 75 bp, Artificial Sequence
  Synthetic
accaaacaaagttgggtaaggatcggtctatcaataattatgatttagtacacttaggattcaagatcctatcga

SEQ ID NO: 295464 - DNA, 75 bp, Artificial Sequence
  Synthetic
gtgatcctcccgagtagaaacctccaatatgtgtcagcaacctacgacacctctagagttgagcatgccattgtg

SEQ ID NO: 295465 - DNA, 75 bp, Artificial Sequence
  Synthetic
cacttaggattcaagatcctatcgaccggagtaggcttaaggcaaaggttctttgaaatggcttctctcttgaag

SEQ ID NO: 295466 - DNA, 75 bp, Artificial Sequence
  Synthetic
ctttgaaatggcttctctcttgaagagcttggccctattcaaaagaacaaaagacaaaccaccccttgctgcagg

SEQ ID NO: 295467 - DNA, 75 bp, Artificial Sequence
  Synthetic
ctctggtggtgctattcggggaatcaagcatgtcattattgtcccgatcccaggagactcctcaatcaccacaag

SEQ ID NO: 295468 - DNA, 75 bp, Artificial Sequence
  Synthetic
aagcatgtcattattgtcccgatcccaggagactcctcaatcaccacaagatcacgccttctagactgtcttgtt

SEQ ID NO: 295469 - DNA, 75 bp, Artificial Sequence
  Synthetic
caggagactcctcaatcaccacaagatcacgccttctagactgtcttgttaaaatggtgggggacccagacatca

SEQ ID NO: 295470 - DNA, 75 bp, Artificial Sequence
  Synthetic
gaatcacctggccaactgattcaaaggatcactgatgaccctgatatcagcattaaattggtggaggtaatccaa

SEQ ID NO: 295471 - DNA, 75 bp, Artificial Sequence
  Synthetic
gcctggatagcggtttttccaatcagaggatcatcaacaatattgagatagggaatgtagtccaatccaaactca

SEQ ID NO: 295472 - DNA, 75 bp, Artificial Sequence
  Synthetic
agtgacaaaactcaatcaggattgacgtttgcttctaggggtgcaagcatggatgacgaggctgatagatacttt

SEQ ID NO: 295473 - DNA, 75 bp, Artificial Sequence
  Synthetic
acctatgatgaacccaatggcggagaagaaaggcagtcttattggtttgagaaccgggagatccaggacattgaa

SEQ ID NO: 295474 - DNA, 75 bp, Artificial Sequence
  Synthetic
catgtgtattatctgacattcgagatggtcttgatgtactgtgacatcatagagggtaggttgatgactgagact

SEQ ID NO: 295475 - DNA, 75 bp, Artificial Sequence
  Synthetic
gttcaggatccagaagggttcaatatgatactggcaaccatcttagcccagatctggatcttattggccaaagca

SEQ ID NO: 295476 - DNA, 75 bp, Artificial Sequence
  Synthetic
gtcacaacccctgatactgcagccgactcagagttacggaggtgggtgaaatacactcaacaaaggagggtaatt

SEQ ID NO: 295477 - DNA, 75 bp, Artificial Sequence
  Synthetic
ttcatggtggcattgatcttggacatcaagagaactccagggaacaaaccgaggattgctgaaatgatctgtgat

SEQ ID NO: 295478 - DNA, 75 bp, Artificial Sequence
  Synthetic
tcctctataagaaatgctcaggcttcgggtgaaggattgacttatgagcagtgcgttgacaactggaagtcattt

SEQ ID NO: 295479 - DNA, 75 bp, Artificial Sequence
  Synthetic
attgacacctacatagtggaggcaggattggctagttttatactcactatcaaatttggcatagaaactatgtac

SEQ ID NO: 295480 - DNA, 75 bp, Artificial Sequence
  Synthetic
caaatttggcatagaaactatgtacccagcactgggcctgcatgaatttgccggagaactctccacaatagagtc

SEQ ID NO: 295481 - DNA, 75 bp, Artificial Sequence
  Synthetic
ctggcagctcttaaaagggaatgggattccgcttacccaaaggaattcctccgctataaccctcccaagagtact

SEQ ID NO: 295482 - DNA, 75 bp, Artificial Sequence
  Synthetic
ccggagaactctccacaatagagtctctcatgaatctatatcaacaaatgggtgagctggctccttacatggtaa

SEQ ID NO: 295483 - DNA, 75 bp, Artificial Sequence
  Synthetic
ttctggagaactcaatccagaacaaattcagtgcaggagcgtaccccctgttgtggagctatgctatgggagttg

SEQ ID NO: 295484 - DNA, 75 bp, Artificial Sequence
  Synthetic
attcagtgcaggagcgtaccccctgttgtggagctatgctatgggagttggggttgagctggagagttccatggg

SEQ ID NO: 295485 - DNA, 75 bp, Artificial Sequence
  Synthetic
tggcaaaagatgagcatgacctcactaaagctcttcacacattggcagtctcaggagtcccaaaggatctcaaag

SEQ ID NO: 295486 - DNA, 75 bp, Artificial Sequence
  Synthetic
agggcttaatttcggcagatcttattttgaccctgcatatttcaggctaggacaagaaatggtacggaggtcagc

SEQ ID NO: 295487 - DNA, 75 bp, Artificial Sequence
  Synthetic
gacaagaaatggtacggaggtcagccgggaaagtcagctctaatttggcgtctgagcttggcatcaccgaggagg

SEQ ID NO: 295488 - DNA, 75 bp, Artificial Sequence
  Synthetic
aagcgaaacttgtctctgaaatcgcagcatacacaggtgatgaccggaacagtaggacctccggacccaaacaga

SEQ ID NO: 295489 - DNA, 75 bp, Artificial Sequence
  Synthetic
cccaggtttcatttctgcgtactgatcaagggggtgagatccagcacaacgcaagtaagaaagatgaggcgagag

SEQ ID NO: 295490 - DNA, 75 bp, Artificial Sequence
  Synthetic
tcaagggggtgagatccagcacaacgcaagtaagaaagatgaggcgagagtactccaagttaggaaggaaacctg

SEQ ID NO: 295491 - DNA, 75 bp, Artificial Sequence
  Synthetic
ggctagcagcaggtcagacaggtacaaggaagacacagacaacgaagctgtaagcccctcagtcaagactctgat

SEQ ID NO: 295492 - DNA, 75 bp, Artificial Sequence
  Synthetic
gacaccgatcctctggggaacaagaagtcagcagaggctctacttaaactgcaggctatggccagcatcctggag

SEQ ID NO: 295493 - DNA, 75 bp, Artificial Sequence
  Synthetic
gacccaacccttggcaatgacagcccgagaacatacaacgacaaggatctcctcagctaaatgaatgctccacac

SEQ ID NO: 295494 - DNA, 75 bp, Artificial Sequence
  Synthetic
cctcagctaaatgaatgctccacacgcctcagcccgcgatctccccctgcaagtcattattataaaaaacttagg

SEQ ID NO: 295495 - DNA, 75 bp, Artificial Sequence
  Synthetic
aagtcattattataaaaaacttaggacccaagcctacgagtccgcccaccccgagacaacccgccccagcagccg

SEQ ID NO: 295496 - DNA, 75 bp, Artificial Sequence
  Synthetic
ttgatagagattcatgctcagtccagctagctagagctctgagaagccacatgtgggctaagctagcccggggaa

SEQ ID NO: 295497 - DNA, 75 bp, Artificial Sequence
  Synthetic
accatgtcaacaaaggtctggagtgcatcaaagcccttagggctcgacctctcgacccctcggtcgttgaagaag

SEQ ID NO: 295498 - DNA, 75 bp, Artificial Sequence
  Synthetic
cccttgcagtatgggtcgagaccccagagggggacacgcttgatcggatgtcctccgatgaggccgaggcagacc

SEQ ID NO: 295499 - DNA, 75 bp, Artificial Sequence
  Synthetic
agagggggacacgcttgatcggatgtcctccgatgaggccgaggcagaccatcagggtaccagcaggccatgccg

SEQ ID NO: 295500 - DNA, 75 bp, Artificial Sequence
  Synthetic
cccagcaactggaccaggcaaaagcagcaggtctagcagtcacgatcagggatctagagaaagcaacagctgtga

SEQ ID NO: 295501 - DNA, 75 bp, Artificial Sequence
  Synthetic
tggggagctgggagcactcatggatgacctcccagtgcacaataccgaggtacagtgttatcatgtttctgatca

SEQ ID NO: 295502 - DNA, 75 bp, Artificial Sequence
  Synthetic
cagcggtgaaaaggttgagggaatcgaagatgctgactctatcctggttcaaccaggctctgatgatggtgtcga

SEQ ID NO: 295503 - DNA, 75 bp, Artificial Sequence
  Synthetic
attctggggaggagatgaagaatctgagaacagcgatgtggatcctggcgaacctgatcccgagggaagtgctcc

SEQ ID NO: 295504 - DNA, 75 bp, Artificial Sequence
  Synthetic
gggagaactcctgacctcattccttgcaaggatgagtaagagcgtgttcaaagtccttgtgaatgcactgagtca

SEQ ID NO: 295505 - DNA, 75 bp, Artificial Sequence
  Synthetic
cgaattcggaaaatgaccaaggcagggaagactcttgtggtgccgccgatcccctctcatgagaagccaactgca

SEQ ID NO: 295506 - DNA, 75 bp, Artificial Sequence
  Synthetic
tcagagcaacccactaaaaagggcacagacgcgaaatcagcctcatctggaacgatgatcgggtcttcatcgaca

SEQ ID NO: 295507 - DNA, 75 bp, Artificial Sequence
  Synthetic
gttggtgcaacccgacctgctcaaaagtcaccgtgggggccgtcagggccaaatgtacctgcggggaatgccctc

SEQ ID NO: 295508 - DNA, 75 bp, Artificial Sequence
  Synthetic
ttcagggatcgaaaacagggtctggtaccacagtcccgcagatatctcagagtaacacaggagctgaggatgatt

SEQ ID NO: 295509 - DNA, 75 bp, Artificial Sequence
  Synthetic
agtaacacaggagctgaggatgattacgatgatgagctgttctcggatatccaagacatcaaagcagcactagcc

SEQ ID NO: 295510 - DNA, 75 bp, Artificial Sequence
  Synthetic
atcaagaagcaaatcagcaagcaaaacattagcatatctaccatagaaggccatctttctagtatcatgatcgcg

SEQ ID NO: 295511 - DNA, 75 bp, Artificial Sequence
  Synthetic
tcaggccagcgagagttatccccttacccgtctgaggtgagcctggttgaacatcagcttggtgtgggggaaact

SEQ ID NO: 295512 - DNA, 75 bp, Artificial Sequence
  Synthetic
atcccgggatttggcaaggatcccaatgatcccactgcagatgtcgacatcaaccctgacctgagacccataatt

SEQ ID NO: 295513 - DNA, 75 bp, Artificial Sequence
  Synthetic
ggtcgggactctgggagggcgcttgctgaggtgcttaagaagccggcgtcagacaggcaatccagggacactggt

SEQ ID NO: 295514 - DNA, 75 bp, Artificial Sequence
  Synthetic
tgttgaagaaggaattccaactgaaaccaatcgataagaaatcgagttcagctatcaagtttgtcccggacgaca

SEQ ID NO: 295515 - DNA, 75 bp, Artificial Sequence
  Synthetic
gtgtcgcatctcgcagtgtgatccgctcaatcatcaagtcaagtcatcttggggaggatcgcaagaattacctga

SEQ ID NO: 295516 - DNA, 75 bp, Artificial Sequence
  Synthetic
ctcaatcatcaagtcaagtcatcttggggaggatcgcaagaattacctgatgggcctcttgaatgacattcaggg

SEQ ID NO: 295517 - DNA, 75 bp, Artificial Sequence
  Synthetic
tgggcctcttgaatgacattcagggctccaaggatcttgctcagttccatcagatgctggcaaaaattataaaga

SEQ ID NO: 295518 - DNA, 75 bp, Artificial Sequence
  Synthetic
cagatgctggcaaaaattataaagaactaggctcggcacaacacggctgatccttgcgcttctcctcagcttagc

SEQ ID NO: 295519 - DNA, 75 bp, Artificial Sequence
  Synthetic
agtagcctgcatgctcattacaaaaaacttaggagcaaggagtaatgctccgcactctcggcatggcagaaattt

SEQ ID NO: 295520 - DNA, 75 bp, Artificial Sequence
  Synthetic
tcaataaaactgcagaaataatatactaaagaaaacttcaaagaagtgaagtttctatccccagctttgtctggt

SEQ ID NO: 295521 - DNA, 75 bp, Artificial Sequence
  Synthetic
accagacaaagctgggtaaggatcggtatattaataattatgatttagtacacttaggattcaagatcctatcga

SEQ ID NO: 295522 - DNA, 75 bp, Artificial Sequence
  Synthetic
tgtcaaagggtcgatcgcgcccatcaggccaacaacatacaatgatggccggttgatccctcaagtaagggtaat

SEQ ID NO: 295523 - DNA, 75 bp, Artificial Sequence
  Synthetic
gatgagtgctttatgtacatctttctgttggggattgttgaagacagtgatccgctaagtctcccgcgaggccga

SEQ ID NO: 295524 - DNA, 75 bp, Artificial Sequence
  Synthetic
tgggtaaatccaccgcaaaaccagaggagctgctcaaagaggcgacagatctagatatagtcgtcagacgcacag

SEQ ID NO: 295525 - DNA, 75 bp, Artificial Sequence
  Synthetic
caccaaaagcccccccgacaccgggcagaacccgagggcacccaggagaatcccccgaccccagacccccaacag

SEQ ID NO: 295526 - DNA, 75 bp, Artificial Sequence
  Synthetic
ctagatatagtcgtcagacgcacagcagggctgaacgaaaaactggtattctacaacaatacccctttatccctc

SEQ ID NO: 295527 - DNA, 75 bp, Artificial Sequence
  Synthetic
tcccccgaccccagacccccaacagcagcatcccccacccaccccccccgtcactcctcccggaactccactccc

SEQ ID NO: 295528 - DNA, 75 bp, Artificial Sequence
  Synthetic
ctacaacaatacccctttatccctcctgacaccctggaaaaagatcctgacaaaagggagtgttttcaacgccaa

SEQ ID NO: 295529 - DNA, 75 bp, Artificial Sequence
  Synthetic
acccccctcccgacgggaacagagggccccatccccccactcctccccgccccggtctccagcccgagacaaccc

SEQ ID NO: 295530 - DNA, 75 bp, Artificial Sequence
  Synthetic
tcaggtgtgcagtgcggtcaacctgatcccgttagataccccacagaggttccgcgtggtgtacatgagtatcac

SEQ ID NO: 295531 - DNA, 75 bp, Artificial Sequence
  Synthetic
atcccgttagataccccacagaggttccgcgtggtgtacatgagtatcacgcgtctatctgacagcggttgttac

SEQ ID NO: 295532 - DNA, 75 bp, Artificial Sequence
  Synthetic
actgtaccaagaaagatgctagagttcagatccgccaatgcaatggcattcaacttattggtcaccctcaagatt

SEQ ID NO: 295533 - DNA, 75 bp, Artificial Sequence
  Synthetic
caacttattggtcaccctcaagattgatcggggcaccgaacctggaagaccagcggtgggggcagtgggtctttc

SEQ ID NO: 295534 - DNA, 75 bp, Artificial Sequence
  Synthetic
aggcctattcagcagattactgtaagatgaagattgaaaagatgggtctagtctttgcactcggagggatagggg

SEQ ID NO: 295535 - DNA, 75 bp, Artificial Sequence
  Synthetic
gatgaagattgaaaagatgggtctagtctttgcactcggagggatagggggaacaagcctacacataagaagtac

SEQ ID NO: 295536 - DNA, 75 bp, Artificial Sequence
  Synthetic
aggcaaaatgagcaagacactccacgcacaattgggattcaagaagacattatgttacccattgatggatatcaa

SEQ ID NO: 295537 - DNA, 75 bp, Artificial Sequence
  Synthetic
taagcccctcagtcaagactctgattgatgtggacacaacccccgaggcagacaccgatcctctggggagcaaga

SEQ ID NO: 295538 - DNA, 75 bp, Artificial Sequence
  Synthetic
aacccagcccaacaacagggcccaaacccccctaacgcagcaccccaccccgaactcaacacacagagcacccag

SEQ ID NO: 295539 - DNA, 75 bp, Artificial Sequence
  Synthetic
tgaagacctcaaccggttgctgtggagatccaaatgtaagattgtcaggattcaggcggtcctacaaccatcagt

SEQ ID NO: 295540 - DNA, 75 bp, Artificial Sequence
  Synthetic
tcctcaagagttccgtatttatgatgatgtgatcataaatgacgatcaagggcttttcaaggttttgtaatactt

SEQ ID NO: 295541 - DNA, 75 bp, Artificial Sequence
  Synthetic
gagttccactaccagtaggagacacaagaggttcgcgggagtcgttttggctggagccgctctcggagttgcaac

SEQ ID NO: 295542 - DNA, 75 bp, Artificial Sequence
  Synthetic
aacccagcccaataacagggcccaaaccctcctaacgcagcaccccaccccgaactcaacccacagagcacccag

SEQ ID NO: 295543 - DNA, 75 bp, Artificial Sequence
  Synthetic
accaaacaaagttgggtaagggtcggtatgtcaataattatgatttagtacacttaggattcaagatcctatcga

SEQ ID NO: 295544 - DNA, 75 bp, Artificial Sequence
  Synthetic
cctagagcaggagccacaccccacccgcaccacaaccccacccgacccggacccccccacagccccgctcacccc

SEQ ID NO: 295545 - DNA, 75 bp, Artificial Sequence
  Synthetic
cgccacccaaagccacaatcccaagcaccataccagagccaacagaggaaggtaactacaggaacccaacaaccc

SEQ ID NO: 295546 - DNA, 75 bp, Artificial Sequence
  Synthetic
cgaggcgaggcaacccacccaccatgaatactaaacaaaacttagggccaaagaatcacatcgacccaagccgcc

SEQ ID NO: 295547 - DNA, 75 bp, Artificial Sequence
  Synthetic
tgttgaagaaggaatttcaactgaaaccaattgataagaaatcaagttcagctatcaggtttgtcccggacgaca

SEQ ID NO: 295548 - DNA, 75 bp, Artificial Sequence
  Synthetic
agaaaggacaacaccatcgccacccaaccaaactggaaaccagggagcagccacccgcagggcccaaagcccggg

SEQ ID NO: 295549 - DNA, 75 bp, Artificial Sequence
  Synthetic
cagcatcccccactcctcccccccgccactctccccggaactccgctcccacccccctcccgacgggaacagagg

SEQ ID NO: 295550 - DNA, 75 bp, Artificial Sequence
  Synthetic
acccccctcccgacgggaacagagggccccggtctccagcccctccccgccccggtccccagcccgagacaaccc

SEQ ID NO: 295551 - DNA, 75 bp, Artificial Sequence
  Synthetic
ccacaccccaacacggaaggtctcggtcgctcagcgccgccgaagatccagccagaaagagcaccaaaggcagac

SEQ ID NO: 295552 - DNA, 75 bp, Artificial Sequence
  Synthetic
gtcgctcagcgccgccgaagatccagccagaaagagcaccaaaggcagaccaccgggccctgtggtggaccccgc

SEQ ID NO: 295553 - DNA, 75 bp, Artificial Sequence
  Synthetic
caaccgggcagccccagacccccaaatccatccgggcatcaaatcacggcagagcaaccaaggcactgctcaaca

SEQ ID NO: 295554 - DNA, 75 bp, Artificial Sequence
  Synthetic
aacccagctcaataacagggcccaaacccccctaacgcagcaccccaccctgaacccaacccacagagcacccag

SEQ ID NO: 295555 - DNA, 75 bp, Artificial Sequence
  Synthetic
aacatgcccagaccacctacaaaggacctagcatggggatcttatttgctgccctgctagcaatgactaacccac

SEQ ID NO: 295556 - DNA, 75 bp, Artificial Sequence
  Synthetic
acctagcatggggatcttatttgctgccctgctagcaatgactaacccacacttagctactggccagatccactg

SEQ ID NO: 295557 - DNA, 75 bp, Artificial Sequence
  Synthetic
acttagctactggccagatccactggggcaacctttcaaaaattggagtcgtagggacaggtagtgccagttata

SEQ ID NO: 295558 - DNA, 75 bp, Artificial Sequence
  Synthetic
cgccacccaaaaacacaatcccaagtaccaaaccagagccaacagaggaaggaaaccacaggaacccaacaaccc

SEQ ID NO: 295559 - DNA, 75 bp, Artificial Sequence
  Synthetic
aggtgatgacccaatcgagtcaccagtcactagttataaagctgatgcccaatatcactgctatagacaattgca

SEQ ID NO: 295560 - DNA, 75 bp, Artificial Sequence
  Synthetic
cgaggcgaggcaacccacccaccatgaatactaaacaaaacttaggatcaaagaatcacatcgacccaagccgcc

SEQ ID NO: 295561 - DNA, 75 bp, Artificial Sequence
  Synthetic
agaaaggacaacaccaccgccatccaaccaaactggaaaccaaggagcagccacccgcagggcccaaagcccagg

SEQ ID NO: 295562 - DNA, 75 bp, Artificial Sequence
  Synthetic
cagaacccgagggcacccaggagaatcccccgaccccagacccccaacagcagcatcccccacccacccctcccg

SEQ ID NO: 295563 - DNA, 75 bp, Artificial Sequence
  Synthetic
cgcagcccagattacagcagggattgctcttcatcagtcaatgatgaattcccaagctatcgaaagtcttaaggc

SEQ ID NO: 295564 - DNA, 75 bp, Artificial Sequence
  Synthetic
tgtccaagattacatcaacaatgaactggtgcctgcgatgggccagctatcgtgtgaaattgtgggtcaaaagct

SEQ ID NO: 295565 - DNA, 75 bp, Artificial Sequence
  Synthetic
ctggagccgctctcggagttgcaaccgcagcccagattacagcagggattgctcttcatcagtcaaggatgaatt

SEQ ID NO: 295566 - DNA, 75 bp, Artificial Sequence
  Synthetic
tacgccttgggtggggacattaataaaatactagaaaagcttgggtatagcgggagtgatctccttgctatactg

SEQ ID NO: 295567 - DNA, 75 bp, Artificial Sequence
  Synthetic
cttcattgtgctcagcatagcttatccgtcactctccgaaattaagggggtgatagtgcaccgtctggagagtgt

SEQ ID NO: 295568 - DNA, 75 bp, Artificial Sequence
  Synthetic
tgatagtgcaccgtctggagagtgtctcttacaatataggatcgcaggagtggtacaccacagtaccgcggtatg

SEQ ID NO: 295569 - DNA, 75 bp, Artificial Sequence
  Synthetic
ctcttacaatataggatcgcaggagtggtacaccacagtaccgcggtatgtggcaacccagggttacctcatttc

SEQ ID NO: 295570 - DNA, 75 bp, Artificial Sequence
  Synthetic
cactggtttcggggtccattgggaataggtttatactatctaaggggaacctcattgcaagctgtgcctctattt

SEQ ID NO: 295571 - DNA, 75 bp, Artificial Sequence
  Synthetic
aaatttcgatgacacaccctgtgcattcactccggagggcactatctgcagtcaaaatgcattatacccgatgag

SEQ ID NO: 295572 - DNA, 75 bp, Artificial Sequence
  Synthetic
gtcaaaatgcattatacccgatgagcccattgctccaagaatgtttccgtgggtcaaccaggtcatgtgcccgta

SEQ ID NO: 295573 - DNA, 75 bp, Artificial Sequence
  Synthetic
gggtcaaccaggtcatgtgcccgtacactggtttcggggtccatagggaataggtttatactatctaaggggaac

SEQ ID NO: 295574 - DNA, 75 bp, Artificial Sequence
  Synthetic
cactggtttcggggtccatagggaataggtttatactatctaaggggaacctcattgccaactgtgcctctattt

SEQ ID NO: 295575 - DNA, 75 bp, Artificial Sequence
  Synthetic
tgtgcaagtgctacaccactggctcaataataagtcaagaccctgacaagatcctaacatatatagctgcagacc

SEQ ID NO: 295576 - DNA, 75 bp, Artificial Sequence
  Synthetic
aataataagtcaagaccctgacaagatcctaacatatatagctgcagaccaatgccccgtcgtagaagtaggcgg

SEQ ID NO: 295577 - DNA, 75 bp, Artificial Sequence
  Synthetic
tgtaaccatccaggtcgggagcagggagtactccgatgcagtgtacctgcatgaaatagatcttggcccaccaat

SEQ ID NO: 295578 - DNA, 75 bp, Artificial Sequence
  Synthetic
agggatatactcaggtcgtggctacaatatttcatctatgataacaatcactgagaaaggcatgtacgggagcac

SEQ ID NO: 295579 - DNA, 75 bp, Artificial Sequence
  Synthetic
atcgctagagaagctggatgtggggactaacctctggaatgcagtgacaaaattggagaaagccaaggatctact

SEQ ID NO: 295580 - DNA, 75 bp, Artificial Sequence
  Synthetic
actaacctctggaatgcagtgacaaaattggagaaagccaaggatctactagattcatctgatctgatcctggaa

SEQ ID NO: 295581 - DNA, 75 bp, Artificial Sequence
  Synthetic
ctgagaaaggcatgtacgggagcacttatctagtcgggaaacataatcaaagagccaggaggccaagcactgctt

SEQ ID NO: 295582 - DNA, 75 bp, Artificial Sequence
  Synthetic
agattcatctgatctgatcctggaaaacatcaagggtgtttcagtcacgaacacaggttacattctagtcggagt

SEQ ID NO: 295583 - DNA, 75 bp, Artificial Sequence
  Synthetic
cgggttgattgcagtggtggggatcctcattattacctgttgttgtaagaagcgcaggagtgacaacaaagtctc

SEQ ID NO: 295584 - DNA, 75 bp, Artificial Sequence
  Synthetic
gggatggacttatacaccccacttgacggtaatgagtactggctgactattcccccattgcaaaattcaacttta

SEQ ID NO: 295585 - DNA, 75 bp, Artificial Sequence
  Synthetic
agaccagatcttactggtacatctaaatcctacgtacggtcgttgtagcaggtgtgtctcccatgtgatcaatgt

SEQ ID NO: 295586 - DNA, 75 bp, Artificial Sequence
  Synthetic
ccccgaataccttatcaaaccttacaatgctttgtcctcctcgcagccagctagtcgctatcctcagcaggcacc

SEQ ID NO: 295587 - DNA, 75 bp, Artificial Sequence
  Synthetic
atgcttgatcgctcattaattgctacaaagaaaaacttaggatgcaagatcatccaccatgtcctccccaagaga

SEQ ID NO: 295588 - DNA, 75 bp, Artificial Sequence
  Synthetic
cagggtcaatgccttctacaaagacaacctccaatttaagaacactcgagtggttcttaataaagagcagctcct

SEQ ID NO: 295589 - DNA, 75 bp, Artificial Sequence
  Synthetic
gatagaaaggccttacatgttgctggcggtgctgtttgttatgttcctgagcctagtggggctgttggccattgc

SEQ ID NO: 295590 - DNA, 75 bp, Artificial Sequence
  Synthetic
aggtatcagactccaccgagctgctgtcaacacagcagagatcaacagtggtctgacgacaagcattgatattac

SEQ ID NO: 295591 - DNA, 75 bp, Artificial Sequence
  Synthetic
caagtctattgagtaccaggtcaaggacgtcttaactcccctcttcaaaataattggagatgaggtcgggctgag

SEQ ID NO: 295592 - DNA, 75 bp, Artificial Sequence
  Synthetic
gacacctcagagattcacagatctgactaaattcatatcagacaagattaagttccttaaccctgataaagagta

SEQ ID NO: 295593 - DNA, 75 bp, Artificial Sequence
  Synthetic
cgacttcagggatattaactggtgcatcagtcccccagagagaatcaagattaattatgatcagtattgtgctca

SEQ ID NO: 295594 - DNA, 75 bp, Artificial Sequence
  Synthetic
gtactgcggtactccgcacatcattagtcaacttggggaggagctgtaccgggtccacaacgactaaaggtcaat

SEQ ID NO: 295595 - DNA, 75 bp, Artificial Sequence
  Synthetic
ctgagaaaggcatgtacggaagcacttatctagtcgggaaacataatcagggagccaggaggccaagcactgctt

SEQ ID NO: 295596 - DNA, 75 bp, Artificial Sequence
  Synthetic
ggcaacaggattaccgagtctttgaagtaggcataattagagaactaggagtgggcacaccagtgtttcatatga

SEQ ID NO: 295597 - DNA, 75 bp, Artificial Sequence
  Synthetic
gctctaggagagttcaaattagctgccctctgcttagctgataactctgtcgcactgcattacggggggttaagg

SEQ ID NO: 295598 - DNA, 75 bp, Artificial Sequence
  Synthetic
ccctctgcttagctgataactctgtcgcactgcattacggggggttaagggacgaccacaagatcaggtttgtca

SEQ ID NO: 295599 - DNA, 75 bp, Artificial Sequence
  Synthetic
aactgggagtatggccatcaccagccgactcagacaccctggccactctttcagcagtagatccgaccttggatg

SEQ ID NO: 295600 - DNA, 75 bp, Artificial Sequence
  Synthetic
ggctctatatcacaactcataggggaatcatagctgcagggaaggccgtatgggctgtccctgtgacgagaacag

SEQ ID NO: 295601 - DNA, 75 bp, Artificial Sequence
  Synthetic
atgaccaaaggaaaatgggacagtgccgccgagaggcttgtcgagagaaaccaccacctttctgtaacagtacag

SEQ ID NO: 295602 - DNA, 75 bp, Artificial Sequence
  Synthetic
ccgccgagaggcttgtcgagagaaaccaccacctttctgtaacagtacagattgggagccattagaggccggccg

SEQ ID NO: 295603 - DNA, 75 bp, Artificial Sequence
  Synthetic
ccaccacctttctgtaacagtacagattgggagccattagaggccggccgtataccggcatatggaatactaact

SEQ ID NO: 295604 - DNA, 75 bp, Artificial Sequence
  Synthetic
atcaggctggggctggctgataagcctgaaattgacataatttcagaatttggtcccttgatcacacatgactca

SEQ ID NO: 295605 - DNA, 75 bp, Artificial Sequence
  Synthetic
tggtcccttgatcacacatgactcagggatggacttatacaccccacttgacggtaatgagtactggctgactat

SEQ ID NO: 295606 - DNA, 75 bp, Artificial Sequence
  Synthetic
gggatggacttatacaccccacttgacggtaatgagtactggctgactattcctccattgcagaattcagcttta

SEQ ID NO: 295607 - DNA, 75 bp, Artificial Sequence
  Synthetic
ggaacggtgaacaccctagttttagagcccagtctcaaaattagtcctaacatccttactctccccatcaggtcg

SEQ ID NO: 295608 - DNA, 75 bp, Artificial Sequence
  Synthetic
gtaatcctcccgagtagaaacctccaatatgtgtcagcaacctacgacacctctagagttgagcatgccattgta

SEQ ID NO: 295609 - DNA, 75 bp, Artificial Sequence
  Synthetic
tactatatctatagcaccgggcgactatcatcgtattactaccctgttaagttgcccataaagggagatcctgtc

SEQ ID NO: 295610 - DNA, 75 bp, Artificial Sequence
  Synthetic
tatcatcgtattactaccctgttaagttgcccataaagggagatcctgtcagcctgcagataggatgcttccctt

SEQ ID NO: 295611 - DNA, 75 bp, Artificial Sequence
  Synthetic
actggcaagcaggtcacccatacaggggcagtagggattgagatcacttgcaatagcagatagcagtgtcttggc

SEQ ID NO: 295612 - DNA, 75 bp, Artificial Sequence
  Synthetic
cctacaagatctcggagaccgggacccccaacagctgtgggaccaggcaccgcggtgcaccatgcagacagcttt

SEQ ID NO: 295613 - DNA, 75 bp, Artificial Sequence
  Synthetic
caatattaccattataaaaaacgtagggtccaggcgatattccaccatggactccctctcagtcaaccagattct

SEQ ID NO: 295614 - DNA, 75 bp, Artificial Sequence
  Synthetic
actccctctcagtcaaccagattctgtaccctgaggtacacctcgatagcccaatagtgactaacaagttggtcg

SEQ ID NO: 295615 - DNA, 75 bp, Artificial Sequence
  Synthetic
actctttgcaaaaatataaagcatcgcctggatagcggtttttccaatcagatgatcatcaacaatattgagata

SEQ ID NO: 295616 - DNA, 75 bp, Artificial Sequence
  Synthetic
gggaatgttgtccaatccaaactcaaaagttatccgaatcatgaacatatcccatatccagaatgcaaccaggag

SEQ ID NO: 295617 - DNA, 75 bp, Artificial Sequence
  Synthetic
aaagttatccgaatcatgaacatatcccatatccagaatgcaaccaggagttgtttagtgctcaggataagaagg

SEQ ID NO: 295618 - DNA, 75 bp, Artificial Sequence
  Synthetic
ccacggtgaagatccgatccctgctaaaaaagggaaccaccctgtactccaagatcagtgatagggtgtgcatat

SEQ ID NO: 295619 - DNA, 75 bp, Artificial Sequence
  Synthetic
gcttagagaccgccaactcaaggctcggattgggtgctgatttaggagttggggtcaaggagaaggtcttgaatc

SEQ ID NO: 295620 - DNA, 75 bp, Artificial Sequence
  Synthetic
taagcttgtacatgcagagttcccagtggtttgagccattcttgttttggttcacgatcaagacagaaatgagat

SEQ ID NO: 295621 - DNA, 75 bp, Artificial Sequence
  Synthetic
caaccattaagtcatcagcccacaccagtcaccgacgaaggtacgtaccctcttttttcaccggtaacacatttg

SEQ ID NO: 295622 - DNA, 75 bp, Artificial Sequence
  Synthetic
tcttttttcaccggtaacacatttgaaatcttgatttctcgtgatttagtggcgatagtacacagaaaactccac

SEQ ID NO: 295623 - DNA, 75 bp, Artificial Sequence
  Synthetic
gctatggtcatagaccccaggtacatagaactcctggggagagtccagtatctgtggaaactcatagacgggttt

SEQ ID NO: 295624 - DNA, 75 bp, Artificial Sequence
  Synthetic
ttcccaactcttggaaactctacctatcaagttgtggccctgttggagccactttcccttgcttacctccaactg

SEQ ID NO: 295625 - DNA, 75 bp, Artificial Sequence
  Synthetic
agggatgtaacaattgagctaagaggtgcattcctaaaccattgcttcacagaaatccatgaaatacttaatcaa

SEQ ID NO: 295626 - DNA, 75 bp, Artificial Sequence
  Synthetic
gtgcattcctaaaccattgcttcacagaaatccatgaaatacttaatcaaaatggggtaacaaatgaaaacacat

SEQ ID NO: 295627 - DNA, 75 bp, Artificial Sequence
  Synthetic
accacgagatcatcgaggccttggattatattttcataactgatgatattcatctcacgggcgagatcttttcat

SEQ ID NO: 295628 - DNA, 75 bp, Artificial Sequence
  Synthetic
tcttcagaagttttggccaccccaggcttgaggcaatcacagccgctgataacgtaagaaagcatatgaaccagc

SEQ ID NO: 295629 - DNA, 75 bp, Artificial Sequence
  Synthetic
gcttgaggcaatcacagccgctgataacgtaagaaagcatatgaaccagccgaaggtaatagtctatgaaacctt

SEQ ID NO: 295630 - DNA, 75 bp, Artificial Sequence
  Synthetic
gatgaaagggcatgccatattttgcgggattatcatcaacgggtatcgggatagacatggagggagctggccacc

SEQ ID NO: 295631 - DNA, 75 bp, Artificial Sequence
  Synthetic
acctctataagaaatgctcaggcttcgggtgagggattgacttatgagcagtgcgtcgacaactggaagtcattt

SEQ ID NO: 295632 - DNA, 75 bp, Artificial Sequence
  Synthetic
agttcacggagactagtcgatgtctttctcaatgattcaacatttgacccttacaacatgatcatgtatgtagtg

SEQ ID NO: 295633 - DNA, 75 bp, Artificial Sequence
  Synthetic
agcggtgattaccttcgagatcctgacttcaatttatcctacagcctaaaggagaaggaaatcaaagagactggg

SEQ ID NO: 295634 - DNA, 75 bp, Artificial Sequence
  Synthetic
aggctctttgccaaaatgacttacaagatgagagcatgccaggtcatagccgaaaacctaatctcgaatggtatc

SEQ ID NO: 295635 - DNA, 75 bp, Artificial Sequence
  Synthetic
gggaagtatttcagagacaatgggatggcaaaagatgagcatgacctcactaaagctcttcatacattggcagtc

SEQ ID NO: 295636 - DNA, 75 bp, Artificial Sequence
  Synthetic
tggcaaaagatgagcatgacctcactaaagctcttcatacattggcagtctcaggagttccaaaggatctcaaag

SEQ ID NO: 295637 - DNA, 75 bp, Artificial Sequence
  Synthetic
taaagctcttcatacattggcagtctcaggagttccaaaggatctcaaaggcaatcaccgcggtgggcccagagc

SEQ ID NO: 295638 - DNA, 75 bp, Artificial Sequence
  Synthetic
taagaccttctctctcaagaagacacacactgggactgggatctcaagggtgtcaagaaatgagacacattaccg

SEQ ID NO: 295639 - DNA, 75 bp, Artificial Sequence
  Synthetic
gtcacccgagctacgagaccgcaacacagatagcccagatcagatagagaattatgaaacagtcagtgcttttat

SEQ ID NO: 295640 - DNA, 75 bp, Artificial Sequence
  Synthetic
cacagctgatcttaagaagtattgcctaaattggaggtatgaaacaataagcttatttgctcaaagattaaatga

SEQ ID NO: 295641 - DNA, 75 bp, Artificial Sequence
  Synthetic
gatatacgggctgccatccttcttccaatggttacatcggcgtcttgaaagagcagtgttgtatgttagtgaccc

SEQ ID NO: 295642 - DNA, 75 bp, Artificial Sequence
  Synthetic
tcattgtccccctgatctagacaaccacgtggacttggacaatgtctcgaatgatcagattttcattaaataccc

SEQ ID NO: 295643 - DNA, 75 bp, Artificial Sequence
  Synthetic
tatgggggggatagaaggctattgtcaaaagctatggacaattagtactatcccctatctttacttggctgcaca

SEQ ID NO: 295644 - DNA, 75 bp, Artificial Sequence
  Synthetic
ttgcagttaccaagcgggtaccaagctcatggccctaccacattaagaaaagagaagctgcacgcgtgacaagag

SEQ ID NO: 295645 - DNA, 75 bp, Artificial Sequence
  Synthetic
ctcatggccctaccacattaagaaaagagaagctgcacgcgtgacaagagaatatttctgtctcctgagacaaag

SEQ ID NO: 295646 - DNA, 75 bp, Artificial Sequence
  Synthetic
actccatgatatcggccatcaccttaaggcaaacgaaacaattgtgtcatcacacttctttgtctactccaaggg

SEQ ID NO: 295647 - DNA, 75 bp, Artificial Sequence
  Synthetic
gatttattacgacggactactagtctcccagtctctcaaaagcattgcacggtgtgtcttctggtcagaaactat

SEQ ID NO: 295648 - DNA, 75 bp, Artificial Sequence
  Synthetic
agtagatgaaacgagggcagcttgtagcaacatcgcaacaactatagccaagagcatagagagaggatttgacag

SEQ ID NO: 295649 - DNA, 75 bp, Artificial Sequence
  Synthetic
gtaccttgcttattccctgaacatcctgaagatcatacaacagatactaatatcactgggttttacaataaactc

SEQ ID NO: 295650 - DNA, 75 bp, Artificial Sequence
  Synthetic
tatcactgggttttacaataaactctacaatgacacaagatgtagtggtccctcttctatcaaacaatgatcttc

SEQ ID NO: 295651 - DNA, 75 bp, Artificial Sequence
  Synthetic
tgataaggatggcccttttacctgctccgatcgggggtatgaattacttaaacatgagtaggttgtttgtcagga

SEQ ID NO: 295652 - DNA, 75 bp, Artificial Sequence
  Synthetic
acatcggggatccagtgacatcgtctatagctgatcttaagagaatgattggtgcgtcactgatgcctgaagaga

SEQ ID NO: 295653 - DNA, 75 bp, Artificial Sequence
  Synthetic
ggtgcgtcactgatgcctgaagagacacttcatcaggtgatgacgcagcagcctggtgactcatcatttctcgac

SEQ ID NO: 295654 - DNA, 75 bp, Artificial Sequence
  Synthetic
tgggctagtgacccctactctgccaacctggtctgcatccagagcataacaaggctccttaagaatatcaccgca

SEQ ID NO: 295655 - DNA, 75 bp, Artificial Sequence
  Synthetic
aggtatgttctaataaatagccccaatccaatgctcagaggtttattccataatgacagcaaggaagaggatgaa

SEQ ID NO: 295656 - DNA, 75 bp, Artificial Sequence
  Synthetic
caattggccaccttcctaatggacagaagtgtaatagtcccgagggctgcccacgaaatactagaccatagtata

SEQ ID NO: 295657 - DNA, 75 bp, Artificial Sequence
  Synthetic
actggggctcgggaagcaattgcaggaatgctagatacaactaagggactcatcaggactagtatgagaagaggg

SEQ ID NO: 295658 - DNA, 75 bp, Artificial Sequence
  Synthetic
ggcttgaccaccagggtaatagcaagactatccacatatgactatgagcagtttaggtctgggatggtgctttta

SEQ ID NO: 295659 - DNA, 75 bp, Artificial Sequence
  Synthetic
acaggctcaaagagaaattatctcattgatagagattcatgctcagtccagctagctagagctctgagaagccat

SEQ ID NO: 295660 - DNA, 75 bp, Artificial Sequence
  Synthetic
atgtgggctaggttagcccggggaaggcccatatatggcttagaggtgccggacgtgcttgagtcaatgagaggt

SEQ ID NO: 295661 - DNA, 75 bp, Artificial Sequence
  Synthetic
ggcccatatatggcttagaggtgccggacgtgcttgagtcaatgagaggtcacctgatccaacgccacgcaactt

SEQ ID NO: 295662 - DNA, 75 bp, Artificial Sequence
  Synthetic
gcgtcttatgtgacttcggttcgcctaactatggttggttttttgtaccatcgaattgtcagttagatgacatag

SEQ ID NO: 295663 - DNA, 75 bp, Artificial Sequence
  Synthetic
tcgaattgtcagttagatgacatagatagggagacatcagcactcagagtcccctacatcggatcaacaacagat

SEQ ID NO: 295664 - DNA, 75 bp, Artificial Sequence
  Synthetic
gtgtactcatgggcatacggagatgacgataaatcatggactgaagccttaaaactagcgcagcagagagcaaaa

SEQ ID NO: 295665 - DNA, 75 bp, Artificial Sequence
  Synthetic
gtgagcctggaggaattaaaaatgataaccccaatttcgacatccaccaacctcgcacatagacttagagaccgg

SEQ ID NO: 295666 - DNA, 75 bp, Artificial Sequence
  Synthetic
tcatttgtcatctcggataagaaggtagatacaaacttcatctatcagcaagggatgttattaggcttgggtgtg

SEQ ID NO: 295667 - DNA, 75 bp, Artificial Sequence
  Synthetic
ctcgagacattgtttaggcttgacaaagacacaggaccctcaaacactgtactgcacctccatgtagaaacagat

SEQ ID NO: 295668 - DNA, 75 bp, Artificial Sequence
  Synthetic
tgctgcgtgattcctatggtagatcacccgaggatcccaagcctgcatgacttgaaattcaaaagggaactatgt

SEQ ID NO: 295669 - DNA, 75 bp, Artificial Sequence
  Synthetic
accaatccactgatttatgacaatgcacccatcatcgatagggacgcaacaaaactctatacccaaagtcatcga

SEQ ID NO: 295670 - DNA, 75 bp, Artificial Sequence
  Synthetic
aaaactctatacccaaagtcatcgaaggcacctcgtggaatttgtaacatggtctacatcccagttgtaccacat

SEQ ID NO: 295671 - DNA, 75 bp, Artificial Sequence
  Synthetic
cctggcaaaatcaactgcattggcgatgatagatttagtgacgaaattcgagaaagatcacatgaatgaggtatc

SEQ ID NO: 295672 - DNA, 75 bp, Artificial Sequence
  Synthetic
tgccctaataggagatgatgacatcaacagttttataacagagttcctccttgtagagcccagattgtttaccgt

SEQ ID NO: 295673 - DNA, 75 bp, Artificial Sequence
  Synthetic
aacagttttataacagagttcctccttgtagagcccagattgtttaccgtatacttaggtcaatgcacagctata

SEQ ID NO: 295674 - DNA, 75 bp, Artificial Sequence
  Synthetic
gggagaactcctgacctcatttcttgcaaggatgagtaagagcgtgttcaaggtctttgtgaatgcactgagtca

SEQ ID NO: 295675 - DNA, 75 bp, Artificial Sequence
  Synthetic
tctccatattaccgtgtgcaatatgatctatagctgctatatgacttaccttgatctactgttaaatgatgaact

SEQ ID NO: 295676 - DNA, 75 bp, Artificial Sequence
  Synthetic
agacgagttcacatacctcctttgcgagagtgatgaggatatagtggctgaccgctttgataacatacaggctag

SEQ ID NO: 295677 - DNA, 75 bp, Artificial Sequence
  Synthetic
acatctgtgtgtcttatcagacttatactgcaatcctagagggtgcccgaccatcaggggcctgcagccagtgga

SEQ ID NO: 295678 - DNA, 75 bp, Artificial Sequence
  Synthetic
tactgcaatcctagagggtgcccgaccatcaggggcctgcagccagtggagaaatgtgtcattatgaccaaacac

SEQ ID NO: 295679 - DNA, 75 bp, Artificial Sequence
  Synthetic
atcgaggccgaggcgaaattgtcccctgccggcccttcatggatcataggtcccattgtgattgatcacttttct

SEQ ID NO: 295680 - DNA, 75 bp, Artificial Sequence
  Synthetic
tgttccttgacttacttaagacggggttcgattaagcaaattcgattgagggttgatccagggttcatttttgaa

SEQ ID NO: 295681 - DNA, 75 bp, Artificial Sequence
  Synthetic
gccttagctgaaacagatccgcagaaacccaacttacagcatgaacaagtcgctgatatgcacataagcaatttt

SEQ ID NO: 295682 - DNA, 75 bp, Artificial Sequence
  Synthetic
aggccgccctatgataatgtggcagaactattagggatcataaactcaagtaagcacaaccttcctatacttgga

SEQ ID NO: 295683 - DNA, 75 bp, Artificial Sequence
  Synthetic
gagatatccactctaatcaagagctctatagatcccggagaggatagcttgttcttaggggaaggatcagggtca

SEQ ID NO: 295684 - DNA, 75 bp, Artificial Sequence
  Synthetic
atgttggttacatataagaaagtccttaagttgaagcaatgcttttataatagcggggtatcagcagagtctaga

SEQ ID NO: 295685 - DNA, 75 bp, Artificial Sequence
  Synthetic
tcgggccagcgagagttagctccttacccatctgaggtgagcctggttgaacatcagcttggtgtagggagaact

SEQ ID NO: 295686 - DNA, 75 bp, Artificial Sequence
  Synthetic
gtcaaagtgctattcaacgggagacctgaggttacctgggtaggcagtgtagactgcttcaattatatcatcagt

SEQ ID NO: 295687 - DNA, 75 bp, Artificial Sequence
  Synthetic
agactgcttcaattatatcatcagtaatatacggacgtctagtcttggcctagtacactcagacatagaaaccct

SEQ ID NO: 295688 - DNA, 75 bp, Artificial Sequence
  Synthetic
ccctacaaaggatatcacagagaaactagaggagttgtcagctatcctcgcgttggctctattgctaggcaaggt

SEQ ID NO: 295689 - DNA, 75 bp, Artificial Sequence
  Synthetic
aggttcagtattagtgatcaaagtaatgcctataagtggagattatgtccaggggttcatgagttatgcagtgcc

SEQ ID NO: 295690 - DNA, 75 bp, Artificial Sequence
  Synthetic
ctattacagagagatactgatcatctacccgagatatagtaacttcatatcaactgaggcatacctagtcctgtt

SEQ ID NO: 295691 - DNA, 75 bp, Artificial Sequence
  Synthetic
caactgaggcatacctagtcctgttgggactcaaggccaatagactgatagaccctgaaagaatcaagcaacagg

SEQ ID NO: 295692 - DNA, 75 bp, Artificial Sequence
  Synthetic
tagtagattctggggtcagaaccatccctggtttagtcggacatatcctctctgttaagcaactcaactgcatac

SEQ ID NO: 295693 - DNA, 75 bp, Artificial Sequence
  Synthetic
ccctggtttagtcggacatatcctctctgttaagcaactcaactgcatacagagtcaagtggggccagctatcac

SEQ ID NO: 295694 - DNA, 75 bp, Artificial Sequence
  Synthetic
cagaggtgagataaacccgatattgagaaagctcacacctattgagcggatcctgatcaactgcgggcttactat

SEQ ID NO: 295695 - DNA, 75 bp, Artificial Sequence
  Synthetic
tatcattctgctcaaagaattagctagattcagggataatcaaaggagtcagcaagggctgttccatgcctaccc

SEQ ID NO: 295696 - DNA, 75 bp, Artificial Sequence
  Synthetic
ttccagtgataggagactactaagcaggctgataagtaacctcaagtctggatatcttttgtttgatcttcacca

SEQ ID NO: 295697 - DNA, 75 bp, Artificial Sequence
  Synthetic
gatatcttttgtttgatcttcaccagaacttattcatgaaaagcctgtcaaaatcagagaagcagctgatcagga

SEQ ID NO: 295698 - DNA, 75 bp, Artificial Sequence
  Synthetic
aaagagtggttcaagctaataggttacagtgcattaattcaagagtgattctataattgcctgcctcctgacccc

SEQ ID NO: 295699 - DNA, 75 bp, Artificial Sequence
  Synthetic
gatcctatcaataaaactggagaaacgatatactaaagaaaacttcaaagaagtgaagtatctatccccagcttt

SEQ ID NO: 295700 - DNA, 75 bp, Artificial Sequence
  Synthetic
tcaataaaactggagaaacgatatactaaagaaaacttcaaagaagtgaagtatctatccccagctttgtctggt

SEQ ID NO: 295701 - DNA, 75 bp, Artificial Sequence
  Synthetic
accaaacaaagttgggtaaggatcggtctatcaatgattatgatttagcacacttaggattcaagatcctatcga

SEQ ID NO: 295702 - DNA, 75 bp, Artificial Sequence
  Synthetic
gtctatcaatgattatgatttagcacacttaggattcaagatcctatcgactggagcaggcttaaggtaaaggtt

SEQ ID NO: 295703 - DNA, 75 bp, Artificial Sequence
  Synthetic
ctttaaaatggcttctctcttgaagagcttagctctgttcaaaagggccaaagacaagccaccccttgctgcagg

SEQ ID NO: 295704 - DNA, 75 bp, Artificial Sequence
  Synthetic
ctctggtggggctatccggggaatcaaacatgtcattgttgttccgattcctggggattcctcaatcaccacaag

SEQ ID NO: 295705 - DNA, 75 bp, Artificial Sequence
  Synthetic
atcccgcctcctagaccgtctcgttaaaatggtgggagacccagacatcagtggccctaaattaaccggggctct

SEQ ID NO: 295706 - DNA, 75 bp, Artificial Sequence
  Synthetic
catcagcatcttatcactgtttgtcgagtcaccaggccaacttattcagagaatcactgatgaccctgatatcag

SEQ ID NO: 295707 - DNA, 75 bp, Artificial Sequence
  Synthetic
cattaaattggtggaggtagtccaaagtgacaaaactcaatcagggctgacatttgcctctaggggtacgagcat

SEQ ID NO: 295708 - DNA, 75 bp, Artificial Sequence
  Synthetic
ggatgacgaggctgatagatatttcacttatgaagaacccaatgacggagaagaaaggcagtcttactggtttga

SEQ ID NO: 295709 - DNA, 75 bp, Artificial Sequence
  Synthetic
gaatcgagatattcaagacattgagatccaggatccagaagggttcaatatgatactggcaaccatcttagccca

SEQ ID NO: 295710 - DNA, 75 bp, Artificial Sequence
  Synthetic
gatctggatcttactagctaaagcagtcacagcccctgatactgcagccgattcagagttacggaggtgggtgaa

SEQ ID NO: 295711 - DNA, 75 bp, Artificial Sequence
  Synthetic
atacactcaacaaaggagggtaattggagaattcagacttgacaaaggatggcttgacacagtgcgcaacagggt

SEQ ID NO: 295712 - DNA, 75 bp, Artificial Sequence
  Synthetic
agcagaagatctctctttacgcagatttatggtggcattgatcttagatatcaagagaaccccaggcaataaacc

SEQ ID NO: 295713 - DNA, 75 bp, Artificial Sequence
  Synthetic
aaggatcgctgaaatgatctgtgacattgatacctacatagtggaggcagggttggccagttttatactcactat

SEQ ID NO: 295714 - DNA, 75 bp, Artificial Sequence
  Synthetic
caaatttggtatagaaacgatgtacccagcactgggcctgcatgaattcgccggagagctctccacaatcgagtc

SEQ ID NO: 295715 - DNA, 75 bp, Artificial Sequence
  Synthetic
tcttatgaatctgtaccagcaaatgggtgaactggctccttatatggtgatcttagagaactcaatccagaacaa

SEQ ID NO: 295716 - DNA, 75 bp, Artificial Sequence
  Synthetic
gttcagtgcaggagcataccccctgttgtggagctatgctatggggattggggttgaattagagaattctatggg

SEQ ID NO: 295717 - DNA, 75 bp, Artificial Sequence
  Synthetic
gggacttaattttggcaggtcgtactttgaccctgcatatttcagattaggacaagaaatggtaaggaggtcagc

SEQ ID NO: 295718 - DNA, 75 bp, Artificial Sequence
  Synthetic
tgggaaggtcagctccaacctggcatctgagctcggcatcaccgaggaggaagcaagacttgtctctgagatcgc

SEQ ID NO: 295719 - DNA, 75 bp, Artificial Sequence
  Synthetic
agcatacacaagtgatgatcggaacaatagaacctctggacccaaacaggcccaggtttcattccttcgcaccga

SEQ ID NO: 295720 - DNA, 75 bp, Artificial Sequence
  Synthetic
tcaagggagtgaggcccagcacagcgcaagcaagaaagatgaagctagagcaccccaggtcaagaaggaaaccag

SEQ ID NO: 295721 - DNA, 75 bp, Artificial Sequence
  Synthetic
gaccagcagcaagtcagacaagcacaaggaaggtacagacaaagaacctgtaagctcctcagctatgactctgat

SEQ ID NO: 295722 - DNA, 75 bp, Artificial Sequence
  Synthetic
tgatgtggacacaaccctcgaggcagatactgatcctctagagagcaagaagtcagcagaggctcttcttagact

SEQ ID NO: 295723 - DNA, 75 bp, Artificial Sequence
  Synthetic
gcaggctatggccggcatcttaggggactcaacccttggcaatgacagtctgagagcatacaacgacaaggatct

SEQ ID NO: 295724 - DNA, 75 bp, Artificial Sequence
  Synthetic
tctcaactgagtgagtgccccgcacgcttcagcacgcaatctccccatgcaaagcgccattataaaaaacttagg

SEQ ID NO: 295725 - DNA, 75 bp, Artificial Sequence
  Synthetic
aaagcgccattataaaaaacttaggacccaggtctacaaatccgctcaccccgggacaacccgccccagcgaccg

SEQ ID NO: 295726 - DNA, 75 bp, Artificial Sequence
  Synthetic
ccgggacaacccgccccagcgaccgacccagatggcagaggagcaagcttaccatgtcaacaaaggcctggaatg

SEQ ID NO: 295727 - DNA, 75 bp, Artificial Sequence
  Synthetic
catcaaggctctcagggcccgacccctcgaccccctggtcgttgaagaagcccttgcagcatgggtcgagacctc

SEQ ID NO: 295728 - DNA, 75 bp, Artificial Sequence
  Synthetic
cgaagggcaaacgcttgaccgtatgtcctccgacgaggccgaagcagaccatcaggatatcagcaagccatgctt

SEQ ID NO: 295729 - DNA, 75 bp, Artificial Sequence
  Synthetic
atcaggatatcagcaagccatgcttcccagcagctggaccaggcaaaagcagcatgtctcgctgtcacgatcagg

SEQ ID NO: 295730 - DNA, 75 bp, Artificial Sequence
  Synthetic
gacttggaggaagcaacagctgtgatgaggagctgggagcattcattggtgactcctcaatgcatagcaccgagg

SEQ ID NO: 295731 - DNA, 75 bp, Artificial Sequence
  Synthetic
tacagcattatcatgtttatgatcacagcggtgaaaaggttgagggagtcgaagatgctgactctatcctggttc

SEQ ID NO: 295732 - DNA, 75 bp, Artificial Sequence
  Synthetic
aatcaggcgctgatgatggtgtcgaagtctggggaggagatgaggaatctgagaacagcgatgtggattctggcg

SEQ ID NO: 295733 - DNA, 75 bp, Artificial Sequence
  Synthetic
aacctgatcccgagggaagtgctcccgctgactggggatcttctcccatctctccagcaacaagagcctccgatg

SEQ ID NO: 295734 - DNA, 75 bp, Artificial Sequence
  Synthetic
ttgaaacagtagaaggggacgagatccaaaagctgctggaagatcagtcacggattcggaaaatgaccaaggcag

SEQ ID NO: 295735 - DNA, 75 bp, Artificial Sequence
  Synthetic
ggaagactcttgtggtgccgccgatcccctctcaggagaggccaactgcatcagagaaacccattaaaaagggca

SEQ ID NO: 295736 - DNA, 75 bp, Artificial Sequence
  Synthetic
cagacgtgaaatcgacctcatctggaacgatggccgagtcttcatcgacaggtggtgcaacccgacctgctctaa

SEQ ID NO: 295737 - DNA, 75 bp, Artificial Sequence
  Synthetic
agtcacagtggggaccgtcagggccaaatgcatctgcggagaatgccctcgcgtctgcgagcaatgtatcaccga

SEQ ID NO: 295738 - DNA, 75 bp, Artificial Sequence
  Synthetic
ctcagggatcgaaaacagaatctggtaccacaacctcgcggatatcccagagtaacattgagcctgaggatgatt

SEQ ID NO: 295739 - DNA, 75 bp, Artificial Sequence
  Synthetic
acgatgatgagctgttctcggatatccaagacatcaaaacagctctagctaaattgcatgatgaccagcaaatta

SEQ ID NO: 295740 - DNA, 75 bp, Artificial Sequence
  Synthetic
taattaccaggttagagtcactgctttcgctcaagggagagattgattcgatcaagaagcaaatcagtaagcaga

SEQ ID NO: 295741 - DNA, 75 bp, Artificial Sequence
  Synthetic
acattagcatctctaccatagaaggccatctctccagcgtcatgatcgcaatcccgggatttggcaaggatccca

SEQ ID NO: 295742 - DNA, 75 bp, Artificial Sequence
  Synthetic
acgatcccactgccgatgtcgacatcaaccctgatctgagacccataattggtcgggactccgggagagcccttg

SEQ ID NO: 295743 - DNA, 75 bp, Artificial Sequence
  Synthetic
ctgaagtactcaaaaagccggcctcagaaaggcaatccaaggacactggcaaattagggatcgagtccaaaggcc

SEQ ID NO: 295744 - DNA, 75 bp, Artificial Sequence
  Synthetic
tgttgaagaaagagttccaactgaaaccaatagaaaagaaatctagttcggctatcagattcgtcccggacggca

SEQ ID NO: 295745 - DNA, 75 bp, Artificial Sequence
  Synthetic
gtgttgcatctcgcagtgtgatccgttcaatcatcaagtcaagtcatctcggggaggatcgcaaggattacctga

SEQ ID NO: 295746 - DNA, 75 bp, Artificial Sequence
  Synthetic
tgagtctcttgaatgacattcagggctccaaggatcttgctcagttccatcagatgctggtcaaaattctaaaga

SEQ ID NO: 295747 - DNA, 75 bp, Artificial Sequence
  Synthetic
actagactcggcacaacatagctgatctcctcgcttcccctcagcttagctacagcttgcatgctcattataaaa

SEQ ID NO: 295748 - DNA, 75 bp, Artificial Sequence
  Synthetic
aacttaggagcaaagcataacgcctcgcactcccaacatggcagaaatttatgattttgacaaatcagcgtggga

SEQ ID NO: 295749 - DNA, 75 bp, Artificial Sequence
  Synthetic
tgtcaaagggtcgattgcaccaatcaggccaaaaacatacagtgacggccgattgattccccaagtgagagtaat

SEQ ID NO: 295750 - DNA, 75 bp, Artificial Sequence
  Synthetic
tgatccaggactcggggatcggaaagacgagtgctttatgtatatcttccttctggggattgtagaagacagtga

SEQ ID NO: 295751 - DNA, 75 bp, Artificial Sequence
  Synthetic
cccgctaagtcccccgcgaggccgaacttttggttccctgccgttaggagtgggcaagtccaccgcaaaaccaga

SEQ ID NO: 295752 - DNA, 75 bp, Artificial Sequence
  Synthetic
ggagctgctcaaggaagtgaccgatctagacatagtcgtcagacgcacagcaggattgaacgaaaaactggtatt

SEQ ID NO: 295753 - DNA, 75 bp, Artificial Sequence
  Synthetic
ctacaacaatacccctttatctctcctgacgccctggaaaaagatcctgacaacagggagtgttttcaatgccaa

SEQ ID NO: 295754 - DNA, 75 bp, Artificial Sequence
  Synthetic
tcaggtgtgcaatgcagttaacctgatcccgctagataccccacagagattccgcgtggtgtacatgagtataac

SEQ ID NO: 295755 - DNA, 75 bp, Artificial Sequence
  Synthetic
gcgtctatctgacagcggttattacactgtaccaaggaagatactagagttcagatccgccaatgcagtggcctt

SEQ ID NO: 295756 - DNA, 75 bp, Artificial Sequence
  Synthetic
caacttattggtcaccctcgagattgacagggacactgaacctggaagaccagcagcggggggattgggcctttc

SEQ ID NO: 295757 - DNA, 75 bp, Artificial Sequence
  Synthetic
cgaggcgacatttatggtccatgttgggaacttcagaaggaagaagaacgaggcttattcagcagattattgtaa

SEQ ID NO: 295758 - DNA, 75 bp, Artificial Sequence
  Synthetic
gatgaagattgagaagatgggcctagtctttgcactcggagggatagggggaacaagccttcacataagaagtac

SEQ ID NO: 295759 - DNA, 75 bp, Artificial Sequence
  Synthetic
tggcaaaatgagcaagacactccacgcacaattgggattcaagaagactttgtgttaccctctgatggatatcaa

SEQ ID NO: 295760 - DNA, 75 bp, Artificial Sequence
  Synthetic
tgaagacctcaaccggttgctgtggagatccagatgcaagattgttaggattcaggctgtcttgcaaccgtcagt

SEQ ID NO: 295761 - DNA, 75 bp, Artificial Sequence
  Synthetic
ccctcaggagtttcgcatttatgatgatgtgatcataaatgacgatcaagggcttttcaaggtcctgtaatactc

SEQ ID NO: 295762 - DNA, 75 bp, Artificial Sequence
  Synthetic
acccagcatcactccacccccgccgcaccgtcccgcagagacccacagcagggcagaacgcccgacaccagcctc

SEQ ID NO: 295763 - DNA, 75 bp, Artificial Sequence
  Synthetic
aacccagccgaacaacaaggcctagacccccacagcgcagccccccaccccgaactcaacacacggagcacccag

SEQ ID NO: 295764 - DNA, 75 bp, Artificial Sequence
  Synthetic
acccccacagcgcagccccccaccccgaactcaacacacggagcacccagctctgggcagcacccgcaccccacc

SEQ ID NO: 295765 - DNA, 75 bp, Artificial Sequence
  Synthetic
cgaactcaacacacggagcacccagctctgggcagcacccgcaccccacctgccctgcacccccacctggtccgg

SEQ ID NO: 295766 - DNA, 75 bp, Artificial Sequence
  Synthetic
acctccccacggctccgcccaccgccgcagccgaccaaggcccgaccaacacgcggccgctgcacatccagagcg

SEQ ID NO: 295767 - DNA, 75 bp, Artificial Sequence
  Synthetic
cacacccgacaacaaccccgacagtcccctaccgaaaggacaaccccagacacccaaccagggccaacagaggaa

SEQ ID NO: 295768 - DNA, 75 bp, Artificial Sequence
  Synthetic
ggaaaccacaggaaccagacacccccgagacgaggcaacctacccaccatgaataccaaacaaaacttagggtca

SEQ ID NO: 295769 - DNA, 75 bp, Artificial Sequence
  Synthetic
aagaatcacatcaacccgaatcgccggaagagacaacatcaccgacacacaaccaaaccgggaaccaaggggcaa

SEQ ID NO: 295770 - DNA, 75 bp, Artificial Sequence
  Synthetic
ccacccgcagggcccagggcccgggcccaccacccagagcagcgcagaaccgaaggacaggcccgccccacgcac

SEQ ID NO: 295771 - DNA, 75 bp, Artificial Sequence
  Synthetic
cccaccacccagagcagcgcagaaccgaaggacaggcccgccccacgcacagcagcagagcacctccagaccccc

SEQ ID NO: 295772 - DNA, 75 bp, Artificial Sequence
  Synthetic
cgaaggacaggcccgccccacgcacagcagcagagcacctccagaccccccacccagagccaccccgacgccgga

SEQ ID NO: 295773 - DNA, 75 bp, Artificial Sequence
  Synthetic
ccgagcccaagagcacccagggggaccctccggtcccagatccccaacagcagcaccccccacgcacccccccca

SEQ ID NO: 295774 - DNA, 75 bp, Artificial Sequence
  Synthetic
ccaccgcccccgggactccacctccacaccacgccagatgggaacagagggccccactcccccgcccccctccgc

SEQ ID NO: 295775 - DNA, 75 bp, Artificial Sequence
  Synthetic
gccccactcccccgcccccctccgcccgagcactcccatcgagaccacccccgcaccccaacacagcggaccctg

SEQ ID NO: 295776 - DNA, 75 bp, Artificial Sequence
  Synthetic
gtcacccatcgccgccggagagccggccaggcggagcaccaagggcaagccactgggtcccgcggcagatctccc

SEQ ID NO: 295777 - DNA, 75 bp, Artificial Sequence
  Synthetic
cagccgggcagcccaaggccaccaaatccatccgagcatcaaaccacggcatagcgaccgagacactgcccaata

SEQ ID NO: 295778 - DNA, 75 bp, Artificial Sequence
  Synthetic
aacacacccagatcacccacataatctctagcatgaagatcttatttgctaccctgctagtagtgaccacccctc

SEQ ID NO: 295779 - DNA, 75 bp, Artificial Sequence
  Synthetic
acttagtcactggccagatccactggggcaatctttcgaaaattggagtcgtagggacgggtagtgctagttaca

SEQ ID NO: 295780 - DNA, 75 bp, Artificial Sequence
  Synthetic
aggtgatgacccaatcgagtcaccagacactagttataaagctgatgcccaatatcaccgctatagacaactgca

SEQ ID NO: 295781 - DNA, 75 bp, Artificial Sequence
  Synthetic
ctaagactgagattgaggagtataagaggctgttggggacagtgcttcagcctattaaggtcgctctgaacgcca

SEQ ID NO: 295782 - DNA, 75 bp, Artificial Sequence
  Synthetic
ttactaagaatataaaaccaatcaggagttccactaccagtaggagacacagaaggttcgcaggggtcgctttgg

SEQ ID NO: 295783 - DNA, 75 bp, Artificial Sequence
  Synthetic
ctggtgcagctctcggagttgcaaccgcagcccagattacagcagggattgctcttcatcaatcaatgatgaata

SEQ ID NO: 295784 - DNA, 75 bp, Artificial Sequence
  Synthetic
cccaggctattgaaagtcttaaggcaagtctggaaacaactaatcaagcaattgaggaaatacgacaagcaggcc

SEQ ID NO: 295785 - DNA, 75 bp, Artificial Sequence
  Synthetic
aagaaatgatcctagcagttcaaggtgtccaggactacatcaacaatgaactggtacctgcaatgggccaattat

SEQ ID NO: 295786 - DNA, 75 bp, Artificial Sequence
  Synthetic
cgtgtgatatcgtgggtcagaagctagggctgaaactgctcagatactacactgaaatattatcattatttggcc

SEQ ID NO: 295787 - DNA, 75 bp, Artificial Sequence
  Synthetic
ccagcctcagagacccaatttcggccgagatttctatccaggctttgagttacgccttaggtggggacataaaca

SEQ ID NO: 295788 - DNA, 75 bp, Artificial Sequence
  Synthetic
aaatactagaaaagctagggtatagcgggagtgatctccttgctatactggaaagtaaaggtatcaaagctaaga

SEQ ID NO: 295789 - DNA, 75 bp, Artificial Sequence
  Synthetic
taacctatgtggatatcgaaagttacttcattgtgctcagcattgcctatccttcgctttctgaaattaaagggg

SEQ ID NO: 295790 - DNA, 75 bp, Artificial Sequence
  Synthetic
tgataattcatcgcctggagggtgtctcttacaatatagggtcgcaggagtggtataccacagtacctcgatatg

SEQ ID NO: 295791 - DNA, 75 bp, Artificial Sequence
  Synthetic
tggcaacccaaggttacctcatttcgaatttcgatgacacaccctgtgcattctccccagagggcactatctgca

SEQ ID NO: 295792 - DNA, 75 bp, Artificial Sequence
  Synthetic
gccagaatgcattatacccaatgagcccactcctccaggaatgtttccgtgggtcaaccaggtcatgcgctcgta

SEQ ID NO: 295793 - DNA, 75 bp, Artificial Sequence
  Synthetic
cactggtctctgggtctatagggaataggtttatcctatccaaggggaacctcattgccaactgtgcctcaatct

SEQ ID NO: 295794 - DNA, 75 bp, Artificial Sequence
  Synthetic
tgtgcaagtgttacaccactggctcaataataagtcaagatcctgacaagatcctaacatatatagctgcagacc

SEQ ID NO: 295795 - DNA, 75 bp, Artificial Sequence
  Synthetic
aatgccccatcgtagaagtggacggtgtaaccatccaggttgggagcagagagtaccctgatgcagtgtacctgc

SEQ ID NO: 295796 - DNA, 75 bp, Artificial Sequence
  Synthetic
ataaaatagaccttggcccaccaatatcgctggagaagctagatgttgggactaacctcggcaatgcagtgacaa

SEQ ID NO: 295797 - DNA, 75 bp, Artificial Sequence
  Synthetic
aactggagaaagccaaggatctactagattcatctgatctgatcctggaaaccatcaagggtgcttcagtcacga

SEQ ID NO: 295798 - DNA, 75 bp, Artificial Sequence
  Synthetic
acacaggccatattctagttggagccgggttgattgcagtagtgggtatcctcattgttacctgttgctgtagga

SEQ ID NO: 295799 - DNA, 75 bp, Artificial Sequence
  Synthetic
agcgcagtaatgacagcaaagtgtccactgtgatattgaatccgggtcttaaaccagacctcactggtacatcca

SEQ ID NO: 295800 - DNA, 75 bp, Artificial Sequence
  Synthetic
aatcctacgtacggtcactgtagtaggtgtgtctcccatgtgaccactgtccccgaacacctcagcaaagcccac

SEQ ID NO: 295801 - DNA, 75 bp, Artificial Sequence
  Synthetic
gatgccttatcccctccacaaccaatcagctgccattcccagcaggcaccctgtccgttcgcttactaattgtta

SEQ ID NO: 295802 - DNA, 75 bp, Artificial Sequence
  Synthetic
taaagaaaaacttaggatgcaaggtcatcaaccatgtctcccccaagagacagggtcgacgcttactacaaggac

SEQ ID NO: 295803 - DNA, 75 bp, Artificial Sequence
  Synthetic
aacttccaattcaagaacactcgggtggttcttaataaagagcagctcctgatagagagaccttgcatgttgctg

SEQ ID NO: 295804 - DNA, 75 bp, Artificial Sequence
  Synthetic
acggtgttgtttgtcatgttcctgagtctagtcgggctattagctatcgcaggtatcagactccatcgagctgct

SEQ ID NO: 295805 - DNA, 75 bp, Artificial Sequence
  Synthetic
gtcaatacagcaaaaatcaacaatgacctgacaacaagtattgatattaccaaatccattgagtaccaggtcaag

SEQ ID NO: 295806 - DNA, 75 bp, Artificial Sequence
  Synthetic
gatgttttaactccactcttcaaaataattggagatgaggtcgggttgaggacgcctcagagattcacagatctg

SEQ ID NO: 295807 - DNA, 75 bp, Artificial Sequence
  Synthetic
actaaattcatatcagacaagatcaagttccttaaccctgataaggagtacgactttagagatatcaactggtgc

SEQ ID NO: 295808 - DNA, 75 bp, Artificial Sequence
  Synthetic
atcaaccctccagagagaattaagattgattatgatcagtattgtgctcacacagcagctgaggatctgataaca

SEQ ID NO: 295809 - DNA, 75 bp, Artificial Sequence
  Synthetic
atgcttgtcaattcatccttaacagggactacagtactccgcacgtcattagtcaacttggggaggaactgtact

SEQ ID NO: 295810 - DNA, 75 bp, Artificial Sequence
  Synthetic
ggacccacaaccactaagggtcagttctctaatatatcattgaccctttccgggatatactcaggtcgtggctac

SEQ ID NO: 295811 - DNA, 75 bp, Artificial Sequence
  Synthetic
aacatttcatctatgatcactattactgggaaaggcatgtacgggagcacttatctggtcgggaaatacaatcaa

SEQ ID NO: 295812 - DNA, 75 bp, Artificial Sequence
  Synthetic
ctgggaaaggcatgtacgggagcacttatctggtcgggaaatacaatcaaagagccaggaggccaagcatagtat

SEQ ID NO: 295813 - DNA, 75 bp, Artificial Sequence
  Synthetic
agtaggcataattagagaactaggagtgggcacaccagtgtttcatatgacaaactacctggaacttccaagaca

SEQ ID NO: 295814 - DNA, 75 bp, Artificial Sequence
  Synthetic
caaactacctggaacttccaagacagccggaattggagacttgcatgctagccctaggagagtccaaattagctg

SEQ ID NO: 295815 - DNA, 75 bp, Artificial Sequence
  Synthetic
ccctctgcctagctgacagccccgtcgcactgcactacgggagggtaggagacgacaacaagatcagatttgtca

SEQ ID NO: 295816 - DNA, 75 bp, Artificial Sequence
  Synthetic
aattgggagtatgggcatcaccggccgaccgagacactttggccactctttcagcaatagacccgacattggacg

SEQ ID NO: 295817 - DNA, 75 bp, Artificial Sequence
  Synthetic
gactctatatcacaactcatagggggatcatagctgcagggactgccatatgggctgtccctgtgacgagaacag

SEQ ID NO: 295818 - DNA, 75 bp, Artificial Sequence
  Synthetic
atgaccaagtgaaaatgggaaagtgccgcctagaggcttgtcgagacagaccaccacctttctgtaacagtacag

SEQ ID NO: 295819 - DNA, 75 bp, Artificial Sequence
  Synthetic
attgggagccactagaggctggccgaataccggcgtatggagtactaaccatcaaactagggctggctgatgagc

SEQ ID NO: 295820 - DNA, 75 bp, Artificial Sequence
  Synthetic
ctaaagttgacataatttcagaatttggtcctctaatcacccatgactcagggatggatttatacacctcatttg

SEQ ID NO: 295821 - DNA, 75 bp, Artificial Sequence
  Synthetic
gggatggatttatacacctcatttgacggtaccaagtactggttgactactcctccattgcagaactcagctcta

SEQ ID NO: 295822 - DNA, 75 bp, Artificial Sequence
  Synthetic
ggagggggtgactgttatactcctacttacctgtcagaccgggctgacgatgatgttaaattgagctccaatctt

SEQ ID NO: 295823 - DNA, 75 bp, Artificial Sequence
  Synthetic
gtaatcctcccaagtagggacctccaatatgtgtctgcaacctacgacatctccagagttgaacatgccattgtg

SEQ ID NO: 295824 - DNA, 75 bp, Artificial Sequence
  Synthetic
taccacatctatagtaccgggcgactatcatcgtattactaccctttcaagttgcccataaagggagatcctgtc

SEQ ID NO: 295825 - DNA, 75 bp, Artificial Sequence
  Synthetic
agtctgcagatcgaatgcttcccgtgggaccgcaaactgtggtgccatcatttctgctctgttatagattcaggg

SEQ ID NO: 295826 - DNA, 75 bp, Artificial Sequence
  Synthetic
actggtgagcaggtcacccatataggggtagtagggattgagatcacttgcaatgggaaatagtggtgtctagac

SEQ ID NO: 295827 - DNA, 75 bp, Artificial Sequence
  Synthetic
tctgcagaggcttataaaccagggcctcccacaatgacgggaccaagcaccgcaaagcaacatacaaacggctac

SEQ ID NO: 295828 - DNA, 75 bp, Artificial Sequence
  Synthetic
caacattaccattataaaaaacgtagggtccaagctgtatttcaccatggactccctctctgttaaccaaatttt

SEQ ID NO: 295829 - DNA, 75 bp, Artificial Sequence
  Synthetic
gtacccggaggtgcaccttgatagcccgatagtgactaacaagctggttgccatattagagtatgcccggatccc

SEQ ID NO: 295830 - DNA, 75 bp, Artificial Sequence
  Synthetic
acataagtacgtcctcgaggatccaactctctgcaaaaatataaagcatcgcctagatagcggtttttcaaatca

SEQ ID NO: 295831 - DNA, 75 bp, Artificial Sequence
  Synthetic
gatgatcatcaacaatgttgagatagggaatgttgtccaatccaaactcaaaggttatccgaaccatgagcacat

SEQ ID NO: 295832 - DNA, 75 bp, Artificial Sequence
  Synthetic
aaggttatccgaaccatgagcacatcccatatccagaatgcaaccaagagttgttcaatgctcgggataagaagg

SEQ ID NO: 295833 - DNA, 75 bp, Artificial Sequence
  Synthetic
ttgttcaatgctcgggataagaaggctacggagaaaattcgatccctgtttaaaaaggggaccaccctgtacacc

SEQ ID NO: 295834 - DNA, 75 bp, Artificial Sequence
  Synthetic
aaaatcagtgataaagtgtgtacatgcttagagactgctaactcaagactaggattgggtgccgacttaggaatt

SEQ ID NO: 295835 - DNA, 75 bp, Artificial Sequence
  Synthetic
gggatcaaggagaagatcttgagtctaagcttgtacatgcagagttcccagtggtatgagccattcttgttctgg

SEQ ID NO: 295836 - DNA, 75 bp, Artificial Sequence
  Synthetic
ttcacgatcaagacagaaatgagatcaacaatcaagtcatcagtccataccagtcaccgacgaaggtacgtaccc

SEQ ID NO: 295837 - DNA, 75 bp, Artificial Sequence
  Synthetic
tctttcttctccggtgactcatttgagattctgatttcccgcgatctagtggcgatagtacacaggagactccat

SEQ ID NO: 295838 - DNA, 75 bp, Artificial Sequence
  Synthetic
catgtgtattacctgacattcgagttggtgttgatgtactgtgatatcatagagggtaggttgatgactgagact

SEQ ID NO: 295839 - DNA, 75 bp, Artificial Sequence
  Synthetic
gctatggtcatagatcccaggtacacagagctgctggagagagtccggtatatgtggaaactcattgatgggttt

SEQ ID NO: 295840 - DNA, 75 bp, Artificial Sequence
  Synthetic
ttcccaactcttggaaattctacttaccaagttgtggctctgttagagccgctttcacttgcctacctccaactg

SEQ ID NO: 295841 - DNA, 75 bp, Artificial Sequence
  Synthetic
agagatgtaacaacagaattaagaggtgcattcctaaatcattgcttcactgagatccgtgaaattcttaatcag

SEQ ID NO: 295842 - DNA, 75 bp, Artificial Sequence
  Synthetic
aacggagtcacagatgacaacacataccacgagatcgtcgaggccctagattatattttcataactgatgacatt

SEQ ID NO: 295843 - DNA, 75 bp, Artificial Sequence
  Synthetic
cacctcacgggtgaaatcttttcattctttagaagtttcggccaccccaggcttgaggcaatcacagccgcagac

SEQ ID NO: 295844 - DNA, 75 bp, Artificial Sequence
  Synthetic
aatgtaaggaaacatatgaaccagccgaaggtaatagtttatgaaaccctgatgaaaggacatgccatattttgc

SEQ ID NO: 295845 - DNA, 75 bp, Artificial Sequence
  Synthetic
gggattatcatcaacgggtatcgggacaggcatggagggagctggccacccatccacctccctgtgcatgccgcc

SEQ ID NO: 295846 - DNA, 75 bp, Artificial Sequence
  Synthetic
acctctataaggaatgctcaggcttcgggtgaagggttgacgtatgagcagtgtgtcgataactggaagtcattt

SEQ ID NO: 295847 - DNA, 75 bp, Artificial Sequence
  Synthetic
gccggtgtaaggtttggctgcttcatgcccctgagtttagacagtgaccttactatgtacttaaaggacaaggct

SEQ ID NO: 295848 - DNA, 75 bp, Artificial Sequence
  Synthetic
ctagcagctctcaaaaaggaatgggactccgcttatccgaaagaattcctccgctataacccacctaagagtact

SEQ ID NO: 295849 - DNA, 75 bp, Artificial Sequence
  Synthetic
agttcacggaggctagtcgatgtcttcctcaatgattcgacatttgacccttataacatgatcatgtatgtggtg

SEQ ID NO: 295850 - DNA, 75 bp, Artificial Sequence
  Synthetic
agcggtgattacctccgagaccctgacttcaattcatcttatagcctaaaggaaaaggaaattaaagagactggg

SEQ ID NO: 295851 - DNA, 75 bp, Artificial Sequence
  Synthetic
ggaaaaggaaattaaagagactgggagactctttgccaaaatgacttacaagatgagagcatgtcaggttatagc

SEQ ID NO: 295852 - DNA, 75 bp, Artificial Sequence
  Synthetic
agactctttgccaaaatgacttacaagatgagagcatgtcaggttatagccgaaaacctgattcccaatggtatc

SEQ ID NO: 295853 - DNA, 75 bp, Artificial Sequence
  Synthetic
caagactttctcctccaagaagacacacactggggctggtatctcaagggtgtctagaaatgaggcaaactaccg

SEQ ID NO: 295854 - DNA, 75 bp, Artificial Sequence
  Synthetic
gtcacccgaacaacgaggctgcaacaccggtggccccgatcagatagagagttatgaaacagttagtgcttttat

SEQ ID NO: 295855 - DNA, 75 bp, Artificial Sequence
  Synthetic
cacagctgatctgaaaaagtattgcctgaactggaggtatgagacaatcagcttatttgctcaaaggctaaatga

SEQ ID NO: 295856 - DNA, 75 bp, Artificial Sequence
  Synthetic
gatatacgggttaccatccttcttccagtggttacataggcgccttgaaagatcagtattgtatgtcagtgaccc

SEQ ID NO: 295857 - DNA, 75 bp, Artificial Sequence
  Synthetic
tcattgtccccccgatttagatagccacgtgaacttggataatgtcccgaatgatcagattttcatcaaataccc

SEQ ID NO: 295858 - DNA, 75 bp, Artificial Sequence
  Synthetic
tatgggggggatagaaggctattgtcaaaaactgtggacaattagcactatcccctatctttacttggctgcaca

SEQ ID NO: 295859 - DNA, 75 bp, Artificial Sequence
  Synthetic
tgagagcggggtcaggattgcctctcttgtccagggagacaatcagacaattgcagtcaccaagcgggtcccaag

SEQ ID NO: 295860 - DNA, 75 bp, Artificial Sequence
  Synthetic
actccatgatattggccatcaccttaaggcaaacgaaactatcgtgtcatcacacttctttgtttactccaaggg

SEQ ID NO: 295861 - DNA, 75 bp, Artificial Sequence
  Synthetic
gatatattacgacggactactaatctcacagtctctcaaaagcattgcacgatgtgtcttctggtcagaaactat

SEQ ID NO: 295862 - DNA, 75 bp, Artificial Sequence
  Synthetic
agttgatgagacaagagcagcttgcagcaacatcgccacgactatagccaagagcatagagagagggtttgacag

SEQ ID NO: 295863 - DNA, 75 bp, Artificial Sequence
  Synthetic
gtaccttgcttattctctgaacatcctgaaagttatacaacagatactaatatcactgggtttcacaataaattc

SEQ ID NO: 295864 - DNA, 75 bp, Artificial Sequence
  Synthetic
tacaatgacacaagatgtagtggtccctcttctatcaaaccatgacctcctgataaggatggcccttttacctgc

SEQ ID NO: 295865 - DNA, 75 bp, Artificial Sequence
  Synthetic
tccaatcgggggtatgaactacttaaacatgagtaggttatttgtcaggaacatcggggatccagtgacatcgtc

SEQ ID NO: 295866 - DNA, 75 bp, Artificial Sequence
  Synthetic
tatagctgacctcaagaggatgattggtgcgtcactgatgcctgaggagacacttcatcaggtgatgacacaaca

SEQ ID NO: 295867 - DNA, 75 bp, Artificial Sequence
  Synthetic
ggtgcgtcactgatgcctgaggagacacttcatcaggtgatgacacaacaaccaggtgactcatcatttctcgac

SEQ ID NO: 295868 - DNA, 75 bp, Artificial Sequence
  Synthetic
tgggctagtgacccctattctgctaacctagtatgcattcaaagcataacaaggcttctcaagaatatcaccgca

SEQ ID NO: 295869 - DNA, 75 bp, Artificial Sequence
  Synthetic
aagtatgttctaatcaacagccccaacccgatgctcagaggtttattccatgatgacagcaaggaagaagatgag

SEQ ID NO: 295870 - DNA, 75 bp, Artificial Sequence
  Synthetic
caattagccacctttctaatggacaggagtgtaatagtcccgagagccgcccacgaaatattagaccatagtata

SEQ ID NO: 295871 - DNA, 75 bp, Artificial Sequence
  Synthetic
actggagcccgggaagcaattgcagggatgctagatacaactaaaggactcatcaggactagctccagaagaggg

SEQ ID NO: 295872 - DNA, 75 bp, Artificial Sequence
  Synthetic
ggcctgaccaccagagtgatagcaagactatccacatatgactatgagcagtttagatctgggatggtgcttcta

SEQ ID NO: 295873 - DNA, 75 bp, Artificial Sequence
  Synthetic
acaggctcaaagagaaattatctcattgatagagactcatgctcagtccagctggctagggctctgagaagccac

SEQ ID NO: 295874 - DNA, 75 bp, Artificial Sequence
  Synthetic
atgtgggccaggctcgcccgaggaaggcccatatatggcttagaggtgccggacgtgctagaatcaatgagaggc

SEQ ID NO: 295875 - DNA, 75 bp, Artificial Sequence
  Synthetic
cacctgatccaacgccatgcaacctgcatcttatgtgactttggttcagccaattatggttggttttttgtacca

SEQ ID NO: 295876 - DNA, 75 bp, Artificial Sequence
  Synthetic
caattatggttggttttttgtaccatcgaactgtcagttggatgacatagatagagagacgtcagcactcagggt

SEQ ID NO: 295877 - DNA, 75 bp, Artificial Sequence
  Synthetic
gcggtcagctgtgcggatagccaccgtgtactcatgggcatacggagatgacgacaaatcatggaatgaagcttt

SEQ ID NO: 295878 - DNA, 75 bp, Artificial Sequence
  Synthetic
aaaactagcacagcagagggcaaaagtgagcctggaggaattaaaaatgataactccaatttcaacatccaccaa

SEQ ID NO: 295879 - DNA, 75 bp, Artificial Sequence
  Synthetic
cctagcacatagactcagggatcggagtacccaagttaagtactctgggacatctttggtcagagtggctcggta

SEQ ID NO: 295880 - DNA, 75 bp, Artificial Sequence
  Synthetic
tacaacaatatcaaatgataacctatcctttgtcatctcggataagaaagtagatacaaacttcatctatcagca

SEQ ID NO: 295881 - DNA, 75 bp, Artificial Sequence
  Synthetic
tcctttgtcatctcggataagaaagtagatacaaacttcatctatcagcaggggatgttactaggtttgggtgtc

SEQ ID NO: 295882 - DNA, 75 bp, Artificial Sequence
  Synthetic
tgctgcgtgatccctatggtagatcacccgaggatcccaagcttgcatgaattgaagttcagaagggagctatgt

SEQ ID NO: 295883 - DNA, 75 bp, Artificial Sequence
  Synthetic
accaacccactgatttatgatagtgcacccatcatcgacagggaagcaacaaaactctatacccaaagtcatcgg

SEQ ID NO: 295884 - DNA, 75 bp, Artificial Sequence
  Synthetic
agacatctcgtggaatttgtgacatggtctacatctcagttgtaccacatcttggcaaaatcaactgcattgtcg

SEQ ID NO: 295885 - DNA, 75 bp, Artificial Sequence
  Synthetic
atgatagacttagtgacaaaattcgagaaagatcatatgaacgaggtatctgctctgataggagatgatgatatc

SEQ ID NO: 295886 - DNA, 75 bp, Artificial Sequence
  Synthetic
aacagttttataacagagttcctccttgtagagcctagactgtttaccgtctacttaggtcagtgtacagctata

SEQ ID NO: 295887 - DNA, 75 bp, Artificial Sequence
  Synthetic
aattgggcatttgacattcattaccatcgaccttcagggaaatatcagatgggggaactcctgacctcattcctt

SEQ ID NO: 295888 - DNA, 75 bp, Artificial Sequence
  Synthetic
catagtgggattatagagccaatccatggtccttcattggatactcaaaatcttcatattactgtatgtaatatg

SEQ ID NO: 295889 - DNA, 75 bp, Artificial Sequence
  Synthetic
atctacagttgctatatgacttaccttgacctactgttgaatgacgaactggacgagttcacatacctcctctgc

SEQ ID NO: 295890 - DNA, 75 bp, Artificial Sequence
  Synthetic
gaaagtgatgaggacatagtggctgaccgctttgataacatacaggctagacatctgtgtgtcctatcggattta

SEQ ID NO: 295891 - DNA, 75 bp, Artificial Sequence
  Synthetic
tactgcaatcccagaggatgcccgaccatcaggggtctacaaccagtagagaaatgtgccatcatgaccaaacac

SEQ ID NO: 295892 - DNA, 75 bp, Artificial Sequence
  Synthetic
atcgaggccgaggcaaaactatccctcgctggcccttcatggaacataggccccattgtaattgatcacttctct

SEQ ID NO: 295893 - DNA, 75 bp, Artificial Sequence
  Synthetic
tgttctctgacttacttaaggcggggttcgatcaagcaaattcggttgagggttgatccagggttcatttttgag

SEQ ID NO: 295894 - DNA, 75 bp, Artificial Sequence
  Synthetic
gctctaactgtaacagatccgcagaaacccaactttcagcatgaacaagccgctgatatgcacataagcaatttt

SEQ ID NO: 295895 - DNA, 75 bp, Artificial Sequence
  Synthetic
aggccgccctatgatggtgtggcagagctgttagggacgataaactcgagtaagcataaccttcctatacttggc

SEQ ID NO: 295896 - DNA, 75 bp, Artificial Sequence
  Synthetic
acaggtgtttataattacgaggtccatgcgtttcgcaggataggattaaactcgtctgcttgttacaaggcagtg

SEQ ID NO: 295897 - DNA, 75 bp, Artificial Sequence
  Synthetic
gagatatccacgctaatcaagagctctatggacccagaagaggatagcttgttcttaggggaaggatcagggtca

SEQ ID NO: 295898 - DNA, 75 bp, Artificial Sequence
  Synthetic
atgttgataacgtataaagaaatccttaaattaaagaagtgcttttacaacagcggggtgtcagcagaatctaga

SEQ ID NO: 295899 - DNA, 75 bp, Artificial Sequence
  Synthetic
tcaggccagcgagagttagccccttacccatctgaggtaagcctggtcgaacatcagcttggtgcagagaaaact

SEQ ID NO: 295900 - DNA, 75 bp, Artificial Sequence
  Synthetic
gtcaaagtactattcaacgggaggcccgaggttacctggataggtagtgtagattgcttcaattatatcatcagc

SEQ ID NO: 295901 - DNA, 75 bp, Artificial Sequence
  Synthetic
aatatacagacatctagccttggcctaatacactcagacatagaaaccctccctacaaaagatatcacagagaaa

SEQ ID NO: 295902 - DNA, 75 bp, Artificial Sequence
  Synthetic
ttggaagagttgtcagctatcctagcgttggctctattgctaggtaaggtaggttcagtattggttatcaaagta

SEQ ID NO: 295903 - DNA, 75 bp, Artificial Sequence
  Synthetic
cgttggctctattgctaggtaaggtaggttcagtattggttatcaaagtaatgcctataagtggagactatgtcc

SEQ ID NO: 295904 - DNA, 75 bp, Artificial Sequence
  Synthetic
aggttcagtattggttatcaaagtaatgcctataagtggagactatgtccaggggttcatgagttatgtggtgcc

SEQ ID NO: 295905 - DNA, 75 bp, Artificial Sequence
  Synthetic
ttattacagagaggtactcatcatctacccgagatatagtaacttcatatcaactgaggcatatctagtcctgtt

SEQ ID NO: 295906 - DNA, 75 bp, Artificial Sequence
  Synthetic
gggactcagggccaatagactgatagatcctgaaagaattaaacaacaggtgatggaatccgggatcagaactat

SEQ ID NO: 295907 - DNA, 75 bp, Artificial Sequence
  Synthetic
ccccggtttagtcggacatatattatccatcaagcagctcaattgcatacaaagccaggcggggccagctatcac

SEQ ID NO: 295908 - DNA, 75 bp, Artificial Sequence
  Synthetic
tagaggtgagataaacccgatattaagaaagctcacacctatcgagcgtattctgatcagctgcgggcttaccat

SEQ ID NO: 295909 - DNA, 75 bp, Artificial Sequence
  Synthetic
caacggcacaaagatttgcagtgatgtagtccaccatgatatatcatcagggccggacggtctgcttaattcttc

SEQ ID NO: 295910 - DNA, 75 bp, Artificial Sequence
  Synthetic
gtagtccaccatgatatatcatcagggccggacggtctgcttaattcttctatcattctgctcaaggagttggcc

SEQ ID NO: 295911 - DNA, 75 bp, Artificial Sequence
  Synthetic
agattcagggataatcaaaggagtcagcaggggatgttccatgcttaccccgttctgctgagcagcaggcagcgt

SEQ ID NO: 295912 - DNA, 75 bp, Artificial Sequence
  Synthetic
gaactgatctccagggttgctagaaagttttggggttacattctcttatactccagcgataggagactactaagt

SEQ ID NO: 295913 - DNA, 75 bp, Artificial Sequence
  Synthetic
aggctggtgagtaatctcaagtctggataccttttgtttgatcttcatcagaacttgttcatgaaaaacctgtca

SEQ ID NO: 295914 - DNA, 75 bp, Artificial Sequence
  Synthetic
gataccttttgtttgatcttcatcagaacttgttcatgaaaaacctgtcaaagtctgagaagcagctgatcagaa

SEQ ID NO: 295915 - DNA, 75 bp, Artificial Sequence
  Synthetic
acagtgcactcattcgggagtgattctgcaactgtctgcttcccgatcctgatctggtcaataaaactgtagaaa

SEQ ID NO: 295916 - DNA, 75 bp, Artificial Sequence
  Synthetic
tcaataaaactgtagaaataatatactaaagaaaacttcaaagaagtgaagtttctatccccagctttgtctggt

SEQ ID NO: 295917 - DNA, 75 bp, Artificial Sequence
  Synthetic
accagacaaagctgggtaaggatcgttctatcaatgattgtgatttagcacacttaggattcaagatcctatcga

SEQ ID NO: 295918 - DNA, 75 bp, Artificial Sequence
  Synthetic
ttctatcaatgattgtgatttagcacacttaggattcaagatcctatcgactggagcaggcttagggcacaggtt

SEQ ID NO: 295919 - DNA, 75 bp, Artificial Sequence
  Synthetic
cgaactcaacacacggagcacccagctctgggcagcacccgcaccccaccctccccgcacccccacctggtccgg

SEQ ID NO: 295920 - DNA, 75 bp, Artificial Sequence
  Synthetic
cgaaggacaggcccgccccacgcacagcagcagagcacccccagaccccccacccaaagccaccccgacgccgga

SEQ ID NO: 295921 - DNA, 75 bp, Artificial Sequence
  Synthetic
gccccactctcccgcccccctccgcccgagcgctcccatcgagaccacccccgcaccccaagacagcggaccctg

SEQ ID NO: 295922 - DNA, 75 bp, Artificial Sequence
  Synthetic
agagccaggaggccaagcaaagtatggcaccaggattaccgagtcttcgaagtaggcataattagagaactagga

SEQ ID NO: 295923 - DNA, 75 bp, Artificial Sequence
  Synthetic
ttgttcattgctcgggataagaaggccacggagaaaattcgatccctgtttaaaaagggtaccactctgtacacc

SEQ ID NO: 295924 - DNA, 75 bp, Artificial Sequence
  Synthetic
agactctttgccaaaatgacttacaagatgagagcatgtcaggttatagccgaaaacctgatctcaaatggtatc

SEQ ID NO: 295925 - DNA, 75 bp, Artificial Sequence
  Synthetic
aggttcagtattggttatcaaagtaatgcctataagtggagactatgtccagggattcatgagttatatggtgcc

SEQ ID NO: 295926 - DNA, 75 bp, Artificial Sequence
  Synthetic
agttgatactgcccgcgacgaggatcacttatttgtcatccttggtgtctgaatcatagacattgctggttggta

SEQ ID NO: 295927 - DNA, 75 bp, Artificial Sequence
  Synthetic
gaatcatagacattgctggttggtatcttgatttcttctgtttggagaagtcacacgcttaccaaaatggtaggt

SEQ ID NO: 295928 - DNA, 75 bp, Artificial Sequence
  Synthetic
aaattgaaaaacgcaaaaaataaagggagaacccggctacgccggcctcccaaagggaaagccatgggcatggga

SEQ ID NO: 295929 - DNA, 75 bp, Artificial Sequence
  Synthetic
ctgattctcggaatcatgaactacgcctcccacatcgctcttggcatgaaagtcaacagcaggctaaagagtttc

SEQ ID NO: 295930 - DNA, 75 bp, Artificial Sequence
  Synthetic
tggaaaatgactccacctgggaaattagctaaggggataaccactctgatgaacatcctccggactctgctaaac

SEQ ID NO: 295931 - DNA, 75 bp, Artificial Sequence
  Synthetic
ggaatcttgggacgcaaaaaacaaaggagaggaggaactgaaagcctgttccccataatgtttctaactggattg

SEQ ID NO: 295932 - DNA, 75 bp, Artificial Sequence
  Synthetic
atggctatgcaggtatcccaaaatggtgatggttggctgctttcacctgatcaaatggatataggaaaaacctac

SEQ ID NO: 295933 - DNA, 75 bp, Artificial Sequence
  Synthetic
aaagttggtactggactatgcattttctcttcactggatattggcgtgccatgcaacttgaccataacatatgcg

SEQ ID NO: 295934 - DNA, 75 bp, Artificial Sequence
  Synthetic
tgtgtcaccttggctaatactgaagagccagtggatttggactgcttttgccgtgacgttcagaatgtgtgggtt

SEQ ID NO: 295935 - DNA, 75 bp, Artificial Sequence
  Synthetic
aaatatccgctttgtaaacctggaggccacaggctaaaacgatcgctgtcaataactgaacatccatcgtctgtc

SEQ ID NO: 295936 - DNA, 75 bp, Artificial Sequence
  Synthetic
tcactagacaaaccaactttgtggcatcactggaacagtgtcaatgatcgaattggcaagagtgaagagtggata

SEQ ID NO: 295937 - DNA, 75 bp, Artificial Sequence
  Synthetic
gttaccaatgcttggaaaagtttggtcattgctattgttgtcatcatggtgtttggaatcagttaccagagcatg

SEQ ID NO: 295938 - DNA, 75 bp, Artificial Sequence
  Synthetic
atagtgatatgcatcgcggctctgatagctccaagctactcaactcagtgtgtcaacatccaaaaacgtgatatc

SEQ ID NO: 295939 - DNA, 75 bp, Artificial Sequence
  Synthetic
ataaggggagcgtctgacgtttcttggtttgatgtcctgttggaaaagggggcttgtgttaccattagtgctcag

SEQ ID NO: 295940 - DNA, 75 bp, Artificial Sequence
  Synthetic
gataaaccaagtgtggatctgtggctcgatgatgtgattcaagaatctctcatcgaaggaagacactattgcacc

SEQ ID NO: 295941 - DNA, 75 bp, Artificial Sequence
  Synthetic
aaggcatccatctcagaccttaaagctgacgctcgctgtcctacgcaaggtgaagccaccatgcgtgaggaacat

SEQ ID NO: 295942 - DNA, 75 bp, Artificial Sequence
  Synthetic
ctcgacggatatgtctgcaagagaagcttcagtgatagaggctggggaaatggttgtggtttgtttggaaaaggc

SEQ ID NO: 295943 - DNA, 75 bp, Artificial Sequence
  Synthetic
agcatcgttggatgtgctaaggccacttgtggggcaaatgacatcatcaaaagctactcgtatgattcaccaaaa

SEQ ID NO: 295944 - DNA, 75 bp, Artificial Sequence
  Synthetic
gtcaaatatgtaattggagctgaagtgcatcaaggcaagttgctaacaaacaacagcaccgacaggatagttaag

SEQ ID NO: 295945 - DNA, 75 bp, Artificial Sequence
  Synthetic
acaactttcacagctgaatctgaaaagcataccatcacaatagcggattatggtagcatggacttcacatgtcgt

SEQ ID NO: 295946 - DNA, 75 bp, Artificial Sequence
  Synthetic
gttgttgctagtgttgaattgtcaaacatcagaatgattgaacttgatggccatatgttcaatgtgcatgaggac

SEQ ID NO: 295947 - DNA, 75 bp, Artificial Sequence
  Synthetic
tggctgagtgacttgccattgccctccaaaatttcaggtggatcttggcatggaatggatcgtttagttgtattt

SEQ ID NO: 295948 - DNA, 75 bp, Artificial Sequence
  Synthetic
aaagaaccacatgcagtaaagatggaaattcaggaatgtggagatcagagaccagcagtttttaaatcattggtc

SEQ ID NO: 295949 - DNA, 75 bp, Artificial Sequence
  Synthetic
aaagctgaagaagtgaccaaaactagcaactcttaccatctcaccggaggacatgttgattgtagagtgagtact

SEQ ID NO: 295950 - DNA, 75 bp, Artificial Sequence
  Synthetic
ctcaatcttcgaatgaagggtttgacgtatcaaatgtgttcttctagctttgtgtggcacaaaagaccagtggcc

SEQ ID NO: 295951 - DNA, 75 bp, Artificial Sequence
  Synthetic
acgcaacatggcacggttgcaatggaagtcaaatataagggatccgatgctccatgtagaatacctgtttctgtt

SEQ ID NO: 295952 - DNA, 75 bp, Artificial Sequence
  Synthetic
gaaaaggaaggttataatgggaagaattttggaaatcttattactgctaacccatttgccgctaataatgaggct

SEQ ID NO: 295953 - DNA, 75 bp, Artificial Sequence
  Synthetic
gttgtgttccttgaattggaagctccgctaggtgtatcgaccatcaaagttggtggagctgtgtttcaatggaaa

SEQ ID NO: 295954 - DNA, 75 bp, Artificial Sequence
  Synthetic
caagagggaagttcaatcggaaaagctgtaactctgatgaaaaggaacattgaaaagacattgataacctcaagt

SEQ ID NO: 295955 - DNA, 75 bp, Artificial Sequence
  Synthetic
gcttactggagcagttcagaacctttcacttcagcaggcataatgcgcattctccgaatgccgtttgacatgata

SEQ ID NO: 295956 - DNA, 75 bp, Artificial Sequence
  Synthetic
tttggaggtgtaggatttctgggaaagctcatgatatctggagttctgatctggttgtgtgtaaatgtccaaaac

SEQ ID NO: 295957 - DNA, 75 bp, Artificial Sequence
  Synthetic
tcaaccttatctgtggtttcaggagtgattggatttatgcttcttggatttacaactggagtcatgggagaccac

SEQ ID NO: 295958 - DNA, 75 bp, Artificial Sequence
  Synthetic
ggatgcgcactagacacatacaggaaagaaatgcggtgcggggatggattgatggtttggaatgatgtcaacaat

SEQ ID NO: 295959 - DNA, 75 bp, Artificial Sequence
  Synthetic
tggcatgaggcctacaaatattaccctgaagatcctgagattttccttgcaagcttggttgaggatagagagaaa

SEQ ID NO: 295960 - DNA, 75 bp, Artificial Sequence
  Synthetic
cattgtggatattctccatcaaaccacattgacttggccatgtggaaagcacttgaggaggagataaactggttt

SEQ ID NO: 295961 - DNA, 75 bp, Artificial Sequence
  Synthetic
ctggaagatcagtcagttgattggaggataatggttggaaatgaagaaaaggttttccacaaaacaaactcaagt

SEQ ID NO: 295962 - DNA, 75 bp, Artificial Sequence
  Synthetic
ggctgggaaagaagagctgggaggaattctctatcatggaagaactgggcgaaaagtttcaaattgatgtcatgg

SEQ ID NO: 295963 - DNA, 75 bp, Artificial Sequence
  Synthetic
attttggagaggaaacaaggcaacggaacgtatttcgtgggtcctgtaggccttgatgaatgtccccttgctaac

SEQ ID NO: 295964 - DNA, 75 bp, Artificial Sequence
  Synthetic
cgatcatggaacgctttcaaagtgtctgagttcggggctggcattttacaaacaagggctttcattgacattcaa

SEQ ID NO: 295965 - DNA, 75 bp, Artificial Sequence
  Synthetic
acatcaaacagtcagttttgtgaccagggactgatagggtctggcgctaaggataaaagaattgtgcatggatct

SEQ ID NO: 295966 - DNA, 75 bp, Artificial Sequence
  Synthetic
ccctggatgtggatggacagctatgaagtcaatggcactctccagctacagaaattagagatgaaatatgccgtt

SEQ ID NO: 295967 - DNA, 75 bp, Artificial Sequence
  Synthetic
gaatgcttatggccattaagccacacacttggaggaaaaggagctcctgagtcacaactcattctccctaagaaa

SEQ ID NO: 295968 - DNA, 75 bp, Artificial Sequence
  Synthetic
cttggaggaccagtatcaacactgaacatgattaaagggtatgctacccaagaattaggaccctggaaaaatggg

SEQ ID NO: 295969 - DNA, 75 bp, Artificial Sequence
  Synthetic
gctcttgttcttgaaagaggagagtgtcctggaacaaaagtccaaattctagaggattgtgataaaagaggacat

SEQ ID NO: 295970 - DNA, 75 bp, Artificial Sequence
  Synthetic
tctgttagaagtaccacccaaggaggggtaacaatacctgactggtgttgtaaacactgtgttttgccacctttg

SEQ ID NO: 295971 - DNA, 75 bp, Artificial Sequence
  Synthetic
aaattcaccaatgccgatggatgttggtatgccatggaaatcagaccactgaaaacgacacctggactagtttat

SEQ ID NO: 295972 - DNA, 75 bp, Artificial Sequence
  Synthetic
gcaggaagtatgacagctttggaagctcagtcatggggagttctctctgtgatgttgctgttttacatgggcttt

SEQ ID NO: 295973 - DNA, 75 bp, Artificial Sequence
  Synthetic
ctaccgaagattgcaaaagaaagatggagtgtgtcaactgccttcatgtttttcgtctttgccatcacagggttg

SEQ ID NO: 295974 - DNA, 75 bp, Artificial Sequence
  Synthetic
attgattgcagggattttctccgctacttgctggcggtgggaacaacctttgcgtggcaatttcctgagccaatg

SEQ ID NO: 295975 - DNA, 75 bp, Artificial Sequence
  Synthetic
ctttggatggttgccatgcagactgtgttcatgctacgtcctgccctgacagttggaattttatttgccagaagc

SEQ ID NO: 295976 - DNA, 75 bp, Artificial Sequence
  Synthetic
tggaagtttgaaagaatcttggctcttgcttctctcctgcaagtctttcaacatgtgactatggagtgggaatca

SEQ ID NO: 295977 - DNA, 75 bp, Artificial Sequence
  Synthetic
gtttggaaagttttggattccttgggctttgttgtctatgggttcttactttctaagtctggaatgcaaagccac

SEQ ID NO: 295978 - DNA, 75 bp, Artificial Sequence
  Synthetic
gtgttcatgctgtttgtagtgtcactgacttggatggatagcatagtaatgcaacatgctctagcacttggagga

SEQ ID NO: 295979 - DNA, 75 bp, Artificial Sequence
  Synthetic
gtgatgctcttgatgtccattagtccaaagttcatgcaatctgattggatacagaagacacagttaaccattctg

SEQ ID NO: 295980 - DNA, 75 bp, Artificial Sequence
  Synthetic
ggaggattgaagatcctgaatgctcctttctatgttgtagcattgattttttacacatgtttcaatgattacatg

SEQ ID NO: 295981 - DNA, 75 bp, Artificial Sequence
  Synthetic
catagaggccaaagagctactgattacacagccatactcggcattgttatggcaataggagcagccatttgcaaa

SEQ ID NO: 295982 - DNA, 75 bp, Artificial Sequence
  Synthetic
aatggtctggaatcaagtggatggatgatcggaatcatgggaattttcctagtcttttttctcctccaattaagc

SEQ ID NO: 295983 - DNA, 75 bp, Artificial Sequence
  Synthetic
aaaggagagatgacagctgaatgggctggatactgtgaatggaaaaaagattgtgataaatctgttggcagtctg

SEQ ID NO: 295984 - DNA, 75 bp, Artificial Sequence
  Synthetic
agtcttgaggtgaaaaggatgtccgacggaagactggtcaacctctcaaaagacaaggagagtatgactgaagtt

SEQ ID NO: 295985 - DNA, 75 bp, Artificial Sequence
  Synthetic
atcatggtgtctgttggaatgattgtcactggttttcattggattggaattcctctaaccatagctatgcttgga

SEQ ID NO: 295986 - DNA, 75 bp, Artificial Sequence
  Synthetic
atcaaaaagtgttatgatgccacgcaaagatcaattattgtgtttggagttggtgaagatccagaaggtgagaaa

SEQ ID NO: 295987 - DNA, 75 bp, Artificial Sequence
  Synthetic
gtcagtattcaagatggggtttaccgaattatggtttcatcactcttcggaaagaaacaagttggagttggaatt

SEQ ID NO: 295988 - DNA, 75 bp, Artificial Sequence
  Synthetic
tggaccggtaactcattccataccatgtggcacgtcacacgtggtgctgtattgaacatctgtgggaggaaaatc

SEQ ID NO: 295989 - DNA, 75 bp, Artificial Sequence
  Synthetic
gtaccagaatgggccagcatcacagaagatctaatatcatataatggtgggtggagattgttcactagatgggat

SEQ ID NO: 295990 - DNA, 75 bp, Artificial Sequence
  Synthetic
ggaacagaagttcaagttcacgcttacacccctgatggaaaagtcaccacaacacagctgcttcctggaagcatg

SEQ ID NO: 295991 - DNA, 75 bp, Artificial Sequence
  Synthetic
aaggttgaaggtggtcttgagttgggcctaattccacttgattttccaccaggatcttctggctcaccaatcata

SEQ ID NO: 295992 - DNA, 75 bp, Artificial Sequence
  Synthetic
tcatcagatggaaagataattgggctgtatggaaatggagtcttacatggggacacatactgtagttctatagct

SEQ ID NO: 295993 - DNA, 75 bp, Artificial Sequence
  Synthetic
caaactgagaagaaggaagaagatgttccacaaccaaagacacttgaaggagatggctggttgtcaaaagggaaa

SEQ ID NO: 295994 - DNA, 75 bp, Artificial Sequence
  Synthetic
ataaccgtaattgatgcccatcctggaagtggtaaaacacatagaatactaccaaatttagttaaaagggctgct

SEQ ID NO: 295995 - DNA, 75 bp, Artificial Sequence
  Synthetic
gagagaaagatgaggacacttgttttagctccaacacgggttgtgataaaagagatggaaagtgctctcaaagga

SEQ ID NO: 295996 - DNA, 75 bp, Artificial Sequence
  Synthetic
atggatatcagttttcactcatcggccgtgtcaacgaagaccccaggatcacttgttgatgtcatgtgccatgct

SEQ ID NO: 295997 - DNA, 75 bp, Artificial Sequence
  Synthetic
acttttgtaaataggaaattaattcatactccacagaggaattatgaggtaataatcatggatgaagctcattgg

SEQ ID NO: 295998 - DNA, 75 bp, Artificial Sequence
  Synthetic
acagacccgagtagcattgcagctcgtggatacatcactagccagtgtgaaatgaaaaaatgtgctgttgtgttg

SEQ ID NO: 295999 - DNA, 75 bp, Artificial Sequence
  Synthetic
atgacggctacacctcctggagttgatgatccatgggcaaacagtaatgagaagattgctgatgttgaaaagatg

SEQ ID NO: 296000 - DNA, 75 bp, Artificial Sequence
  Synthetic
attcctgatgagccatggaaacaaggttatgaatggataacagactttgaaggaagaacagcgtggtttgtgcca

SEQ ID NO: 296001 - DNA, 75 bp, Artificial Sequence
  Synthetic
agaggttttattcccttgtcaggtcatgtggttgacctgggctgcggccgcggcggctggagctactattgcgca

SEQ ID NO: 296002 - DNA, 75 bp, Artificial Sequence
  Synthetic
tcatacaatgcagctcagggaatctcaaaagccttgagagagagaggaaagaaagtcctcattctgacaagcaag

SEQ ID NO: 296003 - DNA, 75 bp, Artificial Sequence
  Synthetic
acctttcatgacaactatcctaagatacagtcagaaaaacctgatttcatactcaccactgacatttcggagatg

SEQ ID NO: 296004 - DNA, 75 bp, Artificial Sequence
  Synthetic
ggtgccaatctagatgttgatagggtaattgatccaaggacaactcttaaaccaatggaaaaaggcaatattgtg

SEQ ID NO: 296005 - DNA, 75 bp, Artificial Sequence
  Synthetic
gaggttagcggtgaaatatcaataacgcctgcctcagcagcccagagaaggggaagagtcggacgagttaaggga

SEQ ID NO: 296006 - DNA, 75 bp, Artificial Sequence
  Synthetic
aaaaaggccgaatacatctatcaaggaaccacggaaatggatgattcagatctaatttgctggaaagaagcacaa

SEQ ID NO: 296007 - DNA, 75 bp, Artificial Sequence
  Synthetic
atgttactggacaacatggatagccgacaaagagcgacatgtcaattctatgaacctgaacaagacaagatgact

SEQ ID NO: 296008 - DNA, 75 bp, Artificial Sequence
  Synthetic
gaaattcctggctattatagactcacagaggagaagagaaaggtattccgtcatctcctaacgcagtgtgatttt

SEQ ID NO: 296009 - DNA, 75 bp, Artificial Sequence
  Synthetic
accccatggctggcatggaatgtagctcagaataccaaaggcatggaggatcgtggatggttaaacataggtccc

SEQ ID NO: 296010 - DNA, 75 bp, Artificial Sequence
  Synthetic
aatcagcatttagtgtcagatgaaaatggtgatccaatcaagtatacaacacctagtgggagagaaaggcaactt

SEQ ID NO: 296011 - DNA, 75 bp, Artificial Sequence
  Synthetic
caaccggtttggttggacaacaggatggtgaaagaaaaaagagacttggtttcattgctagaatacgcccaaatg

SEQ ID NO: 296012 - DNA, 75 bp, Artificial Sequence
  Synthetic
agaagatcaggggttctgctaggcttacccagactgatgtaccaaaaagttgtggaatcaattgacatggtgcac

SEQ ID NO: 296013 - DNA, 75 bp, Artificial Sequence
  Synthetic
acttattacacagctgacccaaattcacggaactttaaacttgctgagaaagaactacctgatgcttttctctgc

SEQ ID NO: 296014 - DNA, 75 bp, Artificial Sequence
  Synthetic
attttgcagtcattgcttatgattgtgggagtgttcatcattctaatgtggatactaagtagaaccaaagttgac

SEQ ID NO: 296015 - DNA, 75 bp, Artificial Sequence
  Synthetic
aggatctggattggaacgttggtgataggaatgtcaggattgacggcatggtacggaggagtgcctttgcctgtt

SEQ ID NO: 296016 - DNA, 75 bp, Artificial Sequence
  Synthetic
atctcaggtggagcgctggtctgctttgtgctgttaatctgtttggtaccagaggaaggaatgcaacgcactcaa

SEQ ID NO: 296017 - DNA, 75 bp, Artificial Sequence
  Synthetic
attgactccacattggcaaccattttaatctgtgtgatactgactgttgtgacagttgttgccaatgaaatgcgg

SEQ ID NO: 296018 - DNA, 75 bp, Artificial Sequence
  Synthetic
ctactggaaaatacaaagcgtgacataatggatctcttcaagagagacaccactgtgaacgaaagtcctgtcttc

SEQ ID NO: 296019 - DNA, 75 bp, Artificial Sequence
  Synthetic
cattacacgtgggaatcactcatggaatgggacatcaggcctttgaccatctgggccacatatgtggtttttgtc

SEQ ID NO: 296020 - DNA, 75 bp, Artificial Sequence
  Synthetic
acgttagctaggccacaagccttgcacaaccttaaaatgttcacacaaagagtcattactggaacagtggctgga

SEQ ID NO: 296021 - DNA, 75 bp, Artificial Sequence
  Synthetic
aaacatgacatggttaacttgcttccatttggagctgcttggctctctttgggtttaggagacttgactttggca

SEQ ID NO: 296022 - DNA, 75 bp, Artificial Sequence
  Synthetic
gtcggggcgttcagaaacatgtcatgtctaaccttggtgggtggagtcttacttgccttggctcattggacttgg

SEQ ID NO: 296023 - DNA, 75 bp, Artificial Sequence
  Synthetic
ttctatccgctgcatgcagcagctgaaagctcaaaagcccacaaaattgtaacacaatctctctcaaagaacacc

SEQ ID NO: 296024 - DNA, 75 bp, Artificial Sequence
  Synthetic
atggtcgatggtgaaaccatttatcaattagaccaaacctctgcagagacagagaggagtgagaagattttctct

SEQ ID NO: 296025 - DNA, 75 bp, Artificial Sequence
  Synthetic
atggtcactggcttcactttgactgctatcaatgttttcactcttcgcaaagcatgggctgtcttggagtgtgtg

SEQ ID NO: 296026 - DNA, 75 bp, Artificial Sequence
  Synthetic
atggttggaatggtgttaatcaagtatctgattgaaccaaagggaactacattttggacccttccagtggttagt

SEQ ID NO: 296027 - DNA, 75 bp, Artificial Sequence
  Synthetic
ggattaacatcactggtccgaggagatttctttggtttgattcccatttctttcagggtctggctatatgccaga

SEQ ID NO: 296028 - DNA, 75 bp, Artificial Sequence
  Synthetic
agtgatagacgaggtatagtaaccagtcatcacacattgggtgaaaagtggaaacttgaacttaaccagctaagt

SEQ ID NO: 296029 - DNA, 75 bp, Artificial Sequence
  Synthetic
cataaagaattcctgagttacaggaaggttggaattttggaagttgacagatccgatgctgtgatgaatttaaat

SEQ ID NO: 296030 - DNA, 75 bp, Artificial Sequence
  Synthetic
aaaggcaaaaccaacactggacacgccgtttctagaggaacttcaaaactggcttggatgcatgaaagaggtttt

SEQ ID NO: 296031 - DNA, 75 bp, Artificial Sequence
  Synthetic
ccgtttctagaggaacttcaaaactggcttggatgcatgaaagaggttttattcccttgtcaggtcatgtggttg

SEQ ID NO: 296032 - DNA, 75 bp, Artificial Sequence
  Synthetic
ggcttggatgcatgaaagaggttttattcccttgtcaggtcatgtggttgatctaggatgtggaaggggaggttg

SEQ ID NO: 296033 - DNA, 75 bp, Artificial Sequence
  Synthetic
gagctactattgcgcagcacaaacaccagtaaggaaagtcaatgcttataccttaggtactggagctcatgagaa

SEQ ID NO: 296034 - DNA, 75 bp, Artificial Sequence
  Synthetic
acctcgtctggtcgaaagcttaggttggaacctcatcacctttaagtcaaaaactgatgtattcaaactaaaacc

SEQ ID NO: 296035 - DNA, 75 bp, Artificial Sequence
  Synthetic
atacagttgtgacactgttttatgtgatataggtgagtctaatccatcatatgctactgaggccaaaaagacact

SEQ ID NO: 296036 - DNA, 75 bp, Artificial Sequence
  Synthetic
aatgaaaattacgtcaactaccttggagcaatgggacgctatgaatgtgatgatgtctcattccaactgtattaa

SEQ ID NO: 296037 - DNA, 75 bp, Artificial Sequence
  Synthetic
tgaagtgattgagatggtcggaaattggatgctagtaaaccctgagtcaaatttttgctttaaagtactgaaccc

SEQ ID NO: 296038 - DNA, 75 bp, Artificial Sequence
  Synthetic
ttactcccctcaagttttagagaggttgacaaagttccagcacatgtttggaggtggaataatcagggtcccgca

SEQ ID NO: 296039 - DNA, 75 bp, Artificial Sequence
  Synthetic
ttcacgaaactcaacacatgaaatgtattttgtgtcaggaatcaccaataatttggttggaagtgtgaatgcagt

SEQ ID NO: 296040 - DNA, 75 bp, Artificial Sequence
  Synthetic
cacaaagaaattaatgcagagaatgagacaagaaggaaaggaaagagtggtggctgacatcaagtttccagtcgg

SEQ ID NO: 296041 - DNA, 75 bp, Artificial Sequence
  Synthetic
cactcgttccaatcttacaacctgtgttaaggctgatgccaagctgattgaacagagaattgaaaaagttaagaa

SEQ ID NO: 296042 - DNA, 75 bp, Artificial Sequence
  Synthetic
tgaaaacaaaaattcctggacgtttgatgataatcatccatatcgcacatggcaataccatggaagctaccaaat

SEQ ID NO: 296043 - DNA, 75 bp, Artificial Sequence
  Synthetic
tcgggatgttggtacaaaagccaatgcaattaactatgtggttaaacttttgagttggccttggcaagcattgga

SEQ ID NO: 296044 - DNA, 75 bp, Artificial Sequence
  Synthetic
aagtgtgttttccatatcaatgactgataccacagctttcggacagcagagagtgttcaaagaaaaagttgacac

SEQ ID NO: 296045 - DNA, 75 bp, Artificial Sequence
  Synthetic
aaaagctcctgaacctccaaaagaggtcaaaatagtgatgaggaaagtgttcacctggttagtgaaaagaatatt

SEQ ID NO: 296046 - DNA, 75 bp, Artificial Sequence
  Synthetic
gaaaaaaggaggtaagattaggaaatgcactaaagaagaattcattaacaaggtggaatcacatgcgtccattgg

SEQ ID NO: 296047 - DNA, 75 bp, Artificial Sequence
  Synthetic
agcatggagccaagagatgcagggatggagtgatgccaaggaagcagttcatgaccccaggttttggaatatggt

SEQ ID NO: 296048 - DNA, 75 bp, Artificial Sequence
  Synthetic
ggacaaagagaggaaactacacctggaaggaaaatgtgaaatgtgcatctataacttgatgggtaaaagagaaaa

SEQ ID NO: 296049 - DNA, 75 bp, Artificial Sequence
  Synthetic
gaaaccaggtgagtttggatgtgccaagggtagccggaccatatggtacatgtggttaggtagcaggttcctaga

SEQ ID NO: 296050 - DNA, 75 bp, Artificial Sequence
  Synthetic
atttgaatctttcggcttcttgaatgaggaacattgggcatcaagagagttgtctggaggaggggtagagagcat

SEQ ID NO: 296051 - DNA, 75 bp, Artificial Sequence
  Synthetic
accactgttctaccttggatatcatctaagagagatggctaagaaacctggaaaactctatgctgatgacactgc

SEQ ID NO: 296052 - DNA, 75 bp, Artificial Sequence
  Synthetic
aggatgggacactcgtataactgaagcagatctggatgatgaatgcatcctctgtgactatatggaggatgagca

SEQ ID NO: 296053 - DNA, 75 bp, Artificial Sequence
  Synthetic
taaacaacttgctctttctctgtttgagctatgttacaaaaataaggtagccctttgtcccaggccaggaagaca

SEQ ID NO: 296054 - DNA, 75 bp, Artificial Sequence
  Synthetic
tggaggaactgtaatggatgtgatctctaggagagatcagagaggatctggtcaagttgtaacatatgcactaaa

SEQ ID NO: 296055 - DNA, 75 bp, Artificial Sequence
  Synthetic
caccttaacaaatattaaagtccagttaatcagattggctgaaagtgaaggtgtgctggatgaagatttcaatga

SEQ ID NO: 296056 - DNA, 75 bp, Artificial Sequence
  Synthetic
tcacgggattgaaacttggctgaaccactatggtgaggaaagattgtctcgtctcttgattagtggtgatgactg

SEQ ID NO: 296057 - DNA, 75 bp, Artificial Sequence
  Synthetic
cgtggtgaacgcatgtgatgaaaggtttgggagaagcttgacatggttgaacaccatggagaaaatccgcaagga

SEQ ID NO: 296058 - DNA, 75 bp, Artificial Sequence
  Synthetic
cattgacttgtgggctccatcaaatggatatgagaactttgaaaaagttgagttctgctcaaaccactttcatga

SEQ ID NO: 296059 - DNA, 75 bp, Artificial Sequence
  Synthetic
gctgatgttgaaagatggacgtcagctggtcgtcccctgcaggagtcaaaatgaattagttggtagagcttctgt

SEQ ID NO: 296060 - DNA, 75 bp, Artificial Sequence
  Synthetic
aaatcagggtggaagtgcaaccgttgcagggactgcgtgtctagccaaagcctatgcccaaatgtggaatttgtt

SEQ ID NO: 296061 - DNA, 75 bp, Artificial Sequence
  Synthetic
gtattttcacagaagagacttgaggcttctggggtttgccatcatgtctgcaacaccatcaaattggattccaac

SEQ ID NO: 296062 - DNA, 75 bp, Artificial Sequence
  Synthetic
tggaagaacaacatggtcaattcatgctacaaaagactggatgaccactgaagatttgttagatgtttggaacag

SEQ ID NO: 296063 - DNA, 75 bp, Artificial Sequence
  Synthetic
aatctggattgatgaaaatccatggatggatgataagacaaacatcacaacatggaagaatgtggcctacctgcc

SEQ ID NO: 296064 - DNA, 75 bp, Artificial Sequence
  Synthetic
cagaggacaagacatgtgttgtggcagtcttattggcagctcaaaaagagcaacttgggccaaactcattcctgg

SEQ ID NO: 296065 - DNA, 75 bp, Artificial Sequence
  Synthetic
agcagttgaaaaagtgagagggatgattgggaatgaaaattacgtcaactaccttggagcaatgggacgctatga

SEQ ID NO: 296066 - DNA, 75 bp, Artificial Sequence
  Synthetic
atgtgatgatgtctcattccaactgtattaaaccacaaaaataaggaagaccattctatgtaaataacctgtaaa

SEQ ID NO: 296067 - DNA, 75 bp, Artificial Sequence
  Synthetic
taatttaattcggtgctgaggggcaactctaggactagcctaatgggtgtgacgaccctaccccaatgcacttgt

SEQ ID NO: 296068 - DNA, 75 bp, Artificial Sequence
  Synthetic
aaataattgagccagtcaaccctgatagggtgaggtttttcccctccctcatgatgaggggaagaagcactccac

SEQ ID NO: 296069 - DNA, 75 bp, Artificial Sequence
  Synthetic
tggagtgtggatgagccggcccccagagaagatagcctaacgcttaatctctggcaaggactagtggttagtgga

SEQ ID NO: 296070 - DNA, 75 bp, Artificial Sequence
  Synthetic
gaccccggctcttcctggactaaattgtggccgtcgccatggctctttgagcctagtagacaagcggggaagcag

SEQ ID NO: 296071 - DNA, 75 bp, Artificial Sequence
  Synthetic
gaaattggcattctgcttcgctgttgctcccgcgtttttcaaattacccaaatatgggggcgtgtgacttcattc

SEQ ID NO: 296072 - DNA, 75 bp, Artificial Sequence
  Synthetic
cttcattcttccaaacagaagcattgcccagattgcatgctgggcttctgtttggcaaaatgaatgccactcgct

SEQ ID NO: 296073 - DNA, 75 bp, Artificial Sequence
  Synthetic
atggtaggtaaattgaaaaacgcaaaaaataaagggagaacccggctacgccggcctcccaaagggaaagccatg

SEQ ID NO: 296074 - DNA, 75 bp, Artificial Sequence
  Synthetic
accatctacactccccgttccagggattcccagcgtgctagggtggcacgtatctgctccgtttacattatttga

SEQ ID NO: 296075 - DNA, 75 bp, Artificial Sequence
  Synthetic
gcagggctggggaactgaatggcaccggtgtggcaccgctattgcgctgcgtgaccgggttggctggagtctcag

SEQ ID NO: 296076 - DNA, 75 bp, Artificial Sequence
  Synthetic
tctctccatgcgggcctggacggaccacaggggaggggagagagcaactgaaagtgtatccatgagtacatggag

SEQ ID NO: 296077 - DNA, 75 bp, Artificial Sequence
  Synthetic
cgctgcagcgagcgcacatctaccacgcttcggcctggctaagatggttggtagccgcctatatggtactgcagt

SEQ ID NO: 296078 - DNA, 75 bp, Artificial Sequence
  Synthetic
agggtatacccgcactggaggggggatagcgttgggtcgctccctgcttactgcctgatagggtcctgccagggg

SEQ ID NO: 296079 - DNA, 75 bp, Artificial Sequence
  Synthetic
cccctcccttctggctgtaaaccacttatggcttttaatctccttaacatttttactttactcaaactcattgat

SEQ ID NO: 296080 - DNA, 75 bp, Artificial Sequence
  Synthetic
cctgaattgtgcaacctgaacatcggcaccggacgaccccgaggaaccgtcaggggtggcgtgtatatcgtccac

SEQ ID NO: 296081 - DNA, 75 bp, Artificial Sequence
  Synthetic
ccaaagaagaccacggaccgcggtgtgcggaggaagaggcggcagcggcgggaccaaggggggtggcgtaggagc

SEQ ID NO: 296082 - DNA, 75 bp, Artificial Sequence
  Synthetic
gccatcggccccatggacccttatgtacgcatgctcacgcagacggcacttccgtctgccgcctacccatcacga

SEQ ID NO: 296083 - DNA, 75 bp, Artificial Sequence
  Synthetic
gatccccgcagacaatcgcggttcttgggccatgtcatcgacggtacgctgggttgggctgctgacatcctccac

SEQ ID NO: 296084 - DNA, 75 bp, Artificial Sequence
  Synthetic
cacgttccggttgtgggcccgttggttgggcaccccgccagggtgatttgcagggttgttcgggccggggaaaat

SEQ ID NO: 296085 - DNA, 75 bp, Artificial Sequence
  Synthetic
gccatcaatgcgttgacaggcactgttggcatccatctgttccttatagccttgcttagctgcctggcgcccgcc

SEQ ID NO: 296086 - DNA, 75 bp, Artificial Sequence
  Synthetic
acggctgtgagcaattgctgcaccgccgatcaggttgtgtattgcacagatgtcacttgtctccatgagtcggga

SEQ ID NO: 296087 - DNA, 75 bp, Artificial Sequence
  Synthetic
tgtgcaatctgtcaggctacagacaacggcacggtttgctgggagccccagggaatcatgctctcccaccatcca

SEQ ID NO: 296088 - DNA, 75 bp, Artificial Sequence
  Synthetic
gactacacgggtgtagaccctttcctcactaatcacatagactttgtagctggcaccgtgttcgtgtgtgatctg

SEQ ID NO: 296089 - DNA, 75 bp, Artificial Sequence
  Synthetic
gctgggatcaaggaggtttgtggcacagctgttttggcagctaactgggccctgaacttcttacccatgccaatt

SEQ ID NO: 296090 - DNA, 75 bp, Artificial Sequence
  Synthetic
gtgcttaacacctctggagactgcttccttctcgtagaaagtggcatcaaccccctttttggatccttctttact

SEQ ID NO: 296091 - DNA, 75 bp, Artificial Sequence
  Synthetic
tggttggctgaagagtttaacaccataacagcaatagttgattttattggcaaaattcctgtagctttaactcat

SEQ ID NO: 296092 - DNA, 75 bp, Artificial Sequence
  Synthetic
gccttcactcaatcgcacttcattgctatgtgcagtattgctggcctggctcttaatggcaacatggtgaaagct

SEQ ID NO: 296093 - DNA, 75 bp, Artificial Sequence
  Synthetic
ctagccctgcttgtcctctacatcgaggcagccgctgccgcacctgcgggccttaccacccaccatgtggtacct

SEQ ID NO: 296094 - DNA, 75 bp, Artificial Sequence
  Synthetic
tggaatggatcctgccctttgatgtcaacagtgggcaggtgtggcaatctcacggaactcagcagacatggcaca

SEQ ID NO: 296095 - DNA, 75 bp, Artificial Sequence
  Synthetic
ggctattgcttctccccgcggactggcttccgcccgctgtctgagcaaacaccagtcgatggctggttctgtgtc

SEQ ID NO: 296096 - DNA, 75 bp, Artificial Sequence
  Synthetic
tgggtttccatgggaaatgatcgcgggcgcgctttttcaagtgagcccgcatgttgcacgctacgccgcctcgca

SEQ ID NO: 296097 - DNA, 75 bp, Artificial Sequence
  Synthetic
cctttctgtaactgcacgagtgattgtagctggatggataaacgaatgacctttgaagcttgtggggcctctcct

SEQ ID NO: 296098 - DNA, 75 bp, Artificial Sequence
  Synthetic
gtcctcaccactgcatgcagcaccgctcggtttgacagtttggccaaggttttgcccaggttgaacggttctacc

SEQ ID NO: 296099 - DNA, 75 bp, Artificial Sequence
  Synthetic
gctccctcttgctttccaaccccaatggcttaccttgctattcctggggtggtgtggcctggtttccggtttggc

SEQ ID NO: 296100 - DNA, 75 bp, Artificial Sequence
  Synthetic
actatcactttagtccatgggtctcaagtgggatactggtacaatgagaaggagctcgccgaattgccaccggag

SEQ ID NO: 296101 - DNA, 75 bp, Artificial Sequence
  Synthetic
cggtgggctcggttaccaggaacccctcctacctacaaaggctcgtggatgcttgtccccaagggcatgtactca

SEQ ID NO: 296102 - DNA, 75 bp, Artificial Sequence
  Synthetic
actaggagggacatctcttctggtttgatcatgaaagaccgtcatcaccaggactaccagctcttgttctcgggc

SEQ ID NO: 296103 - DNA, 75 bp, Artificial Sequence
  Synthetic
gtgggggcgttcatcctgcccggaatcacagcgcatattgtggtcatagctctgcttgctgcgcttggtgcacgc

SEQ ID NO: 296104 - DNA, 75 bp, Artificial Sequence
  Synthetic
tggtgtcttctcctgtatgctactatcaacatactacctgcagcgtacgcgttcacacccgaggtagtggcagca

SEQ ID NO: 296105 - DNA, 75 bp, Artificial Sequence
  Synthetic
acagccgccgctccttgggaggatattgtaatgcgggccatagtctactgtgctaccctaaagtacaggttgcta

SEQ ID NO: 296106 - DNA, 75 bp, Artificial Sequence
  Synthetic
tcagtgcccttcgctgccagttgggttgccctcttcctatcactaatagacgctgcttatgcaatctccctaccc

SEQ ID NO: 296107 - DNA, 75 bp, Artificial Sequence
  Synthetic
gatgttgctgctgctctggcgtccgtcactttcctcattgcatgggctggtttcttttcccgctttatccccgcc

SEQ ID NO: 296108 - DNA, 75 bp, Artificial Sequence
  Synthetic
gtcatgatgctacagtcgtacctacgggttaggttggaggcgacatgtcataggtggtttgaccgtagcatcaca

SEQ ID NO: 296109 - DNA, 75 bp, Artificial Sequence
  Synthetic
tttgtcttcgtcctccttttccctaatgcggtgtggaacacttgtcttaccttatggattgtgtggctgctgcta

SEQ ID NO: 296110 - DNA, 75 bp, Artificial Sequence
  Synthetic
gtggtaggcggccaagccatagtctgcatcttaggtccccatgacaagatagggtttcaccggctcttgcaaacg

SEQ ID NO: 296111 - DNA, 75 bp, Artificial Sequence
  Synthetic
ctttcccggcttaatagatttagggactctgccctgcggtttgccgtttgggttgctggggaacggggcctgttc

SEQ ID NO: 296112 - DNA, 75 bp, Artificial Sequence
  Synthetic
tggttcaagcacaaggacggggagttgccgggccagtgggagtaccaagagccgtactcgatgtttcccactgag

SEQ ID NO: 296113 - DNA, 75 bp, Artificial Sequence
  Synthetic
gttgctgtggcggaagatgttggcatgaagctcgcctgtggagacagcatccgcggccttcccgtctacgcgagg

SEQ ID NO: 296114 - DNA, 75 bp, Artificial Sequence
  Synthetic
tgtggtaaaagtgtgagggctggaatagcatcactgccaaaaggatggaaatacacaatccccttctccgtccgc

SEQ ID NO: 296115 - DNA, 75 bp, Artificial Sequence
  Synthetic
acaacctcgtgtcgcaatagcttgaaatgtctggcactgtgcttaacaggacatgatggtgcagactacaagggt

SEQ ID NO: 296116 - DNA, 75 bp, Artificial Sequence
  Synthetic
agtgtctgcatcataggtacccccttgagatcttggatggggtttggctgcaaaggacaactctacacagcccac

SEQ ID NO: 296117 - DNA, 75 bp, Artificial Sequence
  Synthetic
catggcgcacgcgcacgtaacctcgcgagctctggtggccccagaccccccacactagtcaacaaggagaaggat

SEQ ID NO: 296118 - DNA, 75 bp, Artificial Sequence
  Synthetic
ctcacaacctaccctctacccaagggcatgtcatctctgcccgtctgcaactgttcgtgcagggagttttacctg

SEQ ID NO: 296119 - DNA, 75 bp, Artificial Sequence
  Synthetic
attactcggctgggaaatctggtgccatgtgttgtgtgcggtgataggttcatccctacgggcccactgacgctc

SEQ ID NO: 296120 - DNA, 75 bp, Artificial Sequence
  Synthetic
aaagaggcaaagggttcgtcgggcgcccccatcgtctgcaagtgccagagtgtcaaggctatgttccttagttgc

SEQ ID NO: 296121 - DNA, 75 bp, Artificial Sequence
  Synthetic
cgtagcagcagaggggtagtctcgtcctttggagttgtccacatcacagccgagcaggaagaggacacgcgcact

SEQ ID NO: 296122 - DNA, 75 bp, Artificial Sequence
  Synthetic
ccagtcgcgtcggaattacttccgccccccatacccaaggccggcaagagcattcaacatctggtagctcccact

SEQ ID NO: 296123 - DNA, 75 bp, Artificial Sequence
  Synthetic
gggtacgggaaaacaacaaaactcccaatgcactactacaatcttggctactcggtattggttcttaacccgagt

SEQ ID NO: 296124 - DNA, 75 bp, Artificial Sequence
  Synthetic
gttgcaaccaccaggtccgtccctaagtacatggagtctgaatacaaagtgtgtcccaacattaggactggtgat

SEQ ID NO: 296125 - DNA, 75 bp, Artificial Sequence
  Synthetic
tactgcaaccacaccgggtcacgactgacatacagcacatacggcatgttctgtactcggcctaccatcgacgcc

SEQ ID NO: 296126 - DNA, 75 bp, Artificial Sequence
  Synthetic
gatgtcgtgatctgcgatgaggtgcatgcaaccgacggcactaccgttttgggaattgggagtgccctcagagcc

SEQ ID NO: 296127 - DNA, 75 bp, Artificial Sequence
  Synthetic
tttgaaaattcagctaaaggaagattgctaattctcgccacggcaacccctcccggggccgccatggctgcccac

SEQ ID NO: 296128 - DNA, 75 bp, Artificial Sequence
  Synthetic
ccaaacatcaacactgtcaatttaactgatgagggggacataccgttccatgggaaaaaaatcaagtctgagctg

SEQ ID NO: 296129 - DNA, 75 bp, Artificial Sequence
  Synthetic
cttaaaagggggaggcatctgatattcacccctggtaagaagcactgcgactcattggcaaatgatctccaaaat

SEQ ID NO: 296130 - DNA, 75 bp, Artificial Sequence
  Synthetic
gctggcatcaacgcagtctcttactatcgcggcaaggacgcaaactgcatcccaccagagggtgactgtgtcgtc

SEQ ID NO: 296131 - DNA, 75 bp, Artificial Sequence
  Synthetic
gtggctacagacgccttgatgacagggtacaccgggaactttgattctgtctttgattcatgcttgtcagttgtc

SEQ ID NO: 296132 - DNA, 75 bp, Artificial Sequence
  Synthetic
cccacatttgacatcacaatgaaccccacatttgaggtaggaatacagacccgaaacgccgattcggtcacgagg

SEQ ID NO: 296133 - DNA, 75 bp, Artificial Sequence
  Synthetic
atgcaacgccgtgggcgaacaggaagggggaagccgggcacgtactaccaagtcactccgcactgcataacacac

SEQ ID NO: 296134 - DNA, 75 bp, Artificial Sequence
  Synthetic
ggatctgtgcctactgcctgtgtagtggaggcgtttgactctggcttggcttactttggcatgacaccggccgag

SEQ ID NO: 296135 - DNA, 75 bp, Artificial Sequence
  Synthetic
gtggcaacggccctgtccttctacaaggatgaagctctaaccccttcagtggactgcaacctctttgaaattcag

SEQ ID NO: 296136 - DNA, 75 bp, Artificial Sequence
  Synthetic
ggaatattccaagctttgggctatgtggaacatgtccacgttgaaagaatgaaacaattggctgaaaattacact

SEQ ID NO: 296137 - DNA, 75 bp, Artificial Sequence
  Synthetic
tatttgtatgcagcacagtaccagctggccaagcaggaaaaagcctgtgctccaaacaacaacaaaatctggcaa

SEQ ID NO: 296138 - DNA, 75 bp, Artificial Sequence
  Synthetic
ggactgcaaggttctaacaaattccccgttctctacgatcttgaggagtatgagaacagcaaggtggtggaagct

SEQ ID NO: 296139 - DNA, 75 bp, Artificial Sequence
  Synthetic
ggggccgcagcgcacatcgctgcgtgctttgaggagttctttgcctccggctatgtcactctggctggagtgggc

SEQ ID NO: 296140 - DNA, 75 bp, Artificial Sequence
  Synthetic
ctcagcatggctgccgttgcggtggcgatcgatctccttggcaattgttgcctcaaacgcacatgggagttcacg

SEQ ID NO: 296141 - DNA, 75 bp, Artificial Sequence
  Synthetic
accgacaccacagcggcgcgcgtcgtccaaccccctgaggacgacatcaccgagaaccttgaagaatgttacaac

SEQ ID NO: 296142 - DNA, 75 bp, Artificial Sequence
  Synthetic
tgggatgggttcgctgcgtcagcacagcaggccgtaaattggctaggggaccggttggtggaatggggcgtggct

SEQ ID NO: 296143 - DNA, 75 bp, Artificial Sequence
  Synthetic
gcaggaggccaacatcccaccctccgggtcctagaaaactacatacctcatattctggctgctgtccaatacttt

SEQ ID NO: 296144 - DNA, 75 bp, Artificial Sequence
  Synthetic
gctggcttggcgtgcctgcaagatgcccccggcctggggtccgtcctcggtttcgtgggcggggtcctctcccct

SEQ ID NO: 296145 - DNA, 75 bp, Artificial Sequence
  Synthetic
ctaccgcttaaggcttcattgtttttggcggcattggggggtgcggtcgctgcacgcctaacaacacaacgaggg

SEQ ID NO: 296146 - DNA, 75 bp, Artificial Sequence
  Synthetic
gctgcagtgtttgccgtcgctggcgcgctaggcgccgtcgccggggcatcaggggtaggagccatggtggcgcaa

SEQ ID NO: 296147 - DNA, 75 bp, Artificial Sequence
  Synthetic
gccctcacaacatacgggggagccacggctacctgcctggtagtactgaagttaatcgatggccagatgccagag

SEQ ID NO: 296148 - DNA, 75 bp, Artificial Sequence
  Synthetic
ctatcagaaatagcttcgttggcattcaacatcgcctctccaggagcctgcttggtgggagcagccgccgctgtc

SEQ ID NO: 296149 - DNA, 75 bp, Artificial Sequence
  Synthetic
atggtggcatactgcacccgctctgaatctcaggcttggatgaatagactactggccatcctcaaccgaggcacg

SEQ ID NO: 296150 - DNA, 75 bp, Artificial Sequence
  Synthetic
agctgtgaagactacttcgtggcctcaaccactctaagagcatcagtgatcaaggtgctagagtcggccaatttg

SEQ ID NO: 296151 - DNA, 75 bp, Artificial Sequence
  Synthetic
tgggctgtttttaaatggctcgcaaactggctgaattcccaggatgaagacctatgcacacccaggggcgctttc

SEQ ID NO: 296152 - DNA, 75 bp, Artificial Sequence
  Synthetic
tttgacttcctcgactcggttggacgcgtgttgcggatgataatcgaggctgcacggggcgcactgggtagagtg

SEQ ID NO: 296153 - DNA, 75 bp, Artificial Sequence
  Synthetic
ctggccatacctggagttcccattctccgctgtgacaaggggtacggaggtgagtggcacgggagcggcatggcg

SEQ ID NO: 296154 - DNA, 75 bp, Artificial Sequence
  Synthetic
accgttatgtgcaactgtggagcagaatccacttggaacatcaaggatgggaaggcccagtgggttgctgggtca

SEQ ID NO: 296155 - DNA, 75 bp, Artificial Sequence
  Synthetic
aaaacctgctcgtcctggtggactggcagggttccaattaactgcaaatttgtgagttgtgccagaccaagacca

SEQ ID NO: 296156 - DNA, 75 bp, Artificial Sequence
  Synthetic
gttacctggacaaccatggcagttaacacaggcttttccacatggatcacctatgaaagacgtggagaagacgtg

SEQ ID NO: 296157 - DNA, 75 bp, Artificial Sequence
  Synthetic
tggtgcactggcatctcagcaccctcaactctggtggaagccgtagtaccacccctgctgtctgccgtcgcggta

SEQ ID NO: 296158 - DNA, 75 bp, Artificial Sequence
  Synthetic
gatggagtgcaggtgcaaccctttggtggggacggctggaagaagtgcgggcctttcatcgcccggttcaggagg

SEQ ID NO: 296159 - DNA, 75 bp, Artificial Sequence
  Synthetic
tttggtaaggtttgtgaattgcaggtgcccttcaagatagaaccatgcaaagagccgtacgtgcctaagcactgc

SEQ ID NO: 296160 - DNA, 75 bp, Artificial Sequence
  Synthetic
ccggctcctaccacggttgccctggtgggcacatcggagaggtgcactggcatgatcaaaacttacaaagcctcg

SEQ ID NO: 296161 - DNA, 75 bp, Artificial Sequence
  Synthetic
tcaacggacggttacaaacccagaaagctcgacttgtcatcagatgaggaaactggctatgacatcatggcaaat

SEQ ID NO: 296162 - DNA, 75 bp, Artificial Sequence
  Synthetic
ttggcaaaaaatgctgagaagctcaaagccctaacaggaggcctgccctgtgctggtatggaagttccctcgtcg

SEQ ID NO: 296163 - DNA, 75 bp, Artificial Sequence
  Synthetic
tccaccagcagcagccctctagaagcatgcgcggccgtcgcatcccccccagaacaggtggtaagaccgaagatc

SEQ ID NO: 296164 - DNA, 75 bp, Artificial Sequence
  Synthetic
ctcaagatacccaagaagaaggtcaaattggtcaagggcgcaaaaccgctaccaaacattcccccccgggggcaa

SEQ ID NO: 296165 - DNA, 75 bp, Artificial Sequence
  Synthetic
ccaccatcagaacccgcatattctttacacagctcgagttgggagacaacagagtcagctgaacattcttgctct

SEQ ID NO: 296166 - DNA, 75 bp, Artificial Sequence
  Synthetic
atgtcttacacatggtacctgcctgagctggtgtataaaggcctgaagaggacggccgcggcggtgtcatcctac

SEQ ID NO: 296167 - DNA, 75 bp, Artificial Sequence
  Synthetic
accgctggcctcatcaggtataagccattggtgtacgccacaacaccggcgagcatcaatgagcgggtgagaaag

SEQ ID NO: 296168 - DNA, 75 bp, Artificial Sequence
  Synthetic
gtcacaatcccgcgcagcagggagactactgaagagttccaaaaggtgttggctgctgcaaaagccagagtgcgg

SEQ ID NO: 296169 - DNA, 75 bp, Artificial Sequence
  Synthetic
gggctccagcaagtggaaatgacactcgaagaggcgctggccattaccagcaacaagacggctaagtcagccatc

SEQ ID NO: 296170 - DNA, 75 bp, Artificial Sequence
  Synthetic
actggctgtacagctgctgaccttaagagtggatccaccgctgctgttcatgaaatctacagcgctctgtctgag

SEQ ID NO: 296171 - DNA, 75 bp, Artificial Sequence
  Synthetic
ggccacattgacaagccttggaatgaggtgaacatcatgcctaagtctgaggtgtttgttgaaacgccctccaaa

SEQ ID NO: 296172 - DNA, 75 bp, Artificial Sequence
  Synthetic
agaacacacaaaccttcgcgcatcatagcctacccccatctagaaatgcgcgttgttgagaaaatggtcctcgga

SEQ ID NO: 296173 - DNA, 75 bp, Artificial Sequence
  Synthetic
aacattgggcccgccactgtgaaggcggtgctgggtgagggctacgggtttgtccctccgggcgaacgcgtgtcc

SEQ ID NO: 296174 - DNA, 75 bp, Artificial Sequence
  Synthetic
aggctcctggcgatgtggcagagcaagaagaggcccggtggattcacatgtgacaccgtctgctttgattccacc

SEQ ID NO: 296175 - DNA, 75 bp, Artificial Sequence
  Synthetic
atcacccccgaggacgtggctgtggagtgcgaactctaccagacagccaccgcctgtgaagccaccaggcaaaga

SEQ ID NO: 296176 - DNA, 75 bp, Artificial Sequence
  Synthetic
atcaaggtcctccatgatcaactttatgctggagggccaatggttatgcagggagtggcagttggcgaacgccac

SEQ ID NO: 296177 - DNA, 75 bp, Artificial Sequence
  Synthetic
tgtagggcgagtggtgtgttcaccactagctcgtcaaacacaatgacctgctacctaaaggtttccacagccgcc

SEQ ID NO: 296178 - DNA, 75 bp, Artificial Sequence
  Synthetic
agaatagctggcttgaagcgtccatcgtggctaatttgtggtgacgacacggtctgcatctttgagtccgagtct

SEQ ID NO: 296179 - DNA, 75 bp, Artificial Sequence
  Synthetic
gaagcagaagataagagacggttggctcttttcgcctgcgccatgaagcaaatgggcgcaccccaaggggaggtc

SEQ ID NO: 296180 - DNA, 75 bp, Artificial Sequence
  Synthetic
ccaaggccgcactacagtctagagttgcttgatagctgttctagtaacgtgtctgtggcccacacaaccaaggga

SEQ ID NO: 296181 - DNA, 75 bp, Artificial Sequence
  Synthetic
ctgttccactacatgacccgtgacccgaggattccgttcggtcggatttccattgaaggcaagggtttcaacccc

SEQ ID NO: 296182 - DNA, 75 bp, Artificial Sequence
  Synthetic
ctagggagcatgcttggctacattctggcgaactaccctgcagtatgggtctccaggataatagctgtgaagttc

SEQ ID NO: 296183 - DNA, 75 bp, Artificial Sequence
  Synthetic
cttgaggagctgtttgcccagcctgacatcaccaaggtgacgttcgactggtatggcaacaactacacagttcca

SEQ ID NO: 296184 - DNA, 75 bp, Artificial Sequence
  Synthetic
ataggaaaaattccctacataatccaggcactgcatggaccgcaggcctggggtgtaagacagtacacatcaaga

SEQ ID NO: 296185 - DNA, 75 bp, Artificial Sequence
  Synthetic
gaggtgagccgcgtggcgcttgcactgagggacaacaccatgaagccaatgcgttactggaagagacaagcacga

SEQ ID NO: 296186 - DNA, 75 bp, Artificial Sequence
  Synthetic
gcactctatgcgcgggctaggatgcgtggtggcacatacgcattcctggccaagacgctactgagctgggtgacg

SEQ ID NO: 296187 - DNA, 75 bp, Artificial Sequence
  Synthetic
caggttgaaccaaagttggacccgaggaaggttgcaaaagcccgtgagtttaacttctttgaaccatacgctttt

SEQ ID NO: 296188 - DNA, 75 bp, Artificial Sequence
  Synthetic
gagccagaacttgaggatcggcgatggactgttggcaaaacatggttcctactaggatttgccgcagtagccgtc

SEQ ID NO: 296189 - DNA, 75 bp, Artificial Sequence
  Synthetic
gtactctcgttcttgattaagtaaacatctaagtgtccaggggcagaggccggttgattatcattgcagccgtag

SEQ ID NO: 296190 - DNA, 75 bp, Artificial Sequence
  Synthetic
gggcttggcgacccccccccctcgagccagcctttcaacaaaaccgtctcgggttggaaggcacccccaaccgct

SEQ ID NO: 296191 - DNA, 75 bp, Artificial Sequence
  Synthetic
gtgctgggttggcagccagcacagtatccgcccgtaccaggatacgtatccccaaagggtcctggcccggtctgg

SEQ ID NO: 296192 - DNA, 75 bp, Artificial Sequence
  Synthetic
gcccgtaccaggatacgtatccccaaagggtcctggcccggtctggagtcgaggcgcaacgcccgactccaaact

SEQ ID NO: 296193 - DNA, 75 bp, Artificial Sequence
  Synthetic
cgaagcgccgacctcgctctgggcgggtgccggaggctgagtgcaactctgccggagtcaaggggcaattcgggc

SEQ ID NO: 296194 - DNA, 75 bp, Artificial Sequence
  Synthetic
cgagcaaactctttgacagctggagatctttcaaagagttagctactgttcctctcataaaatggagatgtacag

SEQ ID NO: 296195 - DNA, 75 bp, Artificial Sequence
  Synthetic
cctctcataaaatggagatgtacagtgatagactttgatatgcctttttctgctctaaagaaccaaattgttcca

SEQ ID NO: 296196 - DNA, 75 bp, Artificial Sequence
  Synthetic
tgagcgatcttggcagccgggcaaggctcttaaattatgccagagtccatagagctggtggacctcggttttaag

SEQ ID NO: 296197 - DNA, 75 bp, Artificial Sequence
  Synthetic
tatgaatttgatgttttcagtaaaggatctcaaactgaaggatacactaaaaatgttatatactatccatggcaa

SEQ ID NO: 296198 - DNA, 75 bp, Artificial Sequence
  Synthetic
agaaaggaggctgagtttcgaagactcgtctcttctgcccacaagctgttctgcccttgctctgatcctgcttct

SEQ ID NO: 296199 - DNA, 75 bp, Artificial Sequence
  Synthetic
gatgatggaacaaacactaaagttacttttactcacattgtaccctacaatgaccaacaatctggtccacagggt

SEQ ID NO: 296200 - DNA, 75 bp, Artificial Sequence
  Synthetic
catctaagaggatggcgttcttctaccggaggagatactaccgaccaaggagaacatactaccggaggaggagac

SEQ ID NO: 296201 - DNA, 75 bp, Artificial Sequence
  Synthetic
ccggaggagatactaccgaccaaggagaacatactaccggaggaggagaccctactaccggaggaggagaaccta

SEQ ID NO: 296202 - DNA, 75 bp, Artificial Sequence
  Synthetic
cttttactcacattgtaccctacaatgaccaacaatctggtccacagggtccggctggaagaaatgacttctggc

SEQ ID NO: 296203 - DNA, 75 bp, Artificial Sequence
  Synthetic
ctaatgaaattgaatttaaggacatgaatatgccaatgtggttagcgggcttcggatacaaccaagaatggtatg

SEQ ID NO: 296204 - DNA, 75 bp, Artificial Sequence
  Synthetic
ctaagagggtcgtgcagtggaacccgaggaaccgtaccaagtgcctcatacttggatacatgcctctcatcacca

SEQ ID NO: 296205 - DNA, 75 bp, Artificial Sequence
  Synthetic
atatgagttggatgaacaggagacctagacctcctgatgcaaccactgaaaataaaaaaggcttttggtcctttg

SEQ ID NO: 296206 - DNA, 75 bp, Artificial Sequence
  Synthetic
ctgctagagcaatggacaccgtggctgacacactcatgccgaaaggccctatggtcactgtctggccaggaggag

SEQ ID NO: 296207 - DNA, 75 bp, Artificial Sequence
  Synthetic
ttcaatttaatggtaatccagcatttaaagacaaaacaacaggagatattataaaatgggactatggtaaaggaa

SEQ ID NO: 296208 - DNA, 75 bp, Artificial Sequence
  Synthetic
caagctttgtcaaatggacaacctggggaaatattgccagcatggcaggaccctttgtacctaaaggagctccta

SEQ ID NO: 296209 - DNA, 75 bp, Artificial Sequence
  Synthetic
gagtggacagcggacatcttaccttgttggatttatactgggaagaaagattctggagagctagatggactaaat

SEQ ID NO: 296210 - DNA, 75 bp, Artificial Sequence
  Synthetic
gggaaatattgccagcatggcaggaccctttgtacctaaaggagctcctaaaaaaggtttccatgtagtaatggg

SEQ ID NO: 296211 - DNA, 75 bp, Artificial Sequence
  Synthetic
ctaaccaaggatataaccttgccagatattttggagtagaaattaagctgtacagatacttggacttttcctata

SEQ ID NO: 296212 - DNA, 75 bp, Artificial Sequence
  Synthetic
ctacacaggaaaaaaatacaaaagagagaggatgtggggttatcaccaaaaagaagaaaaatccaaaaaaagaag

SEQ ID NO: 296213 - DNA, 75 bp, Artificial Sequence
  Synthetic
tcttctggtactctgttgatgatggctctgatgatccagaacctttacaaatggctcatcctagtcaaatgctgc

SEQ ID NO: 296214 - DNA, 75 bp, Artificial Sequence
  Synthetic
gtacgagcccgaaccagactcgaccgacatcgaaactgcgaccgagacagcgggatcggagaccgaggaagcgga

SEQ ID NO: 296215 - DNA, 75 bp, Artificial Sequence
  Synthetic
tatatagacataaaattattgttcatagatctctagacaaaagagcaaagaccataagactcaaaataagaccac

SEQ ID NO: 296216 - DNA, 75 bp, Artificial Sequence
  Synthetic
gacatcgaaactgcgaccgagacagcgggatcggagaccgaggaagcggagacgagcaccgaggggatgggacac

SEQ ID NO: 296217 - DNA, 75 bp, Artificial Sequence
  Synthetic
caagtaaactatatgacagttggagaagttttaaagaattagcaactgttcctcttattaaatggagatgtacaa

SEQ ID NO: 296218 - DNA, 75 bp, Artificial Sequence
  Synthetic
tagtagattttgacatgccattttctgcacttaaaaaccaaatagtgccatatgagtttgatgtcttttctaagg

SEQ ID NO: 296219 - DNA, 75 bp, Artificial Sequence
  Synthetic
tttcaatctaaactttaaagactcagactctgaattctcagactgggactatagctctgaatttgatgacatatt

SEQ ID NO: 296220 - DNA, 75 bp, Artificial Sequence
  Synthetic
gatctattgacacaggttacacaaaaaatgttatttattatccatggcaagatgatggcacaaataccaaagtaa

SEQ ID NO: 296221 - DNA, 75 bp, Artificial Sequence
  Synthetic
atttatgtgtgactctaatgttaataaaaacctttatcctaaaattgtgatacaaaatccattaggcatccatac

SEQ ID NO: 296222 - DNA, 75 bp, Artificial Sequence
  Synthetic
cttttacccatgtggtaccatacaatgatacacaaaatggaccacagggacctaataatagacaagacttctggc

SEQ ID NO: 296223 - DNA, 75 bp, Artificial Sequence
  Synthetic
ctgaataaaatatttgttgaaaaaagattactacagcctacctcgatttttaaaaatggcgcgcttcgcgcgctg

SEQ ID NO: 296224 - DNA, 75 bp, Artificial Sequence
  Synthetic
caaatgaaatagaattcaaagatatgaatatgccaatgtggttagcaggatttggatacaaccaggaatggtatg

SEQ ID NO: 296225 - DNA, 75 bp, Artificial Sequence
  Synthetic
atatgagttggatgaacaggagaccaagacctcctggagcaacagctgaacaaatgaaaggatactggtcctatg

SEQ ID NO: 296226 - DNA, 75 bp, Artificial Sequence
  Synthetic
caaaaaaaaggcgccgcggacctgattgagaacagccagccagtagtgacgtaagcaggggggcggagccccccc

SEQ ID NO: 296227 - DNA, 75 bp, Artificial Sequence
  Synthetic
ttcaattcaatggtaatccagcatttaaagacaaatcaacaggagacataattaaatgggacaatggcaaaggaa

SEQ ID NO: 296228 - DNA, 75 bp, Artificial Sequence
  Synthetic
gtaagcaggggggcggagccccccccgcacccccccgctaagggggctccgcccccttgaacccccattggctga

SEQ ID NO: 296229 - DNA, 75 bp, Artificial Sequence
  Synthetic
cttcctttgtcaaatggacaacttggggaaatattgccagtatggcaggaccttttgtagctaaaggagctccta

SEQ ID NO: 296230 - DNA, 75 bp, Artificial Sequence
  Synthetic
gggaaatattgccagtatggcaggaccttttgtagctaaaggagctcctaagaaaggatttcatgtagtaatggg

SEQ ID NO: 296231 - DNA, 75 bp, Artificial Sequence
  Synthetic
gactctaatgaacctaatttgcataagataatatgcaaatcactaaactaaccataaattaaacaggggtgacga

SEQ ID NO: 296232 - DNA, 75 bp, Artificial Sequence
  Synthetic
atataaattctatttccagtggggaggaactccaggaagcagacaacctcctgtgcctcctgaaggcggcggagg

SEQ ID NO: 296233 - DNA, 75 bp, Artificial Sequence
  Synthetic
ctaaccataaattaaacaggggtgacgaatggctgagtttacgctgccagaggaggaccaggcatacccgggaag

SEQ ID NO: 296234 - DNA, 75 bp, Artificial Sequence
  Synthetic
accttcagcctaccaaaaatggggaagtctccgagcagacctcgttgatccaatgcaagcagacgaagaggtact

SEQ ID NO: 296235 - DNA, 75 bp, Artificial Sequence
  Synthetic
agaaaggaggctgagttccgaaggctcgtctcttctgcccacaagctgttctgctcatgttctgatcctgcttct

SEQ ID NO: 296236 - DNA, 75 bp, Artificial Sequence
  Synthetic
cacggacggggactatgactcggggggcatcatcacagacaaagctcttgcaagacttactaaatctcctgtacc

SEQ ID NO: 296237 - DNA, 75 bp, Artificial Sequence
  Synthetic
ctacacaggaaaaaagtacaaaagggagaggatgtggggctttcaccaaaaagaagaaagatccaaaagaagaag

SEQ ID NO: 296238 - DNA, 75 bp, Artificial Sequence
  Synthetic
ccggaggagatactaccgaccaaggagaacctactaccggaggaggagaacctactaccggagaaggagaccata

SEQ ID NO: 296239 - DNA, 75 bp, Artificial Sequence
  Synthetic
gtacgagccagaagcagactcgaccgacatcgagagtgcgaccgagacagcgggatcggagaccgaggaagcgga

SEQ ID NO: 296240 - DNA, 75 bp, Artificial Sequence
  Synthetic
gacatcgagagtgcgaccgagacagcgggatcggagaccgaggaagcggagacgagcaccgaggggatggtacac

SEQ ID NO: 296241 - DNA, 75 bp, Artificial Sequence
  Synthetic
cgaagaagaatccgaagtgtcctccgaattctccggcagctcggaatccgacgacctttgacggtagaccgttct

SEQ ID NO: 296242 - DNA, 75 bp, Artificial Sequence
  Synthetic
gggaaaaaggggtctctctcgtcgatttcaatctaaactttaaagactcagactctgaattttcagactgggact

SEQ ID NO: 296243 - DNA, 75 bp, Artificial Sequence
  Synthetic
cctctcataaaatggagatgtacagtaatagactttgatatgcctttttctgctctaaaaaaccaaattgttcca

SEQ ID NO: 296244 - DNA, 75 bp, Artificial Sequence
  Synthetic
tttcaatctaaactttaaagactcagactctgaattttcagactgggactacagctctgaatttgacgacatttt

SEQ ID NO: 296245 - DNA, 75 bp, Artificial Sequence
  Synthetic
tggagcaccatccactgactcagactccagcttagactggagtctgtctcccatccaccgcccttcacaaagtga

SEQ ID NO: 296246 - DNA, 75 bp, Artificial Sequence
  Synthetic
gatgatggaacaaacactaaagttacttttactcatattgtgccctacaatgaccaacaatctggtccacagggt

SEQ ID NO: 296247 - DNA, 75 bp, Artificial Sequence
  Synthetic
atttgtgtgtgactctaatgtaaataaaaacctttatcctaagattgtaatacagaatccattaggcatccatac

SEQ ID NO: 296248 - DNA, 75 bp, Artificial Sequence
  Synthetic
cttttactcatattgtgccctacaatgaccaacaatctggtccacagggtccggctggaagacatgacttctggc

SEQ ID NO: 296249 - DNA, 75 bp, Artificial Sequence
  Synthetic
ctgaataaaatgtttgttgtgaaaaagattactacagcctacctcgattattaaaaatggcgcgcttcgcgcgct

SEQ ID NO: 296250 - DNA, 75 bp, Artificial Sequence
  Synthetic
agattactacagcctacctcgattattaaaaatggcgcgcttcgcgcgctgttagggggggcgcgggcggacaag

SEQ ID NO: 296251 - DNA, 75 bp, Artificial Sequence
  Synthetic
ggatggtaaacagaatttcgcgggaacggcgccagccgtgaaccgcgaaattcaaaaaaaggcgccgcggacctg

SEQ ID NO: 296252 - DNA, 75 bp, Artificial Sequence
  Synthetic
attgagaacaggaaaatgttagtgaggtaagcaggggggcggagccccccccgcacccccccgaaaagggggctc

SEQ ID NO: 296253 - DNA, 75 bp, Artificial Sequence
  Synthetic
cgcccccttaaacccccattggctgagacacagaggaacctaatttgcataagataatatgcaaatcactaaact

SEQ ID NO: 296254 - DNA, 75 bp, Artificial Sequence
  Synthetic
ctcaccataaatgaaacaggggtgacgaatggctgagtttatgctgccagaggaggaccaggcaaagccgggaag

SEQ ID NO: 296255 - DNA, 75 bp, Artificial Sequence
  Synthetic
agaaaagaggctgagttccggagactcgtctcttctgcccataagctattctgccactgctctgatcctgcttct

SEQ ID NO: 296256 - DNA, 75 bp, Artificial Sequence
  Synthetic
ttgggggggcgcgggcggacaagggatggtaaacagaatttcgcgggaacggcgccagccgtgaaccgcgaaatt

SEQ ID NO: 296257 - DNA, 75 bp, Artificial Sequence
  Synthetic
catctgagaggatggcgttcttctaccggaggagatactaccgaccaaggagaacctactaccggaggaggagac

SEQ ID NO: 296258 - DNA, 75 bp, Artificial Sequence
  Synthetic
ccggaggagatactaccgaccaaggagaacctactaccggaggaggagaccctattaccggaggaggagaaccta

SEQ ID NO: 296259 - DNA, 75 bp, Artificial Sequence
  Synthetic
gacacagaagaacctaatttgcataagataatatgcaaatcactaaactcaccataagagtaacaggggtgacga

SEQ ID NO: 296260 - DNA, 75 bp, Artificial Sequence
  Synthetic
ctaccggaggaggagatggccggtaaggaggagactgggtcggagaagagctaagagggtcgtgcagtggaaccc

SEQ ID NO: 296261 - DNA, 75 bp, Artificial Sequence
  Synthetic
ctcaccataagagtaacaggggtgacgaatggctgagtttatgctgccagaggaggaccaggcatagccgggaag

SEQ ID NO: 296262 - DNA, 75 bp, Artificial Sequence
  Synthetic
gagtggacagcggacatcttaccttactggatttatactgggaagagagattctggagagctagatggactaaat

SEQ ID NO: 296263 - DNA, 75 bp, Artificial Sequence
  Synthetic
ctaaccaaggatataaccttgcaagatattttggtgtggaaattaaactgtacagatacctggacttttcttata

SEQ ID NO: 296264 - DNA, 75 bp, Artificial Sequence
  Synthetic
tcttttggtactctgtggatgacggttctgatgatccagaacccttacaaatggcacatccaagccaaatgttat

SEQ ID NO: 296265 - DNA, 75 bp, Artificial Sequence
  Synthetic
tatacagacataaagtcattgttcatagatctctagacaaaaaagctaagactattaaacttaaaataaagccac

SEQ ID NO: 296266 - DNA, 75 bp, Artificial Sequence
  Synthetic
ctctattatgaggaagaaacgcctaaggccaagcgacagggtcatgttctcggttgggtcaacgctatatacaga

SEQ ID NO: 296267 - DNA, 75 bp, Artificial Sequence
  Synthetic
tggcggacgtgtgacatcaccgttcgcctttcttggatcccttgttactccacgtagtgagagataaacaaccca

SEQ ID NO: 296268 - DNA, 75 bp, Artificial Sequence
  Synthetic
gaatgaaggtcactgtagatgttgaggctgatagcccatttttgaaggcccttcagaaagcattcccggcttttg

SEQ ID NO: 296269 - DNA, 75 bp, Artificial Sequence
  Synthetic
ttttcgcatctggccacaaagttaattgaacaagaggttccaaccaacatcaccatcctggatgtgggcagcgcg

SEQ ID NO: 296270 - DNA, 75 bp, Artificial Sequence
  Synthetic
ttgaacaagaggttccaaccaacatcaccatcctggatgtgggcagcgcgcccgcaaggaggttgatgtctgatc

SEQ ID NO: 296271 - DNA, 75 bp, Artificial Sequence
  Synthetic
acagctaccactgcatttgtcccatgaagagtgcggaagacccagagagattagcgaactatgcccggaaactgg

SEQ ID NO: 296272 - DNA, 75 bp, Artificial Sequence
  Synthetic
caaaaatgtgtccggtaagatcacggacctgcaggacgtcatggcaacccccgatctggaatctccaacgttctg

SEQ ID NO: 296273 - DNA, 75 bp, Artificial Sequence
  Synthetic
gacctgcaggacgtcatggcaacccccgatctggaatctccaacgttctgtctccacaccgacgagacgtgtcgc

SEQ ID NO: 296274 - DNA, 75 bp, Artificial Sequence
  Synthetic
actagagctgaagtagctgtgtaccaggacgtgtacgcggtgcacgcaccgacctcgctttatcatcaagcgatg

SEQ ID NO: 296275 - DNA, 75 bp, Artificial Sequence
  Synthetic
gacctcgctttatcatcaagcgatgaaaggggtcaggacagtatactggataggatttgacaccaccccattcat

SEQ ID NO: 296276 - DNA, 75 bp, Artificial Sequence
  Synthetic
ccaacgtattccacgaattgggcggacgagcaggtcctgcaggcacgtaacatcggcctatgtgcgaccagtctc

SEQ ID NO: 296277 - DNA, 75 bp, Artificial Sequence
  Synthetic
acgagcaggtcctgcaggcacgtaacatcggcctatgtgcgaccagtctcagcgaaggacatcgaggaaaactct

SEQ ID NO: 296278 - DNA, 75 bp, Artificial Sequence
  Synthetic
gttgggtcaacgctatatatagaaagtagacgccttcttaagagttggcatcttccctccgtgttccacctgaaa

SEQ ID NO: 296279 - DNA, 75 bp, Artificial Sequence
  Synthetic
gtagacgccttcttaagagttggcatcttccctccgtgttccacctgaaaggcaagaatagctttacttgcaggt

SEQ ID NO: 296280 - DNA, 75 bp, Artificial Sequence
  Synthetic
tcttccctccgtgttccacctgaaaggcaagaatagctttacttgcaggtgcgacacaatagtttcatgcgaggg

SEQ ID NO: 296281 - DNA, 75 bp, Artificial Sequence
  Synthetic
agaaggtttcctaatgtgcaaggtgacggacactgtgcgcggggagagagtatcattcccggtatgcacttatgt

SEQ ID NO: 296282 - DNA, 75 bp, Artificial Sequence
  Synthetic
acggacactgtgcgcggggagagagtatcattcccggtatgcacttatgtgcctgcaaccatttgcgatcagatg

SEQ ID NO: 296283 - DNA, 75 bp, Artificial Sequence
  Synthetic
ccaacacaatgaaaaactacctattgccggtagtggcccaagctttcagcaagtgggcacgagaagcaaaagcag

SEQ ID NO: 296284 - DNA, 75 bp, Artificial Sequence
  Synthetic
aagtgggcacgagaagcaaaagcagacatggaggatgagaaacctctgggaaccagagaaagaaccctgacgtgc

SEQ ID NO: 296285 - DNA, 75 bp, Artificial Sequence
  Synthetic
tgttgcctgtgggcattcaagagccacaagacacacaccatgtacaaaaggccggatacccaaactatagtcaag

SEQ ID NO: 296286 - DNA, 75 bp, Artificial Sequence
  Synthetic
tctcgcgggacctcccgtactctggagaccgaaacgaagcgcgagaagcagagaaggaagccgaagagaccaagg

SEQ ID NO: 296287 - DNA, 75 bp, Artificial Sequence
  Synthetic
agcaggggtagtggagacacccaggaatgcgctcagagtgacaccacaagagcgcgatcagctgatcggcgcgta

SEQ ID NO: 296288 - DNA, 75 bp, Artificial Sequence
  Synthetic
aatgcgctcagagtgacaccacaagagcgcgatcagctgatcggcgcgtacctgatcttgtctccgcaagcagta

SEQ ID NO: 296289 - DNA, 75 bp, Artificial Sequence
  Synthetic
ggcagatacccggttgaccgctacgacggacgggtgttggtcccgacgggcgcagcgatccccgtcagcgaattt

SEQ ID NO: 296290 - DNA, 75 bp, Artificial Sequence
  Synthetic
cgcagcgatccccgtcagcgaatttcaagcactcagtgagagtgctactatggtctacaacgaacgtgagttcat

SEQ ID NO: 296291 - DNA, 75 bp, Artificial Sequence
  Synthetic
tggtctacaacgaacgtgagttcatcaatcgcaagttgcaccatatagcactctacggccccgccctaaacactg

SEQ ID NO: 296292 - DNA, 75 bp, Artificial Sequence
  Synthetic
ggcagagagagccgaagctgaatacgtgtttgacgttgacaagaggatgtgcgtgaagagagaagaagcatcagg

SEQ ID NO: 296293 - DNA, 75 bp, Artificial Sequence
  Synthetic
gtgtttgacgttgacaagaggatgtgcgtgaagagagaagaagcatcaggccttgtactggttggtgacttaatc

SEQ ID NO: 296294 - DNA, 75 bp, Artificial Sequence
  Synthetic
aacccacccttccatgagttcgcgtatgaaggactgaagatacggcccgcaacgcctttccaaaccacggtcatt

SEQ ID NO: 296295 - DNA, 75 bp, Artificial Sequence
  Synthetic
atgaaggactgaagatacggcccgcaacgcctttccaaaccacggtcattggcgtcttcggggtacctggttcgg

SEQ ID NO: 296296 - DNA, 75 bp, Artificial Sequence
  Synthetic
gcaagtcagccataatcaagagtgtggtgactacgagggacctggtcgccagtgggaagaaggagaactgccagg

SEQ ID NO: 296297 - DNA, 75 bp, Artificial Sequence
  Synthetic
ggtgactacgagggacctggtcgccagtgggaagaaggagaactgccaggagatagttaatgatgtcaaaaagca

SEQ ID NO: 296298 - DNA, 75 bp, Artificial Sequence
  Synthetic
gagaggactggatgtaacagccaggactgttgactctatcctgttgaacgggtgcagaagaggagtagagaacct

SEQ ID NO: 296299 - DNA, 75 bp, Artificial Sequence
  Synthetic
actgttgactctatcctgttgaacgggtgcagaagaggagtagagaacctatacgtggacgaagcatttgcctgt

SEQ ID NO: 296300 - DNA, 75 bp, Artificial Sequence
  Synthetic
cagtgtggattttttaacctgatgcaactgaaggtgaacttcaaccacgatatctgcacacaagtgctccacaaa

SEQ ID NO: 296301 - DNA, 75 bp, Artificial Sequence
  Synthetic
agcatatccagaagatgcaccctcccgatcacggctatcgtctcgaccctacactatcagggtaagatgagaacc

SEQ ID NO: 296302 - DNA, 75 bp, Artificial Sequence
  Synthetic
acgaacttatgtagtgcacccatccagatagacacaacaggtaccactaaaccagccaaaggagacatcgtgtta

SEQ ID NO: 296303 - DNA, 75 bp, Artificial Sequence
  Synthetic
cgaagtcatgacagcagctgcatcacaaggactgactagaaaaggggtatacgccgttaggcagaaagtgaatga

SEQ ID NO: 296304 - DNA, 75 bp, Artificial Sequence
  Synthetic
gaagccggctcatgttaaaggcacaattgataacccagaccttgcgaagctgacttacaagaaatccagtaagta

SEQ ID NO: 296305 - DNA, 75 bp, Artificial Sequence
  Synthetic
aaacccgctttatgccccttcatcagaacatgtcaacgtattgctgactagaactgaaaaccggctggtgtggaa

SEQ ID NO: 296306 - DNA, 75 bp, Artificial Sequence
  Synthetic
gaacatgtcaacgtattgctgactagaactgaaaaccggctggtgtggaaaacactgtcgggagacccgtggata

SEQ ID NO: 296307 - DNA, 75 bp, Artificial Sequence
  Synthetic
aaggtgttaaccaatatccccaagggcgatttcagcgctacgttggaggagtggcaagaggagcatgacaacatc

SEQ ID NO: 296308 - DNA, 75 bp, Artificial Sequence
  Synthetic
gcgatttcagcgctacgttggaggagtggcaagaggagcatgacaacatcatgaacgcccttcgcgagaggtcga

SEQ ID NO: 296309 - DNA, 75 bp, Artificial Sequence
  Synthetic
ggatacgcatgacggcagaggagtgggatacagtgttggctttccgcgaagacagggcgtactcacccgaagtgg

SEQ ID NO: 296310 - DNA, 75 bp, Artificial Sequence
  Synthetic
gggttcccgtataaggctcacattgaaaggaatggtttctcgcccatgactctgcagcttgaagtggtggagaca

SEQ ID NO: 296311 - DNA, 75 bp, Artificial Sequence
  Synthetic
tgtactatgaaaacaaccactgggacaatagaccgggcggccggatgtatggattcaaccgcgaagtcgcccgta

SEQ ID NO: 296312 - DNA, 75 bp, Artificial Sequence
  Synthetic
caatagaccgggcggccggatgtatggattcaaccgcgaagtcgcccgtaagtttgagcaacgctacccattcct

SEQ ID NO: 296313 - DNA, 75 bp, Artificial Sequence
  Synthetic
gagaggcaagatggactcggggctacaagttaatgttccagagagaaaagtacagccattcaatgcggaatgtaa

SEQ ID NO: 296314 - DNA, 75 bp, Artificial Sequence
  Synthetic
ttcacacgagtggtagatgccccggctgtaacagacctgagctgccaggtagcggtctgtacacactcctccgat

SEQ ID NO: 296315 - DNA, 75 bp, Artificial Sequence
  Synthetic
atggcttttgaagaagcttcccggataccatttattgctggtaagcgagtacaatctggcgctgccccataaaag

SEQ ID NO: 296316 - DNA, 75 bp, Artificial Sequence
  Synthetic
taccatttattgctggtaagcgagtacaatctggcgctgccccataaaagagtcttttggattgcaccaccccat

SEQ ID NO: 296317 - DNA, 75 bp, Artificial Sequence
  Synthetic
catataaacccctgaatagtaataaaatataaaacctgattagtaacaaaatagaaaaccacaaaatatgtagtt

SEQ ID NO: 296318 - DNA, 75 bp, Artificial Sequence
  Synthetic
gtgtctggtgcagatcgtatttatgatcttgacctaggattacccctgaatgcaggccgttacgacttggtattt

SEQ ID NO: 296319 - DNA, 75 bp, Artificial Sequence
  Synthetic
atcttgacctaggattacccctgaatgcaggccgttacgacttggtatttgtgaacatacacactgagtacagga

SEQ ID NO: 296320 - DNA, 75 bp, Artificial Sequence
  Synthetic
cgcaccactaccaacagtgcgtcgaccactctatgaagttacagatgttgggcggtgactccttacatctattga

SEQ ID NO: 296321 - DNA, 75 bp, Artificial Sequence
  Synthetic
ggcggtgactccttacatctattgaaaccaggcggctcactgcttatccgtgcttacgggtacgccgacagagtc

SEQ ID NO: 296322 - DNA, 75 bp, Artificial Sequence
  Synthetic
tgcttacgggtacgccgacagagtcagcgaaatggtggtcactgcattagctaggaagttttccgccttcagagt

SEQ ID NO: 296323 - DNA, 75 bp, Artificial Sequence
  Synthetic
agcgaaatggtggtcactgcattagctaggaagttttccgccttcagagtcttgagaccagcatgtgtaacaagt

SEQ ID NO: 296324 - DNA, 75 bp, Artificial Sequence
  Synthetic
aacactgaagtctttctgttgttcaccaattttgataacggcagaagggctgtgactcttcaccaggccaatcag

SEQ ID NO: 296325 - DNA, 75 bp, Artificial Sequence
  Synthetic
ccaattttgataacggcagaagggctgtgactcttcaccaggccaatcagaggctcagctccatgtttgcatgca

SEQ ID NO: 296326 - DNA, 75 bp, Artificial Sequence
  Synthetic
gacgtaggcgtctaatttgtttttttaatattttacaaaaaaaaaaaaaaaaaaaaaaaaaaaaaaaaaaaaaaa

SEQ ID NO: 296327 - DNA, 75 bp, Artificial Sequence
  Synthetic
accctcataccgtgtgcgtaggaccgacatttccgggcacgctgaagaggcggttgttaatgccgccaacgcgaa

SEQ ID NO: 296328 - DNA, 75 bp, Artificial Sequence
  Synthetic
gggcacagtcggcgatggggtttgcagagcggtggcgagaaaatggccagactccttcaaaggtgccgcgactcc

SEQ ID NO: 296329 - DNA, 75 bp, Artificial Sequence
  Synthetic
agagcggtggcgagaaaatggccagactccttcaaaggtgccgcgactcccgtgggtacggctaagttggtacag

SEQ ID NO: 296330 - DNA, 75 bp, Artificial Sequence
  Synthetic
cgtgggtacggctaagttggtacaggccaacggtatgaatgtcatccacgcggtaggcccgaatttctccacggt

SEQ ID NO: 296331 - DNA, 75 bp, Artificial Sequence
  Synthetic
gccaacggtatgaatgtcatccacgcggtaggcccgaatttctccacggtgaccgaggcagagggcgacagagag

SEQ ID NO: 296332 - DNA, 75 bp, Artificial Sequence
  Synthetic
gcgaaagcatcggggactgtgctagacaagaatgtgtccgggaagataacggaccttcaagacgtcatggccact

SEQ ID NO: 296333 - DNA, 75 bp, Artificial Sequence
  Synthetic
taagagtgtagccatccctctgttgtcgacgggagtgttctccggaggtaaagatagagtcatgcagtcactaaa

SEQ ID NO: 296334 - DNA, 75 bp, Artificial Sequence
  Synthetic
acggacgctgacgtagtcatctattgccgcgacaaagcctgggagaagaaaatccaggaggctatcgatcgccgc

SEQ ID NO: 296335 - DNA, 75 bp, Artificial Sequence
  Synthetic
aatccaggaggctatcgatcgccgcaccgccgtggaattggtatctgaagacatctcactcgagtctgacttgat

SEQ ID NO: 296336 - DNA, 75 bp, Artificial Sequence
  Synthetic
accgccgtggaattggtatctgaagacatctcactcgagtctgacttgatacgggtacacccagatagttgcttg

SEQ ID NO: 296337 - DNA, 75 bp, Artificial Sequence
  Synthetic
gtaggcagaaaaggttacagcataacagatgggaagctgcattcatacctggaaggtacccgctttcatcagact

SEQ ID NO: 296338 - DNA, 75 bp, Artificial Sequence
  Synthetic
aaacgaacaaatatgcttgtatgcattgggtgagagtatggacagcatcagaacgaaatgccctgttgaggacgc

SEQ ID NO: 296339 - DNA, 75 bp, Artificial Sequence
  Synthetic
gttacgtggtaaagaagatcaccataagcccgggcatatacggaaaaacagttgattacgcagttacccatcacg

SEQ ID NO: 296340 - DNA, 75 bp, Artificial Sequence
  Synthetic
cgattcgtccacgcctccgaaaacagttccgtgtctgtgtaggtacgctatgactgctgagagagtggcaagact

SEQ ID NO: 296341 - DNA, 75 bp, Artificial Sequence
  Synthetic
cgaagtacaggattgaaggcgtccagaaggtcaagtgcgaccgagtgctgatttttgaccagacggtgccatctc

SEQ ID NO: 296342 - DNA, 75 bp, Artificial Sequence
  Synthetic
acaaacacaatgaaaaactacctactgccagtggtagcgcaagcattcagtaaatgggcacgtgaggcgcgcgca

SEQ ID NO: 296343 - DNA, 75 bp, Artificial Sequence
  Synthetic
atctgaggccacgtatgagaccatggaagtagtagcagaggtgcaccactcggaaccaccagtcccgccaccgcg

SEQ ID NO: 296344 - DNA, 75 bp, Artificial Sequence
  Synthetic
ggcctgaaacgcagactatcgtcaaagtgccttccacttttgactcctttgtgataccgagcctgtggtcatcca

SEQ ID NO: 296345 - DNA, 75 bp, Artificial Sequence
  Synthetic
cggaaccaccagtcccgccaccgcgcaggcgtcgtgcgcaggtgacgatgcaccaccaggagctgttggaagtct

SEQ ID NO: 296346 - DNA, 75 bp, Artificial Sequence
  Synthetic
caccaccaggagctgttggaagtctctgacatgcacaccccgattgcggcaagggtcgagatccccgtgtacgat

SEQ ID NO: 296347 - DNA, 75 bp, Artificial Sequence
  Synthetic
ctgacatgcacaccccgattgcggcaagggtcgagatccccgtgtacgataccgctgttgtagtggagagagtgg

SEQ ID NO: 296348 - DNA, 75 bp, Artificial Sequence
  Synthetic
agtgccttccacttttgactcctttgtgataccgagcctgtggtcatccagtctttccatgggtatcagacagag

SEQ ID NO: 296349 - DNA, 75 bp, Artificial Sequence
  Synthetic
atggcccaaggcctaccatactcaggagaccgcaccgaagctcgcgcggcagaagaagaagagaaagaggcgcag

SEQ ID NO: 296350 - DNA, 75 bp, Artificial Sequence
  Synthetic
caattccttgcacaagcgagtatgcaaaacccataccagcaccacgggcagcaagggtcgtacccgtgccggcac

SEQ ID NO: 296351 - DNA, 75 bp, Artificial Sequence
  Synthetic
cgcgttctgagagcctcggtatgcagtgtgaccactagcgctggggtagagttcccttgggcgcctgaagatctg

SEQ ID NO: 296352 - DNA, 75 bp, Artificial Sequence
  Synthetic
gttcccttgggcgcctgaagatctggaggtactcaccgagcctgtgcactgcaaaatgcgcgagccggttgagtt

SEQ ID NO: 296353 - DNA, 75 bp, Artificial Sequence
  Synthetic
acttgatcctttccccccaaacggttttgaaaagcgagaagctggcacccatccaccctcttgccgagcaagtca

SEQ ID NO: 296354 - DNA, 75 bp, Artificial Sequence
  Synthetic
agagcgggggcgtacatcttctcgtctgataccggaccagggcacttacaacagaagtcagtacggcaacacgca

SEQ ID NO: 296355 - DNA, 75 bp, Artificial Sequence
  Synthetic
acagaagtcagtacggcaacacgcactaccgtgcgaaatgctatacgtccacgaggaagaacggacgtacccccc

SEQ ID NO: 296356 - DNA, 75 bp, Artificial Sequence
  Synthetic
acgaggaagaacggacgtacccccccgcactggatgaggccagggagaaactgctgcaggcaaaaatgcagatgg

SEQ ID NO: 296357 - DNA, 75 bp, Artificial Sequence
  Synthetic
cgcactggatgaggccagggagaaactgctgcaggcaaaaatgcagatggcacctacggaagcaaacaagagcag

SEQ ID NO: 296358 - DNA, 75 bp, Artificial Sequence
  Synthetic
aacgcgggttggacgtgaccgctaggaccgtcgactcaatcttattaaatgggtgcaagagaggcgtagaaaacc

SEQ ID NO: 296359 - DNA, 75 bp, Artificial Sequence
  Synthetic
gtaccaatcaaggaaggttgaaaacatgaaggcagtgatcatagataggctgaaggatggagcaagaacctacct

SEQ ID NO: 296360 - DNA, 75 bp, Artificial Sequence
  Synthetic
tttacgtcgatgaggcgttcgcgtgtcactcgggtactttgctagcgctcattgcgctggtgagaccgtcaggta

SEQ ID NO: 296361 - DNA, 75 bp, Artificial Sequence
  Synthetic
tgaaggatggagcaagaacctacctgacagaacagtcagagaagattccaacctatgttagtaagtacccgcggc

SEQ ID NO: 296362 - DNA, 75 bp, Artificial Sequence
  Synthetic
tcactcgggtactttgctagcgctcattgcgctggtgagaccgtcaggtaaggtagtactgtgtggcgaccctaa

SEQ ID NO: 296363 - DNA, 75 bp, Artificial Sequence
  Synthetic
tagcttgcagaatcccgaggtcgctgtggcggcctgcaatgctttcctggaagccaattacccgacagtggctag

SEQ ID NO: 296364 - DNA, 75 bp, Artificial Sequence
  Synthetic
aagccaattacccgacagtggctagttaccagatcacggacgagtatgatgcctacttggatatggttgatgggt

SEQ ID NO: 296365 - DNA, 75 bp, Artificial Sequence
  Synthetic
gagcatctccagaagatgcacactacctgtcacggcgatcgtgtccaccttgcactaccaagggaagatgagaac

SEQ ID NO: 296366 - DNA, 75 bp, Artificial Sequence
  Synthetic
cctgtcacggcgatcgtgtccaccttgcactaccaagggaagatgagaacgacgaaccgatgcaacacccctatt

SEQ ID NO: 296367 - DNA, 75 bp, Artificial Sequence
  Synthetic
cttctgcccggcaaaattacgctgctacccaaagcatcatgcttaccaccaaccgcaggttaggagcgcggtccc

SEQ ID NO: 296368 - DNA, 75 bp, Artificial Sequence
  Synthetic
aaccgcaggttaggagcgcggtcccatcaccatttcaaaacaccctgcagaatgtgctagcagcagccacgaaga

SEQ ID NO: 296369 - DNA, 75 bp, Artificial Sequence
  Synthetic
aatgtgctagcagcagccacgaagagaaactgcaatgtcacacagatgagagagctacccactctagactcagcc

SEQ ID NO: 296370 - DNA, 75 bp, Artificial Sequence
  Synthetic
gtgcttaacgtggaatgcttcaaaaaattcgcatgcaacggagaatactggcaggaattcaaagacaacccaata

SEQ ID NO: 296371 - DNA, 75 bp, Artificial Sequence
  Synthetic
aattcgcatgcaacggagaatactggcaggaattcaaagacaacccaataagaataactacagagaacataacaa

SEQ ID NO: 296372 - DNA, 75 bp, Artificial Sequence
  Synthetic
gcaggaattcaaagacaacccaataagaataactacagagaacataacaacttatgttactaggcttaagggccc

SEQ ID NO: 296373 - DNA, 75 bp, Artificial Sequence
  Synthetic
cttatgttactaggcttaagggccctaaagcagcggcgctgtttgcaaagactcacaatctagtcccgctgcagg

SEQ ID NO: 296374 - DNA, 75 bp, Artificial Sequence
  Synthetic
taaagcagcggcgctgtttgcaaagactcacaatctagtcccgctgcaggaggtgcccatggaccggtttgtggt

SEQ ID NO: 296375 - DNA, 75 bp, Artificial Sequence
  Synthetic
agatatgaagagagacgtgaaagttacccctggcaccaaacataccgaggaacgcccaaaggtgcaagtcatcca

SEQ ID NO: 296376 - DNA, 75 bp, Artificial Sequence
  Synthetic
aacgcccaaaggtgcaagtcatccaggccgccgaacctttagctacagcttatttatgtggcattcacagggagt

SEQ ID NO: 296377 - DNA, 75 bp, Artificial Sequence
  Synthetic
cctattctcagcgcagtcagtttccctcttctatgagaacaaccactgggacaacaggcctggaggacgcatgta

SEQ ID NO: 296378 - DNA, 75 bp, Artificial Sequence
  Synthetic
tatttatgtggcattcacagggagttagtccgccgcctgaaggccgtcctggccccgaacatacatacattgttc

SEQ ID NO: 296379 - DNA, 75 bp, Artificial Sequence
  Synthetic
tagtccgccgcctgaaggccgtcctggccccgaacatacatacattgttcgatatgtcggcagaagattttgatg

SEQ ID NO: 296380 - DNA, 75 bp, Artificial Sequence
  Synthetic
ccatcatagctgcacatttccaaccaggcgacgcagttttggaaacggacatagcctcctttgacaagagccaag

SEQ ID NO: 296381 - DNA, 75 bp, Artificial Sequence
  Synthetic
aggcgacgcagttttggaaacggacatagcctcctttgacaagagccaagatgactctctggcgttgacggcact

SEQ ID NO: 296382 - DNA, 75 bp, Artificial Sequence
  Synthetic
ctccaaccttttagcgctgaatgcaatatagtcccatccaatcgtcggttaccgcatgctctagtcactagttat

SEQ ID NO: 296383 - DNA, 75 bp, Artificial Sequence
  Synthetic
gatgctgttggaagacctcggggttgaccaagaactactagacttgatagaggcagcgttcggggaaattaccag

SEQ ID NO: 296384 - DNA, 75 bp, Artificial Sequence
  Synthetic
cgtccacctgccaacaggtacgcggttcaagtttggcgccatgatgaagtccggaatgttcctgacactgtttgt

SEQ ID NO: 296385 - DNA, 75 bp, Artificial Sequence
  Synthetic
tacaacctggcgatacctcacaaaagagtcttctggattgcacctccgcgggtgtcaggcgcagaccgcacgtac

SEQ ID NO: 296386 - DNA, 75 bp, Artificial Sequence
  Synthetic
aaataccctgttaaacattgtcatagcatgccgtgtactgcgtgagaagctgacaaactccgtctgcgccgcgtt

SEQ ID NO: 296387 - DNA, 75 bp, Artificial Sequence
  Synthetic
tgatatatcaggacacggtgaggaagcggtcgtaaatgctgccaatgccaaaggtaccgtgagcgatggagtgtg

SEQ ID NO: 296388 - DNA, 75 bp, Artificial Sequence
  Synthetic
accatgtgcgagaaaccaccatatttctgcggcgggtttatattgtatgacaaagtcaccggatcggcgtgccga

SEQ ID NO: 296389 - DNA, 75 bp, Artificial Sequence
  Synthetic
ttaaactaggtaaacctttacccgccggagacacccaagatgaagatcgtaggcgtgcattgaaggatgagacgg

SEQ ID NO: 296390 - DNA, 75 bp, Artificial Sequence
  Synthetic
gtctgaactggaaatagcactaagttctcggtatgaggtgaacgggaccggcaacatagtgcgagcaatggccac

SEQ ID NO: 296391 - DNA, 75 bp, Artificial Sequence
  Synthetic
aaaaagctgcgtggacccatcgtacacctctacggcggtcctaaatagatgcagagacacaccttcatctaatac

SEQ ID NO: 296392 - DNA, 75 bp, Artificial Sequence
  Synthetic
agctcacaacagtaaacatgaattacataccaacccagactttttacggacgccgttggcggcctcgcccggcgt

SEQ ID NO: 296393 - DNA, 75 bp, Artificial Sequence
  Synthetic
cataccaacccagactttttacggacgccgttggcggcctcgcccggcgttccgtccatggcaggtgccgatgca

SEQ ID NO: 296394 - DNA, 75 bp, Artificial Sequence
  Synthetic
cgccgttggcggcctcgcccggcgttccgtccatggcaggtgccgatgcagccgacacctactatggttacaccc

SEQ ID NO: 296395 - DNA, 75 bp, Artificial Sequence
  Synthetic
atgctgcaagcaccagacctacaggcccaacagatgcaacaactgatcagcgctgtctctgcattaaccaccaaa

SEQ ID NO: 296396 - DNA, 75 bp, Artificial Sequence
  Synthetic
cccaacagatgcaacaactgatcagcgctgtctctgcattaaccaccaaacagaatgtaaaagcaccaaaagggc

SEQ ID NO: 296397 - DNA, 75 bp, Artificial Sequence
  Synthetic
cctaggggagacgatggacagcatacgcactaaatgcccagtggaagacgccgattcgtctacaccgccgaaaac

SEQ ID NO: 296398 - DNA, 75 bp, Artificial Sequence
  Synthetic
cagaatgtaaaagcaccaaaagggcaacggaagaagaaacagcagaaaccaaaggaaaagaaggaaaaccagaag

SEQ ID NO: 296399 - DNA, 75 bp, Artificial Sequence
  Synthetic
aacggaagaagaaacagcagaaaccaaaggaaaagaaggaaaaccagaagaaaaagccgacgcaaaagaagaagc

SEQ ID NO: 296400 - DNA, 75 bp, Artificial Sequence
  Synthetic
agcagccgccggaacagctggataatgtgagcctgacttctacgacgtcgacgggatccgcatggtcactcccat

SEQ ID NO: 296401 - DNA, 75 bp, Artificial Sequence
  Synthetic
agcagcagaaaccaaaaccacaggctaagaagaagaaaccagggagaagagaaagaatgtgcatgaagatcgaga

SEQ ID NO: 296402 - DNA, 75 bp, Artificial Sequence
  Synthetic
taagaagaagaaaccagggagaagagaaagaatgtgcatgaagatcgagaatgactgcatattcgaggtcaaact

SEQ ID NO: 296403 - DNA, 75 bp, Artificial Sequence
  Synthetic
tgcctagtcggagacaaggtcatgaagccggctcacgttaaaggcacaattgataacccagaccttgcgaagctg

SEQ ID NO: 296404 - DNA, 75 bp, Artificial Sequence
  Synthetic
cgcgacgacagacatacgcgctatcccagtcccggcacggcgggccattacaatgccagtcccagcccctagggt

SEQ ID NO: 296405 - DNA, 75 bp, Artificial Sequence
  Synthetic
tcgtaaggtcgctaccgaacctccatcagagccagaagctcctatcccggcaccaaggaagagaagaaccactag

SEQ ID NO: 296406 - DNA, 75 bp, Artificial Sequence
  Synthetic
tcagagccagaagctcctatcccggcaccaaggaagagaagaaccactagcaccacacctccgcataaccccggg

SEQ ID NO: 296407 - DNA, 75 bp, Artificial Sequence
  Synthetic
gcacatgaagtccgacgcctccaagtacacacatgaaaaacccgaaggtcattacaattggcaccatggagcagt

SEQ ID NO: 296408 - DNA, 75 bp, Artificial Sequence
  Synthetic
acttacaagaaatccagtaagtatgacctcgaatgcgcccagataccagtgcacatgaagtccgacgcctccaag

SEQ ID NO: 296409 - DNA, 75 bp, Artificial Sequence
  Synthetic
gattttgttcccagggtaccggttgaattaccgtgggagccggaagacctagacatccaattcggtgacttggag

SEQ ID NO: 296410 - DNA, 75 bp, Artificial Sequence
  Synthetic
agacatccaattcggtgacttggagccacgccgccggaacaccagggactgggatgtcagcacaggaatacagtt

SEQ ID NO: 296411 - DNA, 75 bp, Artificial Sequence
  Synthetic
ggtctgccgcgctgatgatgtgtatccttgccaacacctctttcccatgctcatcacctccctgctacccctgct

SEQ ID NO: 296412 - DNA, 75 bp, Artificial Sequence
  Synthetic
ccttgccaacacctctttcccatgctcatcacctccctgctacccctgctgctacgaaaaacagccagaacagac

SEQ ID NO: 296413 - DNA, 75 bp, Artificial Sequence
  Synthetic
actgcggatgctggaagacaatgtgaatagaccagggtactatgagctactggaagcgtccatgacatgcagaaa

SEQ ID NO: 296414 - DNA, 75 bp, Artificial Sequence
  Synthetic
tagaaagactacgcgaaggagcaaaattgtacctccatgagcaaaccgacaaagtacctacgtacaccagcaagt

SEQ ID NO: 296415 - DNA, 75 bp, Artificial Sequence
  Synthetic
aatagaccagggtactatgagctactggaagcgtccatgacatgcagaaacagatcacgccaccgccgtagtgta

SEQ ID NO: 296416 - DNA, 75 bp, Artificial Sequence
  Synthetic
acagagcacttcaatgtgtataaggctactagaccgtacttagcgtattgcgctgactgtggggacgggtacttc

SEQ ID NO: 296417 - DNA, 75 bp, Artificial Sequence
  Synthetic
ctactagaccgtacttagcgtattgcgctgactgtggggacgggtacttctgctatagcccagttgctatcgaga

SEQ ID NO: 296418 - DNA, 75 bp, Artificial Sequence
  Synthetic
cgcagtaccttcccccttccaaaacacgctacaaaacgtgctagccgcggccactaaaagaaattgtaacgtcac

SEQ ID NO: 296419 - DNA, 75 bp, Artificial Sequence
  Synthetic
cccacgcccacacgaagatccgatatatggctggtcatgatgttcaggaatctaagagagattccttgagggtgt

SEQ ID NO: 296420 - DNA, 75 bp, Artificial Sequence
  Synthetic
tctaagagagattccttgagggtgtacacgtccgcagcgtgctctatacatgggacgatgggacacttcatcgtc

SEQ ID NO: 296421 - DNA, 75 bp, Artificial Sequence
  Synthetic
aatcctatacggatcaccaccgaaaacataacgacgtacgtggctaaactcaagggccctaaggctgctgccctt

SEQ ID NO: 296422 - DNA, 75 bp, Artificial Sequence
  Synthetic
tgggacgatgggacacttcatcgtcgcacattgtccgccaggcgactacctcaaggtttcgttcgaggacgcaga

SEQ ID NO: 296423 - DNA, 75 bp, Artificial Sequence
  Synthetic
ttcacacgtgaaggcatgtaaggtccaatacaagcacgacccattgccggtgggtagagagaagttcgtggttag

SEQ ID NO: 296424 - DNA, 75 bp, Artificial Sequence
  Synthetic
accccactttggcgtagagctgccatgcacctcataccagctgacaacagctcccaccgacgaggagatcgacat

SEQ ID NO: 296425 - DNA, 75 bp, Artificial Sequence
  Synthetic
gcacacaccgccagatataccggatcgcaccctgctatcacagacggcgggcaacgtcaaaataacagcaggcgg

SEQ ID NO: 296426 - DNA, 75 bp, Artificial Sequence
  Synthetic
aacggcgctaatgcttctggaagaccttggggtcgaccaagaactgctggaccttatcgaagccgcgtttggtga

SEQ ID NO: 296427 - DNA, 75 bp, Artificial Sequence
  Synthetic
gcaacgtcaaaataacagcaggcggcaggactatcaggtacaattgtacctgtggccgtgacaacgtaggcacta

SEQ ID NO: 296428 - DNA, 75 bp, Artificial Sequence
  Synthetic
aaagtgcatgttccattccctttgactaacgtcacctgccgagtgccgttggctcgagcgccggatgtcacctat

SEQ ID NO: 296429 - DNA, 75 bp, Artificial Sequence
  Synthetic
ctaacgtcacctgccgagtgccgttggctcgagcgccggatgtcacctatggtaagaaggaggtgaccctgagat

SEQ ID NO: 296430 - DNA, 75 bp, Artificial Sequence
  Synthetic
ccgcacccgtacgaggagtgggttgacaagttctctgagcgcatcatcccagtgacggaagaagggattgagtac

SEQ ID NO: 296431 - DNA, 75 bp, Artificial Sequence
  Synthetic
acaagttctctgagcgcatcatcccagtgacggaagaagggattgagtaccagtggggcaacaacccgccggtcc

SEQ ID NO: 296432 - DNA, 75 bp, Artificial Sequence
  Synthetic
gcactgagctcaagataccaagtcagtggtgtcggaaacatcactagagcgatgtccacgttgtctaagaatttg

SEQ ID NO: 296433 - DNA, 75 bp, Artificial Sequence
  Synthetic
cagtggggcaacaacccgccggtccgcctatgggcgcaactgacgaccgagggcaaaccccatggctggccacat

SEQ ID NO: 296434 - DNA, 75 bp, Artificial Sequence
  Synthetic
gaaatcattcagtactattatggactataccccgccgccaccattgccgcagtatccggggcgagtctgatggcc

SEQ ID NO: 296435 - DNA, 75 bp, Artificial Sequence
  Synthetic
ccatcatacatctgtacggcggtcctaaatagatgcaggattacactacatctaaagaccacgcattatagacac

SEQ ID NO: 296436 - DNA, 75 bp, Artificial Sequence
  Synthetic
ccaggagcggtggtaccgttgacactggggctgctttgctgcgcaccgagggcgaacgcagcatcattcgctgag

SEQ ID NO: 296437 - DNA, 75 bp, Artificial Sequence
  Synthetic
actatggcatatctgtgggacgagaacaaaaccctcttttggatggaattcgcggccccagccgcagcgcttgct

SEQ ID NO: 296438 - DNA, 75 bp, Artificial Sequence
  Synthetic
aaaagcgaaggctaagaaaaacgaacagcaaaagaaaaacgagaacaagaaaccaccacccaagcagaagaatct

SEQ ID NO: 296439 - DNA, 75 bp, Artificial Sequence
  Synthetic
ttgctggcatgctgtatcaaaagcctgatctgctgttgtaagccattttcttttttagtgttactgagcctggga

SEQ ID NO: 296440 - DNA, 75 bp, Artificial Sequence
  Synthetic
tgatctgctgttgtaagccattttcttttttagtgttactgagcctgggagcctccgcaaaagcttacgagcaca

SEQ ID NO: 296441 - DNA, 75 bp, Artificial Sequence
  Synthetic
ggctaagaagaagaaaccaggaaaaagggaacgaatgtgcatgaagatagaaaatgattgcatcttcgaggtcaa

SEQ ID NO: 296442 - DNA, 75 bp, Artificial Sequence
  Synthetic
agggaacgaatgtgcatgaagatagaaaatgattgcatcttcgaggtcaagctcgacggtaaggtcacgggatac

SEQ ID NO: 296443 - DNA, 75 bp, Artificial Sequence
  Synthetic
cagccacaattccgaatgtggtggggttcccgtataaggctcacattgaaaggaatggcttctcgcccatgactc

SEQ ID NO: 296444 - DNA, 75 bp, Artificial Sequence
  Synthetic
tacattacctgcgaatacaagacggtggtcccttcgccattcatcaaatgttgcggaacatcagaatgctcatcc

SEQ ID NO: 296445 - DNA, 75 bp, Artificial Sequence
  Synthetic
aaatacacccatgaaaaaccagaaggacactacaattggcatcacggtgcagtgcagtatagcggtggcaggttc

SEQ ID NO: 296446 - DNA, 75 bp, Artificial Sequence
  Synthetic
aaggagcagccagactaccaatgcaaggtgtacacgggtgtatacccattcatgtggggtggagcctactgtttc

SEQ ID NO: 296447 - DNA, 75 bp, Artificial Sequence
  Synthetic
aggtgtacacgggtgtatacccattcatgtggggtggagcctactgtttctgcgactccgagaacacgcagctca

SEQ ID NO: 296448 - DNA, 75 bp, Artificial Sequence
  Synthetic
acaatcccgacaggcgcaggtaagccaggagacagcggccggccgatcttcgacaacaaaggacgtgtggtggcc

SEQ ID NO: 296449 - DNA, 75 bp, Artificial Sequence
  Synthetic
gcgaggcctatgtcgacaggtcagacgtttgcaaacatgatcacgcatcggcctacaaggcacacacggcctctc

SEQ ID NO: 296450 - DNA, 75 bp, Artificial Sequence
  Synthetic
cgacaacaaaggacgtgtggtggccattgtcctgggaggggccaacgaaggagccagaactgccctatctgtcgt

SEQ ID NO: 296451 - DNA, 75 bp, Artificial Sequence
  Synthetic
taaaagcaacaatcaggatcagttatggcaccatcaaccagaccaccgaggccttcgttaatggtgaacacgcgg

SEQ ID NO: 296452 - DNA, 75 bp, Artificial Sequence
  Synthetic
tcaacgtgggcggaagcaagttcatctttggaccgatctcaacagcttggtcaccgttcgacaataaaattgtcg

SEQ ID NO: 296453 - DNA, 75 bp, Artificial Sequence
  Synthetic
gttgctatgaaaaacaaccagaacagacactgaggatgttggaggacaacgtagaccgcccgggctactatgacc

SEQ ID NO: 296454 - DNA, 75 bp, Artificial Sequence
  Synthetic
ggacttcccaccctacggatcaggccagccgggtagattcggagacattcagagcaggacagtggagagcaaaga

SEQ ID NO: 296455 - DNA, 75 bp, Artificial Sequence
  Synthetic
tgctcgaggccacgatgacgtgtaacaatagtgcacgccaccgtcgcagtgtgacggaacacttcaatgtctaca

SEQ ID NO: 296456 - DNA, 75 bp, Artificial Sequence
  Synthetic
cagccgggtagattcggagacattcagagcaggacagtggagagcaaagacttgtatgccaacacggccctaaaa

SEQ ID NO: 296457 - DNA, 75 bp, Artificial Sequence
  Synthetic
gtgacggaacacttcaatgtctacaaggccactaaaccgtatctagcgtattgcgcggattgcggagacgggcag

SEQ ID NO: 296458 - DNA, 75 bp, Artificial Sequence
  Synthetic
ctctcaagaccatcacccggggttgtgcatgtgccatacacgcagacaccatccggatttaaatattggctgaag

SEQ ID NO: 296459 - DNA, 75 bp, Artificial Sequence
  Synthetic
aggccccttttggctgcaagataaagaccaatccagtcagagccatggattgtgcagttggcagtatacctgtgt

SEQ ID NO: 296460 - DNA, 75 bp, Artificial Sequence
  Synthetic
cgatggacatacctgacagtgcattcacacgagtggtagatgccccggctgtaacagacctgagctgccaggtag

SEQ ID NO: 296461 - DNA, 75 bp, Artificial Sequence
  Synthetic
gtacatcgtcgggcattacatgaaagaggccaaccgggattctttacaagtgcatacttccggtgtgtgcgccat

SEQ ID NO: 296462 - DNA, 75 bp, Artificial Sequence
  Synthetic
tggtctgtacacactcctccgatttcggaggagttgccacattgtcttacaaaacggacaaacccggcaagtgcg

SEQ ID NO: 296463 - DNA, 75 bp, Artificial Sequence
  Synthetic
catgcacaccccaccggatatcccagacataacgttgctgtcgcagcagtcaggtgatgtaaagatcacagcagg

SEQ ID NO: 296464 - DNA, 75 bp, Artificial Sequence
  Synthetic
cgtcccttatggggcgagccataacaaccaggtctttccggacatgtcaggaactgcgatgacgtgggtgcagag

SEQ ID NO: 296465 - DNA, 75 bp, Artificial Sequence
  Synthetic
aggaaaaaccatcagatacaactgcacgtgtggtagtggcaacgtgggcaccaccagtagcgacaagactatcaa

SEQ ID NO: 296466 - DNA, 75 bp, Artificial Sequence
  Synthetic
gctctcatcgcggtggttgtgctggtcttggtaacctgcataacaatgcgtcggtaagctttagttcaaagggcc

SEQ ID NO: 296467 - DNA, 75 bp, Artificial Sequence
  Synthetic
gctgcggtgactaaccacgacaagtggcagtacacctcctcgtttgtccctagagccgaccagttgcctcgcaaa

SEQ ID NO: 296468 - DNA, 75 bp, Artificial Sequence
  Synthetic
ggtaaagtgcacgtaccattccctctgaccaactccacatgcagggtgccccttgcacgtgcaccaggtgtcaca

SEQ ID NO: 296469 - DNA, 75 bp, Artificial Sequence
  Synthetic
agtaacaaaatagaaaaccacaaaatatgtagttaagtattataagatgtgtagttcaaagggctatatcacccc

SEQ ID NO: 296470 - DNA, 75 bp, Artificial Sequence
  Synthetic
tatgtagttaagtattataagatgtgtagttcaaagggctatatcacccctgattagtaacaaaatataaaaaca

SEQ ID NO: 296471 - DNA, 75 bp, Artificial Sequence
  Synthetic
aaaatatgtagttaagtactaaccaacaagtagacaaatagatgctaaccatatatataaccagctatagtatac

SEQ ID NO: 296472 - DNA, 75 bp, Artificial Sequence
  Synthetic
gttgacataccggagtctaggagcagatccacgtccgtatgaggagtggatagaccggtacgtcgaacggaccat

SEQ ID NO: 296473 - DNA, 75 bp, Artificial Sequence
  Synthetic
atcactagaaatccagtcattaaattattaattggctagccgaactctaaggagatgtaggcgtccgaactctgc

SEQ ID NO: 296474 - DNA, 75 bp, Artificial Sequence
  Synthetic
cacgagatcatactctattactacgggctatacccagcagccaccattgccgccgtctcagccgcgggtctcgca

SEQ ID NO: 296475 - DNA, 75 bp, Artificial Sequence
  Synthetic
ggagatgtaggcgtccgaactctgcggagatgtaggactaaattctgccgaaccccataacaccggggacgtagg

SEQ ID NO: 296476 - DNA, 75 bp, Artificial Sequence
  Synthetic
ggagatgtaggactaaattctgccgaaccccataacaccggggacgtaggcgtctaatttgtttttttaatattt

SEQ ID NO: 296477 - DNA, 75 bp, Artificial Sequence
  Synthetic
caagtgcctgaccccttacgccctgacccccggagctgtcgtcccggtaacactgggagtactatgctgcgcacc

SEQ ID NO: 296478 - DNA, 75 bp, Artificial Sequence
  Synthetic
cgtctaatttgtttttttaatattttacaaaaaaaaaaaaaaaaaaaaaaaaaaaaaaaaaaaaaaaaaaaaaaa

SEQ ID NO: 296479 - DNA, 75 bp, Artificial Sequence
  Synthetic
cctatccataggcctacggcaaagaataaaactgctattaggcccaaaactctcgcgggacctcccgtactctgg

SEQ ID NO: 296480 - DNA, 75 bp, Artificial Sequence
  Synthetic
atcaccatttcaaaacaccctgcagaatgtgctagcagcagccacgaagagaaactgcaatgttacacagatgag

SEQ ID NO: 296481 - DNA, 75 bp, Artificial Sequence
  Synthetic
gcttgcaacgccgctcgccgccataatcatacttgtatgctgcctgaagaacctgctttgctgctgccaaccgct

SEQ ID NO: 296482 - DNA, 75 bp, Artificial Sequence
  Synthetic
gtgttaggcggggccaacgaaggtgctcgcactgcgctgtctgtggtgacgtggacaaaagacatggtcactcgg

SEQ ID NO: 296483 - DNA, 75 bp, Artificial Sequence
  Synthetic
ttcttttttagtgttggtgagcctgggaactcccgtcgtaaaatcttacgaacacaccgcaacgatcccgaatgt

SEQ ID NO: 296484 - DNA, 75 bp, Artificial Sequence
  Synthetic
aaccagcttggaacccacgctaaacttagagtacataacctgtgaatacaagacagtcgtgccaccaccttacat

SEQ ID NO: 296485 - DNA, 75 bp, Artificial Sequence
  Synthetic
caagtgctgcggggcatcagaatgcagatccatggagcgccccgactatcaatgccaggtctacacaggagtgta

SEQ ID NO: 296486 - DNA, 75 bp, Artificial Sequence
  Synthetic
aatgccaggtctacacaggagtgtacccattcatgtggggcggcgcatactgcttctgcgacactgagaacaccc

SEQ ID NO: 296487 - DNA, 75 bp, Artificial Sequence
  Synthetic
aacaccggggacgtaggcgtctaatttgttttttaatattttacaaaaaaaaaaaaaaaaaaaaaaaaaaaaaaa

SEQ ID NO: 296488 - DNA, 75 bp, Artificial Sequence
  Synthetic
tgcttctgcgacactgagaacacccagttgagtgaagcatacgttgacagatcagacgtatgcaagcacgaccac

SEQ ID NO: 296489 - DNA, 75 bp, Artificial Sequence
  Synthetic
caaccaggacttcccaccctacgggtctggacaaccagggaggtttggagacgtccagagcaggacggtagagag

SEQ ID NO: 296490 - DNA, 75 bp, Artificial Sequence
  Synthetic
tctggacaaccagggaggtttggagacgtccagagcaggacggtagagagcaaagacctgtatgccaacactgcc

SEQ ID NO: 296491 - DNA, 75 bp, Artificial Sequence
  Synthetic
atgttcgaggttttggctggcgcatacccaacgtattccacgaattgggcggacgagcaggtcctgcaggcacgt

SEQ ID NO: 296492 - DNA, 75 bp, Artificial Sequence
  Synthetic
ggacttcggcgggatcgcaactctgactttcaaaaccgacaaacccggaaaatgtgctgtccactcccattcgaa

SEQ ID NO: 296493 - DNA, 75 bp, Artificial Sequence
  Synthetic
agcatccccggcattcatggtatctgtgtgcagtgccaaaacgacatgcatggcggcgtgtgagccgccgaagga

SEQ ID NO: 296494 - DNA, 75 bp, Artificial Sequence
  Synthetic
tcatatcgtcccttatggagcgagccataacaaccaagtttttcccgacatgtctggtacggcaatgacatgggt

SEQ ID NO: 296495 - DNA, 75 bp, Artificial Sequence
  Synthetic
tgtctggtacggcaatgacatgggtgcagcgggtagctggcggactcggcgggctaacactcgccgcagtggcag

SEQ ID NO: 296496 - DNA, 75 bp, Artificial Sequence
  Synthetic
ggctacgttgttaaaaagatcacaatgagcccagggacgtacgggaagacggtcggatacgccgttacgcatcat

SEQ ID NO: 296497 - DNA, 75 bp, Artificial Sequence
  Synthetic
agtaacaaaacataaaaaccaaaaacagtagttcaaagggctatacaacccctgaatagtaacaaaatacagaaa

SEQ ID NO: 296498 - DNA, 75 bp, Artificial Sequence
  Synthetic
ttgaggttgaatcacagcaggtcacacctaatgaccatgctaatgccagagctttttcgcatctggccacaaagt

SEQ ID NO: 296499 - DNA, 75 bp, Artificial Sequence
  Synthetic
gctttttcgcatctggccacaaagttaattgaacaagaggttccagccaacatcaccatcctggacgtgggcagt

SEQ ID NO: 296500 - DNA, 75 bp, Artificial Sequence
  Synthetic
cagagaaggaagccgaagagaccaaggaagcagaattgacacgggaagcactgccaccattggtgggaagcaact

SEQ ID NO: 296501 - DNA, 75 bp, Artificial Sequence
  Synthetic
accacagctaccattgcatttgtcccatgaagagtgcggaagacccagagagattagcgaactacgcccggaaac

SEQ ID NO: 296502 - DNA, 75 bp, Artificial Sequence
  Synthetic
tggcaaaaacagcaggggaagtgctagacaaaaatgtgtccggtaagatcacggacctgcaggacgtcatggcaa

SEQ ID NO: 296503 - DNA, 75 bp, Artificial Sequence
  Synthetic
tactgaagagtgaaaaactcacaccgatacatccactggctgagcaagtgacaatcatgacgcactctggaagat

SEQ ID NO: 296504 - DNA, 75 bp, Artificial Sequence
  Synthetic
aaaggggtcaggacagtatactggataggattcgacaccaccccattcatgttcgaggttgttgctggcgcatac

SEQ ID NO: 296505 - DNA, 75 bp, Artificial Sequence
  Synthetic
agcgaaggacatcgaggaaaaatctctattatgaggaagaaacgcctaaggccgagcgacagggatatgttctcg

SEQ ID NO: 296506 - DNA, 75 bp, Artificial Sequence
  Synthetic
agcgaaggacatcgaggaaaaatctctattatgaggaagaaacgcctaaggccgagcgacagggttatgttctcg

SEQ ID NO: 296507 - DNA, 75 bp, Artificial Sequence
  Synthetic
agcgaaggacatcgaggaaaaatctctattatgaggaagaaacgcctaaggccgagcgacagggctatgttctcg

SEQ ID NO: 296508 - DNA, 75 bp, Artificial Sequence
  Synthetic
agcgaaggacatcgaggaaaaatctctattatgaggaagaaacgcctaaggccgagcgacaggggtatgttctcg

SEQ ID NO: 296509 - DNA, 75 bp, Artificial Sequence
  Synthetic
gcgatacaatagtttcatgcgagggctacgttgttaaaaagatcacaatgagcccggggacgtacgggaagacgg

SEQ ID NO: 296510 - DNA, 75 bp, Artificial Sequence
  Synthetic
acaggaatcctggctaccgacgtcacacccgaagatgcgcagaaactactggtggggttgaaccaacgtatagtt

SEQ ID NO: 296511 - DNA, 75 bp, Artificial Sequence
  Synthetic
gtcattcaggtacactgttggctcttattgccatggtgaaaccaactggcaaggtgatcctatgcggagacccaa

SEQ ID NO: 296512 - DNA, 75 bp, Artificial Sequence
  Synthetic
cctatccataggcatacggcaaagaataaaactgctgttaggcccaaaactctcgcgagacctcccgtactctgg

SEQ ID NO: 296513 - DNA, 75 bp, Artificial Sequence
  Synthetic
gctgatgacgtcgatcaggtagatgtggaagagctgacgtaccgcgccggagcaggggtagtggagacacccagg

SEQ ID NO: 296514 - DNA, 75 bp, Artificial Sequence
  Synthetic
agcgcgatcagctgatcggcgcgtacctgatcttgtctccgcaaacagtactgaagagtgaaaaactcacaccga

SEQ ID NO: 296515 - DNA, 75 bp, Artificial Sequence
  Synthetic
ctgaagagtgaaaaactcacaccgatacatccactcgcggagcaagtgacaatcatgacgcactcaggaagatca

SEQ ID NO: 296516 - DNA, 75 bp, Artificial Sequence
  Synthetic
ctctacggccccgccctaaacactgatgaggagaactacgaaaaagtaagggcagagagagccgaagctgaatac

SEQ ID NO: 296517 - DNA, 75 bp, Artificial Sequence
  Synthetic
gtgtttgacgtcgacaagaggacgtgcgtgaagagagaagatgcatcaggcctcgtactagttggcgacttaatc

SEQ ID NO: 296518 - DNA, 75 bp, Artificial Sequence
  Synthetic
gacagcagtagacccgttccagaacaaagccaaagtctgctgggcaaagtgcctcgtgcaggtcctagaaacggc

SEQ ID NO: 296519 - DNA, 75 bp, Artificial Sequence
  Synthetic
atgaaggactgaagatacggcccgcaacgcctttccaaaccacggtcattggcgttttcggagtacctggttccg

SEQ ID NO: 296520 - DNA, 75 bp, Artificial Sequence
  Synthetic
atacgtggacgaagcatttgcctgtcattcaggtacactgttggcccttattgccatggtgaaaccaactggcaa

SEQ ID NO: 296521 - DNA, 75 bp, Artificial Sequence
  Synthetic
aactgcagatagactatcgtggacacgaagtcatgacagcagctgcatcacaaggactgactagaaaaggggtat

SEQ ID NO: 296522 - DNA, 75 bp, Artificial Sequence
  Synthetic
tacaagttaatgttccagagagaaaagtacagccattcaatgcggaatgtaatatattaccatcaaacaggcgac

SEQ ID NO: 296523 - DNA, 75 bp, Artificial Sequence
  Synthetic
ctctgaacgagatctgtaccaagtattacggcgttgacttagacagcggattgttctctgcccaatcggtctcat

SEQ ID NO: 296524 - DNA, 75 bp, Artificial Sequence
  Synthetic
caagttaatgttccagagagaaaagtacagccattcaatgcggaatgtaatatattactattaaacaggcgactt

SEQ ID NO: 296525 - DNA, 75 bp, Artificial Sequence
  Synthetic
taccatttattgctggtaagcgagtacaatctggcgttgccccataaaagagtattttggattgcaccaccccat

SEQ ID NO: 296526 - DNA, 75 bp, Artificial Sequence
  Synthetic
cgcaccactaccaacagtgcgtcgaccattccatgaagttacagatgttgggcggtgactccttacatctattga

SEQ ID NO: 296527 - DNA, 75 bp, Artificial Sequence
  Synthetic
cgcaccactaccaacagtgcgtcgaccattccatgaagttacagatgttgggcggtgactccttacatctattgt

SEQ ID NO: 296528 - DNA, 75 bp, Artificial Sequence
  Synthetic
cgcaccactaccaacagtgcgtcgaccattccatgaagttacagatgttgggcggtgactccttacatctattgc

SEQ ID NO: 296529 - DNA, 75 bp, Artificial Sequence
  Synthetic
cgcaccactaccaacagtgcgtcgaccattccatgaagttacagatgttgggcggtgactccttacatctattgg

SEQ ID NO: 296530 - DNA, 75 bp, Artificial Sequence
  Synthetic
agcgaaatggtggtcactgcattagctaggaagttttccgcctttagagtcctgagaccagcatgtgtaaccagt

SEQ ID NO: 296531 - DNA, 75 bp, Artificial Sequence
  Synthetic
gggcacagtcggcgttggggtttgcagagcggtggcgagaaaatggccagactccttcaaaggcgccgcgactcc

SEQ ID NO: 296532 - DNA, 75 bp, Artificial Sequence
  Synthetic
taaagatagagtcatgcagtcactaaatcacctgtttaccgcaatggacaccacggacgctgacgtagtcatcta

SEQ ID NO: 296533 - DNA, 75 bp, Artificial Sequence
  Synthetic
agagcggtggcgagaaaatggccagactccttcaaaggcgccgcgactcctgtgggtacggccaagttggtacag

SEQ ID NO: 296534 - DNA, 75 bp, Artificial Sequence
  Synthetic
ttggccgccgcataccgtgccgtggcgggtatcatcaatgctagtaacattaagagtgtagccatccctctgttg

SEQ ID NO: 296535 - DNA, 75 bp, Artificial Sequence
  Synthetic
cgggtatcatcaatgctagtaacattaagagtgtagccatccctctgttgtcgactggggtgttctccggaggta

SEQ ID NO: 296536 - DNA, 75 bp, Artificial Sequence
  Synthetic
accgccgtggaattggtatctgaagacatctcacttgagtctgatttgatacgggtgcacccggatagttgcttg

SEQ ID NO: 296537 - DNA, 75 bp, Artificial Sequence
  Synthetic
ggaaggtacccgctttcatcagactgcggtggatatggctgagatatctaccttgtggccgaaacttcaggacgc

SEQ ID NO: 296538 - DNA, 75 bp, Artificial Sequence
  Synthetic
ccttgtggccgaaacttcaggacgcaaacgaacaaatatgcttgtatgcattgggtgagagtatggacagtatca

SEQ ID NO: 296539 - DNA, 75 bp, Artificial Sequence
  Synthetic
cttcggatgaacaacactaaggccataattgtgtgctcctccttccctttaccgaagtacaggattgaaggcgtc

SEQ ID NO: 296540 - DNA, 75 bp, Artificial Sequence
  Synthetic
aaacgaacaaatatgcttgtatgcattgggtgagagtatggacagtatcagaacgaaatgtcctgtcgaggacgc

SEQ ID NO: 296541 - DNA, 75 bp, Artificial Sequence
  Synthetic
tgactgctgagagagtggcgaggcttcggatgaacaacactaaggccataattgtgtgctcttcattccctttac

SEQ ID NO: 296542 - DNA, 75 bp, Artificial Sequence
  Synthetic
ccagccgccgcctctacgcacgcagataccgtgagcttggattctacagtatccacaggatccgcgtggtcattc

SEQ ID NO: 296543 - DNA, 75 bp, Artificial Sequence
  Synthetic
gaaggtcaagtgcgaccgagtgctgatttttgaccagacggtgccatctctggttagtccaaggaaatacatacc

SEQ ID NO: 296544 - DNA, 75 bp, Artificial Sequence
  Synthetic
ccattccttgcacgagtgagtatgcaacccccataccaacaccacgggcagtaagggtcgtacccgtgccggcac

SEQ ID NO: 296545 - DNA, 75 bp, Artificial Sequence
  Synthetic
cacgcattcagcgagcgtcgacgtacagggtctctcctacacccacgcctcgcgttctgagagcctcggtatgca

SEQ ID NO: 296546 - DNA, 75 bp, Artificial Sequence
  Synthetic
gttcccttgggcgcctgaagatctggaggtactcaccgagcctgtgcattgcgaaatgcgcgagccggttgagtt

SEQ ID NO: 296547 - DNA, 75 bp, Artificial Sequence
  Synthetic
ggcagaacagtcagagaagattccaacctatgctagtaagtacccgcggccagtttactcgccgtcggtagagga

SEQ ID NO: 296548 - DNA, 75 bp, Artificial Sequence
  Synthetic
agaactacctactctagactcagcagtgtttaacgtggaatgcttcaaaaaatttgcatgcaatggagaatactg

SEQ ID NO: 296549 - DNA, 75 bp, Artificial Sequence
  Synthetic
gtgtttaacgtggaatgcttcaaaaaatttgcatgcaatggagaatactggcaggaattcaaagatgacccaata

SEQ ID NO: 296550 - DNA, 75 bp, Artificial Sequence
  Synthetic
agaataactacagagaacataacaacttatgtcactaggcttaagggccctaaagcagcagcgctgtttgcgaag

SEQ ID NO: 296551 - DNA, 75 bp, Artificial Sequence
  Synthetic
cttatgtcactaggcttaagggccctaaagcagcagcgctgtttgcgaagactcacaatttagtcccgctgcaag

SEQ ID NO: 296552 - DNA, 75 bp, Artificial Sequence
  Synthetic
aggtgcccatggaccggtttgtggtagatatgaagagagacgtgaaagttacccctggcactaaacatactgagg

SEQ ID NO: 296553 - DNA, 75 bp, Artificial Sequence
  Synthetic
ccatcatagccgcacatttccaaccaggtgacgcagttttggaaacggacatagcctcctttgacaagagccaag

SEQ ID NO: 296554 - DNA, 75 bp, Artificial Sequence
  Synthetic
atgactctttggcgttgacggcactgatgctgttggaggacctcggggttgaccaagaactactagacctgatag

SEQ ID NO: 296555 - DNA, 75 bp, Artificial Sequence
  Synthetic
cgtccacctgccaacaggtacgcggttcaagtttggcgccatgatgaagtccggaatgtttctgacactatttat

SEQ ID NO: 296556 - DNA, 75 bp, Artificial Sequence
  Synthetic
ggctgaaaggtgcgccagctgggttaatatggaggtaaagataattgacgctaccatgtgcgagaaaccaccata

SEQ ID NO: 296557 - DNA, 75 bp, Artificial Sequence
  Synthetic
tctgcggcgggtttatactgtatgacaatgtcaccggctcggcgtgccgagtggccgaccctctgaaaaggttat

SEQ ID NO: 296558 - DNA, 75 bp, Artificial Sequence
  Synthetic
aggcgtgcattgaaggatgagacggataggtgggcacgagtagggttgaagtctgaactggaaatagcactaagt

SEQ ID NO: 296559 - DNA, 75 bp, Artificial Sequence
  Synthetic
aaaaaactgcgtggacccattgtacacctctacggcggtcctaaatagatgcagagacactccttcatctacagc

SEQ ID NO: 296560 - DNA, 75 bp, Artificial Sequence
  Synthetic
ctgcaagcaccggacctacaggctcaacagatgcaacaactgatcagcgcagtctctgcactaaccaccaaacag

SEQ ID NO: 296561 - DNA, 75 bp, Artificial Sequence
  Synthetic
ccaaaggaaaagaaggaaaaccagaagaaaaagccgacgcaaaagaagaagcagcagcagaaaccaaaaccacag

SEQ ID NO: 296562 - DNA, 75 bp, Artificial Sequence
  Synthetic
cggctcacgttaaaggcacaattgataacccagaccttgcgaagttgacttacaagaaatccagtaagtatgacc

SEQ ID NO: 296563 - DNA, 75 bp, Artificial Sequence
  Synthetic
tgacctcgaatgcgcccagataccagtgcacatgaagtccgacgcctccaagtacacacatgaaaaacccgaagg

SEQ ID NO: 296564 - DNA, 75 bp, Artificial Sequence
  Synthetic
tgactgcggggacgggtacttctgctatagcccggttgctatcgagaagatccgagatgaggcgtctgatggcat

SEQ ID NO: 296565 - DNA, 75 bp, Artificial Sequence
  Synthetic
gacgatgggacacttcatcgtcgcacactgtccaccaggcgactacctcaaggattcgttcgaggacgcaaattc

SEQ ID NO: 296566 - DNA, 75 bp, Artificial Sequence
  Synthetic
gacgatgggacacttcatcgtcgcacactgtccaccaggcgactacctcaaggtttcgttcgaggacgcaaattc

SEQ ID NO: 296567 - DNA, 75 bp, Artificial Sequence
  Synthetic
gacgatgggacacttcatcgtcgcacactgtccaccaggcgactacctcaaggcttcgttcgaggacgcaaattc

SEQ ID NO: 296568 - DNA, 75 bp, Artificial Sequence
  Synthetic
gacgatgggacacttcatcgtcgcacactgtccaccaggcgactacctcaagggttcgttcgaggacgcaaattc

SEQ ID NO: 296569 - DNA, 75 bp, Artificial Sequence
  Synthetic
gaagatccgagatgaggcgtctgacggcatgctcaagatccaagtctccgcccaaataggtctggacaaggcagg

SEQ ID NO: 296570 - DNA, 75 bp, Artificial Sequence
  Synthetic
ggtgggtagagagaagttcgtggttagaccccactttggcgtagagctgccatgcacctcataccagctgacaac

SEQ ID NO: 296571 - DNA, 75 bp, Artificial Sequence
  Synthetic
gttaccagccatgacaaatggaaatttacctctccatttgttcccagggctgatcagacagccaggaaaggcaaa

SEQ ID NO: 296572 - DNA, 75 bp, Artificial Sequence
  Synthetic
gttaccagccatgacaaatggtaatttacctctccatttgttcccagggctgatcagacagccaggaaaggcaaa

SEQ ID NO: 296573 - DNA, 75 bp, Artificial Sequence
  Synthetic
gttaccagccatgacaaatggcaatttacctctccatttgttcccagggctgatcagacagccaggaaaggcaaa

SEQ ID NO: 296574 - DNA, 75 bp, Artificial Sequence
  Synthetic
gttaccagccatgacaaatgggaatttacctctccatttgttcccagggctgatcagacagccaggaaaggcaaa

SEQ ID NO: 296575 - DNA, 75 bp, Artificial Sequence
  Synthetic
aagaaggaggtgaccctaagattacacccagatcatccgacgcacttctcctataggagtttaggagccgtaccg

SEQ ID NO: 296576 - DNA, 75 bp, Artificial Sequence
  Synthetic
aagaaggaggtgaccctaagattacacccagatcatccgacgctcttctcctataggagtttaggagccgtaccg

SEQ ID NO: 296577 - DNA, 75 bp, Artificial Sequence
  Synthetic
aagaaggaggtgaccctaagattacacccagatcatccgacgcccttctcctataggagtttaggagccgtaccg

SEQ ID NO: 296578 - DNA, 75 bp, Artificial Sequence
  Synthetic
aagaaggaggtgaccctaagattacacccagatcatccgacgcgcttctcctataggagtttaggagccgtaccg

SEQ ID NO: 296579 - DNA, 75 bp, Artificial Sequence
  Synthetic
taccagtactgacaagaccatcaacacatgcaagattgaccaatgccatgctgccgttaccagccatgacaaatg

SEQ ID NO: 296580 - DNA, 75 bp, Artificial Sequence
  Synthetic
tggggtaacaacccgccggtccgcctgtgggcgcaactgacgactgagggtaaaccccatggctggccacatgaa

SEQ ID NO: 296581 - DNA, 75 bp, Artificial Sequence
  Synthetic
tgctggccaccgcgaggagaaagtgcctaacaccgtacgctttgacgccaggagcggtggtaccgttgacattgg

SEQ ID NO: 296582 - DNA, 75 bp, Artificial Sequence
  Synthetic
ggaacccacacttaacctggagtacattacctgcgaatacaagacggtggtcccttcgccatttatcaaatgttg

SEQ ID NO: 296583 - DNA, 75 bp, Artificial Sequence
  Synthetic
gtggggtggagcttactgtttctgcgactccgagaacacgcagcttagcgaggcctatgtcgacaggtcagacgt

SEQ ID NO: 296584 - DNA, 75 bp, Artificial Sequence
  Synthetic
ccgggaagattcggagacatccagagcaggacagtggagagcaaagacttgtatgctaatacggccctaaaactc

SEQ ID NO: 296585 - DNA, 75 bp, Artificial Sequence
  Synthetic
ccgggtagattcggagacatccagagcaggacagtggagagcaaagacttgtatgctaatacggccctaaaactc

SEQ ID NO: 296586 - DNA, 75 bp, Artificial Sequence
  Synthetic
ccgggcagattcggagacatccagagcaggacagtggagagcaaagacttgtatgctaatacggccctaaaactc

SEQ ID NO: 296587 - DNA, 75 bp, Artificial Sequence
  Synthetic
ccggggagattcggagacatccagagcaggacagtggagagcaaagacttgtatgctaatacggccctaaaactc

SEQ ID NO: 296588 - DNA, 75 bp, Artificial Sequence
  Synthetic
ttcactcacattccaacgtcgcaacgttgcaagaggcgacggtggatgtcaaggaggatggcaaggtcacagtgc

SEQ ID NO: 296589 - DNA, 75 bp, Artificial Sequence
  Synthetic
ggccagtgggttaggtgggctggccctcatcgcggtggttgtgctggtcttggtaacctgcataacaatgcgtcg

SEQ ID NO: 296590 - DNA, 75 bp, Artificial Sequence
  Synthetic
ctcatcgcggtggttgtgctggtcttggtaacctgcataacaatgcgtcggtaagtttaaagggggctatattac

SEQ ID NO: 296591 - DNA, 75 bp, Artificial Sequence
  Synthetic
ccctgttaagtactaaccaacaagtagacaaatagacgctaaccacatatataaccagctatagcatactatatt

SEQ ID NO: 296592 - DNA, 75 bp, Artificial Sequence
  Synthetic
agacaaatagacgctaaccacatatataaccagctatagcatactatattcagctaagcagttgtagtagtaagg

SEQ ID NO: 296593 - DNA, 75 bp, Artificial Sequence
  Synthetic
aggagaaaggatcttcattgaatacaaaggccccttttggctgcaagataaagaccaatccagtcagagccatgg

SEQ ID NO: 296594 - DNA, 75 bp, Artificial Sequence
  Synthetic
aattgactagccgaactctaaggagatgtaggcgtccgaactctacggagatgtaggactaaattctgccgaacc

SEQ ID NO: 296595 - DNA, 75 bp, Artificial Sequence
  Synthetic
tggcggacgtgtgacatcaccgttcgcctttcttggatcccttgttactccaccgcagtgagagataaacaaccc

SEQ ID NO: 296596 - DNA, 75 bp, Artificial Sequence
  Synthetic
atctccaacgttctgtctccacaccgatgagacgtgtcgcactagggctgaagtagctgtgtaccaggacgtgta

SEQ ID NO: 296597 - DNA, 75 bp, Artificial Sequence
  Synthetic
tagtgcacccatccagatagacacaacaggtaccactaaaccagccaaaggagacatcgtgttaacgtgcttccg

SEQ ID NO: 296598 - DNA, 75 bp, Artificial Sequence
  Synthetic
cctggcggctcactgcttatccgtgcttacgggtacgccgacagagtcagcgaaatggtggtcactgcattagct

SEQ ID NO: 296599 - DNA, 75 bp, Artificial Sequence
  Synthetic
tccccggccttcaaagtgtccgtctgtgacgcaaaaacaacgtgcacggcggcgtgcgagcctccaaaagaccac

SEQ ID NO: 296600 - DNA, 75 bp, Artificial Sequence
  Synthetic
caccaaaagggcaacggaaacagaaacagcagaaaccaaaggaaaagaaggaaaaacagaagaaaaagccgacgc

SEQ ID NO: 296601 - DNA, 75 bp, Artificial Sequence
  Synthetic
ggaaggtttaccatccccacaggcgccggcaaaccaggagatagcggtaggcctatttttgacaacaaagggcga

SEQ ID NO: 296602 - DNA, 75 bp, Artificial Sequence
  Synthetic
cagaaacagatcacgccaccgccgcagtgtaatagagcacttcaatgtgtataaggctactagaccgtacttagc

SEQ ID NO: 296603 - DNA, 75 bp, Artificial Sequence
  Synthetic
tgcgcaccgagggcgaacgcagcatcatttgctgagactatggcctatctgtgggacgagaacaaaaccctcttt

SEQ ID NO: 296604 - DNA, 75 bp, Artificial Sequence
  Synthetic
gggcgaacgcagcatcatttgctgagactatggcctatctgtgggacgagaacaaaaccctcttttggatggaat

SEQ ID NO: 296605 - DNA, 75 bp, Artificial Sequence
  Synthetic
gcgcttgctttgctggcatgctgtatcaaaagcctgatctgctgttgtaagccattttcttttttagtgttactg

SEQ ID NO: 296606 - DNA, 75 bp, Artificial Sequence
  Synthetic
ccatataaacccctgaatagtaacaaaatataaaaattacaaaatatgtagttcaaagggctatactacccctga

SEQ ID NO: 296607 - DNA, 75 bp, Artificial Sequence
  Synthetic
gcaaaagcttatgagcacacagccacaattccgaacgtggtggggttcccgtataaggctcacattgaaaggaat

SEQ ID NO: 296608 - DNA, 75 bp, Artificial Sequence
  Synthetic
caagcttggaacccacacttaacctggagtacattacctgcgaatacaagacggtggtcccttcgccatttatca

SEQ ID NO: 296609 - DNA, 75 bp, Artificial Sequence
  Synthetic
gttgccacattgtcttacaagacggacaaacccggcaagtgcgccgttcactcacattccaacgtcgcaacgttg

SEQ ID NO: 296610 - DNA, 75 bp, Artificial Sequence
  Synthetic
gtccgcctccccggcattcaaagtgtccgtctgtgacgcaaaaacaacgtgcacggcggcgtgcgagcctccgaa

SEQ ID NO: 296611 - DNA, 75 bp, Artificial Sequence
  Synthetic
ttaaaattttacaaaaaaaaaaaaaaaaaaaaaaaaaaaaaaaaaaaaaaaaaaaaaaaaaaaaaaaaaaaaaaa

SEQ ID NO: 296612 - DNA, 75 bp, Artificial Sequence
  Synthetic
ttaatattttacaaaaaaaaaaaaaaaaaaaaaaaaaaaaaaaaaaaaaaaaaaaaaaaaaaaaaaaaaaaaaaa

SEQ ID NO: 296613 - DNA, 75 bp, Artificial Sequence
  Synthetic
ttaacattttacaaaaaaaaaaaaaaaaaaaaaaaaaaaaaaaaaaaaaaaaaaaaaaaaaaaaaaaaaaaaaaa

SEQ ID NO: 296614 - DNA, 75 bp, Artificial Sequence
  Synthetic
ttaagattttacaaaaaaaaaaaaaaaaaaaaaaaaaaaaaaaaaaaaaaaaaaaaaaaaaaaaaaaaaaaaaaa

SEQ ID NO: 296615 - DNA, 75 bp, Artificial Sequence
  Synthetic
cgcccgcaaggaggttgatgtctgaccacagctaccattgcgtttgtcccatgaagagtgcggaagacccagaga

SEQ ID NO: 296616 - DNA, 75 bp, Artificial Sequence
  Synthetic
atgaagagtgcggaagacccagagaggctagcaaactatgcccggaaactggcaaaagcggcaggggaagtgcta

SEQ ID NO: 296617 - DNA, 75 bp, Artificial Sequence
  Synthetic
ccgacctcgctttatcatcaagcgatgaaaggggttaggacagtatactggataggattcgacaccaccccattc

SEQ ID NO: 296618 - DNA, 75 bp, Artificial Sequence
  Synthetic
catcttccctccgtgttccacctgaaaggcaagaatagctttacttgcaggtgtgatacagtagtctcatgcgag

SEQ ID NO: 296619 - DNA, 75 bp, Artificial Sequence
  Synthetic
ggtcggatacgccgttacgcaccatgcagaaggtttcctaatgtgcaaggtgacggacactgtgcgcggggagag

SEQ ID NO: 296620 - DNA, 75 bp, Artificial Sequence
  Synthetic
tgacaggaatcctggctaccgacgtcacacccgaggatgcgcagaaactactggtggggttaaaccaacgtatag

SEQ ID NO: 296621 - DNA, 75 bp, Artificial Sequence
  Synthetic
ttgtgaatggcagaacccaaagaaataccaacacaatgaaaaactacctattgccggtagtggcccaagctttca

SEQ ID NO: 296622 - DNA, 75 bp, Artificial Sequence
  Synthetic
gaataaaactgctattaggcccaaaactctcgcgagacctcccgtactctggagaccgaaacgaagcgcgggaag

SEQ ID NO: 296623 - DNA, 75 bp, Artificial Sequence
  Synthetic
tactgaagagtgaaaaactcacaccgatacatccactggcagagcaagtgacaatcatgacgcactcaggaagat

SEQ ID NO: 296624 - DNA, 75 bp, Artificial Sequence
  Synthetic
ttcaagcactcagtgagagtgctactatggtctacaatgaacgtgagttcatcaatcgcaaattgcaccatatag

SEQ ID NO: 296625 - DNA, 75 bp, Artificial Sequence
  Synthetic
cactctacggccccgccctaaacactgatgaggagaactatgaaaaagtaagggcagagagagccgaagctgaat

SEQ ID NO: 296626 - DNA, 75 bp, Artificial Sequence
  Synthetic
acgtgtttgacgttgacaagaggacgtgcgtgaagagagaagaagcatcaggccttgtactggtcggtgacttaa

SEQ ID NO: 296627 - DNA, 75 bp, Artificial Sequence
  Synthetic
tcaaccctcctttccatgagtttgcgtatgaaggactgaagatacggcccgcaacgcctttccagaccacggtca

SEQ ID NO: 296628 - DNA, 75 bp, Artificial Sequence
  Synthetic
gtatgaaggactgaagatacggcccgcaacgcctttccagaccacggtcattggcgttttcggggtacctggttc

SEQ ID NO: 296629 - DNA, 75 bp, Artificial Sequence
  Synthetic
gtcattcgggtacactgttggcccttattgccatggtgaaaccaactggcaaggtgatcctgtgcggagatccaa

SEQ ID NO: 296630 - DNA, 75 bp, Artificial Sequence
  Synthetic
cacgaagtcatgacagcagctgcatcacaaggattgactagaaaaggggtatacgccgttaggcagaaagtgaac

SEQ ID NO: 296631 - DNA, 75 bp, Artificial Sequence
  Synthetic
acggattcaaccgcgaagtcgcccgtaagtttgagcaacgctacccattcctaagaggcaagatggacttggggc

SEQ ID NO: 296632 - DNA, 75 bp, Artificial Sequence
  Synthetic
ttccgcacgccctcgtcaccagctaccagcagtgccggggcgagagggtagaatggcttttgaagaagcttcccg

SEQ ID NO: 296633 - DNA, 75 bp, Artificial Sequence
  Synthetic
gataccatttattgctggtaagcgagtacaatctggcgctgccccacaaaagggtcttttggattgcaccacccc

SEQ ID NO: 296634 - DNA, 75 bp, Artificial Sequence
  Synthetic
caacgggctacacacagccggatgcgcaccctcataccgtgtgcgcaggaccgacatttccgggcacgctgaaga

SEQ ID NO: 296635 - DNA, 75 bp, Artificial Sequence
  Synthetic
gcaccctcataccgtgtgcgcaggaccgacatttccgggcacgctgaagaggcggttgtcaatgccgccaatgcg

SEQ ID NO: 296636 - DNA, 75 bp, Artificial Sequence
  Synthetic
gtgaccgaggcagagggcgacagagagctggccgccgcataccgtgccgtggcgggtatcatcaatgccagtaac

SEQ ID NO: 296637 - DNA, 75 bp, Artificial Sequence
  Synthetic
aatcatctgtttaccgcaatggacaccacggacgctgacatagttatctactgtcgcgacaaagcctgggagaag

SEQ ID NO: 296638 - DNA, 75 bp, Artificial Sequence
  Synthetic
gcaccgccgtggaattggtatctgaagacatctcactcgagtctgacttgatacgggtgcacccggatagttgct

SEQ ID NO: 296639 - DNA, 75 bp, Artificial Sequence
  Synthetic
gcaaacgagcaaatatgcttgtatgcattgggtgagagtatggacagtatcagaacgaaatgccctgtcgaggac

SEQ ID NO: 296640 - DNA, 75 bp, Artificial Sequence
  Synthetic
gccgattcgtccacgcctccaaaaacagttccgtgtctgtgtaggtatgctatgactgctgagagagtggcgagg

SEQ ID NO: 296641 - DNA, 75 bp, Artificial Sequence
  Synthetic
ccagccgccgcctctatgcacgcagataccgtgagtttggactctacagtattgcacgcagataccgtgagtttg

SEQ ID NO: 296642 - DNA, 75 bp, Artificial Sequence
  Synthetic
ataccgtgagtttggactctacagtattgcacgcagataccgtgagtttggattctacagtatctacaggatctg

SEQ ID NO: 296643 - DNA, 75 bp, Artificial Sequence
  Synthetic
gcaggtgacgatgcaccaccaggagctgttggaagtctccgacatgcacaccccgattgcggcaagggtcgagat

SEQ ID NO: 296644 - DNA, 75 bp, Artificial Sequence
  Synthetic
ctgttggaagtctccgacatgcacaccccgattgcggcaagggtcgagatccctgcgtacgataccgctgttgta

SEQ ID NO: 296645 - DNA, 75 bp, Artificial Sequence
  Synthetic
gtggagagagtggcaattccttgcataagcgagtatgcaaccccaataccagcaccgcacgcagcaagggtcgtt

SEQ ID NO: 296646 - DNA, 75 bp, Artificial Sequence
  Synthetic
taagcgagtatgcaaccccaataccagcaccgcacgcagcaagggtcgttcccatgccggcaccgcgcattcagc

SEQ ID NO: 296647 - DNA, 75 bp, Artificial Sequence
  Synthetic
gagcgtcgacgtacagagtctctcctacacccacgcctcgcgttctgaaagcctcagtatgcagtgtgaccacta

SEQ ID NO: 296648 - DNA, 75 bp, Artificial Sequence
  Synthetic
tacacccacgcctcgcgttctgaaagcctcagtatgcagtgtgaccactagcgctggggtagagttcccttgggc

SEQ ID NO: 296649 - DNA, 75 bp, Artificial Sequence
  Synthetic
acctgaagatctggaggtacttaccgagcctgtgcactgcgaaatgcgcgagccggttgagttaccgtgggagcc

SEQ ID NO: 296650 - DNA, 75 bp, Artificial Sequence
  Synthetic
ggaggacattgacatccaattcggagattttgaaacacccgacaaaatccaattcggcgacatcgattttgacca

SEQ ID NO: 296651 - DNA, 75 bp, Artificial Sequence
  Synthetic
attctgactaggcagagcgggggcgtacatcttctcgtctgataccggaccggggcacttacaacagaagtcagt

SEQ ID NO: 296652 - DNA, 75 bp, Artificial Sequence
  Synthetic
tacatcttctcgtctgataccggaccggggcacttacaacagaagtcagtacggcaacacgcactaccatgcgaa

SEQ ID NO: 296653 - DNA, 75 bp, Artificial Sequence
  Synthetic
aaaatgcagatggcacctacggaagcaaacaagagtaggtaccaatcaaggaaggttgaaaatatgaaggcagtg

SEQ ID NO: 296654 - DNA, 75 bp, Artificial Sequence
  Synthetic
caagaatctacctgacagaacagtcagagaagattccaacctatgttagtaagtacccgcggccagtttactcgc

SEQ ID NO: 296655 - DNA, 75 bp, Artificial Sequence
  Synthetic
tagaccgggctaccttctgcccggcaaaattacgctgctacccaaagcatcatgcttaccaccaaccgcaggtta

SEQ ID NO: 296656 - DNA, 75 bp, Artificial Sequence
  Synthetic
gcagccacgaagagaaattgcaatgttacgcagatgagagagctacccactttagactcagccgtgtttaacgtg

SEQ ID NO: 296657 - DNA, 75 bp, Artificial Sequence
  Synthetic
ggcttaagggccctaaagcggcagcgctgtttgcgaagactcacaacttagtcccgctgcaggaggtgcccatgg

SEQ ID NO: 296658 - DNA, 75 bp, Artificial Sequence
  Synthetic
tgcaagtcatccaggctgccgaacctttagctacagcttatttatgcggcattcacagggagttggtccgtcgcc

SEQ ID NO: 296659 - DNA, 75 bp, Artificial Sequence
  Synthetic
tgaaggccgtcctggccccgaacatacatacattgttcgatatgtcggcagaagattttgatgccatcatagctg

SEQ ID NO: 296660 - DNA, 75 bp, Artificial Sequence
  Synthetic
ggacctcggggttgaccaagaactactagacctgatagaggcagcgtttggggaaattaccagcgtccacctgcc

SEQ ID NO: 296661 - DNA, 75 bp, Artificial Sequence
  Synthetic
gggaaattaccagcgtccacctgccaacaggtacgcggttcaagttcggcgctatgatgaagtccggaatgttcc

SEQ ID NO: 296662 - DNA, 75 bp, Artificial Sequence
  Synthetic
caacatagtgcacggggtaagatctgacccgttgatggctgaaaggtgcgccagctgggttaatatggaggtaaa

SEQ ID NO: 296663 - DNA, 75 bp, Artificial Sequence
  Synthetic
ctgaaaaggttatttaaattaggtaaacctttacccgccggagacacccaagatgaagatcgtaggcgtgcattg

SEQ ID NO: 296664 - DNA, 75 bp, Artificial Sequence
  Synthetic
aatagcactaagttcccggtatgaggtgaacgggaccggcaacatagtgcgagcaatggccacactggccaagag

SEQ ID NO: 296665 - DNA, 75 bp, Artificial Sequence
  Synthetic
gtgaacgggaccggcaacatagtgcgagcaatggccacactggccaagagcttgaagaattttaaaaagctgcgt

SEQ ID NO: 296666 - DNA, 75 bp, Artificial Sequence
  Synthetic
ggacccattgtacacctctacggtggtcctaaatagatgcagagacacaccttcatctaatacagctcacaacag

SEQ ID NO: 296667 - DNA, 75 bp, Artificial Sequence
  Synthetic
aacagcagaaaccaaaggaaaagaaggaaaaacagaagaaaaagccgacgcaaaagaaaaagcagcagcagaaac

SEQ ID NO: 296668 - DNA, 75 bp, Artificial Sequence
  Synthetic
atgaagatcgagaatgactgcatattcgaggtcaaactggacggcaaggttaccggttatgcgtgcctagtcgga

SEQ ID NO: 296669 - DNA, 75 bp, Artificial Sequence
  Synthetic
gccaacgaaggtgctcgcactgcgctgtctgtggtgacgtggacaaaagacatggtcactcgggtaacgccagaa

SEQ ID NO: 296670 - DNA, 75 bp, Artificial Sequence
  Synthetic
agccagaacagacactgcggatgctggaagacaacgtgaacagacctgggtactatgagttactggaagcgtcca

SEQ ID NO: 296671 - DNA, 75 bp, Artificial Sequence
  Synthetic
ggaagacaacgtgaacagacctgggtactatgagttactggaagcgtccatgacatgccgaaacggatcacgcca

SEQ ID NO: 296672 - DNA, 75 bp, Artificial Sequence
  Synthetic
ccgccgtagtgtaacagagcacttcaatgtgtataaggctactagaccatacctagcacattgcgctgattgcgg

SEQ ID NO: 296673 - DNA, 75 bp, Artificial Sequence
  Synthetic
aatgtgtataaggctactagaccatacctagcacattgcgctgattgcggggacgggtacttctgctatagccca

SEQ ID NO: 296674 - DNA, 75 bp, Artificial Sequence
  Synthetic
ccaagtctccgcccaaataggtctggacaaggcaggcacccacgcccacacgaagctccgatatatggctggtca

SEQ ID NO: 296675 - DNA, 75 bp, Artificial Sequence
  Synthetic
ccaggcgactacctcaaggtttcgttcgaggacgcagattcgcacgtgaaggcatgtaaggtccaatacaagcac

SEQ ID NO: 296676 - DNA, 75 bp, Artificial Sequence
  Synthetic
agttcgtggttagaccacactttggcgtagagctgccatgcacctcataccagctgacaacggctcccaccgacg

SEQ ID NO: 296677 - DNA, 75 bp, Artificial Sequence
  Synthetic
ccaatgccatgctgccgtcaccagccatgacaaatggcaatttacctctccatttgttcccagggctgatcagac

SEQ ID NO: 296678 - DNA, 75 bp, Artificial Sequence
  Synthetic
agctaggaaaggcaaggtacacgttccgttccctctgactaacgtcacctgccgagtgccgttggctcgagcgcc

SEQ ID NO: 296679 - DNA, 75 bp, Artificial Sequence
  Synthetic
gtgaccctgagattacacccagatcatccgacactcttctcctataggagtttaggagccgaaccgcacccgtac

SEQ ID NO: 296680 - DNA, 75 bp, Artificial Sequence
  Synthetic
agggattgaataccagtggggcaacaacccgccggtccgcctgtgggcgcaactgacgaccgagggcaaacccca

SEQ ID NO: 296681 - DNA, 75 bp, Artificial Sequence
  Synthetic
gagtctgatggccctcctaactctggcggccacatgctgcatgctggccaccgcgaggagaaagtgcctaacacc

SEQ ID NO: 296682 - DNA, 75 bp, Artificial Sequence
  Synthetic
atcattcgctgagactatggcctatctgtgggacgagaacaaaaccctcttttggatggaatttgcggccccggc

SEQ ID NO: 296683 - DNA, 75 bp, Artificial Sequence
  Synthetic
gtaagccattctcttttttagtgttactgagcctgggagcctccgtaaaagcttacgagcacacggccacaattc

SEQ ID NO: 296684 - DNA, 75 bp, Artificial Sequence
  Synthetic
catttatcaaatgttgcggaacatcagaatgctcatctaaagagcagccagactaccaatgcaaggtatacacgg

SEQ ID NO: 296685 - DNA, 75 bp, Artificial Sequence
  Synthetic
gcgtataccctttcatgtggggtggagcctactgcttctgcgactccgagaacacgcagcttagcgaggcctatg

SEQ ID NO: 296686 - DNA, 75 bp, Artificial Sequence
  Synthetic
agcctactgcttctgcgactccgagaacacgcagcttagcgaggcctatgtcgacaggtctgacatttgcaaaca

SEQ ID NO: 296687 - DNA, 75 bp, Artificial Sequence
  Synthetic
tgatcatgcattggcctacaaggcacacacagcctctctaaaagcaacaatcaggatcagctacggcaccatcaa

SEQ ID NO: 296688 - DNA, 75 bp, Artificial Sequence
  Synthetic
cacacagcctctctaaaagcaacaatcaggatcagctacggcaccatcaaccagaccaccgaggccttcgtcaat

SEQ ID NO: 296689 - DNA, 75 bp, Artificial Sequence
  Synthetic
ctcaacagcttggtcaccgttcgacaataaaattgtcgtgtataaagatgatgtctacaaccaggactttccacc

SEQ ID NO: 296690 - DNA, 75 bp, Artificial Sequence
  Synthetic
ctatggatcaggtcagccgggtagattcggagacattcagagcaggacagtggagagcaaagacctgtacgccaa

SEQ ID NO: 296691 - DNA, 75 bp, Artificial Sequence
  Synthetic
cacggccctaaaactctcaagaccatcacccggggtcgtgcatgtgccatacacgcagacaccatccggatttaa

SEQ ID NO: 296692 - DNA, 75 bp, Artificial Sequence
  Synthetic
actcctccgacttcggaggagttgccacattgtcttacaagacggacaaacccggcaagtgcgctgtccactcac

SEQ ID NO: 296693 - DNA, 75 bp, Artificial Sequence
  Synthetic
attccaatgtcgcaacgctgcaagaggcgacggtggatgtcaaggaggacggcaaggtcacggtgcacttttcca

SEQ ID NO: 296694 - DNA, 75 bp, Artificial Sequence
  Synthetic
cggcgtccgcctccccggcattcaaagtgtccgtctgtgacgcaaaaacaacgtgcacagcggcgtgtgagcctc

SEQ ID NO: 296695 - DNA, 75 bp, Artificial Sequence
  Synthetic
gttaggcgggctggctctcatcgcggtgcttgtgctggtcttggtaacctgcataacaatgcgtcggtaagcatt

SEQ ID NO: 296696 - DNA, 75 bp, Artificial Sequence
  Synthetic
caaaatatgtagttcaaagggctatactacccctgattagtaacaaaatagaaaattacaaaaatatgtagttaa

SEQ ID NO: 296697 - DNA, 75 bp, Artificial Sequence
  Synthetic
gtattataagatgtgtagttcaaagggctataatacccctgattagtaacaaaatataaaaataaaaacatgtag

SEQ ID NO: 296698 - DNA, 75 bp, Artificial Sequence
  Synthetic
gtaagtactaaccaataagtagacaaatatatgctaaccatatatataaccagctacagtatactatatttagtt

SEQ ID NO: 296699 - DNA, 75 bp, Artificial Sequence
  Synthetic
aatatatgctaaccatatatataaccagctacagtatactatatttagttaagcagttgcagtagttaagaatgt

SEQ ID NO: 296700 - DNA, 75 bp, Artificial Sequence
  Synthetic
agttcaaagggctatacaacccctgaatagtaacaaaatacaaaaatactaataaaaattttaaaaatcacaaga

SEQ ID NO: 296701 - DNA, 75 bp, Artificial Sequence
  Synthetic
ggcgtccgaactctacggagatgtaggactaaattctgccgaaccccataacaccggggacgtaggcgtctaatt

SEQ ID NO: 296702 - DNA, 75 bp, Artificial Sequence
  Synthetic
tttgtttttaatattttacaaaaaaaaaaaaaaaaaaaaaaaaaaaaaaaaaaaaaaaaaaaaaaaaaaaaaaaa

SEQ ID NO: 296703 - DNA, 75 bp, Artificial Sequence
  Synthetic
gccggatacccaaactatagtcaaggtgccatctacttttgactcgtttgtgatcccaagcctgtggtcatccag

SEQ ID NO: 296704 - DNA, 75 bp, Artificial Sequence
  Synthetic
gccaacggtatgaatgtcatccacgcggtaggcccaaatttctccacggtgaccgaggcagagggcgatagagag

SEQ ID NO: 296705 - DNA, 75 bp, Artificial Sequence
  Synthetic
ctgacatgcacaccccgattgcggcaagggtcgagatccctgtgtacgataccgctgttgtagtggagagagtgg

SEQ ID NO: 296706 - DNA, 75 bp, Artificial Sequence
  Synthetic
accgtgggagcctgaggacgttgatatccagttcggagattttgaaacatccgacaaaatccaattcggcgacat

SEQ ID NO: 296707 - DNA, 75 bp, Artificial Sequence
  Synthetic
caaagtcaccggatcggcatgccgagtggccgaccctctgaaaaggttatttaaactaggtaaacctttacccgc

SEQ ID NO: 296708 - DNA, 75 bp, Artificial Sequence
  Synthetic
gtggccgaccctctgaaaaggttatttaaactaggtaaacctttacccgccggggatacccaagatgaagatcgt

SEQ ID NO: 296709 - DNA, 75 bp, Artificial Sequence
  Synthetic
gtaacagacctgagctgccaggtagcggtctgtacacactcctccgatttcggaggagttgccacattgtcttac

SEQ ID NO: 296710 - DNA, 75 bp, Artificial Sequence
  Synthetic
cgtcccctatggggcgagccacaacaaccaggtctttccggacatgtcaggaactgcgatgacgtgggtgcagag

SEQ ID NO: 296711 - DNA, 75 bp, Artificial Sequence
  Synthetic
taagcagttgcagtagtaagaatgtagttcaaagggctatacaacccctgaatagtaacaaaatacaaaaatact

SEQ ID NO: 296712 - DNA, 75 bp, Artificial Sequence
  Synthetic
atggcggacgtgtgacatcaccgttcgctctttctaggatcctttgctactccacatagtgagagacaaacaacc

SEQ ID NO: 296713 - DNA, 75 bp, Artificial Sequence
  Synthetic
cgctctttctaggatcctttgctactccacatagtgagagacaaacaacccaaatgaaggtaaccgtggacgttg

SEQ ID NO: 296714 - DNA, 75 bp, Artificial Sequence
  Synthetic
tccacatagtgagagacaaacaacccaaatgaaggtaaccgtggacgttgaggctgatagcccattccttaaggc

SEQ ID NO: 296715 - DNA, 75 bp, Artificial Sequence
  Synthetic
ccttcagaaggcgtttcccgcctttgaggttgaatcacagcaggtcacaccgaatgaccatgctaacgctagagc

SEQ ID NO: 296716 - DNA, 75 bp, Artificial Sequence
  Synthetic
gaggttgaatcacagcaggtcacaccgaatgaccatgctaacgctagagcattttcgcatctggctactaaactg

SEQ ID NO: 296717 - DNA, 75 bp, Artificial Sequence
  Synthetic
attgagcaagaggttccaacaggcgtcaccatcctggacgtgggtagtgcacccgcaaggaggttgatgtctgac

SEQ ID NO: 296718 - DNA, 75 bp, Artificial Sequence
  Synthetic
tcaccatcctggacgtgggtagtgcacccgcaaggaggttgatgtctgaccacacctaccactgcatctgcccca

SEQ ID NO: 296719 - DNA, 75 bp, Artificial Sequence
  Synthetic
tgaaaagtgcggaagacccagagaggctggcgaattacgctcgaaagctggcgaaagcatcggggactgtgctag

SEQ ID NO: 296720 - DNA, 75 bp, Artificial Sequence
  Synthetic
gctggcgaattacgctcgaaagctggcgaaagcatcggggactgtgctagacaagaatgtgtccggaaagataac

SEQ ID NO: 296721 - DNA, 75 bp, Artificial Sequence
  Synthetic
gcgaaagcatcggggactgtgctagacaagaatgtgtccggaaagataacggacctacaagacgtcatggccact

SEQ ID NO: 296722 - DNA, 75 bp, Artificial Sequence
  Synthetic
ccagacttggaatccccgactttttgcctgcacactgacgagacgtgccgcactagggctgaggtcgctgtgtac

SEQ ID NO: 296723 - DNA, 75 bp, Artificial Sequence
  Synthetic
gcctgcacactgacgagacgtgccgcactagggctgaggtcgctgtgtaccaggacgtatacgctgtgcacgcac

SEQ ID NO: 296724 - DNA, 75 bp, Artificial Sequence
  Synthetic
cgacgtcactgtatcaccaggccatcaaaggtgtcaggacggcgtattggattggattcgacaccactccattca

SEQ ID NO: 296725 - DNA, 75 bp, Artificial Sequence
  Synthetic
caaaggtgtcaggacggcgtattggattggattcgacaccactccattcatgttcgaggcactagcgggcgcgta

SEQ ID NO: 296726 - DNA, 75 bp, Artificial Sequence
  Synthetic
tcctgcgtactcgaccaactgggcagatgagcaagtgctgcaggctcgtaacatcggcctgtgcgcgacaggcct

SEQ ID NO: 296727 - DNA, 75 bp, Artificial Sequence
  Synthetic
acatcggcctgtgcgcgacaggcctctccgaggggcgtcgcggcaaactctccatcatgagaaagaagtgcttgc

SEQ ID NO: 296728 - DNA, 75 bp, Artificial Sequence
  Synthetic
gaccgagcgacagagtaatgttttcggtcgggtccaccttgtacaccgagagccgaaagctgctgcgcagctggc

SEQ ID NO: 296729 - DNA, 75 bp, Artificial Sequence
  Synthetic
ggtcgggtccaccttgtacaccgagagccgaaagctgctgcgcagctggcatttaccttccgtgtttcacctgaa

SEQ ID NO: 296730 - DNA, 75 bp, Artificial Sequence
  Synthetic
gggtaagaacagttttacctgcaggtgcgacacggtggtgtcatgcgaaggttacgtggtaaagaagatcaccat

SEQ ID NO: 296731 - DNA, 75 bp, Artificial Sequence
  Synthetic
tgcgacacggtggtgtcatgcgaaggttacgtggtaaagaagatcaccataagcccgggcatatatggaaaaaca

SEQ ID NO: 296732 - DNA, 75 bp, Artificial Sequence
  Synthetic
gttacgtggtaaagaagatcaccataagcccgggcatatatggaaaaacagtcgattacgcagttacccatcacg

SEQ ID NO: 296733 - DNA, 75 bp, Artificial Sequence
  Synthetic
cagagggttttctggtgtgtaagatcactgatacagtcagaggagaaagagtctctttcccggtctgtacctatg

SEQ ID NO: 296734 - DNA, 75 bp, Artificial Sequence
  Synthetic
cactgatacagtcagaggagaaagagtctctttcccggtctgtacctatgtgcctgcaaccatatgcgatcagat

SEQ ID NO: 296735 - DNA, 75 bp, Artificial Sequence
  Synthetic
gacgggtatacttgccaccgacgtgacaccagaggatgcccagaagctcctggttggattgaaccaacgcatagt

SEQ ID NO: 296736 - DNA, 75 bp, Artificial Sequence
  Synthetic
ggtgaatggtaggacgcaaagaaacacaaacacaatgaaaaactatctactgccagtggtagcgcaagcattcag

SEQ ID NO: 296737 - DNA, 75 bp, Artificial Sequence
  Synthetic
acaaacacaatgaaaaactatctactgccagtggtagcgcaagcattcagtaaatgggcacgagaggcacgcgca

SEQ ID NO: 296738 - DNA, 75 bp, Artificial Sequence
  Synthetic
gacatggaggatgaaaaacccctaggcaccagagaacgcacgttgacgtgttgttgcctgtgggcgtttaaaagc

SEQ ID NO: 296739 - DNA, 75 bp, Artificial Sequence
  Synthetic
gcaccagagaacgcacgttgacgtgttgttgcctgtgggcgtttaaaagccacaaaacccacaccatgtataagc

SEQ ID NO: 296740 - DNA, 75 bp, Artificial Sequence
  Synthetic
ggcctgaaactcaaactatcgtcaaagtgccttccacttttgactcctttgtgataccgagcctgaggtcatcca

SEQ ID NO: 296741 - DNA, 75 bp, Artificial Sequence
  Synthetic
agtgccttccacttttgactcctttgtgataccgagcctgaggtcatccagtctttccatggatatcagacggag

SEQ ID NO: 296742 - DNA, 75 bp, Artificial Sequence
  Synthetic
gatcaaactgctactcagcgcaagaatggcccaaggcctaccatactcaggagaccgcactgaagctcgcgcggc

SEQ ID NO: 296743 - DNA, 75 bp, Artificial Sequence
  Synthetic
atggcccaaggcctaccatactcaggagaccgcactgaagctcgcgcggcagaagaagaagagaaggaggcgcag

SEQ ID NO: 296744 - DNA, 75 bp, Artificial Sequence
  Synthetic
gaggcagaacttacgagggcagcgctgccaccgctagtgagcggctcttgtgctgacgatatcgcccaggtggat

SEQ ID NO: 296745 - DNA, 75 bp, Artificial Sequence
  Synthetic
tgctgacgatatcgcccaggtggatgtagaggaattaaccttcagagccggagccggggttgtggaaacacccag

SEQ ID NO: 296746 - DNA, 75 bp, Artificial Sequence
  Synthetic
gagccggggttgtggaaacacccaggaatgccctgaaggttacaccgcaagcacacgaccacctcataggctcct

SEQ ID NO: 296747 - DNA, 75 bp, Artificial Sequence
  Synthetic
gcacacgaccacctcataggctcctacttgatcctttccccccaaacggtgttgaaaagcgagaagctggcaccc

SEQ ID NO: 296748 - DNA, 75 bp, Artificial Sequence
  Synthetic
acttgatcctttccccccaaacggtgttgaaaagcgagaagctggcacccatccaccctcttgctgagcaagtca

SEQ ID NO: 296749 - DNA, 75 bp, Artificial Sequence
  Synthetic
cggtcatgacccactctggaagatccggcagatacccagtcgacaagtacgacggacgggtattgatcccaacag

SEQ ID NO: 296750 - DNA, 75 bp, Artificial Sequence
  Synthetic
cggcagatacccagtcgacaagtacgacggacgggtattgatcccaacaggagcggccatcccagtgagtgagtt

SEQ ID NO: 296751 - DNA, 75 bp, Artificial Sequence
  Synthetic
ccaggcactcagcgagagcgcaaccatggtgtacaatgagagggaatttataaatcgcaagctacaccacatagc

SEQ ID NO: 296752 - DNA, 75 bp, Artificial Sequence
  Synthetic
atggtgtacaatgagagggaatttataaatcgcaagctacaccacatagcgctatacgggccagccttgaatacc

SEQ ID NO: 296753 - DNA, 75 bp, Artificial Sequence
  Synthetic
gacgaggaaagctacgaaaaagtgagagctgagagggcagagacagagtatgtgtttgacgtggacaagaaggca

SEQ ID NO: 296754 - DNA, 75 bp, Artificial Sequence
  Synthetic
gagctgagagggcagagacagagtatgtgtttgacgtggacaagaaggcatgtatcaagaaggaggaggcatcag

SEQ ID NO: 296755 - DNA, 75 bp, Artificial Sequence
  Synthetic
gccttgtgttaacaggggacctaatcaatccacctttccacgaattcgcatacgaaggactcaagatccgcccag

SEQ ID NO: 296756 - DNA, 75 bp, Artificial Sequence
  Synthetic
caatccacctttccacgaattcgcatacgaaggactcaagatccgcccagcagccccgtaccacacgacgatcat

SEQ ID NO: 296757 - DNA, 75 bp, Artificial Sequence
  Synthetic
tggtgtgtttggcgttccaggttcgggcaagtcggctatcattaagaacatggtgacgactcgcgatctggtggc

SEQ ID NO: 296758 - DNA, 75 bp, Artificial Sequence
  Synthetic
ggcaagtcggctatcattaagaacatggtgacgactcgcgatctggtggccagtggaaagaaggagaactgccaa

SEQ ID NO: 296759 - DNA, 75 bp, Artificial Sequence
  Synthetic
gagatcatgaatgatgtaaagaggcaacgcgggttggacgtgaccgctaggaccgtcgactcaatcttattgaat

SEQ ID NO: 296760 - DNA, 75 bp, Artificial Sequence
  Synthetic
aacgcgggttggacgtgaccgctaggaccgtcgactcaatcttattgaatgggtgcaagaaaggcgtagaaaacc

SEQ ID NO: 296761 - DNA, 75 bp, Artificial Sequence
  Synthetic
tttacgtcgatgaggcgttcgcgtgtcactcgggcactttgctagcgctcatcgcgctggtgagaccgtcaggta

SEQ ID NO: 296762 - DNA, 75 bp, Artificial Sequence
  Synthetic
tcactcgggcactttgctagcgctcatcgcgctggtgagaccgtcaggtaaggtagtactgtgcggcgaccccaa

SEQ ID NO: 296763 - DNA, 75 bp, Artificial Sequence
  Synthetic
gcagtgtggtttcttcaatttgatgcaactgaaggtgcactataaccacaacatttgtacaagggtgctccataa

SEQ ID NO: 296764 - DNA, 75 bp, Artificial Sequence
  Synthetic
gagcatctccagaagatgcactctacctgttacggcgatcgtgtccaccttgcactaccaagggaagatgagaac

SEQ ID NO: 296765 - DNA, 75 bp, Artificial Sequence
  Synthetic
cctgttacggcgatcgtgtccaccttgcactaccaagggaagatgagaacgacgaaccgatgcaacacccccatt

SEQ ID NO: 296766 - DNA, 75 bp, Artificial Sequence
  Synthetic
cagattgacaccaccggttcttccaaaccagcctcaggagatatcgtgttaacgtgcttccgcggctgggtgaag

SEQ ID NO: 296767 - DNA, 75 bp, Artificial Sequence
  Synthetic
aaccagcctcaggagatatcgtgttaacgtgcttccgcggctgggtgaagcaactgcaaatcgactatcgtggac

SEQ ID NO: 296768 - DNA, 75 bp, Artificial Sequence
  Synthetic
acgaggtgatgtccgcagctgcttcccagggtctgacaaggaaaggcgtgtacgccgtgagacagaaagtgaacg

SEQ ID NO: 296769 - DNA, 75 bp, Artificial Sequence
  Synthetic
ccagggtctgacaaggaaaggcgtgtacgccgtgagacagaaagtgaacgaaaacccactgtactcaccactgtc

SEQ ID NO: 296770 - DNA, 75 bp, Artificial Sequence
  Synthetic
ggagcacgtcaatgtgctgttgacccgaactgaaaaccgactggtgtggaagacactgtcgggtgacccgtggat

SEQ ID NO: 296771 - DNA, 75 bp, Artificial Sequence
  Synthetic
cgaactgaaaaccgactggtgtggaagacactgtcgggtgacccgtggataaaggtgttaaccaatgttccacgt

SEQ ID NO: 296772 - DNA, 75 bp, Artificial Sequence
  Synthetic
ggggatttcagtgcaactttggaggaatggcaagaagaacatgacggtatcatgagagtgttgaacgagcgaccg

SEQ ID NO: 296773 - DNA, 75 bp, Artificial Sequence
  Synthetic
aatggcaagaagaacatgacggtatcatgagagtgttgaacgagcgaccggcggaggttgatccattccaaaaca

SEQ ID NO: 296774 - DNA, 75 bp, Artificial Sequence
  Synthetic
aggccaaagtgtgctgggcaaaatgtctggtgcaagttcttgagacggccggaatacgtatgacggcagatgaat

SEQ ID NO: 296775 - DNA, 75 bp, Artificial Sequence
  Synthetic
tctggtgcaagttcttgagacggccggaatacgtatgacggcagatgaatggaacaccatcttggctttcagaga

SEQ ID NO: 296776 - DNA, 75 bp, Artificial Sequence
  Synthetic
ggacagagcgtactcaccagaagtcgctctcaacgagatttgcactcgttactacggcgttgacctagacagcgg

SEQ ID NO: 296777 - DNA, 75 bp, Artificial Sequence
  Synthetic
actacggcgttgacctagacagcggcctattctcagcgcagtcagtttccctcttttatgagaacaaccactggg

SEQ ID NO: 296778 - DNA, 75 bp, Artificial Sequence
  Synthetic
cctattctcagcgcagtcagtttccctcttttatgagaacaaccactgggacaacaggcccggaggacgcatgta

SEQ ID NO: 296779 - DNA, 75 bp, Artificial Sequence
  Synthetic
cgggttcaaccatgaagtagccaggaaatatgcagccaggtttccatttctacgtggcaacatgaactcggggct

SEQ ID NO: 296780 - DNA, 75 bp, Artificial Sequence
  Synthetic
acaactaaacgtccctgagaggaagctccaaccttttagcgctgaatgcaatatagtcccatccaatcgtcggtt

SEQ ID NO: 296781 - DNA, 75 bp, Artificial Sequence
  Synthetic
ctccaaccttttagcgctgaatgcaatatagtcccatccaatcgtcggttaccgcatgctctagtcacaagctat

SEQ ID NO: 296782 - DNA, 75 bp, Artificial Sequence
  Synthetic
cagcagtgccgtggggagagggtagagtggttgctgaaaaagattccaggtcaccaaatgttacttgtaagtgag

SEQ ID NO: 296783 - DNA, 75 bp, Artificial Sequence
  Synthetic
tcaccaaatgttacttgtaagtgagtacaacctggtgatacctcacaaaagagtcttctggattgcacctccgcg

SEQ ID NO: 296784 - DNA, 75 bp, Artificial Sequence
  Synthetic
tacaacctggtgatacctcacaaaagagtcttctggattgcacctccgcgggtgtcaggcgcggaccgcacgtac

SEQ ID NO: 296785 - DNA, 75 bp, Artificial Sequence
  Synthetic
gacatggacctagggttacctatggatgcaggccgttacgatctggtattcgtcaacatccatactgagtaccgg

SEQ ID NO: 296786 - DNA, 75 bp, Artificial Sequence
  Synthetic
atgcaggccgttacgatctggtattcgtcaacatccatactgagtaccggcaacaccactaccaacaatgcgtcg

SEQ ID NO: 296787 - DNA, 75 bp, Artificial Sequence
  Synthetic
accattcaatgcgtctgcagatgctgggaggggattcactacacctgcttagaccaggaggctcgctgctgatga

SEQ ID NO: 296788 - DNA, 75 bp, Artificial Sequence
  Synthetic
gggaggggattcactacacctgcttagaccaggaggctcgctgctgatgagagcatatggttacgcagacagagt

SEQ ID NO: 296789 - DNA, 75 bp, Artificial Sequence
  Synthetic
cagcgagatggtggtgacagccctggctaggaaattctcggcgttccgtgtcctgagaccggcgtgtgtgacgag

SEQ ID NO: 296790 - DNA, 75 bp, Artificial Sequence
  Synthetic
gctaggaaattctcggcgttccgtgtcctgagaccggcgtgtgtgacgagcaacacagaagtgttcctgctgttt

SEQ ID NO: 296791 - DNA, 75 bp, Artificial Sequence
  Synthetic
tctaactttgataacggcagaagagcggtaaccttgcaccaagctaaccagaaacttagctcaatgtatgcctgc

SEQ ID NO: 296792 - DNA, 75 bp, Artificial Sequence
  Synthetic
aacggactgcacactgctggctgtgcaccgtcatacagggtccgccgcgcagatatatcaggacacggtgaggaa

SEQ ID NO: 296793 - DNA, 75 bp, Artificial Sequence
  Synthetic
agatatatcaggacacggtgaggaagcagtcgtaaatgctgccaatgccaagggtaccgtgagcgatggagtgtg

SEQ ID NO: 296794 - DNA, 75 bp, Artificial Sequence
  Synthetic
cagggcggtcgctaagaagtggccatcatctttcaaaggggctgcaactccagtcggcacagccaagatgatccg

SEQ ID NO: 296795 - DNA, 75 bp, Artificial Sequence
  Synthetic
cagtcggcacagccaagatgatccgcgcagatggcatgaccgtaatccacgcagtgggaccgaacttctccaccg

SEQ ID NO: 296796 - DNA, 75 bp, Artificial Sequence
  Synthetic
taacagaagccgaaggggacagagagctagcggccgcgtaccgagctgtggctagcataattagtaccaacaaca

SEQ ID NO: 296797 - DNA, 75 bp, Artificial Sequence
  Synthetic
gctagcataattagtaccaacaacataaagagcgtcgcagtaccgctgctatccacaggcaccttttccggcggt

SEQ ID NO: 296798 - DNA, 75 bp, Artificial Sequence
  Synthetic
aaggacagagtgatgcagtccttgaaccacttattcacggcattggatgccaccgatgcagacgtggttatctac

SEQ ID NO: 296799 - DNA, 75 bp, Artificial Sequence
  Synthetic
tgcagagataaaaactgggaaaagaagattcaggaagccatcgacaggcggacggcaatagagctcgtatccgaa

SEQ ID NO: 296800 - DNA, 75 bp, Artificial Sequence
  Synthetic
gacgtgaccttggaaaccgatctggttagggtacacccggacagttgcttagtcggcagaaatggttacagtgca

SEQ ID NO: 296801 - DNA, 75 bp, Artificial Sequence
  Synthetic
ttagggtacacccggacagttgcttagtcggcagaaatggttacagtgcaactgacggtaaactgtactcttacc

SEQ ID NO: 296802 - DNA, 75 bp, Artificial Sequence
  Synthetic
ttgagggcacgaggttccaccagacggcggtcgacatggctgaaatatcaactttatggccaagactccaagatg

SEQ ID NO: 296803 - DNA, 75 bp, Artificial Sequence
  Synthetic
actttatggccaagactccaagatgctaacgagcagatctgcctgtacgccctaggggagacgatggacagcata

SEQ ID NO: 296804 - DNA, 75 bp, Artificial Sequence
  Synthetic
cctaggggagacgatggacagcatacgcactaaatgcccagtagaggacgccgattcgtctacgccgccgaaaac

SEQ ID NO: 296805 - DNA, 75 bp, Artificial Sequence
  Synthetic
ggtaccgtgtctatgtcggtacgcgatgaccgcggagcgggttgccagacttaggatgaataacaccaaaaacat

SEQ ID NO: 296806 - DNA, 75 bp, Artificial Sequence
  Synthetic
atgaccgcggagcgggttgccagacttaggatgaataacaccaaaaacatcatcgtgtgctcctcctttccattg

SEQ ID NO: 296807 - DNA, 75 bp, Artificial Sequence
  Synthetic
ccgaagtacaggatagaaggcgtgcagaaggtgaagtgtgaccgagtgctaatttttgaccagaccgtcccgtca

SEQ ID NO: 296808 - DNA, 75 bp, Artificial Sequence
  Synthetic
ctagtaagtcccagaaagtacatacagcagccgccggaacagctggataatgtgagcctgacttctacgacgtcg

SEQ ID NO: 296809 - DNA, 75 bp, Artificial Sequence
  Synthetic
agcagccgccggaacagctggataatgtgagcctgacttctacgacgtcgacgggatccgcatggtcatttccat

SEQ ID NO: 296810 - DNA, 75 bp, Artificial Sequence
  Synthetic
cggaaacgacctacgaaaccatggaagtcgtagccgaggtacacaccgaacctccgatccctccgcctcgccgac

SEQ ID NO: 296811 - DNA, 75 bp, Artificial Sequence
  Synthetic
agtcgtagccgaggtacacaccgaacctccgatccctccgcctcgccgacgtagagcagccgtcgcccaacttag

SEQ ID NO: 296812 - DNA, 75 bp, Artificial Sequence
  Synthetic
acaggatctggaagtcaccgaggagatcgagccgtacgtgatacagcaagcagagatcatggtcatggagagggt

SEQ ID NO: 296813 - DNA, 75 bp, Artificial Sequence
  Synthetic
cagagatcatggtcatggagagggtcgcgacgacagacatacgcgctatcccagtcccggcacggcgggccatta

SEQ ID NO: 296814 - DNA, 75 bp, Artificial Sequence
  Synthetic
cgcgacgacagacatacgcgctatcccagtcccggcacggcgggccattacaatgccagtcccagcccccagtgt

SEQ ID NO: 296815 - DNA, 75 bp, Artificial Sequence
  Synthetic
tcgtaaggtcgctaccgaacctccattagaaccggaagctcctatcccggcaccaagaaagagaagaaccactgg

SEQ ID NO: 296816 - DNA, 75 bp, Artificial Sequence
  Synthetic
ttagaaccggaagctcctatcccggcaccaagaaagagaagaaccactggcaccacacctccgcataaccccgag

SEQ ID NO: 296817 - DNA, 75 bp, Artificial Sequence
  Synthetic
gatttcgttcccagggtaccggttgagttaccgtgggagccggaagacctagacatccaattcggtgacttggag

SEQ ID NO: 296818 - DNA, 75 bp, Artificial Sequence
  Synthetic
agacatccaattcggtgacttggagccacgccgccggaacaccagggaccgagatgtcagcacaggaatacagtt

SEQ ID NO: 296819 - DNA, 75 bp, Artificial Sequence
  Synthetic
cggtgacatcgactttaaccagtccagactaggcagggctggcgcgtatatcttttcgtctgacactggcccggg

SEQ ID NO: 296820 - DNA, 75 bp, Artificial Sequence
  Synthetic
tcttttcgtctgacactggcccgggtcacctacagcagaagtccgtaaggcaacatgaattgccatgcgagactc

SEQ ID NO: 296821 - DNA, 75 bp, Artificial Sequence
  Synthetic
caacatgaattgccatgcgagactctgtatgcccatgaagacgaacgcatatacccgccggcatttgacggagag

SEQ ID NO: 296822 - DNA, 75 bp, Artificial Sequence
  Synthetic
tgtatgcccatgaagacgaacgcatatacccgccggcatttgacggagagaaagagaaggtactccaggcaaaga

SEQ ID NO: 296823 - DNA, 75 bp, Artificial Sequence
  Synthetic
tgcagatggccccgacagaagcgaataagagcaggtaccagtcgaggaaagtagagaacatgaaggcattaattg

SEQ ID NO: 296824 - DNA, 75 bp, Artificial Sequence
  Synthetic
tagaaagactacgcgaaggagcaaagatgtacctccatgagcaaaccgacaaagtacccacgtacaccagcaagt

SEQ ID NO: 296825 - DNA, 75 bp, Artificial Sequence
  Synthetic
accctagacctgtgtactcaccatcggtggatgacagcctgagcgatccggaagtggctgtggccgcctgtaact

SEQ ID NO: 296826 - DNA, 75 bp, Artificial Sequence
  Synthetic
ggtggatgacagcctgagcgatccggaagtggctgtggccgcctgtaactctttcttagaggagaattatccgac

SEQ ID NO: 296827 - DNA, 75 bp, Artificial Sequence
  Synthetic
cgtggcgaactaccagataaccgatgagtatgacgcttatctggacttggtcgacggctctgaaagctgcctcga

SEQ ID NO: 296828 - DNA, 75 bp, Artificial Sequence
  Synthetic
cagagctacgttctgcccggccaaactaagatgttaccctaagcaccacgcataccaccaaccacaaatcaggag

SEQ ID NO: 296829 - DNA, 75 bp, Artificial Sequence
  Synthetic
cgcagtaccttcccctttccaaaacacgttacaaaacgtgctagccgcggccactaaaagaaattgtaatgtcac

SEQ ID NO: 296830 - DNA, 75 bp, Artificial Sequence
  Synthetic
ccaaatgagagaattaccaaccatggactctgcggtgtttaacgtagaaagcttcaaaaaatacgcctgtaccgg

SEQ ID NO: 296831 - DNA, 75 bp, Artificial Sequence
  Synthetic
cgaatattggcaagaatttaaagacaatcctatacggatcaccaccgaaaacataacgacgtacgtggctaaact

SEQ ID NO: 296832 - DNA, 75 bp, Artificial Sequence
  Synthetic
aatcctatacggatcaccaccgaaaacataacgacgtacgtggctaaactcaagggtccaaaggctgctgccctt

SEQ ID NO: 296833 - DNA, 75 bp, Artificial Sequence
  Synthetic
tttgccaagacgcataacctggtgccgctccaggaggtgccaatggaccgcttcgtgatggatatgaagagagat

SEQ ID NO: 296834 - DNA, 75 bp, Artificial Sequence
  Synthetic
cgctccaggaggtgccaatggaccgcttcgtgatggatatgaagagagatgtgaaagttacaccaggcaccaagc

SEQ ID NO: 296835 - DNA, 75 bp, Artificial Sequence
  Synthetic
ataccgaagaaaggcctaaagtgcaagtgattcaagcggcggaaccattggccacggcatatttatgcggaatcc

SEQ ID NO: 296836 - DNA, 75 bp, Artificial Sequence
  Synthetic
agtgattcaagcggcggaaccattggccacggcatatttatgcggaatccacagagagttagtcaggcggctaaa

SEQ ID NO: 296837 - DNA, 75 bp, Artificial Sequence
  Synthetic
agccgttctgaccccgaacattcacactctgtttgacatgtcggcggaggactttgatgccatcatagcggcaca

SEQ ID NO: 296838 - DNA, 75 bp, Artificial Sequence
  Synthetic
actctgtttgacatgtcggcggaggactttgatgccatcatagcggcacattttcaaccgggagatgctgtactg

SEQ ID NO: 296839 - DNA, 75 bp, Artificial Sequence
  Synthetic
gagacagatatcgcatccttcgataagagccaagacgactccttagcgctaacggcgctaatgcttctggaagac

SEQ ID NO: 296840 - DNA, 75 bp, Artificial Sequence
  Synthetic
aacggcgctaatgcttctggaagacctcggggtcgaccaagaactgctggaccttatcgaagctgcgtttggtga

SEQ ID NO: 296841 - DNA, 75 bp, Artificial Sequence
  Synthetic
gatcacgggtgtgcatctacctaccggtacaagatttaaattcggtgctatgatgaagtcaggaatgtttcttac

SEQ ID NO: 296842 - DNA, 75 bp, Artificial Sequence
  Synthetic
ggtacaagatttaaattcggtgctatgatgaagtcaggaatgtttcttacactcttcatcaacacgctgctgaac

SEQ ID NO: 296843 - DNA, 75 bp, Artificial Sequence
  Synthetic
attgtcatagcgtgccgcgtcttacgcgacaaattatcgtcctcggcgtgcgccgccttcataggtgatgacaac

SEQ ID NO: 296844 - DNA, 75 bp, Artificial Sequence
  Synthetic
gcgacaaattatcgtcctcggcgtgcgccgccttcataggtgatgacaacatagtgcacggcgtgaggtcagacc

SEQ ID NO: 296845 - DNA, 75 bp, Artificial Sequence
  Synthetic
cgctaatggcagaaaggtgtgcgagttgggtcaacatggaagtaaagatcatcgatgccacaatgtgtgagaaac

SEQ ID NO: 296846 - DNA, 75 bp, Artificial Sequence
  Synthetic
ttgggtcaacatggaagtaaagatcatcgatgccacaatgtgtgagaaaccaccgtacttttgtggaggattcat

SEQ ID NO: 296847 - DNA, 75 bp, Artificial Sequence
  Synthetic
cctgtacgacagtgtcgccggtacagcgtgtagggttgcagacccgttaaagaggctgttcaaactcgggaaacc

SEQ ID NO: 296848 - DNA, 75 bp, Artificial Sequence
  Synthetic
agaggctgttcaaactcgggaaaccgctcccagcggacgacaaccaggatgaagacagaagaagggcactaaaag

SEQ ID NO: 296849 - DNA, 75 bp, Artificial Sequence
  Synthetic
gaagacagaagaagggcactaaaagacgaaacagttaagtggtcccgcataggattgagagaagaattagacgtg

SEQ ID NO: 296850 - DNA, 75 bp, Artificial Sequence
  Synthetic
gcactgagctcaagataccaagtcagtggcgtcgggaacatcactagagcgatgtccacgctgtctaagaatttg

SEQ ID NO: 296851 - DNA, 75 bp, Artificial Sequence
  Synthetic
aagtcttttaggaaaataagaggtcccattatacatctgtacggcggtcctaaatagatgcaggattacactaca

SEQ ID NO: 296852 - DNA, 75 bp, Artificial Sequence
  Synthetic
ccattatacatctgtacggcggtcctaaatagatgcaggattacactacatctaaagaccacgtattacagacac

SEQ ID NO: 296853 - DNA, 75 bp, Artificial Sequence
  Synthetic
catgaattacatcccaactcaaaccttttacggacgccgttggcgaccacgcccggcgttccgtccatggcgggt

SEQ ID NO: 296854 - DNA, 75 bp, Artificial Sequence
  Synthetic
ttttacggacgccgttggcgaccacgcccggcgttccgtccatggcgggtgccgatgcagccggccccacccatg

SEQ ID NO: 296855 - DNA, 75 bp, Artificial Sequence
  Synthetic
attccagagctgcaaactccgatcgtccaggcccaacagatgcagcagctaatcagtgcagtttctgccctgacg

SEQ ID NO: 296856 - DNA, 75 bp, Artificial Sequence
  Synthetic
tccaggcccaacagatgcagcagctaatcagtgcagtttctgccctgacgactaagcaaaatggcaaagcaccga

SEQ ID NO: 296857 - DNA, 75 bp, Artificial Sequence
  Synthetic
agaagccgaagaaaaagccgcaaaaagcgaaggctaagaaaaacgaacagcaaaagaaaaacgagaacaagaaac

SEQ ID NO: 296858 - DNA, 75 bp, Artificial Sequence
  Synthetic
agcgaaggctaagaaaaacgaacagcaaaagaaaaacgagaacaagaaaccaccacctaagcagaagaatccggc

SEQ ID NO: 296859 - DNA, 75 bp, Artificial Sequence
  Synthetic
taagaagaagaaaccaggaaaaagggaacgcatgtgcatgaagatagaaaatgattgcatcttcgaggtcaagct

SEQ ID NO: 296860 - DNA, 75 bp, Artificial Sequence
  Synthetic
gaacgcatgtgcatgaagatagaaaatgattgcatcttcgaggtcaagcttgacggtaaggtcacgggatacgcc

SEQ ID NO: 296861 - DNA, 75 bp, Artificial Sequence
  Synthetic
tgcctagtcggggataaagtgatgaagccggcacacgtcaaaggtgtgatcgacaaccccgacctagcgaagctt

SEQ ID NO: 296862 - DNA, 75 bp, Artificial Sequence
  Synthetic
cgacaaccccgacctagcgaagcttacctacaagaaatcgagcaagtatgacctagagtgcgcccagataccggt

SEQ ID NO: 296863 - DNA, 75 bp, Artificial Sequence
  Synthetic
gcacatgaagtcagatgcttcaaaatacacccatgaaaaaccagaagggcactacaattggcatcacggtgcagt

SEQ ID NO: 296864 - DNA, 75 bp, Artificial Sequence
  Synthetic
tacacccatgaaaaaccagaagggcactacaattggcatcacggtgcagtgcagtacagcggtggcaggttcaca

SEQ ID NO: 296865 - DNA, 75 bp, Artificial Sequence
  Synthetic
atcccgacaggcgcaggtaaaccaggagacagcggccggccgatcttcgacaacaaaggacgtgtggtggccatt

SEQ ID NO: 296866 - DNA, 75 bp, Artificial Sequence
  Synthetic
ctggaccaaagacatggtcacacggtacaccccagaaggaacagaagaatggtccgccgccttgatgatgtgcgt

SEQ ID NO: 296867 - DNA, 75 bp, Artificial Sequence
  Synthetic
ggtccgccgccttgatgatgtgcgtcttagccaacgttacattcccacgctcagagcccgcatgtgcaccctgtt

SEQ ID NO: 296868 - DNA, 75 bp, Artificial Sequence
  Synthetic
tcagagcccgcatgtgcaccctgttgctatgaaaaacaaccagaacagacactgaggatgttggaggacaacgtg

SEQ ID NO: 296869 - DNA, 75 bp, Artificial Sequence
  Synthetic
gctatgaaaaacaaccagaacagacactgaggatgttggaggacaacgtggaccgcccgggctactacgacctgc

SEQ ID NO: 296870 - DNA, 75 bp, Artificial Sequence
  Synthetic
tcgaggccacgatgacgtgtaacaacagtgcacgccaccgtcgcagtgtgacggaacacttcaatgtctacaagg

SEQ ID NO: 296871 - DNA, 75 bp, Artificial Sequence
  Synthetic
acggaacacttcaatgtctacaaggccacgaaaccgtacctagcgtattgcgcggactgcggagacgggcagttc

SEQ ID NO: 296872 - DNA, 75 bp, Artificial Sequence
  Synthetic
tgttacagcccggtggctatagaaaaaattagggatgaggcttccgatggcatgataaagatccaggtcgcagcg

SEQ ID NO: 296873 - DNA, 75 bp, Artificial Sequence
  Synthetic
catgataaagatccaggtcgcagcgcaaattggcatcaacaaaggaggaacacacgaacacaacaaaatcaggta

SEQ ID NO: 296874 - DNA, 75 bp, Artificial Sequence
  Synthetic
catcgccgggcatgacatgaaagaggcaaaccgggattctttacaagtgcatacttccggtgtgtgcgctattcg

SEQ ID NO: 296875 - DNA, 75 bp, Artificial Sequence
  Synthetic
aggcacgatgggccacttcatcgtggcctactgccctccagggggcgaactaaaggtccagttccaagatgcaga

SEQ ID NO: 296876 - DNA, 75 bp, Artificial Sequence
  Synthetic
taaaggtccagttccaagatgcagaatcgcacacacaggcctgcaaagtgcagtacaaacacgctccggccccag

SEQ ID NO: 296877 - DNA, 75 bp, Artificial Sequence
  Synthetic
taggcagagaaaaattcaccgtcaggccccacttcggtatcgaagtgccatgcacaacgtaccagctgactaccg

SEQ ID NO: 296878 - DNA, 75 bp, Artificial Sequence
  Synthetic
caccgacggaggaagagatcgacatgcataccccaccggatatcccagacataacgttgctgtcgcagcagtcag

SEQ ID NO: 296879 - DNA, 75 bp, Artificial Sequence
  Synthetic
gcataccccaccggatatcccagacataacgttgctgtcgcagcagtcaggtaacgtaaagatcacagcaggagg

SEQ ID NO: 296880 - DNA, 75 bp, Artificial Sequence
  Synthetic
aaaaaccatcagatacaactgcacgtgtggtagtggcaacgtgggcaccaccagtagcgacaagactatcaattc

SEQ ID NO: 296881 - DNA, 75 bp, Artificial Sequence
  Synthetic
gtgcaaaatagcacagtgccacgctgcggtgactaaccacgataagtggcagtacacctcctcgtttgtccctag

SEQ ID NO: 296882 - DNA, 75 bp, Artificial Sequence
  Synthetic
gcggtgactaaccacgataagtggcagtacacctcctcgtttgtccctagagccgaccagttgtctcgcaaaggt

SEQ ID NO: 296883 - DNA, 75 bp, Artificial Sequence
  Synthetic
aaagtgcacgtacccttccctctgaccaactccacatgcagggtgccccttgcacgtgcaccaggtgtcacatac

SEQ ID NO: 296884 - DNA, 75 bp, Artificial Sequence
  Synthetic
ggaaagagagaactgacagtgaaactgcatccagatcatcccacgctgttgacgtaccggagtctaggagcagat

SEQ ID NO: 296885 - DNA, 75 bp, Artificial Sequence
  Synthetic
gacgtaccggagtctaggagcagatccgcgtccgtatgaggagtggatagaccgatacgtcgaacggaccatacc

SEQ ID NO: 296886 - DNA, 75 bp, Artificial Sequence
  Synthetic
ggtgaccgaagatgggatagagtacagatggggaaacaacccacccgtgcgcttgtgggcccagctgacaactga

SEQ ID NO: 296887 - DNA, 75 bp, Artificial Sequence
  Synthetic
gcttgtgggcccagctgacaactgaaggcaaaccccatgggtggccgcacgagatcatactctattactatgggc

SEQ ID NO: 296888 - DNA, 75 bp, Artificial Sequence
  Synthetic
gagatcatactctattactatgggctatacccagcagccaccatcgtcgctgtctcagccgcgtgtctcgcagtc

SEQ ID NO: 296889 - DNA, 75 bp, Artificial Sequence
  Synthetic
gtactatcgctgctggcgtcatgttacatgttcgccactgcacgccgcaagtgcctgaccccatacgccctgacc

SEQ ID NO: 296890 - DNA, 75 bp, Artificial Sequence
  Synthetic
gtgcctgaccccatacgccctgacccccggagccgtcgtcccggtaacactaggagtactatgctgcgcaccacg

SEQ ID NO: 296891 - DNA, 75 bp, Artificial Sequence
  Synthetic
agcgcatgccgcgtcgtttgcggaatctatggcgtatctatgggatgagaatcaaaccctgttttggctggagct

SEQ ID NO: 296892 - DNA, 75 bp, Artificial Sequence
  Synthetic
atcaaaccctgttttggctggagcttgcaacgccgctcgctgccataatcatacttgtatgctgcctgaagaacc

SEQ ID NO: 296893 - DNA, 75 bp, Artificial Sequence
  Synthetic
tgcaacgccgctcgctgccataatcatacttgtatgctgcctgaagaacctgctttgctgctgcaaaccgctatc

SEQ ID NO: 296894 - DNA, 75 bp, Artificial Sequence
  Synthetic
ttttttagtgttggtgagcctgggaactcccgtcgtaaaatcttacgaacacaccgcaacgatcccgaatgtggt

SEQ ID NO: 296895 - DNA, 75 bp, Artificial Sequence
  Synthetic
actcccgtcgtaaaatcttacgaacacaccgcaacgatcccgaatgtggtgggattcccgtataaggctcacatt

SEQ ID NO: 296896 - DNA, 75 bp, Artificial Sequence
  Synthetic
gagaggaacggcttctccccgatgaccctacagcttgaggtacttggaaccagcttggaacccacactaaactta

SEQ ID NO: 296897 - DNA, 75 bp, Artificial Sequence
  Synthetic
ccctacagcttgaggtacttggaaccagcttggaacccacactaaacttagagtacataacctgtgaatacaaga

SEQ ID NO: 296898 - DNA, 75 bp, Artificial Sequence
  Synthetic
cagcttggaacccacactaaacttagagtacataacctgtgaatacaagacagtcgtgccgtcaccttatatcaa

SEQ ID NO: 296899 - DNA, 75 bp, Artificial Sequence
  Synthetic
gtgctgcgggacatcagaatgcagatccatggagcgccccgactatcaatgccaggtctacacaggagtgtaccc

SEQ ID NO: 296900 - DNA, 75 bp, Artificial Sequence
  Synthetic
ttctgcgacactgagaacacccagctgagtgaagcatacgttgacagatcggacgtatgcaagcacgaccatgcc

SEQ ID NO: 296901 - DNA, 75 bp, Artificial Sequence
  Synthetic
gcggcctacaaggcgcatactgcggcaatgaaagccaccatccgaataagctacgggaacctcaatcagacaaca

SEQ ID NO: 296902 - DNA, 75 bp, Artificial Sequence
  Synthetic
caatgaaagccaccatccgaataagctacgggaacctcaatcagacaacaacggcgttcgtcaacggggagcaca

SEQ ID NO: 296903 - DNA, 75 bp, Artificial Sequence
  Synthetic
cagtgaccgtcggaggcagcaggtttacttttggtccaatctccactgcctggacgcctttcgacaacaagattg

SEQ ID NO: 296904 - DNA, 75 bp, Artificial Sequence
  Synthetic
tacttttggtccaatctccactgcctggacgcctttcgacaacaagattgtcgtctataagaacgacgtctacaa

SEQ ID NO: 296905 - DNA, 75 bp, Artificial Sequence
  Synthetic
cctggacttcccaccctacgggtcaggacaaccaggaaggtttggagacatccagagcaggacggtagagagcaa

SEQ ID NO: 296906 - DNA, 75 bp, Artificial Sequence
  Synthetic
ggacaaccaggaaggtttggagacatccagagcaggacggtagagagcaaggacctgtatgccaacaccgccctc

SEQ ID NO: 296907 - DNA, 75 bp, Artificial Sequence
  Synthetic
aagttgtcaagaccttcgtccggtactgttcacgtgccttacacacagaccccttctggctttaagtactggata

SEQ ID NO: 296908 - DNA, 75 bp, Artificial Sequence
  Synthetic
ctgttcacgtgccttacacacagaccccttctggctttaagtactggataaaagagagaggcacgtcgctgaatg

SEQ ID NO: 296909 - DNA, 75 bp, Artificial Sequence
  Synthetic
acaaggctccctttggatgcgtaatcaagaccaacccagttagagcagaaaattgcgccgttggcaacatcccag

SEQ ID NO: 296910 - DNA, 75 bp, Artificial Sequence
  Synthetic
caagaccaacccagttagagcagaaaattgcgccgttggcaacatcccagtctccatggacatcccggactccgc

SEQ ID NO: 296911 - DNA, 75 bp, Artificial Sequence
  Synthetic
gtttacgcgcgtgattgatgcacctgccgtcacaaacctggagtgccaagtggcggtctgcacgcactcaccgga

SEQ ID NO: 296912 - DNA, 75 bp, Artificial Sequence
  Synthetic
cttcggcgggattgcgactctgactttcaaaaccgacaaacccggaaaatgtgctgtccattctcattcgaacgt

SEQ ID NO: 296913 - DNA, 75 bp, Artificial Sequence
  Synthetic
agccaccatacaggaggcagctgtggacatcaaaacagatggcaagataaccctgcatttctctacagcatcagc

SEQ ID NO: 296914 - DNA, 75 bp, Artificial Sequence
  Synthetic
ccctgcatttctctacagcatcagcatccccggcattcaaggtatctgtgtgcagtgccaaaacgacatgcatgg

SEQ ID NO: 296915 - DNA, 75 bp, Artificial Sequence
  Synthetic
atccccggcattcaaggtatctgtgtgcagtgccaaaacgacatgcatggcagcgtgtgagccgccgaaggatta

SEQ ID NO: 296916 - DNA, 75 bp, Artificial Sequence
  Synthetic
catcgtcccttatggggcgagccataacaaccaagtttttcctgacatgtctggcacggcaatgacatgggtgca

SEQ ID NO: 296917 - DNA, 75 bp, Artificial Sequence
  Synthetic
ctggcacggcaatgacatgggtgcagcgggtagctggcggattcggcgggctaacactcgccgctgtggcagtac

SEQ ID NO: 296918 - DNA, 75 bp, Artificial Sequence
  Synthetic
ttatactggtgacgtgtgtgactatgcgccgctaaccgggaggcttgacataatgtatatatataagcatcatag

SEQ ID NO: 296919 - DNA, 75 bp, Artificial Sequence
  Synthetic
ttttaataaagcacataaataatcaagtagatcaaagggctacctaacccctgaatagtaacaaaacgcaaaata

SEQ ID NO: 296920 - DNA, 75 bp, Artificial Sequence
  Synthetic
agtagatcaaagggctacctaacccctgaatagtaacaaaacgcaaaatacaaaaacattagttcaaagggccag

SEQ ID NO: 296921 - DNA, 75 bp, Artificial Sequence
  Synthetic
taacccctgaatagtaacaaaacataaaaaccaaaaaaaaacagtagttcaaagggctatacaacccctgaatag

SEQ ID NO: 296922 - DNA, 75 bp, Artificial Sequence
  Synthetic
aaaaaccaaaaaaaaacagtagttcaaagggctatacaacccctgaatagtaacaaaatacagaaaaaccataaa

SEQ ID NO: 296923 - DNA, 75 bp, Artificial Sequence
  Synthetic
aattataaaattaactaatctgatcatctaaatttgactaattggaaatagccgaactctacggagatgtaggcg

SEQ ID NO: 296924 - DNA, 75 bp, Artificial Sequence
  Synthetic
gacgtaggacaaaattctgccgaaccccagaccatcggggacgtaggcgtctaatttgtttttttaatattttac

SEQ ID NO: 296925 - DNA, 75 bp, Artificial Sequence
  Synthetic
gaagaaactgaaggtgtagtaagaagattcatagcagaaatgaggcaaagagtacaagctgatcgaaatgtagtt

SEQ ID NO: 296926 - DNA, 75 bp, Artificial Sequence
  Synthetic
ggtaaaccgttagaggctgatttgacggtgaatgagctagactatgagaacaataaaatcacgtcagagctgttt

SEQ ID NO: 296927 - DNA, 75 bp, Artificial Sequence
  Synthetic
tctacataaagcatcaattccaacaatgaaaatagcattaagaacatcgaagtgttcgtataaagtaattaaata

SEQ ID NO: 296928 - DNA, 75 bp, Artificial Sequence
  Synthetic
cattgatggatccagctatattgacatcactgtcatctaatttaaatgcagttatgttttggctagaaaagcatg

SEQ ID NO: 296929 - DNA, 75 bp, Artificial Sequence
  Synthetic
tagtgacgtgggcaaattcatcaatagaaatgctaatgtcagtcttttcacatgaagattatttaattgcgcgtg

SEQ ID NO: 296930 - DNA, 75 bp, Artificial Sequence
  Synthetic
tgaaatcatttttaattatataccagaaagaataaggaatgatgttaattatattttaaatatggatatgaattt

SEQ ID NO: 296931 - DNA, 75 bp, Artificial Sequence
  Synthetic
tataactaatgaggagttggaacttgaattttcaaataagtacgtaaaagcaatagtcccagaccagacatttga

SEQ ID NO: 296932 - DNA, 75 bp, Artificial Sequence
  Synthetic
ccactgatggctaaaatatattcatggtcgtttcatgtgggttttagaaagcagaaaatgttggatgccgcactt

SEQ ID NO: 296933 - DNA, 75 bp, Artificial Sequence
  Synthetic
atttcgtcaacaataatcaatttagacaagtagtaattgatggagtattaaaccaagttctgaatgataacataa

SEQ ID NO: 296934 - DNA, 75 bp, Artificial Sequence
  Synthetic
ggctttttttatgaaaagtcttgtgtgagccatggcgacttttaaagacgcttgttatcattataaaaagttgaa

SEQ ID NO: 296935 - DNA, 75 bp, Artificial Sequence
  Synthetic
ggtcgtttcatgtgggttttagaaagcagaaaatgttggatgccgcacttgatcaacttaaaacagagtacactg

SEQ ID NO: 296936 - DNA, 75 bp, Artificial Sequence
  Synthetic
aatatattagacataacagcagatccaacgactaatccacaaactgagagaatgatgagagtgaattggaaaaaa

SEQ ID NO: 296937 - DNA, 75 bp, Artificial Sequence
  Synthetic
gtgcagtcagtataacaggtgtttcttagatgaagaaccccatttgctgagaatgcgaacatttaaagatgtagt

SEQ ID NO: 296938 - DNA, 75 bp, Artificial Sequence
  Synthetic
tgtgagtgatctaattcaacaatttaaccaaatgataattactatgaatggaaatgagttccaaactggaggaat

SEQ ID NO: 296939 - DNA, 75 bp, Artificial Sequence
  Synthetic
tgtgataccaccggtaaacgtagataaaccaattccattaggcagaagggatgtaccaggaagacgaaccagaat

SEQ ID NO: 296940 - DNA, 75 bp, Artificial Sequence
  Synthetic
aaaccaattccattaggcagaagggatgtaccaggaagacgaaccagaataatattcatattgccatatgagtac

SEQ ID NO: 296941 - DNA, 75 bp, Artificial Sequence
  Synthetic
aagtgtaggaatgaatatttgttagaatggtataatcacttactaatgccaataacattacaagcattgactata

SEQ ID NO: 296942 - DNA, 75 bp, Artificial Sequence
  Synthetic
aatcttgaggataatgtatattatatatttggatactatgattgcatggagcatgaaaaccaaacaccattccaa

SEQ ID NO: 296943 - DNA, 75 bp, Artificial Sequence
  Synthetic
aagtcatccaaactttaaatttatacaagcaaacacaaataaatttaatggactcatacgtccagataccagatg

SEQ ID NO: 296944 - DNA, 75 bp, Artificial Sequence
  Synthetic
agcaggagtgatttctcagatagtcttatggaagatagacatagtccaacatcattaatgcaagtggtacgtaac

SEQ ID NO: 296945 - DNA, 75 bp, Artificial Sequence
  Synthetic
gactcatacgtccagataccagatggcaatataattaagaaaatacagtatggagctgtcgcctcaggagaaaaa

SEQ ID NO: 296946 - DNA, 75 bp, Artificial Sequence
  Synthetic
ttataacgaacgaattaacgatgcagtggccatcattacggctgctaatagattaaacttataccagaagaaaat

SEQ ID NO: 296947 - DNA, 75 bp, Artificial Sequence
  Synthetic
tgtaaatggtgtcagatcaacaaccattacaaagtgtgggaagattttagacttaggaaaatatataataatgta

SEQ ID NO: 296948 - DNA, 75 bp, Artificial Sequence
  Synthetic
aaatgatttttatcttgtagcaaattatgattgggttccaacatctacaacaaaagtctataaacaagtaccaca

SEQ ID NO: 296949 - DNA, 75 bp, Artificial Sequence
  Synthetic
ctaaaagatatatagctggtgggaaaatatttttcagagcaggaattaacttgctaaataacgagaaaagaggtc

SEQ ID NO: 296950 - DNA, 75 bp, Artificial Sequence
  Synthetic
aatttcattacatgagaatgaaatacaattatatttaatttcattaggtataccaaaaatagatgctgatacata

SEQ ID NO: 296951 - DNA, 75 bp, Artificial Sequence
  Synthetic
aacagattaagaggatttgaaacggatagagaatttattttaacgaagataatgcaaatgacttcagttgctata

SEQ ID NO: 296952 - DNA, 75 bp, Artificial Sequence
  Synthetic
atggatgtcctgtactctttgtcaaaaactcttaaagatgctagagacaaaattgtcgaaggcacattatactct

SEQ ID NO: 296953 - DNA, 75 bp, Artificial Sequence
  Synthetic
aaagaagatactgagtgcgatgatatttgactggtttgatacaagatatatgagagaaacaccaatgacgacgtc

SEQ ID NO: 296954 - DNA, 75 bp, Artificial Sequence
  Synthetic
cggatgatgaagtatatatacaaagagcttttatgtcgttgtccagccaaaagtcaggaattgcagatgagatag

SEQ ID NO: 296955 - DNA, 75 bp, Artificial Sequence
  Synthetic
tgagagaaacaccaatgacgacgtcaacaacaaaccaacttcgaacactgaacaaaaggaatgaactcatagatg

SEQ ID NO: 296956 - DNA, 75 bp, Artificial Sequence
  Synthetic
aagtcaggaattgcagatgagatagcggcttcacaaacattcaagaattacgtgtccagactatcagatcaatta

SEQ ID NO: 296957 - DNA, 75 bp, Artificial Sequence
  Synthetic
agtacgacttagaactttcagatgttgagtaaatatggtcacaactacgccagcacaagaccgtctgcactagag

SEQ ID NO: 296958 - DNA, 75 bp, Artificial Sequence
  Synthetic
tctgtaagtaaggatgcgtctacgtattcgctacacagagtaattactcagatgacgtagtgagaggatgtgacc

SEQ ID NO: 296959 - DNA, 75 bp, Artificial Sequence
  Synthetic
actcttaaagatgctagagacaaaattgtcgaaggcactttatactctaatgttagtgatctaattcaacaattt

SEQ ID NO: 296960 - DNA, 75 bp, Artificial Sequence
  Synthetic
tttcattcgaaagatctactaattaaatcagtgctcatagctattggacaatcgaaagaaattgaaactacagct

SEQ ID NO: 296961 - DNA, 75 bp, Artificial Sequence
  Synthetic
agatttcagcactattgaccatgttgcagaaaccagtcacttttaaatcaaataaaataacaataaatgatatac

SEQ ID NO: 296962 - DNA, 75 bp, Artificial Sequence
  Synthetic
ggatccgttagacactccatattctacaatacatcataaagaattattttttgataaagatgtcaataaacttaa

SEQ ID NO: 296963 - DNA, 75 bp, Artificial Sequence
  Synthetic
cagtcagttggatcagagaagaaccagcgcgttacagtgaatccaggaccatttgcgcagacagtatatgcgcca

SEQ ID NO: 296964 - DNA, 75 bp, Artificial Sequence
  Synthetic
ccaatgcattggatcgagaacatatcagattgaagatgatggatcaaagtcggcaatttcaaaattgatatctaa

SEQ ID NO: 296965 - DNA, 75 bp, Artificial Sequence
  Synthetic
attgattattttgttgattttgtagataacgtatgtatggatgaaatggttagagaatcgcaaagaaacggaatt

SEQ ID NO: 296966 - DNA, 75 bp, Artificial Sequence
  Synthetic
ttattgaatataaagtcacattgaatgaagataaaccaatttcagatggacatgtaaaagaattagttgctgagc

SEQ ID NO: 296967 - DNA, 75 bp, Artificial Sequence
  Synthetic
ggatgttgttagcgccaacaggaccaggtgtggtagtggaagggacggacaattctggcagatggttatctgtaa

SEQ ID NO: 296968 - DNA, 75 bp, Artificial Sequence
  Synthetic
tacacgaaaatgaaatacaattatatctgatctctttgggaataccaaaaatagatgctgatacgtatgttggct

SEQ ID NO: 296969 - DNA, 75 bp, Artificial Sequence
  Synthetic
aataaattttgataattcgtcggaatatatagaaaactggaatttgcaaaatagaagacaaagaactggttttac

SEQ ID NO: 296970 - DNA, 75 bp, Artificial Sequence
  Synthetic
cgaacgcgtctgatacgaaatggaaatttgttgaaatgatgaagacggcgattgatggtgactatgcggaatggg

SEQ ID NO: 296971 - DNA, 75 bp, Artificial Sequence
  Synthetic
gttatcagctatttgatttcaattcaccagacttagagaaattgattagaataccatttaaaggaaagattccag

SEQ ID NO: 296972 - DNA, 75 bp, Artificial Sequence
  Synthetic
accagacttagagaaattgattagaataccatttaaaggaaagattccagctgtcacatttatattacatctata

SEQ ID NO: 296973 - DNA, 75 bp, Artificial Sequence
  Synthetic
accagatgctgaaagatttagttttcctagagtaattaattcagctgatggagcaactacatggtattttaatcc

SEQ ID NO: 296974 - DNA, 75 bp, Artificial Sequence
  Synthetic
atgtggaacattacatcattgagatcgccgtatacaagtgctaatttctttcaagattagagcgcttagatgtga

SEQ ID NO: 296975 - DNA, 75 bp, Artificial Sequence
  Synthetic
gaagtagaatttctattgaatggacagataataaatacttatcaggcaagatttggtacaattgtagctagaaat

SEQ ID NO: 296976 - DNA, 75 bp, Artificial Sequence
  Synthetic
taagtgggctgaaatctcatttaaagctgcaaattatcaatacaattacatgagagacggagaagaagttacagc

SEQ ID NO: 296977 - DNA, 75 bp, Artificial Sequence
  Synthetic
tttgctaccaggctggaaattaacatatgtaggatacaacggaagcgatactagaggacactataatttctcatt

SEQ ID NO: 296978 - DNA, 75 bp, Artificial Sequence
  Synthetic
gaaaaaatccgtatgaaccaaaggaagtgactgcagcaatgtaagaggttgagctgccgtcgactgtcttcggaa

SEQ ID NO: 296979 - DNA, 75 bp, Artificial Sequence
  Synthetic
ttgaactctacaagtaagggtacgtttacgtattcgctacgtagagtaatcactcagatgacgtagtgagaggat

SEQ ID NO: 296980 - DNA, 75 bp, Artificial Sequence
  Synthetic
ggaggttctgtattcattgtcaaaaactcttaaagatgctagggataaaatcgttgaaggtacattatattctaa

SEQ ID NO: 296981 - DNA, 75 bp, Artificial Sequence
  Synthetic
gatatgtctgaattggctgatttaatattaaatgaatggttatgcaatccaatggatataacactatattattat

SEQ ID NO: 296982 - DNA, 75 bp, Artificial Sequence
  Synthetic
ttatgttgagactgcaagaactacgattgagtattttattgatttcattgataatgtatgtatggatgaaatggc

SEQ ID NO: 296983 - DNA, 75 bp, Artificial Sequence
  Synthetic
gacggactctttgtccgatgcggcctcatctatcgcaaggagcacatcaatacgatcaataggatcgacggcatc

SEQ ID NO: 296984 - DNA, 75 bp, Artificial Sequence
  Synthetic
atttcataaaccaaacatttttccttattcagcgtcatttacactgaacagatcacaaccagctcatgataattt

SEQ ID NO: 296985 - DNA, 75 bp, Artificial Sequence
  Synthetic
cacatgtaccataagaaattgtaaaaaacttggaccaagagaaaacgttgctgtaatacaggtaggaggtccaga

SEQ ID NO: 296986 - DNA, 75 bp, Artificial Sequence
  Synthetic
gaaattacgactcaaacagaaggaatgaatttcgatgacatatcagcggcggtgctaaaagccaagatagataga

SEQ ID NO: 296987 - DNA, 75 bp, Artificial Sequence
  Synthetic
accagatgcagaaaggtttagttttccaagagtgattaattcagctgacggagcgactacatggtattttaatcc

SEQ ID NO: 296988 - DNA, 75 bp, Artificial Sequence
  Synthetic
aaaatttccactaatggctaaaatatactcatggtcgtttcatgttggattcagaaagcaaaaaatgttagatgc

SEQ ID NO: 296989 - DNA, 75 bp, Artificial Sequence
  Synthetic
catttgaggcgggcactgacggaagatttttcgcgtacaaggtggaaacgcttgaggaaatgccattcaatatag

SEQ ID NO: 296990 - DNA, 75 bp, Artificial Sequence
  Synthetic
atttttcgcgtacaaggtggaaacgcttgaggaaatgccattcaatatagaaaaattcgcagatttagttaccaa

SEQ ID NO: 296991 - DNA, 75 bp, Artificial Sequence
  Synthetic
gcaagcatttaatctgttacggtcaaaccccaaagttttgcgtggatttattgaccaaaacaatccaattataaa

SEQ ID NO: 296992 - DNA, 75 bp, Artificial Sequence
  Synthetic
ctaaccatctggtatccaatcttagttaacatgtagctatgtcaagtcattcagactctacaagtaaggacatga

SEQ ID NO: 296993 - DNA, 75 bp, Artificial Sequence
  Synthetic
ttaacctttttgatatcagttatattgttgaattacgtactcaaatccttaactagaataatggactttattatt

SEQ ID NO: 296994 - DNA, 75 bp, Artificial Sequence
  Synthetic
cctataagtatgacgttaagataccacatttgacatttggagtattgtttatttcagataatatgattccagatg

SEQ ID NO: 296995 - DNA, 75 bp, Artificial Sequence
  Synthetic
gatcacaaccagctcatgataacttgatgggtacgatgtggctcaatgcgggatcagaaattcaggtcgctggat

SEQ ID NO: 296996 - DNA, 75 bp, Artificial Sequence
  Synthetic
ctgatggaatatatgtggcaaatgttagtggagtcttagcggcatattttaaaatgtataatttattttataaaa

SEQ ID NO: 296997 - DNA, 75 bp, Artificial Sequence
  Synthetic
aattagaataccattcaaagggaagataccagctgtcacatttatattacatttatatgctaaattagaagttat

SEQ ID NO: 296998 - DNA, 75 bp, Artificial Sequence
  Synthetic
aagagggcactataatttttcttttaaatgtcaaaatgcagctacagacgatgacgcaataatagaatatatcta

SEQ ID NO: 296999 - DNA, 75 bp, Artificial Sequence
  Synthetic
ttcacaatctgctgtgcaaattccaatttattattcttccaatccggatctagaaaggagatgtgtagaatttca

SEQ ID NO: 297000 - DNA, 75 bp, Artificial Sequence
  Synthetic
actggttggtggattgctcaattgagaaatttcctttgatggcaaaaatttattcttggtcctttcatgtaggat

SEQ ID NO: 297001 - DNA, 75 bp, Artificial Sequence
  Synthetic
tagagatgaagttgtaaagatgttagaagaagcagttaaacatgatgatcatcttctgcaggattctgaattagc

SEQ ID NO: 297002 - DNA, 75 bp, Artificial Sequence
  Synthetic
gagcgcgtgcggaaagatggataaacttgccgacctcaactacacattgagtgtaatcactttaatgaatgacac

SEQ ID NO: 297003 - DNA, 75 bp, Artificial Sequence
  Synthetic
gtgtaatcactttaatgaatgacacattgcattctataattcaggatcctggaatggcgtattttccatatattg

SEQ ID NO: 297004 - DNA, 75 bp, Artificial Sequence
  Synthetic
tttaatggattcatatgtacaaataccagatggaaatgtaattaaaaagatacagtatggagcggttgcgtcagg

SEQ ID NO: 297005 - DNA, 75 bp, Artificial Sequence
  Synthetic
tgaaattatttagaatatttgaaccaagacaattaccaatctatagagcaaatggtgagaaagaattaaggaata

SEQ ID NO: 297006 - DNA, 75 bp, Artificial Sequence
  Synthetic
acattcaattggaaaagtcgctgtagaaggtggaagatattatgaacatgcaccaatcgaattgatatatgcatg

SEQ ID NO: 297007 - DNA, 75 bp, Artificial Sequence
  Synthetic
ggcttttaaagcgctacagtgatgtctctcagcattgacgtaacaagtcttccctcaatttcttctagtatcttt

SEQ ID NO: 297008 - DNA, 75 bp, Artificial Sequence
  Synthetic
atgcgcgaatgaatgctaaagtaaaagctttggtttcgacggttggaatagaaatcgctaaacgctatatcgctg

SEQ ID NO: 297009 - DNA, 75 bp, Artificial Sequence
  Synthetic
taaaacttggtgggctaggttataaatggtcagaaatttcgtttaaagcggctaattatcagtacaattacttgc

SEQ ID NO: 297010 - DNA, 75 bp, Artificial Sequence
  Synthetic
gatccactcaccagcttttcgattagatcgaatgcagttaagacaaatgcagacgctggcgtgtctatggattca

SEQ ID NO: 297011 - DNA, 75 bp, Artificial Sequence
  Synthetic
gtactagttatacttatatgctatctgataatatgtatgtagcaaatgctagtggtgtgttatcaacttatttta

SEQ ID NO: 297012 - DNA, 75 bp, Artificial Sequence
  Synthetic
ttcagagagcatttatgtcgttgtcaagccagaaatcagggatagcagacgaaattgcagcatcacaaacattta

SEQ ID NO: 297013 - DNA, 75 bp, Artificial Sequence
  Synthetic
tgcgcctatctctttggaaaaacgtcgtgcgcaaatctctgctctattgacaatgttacaaaaaccagtgacgtt

SEQ ID NO: 297014 - DNA, 75 bp, Artificial Sequence
  Synthetic
caatgttacaaaaaccagtgacgtttaaatcaaataagataaccattaatgatattttacatgacattaagccgt

SEQ ID NO: 297015 - DNA, 75 bp, Artificial Sequence
  Synthetic
tcactgggtctatggatacagcatacgccaattcaacgcaaaataataattttctatcctcgacattatgtctgt

SEQ ID NO: 297016 - DNA, 75 bp, Artificial Sequence
  Synthetic
aattggtgataatgaatggaaagatacgttatctcagttatttctaactaagggatggccaaccggttcagttta

SEQ ID NO: 297017 - DNA, 75 bp, Artificial Sequence
  Synthetic
caaaaaacaataccgacttttgaaccaaaagaatcaattttgaaaaaattagaggatataaaaccagagcaagct

SEQ ID NO: 297018 - DNA, 75 bp, Artificial Sequence
  Synthetic
aaggtaaatgaaaatatgtactctctccaaaacgttatatcacaacagcagagccagattgctgatttacaaaat

SEQ ID NO: 297019 - DNA, 75 bp, Artificial Sequence
  Synthetic
tgaaaaaggatacgctgccagacggagattatgacgtacgcgagtattttttaaatttatatgatcaaatactga

SEQ ID NO: 297020 - DNA, 75 bp, Artificial Sequence
  Synthetic
cgacaaacacaggcaccttcgagatggtagctgagaacgagaaattggcaatagttgatgtcgttgatggcgtaa

SEQ ID NO: 297021 - DNA, 75 bp, Artificial Sequence
  Synthetic
tggattagtttattctgtaactatccaaaatctgaaatgattaagctttggaagaaaatgtggaatataacttca

SEQ ID NO: 297022 - DNA, 75 bp, Artificial Sequence
  Synthetic
atagttgatgtcgttgatggcgtaaatcataaactagatatcacatctgcaacatgtacaatacgaaattgtaat

SEQ ID NO: 297023 - DNA, 75 bp, Artificial Sequence
  Synthetic
gtggcaggtattctatactgtagttgattatattaatcaaatagtacaggtcatgtccaaaagatcaagatcatt

SEQ ID NO: 297024 - DNA, 75 bp, Artificial Sequence
  Synthetic
actcaatctgatgttgcgagtgtactttcaaaagtagtttctgtaagacatctagagaatttggtacggagaaga

SEQ ID NO: 297025 - DNA, 75 bp, Artificial Sequence
  Synthetic
atctccagatgaattatttgcattaataagatgtaattttacatatgattatgagaataatacagtttatttaca

SEQ ID NO: 297026 - DNA, 75 bp, Artificial Sequence
  Synthetic
taaatttattccttttaatagtttggcaataaaatgtatgttgacagcaaaagtagacaaaaaggatcaagataa

SEQ ID NO: 297027 - DNA, 75 bp, Artificial Sequence
  Synthetic
aaatgcagcttttacaatgtggaaattgacatacctggagcatagcctaatgccaattttggatcaaaattttat

SEQ ID NO: 297028 - DNA, 75 bp, Artificial Sequence
  Synthetic
ttggaccaagaaatgaatctatgtttacatttttaaactttccaactattaaacaattttcaaatggtgcatatc

SEQ ID NO: 297029 - DNA, 75 bp, Artificial Sequence
  Synthetic
aatggaagcattaatgcagttatctagacaacaatttccgactatgccagttgattataaaagatcaatccaaag

SEQ ID NO: 297030 - DNA, 75 bp, Artificial Sequence
  Synthetic
ccgaaagattacagttaacttctgtcacatccttatgtatgttaattggaaataccacagtaattccaagtccac

SEQ ID NO: 297031 - DNA, 75 bp, Artificial Sequence
  Synthetic
agtataatctaatcttgtcagaatatttatcatttatatataactcacaatctgcagttcaaattccaatttatt

SEQ ID NO: 297032 - DNA, 75 bp, Artificial Sequence
  Synthetic
tagatctcaaccacaacatgataatttaatgggtactatgtggcttaatgcgggatcagaaattcaagttgcagg

SEQ ID NO: 297033 - DNA, 75 bp, Artificial Sequence
  Synthetic
agcatatcgtacaattacgtcgtgtcctaacgacagctaccattactctactcccagatgcagagaggtttagtt

SEQ ID NO: 297034 - DNA, 75 bp, Artificial Sequence
  Synthetic
tgaaatgctaatgtcagttttttctcatgaagattatttaattgcgagagaactgatagtactgtcatattctaa

SEQ ID NO: 297035 - DNA, 75 bp, Artificial Sequence
  Synthetic
aactactaaagatgaaatagaaaaacaaatggacagagtcgttaaagaaatgagacgtcagttggaaatgattga

SEQ ID NO: 297036 - DNA, 75 bp, Artificial Sequence
  Synthetic
attaatcaaaagaacgtaaaaacgctagaagaatgggagagtggaagaaatccttatgaaccaaaagaagtgact

SEQ ID NO: 297037 - DNA, 75 bp, Artificial Sequence
  Synthetic
ggcttttaaagcgtctcagtcgccgtttgagccttgcggtgtagccatggctgagctagcttgcttttgttatcc

SEQ ID NO: 297038 - DNA, 75 bp, Artificial Sequence
  Synthetic
tgcctattttggatcagaatttcattgaatataaaattacattgaatgaagataaaccaatttcagatgtatgtg

SEQ ID NO: 297039 - DNA, 75 bp, Artificial Sequence
  Synthetic
tcgtattcctatgataaatataatgctgtagaacggaagttggttaattacgctaaaggtaaaccattagaagca

SEQ ID NO: 297040 - DNA, 75 bp, Artificial Sequence
  Synthetic
aacaaggtaatacaattgatgtatgtaagaaactcctctttcaaaagatgaaacaagagaaaaatccgttcaaag

SEQ ID NO: 297041 - DNA, 75 bp, Artificial Sequence
  Synthetic
ctaaaaggtatattgcaggtgggaaaatattctttagagctggaataaatttactgaataacgaaaagagaggac

SEQ ID NO: 297042 - DNA, 75 bp, Artificial Sequence
  Synthetic
ggctattaaagcagtattagtagtgcgttttacctctgatggtgtaagcatgaaagtattagctttaagacacag

SEQ ID NO: 297043 - DNA, 75 bp, Artificial Sequence
  Synthetic
tgagccatggctactttcaaagatgcatgctaccattataaaagaatgaataaattaaatggttccattttaaaa

SEQ ID NO: 297044 - DNA, 75 bp, Artificial Sequence
  Synthetic
acaaatctaacatactgtaggggatgcgctctatatcatgtatgtcaatggtgtagtcaatacaatcgatgtttt

SEQ ID NO: 297045 - DNA, 75 bp, Artificial Sequence
  Synthetic
cttaatatgtatgatacccttttcccaatacatgaaaagatagtgaataaatttattaataatgttaagcaacgt

SEQ ID NO: 297046 - DNA, 75 bp, Artificial Sequence
  Synthetic
tatttggatactatgactgcatggagcaagagaatcaaacaccatttcattttgtaaatctgatagataattatg

SEQ ID NO: 297047 - DNA, 75 bp, Artificial Sequence
  Synthetic
tttgatctcactaggcataccgaaaatagacgctgatacgtacgtcggatcgaaaatttattctcaagataaata

SEQ ID NO: 297048 - DNA, 75 bp, Artificial Sequence
  Synthetic
tggaccaagaaatgaatccatgttcacattcttaaattttccaaccattaagcaattttcaaacggtgcatacat

SEQ ID NO: 297049 - DNA, 75 bp, Artificial Sequence
  Synthetic
tgtgtcgctgaacatttggatgatgataaatggaataaagcttgcacatatgttataaacgctaagaattacatg

SEQ ID NO: 297050 - DNA, 75 bp, Artificial Sequence
  Synthetic
accagatctagaaaagctgatcagaataccgtttaaaggaaagataccagctgtcacttttatattgcatttata

SEQ ID NO: 297051 - DNA, 75 bp, Artificial Sequence
  Synthetic
gaaactaacgtacttagatcataaactaatgcctattctagatcaaaacttcgttgaatacaagatcaccttgaa

SEQ ID NO: 297052 - DNA, 75 bp, Artificial Sequence
  Synthetic
aattaaaaagatatataataatgtgctagattttattagagcattatctaaatcaaatggtatggcaggacattg

SEQ ID NO: 297053 - DNA, 75 bp, Artificial Sequence
  Synthetic
gcaaactgtcaacaatctaaatattgcatataaatatctagcaacaggaaaagccaaagtgtgttgtgttaaatt

SEQ ID NO: 297054 - DNA, 75 bp, Artificial Sequence
  Synthetic
gagcctgttgacataaatgaagtagaatatgtgctgtttgatcatgagattaattgggaagttagaggcttaatt

SEQ ID NO: 297055 - DNA, 75 bp, Artificial Sequence
  Synthetic
cgagaatattaaatttaagtgatattcgattgatattaagctcgttaatatatgactggtttgatatgagataca

SEQ ID NO: 297056 - DNA, 75 bp, Artificial Sequence
  Synthetic
ttacatgactattcatattatactaataatgaaatacgaactgaccaatattggataaccaagacaaatatagaa

SEQ ID NO: 297057 - DNA, 75 bp, Artificial Sequence
  Synthetic
catttgacgttaggagtactatttatatctgataatatgatacatgatgtagttacagtattgaagaaaatgaag

SEQ ID NO: 297058 - DNA, 75 bp, Artificial Sequence
  Synthetic
aaagaagagcaccaaaaagaaatacagtatgaaattttacaaaaaacgataccaacatttgaaccaaaagagtca

SEQ ID NO: 297059 - DNA, 75 bp, Artificial Sequence
  Synthetic
atggtgaaaaagagttgcgtaacagatggtattggaagttgaagaaggatactttaccagatggagattatgacg

SEQ ID NO: 297060 - DNA, 75 bp, Artificial Sequence
  Synthetic
tttatcatttgtttataattcacaatctgcagttcaaataccaatttattattcttccaattcagaattagaaaa

SEQ ID NO: 297061 - DNA, 75 bp, Artificial Sequence
  Synthetic
agaacacatcaactttagaaccatttttgacatcaacattatgtgtttattatccaacagaagctgaaacagaaa

SEQ ID NO: 297062 - DNA, 75 bp, Artificial Sequence
  Synthetic
taaatgataattcatggaaagacacgctttcacaattatttctgactaagggatggcctactggatccgtttatt

SEQ ID NO: 297063 - DNA, 75 bp, Artificial Sequence
  Synthetic
catgtctgaattggctgatttaatattgaatgaatggttatgtaatccgatggacattactctatattattatca

SEQ ID NO: 297064 - DNA, 75 bp, Artificial Sequence
  Synthetic
acagacagatgaggctaataagtggatttctatggggtcttcatgtacaattaaagtatgtccactaaacacgca

SEQ ID NO: 297065 - DNA, 75 bp, Artificial Sequence
  Synthetic
actgatactacaacttttgaagaagttgcaacagccgaaaaattggtaataacggacgtcgttgatggggtgaat

SEQ ID NO: 297066 - DNA, 75 bp, Artificial Sequence
  Synthetic
acacattgagtgtaatcactttaatgaatgacacattacattctataattcaagatcctggaatggcgtattttc

SEQ ID NO: 297067 - DNA, 75 bp, Artificial Sequence
  Synthetic
gaatgacacattacattctataattcaagatcctggaatggcgtattttccatatattgcatctgttctaacagt

SEQ ID NO: 297068 - DNA, 75 bp, Artificial Sequence
  Synthetic
tttcgtgactacaaattatatgtcattaatttcaggtatgtggttactaactgtagtgccaaatgacatgttcat

SEQ ID NO: 297069 - DNA, 75 bp, Artificial Sequence
  Synthetic
caatttagacaagtagttattgatggtgtattgaatcaggtactgaatgacaatattagaaatggacatgtcatt

SEQ ID NO: 297070 - DNA, 75 bp, Artificial Sequence
  Synthetic
gaaataattaaaatgctagaagtaccagttaaacatgatgatcatctccttcgtgattcagaattagctggattg

SEQ ID NO: 297071 - DNA, 75 bp, Artificial Sequence
  Synthetic
tgggaatgattttcagactggaggaattggtaatttacctattagaaattggacttttgattttggtctattggg

SEQ ID NO: 297072 - DNA, 75 bp, Artificial Sequence
  Synthetic
ggacttttgattttggtctattgggtactacgcttttgaacttagatgcaaattatgttgagactgcaaggacta

SEQ ID NO: 297073 - DNA, 75 bp, Artificial Sequence
  Synthetic
aaaattagcaggtattaaatttaaaagaataaactttgataattcatcagaatacatagaaaattggaatttaca

SEQ ID NO: 297074 - DNA, 75 bp, Artificial Sequence
  Synthetic
tatatttatattaccatatgaatactttattgcgcagcacgctgtcgtagaaaaaatgctatcatacgcaaagca

SEQ ID NO: 297075 - DNA, 75 bp, Artificial Sequence
  Synthetic
cctgtactatcagaaattgcaagaaattgggaccaagagagaatgtagcagtgatacaagtgggtggtgctgata

SEQ ID NO: 297076 - DNA, 75 bp, Artificial Sequence
  Synthetic
ttaatgggaactatgtggcttaatgccggatcagaaattcaagtagccggatttgactattcgtgtgctataaac

SEQ ID NO: 297077 - DNA, 75 bp, Artificial Sequence
  Synthetic
tcttttataactaaaataatcagagttgatggtgatgacaattatgcagtactacaatttaacaccgatgtcact

SEQ ID NO: 297078 - DNA, 75 bp, Artificial Sequence
  Synthetic
aacaaggtaacactcttgatgtatgtaaaaaactactcttccaaaaaatgaagcgagaaagtaatccatttaagg

SEQ ID NO: 297079 - DNA, 75 bp, Artificial Sequence
  Synthetic
tgaacgctactaaagatgaaccatttctaacgtcaacattatgtttatactatccaacagaagctagaacagaaa

SEQ ID NO: 297080 - DNA, 75 bp, Artificial Sequence
  Synthetic
aagcgagaaagtaatccatttaaggggctgtcaactgatagaaaaatggatgaagtttctcaaataggaatttaa

SEQ ID NO: 297081 - DNA, 75 bp, Artificial Sequence
  Synthetic
acaattgattattttgtagattttgtagataacgtatgtatggatgaaatggttagagaatcacaaagaaatgga

SEQ ID NO: 297082 - DNA, 75 bp, Artificial Sequence
  Synthetic
ttagatgtaattttacatatgattacattgatgatatcgtttatttacatgattattcatattacactaataatg

SEQ ID NO: 297083 - DNA, 75 bp, Artificial Sequence
  Synthetic
ctgacgatgaagtatatatacagagagcatttatgtcattgtctagtcaaaagtcaggaatagctgatgaaattg

SEQ ID NO: 297084 - DNA, 75 bp, Artificial Sequence
  Synthetic
ttacgtgaatcaaattgggcaagcaatgtctaagaggtccagatcactgaattcagcagcgtttattatagagtg

SEQ ID NO: 297085 - DNA, 75 bp, Artificial Sequence
  Synthetic
atatattagatataacagctgatcccacaacttctccacaaacagaacgaatgatgcgcgtgaattggaaaaaat

SEQ ID NO: 297086 - DNA, 75 bp, Artificial Sequence
  Synthetic
caaattattggttctgaaaaaacacaaaacgtaacaataaacccaggaccatttgctcaaaccggatatgcgcca

SEQ ID NO: 297087 - DNA, 75 bp, Artificial Sequence
  Synthetic
tacctgataacgtccaatatgttatacaatgtataggatcaaggacgtatcagatagaagatagtgggtcgaaat

SEQ ID NO: 297088 - DNA, 75 bp, Artificial Sequence
  Synthetic
atgattcaacaacagttgagccagtacttgatggcccatatcaacctactacgttcaatccaccagtaagttatt

SEQ ID NO: 297089 - DNA, 75 bp, Artificial Sequence
  Synthetic
aagacatcaaaatgctcgtacaaagtggtgaagtattgcattgtgacaattttcaatacgctgttgaagttggca

SEQ ID NO: 297090 - DNA, 75 bp, Artificial Sequence
  Synthetic
caaaattatggaatgaatcttccaattactggatcaatggatactccatatgcaaactcgacacaagaggaagtg

SEQ ID NO: 297091 - DNA, 75 bp, Artificial Sequence
  Synthetic
acaaagcagaacatataccctatttggacagcaagaacagataacagttgagaatgtttcaacaacgaagtggaa

SEQ ID NO: 297092 - DNA, 75 bp, Artificial Sequence
  Synthetic
aataaatgacaattcatggaaagatacactttctcagctatttctaactaaagggtggccaacaggatctgttta

SEQ ID NO: 297093 - DNA, 75 bp, Artificial Sequence
  Synthetic
aagggtggccaacaggatctgtttattttaaagactacgcagacatcgcctcattttcaattgatccacaattat

SEQ ID NO: 297094 - DNA, 75 bp, Artificial Sequence
  Synthetic
ggattaccaccaatacaaaatactagaaatgtagttccagtatctttaacttctagatcaattgtacacactaga

SEQ ID NO: 297095 - DNA, 75 bp, Artificial Sequence
  Synthetic
actggatccatggacacaccgtatatgaattcaacaatgagtgaaactttcttaacttcaacattatgtttatat

SEQ ID NO: 297096 - DNA, 75 bp, Artificial Sequence
  Synthetic
taattaaatctggtggtctagggtataagtggtctgagatttcatttaaaccggcaaactatcaatataattaca

SEQ ID NO: 297097 - DNA, 75 bp, Artificial Sequence
  Synthetic
tcaaagggtatgcagacatcgcgtcattttctgtagagccacaattatactgcgattacaacattgtagtgatga

SEQ ID NO: 297098 - DNA, 75 bp, Artificial Sequence
  Synthetic
gtggcaggtattttacacaatagttgactatgtgaatcaaattgtgcaggtaatgtccaaaagatcaagatcaat

SEQ ID NO: 297099 - DNA, 75 bp, Artificial Sequence
  Synthetic
tggacgtaaaactttattattatcaacagactgatgaagctaacaaatggatatccatgggttcattgtgtacga

SEQ ID NO: 297100 - DNA, 75 bp, Artificial Sequence
  Synthetic
gccagttggcgcatggccggtaatgactggtggcgctgtatcactacgacctgcaggagtaacactatcaacaca

SEQ ID NO: 297101 - DNA, 75 bp, Artificial Sequence
  Synthetic
ctgcaagatgacttaacagtattaaggtattcaaatgaaatagaaaactatattaatagagtgtatagcataacg

SEQ ID NO: 297102 - DNA, 75 bp, Artificial Sequence
  Synthetic
tcgctaagattcagattcagcttatcagtagaagaaccaccatttgctattgcacgtactagagtatcaggtctg

SEQ ID NO: 297103 - DNA, 75 bp, Artificial Sequence
  Synthetic
caacggtagaaccagttttagatggtccctatcagccaacaagttttaaaccgccgaacgattattggttattgt

SEQ ID NO: 297104 - DNA, 75 bp, Artificial Sequence
  Synthetic
gtgattcaagtaggaggttcaaatgtactcgacataacagcagacccaactactgcaccacaaactgaaaggatg

SEQ ID NO: 297105 - DNA, 75 bp, Artificial Sequence
  Synthetic
attaggaagattttcgcttatatcattagtgccatcgaatgacgattatcagacaccaattattaattcagtaac

SEQ ID NO: 297106 - DNA, 75 bp, Artificial Sequence
  Synthetic
aaccaaacacaaccagtcaagacagacaatacacgctgtttggagaaacgaagcaaataactattgagaataatt

SEQ ID NO: 297107 - DNA, 75 bp, Artificial Sequence
  Synthetic
ggcaagtcttttatacaatagttgattatgttaatcaaattgtacaagtgatgtccaaacgatcacgttccttaa

SEQ ID NO: 297108 - DNA, 75 bp, Artificial Sequence
  Synthetic
ttatgttaatcaaattgtacaagtgatgtccaaacgatcacgttccttaaactcagctgcattttactatcgggt

SEQ ID NO: 297109 - DNA, 75 bp, Artificial Sequence
  Synthetic
tataaaatggcttcactcatttatagacaactacttactaattcgtatacagtcaatctttctgacgagattcaa

SEQ ID NO: 297110 - DNA, 75 bp, Artificial Sequence
  Synthetic
aaagcatggtggacgcgtatggacttttcacggtgaaacaccaaatgctacaaccgattactcaacaacttcgaa

SEQ ID NO: 297111 - DNA, 75 bp, Artificial Sequence
  Synthetic
tcatcaatttcgagaaacccttccataagatcagttggatcatccgtatcagtatggacagacatatctacgcaa

SEQ ID NO: 297112 - DNA, 75 bp, Artificial Sequence
  Synthetic
tactactcgcgccaactgtagagggtgtaattatccaaggaacaaacaatactgatagatggttggccactatat

SEQ ID NO: 297113 - DNA, 75 bp, Artificial Sequence
  Synthetic
aataagtagacgattgagattaaaagaaattacaactcaaacagaaggtatgaatttcgatgatatttcagctgc

SEQ ID NO: 297114 - DNA, 75 bp, Artificial Sequence
  Synthetic
cattatggaaagaaatgcaatacaatagagatattataataaggtttaagtttaataatagtatagtgaagcttg

SEQ ID NO: 297115 - DNA, 75 bp, Artificial Sequence
  Synthetic
cgttgatgtaagcaaaactacactaacaggaagttacacacagcacggaccactgctttctacgccaaaattgta

SEQ ID NO: 297116 - DNA, 75 bp, Artificial Sequence
  Synthetic
aataaactttaacaattcatcagaatatatagaaaattggaatttacaaaatagaagacagcgtactggatttgt

SEQ ID NO: 297117 - DNA, 75 bp, Artificial Sequence
  Synthetic
gtggcattgcattttgcaggggttacgctatctactcaatttactgatttcgtgtcgctcaattcactaagattc

SEQ ID NO: 297118 - DNA, 75 bp, Artificial Sequence
  Synthetic
taactacagctactataactttgttacctgatgcagaaagatttagttttccaagagttattaattcagcggatg

SEQ ID NO: 297119 - DNA, 75 bp, Artificial Sequence
  Synthetic
aatattacgagatagctgggaggttttctcttatttcattagtaccatctaatgatgactatcaaaccccaatta

SEQ ID NO: 297120 - DNA, 75 bp, Artificial Sequence
  Synthetic
ttctcttatttcattagtaccatctaatgatgactatcaaaccccaattatgaattcggttacagttcgacagga

SEQ ID NO: 297121 - DNA, 75 bp, Artificial Sequence
  Synthetic
gtatgaaattttacaaaaaacgataccaacttttgaaccaaaggaatcaattttgaaaaaattagaagacataaa

SEQ ID NO: 297122 - DNA, 75 bp, Artificial Sequence
  Synthetic
tcatttgtttatattgattattgggatgactcacaagcattcagaaacatggtgtatgttcggtcgcttgctgct

SEQ ID NO: 297123 - DNA, 75 bp, Artificial Sequence
  Synthetic
gaagttgttaaaatgcttgaagaatcagtaaaacatgatgaccacctattacaagattctgaattagctggcttg

SEQ ID NO: 297124 - DNA, 75 bp, Artificial Sequence
  Synthetic
caggagttacgttatccacccaattcactgatttcgtatctctcaattcattacgctttagattcagattaactg

SEQ ID NO: 297125 - DNA, 75 bp, Artificial Sequence
  Synthetic
gtcaagtgctgcttcatcgatttctagaggctcatctattagatctggcatatcatccatttccgtatggacgga

SEQ ID NO: 297126 - DNA, 75 bp, Artificial Sequence
  Synthetic
caactaatgaggcctccaaatatgacacctgcagtcgcagctctatttccaaatgctcaaccattcgttcatcat

SEQ ID NO: 297127 - DNA, 75 bp, Artificial Sequence
  Synthetic
caaactgaaggtatgaattttgatgatatttcagcagcagttcttaagactaagatagataaatcaacgcatata

SEQ ID NO: 297128 - DNA, 75 bp, Artificial Sequence
  Synthetic
caactctttctggaaaatctattggtaggaacgaacagtatgtttcatcagatatcgaagcattcaataaataca

SEQ ID NO: 297129 - DNA, 75 bp, Artificial Sequence
  Synthetic
cattgtcacagcaaatagcaatgtcacaattaattgatctagcgttattgccattagatatgttttcgatgtttt

SEQ ID NO: 297130 - DNA, 75 bp, Artificial Sequence
  Synthetic
atgtggatgggaaatttttcgcatataaagttgatacctttgaagaagtaccatttgatgtagataaattcgttg

SEQ ID NO: 297131 - DNA, 75 bp, Artificial Sequence
  Synthetic
cttaattagatctgatcccagagttttgcgagattttatcaatcaaaataatccaattattaaaaatagaatcga

SEQ ID NO: 297132 - DNA, 75 bp, Artificial Sequence
  Synthetic
tggctagcggttagctccttttgatgtatggtattgaatataccacatttctaatctacttaatatcaataatat

SEQ ID NO: 297133 - DNA, 75 bp, Artificial Sequence
  Synthetic
agacataaaaccagaacaggctaaaaagcaaactaaattgtttagaatatttgaaccaagacaattaccaattta

SEQ ID NO: 297134 - DNA, 75 bp, Artificial Sequence
  Synthetic
gaattatggcattaatttaccaataactggatcaatggatgtatcatacgtgaatgccgcgaaggacgaaccatt

SEQ ID NO: 297135 - DNA, 75 bp, Artificial Sequence
  Synthetic
aagcaaactaaattgtttagaatatttgaaccaagacaattaccaatttatcgggcgaacggtgagagagaattg

SEQ ID NO: 297136 - DNA, 75 bp, Artificial Sequence
  Synthetic
gggtggccaactggatctgtgtactttaaagaatatgataatatagctactttttcggtggatcctcaactttat

SEQ ID NO: 297137 - DNA, 75 bp, Artificial Sequence
  Synthetic
tgtgattacaatatagttctaatgcgatataattcaagtttagagcttgacatgtcagaattagcgaacctaata

SEQ ID NO: 297138 - DNA, 75 bp, Artificial Sequence
  Synthetic
atagcgatgggacagtcatgtacgataaaagtgtgtccattgaatactcaaacactaggaataggatgtcagact

SEQ ID NO: 297139 - DNA, 75 bp, Artificial Sequence
  Synthetic
gaatttttgaagagactgcaaattttcgatgtaccacgagtgcctgatgatcaaatgtatagactgagggataga

SEQ ID NO: 297140 - DNA, 75 bp, Artificial Sequence
  Synthetic
cttgtaccattagaaattgtaaaaaactgggaccaagagagaatgtagctgtgatacaagtcggtggtgctgaca

SEQ ID NO: 297141 - DNA, 75 bp, Artificial Sequence
  Synthetic
tccttctatttcttccagcatatataaaaatgaatcatcttcaacaacgtcaactctttctggaaaatctattgg

SEQ ID NO: 297142 - DNA, 75 bp, Artificial Sequence
  Synthetic
gtttgcacaaacgagctatgctccggttaactggggtcctggcgaaacaaatgactcaacagtgatagaaccagt

SEQ ID NO: 297143 - DNA, 75 bp, Artificial Sequence
  Synthetic
aggagtggtagttgaaggcacgaataatacaaataggtggttagcgacaatattaatagaaccgaacgtacagtc

SEQ ID NO: 297144 - DNA, 75 bp, Artificial Sequence
  Synthetic
aggaaacactaccctaaaatagaagcagaatctgattcagatgaatatgtacttgacgattctgatagtgatgat

SEQ ID NO: 297145 - DNA, 75 bp, Artificial Sequence
  Synthetic
caagatggtaactattcgcagcatggaccattattatcaacaccaaaactatatggagtgatgaaacacggaggt

SEQ ID NO: 297146 - DNA, 75 bp, Artificial Sequence
  Synthetic
gaccattattatcaacaccaaaactatatggagtgatgaaacacggaggtaaaatatatacatataatggagaaa

SEQ ID NO: 297147 - DNA, 75 bp, Artificial Sequence
  Synthetic
aaagtgtactgagtacataaataacgggttaccaccgatacaaaacaccagaaacgttgtaccagtgtcaatcag

SEQ ID NO: 297148 - DNA, 75 bp, Artificial Sequence
  Synthetic
ttcttttgaagctgcagttgttgctgccacttcaactcttgaacttatgggtattcaatatgattataatgaagt

SEQ ID NO: 297149 - DNA, 75 bp, Artificial Sequence
  Synthetic
tcgcacttagaatgagaatgaagcaagtcgcaatgcaactgattgaagatttgtaagtctgacctgagaactcac

SEQ ID NO: 297150 - DNA, 75 bp, Artificial Sequence
  Synthetic
ttttctaccaacagattttaatacgaccgatactataataacttcatacgatggatgtttaggtatatttggact

SEQ ID NO: 297151 - DNA, 75 bp, Artificial Sequence
  Synthetic
ataagattcaaattcgctaattcaattgttaaatcaggtggattaggatataaatggtctgaagtgtcatttaaa

SEQ ID NO: 297152 - DNA, 75 bp, Artificial Sequence
  Synthetic
ggtcgttaccaactgactttgttatatcaaagtatgaagttataaaagaaaattcattcgtctacattgactatt

SEQ ID NO: 297153 - DNA, 75 bp, Artificial Sequence
  Synthetic
gataaattatttccatttattgtaaatatgtataaaaaagtgataaatgttggtccaagaaatgagtcaatgttt

SEQ ID NO: 297154 - DNA, 75 bp, Artificial Sequence
  Synthetic
accagttggaaactatccggtcatgaccggtggtgctgtttcactacattcagctggagttacattgtcgacaca

SEQ ID NO: 297155 - DNA, 75 bp, Artificial Sequence
  Synthetic
ttgaagagaaaatggaagtagatacaattgattggaaatcaagatacgaacagttagaaaagagatttgagtcat

SEQ ID NO: 297156 - DNA, 75 bp, Artificial Sequence
  Synthetic
tattgtaataaattggaagttgatctacaaaataaaatcagttcacttgtgtcttcagttgaatggtacatgaaa

SEQ ID NO: 297157 - DNA, 75 bp, Artificial Sequence
  Synthetic
tacggattaccagcagcaaaaccaaataattcacaagaatattatgagatagcaggaagattttcactaatatca

SEQ ID NO: 297158 - DNA, 75 bp, Artificial Sequence
  Synthetic
tctatggaactgcctgatgaaattaagacggatattgaacaacagctaaattctattgacgtaatcaatccaatt

SEQ ID NO: 297159 - DNA, 75 bp, Artificial Sequence
  Synthetic
ttctattgacgtaatcaatccaattaatgctatagatgattttgaatcactgatcagaaatattatacttgatta

SEQ ID NO: 297160 - DNA, 75 bp, Artificial Sequence
  Synthetic
ctactagttacacatatatgttatctgatggagtatatgtagcaaatgttagtggagttttagcgacatatttta

SEQ ID NO: 297161 - DNA, 75 bp, Artificial Sequence
  Synthetic
ataatttgtcacaacaaatagcaatgtcacaactgatagacttagcgctactaccacttgatatgttttcaatgt

SEQ ID NO: 297162 - DNA, 75 bp, Artificial Sequence
  Synthetic
aaatgtacaatttattttataaaagtcagattacattcggccaatctagaatgttcattccgcatataacattaa

SEQ ID NO: 297163 - DNA, 75 bp, Artificial Sequence
  Synthetic
tttcgggaataaaaagcacaattgatgcagcaaagtcaatggcaacaaacgtaatgaagaaatttaaaaagtcaa

SEQ ID NO: 297164 - DNA, 75 bp, Artificial Sequence
  Synthetic
cttgtacttacgagtaattgaatgaccaattcaatattaccatctacacgtaaccctctatgagcaaatagttaa

SEQ ID NO: 297165 - DNA, 75 bp, Artificial Sequence
  Synthetic
tttgcgaagcactcaattcaattaaagttacacaatctgacgttgctaatgttctttcaagagtagtttctgtta

SEQ ID NO: 297166 - DNA, 75 bp, Artificial Sequence
  Synthetic
aactcaatatatttaagaaaaattagaggagatacggtgtttgatatgtctgagtgagctagaaacttaacacac

SEQ ID NO: 297167 - DNA, 75 bp, Artificial Sequence
  Synthetic
agcttggacggaagtatctgaagttgcaacagaagttaatgaactaacaaattcaatatcgacgcagacatcaac

SEQ ID NO: 297168 - DNA, 75 bp, Artificial Sequence
  Synthetic
tttcattcgaaagaactactcttaaaatctgttttgatagctattggtcaatcaaaagaaattgaaactactgct

SEQ ID NO: 297169 - DNA, 75 bp, Artificial Sequence
  Synthetic
tcaactcaaataaatgcgaatacattgcctgacatagtaactgaagcttcagaaaagtttataccgaacagggct

SEQ ID NO: 297170 - DNA, 75 bp, Artificial Sequence
  Synthetic
attttaaaaatatttatgattggacatttctgccaacagattttgaagttaaagattcaataattacatcatatg

SEQ ID NO: 297171 - DNA, 75 bp, Artificial Sequence
  Synthetic
atggtattggaaattaaagaaagacactctaccagatggagattatgatgttagagaatactttctcaatttata

SEQ ID NO: 297172 - DNA, 75 bp, Artificial Sequence
  Synthetic
aaaaattcgcagatttggtgactgattctccagtaatatcagctataattgattttaagacgctgaagaatttga

SEQ ID NO: 297173 - DNA, 75 bp, Artificial Sequence
  Synthetic
attttacatttgaaacatgggatccattggacactccatattctacaacgcatcataaggaactgttttttgata

SEQ ID NO: 297174 - DNA, 75 bp, Artificial Sequence
  Synthetic
gatccaaaggtgttaagagaatttattaatcagaataatccaataatacggaataggatagagaatctaatcatg

SEQ ID NO: 297175 - DNA, 75 bp, Artificial Sequence
  Synthetic
gatgaaacaggaaaagaatccatttaaaggactgtcaactgatagaaaaatggatgaagtctcacatgttggaat

SEQ ID NO: 297176 - DNA, 75 bp, Artificial Sequence
  Synthetic
atgaaagtattagctttaagacacagtgtggctcaggtgtatgcagatacgcaaacctacgtacatgatgattca

SEQ ID NO: 297177 - DNA, 75 bp, Artificial Sequence
  Synthetic
tatgctgatgatccaaattactttataggaattaaatttgatagtataccttatgaatacgatgttaaaattcca

SEQ ID NO: 297178 - DNA, 75 bp, Artificial Sequence
  Synthetic
acaattttgaatctttgtgggatacaataacgacttcaaactatatactagcacggtcagtagtaccggatctaa

SEQ ID NO: 297179 - DNA, 75 bp, Artificial Sequence
  Synthetic
aaattcacaagcagctaatgattgctttaagactttgattgcagcaatgttaagtcaacgaactatgtcgcttga

SEQ ID NO: 297180 - DNA, 75 bp, Artificial Sequence
  Synthetic
atcttcagttgaatggtatatgaaatcaatggaattgcctgatgaagttaaaacggatattgaacaacagctgaa

SEQ ID NO: 297181 - DNA, 75 bp, Artificial Sequence
  Synthetic
cacagccatttagaaaaggaataattatgggtttagatatgttatctaatatgactaacgatccaaaagtaatac

SEQ ID NO: 297182 - DNA, 75 bp, Artificial Sequence
  Synthetic
aatcaattgatggaagctctaatgcaattatcacgacagcagtttccaacaatgccagttgactacaaaaggtcg

SEQ ID NO: 297183 - DNA, 75 bp, Artificial Sequence
  Synthetic
aatgccagttgactacaaaaggtcgattcagcgtggaatattgttgttatctaataggcttggccaattagttga

SEQ ID NO: 297184 - DNA, 75 bp, Artificial Sequence
  Synthetic
cggatgtaaatagtaataatgatcgaatgcaagagaaagatgatgataaacaagatagaaacaataaaatacaat

SEQ ID NO: 297185 - DNA, 75 bp, Artificial Sequence
  Synthetic
caaattataacgaaagaattaatgacgcggtagctataataactgcagctaatagattaaatttgtatcaaaaga

SEQ ID NO: 297186 - DNA, 75 bp, Artificial Sequence
  Synthetic
aatagattaaatttgtatcaaaagaaaatgaaagcaattgttgaggattttttaaagagattacacatttttgat

SEQ ID NO: 297187 - DNA, 75 bp, Artificial Sequence
  Synthetic
taagcagttgcttgaagtgttgaaaacgaaagaggaacatcaaaaagaaatacaatatgaaatcttacaaaaaac

SEQ ID NO: 297188 - DNA, 75 bp, Artificial Sequence
  Synthetic
ctaatttagcactaatcaaaacagttttatcacgcatagcgaacaaatattcatttgtgactaaaataattcgag

SEQ ID NO: 297189 - DNA, 75 bp, Artificial Sequence
  Synthetic
tgtgttgataattcaaagaaaggtttatcattaaaatcattatttgaagaatataaagatgtaatagataatgcg

SEQ ID NO: 297190 - DNA, 75 bp, Artificial Sequence
  Synthetic
agatgcgggaaaagttgtagattctgagacagcaagtatttgtgatgctatatttcaagatgaggaaacggaagg

SEQ ID NO: 297191 - DNA, 75 bp, Artificial Sequence
  Synthetic
tatgcaaatgacatcagtagctattactggatcgcttagattgtttccatcagaaagagttttaacaaccaactc

SEQ ID NO: 297192 - DNA, 75 bp, Artificial Sequence
  Synthetic
catattctggatacatttttagagatctttcaaacaataacttcaacttaataggcactaatgtagagaattccg

SEQ ID NO: 297193 - DNA, 75 bp, Artificial Sequence
  Synthetic
ttaatatggacagaaacttaccatcaacagctagatatataagaccaaatttactacaagacaggttaaatttac

SEQ ID NO: 297194 - DNA, 75 bp, Artificial Sequence
  Synthetic
agaaggtggaaaatattatgaacatgcaccaatcgaattaatatatgcatgtcgatcagctaaagaatttgctat

SEQ ID NO: 297195 - DNA, 75 bp, Artificial Sequence
  Synthetic
gtcgatcagctaaagaatttgctatgctgcaagatgatttaacggtattaagatacgctaatgaaattgaagggt

SEQ ID NO: 297196 - DNA, 75 bp, Artificial Sequence
  Synthetic
gcaaattcaaaaaatgtcacaagatctacaattagaagcgttgacgattcaatcagagacgcagtttctgacggg

SEQ ID NO: 297197 - DNA, 75 bp, Artificial Sequence
  Synthetic
cctatgaatacgatgttaaaattccgcatttaacactcggagtactatttatatctgataatatggtacatgatg

SEQ ID NO: 297198 - DNA, 75 bp, Artificial Sequence
  Synthetic
tcattaatttctggtatgtggttgttaaccgttgttccaaatgacatgttcataagggaatctttagtcgcatgt

SEQ ID NO: 297199 - DNA, 75 bp, Artificial Sequence
  Synthetic
gggtaaccaagacaaatatagaggattatctattaccaggatggaaattgacgtacgttggatacaatgggagtg

SEQ ID NO: 297200 - DNA, 75 bp, Artificial Sequence
  Synthetic
tagtggtgtattgtcgacttacttcaaattatacaatatgttctatagaaatcatatcacgtttggacagtcacg

SEQ ID NO: 297201 - DNA, 75 bp, Artificial Sequence
  Synthetic
aaattatacaatatgttctatagaaatcatatcacgtttggacagtcacgaatgtttattcctcacattacactt

SEQ ID NO: 297202 - DNA, 75 bp, Artificial Sequence
  Synthetic
tgaatataaagttacgttgaatgaagataaaccaatttcagacgaacatgtgaaagaactggtcgctgagcttcg

SEQ ID NO: 297203 - DNA, 75 bp, Artificial Sequence
  Synthetic
caaacaccatttccaatagcagaacaacagatacaaaactttcaagtggcaaattggttgcacttcgttaacaac

SEQ ID NO: 297204 - DNA, 75 bp, Artificial Sequence
  Synthetic
gaccagttaaaaacagagtatactgaagatgtggataatgaaatgtataatgagtatacaatgttaattagagac

SEQ ID NO: 297205 - DNA, 75 bp, Artificial Sequence
  Synthetic
ttcacaatctgctgttcaaataccaatttattattcttccaatcctgaattagagaaaaggtgtattgattttca

SEQ ID NO: 297206 - DNA, 75 bp, Artificial Sequence
  Synthetic
tagagaaaaggtgtattgattttcacgcaaaatgtgtcgataattcaaagagaggtttatcactaaaaccgttgt

SEQ ID NO: 297207 - DNA, 75 bp, Artificial Sequence
  Synthetic
agtacaatctaatcttgtcagaatatttatcatttgtttataattcacaatctgctgtgcaaataccaatttatt

SEQ ID NO: 297208 - DNA, 75 bp, Artificial Sequence
  Synthetic
taaacaagaaagatggcttggtaagagattgtcacagtttgatattggtcaatacaagaatatgctgaatgtatt

SEQ ID NO: 297209 - DNA, 75 bp, Artificial Sequence
  Synthetic
tctaacttaaagtttgagacgtgggacccattggacacaccatattctgatctgcatcataaggagttattttac

SEQ ID NO: 297210 - DNA, 75 bp, Artificial Sequence
  Synthetic
acaaaattatggaataaatttgccaatcactggatctatggatacagcatatgctaactcaacacaagacaataa

SEQ ID NO: 297211 - DNA, 75 bp, Artificial Sequence
  Synthetic
tactgacctcattatcatctaatttaaatgcagttatgttttggttggaacgccattcaaatgatgttgctgacg

SEQ ID NO: 297212 - DNA, 75 bp, Artificial Sequence
  Synthetic
aagtcggctgaagaatacactgattcattaatggatcctgctatactaacttcattatcatctaacttgaatgcc

SEQ ID NO: 297213 - DNA, 75 bp, Artificial Sequence
  Synthetic
aagaacaaaccattagcaatttaaacatcgcatataaatatttatctacggggaaagctaagatatgttgtgtta

SEQ ID NO: 297214 - DNA, 75 bp, Artificial Sequence
  Synthetic
cgattagacatttttaatttaatactaatgaatatggatcaaatagaacgtgcttcagataaaattgcgcagggt

SEQ ID NO: 297215 - DNA, 75 bp, Artificial Sequence
  Synthetic
gggaaagctaagatatgttgtgttaaaatgactgctatggatttagaattgccaatatctgcaaaattattacat

SEQ ID NO: 297216 - DNA, 75 bp, Artificial Sequence
  Synthetic
ggattctagaaatattaaaagatttataccgaaaggtgtattatattcatatgtaaataacataattactgaaaa

SEQ ID NO: 297217 - DNA, 75 bp, Artificial Sequence
  Synthetic
cgcgcaaataactaatatgcttttaaataatcaaccagtagcgctagttggagctcttccatttattacagattc

SEQ ID NO: 297218 - DNA, 75 bp, Artificial Sequence
  Synthetic
gtacatttattacaaacgaagagttagaacttgaattctcagacaaatatgtgagagcaattgtgcctgaccaga

SEQ ID NO: 297219 - DNA, 75 bp, Artificial Sequence
  Synthetic
agaaatgttgatgtcagtattctcacatgaggactatttaatagcgaaagaattaataattttgtcatattctaa

SEQ ID NO: 297220 - DNA, 75 bp, Artificial Sequence
  Synthetic
cagccatttgtgacgcaatctttcaggatgaggaaactgaaggtgtagtgagaagattcatagctgaaatgagac

SEQ ID NO: 297221 - DNA, 75 bp, Artificial Sequence
  Synthetic
tactcatggtcgtttcatgttggatttaggaagcagaaaatgatagatgcagcgttagatcaattaaaaacagaa

SEQ ID NO: 297222 - DNA, 75 bp, Artificial Sequence
  Synthetic
gtaggatttaaaaatatttatgactggacttttttgccaacagatttcgaaacaaacgaatcaatagttacttca

SEQ ID NO: 297223 - DNA, 75 bp, Artificial Sequence
  Synthetic
agcgttagatcaattaaaaacagaatatactgaggatgtggataatgaaatgtacaatgagtatacaatgttaat

SEQ ID NO: 297224 - DNA, 75 bp, Artificial Sequence
  Synthetic
tgtacaatgagtatacaatgttaattagagatgaaatagtcaaaatgttagaagtaccagttaaacatgatgatc

SEQ ID NO: 297225 - DNA, 75 bp, Artificial Sequence
  Synthetic
atagagaatttatattaactaaaattatacaaatgacatctgtagctattactggatcattaagattatttccat

SEQ ID NO: 297226 - DNA, 75 bp, Artificial Sequence
  Synthetic
tcacaagctgctaatgactgttttaaaacgttaattgctgctatgcttagtcaacgtactatgtctttagatttc

SEQ ID NO: 297227 - DNA, 75 bp, Artificial Sequence
  Synthetic
attaatttattataggtataattattcatttgatcttaagcgatggatatatttacattcaacaggtaaagctag

SEQ ID NO: 297228 - DNA, 75 bp, Artificial Sequence
  Synthetic
cgtagagatgttcctggacgaagaacaagaattatatttatattaccatatgagtattttattgcgcaacacgct

SEQ ID NO: 297229 - DNA, 75 bp, Artificial Sequence
  Synthetic
tcatttgatcttaagcgatggatatatttacattcaacaggtaaagctagtattgaaggtggcagatattatgaa

SEQ ID NO: 297230 - DNA, 75 bp, Artificial Sequence
  Synthetic
agaccaattccattggggcgtagagatgttcccggacgaagaacaagaatcatattcatattaccgtacgagtac

SEQ ID NO: 297231 - DNA, 75 bp, Artificial Sequence
  Synthetic
gaaactgcaagatgatttaacagtattaagatattcaaatgagatagaagactatattaataaagtgtatagtat

SEQ ID NO: 297232 - DNA, 75 bp, Artificial Sequence
  Synthetic
ttagaaaaggaataattatgggtttagatatgttagctaatatgactaacgacccaaaagtggtgcagacactga

SEQ ID NO: 297233 - DNA, 75 bp, Artificial Sequence
  Synthetic
tagtaactctatggtattatatacagatgtttcgcaatgggattcatcgcaacacaatacacaaccattcagaaa

SEQ ID NO: 297234 - DNA, 75 bp, Artificial Sequence
  Synthetic
acaatgtataggatcaagaacataccaaatagaagatagtgggtcaaaatcatcaatttcgaaattaatatcgaa

SEQ ID NO: 297235 - DNA, 75 bp, Artificial Sequence
  Synthetic
acattcgatagaaaaagctgatatagaaggtgggaaatattatgaacatgctccaatagaactgatttatgcttg

SEQ ID NO: 297236 - DNA, 75 bp, Artificial Sequence
  Synthetic
tatctgacgaagtgtatgtagcgaatgttagtggcgtgctgtcaacatattttaaaatttataatgcgttttaca

SEQ ID NO: 297237 - DNA, 75 bp, Artificial Sequence
  Synthetic
tgagagaacaagaaatacaattatatttagtttcactgggagttccaccagttgatgcaggtacatatgttggat

SEQ ID NO: 297238 - DNA, 75 bp, Artificial Sequence
  Synthetic
tatgcagatgatccaaattactttataggcattaaattcagacacattccctataaatatgatgttaaaatccca

SEQ ID NO: 297239 - DNA, 75 bp, Artificial Sequence
  Synthetic
ggcttttttttatgaaaagtcttgtgtgagccatggctacttttaaggatgcatgctatcattacaagagaataa

SEQ ID NO: 297240 - DNA, 75 bp, Artificial Sequence
  Synthetic
attaggagctaatgatgaatggagaccagcaccaataacaaaattcaaaggttggtgtttagattgttgtcaata

SEQ ID NO: 297241 - DNA, 75 bp, Artificial Sequence
  Synthetic
gaggaaaaatatttttcagagctggtataaacttactaaataacgaaaagcgtggacaaagtacgcaatgggatc

SEQ ID NO: 297242 - DNA, 75 bp, Artificial Sequence
  Synthetic
tacaaatctgacatactgtagggggtgtgctctataccatgtgtgtcaatggtgtagccagtataatcggtgttt

SEQ ID NO: 297243 - DNA, 75 bp, Artificial Sequence
  Synthetic
tattgtaaataagctacgaggatttgaaaccgatagagaatttatattaactaaaattatacagatgacatctgt

SEQ ID NO: 297244 - DNA, 75 bp, Artificial Sequence
  Synthetic
aggatgagaacatttaaaaacactataagtaaagaagatattgaaaatttactggatatgtatgatactctgttc

SEQ ID NO: 297245 - DNA, 75 bp, Artificial Sequence
  Synthetic
ggaacgactgatgacgaagtatatattcaaagagcattcatgtcattgtctagtcagaaatcaggaatagctgat

SEQ ID NO: 297246 - DNA, 75 bp, Artificial Sequence
  Synthetic
ctcttaccttacaagcattagctataaaattagaaagtagcacatattacatatttggatattatgattacatgg

SEQ ID NO: 297247 - DNA, 75 bp, Artificial Sequence
  Synthetic
agcatttatgtcattatctagtcagaaatcaggaatagctgatgaaattgcttcttcacaaacatttaagaatta

SEQ ID NO: 297248 - DNA, 75 bp, Artificial Sequence
  Synthetic
ctatgttacaaaaaccagtgtcatttaaatcgaataagattaccattaacgatattttacgtgacataaagccat

SEQ ID NO: 297249 - DNA, 75 bp, Artificial Sequence
  Synthetic
atcaatattacaacaagaatatgcattgaggtacttttcaaagtcgagatttatagataaaccaggaagagaatt

SEQ ID NO: 297250 - DNA, 75 bp, Artificial Sequence
  Synthetic
gtttacttagaaaagcgtcgcgctcaaatctccgcattgttaaccatgctacaaaagccagtatcattcaaatca

SEQ ID NO: 297251 - DNA, 75 bp, Artificial Sequence
  Synthetic
accaattcaatacagaaaatttatgcctacattgcctgataatgttcaatatgttatacaatgtataggatcaag

SEQ ID NO: 297252 - DNA, 75 bp, Artificial Sequence
  Synthetic
ttgcattcgtttcagctgatactgttgaaccaattaatgctgtcgcgtttgataacatgcgcatcatgaacgaac

SEQ ID NO: 297253 - DNA, 75 bp, Artificial Sequence
  Synthetic
gatgaatggaataaagcttgtacacaaattgtaaatgttaaagattacatagagatgataaattctgtatacact

SEQ ID NO: 297254 - DNA, 75 bp, Artificial Sequence
  Synthetic
aaattgtaaatgttaaagattacatagagatgataaattctgtatacactgaacattatagtgtctcacaaagat

SEQ ID NO: 297255 - DNA, 75 bp, Artificial Sequence
  Synthetic
caatataggaaatttatgcctacattacctgataacgttcaatatgttatacaatgtataggatcacggacatac

SEQ ID NO: 297256 - DNA, 75 bp, Artificial Sequence
  Synthetic
acaaatacggagtgcctagacataacgcaaaatataggtatgagtatgaagtaatgaaagataaaccatattact

SEQ ID NO: 297257 - DNA, 75 bp, Artificial Sequence
  Synthetic
ttgcaaatggtgtcaggttactagttgctataaaatatgggaagattttagaattgagaaaatatataataatgt

SEQ ID NO: 297258 - DNA, 75 bp, Artificial Sequence
  Synthetic
gaagaattgtataaggtaatatctttgcgagagcaggaaatacaattatatttagtttcattaggagttccacca

SEQ ID NO: 297259 - DNA, 75 bp, Artificial Sequence
  Synthetic
cacgatgaagagcaatggactagatctgtagataaactattcagatgtttagaacctgttgatataagtgaagta

SEQ ID NO: 297260 - DNA, 75 bp, Artificial Sequence
  Synthetic
tggattagtttgttctgtaactatccaaaatctgaaatgattaaattatggaagaaaatgtggaacataacagca

SEQ ID NO: 297261 - DNA, 75 bp, Artificial Sequence
  Synthetic
gtatggtattgaatataccacaattctgaccattttgatatctatcatattattgaattacatattaaaaactat

SEQ ID NO: 297262 - DNA, 75 bp, Artificial Sequence
  Synthetic
ttcgactgatattgagctcattaatatatgactggtttgatataagatacatgagagaaacaccaatgataacat

SEQ ID NO: 297263 - DNA, 75 bp, Artificial Sequence
  Synthetic
atgtatagtactgaatgtactagctttttccttgagataatattctatgttattttgtacacagttatttctagt

SEQ ID NO: 297264 - DNA, 75 bp, Artificial Sequence
  Synthetic
cgccaccaccacaatttaaaaaacgttataatacaaatgacaattcaagaggaatgaattatgaaactccaatgt

SEQ ID NO: 297265 - DNA, 75 bp, Artificial Sequence
  Synthetic
acgtacctattacgggatctttggatgtaacagttttaaattctactcagacgcaaattggcttaacttctacgc

SEQ ID NO: 297266 - DNA, 75 bp, Artificial Sequence
  Synthetic
ttcagtgtatttaaatgaatataatgatttagctgcattttctaatgatccgaaattgtattgtgattataacat

SEQ ID NO: 297267 - DNA, 75 bp, Artificial Sequence
  Synthetic
gagataataactgacgcacaagatgacgttaagatagctgatgaggttaagaaatcatcaaaagaggaatctaaa

SEQ ID NO: 297268 - DNA, 75 bp, Artificial Sequence
  Synthetic
ctgtattattatcaacaaacgagtgaatcaaataagtggatagctatgggtacaaattgtactataaaagtttgt

SEQ ID NO: 297269 - DNA, 75 bp, Artificial Sequence
  Synthetic
ccattgaacgctcaaacattaggtataggttgtcaaactactaatgtaaacacatttgaacaagttacagcctct

SEQ ID NO: 297270 - DNA, 75 bp, Artificial Sequence
  Synthetic
gaactaatgtagcgataatacagattggagggccagaaatattagatatatctgaagatccaatggttgtaccga

SEQ ID NO: 297271 - DNA, 75 bp, Artificial Sequence
  Synthetic
ttggaaaaaatggtggcaagtattttatactattgtagactatatagatactatagttaatgcgatgtctaaacg

SEQ ID NO: 297272 - DNA, 75 bp, Artificial Sequence
  Synthetic
aaacgtgcaacgtcattagatgcatcttcctattacttcagagtatagactcaaggttaaaggctttatgtgacc

SEQ ID NO: 297273 - DNA, 75 bp, Artificial Sequence
  Synthetic
attagaaggtttattgcagatatgagacaacaagttcaagctgacagaaatgttgttaactatccatcaattcta

SEQ ID NO: 297274 - DNA, 75 bp, Artificial Sequence
  Synthetic
attgatgctgatacttatgttggatcaaaaatatattcacaggataagtatcgcatactggaatcgtatgtatat

SEQ ID NO: 297275 - DNA, 75 bp, Artificial Sequence
  Synthetic
atacagtgatgttatagagaacgctacattattatcaatattatcatactcctatgataaatataatgctgtcga

SEQ ID NO: 297276 - DNA, 75 bp, Artificial Sequence
  Synthetic
acgcaagttagttaagtatgcaaaaggtaaaccgttagaagcagatttaacggtaaatgaactagactatgagaa

SEQ ID NO: 297277 - DNA, 75 bp, Artificial Sequence
  Synthetic
tcaagatcattaaattcagctgctttttactacagaatttagatatagcttagattagaattgtatgatgtgacc

SEQ ID NO: 297278 - DNA, 75 bp, Artificial Sequence
  Synthetic
ataaatatggcgtgccaaggcataatgcaaaatatagatatgagtatgatgtaatgaaagataaaccatattact

SEQ ID NO: 297279 - DNA, 75 bp, Artificial Sequence
  Synthetic
tatattatatttaaactataatgtaaaaacgctacaaatattaaataaatctggtatagctgcaatagaaataca

SEQ ID NO: 297280 - DNA, 75 bp, Artificial Sequence
  Synthetic
atgtccaaaagatcacggtcattaaattcagcagctttttattatagaatctgatatatcttagattagaattgt

SEQ ID NO: 297281 - DNA, 75 bp, Artificial Sequence
  Synthetic
aagatgtagatgacgaaatgtatcgcgagtacacgatgttaataagagatgaagttgttaagatgctcgaagaat

SEQ ID NO: 297282 - DNA, 75 bp, Artificial Sequence
  Synthetic
attgattactttgttgattttgtagataatgtctgtatggatgagatggcaagagagtctcaacgaaatggaatc

SEQ ID NO: 297283 - DNA, 75 bp, Artificial Sequence
  Synthetic
actacaaaactgtacatagattctatttatttaagaaaaataaaaggtgacacggtgtttgatatgactgggtga

SEQ ID NO: 297284 - DNA, 75 bp, Artificial Sequence
  Synthetic
tttatagcacagcatgctgtggttgaaaaaatgttaatctacgcaaaacatactagagaatacgctgaattctat

SEQ ID NO: 297285 - DNA, 75 bp, Artificial Sequence
  Synthetic
tactagagaatacgctgaattctattcacaatcaaatcaactattatcatatggcgacgttacacgttttctttc

SEQ ID NO: 297286 - DNA, 75 bp, Artificial Sequence
  Synthetic
gacgtgtctcagtgggactcatctcaacataacacacaaccatttaggaaaggaataataatggggttagacata

SEQ ID NO: 297287 - DNA, 75 bp, Artificial Sequence
  Synthetic
ctacagttggactaactcttcgaattgactcagcgatttgtgaatctgttttggcggatgctaatgaaacgatgt

SEQ ID NO: 297288 - DNA, 75 bp, Artificial Sequence
  Synthetic
accgatactacaacatttgaagaagttgctacagctgaaaaattggtaattactgacgttgttgatggtgtgaat

SEQ ID NO: 297289 - DNA, 75 bp, Artificial Sequence
  Synthetic
tctaatctcacttttactgtttattccaatttgttagcttttgtttctgcagatacagttgaaccgattaacgca

SEQ ID NO: 297290 - DNA, 75 bp, Artificial Sequence
  Synthetic
ggtgaatggaaagactcattatcgcaaatgtttcttacaaaaggttggccaacaggatcagtctattttaaagag

SEQ ID NO: 297291 - DNA, 75 bp, Artificial Sequence
  Synthetic
agcgaaattgaattcgtacgcgccaatatcacttgagaagaggcgtgcgcaaatatcagctttattgacaatgtt

SEQ ID NO: 297292 - DNA, 75 bp, Artificial Sequence
  Synthetic
attagttgcattaatagatatcaatggtacgtttattacaaatgaagaattagaacttgaattttcagataaata

SEQ ID NO: 297293 - DNA, 75 bp, Artificial Sequence
  Synthetic
tgcatgaaaatgaaatacagttatatttgatttcattgggtataccgaaaatagatgctgatacatacgttgggt

SEQ ID NO: 297294 - DNA, 75 bp, Artificial Sequence
  Synthetic
aatctgttatccatcaattatgggtgctatcagttatttgattttaattcaccagacttagagaagctaattaga

SEQ ID NO: 297295 - DNA, 75 bp, Artificial Sequence
  Synthetic
tacagtgaatctttcagatgaaatacagttaattggatcagaaaaaacgcagagaactacagtaaatccaggtcc

SEQ ID NO: 297296 - DNA, 75 bp, Artificial Sequence
  Synthetic
actttcaatccaccagtagaatattggatgcttctagcaccaacatcagaaggggtagttgttgaaggtactaat

SEQ ID NO: 297297 - DNA, 75 bp, Artificial Sequence
  Synthetic
caaacccatcacaaagtaaatggcgttttgttgacgtagctaagaccactgcaaatggaacatattcacaatatg

SEQ ID NO: 297298 - DNA, 75 bp, Artificial Sequence
  Synthetic
aataaatgataattcatggaaggatacactttctcagctatttttaactaaaggatggccaacaggatctgttta

SEQ ID NO: 297299 - DNA, 75 bp, Artificial Sequence
  Synthetic
ttcaactacaaattatgactcagtgaatatgacatcttattgcgatttttacattataccaagagcacaagaatc

SEQ ID NO: 297300 - DNA, 75 bp, Artificial Sequence
  Synthetic
gctgcagtgaacgaagacatagttatatcgaaaacgtcattgtggaaagaaatgcaatataatcgagatatcata

SEQ ID NO: 297301 - DNA, 75 bp, Artificial Sequence
  Synthetic
acgacaatgccacaaacagaaagaatgatgcgagtgaattggaagaaatggtggcaagtattttatacaatagtt

SEQ ID NO: 297302 - DNA, 75 bp, Artificial Sequence
  Synthetic
tacgtgatggagaggaagtaactgcacatacaacatgttcagtgaatggagtgaacgacttcaactataacggag

SEQ ID NO: 297303 - DNA, 75 bp, Artificial Sequence
  Synthetic
catggtatatgtgagatcattagctgcggacttaaatgaagtgacatgtgcagggggtacttataatttccgact

SEQ ID NO: 297304 - DNA, 75 bp, Artificial Sequence
  Synthetic
tcgttaagatttaggttcagtttagcagtagaagaaccgccattctctatttcaaggacacggatatcagggtta

SEQ ID NO: 297305 - DNA, 75 bp, Artificial Sequence
  Synthetic
aaactcctataatgaactcagtgacggtgagacaggacttagagaggcagttaggagaattgagagaagaattta

SEQ ID NO: 297306 - DNA, 75 bp, Artificial Sequence
  Synthetic
tacagtatggagctgtagcgtcaggagagaagcagacgaaagcagctaattcaatagcgaatttagcactgatta

SEQ ID NO: 297307 - DNA, 75 bp, Artificial Sequence
  Synthetic
tgcagctaaatcaatggccactaatgttatgaagaagtttaaaagctcaggcttggccacgtctgtatccacgtt

SEQ ID NO: 297308 - DNA, 75 bp, Artificial Sequence
  Synthetic
atagtggatacgcaagcatcagtcaatacgttggcaactcaaacgtcaactatcagcaagagattaaggttaaaa

SEQ ID NO: 297309 - DNA, 75 bp, Artificial Sequence
  Synthetic
taccagatattgttactgaagcgtcggagaagtttataccaaatagaacgtatagagtaattgacgatgatactg

SEQ ID NO: 297310 - DNA, 75 bp, Artificial Sequence
  Synthetic
ctctccagtaatctcggccattatagactttaaaacgcttaaaaacttgaatgataactatggaattactcgttc

SEQ ID NO: 297311 - DNA, 75 bp, Artificial Sequence
  Synthetic
gatccaagggttctgcgagaatttatcaatcaagataatccaataataagaaacaggatagagcagttaattctg

SEQ ID NO: 297312 - DNA, 75 bp, Artificial Sequence
  Synthetic
catctgtcctaacagttttattcgcattacataaagcatcaattcctacaatgaaaattgcattgaaaacatcaa

SEQ ID NO: 297313 - DNA, 75 bp, Artificial Sequence
  Synthetic
aattaattttgataattcatctgattatattgagaattggaatctacagaatagacgacagcgcactggatttgt

SEQ ID NO: 297314 - DNA, 75 bp, Artificial Sequence
  Synthetic
aaagaaatgagacgtcagttggaaatgattgacaagttgactacacgtgaaatagaacaagttgaattactaaaa

SEQ ID NO: 297315 - DNA, 75 bp, Artificial Sequence
  Synthetic
tgattgacaagttgactacacgtgaaatagaacaagttgaattactaaaacgcattcatgatagattgatggtgc

SEQ ID NO: 297316 - DNA, 75 bp, Artificial Sequence
  Synthetic
gatgggaactatgtggattaacgctggatcagaaattcaagtagctggatttgattactcatgtgccttaaatgc

SEQ ID NO: 297317 - DNA, 75 bp, Artificial Sequence
  Synthetic
ggcttttaaacgaagtcttcaacatggatgtcctttattctttgtcaaaaactcttaaggatgccagagacaaaa

SEQ ID NO: 297318 - DNA, 75 bp, Artificial Sequence
  Synthetic
aattagtacgtccaccgaatatgacaccagcagttgcaaatctatttccgcaagcaccaccatttatatttcatg

SEQ ID NO: 297319 - DNA, 75 bp, Artificial Sequence
  Synthetic
gggtcagagatacaggttgcaggatttgactattcatgtgctattaacgcaccagccaacacgcagcagtttgag

SEQ ID NO: 297320 - DNA, 75 bp, Artificial Sequence
  Synthetic
ttgactattcatgtgctattaacgcaccagccaacacgcagcagtttgagcatatagtgcagctccgtagagtgc

SEQ ID NO: 297321 - DNA, 75 bp, Artificial Sequence
  Synthetic
gattactcatattacactaataatgaaataagaactgatcagcactgggtaactaaaactgatataattgattat

SEQ ID NO: 297322 - DNA, 75 bp, Artificial Sequence
  Synthetic
agtaatactgagaccaaacaatgttgaagtagaatttttgcttaatgggcagataattgacacataccaggcaag

SEQ ID NO: 297323 - DNA, 75 bp, Artificial Sequence
  Synthetic
tttaactagactattagcttacaactatgaaacgctaatggcatgtgttacaatgaacatgcaacatgtccaaac

SEQ ID NO: 297324 - DNA, 75 bp, Artificial Sequence
  Synthetic
aatgcgcagcctttcgaacatcatgccacagttggattgacattgcggattgaatctgctgtgtgtgaatcagta

SEQ ID NO: 297325 - DNA, 75 bp, Artificial Sequence
  Synthetic
tggtccaagaaatgaatctatgttcacatttttaaatttcccaactattaaacaattttcaaacggtgcatacct

SEQ ID NO: 297326 - DNA, 75 bp, Artificial Sequence
  Synthetic
agaatacgcgattccagtcggaccagtttttccaccaggaatgaattggacagatctgatcactaattattcacc

SEQ ID NO: 297327 - DNA, 75 bp, Artificial Sequence
  Synthetic
taagtatgtagctataccaagctgcttgaactctacaagtaaggatgtgtatacacattcgctacgtagagtaat

SEQ ID NO: 297328 - DNA, 75 bp, Artificial Sequence
  Synthetic
ttagacatttttaatttgatactaatgaatatggaccaaatagaacgtgcttcagataaaattgcacaaggtgtt

SEQ ID NO: 297329 - DNA, 75 bp, Artificial Sequence
  Synthetic
attttacgtttgagacgtgggatccattagatactccttattctacaacacaccataaggaactattctttgata

SEQ ID NO: 297330 - DNA, 75 bp, Artificial Sequence
  Synthetic
ggaatggcgtattttccttatattgcatctgtcctaacagttttattcacattacacaaagcgtcaattccaaca

SEQ ID NO: 297331 - DNA, 75 bp, Artificial Sequence
  Synthetic
tcatactgccatttattaaagctcaaaattatggaataaatcttccaataacaggttctatggatgccgcatatg

SEQ ID NO: 297332 - DNA, 75 bp, Artificial Sequence
  Synthetic
aaagaaatgagacgtcaattagaaatgattgataaactaactacacgtgaaattgagcaggttgaattacttaaa

SEQ ID NO: 297333 - DNA, 75 bp, Artificial Sequence
  Synthetic
ctgaattgactttttgcagtggatgttcattagcacatgtttgtcaattgtgtattacaaataaaagatgttttt

SEQ ID NO: 297334 - DNA, 75 bp, Artificial Sequence
  Synthetic
aattaacagtgctatcataaacaaatttaagaaatcaacaagacaaaggaaatgcaggaatggattaaatgagat

SEQ ID NO: 297335 - DNA, 75 bp, Artificial Sequence
  Synthetic
tcagttgaaaatttaccatataggataattaattgtattgatatttatgataaattacttttggatcaaattaat

SEQ ID NO: 297336 - DNA, 75 bp, Artificial Sequence
  Synthetic
attattcagattttactaagcagaatttgattactaaatatagaacaaaatcgagaattgtacacagaaatattt

SEQ ID NO: 297337 - DNA, 75 bp, Artificial Sequence
  Synthetic
tggtactactttacttaatttggatgcaaattatgttgaaaatgctagaactactattgaatattttattgattt

SEQ ID NO: 297338 - DNA, 75 bp, Artificial Sequence
  Synthetic
tctagtacatgatattaatctagggagagtgaaagcagatatgtttgaattgggacatcagtgtaaaccaaatta

SEQ ID NO: 297339 - DNA, 75 bp, Artificial Sequence
  Synthetic
atgtataatgaactaatgagtttcattcaagcatgttataaaagtaatactaacgtagatcattgtagctcaata

SEQ ID NO: 297340 - DNA, 75 bp, Artificial Sequence
  Synthetic
gtattgacagtcaaaaagtaataaattttcattgtcaaatagatttatcgctatatttgcacattaaaatgattc

SEQ ID NO: 297341 - DNA, 75 bp, Artificial Sequence
  Synthetic
aatgcaccagcaaacattcagcagtttgaacatgttgtaccactaagacgtgctctcacaacagctacaattact

SEQ ID NO: 297342 - DNA, 75 bp, Artificial Sequence
  Synthetic
aaggttggccaacaggatcagtctattttaaagagtattcaagtattgttgatttttccgttgacccacaattat

SEQ ID NO: 297343 - DNA, 75 bp, Artificial Sequence
  Synthetic
attacctttatgtattgaatcaacagccacactactcgaattggaagaacaaggaaaattatctgaagagtatga

SEQ ID NO: 297344 - DNA, 75 bp, Artificial Sequence
  Synthetic
gatatgtcagagttagctgatttaatattgaatgaatggttatgtaatccaatggatataacattatattattat

SEQ ID NO: 297345 - DNA, 75 bp, Artificial Sequence
  Synthetic
tttactaatctcagattcagatgatgactaataaataaatatataaacttgccatcacaagaccgtctggactag

SEQ ID NO: 297346 - DNA, 75 bp, Artificial Sequence
  Synthetic
ttcaaaatgtcatttcacaacagcagaaccaaatcgcagatcttcaacaatattgtaataaattagaggctgatt

SEQ ID NO: 297347 - DNA, 75 bp, Artificial Sequence
  Synthetic
caacaaatgtagactcgtttgaaatggttgctgagaatgaaaaattagctatagtggatgtcgttgatgggataa

SEQ ID NO: 297348 - DNA, 75 bp, Artificial Sequence
  Synthetic
cttgttggcaaatgtgacatcagtgcgtcaggaatatgcaataccagtaggaccagtatttccaccaggtatgaa

SEQ ID NO: 297349 - DNA, 75 bp, Artificial Sequence
  Synthetic
tcaccttcaagagaagataacttgcaacgtgtttttacagtagcttccattagaagcatgttgattaagtgagga

SEQ ID NO: 297350 - DNA, 75 bp, Artificial Sequence
  Synthetic
atatccatgggagattcatgtacaattaaggtatgtccattgaatacgcagacattaggaataggatgtcttacc

SEQ ID NO: 297351 - DNA, 75 bp, Artificial Sequence
  Synthetic
acagacactacaacttttgaagaggttgcaacagctgaaaaattggcaataacggacgttgttgatggagtgaac

SEQ ID NO: 297352 - DNA, 75 bp, Artificial Sequence
  Synthetic
caaacgatgttgctgatgcaagtaaaatttacaaacgtagattggatttattcattatagtagcatctacaataa

SEQ ID NO: 297353 - DNA, 75 bp, Artificial Sequence
  Synthetic
gatttatgatattaaacagtattctgattttacatttgaaacatgggatccattagatactccatattctacaac

SEQ ID NO: 297354 - DNA, 75 bp, Artificial Sequence
  Synthetic
acgttaatgtcaaaaatctattcttggtcatttcacgtcggatttagaaaacaaaaaatgattgatgcggcttta

SEQ ID NO: 297355 - DNA, 75 bp, Artificial Sequence
  Synthetic
ggtcatttcacgtcggatttagaaaacaaaaaatgattgatgcggctttagatcaattaaagactgagtacactg

SEQ ID NO: 297356 - DNA, 75 bp, Artificial Sequence
  Synthetic
tgagtacacaatgttaattagagatgaaatagtcaagatgctagaagtaccagttaaacatgatgatcatctact

SEQ ID NO: 297357 - DNA, 75 bp, Artificial Sequence
  Synthetic
aacaaactgttagcaatttaaatattgcatataaatatctatcaacaggaaaagcaaaggtgtgttgtgttaaat

SEQ ID NO: 297358 - DNA, 75 bp, Artificial Sequence
  Synthetic
ttatcaatgtcatcagcttcaaatggcgaatcaagacaactcaaatttggtcgcaagacgatattctcaactaag

SEQ ID NO: 297359 - DNA, 75 bp, Artificial Sequence
  Synthetic
gactgtcaactgatagaaagatggatgaagtttctcaagtaggaatttattcgctatccgtttgaaagtgggtat

SEQ ID NO: 297360 - DNA, 75 bp, Artificial Sequence
  Synthetic
atgttcctggacgaagaacaagaataatattcatattaccatacgaatattttattgcacagcacgccgtagtgg

SEQ ID NO: 297361 - DNA, 75 bp, Artificial Sequence
  Synthetic
gatgtatcacagtgggattcgtcacagcacaatacgcagccattcagaaaaggaataattatgggattagatatg

SEQ ID NO: 297362 - DNA, 75 bp, Artificial Sequence
  Synthetic
aatggatgattctggcgttaagaataatctaataggtaaagcagttacaattgatcaggctttgaatggtaagtt

SEQ ID NO: 297363 - DNA, 75 bp, Artificial Sequence
  Synthetic
gctttcacgaattgcaaataaatattctttcataactaaaataattagagttgatggtgatgataattatgcagt

SEQ ID NO: 297364 - DNA, 75 bp, Artificial Sequence
  Synthetic
cgaaaagatatatagctggagggaaaatatttttcagagctggtataaatttattaaataatgaaaaacgtggac

SEQ ID NO: 297365 - DNA, 75 bp, Artificial Sequence
  Synthetic
gatttcattatagagtatggaacgactgatgatgaagtatacatacagagagcatttatgtcattatctagtcaa

SEQ ID NO: 297366 - DNA, 75 bp, Artificial Sequence
  Synthetic
tatgagtaaacatagtattattaccatcttcacgtagcctcttatgagccacaatagttaaaagctaacactgtc

SEQ ID NO: 297367 - DNA, 75 bp, Artificial Sequence
  Synthetic
aagaagagatgtaccaggaagaagaactagaataatattcatattaccgtatgaatattttatagcacagcatgc

SEQ ID NO: 297368 - DNA, 75 bp, Artificial Sequence
  Synthetic
ttcatctcaacataatacgcaaccgtttaggaaaggaataattatgggattggatatactagctaacatgactaa

SEQ ID NO: 297369 - DNA, 75 bp, Artificial Sequence
  Synthetic
caatataggaaatttatgcctacattgcctgataatgttcaatatgttatacaatgcataggatcaagaacatac

SEQ ID NO: 297370 - DNA, 75 bp, Artificial Sequence
  Synthetic
gaactggagactatggtcaaattactaatatgttattaaacaatcagcctgtagctttggtaggagcattgccat

SEQ ID NO: 297371 - DNA, 75 bp, Artificial Sequence
  Synthetic
aacttgttatctattaactacggatgttatcaactattcgattttaattctccagacttagaaaagcttatacga

SEQ ID NO: 297372 - DNA, 75 bp, Artificial Sequence
  Synthetic
caaacaaaatttacaaacgtagactggatctatttaccatagtagcatctacaataaataaatatggagtgccta

SEQ ID NO: 297373 - DNA, 75 bp, Artificial Sequence
  Synthetic
acagacagctactgtcaaactcgtatactgtagatttatcagatgaaatacaaactattggttctgagaaaacac

SEQ ID NO: 297374 - DNA, 75 bp, Artificial Sequence
  Synthetic
atgactcaacaacaatcgaaccagtacttgacggcccataccaacctactacgtttaatccaccggtaagttatt

SEQ ID NO: 297375 - DNA, 75 bp, Artificial Sequence
  Synthetic
ggacaacaagaacagataacagttgagaatgtttcaacaacgaaatggaaatttgtagatttggctaaaactgac

SEQ ID NO: 297376 - DNA, 75 bp, Artificial Sequence
  Synthetic
tcaaatggtgaatcaaggcagcttaaatttggtcgtaaaacgatattttcaactaagaaaaatatgcatgtcatg

SEQ ID NO: 297377 - DNA, 75 bp, Artificial Sequence
  Synthetic
ctatggagtgatgaagttcagtggcagattatatacgtataatggtgagacaccgaatgcaactactggttatta

SEQ ID NO: 297378 - DNA, 75 bp, Artificial Sequence
  Synthetic
gctcaggcaaatgaagatattgttgtatcgaaaacttcgttatggaaagaaatgcaatataatagagatataact

SEQ ID NO: 297379 - DNA, 75 bp, Artificial Sequence
  Synthetic
tgtggctcaggtgtatgcagatacgcaaacctatgtacacgatgattcaaaagatgagtatgaaaatgcatttct

SEQ ID NO: 297380 - DNA, 75 bp, Artificial Sequence
  Synthetic
aatgcaatataatagagatataactatacgttttaagttcgcaaacgccataatcaaatctggcggcctagggta

SEQ ID NO: 297381 - DNA, 75 bp, Artificial Sequence
  Synthetic
agatatgttatctaatatgactaatgatccaaaagtagtacaaacgctaaatttatataaacaaacacaaattaa

SEQ ID NO: 297382 - DNA, 75 bp, Artificial Sequence
  Synthetic
attaatgattttagttataatggtggttcattaccaacagactttgttatatcaagatatgaagtaattaaagaa

SEQ ID NO: 297383 - DNA, 75 bp, Artificial Sequence
  Synthetic
catggtgtatgttaggtcgttagcggctaatttaaattcagtgatttgtaccggaggaaattacgacttcagatt

SEQ ID NO: 297384 - DNA, 75 bp, Artificial Sequence
  Synthetic
ctactaaagacgaaattgagcaacagatggatagaattgttaaagagatgagacgtcagctggagatgattgata

SEQ ID NO: 297385 - DNA, 75 bp, Artificial Sequence
  Synthetic
tacggtttaccagctgcaaatccaaataacggaaaagattattatgaaatattagggagattctcgctcatatca

SEQ ID NO: 297386 - DNA, 75 bp, Artificial Sequence
  Synthetic
aacagttttcaaacggtgcatatctcgttaagcatactattaaattgaagcaggagagatggttaggcaaaagag

SEQ ID NO: 297387 - DNA, 75 bp, Artificial Sequence
  Synthetic
accatatactattactataatttacactcttcaaaacctgtaatatacatgcttggttcagctccatcttattgg

SEQ ID NO: 297388 - DNA, 75 bp, Artificial Sequence
  Synthetic
ttgccattagacatgttctccatgttcgctggtgttaagagcaccattgatgcagctaagtctatggccactagc

SEQ ID NO: 297389 - DNA, 75 bp, Artificial Sequence
  Synthetic
ttcaattctatatatagacataagaactgatagaggaaatatggattggaaagagtggagaaaagtggtagaaca

SEQ ID NO: 297390 - DNA, 75 bp, Artificial Sequence
  Synthetic
aacagattcattatctgatgccgcttcatcaatctcgaggaatccttctataagatcagtcgggtcatccatatc

SEQ ID NO: 297391 - DNA, 75 bp, Artificial Sequence
  Synthetic
attcagtatcaacgcaaacatctacgataagtcgacgattgagattaaaagaaataacaactcagacggaaggta

SEQ ID NO: 297392 - DNA, 75 bp, Artificial Sequence
  Synthetic
attagcaccattaaaagattcgtaccaaaaggcgtattttatgcttttataaacaatgtaaccacagaaaatgta

SEQ ID NO: 297393 - DNA, 75 bp, Artificial Sequence
  Synthetic
ttgcattgttacgattttcaatacgttgttgaaattggctgggtacaaagaacagataactactaaagatgagat

SEQ ID NO: 297394 - DNA, 75 bp, Artificial Sequence
  Synthetic
gttaagagaatacctggaaaatcatcatcaatagtgaaatgtactagactaatgaaagataaactagaacgtggt

SEQ ID NO: 297395 - DNA, 75 bp, Artificial Sequence
  Synthetic
agaaaagttcataccaaatcgaacttatagagttataaaagacgacgaagtgttagaagctggaacagatgggcg

SEQ ID NO: 297396 - DNA, 75 bp, Artificial Sequence
  Synthetic
atggttgtttaggtatatttggattatcaatatccctatcatcaaaaccaactggaaataatcatctatttataa

SEQ ID NO: 297397 - DNA, 75 bp, Artificial Sequence
  Synthetic
cgcattcacgacaagttggatatacgggctgttgatgaaatagacatgacgaaagaaattaaccagaaaaacgtt

SEQ ID NO: 297398 - DNA, 75 bp, Artificial Sequence
  Synthetic
taaaacatcgagttaatgaaaaatataatcattgggttcttaaagctaggaaagtaaacgaaaacatgaactctc

SEQ ID NO: 297399 - DNA, 75 bp, Artificial Sequence
  Synthetic
agaacgctagaagaatgggagtggggaaaaaatccctatgaacccaaagaagttactgctgcaatgtaagaggtt

SEQ ID NO: 297400 - DNA, 75 bp, Artificial Sequence
  Synthetic
agttgtatttagtttcattaggagttccaccagttgacgcaggcacgtacgttgggtcaagaatatattcgcagg

SEQ ID NO: 297401 - DNA, 75 bp, Artificial Sequence
  Synthetic
gatcctagggtattacgggaatttataaatcaagataatccaataattcgtaataggatagaacaacttattttg

SEQ ID NO: 297402 - DNA, 75 bp, Artificial Sequence
  Synthetic
ttcgtcaatagaatggtatttacgatcaatggaactatctgatgatattaaatcagatattgaacaacagcttaa

SEQ ID NO: 297403 - DNA, 75 bp, Artificial Sequence
  Synthetic
aatgcaatggatgattttgaatcaatacttcgtaatttgatttctgattatgatagattatttataatgtttaaa

SEQ ID NO: 297404 - DNA, 75 bp, Artificial Sequence
  Synthetic
gcacttaattcaattaaaattactcaatctgatcttgctaatgttctttcgagagtagtttctgttagacatttg

SEQ ID NO: 297405 - DNA, 75 bp, Artificial Sequence
  Synthetic
aatctgatcttgctaatgttctttcgagagtagtttctgttagacatttggaaaatttggtgttgagaaaagaaa

SEQ ID NO: 297406 - DNA, 75 bp, Artificial Sequence
  Synthetic
ttatattaatcagattgtacaggtaatgtccaaaagatcaagatcattaattccgctggcgttttattatagagt

SEQ ID NO: 297407 - DNA, 75 bp, Artificial Sequence
  Synthetic
ccaagagtcattaattcagctgatggcgcaactacatggttctttaatccagttattctaagaccaaataatgta

SEQ ID NO: 297408 - DNA, 75 bp, Artificial Sequence
  Synthetic
caaagaatcatttggcaaaattggtatgcatttacatcctcaatgaaacaaggtaacactctagatgtatgcaag

SEQ ID NO: 297409 - DNA, 75 bp, Artificial Sequence
  Synthetic
gagaagccacaaccaatcatatcgcgtgtgactcagtcttaatcccgtttaaccaatccagccagcgctggacgt

SEQ ID NO: 297410 - DNA, 75 bp, Artificial Sequence
  Synthetic
ggaatggcgtacttcccatacatagcatctgtactgactgttttatttactctacataaggcatcaattcccaca

SEQ ID NO: 297411 - DNA, 75 bp, Artificial Sequence
  Synthetic
agtcaagaagaaattaaaattgctgatgaagtgaagaaatcgacgaaagaagaatctaaacaattgcttgaagtt

SEQ ID NO: 297412 - DNA, 75 bp, Artificial Sequence
  Synthetic
cctcgatggatatcaacaaatcaatttagaagagttaatgagaactggagactatggtcaaattactaatatgct

SEQ ID NO: 297413 - DNA, 75 bp, Artificial Sequence
  Synthetic
ttctgatttgctatctttcgtttctgcagatacggttgaacctattaacgcaattgcttttgacaatatgcgcat

SEQ ID NO: 297414 - DNA, 75 bp, Artificial Sequence
  Synthetic
gtgggatacaataacaacttcaaactatattctggcaagatcggtagtaccagatttaaaggaattagtttcaac

SEQ ID NO: 297415 - DNA, 75 bp, Artificial Sequence
  Synthetic
aataacaatcaatttagacaagtagttattgatggtgtattgaatcaggtgctgaatgacaatattagaaatgga

SEQ ID NO: 297416 - DNA, 75 bp, Artificial Sequence
  Synthetic
ttaagaacaatttattgggcaaagcggcaactattgatcaggcattgaatggaaaatttggttcagccgcaagaa

SEQ ID NO: 297417 - DNA, 75 bp, Artificial Sequence
  Synthetic
gtatggtattgaatataccacagttctaacctttttgatatcaattattttattgaattatatactgaaatcttt

SEQ ID NO: 297418 - DNA, 75 bp, Artificial Sequence
  Synthetic
aaaataaattcagattcgaatgacttttacctagttgccaactatgattgggtgcctacttcaaccacaaaagta

SEQ ID NO: 297419 - DNA, 75 bp, Artificial Sequence
  Synthetic
tataagcaagttccacagcaatttgatttcagaaattcgatgcatatgttaacatcaaatcttactttcactgtt

SEQ ID NO: 297420 - DNA, 75 bp, Artificial Sequence
  Synthetic
aaatagtttagtgctcaaactaggagcaaatgatgaatggaggccagcaccagtgacaaaatataaaggatggtg

SEQ ID NO: 297421 - DNA, 75 bp, Artificial Sequence
  Synthetic
tctctcacaactatttctaactaaaggatggcctactggatccgtgtactttaaagagtatacagatattgcatc

SEQ ID NO: 297422 - DNA, 75 bp, Artificial Sequence
  Synthetic
cagttagagaaaaggtttgaatcattgaaacagagagtgaatgagaaatatactagttgggtgcaaaaagcaaag

SEQ ID NO: 297423 - DNA, 75 bp, Artificial Sequence
  Synthetic
tatgtctgaattggctgatctaatattgaatgaatggttgtgtaatccaatggatattactctgtactattatca

SEQ ID NO: 297424 - DNA, 75 bp, Artificial Sequence
  Synthetic
ttgaatgaatggttgtgtaatccaatggatattactctgtactattatcaacagacagatgaagccaataagtgg

SEQ ID NO: 297425 - DNA, 75 bp, Artificial Sequence
  Synthetic
tgtatggtattgattatacctcagtattagtctttctgatttcaattttcattttaaattatatgttgaaagaga

SEQ ID NO: 297426 - DNA, 75 bp, Artificial Sequence
  Synthetic
attttgaatatggatatgaatttgccatcaacagcgagatatattagaccaaatctattgcaagatagactaaac

SEQ ID NO: 297427 - DNA, 75 bp, Artificial Sequence
  Synthetic
aacaggttcaatggatactacattggcaaattcatccatggaaaacacatttatgacatcaactttatgcctgta

SEQ ID NO: 297428 - DNA, 75 bp, Artificial Sequence
  Synthetic
ttgcaacaagagtatgcgttgagatatttttcaaaatcaagatttttaagtaaagggaagaaaagattgagcagg

SEQ ID NO: 297429 - DNA, 75 bp, Artificial Sequence
  Synthetic
tttaaagaatatacagatatagcatcgttctctgtagatccacagctatactgcgattacaatctcgttttaatg

SEQ ID NO: 297430 - DNA, 75 bp, Artificial Sequence
  Synthetic
atgtccaagagatcacgatcattaaattctgctgctttttactacagagtttaggtatagctttggttagaattg

SEQ ID NO: 297431 - DNA, 75 bp, Artificial Sequence
  Synthetic
ggaataaagcgtgtacgcttatagttgatgctagaaattatattagtattatgaactcatcgtatactgagcatt

SEQ ID NO: 297432 - DNA, 75 bp, Artificial Sequence
  Synthetic
tgatgctagaaattatattagtattatgaactcatcgtatactgagcattacagtgtgtcacaaagatgtaaatt

SEQ ID NO: 297433 - DNA, 75 bp, Artificial Sequence
  Synthetic
agcaaactgatgaggcaaataagtggatctcaatgggcagttcgtgtaccattaaagtttgtccattaaatacac

SEQ ID NO: 297434 - DNA, 75 bp, Artificial Sequence
  Synthetic
tcataaattggatgtcacaactgcaacatgcactattcgaaactgtaaaaaattgggaccaagagaaaatgtcgc

SEQ ID NO: 297435 - DNA, 75 bp, Artificial Sequence
  Synthetic
tttatcagggcacttgtgaaatcgaatggaaatgttggacattgttcatcacaggaatcagtgtataagtatata

SEQ ID NO: 297436 - DNA, 75 bp, Artificial Sequence
  Synthetic
ttcgttaaataaaggtcttaaaattaatgccaatttagattcatctatttccatatcaacaaatcgtaagaaaga

SEQ ID NO: 297437 - DNA, 75 bp, Artificial Sequence
  Synthetic
tggcaagtattttatactgtggttgactatattaatcaaatagttcaagcaatgtcaaaaagatcaaggtcactt

SEQ ID NO: 297438 - DNA, 75 bp, Artificial Sequence
  Synthetic
aaatgaagataaaccaatttcagagtcacacgtaaaagaacttattgctgaattacggtggcaatacaataaatt

SEQ ID NO: 297439 - DNA, 75 bp, Artificial Sequence
  Synthetic
actatattaatcaaatagttcaagcaatgtcaaaaagatcaaggtcacttaattcagctgcgttctattacagag

SEQ ID NO: 297440 - DNA, 75 bp, Artificial Sequence
  Synthetic
tactgttaacctatctgaagaaattcaagaattaagcactaataaaacacagtcaacaacagtaaatcctgggcc

SEQ ID NO: 297441 - DNA, 75 bp, Artificial Sequence
  Synthetic
gtaaattttcattcaaattacaacgaacgaattaacgatgctgtggctattattacggctgctaatagactaaac

SEQ ID NO: 297442 - DNA, 75 bp, Artificial Sequence
  Synthetic
acgcttaaagatgctagagataaaattgttgagggtacactttattctaatgttagtgacataatacaacaattc

SEQ ID NO: 297443 - DNA, 75 bp, Artificial Sequence
  Synthetic
ttgttgagggtacactttattctaatgttagtgacataatacaacaattcaatcaaatgatagtaactatgaatg

SEQ ID NO: 297444 - DNA, 75 bp, Artificial Sequence
  Synthetic
tcattcaatccgccaatcaactattggctgcttttatcaccaactaatgcaggtgtagttatgcaaggaacgaat

SEQ ID NO: 297445 - DNA, 75 bp, Artificial Sequence
  Synthetic
ttatgttgaaactgcaagaacaacaatagaatattttattgacttcatagacaatgtatgtatggatgaaatgac

SEQ ID NO: 297446 - DNA, 75 bp, Artificial Sequence
  Synthetic
aaaatacaagttctgataaatggaaatttatcgatgtgggaaaaacgtcattgaatggtagctatgtacagcatg

SEQ ID NO: 297447 - DNA, 75 bp, Artificial Sequence
  Synthetic
gatgacgcgataatagagtatatctattcgaatgaattggacttccagaatttcatacttaaaaagattaaagaa

SEQ ID NO: 297448 - DNA, 75 bp, Artificial Sequence
  Synthetic
gttccataaaccaaacatatttccatattctgcttcttttactttaaacagatcacaaccattgcataatgactt

SEQ ID NO: 297449 - DNA, 75 bp, Artificial Sequence
  Synthetic
ttccacaacaaattttgattcagttaacgtaacaacgtttgcagatttttatatcatatcaagagataatgaaca

SEQ ID NO: 297450 - DNA, 75 bp, Artificial Sequence
  Synthetic
ttgtcgcaatttgacattggtcaatataaaaatatgttaaatgtattaacaactttgtatcaatactatgacata

SEQ ID NO: 297451 - DNA, 75 bp, Artificial Sequence
  Synthetic
tagttaaagatacaataaagcttaaacaagagagatggctcggtaagagactatcgcaatttgacatcggtcagt

SEQ ID NO: 297452 - DNA, 75 bp, Artificial Sequence
  Synthetic
gaagtagaattcctacttaatgggcagataattaatacataccaagcacggtttggcactataattgcaagaaat

SEQ ID NO: 297453 - DNA, 75 bp, Artificial Sequence
  Synthetic
cattagacacgccatactccgatttgcatcataaagaattgttttatataaacgatgtaactaaacttaaggata

SEQ ID NO: 297454 - DNA, 75 bp, Artificial Sequence
  Synthetic
caagagatggagaagaagttactgcgcatacaacttgttctgttaatggtattaacgactttaactataatggcg

SEQ ID NO: 297455 - DNA, 75 bp, Artificial Sequence
  Synthetic
catggtttatgtaagatcattatctgcagagtttaataatgtagagtgtactggcggagattatagtttttcatt

SEQ ID NO: 297456 - DNA, 75 bp, Artificial Sequence
  Synthetic
tagcaaacgtgacagctgtaagacaagaatatgcagtaccagttggaccagtatttccaccaggaatgaattgga

SEQ ID NO: 297457 - DNA, 75 bp, Artificial Sequence
  Synthetic
tgcgtataaatacttatccacagggaaagctaaagtatgttgtgttaaaatgactgctatggatttggaattacc

SEQ ID NO: 297458 - DNA, 75 bp, Artificial Sequence
  Synthetic
tttaaaatttgaaacatgggatccactagatacaccatactctaatttacatcataaggaattattttacataaa

SEQ ID NO: 297459 - DNA, 75 bp, Artificial Sequence
  Synthetic
tctctcagatttagatttcgattaactgtaggagaaccaccattcgcaatactcaggacacgaatgtcaggttta

SEQ ID NO: 297460 - DNA, 75 bp, Artificial Sequence
  Synthetic
ttagcatgtagctatatcaagttatacagactctgcaagtaaggatatatttatatattcactacgcagagtaac

SEQ ID NO: 297461 - DNA, 75 bp, Artificial Sequence
  Synthetic
taaataatataatcactgagaatgtattcatacaacaaccgtttaaattgaaaacattaaaaaatgaatacgtgg

SEQ ID NO: 297462 - DNA, 75 bp, Artificial Sequence
  Synthetic
gtttatacaacaaccgtttaaattgagaacattaaggaatgagtatgtggttgcgttgtacgcgctgtctaacga

SEQ ID NO: 297463 - DNA, 75 bp, Artificial Sequence
  Synthetic
aaacaccaatagtaaattcagttactgtcagacaagatttggacagacaattggctgaactaaggcaagagttta

SEQ ID NO: 297464 - DNA, 75 bp, Artificial Sequence
  Synthetic
aaacacttgaaatacttaataaatcaggaattgcagcagtggaaattcaatctcttgatgagttatttactttaa

SEQ ID NO: 297465 - DNA, 75 bp, Artificial Sequence
  Synthetic
agctgcaaaatcaatggcaacaaatgttatgaaaaagtttaaaaaatcatcattggcatcatcaatggctacatt

SEQ ID NO: 297466 - DNA, 75 bp, Artificial Sequence
  Synthetic
gaccaaaactaacattgaagaatatttgttaccaggatggaaattaacatacgtaggatataatggaagcgatac

SEQ ID NO: 297467 - DNA, 75 bp, Artificial Sequence
  Synthetic
gtaagcgacatatcgtcaactgtaagcagcgtttcatcacaaacttctactataagtagaaggctaagactaaaa

SEQ ID NO: 297468 - DNA, 75 bp, Artificial Sequence
  Synthetic
tatctggacatgtgtataatgcattaatttattatagatataattattcatttgatcttaagcgatggatatact

SEQ ID NO: 297469 - DNA, 75 bp, Artificial Sequence
  Synthetic
ttcatgctaactaaaataaaagaacgcatgactacatccttaccaatagcgcgtttatcaaatagagtttttaga

SEQ ID NO: 297470 - DNA, 75 bp, Artificial Sequence
  Synthetic
taccagatattgttactgaagcatcagaaaaattcataccaaaaagagcgtacagggtgattaaaaatgacgaag

SEQ ID NO: 297471 - DNA, 75 bp, Artificial Sequence
  Synthetic
agcaattttcaaacggtccgtatttagttaaacatactatcaaattaaaacaggagagatggttagggaaaagag

SEQ ID NO: 297472 - DNA, 75 bp, Artificial Sequence
  Synthetic
taaagattcgataattacatcatatgatggttgtttaggcatattcggattatcaatatctttatcatctaaacc

SEQ ID NO: 297473 - DNA, 75 bp, Artificial Sequence
  Synthetic
caggagagatggttagggaaaagagtatctcaatttgatataggacaatataaaaacatgatgaatgtcattaca

SEQ ID NO: 297474 - DNA, 75 bp, Artificial Sequence
  Synthetic
atttcagattcaatggtgccagatgtagtagcgattttaaagaagtttaagaatgaattgtttaaaatggatgta

SEQ ID NO: 297475 - DNA, 75 bp, Artificial Sequence
  Synthetic
ttcaccagtcatttctgcaataatagattttaaaacacttaaaaatctcaatgacaattacggcatttcaaagca

SEQ ID NO: 297476 - DNA, 75 bp, Artificial Sequence
  Synthetic
gacccgagagtattgcgcgaattcatcaatcaaaataatccaataattaagcacagaatagaacagttaataatg

SEQ ID NO: 297477 - DNA, 75 bp, Artificial Sequence
  Synthetic
actcttaaagatgcaagagataaaattgtagaaggtacgctatactcaaatgttagcgacttaattcagcagttt

SEQ ID NO: 297478 - DNA, 75 bp, Artificial Sequence
  Synthetic
agctttagcaacaagaaagtagtgagaatagacagtacgcggttaaacatagactttatatacttaaggaaaata

SEQ ID NO: 297479 - DNA, 75 bp, Artificial Sequence
  Synthetic
aggagtggaggaaagtggttgaaaagcagacgcttagtaatctttctatagcatataagtatctatcaactggta

SEQ ID NO: 297480 - DNA, 75 bp, Artificial Sequence
  Synthetic
gcatataagtatctatcaactggtaaagcaaaagtatgttgcgttaagatgacagctatggatttagagcttccg

SEQ ID NO: 297481 - DNA, 75 bp, Artificial Sequence
  Synthetic
ctactttactcaatttggatgctaattacgtcgaggatgctaggactaccattaattattttattgatttcattg

SEQ ID NO: 297482 - DNA, 75 bp, Artificial Sequence
  Synthetic
tagagaatagatgtattgaatttcattctaaatgcttagaaaactcaaagaatggactatcactaaaaaaacttt

SEQ ID NO: 297483 - DNA, 75 bp, Artificial Sequence
  Synthetic
ctaaaggagtcttgtattcgtttataaataacattactactgaaaatgtatttatacaaccaccatttaaaataa

SEQ ID NO: 297484 - DNA, 75 bp, Artificial Sequence
  Synthetic
gataaattttaataatgactctgaatacattgaaaattggaatttacagcatcggagacaaagaactggattcgt

SEQ ID NO: 297485 - DNA, 75 bp, Artificial Sequence
  Synthetic
ttcaataatagagagcatgtagtgaacttgatcaacaaccagaaacattcattaatcactgttagaattaataat

SEQ ID NO: 297486 - DNA, 75 bp, Artificial Sequence
  Synthetic
ggatcagaattacaggtaattggttttgattatcaatgtgcattaaatgccccagctaatattcagcagtttgaa

SEQ ID NO: 297487 - DNA, 75 bp, Artificial Sequence
  Synthetic
gagcaacaacttggtatttcaatccagtaatatttagaccaaatgacgttcaaatcgattttctactaaatggcc

SEQ ID NO: 297488 - DNA, 75 bp, Artificial Sequence
  Synthetic
attggatcaatttgctaatcatactggaatatcaagaagatcgcaccaaattagattttctgaatccgcgacatc

SEQ ID NO: 297489 - DNA, 75 bp, Artificial Sequence
  Synthetic
gcccgctgttgctgctctttttccaaacgcaggtccattcaacaatcatgctgctgtagggctcacgctgcgaat

SEQ ID NO: 297490 - DNA, 75 bp, Artificial Sequence
  Synthetic
tgcatatgagtagtcacataattaaaaatattaaccatctacacatgaccctctatgagcacaatagttaaaagc

SEQ ID NO: 297491 - DNA, 75 bp, Artificial Sequence
  Synthetic
ttgatttaaaaagatggatatatttacattcaatagataaagtcgacatagaaggaggaaggtattatgaacatg

SEQ ID NO: 297492 - DNA, 75 bp, Artificial Sequence
  Synthetic
gtatttccgccaggaatggaatggactgagttaattacaaattattctccatcacgagaggataacttgcaacga

SEQ ID NO: 297493 - DNA, 75 bp, Artificial Sequence
  Synthetic
cataaataaagtatacagtataacgtatgcagatgatccaaactactttataggtattaaattcaagaacatccc

SEQ ID NO: 297494 - DNA, 75 bp, Artificial Sequence
  Synthetic
caatcatgtagctatatatgggttctatagactgataaagtaaggtcagctttagttgatcgctaccatcagtaa

SEQ ID NO: 297495 - DNA, 75 bp, Artificial Sequence
  Synthetic
aagagatgaagttgtgaaaatgcttgaggaaccagtaaagcatgatgatcatttgttacaggattccgaattggc

SEQ ID NO: 297496 - DNA, 75 bp, Artificial Sequence
  Synthetic
gagtcaatatatttaaggaaaattagaggagatacagtatttggtatgtctgagtgagctaaaaacttaacacac

SEQ ID NO: 297497 - DNA, 75 bp, Artificial Sequence
  Synthetic
tctgatggattcatacgttcaaataccagatggtaatgttattaaaaagatacagtatggggctgtagcgtcagg

SEQ ID NO: 297498 - DNA, 75 bp, Artificial Sequence
  Synthetic
tacagtatggggctgtagcgtcaggagagaagcagacgaaagcagcgaattcaatagcgaatttagcactgatca

SEQ ID NO: 297499 - DNA, 75 bp, Artificial Sequence
  Synthetic
catttgaagaggtggctacaaatgaaaaattagtaataaccgatgttgttgatggtgtaaaccataaacttgatg

SEQ ID NO: 297500 - DNA, 75 bp, Artificial Sequence
  Synthetic
ataagagttgacggagatgacaattacgcagtattgcagttcaatacagaagtaactaagcagatggttcaagat

SEQ ID NO: 297501 - DNA, 75 bp, Artificial Sequence
  Synthetic
tgccaattcttgatcaaaattttattgaatataaaattacagtaaatgaagataaaccaatttcagagtcacacg

SEQ ID NO: 297502 - DNA, 75 bp, Artificial Sequence
  Synthetic
taaaagaacttattgctgaattgcggtggcaatataataaatttgcagtaattacacatggtaaaggtcactaca

SEQ ID NO: 297503 - DNA, 75 bp, Artificial Sequence
  Synthetic
tggtacgcattcacgtcctcaatgaaacaaggtaatactcttgatgtatgcaaaaaactgctctttcagaaaatg

SEQ ID NO: 297504 - DNA, 75 bp, Artificial Sequence
  Synthetic
gactgtcaaccgatagaaagatggatgaagtttctcaagtaggaatttaattcgttatctgtttgaaagtgggta

SEQ ID NO: 297505 - DNA, 75 bp, Artificial Sequence
  Synthetic
ctatgctgcaaaaaccggttacttttaaatcaagtaaaataacaataaatgatatacttagagatataaagccat

SEQ ID NO: 297506 - DNA, 75 bp, Artificial Sequence
  Synthetic
gtacgaagatgtcatagagaatgctacactactatcaatattatcatattcttatgataaatataatgctgttga

SEQ ID NO: 297507 - DNA, 75 bp, Artificial Sequence
  Synthetic
ttctttgtcatcaaacttaaatgcagttatgttttggctagaaaaacacgaaaatgatgttgccgaaaaacttaa

SEQ ID NO: 297508 - DNA, 75 bp, Artificial Sequence
  Synthetic
aaatggtgtcaatcataaaataaatatttcagtaaatacgtgcactatacgtaattgtaataaactaggaccacg

SEQ ID NO: 297509 - DNA, 75 bp, Artificial Sequence
  Synthetic
gaaggtaagatatctgaagaatatgagctcctaatctcagattctgaagacgatgatcaatgattaaataaaaca

SEQ ID NO: 297510 - DNA, 75 bp, Artificial Sequence
  Synthetic
tcatcaccaatgtcaattttagtagctttagtggatgttaatggaacattcattacgaatgaagaattagaatta

SEQ ID NO: 297511 - DNA, 75 bp, Artificial Sequence
  Synthetic
catgtcggaactcgcagatttgattttaaatgaatggttatgtaaccccatggatataactttgtactattatca

SEQ ID NO: 297512 - DNA, 75 bp, Artificial Sequence
  Synthetic
gtgaatctagacaacttaagtttggtagaaagacaattttctcaactaaaaagaatatgcacgttatggatgaca

SEQ ID NO: 297513 - DNA, 75 bp, Artificial Sequence
  Synthetic
tgtcaacaccgaaactgtatggagtgatgaaacatggaggtaaaatttacacttataatggagagacaccgaacg

SEQ ID NO: 297514 - DNA, 75 bp, Artificial Sequence
  Synthetic
tggatataactttgtactattatcagcaaacagatgaaacgaacaaatggatatcgatgggctcatcttgcacca

SEQ ID NO: 297515 - DNA, 75 bp, Artificial Sequence
  Synthetic
ctagctaatatgactaacaatgctaaagttattcagacattaaatttatataaacaaacacaaatcaatctcatg

SEQ ID NO: 297516 - DNA, 75 bp, Artificial Sequence
  Synthetic
acaacgaatagatggttcgcctgcgtactcgttgaaccaagcgtacaaagcacacgccgggaatacgttcttgac

SEQ ID NO: 297517 - DNA, 75 bp, Artificial Sequence
  Synthetic
aatgaatgctaaagttaaggctctggtatctactgtgggaatagaaatagctaaaagatacattgcaggagggaa

SEQ ID NO: 297518 - DNA, 75 bp, Artificial Sequence
  Synthetic
gtatctactgtgggaatagaaatagctaaaagatacattgcaggagggaagatattctttagagctggaataaat

SEQ ID NO: 297519 - DNA, 75 bp, Artificial Sequence
  Synthetic
ggagattatgcacaaataactaatatgcttttaaataatcaaccagtagcactagttggagctcttccatttgtt

SEQ ID NO: 297520 - DNA, 75 bp, Artificial Sequence
  Synthetic
ttattctcaaaaaataatatagtgtctagaggaatagctttgactgaaaaagcaaagttgaattcatatgcacca

SEQ ID NO: 297521 - DNA, 75 bp, Artificial Sequence
  Synthetic
cttatcagatgaaatagaagttattggatcagaaagatcaagcaatgtgactattaatccaggtccattcgcaca

SEQ ID NO: 297522 - DNA, 75 bp, Artificial Sequence
  Synthetic
acagaaaccagttacttttaaatcaagtaaaataacaataaatgacatacttagagacataaaaccatttttttc

SEQ ID NO: 297523 - DNA, 75 bp, Artificial Sequence
  Synthetic
cctgatgttgattattggttgttactggaaccaaagaacgatggagtcgttttcgaaacaacgaatggcactaat

SEQ ID NO: 297524 - DNA, 75 bp, Artificial Sequence
  Synthetic
attaaagatgatgaagtgctagaggctagtactgatggtaaatatttcgcttacaaagttgaaacatttgaagag

SEQ ID NO: 297525 - DNA, 75 bp, Artificial Sequence
  Synthetic
caactacaaagtggaaactcgttgaattagtaaaacaaacacaaaatggagtatatacgcagcatggtgagcttt

SEQ ID NO: 297526 - DNA, 75 bp, Artificial Sequence
  Synthetic
aaattatagcgaattaagtatcgcagtacactgtgacttctacataatttcacgtgcacaagaagcggaatgcac

SEQ ID NO: 297527 - DNA, 75 bp, Artificial Sequence
  Synthetic
aatgaagacattatggtatcaaaaacgtctctatggaaagaaatgcaatataatagagacattaaaattaaattc

SEQ ID NO: 297528 - DNA, 75 bp, Artificial Sequence
  Synthetic
agaaatgataaaattatggaagaagatgtggaacattacgtcactacgttcgccatatactaatgcgaacttctt

SEQ ID NO: 297529 - DNA, 75 bp, Artificial Sequence
  Synthetic
gagagttggttacagcgcatacaacatgttctgtcaatggtgtttatgactttaatttcaatagtggatcgctgc

SEQ ID NO: 297530 - DNA, 75 bp, Artificial Sequence
  Synthetic
tgttaggtcattagccgctaatttaaattccgtaacatgtaacggtggtgactacgtttttagactacctgtagg

SEQ ID NO: 297531 - DNA, 75 bp, Artificial Sequence
  Synthetic
tatgtcagaattagctgatcttattttgaacgaatggttatgcaatccaatggacataacattgtattactacca

SEQ ID NO: 297532 - DNA, 75 bp, Artificial Sequence
  Synthetic
tgcatgccgatcagctaaagagtttgctatattacaagatgacttaacggtattgagatacgctaatgaaattga

SEQ ID NO: 297533 - DNA, 75 bp, Artificial Sequence
  Synthetic
ttcagatttagcttggaagtattagacccacctttctccatcttaaagactagggtatctagattatatggactg

SEQ ID NO: 297534 - DNA, 75 bp, Artificial Sequence
  Synthetic
ttgagctgccgtcgactgtcctcggaagcggcggagttcttaacagtaagccccatcggacctgatggctggctg

SEQ ID NO: 297535 - DNA, 75 bp, Artificial Sequence
  Synthetic
tcatgaattcagttacagtaaggcaggatctagaacgacaactgaatagcttgagagatgaatttaataaattgt

SEQ ID NO: 297536 - DNA, 75 bp, Artificial Sequence
  Synthetic
tgtggctcaagccttaatcccgtttaaccaatccggtcagcaccggacgttaatggaaggaacggtcttaatgtg

SEQ ID NO: 297537 - DNA, 75 bp, Artificial Sequence
  Synthetic
agaacgtgttcatacaacaaccgtttaaattgaaaacattaaggaatgaatatgtagttgcattgtacgcgctgt

SEQ ID NO: 297538 - DNA, 75 bp, Artificial Sequence
  Synthetic
ctatgtgaatcagataattcaagcaatgtccagaaggtctaggtcactaaattcagctgcattttattatagggt

SEQ ID NO: 297539 - DNA, 75 bp, Artificial Sequence
  Synthetic
atcaatggccactagtgttatgaaaaagttcaagagatccagtcttgcatcatcaatatcatcattgactgattc

SEQ ID NO: 297540 - DNA, 75 bp, Artificial Sequence
  Synthetic
acagcgagctctattgcaaatcaaacttccactatcagtcggaggttaagattgaaagagatggctactcagacg

SEQ ID NO: 297541 - DNA, 75 bp, Artificial Sequence
  Synthetic
agtatgaaattttgcaaaaaacaataccaacatttgaaccaaaaggatcaatattgaagaaattagaggatatta

SEQ ID NO: 297542 - DNA, 75 bp, Artificial Sequence
  Synthetic
accaacatttgaaccaaaaggatcaatattgaagaaattagaggatattaaaccggaacaagcgaagaagcaaac

SEQ ID NO: 297543 - DNA, 75 bp, Artificial Sequence
  Synthetic
aggcttcagaaaagttcattcctaacagatcatatagagtaattaaggatgacgaggtgctagaggcgagtactg

SEQ ID NO: 297544 - DNA, 75 bp, Artificial Sequence
  Synthetic
cttgcttccattataggagaataacaaaactaaacagagaattactaaggataggagcaaactcagtttggactc

SEQ ID NO: 297545 - DNA, 75 bp, Artificial Sequence
  Synthetic
tataatagattttaaaactttaaaaaatttaaacgataactatggtattacgcgtgaacaggcttttaacttact

SEQ ID NO: 297546 - DNA, 75 bp, Artificial Sequence
  Synthetic
acggcaagtatttgtgatgctatatttcaagatgaagaaacagaaggtgcagtgagaagattcattgcggaaatg

SEQ ID NO: 297547 - DNA, 75 bp, Artificial Sequence
  Synthetic
cgcgtgaacaggcttttaacttacttagatcagatccacgcgtactaagagaattcattaaccaaaacaatccaa

SEQ ID NO: 297548 - DNA, 75 bp, Artificial Sequence
  Synthetic
gtgtattcaaaataagcgttgttttctagataacgagccacatcttctaaaattgagaactttcgaatcaccaat

SEQ ID NO: 297549 - DNA, 75 bp, Artificial Sequence
  Synthetic
acatcccatagattatgcttttaatgaatactttttacaacaccaattagtagaaccattaaataatgatataat

SEQ ID NO: 297550 - DNA, 75 bp, Artificial Sequence
  Synthetic
gtttaaaaagacagttaaacagaggaagtgcagaaatgaattggataagagttggtacaatcaactgcttcttcc

SEQ ID NO: 297551 - DNA, 75 bp, Artificial Sequence
  Synthetic
ggatgtgactacgagttatacgtatatgttatcagacgaaatctatgtagcaaacgtaagtggcgtattatcaac

SEQ ID NO: 297552 - DNA, 75 bp, Artificial Sequence
  Synthetic
tgcaaattcatcacagcaagaaacatttttaacttcaacgctttgcttatattatcctaccgaagcatcaactca

SEQ ID NO: 297553 - DNA, 75 bp, Artificial Sequence
  Synthetic
caattagaagcattaacaattcaatcagaaacacagtttttgacaggtataaattcgcaggcagctaatgattgc

SEQ ID NO: 297554 - DNA, 75 bp, Artificial Sequence
  Synthetic
tttgtaaattgtatagatctgtatgacaaattgttgctagatcaaataaattttgaaagaatgagttctcttcca

SEQ ID NO: 297555 - DNA, 75 bp, Artificial Sequence
  Synthetic
ttttgaaagaatgagttctcttccaactaatttacaatccatttatgcaaataaatactttaaattaagtagact

SEQ ID NO: 297556 - DNA, 75 bp, Artificial Sequence
  Synthetic
ataattcacaatctgcagttcaaattccaatttattattcttccaatagtgaattagagaatagatgtattgaat

SEQ ID NO: 297557 - DNA, 75 bp, Artificial Sequence
  Synthetic
actgaatttacctgggattttcaacttgacttacattatgatttatttaacaataaagacaaaatatttgccgca

SEQ ID NO: 297558 - DNA, 75 bp, Artificial Sequence
  Synthetic
aatcagtgactcgaataatggactacattatatatagatttttgttaatttttgtagcattatttgccttaacta

SEQ ID NO: 297559 - DNA, 75 bp, Artificial Sequence
  Synthetic
agcttcaacaatttctaagtgtaagtggtgtaacgttaaatatgcattcagagacatagattggaagatggaatc

SEQ ID NO: 297560 - DNA, 75 bp, Artificial Sequence
  Synthetic
gattatattaatcagattgtacaagttatgtccaaaagatcacggtcattaaattcggcagctttttattataga

SEQ ID NO: 297561 - DNA, 75 bp, Artificial Sequence
  Synthetic
caaatagacttggtcaattagttgatttaactagactattagcttacaactatgaaactctaatggcatgtatta

SEQ ID NO: 297562 - DNA, 75 bp, Artificial Sequence
  Synthetic
gatgttttgtggcattcaataactaagtatattgatcaaaccattgagaaattgttcaacgtaatgaatcctgta

SEQ ID NO: 297563 - DNA, 75 bp, Artificial Sequence
  Synthetic
caataaatccaggaccatttgctcagactggatacgcacccgtgaattggggacccggagagacgaatgactcaa

SEQ ID NO: 297564 - DNA, 75 bp, Artificial Sequence
  Synthetic
tggtgcaacgtaaacgaattggatactttgcctttatgcactgaacagactgatacactggtaaggcttgaagaa

SEQ ID NO: 297565 - DNA, 75 bp, Artificial Sequence
  Synthetic
agtagagggaacgaacaattcagatagatggttagctaccatactaattgaaccaaacgtcacatcacaaagtag

SEQ ID NO: 297566 - DNA, 75 bp, Artificial Sequence
  Synthetic
agcttcttatctcagattctgaagatgacgattaacacttaaataaactattaactcagtttttgccatcacaag

SEQ ID NO: 297567 - DNA, 75 bp, Artificial Sequence
  Synthetic
tgacgattaacacttaaataaactattaactcagtttttgccatcacaagaccttctggactagagtagcgccta

SEQ ID NO: 297568 - DNA, 75 bp, Artificial Sequence
  Synthetic
gaacaaataatagttgaaaatgtttcaacaacgaaatggaaatttatagatttggctaaaactgatattaatgga

SEQ ID NO: 297569 - DNA, 75 bp, Artificial Sequence
  Synthetic
acgtacaatggtcaaacaccgaatgcagttactggttattacaccacaactaactatgacacagtgagcatgacg

SEQ ID NO: 297570 - DNA, 75 bp, Artificial Sequence
  Synthetic
aattgatgagaacaggtgattatgcacaaataactaatatgcttttaaataatcaaccagtagcattagttggag

SEQ ID NO: 297571 - DNA, 75 bp, Artificial Sequence
  Synthetic
gttttgcttgcaccatttattaagactcagaactatggaattaatttgccaataactggatccatggatacacca

SEQ ID NO: 297572 - DNA, 75 bp, Artificial Sequence
  Synthetic
ccaatacaaaacactaggaatgtggttccagtgtctttaacttctaggtcaattgtatatactagagctcaggca

SEQ ID NO: 297573 - DNA, 75 bp, Artificial Sequence
  Synthetic
aaacgttatcgcaattatttctaactaaaggatggccgacaggatcagtttatttcaaaggatatgcagacatcg

SEQ ID NO: 297574 - DNA, 75 bp, Artificial Sequence
  Synthetic
catcattttctgtagaaccacaattatattgtgattataatattgtgttaatgaaatatgatgcaaatttgcaat

SEQ ID NO: 297575 - DNA, 75 bp, Artificial Sequence
  Synthetic
aaggatggccgacaggatctgtctattttaaagactatgcagatattgcctcgttttcagtcgatccacaattat

SEQ ID NO: 297576 - DNA, 75 bp, Artificial Sequence
  Synthetic
ctggcggtctagggtataagtggtctgagatttcatttaaaccagcaaactatcaatatacttatacgcgagatg

SEQ ID NO: 297577 - DNA, 75 bp, Artificial Sequence
  Synthetic
tgagatttcatttaaaccagcaaactatcaatatacttatacgcgagatgaggaagtgattacagcgcatacaac

SEQ ID NO: 297578 - DNA, 75 bp, Artificial Sequence
  Synthetic
atcagcaaactgatgaagctaacaagtggatatccatgggttcttcatgtacaattaaagtgtgtcctctaaata

SEQ ID NO: 297579 - DNA, 75 bp, Artificial Sequence
  Synthetic
ttataactgatgttgttgatggagttaatcataaattagacgtaacaacgagtacatgtactataagaaattgta

SEQ ID NO: 297580 - DNA, 75 bp, Artificial Sequence
  Synthetic
taatcataaattagacgtaacaacgagtacatgtactataagaaattgtaaaaaacttggaccaagggaaaatgt

SEQ ID NO: 297581 - DNA, 75 bp, Artificial Sequence
  Synthetic
attatgacttcagattaccagttggtgcatggccagtgatgactggtggcgctgtgtcattacgacccgcaggag

SEQ ID NO: 297582 - DNA, 75 bp, Artificial Sequence
  Synthetic
tagagtgtcaggtctgtacggtctaccagctgcaaatccaaataatggaaaggattattatgaaatattaggaag

SEQ ID NO: 297583 - DNA, 75 bp, Artificial Sequence
  Synthetic
ctacgtcaagaatttaattcgctgtcacaagaaatagcgatgtcgcaactcattgatctagctttattgccatta

SEQ ID NO: 297584 - DNA, 75 bp, Artificial Sequence
  Synthetic
cacagattttgtatcattgaattcactacgatttagatttagtttgacagtggatgaaccatctttttcaatatt

SEQ ID NO: 297585 - DNA, 75 bp, Artificial Sequence
  Synthetic
acatttgaagaggtagcaaacgcggaaaaattagtaataactgacgtcgtggatggagtcaatcataagattaat

SEQ ID NO: 297586 - DNA, 75 bp, Artificial Sequence
  Synthetic
catctatatcgactttaacagattcattatctgacgctgcatcatcaatttcgaggaatccttctgtaagatcga

SEQ ID NO: 297587 - DNA, 75 bp, Artificial Sequence
  Synthetic
ggtagttctgacgtcatagacataacagcagatccaacaacgatcccacaaactgaaagaatgatgcgaataaac

SEQ ID NO: 297588 - DNA, 75 bp, Artificial Sequence
  Synthetic
caacgcaaacatctacgataagtagacgattgagattgaaagaaatcacgactcagacagaaggtatgaattttg

SEQ ID NO: 297589 - DNA, 75 bp, Artificial Sequence
  Synthetic
aactgaaagaatgatgcgaataaactggaaaaaatggtggcaagtgttttataccgtagtagattacataaatca

SEQ ID NO: 297590 - DNA, 75 bp, Artificial Sequence
  Synthetic
atgaaaaaatttagaaaatcaaaattagctacatcaatttcagaaatgactaattcattgtcagacgcggcttca

SEQ ID NO: 297591 - DNA, 75 bp, Artificial Sequence
  Synthetic
ataccgtagtagattacataaatcaaatagttcaggtaatgtccaaacgatcaaggtcactaaattcagctgctt

SEQ ID NO: 297592 - DNA, 75 bp, Artificial Sequence
  Synthetic
cataccgaatcgagcctatagggttataaaaaatgatgaagtattagaagctggaacggacggacgattcttcgc

SEQ ID NO: 297593 - DNA, 75 bp, Artificial Sequence
  Synthetic
acgttgaaaaacttgaatgataattacggaataaccagagaacaagctttcaatttgttaaaatcagatcctagg

SEQ ID NO: 297594 - DNA, 75 bp, Artificial Sequence
  Synthetic
acggaataaccagagaacaagctttcaatttgttaaaatcagatcctagggtattgcgagaatttataaatcaag

SEQ ID NO: 297595 - DNA, 75 bp, Artificial Sequence
  Synthetic
ttttctgtagaaccacaattatattgtgattataatattgtgttaatgaagtatgatgcaaatttgcaattggat

SEQ ID NO: 297596 - DNA, 75 bp, Artificial Sequence
  Synthetic
tatgcagatacgcaaacttacatacatgatgattcaaaagatgagtatgaaaatgcatttctcatttctaatcta

SEQ ID NO: 297597 - DNA, 75 bp, Artificial Sequence
  Synthetic
tatgaatagtcacataattaaaatcattaaccatctacacatgaccctctatgagcacaatagttaaaagctaac

SEQ ID NO: 297598 - DNA, 75 bp, Artificial Sequence
  Synthetic
taactaagacaaatatagaagattatttattaccaggatggaagctgacatacgttggatacaatggaagtgata

SEQ ID NO: 297599 - DNA, 75 bp, Artificial Sequence
  Synthetic
agtcttccttctatctcttcgagtatatataacagtgagtccttttcaacttcgtcaactatttctggaaaatct

SEQ ID NO: 297600 - DNA, 75 bp, Artificial Sequence
  Synthetic
aacgtgaaaacttaccacaacagaatgaacgtctgcaagaaaaagaagttgaaaagaatatagacgcatctatgg

SEQ ID NO: 297601 - DNA, 75 bp, Artificial Sequence
  Synthetic
cgctatatttcaagatgaggaaacggagggagttattagaagattcattgcagatatgaggcaacaagttcaagc

SEQ ID NO: 297602 - DNA, 75 bp, Artificial Sequence
  Synthetic
tactaattattcaccatctagggaagataatttgcaacgtgtctttacagtagcctctatcagaagcatgttgat

SEQ ID NO: 297603 - DNA, 75 bp, Artificial Sequence
  Synthetic
ttatttccgaatgcacagccatttgaacatcatgctacagtaggactcacacttagaattgaatctgcagtttgt

SEQ ID NO: 297604 - DNA, 75 bp, Artificial Sequence
  Synthetic
gaaccaaaacaattaccgatttatagagcaaatggagaaagagaattgcgtaatagatggtattggaaattaaag

SEQ ID NO: 297605 - DNA, 75 bp, Artificial Sequence
  Synthetic
tttattgaattatatattaaaatcattaactagtgtaatggactttataatttatagatttcttttactcattgt

SEQ ID NO: 297606 - DNA, 75 bp, Artificial Sequence
  Synthetic
tcactggttccatggatacagcatatgcaaattcgtcacagcaagagacatttttaacttcaacgttgtgtttat

SEQ ID NO: 297607 - DNA, 75 bp, Artificial Sequence
  Synthetic
tgccaattttggatcaaaattttatcgaatataaaataacagtgaatgaagataaaccaatttcagaatcacatg

SEQ ID NO: 297608 - DNA, 75 bp, Artificial Sequence
  Synthetic
aagcgagaaagtaatccgtttaagggactgtcaactgatagaaagatggatgaggtctctcaaataggaatttaa

SEQ ID NO: 297609 - DNA, 75 bp, Artificial Sequence
  Synthetic
gtggcaagttttttatacagtagtagattatattaatcagattgtacaaatcatgtccaaaagatcaagatcgtt

SEQ ID NO: 297610 - DNA, 75 bp, Artificial Sequence
  Synthetic
gcaggatttacaattagaggcattaacaattcagtcagaaacacaattcttaacaggcataaattcgcaagcagc

SEQ ID NO: 297611 - DNA, 75 bp, Artificial Sequence
  Synthetic
attctattgtttatggaattgcgccaccaccacagttcaaaaaacgttataatactagtgataattcaagaggca

SEQ ID NO: 297612 - DNA, 75 bp, Artificial Sequence
  Synthetic
agcttataattatgagacactgatggcatgcattactatgaacatgcaacatgttcaaactttaacaacagaaaa

SEQ ID NO: 297613 - DNA, 75 bp, Artificial Sequence
  Synthetic
ctaatattaatgaatatggagcaaattgaacgtgcttcagataagattgctcaaggtgtaatcattgcctatcgt

SEQ ID NO: 297614 - DNA, 75 bp, Artificial Sequence
  Synthetic
atactgaagggaaagtctttgcatataaaatagatacacttaatgaagtgccatttgatgtaaataaatttgctg

SEQ ID NO: 297615 - DNA, 75 bp, Artificial Sequence
  Synthetic
aaaaatttattcttggtcatttcatgttggttttagaaaacaaaaaatgattgatgcagcattagaccaattgaa

SEQ ID NO: 297616 - DNA, 75 bp, Artificial Sequence
  Synthetic
aggtatactcctggtgtcattcctccagtaaacgtagatagaccaattccactaggtcgtagagatgttcctgga

SEQ ID NO: 297617 - DNA, 75 bp, Artificial Sequence
  Synthetic
cagtaaacgtagatagaccaattccactaggtcgtagagatgttcctggacgaagaacaagaattatattcatat

SEQ ID NO: 297618 - DNA, 75 bp, Artificial Sequence
  Synthetic
aaaaagattcagtatggtgctgttgcttcaggagaaaaacaaactaaggcagctaattctatagctaatttggca

SEQ ID NO: 297619 - DNA, 75 bp, Artificial Sequence
  Synthetic
atgagaataacatagtttatttacatgattattcatattatactaataatgagataagaacagatcaacattgga

SEQ ID NO: 297620 - DNA, 75 bp, Artificial Sequence
  Synthetic
ctatgtgagaggttgagttgccgtcgtctgtcttcggaagcggcggaactctttaccgcaagacccattggacct

SEQ ID NO: 297621 - DNA, 75 bp, Artificial Sequence
  Synthetic
aggagcattaccattcataacagactcatcagtcatatcactaatagctaaattagacgctactgtctttgcaca

SEQ ID NO: 297622 - DNA, 75 bp, Artificial Sequence
  Synthetic
tagacttatttattatagtagcatccacaattaataagtatggagttccaagacataatgaaaagtatagatacg

SEQ ID NO: 297623 - DNA, 75 bp, Artificial Sequence
  Synthetic
tttgatcttaaaaggtggatttatttacattcaattggaaaagtcgctgtagaaggtggaagatattatgaacat

SEQ ID NO: 297624 - DNA, 75 bp, Artificial Sequence
  Synthetic
ctgcattggatcaattaaagactgaatacactgaggatgtagatgatgaaatgtataacgaatacaccatgttaa

SEQ ID NO: 297625 - DNA, 75 bp, Artificial Sequence
  Synthetic
acaagaattatattcatattaccgtatgaatactttatcgcgcaacacgctgtggtagaaaaaatgttatcatat

SEQ ID NO: 297626 - DNA, 75 bp, Artificial Sequence
  Synthetic
atctcatggattcatatgtacaaataccggacggtaatgtgataaaaaagattcagtatggagctgtggcttcag

SEQ ID NO: 297627 - DNA, 75 bp, Artificial Sequence
  Synthetic
aatagtgacttttggacagcagttatcgctgttgaaccacatgtcagtcaaacaaataggcaatatattttattt

SEQ ID NO: 297628 - DNA, 75 bp, Artificial Sequence
  Synthetic
tactctagaatgaatgcgaaagtaaaagctttagtgtctaccgtcggtattgaaatagcgaaaagatatatagct

SEQ ID NO: 297629 - DNA, 75 bp, Artificial Sequence
  Synthetic
acattgtgaataaattgcgagggtttgatactgatagagaattcatattaactaaaattatacagatgacatctg

SEQ ID NO: 297630 - DNA, 75 bp, Artificial Sequence
  Synthetic
ttgaacagcagttgaattcaattgatgcaatcaatccgattaatgctatagatgatctcgaatcactgatcagaa

SEQ ID NO: 297631 - DNA, 75 bp, Artificial Sequence
  Synthetic
gtgatggtgaacaagttactgcacataccacctgttcagtaaatggagtaaataattttagctataatggaggct

SEQ ID NO: 297632 - DNA, 75 bp, Artificial Sequence
  Synthetic
ttctcactaattcatattcagtagatttacatgatgaaatagagcaaattgggtcagaaaaaactcaaaatgtaa

SEQ ID NO: 297633 - DNA, 75 bp, Artificial Sequence
  Synthetic
gacaagtataaaatattagaatcttacgtatataatttattatcaattaattatggatgctatcaattattcgat

SEQ ID NO: 297634 - DNA, 75 bp, Artificial Sequence
  Synthetic
ttctttgtaactaccgaagctaatttaccaattcaatataggaaatttatgcctacattacctgataacgttcaa

SEQ ID NO: 297635 - DNA, 75 bp, Artificial Sequence
  Synthetic
ccacctactgattattggatacttattaactcaaatacaaatggagtagtatacgagagtacaaataatagtgac

SEQ ID NO: 297636 - DNA, 75 bp, Artificial Sequence
  Synthetic
ttccaccagttgatgcaggcacgtatgttggatccagaatatattcacaagataaatacaaaatacttgaatcct

SEQ ID NO: 297637 - DNA, 75 bp, Artificial Sequence
  Synthetic
ggcaaactattgacaatttgcatattgcatacaaatatctatctacagggaaagctaaggtatgttgcgttaaaa

SEQ ID NO: 297638 - DNA, 75 bp, Artificial Sequence
  Synthetic
gtgaatcaaattgtgcaagcgatgtccaaaagatcgagatcattaaattctgctgcattttactacagagtatag

SEQ ID NO: 297639 - DNA, 75 bp, Artificial Sequence
  Synthetic
cattcagaattttatattattccaaggtcccaagagtctaagtgtaatgaatatattaacaacggtctgccacca

SEQ ID NO: 297640 - DNA, 75 bp, Artificial Sequence
  Synthetic
attcaaaatactagaaatgtagtaccattatcattatcatccagatctatacagtataagagagcacaagttaat

SEQ ID NO: 297641 - DNA, 75 bp, Artificial Sequence
  Synthetic
aatttctaatctcactacacataatatattatatttaaattatagtgtaaaaacactgcaaatattaaataaatc

SEQ ID NO: 297642 - DNA, 75 bp, Artificial Sequence
  Synthetic
aacgatgattatcagactccaattatgaattcagtaacagtaagacaagatttagaacgtcaacttactgattta

SEQ ID NO: 297643 - DNA, 75 bp, Artificial Sequence
  Synthetic
tttagaacgtcaacttactgatttacgagaggaattcaattcattatcacaagaaatagctatgtcacaattaat

SEQ ID NO: 297644 - DNA, 75 bp, Artificial Sequence
  Synthetic
gtcagacgcagcatcatcagcatcaagaagcgtttctgttagatcgaatatatccgcagtttcaaattggactaa

SEQ ID NO: 297645 - DNA, 75 bp, Artificial Sequence
  Synthetic
acttagattaaaagaaatgattactcaaactgaaggaatgagttttgatgatatttcagcagcagtactgaaaac

SEQ ID NO: 297646 - DNA, 75 bp, Artificial Sequence
  Synthetic
atcaatatcgctagcttcaaaaccaactggtaataatcatttattcattttgagtggcacggacaagtattttaa

SEQ ID NO: 297647 - DNA, 75 bp, Artificial Sequence
  Synthetic
atcagagtcgatggtgatgataattatgcagtactacaatttaacaccgatgtcactaaacaaatggtccaagat

SEQ ID NO: 297648 - DNA, 75 bp, Artificial Sequence
  Synthetic
aataaaagtgtgtccgttgaatacgcagactttaggaataggctgtacaactacaaatacagcaacatttgagga

SEQ ID NO: 297649 - DNA, 75 bp, Artificial Sequence
  Synthetic
tagctacatcaatttcagaaatgactaattcattgtcagacgcagcatcatcagcatcaagaagcgtttctatta

SEQ ID NO: 297650 - DNA, 75 bp, Artificial Sequence
  Synthetic
aactaagaaaaatatgcatgttatggatgatattgcacatggaagatatactcctggtgtcattcctccagtaaa

SEQ ID NO: 297651 - DNA, 75 bp, Artificial Sequence
  Synthetic
gattatatcaatcagattgttcaagttatgtccaaaagatcgcgatcgttgaattcagcagctttctactataga

SEQ ID NO: 297652 - DNA, 75 bp, Artificial Sequence
  Synthetic
aaattatggaattaatttaccgatcactggctccatggatacagcatatgcaaattcatcacagcaagaaacatt

SEQ ID NO: 297653 - DNA, 75 bp, Artificial Sequence
  Synthetic
tatacgaattccttttaaaggtaagataccagccgtaacatttatattacatctttacgctaaactcgaaataat

SEQ ID NO: 297654 - DNA, 75 bp, Artificial Sequence
  Synthetic
tgtgattataatgttgtactgatgaagtatgattcaacgttagagctagatatgtctgaattagctgatttaatt

SEQ ID NO: 297655 - DNA, 75 bp, Artificial Sequence
  Synthetic
aaccgatgttgttgatggtgtgaaccataaacttgatgtgactacaaatacctgtacaattaggaattgtaagaa

SEQ ID NO: 297656 - DNA, 75 bp, Artificial Sequence
  Synthetic
gataagccaatctcagaatcacatgtaaaagaacttattgctgaattgcggtggcagtataataaatttgcggta

SEQ ID NO: 297657 - DNA, 75 bp, Artificial Sequence
  Synthetic
tgttagatattacagcggatccaactactgcaccacaaactgaacgtatgatgcgagtaaattggaagaaatggt

SEQ ID NO: 297658 - DNA, 75 bp, Artificial Sequence
  Synthetic
tgaacatctgcaagaaaaggagattgagaagaatacagatataaacatggaaaacaaaactagtaataaaattag

SEQ ID NO: 297659 - DNA, 75 bp, Artificial Sequence
  Synthetic
tcatcaaaagaagaatcgaaacagttacttgaaatattaaagactaaagaagatcatcagaaagaaatacaatat

SEQ ID NO: 297660 - DNA, 75 bp, Artificial Sequence
  Synthetic
gtcatgttttggttggaaaaacacgaaaatgatactgctgaaaagcttaaaatttataaaagaagattggattta

SEQ ID NO: 297661 - DNA, 75 bp, Artificial Sequence
  Synthetic
tggaatcaacctaccaattactggttcaatggatactgcatatgttaattctacacaagagaacatttttctaac

SEQ ID NO: 297662 - DNA, 75 bp, Artificial Sequence
  Synthetic
tcagttatttttaactaaaggatggcctactgggtctgtgtatttaaaagaatatacagacataacttctttttc

SEQ ID NO: 297663 - DNA, 75 bp, Artificial Sequence
  Synthetic
actacataccagagagaataagaaatgatgtcaattatattttaaatatggacatgaatctaccatcaacagcaa

SEQ ID NO: 297664 - DNA, 75 bp, Artificial Sequence
  Synthetic
gtgacttggagtcatggagaagtgaatgattcaacaacagtagaaccagtcttagatggtccctatcaaccgaca

SEQ ID NO: 297665 - DNA, 75 bp, Artificial Sequence
  Synthetic
ttcgaatcactatgggacacaataacaacatcaaactatatattagctagatcagtagtgcctgacttgaaagag

SEQ ID NO: 297666 - DNA, 75 bp, Artificial Sequence
  Synthetic
tacttatcgaaccaaatataaccagtcaaagcagacaatacacattatttggagaaacaaaacaaattactattg

SEQ ID NO: 297667 - DNA, 75 bp, Artificial Sequence
  Synthetic
ctcagaattatggacttaacataccaataacaggatcaatggacactgtatactccaactctactcaagaaggaa

SEQ ID NO: 297668 - DNA, 75 bp, Artificial Sequence
  Synthetic
ctatcaatgtcatcggcatcaaatggagaatctagacagcttaaatttggtagaaagacgattttttcaactaaa

SEQ ID NO: 297669 - DNA, 75 bp, Artificial Sequence
  Synthetic
tcgcgatcgttaaattctgctgcattctattatagagtttaggtatagcttagattagaattgtatgatgtgacc

SEQ ID NO: 297670 - DNA, 75 bp, Artificial Sequence
  Synthetic
atgcaatgaatatataaatacaggattaccaccgatgcaaaacacaaggaatatagttccagttgccttatcatc

SEQ ID NO: 297671 - DNA, 75 bp, Artificial Sequence
  Synthetic
aaaaatattaaccatctacacatgaccctctatgagcacaatagttaaaagctaacactgtcaaaaacctaaatg

SEQ ID NO: 297672 - DNA, 75 bp, Artificial Sequence
  Synthetic
aatgatgagagtgaattggaaaaaatggtggcaagtgttttatactatagtagattatattaatcagattgtaca

SEQ ID NO: 297673 - DNA, 75 bp, Artificial Sequence
  Synthetic
aatttaaattcagtgaaatgtagtggaggtaattatgactttcagataccagttggcgcatggccagtaatgagt

SEQ ID NO: 297674 - DNA, 75 bp, Artificial Sequence
  Synthetic
atgcggtagctattataacagcagctaatagactgaatttatatcagaagaaaatgaagtcaatagttgaggatt

SEQ ID NO: 297675 - DNA, 75 bp, Artificial Sequence
  Synthetic
gtatctttaaaaatgaatcgtcttctacaacgtcaaatctttctggaaaatctattggtaggagtgaacagtaca

SEQ ID NO: 297676 - DNA, 75 bp, Artificial Sequence
  Synthetic
caggagttacgctatctactcaatttactgattttgtatcgcttaattccttaagattcaggttcagtctaactg

SEQ ID NO: 297677 - DNA, 75 bp, Artificial Sequence
  Synthetic
gactgttaccagttgaaaggcgaagacttgatatatttaatttaatattgatgaatatggagcagattgaacgag

SEQ ID NO: 297678 - DNA, 75 bp, Artificial Sequence
  Synthetic
atcagaaattcaagtagctggatttgactactcgtgtgctctaaatgctccagcaaatattcagcagtttgaaca

SEQ ID NO: 297679 - DNA, 75 bp, Artificial Sequence
  Synthetic
tgggtatcagcaaattaatttagaagaattaatgagaactggagattatggtcaaattactaatatgttattaaa

SEQ ID NO: 297680 - DNA, 75 bp, Artificial Sequence
  Synthetic
gtcaaattactaatatgttattaaataatcagccagtggcattagtaggagcactgccattcattacagattcat

SEQ ID NO: 297681 - DNA, 75 bp, Artificial Sequence
  Synthetic
atggcgtacaggaagcgcggagctaaacgtgaagacttaccacaacaaaatgaacgtctgcaagaaaaagaagtt

SEQ ID NO: 297682 - DNA, 75 bp, Artificial Sequence
  Synthetic
gttgcgaattatgattggataccaacttcaaccacaaaagtatataaacaagtaccgcaacctttcgacttcaga

SEQ ID NO: 297683 - DNA, 75 bp, Artificial Sequence
  Synthetic
tcggtttctagaggttcatctattagatctggtgtatcgtccatttcagtatggacggacgtttctgaacaaata

SEQ ID NO: 297684 - DNA, 75 bp, Artificial Sequence
  Synthetic
caaccttgtcaacaccgcataagttatgcgcgtggatgaaaagagacaacagagtgtactggtatcaaggagcga

SEQ ID NO: 297685 - DNA, 75 bp, Artificial Sequence
  Synthetic
atttgataccgcaatcgcagactgctatgtgtacacaatatataaataatggtttaccaccaattcagaatacaa

SEQ ID NO: 297686 - DNA, 75 bp, Artificial Sequence
  Synthetic
aaatattgatagaaatgccagattatttattgctaaaagatatggctgtagaaaataaaaactctagagatgctg

SEQ ID NO: 297687 - DNA, 75 bp, Artificial Sequence
  Synthetic
gtaaagttgtagattctgagactgcaaatatttgtgatgctatatttcaagatgaggagacagagggagttatta

SEQ ID NO: 297688 - DNA, 75 bp, Artificial Sequence
  Synthetic
ctcctttaacaaagcagtgaaggtaaatgcaaatttagattcatcaatatctatatcaacggaccaaaaacggga

SEQ ID NO: 297689 - DNA, 75 bp, Artificial Sequence
  Synthetic
ttcgcttatttctttagttccaaccaacgatgattatcagactcccattatgaattcagtaacagtaagacaaga

SEQ ID NO: 297690 - DNA, 75 bp, Artificial Sequence
  Synthetic
cgctagtgtgtccataagttcataaacacaatcacgactattaagcaacgctgggtgcaatcaaatggatttctc

SEQ ID NO: 297691 - DNA, 75 bp, Artificial Sequence
  Synthetic
taaattcacaagcagcaaatgattgttttaaaacactgatagcagctatgttaagccaacgtacaatgtcattag

SEQ ID NO: 297692 - DNA, 75 bp, Artificial Sequence
  Synthetic
acacactaaaattgaagcagaatccgattcggatgattatgcacttggtgattcagatagtgatgatagaaaatg

SEQ ID NO: 297693 - DNA, 75 bp, Artificial Sequence
  Synthetic
tactgatgttgtagacggagtcaatcataagatcaatattacattgaatacatgcactatacaaaattgtaaaaa

SEQ ID NO: 297694 - DNA, 75 bp, Artificial Sequence
  Synthetic
tctctggaataaaatcaacggtagaggcagtaaaatctatgactacgaatgtgatgaaaagatttaaaacatcaa

SEQ ID NO: 297695 - DNA, 75 bp, Artificial Sequence
  Synthetic
caatgcaattaattgaagattcgtaagtctgacctgagaggtcactagggagctccccactcccgttttgtgacc

SEQ ID NO: 297696 - DNA, 75 bp, Artificial Sequence
  Synthetic
cagatatataagacctaatttacttcaagatagattgaatttgcacgataattttgaatcgctatgggatacaat

SEQ ID NO: 297697 - DNA, 75 bp, Artificial Sequence
  Synthetic
ctaaatgaatggttatgtaacccaatggatataacattatattattatcagcaaacaaatgaagcgaataaatgg

SEQ ID NO: 297698 - DNA, 75 bp, Artificial Sequence
  Synthetic
atgctgtggctattattacggctgctaatagactaaacttatatcagaagaaaatgaaatcaatagttgaggatt

SEQ ID NO: 297699 - DNA, 75 bp, Artificial Sequence
  Synthetic
atagattaagggatagattacgtttattgccagtagaaatcagaagattggatatcttcaatctaatattaatga

SEQ ID NO: 297700 - DNA, 75 bp, Artificial Sequence
  Synthetic
ttccttttaatagtttggcaataaaatgcatgttgacagcaaaggtagacaaaaaggatcaagataaattttata

SEQ ID NO: 297701 - DNA, 75 bp, Artificial Sequence
  Synthetic
aaaaaggatcaagataaattttataactcaattgtttatggaattgcgccacctccacaatttaaaaagcgttat

SEQ ID NO: 297702 - DNA, 75 bp, Artificial Sequence
  Synthetic
gttagcaaaactagtttcatctccaatgtcaatattagttgcattaatagatatcaatggtacgtttattacgaa

SEQ ID NO: 297703 - DNA, 75 bp, Artificial Sequence
  Synthetic
ttatgcaatattggatatatgggacattagtactattaaaagattcgtaccaaaaggcgtgttttatgcctttat

SEQ ID NO: 297704 - DNA, 75 bp, Artificial Sequence
  Synthetic
cggcgaatgaactcgattatgaaaataataaaataacttctgaattattccaatcagctgaagaatatactgatt

SEQ ID NO: 297705 - DNA, 75 bp, Artificial Sequence
  Synthetic
cattaatggatcctgctatactgacttcattatcatctaatttaaatgcagttatgttttggttggaacgccatt

SEQ ID NO: 297706 - DNA, 75 bp, Artificial Sequence
  Synthetic
cataacatactatatttaaattatagtcttaaaacattaaaaatattaaataaatcaggtatagcagcagttgaa

SEQ ID NO: 297707 - DNA, 75 bp, Artificial Sequence
  Synthetic
ttgaagcaggagaaatggttgggtagaagagtgtcacaatttgacattggacaatataaaaacatgttaaatgta

SEQ ID NO: 297708 - DNA, 75 bp, Artificial Sequence
  Synthetic
aaccgcacgttaacccagtagatagacaatatatgatatttggtgaaagcaaacaatttaatgtgagtaacgatt

SEQ ID NO: 297709 - DNA, 75 bp, Artificial Sequence
  Synthetic
ttaagaacaacttgttaggtaaagcggcaactattgatcaggcacttaacgggaaatttagctcagctgtgcgaa

SEQ ID NO: 297710 - DNA, 75 bp, Artificial Sequence
  Synthetic
tactacctgggtgcaaaaggcaaagaaagtcaatgaaaacatgtactctcttcagaatgtcatttcacagcaaca

SEQ ID NO: 297711 - DNA, 75 bp, Artificial Sequence
  Synthetic
aaaatcaattcaatttacttaagaaagattaaaggggagaccgtatttgatatgtctgagtaagctaaaaactta

SEQ ID NO: 297712 - DNA, 75 bp, Artificial Sequence
  Synthetic
ttctaaaacggttgctaaattagatgaagacgtgaataaacttagaatgacattatcttctaaaggaattgatca

SEQ ID NO: 297713 - DNA, 75 bp, Artificial Sequence
  Synthetic
taataaaataacttctgaattatttcaatcagctgaagaatatactgattcattaatggatcctgctatattgac

SEQ ID NO: 297714 - DNA, 75 bp, Artificial Sequence
  Synthetic
aaaatagaaataaaaataaaaataacaatagaaagcaacaattatctgacaaagtgttatcacaaaaagaggaaa

SEQ ID NO: 297715 - DNA, 75 bp, Artificial Sequence
  Synthetic
ctgatttgcaaggcaaatttagttcattagtgtcatcagttgagtggtatctaaggtctatggaattaccagatg

SEQ ID NO: 297716 - DNA, 75 bp, Artificial Sequence
  Synthetic
gaatgcgaacttttagaaatgaaatcacaaagagtgatttagaaaacttaattaatatgtataatacattatttc

SEQ ID NO: 297717 - DNA, 75 bp, Artificial Sequence
  Synthetic
gtttaaaggtagtagtcagagtgatttttctaatagacgaactctaacttctaataatagacttgtagggatgct

SEQ ID NO: 297718 - DNA, 75 bp, Artificial Sequence
  Synthetic
tgagtagtcacataattaaaaaatattaaccatctacacatgaccctctatgagcacaatagttaaaagctaaca

SEQ ID NO: 297719 - DNA, 75 bp, Artificial Sequence
  Synthetic
cattatctacacagttcactgattttgtatcattaaattcactacgatttagattcagtttaacagtagatgaac

SEQ ID NO: 297720 - DNA, 75 bp, Artificial Sequence
  Synthetic
cgtcaagagtatgctataccagttggaccggtattcccaccaggcatgaattggactgagctaattactaattat

SEQ ID NO: 297721 - DNA, 75 bp, Artificial Sequence
  Synthetic
agaactgcagaacatgattcaggtatatccgatattgaatgattttaaagaaattctcgccaccatgagactctc

SEQ ID NO: 297722 - DNA, 75 bp, Artificial Sequence
  Synthetic
aattcaaccaaatgatagttactatgaacggaaatgattttcaaactggaggaattggtaatctacccgtcagga

SEQ ID NO: 297723 - DNA, 75 bp, Artificial Sequence
  Synthetic
tctaacctttctgatatcgattattctactaaattacatacttaaatcattaactagaataatggactttataat

SEQ ID NO: 297724 - DNA, 75 bp, Artificial Sequence
  Synthetic
caactaagaaaaatatgcatgtcatggatgatatcgcacatggaagatatactccgggtgtcattcctccagtaa

SEQ ID NO: 297725 - DNA, 75 bp, Artificial Sequence
  Synthetic
tgtagataacgtatgtatggatgagatggcaagagagtctcaacgaaatggaattgctccacaatctgatgcact

SEQ ID NO: 297726 - DNA, 75 bp, Artificial Sequence
  Synthetic
gctaattcaacgcaagaagaaacattcctcacttctacactttgcctatattatccgactgaggctgcgactgaa

SEQ ID NO: 297727 - DNA, 75 bp, Artificial Sequence
  Synthetic
ctgagtatatagaaaactggaatttgcagaatagaagacagaggacgggatttacatttcataaaccaaacattt

SEQ ID NO: 297728 - DNA, 75 bp, Artificial Sequence
  Synthetic
acactgaaggaaagttttttgcgtataaagtggatacacttaatgagataccatttgatataaataaattcgctg

SEQ ID NO: 297729 - DNA, 75 bp, Artificial Sequence
  Synthetic
cgttttctgttgatccgcagttgtattgtgattataacgtagtactaatgaaatatgacgcgacgttgcaattgg

SEQ ID NO: 297730 - DNA, 75 bp, Artificial Sequence
  Synthetic
aggatttgattattcatgcgcacttaatgctccagctaatatccaacaatttgagcacatagttcaattgcgccg

SEQ ID NO: 297731 - DNA, 75 bp, Artificial Sequence
  Synthetic
gatatcaatgggctcatcatgtacaattaaagtatgtccacttaatacacaaactcttggaattggatgcttgac

SEQ ID NO: 297732 - DNA, 75 bp, Artificial Sequence
  Synthetic
acgtgtactattagaaactgtaagaaattgggaccaagagaaaacgtagccgttatacaagttggtggttctgac

SEQ ID NO: 297733 - DNA, 75 bp, Artificial Sequence
  Synthetic
ctgattcaacattagttcagccaacgcttgatggaccgtatcagccaaccacgtttaacttacctattgattatt

SEQ ID NO: 297734 - DNA, 75 bp, Artificial Sequence
  Synthetic
actatgtagatcagataatacaagttatgtccaaaagatcaagatcactaaattcagcagcattttattacagag

SEQ ID NO: 297735 - DNA, 75 bp, Artificial Sequence
  Synthetic
acgtggacaaagtacacaatgggatcaagcagctattttatactcaaactacattgttaacaaattacgaggatt

SEQ ID NO: 297736 - DNA, 75 bp, Artificial Sequence
  Synthetic
tctccatcacgtgaagacaatttgcagcgtgtatttactgtggcttccattagaagcatgcttgttaagtgagga

SEQ ID NO: 297737 - DNA, 75 bp, Artificial Sequence
  Synthetic
agcgtgtatttactgtggcttccattagaagcatgcttgttaagtgaggactgaactaataattcagtatccaat

SEQ ID NO: 297738 - DNA, 75 bp, Artificial Sequence
  Synthetic
tacgcaaagagaatatgttttagatggacagacggtacaactacaagtttcaaacgattcaagtaccctttggaa

SEQ ID NO: 297739 - DNA, 75 bp, Artificial Sequence
  Synthetic
gcttttaaagcgctacagtgatgtctctcagtattgacgtgacgagtcttccttctattccttcaactatatata

SEQ ID NO: 297740 - DNA, 75 bp, Artificial Sequence
  Synthetic
gaattatggagtgaatttgccaataacagggtcaatggatactacatatgcaaattcaacgcagagcgagtcatt

SEQ ID NO: 297741 - DNA, 75 bp, Artificial Sequence
  Synthetic
cttaaccggcatgtagctatatcaagctgctcagactctataagtaaggatgtgatttcacattcgctacataga

SEQ ID NO: 297742 - DNA, 75 bp, Artificial Sequence
  Synthetic
atggcttcgctcatttatagacaactacttactaattcatacacagtcaatctttctgacgaaattcaagagatt

SEQ ID NO: 297743 - DNA, 75 bp, Artificial Sequence
  Synthetic
agagtatattcctacgcaggagttacaccgaatgcatcggaaagctattatctgacgataaataatgatgatagc

SEQ ID NO: 297744 - DNA, 75 bp, Artificial Sequence
  Synthetic
ggatggccaactggatccgtgtactttaaagaatacactgatatagcagctttttcagtagatcctcaattgtac

SEQ ID NO: 297745 - DNA, 75 bp, Artificial Sequence
  Synthetic
tctgacgataaataatgatgatagcaatgtatcatcagacgctgaattttatttgataccacagtcacagactga

SEQ ID NO: 297746 - DNA, 75 bp, Artificial Sequence
  Synthetic
cagcacaatcacgaccttcaagtaatgtcggatgcgatcaagtggatttctccttaaataaaggcttaaaagtaa

SEQ ID NO: 297747 - DNA, 75 bp, Artificial Sequence
  Synthetic
tggacataacactgtattactatcaacaaacagatgaagctaataaatggatatcaatgggttcatcttgcacag

SEQ ID NO: 297748 - DNA, 75 bp, Artificial Sequence
  Synthetic
aaccaaacgtacaaacaactaacagaatatacaatctttttggtcagcaagtaactttatcggtggagaatacgt

SEQ ID NO: 297749 - DNA, 75 bp, Artificial Sequence
  Synthetic
aactgatgttgtagatggcgttaatcataaactagatgttacaacaacgacttgtactatacgtaactgcaaaaa

SEQ ID NO: 297750 - DNA, 75 bp, Artificial Sequence
  Synthetic
atgctcaagatggagtctacgcaacagatggccgtctcaattattaactcttcttttgaagctgcagttgtagct

SEQ ID NO: 297751 - DNA, 75 bp, Artificial Sequence
  Synthetic
aatgaaattcagtggtagaatatatacatataatggaaccacaccaaacgcaacaacaggatactattcaactac

SEQ ID NO: 297752 - DNA, 75 bp, Artificial Sequence
  Synthetic
gcaacctcagctcttgagaatatgggaatagaatatgattatcaggatatatattctagagtaaagaataaattt

SEQ ID NO: 297753 - DNA, 75 bp, Artificial Sequence
  Synthetic
aactcatatgtatatattgattactgggatgattcacaagcattcagaaatatggtgtatgttagatcattagcg

SEQ ID NO: 297754 - DNA, 75 bp, Artificial Sequence
  Synthetic
atgcgagtaaattggaaaaaatggtggcaggtattttatacagttgtagattacgtcaatcagataattcaggcg

SEQ ID NO: 297755 - DNA, 75 bp, Artificial Sequence
  Synthetic
tatggtgtatgttagatcattagcggctgatttaaacgacgtagtttgtagtggcggtgactacagttttgcatt

SEQ ID NO: 297756 - DNA, 75 bp, Artificial Sequence
  Synthetic
ttacgtcaatcagataattcaggcgatgtccaaaagatctagatcattgaattcatcatcattttactacagagt

SEQ ID NO: 297757 - DNA, 75 bp, Artificial Sequence
  Synthetic
aataaatttggatctgctataagaaatagaaactggcttgctgatacttctagagcagctaaattggatgaggat

SEQ ID NO: 297758 - DNA, 75 bp, Artificial Sequence
  Synthetic
catctattattaaatgcacaaaattgatgcgtgataaattggaacgtggtgaagttgaagtggatgattcatttg

SEQ ID NO: 297759 - DNA, 75 bp, Artificial Sequence
  Synthetic
agccggcagattttcattaatatctctagtaccaactaatgacgattatcagacaccaatagctaattccgtgac

SEQ ID NO: 297760 - DNA, 75 bp, Artificial Sequence
  Synthetic
cattctataattcaggatcctggaatggcgtattttccatatattgcatctgttctaacagttttgtttacatta

SEQ ID NO: 297761 - DNA, 75 bp, Artificial Sequence
  Synthetic
ctgggtgaattaagagaagaattcaactcgttatcgcaagaaattgcgctgtcacaactgattgatctagcaaca

SEQ ID NO: 297762 - DNA, 75 bp, Artificial Sequence
  Synthetic
taataattgggtgttgaaagcaagaaaaatgaatgaaaatatgcattctcttcaaaatgtcatctctcaacagca

SEQ ID NO: 297763 - DNA, 75 bp, Artificial Sequence
  Synthetic
aaatagcattgaaaacatcaaaatgttcatataaagtgattaaatattgtatagtcacgattattaatactcttt

SEQ ID NO: 297764 - DNA, 75 bp, Artificial Sequence
  Synthetic
cacaagcattcagaaacatggtatatgttcggtcacttgctgctaatttgaatacagtaacgtgtactggtggta

SEQ ID NO: 297765 - DNA, 75 bp, Artificial Sequence
  Synthetic
tgcaaaataaaattggatcccttacttcttcgattgaatggtatttaagatcaatggaattagaccctgaaataa

SEQ ID NO: 297766 - DNA, 75 bp, Artificial Sequence
  Synthetic
gatgcgaattagtactgctatacagaccggagaggatttaagaacgatgacagatgcgtcaacgcaaatatcaaa

SEQ ID NO: 297767 - DNA, 75 bp, Artificial Sequence
  Synthetic
cacagtcaatcatatcgcgtgtgactcagtcttaatcccgtttaaccaatccagcgaatgttggacgttaatgga
